United States Patent 7,888,497 (BIOINFORMATICALLY DETECTABLE GROUP OF NOVEL REGULATORY OLIGONUCLEOTIDES AND USES THEREOF) - sequence listing, part 61

SEQ ID NO: 2564995 - DNA, 23 bp, Homo sapiens
gtgcgagtgtgtgcatgtgtgtg

SEQ ID NO: 2564996 - DNA, 21 bp, Homo sapiens
gtgcgatctgggttcactgca

SEQ ID NO: 2564997 - DNA, 22 bp, Homo sapiens
gtgcgccgagtctgtctctgtc

SEQ ID NO: 2564998 - DNA, 14 bp, Homo sapiens
gtgcgcctacagga

SEQ ID NO: 2564999 - DNA, 15 bp, Homo sapiens
gtgcgtgaaacacac

SEQ ID NO: 2565000 - DNA, 14 bp, Homo sapiens
gtgcgtgggtgaag

SEQ ID NO: 2565001 - DNA, 13 bp, Homo sapiens
gtgcgtgtgtgca

SEQ ID NO: 2565002 - DNA, 14 bp, Homo sapiens
gtgcgtgtttgcac

SEQ ID NO: 2565003 - DNA, 21 bp, Homo sapiens
gtgctaataacagtgcatatt

SEQ ID NO: 2565004 - DNA, 21 bp, Homo sapiens
gtgctacaaaaacacagcaag

SEQ ID NO: 2565005 - DNA, 22 bp, Homo sapiens
gtgctaggaacactccttcaca

SEQ ID NO: 2565006 - DNA, 21 bp, Homo sapiens
gtgctatactgcatacttttt

SEQ ID NO: 2565007 - DNA, 18 bp, Homo sapiens
gtgctataggctggagaa

SEQ ID NO: 2565008 - DNA, 21 bp, Homo sapiens
gtgctataggctggagaagct

SEQ ID NO: 2565009 - DNA, 15 bp, Homo sapiens
gtgctatctccccca

SEQ ID NO: 2565010 - DNA, 18 bp, Homo sapiens
gtgctatctcccccagcc

SEQ ID NO: 2565011 - DNA, 16 bp, Homo sapiens
gtgctcatttcaggat

SEQ ID NO: 2565012 - DNA, 13 bp, Homo sapiens
gtgctccgtgcct

SEQ ID NO: 2565013 - DNA, 17 bp, Homo sapiens
gtgctccgtgcctccac

SEQ ID NO: 2565014 - DNA, 18 bp, Homo sapiens
gtgctccgtgcctccacc

SEQ ID NO: 2565015 - DNA, 13 bp, Homo sapiens
gtgctctggacag

SEQ ID NO: 2565016 - DNA, 17 bp, Homo sapiens
gtgctctggacaggcat

SEQ ID NO: 2565017 - DNA, 23 bp, Homo sapiens
gtgctgaatggttttcaaaataa

SEQ ID NO: 2565018 - DNA, 15 bp, Homo sapiens
gtgctgacggaagcc

SEQ ID NO: 2565019 - DNA, 12 bp, Homo sapiens
gtgctgagtctg

SEQ ID NO: 2565020 - DNA, 16 bp, Homo sapiens
gtgctgagtctgaagg

SEQ ID NO: 2565021 - DNA, 22 bp, Homo sapiens
gtgctgatcgtgctaaattttc

SEQ ID NO: 2565022 - DNA, 20 bp, Homo sapiens
gtgctgcatttaaaagatac

SEQ ID NO: 2565023 - DNA, 19 bp, Homo sapiens
gtgctgccatccaggttca

SEQ ID NO: 2565024 - DNA, 20 bp, Homo sapiens
gtgctgccctgcccacctgg

SEQ ID NO: 2565025 - DNA, 23 bp, Homo sapiens
gtgctgccctgcccacctggcct

SEQ ID NO: 2565026 - DNA, 19 bp, Homo sapiens
gtgctgcctctacctgaca

SEQ ID NO: 2565027 - DNA, 15 bp, Homo sapiens
gtgctgctgctgctg

SEQ ID NO: 2565028 - DNA, 14 bp, Homo sapiens
gtgctggaggactg

SEQ ID NO: 2565029 - DNA, 18 bp, Homo sapiens
gtgctggcaccaccaggc

SEQ ID NO: 2565030 - DNA, 22 bp, Homo sapiens
gtgctgggactgagccagtccc

SEQ ID NO: 2565031 - DNA, 20 bp, Homo sapiens
gtgctgggattacaggcgtg

SEQ ID NO: 2565032 - DNA, 19 bp, Homo sapiens
gtgctggtgtcctgaccac

SEQ ID NO: 2565033 - DNA, 15 bp, Homo sapiens
gtgctgtgcccaagt

SEQ ID NO: 2565034 - DNA, 14 bp, Homo sapiens
gtgctgtggccagg

SEQ ID NO: 2565035 - DNA, 23 bp, Homo sapiens
gtgctgtggccagggtgagagct

SEQ ID NO: 2565036 - DNA, 13 bp, Homo sapiens
gtgctgtgtaaag

SEQ ID NO: 2565037 - DNA, 22 bp, Homo sapiens
gtgcttaagcagaagcattaac

SEQ ID NO: 2565038 - DNA, 17 bp, Homo sapiens
gtgcttcgggcccttcc

SEQ ID NO: 2565039 - DNA, 16 bp, Homo sapiens
gtgcttgccacagagc

SEQ ID NO: 2565040 - DNA, 13 bp, Homo sapiens
gtgcttggaggaa

SEQ ID NO: 2565041 - DNA, 15 bp, Homo sapiens
gtgcttgtgtgtgtg

SEQ ID NO: 2565042 - DNA, 23 bp, Homo sapiens
gtgcttgtttgctcacctggggt

SEQ ID NO: 2565043 - DNA, 13 bp, Homo sapiens
gtgctttccagct

SEQ ID NO: 2565044 - DNA, 16 bp, Homo sapiens
gtgctttccagctcac

SEQ ID NO: 2565045 - DNA, 19 bp, Homo sapiens
gtgcttttcctatttgttt

SEQ ID NO: 2565046 - DNA, 14 bp, Homo sapiens
gtggaaaaatattt

SEQ ID NO: 2565047 - DNA, 19 bp, Homo sapiens
gtggaaagtgaatttgaat

SEQ ID NO: 2565048 - DNA, 16 bp, Homo sapiens
gtggaaagtgtaaagc

SEQ ID NO: 2565049 - DNA, 19 bp, Homo sapiens
gtggaaattaagaagaaac

SEQ ID NO: 2565050 - DNA, 20 bp, Homo sapiens
gtggaaattaagaagaaact

SEQ ID NO: 2565051 - DNA, 21 bp, Homo sapiens
gtggaaccactgactactggc

SEQ ID NO: 2565052 - DNA, 22 bp, Homo sapiens
gtggaacgtttttcctgttctt

SEQ ID NO: 2565053 - DNA, 16 bp, Homo sapiens
gtggaagaagagggag

SEQ ID NO: 2565054 - DNA, 16 bp, Homo sapiens
gtggaagaggggacag

SEQ ID NO: 2565055 - DNA, 19 bp, Homo sapiens
gtggaagtgtgggtctgtg

SEQ ID NO: 2565056 - DNA, 20 bp, Homo sapiens
gtggaagtgtgggtctgtgt

SEQ ID NO: 2565057 - DNA, 14 bp, Homo sapiens
gtggaataaaatac

SEQ ID NO: 2565058 - DNA, 19 bp, Homo sapiens
gtggaatagtatcctccag

SEQ ID NO: 2565059 - DNA, 21 bp, Homo sapiens
gtggaatagtatcctccaggt

SEQ ID NO: 2565060 - DNA, 22 bp, Homo sapiens
gtggaatagtatcctccaggtt

SEQ ID NO: 2565061 - DNA, 23 bp, Homo sapiens
gtggaatagtatcctccaggttt

SEQ ID NO: 2565062 - DNA, 17 bp, Homo sapiens
gtggacacagctcttct

SEQ ID NO: 2565063 - DNA, 23 bp, Homo sapiens
gtggacacagctcttctccaggc

SEQ ID NO: 2565064 - DNA, 13 bp, Homo sapiens
gtcctccagaagc

SEQ ID NO: 2565065 - DNA, 20 bp, Homo sapiens
gtcctccagaagcctctggc

SEQ ID NO: 2565066 - DNA, 19 bp, Homo sapiens
gtcctcccatcccctggac

SEQ ID NO: 2565067 - DNA, 21 bp, Homo sapiens
gtcctcccatcccctggactg

SEQ ID NO: 2565068 - DNA, 14 bp, Homo sapiens
gtcctcccatctca

SEQ ID NO: 2565069 - DNA, 23 bp, Homo sapiens
gtcctcccatctcacacatgagc

SEQ ID NO: 2565070 - DNA, 13 bp, Homo sapiens
gtcctccccttgg

SEQ ID NO: 2565071 - DNA, 17 bp, Homo sapiens
gtcctcccgggccctcc

SEQ ID NO: 2565072 - DNA, 22 bp, Homo sapiens
gtcctcctaccgaaaccttgcc

SEQ ID NO: 2565073 - DNA, 12 bp, Homo sapiens
gtcctcctctgt

SEQ ID NO: 2565074 - DNA, 23 bp, Homo sapiens
gtcctcctggtgggtccaggggc

SEQ ID NO: 2565075 - DNA, 16 bp, Homo sapiens
gtcctctctggctggg

SEQ ID NO: 2565076 - DNA, 18 bp, Homo sapiens
gtcctctctggctgggga

SEQ ID NO: 2565077 - DNA, 19 bp, Homo sapiens
gtcctctgatacccagagc

SEQ ID NO: 2565078 - DNA, 21 bp, Homo sapiens
gtcctctggatggcaccagag

SEQ ID NO: 2565079 - DNA, 13 bp, Homo sapiens
gtcctcttctgca

SEQ ID NO: 2565080 - DNA, 15 bp, Homo sapiens
gtcctctttcaaagg

SEQ ID NO: 2565081 - DNA, 17 bp, Homo sapiens
gtcctgaagaggcgggc

SEQ ID NO: 2565082 - DNA, 20 bp, Homo sapiens
gtcctgaagaggcgggccag

SEQ ID NO: 2565083 - DNA, 14 bp, Homo sapiens
gtcctgaccaccct

SEQ ID NO: 2565084 - DNA, 17 bp, Homo sapiens
gtcctgaccaccctccc

SEQ ID NO: 2565085 - DNA, 23 bp, Homo sapiens
gtcctgaccaccctcccctctct

SEQ ID NO: 2565086 - DNA, 15 bp, Homo sapiens
gtcctgatcagagcc

SEQ ID NO: 2565087 - DNA, 19 bp, Homo sapiens
gtcctgcagtctggctgag

SEQ ID NO: 2565088 - DNA, 17 bp, Homo sapiens
gtcctgcctcagcctcc

SEQ ID NO: 2565089 - DNA, 19 bp, Homo sapiens
gtcctgcgtcgaagctttg

SEQ ID NO: 2565090 - DNA, 19 bp, Homo sapiens
gtcctgctgcagttgccag

SEQ ID NO: 2565091 - DNA, 19 bp, Homo sapiens
gtcctggagcagaccaccc

SEQ ID NO: 2565092 - DNA, 14 bp, Homo sapiens
gtcctggcctggct

SEQ ID NO: 2565093 - DNA, 19 bp, Homo sapiens
gtcctgggagaacctcagg

SEQ ID NO: 2565094 - DNA, 17 bp, Homo sapiens
gtcctgggagtgagctg

SEQ ID NO: 2565095 - DNA, 18 bp, Homo sapiens
gtcctgggagtgagctgg

SEQ ID NO: 2565096 - DNA, 19 bp, Homo sapiens
gtcctgggagtgagctggt

SEQ ID NO: 2565097 - DNA, 19 bp, Homo sapiens
gtcctgggcgccctggaag

SEQ ID NO: 2565098 - DNA, 23 bp, Homo sapiens
gtccttaaacagggcatctccag

SEQ ID NO: 2565099 - DNA, 16 bp, Homo sapiens
gtccttaccagcagag

SEQ ID NO: 2565100 - DNA, 15 bp, Homo sapiens
gtccttcacctcact

SEQ ID NO: 2565101 - DNA, 15 bp, Homo sapiens
gtccttcagatggaa

SEQ ID NO: 2565102 - DNA, 14 bp, Homo sapiens
gtccttccacctcg

SEQ ID NO: 2565103 - DNA, 11 bp, Homo sapiens
gtccttgaaaa

SEQ ID NO: 2565104 - DNA, 18 bp, Homo sapiens
gtccttgcacccctcact

SEQ ID NO: 2565105 - DNA, 22 bp, Homo sapiens
gtccttgctggttttctggatg

SEQ ID NO: 2565106 - DNA, 17 bp, Homo sapiens
gtccttggaagtttcat

SEQ ID NO: 2565107 - DNA, 16 bp, Homo sapiens
gtcctttatgtggaaa

SEQ ID NO: 2565108 - DNA, 20 bp, Homo sapiens
gtcctttatgtggaaaacag

SEQ ID NO: 2565109 - DNA, 21 bp, Homo sapiens
gtcctttatgtggaaaacaga

SEQ ID NO: 2565110 - DNA, 20 bp, Homo sapiens
gtcctttccaaggcttctcc

SEQ ID NO: 2565111 - DNA, 14 bp, Homo sapiens
gtcgcccagtctgg

SEQ ID NO: 2565112 - DNA, 23 bp, Homo sapiens
gtcgcccagtctggaatgcagtg

SEQ ID NO: 2565113 - DNA, 18 bp, Homo sapiens
gtcgctctgctggcctgg

SEQ ID NO: 2565114 - DNA, 20 bp, Homo sapiens
gtcgctctgctggcctggcc

SEQ ID NO: 2565115 - DNA, 20 bp, Homo sapiens
gtcggcctctaaccccaggc

SEQ ID NO: 2565116 - DNA, 22 bp, Homo sapiens
gtcggcctctaaccccaggccc

SEQ ID NO: 2565117 - DNA, 17 bp, Homo sapiens
gtcggggggacagctcc

SEQ ID NO: 2565118 - DNA, 23 bp, Homo sapiens
gtcgggttttattgtttaaaatc

SEQ ID NO: 2565119 - DNA, 22 bp, Homo sapiens
gtcgtggcagataatcagcctc

SEQ ID NO: 2565120 - DNA, 19 bp, Homo sapiens
gtcgttgactttagggact

SEQ ID NO: 2565121 - DNA, 14 bp, Homo sapiens
gtctaaaacaataa

SEQ ID NO: 2565122 - DNA, 16 bp, Homo sapiens
gtctaaatatttcctt

SEQ ID NO: 2565123 - DNA, 15 bp, Homo sapiens
gtctacactgtgctg

SEQ ID NO: 2565124 - DNA, 17 bp, Homo sapiens
gtctacccagagaagcc

SEQ ID NO: 2565125 - DNA, 13 bp, Homo sapiens
gtctacctgaggg

SEQ ID NO: 2565126 - DNA, 16 bp, Homo sapiens
gtctacctgaggggcc

SEQ ID NO: 2565127 - DNA, 17 bp, Homo sapiens
gtctactcttaagccat

SEQ ID NO: 2565128 - DNA, 21 bp, Homo sapiens
gtctagaagttgtttgtcatc

SEQ ID NO: 2565129 - DNA, 23 bp, Homo sapiens
gtctaggcaggacctgtggccaa

SEQ ID NO: 2565130 - DNA, 20 bp, Homo sapiens
gtctataatcccagcacttt

SEQ ID NO: 2565131 - DNA, 21 bp, Homo sapiens
gtctataatcccagcactttg

SEQ ID NO: 2565132 - DNA, 14 bp, Homo sapiens
gtctatatgtttgt

SEQ ID NO: 2565133 - DNA, 13 bp, Homo sapiens
gtctatccacaga

SEQ ID NO: 2565134 - DNA, 14 bp, Homo sapiens
gtctatgggactca

SEQ ID NO: 2565135 - DNA, 22 bp, Homo sapiens
gtctatgtaaatgcatctgtcc

SEQ ID NO: 2565136 - DNA, 21 bp, Homo sapiens
gtctcaacccttttgtctgcc

SEQ ID NO: 2565137 - DNA, 19 bp, Homo sapiens
gtctcaagggctagcatcc

SEQ ID NO: 2565138 - DNA, 21 bp, Homo sapiens
gtctcactatgttgcccaggc

SEQ ID NO: 2565139 - DNA, 16 bp, Homo sapiens
gtctcactctgtcgcc

SEQ ID NO: 2565140 - DNA, 22 bp, Homo sapiens
gtctcactctgtcgcccagtct

SEQ ID NO: 2565141 - DNA, 18 bp, Homo sapiens
gtctcactgttgcccagg

SEQ ID NO: 2565142 - DNA, 20 bp, Homo sapiens
gtctcactgttgcccaggct

SEQ ID NO: 2565143 - DNA, 21 bp, Homo sapiens
gtctcactgttgcccaggctg

SEQ ID NO: 2565144 - DNA, 22 bp, Homo sapiens
gtctcacttgtgcagtgttgac

SEQ ID NO: 2565145 - DNA, 15 bp, Homo sapiens
gtctcaggacctagg

SEQ ID NO: 2565146 - DNA, 12 bp, Homo sapiens
gtctcaggagca

SEQ ID NO: 2565147 - DNA, 16 bp, Homo sapiens
gtctcaggagcatggg

SEQ ID NO: 2565148 - DNA, 21 bp, Homo sapiens
gtctcagtttgtgtgtcttaa

SEQ ID NO: 2565149 - DNA, 11 bp, Homo sapiens
gtctcatgtgt

SEQ ID NO: 2565150 - DNA, 21 bp, Homo sapiens
gtctccagtatccactttgca

SEQ ID NO: 2565151 - DNA, 20 bp, Homo sapiens
gtctccagtggttgctgttg

SEQ ID NO: 2565152 - DNA, 14 bp, Homo sapiens
gtctccatggccct

SEQ ID NO: 2565153 - DNA, 15 bp, Homo sapiens
gtctcccttctccca

SEQ ID NO: 2565154 - DNA, 14 bp, Homo sapiens
gtctcctcactccc

SEQ ID NO: 2565155 - DNA, 13 bp, Homo sapiens
gtctcctcagcct

SEQ ID NO: 2565156 - DNA, 20 bp, Homo sapiens
gtctcctttgcactgagggc

SEQ ID NO: 2565157 - DNA, 16 bp, Homo sapiens
gtctcggactaagcct

SEQ ID NO: 2565158 - DNA, 13 bp, Homo sapiens
gtctctaggctgg

SEQ ID NO: 2565159 - DNA, 16 bp, Homo sapiens
gtctctagtgctgtga

SEQ ID NO: 2565160 - DNA, 13 bp, Homo sapiens
gtctctctcccat

SEQ ID NO: 2565161 - DNA, 16 bp, Homo sapiens
gtctctctcccatgga

SEQ ID NO: 2565162 - DNA, 19 bp, Homo sapiens
gtctctctctctctacaaa

SEQ ID NO: 2565163 - DNA, 14 bp, Homo sapiens
gtctctgagggctt

SEQ ID NO: 2565164 - DNA, 21 bp, Homo sapiens
gtctctgagggcttcctttgg

SEQ ID NO: 2565165 - DNA, 18 bp, Homo sapiens
gtctctgccggctctttc

SEQ ID NO: 2565166 - DNA, 13 bp, Homo sapiens
gtctctggcctgt

SEQ ID NO: 2565167 - DNA, 14 bp, Homo sapiens
gtctcttctgagct

SEQ ID NO: 2565168 - DNA, 13 bp, Homo sapiens
gtctcttgaggga

SEQ ID NO: 2565169 - DNA, 23 bp, Homo sapiens
gtctcttgagggagcttagccaa

SEQ ID NO: 2565170 - DNA, 20 bp, Homo sapiens
gtctcttggtcctgctgcag

SEQ ID NO: 2565171 - DNA, 17 bp, Homo sapiens
gtctctttaatcttcag

SEQ ID NO: 2565172 - DNA, 23 bp, Homo sapiens
gtctctttaatgtcacaggcagg

SEQ ID NO: 2565173 - DNA, 14 bp, Homo sapiens
gtctgaatgttctg

SEQ ID NO: 2565174 - DNA, 15 bp, Homo sapiens
gtctgaatgttctga

SEQ ID NO: 2565175 - DNA, 18 bp, Homo sapiens
gtctgaatgttctgacat

SEQ ID NO: 2565176 - DNA, 22 bp, Homo sapiens
gtctgacaggcaatgctggctg

SEQ ID NO: 2565177 - DNA, 14 bp, Homo sapiens
gtctgactgtgtgt

SEQ ID NO: 2565178 - DNA, 18 bp, Homo sapiens
gtctgaggaatccagacc

SEQ ID NO: 2565179 - DNA, 22 bp, Homo sapiens
gtctgaggggcaactgagtctg

SEQ ID NO: 2565180 - DNA, 19 bp, Homo sapiens
gtctgatcgtgacgctgaa

SEQ ID NO: 2565181 - DNA, 20 bp, Homo sapiens
gtctgatcgtgacgctgaat

SEQ ID NO: 2565182 - DNA, 21 bp, Homo sapiens
gtctgatctgtgctttccagc

SEQ ID NO: 2565183 - DNA, 23 bp, Homo sapiens
gtctgatctgtgctttccagctc

SEQ ID NO: 2565184 - DNA, 24 bp, Homo sapiens
gtctgatctgtgctttccagctca

SEQ ID NO: 2565185 - DNA, 17 bp, Homo sapiens
gtctgattcccaagctc

SEQ ID NO: 2565186 - DNA, 21 bp, Homo sapiens
gtctgattcccaagctctgct

SEQ ID NO: 2565187 - DNA, 16 bp, Homo sapiens
gtctgatttgtgatga

SEQ ID NO: 2565188 - DNA, 22 bp, Homo sapiens
gtctgcaagattctgaaacatt

SEQ ID NO: 2565189 - DNA, 13 bp, Homo sapiens
gtctgcaagtcag

SEQ ID NO: 2565190 - DNA, 16 bp, Homo sapiens
gtctgcaagtcagagg

SEQ ID NO: 2565191 - DNA, 12 bp, Homo sapiens
gtctgcaggcag

SEQ ID NO: 2565192 - DNA, 16 bp, Homo sapiens
gtctgctgccctccat

SEQ ID NO: 2565193 - DNA, 18 bp, Homo sapiens
gtctgctgccctccatcc

SEQ ID NO: 2565194 - DNA, 16 bp, Homo sapiens
gtctggctgagccctg

SEQ ID NO: 2565195 - DNA, 15 bp, Homo sapiens
gtctggctgagctga

SEQ ID NO: 2565196 - DNA, 15 bp, Homo sapiens
gtctggcttcacaga

SEQ ID NO: 2565197 - DNA, 20 bp, Homo sapiens
gtctgggacttccttgctct

SEQ ID NO: 2565198 - DNA, 16 bp, Homo sapiens
gtctgggagaaattga

SEQ ID NO: 2565199 - DNA, 13 bp, Homo sapiens
gtctggtgggagg

SEQ ID NO: 2565200 - DNA, 16 bp, Homo sapiens
gtctggttttaacaat

SEQ ID NO: 2565201 - DNA, 20 bp, Homo sapiens
gtctgtacacgtgtcctgta

SEQ ID NO: 2565202 - DNA, 19 bp, Homo sapiens
gtctgtagagggccctggt

SEQ ID NO: 2565203 - DNA, 22 bp, Homo sapiens
gtctgtagagggccctggtgtt

SEQ ID NO: 2565204 - DNA, 19 bp, Homo sapiens
gtctgtatttatgtgtgag

SEQ ID NO: 2565205 - DNA, 22 bp, Homo sapiens
gtctgtcatgaacatgttcctg

SEQ ID NO: 2565206 - DNA, 23 bp, Homo sapiens
gtctgtcccggggtcctgtggca

SEQ ID NO: 2565207 - DNA, 20 bp, Homo sapiens
gtctgtggctttcagcctct

SEQ ID NO: 2565208 - DNA, 11 bp, Homo sapiens
gtctgtgtgtg

SEQ ID NO: 2565209 - DNA, 12 bp, Homo sapiens
gtctgtgtgtgt

SEQ ID NO: 2565210 - DNA, 22 bp, Homo sapiens
gtctgtgtgtttatgtgtgtgt

SEQ ID NO: 2565211 - DNA, 16 bp, Homo sapiens
gtctgttaacttaata

SEQ ID NO: 2565212 - DNA, 17 bp, Homo sapiens
gtctgtttataaacatt

SEQ ID NO: 2565213 - DNA, 13 bp, Homo sapiens
gtctgttttatga

SEQ ID NO: 2565214 - DNA, 15 bp, Homo sapiens
gtcagccagggccag

SEQ ID NO: 2565215 - DNA, 16 bp, Homo sapiens
gtcagccagggccagg

SEQ ID NO: 2565216 - DNA, 16 bp, Homo sapiens
gtcagccgggccctga

SEQ ID NO: 2565217 - DNA, 12 bp, Homo sapiens
gtcagcctccag

SEQ ID NO: 2565218 - DNA, 14 bp, Homo sapiens
gtcagcctccagcc

SEQ ID NO: 2565219 - DNA, 16 bp, Homo sapiens
gtcagcctccagcctc

SEQ ID NO: 2565220 - DNA, 11 bp, Homo sapiens
gtcagcctctc

SEQ ID NO: 2565221 - DNA, 20 bp, Homo sapiens
gtcagcctctctcccagtct

SEQ ID NO: 2565222 - DNA, 21 bp, Homo sapiens
gtcagcctctctcccagtcta

SEQ ID NO: 2565223 - DNA, 21 bp, Homo sapiens
gtcagctcccctcggagaaga

SEQ ID NO: 2565224 - DNA, 18 bp, Homo sapiens
gtcagctttgccttccac

SEQ ID NO: 2565225 - DNA, 15 bp, Homo sapiens
gtcaggaacagaagg

SEQ ID NO: 2565226 - DNA, 12 bp, Homo sapiens
gtcaggagagca

SEQ ID NO: 2565227 - DNA, 21 bp, Homo sapiens
gtcaggcccttattttcaaga

SEQ ID NO: 2565228 - DNA, 15 bp, Homo sapiens
gtcaggcctgtgtgt

SEQ ID NO: 2565229 - DNA, 13 bp, Homo sapiens
gtcaggctgctgg

SEQ ID NO: 2565230 - DNA, 16 bp, Homo sapiens
gtcaggctgctggcgc

SEQ ID NO: 2565231 - DNA, 16 bp, Homo sapiens
gtcagggaccaaggac

SEQ ID NO: 2565232 - DNA, 19 bp, Homo sapiens
gtcagggcccaagtccctg

SEQ ID NO: 2565233 - DNA, 14 bp, Homo sapiens
gtcaggggcagctg

SEQ ID NO: 2565234 - DNA, 18 bp, Homo sapiens
gtcaggtggggcagcttg

SEQ ID NO: 2565235 - DNA, 21 bp, Homo sapiens
gtcagtatctgtatctctctc

SEQ ID NO: 2565236 - DNA, 17 bp, Homo sapiens
gtcagtatgtggaagtg

SEQ ID NO: 2565237 - DNA, 19 bp, Homo sapiens
gtcagtcatgatggcacca

SEQ ID NO: 2565238 - DNA, 23 bp, Homo sapiens
gtcagtgaggcccagggagaggc

SEQ ID NO: 2565239 - DNA, 18 bp, Homo sapiens
gtcataactaaataaagc

SEQ ID NO: 2565240 - DNA, 13 bp, Homo sapiens
gtcatagaaatta

SEQ ID NO: 2565241 - DNA, 22 bp, Homo sapiens
gtcatagaaattacacccaaag

SEQ ID NO: 2565242 - DNA, 12 bp, Homo sapiens
gtcatattttga

SEQ ID NO: 2565243 - DNA, 20 bp, Homo sapiens
gtcatattttgattattgta

SEQ ID NO: 2565244 - DNA, 17 bp, Homo sapiens
gtcatcacttttcagtg

SEQ ID NO: 2565245 - DNA, 16 bp, Homo sapiens
gtcatctcagctggat

SEQ ID NO: 2565246 - DNA, 16 bp, Homo sapiens
gtcatctggtagattt

SEQ ID NO: 2565247 - DNA, 20 bp, Homo sapiens
gtcatcttgaccaagcagga

SEQ ID NO: 2565248 - DNA, 18 bp, Homo sapiens
gtcatctttttctctaaa

SEQ ID NO: 2565249 - DNA, 20 bp, Homo sapiens
gtcatgaattcttatgctta

SEQ ID NO: 2565250 - DNA, 18 bp, Homo sapiens
gtcatgagctgagcaggg

SEQ ID NO: 2565251 - DNA, 16 bp, Homo sapiens
gtcatgcaaaggctgg

SEQ ID NO: 2565252 - DNA, 15 bp, Homo sapiens
gtcatgcccccctca

SEQ ID NO: 2565253 - DNA, 20 bp, Homo sapiens
gtcatggcttaatgtttatt

SEQ ID NO: 2565254 - DNA, 20 bp, Homo sapiens
gtcatgtaagctgaaaatat

SEQ ID NO: 2565255 - DNA, 17 bp, Homo sapiens
gtcatgttccttcaaga

SEQ ID NO: 2565256 - DNA, 23 bp, Homo sapiens
gtcatgttggtcaaaagctggat

SEQ ID NO: 2565257 - DNA, 12 bp, Homo sapiens
gtcattaaaggt

SEQ ID NO: 2565258 - DNA, 11 bp, Homo sapiens
gtcattaaatg

SEQ ID NO: 2565259 - DNA, 16 bp, Homo sapiens
gtcattagactcctcc

SEQ ID NO: 2565260 - DNA, 18 bp, Homo sapiens
gtcattgctgttgtccct

SEQ ID NO: 2565261 - DNA, 22 bp, Homo sapiens
gtcattgctgttgtccctctgc

SEQ ID NO: 2565262 - DNA, 21 bp, Homo sapiens
gtcatttgagcagggctcagc

SEQ ID NO: 2565263 - DNA, 17 bp, Homo sapiens
gtccaaagcagggtctg

SEQ ID NO: 2565264 - DNA, 11 bp, Homo sapiens
gtccaaataaa

SEQ ID NO: 2565265 - DNA, 22 bp, Homo sapiens
gtccaaatgtcctccagaagcc

SEQ ID NO: 2565266 - DNA, 20 bp, Homo sapiens
gtccaacccgaggcccgcat

SEQ ID NO: 2565267 - DNA, 15 bp, Homo sapiens
gtccaagaagcccag

SEQ ID NO: 2565268 - DNA, 17 bp, Homo sapiens
gtccaaggaaaccacag

SEQ ID NO: 2565269 - DNA, 22 bp, Homo sapiens
gtccaaggaaaccacagctgct

SEQ ID NO: 2565270 - DNA, 15 bp, Homo sapiens
gtccaagtgtgtgtg

SEQ ID NO: 2565271 - DNA, 12 bp, Homo sapiens
gtccaatcctat

SEQ ID NO: 2565272 - DNA, 19 bp, Homo sapiens
gtccaatttgtaaaaacag

SEQ ID NO: 2565273 - DNA, 13 bp, Homo sapiens
gtccacaggaagt

SEQ ID NO: 2565274 - DNA, 20 bp, Homo sapiens
gtccacccacctatgtgcca

SEQ ID NO: 2565275 - DNA, 16 bp, Homo sapiens
gtccacccaggagccc

SEQ ID NO: 2565276 - DNA, 23 bp, Homo sapiens
gtccacccaggagccccgaggcc

SEQ ID NO: 2565277 - DNA, 15 bp, Homo sapiens
gtccactcccagtgc

SEQ ID NO: 2565278 - DNA, 14 bp, Homo sapiens
gtccactgtgtata

SEQ ID NO: 2565279 - DNA, 15 bp, Homo sapiens
gtccagaagaatatt

SEQ ID NO: 2565280 - DNA, 22 bp, Homo sapiens
gtccagaagaatattcaggact

SEQ ID NO: 2565281 - DNA, 14 bp, Homo sapiens
gtccagacagcctg

SEQ ID NO: 2565282 - DNA, 15 bp, Homo sapiens
gtccagacagcctgt

SEQ ID NO: 2565283 - DNA, 20 bp, Homo sapiens
gtccagagagagaagtgccc

SEQ ID NO: 2565284 - DNA, 23 bp, Homo sapiens
gtccagagagagaagtgcccctg

SEQ ID NO: 2565285 - DNA, 22 bp, Homo sapiens
gtccagatttacactgggagag

SEQ ID NO: 2565286 - DNA, 21 bp, Homo sapiens
ggctgggttctacccaggtgc

SEQ ID NO: 2565287 - DNA, 22 bp, Homo sapiens
ggctgggttctacccaggtgct

SEQ ID NO: 2565288 - DNA, 14 bp, Homo sapiens
ggctgggttggagg

SEQ ID NO: 2565289 - DNA, 15 bp, Homo sapiens
ggctggtagctcagg

SEQ ID NO: 2565290 - DNA, 15 bp, Homo sapiens
ggctggtgccagcct

SEQ ID NO: 2565291 - DNA, 19 bp, Homo sapiens
ggctgtatcccatgagcct

SEQ ID NO: 2565292 - DNA, 20 bp, Homo sapiens
ggctgtatcccatgagcctc

SEQ ID NO: 2565293 - DNA, 13 bp, Homo sapiens
ggctgtgaggccc

SEQ ID NO: 2565294 - DNA, 13 bp, Homo sapiens
ggctgtgcctctg

SEQ ID NO: 2565295 - DNA, 20 bp, Homo sapiens
ggctgtgctccctggttctg

SEQ ID NO: 2565296 - DNA, 21 bp, Homo sapiens
ggctgtgggcctcaaggactt

SEQ ID NO: 2565297 - DNA, 20 bp, Homo sapiens
ggctgttggctgggggcctc

SEQ ID NO: 2565298 - DNA, 12 bp, Homo sapiens
ggcttaatgttt

SEQ ID NO: 2565299 - DNA, 16 bp, Homo sapiens
ggcttaatgtttattc

SEQ ID NO: 2565300 - DNA, 14 bp, Homo sapiens
ggcttagtcactga

SEQ ID NO: 2565301 - DNA, 21 bp, Homo sapiens
ggcttcacggaagagccttgc

SEQ ID NO: 2565302 - DNA, 19 bp, Homo sapiens
ggcttcactgtataaatag

SEQ ID NO: 2565303 - DNA, 21 bp, Homo sapiens
ggcttcactgtataaatagga

SEQ ID NO: 2565304 - DNA, 17 bp, Homo sapiens
ggcttcagcatatttat

SEQ ID NO: 2565305 - DNA, 16 bp, Homo sapiens
ggcttcagtggcagct

SEQ ID NO: 2565306 - DNA, 18 bp, Homo sapiens
ggcttcagtggcagctgc

SEQ ID NO: 2565307 - DNA, 12 bp, Homo sapiens
ggcttccaggta

SEQ ID NO: 2565308 - DNA, 22 bp, Homo sapiens
ggcttccatttgtgtgtgtgca

SEQ ID NO: 2565309 - DNA, 20 bp, Homo sapiens
ggcttcccagtggctgctgc

SEQ ID NO: 2565310 - DNA, 21 bp, Homo sapiens
ggcttcccagtggctgctgcc

SEQ ID NO: 2565311 - DNA, 16 bp, Homo sapiens
ggcttcctcatagtat

SEQ ID NO: 2565312 - DNA, 14 bp, Homo sapiens
ggcttctctctgtg

SEQ ID NO: 2565313 - DNA, 13 bp, Homo sapiens
ggcttctgcaccc

SEQ ID NO: 2565314 - DNA, 21 bp, Homo sapiens
ggcttctgcaccctccaccct

SEQ ID NO: 2565315 - DNA, 16 bp, Homo sapiens
ggcttctggagccctt

SEQ ID NO: 2565316 - DNA, 18 bp, Homo sapiens
ggcttctggagcccttgg

SEQ ID NO: 2565317 - DNA, 16 bp, Homo sapiens
ggcttgccacagctct

SEQ ID NO: 2565318 - DNA, 14 bp, Homo sapiens
ggcttgcctgcagg

SEQ ID NO: 2565319 - DNA, 23 bp, Homo sapiens
ggcttgggcttccatttgtgtgt

SEQ ID NO: 2565320 - DNA, 16 bp, Homo sapiens
ggctttcccttatcaa

SEQ ID NO: 2565321 - DNA, 20 bp, Homo sapiens
ggcttttattaatgcacttt

SEQ ID NO: 2565322 - DNA, 10 bp, Homo sapiens
ggcttttgtg

SEQ ID NO: 2565323 - DNA, 16 bp, Homo sapiens
ggctttttttttctct

SEQ ID NO: 2565324 - DNA, 17 bp, Homo sapiens
ggctttttttttctctt

SEQ ID NO: 2565325 - DNA, 15 bp, Homo sapiens
gggaaagccacctct

SEQ ID NO: 2565326 - DNA, 15 bp, Homo sapiens
gggaaaggatatttt

SEQ ID NO: 2565327 - DNA, 14 bp, Homo sapiens
gggaaatggtgcct

SEQ ID NO: 2565328 - DNA, 20 bp, Homo sapiens
gggaacccaagtccaagcat

SEQ ID NO: 2565329 - DNA, 23 bp, Homo sapiens
gggaactcacctggggctgctgg

SEQ ID NO: 2565330 - DNA, 16 bp, Homo sapiens
gggaagaaagagaagg

SEQ ID NO: 2565331 - DNA, 15 bp, Homo sapiens
gggaagacgaggccc

SEQ ID NO: 2565332 - DNA, 18 bp, Homo sapiens
gggaagagaggagttcaa

SEQ ID NO: 2565333 - DNA, 22 bp, Homo sapiens
gggaagagaggagttcaatgat

SEQ ID NO: 2565334 - DNA, 23 bp, Homo sapiens
gggaagagaggagttcaatgatc

SEQ ID NO: 2565335 - DNA, 17 bp, Homo sapiens
gggaagagtgtactggg

SEQ ID NO: 2565336 - DNA, 20 bp, Homo sapiens
gggaaggagggttagggagg

SEQ ID NO: 2565337 - DNA, 16 bp, Homo sapiens
gggaaggatacaaaag

SEQ ID NO: 2565338 - DNA, 13 bp, Homo sapiens
gggaagggccagt

SEQ ID NO: 2565339 - DNA, 14 bp, Homo sapiens
gggaagggggctgg

SEQ ID NO: 2565340 - DNA, 12 bp, Homo sapiens
gggaatatttta

SEQ ID NO: 2565341 - DNA, 12 bp, Homo sapiens
gggaatcaagat

SEQ ID NO: 2565342 - DNA, 24 bp, Homo sapiens
gggaatgaagcttgtgtatccatt

SEQ ID NO: 2565343 - DNA, 20 bp, Homo sapiens
gggaatgaggcttgctgaga

SEQ ID NO: 2565344 - DNA, 21 bp, Homo sapiens
gggaatgaggcttgctgagag

SEQ ID NO: 2565345 - DNA, 21 bp, Homo sapiens
gggaatgtttgcctctgcctc

SEQ ID NO: 2565346 - DNA, 13 bp, Homo sapiens
gggaatttcctct

SEQ ID NO: 2565347 - DNA, 18 bp, Homo sapiens
gggacaaaacccaccttg

SEQ ID NO: 2565348 - DNA, 14 bp, Homo sapiens
gggacaccagccag

SEQ ID NO: 2565349 - DNA, 15 bp, Homo sapiens
gggacagaggcctgc

SEQ ID NO: 2565350 - DNA, 15 bp, Homo sapiens
gggacagagtctggg

SEQ ID NO: 2565351 - DNA, 12 bp, Homo sapiens
gggacagctcct

SEQ ID NO: 2565352 - DNA, 15 bp, Homo sapiens
gggacagctccttct

SEQ ID NO: 2565353 - DNA, 14 bp, Homo sapiens
gggacagggctcgc

SEQ ID NO: 2565354 - DNA, 12 bp, Homo sapiens
gggacagggctg

SEQ ID NO: 2565355 - DNA, 18 bp, Homo sapiens
gggacagggctggcccag

SEQ ID NO: 2565356 - DNA, 20 bp, Homo sapiens
gggacagggctggcccagcc

SEQ ID NO: 2565357 - DNA, 15 bp, Homo sapiens
gggacatctctttga

SEQ ID NO: 2565358 - DNA, 15 bp, Homo sapiens
gggacattgggaagg

SEQ ID NO: 2565359 - DNA, 16 bp, Homo sapiens
gggaccaactgggccc

SEQ ID NO: 2565360 - DNA, 19 bp, Homo sapiens
gggaccaaggcaaggcagg

SEQ ID NO: 2565361 - DNA, 23 bp, Homo sapiens
gggaccaaggcaaggcaggtgcc

SEQ ID NO: 2565362 - DNA, 13 bp, Homo sapiens
gggacccctcctc

SEQ ID NO: 2565363 - DNA, 23 bp, Homo sapiens
gggaccgccagatggggcctctg

SEQ ID NO: 2565364 - DNA, 22 bp, Homo sapiens
gggacctcccctgaggctcagg

SEQ ID NO: 2565365 - DNA, 12 bp, Homo sapiens
gggacctctccc

SEQ ID NO: 2565366 - DNA, 23 bp, Homo sapiens
gggacctctcccagggtccctgg

SEQ ID NO: 2565367 - DNA, 17 bp, Homo sapiens
gggactcaatgcactga

SEQ ID NO: 2565368 - DNA, 20 bp, Homo sapiens
gggactcaatttctccccag

SEQ ID NO: 2565369 - DNA, 16 bp, Homo sapiens
gggactcagccctgag

SEQ ID NO: 2565370 - DNA, 19 bp, Homo sapiens
gggactctgaagcctctgg

SEQ ID NO: 2565371 - DNA, 13 bp, Homo sapiens
gggactgagccag

SEQ ID NO: 2565372 - DNA, 21 bp, Homo sapiens
gggactgaggggaggggagca

SEQ ID NO: 2565373 - DNA, 21 bp, Homo sapiens
gggactgtctttcagatacat

SEQ ID NO: 2565374 - DNA, 17 bp, Homo sapiens
gggacttggaagctccg

SEQ ID NO: 2565375 - DNA, 14 bp, Homo sapiens
gggagaacctcagg

SEQ ID NO: 2565376 - DNA, 15 bp, Homo sapiens
gggagaatcatgtga

SEQ ID NO: 2565377 - DNA, 14 bp, Homo sapiens
gggagacactggcc

SEQ ID NO: 2565378 - DNA, 14 bp, Homo sapiens
gggagactgggctg

SEQ ID NO: 2565379 - DNA, 16 bp, Homo sapiens
gggagactgggctgag

SEQ ID NO: 2565380 - DNA, 14 bp, Homo sapiens
gggagagcaggctg

SEQ ID NO: 2565381 - DNA, 14 bp, Homo sapiens
gggagagccagctc

SEQ ID NO: 2565382 - DNA, 15 bp, Homo sapiens
gggagagccagctcc

SEQ ID NO: 2565383 - DNA, 19 bp, Homo sapiens
gggagagccttccaggggt

SEQ ID NO: 2565384 - DNA, 21 bp, Homo sapiens
gggagaggatttttttctgag

SEQ ID NO: 2565385 - DNA, 22 bp, Homo sapiens
gggagaggccatgattcgccca

SEQ ID NO: 2565386 - DNA, 16 bp, Homo sapiens
gggagaggtgccagca

SEQ ID NO: 2565387 - DNA, 13 bp, Homo sapiens
gggagcagagaca

SEQ ID NO: 2565388 - DNA, 16 bp, Homo sapiens
gggagcatggctgtga

SEQ ID NO: 2565389 - DNA, 12 bp, Homo sapiens
gggagccagggc

SEQ ID NO: 2565390 - DNA, 21 bp, Homo sapiens
gggagccccagggtcttccct

SEQ ID NO: 2565391 - DNA, 16 bp, Homo sapiens
gggagcccccgccccg

SEQ ID NO: 2565392 - DNA, 16 bp, Homo sapiens
gggagccgctggcaga

SEQ ID NO: 2565393 - DNA, 20 bp, Homo sapiens
gggagctcctctcctggagg

SEQ ID NO: 2565394 - DNA, 22 bp, Homo sapiens
gggagctcctctcctggaggat

SEQ ID NO: 2565395 - DNA, 12 bp, Homo sapiens
gggagctctgca

SEQ ID NO: 2565396 - DNA, 13 bp, Homo sapiens
gggagctgcctgt

SEQ ID NO: 2565397 - DNA, 24 bp, Homo sapiens
gggaggaaatttgaatgggtccat

SEQ ID NO: 2565398 - DNA, 21 bp, Homo sapiens
gggaggaccagggcagggcca

SEQ ID NO: 2565399 - DNA, 14 bp, Homo sapiens
gggaggagaatgag

SEQ ID NO: 2565400 - DNA, 17 bp, Homo sapiens
gggaggatcactggagc

SEQ ID NO: 2565401 - DNA, 20 bp, Homo sapiens
gggaggcagaggttgcagtg

SEQ ID NO: 2565402 - DNA, 11 bp, Homo sapiens
gggaggcccca

SEQ ID NO: 2565403 - DNA, 17 bp, Homo sapiens
gggaggcctaggcgggc

SEQ ID NO: 2565404 - DNA, 14 bp, Homo sapiens
gggaggcgcgagcc

SEQ ID NO: 2565405 - DNA, 21 bp, Homo sapiens
gggaggcggacgttccagccg

SEQ ID NO: 2565406 - DNA, 18 bp, Homo sapiens
gggaggcggagagtacag

SEQ ID NO: 2565407 - DNA, 14 bp, Homo sapiens
gggagggctccaga

SEQ ID NO: 2565408 - DNA, 17 bp, Homo sapiens
gggagggctccagacac

SEQ ID NO: 2565409 - DNA, 20 bp, Homo sapiens
gggaggggcgctggcccagc

SEQ ID NO: 2565410 - DNA, 21 bp, Homo sapiens
gggaggggcgctggcccagcc

SEQ ID NO: 2565411 - DNA, 15 bp, Homo sapiens
gggaggtcgaggcag

SEQ ID NO: 2565412 - DNA, 17 bp, Homo sapiens
gggaggtgggatcctcc

SEQ ID NO: 2565413 - DNA, 17 bp, Homo sapiens
gggagtccccttttctt

SEQ ID NO: 2565414 - DNA, 23 bp, Homo sapiens
gggagtctgaagcagatgcaaag

SEQ ID NO: 2565415 - DNA, 20 bp, Homo sapiens
gggagtgggacagagtctgg

SEQ ID NO: 2565416 - DNA, 21 bp, Homo sapiens
gggagtttctttcctgccttc

SEQ ID NO: 2565417 - DNA, 13 bp, Homo sapiens
gggatagagagag

SEQ ID NO: 2565418 - DNA, 13 bp, Homo sapiens
gggatagatgtgt

SEQ ID NO: 2565419 - DNA, 14 bp, Homo sapiens
gggatagatgtgtg

SEQ ID NO: 2565420 - DNA, 15 bp, Homo sapiens
gggatataggagagg

SEQ ID NO: 2565421 - DNA, 16 bp, Homo sapiens
gggatataggagagga

SEQ ID NO: 2565422 - DNA, 16 bp, Homo sapiens
gggatcctccaggtgc

SEQ ID NO: 2565423 - DNA, 15 bp, Homo sapiens
gggatgaaagagaag

SEQ ID NO: 2565424 - DNA, 20 bp, Homo sapiens
gggatgacatgcactcagct

SEQ ID NO: 2565425 - DNA, 15 bp, Homo sapiens
ggtgcgatctgggtt

SEQ ID NO: 2565426 - DNA, 21 bp, Homo sapiens
ggtgctacaaaaacacagcaa

SEQ ID NO: 2565427 - DNA, 19 bp, Homo sapiens
ggtgctatctcccccagcc

SEQ ID NO: 2565428 - DNA, 20 bp, Homo sapiens
ggtgctatctcccccagccc

SEQ ID NO: 2565429 - DNA, 15 bp, Homo sapiens
ggtgctccaggcagg

SEQ ID NO: 2565430 - DNA, 15 bp, Homo sapiens
ggtgctgccatccag

SEQ ID NO: 2565431 - DNA, 17 bp, Homo sapiens
ggtgctgcctctacctg

SEQ ID NO: 2565432 - DNA, 14 bp, Homo sapiens
ggtgctgggactga

SEQ ID NO: 2565433 - DNA, 16 bp, Homo sapiens
ggtgctgtggccaggg

SEQ ID NO: 2565434 - DNA, 16 bp, Homo sapiens
ggtggaagaggggaca

SEQ ID NO: 2565435 - DNA, 17 bp, Homo sapiens
ggtggacagtcctggga

SEQ ID NO: 2565436 - DNA, 15 bp, Homo sapiens
ggtggacatggcccc

SEQ ID NO: 2565437 - DNA, 12 bp, Homo sapiens
ggtggacccagg

SEQ ID NO: 2565438 - DNA, 15 bp, Homo sapiens
ggtggactcgcctgt

SEQ ID NO: 2565439 - DNA, 13 bp, Homo sapiens
ggtggagaagcca

SEQ ID NO: 2565440 - DNA, 15 bp, Homo sapiens
ggtggagaagccatt

SEQ ID NO: 2565441 - DNA, 16 bp, Homo sapiens
ggtggatcacctgagg

SEQ ID NO: 2565442 - DNA, 13 bp, Homo sapiens
ggtggatgcctgg

SEQ ID NO: 2565443 - DNA, 21 bp, Homo sapiens
ggtggatgcctggtggcagct

SEQ ID NO: 2565444 - DNA, 13 bp, Homo sapiens
ggtggcaagagcc

SEQ ID NO: 2565445 - DNA, 15 bp, Homo sapiens
ggtggcactgagccc

SEQ ID NO: 2565446 - DNA, 16 bp, Homo sapiens
ggtggcactgagcccc

SEQ ID NO: 2565447 - DNA, 15 bp, Homo sapiens
ggtggcagctgcggt

SEQ ID NO: 2565448 - DNA, 17 bp, Homo sapiens
ggtggcaggaccaggac

SEQ ID NO: 2565449 - DNA, 18 bp, Homo sapiens
ggtggcaggaccaggact

SEQ ID NO: 2565450 - DNA, 17 bp, Homo sapiens
ggtggcatcccagtggc

SEQ ID NO: 2565451 - DNA, 19 bp, Homo sapiens
ggtggcccacgcctgtaat

SEQ ID NO: 2565452 - DNA, 22 bp, Homo sapiens
ggtggcctcccaactcacccca

SEQ ID NO: 2565453 - DNA, 23 bp, Homo sapiens
ggtggcctcccaactcaccccag

SEQ ID NO: 2565454 - DNA, 12 bp, Homo sapiens
ggtggcctcggg

SEQ ID NO: 2565455 - DNA, 22 bp, Homo sapiens
ggtggcctcgggacacctgccc

SEQ ID NO: 2565456 - DNA, 23 bp, Homo sapiens
ggtggcctctccttgtggcctgg

SEQ ID NO: 2565457 - DNA, 20 bp, Homo sapiens
ggtggctcccggagggccct

SEQ ID NO: 2565458 - DNA, 12 bp, Homo sapiens
ggtggctgggtt

SEQ ID NO: 2565459 - DNA, 16 bp, Homo sapiens
ggtgggagagcccagc

SEQ ID NO: 2565460 - DNA, 20 bp, Homo sapiens
ggtgggaggatctcttgagc

SEQ ID NO: 2565461 - DNA, 17 bp, Homo sapiens
ggtgggcacccaccctg

SEQ ID NO: 2565462 - DNA, 16 bp, Homo sapiens
ggtgggcaggtggtgg

SEQ ID NO: 2565463 - DNA, 18 bp, Homo sapiens
ggtgggcccaggaccagc

SEQ ID NO: 2565464 - DNA, 21 bp, Homo sapiens
ggtgggcgtggtcactgctgt

SEQ ID NO: 2565465 - DNA, 15 bp, Homo sapiens
ggtgggctgagccct

SEQ ID NO: 2565466 - DNA, 11 bp, Homo sapiens
gtaagatgctg

SEQ ID NO: 2565467 - DNA, 14 bp, Homo sapiens
gtaaggtgagggaa

SEQ ID NO: 2565468 - DNA, 23 bp, Homo sapiens
gtaagtaattatcgggaacagtg

SEQ ID NO: 2565469 - DNA, 14 bp, Homo sapiens
gtaagtgccttcca

SEQ ID NO: 2565470 - DNA, 21 bp, Homo sapiens
gtaagtttaaaggatgttggt

SEQ ID NO: 2565471 - DNA, 13 bp, Homo sapiens
gtaagtttcaggt

SEQ ID NO: 2565472 - DNA, 16 bp, Homo sapiens
gtaagtttcaggtgac

SEQ ID NO: 2565473 - DNA, 17 bp, Homo sapiens
gtaatatgcacacattt

SEQ ID NO: 2565474 - DNA, 17 bp, Homo sapiens
gtaatccatcactagcc

SEQ ID NO: 2565475 - DNA, 15 bp, Homo sapiens
gtaatcccagcactt

SEQ ID NO: 2565476 - DNA, 20 bp, Homo sapiens
gtaatcccagcactttggga

SEQ ID NO: 2565477 - DNA, 16 bp, Homo sapiens
gtaatcccagctactt

SEQ ID NO: 2565478 - DNA, 20 bp, Homo sapiens
gtaatcccagctacttggga

SEQ ID NO: 2565479 - DNA, 22 bp, Homo sapiens
gtaatctccacagtcaaagaag

SEQ ID NO: 2565480 - DNA, 18 bp, Homo sapiens
gtaatctcgtttcaaaaa

SEQ ID NO: 2565481 - DNA, 21 bp, Homo sapiens
gtaatgatatagccagaaaaa

SEQ ID NO: 2565482 - DNA, 14 bp, Homo sapiens
gtaatgttactgat

SEQ ID NO: 2565483 - DNA, 23 bp, Homo sapiens
gtaatgttactgatcatgcattg

SEQ ID NO: 2565484 - DNA, 14 bp, Homo sapiens
gtaattaagtacta

SEQ ID NO: 2565485 - DNA, 20 bp, Homo sapiens
gtaattatcgggaacagtgt

SEQ ID NO: 2565486 - DNA, 17 bp, Homo sapiens
gtaattattttggtact

SEQ ID NO: 2565487 - DNA, 18 bp, Homo sapiens
gtaattctaaatgaatgt

SEQ ID NO: 2565488 - DNA, 15 bp, Homo sapiens
gtaattgaacttatc

SEQ ID NO: 2565489 - DNA, 12 bp, Homo sapiens
gtaattgcttac

SEQ ID NO: 2565490 - DNA, 15 bp, Homo sapiens
gtaattgcttacatt

SEQ ID NO: 2565491 - DNA, 14 bp, Homo sapiens
gtaattgtgaaaaa

SEQ ID NO: 2565492 - DNA, 23 bp, Homo sapiens
gtaattgttgtttgtatgtataa

SEQ ID NO: 2565493 - DNA, 20 bp, Homo sapiens
gtaatttaaaattgtgatgt

SEQ ID NO: 2565494 - DNA, 14 bp, Homo sapiens
gtaatttaaacagg

SEQ ID NO: 2565495 - DNA, 21 bp, Homo sapiens
gtaatttaaacaggcccagca

SEQ ID NO: 2565496 - DNA, 14 bp, Homo sapiens
gtaatttctttgcc

SEQ ID NO: 2565497 - DNA, 22 bp, Homo sapiens
gtaatttctttgcctgttcagt

SEQ ID NO: 2565498 - DNA, 15 bp, Homo sapiens
gtaatttgtgataca

SEQ ID NO: 2565499 - DNA, 21 bp, Homo sapiens
gtaatttttttaatttacaaa

SEQ ID NO: 2565500 - DNA, 19 bp, Homo sapiens
gtacaaaaaaaaagtttta

SEQ ID NO: 2565501 - DNA, 20 bp, Homo sapiens
gtacaaaaaaaaagttttat

SEQ ID NO: 2565502 - DNA, 16 bp, Homo sapiens
gtacaaaataaacaaa

SEQ ID NO: 2565503 - DNA, 17 bp, Homo sapiens
gtacaaggcgatcccat

SEQ ID NO: 2565504 - DNA, 12 bp, Homo sapiens
gtacaatattta

SEQ ID NO: 2565505 - DNA, 13 bp, Homo sapiens
gtacaatatttaa

SEQ ID NO: 2565506 - DNA, 14 bp, Homo sapiens
gtacaatatttaaa

SEQ ID NO: 2565507 - DNA, 20 bp, Homo sapiens
gtacacagctctagacactg

SEQ ID NO: 2565508 - DNA, 13 bp, Homo sapiens
gtacagaaagctg

SEQ ID NO: 2565509 - DNA, 14 bp, Homo sapiens
gtacagaaagctgc

SEQ ID NO: 2565510 - DNA, 12 bp, Homo sapiens
gtacagagccca

SEQ ID NO: 2565511 - DNA, 18 bp, Homo sapiens
gtacagagcccacgcccc

SEQ ID NO: 2565512 - DNA, 22 bp, Homo sapiens
gtacagagcccacgcccccact

SEQ ID NO: 2565513 - DNA, 16 bp, Homo sapiens
gtacagtcttgtatta

SEQ ID NO: 2565514 - DNA, 12 bp, Homo sapiens
gtacagttcttc

SEQ ID NO: 2565515 - DNA, 12 bp, Homo sapiens
gtacagttttta

SEQ ID NO: 2565516 - DNA, 20 bp, Homo sapiens
gtacatcccatgtaacagaa

SEQ ID NO: 2565517 - DNA, 23 bp, Homo sapiens
gtacatcccatgtaacagaaagg

SEQ ID NO: 2565518 - DNA, 14 bp, Homo sapiens
gtacatctggcctt

SEQ ID NO: 2565519 - DNA, 19 bp, Homo sapiens
gtacatggaataacatgta

SEQ ID NO: 2565520 - DNA, 16 bp, Homo sapiens
gtacatttatgattta

SEQ ID NO: 2565521 - DNA, 19 bp, Homo sapiens
gtacatttatgatttaata

SEQ ID NO: 2565522 - DNA, 18 bp, Homo sapiens
gtacatttccctgtgctg

SEQ ID NO: 2565523 - DNA, 15 bp, Homo sapiens
gtacattttgtaaca

SEQ ID NO: 2565524 - DNA, 14 bp, Homo sapiens
gtaccaatcatttt

SEQ ID NO: 2565525 - DNA, 14 bp, Homo sapiens
gtaccactcaggcc

SEQ ID NO: 2565526 - DNA, 16 bp, Homo sapiens
gtacccactgctctgg

SEQ ID NO: 2565527 - DNA, 19 bp, Homo sapiens
gtaccccaccctcagcacc

SEQ ID NO: 2565528 - DNA, 23 bp, Homo sapiens
gtaccccaccctcagcacccctt

SEQ ID NO: 2565529 - DNA, 17 bp, Homo sapiens
gtaccctcctggctctt

SEQ ID NO: 2565530 - DNA, 17 bp, Homo sapiens
gtaccctctcagctcca

SEQ ID NO: 2565531 - DNA, 23 bp, Homo sapiens
gtaccgccttgcacactcagaag

SEQ ID NO: 2565532 - DNA, 13 bp, Homo sapiens
gtacctataaagt

SEQ ID NO: 2565533 - DNA, 14 bp, Homo sapiens
gtacctataaagta

SEQ ID NO: 2565534 - DNA, 14 bp, Homo sapiens
gtacctgaaaagta

SEQ ID NO: 2565535 - DNA, 23 bp, Homo sapiens
gtacctgaaaagtaacttggctt

SEQ ID NO: 2565536 - DNA, 18 bp, Homo sapiens
gtaccttgaacactgggg

SEQ ID NO: 2565537 - DNA, 23 bp, Homo sapiens
gtaccttgaacactgggggaggg

SEQ ID NO: 2565538 - DNA, 21 bp, Homo sapiens
gtaccttttgaggagccccag

SEQ ID NO: 2565539 - DNA, 23 bp, Homo sapiens
gtaccttttgaggagccccagct

SEQ ID NO: 2565540 - DNA, 14 bp, Homo sapiens
gtacgttgtgcatt

SEQ ID NO: 2565541 - DNA, 17 bp, Homo sapiens
gtacgttgtgcatttgg

SEQ ID NO: 2565542 - DNA, 17 bp, Homo sapiens
gtacgtttgtatgtgtg

SEQ ID NO: 2565543 - DNA, 17 bp, Homo sapiens
gtactatgtatcaatga

SEQ ID NO: 2565544 - DNA, 16 bp, Homo sapiens
gtactcctgcaaaatt

SEQ ID NO: 2565545 - DNA, 21 bp, Homo sapiens
gtactcctgcaaaattttata

SEQ ID NO: 2565546 - DNA, 16 bp, Homo sapiens
gtactggcatggtacg

SEQ ID NO: 2565547 - DNA, 14 bp, Homo sapiens
gtactgtagttttt

SEQ ID NO: 2565548 - DNA, 23 bp, Homo sapiens
gtactgttctcttcttgaacact

SEQ ID NO: 2565549 - DNA, 14 bp, Homo sapiens
gtactgttctgtgt

SEQ ID NO: 2565550 - DNA, 15 bp, Homo sapiens
gtactgttctgtgtc

SEQ ID NO: 2565551 - DNA, 16 bp, Homo sapiens
gtacttagcagctatc

SEQ ID NO: 2565552 - DNA, 19 bp, Homo sapiens
gtacttctccaccctgctc

SEQ ID NO: 2565553 - DNA, 20 bp, Homo sapiens
gtacttctccaccctgctct

SEQ ID NO: 2565554 - DNA, 14 bp, Homo sapiens
gtacttgtcaaaga

SEQ ID NO: 2565555 - DNA, 21 bp, Homo sapiens
gtacttgtggacacagctctt

SEQ ID NO: 2565556 - DNA, 20 bp, Homo sapiens
gtagaaaagggaactgaaca

SEQ ID NO: 2565557 - DNA, 16 bp, Homo sapiens
gtagaaataatatgca

SEQ ID NO: 2565558 - DNA, 21 bp, Homo sapiens
gtagaaatatctgaaaatgta

SEQ ID NO: 2565559 - DNA, 13 bp, Homo sapiens
gtagaagagggat

SEQ ID NO: 2565560 - DNA, 15 bp, Homo sapiens
gtagaagcattcctt

SEQ ID NO: 2565561 - DNA, 13 bp, Homo sapiens
gtagaaggagaca

SEQ ID NO: 2565562 - DNA, 18 bp, Homo sapiens
gtagaatgtattgtacct

SEQ ID NO: 2565563 - DNA, 22 bp, Homo sapiens
gtagacaagcaattagacaaga

SEQ ID NO: 2565564 - DNA, 16 bp, Homo sapiens
gtagaccaaaataaaa

SEQ ID NO: 2565565 - DNA, 13 bp, Homo sapiens
gtagagacagggt

SEQ ID NO: 2565566 - DNA, 10 bp, Homo sapiens
gtagagccag

SEQ ID NO: 2565567 - DNA, 11 bp, Homo sapiens
gtagagccagg

SEQ ID NO: 2565568 - DNA, 13 bp, Homo sapiens
gtagagtgggagc

SEQ ID NO: 2565569 - DNA, 12 bp, Homo sapiens
gtagagttaaga

SEQ ID NO: 2565570 - DNA, 20 bp, Homo sapiens
gtagagtttgaaggaggtga

SEQ ID NO: 2565571 - DNA, 17 bp, Homo sapiens
gtagatcagagcagcag

SEQ ID NO: 2565572 - DNA, 19 bp, Homo sapiens
gtagattctgtggaacaag

SEQ ID NO: 2565573 - DNA, 16 bp, Homo sapiens
gtagatttatttcatc

SEQ ID NO: 2565574 - DNA, 21 bp, Homo sapiens
gtagattttaaaagttattaa

SEQ ID NO: 2565575 - DNA, 21 bp, Homo sapiens
gtagcaagttctagagaagag

SEQ ID NO: 2565576 - DNA, 13 bp, Homo sapiens
gtagcagctggac

SEQ ID NO: 2565577 - DNA, 19 bp, Homo sapiens
gtagcatttcattcttctc

SEQ ID NO: 2565578 - DNA, 15 bp, Homo sapiens
gtagcccgcctgcca

SEQ ID NO: 2565579 - DNA, 14 bp, Homo sapiens
gtagctagaggaac

SEQ ID NO: 2565580 - DNA, 11 bp, Homo sapiens
gtagctcaggt

SEQ ID NO: 2565581 - DNA, 22 bp, Homo sapiens
gtagctctaggagggctggcaa

SEQ ID NO: 2565582 - DNA, 18 bp, Homo sapiens
gtagctgggactacaggc

SEQ ID NO: 2565583 - DNA, 20 bp, Homo sapiens
gtagctgtaaggcatgaagg

SEQ ID NO: 2565584 - DNA, 22 bp, Homo sapiens
gtagcttaccagaagcttccat

SEQ ID NO: 2565585 - DNA, 17 bp, Homo sapiens
gtagctttcccaaataa

SEQ ID NO: 2565586 - DNA, 19 bp, Homo sapiens
gtaggaaaaataaaaacag

SEQ ID NO: 2565587 - DNA, 18 bp, Homo sapiens
gtaggaaggttaatgttc

SEQ ID NO: 2565588 - DNA, 13 bp, Homo sapiens
gtaggcagagcct

SEQ ID NO: 2565589 - DNA, 17 bp, Homo sapiens
gtaggctcaactaggga

SEQ ID NO: 2565590 - DNA, 19 bp, Homo sapiens
gtaggctcaactagggagt

SEQ ID NO: 2565591 - DNA, 15 bp, Homo sapiens
gtagggaactctggg

SEQ ID NO: 2565592 - DNA, 16 bp, Homo sapiens
gtagggcgggaggatg

SEQ ID NO: 2565593 - DNA, 16 bp, Homo sapiens
gtagggttataataat

SEQ ID NO: 2565594 - DNA, 20 bp, Homo sapiens
gtaggttggaagctagctcc

SEQ ID NO: 2565595 - DNA, 17 bp, Homo sapiens
gtagtcaagattgtgtt

SEQ ID NO: 2565596 - DNA, 12 bp, Homo sapiens
gtagtcccagcc

SEQ ID NO: 2565597 - DNA, 12 bp, Homo sapiens
gtagtcccagct

SEQ ID NO: 2565598 - DNA, 16 bp, Homo sapiens
gtagttaggaaataaa

SEQ ID NO: 2565599 - DNA, 12 bp, Homo sapiens
gtagttgtcttt

SEQ ID NO: 2565600 - DNA, 17 bp, Homo sapiens
gtagtttttcttcaaca

SEQ ID NO: 2565601 - DNA, 12 bp, Homo sapiens
gtataaaaacaa

SEQ ID NO: 2565602 - DNA, 23 bp, Homo sapiens
gtataaagcaactgttatgaaat

SEQ ID NO: 2565603 - DNA, 13 bp, Homo sapiens
gtataaataggag

SEQ ID NO: 2565604 - DNA, 12 bp, Homo sapiens
gtataaatttat

SEQ ID NO: 2565605 - DNA, 14 bp, Homo sapiens
gtataaatttattt

SEQ ID NO: 2565606 - DNA, 22 bp, Homo sapiens
gtataacaggttattttagttt

SEQ ID NO: 2565607 - DNA, 12 bp, Homo sapiens
gtatacatgcca

SEQ ID NO: 2565608 - DNA, 15 bp, Homo sapiens
gtatacctgattttt

SEQ ID NO: 2565609 - DNA, 15 bp, Homo sapiens
gtatagaaatgctgg

SEQ ID NO: 2565610 - DNA, 22 bp, Homo sapiens
gtatagaaatgctggtttttca

SEQ ID NO: 2565611 - DNA, 23 bp, Homo sapiens
gtatagaaatgctggtttttcag

SEQ ID NO: 2565612 - DNA, 14 bp, Homo sapiens
gtatagctgtattg

SEQ ID NO: 2565613 - DNA, 19 bp, Homo sapiens
gtatagctgtattgaatca

SEQ ID NO: 2565614 - DNA, 16 bp, Homo sapiens
gtatagtgtaaaataa

SEQ ID NO: 2565615 - DNA, 16 bp, Homo sapiens
gtatataaaatatttt

SEQ ID NO: 2565616 - DNA, 22 bp, Homo sapiens
gtatataaaggaaaaaagagaa

SEQ ID NO: 2565617 - DNA, 16 bp, Homo sapiens
gtatatacgcatctat

SEQ ID NO: 2565618 - DNA, 18 bp, Homo sapiens
gatgcaatgtgctactga

SEQ ID NO: 2565619 - DNA, 19 bp, Homo sapiens
gatgcagcctcacagtcct

SEQ ID NO: 2565620 - DNA, 22 bp, Homo sapiens
gatgcatctaccgctcttggga

SEQ ID NO: 2565621 - DNA, 18 bp, Homo sapiens
gatgcattaaaagaaaat

SEQ ID NO: 2565622 - DNA, 11 bp, Homo sapiens
gatgccaggac

SEQ ID NO: 2565623 - DNA, 14 bp, Homo sapiens
gatgccaggttcta

SEQ ID NO: 2565624 - DNA, 15 bp, Homo sapiens
gatgcccactgagga

SEQ ID NO: 2565625 - DNA, 21 bp, Homo sapiens
gatgcccagggccactctgcc

SEQ ID NO: 2565626 - DNA, 15 bp, Homo sapiens
gatgcctgattgcca

SEQ ID NO: 2565627 - DNA, 16 bp, Homo sapiens
gatgcctggtggcagc

SEQ ID NO: 2565628 - DNA, 14 bp, Homo sapiens
gatgcgcactgcat

SEQ ID NO: 2565629 - DNA, 21 bp, Homo sapiens
gatgctcaggcttgaaatgca

SEQ ID NO: 2565630 - DNA, 15 bp, Homo sapiens
gatgctccctcccct

SEQ ID NO: 2565631 - DNA, 13 bp, Homo sapiens
gatgctccttggg

SEQ ID NO: 2565632 - DNA, 21 bp, Homo sapiens
gatgctccttgggccctttga

SEQ ID NO: 2565633 - DNA, 18 bp, Homo sapiens
gatgctgatgttcagtgt

SEQ ID NO: 2565634 - DNA, 12 bp, Homo sapiens
gatgctgctttc

SEQ ID NO: 2565635 - DNA, 15 bp, Homo sapiens
gatgctgctttcccc

SEQ ID NO: 2565636 - DNA, 15 bp, Homo sapiens
gatgctggagaggtt

SEQ ID NO: 2565637 - DNA, 18 bp, Homo sapiens
gatgctggatgctccttc

SEQ ID NO: 2565638 - DNA, 22 bp, Homo sapiens
gatgctggatgtctgccaattt

SEQ ID NO: 2565639 - DNA, 19 bp, Homo sapiens
gatgctgggttggtgcaca

SEQ ID NO: 2565640 - DNA, 13 bp, Homo sapiens
gatgctgtttgac

SEQ ID NO: 2565641 - DNA, 21 bp, Homo sapiens
gatgcttcttcagagactcct

SEQ ID NO: 2565642 - DNA, 16 bp, Homo sapiens
gatgcttgtacataat

SEQ ID NO: 2565643 - DNA, 15 bp, Homo sapiens
gatggaaaaggaaga

SEQ ID NO: 2565644 - DNA, 22 bp, Homo sapiens
gatggaacccttttggcccccg

SEQ ID NO: 2565645 - DNA, 22 bp, Homo sapiens
gatggaaccgcaggaagctgct

SEQ ID NO: 2565646 - DNA, 21 bp, Homo sapiens
gatggaagttgcagtgagctg

SEQ ID NO: 2565647 - DNA, 13 bp, Homo sapiens
gatggaatgatgg

SEQ ID NO: 2565648 - DNA, 23 bp, Homo sapiens
gatggagactggtcctgtgtgca

SEQ ID NO: 2565649 - DNA, 20 bp, Homo sapiens
gatggagccagctctgcatt

SEQ ID NO: 2565650 - DNA, 19 bp, Homo sapiens
gatggagttcttgtgccat

SEQ ID NO: 2565651 - DNA, 19 bp, Homo sapiens
gatggatatatgtttttga

SEQ ID NO: 2565652 - DNA, 21 bp, Homo sapiens
gatggattccaaccccaactc

SEQ ID NO: 2565653 - DNA, 16 bp, Homo sapiens
gatggattctcagata

SEQ ID NO: 2565654 - DNA, 22 bp, Homo sapiens
gatggattctcagatatttata

SEQ ID NO: 2565655 - DNA, 20 bp, Homo sapiens
gatggcaaagaaggagagca

SEQ ID NO: 2565656 - DNA, 21 bp, Homo sapiens
gatggcacttataaccaaagc

SEQ ID NO: 2565657 - DNA, 21 bp, Homo sapiens
gatggcaggatggcctggcca

SEQ ID NO: 2565658 - DNA, 22 bp, Homo sapiens
gatggcaggatggcctggccag

SEQ ID NO: 2565659 - DNA, 21 bp, Homo sapiens
gatggcatcctgtgaagtcct

SEQ ID NO: 2565660 - DNA, 16 bp, Homo sapiens
gatggcgggtgggggt

SEQ ID NO: 2565661 - DNA, 18 bp, Homo sapiens
gatggctgtgcctctgcc

SEQ ID NO: 2565662 - DNA, 21 bp, Homo sapiens
gatggctttgaatgcggccca

SEQ ID NO: 2565663 - DNA, 18 bp, Homo sapiens
gatgggaaggagggaggt

SEQ ID NO: 2565664 - DNA, 13 bp, Homo sapiens
gatgggaatgaag

SEQ ID NO: 2565665 - DNA, 20 bp, Homo sapiens
gatgggagctcctctcctgg

SEQ ID NO: 2565666 - DNA, 23 bp, Homo sapiens
gatgggagctcctctcctggagg

SEQ ID NO: 2565667 - DNA, 20 bp, Homo sapiens
gatgggatggtggagggcca

SEQ ID NO: 2565668 - DNA, 16 bp, Homo sapiens
gatgggcccaattctt

SEQ ID NO: 2565669 - DNA, 13 bp, Homo sapiens
gatggggccctgc

SEQ ID NO: 2565670 - DNA, 15 bp, Homo sapiens
gatggggctgcaccg

SEQ ID NO: 2565671 - DNA, 19 bp, Homo sapiens
gatggggctgcaccggctg

SEQ ID NO: 2565672 - DNA, 22 bp, Homo sapiens
gatgggtctggtttgcagagct

SEQ ID NO: 2565673 - DNA, 22 bp, Homo sapiens
gatgggttctaattttggatgg

SEQ ID NO: 2565674 - DNA, 23 bp, Homo sapiens
gatgggttctaattttggatgga

SEQ ID NO: 2565675 - DNA, 13 bp, Homo sapiens
gatggtcctgggg

SEQ ID NO: 2565676 - DNA, 14 bp, Homo sapiens
gatggtggagggcc

SEQ ID NO: 2565677 - DNA, 12 bp, Homo sapiens
gatgtaaagtga

SEQ ID NO: 2565678 - DNA, 17 bp, Homo sapiens
gatgtacagtctgtcat

SEQ ID NO: 2565679 - DNA, 19 bp, Homo sapiens
gatgtaccatgaaacaaag

SEQ ID NO: 2565680 - DNA, 19 bp, Homo sapiens
gatgtatgcagctatctgg

SEQ ID NO: 2565681 - DNA, 18 bp, Homo sapiens
gatgtcccaacttgtaaa

SEQ ID NO: 2565682 - DNA, 21 bp, Homo sapiens
gatgtccctttcttggccagt

SEQ ID NO: 2565683 - DNA, 21 bp, Homo sapiens
gatgtcctcaccacatgcgga

SEQ ID NO: 2565684 - DNA, 14 bp, Homo sapiens
gatgtctaatagtt

SEQ ID NO: 2565685 - DNA, 14 bp, Homo sapiens
gatgtcttcatacc

SEQ ID NO: 2565686 - DNA, 14 bp, Homo sapiens
gatgtcttctgcct

SEQ ID NO: 2565687 - DNA, 16 bp, Homo sapiens
gatgtcttctgcctgt

SEQ ID NO: 2565688 - DNA, 14 bp, Homo sapiens
gatgtgaacacatc

SEQ ID NO: 2565689 - DNA, 23 bp, Homo sapiens
gatgtgaattgcctgcagagaga

SEQ ID NO: 2565690 - DNA, 15 bp, Homo sapiens
gatgtgcatgggagc

SEQ ID NO: 2565691 - DNA, 21 bp, Homo sapiens
gatgtgcatttttgtgaaatg

SEQ ID NO: 2565692 - DNA, 23 bp, Homo sapiens
gatgtgcatttttgtgaaatgaa

SEQ ID NO: 2565693 - DNA, 13 bp, Homo sapiens
gatgtgcctgggt

SEQ ID NO: 2565694 - DNA, 17 bp, Homo sapiens
gatgtggagtggggcag

SEQ ID NO: 2565695 - DNA, 22 bp, Homo sapiens
gatgtgggagggagcagacagg

SEQ ID NO: 2565696 - DNA, 20 bp, Homo sapiens
gatgtgggggaagacctggc

SEQ ID NO: 2565697 - DNA, 15 bp, Homo sapiens
gatgtggtgcctgag

SEQ ID NO: 2565698 - DNA, 22 bp, Homo sapiens
gatgtggtgcctgaggtctgta

SEQ ID NO: 2565699 - DNA, 19 bp, Homo sapiens
gatgttaacacattttgta

SEQ ID NO: 2565700 - DNA, 22 bp, Homo sapiens
gatgttaacacattttgtataa

SEQ ID NO: 2565701 - DNA, 15 bp, Homo sapiens
gatgttcagtgtaat

SEQ ID NO: 2565702 - DNA, 19 bp, Homo sapiens
gatgttgaaaaagttctgc

SEQ ID NO: 2565703 - DNA, 15 bp, Homo sapiens
gccaagtttatatac

SEQ ID NO: 2565704 - DNA, 13 bp, Homo sapiens
gccaatatgtatt

SEQ ID NO: 2565705 - DNA, 17 bp, Homo sapiens
gccaatatgtattgtaa

SEQ ID NO: 2565706 - DNA, 23 bp, Homo sapiens
gccaatatgtattgtaaacatgt

SEQ ID NO: 2565707 - DNA, 15 bp, Homo sapiens
gccaatcaagggcaa

SEQ ID NO: 2565708 - DNA, 19 bp, Homo sapiens
gccaatcccctccttgggc

SEQ ID NO: 2565709 - DNA, 20 bp, Homo sapiens
gccaatttcaagttccaagt

SEQ ID NO: 2565710 - DNA, 15 bp, Homo sapiens
gccacaaataaaatg

SEQ ID NO: 2565711 - DNA, 16 bp, Homo sapiens
gccacaagacccttgt

SEQ ID NO: 2565712 - DNA, 10 bp, Homo sapiens
gccacacaca

SEQ ID NO: 2565713 - DNA, 12 bp, Homo sapiens
gccacacacaca

SEQ ID NO: 2565714 - DNA, 18 bp, Homo sapiens
gccacacacacagaaaat

SEQ ID NO: 2565715 - DNA, 23 bp, Homo sapiens
gccacacatcacccttaccatgt

SEQ ID NO: 2565716 - DNA, 19 bp, Homo sapiens
gccacaccatctcctttca

SEQ ID NO: 2565717 - DNA, 22 bp, Homo sapiens
gccacaccctcccccgccactc

SEQ ID NO: 2565718 - DNA, 13 bp, Homo sapiens
gcctgcccaggcc

SEQ ID NO: 2565719 - DNA, 18 bp, Homo sapiens
gcctgcccaggcccctgc

SEQ ID NO: 2565720 - DNA, 19 bp, Homo sapiens
gcctgcccaggcccctgcc

SEQ ID NO: 2565721 - DNA, 22 bp, Homo sapiens
gcctgcccaggcccctgccacc

SEQ ID NO: 2565722 - DNA, 16 bp, Homo sapiens
gcctgcccctcccaga

SEQ ID NO: 2565723 - DNA, 14 bp, Homo sapiens
gcctgcctggagcg

SEQ ID NO: 2565724 - DNA, 16 bp, Homo sapiens
gcctgccttgaagcca

SEQ ID NO: 2565725 - DNA, 23 bp, Homo sapiens
gcctgccttgaagccactgaagc

SEQ ID NO: 2565726 - DNA, 18 bp, Homo sapiens
gcctgcgcccaccccgct

SEQ ID NO: 2565727 - DNA, 20 bp, Homo sapiens
gcctgcgttttggaagctct

SEQ ID NO: 2565728 - DNA, 20 bp, Homo sapiens
gcctgctcccagcagcccta

SEQ ID NO: 2565729 - DNA, 14 bp, Homo sapiens
gcctggaagacaga

SEQ ID NO: 2565730 - DNA, 12 bp, Homo sapiens
gcctggagaagc

SEQ ID NO: 2565731 - DNA, 15 bp, Homo sapiens
gcctggagaagctga

SEQ ID NO: 2565732 - DNA, 16 bp, Homo sapiens
gcctggatggggctgc

SEQ ID NO: 2565733 - DNA, 18 bp, Homo sapiens
gcctggcagaactgagct

SEQ ID NO: 2565734 - DNA, 14 bp, Homo sapiens
gcctggcaggctgt

SEQ ID NO: 2565735 - DNA, 15 bp, Homo sapiens
gcctggccaaaggga

SEQ ID NO: 2565736 - DNA, 14 bp, Homo sapiens
gcctggccacctct

SEQ ID NO: 2565737 - DNA, 17 bp, Homo sapiens
gcctggccacctctctc

SEQ ID NO: 2565738 - DNA, 18 bp, Homo sapiens
gcctggccacctctctcc

SEQ ID NO: 2565739 - DNA, 21 bp, Homo sapiens
gcctggccagatgcaccagcc

SEQ ID NO: 2565740 - DNA, 19 bp, Homo sapiens
gcctggccaggagctcttc

SEQ ID NO: 2565741 - DNA, 12 bp, Homo sapiens
gcctggccaggc

SEQ ID NO: 2565742 - DNA, 14 bp, Homo sapiens
gcctggccaggcag

SEQ ID NO: 2565743 - DNA, 22 bp, Homo sapiens
gcctggcccctcagggtccctg

SEQ ID NO: 2565744 - DNA, 18 bp, Homo sapiens
gcctggcctgagctggga

SEQ ID NO: 2565745 - DNA, 20 bp, Homo sapiens
gcctggcctgagctgggatg

SEQ ID NO: 2565746 - DNA, 14 bp, Homo sapiens
gcctggctcagagc

SEQ ID NO: 2565747 - DNA, 13 bp, Homo sapiens
gcctggctcaggt

SEQ ID NO: 2565748 - DNA, 14 bp, Homo sapiens
gctagggtggccct

SEQ ID NO: 2565749 - DNA, 19 bp, Homo sapiens
gctaggtgggccagcccct

SEQ ID NO: 2565750 - DNA, 20 bp, Homo sapiens
gctaggtgggccagcccctc

SEQ ID NO: 2565751 - DNA, 22 bp, Homo sapiens
gctagtgtggtgtttcctggca

SEQ ID NO: 2565752 - DNA, 18 bp, Homo sapiens
gctatagctacaggaagc

SEQ ID NO: 2565753 - DNA, 16 bp, Homo sapiens
gctataggctggagaa

SEQ ID NO: 2565754 - DNA, 15 bp, Homo sapiens
gctatatccatgtac

SEQ ID NO: 2565755 - DNA, 19 bp, Homo sapiens
gctatatctatatataatt

SEQ ID NO: 2565756 - DNA, 13 bp, Homo sapiens
gctatctccccca

SEQ ID NO: 2565757 - DNA, 16 bp, Homo sapiens
gctatctctgtgtgca

SEQ ID NO: 2565758 - DNA, 13 bp, Homo sapiens
gctatgcatttga

SEQ ID NO: 2565759 - DNA, 21 bp, Homo sapiens
gctatgggagccccagggtct

SEQ ID NO: 2565760 - DNA, 18 bp, Homo sapiens
gctatggggagaaaagac

SEQ ID NO: 2565761 - DNA, 11 bp, Homo sapiens
gctatgtgact

SEQ ID NO: 2565762 - DNA, 23 bp, Homo sapiens
gctattactaaggagtaatctgt

SEQ ID NO: 2565763 - DNA, 15 bp, Homo sapiens
gctattactgtctgg

SEQ ID NO: 2565764 - DNA, 18 bp, Homo sapiens
gctattagccaggatcat

SEQ ID NO: 2565765 - DNA, 21 bp, Homo sapiens
gctattattttcactgtagaa

SEQ ID NO: 2565766 - DNA, 13 bp, Homo sapiens
gctattgtaaata

SEQ ID NO: 2565767 - DNA, 22 bp, Homo sapiens
gctatttaaaaaaaaaagagga

SEQ ID NO: 2565768 - DNA, 23 bp, Homo sapiens
gctcaaaatttgaagaatgaaca

SEQ ID NO: 2565769 - DNA, 12 bp, Homo sapiens
gctcaaaggcac

SEQ ID NO: 2565770 - DNA, 16 bp, Homo sapiens
gctcaaaggcacagtg

SEQ ID NO: 2565771 - DNA, 21 bp, Homo sapiens
gctcaaaggcacagtgaaggc

SEQ ID NO: 2565772 - DNA, 21 bp, Homo sapiens
gctcaagaagacatggagact

SEQ ID NO: 2565773 - DNA, 23 bp, Homo sapiens
gctcaaggaaagggggtcccagt

SEQ ID NO: 2565774 - DNA, 17 bp, Homo sapiens
gctcaagtcttccctga

SEQ ID NO: 2565775 - DNA, 19 bp, Homo sapiens
gctcaatattcctgaatga

SEQ ID NO: 2565776 - DNA, 17 bp, Homo sapiens
gctcaccccccacactc

SEQ ID NO: 2565777 - DNA, 16 bp, Homo sapiens
gctcacccccttctcc

SEQ ID NO: 2565778 - DNA, 22 bp, Homo sapiens
gctcacccccttctccatccac

SEQ ID NO: 2565779 - DNA, 12 bp, Homo sapiens
gctcacctgggg

SEQ ID NO: 2565780 - DNA, 22 bp, Homo sapiens
gctcacctgttgcttacaattt

SEQ ID NO: 2565781 - DNA, 22 bp, Homo sapiens
gctcacgcctatgatcccagca

SEQ ID NO: 2565782 - DNA, 15 bp, Homo sapiens
gctcacgtgtgtgac

SEQ ID NO: 2565783 - DNA, 16 bp, Homo sapiens
gctcactcggcaccct

SEQ ID NO: 2565784 - DNA, 11 bp, Homo sapiens
gctcactgcag

SEQ ID NO: 2565785 - DNA, 12 bp, Homo sapiens
gctcactgcagc

SEQ ID NO: 2565786 - DNA, 13 bp, Homo sapiens
gctcactgcagcc

SEQ ID NO: 2565787 - DNA, 14 bp, Homo sapiens
gctcactgcagcct

SEQ ID NO: 2565788 - DNA, 16 bp, Homo sapiens
gctcactgcagcctca

SEQ ID NO: 2565789 - DNA, 23 bp, Homo sapiens
gctcacttctgggcttcatctgg

SEQ ID NO: 2565790 - DNA, 14 bp, Homo sapiens
gctcagagagggtg

SEQ ID NO: 2565791 - DNA, 17 bp, Homo sapiens
gctcagcaaaagatgct

SEQ ID NO: 2565792 - DNA, 20 bp, Homo sapiens
gctcagcaaaagatgcttct

SEQ ID NO: 2565793 - DNA, 13 bp, Homo sapiens
gctctgatccctc

SEQ ID NO: 2565794 - DNA, 23 bp, Homo sapiens
gctctgatccctctacagagctt

SEQ ID NO: 2565795 - DNA, 23 bp, Homo sapiens
gctctgcaagaattgaagcagga

SEQ ID NO: 2565796 - DNA, 15 bp, Homo sapiens
gctctgcacagatgg

SEQ ID NO: 2565797 - DNA, 15 bp, Homo sapiens
gctctgcaggcacct

SEQ ID NO: 2565798 - DNA, 16 bp, Homo sapiens
gctctgcatgcggccc

SEQ ID NO: 2565799 - DNA, 21 bp, Homo sapiens
gctctgcatgcggcccagccc

SEQ ID NO: 2565800 - DNA, 12 bp, Homo sapiens
gctctgccccag

SEQ ID NO: 2565801 - DNA, 15 bp, Homo sapiens
gctctgccccagagg

SEQ ID NO: 2565802 - DNA, 23 bp, Homo sapiens
gctctgcccttggttaggcattg

SEQ ID NO: 2565803 - DNA, 14 bp, Homo sapiens
gctctgcctcccat

SEQ ID NO: 2565804 - DNA, 15 bp, Homo sapiens
gctctgcctcccatc

SEQ ID NO: 2565805 - DNA, 14 bp, Homo sapiens
gctctgctcctctc

SEQ ID NO: 2565806 - DNA, 19 bp, Homo sapiens
gctctgctcctctccccag

SEQ ID NO: 2565807 - DNA, 21 bp, Homo sapiens
gctctgctcctctccccagca

SEQ ID NO: 2565808 - DNA, 13 bp, Homo sapiens
gctctgctgacag

SEQ ID NO: 2565809 - DNA, 19 bp, Homo sapiens
gctctgctgacagacacag

SEQ ID NO: 2565810 - DNA, 13 bp, Homo sapiens
gctctgctggcct

SEQ ID NO: 2565811 - DNA, 22 bp, Homo sapiens
gctctggaaaatgtgacccaga

SEQ ID NO: 2565812 - DNA, 14 bp, Homo sapiens
gctctggaagagag

SEQ ID NO: 2565813 - DNA, 15 bp, Homo sapiens
gctctggaagagagg

SEQ ID NO: 2565814 - DNA, 16 bp, Homo sapiens
gctctggacaggcatg

SEQ ID NO: 2565815 - DNA, 21 bp, Homo sapiens
gctctggacaggcatgttctc

SEQ ID NO: 2565816 - DNA, 22 bp, Homo sapiens
gctctggacaggcatgttctct

SEQ ID NO: 2565817 - DNA, 19 bp, Homo sapiens
gctctggctgaaccctgtg

SEQ ID NO: 2565818 - DNA, 16 bp, Homo sapiens
gctctgtcacccaggc

SEQ ID NO: 2565819 - DNA, 16 bp, Homo sapiens
gctctgtcctgggagt

SEQ ID NO: 2565820 - DNA, 15 bp, Homo sapiens
gctctgtgctgaccc

SEQ ID NO: 2565821 - DNA, 18 bp, Homo sapiens
gctctgtgctgaccctcc

SEQ ID NO: 2565822 - DNA, 21 bp, Homo sapiens
gctctgtgctgaccctcctgt

SEQ ID NO: 2565823 - DNA, 12 bp, Homo sapiens
gctcttcaggcc

SEQ ID NO: 2565824 - DNA, 18 bp, Homo sapiens
gctcttcaggcctccctc

SEQ ID NO: 2565825 - DNA, 12 bp, Homo sapiens
gctcttccaggc

SEQ ID NO: 2565826 - DNA, 19 bp, Homo sapiens
gctcttccaggctgggaga

SEQ ID NO: 2565827 - DNA, 14 bp, Homo sapiens
gctcttctccaggc

SEQ ID NO: 2565828 - DNA, 21 bp, Homo sapiens
gctcttctgactactgggcaa

SEQ ID NO: 2565829 - DNA, 14 bp, Homo sapiens
gctcttctgccggc

SEQ ID NO: 2565830 - DNA, 21 bp, Homo sapiens
gctcttctgccggccctgggg

SEQ ID NO: 2565831 - DNA, 12 bp, Homo sapiens
gctcttcttaaa

SEQ ID NO: 2565832 - DNA, 19 bp, Homo sapiens
gctcttgatacccccctct

SEQ ID NO: 2565833 - DNA, 12 bp, Homo sapiens
gctcttgccctt

SEQ ID NO: 2565834 - DNA, 19 bp, Homo sapiens
gctcttgcccttccctgtc

SEQ ID NO: 2565835 - DNA, 22 bp, Homo sapiens
gctcttgcccttccctgtccct

SEQ ID NO: 2565836 - DNA, 23 bp, Homo sapiens
gctcttgcccttccctgtccctc

SEQ ID NO: 2565837 - DNA, 20 bp, Homo sapiens
gctcttgctaatcagtgtct

SEQ ID NO: 2565838 - DNA, 23 bp, Homo sapiens
gctcttgctaatcagtgtctcac

SEQ ID NO: 2565839 - DNA, 14 bp, Homo sapiens
gctctttagccagt

SEQ ID NO: 2565840 - DNA, 18 bp, Homo sapiens
gctctttccttgctcaac

SEQ ID NO: 2565841 - DNA, 22 bp, Homo sapiens
gctctttggggtcagccagggc

SEQ ID NO: 2565842 - DNA, 20 bp, Homo sapiens
gctgaaaacctaagtccttt

SEQ ID NO: 2565843 - DNA, 11 bp, Homo sapiens
gctgaaaatat

SEQ ID NO: 2565844 - DNA, 20 bp, Homo sapiens
gctgaacactccaattaagg

SEQ ID NO: 2565845 - DNA, 13 bp, Homo sapiens
gctgaaccctgtg

SEQ ID NO: 2565846 - DNA, 16 bp, Homo sapiens
gctgaaccctgtgctg

SEQ ID NO: 2565847 - DNA, 20 bp, Homo sapiens
gctgaaccctgtgctggtgt

SEQ ID NO: 2565848 - DNA, 21 bp, Homo sapiens
gctgaaccctgtgctggtgtc

SEQ ID NO: 2565849 - DNA, 13 bp, Homo sapiens
gctgaagctgcct

SEQ ID NO: 2565850 - DNA, 15 bp, Homo sapiens
gctgaagctgcctgc

SEQ ID NO: 2565851 - DNA, 12 bp, Homo sapiens
gctgaaggactg

SEQ ID NO: 2565852 - DNA, 20 bp, Homo sapiens
gctgaaggctcgagcatgcc

SEQ ID NO: 2565853 - DNA, 20 bp, Homo sapiens
gctgaagggaccttgaaggg

SEQ ID NO: 2565854 - DNA, 12 bp, Homo sapiens
gctgaataaatg

SEQ ID NO: 2565855 - DNA, 17 bp, Homo sapiens
gctgaatacagaggcaa

SEQ ID NO: 2565856 - DNA, 15 bp, Homo sapiens
gctgaatccagatca

SEQ ID NO: 2565857 - DNA, 23 bp, Homo sapiens
gctgaatgttgggactgctaaat

SEQ ID NO: 2565858 - DNA, 21 bp, Homo sapiens
gctgacaaccaccgctcccca

SEQ ID NO: 2565859 - DNA, 22 bp, Homo sapiens
gctgacaaccaccgctccccag

SEQ ID NO: 2565860 - DNA, 17 bp, Homo sapiens
gctgacacaaacctgcc

SEQ ID NO: 2565861 - DNA, 18 bp, Homo sapiens
gctgacagacacaggccc

SEQ ID NO: 2565862 - DNA, 13 bp, Homo sapiens
gctgaccaagaga

SEQ ID NO: 2565863 - DNA, 20 bp, Homo sapiens
gctgaccaagagagaaagaa

SEQ ID NO: 2565864 - DNA, 22 bp, Homo sapiens
gctgacccagccccttgagaaa

SEQ ID NO: 2565865 - DNA, 18 bp, Homo sapiens
gctgaccccaaagagcct

SEQ ID NO: 2565866 - DNA, 19 bp, Homo sapiens
gctgaccccaaagagcctg

SEQ ID NO: 2565867 - DNA, 14 bp, Homo sapiens
gctgaccctcctgt

SEQ ID NO: 2565868 - DNA, 15 bp, Homo sapiens
gctgaccctcctgtt

SEQ ID NO: 2565869 - DNA, 14 bp, Homo sapiens
gctgacctccacag

SEQ ID NO: 2565870 - DNA, 18 bp, Homo sapiens
gctgacctctgttgtcct

SEQ ID NO: 2565871 - DNA, 18 bp, Homo sapiens
gctgaccttcctcgcaga

SEQ ID NO: 2565872 - DNA, 22 bp, Homo sapiens
gctgaccttcctcgcagagagg

SEQ ID NO: 2565873 - DNA, 17 bp, Homo sapiens
gctgacggtgcagtctg

SEQ ID NO: 2565874 - DNA, 18 bp, Homo sapiens
gctgactttgctctttct

SEQ ID NO: 2565875 - DNA, 14 bp, Homo sapiens
gctgagaacactgt

SEQ ID NO: 2565876 - DNA, 23 bp, Homo sapiens
gctgagaaccctgcgtggggaca

SEQ ID NO: 2565877 - DNA, 19 bp, Homo sapiens
gctgagactggatactgcc

SEQ ID NO: 2565878 - DNA, 20 bp, Homo sapiens
gctgagactggatactgccc

SEQ ID NO: 2565879 - DNA, 22 bp, Homo sapiens
ggacagggctggcccagccctg

SEQ ID NO: 2565880 - DNA, 19 bp, Homo sapiens
ggacagtatttgtggggag

SEQ ID NO: 2565881 - DNA, 13 bp, Homo sapiens
ggacagtcctggg

SEQ ID NO: 2565882 - DNA, 14 bp, Homo sapiens
ggacagtcctggga

SEQ ID NO: 2565883 - DNA, 23 bp, Homo sapiens
ggacagtgcttcagcctgaggct

SEQ ID NO: 2565884 - DNA, 15 bp, Homo sapiens
ggacatagagaggga

SEQ ID NO: 2565885 - DNA, 18 bp, Homo sapiens
ggacatagcgaatacaaa

SEQ ID NO: 2565886 - DNA, 20 bp, Homo sapiens
ggacatccccccgccaaaag

SEQ ID NO: 2565887 - DNA, 14 bp, Homo sapiens
ggacatcctcttct

SEQ ID NO: 2565888 - DNA, 15 bp, Homo sapiens
ggacatctctttgaa

SEQ ID NO: 2565889 - DNA, 17 bp, Homo sapiens
ggacatgttttgataaa

SEQ ID NO: 2565890 - DNA, 17 bp, Homo sapiens
ggacattccaagacagt

SEQ ID NO: 2565891 - DNA, 14 bp, Homo sapiens
ggacatttctctaa

SEQ ID NO: 2565892 - DNA, 15 bp, Homo sapiens
ggacattttttcagt

SEQ ID NO: 2565893 - DNA, 17 bp, Homo sapiens
ggaccaaccctgtttcc

SEQ ID NO: 2565894 - DNA, 22 bp, Homo sapiens
ggaccaaggcaaggcaggtgcc

SEQ ID NO: 2565895 - DNA, 13 bp, Homo sapiens
ggaccacacctcc

SEQ ID NO: 2565896 - DNA, 21 bp, Homo sapiens
ggaccacacctccctgaacca

SEQ ID NO: 2565897 - DNA, 19 bp, Homo sapiens
ggaccagaagccaaagact

SEQ ID NO: 2565898 - DNA, 22 bp, Homo sapiens
ggaccagctggggcgtggggag

SEQ ID NO: 2565899 - DNA, 21 bp, Homo sapiens
ggaccaggactatagcccagg

SEQ ID NO: 2565900 - DNA, 19 bp, Homo sapiens
ggaccagtcaacctgggca

SEQ ID NO: 2565901 - DNA, 14 bp, Homo sapiens
ggacccagacccag

SEQ ID NO: 2565902 - DNA, 18 bp, Homo sapiens
ggaccccatctgtgaata

SEQ ID NO: 2565903 - DNA, 20 bp, Homo sapiens
ggaccccatctgtgaataag

SEQ ID NO: 2565904 - DNA, 16 bp, Homo sapiens
ggacccccgccccctg

SEQ ID NO: 2565905 - DNA, 20 bp, Homo sapiens
ggacccccgccccctgccct

SEQ ID NO: 2565906 - DNA, 22 bp, Homo sapiens
ggacccccgccccctgccctcc

SEQ ID NO: 2565907 - DNA, 23 bp, Homo sapiens
ggacccccgccccctgccctccc

SEQ ID NO: 2565908 - DNA, 14 bp, Homo sapiens
ggacccccttcccc

SEQ ID NO: 2565909 - DNA, 15 bp, Homo sapiens
ggaccccgagcctgg

SEQ ID NO: 2565910 - DNA, 21 bp, Homo sapiens
ggaccccgagcctggctccaa

SEQ ID NO: 2565911 - DNA, 11 bp, Homo sapiens
ggaccctgagg

SEQ ID NO: 2565912 - DNA, 12 bp, Homo sapiens
ggaccctgaggc

SEQ ID NO: 2565913 - DNA, 14 bp, Homo sapiens
ggaccctgaggccc

SEQ ID NO: 2565914 - DNA, 21 bp, Homo sapiens
ggacccttcccttgagccctc

SEQ ID NO: 2565915 - DNA, 22 bp, Homo sapiens
ggaccgccagatggggcctctg

SEQ ID NO: 2565916 - DNA, 23 bp, Homo sapiens
ggacctcaggtgagaagcagagg

SEQ ID NO: 2565917 - DNA, 15 bp, Homo sapiens
ggacctctcccaggg

SEQ ID NO: 2565918 - DNA, 16 bp, Homo sapiens
ggacctctgctctgag

SEQ ID NO: 2565919 - DNA, 22 bp, Homo sapiens
ggacctgcctcctgcctgcccc

SEQ ID NO: 2565920 - DNA, 17 bp, Homo sapiens
ggacctggtgctgcctc

SEQ ID NO: 2565921 - DNA, 13 bp, Homo sapiens
ggaccttcctgcc

SEQ ID NO: 2565922 - DNA, 15 bp, Homo sapiens
ggacgccacccagca

SEQ ID NO: 2565923 - DNA, 17 bp, Homo sapiens
ggacgctacccgggaag

SEQ ID NO: 2565924 - DNA, 19 bp, Homo sapiens
ggacgctacccgggaaggg

SEQ ID NO: 2565925 - DNA, 17 bp, Homo sapiens
ggacgctccctgctcca

SEQ ID NO: 2565926 - DNA, 22 bp, Homo sapiens
ggacggcctgatgctccctccc

SEQ ID NO: 2565927 - DNA, 18 bp, Homo sapiens
ggacggtgctccaggcag

SEQ ID NO: 2565928 - DNA, 16 bp, Homo sapiens
ggacgttccagccggc

SEQ ID NO: 2565929 - DNA, 16 bp, Homo sapiens
ggactaagcctacctg

SEQ ID NO: 2565930 - DNA, 14 bp, Homo sapiens
ggactacaggtgtg

SEQ ID NO: 2565931 - DNA, 14 bp, Homo sapiens
ggactagaacctgg

SEQ ID NO: 2565932 - DNA, 16 bp, Homo sapiens
ggactcaatgcactga

SEQ ID NO: 2565933 - DNA, 18 bp, Homo sapiens
ggactcaatgcactgaca

SEQ ID NO: 2565934 - DNA, 22 bp, Homo sapiens
ggactcaatgcactgacattgt

SEQ ID NO: 2565935 - DNA, 18 bp, Homo sapiens
ggactcaatttctcccca

SEQ ID NO: 2565936 - DNA, 18 bp, Homo sapiens
ggactcaggatgcccagg

SEQ ID NO: 2565937 - DNA, 20 bp, Homo sapiens
ggactccacccatcctatca

SEQ ID NO: 2565938 - DNA, 14 bp, Homo sapiens
ggactccagactct

SEQ ID NO: 2565939 - DNA, 14 bp, Homo sapiens
ggactccccaggcc

SEQ ID NO: 2565940 - DNA, 18 bp, Homo sapiens
ggactccccaggccaggc

SEQ ID NO: 2565941 - DNA, 19 bp, Homo sapiens
ggactccccaggccaggcc

SEQ ID NO: 2565942 - DNA, 20 bp, Homo sapiens
ggactccctcctcacctctg

SEQ ID NO: 2565943 - DNA, 16 bp, Homo sapiens
ggactccggccctcct

SEQ ID NO: 2565944 - DNA, 12 bp, Homo sapiens
ggactcctctgt

SEQ ID NO: 2565945 - DNA, 15 bp, Homo sapiens
ggactcctctgtcca

SEQ ID NO: 2565946 - DNA, 21 bp, Homo sapiens
ggactctcagtctctgagcag

SEQ ID NO: 2565947 - DNA, 19 bp, Homo sapiens
ggactctgaagcctctggg

SEQ ID NO: 2565948 - DNA, 21 bp, Homo sapiens
ggactctgcacatgtcttgta

SEQ ID NO: 2565949 - DNA, 17 bp, Homo sapiens
ggactctggggttttta

SEQ ID NO: 2565950 - DNA, 17 bp, Homo sapiens
ggactgaaaacctctcc

SEQ ID NO: 2565951 - DNA, 19 bp, Homo sapiens
ggactgaagcctgcaggag

SEQ ID NO: 2565952 - DNA, 17 bp, Homo sapiens
ggactgagccagtccca

SEQ ID NO: 2565953 - DNA, 17 bp, Homo sapiens
ggactgagggactctga

SEQ ID NO: 2565954 - DNA, 23 bp, Homo sapiens
ggactgcacagcgtcctgtccac

SEQ ID NO: 2565955 - DNA, 20 bp, Homo sapiens
ggactgccttgaatatcccc

SEQ ID NO: 2565956 - DNA, 15 bp, Homo sapiens
ggactggaaccaggg

SEQ ID NO: 2565957 - DNA, 14 bp, Homo sapiens
ggactggcccctgg

SEQ ID NO: 2565958 - DNA, 15 bp, Homo sapiens
ggactggcccctggg

SEQ ID NO: 2565959 - DNA, 17 bp, Homo sapiens
ggactggcccctgggtc

SEQ ID NO: 2565960 - DNA, 22 bp, Homo sapiens
ggactggctagagtcctcactc

SEQ ID NO: 2565961 - DNA, 21 bp, Homo sapiens
ggactgggtttggaccccagc

SEQ ID NO: 2565962 - DNA, 24 bp, Homo sapiens
ggactgggtttggaccccagctgg

SEQ ID NO: 2565963 - DNA, 20 bp, Homo sapiens
ggactgttttttcctgagct

SEQ ID NO: 2565964 - DNA, 21 bp, Homo sapiens
ggactgttttttcctgagctt

SEQ ID NO: 2565965 - DNA, 23 bp, Homo sapiens
ggactgttttttcctgagcttgg

SEQ ID NO: 2565966 - DNA, 14 bp, Homo sapiens
ggacttggaagctc

SEQ ID NO: 2565967 - DNA, 17 bp, Homo sapiens
ggactttccaccccctc

SEQ ID NO: 2565968 - DNA, 20 bp, Homo sapiens
ggactttcctaaatgtttaa

SEQ ID NO: 2565969 - DNA, 11 bp, Homo sapiens
ggagaaacaca

SEQ ID NO: 2565970 - DNA, 15 bp, Homo sapiens
ggagaacctcaggct

SEQ ID NO: 2565971 - DNA, 17 bp, Homo sapiens
ggagaaccttgtgcctg

SEQ ID NO: 2565972 - DNA, 18 bp, Homo sapiens
ggagaactagaacctgga

SEQ ID NO: 2565973 - DNA, 22 bp, Homo sapiens
ggagaactagaacctggagggc

SEQ ID NO: 2565974 - DNA, 15 bp, Homo sapiens
ggagaagagctgttc

SEQ ID NO: 2565975 - DNA, 13 bp, Homo sapiens
ggagaagcatgaa

SEQ ID NO: 2565976 - DNA, 12 bp, Homo sapiens
ggagaagccatt

SEQ ID NO: 2565977 - DNA, 17 bp, Homo sapiens
ggagaagccattgtctt

SEQ ID NO: 2565978 - DNA, 14 bp, Homo sapiens
ggagaagggatgga

SEQ ID NO: 2565979 - DNA, 15 bp, Homo sapiens
ggagaatcacttgaa

SEQ ID NO: 2565980 - DNA, 19 bp, Homo sapiens
ggagaatcatgtgaacccg

SEQ ID NO: 2565981 - DNA, 16 bp, Homo sapiens
ggagaattttactgtg

SEQ ID NO: 2565982 - DNA, 16 bp, Homo sapiens
gctgccgcctcccagc

SEQ ID NO: 2565983 - DNA, 18 bp, Homo sapiens
gctgccgcctcccagcct

SEQ ID NO: 2565984 - DNA, 19 bp, Homo sapiens
gctgccgcctcccagcctg

SEQ ID NO: 2565985 - DNA, 20 bp, Homo sapiens
gctgccgcctcccagcctgg

SEQ ID NO: 2565986 - DNA, 21 bp, Homo sapiens
gctgcctctacctgacactcc

SEQ ID NO: 2565987 - DNA, 13 bp, Homo sapiens
gctgcctcttctg

SEQ ID NO: 2565988 - DNA, 16 bp, Homo sapiens
gctgcctgggatccct

SEQ ID NO: 2565989 - DNA, 12 bp, Homo sapiens
gctgcctgtagt

SEQ ID NO: 2565990 - DNA, 15 bp, Homo sapiens
gctgcctgtagttag

SEQ ID NO: 2565991 - DNA, 16 bp, Homo sapiens
gctgcctgtagttagg

SEQ ID NO: 2565992 - DNA, 18 bp, Homo sapiens
gctgcctgttcagctcca

SEQ ID NO: 2565993 - DNA, 15 bp, Homo sapiens
gctgcggtccaccca

SEQ ID NO: 2565994 - DNA, 18 bp, Homo sapiens
gctgcggtccacccagga

SEQ ID NO: 2565995 - DNA, 21 bp, Homo sapiens
gctgctacaaagaagacatgt

SEQ ID NO: 2565996 - DNA, 14 bp, Homo sapiens
gctgctacccagaa

SEQ ID NO: 2565997 - DNA, 23 bp, Homo sapiens
gctgctacttaattcctttctca

SEQ ID NO: 2565998 - DNA, 21 bp, Homo sapiens
gctgctcagggaaaagcagct

SEQ ID NO: 2565999 - DNA, 19 bp, Homo sapiens
gctgctcatctgatttttg

SEQ ID NO: 2566000 - DNA, 19 bp, Homo sapiens
gctgctccccagcagcgga

SEQ ID NO: 2566001 - DNA, 13 bp, Homo sapiens
gctgctcctcatg

SEQ ID NO: 2566002 - DNA, 22 bp, Homo sapiens
gctgctctgaattagtccttgc

SEQ ID NO: 2566003 - DNA, 16 bp, Homo sapiens
gctgctgaagctgcct

SEQ ID NO: 2566004 - DNA, 14 bp, Homo sapiens
gctgctgaaggctc

SEQ ID NO: 2566005 - DNA, 18 bp, Homo sapiens
gctgctgacctccacagc

SEQ ID NO: 2566006 - DNA, 19 bp, Homo sapiens
gctgctgacctccacagct

SEQ ID NO: 2566007 - DNA, 13 bp, Homo sapiens
gctgctgcccagg

SEQ ID NO: 2566008 - DNA, 15 bp, Homo sapiens
gctgctgcccaggcc

SEQ ID NO: 2566009 - DNA, 16 bp, Homo sapiens
gctgctgtccctcccc

SEQ ID NO: 2566010 - DNA, 21 bp, Homo sapiens
gctgcttccctctgcctgtcc

SEQ ID NO: 2566011 - DNA, 18 bp, Homo sapiens
gctgctttcccctgtggg

SEQ ID NO: 2566012 - DNA, 19 bp, Homo sapiens
gctgctttttgaggtggca

SEQ ID NO: 2566013 - DNA, 23 bp, Homo sapiens
gctggaaaagggtcttgggaaat

SEQ ID NO: 2566014 - DNA, 22 bp, Homo sapiens
gctggaccttgaactgggtact

SEQ ID NO: 2566015 - DNA, 21 bp, Homo sapiens
gctggacggggactggggatg

SEQ ID NO: 2566016 - DNA, 21 bp, Homo sapiens
gctggactctcagtctctgag

SEQ ID NO: 2566017 - DNA, 17 bp, Homo sapiens
gctggagaccatgcaga

SEQ ID NO: 2566018 - DNA, 18 bp, Homo sapiens
gctggagactcctaggca

SEQ ID NO: 2566019 - DNA, 13 bp, Homo sapiens
gctggagaggtta

SEQ ID NO: 2566020 - DNA, 17 bp, Homo sapiens
gctggagcctggtgccc

SEQ ID NO: 2566021 - DNA, 21 bp, Homo sapiens
gctggaggactagaacctgga

SEQ ID NO: 2566022 - DNA, 23 bp, Homo sapiens
gctggaggactagaacctggagg

SEQ ID NO: 2566023 - DNA, 16 bp, Homo sapiens
gctggaggtggggcct

SEQ ID NO: 2566024 - DNA, 12 bp, Homo sapiens
gctggagtgcag

SEQ ID NO: 2566025 - DNA, 22 bp, Homo sapiens
gctggagtgcagtgagccgaga

SEQ ID NO: 2566026 - DNA, 23 bp, Homo sapiens
gctggatcacagctgctttctgt

SEQ ID NO: 2566027 - DNA, 15 bp, Homo sapiens
gctggcaaagacaga

SEQ ID NO: 2566028 - DNA, 20 bp, Homo sapiens
gctggcaaaggtggctctcc

SEQ ID NO: 2566029 - DNA, 16 bp, Homo sapiens
gctggcagctctccag

SEQ ID NO: 2566030 - DNA, 19 bp, Homo sapiens
gctggccactgcacagagc

SEQ ID NO: 2566031 - DNA, 11 bp, Homo sapiens
gctggcccagc

SEQ ID NO: 2566032 - DNA, 12 bp, Homo sapiens
gctggcccagcc

SEQ ID NO: 2566033 - DNA, 16 bp, Homo sapiens
gctggcccagccctgc

SEQ ID NO: 2566034 - DNA, 20 bp, Homo sapiens
gctggcccagccctgctggc

SEQ ID NO: 2566035 - DNA, 20 bp, Homo sapiens
gctggcccagccggcctctc

SEQ ID NO: 2566036 - DNA, 23 bp, Homo sapiens
gctggcccagccggcctctctgg

SEQ ID NO: 2566037 - DNA, 14 bp, Homo sapiens
gctggcccctcacc

SEQ ID NO: 2566038 - DNA, 22 bp, Homo sapiens
gctggcccgtgacagactcctg

SEQ ID NO: 2566039 - DNA, 19 bp, Homo sapiens
gctggccgagggtcctggc

SEQ ID NO: 2566040 - DNA, 15 bp, Homo sapiens
gctggcctggatctc

SEQ ID NO: 2566041 - DNA, 17 bp, Homo sapiens
gctggcctggcccctca

SEQ ID NO: 2566042 - DNA, 18 bp, Homo sapiens
gctggcctggcccctcag

SEQ ID NO: 2566043 - DNA, 13 bp, Homo sapiens
gctggccttcctg

SEQ ID NO: 2566044 - DNA, 19 bp, Homo sapiens
gctggccttcctgccctac

SEQ ID NO: 2566045 - DNA, 16 bp, Homo sapiens
gctggcgcagccaagg

SEQ ID NO: 2566046 - DNA, 17 bp, Homo sapiens
gctggcgcagccaaggc

SEQ ID NO: 2566047 - DNA, 12 bp, Homo sapiens
gctggcgcctct

SEQ ID NO: 2566048 - DNA, 16 bp, Homo sapiens
gctggcgcctctgcaa

SEQ ID NO: 2566049 - DNA, 14 bp, Homo sapiens
gctggcgtgcagtg

SEQ ID NO: 2566050 - DNA, 15 bp, Homo sapiens
gctggcgtgcagtgg

SEQ ID NO: 2566051 - DNA, 19 bp, Homo sapiens
gctggctgttggctggggg

SEQ ID NO: 2566052 - DNA, 20 bp, Homo sapiens
gctggctgttggctgggggc

SEQ ID NO: 2566053 - DNA, 23 bp, Homo sapiens
gctggctgttggctgggggcctc

SEQ ID NO: 2566054 - DNA, 16 bp, Homo sapiens
gctgggaactcacctg

SEQ ID NO: 2566055 - DNA, 21 bp, Homo sapiens
gctgggaactcacctggggct

SEQ ID NO: 2566056 - DNA, 23 bp, Homo sapiens
gctgggaactcacctggggctgc

SEQ ID NO: 2566057 - DNA, 21 bp, Homo sapiens
gcttcagcctgaggctgagac

SEQ ID NO: 2566058 - DNA, 17 bp, Homo sapiens
gcttcaggttatcgaaa

SEQ ID NO: 2566059 - DNA, 22 bp, Homo sapiens
gcttcaggttatcgaaataaca

SEQ ID NO: 2566060 - DNA, 14 bp, Homo sapiens
gcttcagtggcagc

SEQ ID NO: 2566061 - DNA, 18 bp, Homo sapiens
gcttcagtggcagctgct

SEQ ID NO: 2566062 - DNA, 18 bp, Homo sapiens
gcttcataaatgaagcag

SEQ ID NO: 2566063 - DNA, 22 bp, Homo sapiens
gcttcataaatgaagcagcttt

SEQ ID NO: 2566064 - DNA, 16 bp, Homo sapiens
gcttcatgacattcct

SEQ ID NO: 2566065 - DNA, 14 bp, Homo sapiens
gcttcatgccagct

SEQ ID NO: 2566066 - DNA, 17 bp, Homo sapiens
gcttcatggcagaaggc

SEQ ID NO: 2566067 - DNA, 16 bp, Homo sapiens
gcttcattagagcagg

SEQ ID NO: 2566068 - DNA, 16 bp, Homo sapiens
gcttcatttcctgtgt

SEQ ID NO: 2566069 - DNA, 12 bp, Homo sapiens
gcttccaatttt

SEQ ID NO: 2566070 - DNA, 19 bp, Homo sapiens
gcttccagagagtcctctg

SEQ ID NO: 2566071 - DNA, 20 bp, Homo sapiens
gcttccagagagtcctctgg

SEQ ID NO: 2566072 - DNA, 21 bp, Homo sapiens
gcttccagagagtcctctgga

SEQ ID NO: 2566073 - DNA, 20 bp, Homo sapiens
gcttccaggtatctccagga

SEQ ID NO: 2566074 - DNA, 15 bp, Homo sapiens
gcttccagtgaggct

SEQ ID NO: 2566075 - DNA, 22 bp, Homo sapiens
gcttccagtgaggctctgccct

SEQ ID NO: 2566076 - DNA, 20 bp, Homo sapiens
gcttccatttgtgtgtgtgc

SEQ ID NO: 2566077 - DNA, 12 bp, Homo sapiens
gcttcccatcct

SEQ ID NO: 2566078 - DNA, 19 bp, Homo sapiens
gcttcccattgtggctcct

SEQ ID NO: 2566079 - DNA, 17 bp, Homo sapiens
gcttccctctgcctgtc

SEQ ID NO: 2566080 - DNA, 18 bp, Homo sapiens
gcttccctgactcattct

SEQ ID NO: 2566081 - DNA, 23 bp, Homo sapiens
gcttcctacccacacctctgcca

SEQ ID NO: 2566082 - DNA, 21 bp, Homo sapiens
gcttcgaggcccagcgacctc

SEQ ID NO: 2566083 - DNA, 18 bp, Homo sapiens
gcttcgggcccttcccac

SEQ ID NO: 2566084 - DNA, 14 bp, Homo sapiens
gcttcgtttatttt

SEQ ID NO: 2566085 - DNA, 16 bp, Homo sapiens
gcttcgtttattttca

SEQ ID NO: 2566086 - DNA, 20 bp, Homo sapiens
gcttctatcccaggaggtgg

SEQ ID NO: 2566087 - DNA, 18 bp, Homo sapiens
gcttctcatcctgcaggc

SEQ ID NO: 2566088 - DNA, 14 bp, Homo sapiens
gcttctctacagac

SEQ ID NO: 2566089 - DNA, 19 bp, Homo sapiens
gcttctctgtgaacgattt

SEQ ID NO: 2566090 - DNA, 21 bp, Homo sapiens
gcttctgcaccctccaccctg

SEQ ID NO: 2566091 - DNA, 13 bp, Homo sapiens
gcttctgcctgca

SEQ ID NO: 2566092 - DNA, 12 bp, Homo sapiens
gcttctggagcc

SEQ ID NO: 2566093 - DNA, 18 bp, Homo sapiens
gcttctggagcccttggg

SEQ ID NO: 2566094 - DNA, 15 bp, Homo sapiens
gcttctggtactctc

SEQ ID NO: 2566095 - DNA, 21 bp, Homo sapiens
gcttcttaatcttttcacaaa

SEQ ID NO: 2566096 - DNA, 15 bp, Homo sapiens
gcttcttcagagact

SEQ ID NO: 2566097 - DNA, 21 bp, Homo sapiens
gcttcttcctatttgccatgg

SEQ ID NO: 2566098 - DNA, 23 bp, Homo sapiens
gcttcttttagttgtatctcttt

SEQ ID NO: 2566099 - DNA, 20 bp, Homo sapiens
gcttgaaagaaaatatgcat

SEQ ID NO: 2566100 - DNA, 22 bp, Homo sapiens
gcttgaagatcgttagtatcta

SEQ ID NO: 2566101 - DNA, 20 bp, Homo sapiens
gcttgagggttgggctggtg

SEQ ID NO: 2566102 - DNA, 23 bp, Homo sapiens
gcttgcataataagctaaagagg

SEQ ID NO: 2566103 - DNA, 13 bp, Homo sapiens
gcttgcctagggc

SEQ ID NO: 2566104 - DNA, 15 bp, Homo sapiens
gcttgcctctctgtt

SEQ ID NO: 2566105 - DNA, 14 bp, Homo sapiens
gcttgctcattttt

SEQ ID NO: 2566106 - DNA, 12 bp, Homo sapiens
gcttgctgagag

SEQ ID NO: 2566107 - DNA, 18 bp, Homo sapiens
gcttggaaactggatgag

SEQ ID NO: 2566108 - DNA, 21 bp, Homo sapiens
gcttggaaagcatcacctcag

SEQ ID NO: 2566109 - DNA, 14 bp, Homo sapiens
gcttggagcagagg

SEQ ID NO: 2566110 - DNA, 13 bp, Homo sapiens
gcttggcagctga

SEQ ID NO: 2566111 - DNA, 18 bp, Homo sapiens
gcttggccagaagggggc

SEQ ID NO: 2566112 - DNA, 14 bp, Homo sapiens
gcttggctgcttgg

SEQ ID NO: 2566113 - DNA, 14 bp, Homo sapiens
gcttgggacaaatc

SEQ ID NO: 2566114 - DNA, 19 bp, Homo sapiens
gcttgggaccgccagatgg

SEQ ID NO: 2566115 - DNA, 15 bp, Homo sapiens
gcttgggcccagctg

SEQ ID NO: 2566116 - DNA, 18 bp, Homo sapiens
gcttgggcccagctgggc

SEQ ID NO: 2566117 - DNA, 23 bp, Homo sapiens
gcttgggcttccatttgtgtgtg

SEQ ID NO: 2566118 - DNA, 18 bp, Homo sapiens
gcttgggtggagaagcca

SEQ ID NO: 2566119 - DNA, 22 bp, Homo sapiens
gcttggtggatgaaatgtcagt

SEQ ID NO: 2566120 - DNA, 18 bp, Homo sapiens
gcttgtaaatagctcagg

SEQ ID NO: 2566121 - DNA, 20 bp, Homo sapiens
gcttgtaaatagctcaggtg

SEQ ID NO: 2566122 - DNA, 14 bp, Homo sapiens
gcttgtatagtgta

SEQ ID NO: 2566123 - DNA, 17 bp, Homo sapiens
gcttgtatcaacactgt

SEQ ID NO: 2566124 - DNA, 13 bp, Homo sapiens
gcttgtcagagct

SEQ ID NO: 2566125 - DNA, 14 bp, Homo sapiens
gcttgtcagagctg

SEQ ID NO: 2566126 - DNA, 17 bp, Homo sapiens
gcttgtcagagctggga

SEQ ID NO: 2566127 - DNA, 18 bp, Homo sapiens
gcttgtcagagctgggag

SEQ ID NO: 2566128 - DNA, 20 bp, Homo sapiens
gcttgtggagccccacactg

SEQ ID NO: 2566129 - DNA, 23 bp, Homo sapiens
gcttgtggattgagggtaggagg

SEQ ID NO: 2566130 - DNA, 16 bp, Homo sapiens
gcttgtgtgtttcact

SEQ ID NO: 2566131 - DNA, 19 bp, Homo sapiens
gcttgtgtgtttcactttt

SEQ ID NO: 2566132 - DNA, 14 bp, Homo sapiens
gcttgttggatttt

SEQ ID NO: 2566133 - DNA, 15 bp, Homo sapiens
gcttgtttcctagca

SEQ ID NO: 2566134 - DNA, 19 bp, Homo sapiens
gcttgtttgctcacctggg

SEQ ID NO: 2566135 - DNA, 13 bp, Homo sapiens
gctttaaacaaat

SEQ ID NO: 2566136 - DNA, 17 bp, Homo sapiens
gctttaaacaaattcat

SEQ ID NO: 2566137 - DNA, 22 bp, Homo sapiens
gctttaaacattggttcttgta

SEQ ID NO: 2566138 - DNA, 22 bp, Homo sapiens
gctttaaactcagggacagagc

SEQ ID NO: 2566139 - DNA, 17 bp, Homo sapiens
gctttattttttaagta

SEQ ID NO: 2566140 - DNA, 19 bp, Homo sapiens
gctttattttttaagtatt

SEQ ID NO: 2566141 - DNA, 16 bp, Homo sapiens
gctttcaattccgtag

SEQ ID NO: 2566142 - DNA, 14 bp, Homo sapiens
ggataggagcctgc

SEQ ID NO: 2566143 - DNA, 21 bp, Homo sapiens
ggataggagttcacttcatct

SEQ ID NO: 2566144 - DNA, 16 bp, Homo sapiens
ggatatagttttactt

SEQ ID NO: 2566145 - DNA, 14 bp, Homo sapiens
ggatcacagggccc

SEQ ID NO: 2566146 - DNA, 18 bp, Homo sapiens
ggatcactggagcccagg

SEQ ID NO: 2566147 - DNA, 21 bp, Homo sapiens
ggatcagatgaactcttagaa

SEQ ID NO: 2566148 - DNA, 16 bp, Homo sapiens
ggatcagattgcatgt

SEQ ID NO: 2566149 - DNA, 16 bp, Homo sapiens
ggatcatggtgtaata

SEQ ID NO: 2566150 - DNA, 18 bp, Homo sapiens
ggatccctcatctgtccc

SEQ ID NO: 2566151 - DNA, 18 bp, Homo sapiens
ggatcctagccttatcct

SEQ ID NO: 2566152 - DNA, 14 bp, Homo sapiens
ggatcctattctca

SEQ ID NO: 2566153 - DNA, 23 bp, Homo sapiens
ggatcggaggcttgtcagagctg

SEQ ID NO: 2566154 - DNA, 13 bp, Homo sapiens
ggatctaccagca

SEQ ID NO: 2566155 - DNA, 10 bp, Homo sapiens
ggatctcagg

SEQ ID NO: 2566156 - DNA, 21 bp, Homo sapiens
ggatctggtagggggaaaatg

SEQ ID NO: 2566157 - DNA, 16 bp, Homo sapiens
ggatcttgcattccca

SEQ ID NO: 2566158 - DNA, 22 bp, Homo sapiens
ggatcttgcattcccagtggtc

SEQ ID NO: 2566159 - DNA, 21 bp, Homo sapiens
ggatctttggacagaagcagc

SEQ ID NO: 2566160 - DNA, 14 bp, Homo sapiens
ggatgaatgaggtc

SEQ ID NO: 2566161 - DNA, 22 bp, Homo sapiens
ggatgaatgaggtcccaggcag

SEQ ID NO: 2566162 - DNA, 23 bp, Homo sapiens
ggatgaatgtatgtgcactgtca

SEQ ID NO: 2566163 - DNA, 21 bp, Homo sapiens
ggatgaattccaaattctgct

SEQ ID NO: 2566164 - DNA, 15 bp, Homo sapiens
ggatgacatgtccct

SEQ ID NO: 2566165 - DNA, 20 bp, Homo sapiens
ggatgacatgtccctacacc

SEQ ID NO: 2566166 - DNA, 21 bp, Homo sapiens
ggatgagaatttgagtgctct

SEQ ID NO: 2566167 - DNA, 23 bp, Homo sapiens
ggatgagaatttgagtgctctga

SEQ ID NO: 2566168 - DNA, 20 bp, Homo sapiens
ggatgagagcccagaggtaa

SEQ ID NO: 2566169 - DNA, 20 bp, Homo sapiens
ggatgagcatggagctggcc

SEQ ID NO: 2566170 - DNA, 23 bp, Homo sapiens
ggatgagtacccaaaagctcagc

SEQ ID NO: 2566171 - DNA, 16 bp, Homo sapiens
ggatgatctaggaaga

SEQ ID NO: 2566172 - DNA, 15 bp, Homo sapiens
ggatgatgcctcatg

SEQ ID NO: 2566173 - DNA, 17 bp, Homo sapiens
ggatgattggattattc

SEQ ID NO: 2566174 - DNA, 16 bp, Homo sapiens
ggatgcagagtcagca

SEQ ID NO: 2566175 - DNA, 17 bp, Homo sapiens
ggatgcagcctcacagt

SEQ ID NO: 2566176 - DNA, 19 bp, Homo sapiens
ggatgcctggtggcagctg

SEQ ID NO: 2566177 - DNA, 21 bp, Homo sapiens
ggatgctcctcccttctctac

SEQ ID NO: 2566178 - DNA, 14 bp, Homo sapiens
ggatgctgcctgag

SEQ ID NO: 2566179 - DNA, 19 bp, Homo sapiens
ggatggaaaaggaagacta

SEQ ID NO: 2566180 - DNA, 17 bp, Homo sapiens
ggatggaatgatgggtc

SEQ ID NO: 2566181 - DNA, 19 bp, Homo sapiens
ggatggaggggtggtcctg

SEQ ID NO: 2566182 - DNA, 16 bp, Homo sapiens
ggatggcctggccagg

SEQ ID NO: 2566183 - DNA, 15 bp, Homo sapiens
ggatgggagtgagac

SEQ ID NO: 2566184 - DNA, 20 bp, Homo sapiens
ggatgggggaaatggtgcct

SEQ ID NO: 2566185 - DNA, 14 bp, Homo sapiens
ggatggtcctgggg

SEQ ID NO: 2566186 - DNA, 22 bp, Homo sapiens
ggatggtcctggggctctgtgc

SEQ ID NO: 2566187 - DNA, 16 bp, Homo sapiens
ggatgtacatttccaa

SEQ ID NO: 2566188 - DNA, 17 bp, Homo sapiens
ggatgtcttccttggag

SEQ ID NO: 2566189 - DNA, 22 bp, Homo sapiens
ggatgtgaattgcctgcagaga

SEQ ID NO: 2566190 - DNA, 23 bp, Homo sapiens
ggatgtgggagggagcagacagg

SEQ ID NO: 2566191 - DNA, 15 bp, Homo sapiens
ggatgttctgggaca

SEQ ID NO: 2566192 - DNA, 16 bp, Homo sapiens
ggatgttctgggacac

SEQ ID NO: 2566193 - DNA, 22 bp, Homo sapiens
ggatgttgaaaaagttctgcag

SEQ ID NO: 2566194 - DNA, 23 bp, Homo sapiens
ggattaaacttaatctaaatgga

SEQ ID NO: 2566195 - DNA, 17 bp, Homo sapiens
ggattagggagagaaga

SEQ ID NO: 2566196 - DNA, 20 bp, Homo sapiens
ggattattttttcagaccga

SEQ ID NO: 2566197 - DNA, 19 bp, Homo sapiens
ggattcctgacccaggccg

SEQ ID NO: 2566198 - DNA, 20 bp, Homo sapiens
ggattcctgacccaggccgc

SEQ ID NO: 2566199 - DNA, 13 bp, Homo sapiens
ggattctgggagg

SEQ ID NO: 2566200 - DNA, 23 bp, Homo sapiens
ggattctgtacatgcattgagct

SEQ ID NO: 2566201 - DNA, 14 bp, Homo sapiens
ggattgaagccctc

SEQ ID NO: 2566202 - DNA, 20 bp, Homo sapiens
ggattgatcggagcctcctc

SEQ ID NO: 2566203 - DNA, 14 bp, Homo sapiens
ggattgctgccact

SEQ ID NO: 2566204 - DNA, 18 bp, Homo sapiens
ggattggggaagactgtg

SEQ ID NO: 2566205 - DNA, 16 bp, Homo sapiens
ggattgtccccgaccc

SEQ ID NO: 2566206 - DNA, 17 bp, Homo sapiens
ggatttaacagaaatgt

SEQ ID NO: 2566207 - DNA, 18 bp, Homo sapiens
ggatttataaatgctatt

SEQ ID NO: 2566208 - DNA, 19 bp, Homo sapiens
ggatttccagccagggctg

SEQ ID NO: 2566209 - DNA, 13 bp, Homo sapiens
ggatttctcccag

SEQ ID NO: 2566210 - DNA, 13 bp, Homo sapiens
ggatttgaagcaa

SEQ ID NO: 2566211 - DNA, 22 bp, Homo sapiens
ggatttgccccttcccatctct

SEQ ID NO: 2566212 - DNA, 19 bp, Homo sapiens
ggatttgggttggaagtga

SEQ ID NO: 2566213 - DNA, 21 bp, Homo sapiens
ggattttgatccaagctggtc

SEQ ID NO: 2566214 - DNA, 21 bp, Homo sapiens
ggcaaagggagcagaactgaa

SEQ ID NO: 2566215 - DNA, 13 bp, Homo sapiens
ggcaaatgcccaa

SEQ ID NO: 2566216 - DNA, 21 bp, Homo sapiens
ggcaaccacaggcagcattta

SEQ ID NO: 2566217 - DNA, 16 bp, Homo sapiens
ggcaaccccagttctg

SEQ ID NO: 2566218 - DNA, 17 bp, Homo sapiens
ggcaacccccagcctgc

SEQ ID NO: 2566219 - DNA, 18 bp, Homo sapiens
ggcaacccccagcctgct

SEQ ID NO: 2566220 - DNA, 19 bp, Homo sapiens
ggcaacccccagcctgcta

SEQ ID NO: 2566221 - DNA, 19 bp, Homo sapiens
ggcaactgaggcagacagc

SEQ ID NO: 2566222 - DNA, 19 bp, Homo sapiens
ggcaactgcattggctttg

SEQ ID NO: 2566223 - DNA, 22 bp, Homo sapiens
ggcaactttccttgttccccat

SEQ ID NO: 2566224 - DNA, 18 bp, Homo sapiens
ggcaagaaggaattgact

SEQ ID NO: 2566225 - DNA, 22 bp, Homo sapiens
ggcaagcttggctgtagaagga

SEQ ID NO: 2566226 - DNA, 14 bp, Homo sapiens
ggcaaggacacaga

SEQ ID NO: 2566227 - DNA, 14 bp, Homo sapiens
ggcaaggctgtgct

SEQ ID NO: 2566228 - DNA, 18 bp, Homo sapiens
ggcaatagtgtgttctga

SEQ ID NO: 2566229 - DNA, 14 bp, Homo sapiens
ggcaatgctggctg

SEQ ID NO: 2566230 - DNA, 23 bp, Homo sapiens
ggcaatgctggctgttggctggg

SEQ ID NO: 2566231 - DNA, 20 bp, Homo sapiens
ggcacaatggctaattccca

SEQ ID NO: 2566232 - DNA, 13 bp, Homo sapiens
ggcacacacctgt

SEQ ID NO: 2566233 - DNA, 21 bp, Homo sapiens
ggcacacacctgtagtcccag

SEQ ID NO: 2566234 - DNA, 19 bp, Homo sapiens
ggcacacgcctcccactgg

SEQ ID NO: 2566235 - DNA, 20 bp, Homo sapiens
ggcacagcaactctaagact

SEQ ID NO: 2566236 - DNA, 13 bp, Homo sapiens
ggcacagccttct

SEQ ID NO: 2566237 - DNA, 18 bp, Homo sapiens
ggcacagcggggccccag

SEQ ID NO: 2566238 - DNA, 21 bp, Homo sapiens
ggcacagttttctgagaaaga

SEQ ID NO: 2566239 - DNA, 18 bp, Homo sapiens
ggcacatcctatgcaata

SEQ ID NO: 2566240 - DNA, 14 bp, Homo sapiens
ggcacatggaggag

SEQ ID NO: 2566241 - DNA, 18 bp, Homo sapiens
ggcacatttaagagacag

SEQ ID NO: 2566242 - DNA, 22 bp, Homo sapiens
ggcaccactgcactccagcctg

SEQ ID NO: 2566243 - DNA, 22 bp, Homo sapiens
ggcaccagaggctgcagaaggc

SEQ ID NO: 2566244 - DNA, 15 bp, Homo sapiens
ggcaccagcagcctg

SEQ ID NO: 2566245 - DNA, 20 bp, Homo sapiens
ggcacccacaagtgccactg

SEQ ID NO: 2566246 - DNA, 23 bp, Homo sapiens
ggcacccaccatcatgtctggct

SEQ ID NO: 2566247 - DNA, 16 bp, Homo sapiens
ggcaccccctggagag

SEQ ID NO: 2566248 - DNA, 15 bp, Homo sapiens
ggcacccggcccctg

SEQ ID NO: 2566249 - DNA, 16 bp, Homo sapiens
ggcacccggcccctgc

SEQ ID NO: 2566250 - DNA, 17 bp, Homo sapiens
ggcacccggcccctgct

SEQ ID NO: 2566251 - DNA, 19 bp, Homo sapiens
ggcacccggcccctgctgg

SEQ ID NO: 2566252 - DNA, 20 bp, Homo sapiens
ggcacccggcccctgctggt

SEQ ID NO: 2566253 - DNA, 20 bp, Homo sapiens
ggcacccttctttcctcttc

SEQ ID NO: 2566254 - DNA, 22 bp, Homo sapiens
ggcacccttctttcctcttccc

SEQ ID NO: 2566255 - DNA, 15 bp, Homo sapiens
ggcaccgagaatgtt

SEQ ID NO: 2566256 - DNA, 17 bp, Homo sapiens
ggcacctggggagtggg

SEQ ID NO: 2566257 - DNA, 21 bp, Homo sapiens
ggcacgcttgcgtatgtctgt

SEQ ID NO: 2566258 - DNA, 17 bp, Homo sapiens
ggcgcagtgcctctggt

SEQ ID NO: 2566259 - DNA, 16 bp, Homo sapiens
ggcgccctggaagccg

SEQ ID NO: 2566260 - DNA, 19 bp, Homo sapiens
ggcgccggcgggcgggccg

SEQ ID NO: 2566261 - DNA, 14 bp, Homo sapiens
ggcgcggccagccc

SEQ ID NO: 2566262 - DNA, 12 bp, Homo sapiens
ggcgctggccca

SEQ ID NO: 2566263 - DNA, 17 bp, Homo sapiens
ggcggacgttccagccg

SEQ ID NO: 2566264 - DNA, 14 bp, Homo sapiens
ggcggcacagcctt

SEQ ID NO: 2566265 - DNA, 15 bp, Homo sapiens
ggcggcacagccttc

SEQ ID NO: 2566266 - DNA, 14 bp, Homo sapiens
ggcggcagcagcca

SEQ ID NO: 2566267 - DNA, 22 bp, Homo sapiens
ggcgggcacctatagtcccagc

SEQ ID NO: 2566268 - DNA, 17 bp, Homo sapiens
ggcgggccaaggactgc

SEQ ID NO: 2566269 - DNA, 14 bp, Homo sapiens
ggcgggccagccag

SEQ ID NO: 2566270 - DNA, 21 bp, Homo sapiens
ggcggtgggcacccaccctgg

SEQ ID NO: 2566271 - DNA, 22 bp, Homo sapiens
ggcggtgggcacccaccctggg

SEQ ID NO: 2566272 - DNA, 15 bp, Homo sapiens
ggcgtgaggatggga

SEQ ID NO: 2566273 - DNA, 14 bp, Homo sapiens
ggcgtgcagtggtg

SEQ ID NO: 2566274 - DNA, 15 bp, Homo sapiens
ggcgtggagctgcct

SEQ ID NO: 2566275 - DNA, 19 bp, Homo sapiens
ggctaaggcgtggagctgc

SEQ ID NO: 2566276 - DNA, 22 bp, Homo sapiens
ggctaaggcgtggagctgcctg

SEQ ID NO: 2566277 - DNA, 12 bp, Homo sapiens
ggctacacaggg

SEQ ID NO: 2566278 - DNA, 15 bp, Homo sapiens
ggctacacagggatg

SEQ ID NO: 2566279 - DNA, 21 bp, Homo sapiens
ggctagaacctagaagggcta

SEQ ID NO: 2566280 - DNA, 22 bp, Homo sapiens
ggctagaacctggagagctaga

SEQ ID NO: 2566281 - DNA, 22 bp, Homo sapiens
ggctagaatctggagagctaga

SEQ ID NO: 2566282 - DNA, 20 bp, Homo sapiens
ggctagaggccagccccacc

SEQ ID NO: 2566283 - DNA, 14 bp, Homo sapiens
ggctagagtcctca

SEQ ID NO: 2566284 - DNA, 20 bp, Homo sapiens
ggctagagtgcagtggcatg

SEQ ID NO: 2566285 - DNA, 16 bp, Homo sapiens
ggctaggacccctcca

SEQ ID NO: 2566286 - DNA, 13 bp, Homo sapiens
ggctaggtacaca

SEQ ID NO: 2566287 - DNA, 19 bp, Homo sapiens
ggctatagctacaggaagc

SEQ ID NO: 2566288 - DNA, 13 bp, Homo sapiens
ggctatgcatttg

SEQ ID NO: 2566289 - DNA, 21 bp, Homo sapiens
ggctatggggatagatgtgtg

SEQ ID NO: 2566290 - DNA, 17 bp, Homo sapiens
ggctcacgcctgtaatc

SEQ ID NO: 2566291 - DNA, 23 bp, Homo sapiens
ggctcacgcctgtaatcccagca

SEQ ID NO: 2566292 - DNA, 16 bp, Homo sapiens
ggctcactgcagcctc

SEQ ID NO: 2566293 - DNA, 14 bp, Homo sapiens
ggctcagagtgggg

SEQ ID NO: 2566294 - DNA, 10 bp, Homo sapiens
ggctcagcct

SEQ ID NO: 2566295 - DNA, 12 bp, Homo sapiens
ggctcagcctgg

SEQ ID NO: 2566296 - DNA, 13 bp, Homo sapiens
ggctcagcctggt

SEQ ID NO: 2566297 - DNA, 12 bp, Homo sapiens
ggctcaggaaaa

SEQ ID NO: 2566298 - DNA, 14 bp, Homo sapiens
ggctcagtctcagg

SEQ ID NO: 2566299 - DNA, 17 bp, Homo sapiens
ggctccaaaccctcgag

SEQ ID NO: 2566300 - DNA, 16 bp, Homo sapiens
ggctccagagggcact

SEQ ID NO: 2566301 - DNA, 12 bp, Homo sapiens
ggctccaggagc

SEQ ID NO: 2566302 - DNA, 13 bp, Homo sapiens
ggctccaggagca

SEQ ID NO: 2566303 - DNA, 17 bp, Homo sapiens
ggctccaggagcagcca

SEQ ID NO: 2566304 - DNA, 19 bp, Homo sapiens
ggctccaggagcagccaca

SEQ ID NO: 2566305 - DNA, 11 bp, Homo sapiens
ggctccaggct

SEQ ID NO: 2566306 - DNA, 13 bp, Homo sapiens
ggctccaggctcc

SEQ ID NO: 2566307 - DNA, 16 bp, Homo sapiens
ggctccaggctccttt

SEQ ID NO: 2566308 - DNA, 19 bp, Homo sapiens
ggctcccatgaccatactg

SEQ ID NO: 2566309 - DNA, 21 bp, Homo sapiens
ggctccccatgtgtcctggtt

SEQ ID NO: 2566310 - DNA, 22 bp, Homo sapiens
ggctccccatgtgtcctggttc

SEQ ID NO: 2566311 - DNA, 18 bp, Homo sapiens
ggctccctgactgggagt

SEQ ID NO: 2566312 - DNA, 21 bp, Homo sapiens
ggctccctgtaacctcttcag

SEQ ID NO: 2566313 - DNA, 13 bp, Homo sapiens
ggctcccttccca

SEQ ID NO: 2566314 - DNA, 12 bp, Homo sapiens
ggctcctgtgct

SEQ ID NO: 2566315 - DNA, 20 bp, Homo sapiens
ggctcctgtgctactttgcc

SEQ ID NO: 2566316 - DNA, 20 bp, Homo sapiens
ggctccttcccatcgctgtc

SEQ ID NO: 2566317 - DNA, 20 bp, Homo sapiens
ggctcctttctccagccagc

SEQ ID NO: 2566318 - DNA, 21 bp, Homo sapiens
ggctcctttctccagccagca

SEQ ID NO: 2566319 - DNA, 18 bp, Homo sapiens
ggctctacaactgagtcc

SEQ ID NO: 2566320 - DNA, 14 bp, Homo sapiens
ggctctcagctcag

SEQ ID NO: 2566321 - DNA, 17 bp, Homo sapiens
ggctctccaagtgccag

SEQ ID NO: 2566322 - DNA, 13 bp, Homo sapiens
ggctctccagtta

SEQ ID NO: 2566323 - DNA, 20 bp, Homo sapiens
ggctctcctcagaagaaaga

SEQ ID NO: 2566324 - DNA, 22 bp, Homo sapiens
ggctctctatagcaccagggct

SEQ ID NO: 2566325 - DNA, 13 bp, Homo sapiens
ggctctctccagg

SEQ ID NO: 2566326 - DNA, 14 bp, Homo sapiens
ggctctctccagga

SEQ ID NO: 2566327 - DNA, 13 bp, Homo sapiens
ggctctgaccagt

SEQ ID NO: 2566328 - DNA, 17 bp, Homo sapiens
ggctctgaggtgcctgt

SEQ ID NO: 2566329 - DNA, 20 bp, Homo sapiens
ggctctgcaatgggcactgg

SEQ ID NO: 2566330 - DNA, 17 bp, Homo sapiens
ggctctgccccagaggc

SEQ ID NO: 2566331 - DNA, 23 bp, Homo sapiens
ggctctgccccagctctggcttc

SEQ ID NO: 2566332 - DNA, 12 bp, Homo sapiens
ggctctgccctt

SEQ ID NO: 2566333 - DNA, 13 bp, Homo sapiens
ggctctgcctccc

SEQ ID NO: 2566334 - DNA, 15 bp, Homo sapiens
ggctctgtgcaggga

SEQ ID NO: 2566335 - DNA, 20 bp, Homo sapiens
ggctctgtgctgaccctcct

SEQ ID NO: 2566336 - DNA, 12 bp, Homo sapiens
ggctcttccagg

SEQ ID NO: 2566337 - DNA, 18 bp, Homo sapiens
ggctcttccaggctggga

SEQ ID NO: 2566338 - DNA, 17 bp, Homo sapiens
ggctcttctccccagag

SEQ ID NO: 2566339 - DNA, 14 bp, Homo sapiens
ggctcttctgacta

SEQ ID NO: 2566340 - DNA, 14 bp, Homo sapiens
ggctctttccttgc

SEQ ID NO: 2566341 - DNA, 20 bp, Homo sapiens
ggctgaaagaggccaatgcc

SEQ ID NO: 2566342 - DNA, 11 bp, Homo sapiens
ggctgaaagcc

SEQ ID NO: 2566343 - DNA, 15 bp, Homo sapiens
ggctgaaccctgtgc

SEQ ID NO: 2566344 - DNA, 20 bp, Homo sapiens
ggctgaaccctgtgctggtg

SEQ ID NO: 2566345 - DNA, 14 bp, Homo sapiens
ggctgaaggactgt

SEQ ID NO: 2566346 - DNA, 18 bp, Homo sapiens
ggctgaaggactgtgaca

SEQ ID NO: 2566347 - DNA, 18 bp, Homo sapiens
ggctgaccccaaagagcc

SEQ ID NO: 2566348 - DNA, 19 bp, Homo sapiens
ggctgaccccaaagagcct

SEQ ID NO: 2566349 - DNA, 23 bp, Homo sapiens
ggctgaccttcctcgcagagagg

SEQ ID NO: 2566350 - DNA, 24 bp, Homo sapiens
ggctgactagaagggccagtcctg

SEQ ID NO: 2566351 - DNA, 14 bp, Homo sapiens
ggctgagaacactg

SEQ ID NO: 2566352 - DNA, 17 bp, Homo sapiens
ggctgagaaccctgcgt

SEQ ID NO: 2566353 - DNA, 15 bp, Homo sapiens
ggctgagacaggaga

SEQ ID NO: 2566354 - DNA, 13 bp, Homo sapiens
ggctgagccctgg

SEQ ID NO: 2566355 - DNA, 15 bp, Homo sapiens
ggctgagctctctgt

SEQ ID NO: 2566356 - DNA, 20 bp, Homo sapiens
ggctgagctctctgtgggct

SEQ ID NO: 2566357 - DNA, 22 bp, Homo sapiens
ggctgaggaaaggccagctggc

SEQ ID NO: 2566358 - DNA, 20 bp, Homo sapiens
ggctgaggaggcctccatct

SEQ ID NO: 2566359 - DNA, 15 bp, Homo sapiens
ggctgagggagcctg

SEQ ID NO: 2566360 - DNA, 15 bp, Homo sapiens
ggctgatggagtaaa

SEQ ID NO: 2566361 - DNA, 13 bp, Homo sapiens
ggctgcagcagcg

SEQ ID NO: 2566362 - DNA, 22 bp, Homo sapiens
ggctgcagcagcggtggcctct

SEQ ID NO: 2566363 - DNA, 15 bp, Homo sapiens
ggctgcagtgagcca

SEQ ID NO: 2566364 - DNA, 23 bp, Homo sapiens
ggctgcatctgggattcccacca

SEQ ID NO: 2566365 - DNA, 17 bp, Homo sapiens
ggctgccaaggccagag

SEQ ID NO: 2566366 - DNA, 18 bp, Homo sapiens
ggctgccatgtgaagagg

SEQ ID NO: 2566367 - DNA, 19 bp, Homo sapiens
ggctgcccccggccccctg

SEQ ID NO: 2566368 - DNA, 15 bp, Homo sapiens
ggctgccctggccct

SEQ ID NO: 2566369 - DNA, 16 bp, Homo sapiens
ggctgccctggccctg

SEQ ID NO: 2566370 - DNA, 22 bp, Homo sapiens
ggctgccctggccctgaggtgt

SEQ ID NO: 2566371 - DNA, 17 bp, Homo sapiens
ggctgcctgggctgttg

SEQ ID NO: 2566372 - DNA, 18 bp, Homo sapiens
ggctgctgaaggctcgag

SEQ ID NO: 2566373 - DNA, 16 bp, Homo sapiens
ggctgctgacctccac

SEQ ID NO: 2566374 - DNA, 21 bp, Homo sapiens
ggctgctgacctccacagctt

SEQ ID NO: 2566375 - DNA, 14 bp, Homo sapiens
ggctgctgcccagg

SEQ ID NO: 2566376 - DNA, 13 bp, Homo sapiens
ggctgctggcctg

SEQ ID NO: 2566377 - DNA, 18 bp, Homo sapiens
ggctgctggcgcctctgc

SEQ ID NO: 2566378 - DNA, 15 bp, Homo sapiens
ggctgctgtgtgcct

SEQ ID NO: 2566379 - DNA, 22 bp, Homo sapiens
ggctggaacagattcacactgt

SEQ ID NO: 2566380 - DNA, 16 bp, Homo sapiens
ggctggaatctggaga

SEQ ID NO: 2566381 - DNA, 20 bp, Homo sapiens
ggctggaatctggagagcta

SEQ ID NO: 2566382 - DNA, 15 bp, Homo sapiens
ggctggacgtggtgg

SEQ ID NO: 2566383 - DNA, 19 bp, Homo sapiens
ggctggagaccatgcagag

SEQ ID NO: 2566384 - DNA, 19 bp, Homo sapiens
ggctggagacgggtgggcg

SEQ ID NO: 2566385 - DNA, 13 bp, Homo sapiens
ggctggagctggc

SEQ ID NO: 2566386 - DNA, 15 bp, Homo sapiens
ggctggatgaaattt

SEQ ID NO: 2566387 - DNA, 15 bp, Homo sapiens
ggctggatgtggtgg

SEQ ID NO: 2566388 - DNA, 19 bp, Homo sapiens
ggctggatgtggtggcata

SEQ ID NO: 2566389 - DNA, 20 bp, Homo sapiens
ggctggcagctctccagtca

SEQ ID NO: 2566390 - DNA, 14 bp, Homo sapiens
ggctggcaggtatg

SEQ ID NO: 2566391 - DNA, 23 bp, Homo sapiens
ggctggccactgcacagagctct

SEQ ID NO: 2566392 - DNA, 16 bp, Homo sapiens
ggctggcccagccctg

SEQ ID NO: 2566393 - DNA, 21 bp, Homo sapiens
ggctggcccagccctgctggc

SEQ ID NO: 2566394 - DNA, 13 bp, Homo sapiens
ggctggcctggcc

SEQ ID NO: 2566395 - DNA, 13 bp, Homo sapiens
ggctggccttcct

SEQ ID NO: 2566396 - DNA, 14 bp, Homo sapiens
ggctggcgcagcca

SEQ ID NO: 2566397 - DNA, 17 bp, Homo sapiens
ggctggcgcagccaagg

SEQ ID NO: 2566398 - DNA, 20 bp, Homo sapiens
ggctggcgtgcagtggtgcg

SEQ ID NO: 2566399 - DNA, 14 bp, Homo sapiens
ggctggctgcagtg

SEQ ID NO: 2566400 - DNA, 16 bp, Homo sapiens
ggctgggatgggcctg

SEQ ID NO: 2566401 - DNA, 13 bp, Homo sapiens
ggctgggcttcag

SEQ ID NO: 2566402 - DNA, 17 bp, Homo sapiens
ggctgggcttcagtggc

SEQ ID NO: 2566403 - DNA, 21 bp, Homo sapiens
ggctgggcttcagtggcagct

SEQ ID NO: 2566404 - DNA, 22 bp, Homo sapiens
gattctcagggtctctgctgcc

SEQ ID NO: 2566405 - DNA, 23 bp, Homo sapiens
gattctcagggtctctgctgccg

SEQ ID NO: 2566406 - DNA, 15 bp, Homo sapiens
gattctcctgcctca

SEQ ID NO: 2566407 - DNA, 19 bp, Homo sapiens
gattctcctgcctcagcct

SEQ ID NO: 2566408 - DNA, 20 bp, Homo sapiens
gattctcctgcctcagcctc

SEQ ID NO: 2566409 - DNA, 20 bp, Homo sapiens
gattcttctgcttcagcctc

SEQ ID NO: 2566410 - DNA, 18 bp, Homo sapiens
gattctttcctgaggctg

SEQ ID NO: 2566411 - DNA, 20 bp, Homo sapiens
gattctttttaaagtgtttc

SEQ ID NO: 2566412 - DNA, 15 bp, Homo sapiens
gattgaaaacttttc

SEQ ID NO: 2566413 - DNA, 23 bp, Homo sapiens
gattgacgggactgttggtattg

SEQ ID NO: 2566414 - DNA, 13 bp, Homo sapiens
gattgaggcctgc

SEQ ID NO: 2566415 - DNA, 23 bp, Homo sapiens
gattgcaccactgcactccagcc

SEQ ID NO: 2566416 - DNA, 23 bp, Homo sapiens
gattgcaggagtccctgccatca

SEQ ID NO: 2566417 - DNA, 22 bp, Homo sapiens
gattgcgtggaattgtgctgag

SEQ ID NO: 2566418 - DNA, 15 bp, Homo sapiens
gattgctatgaatga

SEQ ID NO: 2566419 - DNA, 18 bp, Homo sapiens
gattgcttaaaatagcaa

SEQ ID NO: 2566420 - DNA, 16 bp, Homo sapiens
gattggacggcctgat

SEQ ID NO: 2566421 - DNA, 22 bp, Homo sapiens
gattggatacgcatcagacaga

SEQ ID NO: 2566422 - DNA, 14 bp, Homo sapiens
gattggattattca

SEQ ID NO: 2566423 - DNA, 15 bp, Homo sapiens
gattggattattcat

SEQ ID NO: 2566424 - DNA, 20 bp, Homo sapiens
gattggattattcatttaaa

SEQ ID NO: 2566425 - DNA, 13 bp, Homo sapiens
gattggattattt

SEQ ID NO: 2566426 - DNA, 22 bp, Homo sapiens
gattggctcacccaagcaaggc

SEQ ID NO: 2566427 - DNA, 18 bp, Homo sapiens
gattggcttgtgtgtttc

SEQ ID NO: 2566428 - DNA, 17 bp, Homo sapiens
gattgggggctggtgcc

SEQ ID NO: 2566429 - DNA, 20 bp, Homo sapiens
gattgtaaaatagcttgtat

SEQ ID NO: 2566430 - DNA, 19 bp, Homo sapiens
gattgtaacgttgctgtgg

SEQ ID NO: 2566431 - DNA, 13 bp, Homo sapiens
gatttaacagaaa

SEQ ID NO: 2566432 - DNA, 15 bp, Homo sapiens
gatttaacagaaatg

SEQ ID NO: 2566433 - DNA, 16 bp, Homo sapiens
gatttaacagaaatgt

SEQ ID NO: 2566434 - DNA, 17 bp, Homo sapiens
gatttaacagtcattta

SEQ ID NO: 2566435 - DNA, 22 bp, Homo sapiens
gatttaagggatggaaaaggaa

SEQ ID NO: 2566436 - DNA, 14 bp, Homo sapiens
gatttaataaaata

SEQ ID NO: 2566437 - DNA, 14 bp, Homo sapiens
gatttaatagtgtt

SEQ ID NO: 2566438 - DNA, 15 bp, Homo sapiens
gatttaatagtgtta

SEQ ID NO: 2566439 - DNA, 12 bp, Homo sapiens
gatttaattctc

SEQ ID NO: 2566440 - DNA, 18 bp, Homo sapiens
gatttatttcatcatatt

SEQ ID NO: 2566441 - DNA, 20 bp, Homo sapiens
gatttcaggatactctgtca

SEQ ID NO: 2566442 - DNA, 18 bp, Homo sapiens
gatttcatgctatctctg

SEQ ID NO: 2566443 - DNA, 19 bp, Homo sapiens
gatttccagccagggctgc

SEQ ID NO: 2566444 - DNA, 23 bp, Homo sapiens
gatttctagaaagcctgttcccc

SEQ ID NO: 2566445 - DNA, 11 bp, Homo sapiens
gatttctgttt

SEQ ID NO: 2566446 - DNA, 11 bp, Homo sapiens
gatttctttcc

SEQ ID NO: 2566447 - DNA, 13 bp, Homo sapiens
gatttgaactcag

SEQ ID NO: 2566448 - DNA, 13 bp, Homo sapiens
gatttgactgttt

SEQ ID NO: 2566449 - DNA, 18 bp, Homo sapiens
gatttgactgtttttacc

SEQ ID NO: 2566450 - DNA, 15 bp, Homo sapiens
gatttgatgctggag

SEQ ID NO: 2566451 - DNA, 12 bp, Homo sapiens
gatttggaaaaa

SEQ ID NO: 2566452 - DNA, 20 bp, Homo sapiens
gattttaacaaaagcaagac

SEQ ID NO: 2566453 - DNA, 15 bp, Homo sapiens
gattttaacaataac

SEQ ID NO: 2566454 - DNA, 23 bp, Homo sapiens
gattttaacaataactactgtgt

SEQ ID NO: 2566455 - DNA, 13 bp, Homo sapiens
gattttaattttg

SEQ ID NO: 2566456 - DNA, 22 bp, Homo sapiens
gattttatctttcgcacagcag

SEQ ID NO: 2566457 - DNA, 19 bp, Homo sapiens
gattttcaaagctttttcc

SEQ ID NO: 2566458 - DNA, 17 bp, Homo sapiens
gattttctattgttact

SEQ ID NO: 2566459 - DNA, 22 bp, Homo sapiens
gattttctattgttactctggt

SEQ ID NO: 2566460 - DNA, 24 bp, Homo sapiens
gattttctttaaaagaatgggcag

SEQ ID NO: 2566461 - DNA, 13 bp, Homo sapiens
gattttgcctgtg

SEQ ID NO: 2566462 - DNA, 16 bp, Homo sapiens
gattttgctgtagaag

SEQ ID NO: 2566463 - DNA, 12 bp, Homo sapiens
gatttttctcaa

SEQ ID NO: 2566464 - DNA, 15 bp, Homo sapiens
gatttttgtaagaca

SEQ ID NO: 2566465 - DNA, 15 bp, Homo sapiens
gatttttgtcttgtg

SEQ ID NO: 2566466 - DNA, 20 bp, Homo sapiens
gattttttacagctgcctgc

SEQ ID NO: 2566467 - DNA, 22 bp, Homo sapiens
gcaaaacagcgtttaagactgt

SEQ ID NO: 2566468 - DNA, 16 bp, Homo sapiens
gcaaaagactaattta

SEQ ID NO: 2566469 - DNA, 15 bp, Homo sapiens
gcaaaagatgcttct

SEQ ID NO: 2566470 - DNA, 17 bp, Homo sapiens
gcaaaagatgcttctca

SEQ ID NO: 2566471 - DNA, 13 bp, Homo sapiens
gcaaaataatttt

SEQ ID NO: 2566472 - DNA, 20 bp, Homo sapiens
gcaaaatcatggaatggtta

SEQ ID NO: 2566473 - DNA, 16 bp, Homo sapiens
gcaaaattcccaggga

SEQ ID NO: 2566474 - DNA, 10 bp, Homo sapiens
gcaaaatttc

SEQ ID NO: 2566475 - DNA, 20 bp, Homo sapiens
gcaaaatttgatgccaggac

SEQ ID NO: 2566476 - DNA, 21 bp, Homo sapiens
gcaaaatttgatgccaggaca

SEQ ID NO: 2566477 - DNA, 16 bp, Homo sapiens
gcaaaattttatagct

SEQ ID NO: 2566478 - DNA, 17 bp, Homo sapiens
gcaaacacacaaaggta

SEQ ID NO: 2566479 - DNA, 15 bp, Homo sapiens
gcaaaccacactgga

SEQ ID NO: 2566480 - DNA, 18 bp, Homo sapiens
gcaaaccacactggactc

SEQ ID NO: 2566481 - DNA, 20 bp, Homo sapiens
gcaaaccacactggactccg

SEQ ID NO: 2566482 - DNA, 19 bp, Homo sapiens
gcaaacccatcaacaaaaa

SEQ ID NO: 2566483 - DNA, 19 bp, Homo sapiens
gcaaactaagcccccgctg

SEQ ID NO: 2566484 - DNA, 23 bp, Homo sapiens
gcaaacttggaatttgtaacctc

SEQ ID NO: 2566485 - DNA, 15 bp, Homo sapiens
gcaaagacagaagcc

SEQ ID NO: 2566486 - DNA, 16 bp, Homo sapiens
gcaaagacagaagcct

SEQ ID NO: 2566487 - DNA, 17 bp, Homo sapiens
gcaaagacagaagcctc

SEQ ID NO: 2566488 - DNA, 18 bp, Homo sapiens
gcaaagaggcaagaggct

SEQ ID NO: 2566489 - DNA, 12 bp, Homo sapiens
gcaaagatcaaa

SEQ ID NO: 2566490 - DNA, 22 bp, Homo sapiens
gcaaagcaccagcttctccagg

SEQ ID NO: 2566491 - DNA, 23 bp, Homo sapiens
gcaaaggactgttttttcctgag

SEQ ID NO: 2566492 - DNA, 17 bp, Homo sapiens
gcaaagggagcagaact

SEQ ID NO: 2566493 - DNA, 18 bp, Homo sapiens
gcaaagggagcagaactg

SEQ ID NO: 2566494 - DNA, 20 bp, Homo sapiens
gcaaaggggctgaaagaaca

SEQ ID NO: 2566495 - DNA, 18 bp, Homo sapiens
gcaaaggtggctctccag

SEQ ID NO: 2566496 - DNA, 21 bp, Homo sapiens
gcaaagtcatgcaaaggctgg

SEQ ID NO: 2566497 - DNA, 23 bp, Homo sapiens
gcaaagtcatgcaaaggctggga

SEQ ID NO: 2566498 - DNA, 23 bp, Homo sapiens
gcaaagttccctacttcctgtga

SEQ ID NO: 2566499 - DNA, 15 bp, Homo sapiens
gcaaatcagaaactt

SEQ ID NO: 2566500 - DNA, 20 bp, Homo sapiens
gcaaatcagaaacttgtgaa

SEQ ID NO: 2566501 - DNA, 19 bp, Homo sapiens
gcaaatcctatgtgatttt

SEQ ID NO: 2566502 - DNA, 12 bp, Homo sapiens
gcaaatgacttt

SEQ ID NO: 2566503 - DNA, 13 bp, Homo sapiens
gcaaatgactttg

SEQ ID NO: 2566504 - DNA, 23 bp, Homo sapiens
gcaacacaagctggaagcacatg

SEQ ID NO: 2566505 - DNA, 17 bp, Homo sapiens
gcaacagtagcatagga

SEQ ID NO: 2566506 - DNA, 19 bp, Homo sapiens
gcaaccccagttctgctcc

SEQ ID NO: 2566507 - DNA, 21 bp, Homo sapiens
gcaaccccagttctgctcctc

SEQ ID NO: 2566508 - DNA, 24 bp, Homo sapiens
gcaaccccagttctgctcctctcc

SEQ ID NO: 2566509 - DNA, 17 bp, Homo sapiens
gcaacccccagcctgct

SEQ ID NO: 2566510 - DNA, 18 bp, Homo sapiens
gcaacccccagcctgcta

SEQ ID NO: 2566511 - DNA, 19 bp, Homo sapiens
gcaacctccgcctcttggg

SEQ ID NO: 2566512 - DNA, 20 bp, Homo sapiens
gcaacctccgcctcttgggt

SEQ ID NO: 2566513 - DNA, 14 bp, Homo sapiens
gcaacctgggtcca

SEQ ID NO: 2566514 - DNA, 18 bp, Homo sapiens
gcaacctgggtccaaata

SEQ ID NO: 2566515 - DNA, 13 bp, Homo sapiens
gcaactgaataaa

SEQ ID NO: 2566516 - DNA, 13 bp, Homo sapiens
gcaactgaggcag

SEQ ID NO: 2566517 - DNA, 14 bp, Homo sapiens
gcaactgaggcaga

SEQ ID NO: 2566518 - DNA, 15 bp, Homo sapiens
gcaactgaggcagac

SEQ ID NO: 2566519 - DNA, 19 bp, Homo sapiens
gcaactgaggcagacagca

SEQ ID NO: 2566520 - DNA, 22 bp, Homo sapiens
gcaactgaggcagacagcagct

SEQ ID NO: 2566521 - DNA, 18 bp, Homo sapiens
gcaactgcattggctttg

SEQ ID NO: 2566522 - DNA, 20 bp, Homo sapiens
gcaactgttatgaaataaag

SEQ ID NO: 2566523 - DNA, 21 bp, Homo sapiens
gcaactgttatgaaataaaga

SEQ ID NO: 2566524 - DNA, 19 bp, Homo sapiens
gcaacttgtctttttctgg

SEQ ID NO: 2566525 - DNA, 14 bp, Homo sapiens
gcaagaaggaattg

SEQ ID NO: 2566526 - DNA, 17 bp, Homo sapiens
gcaagaattgaagcagg

SEQ ID NO: 2566527 - DNA, 20 bp, Homo sapiens
gcaagagactctggcctcca

SEQ ID NO: 2566528 - DNA, 17 bp, Homo sapiens
gcaagaggggtggagac

SEQ ID NO: 2566529 - DNA, 13 bp, Homo sapiens
gcaagattgctta

SEQ ID NO: 2566530 - DNA, 15 bp, Homo sapiens
gcaagcacctcctgc

SEQ ID NO: 2566531 - DNA, 20 bp, Homo sapiens
gcaagcacctcctgcctcga

SEQ ID NO: 2566532 - DNA, 19 bp, Homo sapiens
gcaagctagaacctggagg

SEQ ID NO: 2566533 - DNA, 13 bp, Homo sapiens
gcaaggaaggaaa

SEQ ID NO: 2566534 - DNA, 14 bp, Homo sapiens
gcaaggaaggaaag

SEQ ID NO: 2566535 - DNA, 15 bp, Homo sapiens
gcaaggaccaggact

SEQ ID NO: 2566536 - DNA, 21 bp, Homo sapiens
gcaaggaccaggactccctcc

SEQ ID NO: 2566537 - DNA, 19 bp, Homo sapiens
gcaagggccatgctgaagg

SEQ ID NO: 2566538 - DNA, 14 bp, Homo sapiens
gcaagggtgatggg

SEQ ID NO: 2566539 - DNA, 14 bp, Homo sapiens
gcaaggtcattttt

SEQ ID NO: 2566540 - DNA, 14 bp, Homo sapiens
gcaaggtgctcaca

SEQ ID NO: 2566541 - DNA, 21 bp, Homo sapiens
gcaaggtgctcacaccccatt

SEQ ID NO: 2566542 - DNA, 23 bp, Homo sapiens
gcaagtatgttttagcatgtgtt

SEQ ID NO: 2566543 - DNA, 13 bp, Homo sapiens
gcaagtcagggtt

SEQ ID NO: 2566544 - DNA, 13 bp, Homo sapiens
gcaagtgagagct

SEQ ID NO: 2566545 - DNA, 13 bp, Homo sapiens
gcaagtgtgtgca

SEQ ID NO: 2566546 - DNA, 19 bp, Homo sapiens
gcaagtgtgtgcatgtgtg

SEQ ID NO: 2566547 - DNA, 21 bp, Homo sapiens
gcaagtgtgtgcatgtgtgcg

SEQ ID NO: 2566548 - DNA, 15 bp, Homo sapiens
gcactgcttccagtg

SEQ ID NO: 2566549 - DNA, 18 bp, Homo sapiens
gcactgcttccagtgagg

SEQ ID NO: 2566550 - DNA, 15 bp, Homo sapiens
gcactggagtgcagg

SEQ ID NO: 2566551 - DNA, 16 bp, Homo sapiens
gcactggagtgcaggg

SEQ ID NO: 2566552 - DNA, 11 bp, Homo sapiens
gcactggcctg

SEQ ID NO: 2566553 - DNA, 17 bp, Homo sapiens
gcactggctctctccag

SEQ ID NO: 2566554 - DNA, 19 bp, Homo sapiens
gcactggctctctccagga

SEQ ID NO: 2566555 - DNA, 18 bp, Homo sapiens
gcactggggagcccgtct

SEQ ID NO: 2566556 - DNA, 22 bp, Homo sapiens
gcactggggagcccgtctcagt

SEQ ID NO: 2566557 - DNA, 23 bp, Homo sapiens
gcactggggagcccgtctcagtg

SEQ ID NO: 2566558 - DNA, 16 bp, Homo sapiens
gcactgggggcagcgg

SEQ ID NO: 2566559 - DNA, 18 bp, Homo sapiens
gcactgggttgcagggga

SEQ ID NO: 2566560 - DNA, 21 bp, Homo sapiens
gcactgggttgcaggggattg

SEQ ID NO: 2566561 - DNA, 16 bp, Homo sapiens
gcactgtcactttgct

SEQ ID NO: 2566562 - DNA, 14 bp, Homo sapiens
gcactgtgctaata

SEQ ID NO: 2566563 - DNA, 16 bp, Homo sapiens
gcactgttccagcctg

SEQ ID NO: 2566564 - DNA, 17 bp, Homo sapiens
gcacttagctatcagaa

SEQ ID NO: 2566565 - DNA, 14 bp, Homo sapiens
gcacttcacagagt

SEQ ID NO: 2566566 - DNA, 22 bp, Homo sapiens
gcacttcgggaggtcgaggcag

SEQ ID NO: 2566567 - DNA, 22 bp, Homo sapiens
gcacttgcacgcccatgtgtga

SEQ ID NO: 2566568 - DNA, 16 bp, Homo sapiens
gcacttgcagactcta

SEQ ID NO: 2566569 - DNA, 14 bp, Homo sapiens
gcacttgcatctgt

SEQ ID NO: 2566570 - DNA, 22 bp, Homo sapiens
gcacttggagccaagggttcag

SEQ ID NO: 2566571 - DNA, 15 bp, Homo sapiens
gcacttgtatatacg

SEQ ID NO: 2566572 - DNA, 17 bp, Homo sapiens
gcactttcctcctggca

SEQ ID NO: 2566573 - DNA, 20 bp, Homo sapiens
gcactttctatcctctgtaa

SEQ ID NO: 2566574 - DNA, 16 bp, Homo sapiens
gcactttgggaggctg

SEQ ID NO: 2566575 - DNA, 21 bp, Homo sapiens
gcactttgggaggctgaggcg

SEQ ID NO: 2566576 - DNA, 22 bp, Homo sapiens
gcactttgttctggctcttcca

SEQ ID NO: 2566577 - DNA, 16 bp, Homo sapiens
gcactttttaattcac

SEQ ID NO: 2566578 - DNA, 20 bp, Homo sapiens
gcactttttcatttgcctat

SEQ ID NO: 2566579 - DNA, 20 bp, Homo sapiens
gcagaaagcaaaattatgtt

SEQ ID NO: 2566580 - DNA, 23 bp, Homo sapiens
gcagaaagcaaatgtgacctgtg

SEQ ID NO: 2566581 - DNA, 18 bp, Homo sapiens
gcagaaaggttctgcccg

SEQ ID NO: 2566582 - DNA, 14 bp, Homo sapiens
gcagaacactaacc

SEQ ID NO: 2566583 - DNA, 12 bp, Homo sapiens
gcagaacagtga

SEQ ID NO: 2566584 - DNA, 18 bp, Homo sapiens
gcagaacagtgattacca

SEQ ID NO: 2566585 - DNA, 14 bp, Homo sapiens
gcagaactgagctc

SEQ ID NO: 2566586 - DNA, 16 bp, Homo sapiens
gcagaactgagctcct

SEQ ID NO: 2566587 - DNA, 22 bp, Homo sapiens
gcagaagaatgggaatatttta

SEQ ID NO: 2566588 - DNA, 14 bp, Homo sapiens
gcagaagacaccag

SEQ ID NO: 2566589 - DNA, 14 bp, Homo sapiens
gcagaagacagtat

SEQ ID NO: 2566590 - DNA, 13 bp, Homo sapiens
gcagaagcattaa

SEQ ID NO: 2566591 - DNA, 23 bp, Homo sapiens
gcagaatcctaggctccacccca

SEQ ID NO: 2566592 - DNA, 17 bp, Homo sapiens
gcagaatcctggccctc

SEQ ID NO: 2566593 - DNA, 18 bp, Homo sapiens
gcagacagcagctcaggc

SEQ ID NO: 2566594 - DNA, 21 bp, Homo sapiens
gcagacagcagctcaggcaca

SEQ ID NO: 2566595 - DNA, 12 bp, Homo sapiens
gcagacaggacc

SEQ ID NO: 2566596 - DNA, 13 bp, Homo sapiens
gcagacaggacca

SEQ ID NO: 2566597 - DNA, 19 bp, Homo sapiens
gcagacaggcaagcacctc

SEQ ID NO: 2566598 - DNA, 23 bp, Homo sapiens
gcagacaggcaagcacctcctgc

SEQ ID NO: 2566599 - DNA, 21 bp, Homo sapiens
gcagaccaccccgcctgccct

SEQ ID NO: 2566600 - DNA, 14 bp, Homo sapiens
gcagacctgtcctc

SEQ ID NO: 2566601 - DNA, 15 bp, Homo sapiens
gcagactctacagag

SEQ ID NO: 2566602 - DNA, 17 bp, Homo sapiens
gcagactctacagaggc

SEQ ID NO: 2566603 - DNA, 22 bp, Homo sapiens
gcagactctacagaggccatgg

SEQ ID NO: 2566604 - DNA, 16 bp, Homo sapiens
gcagagaaagaagaga

SEQ ID NO: 2566605 - DNA, 20 bp, Homo sapiens
gcagagaatgaaagggccca

SEQ ID NO: 2566606 - DNA, 17 bp, Homo sapiens
gcagagacaggacctga

SEQ ID NO: 2566607 - DNA, 17 bp, Homo sapiens
gcagagaccatccctga

SEQ ID NO: 2566608 - DNA, 12 bp, Homo sapiens
gcagagacttgg

SEQ ID NO: 2566609 - DNA, 12 bp, Homo sapiens
gcagagagaagc

SEQ ID NO: 2566610 - DNA, 13 bp, Homo sapiens
gcagagagaagcc

SEQ ID NO: 2566611 - DNA, 15 bp, Homo sapiens
gcagagaggccaggt

SEQ ID NO: 2566612 - DNA, 22 bp, Homo sapiens
gcagagattggaatgggcagct

SEQ ID NO: 2566613 - DNA, 19 bp, Homo sapiens
gcagagcaccttagacagt

SEQ ID NO: 2566614 - DNA, 22 bp, Homo sapiens
gcagagcaccttagacagtccc

SEQ ID NO: 2566615 - DNA, 24 bp, Homo sapiens
gcagagcaccttagacagtccctg

SEQ ID NO: 2566616 - DNA, 19 bp, Homo sapiens
gcagagcagagaccatccc

SEQ ID NO: 2566617 - DNA, 20 bp, Homo sapiens
gcagagcagagaccatccct

SEQ ID NO: 2566618 - DNA, 14 bp, Homo sapiens
gcagagcaggggca

SEQ ID NO: 2566619 - DNA, 14 bp, Homo sapiens
gcagagctctgccg

SEQ ID NO: 2566620 - DNA, 17 bp, Homo sapiens
gcagagcttggactgga

SEQ ID NO: 2566621 - DNA, 12 bp, Homo sapiens
gcagaggcactg

SEQ ID NO: 2566622 - DNA, 12 bp, Homo sapiens
gcagaggggctt

SEQ ID NO: 2566623 - DNA, 16 bp, Homo sapiens
gcagaggggctttctg

SEQ ID NO: 2566624 - DNA, 21 bp, Homo sapiens
gcagaggggctttctggagag

SEQ ID NO: 2566625 - DNA, 23 bp, Homo sapiens
gcagaggtggccagagctgggag

SEQ ID NO: 2566626 - DNA, 23 bp, Homo sapiens
gcagaggttgcagtgagccgaga

SEQ ID NO: 2566627 - DNA, 22 bp, Homo sapiens
gcagagtcctgcacagttttct

SEQ ID NO: 2566628 - DNA, 18 bp, Homo sapiens
gcagataaacagtagtga

SEQ ID NO: 2566629 - DNA, 19 bp, Homo sapiens
gcagataatcagcctctta

SEQ ID NO: 2566630 - DNA, 22 bp, Homo sapiens
gcagatacaggaaaagctgctg

SEQ ID NO: 2566631 - DNA, 13 bp, Homo sapiens
gcagatgacaaaa

SEQ ID NO: 2566632 - DNA, 15 bp, Homo sapiens
gcagatgcaaagagg

SEQ ID NO: 2566633 - DNA, 18 bp, Homo sapiens
gcagatgcaaagaggcaa

SEQ ID NO: 2566634 - DNA, 22 bp, Homo sapiens
gcagatgcaaagaggcaagagg

SEQ ID NO: 2566635 - DNA, 17 bp, Homo sapiens
gcagattgaaaaggaca

SEQ ID NO: 2566636 - DNA, 16 bp, Homo sapiens
gcagcaataaagcagc

SEQ ID NO: 2566637 - DNA, 16 bp, Homo sapiens
gcagcactcacacagg

SEQ ID NO: 2566638 - DNA, 15 bp, Homo sapiens
gcagcagaggcactg

SEQ ID NO: 2566639 - DNA, 20 bp, Homo sapiens
gcagcagggctaccctgagc

SEQ ID NO: 2566640 - DNA, 18 bp, Homo sapiens
gcagcagtgaaaacaagt

SEQ ID NO: 2566641 - DNA, 19 bp, Homo sapiens
gcagcagtgtgaggccagg

SEQ ID NO: 2566642 - DNA, 23 bp, Homo sapiens
gcagcatattcaggaagctcagg

SEQ ID NO: 2566643 - DNA, 21 bp, Homo sapiens
gcagccaaacccatgaggcaa

SEQ ID NO: 2566644 - DNA, 23 bp, Homo sapiens
gcagccaaggccgaagctctggc

SEQ ID NO: 2566645 - DNA, 16 bp, Homo sapiens
gcagccacattcctga

SEQ ID NO: 2566646 - DNA, 18 bp, Homo sapiens
gcagccagctctcagcca

SEQ ID NO: 2566647 - DNA, 12 bp, Homo sapiens
gcagccaggcca

SEQ ID NO: 2566648 - DNA, 12 bp, Homo sapiens
gcagccaggctg

SEQ ID NO: 2566649 - DNA, 17 bp, Homo sapiens
gcagccaggctgccaag

SEQ ID NO: 2566650 - DNA, 17 bp, Homo sapiens
gcagcccaggccggggt

SEQ ID NO: 2566651 - DNA, 15 bp, Homo sapiens
gcagcccatgcccac

SEQ ID NO: 2566652 - DNA, 17 bp, Homo sapiens
gcagcccatgcccacct

SEQ ID NO: 2566653 - DNA, 21 bp, Homo sapiens
gcagccccattctgcctgccc

SEQ ID NO: 2566654 - DNA, 23 bp, Homo sapiens
gcagccccgcgcctccttccttg

SEQ ID NO: 2566655 - DNA, 21 bp, Homo sapiens
gcagcccgtgtggccccttca

SEQ ID NO: 2566656 - DNA, 17 bp, Homo sapiens
gcagccctagagcctgc

SEQ ID NO: 2566657 - DNA, 18 bp, Homo sapiens
gcagccctggagtcatgc

SEQ ID NO: 2566658 - DNA, 12 bp, Homo sapiens
gcagcccttgct

SEQ ID NO: 2566659 - DNA, 14 bp, Homo sapiens
gcagccgagctcgt

SEQ ID NO: 2566660 - DNA, 16 bp, Homo sapiens
gcagccgctgagcgag

SEQ ID NO: 2566661 - DNA, 20 bp, Homo sapiens
gcagcctcaacctcctgggc

SEQ ID NO: 2566662 - DNA, 22 bp, Homo sapiens
gcagcctcaacctcctgggcta

SEQ ID NO: 2566663 - DNA, 15 bp, Homo sapiens
gcagcctcacagtcc

SEQ ID NO: 2566664 - DNA, 14 bp, Homo sapiens
gcagcctccctctg

SEQ ID NO: 2566665 - DNA, 22 bp, Homo sapiens
gcagcctgtggcatctttgcct

SEQ ID NO: 2566666 - DNA, 15 bp, Homo sapiens
gcagccttggcaaac

SEQ ID NO: 2566667 - DNA, 17 bp, Homo sapiens
gcagcctttgcctcccc

SEQ ID NO: 2566668 - DNA, 18 bp, Homo sapiens
gcagcctttgcctccccg

SEQ ID NO: 2566669 - DNA, 13 bp, Homo sapiens
gcagcgaccaccc

SEQ ID NO: 2566670 - DNA, 15 bp, Homo sapiens
gcagcgaccacccct

SEQ ID NO: 2566671 - DNA, 16 bp, Homo sapiens
gcagcgaccgccccct

SEQ ID NO: 2566672 - DNA, 24 bp, Homo sapiens
gcagcgagttgtggaaagcctctg

SEQ ID NO: 2566673 - DNA, 21 bp, Homo sapiens
gcagcggggcgaagcccaggc

SEQ ID NO: 2566674 - DNA, 14 bp, Homo sapiens
gcagctcaaaggca

SEQ ID NO: 2566675 - DNA, 14 bp, Homo sapiens
gcagctcacctctc

SEQ ID NO: 2566676 - DNA, 16 bp, Homo sapiens
gcagctcacctctccc

SEQ ID NO: 2566677 - DNA, 14 bp, Homo sapiens
gcagctcagagagg

SEQ ID NO: 2566678 - DNA, 15 bp, Homo sapiens
gcagctcttgccctt

SEQ ID NO: 2566679 - DNA, 16 bp, Homo sapiens
gcagctgatacaaatt

SEQ ID NO: 2566680 - DNA, 14 bp, Homo sapiens
gcagctgccagaga

SEQ ID NO: 2566681 - DNA, 20 bp, Homo sapiens
gcagctgcttttgtctatgg

SEQ ID NO: 2566682 - DNA, 15 bp, Homo sapiens
gcagctggactaccc

SEQ ID NO: 2566683 - DNA, 19 bp, Homo sapiens
gcagctgggcccaaccctg

SEQ ID NO: 2566684 - DNA, 23 bp, Homo sapiens
gcagctgggcccaaccctgtctg

SEQ ID NO: 2566685 - DNA, 21 bp, Homo sapiens
gcagctgttttagttaaattt

SEQ ID NO: 2566686 - DNA, 15 bp, Homo sapiens
gcagcttattcacaa

SEQ ID NO: 2566687 - DNA, 14 bp, Homo sapiens
gcagcttcaccaga

SEQ ID NO: 2566688 - DNA, 19 bp, Homo sapiens
gcagcttgagggttgggct

SEQ ID NO: 2566689 - DNA, 21 bp, Homo sapiens
gcagcttgagggttgggctgg

SEQ ID NO: 2566690 - DNA, 12 bp, Homo sapiens
gcagcttgcccc

SEQ ID NO: 2566691 - DNA, 14 bp, Homo sapiens
gcagcttgccccgg

SEQ ID NO: 2566692 - DNA, 16 bp, Homo sapiens
gcatctccaggaaggc

SEQ ID NO: 2566693 - DNA, 12 bp, Homo sapiens
gcatctcccaga

SEQ ID NO: 2566694 - DNA, 21 bp, Homo sapiens
gcatctcccagataatgtgaa

SEQ ID NO: 2566695 - DNA, 21 bp, Homo sapiens
gcatctcttgaggccaggagt

SEQ ID NO: 2566696 - DNA, 14 bp, Homo sapiens
gcatctgcccctcc

SEQ ID NO: 2566697 - DNA, 18 bp, Homo sapiens
gcatctgctaataaaacc

SEQ ID NO: 2566698 - DNA, 20 bp, Homo sapiens
gcatctgggattcccaccaa

SEQ ID NO: 2566699 - DNA, 23 bp, Homo sapiens
gcatctgggattcccaccaaggt

SEQ ID NO: 2566700 - DNA, 17 bp, Homo sapiens
gcatctgggtagctgta

SEQ ID NO: 2566701 - DNA, 16 bp, Homo sapiens
gcatcttactgaaggt

SEQ ID NO: 2566702 - DNA, 19 bp, Homo sapiens
gcatcttctggagtctcca

SEQ ID NO: 2566703 - DNA, 23 bp, Homo sapiens
gcatcttctggagtctccagtgg

SEQ ID NO: 2566704 - DNA, 15 bp, Homo sapiens
gcatctttgccttgg

SEQ ID NO: 2566705 - DNA, 18 bp, Homo sapiens
gcatctttgccttgggct

SEQ ID NO: 2566706 - DNA, 22 bp, Homo sapiens
gcatctttgccttgggctgctc

SEQ ID NO: 2566707 - DNA, 13 bp, Homo sapiens
gcatgaaggtttc

SEQ ID NO: 2566708 - DNA, 18 bp, Homo sapiens
gcatgacaagccccaggc

SEQ ID NO: 2566709 - DNA, 21 bp, Homo sapiens
gcatgacaagccccaggcagg

SEQ ID NO: 2566710 - DNA, 21 bp, Homo sapiens
gcatgcactgttccccctgtg

SEQ ID NO: 2566711 - DNA, 17 bp, Homo sapiens
gcatgcctggatggggc

SEQ ID NO: 2566712 - DNA, 22 bp, Homo sapiens
gcatgcctggatggggctgcac

SEQ ID NO: 2566713 - DNA, 15 bp, Homo sapiens
gcatgcctgtgtgac

SEQ ID NO: 2566714 - DNA, 14 bp, Homo sapiens
gcatgcggcccagc

SEQ ID NO: 2566715 - DNA, 15 bp, Homo sapiens
gcatgcggcccagcc

SEQ ID NO: 2566716 - DNA, 20 bp, Homo sapiens
gcatgcggcccagcccggct

SEQ ID NO: 2566717 - DNA, 23 bp, Homo sapiens
gcatggaaattcccttcatctgg

SEQ ID NO: 2566718 - DNA, 15 bp, Homo sapiens
gcatggagaataaac

SEQ ID NO: 2566719 - DNA, 15 bp, Homo sapiens
gcatggagctggccg

SEQ ID NO: 2566720 - DNA, 17 bp, Homo sapiens
gcatggagtgtgtattg

SEQ ID NO: 2566721 - DNA, 20 bp, Homo sapiens
gcatggcacttgcatctgtg

SEQ ID NO: 2566722 - DNA, 18 bp, Homo sapiens
gcatggcatcacctccac

SEQ ID NO: 2566723 - DNA, 16 bp, Homo sapiens
gcatggccctggggtc

SEQ ID NO: 2566724 - DNA, 15 bp, Homo sapiens
gcatggctgtgagga

SEQ ID NO: 2566725 - DNA, 20 bp, Homo sapiens
gcatgggaaagccacctctc

SEQ ID NO: 2566726 - DNA, 13 bp, Homo sapiens
gcatgggcctggc

SEQ ID NO: 2566727 - DNA, 23 bp, Homo sapiens
gcatggggataaaggagaaggca

SEQ ID NO: 2566728 - DNA, 18 bp, Homo sapiens
gcatgtaccatttgcatg

SEQ ID NO: 2566729 - DNA, 15 bp, Homo sapiens
gcatgtatgtcttgg

SEQ ID NO: 2566730 - DNA, 15 bp, Homo sapiens
gcatgtgactctgaa

SEQ ID NO: 2566731 - DNA, 16 bp, Homo sapiens
gcatgtggcctgtggc

SEQ ID NO: 2566732 - DNA, 12 bp, Homo sapiens
gcatgtgtattt

SEQ ID NO: 2566733 - DNA, 20 bp, Homo sapiens
gcatgtgtatttccagtgca

SEQ ID NO: 2566734 - DNA, 15 bp, Homo sapiens
gcatgttctctgagg

SEQ ID NO: 2566735 - DNA, 21 bp, Homo sapiens
gcatgttctctgaggacacta

SEQ ID NO: 2566736 - DNA, 18 bp, Homo sapiens
gcatgttgagccaggcct

SEQ ID NO: 2566737 - DNA, 16 bp, Homo sapiens
gcatgttgctgaggag

SEQ ID NO: 2566738 - DNA, 15 bp, Homo sapiens
gcatgtttcatgttt

SEQ ID NO: 2566739 - DNA, 17 bp, Homo sapiens
gcatgtttgtgattgac

SEQ ID NO: 2566740 - DNA, 19 bp, Homo sapiens
gcatgttttccagctcctc

SEQ ID NO: 2566741 - DNA, 18 bp, Homo sapiens
gcattaactaatctattg

SEQ ID NO: 2566742 - DNA, 22 bp, Homo sapiens
gcattaactaatctattgggtt

SEQ ID NO: 2566743 - DNA, 16 bp, Homo sapiens
gcattacatttccaaa

SEQ ID NO: 2566744 - DNA, 17 bp, Homo sapiens
gcattacgtgagccagg

SEQ ID NO: 2566745 - DNA, 21 bp, Homo sapiens
gcattagaaatagacagtata

SEQ ID NO: 2566746 - DNA, 15 bp, Homo sapiens
gcattagaattattt

SEQ ID NO: 2566747 - DNA, 18 bp, Homo sapiens
gcattatatttgtaaatt

SEQ ID NO: 2566748 - DNA, 12 bp, Homo sapiens
gcattcacccag

SEQ ID NO: 2566749 - DNA, 19 bp, Homo sapiens
gcattcacccagacagctc

SEQ ID NO: 2566750 - DNA, 20 bp, Homo sapiens
gcattcacccagacagctcc

SEQ ID NO: 2566751 - DNA, 18 bp, Homo sapiens
gcattccaacaaagggtt

SEQ ID NO: 2566752 - DNA, 12 bp, Homo sapiens
gcattccccagg

SEQ ID NO: 2566753 - DNA, 14 bp, Homo sapiens
gcattccccaggag

SEQ ID NO: 2566754 - DNA, 15 bp, Homo sapiens
gcattccccaggagg

SEQ ID NO: 2566755 - DNA, 18 bp, Homo sapiens
gcattccccaggaggcca

SEQ ID NO: 2566756 - DNA, 21 bp, Homo sapiens
gcattccccaggaggccagcc

SEQ ID NO: 2566757 - DNA, 19 bp, Homo sapiens
gcattcctgatatgattta

SEQ ID NO: 2566758 - DNA, 15 bp, Homo sapiens
gcattccttctttga

SEQ ID NO: 2566759 - DNA, 22 bp, Homo sapiens
gcattctgccgtgtgccctcgg

SEQ ID NO: 2566760 - DNA, 18 bp, Homo sapiens
gcattctttctgtattga

SEQ ID NO: 2566761 - DNA, 21 bp, Homo sapiens
gcattgagaactgcatatgtt

SEQ ID NO: 2566762 - DNA, 16 bp, Homo sapiens
gcattgccaagggctt

SEQ ID NO: 2566763 - DNA, 13 bp, Homo sapiens
gcattgctggttc

SEQ ID NO: 2566764 - DNA, 16 bp, Homo sapiens
gcattgttgaggtggt

SEQ ID NO: 2566765 - DNA, 18 bp, Homo sapiens
gcattgtttgcttattgt

SEQ ID NO: 2566766 - DNA, 23 bp, Homo sapiens
gcattgtttgcttattgttccaa

SEQ ID NO: 2566767 - DNA, 16 bp, Homo sapiens
gcatttaaaagataca

SEQ ID NO: 2566768 - DNA, 18 bp, Homo sapiens
gcatttaaaagatacagt

SEQ ID NO: 2566769 - DNA, 15 bp, Homo sapiens
gcatttactttgtgt

SEQ ID NO: 2566770 - DNA, 19 bp, Homo sapiens
gcatttatggtcaacactt

SEQ ID NO: 2566771 - DNA, 13 bp, Homo sapiens
gcatttctctggg

SEQ ID NO: 2566772 - DNA, 13 bp, Homo sapiens
gcatttgagaaat

SEQ ID NO: 2566773 - DNA, 18 bp, Homo sapiens
gcatttgaggtctgttct

SEQ ID NO: 2566774 - DNA, 20 bp, Homo sapiens
gcatttgaggtctgttcttt

SEQ ID NO: 2566775 - DNA, 14 bp, Homo sapiens
gcatttgagtttat

SEQ ID NO: 2566776 - DNA, 17 bp, Homo sapiens
gcatttgctgaatacag

SEQ ID NO: 2566777 - DNA, 12 bp, Homo sapiens
gcattttattct

SEQ ID NO: 2566778 - DNA, 13 bp, Homo sapiens
gcattttgctatt

SEQ ID NO: 2566779 - DNA, 19 bp, Homo sapiens
gcattttgctattgtaaat

SEQ ID NO: 2566780 - DNA, 21 bp, Homo sapiens
gcatttttgatttatgcatgg

SEQ ID NO: 2566781 - DNA, 16 bp, Homo sapiens
gccaaaaaaagacagg

SEQ ID NO: 2566782 - DNA, 15 bp, Homo sapiens
gccaaaagctgctca

SEQ ID NO: 2566783 - DNA, 15 bp, Homo sapiens
gccaaaccctgtctg

SEQ ID NO: 2566784 - DNA, 17 bp, Homo sapiens
gccaaacctctgttcag

SEQ ID NO: 2566785 - DNA, 19 bp, Homo sapiens
gccaaagcctcctccagcc

SEQ ID NO: 2566786 - DNA, 22 bp, Homo sapiens
gccaaagctaggcctggccaga

SEQ ID NO: 2566787 - DNA, 23 bp, Homo sapiens
gccaaaggagggtcaggaaggat

SEQ ID NO: 2566788 - DNA, 16 bp, Homo sapiens
gccaaatgtaattgaa

SEQ ID NO: 2566789 - DNA, 18 bp, Homo sapiens
gccaaatgtaattgaata

SEQ ID NO: 2566790 - DNA, 19 bp, Homo sapiens
gccaaattatttgtgtaat

SEQ ID NO: 2566791 - DNA, 18 bp, Homo sapiens
gccaacaaagctgttgat

SEQ ID NO: 2566792 - DNA, 14 bp, Homo sapiens
gccaacaccaggga

SEQ ID NO: 2566793 - DNA, 19 bp, Homo sapiens
gccaacagaagcttccatt

SEQ ID NO: 2566794 - DNA, 20 bp, Homo sapiens
gccaacagtcaaaacagaga

SEQ ID NO: 2566795 - DNA, 20 bp, Homo sapiens
gccaacatcgtgaaaccctg

SEQ ID NO: 2566796 - DNA, 22 bp, Homo sapiens
gccaacatcgtgaaaccctgtc

SEQ ID NO: 2566797 - DNA, 15 bp, Homo sapiens
gccaacccctgtgga

SEQ ID NO: 2566798 - DNA, 23 bp, Homo sapiens
gccaacgacaaagccaaactctg

SEQ ID NO: 2566799 - DNA, 15 bp, Homo sapiens
gccaacttgagggcc

SEQ ID NO: 2566800 - DNA, 14 bp, Homo sapiens
gccaacttgtaaat

SEQ ID NO: 2566801 - DNA, 17 bp, Homo sapiens
gccaacttgtaaataca

SEQ ID NO: 2566802 - DNA, 16 bp, Homo sapiens
gccaagagcagaggca

SEQ ID NO: 2566803 - DNA, 18 bp, Homo sapiens
gccaagatcgcgccactg

SEQ ID NO: 2566804 - DNA, 13 bp, Homo sapiens
gccaagcaacctg

SEQ ID NO: 2566805 - DNA, 18 bp, Homo sapiens
gccaagcactgtgctcag

SEQ ID NO: 2566806 - DNA, 22 bp, Homo sapiens
gccaagccctccccatcccatg

SEQ ID NO: 2566807 - DNA, 23 bp, Homo sapiens
gccaagctcaggaccaggcaatg

SEQ ID NO: 2566808 - DNA, 17 bp, Homo sapiens
gccaagctccttgggag

SEQ ID NO: 2566809 - DNA, 20 bp, Homo sapiens
gccaaggccagagtggcctg

SEQ ID NO: 2566810 - DNA, 20 bp, Homo sapiens
gccaaggccgaagctctggc

SEQ ID NO: 2566811 - DNA, 19 bp, Homo sapiens
gccaaggctggagtgcagt

SEQ ID NO: 2566812 - DNA, 21 bp, Homo sapiens
gccaagggatgaaagagaagg

SEQ ID NO: 2566813 - DNA, 19 bp, Homo sapiens
gccaaggtgggctgagccc

SEQ ID NO: 2566814 - DNA, 22 bp, Homo sapiens
gccaaggtgggctgagccctgg

SEQ ID NO: 2566815 - DNA, 16 bp, Homo sapiens
gccaagtaagaaagtg

SEQ ID NO: 2566816 - DNA, 12 bp, Homo sapiens
gccaagtccaga

SEQ ID NO: 2566817 - DNA, 14 bp, Homo sapiens
gccaagtccagatt

SEQ ID NO: 2566818 - DNA, 15 bp, Homo sapiens
gaggcccttctctcc

SEQ ID NO: 2566819 - DNA, 20 bp, Homo sapiens
gaggcccttctctccagccc

SEQ ID NO: 2566820 - DNA, 21 bp, Homo sapiens
gaggcccttctctccagcccc

SEQ ID NO: 2566821 - DNA, 22 bp, Homo sapiens
gaggcccttctctccagcccct

SEQ ID NO: 2566822 - DNA, 23 bp, Homo sapiens
gaggcccttctctccagcccctg

SEQ ID NO: 2566823 - DNA, 24 bp, Homo sapiens
gaggcccttctctccagcccctgg

SEQ ID NO: 2566824 - DNA, 18 bp, Homo sapiens
gaggcctactcttccatc

SEQ ID NO: 2566825 - DNA, 22 bp, Homo sapiens
gaggcctctcattccagaggaa

SEQ ID NO: 2566826 - DNA, 24 bp, Homo sapiens
gaggcctcttggacctctgctctg

SEQ ID NO: 2566827 - DNA, 20 bp, Homo sapiens
gaggcctgaggatgagctgg

SEQ ID NO: 2566828 - DNA, 12 bp, Homo sapiens
gaggcctgcccg

SEQ ID NO: 2566829 - DNA, 18 bp, Homo sapiens
gaggcctggagtaacaca

SEQ ID NO: 2566830 - DNA, 14 bp, Homo sapiens
gaggccttctctga

SEQ ID NO: 2566831 - DNA, 15 bp, Homo sapiens
gaggccttgagaggc

SEQ ID NO: 2566832 - DNA, 20 bp, Homo sapiens
gaggcggagcttgcagtgag

SEQ ID NO: 2566833 - DNA, 15 bp, Homo sapiens
gaggcgggagaatca

SEQ ID NO: 2566834 - DNA, 15 bp, Homo sapiens
gaggcgggccagcca

SEQ ID NO: 2566835 - DNA, 17 bp, Homo sapiens
gaggcgggccagccagg

SEQ ID NO: 2566836 - DNA, 14 bp, Homo sapiens
gaggctccagaggg

SEQ ID NO: 2566837 - DNA, 16 bp, Homo sapiens
gaggctgaggcaagag

SEQ ID NO: 2566838 - DNA, 9 bp, Homo sapiens
gaggctgcc

SEQ ID NO: 2566839 - DNA, 21 bp, Homo sapiens
gaggctgcccccggccccctg

SEQ ID NO: 2566840 - DNA, 22 bp, Homo sapiens
gaggctgcccccggccccctgg

SEQ ID NO: 2566841 - DNA, 12 bp, Homo sapiens
gaggctggcagg

SEQ ID NO: 2566842 - DNA, 13 bp, Homo sapiens
gaggctggcaggt

SEQ ID NO: 2566843 - DNA, 22 bp, Homo sapiens
gaggctggtgctgtggccaggg

SEQ ID NO: 2566844 - DNA, 12 bp, Homo sapiens
gaggctgtagga

SEQ ID NO: 2566845 - DNA, 20 bp, Homo sapiens
gaggcttccagagagtcctc

SEQ ID NO: 2566846 - DNA, 15 bp, Homo sapiens
gaggcttgctgagag

SEQ ID NO: 2566847 - DNA, 15 bp, Homo sapiens
gaggcttggaaagca

SEQ ID NO: 2566848 - DNA, 18 bp, Homo sapiens
gaggcttgggaccgccag

SEQ ID NO: 2566849 - DNA, 17 bp, Homo sapiens
gaggcttgtcagagctg

SEQ ID NO: 2566850 - DNA, 18 bp, Homo sapiens
gagggaccaactgggccc

SEQ ID NO: 2566851 - DNA, 12 bp, Homo sapiens
gagggaccagcc

SEQ ID NO: 2566852 - DNA, 15 bp, Homo sapiens
gagggacgcctgggg

SEQ ID NO: 2566853 - DNA, 14 bp, Homo sapiens
gagggagaagcatg

SEQ ID NO: 2566854 - DNA, 12 bp, Homo sapiens
gagggagatgga

SEQ ID NO: 2566855 - DNA, 22 bp, Homo sapiens
gagggagcaagtccttcccttt

SEQ ID NO: 2566856 - DNA, 12 bp, Homo sapiens
gagggagcagac

SEQ ID NO: 2566857 - DNA, 15 bp, Homo sapiens
gagggagcttagcca

SEQ ID NO: 2566858 - DNA, 12 bp, Homo sapiens
gagggaggaggc

SEQ ID NO: 2566859 - DNA, 17 bp, Homo sapiens
gagggaggaggccacct

SEQ ID NO: 2566860 - DNA, 14 bp, Homo sapiens
gagggagggagggc

SEQ ID NO: 2566861 - DNA, 15 bp, Homo sapiens
gagggagggagggct

SEQ ID NO: 2566862 - DNA, 16 bp, Homo sapiens
gagggagggctccaga

SEQ ID NO: 2566863 - DNA, 20 bp, Homo sapiens
gagggagggctccagacaca

SEQ ID NO: 2566864 - DNA, 13 bp, Homo sapiens
gagggagggggct

SEQ ID NO: 2566865 - DNA, 15 bp, Homo sapiens
gagggaggtgtttaa

SEQ ID NO: 2566866 - DNA, 13 bp, Homo sapiens
gagggagtgacag

SEQ ID NO: 2566867 - DNA, 16 bp, Homo sapiens
gagggagtgacagagg

SEQ ID NO: 2566868 - DNA, 12 bp, Homo sapiens
gagggcacacac

SEQ ID NO: 2566869 - DNA, 21 bp, Homo sapiens
gagggcagaaaggttctgccc

SEQ ID NO: 2566870 - DNA, 22 bp, Homo sapiens
gagggcagaaaggttctgcccg

SEQ ID NO: 2566871 - DNA, 16 bp, Homo sapiens
gagggcagcagggcta

SEQ ID NO: 2566872 - DNA, 19 bp, Homo sapiens
gagggcagcagggctaccc

SEQ ID NO: 2566873 - DNA, 16 bp, Homo sapiens
gagggccacatgggag

SEQ ID NO: 2566874 - DNA, 16 bp, Homo sapiens
gagggccacgggtctg

SEQ ID NO: 2566875 - DNA, 15 bp, Homo sapiens
gagggcccagagcag

SEQ ID NO: 2566876 - DNA, 18 bp, Homo sapiens
gagggcccagagcaggaa

SEQ ID NO: 2566877 - DNA, 20 bp, Homo sapiens
gagggcccagagcaggaagc

SEQ ID NO: 2566878 - DNA, 13 bp, Homo sapiens
gagggcccaggca

SEQ ID NO: 2566879 - DNA, 17 bp, Homo sapiens
gagggcccctctgccca

SEQ ID NO: 2566880 - DNA, 17 bp, Homo sapiens
gagggccctgagctgag

SEQ ID NO: 2566881 - DNA, 12 bp, Homo sapiens
gagggccctggt

SEQ ID NO: 2566882 - DNA, 17 bp, Homo sapiens
gagggccgtaccccacc

SEQ ID NO: 2566883 - DNA, 18 bp, Homo sapiens
gagggccgtaccccaccc

SEQ ID NO: 2566884 - DNA, 17 bp, Homo sapiens
gagggcctgcaagggag

SEQ ID NO: 2566885 - DNA, 23 bp, Homo sapiens
gagggcgaccccgtcacagcctc

SEQ ID NO: 2566886 - DNA, 19 bp, Homo sapiens
gagggctagaacctggaga

SEQ ID NO: 2566887 - DNA, 20 bp, Homo sapiens
gagggctagaacctggcagg

SEQ ID NO: 2566888 - DNA, 18 bp, Homo sapiens
gagggctagaactggaga

SEQ ID NO: 2566889 - DNA, 18 bp, Homo sapiens
gagggctagaatctggag

SEQ ID NO: 2566890 - DNA, 21 bp, Homo sapiens
gagggctagaatctggagagc

SEQ ID NO: 2566891 - DNA, 12 bp, Homo sapiens
gagggctccaga

SEQ ID NO: 2566892 - DNA, 21 bp, Homo sapiens
gagggctggaatctggagagc

SEQ ID NO: 2566893 - DNA, 14 bp, Homo sapiens
gaggggaagggcca

SEQ ID NO: 2566894 - DNA, 18 bp, Homo sapiens
gaggggaataatagaaga

SEQ ID NO: 2566895 - DNA, 19 bp, Homo sapiens
gaggggaataatagaagaa

SEQ ID NO: 2566896 - DNA, 19 bp, Homo sapiens
gaggggacaaaacccacct

SEQ ID NO: 2566897 - DNA, 15 bp, Homo sapiens
gaggggcagcccttg

SEQ ID NO: 2566898 - DNA, 16 bp, Homo sapiens
gaggggcagcccttgc

SEQ ID NO: 2566899 - DNA, 16 bp, Homo sapiens
gaggggcgctggccca

SEQ ID NO: 2566900 - DNA, 18 bp, Homo sapiens
gaggggcgctggcccagc

SEQ ID NO: 2566901 - DNA, 12 bp, Homo sapiens
gaggggctctca

SEQ ID NO: 2566902 - DNA, 16 bp, Homo sapiens
gatacagttactcaga

SEQ ID NO: 2566903 - DNA, 19 bp, Homo sapiens
gatacagttactcagaatt

SEQ ID NO: 2566904 - DNA, 23 bp, Homo sapiens
gatacagttactcagaattctct

SEQ ID NO: 2566905 - DNA, 12 bp, Homo sapiens
gatacatgtgcc

SEQ ID NO: 2566906 - DNA, 21 bp, Homo sapiens
gatacccccctctgtcttgtg

SEQ ID NO: 2566907 - DNA, 16 bp, Homo sapiens
gatacgcatcagacag

SEQ ID NO: 2566908 - DNA, 20 bp, Homo sapiens
gatactaaaagttcttctcc

SEQ ID NO: 2566909 - DNA, 11 bp, Homo sapiens
gatactacagt

SEQ ID NO: 2566910 - DNA, 20 bp, Homo sapiens
gatactggaagttttgcatt

SEQ ID NO: 2566911 - DNA, 17 bp, Homo sapiens
gatactgtatcatgaca

SEQ ID NO: 2566912 - DNA, 13 bp, Homo sapiens
gatagatgtgtgg

SEQ ID NO: 2566913 - DNA, 13 bp, Homo sapiens
gatagcagggcat

SEQ ID NO: 2566914 - DNA, 23 bp, Homo sapiens
gatagcatttttgatttatgcat

SEQ ID NO: 2566915 - DNA, 20 bp, Homo sapiens
gatagccttccgtaacccaa

SEQ ID NO: 2566916 - DNA, 16 bp, Homo sapiens
gatagctaacatttta

SEQ ID NO: 2566917 - DNA, 20 bp, Homo sapiens
gatagctaacattttaaata

SEQ ID NO: 2566918 - DNA, 22 bp, Homo sapiens
gatagctaacattttaaataaa

SEQ ID NO: 2566919 - DNA, 17 bp, Homo sapiens
gataggagcctgctggt

SEQ ID NO: 2566920 - DNA, 18 bp, Homo sapiens
gatagtagcatacattta

SEQ ID NO: 2566921 - DNA, 23 bp, Homo sapiens
gatagtgggcaccccactgcaat

SEQ ID NO: 2566922 - DNA, 17 bp, Homo sapiens
gatagttactgttgtga

SEQ ID NO: 2566923 - DNA, 18 bp, Homo sapiens
gatataaaagactgacca

SEQ ID NO: 2566924 - DNA, 13 bp, Homo sapiens
gatataaataaaa

SEQ ID NO: 2566925 - DNA, 15 bp, Homo sapiens
gatataaatggctgg

SEQ ID NO: 2566926 - DNA, 18 bp, Homo sapiens
gatatacacggatgactt

SEQ ID NO: 2566927 - DNA, 19 bp, Homo sapiens
gatatatgtttttgaaggc

SEQ ID NO: 2566928 - DNA, 23 bp, Homo sapiens
gatatattttacaattttttatc

SEQ ID NO: 2566929 - DNA, 17 bp, Homo sapiens
gatatatttttaagata

SEQ ID NO: 2566930 - DNA, 20 bp, Homo sapiens
gatatctgagggaggaggcc

SEQ ID NO: 2566931 - DNA, 14 bp, Homo sapiens
gatatgaaaaatat

SEQ ID NO: 2566932 - DNA, 14 bp, Homo sapiens
gatatgcttagtaa

SEQ ID NO: 2566933 - DNA, 16 bp, Homo sapiens
gatatgcttagtaatg

SEQ ID NO: 2566934 - DNA, 15 bp, Homo sapiens
gatatggagccctgt

SEQ ID NO: 2566935 - DNA, 15 bp, Homo sapiens
gatatggcagaagac

SEQ ID NO: 2566936 - DNA, 17 bp, Homo sapiens
gatatgggacatttttg

SEQ ID NO: 2566937 - DNA, 19 bp, Homo sapiens
gatatgtaaacataattct

SEQ ID NO: 2566938 - DNA, 16 bp, Homo sapiens
gatattaaaggagtta

SEQ ID NO: 2566939 - DNA, 15 bp, Homo sapiens
gatattattcttgta

SEQ ID NO: 2566940 - DNA, 19 bp, Homo sapiens
gatattccatgaatgtatc

SEQ ID NO: 2566941 - DNA, 22 bp, Homo sapiens
gatattgtcagagttctgctct

SEQ ID NO: 2566942 - DNA, 13 bp, Homo sapiens
gatatttatatat

SEQ ID NO: 2566943 - DNA, 23 bp, Homo sapiens
gatatttctatttcctggaatgg

SEQ ID NO: 2566944 - DNA, 18 bp, Homo sapiens
gatattttcaaattgtat

SEQ ID NO: 2566945 - DNA, 18 bp, Homo sapiens
gatatttttccatttttt

SEQ ID NO: 2566946 - DNA, 17 bp, Homo sapiens
gatatttttttcttttc

SEQ ID NO: 2566947 - DNA, 23 bp, Homo sapiens
gatcaaaaggttaataaagtaat

SEQ ID NO: 2566948 - DNA, 20 bp, Homo sapiens
gatcaaaataaaaagtgaca

SEQ ID NO: 2566949 - DNA, 17 bp, Homo sapiens
gatcaaaggcacacagc

SEQ ID NO: 2566950 - DNA, 14 bp, Homo sapiens
gatcaagaaagtgt

SEQ ID NO: 2566951 - DNA, 16 bp, Homo sapiens
gatcaaggagaggagg

SEQ ID NO: 2566952 - DNA, 19 bp, Homo sapiens
gatcaataaaatgtgattt

SEQ ID NO: 2566953 - DNA, 21 bp, Homo sapiens
gatcaataaaatgtgattttt

SEQ ID NO: 2566954 - DNA, 12 bp, Homo sapiens
gatcaatgacag

SEQ ID NO: 2566955 - DNA, 14 bp, Homo sapiens
gatcaatgacagag

SEQ ID NO: 2566956 - DNA, 19 bp, Homo sapiens
gatcacagagacattcctc

SEQ ID NO: 2566957 - DNA, 14 bp, Homo sapiens
gatcacagcctctg

SEQ ID NO: 2566958 - DNA, 17 bp, Homo sapiens
gatcacagctgctttct

SEQ ID NO: 2566959 - DNA, 20 bp, Homo sapiens
gatcacagctgctttctgtt

SEQ ID NO: 2566960 - DNA, 22 bp, Homo sapiens
gatcaccagcccggcctgctcc

SEQ ID NO: 2566961 - DNA, 23 bp, Homo sapiens
gatcacgccactgcactccagcc

SEQ ID NO: 2566962 - DNA, 12 bp, Homo sapiens
gatcacggctca

SEQ ID NO: 2566963 - DNA, 23 bp, Homo sapiens
gatcacggctcactgcagcctca

SEQ ID NO: 2566964 - DNA, 12 bp, Homo sapiens
gatcactactgc

SEQ ID NO: 2566965 - DNA, 14 bp, Homo sapiens
gatcactactgcag

SEQ ID NO: 2566966 - DNA, 22 bp, Homo sapiens
gatcagaccttggatcagatga

SEQ ID NO: 2566967 - DNA, 18 bp, Homo sapiens
gatcagttataagtagca

SEQ ID NO: 2566968 - DNA, 13 bp, Homo sapiens
gatcatccactgt

SEQ ID NO: 2566969 - DNA, 13 bp, Homo sapiens
gatcatgcattgt

SEQ ID NO: 2566970 - DNA, 14 bp, Homo sapiens
gatcatgcattgtt

SEQ ID NO: 2566971 - DNA, 21 bp, Homo sapiens
gatcatggtgtaataagacat

SEQ ID NO: 2566972 - DNA, 18 bp, Homo sapiens
gatcatttgttggaatga

SEQ ID NO: 2566973 - DNA, 15 bp, Homo sapiens
gatcattttcccccc

SEQ ID NO: 2566974 - DNA, 16 bp, Homo sapiens
gatccaagctggtccc

SEQ ID NO: 2566975 - DNA, 17 bp, Homo sapiens
gatccaagctggtccca

SEQ ID NO: 2566976 - DNA, 14 bp, Homo sapiens
gatccacacacaga

SEQ ID NO: 2566977 - DNA, 19 bp, Homo sapiens
gatccacacacagaggaag

SEQ ID NO: 2566978 - DNA, 22 bp, Homo sapiens
gatccacccacctcagcctccc

SEQ ID NO: 2566979 - DNA, 19 bp, Homo sapiens
gacttcttttcacattctt

SEQ ID NO: 2566980 - DNA, 21 bp, Homo sapiens
gacttcttttcacattcttat

SEQ ID NO: 2566981 - DNA, 22 bp, Homo sapiens
gacttcttttcacattcttata

SEQ ID NO: 2566982 - DNA, 13 bp, Homo sapiens
gacttgaaagcat

SEQ ID NO: 2566983 - DNA, 14 bp, Homo sapiens
gacttgaaagcatc

SEQ ID NO: 2566984 - DNA, 13 bp, Homo sapiens
gacttgcattttt

SEQ ID NO: 2566985 - DNA, 19 bp, Homo sapiens
gacttggcaacagaagcag

SEQ ID NO: 2566986 - DNA, 20 bp, Homo sapiens
gacttggggagatggagttc

SEQ ID NO: 2566987 - DNA, 16 bp, Homo sapiens
gacttggtcaccagct

SEQ ID NO: 2566988 - DNA, 19 bp, Homo sapiens
gacttgtatatttgtacaa

SEQ ID NO: 2566989 - DNA, 13 bp, Homo sapiens
gacttgtgtctct

SEQ ID NO: 2566990 - DNA, 16 bp, Homo sapiens
gacttgtgtctctgtg

SEQ ID NO: 2566991 - DNA, 23 bp, Homo sapiens
gactttctcagcctctgaatatg

SEQ ID NO: 2566992 - DNA, 19 bp, Homo sapiens
gactttggctgcatgcgag

SEQ ID NO: 2566993 - DNA, 13 bp, Homo sapiens
gactttgtgatcc

SEQ ID NO: 2566994 - DNA, 19 bp, Homo sapiens
gacttttccaaccctcatc

SEQ ID NO: 2566995 - DNA, 20 bp, Homo sapiens
gacttttccaaccctcatca

SEQ ID NO: 2566996 - DNA, 17 bp, Homo sapiens
gagaaaaagctcctgtc

SEQ ID NO: 2566997 - DNA, 21 bp, Homo sapiens
gagaaaacgtcttgcttggga

SEQ ID NO: 2566998 - DNA, 9 bp, Homo sapiens
gagaaaaga

SEQ ID NO: 2566999 - DNA, 10 bp, Homo sapiens
gagaaaagaa

SEQ ID NO: 2567000 - DNA, 19 bp, Homo sapiens
gagaaaagaaaaaaaaaga

SEQ ID NO: 2567001 - DNA, 12 bp, Homo sapiens
gagaaaataaaa

SEQ ID NO: 2567002 - DNA, 14 bp, Homo sapiens
gagaaacagagaca

SEQ ID NO: 2567003 - DNA, 23 bp, Homo sapiens
gagaaaccttattgtacctctct

SEQ ID NO: 2567004 - DNA, 15 bp, Homo sapiens
gagaaagactattca

SEQ ID NO: 2567005 - DNA, 18 bp, Homo sapiens
gagaaagactattcaaac

SEQ ID NO: 2567006 - DNA, 16 bp, Homo sapiens
gagaaaggttgaagca

SEQ ID NO: 2567007 - DNA, 12 bp, Homo sapiens
gagaaatgcata

SEQ ID NO: 2567008 - DNA, 20 bp, Homo sapiens
gagaaccctgcgtggggaca

SEQ ID NO: 2567009 - DNA, 18 bp, Homo sapiens
gagaacctaagtttcagt

SEQ ID NO: 2567010 - DNA, 19 bp, Homo sapiens
gagaacctggagttcctga

SEQ ID NO: 2567011 - DNA, 15 bp, Homo sapiens
gagaacgcagcccta

SEQ ID NO: 2567012 - DNA, 24 bp, Homo sapiens
gagaacgcagccctagagcctgcc

SEQ ID NO: 2567013 - DNA, 19 bp, Homo sapiens
gagaactagaacctggagg

SEQ ID NO: 2567014 - DNA, 23 bp, Homo sapiens
gagaactcatccctaatgctgca

SEQ ID NO: 2567015 - DNA, 15 bp, Homo sapiens
gagaagacaaaatta

SEQ ID NO: 2567016 - DNA, 13 bp, Homo sapiens
gagaagagctgtt

SEQ ID NO: 2567017 - DNA, 21 bp, Homo sapiens
gagaagaggctggtgctgtgg

SEQ ID NO: 2567018 - DNA, 15 bp, Homo sapiens
gagaagagggcctgt

SEQ ID NO: 2567019 - DNA, 12 bp, Homo sapiens
gagaagcactgt

SEQ ID NO: 2567020 - DNA, 15 bp, Homo sapiens
gagaagcggctggca

SEQ ID NO: 2567021 - DNA, 17 bp, Homo sapiens
gagaagctcccaggaac

SEQ ID NO: 2567022 - DNA, 12 bp, Homo sapiens
gagaaggaagcc

SEQ ID NO: 2567023 - DNA, 11 bp, Homo sapiens
gagaaggagcc

SEQ ID NO: 2567024 - DNA, 23 bp, Homo sapiens
gagaagtcttagacttgaaatac

SEQ ID NO: 2567025 - DNA, 23 bp, Homo sapiens
gagaagtgacagggaagctacag

SEQ ID NO: 2567026 - DNA, 23 bp, Homo sapiens
gagaagtgcccctgctgcctccc

SEQ ID NO: 2567027 - DNA, 17 bp, Homo sapiens
gagaagtttctggccct

SEQ ID NO: 2567028 - DNA, 14 bp, Homo sapiens
gagaatcacttgaa

SEQ ID NO: 2567029 - DNA, 17 bp, Homo sapiens
gagaatgagggccaaga

SEQ ID NO: 2567030 - DNA, 16 bp, Homo sapiens
gagaattcttacatgt

SEQ ID NO: 2567031 - DNA, 22 bp, Homo sapiens
gagaattcttacatgttttctt

SEQ ID NO: 2567032 - DNA, 17 bp, Homo sapiens
gagaattgggattacat

SEQ ID NO: 2567033 - DNA, 17 bp, Homo sapiens
gagacacttgccttctt

SEQ ID NO: 2567034 - DNA, 14 bp, Homo sapiens
gagacagagctggt

SEQ ID NO: 2567035 - DNA, 19 bp, Homo sapiens
gagacagagttttcactct

SEQ ID NO: 2567036 - DNA, 14 bp, Homo sapiens
gagacagcccgggc

SEQ ID NO: 2567037 - DNA, 18 bp, Homo sapiens
gagacagcccgggctctg

SEQ ID NO: 2567038 - DNA, 20 bp, Homo sapiens
gagacagcccgggctctgcc

SEQ ID NO: 2567039 - DNA, 24 bp, Homo sapiens
gagacagcccgggctctgcctccc

SEQ ID NO: 2567040 - DNA, 18 bp, Homo sapiens
gagacagctctgcatact

SEQ ID NO: 2567041 - DNA, 20 bp, Homo sapiens
gagacagctctgcatactca

SEQ ID NO: 2567042 - DNA, 12 bp, Homo sapiens
gagacaggaagg

SEQ ID NO: 2567043 - DNA, 17 bp, Homo sapiens
gagacagtgatctccat

SEQ ID NO: 2567044 - DNA, 14 bp, Homo sapiens
gagacagtgggaaa

SEQ ID NO: 2567045 - DNA, 15 bp, Homo sapiens
gagacagtgggaaat

SEQ ID NO: 2567046 - DNA, 16 bp, Homo sapiens
gagacagtgggaaata

SEQ ID NO: 2567047 - DNA, 21 bp, Homo sapiens
gagacagtttcttagcttttt

SEQ ID NO: 2567048 - DNA, 18 bp, Homo sapiens
gagaccaaggcgggagca

SEQ ID NO: 2567049 - DNA, 14 bp, Homo sapiens
gagaccagcctggc

SEQ ID NO: 2567050 - DNA, 19 bp, Homo sapiens
gagaccagcctgggcagca

SEQ ID NO: 2567051 - DNA, 17 bp, Homo sapiens
gagaccaggagggcact

SEQ ID NO: 2567052 - DNA, 14 bp, Homo sapiens
gagaccaggcaaag

SEQ ID NO: 2567053 - DNA, 20 bp, Homo sapiens
gagaccagttgggagcactg

SEQ ID NO: 2567054 - DNA, 22 bp, Homo sapiens
gagaccagttgggagcactgga

SEQ ID NO: 2567055 - DNA, 18 bp, Homo sapiens
gagaccatccctgaaggc

SEQ ID NO: 2567056 - DNA, 21 bp, Homo sapiens
gagaccatccctgaaggcccc

SEQ ID NO: 2567057 - DNA, 18 bp, Homo sapiens
gagaccatgcagagcgcc

SEQ ID NO: 2567058 - DNA, 13 bp, Homo sapiens
gagacccccacac

SEQ ID NO: 2567059 - DNA, 14 bp, Homo sapiens
gagacccccacacc

SEQ ID NO: 2567060 - DNA, 14 bp, Homo sapiens
gagacccctggcct

SEQ ID NO: 2567061 - DNA, 15 bp, Homo sapiens
gagacccctggcctc

SEQ ID NO: 2567062 - DNA, 17 bp, Homo sapiens
gagacccctggcctccg

SEQ ID NO: 2567063 - DNA, 14 bp, Homo sapiens
gagacctacctcag

SEQ ID NO: 2567064 - DNA, 17 bp, Homo sapiens
gagacctacctcaggtt

SEQ ID NO: 2567065 - DNA, 21 bp, Homo sapiens
gagacctacctcaggttgctg

SEQ ID NO: 2567066 - DNA, 18 bp, Homo sapiens
gagacctcatcaggatga

SEQ ID NO: 2567067 - DNA, 13 bp, Homo sapiens
gagacctcctgcc

SEQ ID NO: 2567068 - DNA, 15 bp, Homo sapiens
gagacctcctgcctc

SEQ ID NO: 2567069 - DNA, 14 bp, Homo sapiens
gagacggagtccca

SEQ ID NO: 2567070 - DNA, 15 bp, Homo sapiens
gagacggtcgagcag

SEQ ID NO: 2567071 - DNA, 15 bp, Homo sapiens
gagacgtgtacatag

SEQ ID NO: 2567072 - DNA, 16 bp, Homo sapiens
gagacgtgtacatagt

SEQ ID NO: 2567073 - DNA, 15 bp, Homo sapiens
gagactaagccctgt

SEQ ID NO: 2567074 - DNA, 16 bp, Homo sapiens
gagactaagccctgtc

SEQ ID NO: 2567075 - DNA, 22 bp, Homo sapiens
gagactaagccctgtcgagaca

SEQ ID NO: 2567076 - DNA, 18 bp, Homo sapiens
gagactccgtctcaagga

SEQ ID NO: 2567077 - DNA, 16 bp, Homo sapiens
gagactcctaggcagg

SEQ ID NO: 2567078 - DNA, 14 bp, Homo sapiens
gagactcctgcagg

SEQ ID NO: 2567079 - DNA, 17 bp, Homo sapiens
gagactcctgcaggcag

SEQ ID NO: 2567080 - DNA, 17 bp, Homo sapiens
gagactcctgccctgtt

SEQ ID NO: 2567081 - DNA, 19 bp, Homo sapiens
gagactgcgggatggtcct

SEQ ID NO: 2567082 - DNA, 23 bp, Homo sapiens
gagactgcttcccatcctaccct

SEQ ID NO: 2567083 - DNA, 13 bp, Homo sapiens
gagactgggaaga

SEQ ID NO: 2567084 - DNA, 14 bp, Homo sapiens
gagactgggctgag

SEQ ID NO: 2567085 - DNA, 21 bp, Homo sapiens
gagactgggctgagggagcct

SEQ ID NO: 2567086 - DNA, 13 bp, Homo sapiens
gagagaaaataaa

SEQ ID NO: 2567087 - DNA, 21 bp, Homo sapiens
gagagaaaataaaaagttaaa

SEQ ID NO: 2567088 - DNA, 22 bp, Homo sapiens
gagagaaagtgtgagcaaacta

SEQ ID NO: 2567089 - DNA, 21 bp, Homo sapiens
gagagaagtgcccctgctgcc

SEQ ID NO: 2567090 - DNA, 14 bp, Homo sapiens
gagagaccaggcaa

SEQ ID NO: 2567091 - DNA, 17 bp, Homo sapiens
gagagacctcatcagga

SEQ ID NO: 2567092 - DNA, 18 bp, Homo sapiens
gagagacctcatcaggat

SEQ ID NO: 2567093 - DNA, 17 bp, Homo sapiens
gacctgtaacttttgta

SEQ ID NO: 2567094 - DNA, 17 bp, Homo sapiens
gacctgtcatgcccccc

SEQ ID NO: 2567095 - DNA, 15 bp, Homo sapiens
gacctgtcctcctgg

SEQ ID NO: 2567096 - DNA, 19 bp, Homo sapiens
gacctgtcctcctggtggg

SEQ ID NO: 2567097 - DNA, 15 bp, Homo sapiens
gacctgtgaccagca

SEQ ID NO: 2567098 - DNA, 17 bp, Homo sapiens
gacctgtgaccagcact

SEQ ID NO: 2567099 - DNA, 20 bp, Homo sapiens
gacctgtggggatttctccc

SEQ ID NO: 2567100 - DNA, 22 bp, Homo sapiens
gaccttagtgtttctgtgcatg

SEQ ID NO: 2567101 - DNA, 23 bp, Homo sapiens
gaccttagtgtttctgtgcatgg

SEQ ID NO: 2567102 - DNA, 14 bp, Homo sapiens
gaccttatctgtgc

SEQ ID NO: 2567103 - DNA, 22 bp, Homo sapiens
gaccttatctgtgcgtgaaaca

SEQ ID NO: 2567104 - DNA, 19 bp, Homo sapiens
gaccttcaccaaacatact

SEQ ID NO: 2567105 - DNA, 16 bp, Homo sapiens
gaccttcctcgcagag

SEQ ID NO: 2567106 - DNA, 19 bp, Homo sapiens
gaccttcctcgcagagagg

SEQ ID NO: 2567107 - DNA, 16 bp, Homo sapiens
gaccttcctgccacca

SEQ ID NO: 2567108 - DNA, 23 bp, Homo sapiens
gaccttcctgccaccagtcactg

SEQ ID NO: 2567109 - DNA, 19 bp, Homo sapiens
gaccttgaagggtaaagaa

SEQ ID NO: 2567110 - DNA, 23 bp, Homo sapiens
gaccttgcaacttcatgtcaact

SEQ ID NO: 2567111 - DNA, 14 bp, Homo sapiens
gaccttgttgcatg

SEQ ID NO: 2567112 - DNA, 22 bp, Homo sapiens
gacctttagtggtggccattta

SEQ ID NO: 2567113 - DNA, 22 bp, Homo sapiens
gaccttttcaacttggcttcct

SEQ ID NO: 2567114 - DNA, 17 bp, Homo sapiens
gacgaggccctcgggcc

SEQ ID NO: 2567115 - DNA, 13 bp, Homo sapiens
gacgccatcccag

SEQ ID NO: 2567116 - DNA, 21 bp, Homo sapiens
gacgccggggacagaggcctg

SEQ ID NO: 2567117 - DNA, 20 bp, Homo sapiens
gacgcctgccctccccagag

SEQ ID NO: 2567118 - DNA, 16 bp, Homo sapiens
gacgctacccgggaag

SEQ ID NO: 2567119 - DNA, 23 bp, Homo sapiens
gacgctacccgggaagggggctg

SEQ ID NO: 2567120 - DNA, 13 bp, Homo sapiens
gacgctgaataaa

SEQ ID NO: 2567121 - DNA, 12 bp, Homo sapiens
gacgctgtgctg

SEQ ID NO: 2567122 - DNA, 21 bp, Homo sapiens
gacgctgtgctgccctgccca

SEQ ID NO: 2567123 - DNA, 21 bp, Homo sapiens
gacggagtcccaccttggctg

SEQ ID NO: 2567124 - DNA, 15 bp, Homo sapiens
gacggcctgatgctc

SEQ ID NO: 2567125 - DNA, 20 bp, Homo sapiens
gacggcctgatgctccctcc

SEQ ID NO: 2567126 - DNA, 17 bp, Homo sapiens
gacggggggccccagtc

SEQ ID NO: 2567127 - DNA, 22 bp, Homo sapiens
gacggggggccccagtcagcct

SEQ ID NO: 2567128 - DNA, 17 bp, Homo sapiens
gacggtgctccaggcag

SEQ ID NO: 2567129 - DNA, 18 bp, Homo sapiens
gacgtcccttttttctct

SEQ ID NO: 2567130 - DNA, 22 bp, Homo sapiens
gacgtgattcaattcaacactc

SEQ ID NO: 2567131 - DNA, 18 bp, Homo sapiens
gacgtgcacctgtactca

SEQ ID NO: 2567132 - DNA, 14 bp, Homo sapiens
gacgtgtttgtgtt

SEQ ID NO: 2567133 - DNA, 13 bp, Homo sapiens
gacgttccagccg

SEQ ID NO: 2567134 - DNA, 13 bp, Homo sapiens
gactaattgtata

SEQ ID NO: 2567135 - DNA, 13 bp, Homo sapiens
gactacaggcacc

SEQ ID NO: 2567136 - DNA, 21 bp, Homo sapiens
gactacaggtgtgagtcacca

SEQ ID NO: 2567137 - DNA, 14 bp, Homo sapiens
gactacatttagag

SEQ ID NO: 2567138 - DNA, 15 bp, Homo sapiens
gactagaggcaggga

SEQ ID NO: 2567139 - DNA, 20 bp, Homo sapiens
gactagagggacctctccca

SEQ ID NO: 2567140 - DNA, 18 bp, Homo sapiens
gactagggattcaggctg

SEQ ID NO: 2567141 - DNA, 21 bp, Homo sapiens
gactagggattcaggctgctt

SEQ ID NO: 2567142 - DNA, 22 bp, Homo sapiens
gactatctaaatgttgaaagat

SEQ ID NO: 2567143 - DNA, 21 bp, Homo sapiens
gactatgaatgggcaaaactg

SEQ ID NO: 2567144 - DNA, 16 bp, Homo sapiens
gactattcaaacagtc

SEQ ID NO: 2567145 - DNA, 14 bp, Homo sapiens
gactcaaaccaaat

SEQ ID NO: 2567146 - DNA, 17 bp, Homo sapiens
gactcacaagaagacca

SEQ ID NO: 2567147 - DNA, 22 bp, Homo sapiens
gactcacaagaagaccagactg

SEQ ID NO: 2567148 - DNA, 23 bp, Homo sapiens
gactcacttatcccaagagaatg

SEQ ID NO: 2567149 - DNA, 11 bp, Homo sapiens
gactcagccct

SEQ ID NO: 2567150 - DNA, 17 bp, Homo sapiens
gactcagctccccagag

SEQ ID NO: 2567151 - DNA, 20 bp, Homo sapiens
gactcagctccccagagtcc

SEQ ID NO: 2567152 - DNA, 15 bp, Homo sapiens
gactcaggatgccca

SEQ ID NO: 2567153 - DNA, 16 bp, Homo sapiens
gactcaggatgcccag

SEQ ID NO: 2567154 - DNA, 23 bp, Homo sapiens
gactcaggatgcccagggccact

SEQ ID NO: 2567155 - DNA, 18 bp, Homo sapiens
gactcagggccccagcac

SEQ ID NO: 2567156 - DNA, 20 bp, Homo sapiens
gactcagggccccagcacta

SEQ ID NO: 2567157 - DNA, 12 bp, Homo sapiens
gactcagggctc

SEQ ID NO: 2567158 - DNA, 16 bp, Homo sapiens
gactcagggctcctgg

SEQ ID NO: 2567159 - DNA, 21 bp, Homo sapiens
gactcaggttgtagtaaagaa

SEQ ID NO: 2567160 - DNA, 12 bp, Homo sapiens
gactcagtgttc

SEQ ID NO: 2567161 - DNA, 13 bp, Homo sapiens
gactcattctgaa

SEQ ID NO: 2567162 - DNA, 16 bp, Homo sapiens
gactcattctgaagga

SEQ ID NO: 2567163 - DNA, 21 bp, Homo sapiens
gactcattttaaaaaatggaa

SEQ ID NO: 2567164 - DNA, 12 bp, Homo sapiens
gactccaaagaa

SEQ ID NO: 2567165 - DNA, 15 bp, Homo sapiens
gactccaaagaaatg

SEQ ID NO: 2567166 - DNA, 16 bp, Homo sapiens
gactccaaagaaatgt

SEQ ID NO: 2567167 - DNA, 16 bp, Homo sapiens
gactccagactctctg

SEQ ID NO: 2567168 - DNA, 20 bp, Homo sapiens
gactccagcctgcctggcag

SEQ ID NO: 2567169 - DNA, 16 bp, Homo sapiens
gactccaggagaggag

SEQ ID NO: 2567170 - DNA, 15 bp, Homo sapiens
gactccccaggccag

SEQ ID NO: 2567171 - DNA, 13 bp, Homo sapiens
gactccctcctca

SEQ ID NO: 2567172 - DNA, 24 bp, Homo sapiens
gactccctcctcacctctggactg

SEQ ID NO: 2567173 - DNA, 15 bp, Homo sapiens
gactccgctggaggt

SEQ ID NO: 2567174 - DNA, 22 bp, Homo sapiens
gactccggccctcctaccctgc

SEQ ID NO: 2567175 - DNA, 13 bp, Homo sapiens
gactcctgcaggc

SEQ ID NO: 2567176 - DNA, 17 bp, Homo sapiens
gactcctgcaggcagcc

SEQ ID NO: 2567177 - DNA, 19 bp, Homo sapiens
gactcctgcaggcagccag

SEQ ID NO: 2567178 - DNA, 16 bp, Homo sapiens
gactcctgtgcaactt

SEQ ID NO: 2567179 - DNA, 20 bp, Homo sapiens
gactcgtctgactgtgtgtg

SEQ ID NO: 2567180 - DNA, 15 bp, Homo sapiens
gactctacagaggcc

SEQ ID NO: 2567181 - DNA, 19 bp, Homo sapiens
gactctacctcatatcagt

SEQ ID NO: 2567182 - DNA, 23 bp, Homo sapiens
gactctacctcatatcagtttgc

SEQ ID NO: 2567183 - DNA, 14 bp, Homo sapiens
gactctcaaatctt

SEQ ID NO: 2567184 - DNA, 20 bp, Homo sapiens
gactctcagtctctgagcag

SEQ ID NO: 2567185 - DNA, 12 bp, Homo sapiens
gactctctgtga

SEQ ID NO: 2567186 - DNA, 18 bp, Homo sapiens
gactctgaaatctgaaga

SEQ ID NO: 2567187 - DNA, 18 bp, Homo sapiens
gactctgaagcctctggg

SEQ ID NO: 2567188 - DNA, 21 bp, Homo sapiens
gactctgaatctttttcagaa

SEQ ID NO: 2567189 - DNA, 23 bp, Homo sapiens
gactctgacctcttggccacaga

SEQ ID NO: 2567190 - DNA, 10 bp, Homo sapiens
gactctgccc

SEQ ID NO: 2567191 - DNA, 12 bp, Homo sapiens
gactctgccccc

SEQ ID NO: 2567192 - DNA, 16 bp, Homo sapiens
gactctgccccctgct

SEQ ID NO: 2567193 - DNA, 22 bp, Homo sapiens
gactctgtcaatttccctgact

SEQ ID NO: 2567194 - DNA, 19 bp, Homo sapiens
gactctgtctcaaaaaaac

SEQ ID NO: 2567195 - DNA, 17 bp, Homo sapiens
gactctgtggggccttg

SEQ ID NO: 2567196 - DNA, 19 bp, Homo sapiens
gactcttgttttcagtttc

SEQ ID NO: 2567197 - DNA, 18 bp, Homo sapiens
gactctttggtggctttg

SEQ ID NO: 2567198 - DNA, 19 bp, Homo sapiens
gactctttggtggctttgc

SEQ ID NO: 2567199 - DNA, 20 bp, Homo sapiens
gactctttttagggccaggc

SEQ ID NO: 2567200 - DNA, 18 bp, Homo sapiens
gactgaaaacctctcctc

SEQ ID NO: 2567201 - DNA, 20 bp, Homo sapiens
gactgaaaacctctcctcat

SEQ ID NO: 2567202 - DNA, 14 bp, Homo sapiens
gactgaatttcttt

SEQ ID NO: 2567203 - DNA, 14 bp, Homo sapiens
gactgagcacctgc

SEQ ID NO: 2567204 - DNA, 15 bp, Homo sapiens
gactgagcacctgct

SEQ ID NO: 2567205 - DNA, 19 bp, Homo sapiens
gactgagtaagaaatgctg

SEQ ID NO: 2567206 - DNA, 22 bp, Homo sapiens
gactgagtcctcgtagccatct

SEQ ID NO: 2567207 - DNA, 16 bp, Homo sapiens
gactgccgaccgaggc

SEQ ID NO: 2567208 - DNA, 20 bp, Homo sapiens
gactgcgatcttcagagcag

SEQ ID NO: 2567209 - DNA, 14 bp, Homo sapiens
gactgctaaataaa

SEQ ID NO: 2567210 - DNA, 15 bp, Homo sapiens
gactggaaccaggga

SEQ ID NO: 2567211 - DNA, 18 bp, Homo sapiens
gactggaagcacagcttc

SEQ ID NO: 2567212 - DNA, 18 bp, Homo sapiens
gactggcacagttttctg

SEQ ID NO: 2567213 - DNA, 14 bp, Homo sapiens
gactggcccctggg

SEQ ID NO: 2567214 - DNA, 22 bp, Homo sapiens
gactggcccctgggtcagtctg

SEQ ID NO: 2567215 - DNA, 20 bp, Homo sapiens
gactggctagagtcctcact

SEQ ID NO: 2567216 - DNA, 22 bp, Homo sapiens
gaaataactccttcttgtagta

SEQ ID NO: 2567217 - DNA, 15 bp, Homo sapiens
gaaatactgtttgag

SEQ ID NO: 2567218 - DNA, 17 bp, Homo sapiens
gaaatatatatgtgtgt

SEQ ID NO: 2567219 - DNA, 14 bp, Homo sapiens
gaaatatcatttat

SEQ ID NO: 2567220 - DNA, 19 bp, Homo sapiens
gaaatatctgaaaatgtat

SEQ ID NO: 2567221 - DNA, 17 bp, Homo sapiens
gaaatatgcacaatagc

SEQ ID NO: 2567222 - DNA, 13 bp, Homo sapiens
gaaatatgcatct

SEQ ID NO: 2567223 - DNA, 19 bp, Homo sapiens
gaaatattaaaccctggat

SEQ ID NO: 2567224 - DNA, 17 bp, Homo sapiens
gaaatcaaatatgcaaa

SEQ ID NO: 2567225 - DNA, 21 bp, Homo sapiens
gaaatcaaatatgcaaagcac

SEQ ID NO: 2567226 - DNA, 15 bp, Homo sapiens
gaaatctagtatttc

SEQ ID NO: 2567227 - DNA, 20 bp, Homo sapiens
gaaatctgtgcctgagaaca

SEQ ID NO: 2567228 - DNA, 13 bp, Homo sapiens
gaaatgaataatt

SEQ ID NO: 2567229 - DNA, 18 bp, Homo sapiens
gaaatgaataatttccca

SEQ ID NO: 2567230 - DNA, 15 bp, Homo sapiens
gaaatgagaaggcag

SEQ ID NO: 2567231 - DNA, 18 bp, Homo sapiens
gaaatgagatcaggctct

SEQ ID NO: 2567232 - DNA, 18 bp, Homo sapiens
gaaatgaggtcagagcct

SEQ ID NO: 2567233 - DNA, 18 bp, Homo sapiens
gaaatgctgatggataac

SEQ ID NO: 2567234 - DNA, 16 bp, Homo sapiens
gaaatgctgcctgcct

SEQ ID NO: 2567235 - DNA, 17 bp, Homo sapiens
gaaatggcttgaagcca

SEQ ID NO: 2567236 - DNA, 14 bp, Homo sapiens
gaaatgggcagagc

SEQ ID NO: 2567237 - DNA, 16 bp, Homo sapiens
gaaatgggcagagcag

SEQ ID NO: 2567238 - DNA, 22 bp, Homo sapiens
gaaatgtaagggaaactgccag

SEQ ID NO: 2567239 - DNA, 17 bp, Homo sapiens
gaaattacacccaaaga

SEQ ID NO: 2567240 - DNA, 20 bp, Homo sapiens
gaaattaccagagttgttct

SEQ ID NO: 2567241 - DNA, 19 bp, Homo sapiens
gaaattactacaaaatttg

SEQ ID NO: 2567242 - DNA, 21 bp, Homo sapiens
gaaattacttatcatccacat

SEQ ID NO: 2567243 - DNA, 13 bp, Homo sapiens
gaaattagggccc

SEQ ID NO: 2567244 - DNA, 18 bp, Homo sapiens
gaaattatgtatgtttac

SEQ ID NO: 2567245 - DNA, 17 bp, Homo sapiens
gaaattatttaataaaa

SEQ ID NO: 2567246 - DNA, 22 bp, Homo sapiens
gaaattcccttcatctggaacc

SEQ ID NO: 2567247 - DNA, 12 bp, Homo sapiens
gaaattgacaga

SEQ ID NO: 2567248 - DNA, 22 bp, Homo sapiens
gaaattggaacagaatgtttta

SEQ ID NO: 2567249 - DNA, 21 bp, Homo sapiens
gaaattgtctagcagagcagg

SEQ ID NO: 2567250 - DNA, 23 bp, Homo sapiens
gaaatttaattcatgtttcttaa

SEQ ID NO: 2567251 - DNA, 15 bp, Homo sapiens
gaaattttatatgct

SEQ ID NO: 2567252 - DNA, 14 bp, Homo sapiens
gaaattttccaatg

SEQ ID NO: 2567253 - DNA, 20 bp, Homo sapiens
gaaattttctagactttctg

SEQ ID NO: 2567254 - DNA, 20 bp, Homo sapiens
gaaatttttcagatgcttct

SEQ ID NO: 2567255 - DNA, 23 bp, Homo sapiens
gacatactaaccagcagaaatgc

SEQ ID NO: 2567256 - DNA, 20 bp, Homo sapiens
gacatagaattaacacatga

SEQ ID NO: 2567257 - DNA, 20 bp, Homo sapiens
gacatagagagggagaagaa

SEQ ID NO: 2567258 - DNA, 22 bp, Homo sapiens
gacatcacttgtacaaaataaa

SEQ ID NO: 2567259 - DNA, 20 bp, Homo sapiens
gacatcagtggcatggctcc

SEQ ID NO: 2567260 - DNA, 16 bp, Homo sapiens
gacatccataaagaag

SEQ ID NO: 2567261 - DNA, 23 bp, Homo sapiens
gacatccccccgccaaaagctgc

SEQ ID NO: 2567262 - DNA, 16 bp, Homo sapiens
gacatctcaggggcca

SEQ ID NO: 2567263 - DNA, 22 bp, Homo sapiens
gacatctcaggggccagaggaa

SEQ ID NO: 2567264 - DNA, 17 bp, Homo sapiens
gacatctctgcaccctg

SEQ ID NO: 2567265 - DNA, 16 bp, Homo sapiens
gacatctctttgaatt

SEQ ID NO: 2567266 - DNA, 21 bp, Homo sapiens
gacatctgtttctaaatgttt

SEQ ID NO: 2567267 - DNA, 19 bp, Homo sapiens
gacatgagtgcgtgctcag

SEQ ID NO: 2567268 - DNA, 15 bp, Homo sapiens
gacatgctgaagcca

SEQ ID NO: 2567269 - DNA, 17 bp, Homo sapiens
gacatggacccggagct

SEQ ID NO: 2567270 - DNA, 20 bp, Homo sapiens
gacatggagactcctgccct

SEQ ID NO: 2567271 - DNA, 21 bp, Homo sapiens
gacatggcttgccacagctct

SEQ ID NO: 2567272 - DNA, 16 bp, Homo sapiens
gacatggggaggaagg

SEQ ID NO: 2567273 - DNA, 17 bp, Homo sapiens
gacatgtctgttctaca

SEQ ID NO: 2567274 - DNA, 17 bp, Homo sapiens
gacatgtcttttcttgc

SEQ ID NO: 2567275 - DNA, 15 bp, Homo sapiens
gacatgtgaaacctt

SEQ ID NO: 2567276 - DNA, 23 bp, Homo sapiens
gacatgtgaaaccttttttaaga

SEQ ID NO: 2567277 - DNA, 20 bp, Homo sapiens
gacatgttttgataaagtag

SEQ ID NO: 2567278 - DNA, 18 bp, Homo sapiens
gacatgtttttgttttct

SEQ ID NO: 2567279 - DNA, 14 bp, Homo sapiens
gacattaacagttt

SEQ ID NO: 2567280 - DNA, 18 bp, Homo sapiens
gacattaacagttttcca

SEQ ID NO: 2567281 - DNA, 16 bp, Homo sapiens
gacattcatgcctggc

SEQ ID NO: 2567282 - DNA, 22 bp, Homo sapiens
gacattcctaaactatcttttt

SEQ ID NO: 2567283 - DNA, 14 bp, Homo sapiens
gacattctgccagg

SEQ ID NO: 2567284 - DNA, 18 bp, Homo sapiens
gacattgctaagatgctc

SEQ ID NO: 2567285 - DNA, 23 bp, Homo sapiens
gacattgctttactgtcaaaata

SEQ ID NO: 2567286 - DNA, 11 bp, Homo sapiens
gacatttccca

SEQ ID NO: 2567287 - DNA, 17 bp, Homo sapiens
gaccaaaatccccttct

SEQ ID NO: 2567288 - DNA, 17 bp, Homo sapiens
gaccaaacctagcccct

SEQ ID NO: 2567289 - DNA, 17 bp, Homo sapiens
gaccaaccctgtttcct

SEQ ID NO: 2567290 - DNA, 17 bp, Homo sapiens
gaccaactagacattct

SEQ ID NO: 2567291 - DNA, 18 bp, Homo sapiens
gaccaactagacattctg

SEQ ID NO: 2567292 - DNA, 20 bp, Homo sapiens
gaccaactagacattctgtc

SEQ ID NO: 2567293 - DNA, 15 bp, Homo sapiens
gaccaagcaggaagc

SEQ ID NO: 2567294 - DNA, 17 bp, Homo sapiens
gaccaagcaggaagctc

SEQ ID NO: 2567295 - DNA, 16 bp, Homo sapiens
gaccaaggacccctca

SEQ ID NO: 2567296 - DNA, 21 bp, Homo sapiens
gaccaagttataaatcaatgt

SEQ ID NO: 2567297 - DNA, 20 bp, Homo sapiens
gaccaatattatactaagaa

SEQ ID NO: 2567298 - DNA, 18 bp, Homo sapiens
gaccaatattcaaatgcg

SEQ ID NO: 2567299 - DNA, 18 bp, Homo sapiens
gaccaatattgtacagtt

SEQ ID NO: 2567300 - DNA, 21 bp, Homo sapiens
gaccaatattgtacagttttt

SEQ ID NO: 2567301 - DNA, 18 bp, Homo sapiens
gaccacaaaacttttcta

SEQ ID NO: 2567302 - DNA, 16 bp, Homo sapiens
gaccacaccctgtact

SEQ ID NO: 2567303 - DNA, 23 bp, Homo sapiens
gaccacacttcctgtccagagag

SEQ ID NO: 2567304 - DNA, 21 bp, Homo sapiens
gaccacagggttcaaaatgtc

SEQ ID NO: 2567305 - DNA, 17 bp, Homo sapiens
gaccaccctcccctctc

SEQ ID NO: 2567306 - DNA, 18 bp, Homo sapiens
gaccactgcagaagacag

SEQ ID NO: 2567307 - DNA, 21 bp, Homo sapiens
gaccagagccccacacggagg

SEQ ID NO: 2567308 - DNA, 20 bp, Homo sapiens
gaccagcagatcccagctca

SEQ ID NO: 2567309 - DNA, 11 bp, Homo sapiens
gaccagcctgg

SEQ ID NO: 2567310 - DNA, 23 bp, Homo sapiens
gaccagcctgttggacccgctct

SEQ ID NO: 2567311 - DNA, 17 bp, Homo sapiens
gaccaggactccctcct

SEQ ID NO: 2567312 - DNA, 21 bp, Homo sapiens
gaccaggactccctcctcacc

SEQ ID NO: 2567313 - DNA, 23 bp, Homo sapiens
gaccaggactccctcctcacctc

SEQ ID NO: 2567314 - DNA, 16 bp, Homo sapiens
gaccaggagggcactg

SEQ ID NO: 2567315 - DNA, 22 bp, Homo sapiens
gaccaggggtgatttcagagag

SEQ ID NO: 2567316 - DNA, 15 bp, Homo sapiens
gaccagttgggagca

SEQ ID NO: 2567317 - DNA, 16 bp, Homo sapiens
gaccataacagccaac

SEQ ID NO: 2567318 - DNA, 20 bp, Homo sapiens
gaccataatgttacattatt

SEQ ID NO: 2567319 - DNA, 16 bp, Homo sapiens
gaccatccctgaaggc

SEQ ID NO: 2567320 - DNA, 18 bp, Homo sapiens
gaccatccctgaaggccc

SEQ ID NO: 2567321 - DNA, 22 bp, Homo sapiens
gaccattctccacctgccaggg

SEQ ID NO: 2567322 - DNA, 16 bp, Homo sapiens
gacccaaaaggcagaa

SEQ ID NO: 2567323 - DNA, 19 bp, Homo sapiens
gacccaaaaggcagaagca

SEQ ID NO: 2567324 - DNA, 20 bp, Homo sapiens
gacccaaaaggcagaagcaa

SEQ ID NO: 2567325 - DNA, 13 bp, Homo sapiens
gacccaaagacca

SEQ ID NO: 2567326 - DNA, 15 bp, Homo sapiens
gacccacaagaaatg

SEQ ID NO: 2567327 - DNA, 22 bp, Homo sapiens
gacccacaagaaatgaaagcag

SEQ ID NO: 2567328 - DNA, 16 bp, Homo sapiens
gacccacccctgtgct

SEQ ID NO: 2567329 - DNA, 17 bp, Homo sapiens
gacccacccctgtgctc

SEQ ID NO: 2567330 - DNA, 11 bp, Homo sapiens
gacccactgct

SEQ ID NO: 2567331 - DNA, 16 bp, Homo sapiens
gacccagacccagtgg

SEQ ID NO: 2567332 - DNA, 17 bp, Homo sapiens
gacccagcactgcccaa

SEQ ID NO: 2567333 - DNA, 13 bp, Homo sapiens
gacccaggccgca

SEQ ID NO: 2567334 - DNA, 19 bp, Homo sapiens
gacccaggccgcagctctt

SEQ ID NO: 2567335 - DNA, 22 bp, Homo sapiens
gacccaggccgcagctcttgcc

SEQ ID NO: 2567336 - DNA, 13 bp, Homo sapiens
gacccaggctggg

SEQ ID NO: 2567337 - DNA, 16 bp, Homo sapiens
gacccatgctgccctg

SEQ ID NO: 2567338 - DNA, 17 bp, Homo sapiens
gacccatgctgccctgt

SEQ ID NO: 2567339 - DNA, 18 bp, Homo sapiens
gacccatgctgccctgtg

SEQ ID NO: 2567340 - DNA, 20 bp, Homo sapiens
gacccatgctgccctgtgag

SEQ ID NO: 2567341 - DNA, 23 bp, Homo sapiens
gaccccaaacaccttccagctcc

SEQ ID NO: 2567342 - DNA, 19 bp, Homo sapiens
gaccccaaagagcctggag

SEQ ID NO: 2567343 - DNA, 21 bp, Homo sapiens
gaccccaaagagcctggagaa

SEQ ID NO: 2567344 - DNA, 20 bp, Homo sapiens
gaccccacccaagcttggca

SEQ ID NO: 2567345 - DNA, 12 bp, Homo sapiens
gaccccagctgg

SEQ ID NO: 2567346 - DNA, 13 bp, Homo sapiens
gaccccagctggg

SEQ ID NO: 2567347 - DNA, 14 bp, Homo sapiens
gaccccagctggga

SEQ ID NO: 2567348 - DNA, 13 bp, Homo sapiens
gacccccacccct

SEQ ID NO: 2567349 - DNA, 22 bp, Homo sapiens
gacccccaccccttccccactg

SEQ ID NO: 2567350 - DNA, 20 bp, Homo sapiens
gaccccccaccaccagccgg

SEQ ID NO: 2567351 - DNA, 22 bp, Homo sapiens
gacccctcaccttgcaacacac

SEQ ID NO: 2567352 - DNA, 11 bp, Homo sapiens
gacccctcctc

SEQ ID NO: 2567353 - DNA, 16 bp, Homo sapiens
gacccctcctcccttt

SEQ ID NO: 2567354 - DNA, 21 bp, Homo sapiens
gacccggagctaacactggcc

SEQ ID NO: 2567355 - DNA, 15 bp, Homo sapiens
gacccggaggccaca

SEQ ID NO: 2567356 - DNA, 18 bp, Homo sapiens
gaccctaagaccggcggc

SEQ ID NO: 2567357 - DNA, 14 bp, Homo sapiens
gaccctacaggaga

SEQ ID NO: 2567358 - DNA, 16 bp, Homo sapiens
gaccctattgctgctt

SEQ ID NO: 2567359 - DNA, 18 bp, Homo sapiens
gaccctcctgttgcaccc

SEQ ID NO: 2567360 - DNA, 20 bp, Homo sapiens
gaccctcctgttgcacccag

SEQ ID NO: 2567361 - DNA, 20 bp, Homo sapiens
gaccctctgaatggtccagg

SEQ ID NO: 2567362 - DNA, 10 bp, Homo sapiens
gaccctgagg

SEQ ID NO: 2567363 - DNA, 23 bp, Homo sapiens
gaccctgaggcccagagggcctg

SEQ ID NO: 2567364 - DNA, 12 bp, Homo sapiens
gaccctgccctg

SEQ ID NO: 2567365 - DNA, 21 bp, Homo sapiens
gaccctgcgaaggggccctgg

SEQ ID NO: 2567366 - DNA, 23 bp, Homo sapiens
gaccctgtctcaaaaaaagaaaa

SEQ ID NO: 2567367 - DNA, 19 bp, Homo sapiens
gacccttcccttgagccct

SEQ ID NO: 2567368 - DNA, 20 bp, Homo sapiens
gacccttgccgtctacctga

SEQ ID NO: 2567369 - DNA, 23 bp, Homo sapiens
gacccttgccgtctacctgaggg

SEQ ID NO: 2567370 - DNA, 23 bp, Homo sapiens
gaccctttagccaaacccttgtc

SEQ ID NO: 2567371 - DNA, 17 bp, Homo sapiens
gaccgaggctggagctg

SEQ ID NO: 2567372 - DNA, 12 bp, Homo sapiens
gaccgccccctc

SEQ ID NO: 2567373 - DNA, 16 bp, Homo sapiens
gaccgccccctcctct

SEQ ID NO: 2567374 - DNA, 18 bp, Homo sapiens
gaccgtgggcggggcctt

SEQ ID NO: 2567375 - DNA, 13 bp, Homo sapiens
gacctacctcagg

SEQ ID NO: 2567376 - DNA, 20 bp, Homo sapiens
gacctagggatgttctggcc

SEQ ID NO: 2567377 - DNA, 23 bp, Homo sapiens
gacctagggatgttctggccctc

SEQ ID NO: 2567378 - DNA, 15 bp, Homo sapiens
gacctatcacttcca

SEQ ID NO: 2567379 - DNA, 16 bp, Homo sapiens
gacctattcctcctgg

SEQ ID NO: 2567380 - DNA, 17 bp, Homo sapiens
gacctattcctcctggg

SEQ ID NO: 2567381 - DNA, 13 bp, Homo sapiens
gacctcaacctgt

SEQ ID NO: 2567382 - DNA, 18 bp, Homo sapiens
gacctcagagtccaggcc

SEQ ID NO: 2567383 - DNA, 11 bp, Homo sapiens
gacctcagcct

SEQ ID NO: 2567384 - DNA, 12 bp, Homo sapiens
gacctcagcctg

SEQ ID NO: 2567385 - DNA, 13 bp, Homo sapiens
gacctcagccttc

SEQ ID NO: 2567386 - DNA, 14 bp, Homo sapiens
gacctcagccttcc

SEQ ID NO: 2567387 - DNA, 20 bp, Homo sapiens
gacctcagccttccccttgc

SEQ ID NO: 2567388 - DNA, 21 bp, Homo sapiens
gacctcaggtgagaagcagag

SEQ ID NO: 2567389 - DNA, 21 bp, Homo sapiens
gacctcagttttatcattttc

SEQ ID NO: 2567390 - DNA, 10 bp, Homo sapiens
gacctcatca

SEQ ID NO: 2567391 - DNA, 23 bp, Homo sapiens
gacctcccagccctatggatgtg

SEQ ID NO: 2567392 - DNA, 19 bp, Homo sapiens
gacctctccatcttcagct

SEQ ID NO: 2567393 - DNA, 16 bp, Homo sapiens
gaaaatatactgtaaa

SEQ ID NO: 2567394 - DNA, 19 bp, Homo sapiens
gaaaatatactgtaaagaa

SEQ ID NO: 2567395 - DNA, 23 bp, Homo sapiens
gaaaatatactgtaaagaaagag

SEQ ID NO: 2567396 - DNA, 12 bp, Homo sapiens
gaaaatatgcat

SEQ ID NO: 2567397 - DNA, 19 bp, Homo sapiens
gaaaatcaaatacatactt

SEQ ID NO: 2567398 - DNA, 14 bp, Homo sapiens
gaaaatcagcctgc

SEQ ID NO: 2567399 - DNA, 20 bp, Homo sapiens
gaaaatcagcctgctccagc

SEQ ID NO: 2567400 - DNA, 20 bp, Homo sapiens
gaaaatctaatattaaaaat

SEQ ID NO: 2567401 - DNA, 23 bp, Homo sapiens
gaaaatgctgtattagtcacaga

SEQ ID NO: 2567402 - DNA, 17 bp, Homo sapiens
gaaaatgtaagctgttt

SEQ ID NO: 2567403 - DNA, 21 bp, Homo sapiens
gaaaatgtcagaaaccagtta

SEQ ID NO: 2567404 - DNA, 13 bp, Homo sapiens
gaaaattaacact

SEQ ID NO: 2567405 - DNA, 18 bp, Homo sapiens
gaaaattaggatttcatg

SEQ ID NO: 2567406 - DNA, 18 bp, Homo sapiens
gaaaattttgatgtttta

SEQ ID NO: 2567407 - DNA, 22 bp, Homo sapiens
gaaacaaagcttagcaggagag

SEQ ID NO: 2567408 - DNA, 15 bp, Homo sapiens
gaaacaacagcttta

SEQ ID NO: 2567409 - DNA, 21 bp, Homo sapiens
gaaacaatactcataatgtga

SEQ ID NO: 2567410 - DNA, 22 bp, Homo sapiens
gaaacaatactcataatgtgaa

SEQ ID NO: 2567411 - DNA, 17 bp, Homo sapiens
gaaacacaccaggctgt

SEQ ID NO: 2567412 - DNA, 23 bp, Homo sapiens
gaaacacaccaggctgtgggcct

SEQ ID NO: 2567413 - DNA, 22 bp, Homo sapiens
gaaacaccctcacactgggact

SEQ ID NO: 2567414 - DNA, 22 bp, Homo sapiens
gaaacagaaacaaaaacactaa

SEQ ID NO: 2567415 - DNA, 12 bp, Homo sapiens
gaaacagaggct

SEQ ID NO: 2567416 - DNA, 18 bp, Homo sapiens
gaaaccacagctgctgga

SEQ ID NO: 2567417 - DNA, 16 bp, Homo sapiens
gaaacccagctctggt

SEQ ID NO: 2567418 - DNA, 18 bp, Homo sapiens
gaaacccagctctggtcc

SEQ ID NO: 2567419 - DNA, 19 bp, Homo sapiens
gaaacccagctctggtcca

SEQ ID NO: 2567420 - DNA, 17 bp, Homo sapiens
gaaaccccatctctact

SEQ ID NO: 2567421 - DNA, 17 bp, Homo sapiens
gaaaccttattgtacct

SEQ ID NO: 2567422 - DNA, 17 bp, Homo sapiens
gaaaccttggtgtagtt

SEQ ID NO: 2567423 - DNA, 19 bp, Homo sapiens
gaaacctttagggcagctt

SEQ ID NO: 2567424 - DNA, 20 bp, Homo sapiens
gaaacctttagggcagcttg

SEQ ID NO: 2567425 - DNA, 18 bp, Homo sapiens
gaaaccttttttaagatt

SEQ ID NO: 2567426 - DNA, 19 bp, Homo sapiens
gaaaccttttttaagattt

SEQ ID NO: 2567427 - DNA, 21 bp, Homo sapiens
gaaaccttttttaagattttt

SEQ ID NO: 2567428 - DNA, 22 bp, Homo sapiens
gaaaccttttttaagatttttc

SEQ ID NO: 2567429 - DNA, 23 bp, Homo sapiens
gaaaccttttttaagatttttct

SEQ ID NO: 2567430 - DNA, 13 bp, Homo sapiens
gaaactaggtctg

SEQ ID NO: 2567431 - DNA, 18 bp, Homo sapiens
gaaactaggtctgatatt

SEQ ID NO: 2567432 - DNA, 18 bp, Homo sapiens
gaaactcacctgctggcc

SEQ ID NO: 2567433 - DNA, 23 bp, Homo sapiens
gaaactcacctgctggcccctca

SEQ ID NO: 2567434 - DNA, 20 bp, Homo sapiens
gaaactccaccttgcgggga

SEQ ID NO: 2567435 - DNA, 20 bp, Homo sapiens
gaaactcttatctcagtcat

SEQ ID NO: 2567436 - DNA, 19 bp, Homo sapiens
gaaactctttttgggctcc

SEQ ID NO: 2567437 - DNA, 18 bp, Homo sapiens
gaaactgaggaattttct

SEQ ID NO: 2567438 - DNA, 15 bp, Homo sapiens
gaaactgcagggaaa

SEQ ID NO: 2567439 - DNA, 15 bp, Homo sapiens
gaaactgccagcaac

SEQ ID NO: 2567440 - DNA, 20 bp, Homo sapiens
gaaactgttcccacctgctg

SEQ ID NO: 2567441 - DNA, 19 bp, Homo sapiens
gaaacttatttttttctga

SEQ ID NO: 2567442 - DNA, 20 bp, Homo sapiens
gaaacttatttttttctgat

SEQ ID NO: 2567443 - DNA, 21 bp, Homo sapiens
gaaagaaacccgacagaggga

SEQ ID NO: 2567444 - DNA, 15 bp, Homo sapiens
gaaagaaagaaggaa

SEQ ID NO: 2567445 - DNA, 11 bp, Homo sapiens
gaaagaaggaa

SEQ ID NO: 2567446 - DNA, 16 bp, Homo sapiens
gaaagaatgaaagagt

SEQ ID NO: 2567447 - DNA, 16 bp, Homo sapiens
gaaagacagcttctca

SEQ ID NO: 2567448 - DNA, 23 bp, Homo sapiens
gaaagacatccataaagaagcaa

SEQ ID NO: 2567449 - DNA, 15 bp, Homo sapiens
gaaagactattcaaa

SEQ ID NO: 2567450 - DNA, 23 bp, Homo sapiens
gaaagactattcaaacagtctca

SEQ ID NO: 2567451 - DNA, 15 bp, Homo sapiens
gaaagagaaggtggg

SEQ ID NO: 2567452 - DNA, 14 bp, Homo sapiens
gaaagagagaaaat

SEQ ID NO: 2567453 - DNA, 21 bp, Homo sapiens
gaaagagagaaaataaaaagt

SEQ ID NO: 2567454 - DNA, 22 bp, Homo sapiens
gaaagagagaaaataaaaagtt

SEQ ID NO: 2567455 - DNA, 23 bp, Homo sapiens
gaaagagagaaaataaaaagtta

SEQ ID NO: 2567456 - DNA, 22 bp, Homo sapiens
gaaagatggctgtgcctctgcc

SEQ ID NO: 2567457 - DNA, 20 bp, Homo sapiens
gaaagcagatacctcaccct

SEQ ID NO: 2567458 - DNA, 14 bp, Homo sapiens
gaaagcagctgaac

SEQ ID NO: 2567459 - DNA, 14 bp, Homo sapiens
gaaagcagggactt

SEQ ID NO: 2567460 - DNA, 17 bp, Homo sapiens
gaaagcatcacctcagg

SEQ ID NO: 2567461 - DNA, 18 bp, Homo sapiens
gaaagccacctctccctc

SEQ ID NO: 2567462 - DNA, 16 bp, Homo sapiens
gaaagccagtgactcc

SEQ ID NO: 2567463 - DNA, 19 bp, Homo sapiens
gaaagccagtgactccagg

SEQ ID NO: 2567464 - DNA, 17 bp, Homo sapiens
gaaagccctgagctttc

SEQ ID NO: 2567465 - DNA, 21 bp, Homo sapiens
gaaagccctgagctttctgct

SEQ ID NO: 2567466 - DNA, 18 bp, Homo sapiens
gaaagctcctagcagaga

SEQ ID NO: 2567467 - DNA, 14 bp, Homo sapiens
gaaaggattcatgt

SEQ ID NO: 2567468 - DNA, 16 bp, Homo sapiens
gaaaggcattctctga

SEQ ID NO: 2567469 - DNA, 21 bp, Homo sapiens
gaaaggctcagtctcaggagc

SEQ ID NO: 2567470 - DNA, 22 bp, Homo sapiens
gaaaggctcagtctcaggagca

SEQ ID NO: 2567471 - DNA, 15 bp, Homo sapiens
gaaaggctctgaaag

SEQ ID NO: 2567472 - DNA, 22 bp, Homo sapiens
gaaagggacttggaagctccgc

SEQ ID NO: 2567473 - DNA, 16 bp, Homo sapiens
gaaagggggtcccagt

SEQ ID NO: 2567474 - DNA, 17 bp, Homo sapiens
gaaagggggtcccagtg

SEQ ID NO: 2567475 - DNA, 18 bp, Homo sapiens
gaaagggggtcccagtgg

SEQ ID NO: 2567476 - DNA, 19 bp, Homo sapiens
gaaagggtgctgcttccct

SEQ ID NO: 2567477 - DNA, 23 bp, Homo sapiens
gaaagggtgtttttctgttttat

SEQ ID NO: 2567478 - DNA, 21 bp, Homo sapiens
gaaagtacttctccaccctgc

SEQ ID NO: 2567479 - DNA, 20 bp, Homo sapiens
gaaagtcagatgcccagagg

SEQ ID NO: 2567480 - DNA, 21 bp, Homo sapiens
gaaagtgatatcccccagcct

SEQ ID NO: 2567481 - DNA, 16 bp, Homo sapiens
gaaagtggtgctcagt

SEQ ID NO: 2567482 - DNA, 13 bp, Homo sapiens
gaaagtgtaaagc

SEQ ID NO: 2567483 - DNA, 16 bp, Homo sapiens
gaaagtgtaaagcatt

SEQ ID NO: 2567484 - DNA, 17 bp, Homo sapiens
gaaagttacaaattgct

SEQ ID NO: 2567485 - DNA, 19 bp, Homo sapiens
gaaagttgcacggctgctg

SEQ ID NO: 2567486 - DNA, 17 bp, Homo sapiens
gaaataaaacctttcaa

SEQ ID NO: 2567487 - DNA, 18 bp, Homo sapiens
gaaataaaacctttcaaa

SEQ ID NO: 2567488 - DNA, 18 bp, Homo sapiens
gaaataaagttggtgaca

SEQ ID NO: 2567489 - DNA, 17 bp, Homo sapiens
gaaataacaatgttaag

SEQ ID NO: 2567490 - DNA, 18 bp, Homo sapiens
gaaataacaatgttaagg

SEQ ID NO: 2567491 - DNA, 18 bp, Homo sapiens
cttgaaaaatgtgcaaaa

SEQ ID NO: 2567492 - DNA, 18 bp, Homo sapiens
cttgaaagcatccatgtg

SEQ ID NO: 2567493 - DNA, 19 bp, Homo sapiens
cttgaaatataggaactta

SEQ ID NO: 2567494 - DNA, 22 bp, Homo sapiens
cttgaaatgaaagtataactga

SEQ ID NO: 2567495 - DNA, 13 bp, Homo sapiens
cttgaaattttaa

SEQ ID NO: 2567496 - DNA, 15 bp, Homo sapiens
cttgaaattttaacc

SEQ ID NO: 2567497 - DNA, 20 bp, Homo sapiens
cttgaacactcatgctgaaa

SEQ ID NO: 2567498 - DNA, 16 bp, Homo sapiens
cttgaacactggggga

SEQ ID NO: 2567499 - DNA, 13 bp, Homo sapiens
cttgaactcctgg

SEQ ID NO: 2567500 - DNA, 14 bp, Homo sapiens
cttgaactcctggc

SEQ ID NO: 2567501 - DNA, 16 bp, Homo sapiens
cttgaactgggtactt

SEQ ID NO: 2567502 - DNA, 20 bp, Homo sapiens
cttgaactgggtacttgtgg

SEQ ID NO: 2567503 - DNA, 12 bp, Homo sapiens
cttgaagcagta

SEQ ID NO: 2567504 - DNA, 13 bp, Homo sapiens
cttgaagccactg

SEQ ID NO: 2567505 - DNA, 18 bp, Homo sapiens
cttgaagccactgaagct

SEQ ID NO: 2567506 - DNA, 16 bp, Homo sapiens
cttgaagggtaaagaa

SEQ ID NO: 2567507 - DNA, 20 bp, Homo sapiens
cttgaatttctaaaaaacag

SEQ ID NO: 2567508 - DNA, 14 bp, Homo sapiens
cttgacagaacact

SEQ ID NO: 2567509 - DNA, 16 bp, Homo sapiens
cttgacagaacactgt

SEQ ID NO: 2567510 - DNA, 13 bp, Homo sapiens
cttgacagggcac

SEQ ID NO: 2567511 - DNA, 19 bp, Homo sapiens
cttgaccaagcaggaagct

SEQ ID NO: 2567512 - DNA, 11 bp, Homo sapiens
cttgaccagca

SEQ ID NO: 2567513 - DNA, 20 bp, Homo sapiens
cttgaccattctccacctgc

SEQ ID NO: 2567514 - DNA, 21 bp, Homo sapiens
cttgaccattctccacctgcc

SEQ ID NO: 2567515 - DNA, 16 bp, Homo sapiens
cttgacccatctcccc

SEQ ID NO: 2567516 - DNA, 12 bp, Homo sapiens
cttgagaaacct

SEQ ID NO: 2567517 - DNA, 16 bp, Homo sapiens
cttgagagaccaggca

SEQ ID NO: 2567518 - DNA, 20 bp, Homo sapiens
cttgagagtagatggtttga

SEQ ID NO: 2567519 - DNA, 20 bp, Homo sapiens
cttgagcaagttccttctgg

SEQ ID NO: 2567520 - DNA, 12 bp, Homo sapiens
cttgagcccagg

SEQ ID NO: 2567521 - DNA, 15 bp, Homo sapiens
cttgagcccaggagt

SEQ ID NO: 2567522 - DNA, 15 bp, Homo sapiens
cttgagccttgaact

SEQ ID NO: 2567523 - DNA, 19 bp, Homo sapiens
cttgagccttgaactttga

SEQ ID NO: 2567524 - DNA, 13 bp, Homo sapiens
cttgagctgagat

SEQ ID NO: 2567525 - DNA, 18 bp, Homo sapiens
cttgaggaaacaacagct

SEQ ID NO: 2567526 - DNA, 20 bp, Homo sapiens
cttgaggaaacaacagcttt

SEQ ID NO: 2567527 - DNA, 22 bp, Homo sapiens
cttgaggaggggcaggtaaact

SEQ ID NO: 2567528 - DNA, 24 bp, Homo sapiens
cttgaggcttagctttgctctgcc

SEQ ID NO: 2567529 - DNA, 19 bp, Homo sapiens
cttgagggcccagagcagg

SEQ ID NO: 2567530 - DNA, 19 bp, Homo sapiens
cttgagggttgggctggtg

SEQ ID NO: 2567531 - DNA, 21 bp, Homo sapiens
cttgagggttgggctggtgtc

SEQ ID NO: 2567532 - DNA, 19 bp, Homo sapiens
cttgagttgattcagctct

SEQ ID NO: 2567533 - DNA, 16 bp, Homo sapiens
cttgatacccccctct

SEQ ID NO: 2567534 - DNA, 20 bp, Homo sapiens
cttgatacccccctctgtct

SEQ ID NO: 2567535 - DNA, 21 bp, Homo sapiens
cttgatacccccctctgtctt

SEQ ID NO: 2567536 - DNA, 20 bp, Homo sapiens
cttgatctgtatatacaata

SEQ ID NO: 2567537 - DNA, 12 bp, Homo sapiens
cttgatgtgcct

SEQ ID NO: 2567538 - DNA, 18 bp, Homo sapiens
cttgattcacaatgaaat

SEQ ID NO: 2567539 - DNA, 12 bp, Homo sapiens
cttgatttttgc

SEQ ID NO: 2567540 - DNA, 16 bp, Homo sapiens
cttgcaaaaagggtca

SEQ ID NO: 2567541 - DNA, 12 bp, Homo sapiens
cttgcaaagtat

SEQ ID NO: 2567542 - DNA, 20 bp, Homo sapiens
cttgcaacttcatgtcaact

SEQ ID NO: 2567543 - DNA, 22 bp, Homo sapiens
cttgcaagaatcagtgcaaaga

SEQ ID NO: 2567544 - DNA, 18 bp, Homo sapiens
cttgcaatggcagccttg

SEQ ID NO: 2567545 - DNA, 17 bp, Homo sapiens
cttgcaatttctaccta

SEQ ID NO: 2567546 - DNA, 15 bp, Homo sapiens
cttgcacccgcctct

SEQ ID NO: 2567547 - DNA, 16 bp, Homo sapiens
cttgcacctctgacct

SEQ ID NO: 2567548 - DNA, 20 bp, Homo sapiens
cttgcagactctacagaggc

SEQ ID NO: 2567549 - DNA, 19 bp, Homo sapiens
cttgcagcactcacacagg

SEQ ID NO: 2567550 - DNA, 22 bp, Homo sapiens
cttgcagcactcacacaggacc

SEQ ID NO: 2567551 - DNA, 12 bp, Homo sapiens
cttgcagcagga

SEQ ID NO: 2567552 - DNA, 13 bp, Homo sapiens
cttgcagcaggat

SEQ ID NO: 2567553 - DNA, 23 bp, Homo sapiens
cttgcagcaggatctagaggggg

SEQ ID NO: 2567554 - DNA, 14 bp, Homo sapiens
cttgcagtagattt

SEQ ID NO: 2567555 - DNA, 22 bp, Homo sapiens
cttgcagtagattttctttaaa

SEQ ID NO: 2567556 - DNA, 22 bp, Homo sapiens
cttgcagttcagcaccacccta

SEQ ID NO: 2567557 - DNA, 15 bp, Homo sapiens
cttgcatccaactcc

SEQ ID NO: 2567558 - DNA, 14 bp, Homo sapiens
cttgcattcccagt

SEQ ID NO: 2567559 - DNA, 18 bp, Homo sapiens
cttgcattgaatatatta

SEQ ID NO: 2567560 - DNA, 14 bp, Homo sapiens
cttgcattgcagag

SEQ ID NO: 2567561 - DNA, 13 bp, Homo sapiens
cttgcatttttgc

SEQ ID NO: 2567562 - DNA, 14 bp, Homo sapiens
cttgccacagctct

SEQ ID NO: 2567563 - DNA, 18 bp, Homo sapiens
cttgccaccccaccctcc

SEQ ID NO: 2567564 - DNA, 20 bp, Homo sapiens
cttgccaccccaccctccct

SEQ ID NO: 2567565 - DNA, 16 bp, Homo sapiens
cttgccagacatgtgg

SEQ ID NO: 2567566 - DNA, 20 bp, Homo sapiens
cttgcccagggctcagcctg

SEQ ID NO: 2567567 - DNA, 21 bp, Homo sapiens
cttgcccagggctcagcctgg

SEQ ID NO: 2567568 - DNA, 23 bp, Homo sapiens
cttgcccagggctcagcctggtg

SEQ ID NO: 2567569 - DNA, 20 bp, Homo sapiens
cttgcccagtttcagggcta

SEQ ID NO: 2567570 - DNA, 14 bp, Homo sapiens
cttgccccccaccc

SEQ ID NO: 2567571 - DNA, 16 bp, Homo sapiens
cttgccccccacccca

SEQ ID NO: 2567572 - DNA, 19 bp, Homo sapiens
cttgccccccaccccagcc

SEQ ID NO: 2567573 - DNA, 17 bp, Homo sapiens
cttgcccggattctggg

SEQ ID NO: 2567574 - DNA, 14 bp, Homo sapiens
cttgccctgacctc

SEQ ID NO: 2567575 - DNA, 14 bp, Homo sapiens
cttgccctgttaaa

SEQ ID NO: 2567576 - DNA, 22 bp, Homo sapiens
cttgccctgttaaaagatgaaa

SEQ ID NO: 2567577 - DNA, 12 bp, Homo sapiens
cttgcccttccc

SEQ ID NO: 2567578 - DNA, 16 bp, Homo sapiens
ctttgggcccagggac

SEQ ID NO: 2567579 - DNA, 17 bp, Homo sapiens
ctttgggttaagcatta

SEQ ID NO: 2567580 - DNA, 19 bp, Homo sapiens
ctttgtaagagtgtagaag

SEQ ID NO: 2567581 - DNA, 20 bp, Homo sapiens
ctttgtaagagtgtagaagc

SEQ ID NO: 2567582 - DNA, 22 bp, Homo sapiens
ctttgtaagagtgtagaagcat

SEQ ID NO: 2567583 - DNA, 23 bp, Homo sapiens
ctttgtaagagtgtagaagcatt

SEQ ID NO: 2567584 - DNA, 19 bp, Homo sapiens
ctttgtaatcgttatgtgt

SEQ ID NO: 2567585 - DNA, 21 bp, Homo sapiens
ctttgtaatcgttatgtgtgt

SEQ ID NO: 2567586 - DNA, 13 bp, Homo sapiens
ctttgtaatggga

SEQ ID NO: 2567587 - DNA, 20 bp, Homo sapiens
ctttgtatgtcatttccttc

SEQ ID NO: 2567588 - DNA, 20 bp, Homo sapiens
ctttgtatttttacttttaa

SEQ ID NO: 2567589 - DNA, 22 bp, Homo sapiens
ctttgtccccaccgcagacagg

SEQ ID NO: 2567590 - DNA, 15 bp, Homo sapiens
ctttgtcccggggct

SEQ ID NO: 2567591 - DNA, 17 bp, Homo sapiens
ctttgtcctttttgtta

SEQ ID NO: 2567592 - DNA, 15 bp, Homo sapiens
ctttgtctgaaaaat

SEQ ID NO: 2567593 - DNA, 15 bp, Homo sapiens
ctttgtgaggaagcc

SEQ ID NO: 2567594 - DNA, 12 bp, Homo sapiens
ctttgtgatttt

SEQ ID NO: 2567595 - DNA, 19 bp, Homo sapiens
ctttgtgatttttgtaatt

SEQ ID NO: 2567596 - DNA, 17 bp, Homo sapiens
ctttgtggatgtcttcc

SEQ ID NO: 2567597 - DNA, 16 bp, Homo sapiens
ctttgtgtagctttgc

SEQ ID NO: 2567598 - DNA, 23 bp, Homo sapiens
ctttgtgtttctattgacttcaa

SEQ ID NO: 2567599 - DNA, 18 bp, Homo sapiens
ctttgttagtttctccaa

SEQ ID NO: 2567600 - DNA, 16 bp, Homo sapiens
ctttgttctggctctt

SEQ ID NO: 2567601 - DNA, 16 bp, Homo sapiens
ctttgttgcccaggct

SEQ ID NO: 2567602 - DNA, 20 bp, Homo sapiens
cttttaaacctcacctttgt

SEQ ID NO: 2567603 - DNA, 12 bp, Homo sapiens
cttttaaactgt

SEQ ID NO: 2567604 - DNA, 23 bp, Homo sapiens
cttttaaaggggcagaaaaactc

SEQ ID NO: 2567605 - DNA, 21 bp, Homo sapiens
cttttaacacctgatgtgtac

SEQ ID NO: 2567606 - DNA, 23 bp, Homo sapiens
cttttaattaatgaaatatctgt

SEQ ID NO: 2567607 - DNA, 14 bp, Homo sapiens
cttttaattttcct

SEQ ID NO: 2567608 - DNA, 13 bp, Homo sapiens
cttttacatactg

SEQ ID NO: 2567609 - DNA, 20 bp, Homo sapiens
cttttagttgtatctctttt

SEQ ID NO: 2567610 - DNA, 21 bp, Homo sapiens
cttttagttgtatctcttttg

SEQ ID NO: 2567611 - DNA, 19 bp, Homo sapiens
cttttatcacgatattatt

SEQ ID NO: 2567612 - DNA, 18 bp, Homo sapiens
cttttatgttatttatat

SEQ ID NO: 2567613 - DNA, 16 bp, Homo sapiens
cttttattaatgcact

SEQ ID NO: 2567614 - DNA, 16 bp, Homo sapiens
cttttattgtataaac

SEQ ID NO: 2567615 - DNA, 19 bp, Homo sapiens
cttttattgtataaactat

SEQ ID NO: 2567616 - DNA, 14 bp, Homo sapiens
cttttcacaaataa

SEQ ID NO: 2567617 - DNA, 14 bp, Homo sapiens
cttttcacattctt

SEQ ID NO: 2567618 - DNA, 19 bp, Homo sapiens
cttttcacattcttataaa

SEQ ID NO: 2567619 - DNA, 22 bp, Homo sapiens
cttttcataacctagccttaga

SEQ ID NO: 2567620 - DNA, 16 bp, Homo sapiens
cttttcatctgggaaa

SEQ ID NO: 2567621 - DNA, 14 bp, Homo sapiens
cttttcccttcttt

SEQ ID NO: 2567622 - DNA, 19 bp, Homo sapiens
cttttcctattttcagccc

SEQ ID NO: 2567623 - DNA, 23 bp, Homo sapiens
cttttcctcccttgggttctgat

SEQ ID NO: 2567624 - DNA, 18 bp, Homo sapiens
cttttctaggctacaatt

SEQ ID NO: 2567625 - DNA, 13 bp, Homo sapiens
cttttctctttct

SEQ ID NO: 2567626 - DNA, 12 bp, Homo sapiens
cttttctgcaga

SEQ ID NO: 2567627 - DNA, 15 bp, Homo sapiens
cttttctgcagaggg

SEQ ID NO: 2567628 - DNA, 23 bp, Homo sapiens
cttttcttgcatgaggctagtgt

SEQ ID NO: 2567629 - DNA, 20 bp, Homo sapiens
cttttcttttctaccctagc

SEQ ID NO: 2567630 - DNA, 20 bp, Homo sapiens
cttttgaatccatgcttggg

SEQ ID NO: 2567631 - DNA, 21 bp, Homo sapiens
cttttgaatccatgcttgggt

SEQ ID NO: 2567632 - DNA, 23 bp, Homo sapiens
cttttgaatccatgcttgggtgt

SEQ ID NO: 2567633 - DNA, 22 bp, Homo sapiens
cttttgataatcaactgggctg

SEQ ID NO: 2567634 - DNA, 14 bp, Homo sapiens
cttttgcaaacttt

SEQ ID NO: 2567635 - DNA, 12 bp, Homo sapiens
cttttgcacccc

SEQ ID NO: 2567636 - DNA, 15 bp, Homo sapiens
cttttgcacccctcc

SEQ ID NO: 2567637 - DNA, 18 bp, Homo sapiens
cttttgcacccctcccat

SEQ ID NO: 2567638 - DNA, 20 bp, Homo sapiens
cttttgcacccctcccatta

SEQ ID NO: 2567639 - DNA, 21 bp, Homo sapiens
cttttgcccttcacagtgttt

SEQ ID NO: 2567640 - DNA, 15 bp, Homo sapiens
cttttgccctttgat

SEQ ID NO: 2567641 - DNA, 18 bp, Homo sapiens
cttttgccgttattaaaa

SEQ ID NO: 2567642 - DNA, 15 bp, Homo sapiens
cttttggcttccatg

SEQ ID NO: 2567643 - DNA, 20 bp, Homo sapiens
cttttggtaaagactggctt

SEQ ID NO: 2567644 - DNA, 20 bp, Homo sapiens
cttttggttaagtctgtttt

SEQ ID NO: 2567645 - DNA, 13 bp, Homo sapiens
cttttgtaagaca

SEQ ID NO: 2567646 - DNA, 20 bp, Homo sapiens
cttttgtaagacaaaggttt

SEQ ID NO: 2567647 - DNA, 14 bp, Homo sapiens
cttttgtatagttg

SEQ ID NO: 2567648 - DNA, 14 bp, Homo sapiens
cttttgtcccagaa

SEQ ID NO: 2567649 - DNA, 14 bp, Homo sapiens
cttttgtgaacttt

SEQ ID NO: 2567650 - DNA, 13 bp, Homo sapiens
cttttgtgcatta

SEQ ID NO: 2567651 - DNA, 18 bp, Homo sapiens
cttttgtgcattatctag

SEQ ID NO: 2567652 - DNA, 23 bp, Homo sapiens
cttttgtgtacagtgtgtaaagt

SEQ ID NO: 2567653 - DNA, 11 bp, Homo sapiens
cttttgttctt

SEQ ID NO: 2567654 - DNA, 22 bp, Homo sapiens
cttttgttcttggtttgtaaat

SEQ ID NO: 2567655 - DNA, 20 bp, Homo sapiens
ctttttaaatgtaaagatat

SEQ ID NO: 2567656 - DNA, 14 bp, Homo sapiens
ctttttaataaaaa

SEQ ID NO: 2567657 - DNA, 15 bp, Homo sapiens
ctttttaataaaaag

SEQ ID NO: 2567658 - DNA, 15 bp, Homo sapiens
ctttttactcccctt

SEQ ID NO: 2567659 - DNA, 13 bp, Homo sapiens
ctttttatttgca

SEQ ID NO: 2567660 - DNA, 17 bp, Homo sapiens
ctttttcatatgttgct

SEQ ID NO: 2567661 - DNA, 12 bp, Homo sapiens
ctttttcatttg

SEQ ID NO: 2567662 - DNA, 22 bp, Homo sapiens
ctttttccagacacttttttga

SEQ ID NO: 2567663 - DNA, 17 bp, Homo sapiens
ctttttccccaaagtct

SEQ ID NO: 2567664 - DNA, 21 bp, Homo sapiens
ctttttctccagctgggctct

SEQ ID NO: 2567665 - DNA, 17 bp, Homo sapiens
cttccctcatctctcct

SEQ ID NO: 2567666 - DNA, 15 bp, Homo sapiens
cttccctccctatct

SEQ ID NO: 2567667 - DNA, 11 bp, Homo sapiens
cttccctctgc

SEQ ID NO: 2567668 - DNA, 19 bp, Homo sapiens
cttccctctgcctgtccct

SEQ ID NO: 2567669 - DNA, 22 bp, Homo sapiens
cttccctgtattttctttctct

SEQ ID NO: 2567670 - DNA, 14 bp, Homo sapiens
cttccctgtccctc

SEQ ID NO: 2567671 - DNA, 15 bp, Homo sapiens
cttccctgtccctct

SEQ ID NO: 2567672 - DNA, 16 bp, Homo sapiens
cttcccttctccatct

SEQ ID NO: 2567673 - DNA, 15 bp, Homo sapiens
cttcccttgagccct

SEQ ID NO: 2567674 - DNA, 22 bp, Homo sapiens
cttccgaaaaatcctcttcctc

SEQ ID NO: 2567675 - DNA, 23 bp, Homo sapiens
cttccgaaaaatcctcttcctct

SEQ ID NO: 2567676 - DNA, 18 bp, Homo sapiens
cttccggctcctgtgctt

SEQ ID NO: 2567677 - DNA, 17 bp, Homo sapiens
cttccgtaacccaactc

SEQ ID NO: 2567678 - DNA, 23 bp, Homo sapiens
cttccgtaacccaactctcctgg

SEQ ID NO: 2567679 - DNA, 24 bp, Homo sapiens
cttcctacaagagcagcctgtggc

SEQ ID NO: 2567680 - DNA, 22 bp, Homo sapiens
cttcctacccacacctctgcca

SEQ ID NO: 2567681 - DNA, 14 bp, Homo sapiens
cttcctcacttcca

SEQ ID NO: 2567682 - DNA, 21 bp, Homo sapiens
cttcctcccaagtggtgccta

SEQ ID NO: 2567683 - DNA, 15 bp, Homo sapiens
cttcctccctcattc

SEQ ID NO: 2567684 - DNA, 20 bp, Homo sapiens
cttcctccgaggccagtacc

SEQ ID NO: 2567685 - DNA, 17 bp, Homo sapiens
cttcctcctccccactt

SEQ ID NO: 2567686 - DNA, 16 bp, Homo sapiens
cttcctcctccctcct

SEQ ID NO: 2567687 - DNA, 22 bp, Homo sapiens
cttcctcctgggccctctctgc

SEQ ID NO: 2567688 - DNA, 12 bp, Homo sapiens
cttcctctgagg

SEQ ID NO: 2567689 - DNA, 19 bp, Homo sapiens
cttcctctgcagctgacct

SEQ ID NO: 2567690 - DNA, 12 bp, Homo sapiens
cttcctctgctg

SEQ ID NO: 2567691 - DNA, 15 bp, Homo sapiens
cttcctgacacttta

SEQ ID NO: 2567692 - DNA, 16 bp, Homo sapiens
cttcctgacactttaa

SEQ ID NO: 2567693 - DNA, 22 bp, Homo sapiens
cttcctgtaacacaagccacag

SEQ ID NO: 2567694 - DNA, 23 bp, Homo sapiens
cttcctgtaacacaagccacaga

SEQ ID NO: 2567695 - DNA, 19 bp, Homo sapiens
cttcctgtccagagagaga

SEQ ID NO: 2567696 - DNA, 21 bp, Homo sapiens
cttcctgtcccacctcttctc

SEQ ID NO: 2567697 - DNA, 13 bp, Homo sapiens
cttcctgtgactt

SEQ ID NO: 2567698 - DNA, 16 bp, Homo sapiens
cttcctgtttgggccc

SEQ ID NO: 2567699 - DNA, 16 bp, Homo sapiens
cttcctgtttttcaca

SEQ ID NO: 2567700 - DNA, 14 bp, Homo sapiens
cttccttgaccagc

SEQ ID NO: 2567701 - DNA, 15 bp, Homo sapiens
cttccttgaccagca

SEQ ID NO: 2567702 - DNA, 22 bp, Homo sapiens
cttccttgaccagcagatccca

SEQ ID NO: 2567703 - DNA, 15 bp, Homo sapiens
cttccttgctctccc

SEQ ID NO: 2567704 - DNA, 16 bp, Homo sapiens
cttccttgctctgcac

SEQ ID NO: 2567705 - DNA, 17 bp, Homo sapiens
cttccttgctctgcacc

SEQ ID NO: 2567706 - DNA, 20 bp, Homo sapiens
cttccttgctgtcctaggcc

SEQ ID NO: 2567707 - DNA, 20 bp, Homo sapiens
cttccttggactcattttaa

SEQ ID NO: 2567708 - DNA, 15 bp, Homo sapiens
cttcgactcaggatc

SEQ ID NO: 2567709 - DNA, 17 bp, Homo sapiens
cttcgagcactgtccag

SEQ ID NO: 2567710 - DNA, 21 bp, Homo sapiens
cttcgcatcaaaagacaattc

SEQ ID NO: 2567711 - DNA, 14 bp, Homo sapiens
cttcgctcctgtgt

SEQ ID NO: 2567712 - DNA, 16 bp, Homo sapiens
cttcgctcctgtgtct

SEQ ID NO: 2567713 - DNA, 19 bp, Homo sapiens
cttcggaaaccttggtgta

SEQ ID NO: 2567714 - DNA, 23 bp, Homo sapiens
cttcgggaagagaggagttcaat

SEQ ID NO: 2567715 - DNA, 19 bp, Homo sapiens
cttcgggaggtcgaggcag

SEQ ID NO: 2567716 - DNA, 17 bp, Homo sapiens
cttcgggcccttcccac

SEQ ID NO: 2567717 - DNA, 14 bp, Homo sapiens
cttcgtacagttct

SEQ ID NO: 2567718 - DNA, 13 bp, Homo sapiens
cttctaaatgcat

SEQ ID NO: 2567719 - DNA, 15 bp, Homo sapiens
cttctaaatgcatat

SEQ ID NO: 2567720 - DNA, 23 bp, Homo sapiens
cttctaagtaaaaccacagcagt

SEQ ID NO: 2567721 - DNA, 18 bp, Homo sapiens
cttctaatatatttttat

SEQ ID NO: 2567722 - DNA, 17 bp, Homo sapiens
cttctaccatgaacaga

SEQ ID NO: 2567723 - DNA, 12 bp, Homo sapiens
cttctacctgcc

SEQ ID NO: 2567724 - DNA, 14 bp, Homo sapiens
cttctacctgccac

SEQ ID NO: 2567725 - DNA, 17 bp, Homo sapiens
cttctacctgccactca

SEQ ID NO: 2567726 - DNA, 21 bp, Homo sapiens
cttctacttctgcccttgcca

SEQ ID NO: 2567727 - DNA, 13 bp, Homo sapiens
cttctagaaccag

SEQ ID NO: 2567728 - DNA, 23 bp, Homo sapiens
cttctatggactggttgttgcca

SEQ ID NO: 2567729 - DNA, 18 bp, Homo sapiens
cttctattagccagtctt

SEQ ID NO: 2567730 - DNA, 19 bp, Homo sapiens
cttctcaaacctgtttaaa

SEQ ID NO: 2567731 - DNA, 16 bp, Homo sapiens
cttctcagaaggcaaa

SEQ ID NO: 2567732 - DNA, 15 bp, Homo sapiens
cttctcaggctctgc

SEQ ID NO: 2567733 - DNA, 19 bp, Homo sapiens
cttctcaggctctgccctg

SEQ ID NO: 2567734 - DNA, 18 bp, Homo sapiens
cttctcatcactcccctc

SEQ ID NO: 2567735 - DNA, 15 bp, Homo sapiens
cttctcatcctgcag

SEQ ID NO: 2567736 - DNA, 17 bp, Homo sapiens
cttctcatcctgcaggc

SEQ ID NO: 2567737 - DNA, 19 bp, Homo sapiens
cttctccaattctgcccaa

SEQ ID NO: 2567738 - DNA, 15 bp, Homo sapiens
cttctccaccctgct

SEQ ID NO: 2567739 - DNA, 17 bp, Homo sapiens
cttctccaccctgctct

SEQ ID NO: 2567740 - DNA, 21 bp, Homo sapiens
cttctccaccctgctctccga

SEQ ID NO: 2567741 - DNA, 12 bp, Homo sapiens
cttctccaggct

SEQ ID NO: 2567742 - DNA, 13 bp, Homo sapiens
cttctccagggtc

SEQ ID NO: 2567743 - DNA, 20 bp, Homo sapiens
cttctccaggtctcacgggc

SEQ ID NO: 2567744 - DNA, 13 bp, Homo sapiens
cttctccatctct

SEQ ID NO: 2567745 - DNA, 13 bp, Homo sapiens
cttctcccacact

SEQ ID NO: 2567746 - DNA, 21 bp, Homo sapiens
cttctcgaccacgggaagcat

SEQ ID NO: 2567747 - DNA, 15 bp, Homo sapiens
cttctctacagactt

SEQ ID NO: 2567748 - DNA, 19 bp, Homo sapiens
cttctctccagcccctgga

SEQ ID NO: 2567749 - DNA, 13 bp, Homo sapiens
cttctctctgtgg

SEQ ID NO: 2567750 - DNA, 11 bp, Homo sapiens
cttctctgaag

SEQ ID NO: 2567751 - DNA, 13 bp, Homo sapiens
cttctctgaagga

SEQ ID NO: 2567752 - DNA, 11 bp, Homo sapiens
cttctctgctc

SEQ ID NO: 2567753 - DNA, 15 bp, Homo sapiens
cttctctgctccacc

SEQ ID NO: 2567754 - DNA, 20 bp, Homo sapiens
cttctctggagccaagtcca

SEQ ID NO: 2567755 - DNA, 22 bp, Homo sapiens
cttctctggagccaagtccaga

SEQ ID NO: 2567756 - DNA, 21 bp, Homo sapiens
cttctctgtgaacgatttaga

SEQ ID NO: 2567757 - DNA, 22 bp, Homo sapiens
cttctgaactcaaactgaggaa

SEQ ID NO: 2567758 - DNA, 14 bp, Homo sapiens
cttctgaccacact

SEQ ID NO: 2567759 - DNA, 15 bp, Homo sapiens
cttctgaccacactt

SEQ ID NO: 2567760 - DNA, 23 bp, Homo sapiens
cttctgaccacacttcctgtcca

SEQ ID NO: 2567761 - DNA, 18 bp, Homo sapiens
cttctgacccatgctgcc

SEQ ID NO: 2567762 - DNA, 22 bp, Homo sapiens
cttagcttagacctcagcctgt

SEQ ID NO: 2567763 - DNA, 23 bp, Homo sapiens
cttagcttagacctcagcctgtg

SEQ ID NO: 2567764 - DNA, 16 bp, Homo sapiens
cttagctttttaattg

SEQ ID NO: 2567765 - DNA, 17 bp, Homo sapiens
cttaggaagagaaacca

SEQ ID NO: 2567766 - DNA, 18 bp, Homo sapiens
cttaggagcagagctctg

SEQ ID NO: 2567767 - DNA, 14 bp, Homo sapiens
cttaggatgtgtgc

SEQ ID NO: 2567768 - DNA, 16 bp, Homo sapiens
cttaggatgtgtgcat

SEQ ID NO: 2567769 - DNA, 18 bp, Homo sapiens
cttaggatgtgtgcatgt

SEQ ID NO: 2567770 - DNA, 19 bp, Homo sapiens
cttagggaaggatacaaaa

SEQ ID NO: 2567771 - DNA, 16 bp, Homo sapiens
cttaggggctgctgac

SEQ ID NO: 2567772 - DNA, 18 bp, Homo sapiens
cttaggtacttattccag

SEQ ID NO: 2567773 - DNA, 23 bp, Homo sapiens
cttaggttggcaaaaaggcagga

SEQ ID NO: 2567774 - DNA, 22 bp, Homo sapiens
cttagtaatgctacgtgtgatt

SEQ ID NO: 2567775 - DNA, 14 bp, Homo sapiens
cttagtactgagtt

SEQ ID NO: 2567776 - DNA, 20 bp, Homo sapiens
cttagtcactgagacagccc

SEQ ID NO: 2567777 - DNA, 22 bp, Homo sapiens
cttagtcactgagacagcccgg

SEQ ID NO: 2567778 - DNA, 13 bp, Homo sapiens
cttagtctcagtt

SEQ ID NO: 2567779 - DNA, 23 bp, Homo sapiens
cttagtctcagtttgtgtgtctt

SEQ ID NO: 2567780 - DNA, 17 bp, Homo sapiens
cttagtgaaattacttc

SEQ ID NO: 2567781 - DNA, 13 bp, Homo sapiens
cttagtggctttt

SEQ ID NO: 2567782 - DNA, 22 bp, Homo sapiens
cttagtggcttttttcctcctg

SEQ ID NO: 2567783 - DNA, 17 bp, Homo sapiens
cttagtggttccccacc

SEQ ID NO: 2567784 - DNA, 16 bp, Homo sapiens
cttagtgtttctgtgc

SEQ ID NO: 2567785 - DNA, 14 bp, Homo sapiens
cttagttctcactg

SEQ ID NO: 2567786 - DNA, 19 bp, Homo sapiens
cttagtttggattcttatg

SEQ ID NO: 2567787 - DNA, 14 bp, Homo sapiens
cttatagaatattt

SEQ ID NO: 2567788 - DNA, 20 bp, Homo sapiens
cttatagaatatttattacc

SEQ ID NO: 2567789 - DNA, 23 bp, Homo sapiens
cttatagtcaatgtttcttttat

SEQ ID NO: 2567790 - DNA, 17 bp, Homo sapiens
cttatatatgtgaacat

SEQ ID NO: 2567791 - DNA, 21 bp, Homo sapiens
cttatattaatattcctcagt

SEQ ID NO: 2567792 - DNA, 14 bp, Homo sapiens
cttatattgtaaga

SEQ ID NO: 2567793 - DNA, 12 bp, Homo sapiens
cttatcaagtgt

SEQ ID NO: 2567794 - DNA, 15 bp, Homo sapiens
ctgggcaaagcctag

SEQ ID NO: 2567795 - DNA, 19 bp, Homo sapiens
ctgggcaatgatggcaatt

SEQ ID NO: 2567796 - DNA, 22 bp, Homo sapiens
ctgggcacacgcctcccactgg

SEQ ID NO: 2567797 - DNA, 17 bp, Homo sapiens
ctgggcacctggggagt

SEQ ID NO: 2567798 - DNA, 19 bp, Homo sapiens
ctgggcacctggggagtgg

SEQ ID NO: 2567799 - DNA, 16 bp, Homo sapiens
ctgggcagaaggccaa

SEQ ID NO: 2567800 - DNA, 13 bp, Homo sapiens
ctgggcagacctt

SEQ ID NO: 2567801 - DNA, 17 bp, Homo sapiens
ctgggcagcatagcaag

SEQ ID NO: 2567802 - DNA, 18 bp, Homo sapiens
ctgggcagccaggctgcc

SEQ ID NO: 2567803 - DNA, 20 bp, Homo sapiens
ctgggcaggttggtgggggc

SEQ ID NO: 2567804 - DNA, 23 bp, Homo sapiens
ctgggcatagatgcaggtgagcc

SEQ ID NO: 2567805 - DNA, 17 bp, Homo sapiens
ctgggcattgctttcca

SEQ ID NO: 2567806 - DNA, 19 bp, Homo sapiens
ctgggccaactcacctgag

SEQ ID NO: 2567807 - DNA, 18 bp, Homo sapiens
ctgggccaagttcctcta

SEQ ID NO: 2567808 - DNA, 13 bp, Homo sapiens
ctgggccagagta

SEQ ID NO: 2567809 - DNA, 14 bp, Homo sapiens
ctgggcccaaccct

SEQ ID NO: 2567810 - DNA, 18 bp, Homo sapiens
ctgggcccaaccctgtct

SEQ ID NO: 2567811 - DNA, 23 bp, Homo sapiens
ctgggcccagaaggttgtgatga

SEQ ID NO: 2567812 - DNA, 24 bp, Homo sapiens
ctgggccccaaacgggctgccctg

SEQ ID NO: 2567813 - DNA, 14 bp, Homo sapiens
ctgggccccagccc

SEQ ID NO: 2567814 - DNA, 16 bp, Homo sapiens
ctgggccccagcccac

SEQ ID NO: 2567815 - DNA, 18 bp, Homo sapiens
ctgggccccagcccaccc

SEQ ID NO: 2567816 - DNA, 19 bp, Homo sapiens
ctgggccccagcccaccct

SEQ ID NO: 2567817 - DNA, 21 bp, Homo sapiens
ctgggcccctcatctgctcag

SEQ ID NO: 2567818 - DNA, 15 bp, Homo sapiens
ctgggcgccctggaa

SEQ ID NO: 2567819 - DNA, 19 bp, Homo sapiens
ctgggctcccttcccacct

SEQ ID NO: 2567820 - DNA, 17 bp, Homo sapiens
ctgggctcggaggctgc

SEQ ID NO: 2567821 - DNA, 13 bp, Homo sapiens
ctgggctctgcca

SEQ ID NO: 2567822 - DNA, 14 bp, Homo sapiens
ctgggctctgccac

SEQ ID NO: 2567823 - DNA, 21 bp, Homo sapiens
ctgggctctgccaccctacct

SEQ ID NO: 2567824 - DNA, 18 bp, Homo sapiens
ctgggctctgggagcagc

SEQ ID NO: 2567825 - DNA, 15 bp, Homo sapiens
ctgggctgagcccct

SEQ ID NO: 2567826 - DNA, 16 bp, Homo sapiens
ctgggctgagggagcc

SEQ ID NO: 2567827 - DNA, 18 bp, Homo sapiens
ctgggctgagggagcctg

SEQ ID NO: 2567828 - DNA, 19 bp, Homo sapiens
ctgggctgagggagcctgg

SEQ ID NO: 2567829 - DNA, 22 bp, Homo sapiens
ctgggcttcagtggcagctgct

SEQ ID NO: 2567830 - DNA, 19 bp, Homo sapiens
ctgggcttcatctggcaac

SEQ ID NO: 2567831 - DNA, 19 bp, Homo sapiens
ctggggaaataacagctgt

SEQ ID NO: 2567832 - DNA, 19 bp, Homo sapiens
ctggggacggggggcccca

SEQ ID NO: 2567833 - DNA, 23 bp, Homo sapiens
ctggggacggggggccccagtca

SEQ ID NO: 2567834 - DNA, 13 bp, Homo sapiens
ctggggagaaagt

SEQ ID NO: 2567835 - DNA, 14 bp, Homo sapiens
ctggggagaaagta

SEQ ID NO: 2567836 - DNA, 12 bp, Homo sapiens
ctggggagcccg

SEQ ID NO: 2567837 - DNA, 20 bp, Homo sapiens
ctggggagcccgtctcagtg

SEQ ID NO: 2567838 - DNA, 15 bp, Homo sapiens
ctggggatgtgggag

SEQ ID NO: 2567839 - DNA, 21 bp, Homo sapiens
ctggggcaagtccctgactct

SEQ ID NO: 2567840 - DNA, 23 bp, Homo sapiens
ctggggcctcggagcctcatccg

SEQ ID NO: 2567841 - DNA, 14 bp, Homo sapiens
ctggggctcccttc

SEQ ID NO: 2567842 - DNA, 15 bp, Homo sapiens
ctggggctctgggat

SEQ ID NO: 2567843 - DNA, 14 bp, Homo sapiens
ctggggctgacctt

SEQ ID NO: 2567844 - DNA, 18 bp, Homo sapiens
ctggggctgaccttcctc

SEQ ID NO: 2567845 - DNA, 12 bp, Homo sapiens
ctggggctgctg

SEQ ID NO: 2567846 - DNA, 15 bp, Homo sapiens
ctggggctgctggcc

SEQ ID NO: 2567847 - DNA, 16 bp, Homo sapiens
ctggggctgctggcct

SEQ ID NO: 2567848 - DNA, 15 bp, Homo sapiens
ctggggctggcacaa

SEQ ID NO: 2567849 - DNA, 13 bp, Homo sapiens
ctgggggaagaag

SEQ ID NO: 2567850 - DNA, 14 bp, Homo sapiens
ctgggggagtggaa

SEQ ID NO: 2567851 - DNA, 14 bp, Homo sapiens
ctgggggccatgag

SEQ ID NO: 2567852 - DNA, 18 bp, Homo sapiens
ctgggggccatgagctcc

SEQ ID NO: 2567853 - DNA, 17 bp, Homo sapiens
ctgggggcctcagtgcc

SEQ ID NO: 2567854 - DNA, 14 bp, Homo sapiens
ctgggggtgccagg

SEQ ID NO: 2567855 - DNA, 16 bp, Homo sapiens
ctgggggttgcggggg

SEQ ID NO: 2567856 - DNA, 16 bp, Homo sapiens
ctggggtaccaagaga

SEQ ID NO: 2567857 - DNA, 18 bp, Homo sapiens
ctggggtcctggggcctc

SEQ ID NO: 2567858 - DNA, 16 bp, Homo sapiens
ctgggtaaatgcagcg

SEQ ID NO: 2567859 - DNA, 20 bp, Homo sapiens
ctgggtaactagggaagata

SEQ ID NO: 2567860 - DNA, 18 bp, Homo sapiens
ctgggtacttgtggacac

SEQ ID NO: 2567861 - DNA, 13 bp, Homo sapiens
ctgggtcagtctg

SEQ ID NO: 2567862 - DNA, 21 bp, Homo sapiens
ctgggtcagtctggtgggagg

SEQ ID NO: 2567863 - DNA, 13 bp, Homo sapiens
ctgggtccaaata

SEQ ID NO: 2567864 - DNA, 16 bp, Homo sapiens
ctgggtccaaataaaa

SEQ ID NO: 2567865 - DNA, 15 bp, Homo sapiens
ctgggtctgtgtctc

SEQ ID NO: 2567866 - DNA, 17 bp, Homo sapiens
ctgggtctgtgtctctt

SEQ ID NO: 2567867 - DNA, 23 bp, Homo sapiens
ctgggtgacagagcaagactctg

SEQ ID NO: 2567868 - DNA, 16 bp, Homo sapiens
ctgggtggcctcggga

SEQ ID NO: 2567869 - DNA, 23 bp, Homo sapiens
ctgggtggcctcgggacacctgc

SEQ ID NO: 2567870 - DNA, 12 bp, Homo sapiens
ctgggtgggtgg

SEQ ID NO: 2567871 - DNA, 16 bp, Homo sapiens
ctgggtggtaccctct

SEQ ID NO: 2567872 - DNA, 19 bp, Homo sapiens
ctgggtggtctgcaggcag

SEQ ID NO: 2567873 - DNA, 21 bp, Homo sapiens
ctgggttcagaaatgctgcct

SEQ ID NO: 2567874 - DNA, 20 bp, Homo sapiens
ctgggttccctttccttcca

SEQ ID NO: 2567875 - DNA, 13 bp, Homo sapiens
ctgggttggaaaa

SEQ ID NO: 2567876 - DNA, 18 bp, Homo sapiens
ctgggttggaaaacagta

SEQ ID NO: 2567877 - DNA, 15 bp, Homo sapiens
ctgggttggagggtg

SEQ ID NO: 2567878 - DNA, 16 bp, Homo sapiens
ctgggttggtgcacag

SEQ ID NO: 2567879 - DNA, 19 bp, Homo sapiens
ctgggttggtgcacagtga

SEQ ID NO: 2567880 - DNA, 15 bp, Homo sapiens
ctgggtttggacccc

SEQ ID NO: 2567881 - DNA, 22 bp, Homo sapiens
ctgggttttgtattctctgagc

SEQ ID NO: 2567882 - DNA, 18 bp, Homo sapiens
ctggtaacagttcatgtt

SEQ ID NO: 2567883 - DNA, 16 bp, Homo sapiens
ctggtacccagccatc

SEQ ID NO: 2567884 - DNA, 23 bp, Homo sapiens
ctggtacccagccatctgcccag

SEQ ID NO: 2567885 - DNA, 16 bp, Homo sapiens
ctggtactctcctaga

SEQ ID NO: 2567886 - DNA, 12 bp, Homo sapiens
ctggtagggcag

SEQ ID NO: 2567887 - DNA, 14 bp, Homo sapiens
ctggtattcctgcc

SEQ ID NO: 2567888 - DNA, 19 bp, Homo sapiens
ctggtcacagcctcctctg

SEQ ID NO: 2567889 - DNA, 22 bp, Homo sapiens
ctggtcacaggactctgcctcc

SEQ ID NO: 2567890 - DNA, 21 bp, Homo sapiens
ctggtccagggaagctggccg

SEQ ID NO: 2567891 - DNA, 16 bp, Homo sapiens
ctggtccatgatggag

SEQ ID NO: 2567892 - DNA, 19 bp, Homo sapiens
ctggtccatgatggagtca

SEQ ID NO: 2567893 - DNA, 17 bp, Homo sapiens
ctggtcccttgcagcta

SEQ ID NO: 2567894 - DNA, 19 bp, Homo sapiens
ctggtcctgagggtcccca

SEQ ID NO: 2567895 - DNA, 19 bp, Homo sapiens
ctggtccttccaggccccc

SEQ ID NO: 2567896 - DNA, 14 bp, Homo sapiens
ctggtctctaggct

SEQ ID NO: 2567897 - DNA, 15 bp, Homo sapiens
ctggtctttcctctg

SEQ ID NO: 2567898 - DNA, 16 bp, Homo sapiens
ctggtgacaccagcct

SEQ ID NO: 2567899 - DNA, 17 bp, Homo sapiens
ctggtgaggccttgctc

SEQ ID NO: 2567900 - DNA, 23 bp, Homo sapiens
ctggtgagtcttggcggcagcag

SEQ ID NO: 2567901 - DNA, 12 bp, Homo sapiens
ctggtgcagtgg

SEQ ID NO: 2567902 - DNA, 16 bp, Homo sapiens
ctggtgcattacagag

SEQ ID NO: 2567903 - DNA, 18 bp, Homo sapiens
ctggtgcattacagagag

SEQ ID NO: 2567904 - DNA, 19 bp, Homo sapiens
ctggtgcattacagagagg

SEQ ID NO: 2567905 - DNA, 21 bp, Homo sapiens
ctggtgccagccttcctctgc

SEQ ID NO: 2567906 - DNA, 21 bp, Homo sapiens
ctggtgcctcaccccttgcca

SEQ ID NO: 2567907 - DNA, 19 bp, Homo sapiens
ctggtgctataggctggag

SEQ ID NO: 2567908 - DNA, 20 bp, Homo sapiens
ctggtgctataggctggaga

SEQ ID NO: 2567909 - DNA, 12 bp, Homo sapiens
ctggtgctgctg

SEQ ID NO: 2567910 - DNA, 23 bp, Homo sapiens
ctggtgctgtggccagggtgaga

SEQ ID NO: 2567911 - DNA, 15 bp, Homo sapiens
ctggtggacagtcct

SEQ ID NO: 2567912 - DNA, 21 bp, Homo sapiens
ctggtggacagtcctgggaga

SEQ ID NO: 2567913 - DNA, 12 bp, Homo sapiens
ctggtggcagct

SEQ ID NO: 2567914 - DNA, 20 bp, Homo sapiens
ctggtggcagctcacctctc

SEQ ID NO: 2567915 - DNA, 14 bp, Homo sapiens
ctggtggcagtggg

SEQ ID NO: 2567916 - DNA, 19 bp, Homo sapiens
ctggtggcagtgggagctg

SEQ ID NO: 2567917 - DNA, 17 bp, Homo sapiens
ctggtgggtccaggggc

SEQ ID NO: 2567918 - DNA, 22 bp, Homo sapiens
ctggtgggtccaggggcccctc

SEQ ID NO: 2567919 - DNA, 16 bp, Homo sapiens
ctggtggtttcacggt

SEQ ID NO: 2567920 - DNA, 20 bp, Homo sapiens
ctggtggtttcacggtgcca

SEQ ID NO: 2567921 - DNA, 18 bp, Homo sapiens
ctggtgtcacttactgtt

SEQ ID NO: 2567922 - DNA, 12 bp, Homo sapiens
ctggtgtcctga

SEQ ID NO: 2567923 - DNA, 13 bp, Homo sapiens
ctggtgtcctgac

SEQ ID NO: 2567924 - DNA, 14 bp, Homo sapiens
ctggtgtcctgacc

SEQ ID NO: 2567925 - DNA, 16 bp, Homo sapiens
ctggtgtgaactaaac

SEQ ID NO: 2567926 - DNA, 21 bp, Homo sapiens
ctggttcccgtttctccacct

SEQ ID NO: 2567927 - DNA, 16 bp, Homo sapiens
ctggttctatttaatg

SEQ ID NO: 2567928 - DNA, 18 bp, Homo sapiens
ctggttctatttaatgga

SEQ ID NO: 2567929 - DNA, 23 bp, Homo sapiens
ctggttctgatgatgtgcctggg

SEQ ID NO: 2567930 - DNA, 14 bp, Homo sapiens
ctggttgctgtgtg

SEQ ID NO: 2567931 - DNA, 23 bp, Homo sapiens
ctggtttcatttctactgtgact

SEQ ID NO: 2567932 - DNA, 22 bp, Homo sapiens
ctggtttgactccgctggaggt

SEQ ID NO: 2567933 - DNA, 15 bp, Homo sapiens
ctggtttggaatgct

SEQ ID NO: 2567934 - DNA, 17 bp, Homo sapiens
ctggtttggaatgcttc

SEQ ID NO: 2567935 - DNA, 16 bp, Homo sapiens
ctggtttggggcgagg

SEQ ID NO: 2567936 - DNA, 17 bp, Homo sapiens
ctggtttggggcgaggc

SEQ ID NO: 2567937 - DNA, 20 bp, Homo sapiens
ctggttttctggatggttcc

SEQ ID NO: 2567938 - DNA, 14 bp, Homo sapiens
ctggttttgctatt

SEQ ID NO: 2567939 - DNA, 21 bp, Homo sapiens
ctggcacggtggctcaggcct

SEQ ID NO: 2567940 - DNA, 16 bp, Homo sapiens
ctggcactataatgta

SEQ ID NO: 2567941 - DNA, 13 bp, Homo sapiens
ctggcactgcttc

SEQ ID NO: 2567942 - DNA, 14 bp, Homo sapiens
ctggcactgcttcc

SEQ ID NO: 2567943 - DNA, 15 bp, Homo sapiens
ctggcactgcttcca

SEQ ID NO: 2567944 - DNA, 16 bp, Homo sapiens
ctggcactgcttccag

SEQ ID NO: 2567945 - DNA, 21 bp, Homo sapiens
ctggcacttggagacttgtat

SEQ ID NO: 2567946 - DNA, 13 bp, Homo sapiens
ctggcagaactga

SEQ ID NO: 2567947 - DNA, 16 bp, Homo sapiens
ctggcagaactgagct

SEQ ID NO: 2567948 - DNA, 17 bp, Homo sapiens
ctggcagaactgagctc

SEQ ID NO: 2567949 - DNA, 18 bp, Homo sapiens
ctggcagaactgagctcc

SEQ ID NO: 2567950 - DNA, 20 bp, Homo sapiens
ctggcagaactgagctcctc

SEQ ID NO: 2567951 - DNA, 13 bp, Homo sapiens
ctggcagaaggga

SEQ ID NO: 2567952 - DNA, 11 bp, Homo sapiens
ctggcagccca

SEQ ID NO: 2567953 - DNA, 14 bp, Homo sapiens
ctggcagctcagag

SEQ ID NO: 2567954 - DNA, 13 bp, Homo sapiens
ctggcagctctcc

SEQ ID NO: 2567955 - DNA, 14 bp, Homo sapiens
ctggcagctctcca

SEQ ID NO: 2567956 - DNA, 17 bp, Homo sapiens
ctggcagctctccagtc

SEQ ID NO: 2567957 - DNA, 18 bp, Homo sapiens
ctggcagctctccagtca

SEQ ID NO: 2567958 - DNA, 20 bp, Homo sapiens
ctggcaggatgaccctgcga

SEQ ID NO: 2567959 - DNA, 19 bp, Homo sapiens
ctggcagtggaactaagaa

SEQ ID NO: 2567960 - DNA, 22 bp, Homo sapiens
ctggcattagaattatttaaac

SEQ ID NO: 2567961 - DNA, 17 bp, Homo sapiens
ctggcattgtccctgtg

SEQ ID NO: 2567962 - DNA, 16 bp, Homo sapiens
ctggccaacggggtga

SEQ ID NO: 2567963 - DNA, 15 bp, Homo sapiens
ctggccaccaggctg

SEQ ID NO: 2567964 - DNA, 16 bp, Homo sapiens
ctggccaccaggctgg

SEQ ID NO: 2567965 - DNA, 17 bp, Homo sapiens
ctggccaccaggctggc

SEQ ID NO: 2567966 - DNA, 19 bp, Homo sapiens
ctggccaccaggctggcgc

SEQ ID NO: 2567967 - DNA, 22 bp, Homo sapiens
ctggccaccaggctggcgcagc

SEQ ID NO: 2567968 - DNA, 18 bp, Homo sapiens
ctggccacctctctcctt

SEQ ID NO: 2567969 - DNA, 17 bp, Homo sapiens
ctggccacctgaggtgg

SEQ ID NO: 2567970 - DNA, 18 bp, Homo sapiens
ctggccacctgaggtggg

SEQ ID NO: 2567971 - DNA, 15 bp, Homo sapiens
ctggccactgcacag

SEQ ID NO: 2567972 - DNA, 18 bp, Homo sapiens
ctggccactgcacagagc

SEQ ID NO: 2567973 - DNA, 19 bp, Homo sapiens
ctggccagatgcaccagcc

SEQ ID NO: 2567974 - DNA, 20 bp, Homo sapiens
ctggccagatgcaccagccc

SEQ ID NO: 2567975 - DNA, 21 bp, Homo sapiens
ctggccagatgcaccagccct

SEQ ID NO: 2567976 - DNA, 13 bp, Homo sapiens
ctggccaggagct

SEQ ID NO: 2567977 - DNA, 23 bp, Homo sapiens
ctggccagggcctggaagacaga

SEQ ID NO: 2567978 - DNA, 10 bp, Homo sapiens
ctggcccagc

SEQ ID NO: 2567979 - DNA, 11 bp, Homo sapiens
ctggcccagcc

SEQ ID NO: 2567980 - DNA, 13 bp, Homo sapiens
ctggcccagccaa

SEQ ID NO: 2567981 - DNA, 14 bp, Homo sapiens
ctggcccagccctg

SEQ ID NO: 2567982 - DNA, 19 bp, Homo sapiens
ctggcccagccctgctggc

SEQ ID NO: 2567983 - DNA, 22 bp, Homo sapiens
ctggcccagccctgctggccgc

SEQ ID NO: 2567984 - DNA, 12 bp, Homo sapiens
ctggcccagccg

SEQ ID NO: 2567985 - DNA, 13 bp, Homo sapiens
ctggcccagccgg

SEQ ID NO: 2567986 - DNA, 19 bp, Homo sapiens
ctggcccagccggcctctc

SEQ ID NO: 2567987 - DNA, 22 bp, Homo sapiens
ctggcccagccggcctctctgg

SEQ ID NO: 2567988 - DNA, 12 bp, Homo sapiens
ctggcccagcgg

SEQ ID NO: 2567989 - DNA, 13 bp, Homo sapiens
ctggcccagcggc

SEQ ID NO: 2567990 - DNA, 17 bp, Homo sapiens
ctggccccatggtcagc

SEQ ID NO: 2567991 - DNA, 12 bp, Homo sapiens
ctggccccgccg

SEQ ID NO: 2567992 - DNA, 16 bp, Homo sapiens
ctggccccgccgcctg

SEQ ID NO: 2567993 - DNA, 13 bp, Homo sapiens
ctggcccctgggt

SEQ ID NO: 2567994 - DNA, 14 bp, Homo sapiens
ctggcccctgggtc

SEQ ID NO: 2567995 - DNA, 16 bp, Homo sapiens
ctggcccgtgacagac

SEQ ID NO: 2567996 - DNA, 23 bp, Homo sapiens
ctggcccgtgacagactcctgag

SEQ ID NO: 2567997 - DNA, 22 bp, Homo sapiens
ctggccctcacccctgccctgg

SEQ ID NO: 2567998 - DNA, 16 bp, Homo sapiens
ctggccctctgtgttg

SEQ ID NO: 2567999 - DNA, 13 bp, Homo sapiens
ctggccctgaggt

SEQ ID NO: 2568000 - DNA, 19 bp, Homo sapiens
ctggccctgaggtgtgggg

SEQ ID NO: 2568001 - DNA, 20 bp, Homo sapiens
ctggccgagggtcctggctc

SEQ ID NO: 2568002 - DNA, 21 bp, Homo sapiens
ctggccgagggtcctggctcc

SEQ ID NO: 2568003 - DNA, 16 bp, Homo sapiens
ctggccgcctcacccc

SEQ ID NO: 2568004 - DNA, 22 bp, Homo sapiens
ctggccggtctgcaagtcagag

SEQ ID NO: 2568005 - DNA, 22 bp, Homo sapiens
ctggccgttgatgttggctggg

SEQ ID NO: 2568006 - DNA, 21 bp, Homo sapiens
ctggcctaggagatatctgag

SEQ ID NO: 2568007 - DNA, 15 bp, Homo sapiens
ctggcctcccacccg

SEQ ID NO: 2568008 - DNA, 22 bp, Homo sapiens
ctggcctccggcgtcagcctcc

SEQ ID NO: 2568009 - DNA, 12 bp, Homo sapiens
ctggcctctgca

SEQ ID NO: 2568010 - DNA, 13 bp, Homo sapiens
ctggcctctgcac

SEQ ID NO: 2568011 - DNA, 18 bp, Homo sapiens
ctggcctctgcactcccc

SEQ ID NO: 2568012 - DNA, 20 bp, Homo sapiens
ctggcctctgcactcccctg

SEQ ID NO: 2568013 - DNA, 21 bp, Homo sapiens
ctggcctctgcactcccctgc

SEQ ID NO: 2568014 - DNA, 18 bp, Homo sapiens
ctggcctggactgttttc

SEQ ID NO: 2568015 - DNA, 15 bp, Homo sapiens
ctggcctggatctcc

SEQ ID NO: 2568016 - DNA, 22 bp, Homo sapiens
ctggcctggcacacatcaggag

SEQ ID NO: 2568017 - DNA, 17 bp, Homo sapiens
ctggcctggcccctcag

SEQ ID NO: 2568018 - DNA, 24 bp, Homo sapiens
ctggcctggcccctcagggtccct

SEQ ID NO: 2568019 - DNA, 15 bp, Homo sapiens
ctggcctggccggca

SEQ ID NO: 2568020 - DNA, 13 bp, Homo sapiens
ctggcctggcttc

SEQ ID NO: 2568021 - DNA, 12 bp, Homo sapiens
ctggcctgttct

SEQ ID NO: 2568022 - DNA, 17 bp, Homo sapiens
ctggccttccacttggc

SEQ ID NO: 2568023 - DNA, 16 bp, Homo sapiens
ctggccttcctgccct

SEQ ID NO: 2568024 - DNA, 19 bp, Homo sapiens
ctggcgacagttttccttc

SEQ ID NO: 2568025 - DNA, 13 bp, Homo sapiens
ctggcgcagccaa

SEQ ID NO: 2568026 - DNA, 19 bp, Homo sapiens
ctggcgccatcgccgggac

SEQ ID NO: 2568027 - DNA, 21 bp, Homo sapiens
ctggcgtagaagtttttgtac

SEQ ID NO: 2568028 - DNA, 22 bp, Homo sapiens
ctggcgtagaagtttttgtact

SEQ ID NO: 2568029 - DNA, 18 bp, Homo sapiens
ctggcgtcatgcaaagtc

SEQ ID NO: 2568030 - DNA, 15 bp, Homo sapiens
ctggcgtgcagtggt

SEQ ID NO: 2568031 - DNA, 19 bp, Homo sapiens
ctggctagagtcctcactc

SEQ ID NO: 2568032 - DNA, 14 bp, Homo sapiens
ctggctatgcattt

SEQ ID NO: 2568033 - DNA, 14 bp, Homo sapiens
ctggctccctcttg

SEQ ID NO: 2568034 - DNA, 16 bp, Homo sapiens
ctggctcctgaggggc

SEQ ID NO: 2568035 - DNA, 15 bp, Homo sapiens
ctggctctccaagtg

SEQ ID NO: 2568036 - DNA, 20 bp, Homo sapiens
ctggctctccaagtgccaga

SEQ ID NO: 2568037 - DNA, 22 bp, Homo sapiens
ctggctctccaagtgccagagg

SEQ ID NO: 2568038 - DNA, 13 bp, Homo sapiens
ctggctctctcca

SEQ ID NO: 2568039 - DNA, 16 bp, Homo sapiens
ctggctctctccagga

SEQ ID NO: 2568040 - DNA, 18 bp, Homo sapiens
ctggctcttccaggctgg

SEQ ID NO: 2568041 - DNA, 24 bp, Homo sapiens
ctggctcttccaggctgggagagc

SEQ ID NO: 2568042 - DNA, 15 bp, Homo sapiens
ctggctcttctgccc

SEQ ID NO: 2568043 - DNA, 17 bp, Homo sapiens
ctggctcttctgcccaa

SEQ ID NO: 2568044 - DNA, 22 bp, Homo sapiens
ctggctcttgatacccccctct

SEQ ID NO: 2568045 - DNA, 22 bp, Homo sapiens
ctggctctttggagatcaagga

SEQ ID NO: 2568046 - DNA, 17 bp, Homo sapiens
ctggctgaaccctgtgc

SEQ ID NO: 2568047 - DNA, 19 bp, Homo sapiens
ctggctgaaccctgtgctg

SEQ ID NO: 2568048 - DNA, 13 bp, Homo sapiens
ctggctgcccaga

SEQ ID NO: 2568049 - DNA, 16 bp, Homo sapiens
ctggctgccccaacct

SEQ ID NO: 2568050 - DNA, 16 bp, Homo sapiens
ctggctgccctggccc

SEQ ID NO: 2568051 - DNA, 17 bp, Homo sapiens
ctggctgccctggccct

SEQ ID NO: 2568052 - DNA, 20 bp, Homo sapiens
ctggctgccctggccctgag

SEQ ID NO: 2568053 - DNA, 23 bp, Homo sapiens
ctggctgccctggccctgaggtg

SEQ ID NO: 2568054 - DNA, 14 bp, Homo sapiens
ctggctggaaggga

SEQ ID NO: 2568055 - DNA, 12 bp, Homo sapiens
ctggctggagcc

SEQ ID NO: 2568056 - DNA, 14 bp, Homo sapiens
ctggctgggcatgg

SEQ ID NO: 2568057 - DNA, 15 bp, Homo sapiens
ctggctgggcatgga

SEQ ID NO: 2568058 - DNA, 15 bp, Homo sapiens
ctggcttccaggtat

SEQ ID NO: 2568059 - DNA, 22 bp, Homo sapiens
ctggcttccaggtatctccagg

SEQ ID NO: 2568060 - DNA, 23 bp, Homo sapiens
ctggcttccaggtatctccagga

SEQ ID NO: 2568061 - DNA, 15 bp, Homo sapiens
ctggcttctggagcc

SEQ ID NO: 2568062 - DNA, 20 bp, Homo sapiens
ctggcttctggagcccttgg

SEQ ID NO: 2568063 - DNA, 23 bp, Homo sapiens
ctggcttttattaatgcactttc

SEQ ID NO: 2568064 - DNA, 17 bp, Homo sapiens
ctgggaaaataccccat

SEQ ID NO: 2568065 - DNA, 19 bp, Homo sapiens
ctgggaaatgagaaggcag

SEQ ID NO: 2568066 - DNA, 22 bp, Homo sapiens
ctgggaaatgagaaggcagcca

SEQ ID NO: 2568067 - DNA, 19 bp, Homo sapiens
ctgggaagacgcctgagct

SEQ ID NO: 2568068 - DNA, 20 bp, Homo sapiens
ctgggaagataggctctgca

SEQ ID NO: 2568069 - DNA, 13 bp, Homo sapiens
ctgggaagggaag

SEQ ID NO: 2568070 - DNA, 23 bp, Homo sapiens
ctgggaatgtattattctgcagc

SEQ ID NO: 2568071 - DNA, 16 bp, Homo sapiens
ctgggaccacgtgaga

SEQ ID NO: 2568072 - DNA, 13 bp, Homo sapiens
ctgggacctttag

SEQ ID NO: 2568073 - DNA, 15 bp, Homo sapiens
ctgggactacaggca

SEQ ID NO: 2568074 - DNA, 17 bp, Homo sapiens
ctgggactacaggcacc

SEQ ID NO: 2568075 - DNA, 21 bp, Homo sapiens
ctgggactacaggcacccacc

SEQ ID NO: 2568076 - DNA, 13 bp, Homo sapiens
ctgggactgagcc

SEQ ID NO: 2568077 - DNA, 14 bp, Homo sapiens
ctgggactggccag

SEQ ID NO: 2568078 - DNA, 20 bp, Homo sapiens
ctgggacttccttgctctcc

SEQ ID NO: 2568079 - DNA, 18 bp, Homo sapiens
ctgggagaggtgccagca

SEQ ID NO: 2568080 - DNA, 23 bp, Homo sapiens
ctgggagaggtgccagcaactga

SEQ ID NO: 2568081 - DNA, 13 bp, Homo sapiens
ctgggagctctgc

SEQ ID NO: 2568082 - DNA, 13 bp, Homo sapiens
ctgggaggaagca

SEQ ID NO: 2568083 - DNA, 18 bp, Homo sapiens
ctgggaggcaagaggggt

SEQ ID NO: 2568084 - DNA, 21 bp, Homo sapiens
ctgggaggcaagaggggtgga

SEQ ID NO: 2568085 - DNA, 19 bp, Homo sapiens
ctgggaggcatggccctgg

SEQ ID NO: 2568086 - DNA, 22 bp, Homo sapiens
ctgggaggcggagagtacagtg

SEQ ID NO: 2568087 - DNA, 13 bp, Homo sapiens
ctgggagggcagc

SEQ ID NO: 2568088 - DNA, 17 bp, Homo sapiens
ctgggagggcagcaggg

SEQ ID NO: 2568089 - DNA, 20 bp, Homo sapiens
ctgggagggcagcagggcta

SEQ ID NO: 2568090 - DNA, 15 bp, Homo sapiens
ctgctggcctggatc

SEQ ID NO: 2568091 - DNA, 16 bp, Homo sapiens
ctgctggcctggccgg

SEQ ID NO: 2568092 - DNA, 19 bp, Homo sapiens
ctgctggctcttctgccca

SEQ ID NO: 2568093 - DNA, 19 bp, Homo sapiens
ctgctgggactggccaggt

SEQ ID NO: 2568094 - DNA, 17 bp, Homo sapiens
ctgctgggtgtggcgca

SEQ ID NO: 2568095 - DNA, 17 bp, Homo sapiens
ctgctggtcacagcctc

SEQ ID NO: 2568096 - DNA, 22 bp, Homo sapiens
ctgctggtgcagagctgaagat

SEQ ID NO: 2568097 - DNA, 15 bp, Homo sapiens
ctgctgtccagacag

SEQ ID NO: 2568098 - DNA, 17 bp, Homo sapiens
ctgctgtccagacagcc

SEQ ID NO: 2568099 - DNA, 19 bp, Homo sapiens
ctgctgtgctgtgcccaag

SEQ ID NO: 2568100 - DNA, 14 bp, Homo sapiens
ctgcttaatgaaaa

SEQ ID NO: 2568101 - DNA, 18 bp, Homo sapiens
ctgcttacaattccctgc

SEQ ID NO: 2568102 - DNA, 18 bp, Homo sapiens
ctgcttaggagagaccga

SEQ ID NO: 2568103 - DNA, 21 bp, Homo sapiens
ctgcttcaatacccaaatcct

SEQ ID NO: 2568104 - DNA, 23 bp, Homo sapiens
ctgcttcagcctcccgagtagct

SEQ ID NO: 2568105 - DNA, 12 bp, Homo sapiens
ctgcttcagtgg

SEQ ID NO: 2568106 - DNA, 14 bp, Homo sapiens
ctgcttccagtgag

SEQ ID NO: 2568107 - DNA, 20 bp, Homo sapiens
ctgcttccagtgaggctctg

SEQ ID NO: 2568108 - DNA, 11 bp, Homo sapiens
ctgcttcccat

SEQ ID NO: 2568109 - DNA, 13 bp, Homo sapiens
ctgcttcccatcc

SEQ ID NO: 2568110 - DNA, 14 bp, Homo sapiens
ctgcttcccatcct

SEQ ID NO: 2568111 - DNA, 15 bp, Homo sapiens
ctgcttcccatccta

SEQ ID NO: 2568112 - DNA, 21 bp, Homo sapiens
ctgcttccctctgcctgtccc

SEQ ID NO: 2568113 - DNA, 22 bp, Homo sapiens
ctgcttccctctgcctgtccct

SEQ ID NO: 2568114 - DNA, 13 bp, Homo sapiens
ctgcttgaggcaa

SEQ ID NO: 2568115 - DNA, 20 bp, Homo sapiens
ctgcttgaggcaactcatct

SEQ ID NO: 2568116 - DNA, 22 bp, Homo sapiens
ctgcttgaggcaactcatctta

SEQ ID NO: 2568117 - DNA, 20 bp, Homo sapiens
ctgcttgcttgctttttaat

SEQ ID NO: 2568118 - DNA, 14 bp, Homo sapiens
ctgcttgggtggag

SEQ ID NO: 2568119 - DNA, 18 bp, Homo sapiens
ctgcttgggtggagaagc

SEQ ID NO: 2568120 - DNA, 21 bp, Homo sapiens
ctgcttgggtggagaagccat

SEQ ID NO: 2568121 - DNA, 22 bp, Homo sapiens
ctgcttgggtggagaagccatt

SEQ ID NO: 2568122 - DNA, 15 bp, Homo sapiens
ctgctttcccctgtg

SEQ ID NO: 2568123 - DNA, 19 bp, Homo sapiens
ctgctttcccctgtgggga

SEQ ID NO: 2568124 - DNA, 20 bp, Homo sapiens
ctgctttcccctgtggggat

SEQ ID NO: 2568125 - DNA, 21 bp, Homo sapiens
ctgcttttccttggggcaggc

SEQ ID NO: 2568126 - DNA, 20 bp, Homo sapiens
ctgcttttgtctatgggact

SEQ ID NO: 2568127 - DNA, 21 bp, Homo sapiens
ctgcttttgtctatgggactc

SEQ ID NO: 2568128 - DNA, 22 bp, Homo sapiens
ctgctttttaaagaatgctctt

SEQ ID NO: 2568129 - DNA, 18 bp, Homo sapiens
ctggaaaatgtgacccag

SEQ ID NO: 2568130 - DNA, 15 bp, Homo sapiens
ctggaaaggctcagt

SEQ ID NO: 2568131 - DNA, 20 bp, Homo sapiens
ctcaggtcagggtgaggatg

SEQ ID NO: 2568132 - DNA, 14 bp, Homo sapiens
ctcaggtgagaagc

SEQ ID NO: 2568133 - DNA, 19 bp, Homo sapiens
ctcaggtgagaagcagagg

SEQ ID NO: 2568134 - DNA, 21 bp, Homo sapiens
ctcaggtggggtcactctggc

SEQ ID NO: 2568135 - DNA, 22 bp, Homo sapiens
ctcaggtggggtcactctggca

SEQ ID NO: 2568136 - DNA, 15 bp, Homo sapiens
ctcaggtgtccctgc

SEQ ID NO: 2568137 - DNA, 16 bp, Homo sapiens
ctcaggtgtccctgca

SEQ ID NO: 2568138 - DNA, 12 bp, Homo sapiens
ctcaggttccta

SEQ ID NO: 2568139 - DNA, 22 bp, Homo sapiens
ctcaggttgtagtaaagaaatt

SEQ ID NO: 2568140 - DNA, 16 bp, Homo sapiens
ctcagtaaagcacttg

SEQ ID NO: 2568141 - DNA, 19 bp, Homo sapiens
ctcagtaagacgacaagga

SEQ ID NO: 2568142 - DNA, 21 bp, Homo sapiens
ctcagtaagacgacaaggaaa

SEQ ID NO: 2568143 - DNA, 14 bp, Homo sapiens
ctcagtcatgcata

SEQ ID NO: 2568144 - DNA, 16 bp, Homo sapiens
ctcagtccatgaagat

SEQ ID NO: 2568145 - DNA, 15 bp, Homo sapiens
ctcagtctccctttc

SEQ ID NO: 2568146 - DNA, 13 bp, Homo sapiens
ctcagtctctgag

SEQ ID NO: 2568147 - DNA, 21 bp, Homo sapiens
ctcagtggcttcatctgtcaa

SEQ ID NO: 2568148 - DNA, 18 bp, Homo sapiens
ctcagtgtcatttatgaa

SEQ ID NO: 2568149 - DNA, 15 bp, Homo sapiens
ctcagttcccttggc

SEQ ID NO: 2568150 - DNA, 16 bp, Homo sapiens
ctcagttcccttggcc

SEQ ID NO: 2568151 - DNA, 18 bp, Homo sapiens
ctcagttcccttggcctc

SEQ ID NO: 2568152 - DNA, 22 bp, Homo sapiens
ctcagttccgatttcccaggct

SEQ ID NO: 2568153 - DNA, 15 bp, Homo sapiens
ctcagttctagtctc

SEQ ID NO: 2568154 - DNA, 17 bp, Homo sapiens
ctcagttttatcatttt

SEQ ID NO: 2568155 - DNA, 18 bp, Homo sapiens
ctcagttttatcattttc

SEQ ID NO: 2568156 - DNA, 13 bp, Homo sapiens
ctcagttttcata

SEQ ID NO: 2568157 - DNA, 14 bp, Homo sapiens
ctcagttttcataa

SEQ ID NO: 2568158 - DNA, 18 bp, Homo sapiens
ctcataatagacttccca

SEQ ID NO: 2568159 - DNA, 15 bp, Homo sapiens
ctcatacccaccccc

SEQ ID NO: 2568160 - DNA, 16 bp, Homo sapiens
ctcatacccaccccca

SEQ ID NO: 2568161 - DNA, 19 bp, Homo sapiens
ctcatacccacccccaccc

SEQ ID NO: 2568162 - DNA, 16 bp, Homo sapiens
ctcatacctttaaagg

SEQ ID NO: 2568163 - DNA, 18 bp, Homo sapiens
ctcatacctttaaaggaa

SEQ ID NO: 2568164 - DNA, 12 bp, Homo sapiens
ctcatagcatta

SEQ ID NO: 2568165 - DNA, 18 bp, Homo sapiens
ctcatagcattaactaat

SEQ ID NO: 2568166 - DNA, 15 bp, Homo sapiens
ctcatatcagtttgc

SEQ ID NO: 2568167 - DNA, 13 bp, Homo sapiens
ctcatatggccca

SEQ ID NO: 2568168 - DNA, 18 bp, Homo sapiens
ctcatatggcccagtgtc

SEQ ID NO: 2568169 - DNA, 19 bp, Homo sapiens
ctcatatggcccagtgtca

SEQ ID NO: 2568170 - DNA, 21 bp, Homo sapiens
ctcatattgtgattctgcctt

SEQ ID NO: 2568171 - DNA, 22 bp, Homo sapiens
ctcatcaccaacgtctgtgcca

SEQ ID NO: 2568172 - DNA, 24 bp, Homo sapiens
ctcatcagtgtcctcttgctcaaa

SEQ ID NO: 2568173 - DNA, 12 bp, Homo sapiens
ctcatcataaaa

SEQ ID NO: 2568174 - DNA, 13 bp, Homo sapiens
ctcatcattctct

SEQ ID NO: 2568175 - DNA, 15 bp, Homo sapiens
ctcatcattctctgt

SEQ ID NO: 2568176 - DNA, 13 bp, Homo sapiens
ctcatccacccca

SEQ ID NO: 2568177 - DNA, 19 bp, Homo sapiens
ctcatccatcatcatgtgt

SEQ ID NO: 2568178 - DNA, 19 bp, Homo sapiens
ctcatcccacgcactccat

SEQ ID NO: 2568179 - DNA, 23 bp, Homo sapiens
ctcatccccaggggtcccagcca

SEQ ID NO: 2568180 - DNA, 22 bp, Homo sapiens
ctcatcccgagcacctccacat

SEQ ID NO: 2568181 - DNA, 16 bp, Homo sapiens
ctcatcccgtgttctc

SEQ ID NO: 2568182 - DNA, 21 bp, Homo sapiens
ctcatccctaatgctgcagat

SEQ ID NO: 2568183 - DNA, 16 bp, Homo sapiens
ctcatcgcgtcctcct

SEQ ID NO: 2568184 - DNA, 18 bp, Homo sapiens
ctcatctgtccctccggg

SEQ ID NO: 2568185 - DNA, 23 bp, Homo sapiens
ctcatgatagaaggctatgggga

SEQ ID NO: 2568186 - DNA, 14 bp, Homo sapiens
ctcatgcatctcca

SEQ ID NO: 2568187 - DNA, 18 bp, Homo sapiens
ctcatgcatctccacctg

SEQ ID NO: 2568188 - DNA, 15 bp, Homo sapiens
ctcatgctgaaagcc

SEQ ID NO: 2568189 - DNA, 15 bp, Homo sapiens
ctcatggcccctctg

SEQ ID NO: 2568190 - DNA, 20 bp, Homo sapiens
ctcatggcccctctgacctg

SEQ ID NO: 2568191 - DNA, 16 bp, Homo sapiens
ctcatgtacataccct

SEQ ID NO: 2568192 - DNA, 12 bp, Homo sapiens
ctcatgtgatcc

SEQ ID NO: 2568193 - DNA, 12 bp, Homo sapiens
ctcatgtgtatg

SEQ ID NO: 2568194 - DNA, 19 bp, Homo sapiens
ctcatgtgtgctcttcttc

SEQ ID NO: 2568195 - DNA, 18 bp, Homo sapiens
ctcatgttcttaattctt

SEQ ID NO: 2568196 - DNA, 19 bp, Homo sapiens
ctcatgttcttaattctta

SEQ ID NO: 2568197 - DNA, 18 bp, Homo sapiens
ctcatgttttccattgtt

SEQ ID NO: 2568198 - DNA, 21 bp, Homo sapiens
ctcatgttttccattgtttga

SEQ ID NO: 2568199 - DNA, 21 bp, Homo sapiens
ctcattagcattttgctaaat

SEQ ID NO: 2568200 - DNA, 18 bp, Homo sapiens
ctcattaggatggctagt

SEQ ID NO: 2568201 - DNA, 15 bp, Homo sapiens
ctcattcaaaagttg

SEQ ID NO: 2568202 - DNA, 19 bp, Homo sapiens
ctcattcaaaagttgaaat

SEQ ID NO: 2568203 - DNA, 21 bp, Homo sapiens
ctcattcctccacctgccgtg

SEQ ID NO: 2568204 - DNA, 13 bp, Homo sapiens
ctcattcctgcct

SEQ ID NO: 2568205 - DNA, 17 bp, Homo sapiens
ctcattctgaaggagcc

SEQ ID NO: 2568206 - DNA, 21 bp, Homo sapiens
ctcattgacctgaggcccttc

SEQ ID NO: 2568207 - DNA, 16 bp, Homo sapiens
ctcatttcaggagcag

SEQ ID NO: 2568208 - DNA, 13 bp, Homo sapiens
ctcatttcaggat

SEQ ID NO: 2568209 - DNA, 21 bp, Homo sapiens
ctcatttgtcacacactttgg

SEQ ID NO: 2568210 - DNA, 16 bp, Homo sapiens
ctccaaaagcacttac

SEQ ID NO: 2568211 - DNA, 18 bp, Homo sapiens
ctccaaaataaaactttt

SEQ ID NO: 2568212 - DNA, 18 bp, Homo sapiens
ctccaactggattataaa

SEQ ID NO: 2568213 - DNA, 17 bp, Homo sapiens
ctccaagaatgctgaaa

SEQ ID NO: 2568214 - DNA, 20 bp, Homo sapiens
ctccaagaatgctgaaacca

SEQ ID NO: 2568215 - DNA, 21 bp, Homo sapiens
ctccaagacctgttggttcca

SEQ ID NO: 2568216 - DNA, 17 bp, Homo sapiens
ctccaagaccttctcct

SEQ ID NO: 2568217 - DNA, 14 bp, Homo sapiens
ctccaagcaggaca

SEQ ID NO: 2568218 - DNA, 13 bp, Homo sapiens
ctccaagccagcg

SEQ ID NO: 2568219 - DNA, 14 bp, Homo sapiens
ctccaagctccatc

SEQ ID NO: 2568220 - DNA, 18 bp, Homo sapiens
ctccaagctccatctcca

SEQ ID NO: 2568221 - DNA, 14 bp, Homo sapiens
ctccaagctcccag

SEQ ID NO: 2568222 - DNA, 16 bp, Homo sapiens
ctccaagctcccaggc

SEQ ID NO: 2568223 - DNA, 17 bp, Homo sapiens
ctccaagctcccaggca

SEQ ID NO: 2568224 - DNA, 12 bp, Homo sapiens
ctccaaggacca

SEQ ID NO: 2568225 - DNA, 15 bp, Homo sapiens
ctccaaggaccaggt

SEQ ID NO: 2568226 - DNA, 19 bp, Homo sapiens
ctccaagggcttctgcacc

SEQ ID NO: 2568227 - DNA, 23 bp, Homo sapiens
ctccaagggcttctgcaccctcc

SEQ ID NO: 2568228 - DNA, 17 bp, Homo sapiens
ctccaagtctcagtggc

SEQ ID NO: 2568229 - DNA, 14 bp, Homo sapiens
ctccaagtgccaga

SEQ ID NO: 2568230 - DNA, 15 bp, Homo sapiens
ctccaagtgccagag

SEQ ID NO: 2568231 - DNA, 18 bp, Homo sapiens
ctccaagtgccagaggtg

SEQ ID NO: 2568232 - DNA, 19 bp, Homo sapiens
ctccaagtgccagaggtgg

SEQ ID NO: 2568233 - DNA, 14 bp, Homo sapiens
ctccaatcctgccc

SEQ ID NO: 2568234 - DNA, 15 bp, Homo sapiens
ctccaatcctgcccc

SEQ ID NO: 2568235 - DNA, 20 bp, Homo sapiens
ctccaattaaggattttatg

SEQ ID NO: 2568236 - DNA, 22 bp, Homo sapiens
ctccaattaaggattttatgct

SEQ ID NO: 2568237 - DNA, 21 bp, Homo sapiens
ctccacacacagctgggctgt

SEQ ID NO: 2568238 - DNA, 17 bp, Homo sapiens
ctccacaccctctccca

SEQ ID NO: 2568239 - DNA, 14 bp, Homo sapiens
ctccacagccgcag

SEQ ID NO: 2568240 - DNA, 15 bp, Homo sapiens
ctccacagttcagtg

SEQ ID NO: 2568241 - DNA, 23 bp, Homo sapiens
ctccacagttcagtggcagggct

SEQ ID NO: 2568242 - DNA, 22 bp, Homo sapiens
ctccacagttcgacctgcggct

SEQ ID NO: 2568243 - DNA, 15 bp, Homo sapiens
ctccaccaccactgg

SEQ ID NO: 2568244 - DNA, 17 bp, Homo sapiens
ctccaccaccactggcc

SEQ ID NO: 2568245 - DNA, 14 bp, Homo sapiens
ctccacccatccta

SEQ ID NO: 2568246 - DNA, 15 bp, Homo sapiens
ctccacccccagctg

SEQ ID NO: 2568247 - DNA, 17 bp, Homo sapiens
ctccacccccagctgct

SEQ ID NO: 2568248 - DNA, 18 bp, Homo sapiens
ctccacccccagctgctt

SEQ ID NO: 2568249 - DNA, 16 bp, Homo sapiens
ctccaccccccagaac

SEQ ID NO: 2568250 - DNA, 21 bp, Homo sapiens
ctccaccccccagaacctgtc

SEQ ID NO: 2568251 - DNA, 23 bp, Homo sapiens
ctccaccccccagaacctgtcct

SEQ ID NO: 2568252 - DNA, 11 bp, Homo sapiens
ctccaccctgc

SEQ ID NO: 2568253 - DNA, 17 bp, Homo sapiens
ctccaccctgtccccca

SEQ ID NO: 2568254 - DNA, 18 bp, Homo sapiens
ctccaccctgtcccccag

SEQ ID NO: 2568255 - DNA, 22 bp, Homo sapiens
ctccaccctgtcccccagctct

SEQ ID NO: 2568256 - DNA, 23 bp, Homo sapiens
ctccaccctgtcccccagctctg

SEQ ID NO: 2568257 - DNA, 12 bp, Homo sapiens
ctccacccttgg

SEQ ID NO: 2568258 - DNA, 13 bp, Homo sapiens
ctccacccttggc

SEQ ID NO: 2568259 - DNA, 15 bp, Homo sapiens
ctccacccttggcct

SEQ ID NO: 2568260 - DNA, 15 bp, Homo sapiens
ctccacctagactgt

SEQ ID NO: 2568261 - DNA, 14 bp, Homo sapiens
ctccacctgccagg

SEQ ID NO: 2568262 - DNA, 21 bp, Homo sapiens
ctccacctgccagggacagag

SEQ ID NO: 2568263 - DNA, 18 bp, Homo sapiens
ctccacgttctgctcatc

SEQ ID NO: 2568264 - DNA, 23 bp, Homo sapiens
ctccactggccggagtcagtgcc

SEQ ID NO: 2568265 - DNA, 12 bp, Homo sapiens
ctccactgtcac

SEQ ID NO: 2568266 - DNA, 21 bp, Homo sapiens
ctccacttcttgttccccact

SEQ ID NO: 2568267 - DNA, 19 bp, Homo sapiens
ctccagaaccgcagaagcc

SEQ ID NO: 2568268 - DNA, 14 bp, Homo sapiens
ctccagaagatagc

SEQ ID NO: 2568269 - DNA, 15 bp, Homo sapiens
ctccagaagatagct

SEQ ID NO: 2568270 - DNA, 23 bp, Homo sapiens
ctccagaagatagcttcacccca

SEQ ID NO: 2568271 - DNA, 15 bp, Homo sapiens
ttatgtctcttctga

SEQ ID NO: 2568272 - DNA, 19 bp, Homo sapiens
ttatgtctgctgaataata

SEQ ID NO: 2568273 - DNA, 23 bp, Homo sapiens
ttatgtgaatgatctctctgaat

SEQ ID NO: 2568274 - DNA, 12 bp, Homo sapiens
ttatgtgtgtgt

SEQ ID NO: 2568275 - DNA, 23 bp, Homo sapiens
ttattaaaaatctcaaatttcta

SEQ ID NO: 2568276 - DNA, 17 bp, Homo sapiens
ttattaaagttctgtaa

SEQ ID NO: 2568277 - DNA, 21 bp, Homo sapiens
ttattaaatgcccagcccctt

SEQ ID NO: 2568278 - DNA, 18 bp, Homo sapiens
ttattaacataggtgaaa

SEQ ID NO: 2568279 - DNA, 23 bp, Homo sapiens
ttattaagatggattctcagata

SEQ ID NO: 2568280 - DNA, 11 bp, Homo sapiens
ttattaatgca

SEQ ID NO: 2568281 - DNA, 12 bp, Homo sapiens
ttattacatctt

SEQ ID NO: 2568282 - DNA, 12 bp, Homo sapiens
ttattacctctg

SEQ ID NO: 2568283 - DNA, 21 bp, Homo sapiens
ttattagagattacctcctga

SEQ ID NO: 2568284 - DNA, 20 bp, Homo sapiens
ttattagtaaatgcttatca

SEQ ID NO: 2568285 - DNA, 15 bp, Homo sapiens
ttattagttaatata

SEQ ID NO: 2568286 - DNA, 15 bp, Homo sapiens
ttattagtttacatc

SEQ ID NO: 2568287 - DNA, 18 bp, Homo sapiens
ttattagtttacatcatt

SEQ ID NO: 2568288 - DNA, 12 bp, Homo sapiens
ttattataattg

SEQ ID NO: 2568289 - DNA, 15 bp, Homo sapiens
ttattataattgtat

SEQ ID NO: 2568290 - DNA, 16 bp, Homo sapiens
ttattatctaaagtgt

SEQ ID NO: 2568291 - DNA, 22 bp, Homo sapiens
ttattatctaaagtgtgttgtt

SEQ ID NO: 2568292 - DNA, 13 bp, Homo sapiens
ttattatgcatga

SEQ ID NO: 2568293 - DNA, 22 bp, Homo sapiens
ttattatttgtgttttaattta

SEQ ID NO: 2568294 - DNA, 16 bp, Homo sapiens
ttattattttcacctg

SEQ ID NO: 2568295 - DNA, 20 bp, Homo sapiens
ttattcagcttcatttgtgt

SEQ ID NO: 2568296 - DNA, 12 bp, Homo sapiens
ttattccacatc

SEQ ID NO: 2568297 - DNA, 13 bp, Homo sapiens
ttattccacatct

SEQ ID NO: 2568298 - DNA, 20 bp, Homo sapiens
ttattccatattcatgtaaa

SEQ ID NO: 2568299 - DNA, 20 bp, Homo sapiens
ttattccccattcttcctag

SEQ ID NO: 2568300 - DNA, 16 bp, Homo sapiens
ttattccctgtacaat

SEQ ID NO: 2568301 - DNA, 20 bp, Homo sapiens
ttattcctatatagtttatt

SEQ ID NO: 2568302 - DNA, 16 bp, Homo sapiens
ttattcctcctgctca

SEQ ID NO: 2568303 - DNA, 20 bp, Homo sapiens
ttattcctcctgctcatatt

SEQ ID NO: 2568304 - DNA, 21 bp, Homo sapiens
ttattcctgataataattgat

SEQ ID NO: 2568305 - DNA, 19 bp, Homo sapiens
ttattcctgtatgttgtcc

SEQ ID NO: 2568306 - DNA, 11 bp, Homo sapiens
ttattctgctc

SEQ ID NO: 2568307 - DNA, 13 bp, Homo sapiens
ttattctttttaa

SEQ ID NO: 2568308 - DNA, 20 bp, Homo sapiens
ttattgaatctatttaagta

SEQ ID NO: 2568309 - DNA, 13 bp, Homo sapiens
ttattgagaattt

SEQ ID NO: 2568310 - DNA, 13 bp, Homo sapiens
ttattggaattaa

SEQ ID NO: 2568311 - DNA, 16 bp, Homo sapiens
ttattggaattaacct

SEQ ID NO: 2568312 - DNA, 14 bp, Homo sapiens
ttattggctgagat

SEQ ID NO: 2568313 - DNA, 16 bp, Homo sapiens
ttattggctgagatat

SEQ ID NO: 2568314 - DNA, 19 bp, Homo sapiens
ttattgtacagctgtttaa

SEQ ID NO: 2568315 - DNA, 15 bp, Homo sapiens
ttattgtacctctct

SEQ ID NO: 2568316 - DNA, 21 bp, Homo sapiens
ttattgtataaactatcagtt

SEQ ID NO: 2568317 - DNA, 20 bp, Homo sapiens
ttattgtgtttttaatttat

SEQ ID NO: 2568318 - DNA, 16 bp, Homo sapiens
ttattgttccaagaca

SEQ ID NO: 2568319 - DNA, 17 bp, Homo sapiens
ttattgttccaagacat

SEQ ID NO: 2568320 - DNA, 13 bp, Homo sapiens
ttatttaaaagat

SEQ ID NO: 2568321 - DNA, 14 bp, Homo sapiens
ttatttaaaagatt

SEQ ID NO: 2568322 - DNA, 17 bp, Homo sapiens
ttatttaaaagattcat

SEQ ID NO: 2568323 - DNA, 12 bp, Homo sapiens
ttatttaaatga

SEQ ID NO: 2568324 - DNA, 13 bp, Homo sapiens
ttatttaataaca

SEQ ID NO: 2568325 - DNA, 14 bp, Homo sapiens
ttatttaataacaa

SEQ ID NO: 2568326 - DNA, 19 bp, Homo sapiens
ttatttaataacattacct

SEQ ID NO: 2568327 - DNA, 17 bp, Homo sapiens
ttatttactgagcttct

SEQ ID NO: 2568328 - DNA, 22 bp, Homo sapiens
ttatttactgagcttctctgtg

SEQ ID NO: 2568329 - DNA, 17 bp, Homo sapiens
ttatttagactcatctt

SEQ ID NO: 2568330 - DNA, 23 bp, Homo sapiens
ttatttagactcatcttactgta

SEQ ID NO: 2568331 - DNA, 15 bp, Homo sapiens
ttatttatttatgga

SEQ ID NO: 2568332 - DNA, 20 bp, Homo sapiens
ttatttcactttagatgctg

SEQ ID NO: 2568333 - DNA, 15 bp, Homo sapiens
ttatttcagaaatgt

SEQ ID NO: 2568334 - DNA, 15 bp, Homo sapiens
ttatttcatgaaaat

SEQ ID NO: 2568335 - DNA, 22 bp, Homo sapiens
ttatttgaaaacatataaagca

SEQ ID NO: 2568336 - DNA, 15 bp, Homo sapiens
ttatttgcagagaca

SEQ ID NO: 2568337 - DNA, 13 bp, Homo sapiens
ttatttgcatgtg

SEQ ID NO: 2568338 - DNA, 17 bp, Homo sapiens
ttattttaaacaaaata

SEQ ID NO: 2568339 - DNA, 16 bp, Homo sapiens
ttattttagtttctgt

SEQ ID NO: 2568340 - DNA, 12 bp, Homo sapiens
ttattttcactg

SEQ ID NO: 2568341 - DNA, 15 bp, Homo sapiens
ttattttcctcccca

SEQ ID NO: 2568342 - DNA, 21 bp, Homo sapiens
ttattttctggtagatagaaa

SEQ ID NO: 2568343 - DNA, 23 bp, Homo sapiens
ttattttgccatggatgagagtc

SEQ ID NO: 2568344 - DNA, 20 bp, Homo sapiens
ttcagtgagggtcttcttac

SEQ ID NO: 2568345 - DNA, 13 bp, Homo sapiens
ttcagtgctgtgg

SEQ ID NO: 2568346 - DNA, 14 bp, Homo sapiens
ttcagtggggcagt

SEQ ID NO: 2568347 - DNA, 13 bp, Homo sapiens
ttcagtgtaattt

SEQ ID NO: 2568348 - DNA, 19 bp, Homo sapiens
ttcagtgtaatttctttgc

SEQ ID NO: 2568349 - DNA, 20 bp, Homo sapiens
ttcagtgtaatttctttgcc

SEQ ID NO: 2568350 - DNA, 13 bp, Homo sapiens
ttcagtgtacatg

SEQ ID NO: 2568351 - DNA, 15 bp, Homo sapiens
ttcagttacagaaag

SEQ ID NO: 2568352 - DNA, 19 bp, Homo sapiens
ttcagttggctgacttcca

SEQ ID NO: 2568353 - DNA, 19 bp, Homo sapiens
ttcagttttaccagatgat

SEQ ID NO: 2568354 - DNA, 12 bp, Homo sapiens
ttcagttttcag

SEQ ID NO: 2568355 - DNA, 20 bp, Homo sapiens
ttcataagtattatgtctct

SEQ ID NO: 2568356 - DNA, 19 bp, Homo sapiens
ttcatagctaagaaataaa

SEQ ID NO: 2568357 - DNA, 21 bp, Homo sapiens
ttcatatatgaggacttgtgt

SEQ ID NO: 2568358 - DNA, 20 bp, Homo sapiens
ttcatatgtaccatgtacat

SEQ ID NO: 2568359 - DNA, 16 bp, Homo sapiens
ttcatatgttgctcag

SEQ ID NO: 2568360 - DNA, 14 bp, Homo sapiens
ttcatattgaatat

SEQ ID NO: 2568361 - DNA, 22 bp, Homo sapiens
ttcatattgtgccaatatgtat

SEQ ID NO: 2568362 - DNA, 14 bp, Homo sapiens
ttcatcaagactgg

SEQ ID NO: 2568363 - DNA, 15 bp, Homo sapiens
ttcatcaatgaatga

SEQ ID NO: 2568364 - DNA, 18 bp, Homo sapiens
ttcatcatcctaagctat

SEQ ID NO: 2568365 - DNA, 20 bp, Homo sapiens
ttcatccaatcctcactggg

SEQ ID NO: 2568366 - DNA, 21 bp, Homo sapiens
ttcatccaatcctcactgggt

SEQ ID NO: 2568367 - DNA, 18 bp, Homo sapiens
ttcatcctgactctgccc

SEQ ID NO: 2568368 - DNA, 18 bp, Homo sapiens
ttcatctatttctgagaa

SEQ ID NO: 2568369 - DNA, 15 bp, Homo sapiens
ttcatctccagggag

SEQ ID NO: 2568370 - DNA, 22 bp, Homo sapiens
ttcatctccagggagtcccctc

SEQ ID NO: 2568371 - DNA, 14 bp, Homo sapiens
ttcatctctcagaa

SEQ ID NO: 2568372 - DNA, 22 bp, Homo sapiens
ttcatcttggtcacatacaatt

SEQ ID NO: 2568373 - DNA, 17 bp, Homo sapiens
ttcatgatttcatttca

SEQ ID NO: 2568374 - DNA, 17 bp, Homo sapiens
ttcatgattttgaaatc

SEQ ID NO: 2568375 - DNA, 22 bp, Homo sapiens
ttcatgccaccatggccagcca

SEQ ID NO: 2568376 - DNA, 22 bp, Homo sapiens
ttcatgccagctacttcctcct

SEQ ID NO: 2568377 - DNA, 17 bp, Homo sapiens
ttcatgctatctctgtg

SEQ ID NO: 2568378 - DNA, 22 bp, Homo sapiens
ttcatgtcaacttctggctcct

SEQ ID NO: 2568379 - DNA, 16 bp, Homo sapiens
ttcatgttttgtgact

SEQ ID NO: 2568380 - DNA, 17 bp, Homo sapiens
ttcatgttttgtgacta

SEQ ID NO: 2568381 - DNA, 19 bp, Homo sapiens
ttcattaagccctcttcca

SEQ ID NO: 2568382 - DNA, 21 bp, Homo sapiens
ttcattaccttttttgataaa

SEQ ID NO: 2568383 - DNA, 17 bp, Homo sapiens
ttcattattggaattaa

SEQ ID NO: 2568384 - DNA, 15 bp, Homo sapiens
ttcattctcctgcct

SEQ ID NO: 2568385 - DNA, 16 bp, Homo sapiens
ttcattcttctctagc

SEQ ID NO: 2568386 - DNA, 19 bp, Homo sapiens
ttcattcttgaaagctgtg

SEQ ID NO: 2568387 - DNA, 17 bp, Homo sapiens
ttcattgagagttttgt

SEQ ID NO: 2568388 - DNA, 22 bp, Homo sapiens
ttcattgagagttttgtcttga

SEQ ID NO: 2568389 - DNA, 21 bp, Homo sapiens
ttcattgccttaactggagcc

SEQ ID NO: 2568390 - DNA, 12 bp, Homo sapiens
ttcattgtaaaa

SEQ ID NO: 2568391 - DNA, 17 bp, Homo sapiens
ttcattgtaatgttact

SEQ ID NO: 2568392 - DNA, 13 bp, Homo sapiens
ttcattgtataaa

SEQ ID NO: 2568393 - DNA, 17 bp, Homo sapiens
ttcatttaaaatgatta

SEQ ID NO: 2568394 - DNA, 15 bp, Homo sapiens
ttcatttcaactgtt

SEQ ID NO: 2568395 - DNA, 12 bp, Homo sapiens
ttcatttcattg

SEQ ID NO: 2568396 - DNA, 16 bp, Homo sapiens
ttcatttgatgctaaa

SEQ ID NO: 2568397 - DNA, 19 bp, Homo sapiens
ttcatttggaaataagctg

SEQ ID NO: 2568398 - DNA, 14 bp, Homo sapiens
ttcatttttaatca

SEQ ID NO: 2568399 - DNA, 17 bp, Homo sapiens
ttcatttttaatcatga

SEQ ID NO: 2568400 - DNA, 23 bp, Homo sapiens
ttcatttttttcactggagttac

SEQ ID NO: 2568401 - DNA, 16 bp, Homo sapiens
ttccaaaagtggcctc

SEQ ID NO: 2568402 - DNA, 21 bp, Homo sapiens
ttccaaaagtggcctctttgt

SEQ ID NO: 2568403 - DNA, 20 bp, Homo sapiens
ttccaaagcacattgaaaga

SEQ ID NO: 2568404 - DNA, 17 bp, Homo sapiens
ttccaaatgaatgttgt

SEQ ID NO: 2568405 - DNA, 21 bp, Homo sapiens
ttccaaatgaatgttgtctgt

SEQ ID NO: 2568406 - DNA, 23 bp, Homo sapiens
ttccaacaccacagacacacaca

SEQ ID NO: 2568407 - DNA, 23 bp, Homo sapiens
ttccaacagctcaagtcttccct

SEQ ID NO: 2568408 - DNA, 16 bp, Homo sapiens
ttccaagacattgtca

SEQ ID NO: 2568409 - DNA, 17 bp, Homo sapiens
ttccaagacattgtcaa

SEQ ID NO: 2568410 - DNA, 15 bp, Homo sapiens
ttccaagggtactaa

SEQ ID NO: 2568411 - DNA, 12 bp, Homo sapiens
ttccaagtgtgc

SEQ ID NO: 2568412 - DNA, 18 bp, Homo sapiens
ttccacaaaatctgtcca

SEQ ID NO: 2568413 - DNA, 18 bp, Homo sapiens
ttccacaccaagcagcaa

SEQ ID NO: 2568414 - DNA, 17 bp, Homo sapiens
ttccacacccccacccc

SEQ ID NO: 2568415 - DNA, 21 bp, Homo sapiens
ttccacacctggcactgctgt

SEQ ID NO: 2568416 - DNA, 12 bp, Homo sapiens
ttccaccagcct

SEQ ID NO: 2568417 - DNA, 19 bp, Homo sapiens
ttccaccatcaagccacca

SEQ ID NO: 2568418 - DNA, 13 bp, Homo sapiens
ttccaccccctcc

SEQ ID NO: 2568419 - DNA, 15 bp, Homo sapiens
ttccacctccctccc

SEQ ID NO: 2568420 - DNA, 19 bp, Homo sapiens
ttccacgatgaaaaacttc

SEQ ID NO: 2568421 - DNA, 15 bp, Homo sapiens
ttccacggagccact

SEQ ID NO: 2568422 - DNA, 21 bp, Homo sapiens
ttccacggagccactcctctg

SEQ ID NO: 2568423 - DNA, 24 bp, Homo sapiens
ttccacggagccactcctctgact

SEQ ID NO: 2568424 - DNA, 14 bp, Homo sapiens
ttccactgagctcc

SEQ ID NO: 2568425 - DNA, 22 bp, Homo sapiens
ttccactggacttgagcttggc

SEQ ID NO: 2568426 - DNA, 20 bp, Homo sapiens
ttccagaggctattattttc

SEQ ID NO: 2568427 - DNA, 20 bp, Homo sapiens
ttccagctcaccccccacac

SEQ ID NO: 2568428 - DNA, 17 bp, Homo sapiens
ttccagtacctttgtca

SEQ ID NO: 2568429 - DNA, 18 bp, Homo sapiens
ttccagtacctttgtcac

SEQ ID NO: 2568430 - DNA, 19 bp, Homo sapiens
ttccagtacctttgtcaca

SEQ ID NO: 2568431 - DNA, 15 bp, Homo sapiens
ttccagtgaggctct

SEQ ID NO: 2568432 - DNA, 17 bp, Homo sapiens
ttccagtgaggctctgc

SEQ ID NO: 2568433 - DNA, 19 bp, Homo sapiens
ttccagtgcaacactgaag

SEQ ID NO: 2568434 - DNA, 17 bp, Homo sapiens
ttccataaggaatgtag

SEQ ID NO: 2568435 - DNA, 22 bp, Homo sapiens
ttccataatctggactcctctg

SEQ ID NO: 2568436 - DNA, 16 bp, Homo sapiens
ttccataatgtataaa

SEQ ID NO: 2568437 - DNA, 19 bp, Homo sapiens
ttccataatgtataaagaa

SEQ ID NO: 2568438 - DNA, 16 bp, Homo sapiens
ttccataattatgaca

SEQ ID NO: 2568439 - DNA, 22 bp, Homo sapiens
ttccataattatgacagttata

SEQ ID NO: 2568440 - DNA, 18 bp, Homo sapiens
ttccatatattagcattt

SEQ ID NO: 2568441 - DNA, 15 bp, Homo sapiens
ttccatatgacctca

SEQ ID NO: 2568442 - DNA, 16 bp, Homo sapiens
ttccatcatgtcccca

SEQ ID NO: 2568443 - DNA, 14 bp, Homo sapiens
ttccatcccagagg

SEQ ID NO: 2568444 - DNA, 21 bp, Homo sapiens
ttccatccctaccccctaaga

SEQ ID NO: 2568445 - DNA, 23 bp, Homo sapiens
ttccatctcgccacccctccttc

SEQ ID NO: 2568446 - DNA, 20 bp, Homo sapiens
ttccatgaagtttgaacttc

SEQ ID NO: 2568447 - DNA, 15 bp, Homo sapiens
ttccatgaatcgctt

SEQ ID NO: 2568448 - DNA, 20 bp, Homo sapiens
ttccatgaatgtatcaggaa

SEQ ID NO: 2568449 - DNA, 18 bp, Homo sapiens
ttccatgagaacagcagg

SEQ ID NO: 2568450 - DNA, 13 bp, Homo sapiens
ttccatgcctgag

SEQ ID NO: 2568451 - DNA, 15 bp, Homo sapiens
ttccatgcctgaggg

SEQ ID NO: 2568452 - DNA, 15 bp, Homo sapiens
ttccatggactttgt

SEQ ID NO: 2568453 - DNA, 17 bp, Homo sapiens
ttccatgtcgcctctgc

SEQ ID NO: 2568454 - DNA, 19 bp, Homo sapiens
ttccatgtcgcctctgcat

SEQ ID NO: 2568455 - DNA, 20 bp, Homo sapiens
ttccatgtcgcctctgcatt

SEQ ID NO: 2568456 - DNA, 21 bp, Homo sapiens
ttccatgtcgcctctgcattc

SEQ ID NO: 2568457 - DNA, 14 bp, Homo sapiens
ttccattatgattc

SEQ ID NO: 2568458 - DNA, 17 bp, Homo sapiens
ttccattggatctcatt

SEQ ID NO: 2568459 - DNA, 15 bp, Homo sapiens
ttccattgtttgaaa

SEQ ID NO: 2568460 - DNA, 21 bp, Homo sapiens
ttccattgtttggagacattc

SEQ ID NO: 2568461 - DNA, 19 bp, Homo sapiens
ttccatttatctttctaca

SEQ ID NO: 2568462 - DNA, 16 bp, Homo sapiens
ttcccaaaggactcca

SEQ ID NO: 2568463 - DNA, 19 bp, Homo sapiens
ttcccaaaggactccaccc

SEQ ID NO: 2568464 - DNA, 15 bp, Homo sapiens
ttcccaagctctgct

SEQ ID NO: 2568465 - DNA, 16 bp, Homo sapiens
ttcccaagctctgctc

SEQ ID NO: 2568466 - DNA, 18 bp, Homo sapiens
ttcccaagctctgctcct

SEQ ID NO: 2568467 - DNA, 14 bp, Homo sapiens
ttcccaattcacat

SEQ ID NO: 2568468 - DNA, 18 bp, Homo sapiens
ttcccacaggacatttct

SEQ ID NO: 2568469 - DNA, 15 bp, Homo sapiens
ttcccaccaaggtct

SEQ ID NO: 2568470 - DNA, 18 bp, Homo sapiens
ttcccaccaggctgctca

SEQ ID NO: 2568471 - DNA, 18 bp, Homo sapiens
ttcccactctagggcagt

SEQ ID NO: 2568472 - DNA, 15 bp, Homo sapiens
ttcccactgtttaag

SEQ ID NO: 2568473 - DNA, 13 bp, Homo sapiens
ttcccagaaggca

SEQ ID NO: 2568474 - DNA, 23 bp, Homo sapiens
ttcccagaaggcatatcagtctc

SEQ ID NO: 2568475 - DNA, 12 bp, Homo sapiens
ttcccagaatca

SEQ ID NO: 2568476 - DNA, 23 bp, Homo sapiens
ttcccagaatcaaagcaatgcat

SEQ ID NO: 2568477 - DNA, 14 bp, Homo sapiens
ttcccagatacttc

SEQ ID NO: 2568478 - DNA, 10 bp, Homo sapiens
ttcccagggt

SEQ ID NO: 2568479 - DNA, 20 bp, Homo sapiens
ttcccagggtagcccgcctg

SEQ ID NO: 2568480 - DNA, 23 bp, Homo sapiens
ttcccagggtagcccgcctgcca

SEQ ID NO: 2568481 - DNA, 18 bp, Homo sapiens
ttcccagtggctgctgcc

SEQ ID NO: 2568482 - DNA, 19 bp, Homo sapiens
ttcccagtggctgctgccc

SEQ ID NO: 2568483 - DNA, 13 bp, Homo sapiens
ttcccatcctacc

SEQ ID NO: 2568484 - DNA, 18 bp, Homo sapiens
ttcccatgacccaggctg

SEQ ID NO: 2568485 - DNA, 15 bp, Homo sapiens
ttaccatatgtgctt

SEQ ID NO: 2568486 - DNA, 23 bp, Homo sapiens
ttaccattttggggtacccactg

SEQ ID NO: 2568487 - DNA, 16 bp, Homo sapiens
ttacccacacacagat

SEQ ID NO: 2568488 - DNA, 20 bp, Homo sapiens
ttacccatatcccctctccc

SEQ ID NO: 2568489 - DNA, 16 bp, Homo sapiens
ttaccctcctgtaaat

SEQ ID NO: 2568490 - DNA, 16 bp, Homo sapiens
ttaccctttagactgt

SEQ ID NO: 2568491 - DNA, 17 bp, Homo sapiens
ttacctaaacagatata

SEQ ID NO: 2568492 - DNA, 18 bp, Homo sapiens
ttacctaaacagatataa

SEQ ID NO: 2568493 - DNA, 18 bp, Homo sapiens
ttacctaccacagtgtct

SEQ ID NO: 2568494 - DNA, 11 bp, Homo sapiens
ttacctctgat

SEQ ID NO: 2568495 - DNA, 18 bp, Homo sapiens
ttacctgatcaatgacag

SEQ ID NO: 2568496 - DNA, 14 bp, Homo sapiens
ttaccttcaataaa

SEQ ID NO: 2568497 - DNA, 18 bp, Homo sapiens
ttacctttttatttgcat

SEQ ID NO: 2568498 - DNA, 17 bp, Homo sapiens
ttaccttttttgataaa

SEQ ID NO: 2568499 - DNA, 16 bp, Homo sapiens
ttacggacaccccctc

SEQ ID NO: 2568500 - DNA, 18 bp, Homo sapiens
ttactaagccacaagaaa

SEQ ID NO: 2568501 - DNA, 20 bp, Homo sapiens
ttactaagccacaagaaatt

SEQ ID NO: 2568502 - DNA, 20 bp, Homo sapiens
ttactacaaaatttgaaatt

SEQ ID NO: 2568503 - DNA, 13 bp, Homo sapiens
ttactacagttgt

SEQ ID NO: 2568504 - DNA, 20 bp, Homo sapiens
ttactagggatccctcatct

SEQ ID NO: 2568505 - DNA, 23 bp, Homo sapiens
ttactcagaattctctagtttga

SEQ ID NO: 2568506 - DNA, 21 bp, Homo sapiens
ttactcatttttttaatttat

SEQ ID NO: 2568507 - DNA, 11 bp, Homo sapiens
ttactcccctt

SEQ ID NO: 2568508 - DNA, 23 bp, Homo sapiens
ttactgaacaatcaaagcacttg

SEQ ID NO: 2568509 - DNA, 19 bp, Homo sapiens
ttactgaaggtaaaattga

SEQ ID NO: 2568510 - DNA, 12 bp, Homo sapiens
ttactgaatgca

SEQ ID NO: 2568511 - DNA, 23 bp, Homo sapiens
ttactgaatgcaccatggtcaaa

SEQ ID NO: 2568512 - DNA, 12 bp, Homo sapiens
ttactgaccagc

SEQ ID NO: 2568513 - DNA, 14 bp, Homo sapiens
ttactgatcatgca

SEQ ID NO: 2568514 - DNA, 17 bp, Homo sapiens
ttactgatcatgcattg

SEQ ID NO: 2568515 - DNA, 23 bp, Homo sapiens
ttactgtctggttttaacaattt

SEQ ID NO: 2568516 - DNA, 20 bp, Homo sapiens
ttactgtggaggaaggattg

SEQ ID NO: 2568517 - DNA, 23 bp, Homo sapiens
ttactgttacctgatcaatgaca

SEQ ID NO: 2568518 - DNA, 18 bp, Homo sapiens
ttactgttagtcatttgc

SEQ ID NO: 2568519 - DNA, 14 bp, Homo sapiens
ttactgtttctgtc

SEQ ID NO: 2568520 - DNA, 15 bp, Homo sapiens
ttactgtttctgtca

SEQ ID NO: 2568521 - DNA, 21 bp, Homo sapiens
ttacttaaaccgccaaggctg

SEQ ID NO: 2568522 - DNA, 18 bp, Homo sapiens
ttacttaggtgtggggga

SEQ ID NO: 2568523 - DNA, 12 bp, Homo sapiens
ttacttctgcta

SEQ ID NO: 2568524 - DNA, 19 bp, Homo sapiens
ttacttgcattgaatatat

SEQ ID NO: 2568525 - DNA, 14 bp, Homo sapiens
ttacttttaaactg

SEQ ID NO: 2568526 - DNA, 21 bp, Homo sapiens
ttagaaaacataatcttctgc

SEQ ID NO: 2568527 - DNA, 22 bp, Homo sapiens
ttagaaagaagcccaatattat

SEQ ID NO: 2568528 - DNA, 18 bp, Homo sapiens
ttagaaggttctctcctc

SEQ ID NO: 2568529 - DNA, 16 bp, Homo sapiens
ttagaagtcacacagt

SEQ ID NO: 2568530 - DNA, 13 bp, Homo sapiens
ttagaagtgttaa

SEQ ID NO: 2568531 - DNA, 16 bp, Homo sapiens
ttagaattaaaagttg

SEQ ID NO: 2568532 - DNA, 13 bp, Homo sapiens
ttagaattattta

SEQ ID NO: 2568533 - DNA, 20 bp, Homo sapiens
ttagacaaatactcatgtgt

SEQ ID NO: 2568534 - DNA, 23 bp, Homo sapiens
ttagacaaatactcatgtgtatg

SEQ ID NO: 2568535 - DNA, 13 bp, Homo sapiens
ttagacagagtct

SEQ ID NO: 2568536 - DNA, 14 bp, Homo sapiens
ttagacagtccctg

SEQ ID NO: 2568537 - DNA, 13 bp, Homo sapiens
ttagacataacaa

SEQ ID NO: 2568538 - DNA, 13 bp, Homo sapiens
ttagacctcagcc

SEQ ID NO: 2568539 - DNA, 15 bp, Homo sapiens
ttagacctcagcctg

SEQ ID NO: 2568540 - DNA, 14 bp, Homo sapiens
ttagactacattta

SEQ ID NO: 2568541 - DNA, 14 bp, Homo sapiens
ttagactgtagcct

SEQ ID NO: 2568542 - DNA, 20 bp, Homo sapiens
ttagactgtagcctggatat

SEQ ID NO: 2568543 - DNA, 13 bp, Homo sapiens
ttagagatgaatt

SEQ ID NO: 2568544 - DNA, 18 bp, Homo sapiens
ttagaggaaaaaaatgac

SEQ ID NO: 2568545 - DNA, 15 bp, Homo sapiens
tttcatattgtgcca

SEQ ID NO: 2568546 - DNA, 16 bp, Homo sapiens
tttcatctgggaaaga

SEQ ID NO: 2568547 - DNA, 16 bp, Homo sapiens
tttcatgctatctctg

SEQ ID NO: 2568548 - DNA, 22 bp, Homo sapiens
tttcatggggtgatgctgggct

SEQ ID NO: 2568549 - DNA, 17 bp, Homo sapiens
tttcatgttttaacaaa

SEQ ID NO: 2568550 - DNA, 19 bp, Homo sapiens
tttcatgttttaacaaaaa

SEQ ID NO: 2568551 - DNA, 17 bp, Homo sapiens
ttggcttcctttcttgg

SEQ ID NO: 2568552 - DNA, 14 bp, Homo sapiens
ttgggaataaatat

SEQ ID NO: 2568553 - DNA, 16 bp, Homo sapiens
ttgggaatgaggcttg

SEQ ID NO: 2568554 - DNA, 16 bp, Homo sapiens
ttgggaccgccagatg

SEQ ID NO: 2568555 - DNA, 22 bp, Homo sapiens
ttgggaccgccagatggggcct

SEQ ID NO: 2568556 - DNA, 16 bp, Homo sapiens
ttgggagcactggagt

SEQ ID NO: 2568557 - DNA, 19 bp, Homo sapiens
ttgggagcttgggaatgga

SEQ ID NO: 2568558 - DNA, 18 bp, Homo sapiens
ttgggatgatgcctcatg

SEQ ID NO: 2568559 - DNA, 21 bp, Homo sapiens
ttgggattgggggctggtgcc

SEQ ID NO: 2568560 - DNA, 22 bp, Homo sapiens
ttgggattgggggctggtgcca

SEQ ID NO: 2568561 - DNA, 12 bp, Homo sapiens
ttgggcccagct

SEQ ID NO: 2568562 - DNA, 22 bp, Homo sapiens
ttgggcccagctgggctctgcc

SEQ ID NO: 2568563 - DNA, 14 bp, Homo sapiens
ttgggccccagcct

SEQ ID NO: 2568564 - DNA, 12 bp, Homo sapiens
ttgggccctcct

SEQ ID NO: 2568565 - DNA, 16 bp, Homo sapiens
ttgggcggctgagagc

SEQ ID NO: 2568566 - DNA, 15 bp, Homo sapiens
ttgggctcctttttc

SEQ ID NO: 2568567 - DNA, 21 bp, Homo sapiens
ttcctggtacccagccatctg

SEQ ID NO: 2568568 - DNA, 11 bp, Homo sapiens
ttcctgtaaca

SEQ ID NO: 2568569 - DNA, 22 bp, Homo sapiens
ttcctgtaacacaagccacaga

SEQ ID NO: 2568570 - DNA, 15 bp, Homo sapiens
ttcctgtagcatctt

SEQ ID NO: 2568571 - DNA, 17 bp, Homo sapiens
ttcctgtagcatcttct

SEQ ID NO: 2568572 - DNA, 16 bp, Homo sapiens
ttcctgtatgttgtcc

SEQ ID NO: 2568573 - DNA, 15 bp, Homo sapiens
ttcctgtccagagag

SEQ ID NO: 2568574 - DNA, 15 bp, Homo sapiens
ttcctgtcccacctc

SEQ ID NO: 2568575 - DNA, 14 bp, Homo sapiens
ttcctgtcttcctg

SEQ ID NO: 2568576 - DNA, 23 bp, Homo sapiens
ttcctgttaggtattagaaagtg

SEQ ID NO: 2568577 - DNA, 19 bp, Homo sapiens
ttcctgttggatttgttta

SEQ ID NO: 2568578 - DNA, 16 bp, Homo sapiens
ttccttaaactgtgtg

SEQ ID NO: 2568579 - DNA, 16 bp, Homo sapiens
ttccttctcatctgtg

SEQ ID NO: 2568580 - DNA, 13 bp, Homo sapiens
ttccttctgaagt

SEQ ID NO: 2568581 - DNA, 19 bp, Homo sapiens
ttccttctttgataatgtt

SEQ ID NO: 2568582 - DNA, 15 bp, Homo sapiens
ttccttgaccagcag

SEQ ID NO: 2568583 - DNA, 20 bp, Homo sapiens
ttccttgagttgattcagct

SEQ ID NO: 2568584 - DNA, 15 bp, Homo sapiens
ttccttgctcaacca

SEQ ID NO: 2568585 - DNA, 17 bp, Homo sapiens
ttccttggactcatttt

SEQ ID NO: 2568586 - DNA, 18 bp, Homo sapiens
ttccttggcatgccttcc

SEQ ID NO: 2568587 - DNA, 15 bp, Homo sapiens
ttccttggctggtgc

SEQ ID NO: 2568588 - DNA, 17 bp, Homo sapiens
ttccttggggcaggcag

SEQ ID NO: 2568589 - DNA, 16 bp, Homo sapiens
ttccttgtcactggta

SEQ ID NO: 2568590 - DNA, 13 bp, Homo sapiens
ttccttgtcccca

SEQ ID NO: 2568591 - DNA, 16 bp, Homo sapiens
ttccttgtccccacac

SEQ ID NO: 2568592 - DNA, 17 bp, Homo sapiens
ttccttgtccccacact

SEQ ID NO: 2568593 - DNA, 16 bp, Homo sapiens
ttcctttaaaaaaatt

SEQ ID NO: 2568594 - DNA, 17 bp, Homo sapiens
ttcctttaaaaaaattt

SEQ ID NO: 2568595 - DNA, 10 bp, Homo sapiens
ttcctttctc

SEQ ID NO: 2568596 - DNA, 12 bp, Homo sapiens
ttccttttatca

SEQ ID NO: 2568597 - DNA, 22 bp, Homo sapiens
ttcgaagctcagcccacccccc

SEQ ID NO: 2568598 - DNA, 19 bp, Homo sapiens
ttcgactgtgacctgtggg

SEQ ID NO: 2568599 - DNA, 17 bp, Homo sapiens
ttcgacttgcatttttg

SEQ ID NO: 2568600 - DNA, 15 bp, Homo sapiens
ttcgagaagctgctc

SEQ ID NO: 2568601 - DNA, 17 bp, Homo sapiens
ttcgagaccagcctggc

SEQ ID NO: 2568602 - DNA, 14 bp, Homo sapiens
ttcgcatcaaaaga

SEQ ID NO: 2568603 - DNA, 21 bp, Homo sapiens
ttcgcatcaaaagacaattct

SEQ ID NO: 2568604 - DNA, 12 bp, Homo sapiens
ttcggaaacctt

SEQ ID NO: 2568605 - DNA, 20 bp, Homo sapiens
ttcggtttctaacttggagc

SEQ ID NO: 2568606 - DNA, 15 bp, Homo sapiens
ttcgtacagttcttc

SEQ ID NO: 2568607 - DNA, 23 bp, Homo sapiens
ttcgtacagttcttcgggaagag

SEQ ID NO: 2568608 - DNA, 13 bp, Homo sapiens
ttcgtcttctaat

SEQ ID NO: 2568609 - DNA, 14 bp, Homo sapiens
ttctaaaaaaagaa

SEQ ID NO: 2568610 - DNA, 15 bp, Homo sapiens
ttctaaagatggaaa

SEQ ID NO: 2568611 - DNA, 18 bp, Homo sapiens
ttctaaagccttaagtct

SEQ ID NO: 2568612 - DNA, 17 bp, Homo sapiens
ttctaaaggctaccttt

SEQ ID NO: 2568613 - DNA, 18 bp, Homo sapiens
ttctaaaggctacctttg

SEQ ID NO: 2568614 - DNA, 14 bp, Homo sapiens
ttctaaatgaagtg

SEQ ID NO: 2568615 - DNA, 23 bp, Homo sapiens
ttctaaatgcatatcctgagcca

SEQ ID NO: 2568616 - DNA, 18 bp, Homo sapiens
tttcatgttttgtgacta

SEQ ID NO: 2568617 - DNA, 21 bp, Homo sapiens
tttcattattagtactgctct

SEQ ID NO: 2568618 - DNA, 22 bp, Homo sapiens
tttcattgctgggcttgtctgt

SEQ ID NO: 2568619 - DNA, 14 bp, Homo sapiens
tttcattgtaaaac

SEQ ID NO: 2568620 - DNA, 17 bp, Homo sapiens
tttcattgtatgatgtg

SEQ ID NO: 2568621 - DNA, 23 bp, Homo sapiens
tttcattgtatgatgtgttgtga

SEQ ID NO: 2568622 - DNA, 17 bp, Homo sapiens
tttccaaaaaaatactg

SEQ ID NO: 2568623 - DNA, 24 bp, Homo sapiens
tttccaaaagtggcctctttgtct

SEQ ID NO: 2568624 - DNA, 12 bp, Homo sapiens
tttccaaagtac

SEQ ID NO: 2568625 - DNA, 15 bp, Homo sapiens
tttccaaagtacact

SEQ ID NO: 2568626 - DNA, 20 bp, Homo sapiens
tttccaacaccacagacaca

SEQ ID NO: 2568627 - DNA, 22 bp, Homo sapiens
tttccaacaccacagacacaca

SEQ ID NO: 2568628 - DNA, 14 bp, Homo sapiens
tttccaagagctga

SEQ ID NO: 2568629 - DNA, 19 bp, Homo sapiens
tttccacgatgaaaaactt

SEQ ID NO: 2568630 - DNA, 12 bp, Homo sapiens
tttccactgaag

SEQ ID NO: 2568631 - DNA, 15 bp, Homo sapiens
tttccataaggaatg

SEQ ID NO: 2568632 - DNA, 12 bp, Homo sapiens
tttccatatgtt

SEQ ID NO: 2568633 - DNA, 16 bp, Homo sapiens
tttccatgaaaacgtt

SEQ ID NO: 2568634 - DNA, 15 bp, Homo sapiens
tttcccaattaggaa

SEQ ID NO: 2568635 - DNA, 21 bp, Homo sapiens
tttcccactgtttaaggagtt

SEQ ID NO: 2568636 - DNA, 14 bp, Homo sapiens
tttccccaaagtct

SEQ ID NO: 2568637 - DNA, 21 bp, Homo sapiens
tttccccaaagtcttaaaata

SEQ ID NO: 2568638 - DNA, 15 bp, Homo sapiens
tttccccaacagtgt

SEQ ID NO: 2568639 - DNA, 19 bp, Homo sapiens
tttccccaggggaaaatga

SEQ ID NO: 2568640 - DNA, 23 bp, Homo sapiens
tttccccccactctccccacact

SEQ ID NO: 2568641 - DNA, 21 bp, Homo sapiens
tttcccccttttctgcatttt

SEQ ID NO: 2568642 - DNA, 13 bp, Homo sapiens
tttcccctccctg

SEQ ID NO: 2568643 - DNA, 12 bp, Homo sapiens
tttccctgtgct

SEQ ID NO: 2568644 - DNA, 14 bp, Homo sapiens
tttcccttatcaaa

SEQ ID NO: 2568645 - DNA, 20 bp, Homo sapiens
tttcccttcagtaccctctc

SEQ ID NO: 2568646 - DNA, 15 bp, Homo sapiens
tttccgttaaaatac

SEQ ID NO: 2568647 - DNA, 21 bp, Homo sapiens
tttcctaataaagttctgtac

SEQ ID NO: 2568648 - DNA, 24 bp, Homo sapiens
tttcctaataaagttctgtactca

SEQ ID NO: 2568649 - DNA, 18 bp, Homo sapiens
tttcctagcacacacttt

SEQ ID NO: 2568650 - DNA, 21 bp, Homo sapiens
tttcctagcacacacttttgg

SEQ ID NO: 2568651 - DNA, 16 bp, Homo sapiens
tttcctccccagcagg

SEQ ID NO: 2568652 - DNA, 11 bp, Homo sapiens
tttcctccctt

SEQ ID NO: 2568653 - DNA, 19 bp, Homo sapiens
tttcctctattgatgtaca

SEQ ID NO: 2568654 - DNA, 21 bp, Homo sapiens
tttcctcttctattttgtaaa

SEQ ID NO: 2568655 - DNA, 20 bp, Homo sapiens
tttcctgagaccacagagag

SEQ ID NO: 2568656 - DNA, 13 bp, Homo sapiens
tttcctgagcttg

SEQ ID NO: 2568657 - DNA, 21 bp, Homo sapiens
tttcctggacatcctcttctg

SEQ ID NO: 2568658 - DNA, 19 bp, Homo sapiens
tttcctggtgccaatttca

SEQ ID NO: 2568659 - DNA, 22 bp, Homo sapiens
tttcctggtgccaatttcaagt

SEQ ID NO: 2568660 - DNA, 16 bp, Homo sapiens
tttccttaaactgtgt

SEQ ID NO: 2568661 - DNA, 14 bp, Homo sapiens
tttccttccatccc

SEQ ID NO: 2568662 - DNA, 14 bp, Homo sapiens
tttccttctgaagt

SEQ ID NO: 2568663 - DNA, 18 bp, Homo sapiens
tttccttggggcaggcag

SEQ ID NO: 2568664 - DNA, 19 bp, Homo sapiens
tttcctttcatttactgtg

SEQ ID NO: 2568665 - DNA, 14 bp, Homo sapiens
tttcctttctcacc

SEQ ID NO: 2568666 - DNA, 23 bp, Homo sapiens
tttcctttgtcatcattgtatat

SEQ ID NO: 2568667 - DNA, 21 bp, Homo sapiens
tttccttttttaaaaatgcaa

SEQ ID NO: 2568668 - DNA, 16 bp, Homo sapiens
tttccttttttgttat

SEQ ID NO: 2568669 - DNA, 15 bp, Homo sapiens
tttcgacttgcattt

SEQ ID NO: 2568670 - DNA, 19 bp, Homo sapiens
tttcgacttgcatttttgc

SEQ ID NO: 2568671 - DNA, 14 bp, Homo sapiens
tttctaaaggctac

SEQ ID NO: 2568672 - DNA, 21 bp, Homo sapiens
tttctaaaggctacctttgta

SEQ ID NO: 2568673 - DNA, 19 bp, Homo sapiens
tttctaaatctccaaaata

SEQ ID NO: 2568674 - DNA, 15 bp, Homo sapiens
tttctacccagcgag

SEQ ID NO: 2568675 - DNA, 15 bp, Homo sapiens
tttctaccctagcca

SEQ ID NO: 2568676 - DNA, 17 bp, Homo sapiens
tttctaccctagccatt

SEQ ID NO: 2568677 - DNA, 16 bp, Homo sapiens
tttctaccttgaggtc

SEQ ID NO: 2568678 - DNA, 20 bp, Homo sapiens
tttctagaacatccctgcca

SEQ ID NO: 2568679 - DNA, 21 bp, Homo sapiens
tttctagaatttatcacactt

SEQ ID NO: 2568680 - DNA, 22 bp, Homo sapiens
tttctagctagaaatatgattt

SEQ ID NO: 2568681 - DNA, 20 bp, Homo sapiens
tttctaggcctacatgcttt

SEQ ID NO: 2568682 - DNA, 14 bp, Homo sapiens
tttctagtggtctt

SEQ ID NO: 2568683 - DNA, 20 bp, Homo sapiens
tttctagtggtctttgtaag

SEQ ID NO: 2568684 - DNA, 17 bp, Homo sapiens
tttctattgaaaaatca

SEQ ID NO: 2568685 - DNA, 14 bp, Homo sapiens
tttctattgttact

SEQ ID NO: 2568686 - DNA, 17 bp, Homo sapiens
tttctatttctcctcca

SEQ ID NO: 2568687 - DNA, 14 bp, Homo sapiens
tttctcaaagtttt

SEQ ID NO: 2568688 - DNA, 19 bp, Homo sapiens
tttctcagactttggaaaa

SEQ ID NO: 2568689 - DNA, 17 bp, Homo sapiens
tttctcagatccttgtt

SEQ ID NO: 2568690 - DNA, 23 bp, Homo sapiens
tttctcagatccttgtttcaaac

SEQ ID NO: 2568691 - DNA, 23 bp, Homo sapiens
tttctcagccgcttctgactgct

SEQ ID NO: 2568692 - DNA, 18 bp, Homo sapiens
tttctcatgaatctgcaa

SEQ ID NO: 2568693 - DNA, 12 bp, Homo sapiens
tttctccagctg

SEQ ID NO: 2568694 - DNA, 12 bp, Homo sapiens
tttctccccagg

SEQ ID NO: 2568695 - DNA, 20 bp, Homo sapiens
tttctccctctcactgtctg

SEQ ID NO: 2568696 - DNA, 13 bp, Homo sapiens
tttctccctctgg

SEQ ID NO: 2568697 - DNA, 20 bp, Homo sapiens
tttctccttagtcttctcat

SEQ ID NO: 2568698 - DNA, 20 bp, Homo sapiens
tttctctccagcctgacttg

SEQ ID NO: 2568699 - DNA, 17 bp, Homo sapiens
tttctctgtgtttgttc

SEQ ID NO: 2568700 - DNA, 17 bp, Homo sapiens
tttctcttactgcaaat

SEQ ID NO: 2568701 - DNA, 21 bp, Homo sapiens
tttctcttgggctgagactgg

SEQ ID NO: 2568702 - DNA, 16 bp, Homo sapiens
tttctctttctctcct

SEQ ID NO: 2568703 - DNA, 19 bp, Homo sapiens
tttctgaaaattaacactg

SEQ ID NO: 2568704 - DNA, 14 bp, Homo sapiens
tttctgaaataaca

SEQ ID NO: 2568705 - DNA, 18 bp, Homo sapiens
tttctgcattttgctatt

SEQ ID NO: 2568706 - DNA, 15 bp, Homo sapiens
tttctgccttccttg

SEQ ID NO: 2568707 - DNA, 20 bp, Homo sapiens
tttctgccttccttgctaat

SEQ ID NO: 2568708 - DNA, 21 bp, Homo sapiens
tttctggaatacatgaaatat

SEQ ID NO: 2568709 - DNA, 23 bp, Homo sapiens
tttctggactgaagcctgcagga

SEQ ID NO: 2568710 - DNA, 16 bp, Homo sapiens
tttctggaggttgata

SEQ ID NO: 2568711 - DNA, 17 bp, Homo sapiens
tttctggaggttgataa

SEQ ID NO: 2568712 - DNA, 16 bp, Homo sapiens
tttctggctatgcatt

SEQ ID NO: 2568713 - DNA, 19 bp, Homo sapiens
tttctggctggagcctaga

SEQ ID NO: 2568714 - DNA, 23 bp, Homo sapiens
tttctgggagacagaaaacatgt

SEQ ID NO: 2568715 - DNA, 16 bp, Homo sapiens
tttctgggataagtaa

SEQ ID NO: 2568716 - DNA, 21 bp, Homo sapiens
tttctgggctgtctattctag

SEQ ID NO: 2568717 - DNA, 15 bp, Homo sapiens
tttctgtcaagaaga

SEQ ID NO: 2568718 - DNA, 17 bp, Homo sapiens
tttctgtgcctgaatat

SEQ ID NO: 2568719 - DNA, 22 bp, Homo sapiens
tttctgtgtgcaccttaccaac

SEQ ID NO: 2568720 - DNA, 19 bp, Homo sapiens
tttctgttatataaatggt

SEQ ID NO: 2568721 - DNA, 19 bp, Homo sapiens
tttctgttctgtggaaagt

SEQ ID NO: 2568722 - DNA, 22 bp, Homo sapiens
tttctgttctgtggaaagtgta

SEQ ID NO: 2568723 - DNA, 14 bp, Homo sapiens
tttctgttgccaca

SEQ ID NO: 2568724 - DNA, 13 bp, Homo sapiens
tttctgttgtcat

SEQ ID NO: 2568725 - DNA, 12 bp, Homo sapiens
tttctgttttct

SEQ ID NO: 2568726 - DNA, 16 bp, Homo sapiens
tttcttaaaccttcag

SEQ ID NO: 2568727 - DNA, 20 bp, Homo sapiens
tttcttagctttttaattgt

SEQ ID NO: 2568728 - DNA, 21 bp, Homo sapiens
tttcttagctttttaattgtt

SEQ ID NO: 2568729 - DNA, 21 bp, Homo sapiens
tttcttcactgttgaaaatta

SEQ ID NO: 2568730 - DNA, 16 bp, Homo sapiens
tttcttcatgcaatga

SEQ ID NO: 2568731 - DNA, 18 bp, Homo sapiens
tttcttcatgcaatgaca

SEQ ID NO: 2568732 - DNA, 18 bp, Homo sapiens
tttcttccctgtattttc

SEQ ID NO: 2568733 - DNA, 12 bp, Homo sapiens
tttcttctattt

SEQ ID NO: 2568734 - DNA, 13 bp, Homo sapiens
tttcttcttccct

SEQ ID NO: 2568735 - DNA, 18 bp, Homo sapiens
tttcttggttcataaatg

SEQ ID NO: 2568736 - DNA, 23 bp, Homo sapiens
tttcttggttcataaatgaattt

SEQ ID NO: 2568737 - DNA, 15 bp, Homo sapiens
tttctttgtgtagct

SEQ ID NO: 2568738 - DNA, 21 bp, Homo sapiens
tttcttttctaccctagccat

SEQ ID NO: 2568739 - DNA, 19 bp, Homo sapiens
tttctttttcttcttccct

SEQ ID NO: 2568740 - DNA, 15 bp, Homo sapiens
tttgaaaacatataa

SEQ ID NO: 2568741 - DNA, 22 bp, Homo sapiens
tttgaacaactaggcttcagca

SEQ ID NO: 2568742 - DNA, 15 bp, Homo sapiens
tttgaactaataaaa

SEQ ID NO: 2568743 - DNA, 15 bp, Homo sapiens
tttgaactcagatct

SEQ ID NO: 2568744 - DNA, 19 bp, Homo sapiens
tttgaagaatgaacaaatt

SEQ ID NO: 2568745 - DNA, 13 bp, Homo sapiens
tttgaaggaaaca

SEQ ID NO: 2568746 - DNA, 20 bp, Homo sapiens
tttgaaggaaacagttaata

SEQ ID NO: 2568747 - DNA, 19 bp, Homo sapiens
tttgaaggaggtgagggat

SEQ ID NO: 2568748 - DNA, 22 bp, Homo sapiens
tttgaagtaatcccgccaccta

SEQ ID NO: 2568749 - DNA, 23 bp, Homo sapiens
tttgaagtagtttgtataacttc

SEQ ID NO: 2568750 - DNA, 13 bp, Homo sapiens
tttgtgccagccg

SEQ ID NO: 2568751 - DNA, 17 bp, Homo sapiens
tttgtggcaccttttct

SEQ ID NO: 2568752 - DNA, 19 bp, Homo sapiens
tttgtgtaatagaaaactg

SEQ ID NO: 2568753 - DNA, 14 bp, Homo sapiens
tttgtgtacagtgt

SEQ ID NO: 2568754 - DNA, 13 bp, Homo sapiens
tttgtgtatttaa

SEQ ID NO: 2568755 - DNA, 22 bp, Homo sapiens
tttgtgtcaatgggcaatgaca

SEQ ID NO: 2568756 - DNA, 15 bp, Homo sapiens
tttgtgtgttgtctt

SEQ ID NO: 2568757 - DNA, 21 bp, Homo sapiens
tttgtgttgttggaaaaagtc

SEQ ID NO: 2568758 - DNA, 22 bp, Homo sapiens
tttgtgtttcagccatgtattt

SEQ ID NO: 2568759 - DNA, 18 bp, Homo sapiens
tttgttaaatatttacat

SEQ ID NO: 2568760 - DNA, 22 bp, Homo sapiens
tttgttaaatatttacatatga

SEQ ID NO: 2568761 - DNA, 22 bp, Homo sapiens
tttgttagtatgaggcatttgt

SEQ ID NO: 2568762 - DNA, 20 bp, Homo sapiens
tttgttattttcagtatttt

SEQ ID NO: 2568763 - DNA, 15 bp, Homo sapiens
tttgttattttgcaa

SEQ ID NO: 2568764 - DNA, 15 bp, Homo sapiens
tttgttcttcttaaa

SEQ ID NO: 2568765 - DNA, 15 bp, Homo sapiens
tttgttgtcagctga

SEQ ID NO: 2568766 - DNA, 14 bp, Homo sapiens
tttgtttaaaagga

SEQ ID NO: 2568767 - DNA, 12 bp, Homo sapiens
tttgtttgaact

SEQ ID NO: 2568768 - DNA, 13 bp, Homo sapiens
tttgttttttggt

SEQ ID NO: 2568769 - DNA, 16 bp, Homo sapiens
tttgtttttttccaac

SEQ ID NO: 2568770 - DNA, 22 bp, Homo sapiens
tttgtttttttccaactgtgtt

SEQ ID NO: 2568771 - DNA, 21 bp, Homo sapiens
ttttaaaaaactgctgactgt

SEQ ID NO: 2568772 - DNA, 13 bp, Homo sapiens
ttttaaaacccag

SEQ ID NO: 2568773 - DNA, 14 bp, Homo sapiens
tgagcctgggaggt

SEQ ID NO: 2568774 - DNA, 19 bp, Homo sapiens
tgagcctgggaggtcaagg

SEQ ID NO: 2568775 - DNA, 14 bp, Homo sapiens
tgagccttgaactt

SEQ ID NO: 2568776 - DNA, 15 bp, Homo sapiens
tgagccttgaacttt

SEQ ID NO: 2568777 - DNA, 18 bp, Homo sapiens
tgagctacgcctgcctcc

SEQ ID NO: 2568778 - DNA, 11 bp, Homo sapiens
tgagctcagga

SEQ ID NO: 2568779 - DNA, 13 bp, Homo sapiens
tgagctccagacc

SEQ ID NO: 2568780 - DNA, 18 bp, Homo sapiens
tgagctccagacccccag

SEQ ID NO: 2568781 - DNA, 19 bp, Homo sapiens
tgagctccagacccccagc

SEQ ID NO: 2568782 - DNA, 16 bp, Homo sapiens
tgagctccatgtgccc

SEQ ID NO: 2568783 - DNA, 15 bp, Homo sapiens
tgagctccccaaaaa

SEQ ID NO: 2568784 - DNA, 21 bp, Homo sapiens
tgagctccccaaaaacctcac

SEQ ID NO: 2568785 - DNA, 21 bp, Homo sapiens
tgagctcggtggacccaggga

SEQ ID NO: 2568786 - DNA, 12 bp, Homo sapiens
tgagctctctgt

SEQ ID NO: 2568787 - DNA, 13 bp, Homo sapiens
tgagctgagcagg

SEQ ID NO: 2568788 - DNA, 20 bp, Homo sapiens
tgagctgcctgtaacttgag

SEQ ID NO: 2568789 - DNA, 20 bp, Homo sapiens
tgagctggggatgtctctca

SEQ ID NO: 2568790 - DNA, 23 bp, Homo sapiens
tgagcttaagaattttgagcagg

SEQ ID NO: 2568791 - DNA, 15 bp, Homo sapiens
tgagcttctctgtga

SEQ ID NO: 2568792 - DNA, 16 bp, Homo sapiens
tgagcttggccagaag

SEQ ID NO: 2568793 - DNA, 23 bp, Homo sapiens
tgagctttgcatgttccactaac

SEQ ID NO: 2568794 - DNA, 19 bp, Homo sapiens
tgaggaaagcatgtattca

SEQ ID NO: 2568795 - DNA, 18 bp, Homo sapiens
tgaggaaaggccagctgg

SEQ ID NO: 2568796 - DNA, 19 bp, Homo sapiens
tgaggaagccgctggggcc

SEQ ID NO: 2568797 - DNA, 17 bp, Homo sapiens
tgaggaataattattta

SEQ ID NO: 2568798 - DNA, 22 bp, Homo sapiens
tgaggaatccagacccggctgc

SEQ ID NO: 2568799 - DNA, 13 bp, Homo sapiens
tgaggaattttct

SEQ ID NO: 2568800 - DNA, 20 bp, Homo sapiens
tgaggacaaccattccagac

SEQ ID NO: 2568801 - DNA, 20 bp, Homo sapiens
tgaggacattccaagacagt

SEQ ID NO: 2568802 - DNA, 16 bp, Homo sapiens
tgaggactatggaaat

SEQ ID NO: 2568803 - DNA, 23 bp, Homo sapiens
tgaggacttaaaatattcctgca

SEQ ID NO: 2568804 - DNA, 15 bp, Homo sapiens
tgaggagccaggccg

SEQ ID NO: 2568805 - DNA, 11 bp, Homo sapiens
tgaggagcccc

SEQ ID NO: 2568806 - DNA, 16 bp, Homo sapiens
tgaggagccccagcta

SEQ ID NO: 2568807 - DNA, 13 bp, Homo sapiens
tgaggagctgctg

SEQ ID NO: 2568808 - DNA, 15 bp, Homo sapiens
tgaggagctgctggc

SEQ ID NO: 2568809 - DNA, 19 bp, Homo sapiens
tgaggaggggcaggtaaac

SEQ ID NO: 2568810 - DNA, 15 bp, Homo sapiens
tgaggagtcttgtgt

SEQ ID NO: 2568811 - DNA, 12 bp, Homo sapiens
tgaggatgggaa

SEQ ID NO: 2568812 - DNA, 16 bp, Homo sapiens
tgaggatgggaaggag

SEQ ID NO: 2568813 - DNA, 16 bp, Homo sapiens
tgaggatttcaagcct

SEQ ID NO: 2568814 - DNA, 20 bp, Homo sapiens
tgaggcaataaaaatcatag

SEQ ID NO: 2568815 - DNA, 22 bp, Homo sapiens
tgaggcacgaatgatctttctt

SEQ ID NO: 2568816 - DNA, 14 bp, Homo sapiens
tgaggcagggaagt

SEQ ID NO: 2568817 - DNA, 12 bp, Homo sapiens
tgaggcatttgt

SEQ ID NO: 2568818 - DNA, 19 bp, Homo sapiens
tgaggcatttgtttgaact

SEQ ID NO: 2568819 - DNA, 20 bp, Homo sapiens
tgaggcatttgtttgaactg

SEQ ID NO: 2568820 - DNA, 23 bp, Homo sapiens
tgaggcatttgtttgaactgata

SEQ ID NO: 2568821 - DNA, 15 bp, Homo sapiens
tgaggcccagagggc

SEQ ID NO: 2568822 - DNA, 21 bp, Homo sapiens
tgaggcccagagggcctgcaa

SEQ ID NO: 2568823 - DNA, 13 bp, Homo sapiens
tgaggcccaggga

SEQ ID NO: 2568824 - DNA, 17 bp, Homo sapiens
tgaggcccagggagagg

SEQ ID NO: 2568825 - DNA, 23 bp, Homo sapiens
tgaggcccagggagaggccatga

SEQ ID NO: 2568826 - DNA, 22 bp, Homo sapiens
tgaggccgctagaggcctgagg

SEQ ID NO: 2568827 - DNA, 21 bp, Homo sapiens
tgaggcctcttggacctctgc

SEQ ID NO: 2568828 - DNA, 19 bp, Homo sapiens
tgaggcctgccctcaggga

SEQ ID NO: 2568829 - DNA, 15 bp, Homo sapiens
tgaggcctggccagg

SEQ ID NO: 2568830 - DNA, 13 bp, Homo sapiens
tgaggccttgctc

SEQ ID NO: 2568831 - DNA, 15 bp, Homo sapiens
tgaggctcctgtgct

SEQ ID NO: 2568832 - DNA, 16 bp, Homo sapiens
tgaggctcctgtgcta

SEQ ID NO: 2568833 - DNA, 14 bp, Homo sapiens
tgaggctctgccct

SEQ ID NO: 2568834 - DNA, 18 bp, Homo sapiens
tgaggctctgcccttggt

SEQ ID NO: 2568835 - DNA, 16 bp, Homo sapiens
tgaggctctttctggg

SEQ ID NO: 2568836 - DNA, 18 bp, Homo sapiens
tgaggctctttctgggcc

SEQ ID NO: 2568837 - DNA, 15 bp, Homo sapiens
tgaggctgggctccc

SEQ ID NO: 2568838 - DNA, 21 bp, Homo sapiens
tgaggctgggctcccttccca

SEQ ID NO: 2568839 - DNA, 13 bp, Homo sapiens
tgaggctgtagga

SEQ ID NO: 2568840 - DNA, 18 bp, Homo sapiens
tgagggactggaaccagg

SEQ ID NO: 2568841 - DNA, 14 bp, Homo sapiens
tgagggagcctggc

SEQ ID NO: 2568842 - DNA, 18 bp, Homo sapiens
tgagggaggaggccacct

SEQ ID NO: 2568843 - DNA, 19 bp, Homo sapiens
tgagggaggaggccacctc

SEQ ID NO: 2568844 - DNA, 23 bp, Homo sapiens
tgagggaggaggccacctctcca

SEQ ID NO: 2568845 - DNA, 17 bp, Homo sapiens
tgagggatcacagggcc

SEQ ID NO: 2568846 - DNA, 18 bp, Homo sapiens
tgagggatcacagggccc

SEQ ID NO: 2568847 - DNA, 19 bp, Homo sapiens
tgagggcccagagcaggaa

SEQ ID NO: 2568848 - DNA, 21 bp, Homo sapiens
tgagggcccagagcaggaagc

SEQ ID NO: 2568849 - DNA, 16 bp, Homo sapiens
tgagggcccctctgcc

SEQ ID NO: 2568850 - DNA, 19 bp, Homo sapiens
tgagggcccctctgcccag

SEQ ID NO: 2568851 - DNA, 22 bp, Homo sapiens
tgaggggaggatcactggagcc

SEQ ID NO: 2568852 - DNA, 14 bp, Homo sapiens
tgaggggctggcct

SEQ ID NO: 2568853 - DNA, 22 bp, Homo sapiens
tgaggggggccgtgcccagggg

SEQ ID NO: 2568854 - DNA, 18 bp, Homo sapiens
tgaggggtaaaagctgat

SEQ ID NO: 2568855 - DNA, 20 bp, Homo sapiens
tgaggggtctccaggaggag

SEQ ID NO: 2568856 - DNA, 18 bp, Homo sapiens
tgagggtatcaaataaaa

SEQ ID NO: 2568857 - DNA, 12 bp, Homo sapiens
tgagggtcttct

SEQ ID NO: 2568858 - DNA, 16 bp, Homo sapiens
tgaggtcagagcctgc

SEQ ID NO: 2568859 - DNA, 18 bp, Homo sapiens
tgaggtcatagcagtgct

SEQ ID NO: 2568860 - DNA, 13 bp, Homo sapiens
tgaggtcccaggc

SEQ ID NO: 2568861 - DNA, 18 bp, Homo sapiens
tgaggtctcttgagggag

SEQ ID NO: 2568862 - DNA, 15 bp, Homo sapiens
tgaggtctgctcggc

SEQ ID NO: 2568863 - DNA, 15 bp, Homo sapiens
tgaggtgaaagggag

SEQ ID NO: 2568864 - DNA, 18 bp, Homo sapiens
tgaggtgaaagggagcta

SEQ ID NO: 2568865 - DNA, 21 bp, Homo sapiens
tgaggtgcagagtgcccagaa

SEQ ID NO: 2568866 - DNA, 15 bp, Homo sapiens
tgaggtgcctgtccc

SEQ ID NO: 2568867 - DNA, 16 bp, Homo sapiens
tgaggtgcctgtccca

SEQ ID NO: 2568868 - DNA, 12 bp, Homo sapiens
tgaggtgggagg

SEQ ID NO: 2568869 - DNA, 18 bp, Homo sapiens
tgaggtggtctgaatgtt

SEQ ID NO: 2568870 - DNA, 19 bp, Homo sapiens
tgaggtggtctgaatgttc

SEQ ID NO: 2568871 - DNA, 21 bp, Homo sapiens
tgaggtggtctgaatgttctg

SEQ ID NO: 2568872 - DNA, 14 bp, Homo sapiens
tgaggtgtgggggc

SEQ ID NO: 2568873 - DNA, 23 bp, Homo sapiens
tgaggtgtgggggctgcagcatg

SEQ ID NO: 2568874 - DNA, 19 bp, Homo sapiens
tgaggtttcaaacctccct

SEQ ID NO: 2568875 - DNA, 13 bp, Homo sapiens
tgagtaagagctg

SEQ ID NO: 2568876 - DNA, 16 bp, Homo sapiens
tgagtaagagctggtg

SEQ ID NO: 2568877 - DNA, 18 bp, Homo sapiens
tgagtacgttgtgcattt

SEQ ID NO: 2568878 - DNA, 19 bp, Homo sapiens
tgagtacgttgtgcatttg

SEQ ID NO: 2568879 - DNA, 14 bp, Homo sapiens
tgagtactacagtc

SEQ ID NO: 2568880 - DNA, 15 bp, Homo sapiens
tgagtactacagtcc

SEQ ID NO: 2568881 - DNA, 23 bp, Homo sapiens
tgagtactacagtcctcccatct

SEQ ID NO: 2568882 - DNA, 13 bp, Homo sapiens
tgagtagctggat

SEQ ID NO: 2568883 - DNA, 15 bp, Homo sapiens
tgagtcaatgtgcag

SEQ ID NO: 2568884 - DNA, 18 bp, Homo sapiens
tgagtcaatgtgcagtgt

SEQ ID NO: 2568885 - DNA, 14 bp, Homo sapiens
tgagtcaccaagcc

SEQ ID NO: 2568886 - DNA, 18 bp, Homo sapiens
tgagtcaccaagcccagt

SEQ ID NO: 2568887 - DNA, 20 bp, Homo sapiens
tgagtcaccctacctgtgcc

SEQ ID NO: 2568888 - DNA, 19 bp, Homo sapiens
tgagtccagaagtttgaga

SEQ ID NO: 2568889 - DNA, 16 bp, Homo sapiens
tgagtcccagtgggag

SEQ ID NO: 2568890 - DNA, 19 bp, Homo sapiens
tgagtcccctgtttgtttc

SEQ ID NO: 2568891 - DNA, 21 bp, Homo sapiens
tgagtcccctgtttgtttctg

SEQ ID NO: 2568892 - DNA, 14 bp, Homo sapiens
tgagtcgaggacag

SEQ ID NO: 2568893 - DNA, 19 bp, Homo sapiens
tgagtcgaggacagggagg

SEQ ID NO: 2568894 - DNA, 18 bp, Homo sapiens
tgagtcgtcatcactttt

SEQ ID NO: 2568895 - DNA, 23 bp, Homo sapiens
tgagtcttggcggcagcagccat

SEQ ID NO: 2568896 - DNA, 15 bp, Homo sapiens
tgagtgatcctccaa

SEQ ID NO: 2568897 - DNA, 15 bp, Homo sapiens
tgagtgcagtcctga

SEQ ID NO: 2568898 - DNA, 12 bp, Homo sapiens
tgagtgcctggc

SEQ ID NO: 2568899 - DNA, 14 bp, Homo sapiens
tgagtgcctggcca

SEQ ID NO: 2568900 - DNA, 12 bp, Homo sapiens
tgagtgctctga

SEQ ID NO: 2568901 - DNA, 18 bp, Homo sapiens
tgagtggatgatgtttcg

SEQ ID NO: 2568902 - DNA, 11 bp, Homo sapiens
tgagtgtacca

SEQ ID NO: 2568903 - DNA, 18 bp, Homo sapiens
tgagtgtcttaattaaaa

SEQ ID NO: 2568904 - DNA, 18 bp, Homo sapiens
tgagtgtggctcccctct

SEQ ID NO: 2568905 - DNA, 17 bp, Homo sapiens
tgagtgtgtccaagtgt

SEQ ID NO: 2568906 - DNA, 22 bp, Homo sapiens
tgagtgtttttactacagttgt

SEQ ID NO: 2568907 - DNA, 16 bp, Homo sapiens
tgagttcaggtagctg

SEQ ID NO: 2568908 - DNA, 13 bp, Homo sapiens
tgagttctcaggg

SEQ ID NO: 2568909 - DNA, 17 bp, Homo sapiens
tgagttctcagggctcc

SEQ ID NO: 2568910 - DNA, 18 bp, Homo sapiens
tgagttctcagggctcct

SEQ ID NO: 2568911 - DNA, 14 bp, Homo sapiens
tgagtttaaagcaa

SEQ ID NO: 2568912 - DNA, 18 bp, Homo sapiens
tgagtttcattctcctgc

SEQ ID NO: 2568913 - DNA, 18 bp, Homo sapiens
tgagttttcttctgtgat

SEQ ID NO: 2568914 - DNA, 20 bp, Homo sapiens
tgagttttgttttaaaatta

SEQ ID NO: 2568915 - DNA, 18 bp, Homo sapiens
tgagtttttgatagcttt

SEQ ID NO: 2568916 - DNA, 19 bp, Homo sapiens
tgagttttttctcttgggc

SEQ ID NO: 2568917 - DNA, 14 bp, Homo sapiens
tgataaactttgct

SEQ ID NO: 2568918 - DNA, 21 bp, Homo sapiens
tgataaagtttctcagatcct

SEQ ID NO: 2568919 - DNA, 19 bp, Homo sapiens
tgataaattccactggact

SEQ ID NO: 2568920 - DNA, 18 bp, Homo sapiens
tgataacaacctggagac

SEQ ID NO: 2568921 - DNA, 19 bp, Homo sapiens
tgataactgcaattttaat

SEQ ID NO: 2568922 - DNA, 17 bp, Homo sapiens
tgataactttgcttgca

SEQ ID NO: 2568923 - DNA, 14 bp, Homo sapiens
tgataatcaactgg

SEQ ID NO: 2568924 - DNA, 15 bp, Homo sapiens
tgataattccagtgg

SEQ ID NO: 2568925 - DNA, 20 bp, Homo sapiens
tgatacaatgctgtgcccta

SEQ ID NO: 2568926 - DNA, 21 bp, Homo sapiens
tgatacccatagcttccatga

SEQ ID NO: 2568927 - DNA, 17 bp, Homo sapiens
tgatactacagtttgtt

SEQ ID NO: 2568928 - DNA, 14 bp, Homo sapiens
tgatagcacagacc

SEQ ID NO: 2568929 - DNA, 21 bp, Homo sapiens
tgatagcacagaccctgccct

SEQ ID NO: 2568930 - DNA, 21 bp, Homo sapiens
tgatagctaacattttaaata

SEQ ID NO: 2568931 - DNA, 22 bp, Homo sapiens
tgatagctctttggcagtctat

SEQ ID NO: 2568932 - DNA, 23 bp, Homo sapiens
tgatagctttattttttaagtat

SEQ ID NO: 2568933 - DNA, 13 bp, Homo sapiens
tgatagttactgt

SEQ ID NO: 2568934 - DNA, 14 bp, Homo sapiens
tgatagttactgtt

SEQ ID NO: 2568935 - DNA, 13 bp, Homo sapiens
tgatatatgtgtt

SEQ ID NO: 2568936 - DNA, 14 bp, Homo sapiens
tgatatattttaca

SEQ ID NO: 2568937 - DNA, 16 bp, Homo sapiens
tgatatcccccagcct

SEQ ID NO: 2568938 - DNA, 15 bp, Homo sapiens
tgatatgatttaaaa

SEQ ID NO: 2568939 - DNA, 20 bp, Homo sapiens
tgatatggagccctgtaatt

SEQ ID NO: 2568940 - DNA, 20 bp, Homo sapiens
tgatcaaagtccgaggggcg

SEQ ID NO: 2568941 - DNA, 16 bp, Homo sapiens
tgatcaaattcatttt

SEQ ID NO: 2568942 - DNA, 22 bp, Homo sapiens
tgatcaaattcatttttttcac

SEQ ID NO: 2568943 - DNA, 17 bp, Homo sapiens
tgatcaagggaatgtaa

SEQ ID NO: 2568944 - DNA, 18 bp, Homo sapiens
tgatcaataaaatgtgat

SEQ ID NO: 2568945 - DNA, 21 bp, Homo sapiens
tgatcaataaaatgtgatttt

SEQ ID NO: 2568946 - DNA, 19 bp, Homo sapiens
tgatcaatgacagagcctt

SEQ ID NO: 2568947 - DNA, 14 bp, Homo sapiens
tgatcaattaaatg

SEQ ID NO: 2568948 - DNA, 13 bp, Homo sapiens
tgatcacactctg

SEQ ID NO: 2568949 - DNA, 14 bp, Homo sapiens
tgatcacagcagct

SEQ ID NO: 2568950 - DNA, 15 bp, Homo sapiens
tgatcacggctcact

SEQ ID NO: 2568951 - DNA, 18 bp, Homo sapiens
tgatcacggctcactgca

SEQ ID NO: 2568952 - DNA, 20 bp, Homo sapiens
tgatcacggctcactgcagc

SEQ ID NO: 2568953 - DNA, 22 bp, Homo sapiens
tgatcacggctcactgcagcct

SEQ ID NO: 2568954 - DNA, 22 bp, Homo sapiens
tgatcagagccgtggtcctttg

SEQ ID NO: 2568955 - DNA, 17 bp, Homo sapiens
tgatcagctgtttgtca

SEQ ID NO: 2568956 - DNA, 14 bp, Homo sapiens
tgatcatgcattgt

SEQ ID NO: 2568957 - DNA, 15 bp, Homo sapiens
tgatcatgcattgtt

SEQ ID NO: 2568958 - DNA, 17 bp, Homo sapiens
tgatcatgcattgttga

SEQ ID NO: 2568959 - DNA, 23 bp, Homo sapiens
tgatcatgcattgttgaggtggt

SEQ ID NO: 2568960 - DNA, 20 bp, Homo sapiens
tgatcattttccccccactc

SEQ ID NO: 2568961 - DNA, 13 bp, Homo sapiens
tgatccaactaat

SEQ ID NO: 2568962 - DNA, 20 bp, Homo sapiens
tgatccacccacctcagcct

SEQ ID NO: 2568963 - DNA, 18 bp, Homo sapiens
tgatccagcctctcccct

SEQ ID NO: 2568964 - DNA, 19 bp, Homo sapiens
tgatccagcctctcccctg

SEQ ID NO: 2568965 - DNA, 15 bp, Homo sapiens
tgatcctcccacctc

SEQ ID NO: 2568966 - DNA, 13 bp, Homo sapiens
tgatcctgtgaag

SEQ ID NO: 2568967 - DNA, 15 bp, Homo sapiens
tgatcgcctttccca

SEQ ID NO: 2568968 - DNA, 18 bp, Homo sapiens
tgatcggagcctcctctc

SEQ ID NO: 2568969 - DNA, 21 bp, Homo sapiens
tgatcgtgacgctgaataaat

SEQ ID NO: 2568970 - DNA, 15 bp, Homo sapiens
tgatcgtgctaaatt

SEQ ID NO: 2568971 - DNA, 17 bp, Homo sapiens
tgatctagagccagtta

SEQ ID NO: 2568972 - DNA, 13 bp, Homo sapiens
tgatctaggaaga

SEQ ID NO: 2568973 - DNA, 21 bp, Homo sapiens
tgatctaggaagactttggaa

SEQ ID NO: 2568974 - DNA, 15 bp, Homo sapiens
tgatctaggtttaac

SEQ ID NO: 2568975 - DNA, 17 bp, Homo sapiens
tgatctaggtttaactc

SEQ ID NO: 2568976 - DNA, 20 bp, Homo sapiens
tgatctaggtttaactcaga

SEQ ID NO: 2568977 - DNA, 19 bp, Homo sapiens
tgatctccatatgttacac

SEQ ID NO: 2568978 - DNA, 21 bp, Homo sapiens
tgatctccatatgttacacta

SEQ ID NO: 2568979 - DNA, 21 bp, Homo sapiens
tgatctcggctcactgcaacc

SEQ ID NO: 2568980 - DNA, 23 bp, Homo sapiens
tgatctcttcttttggcttccat

SEQ ID NO: 2568981 - DNA, 20 bp, Homo sapiens
tgatctgatgcaagcaagaa

SEQ ID NO: 2568982 - DNA, 19 bp, Homo sapiens
tgatctgtatatacaataa

SEQ ID NO: 2568983 - DNA, 12 bp, Homo sapiens
tgatctgtgctt

SEQ ID NO: 2568984 - DNA, 21 bp, Homo sapiens
tgatctgtgctttccagctca

SEQ ID NO: 2568985 - DNA, 19 bp, Homo sapiens
tgatctttgcagacaggca

SEQ ID NO: 2568986 - DNA, 20 bp, Homo sapiens
tgatctttgcagacaggcaa

SEQ ID NO: 2568987 - DNA, 23 bp, Homo sapiens
tgatgaaatgaggtcagagcctg

SEQ ID NO: 2568988 - DNA, 20 bp, Homo sapiens
tgatgaagaaaagtgggcca

SEQ ID NO: 2568989 - DNA, 15 bp, Homo sapiens
tgatgagctcctctt

SEQ ID NO: 2568990 - DNA, 18 bp, Homo sapiens
tgatgaggcctcttggac

SEQ ID NO: 2568991 - DNA, 22 bp, Homo sapiens
tgatgaggcctcttggacctct

SEQ ID NO: 2568992 - DNA, 15 bp, Homo sapiens
tgatgatacaagatt

SEQ ID NO: 2568993 - DNA, 20 bp, Homo sapiens
tgatgatcctaggcatttgc

SEQ ID NO: 2568994 - DNA, 14 bp, Homo sapiens
tgatgatctttaaa

SEQ ID NO: 2568995 - DNA, 17 bp, Homo sapiens
tgatgatctttaaaata

SEQ ID NO: 2568996 - DNA, 20 bp, Homo sapiens
tgatgatctttgcagacagg

SEQ ID NO: 2568997 - DNA, 21 bp, Homo sapiens
tgatgatctttgcagacaggc

SEQ ID NO: 2568998 - DNA, 18 bp, Homo sapiens
tgatgatgggaattgtgt

SEQ ID NO: 2568999 - DNA, 18 bp, Homo sapiens
tgatgcatgcactgttcc

SEQ ID NO: 2569000 - DNA, 23 bp, Homo sapiens
tgatgcatgcactgttccccctg

SEQ ID NO: 2569001 - DNA, 15 bp, Homo sapiens
tgatgccaacctctg

SEQ ID NO: 2569002 - DNA, 19 bp, Homo sapiens
tgatgccaggttctatttg

SEQ ID NO: 2569003 - DNA, 22 bp, Homo sapiens
tgatgctccctcccctgccctg

SEQ ID NO: 2569004 - DNA, 23 bp, Homo sapiens
tgatgctccctcccctgccctgg

SEQ ID NO: 2569005 - DNA, 20 bp, Homo sapiens
tgatgctgtgctatgaattt

SEQ ID NO: 2569006 - DNA, 22 bp, Homo sapiens
tgatgcttcttcagagactcct

SEQ ID NO: 2569007 - DNA, 18 bp, Homo sapiens
tgatgctttcagattaaa

SEQ ID NO: 2569008 - DNA, 22 bp, Homo sapiens
tgatggcacttagctatcagaa

SEQ ID NO: 2569009 - DNA, 14 bp, Homo sapiens
tgatgggaaagcat

SEQ ID NO: 2569010 - DNA, 21 bp, Homo sapiens
tgatgggcaacccccagcctg

SEQ ID NO: 2569011 - DNA, 15 bp, Homo sapiens
tgatgggggaggggg

SEQ ID NO: 2569012 - DNA, 15 bp, Homo sapiens
tgatgggtcagttgt

SEQ ID NO: 2569013 - DNA, 16 bp, Homo sapiens
tgatggtgatgaaatg

SEQ ID NO: 2569014 - DNA, 16 bp, Homo sapiens
tgatgtacagtctgtc

SEQ ID NO: 2569015 - DNA, 17 bp, Homo sapiens
tgatgtacagtctgtca

SEQ ID NO: 2569016 - DNA, 18 bp, Homo sapiens
tgatgtacagtctgtcat

SEQ ID NO: 2569017 - DNA, 20 bp, Homo sapiens
tgatgtaccatgaaacaaag

SEQ ID NO: 2569018 - DNA, 12 bp, Homo sapiens
tgatgtatattt

SEQ ID NO: 2569019 - DNA, 13 bp, Homo sapiens
tgatgtccagaag

SEQ ID NO: 2569020 - DNA, 15 bp, Homo sapiens
tgatgtccagaagaa

SEQ ID NO: 2569021 - DNA, 17 bp, Homo sapiens
tgatgtggagtggggca

SEQ ID NO: 2569022 - DNA, 18 bp, Homo sapiens
tgatgtggagtggggcag

SEQ ID NO: 2569023 - DNA, 20 bp, Homo sapiens
tgatgtggtgaggcaggctt

SEQ ID NO: 2569024 - DNA, 13 bp, Homo sapiens
tgatgtgtacatc

SEQ ID NO: 2569025 - DNA, 16 bp, Homo sapiens
tgatgttaacacattt

SEQ ID NO: 2569026 - DNA, 18 bp, Homo sapiens
tgatgttaacacattttg

SEQ ID NO: 2569027 - DNA, 14 bp, Homo sapiens
tgatgttggctggg

SEQ ID NO: 2569028 - DNA, 16 bp, Homo sapiens
tgatgtttgtggcctc

SEQ ID NO: 2569029 - DNA, 19 bp, Homo sapiens
tgatgtttgtggcctcaga

SEQ ID NO: 2569030 - DNA, 17 bp, Homo sapiens
tgatgttttaaggatgc

SEQ ID NO: 2569031 - DNA, 18 bp, Homo sapiens
tgatgttttaaggatgct

SEQ ID NO: 2569032 - DNA, 17 bp, Homo sapiens
tgatgttttccatgagt

SEQ ID NO: 2569033 - DNA, 12 bp, Homo sapiens
tgattaaaccaa

SEQ ID NO: 2569034 - DNA, 20 bp, Homo sapiens
tgattaaacgtgcagactat

SEQ ID NO: 2569035 - DNA, 16 bp, Homo sapiens
tgattaatccagaata

SEQ ID NO: 2569036 - DNA, 14 bp, Homo sapiens
tgattaccagggac

SEQ ID NO: 2569037 - DNA, 16 bp, Homo sapiens
tgattaccagggactg

SEQ ID NO: 2569038 - DNA, 21 bp, Homo sapiens
tgattagaaggcaagtttcta

SEQ ID NO: 2569039 - DNA, 18 bp, Homo sapiens
tgattagcaagttacagt

SEQ ID NO: 2569040 - DNA, 17 bp, Homo sapiens
tgattcaatctgtaaac

SEQ ID NO: 2569041 - DNA, 12 bp, Homo sapiens
tgattcaattca

SEQ ID NO: 2569042 - DNA, 22 bp, Homo sapiens
tgattcacccccaaacagtgac

SEQ ID NO: 2569043 - DNA, 19 bp, Homo sapiens
tgattcagacagctgcctg

SEQ ID NO: 2569044 - DNA, 20 bp, Homo sapiens
tgattcagacagctgcctgg

SEQ ID NO: 2569045 - DNA, 12 bp, Homo sapiens
tgattcagtgtt

SEQ ID NO: 2569046 - DNA, 21 bp, Homo sapiens
tgattcccaagctctgctcct

SEQ ID NO: 2569047 - DNA, 22 bp, Homo sapiens
tgattcccaagctctgctcctc

SEQ ID NO: 2569048 - DNA, 23 bp, Homo sapiens
tgattcccaagctctgctcctct

SEQ ID NO: 2569049 - DNA, 17 bp, Homo sapiens
tgattccctcctgctac

SEQ ID NO: 2569050 - DNA, 16 bp, Homo sapiens
tgattcgcccaaagcc

SEQ ID NO: 2569051 - DNA, 21 bp, Homo sapiens
tgattcgcccaaagccagaca

SEQ ID NO: 2569052 - DNA, 15 bp, Homo sapiens
tgattctaatgtctt

SEQ ID NO: 2569053 - DNA, 17 bp, Homo sapiens
tgattctaatgtcttca

SEQ ID NO: 2569054 - DNA, 23 bp, Homo sapiens
tgattctcagggtctctgctgcc

SEQ ID NO: 2569055 - DNA, 20 bp, Homo sapiens
tgattctcctgcctcagcct

SEQ ID NO: 2569056 - DNA, 21 bp, Homo sapiens
tgattctcctgcctcagcctc

SEQ ID NO: 2569057 - DNA, 15 bp, Homo sapiens
tgattctgtgtgttt

SEQ ID NO: 2569058 - DNA, 16 bp, Homo sapiens
tgattgctaaatgtaa

SEQ ID NO: 2569059 - DNA, 20 bp, Homo sapiens
tgattgctaaatgtaacagt

SEQ ID NO: 2569060 - DNA, 22 bp, Homo sapiens
tgattgctaaatgtaacagtct

SEQ ID NO: 2569061 - DNA, 17 bp, Homo sapiens
tgattggattattcatt

SEQ ID NO: 2569062 - DNA, 19 bp, Homo sapiens
tgattggattattcattta

SEQ ID NO: 2569063 - DNA, 20 bp, Homo sapiens
tgattggcaggagttggaag

SEQ ID NO: 2569064 - DNA, 16 bp, Homo sapiens
tgattggcatataatg

SEQ ID NO: 2569065 - DNA, 16 bp, Homo sapiens
tgattgggaataaata

SEQ ID NO: 2569066 - DNA, 18 bp, Homo sapiens
tgattgggaataaatatg

SEQ ID NO: 2569067 - DNA, 20 bp, Homo sapiens
tgattgggaataaatatgcc

SEQ ID NO: 2569068 - DNA, 21 bp, Homo sapiens
tgattgggaataaatatgcct

SEQ ID NO: 2569069 - DNA, 17 bp, Homo sapiens
tgattggtgcaaccctt

SEQ ID NO: 2569070 - DNA, 17 bp, Homo sapiens
tgattgtaaaatagctt

SEQ ID NO: 2569071 - DNA, 23 bp, Homo sapiens
tgattgtaaaatagcttgtatag

SEQ ID NO: 2569072 - DNA, 17 bp, Homo sapiens
tgattgtaacgttgctg

SEQ ID NO: 2569073 - DNA, 15 bp, Homo sapiens
tgacctgtgtcacta

SEQ ID NO: 2569074 - DNA, 16 bp, Homo sapiens
tgaccttagtgtttct

SEQ ID NO: 2569075 - DNA, 13 bp, Homo sapiens
tgaccttctggga

SEQ ID NO: 2569076 - DNA, 14 bp, Homo sapiens
tgacgccatcccag

SEQ ID NO: 2569077 - DNA, 16 bp, Homo sapiens
tgacgccatcccagcc

SEQ ID NO: 2569078 - DNA, 18 bp, Homo sapiens
tgacgccatcccagcccc

SEQ ID NO: 2569079 - DNA, 20 bp, Homo sapiens
tgacgccatcccagccccaa

SEQ ID NO: 2569080 - DNA, 14 bp, Homo sapiens
tgacgctgaataaa

SEQ ID NO: 2569081 - DNA, 15 bp, Homo sapiens
tgacgctgaataaat

SEQ ID NO: 2569082 - DNA, 17 bp, Homo sapiens
tgacgctgaataaatgt

SEQ ID NO: 2569083 - DNA, 18 bp, Homo sapiens
tgacgctgaataaatgtc

SEQ ID NO: 2569084 - DNA, 22 bp, Homo sapiens
tgacgctgaataaatgtctttt

SEQ ID NO: 2569085 - DNA, 19 bp, Homo sapiens
tgacggatgattggattat

SEQ ID NO: 2569086 - DNA, 23 bp, Homo sapiens
tgacgtgcacctgtactcaggag

SEQ ID NO: 2569087 - DNA, 16 bp, Homo sapiens
tgacgtgccttttgca

SEQ ID NO: 2569088 - DNA, 22 bp, Homo sapiens
tgactaaaaatattataactta

SEQ ID NO: 2569089 - DNA, 17 bp, Homo sapiens
tgactaaagagagaatg

SEQ ID NO: 2569090 - DNA, 15 bp, Homo sapiens
tgactaattgtataa

SEQ ID NO: 2569091 - DNA, 17 bp, Homo sapiens
tgactaattgtataaca

SEQ ID NO: 2569092 - DNA, 21 bp, Homo sapiens
tgactaattgtataacaggtt

SEQ ID NO: 2569093 - DNA, 23 bp, Homo sapiens
tgactaattgtataacaggttat

SEQ ID NO: 2569094 - DNA, 19 bp, Homo sapiens
tgactagggattcaggctg

SEQ ID NO: 2569095 - DNA, 23 bp, Homo sapiens
tgactagggattcaggctgcttg

SEQ ID NO: 2569096 - DNA, 19 bp, Homo sapiens
tgactatatagagatgttt

SEQ ID NO: 2569097 - DNA, 16 bp, Homo sapiens
tgactatcaaactgaa

SEQ ID NO: 2569098 - DNA, 20 bp, Homo sapiens
tgactattgaagttgcagat

SEQ ID NO: 2569099 - DNA, 19 bp, Homo sapiens
tgactatttttcagaatct

SEQ ID NO: 2569100 - DNA, 14 bp, Homo sapiens
tgactcaacatgtt

SEQ ID NO: 2569101 - DNA, 18 bp, Homo sapiens
tgactcacttatcccaag

SEQ ID NO: 2569102 - DNA, 16 bp, Homo sapiens
tgactcagatgtctct

SEQ ID NO: 2569103 - DNA, 15 bp, Homo sapiens
tgactcagggctcct

SEQ ID NO: 2569104 - DNA, 17 bp, Homo sapiens
tgactcctctaagccac

SEQ ID NO: 2569105 - DNA, 21 bp, Homo sapiens
tgactcgtatatgtctcaggt

SEQ ID NO: 2569106 - DNA, 15 bp, Homo sapiens
tgactcgtctgactg

SEQ ID NO: 2569107 - DNA, 16 bp, Homo sapiens
tgactcgtctgactgt

SEQ ID NO: 2569108 - DNA, 22 bp, Homo sapiens
tgactctgaaatctgaagacct

SEQ ID NO: 2569109 - DNA, 14 bp, Homo sapiens
tgactctgccccct

SEQ ID NO: 2569110 - DNA, 22 bp, Homo sapiens
tgactctttttagggccaggca

SEQ ID NO: 2569111 - DNA, 13 bp, Homo sapiens
tgactgaatttct

SEQ ID NO: 2569112 - DNA, 15 bp, Homo sapiens
tgactgagcttccct

SEQ ID NO: 2569113 - DNA, 20 bp, Homo sapiens
tgactgctccccagccctgg

SEQ ID NO: 2569114 - DNA, 22 bp, Homo sapiens
tgactgctccccagccctggct

SEQ ID NO: 2569115 - DNA, 21 bp, Homo sapiens
tgactgggccctgcctctgtt

SEQ ID NO: 2569116 - DNA, 23 bp, Homo sapiens
tgactgggtttctctgtatagta

SEQ ID NO: 2569117 - DNA, 16 bp, Homo sapiens
tgactgtcactgttcc

SEQ ID NO: 2569118 - DNA, 24 bp, Homo sapiens
tgactgttcaagagcacacttggc

SEQ ID NO: 2569119 - DNA, 16 bp, Homo sapiens
tgactgtttttaccca

SEQ ID NO: 2569120 - DNA, 18 bp, Homo sapiens
tgactgtttttacccata

SEQ ID NO: 2569121 - DNA, 16 bp, Homo sapiens
tgacttaactgcattt

SEQ ID NO: 2569122 - DNA, 21 bp, Homo sapiens
tgacttatttatataaatttt

SEQ ID NO: 2569123 - DNA, 22 bp, Homo sapiens
tgacttcattaataataaattc

SEQ ID NO: 2569124 - DNA, 20 bp, Homo sapiens
tgacttcgactgtgacctgt

SEQ ID NO: 2569125 - DNA, 24 bp, Homo sapiens
tgacttctaagtaaaaccacagca

SEQ ID NO: 2569126 - DNA, 18 bp, Homo sapiens
tgacttggggagatggag

SEQ ID NO: 2569127 - DNA, 19 bp, Homo sapiens
tgacttggggagatggagt

SEQ ID NO: 2569128 - DNA, 12 bp, Homo sapiens
tgactttcaggt

SEQ ID NO: 2569129 - DNA, 16 bp, Homo sapiens
tgactttggctgcatg

SEQ ID NO: 2569130 - DNA, 17 bp, Homo sapiens
tgactttttgcatttaa

SEQ ID NO: 2569131 - DNA, 20 bp, Homo sapiens
tgagaaacaacaatttctac

SEQ ID NO: 2569132 - DNA, 15 bp, Homo sapiens
tgagaaatgaataat

SEQ ID NO: 2569133 - DNA, 11 bp, Homo sapiens
tgagaaatgca

SEQ ID NO: 2569134 - DNA, 14 bp, Homo sapiens
tgagaacactgtga

SEQ ID NO: 2569135 - DNA, 16 bp, Homo sapiens
tgagaacactgtgaaa

SEQ ID NO: 2569136 - DNA, 19 bp, Homo sapiens
tgagaactactcagggaat

SEQ ID NO: 2569137 - DNA, 17 bp, Homo sapiens
tgagaactgcatatgtt

SEQ ID NO: 2569138 - DNA, 17 bp, Homo sapiens
tgagaagagggcctgtg

SEQ ID NO: 2569139 - DNA, 17 bp, Homo sapiens
tgagaaggaatttgagt

SEQ ID NO: 2569140 - DNA, 16 bp, Homo sapiens
tgagaaggcagccacc

SEQ ID NO: 2569141 - DNA, 17 bp, Homo sapiens
tgagaaggcagccacca

SEQ ID NO: 2569142 - DNA, 16 bp, Homo sapiens
tgagaaggtccttaat

SEQ ID NO: 2569143 - DNA, 17 bp, Homo sapiens
tgagaagttttgtacag

SEQ ID NO: 2569144 - DNA, 24 bp, Homo sapiens
tgagaagttttgtacagagaatta

SEQ ID NO: 2569145 - DNA, 17 bp, Homo sapiens
tgagaatcagatcattt

SEQ ID NO: 2569146 - DNA, 20 bp, Homo sapiens
tgagaatttgagtgctctga

SEQ ID NO: 2569147 - DNA, 15 bp, Homo sapiens
tgagaattttaaatt

SEQ ID NO: 2569148 - DNA, 18 bp, Homo sapiens
tgagacaaatggaggcct

SEQ ID NO: 2569149 - DNA, 21 bp, Homo sapiens
tgagacagagttttcactctt

SEQ ID NO: 2569150 - DNA, 13 bp, Homo sapiens
tgagacagcccgg

SEQ ID NO: 2569151 - DNA, 12 bp, Homo sapiens
tgagacagctct

SEQ ID NO: 2569152 - DNA, 14 bp, Homo sapiens
tgagacagctctgc

SEQ ID NO: 2569153 - DNA, 16 bp, Homo sapiens
tgagacagctctgcat

SEQ ID NO: 2569154 - DNA, 16 bp, Homo sapiens
tgagacagtgggaaat

SEQ ID NO: 2569155 - DNA, 19 bp, Homo sapiens
tgagacagtttcttagctt

SEQ ID NO: 2569156 - DNA, 13 bp, Homo sapiens
tgagacccccaca

SEQ ID NO: 2569157 - DNA, 13 bp, Homo sapiens
tgagacccctggc

SEQ ID NO: 2569158 - DNA, 14 bp, Homo sapiens
tgagacccctggcc

SEQ ID NO: 2569159 - DNA, 15 bp, Homo sapiens
tgagacccctggcct

SEQ ID NO: 2569160 - DNA, 18 bp, Homo sapiens
tgagacccctggcctccg

SEQ ID NO: 2569161 - DNA, 22 bp, Homo sapiens
tgagacccctggcctccggcgt

SEQ ID NO: 2569162 - DNA, 18 bp, Homo sapiens
tgagagaataagtcatgt

SEQ ID NO: 2569163 - DNA, 14 bp, Homo sapiens
tgagagaatggaaa

SEQ ID NO: 2569164 - DNA, 23 bp, Homo sapiens
tgagagaatggaaaacagactca

SEQ ID NO: 2569165 - DNA, 19 bp, Homo sapiens
tgagagaattgtatcattt

SEQ ID NO: 2569166 - DNA, 24 bp, Homo sapiens
tgagagaccaggcaaagcaagtga

SEQ ID NO: 2569167 - DNA, 14 bp, Homo sapiens
tgagagctgggtgt

SEQ ID NO: 2569168 - DNA, 15 bp, Homo sapiens
tgagaggatgaatgt

SEQ ID NO: 2569169 - DNA, 18 bp, Homo sapiens
tgagaggggaacagactg

SEQ ID NO: 2569170 - DNA, 16 bp, Homo sapiens
tgagataatgttagag

SEQ ID NO: 2569171 - DNA, 19 bp, Homo sapiens
tgagatagcattgtgaact

SEQ ID NO: 2569172 - DNA, 23 bp, Homo sapiens
tgagatagtagcatacatttata

SEQ ID NO: 2569173 - DNA, 15 bp, Homo sapiens
tgagatcaaaacggt

SEQ ID NO: 2569174 - DNA, 15 bp, Homo sapiens
tgagatcagcctggg

SEQ ID NO: 2569175 - DNA, 14 bp, Homo sapiens
tgagatcaggctct

SEQ ID NO: 2569176 - DNA, 18 bp, Homo sapiens
tgagatccttccttttga

SEQ ID NO: 2569177 - DNA, 18 bp, Homo sapiens
tgagatgattcagaaggg

SEQ ID NO: 2569178 - DNA, 16 bp, Homo sapiens
tgagatgcagctggaa

SEQ ID NO: 2569179 - DNA, 18 bp, Homo sapiens
tgagcaaactaacttgac

SEQ ID NO: 2569180 - DNA, 20 bp, Homo sapiens
tgagcaaagggaacagtgag

SEQ ID NO: 2569181 - DNA, 19 bp, Homo sapiens
tgagcaaatgtggctcctg

SEQ ID NO: 2569182 - DNA, 13 bp, Homo sapiens
tgagcacacttta

SEQ ID NO: 2569183 - DNA, 17 bp, Homo sapiens
tgagcaccgtcatggct

SEQ ID NO: 2569184 - DNA, 20 bp, Homo sapiens
tgagcactaaggtgtgctct

SEQ ID NO: 2569185 - DNA, 22 bp, Homo sapiens
tgagcactaaggtgtgctctga

SEQ ID NO: 2569186 - DNA, 23 bp, Homo sapiens
tgagcactaaggtgtgctctgat

SEQ ID NO: 2569187 - DNA, 15 bp, Homo sapiens
tgagcactcccaagt

SEQ ID NO: 2569188 - DNA, 15 bp, Homo sapiens
tgagcaggattttaa

SEQ ID NO: 2569189 - DNA, 20 bp, Homo sapiens
tgagcaggattttaatcttt

SEQ ID NO: 2569190 - DNA, 12 bp, Homo sapiens
tgagcagggctc

SEQ ID NO: 2569191 - DNA, 16 bp, Homo sapiens
tgagcagggctcagcg

SEQ ID NO: 2569192 - DNA, 22 bp, Homo sapiens
tgagcagggctcagcggggaca

SEQ ID NO: 2569193 - DNA, 14 bp, Homo sapiens
tgagcatcacagtt

SEQ ID NO: 2569194 - DNA, 15 bp, Homo sapiens
tgagcatcacagttt

SEQ ID NO: 2569195 - DNA, 20 bp, Homo sapiens
tgagcatcaggccaggccct

SEQ ID NO: 2569196 - DNA, 22 bp, Homo sapiens
tgagcatcaggccaggccctct

SEQ ID NO: 2569197 - DNA, 24 bp, Homo sapiens
tgagcatcaggccaggccctctgc

SEQ ID NO: 2569198 - DNA, 15 bp, Homo sapiens
tgagcatggagctgg

SEQ ID NO: 2569199 - DNA, 16 bp, Homo sapiens
tgagcatggagctggc

SEQ ID NO: 2569200 - DNA, 18 bp, Homo sapiens
tgagcatggagctggccg

SEQ ID NO: 2569201 - DNA, 21 bp, Homo sapiens
tgagcattgtggctgtcagca

SEQ ID NO: 2569202 - DNA, 22 bp, Homo sapiens
tgagcattgtggctgtcagcag

SEQ ID NO: 2569203 - DNA, 23 bp, Homo sapiens
tgagcattgtggctgtcagcagg

SEQ ID NO: 2569204 - DNA, 18 bp, Homo sapiens
tgagccactgcaccgggc

SEQ ID NO: 2569205 - DNA, 20 bp, Homo sapiens
tgagccaggtaatgagggac

SEQ ID NO: 2569206 - DNA, 14 bp, Homo sapiens
tgagccagtcccag

SEQ ID NO: 2569207 - DNA, 16 bp, Homo sapiens
tgagccagtcccaggg

SEQ ID NO: 2569208 - DNA, 18 bp, Homo sapiens
tgagccagtcccaggggc

SEQ ID NO: 2569209 - DNA, 22 bp, Homo sapiens
tgagccagttcagtacctggag

SEQ ID NO: 2569210 - DNA, 19 bp, Homo sapiens
tgagcccactgcccacccc

SEQ ID NO: 2569211 - DNA, 12 bp, Homo sapiens
tgagcccaggag

SEQ ID NO: 2569212 - DNA, 13 bp, Homo sapiens
tgagcccaggagt

SEQ ID NO: 2569213 - DNA, 17 bp, Homo sapiens
tgagcccatggccctcc

SEQ ID NO: 2569214 - DNA, 14 bp, Homo sapiens
tgagccccaagtcc

SEQ ID NO: 2569215 - DNA, 21 bp, Homo sapiens
tgagccccaagtcctgaagag

SEQ ID NO: 2569216 - DNA, 13 bp, Homo sapiens
tgagccccttcct

SEQ ID NO: 2569217 - DNA, 14 bp, Homo sapiens
tgagcccgggctgc

SEQ ID NO: 2569218 - DNA, 15 bp, Homo sapiens
tgagcccgggctgcc

SEQ ID NO: 2569219 - DNA, 22 bp, Homo sapiens
tgagcccgggctgcctgggctg

SEQ ID NO: 2569220 - DNA, 16 bp, Homo sapiens
tgagccctcaaagtga

SEQ ID NO: 2569221 - DNA, 15 bp, Homo sapiens
tgagcctctcacctg

SEQ ID NO: 2569222 - DNA, 11 bp, Homo sapiens
tgagcctggca

SEQ ID NO: 2569223 - DNA, 18 bp, Homo sapiens
tgaatgttctgacattaa

SEQ ID NO: 2569224 - DNA, 22 bp, Homo sapiens
tgaatgtttccaacctggagta

SEQ ID NO: 2569225 - DNA, 20 bp, Homo sapiens
tgaattaatgacagagccag

SEQ ID NO: 2569226 - DNA, 14 bp, Homo sapiens
tgaattagctcact

SEQ ID NO: 2569227 - DNA, 17 bp, Homo sapiens
tgaattcagattttaaa

SEQ ID NO: 2569228 - DNA, 19 bp, Homo sapiens
tgaattctgcaatgttttc

SEQ ID NO: 2569229 - DNA, 16 bp, Homo sapiens
tgaattgcctgcagag

SEQ ID NO: 2569230 - DNA, 14 bp, Homo sapiens
tgaatttaaatata

SEQ ID NO: 2569231 - DNA, 16 bp, Homo sapiens
tgaatttaaatataat

SEQ ID NO: 2569232 - DNA, 18 bp, Homo sapiens
tgaatttattattgttct

SEQ ID NO: 2569233 - DNA, 20 bp, Homo sapiens
tgaatttcttcactgttgaa

SEQ ID NO: 2569234 - DNA, 16 bp, Homo sapiens
tgaatttgaatgaaaa

SEQ ID NO: 2569235 - DNA, 17 bp, Homo sapiens
tgaatttggagactctg

SEQ ID NO: 2569236 - DNA, 23 bp, Homo sapiens
tgaattttctttttaataaaaag

SEQ ID NO: 2569237 - DNA, 19 bp, Homo sapiens
tgacaaaaagtttccatat

SEQ ID NO: 2569238 - DNA, 13 bp, Homo sapiens
tgacaacactcat

SEQ ID NO: 2569239 - DNA, 20 bp, Homo sapiens
tgacaaccaccgctccccag

SEQ ID NO: 2569240 - DNA, 19 bp, Homo sapiens
tgacaaccatgagaccact

SEQ ID NO: 2569241 - DNA, 17 bp, Homo sapiens
tgacaagccccaggcag

SEQ ID NO: 2569242 - DNA, 21 bp, Homo sapiens
tgacaagccccaggcaggctg

SEQ ID NO: 2569243 - DNA, 16 bp, Homo sapiens
tgacaaggccccagag

SEQ ID NO: 2569244 - DNA, 18 bp, Homo sapiens
tgacaaggccccagagac

SEQ ID NO: 2569245 - DNA, 14 bp, Homo sapiens
tgacaataaaacat

SEQ ID NO: 2569246 - DNA, 17 bp, Homo sapiens
tgacaataaaacattaa

SEQ ID NO: 2569247 - DNA, 14 bp, Homo sapiens
tgacaataatttca

SEQ ID NO: 2569248 - DNA, 18 bp, Homo sapiens
tgacaatcaactctaata

SEQ ID NO: 2569249 - DNA, 18 bp, Homo sapiens
tgacaattttgtacaaat

SEQ ID NO: 2569250 - DNA, 19 bp, Homo sapiens
tgacacaaacctgcctggg

SEQ ID NO: 2569251 - DNA, 15 bp, Homo sapiens
tgacacacagctctg

SEQ ID NO: 2569252 - DNA, 18 bp, Homo sapiens
tgacacacagctctgtcc

SEQ ID NO: 2569253 - DNA, 22 bp, Homo sapiens
tgacacagtcttggctcactgc

SEQ ID NO: 2569254 - DNA, 23 bp, Homo sapiens
tgacacagtcttggctcactgca

SEQ ID NO: 2569255 - DNA, 16 bp, Homo sapiens
tgacacatggcccctc

SEQ ID NO: 2569256 - DNA, 22 bp, Homo sapiens
tgacacatggcccctccccctg

SEQ ID NO: 2569257 - DNA, 12 bp, Homo sapiens
tgacaccagcct

SEQ ID NO: 2569258 - DNA, 22 bp, Homo sapiens
tgacaccagcctttctcccagg

SEQ ID NO: 2569259 - DNA, 21 bp, Homo sapiens
tgacaccggggtggtgggaac

SEQ ID NO: 2569260 - DNA, 23 bp, Homo sapiens
tgacactagcccaatgaaatgaa

SEQ ID NO: 2569261 - DNA, 17 bp, Homo sapiens
tgacactatatctgtat

SEQ ID NO: 2569262 - DNA, 19 bp, Homo sapiens
tgacactatatctgtatat

SEQ ID NO: 2569263 - DNA, 22 bp, Homo sapiens
tgacactatatctgtatataaa

SEQ ID NO: 2569264 - DNA, 19 bp, Homo sapiens
tgacactggtattcctgcc

SEQ ID NO: 2569265 - DNA, 20 bp, Homo sapiens
tgacactggtattcctgcct

SEQ ID NO: 2569266 - DNA, 21 bp, Homo sapiens
tgacactggtattcctgcctc

SEQ ID NO: 2569267 - DNA, 15 bp, Homo sapiens
tgacacttaaaaatg

SEQ ID NO: 2569268 - DNA, 16 bp, Homo sapiens
tgacacttaaaaatgg

SEQ ID NO: 2569269 - DNA, 16 bp, Homo sapiens
tgacacttcagagagc

SEQ ID NO: 2569270 - DNA, 17 bp, Homo sapiens
tgacacttcagagagct

SEQ ID NO: 2569271 - DNA, 18 bp, Homo sapiens
tgacacttcagagagctg

SEQ ID NO: 2569272 - DNA, 24 bp, Homo sapiens
tgacacttcagagagctggtagtt

SEQ ID NO: 2569273 - DNA, 20 bp, Homo sapiens
tgacactttgccagaaagca

SEQ ID NO: 2569274 - DNA, 17 bp, Homo sapiens
tgacagaacactgtctt

SEQ ID NO: 2569275 - DNA, 23 bp, Homo sapiens
tgacagacacaggcccggctcca

SEQ ID NO: 2569276 - DNA, 17 bp, Homo sapiens
tgacagaccacatcttt

SEQ ID NO: 2569277 - DNA, 18 bp, Homo sapiens
tgacagaccacatcttta

SEQ ID NO: 2569278 - DNA, 22 bp, Homo sapiens
tgacagaccacatctttatctg

SEQ ID NO: 2569279 - DNA, 17 bp, Homo sapiens
tgacagactcctgagga

SEQ ID NO: 2569280 - DNA, 18 bp, Homo sapiens
tgacagagcaagactctg

SEQ ID NO: 2569281 - DNA, 22 bp, Homo sapiens
tgacagagccttctgaggacat

SEQ ID NO: 2569282 - DNA, 18 bp, Homo sapiens
tgacagaggcagccccat

SEQ ID NO: 2569283 - DNA, 23 bp, Homo sapiens
tgacagaggcagccccattctgc

SEQ ID NO: 2569284 - DNA, 17 bp, Homo sapiens
tgacagagtgagactct

SEQ ID NO: 2569285 - DNA, 17 bp, Homo sapiens
tgacagatcaagctgtg

SEQ ID NO: 2569286 - DNA, 19 bp, Homo sapiens
tgacagatcaagctgtgag

SEQ ID NO: 2569287 - DNA, 21 bp, Homo sapiens
tgacagatcaagctgtgagac

SEQ ID NO: 2569288 - DNA, 19 bp, Homo sapiens
tgacagatgtcagccgagc

SEQ ID NO: 2569289 - DNA, 12 bp, Homo sapiens
tgacagcctccc

SEQ ID NO: 2569290 - DNA, 13 bp, Homo sapiens
tgacaggcagcag

SEQ ID NO: 2569291 - DNA, 12 bp, Homo sapiens
tgacagggaagc

SEQ ID NO: 2569292 - DNA, 21 bp, Homo sapiens
tgacagggaagctacaggtta

SEQ ID NO: 2569293 - DNA, 16 bp, Homo sapiens
tgacagggcacaccgg

SEQ ID NO: 2569294 - DNA, 20 bp, Homo sapiens
tgacagggcacaccgggcac

SEQ ID NO: 2569295 - DNA, 22 bp, Homo sapiens
tgacagggcacaccgggcactc

SEQ ID NO: 2569296 - DNA, 15 bp, Homo sapiens
tgacagtcttgtgct

SEQ ID NO: 2569297 - DNA, 17 bp, Homo sapiens
tgacagtgcctgggaat

SEQ ID NO: 2569298 - DNA, 21 bp, Homo sapiens
tgacagtgcctgggaatgtat

SEQ ID NO: 2569299 - DNA, 16 bp, Homo sapiens
tgacagtgttgaaaat

SEQ ID NO: 2569300 - DNA, 16 bp, Homo sapiens
tgacagttctgaagaa

SEQ ID NO: 2569301 - DNA, 17 bp, Homo sapiens
tgacataacactataaa

SEQ ID NO: 2569302 - DNA, 16 bp, Homo sapiens
tgacatattatgtctt

SEQ ID NO: 2569303 - DNA, 16 bp, Homo sapiens
tgacatcacttgtaca

SEQ ID NO: 2569304 - DNA, 17 bp, Homo sapiens
tgacatcacttgtacaa

SEQ ID NO: 2569305 - DNA, 21 bp, Homo sapiens
tgacatcacttgtacaaaata

SEQ ID NO: 2569306 - DNA, 15 bp, Homo sapiens
tgacatctcaggggc

SEQ ID NO: 2569307 - DNA, 22 bp, Homo sapiens
tgacatctcaggggccagagga

SEQ ID NO: 2569308 - DNA, 23 bp, Homo sapiens
tgacatctctgcaatcttctcag

SEQ ID NO: 2569309 - DNA, 12 bp, Homo sapiens
tgacatctcttt

SEQ ID NO: 2569310 - DNA, 14 bp, Homo sapiens
tgacatctctttga

SEQ ID NO: 2569311 - DNA, 17 bp, Homo sapiens
tgacatcttagtatttg

SEQ ID NO: 2569312 - DNA, 15 bp, Homo sapiens
tgacatgtcttttct

SEQ ID NO: 2569313 - DNA, 22 bp, Homo sapiens
tgacatgtggaaagtgaatttg

SEQ ID NO: 2569314 - DNA, 13 bp, Homo sapiens
tgacattaacagt

SEQ ID NO: 2569315 - DNA, 21 bp, Homo sapiens
tgacattaacagttttccatg

SEQ ID NO: 2569316 - DNA, 18 bp, Homo sapiens
tgacatttatttttcatt

SEQ ID NO: 2569317 - DNA, 20 bp, Homo sapiens
tgaccaacatggagaaaccc

SEQ ID NO: 2569318 - DNA, 22 bp, Homo sapiens
tgaccaactagacattctgtcg

SEQ ID NO: 2569319 - DNA, 16 bp, Homo sapiens
tgaccaagagagaaag

SEQ ID NO: 2569320 - DNA, 18 bp, Homo sapiens
tgaccaagagagaaagaa

SEQ ID NO: 2569321 - DNA, 21 bp, Homo sapiens
tgaccaagcaggaagctcaga

SEQ ID NO: 2569322 - DNA, 20 bp, Homo sapiens
tgaccaagttataaatcaat

SEQ ID NO: 2569323 - DNA, 19 bp, Homo sapiens
tgaccaatattgtacagtt

SEQ ID NO: 2569324 - DNA, 21 bp, Homo sapiens
tgaccaatattgtacagtttt

SEQ ID NO: 2569325 - DNA, 23 bp, Homo sapiens
tgaccacacttcctgtccagaga

SEQ ID NO: 2569326 - DNA, 21 bp, Homo sapiens
tgaccacatagcatgaggcca

SEQ ID NO: 2569327 - DNA, 12 bp, Homo sapiens
tgaccaccctcc

SEQ ID NO: 2569328 - DNA, 16 bp, Homo sapiens
tgaccactgcagaaga

SEQ ID NO: 2569329 - DNA, 18 bp, Homo sapiens
tgaccagcactgtctcag

SEQ ID NO: 2569330 - DNA, 17 bp, Homo sapiens
tgaccagcagatcccag

SEQ ID NO: 2569331 - DNA, 22 bp, Homo sapiens
tgaccaggggtgatttcagaga

SEQ ID NO: 2569332 - DNA, 20 bp, Homo sapiens
tgaccagtttaacctgatgc

SEQ ID NO: 2569333 - DNA, 16 bp, Homo sapiens
tgaccatactgaggga

SEQ ID NO: 2569334 - DNA, 23 bp, Homo sapiens
tgaccatccactctaccctccca

SEQ ID NO: 2569335 - DNA, 17 bp, Homo sapiens
tgaccattctccacctg

SEQ ID NO: 2569336 - DNA, 20 bp, Homo sapiens
tgaccattctccacctgcca

SEQ ID NO: 2569337 - DNA, 12 bp, Homo sapiens
tgacccacccct

SEQ ID NO: 2569338 - DNA, 13 bp, Homo sapiens
tgacccacccctg

SEQ ID NO: 2569339 - DNA, 20 bp, Homo sapiens
tgacccagcactgcccaaag

SEQ ID NO: 2569340 - DNA, 18 bp, Homo sapiens
tgacccagccccttgaga

SEQ ID NO: 2569341 - DNA, 19 bp, Homo sapiens
tgacccagccccttgagaa

SEQ ID NO: 2569342 - DNA, 12 bp, Homo sapiens
tgacccaggccg

SEQ ID NO: 2569343 - DNA, 12 bp, Homo sapiens
tgacccatgctg

SEQ ID NO: 2569344 - DNA, 18 bp, Homo sapiens
tgacccatgctgccctgt

SEQ ID NO: 2569345 - DNA, 20 bp, Homo sapiens
tgacccatgctgccctgtga

SEQ ID NO: 2569346 - DNA, 21 bp, Homo sapiens
tgacccatgctgccctgtgag

SEQ ID NO: 2569347 - DNA, 19 bp, Homo sapiens
tgaccccaaagagcctgga

SEQ ID NO: 2569348 - DNA, 22 bp, Homo sapiens
tgaccccaaagagcctggagaa

SEQ ID NO: 2569349 - DNA, 13 bp, Homo sapiens
tgaccccagagga

SEQ ID NO: 2569350 - DNA, 17 bp, Homo sapiens
tgacccggaggccacat

SEQ ID NO: 2569351 - DNA, 21 bp, Homo sapiens
tgaccctcctgttgcacccag

SEQ ID NO: 2569352 - DNA, 20 bp, Homo sapiens
tgaccctgcgaaggggccct

SEQ ID NO: 2569353 - DNA, 23 bp, Homo sapiens
tgaccctgcgaaggggccctggt

SEQ ID NO: 2569354 - DNA, 13 bp, Homo sapiens
tgacctcatgcat

SEQ ID NO: 2569355 - DNA, 14 bp, Homo sapiens
tgacctccacagct

SEQ ID NO: 2569356 - DNA, 22 bp, Homo sapiens
tgacctccctctaatttatctt

SEQ ID NO: 2569357 - DNA, 23 bp, Homo sapiens
tgacctctgcagcaataaagcag

SEQ ID NO: 2569358 - DNA, 12 bp, Homo sapiens
tgacctgaggcc

SEQ ID NO: 2569359 - DNA, 19 bp, Homo sapiens
tgacctgaggcccttctct

SEQ ID NO: 2569360 - DNA, 20 bp, Homo sapiens
tgacctgaggctcctgtgct

SEQ ID NO: 2569361 - DNA, 20 bp, Homo sapiens
tgacctgcaggccaagagca

SEQ ID NO: 2569362 - DNA, 13 bp, Homo sapiens
tgacctgccccgc

SEQ ID NO: 2569363 - DNA, 19 bp, Homo sapiens
tgacctgccccgcccagct

SEQ ID NO: 2569364 - DNA, 16 bp, Homo sapiens
tgacctgcctcccttc

SEQ ID NO: 2569365 - DNA, 23 bp, Homo sapiens
tgacctgcctcccttcatgcatg

SEQ ID NO: 2569366 - DNA, 21 bp, Homo sapiens
tgacctgctgggtaaactgtg

SEQ ID NO: 2569367 - DNA, 19 bp, Homo sapiens
tgacctgtcatgcccccct

SEQ ID NO: 2569368 - DNA, 18 bp, Homo sapiens
tgacctgtgaccagcact

SEQ ID NO: 2569369 - DNA, 22 bp, Homo sapiens
tgacctgtgaccagcactgtct

SEQ ID NO: 2569370 - DNA, 22 bp, Homo sapiens
tgacctgtggggatttctccca

SEQ ID NO: 2569371 - DNA, 17 bp, Homo sapiens
tgaaattttaaactata

SEQ ID NO: 2569372 - DNA, 22 bp, Homo sapiens
tgaaattttaacctatgatatt

SEQ ID NO: 2569373 - DNA, 22 bp, Homo sapiens
tgaaattttatatgcttactga

SEQ ID NO: 2569374 - DNA, 17 bp, Homo sapiens
tgaaattttccaatgtc

SEQ ID NO: 2569375 - DNA, 19 bp, Homo sapiens
tgaaattttccaatgtctg

SEQ ID NO: 2569376 - DNA, 17 bp, Homo sapiens
tgaaattttctagactt

SEQ ID NO: 2569377 - DNA, 20 bp, Homo sapiens
tgaacaaatttacagagaca

SEQ ID NO: 2569378 - DNA, 15 bp, Homo sapiens
tgaacaagtccctgt

SEQ ID NO: 2569379 - DNA, 14 bp, Homo sapiens
tgaacactcatgct

SEQ ID NO: 2569380 - DNA, 17 bp, Homo sapiens
tgaacactcatgctgaa

SEQ ID NO: 2569381 - DNA, 18 bp, Homo sapiens
tgaacactcatgctgaaa

SEQ ID NO: 2569382 - DNA, 22 bp, Homo sapiens
tgaacactccaattaaggattt

SEQ ID NO: 2569383 - DNA, 20 bp, Homo sapiens
tgaacagaaaacattctgat

SEQ ID NO: 2569384 - DNA, 21 bp, Homo sapiens
tgaaccacatcttgctctgct

SEQ ID NO: 2569385 - DNA, 21 bp, Homo sapiens
tgaaccaccacacccagccca

SEQ ID NO: 2569386 - DNA, 22 bp, Homo sapiens
tgaaccaccacacccagcccac

SEQ ID NO: 2569387 - DNA, 19 bp, Homo sapiens
tgaaccctgtgctggtgtc

SEQ ID NO: 2569388 - DNA, 20 bp, Homo sapiens
tgaaccgaggggctcaggaa

SEQ ID NO: 2569389 - DNA, 17 bp, Homo sapiens
tgaacctgatgctgact

SEQ ID NO: 2569390 - DNA, 17 bp, Homo sapiens
tgaactaaactttcaca

SEQ ID NO: 2569391 - DNA, 19 bp, Homo sapiens
tgaactaaactttcacacc

SEQ ID NO: 2569392 - DNA, 17 bp, Homo sapiens
tgaactcaaactgagga

SEQ ID NO: 2569393 - DNA, 18 bp, Homo sapiens
tgaactcagatctgtctg

SEQ ID NO: 2569394 - DNA, 22 bp, Homo sapiens
tgaactcagatctgtctgatag

SEQ ID NO: 2569395 - DNA, 19 bp, Homo sapiens
tgaactcagccaagcacag

SEQ ID NO: 2569396 - DNA, 23 bp, Homo sapiens
tgaactcagccaagcacagtggt

SEQ ID NO: 2569397 - DNA, 15 bp, Homo sapiens
tgaactcctggcctc

SEQ ID NO: 2569398 - DNA, 14 bp, Homo sapiens
tgaactcttaatca

SEQ ID NO: 2569399 - DNA, 12 bp, Homo sapiens
tgaactgaagtt

SEQ ID NO: 2569400 - DNA, 15 bp, Homo sapiens
tgaactgaagtttca

SEQ ID NO: 2569401 - DNA, 17 bp, Homo sapiens
tgaactgaagtttcaca

SEQ ID NO: 2569402 - DNA, 15 bp, Homo sapiens
tgaacttaaaatgaa

SEQ ID NO: 2569403 - DNA, 15 bp, Homo sapiens
tgaacttctctcaga

SEQ ID NO: 2569404 - DNA, 22 bp, Homo sapiens
tgaactttctcttcatactttt

SEQ ID NO: 2569405 - DNA, 11 bp, Homo sapiens
tgaactttgac

SEQ ID NO: 2569406 - DNA, 20 bp, Homo sapiens
tgaactttgacctctgcagc

SEQ ID NO: 2569407 - DNA, 15 bp, Homo sapiens
tgaactttgctgagc

SEQ ID NO: 2569408 - DNA, 19 bp, Homo sapiens
tgaagaaaaaatacatttt

SEQ ID NO: 2569409 - DNA, 21 bp, Homo sapiens
tgaagaaaccttcagatttgt

SEQ ID NO: 2569410 - DNA, 19 bp, Homo sapiens
tgaagaactgaggaggaaa

SEQ ID NO: 2569411 - DNA, 12 bp, Homo sapiens
tgaagacataaa

SEQ ID NO: 2569412 - DNA, 20 bp, Homo sapiens
tgaagaccacatccacacac

SEQ ID NO: 2569413 - DNA, 20 bp, Homo sapiens
tgaagactcattcttctgta

SEQ ID NO: 2569414 - DNA, 23 bp, Homo sapiens
tgaagagaccaagactctgaaat

SEQ ID NO: 2569415 - DNA, 15 bp, Homo sapiens
tgaagagatttttca

SEQ ID NO: 2569416 - DNA, 18 bp, Homo sapiens
tgaagaggatcggaggct

SEQ ID NO: 2569417 - DNA, 12 bp, Homo sapiens
tgaagaggggca

SEQ ID NO: 2569418 - DNA, 13 bp, Homo sapiens
tgaagaggggcag

SEQ ID NO: 2569419 - DNA, 17 bp, Homo sapiens
tgaagaggggcagccct

SEQ ID NO: 2569420 - DNA, 16 bp, Homo sapiens
tgaagagtgagagggc

SEQ ID NO: 2569421 - DNA, 18 bp, Homo sapiens
tgaagagtgagagggcat

SEQ ID NO: 2569422 - DNA, 18 bp, Homo sapiens
tgaagatgtagaggagaa

SEQ ID NO: 2569423 - DNA, 16 bp, Homo sapiens
tgaagatgtctaatag

SEQ ID NO: 2569424 - DNA, 16 bp, Homo sapiens
tgaagattctttccca

SEQ ID NO: 2569425 - DNA, 13 bp, Homo sapiens
tgaagcaaacaca

SEQ ID NO: 2569426 - DNA, 14 bp, Homo sapiens
tgaagcaaatcaga

SEQ ID NO: 2569427 - DNA, 22 bp, Homo sapiens
tgaagcagatgcaaagaggcaa

SEQ ID NO: 2569428 - DNA, 17 bp, Homo sapiens
tgaagcagctttaaaca

SEQ ID NO: 2569429 - DNA, 19 bp, Homo sapiens
tgaagcagctttaaacaaa

SEQ ID NO: 2569430 - DNA, 16 bp, Homo sapiens
tgaagcatgtttcatg

SEQ ID NO: 2569431 - DNA, 14 bp, Homo sapiens
tgaagcattttata

SEQ ID NO: 2569432 - DNA, 17 bp, Homo sapiens
tgaagcattttataaat

SEQ ID NO: 2569433 - DNA, 20 bp, Homo sapiens
tgaagccactgaagctggga

SEQ ID NO: 2569434 - DNA, 16 bp, Homo sapiens
tgaagcccaagtgaaa

SEQ ID NO: 2569435 - DNA, 13 bp, Homo sapiens
tgaagcctctggg

SEQ ID NO: 2569436 - DNA, 19 bp, Homo sapiens
tgaagctatttatctgtag

SEQ ID NO: 2569437 - DNA, 16 bp, Homo sapiens
tgaagctcacttctgg

SEQ ID NO: 2569438 - DNA, 15 bp, Homo sapiens
tgaagctgcctgctt

SEQ ID NO: 2569439 - DNA, 14 bp, Homo sapiens
tgaagcttgtgtat

SEQ ID NO: 2569440 - DNA, 12 bp, Homo sapiens
tgaagctttata

SEQ ID NO: 2569441 - DNA, 12 bp, Homo sapiens
tgaaggaaacag

SEQ ID NO: 2569442 - DNA, 14 bp, Homo sapiens
tgaaggaaacagtt

SEQ ID NO: 2569443 - DNA, 20 bp, Homo sapiens
tgaaggacattgcggacagc

SEQ ID NO: 2569444 - DNA, 14 bp, Homo sapiens
tgaaggactgtgac

SEQ ID NO: 2569445 - DNA, 15 bp, Homo sapiens
tgaaggatgccaaga

SEQ ID NO: 2569446 - DNA, 17 bp, Homo sapiens
tgaaggccccgcccagg

SEQ ID NO: 2569447 - DNA, 19 bp, Homo sapiens
tgaaggccgagaagcaaga

SEQ ID NO: 2569448 - DNA, 22 bp, Homo sapiens
tgaagggaaaggatattttctt

SEQ ID NO: 2569449 - DNA, 11 bp, Homo sapiens
tgaagggaggt

SEQ ID NO: 2569450 - DNA, 21 bp, Homo sapiens
tgaagggaggtggggatgaga

SEQ ID NO: 2569451 - DNA, 14 bp, Homo sapiens
tgaaggtgtcagaa

SEQ ID NO: 2569452 - DNA, 15 bp, Homo sapiens
tgaaggtgtcagaat

SEQ ID NO: 2569453 - DNA, 14 bp, Homo sapiens
tgaaggttgaagag

SEQ ID NO: 2569454 - DNA, 15 bp, Homo sapiens
tgaagtaagcaaaga

SEQ ID NO: 2569455 - DNA, 14 bp, Homo sapiens
tgaagtaatgaatt

SEQ ID NO: 2569456 - DNA, 20 bp, Homo sapiens
tgaagtaatgaatttttatg

SEQ ID NO: 2569457 - DNA, 17 bp, Homo sapiens
tgaagtactcatacatg

SEQ ID NO: 2569458 - DNA, 14 bp, Homo sapiens
tgaagtagtttgta

SEQ ID NO: 2569459 - DNA, 15 bp, Homo sapiens
tgaagtatactgtat

SEQ ID NO: 2569460 - DNA, 16 bp, Homo sapiens
tgaagtatataatggt

SEQ ID NO: 2569461 - DNA, 21 bp, Homo sapiens
tgaagtcgtcttaactcacca

SEQ ID NO: 2569462 - DNA, 12 bp, Homo sapiens
tgaagtctgaaa

SEQ ID NO: 2569463 - DNA, 14 bp, Homo sapiens
tgaagtgaaactgc

SEQ ID NO: 2569464 - DNA, 17 bp, Homo sapiens
tgaagtgagcacagcct

SEQ ID NO: 2569465 - DNA, 18 bp, Homo sapiens
tgaagtgcatccaaaggt

SEQ ID NO: 2569466 - DNA, 16 bp, Homo sapiens
tgaagtgtgtttcctt

SEQ ID NO: 2569467 - DNA, 20 bp, Homo sapiens
tgaagtgttttgttctttct

SEQ ID NO: 2569468 - DNA, 14 bp, Homo sapiens
tgaagttaacagag

SEQ ID NO: 2569469 - DNA, 16 bp, Homo sapiens
tgaagttcaccattaa

SEQ ID NO: 2569470 - DNA, 17 bp, Homo sapiens
tgaagtttacaatcaaa

SEQ ID NO: 2569471 - DNA, 14 bp, Homo sapiens
tgaagtttcactcc

SEQ ID NO: 2569472 - DNA, 18 bp, Homo sapiens
tgaagtttgaacttcata

SEQ ID NO: 2569473 - DNA, 14 bp, Homo sapiens
tgaataaaaatgca

SEQ ID NO: 2569474 - DNA, 19 bp, Homo sapiens
tgaataaaattattccttt

SEQ ID NO: 2569475 - DNA, 20 bp, Homo sapiens
tgaataaactagattacatt

SEQ ID NO: 2569476 - DNA, 20 bp, Homo sapiens
tgaataaagcctgcttttta

SEQ ID NO: 2569477 - DNA, 16 bp, Homo sapiens
tgaataaataaatgta

SEQ ID NO: 2569478 - DNA, 15 bp, Homo sapiens
tgaataaatacctct

SEQ ID NO: 2569479 - DNA, 19 bp, Homo sapiens
tgaataaatacctcttagc

SEQ ID NO: 2569480 - DNA, 12 bp, Homo sapiens
tgaataaatgtc

SEQ ID NO: 2569481 - DNA, 13 bp, Homo sapiens
tgaataatacagt

SEQ ID NO: 2569482 - DNA, 22 bp, Homo sapiens
tgaataatttcccaattaggaa

SEQ ID NO: 2569483 - DNA, 15 bp, Homo sapiens
tgaatacaaacaatg

SEQ ID NO: 2569484 - DNA, 16 bp, Homo sapiens
tgaatacaaacaatgg

SEQ ID NO: 2569485 - DNA, 20 bp, Homo sapiens
tgaatacaaacaatggaaac

SEQ ID NO: 2569486 - DNA, 19 bp, Homo sapiens
tgaatacagggcatgcatt

SEQ ID NO: 2569487 - DNA, 16 bp, Homo sapiens
tgaatactgtattttg

SEQ ID NO: 2569488 - DNA, 21 bp, Homo sapiens
tgaatataatatatttgtgta

SEQ ID NO: 2569489 - DNA, 22 bp, Homo sapiens
tgaatataccccttagtgtttg

SEQ ID NO: 2569490 - DNA, 18 bp, Homo sapiens
tgaatatcccctcccagt

SEQ ID NO: 2569491 - DNA, 21 bp, Homo sapiens
tgaatatttgttatgtagata

SEQ ID NO: 2569492 - DNA, 13 bp, Homo sapiens
tgaatcaaagaca

SEQ ID NO: 2569493 - DNA, 16 bp, Homo sapiens
tgaatcaataatatat

SEQ ID NO: 2569494 - DNA, 17 bp, Homo sapiens
tgaatcaataatatatt

SEQ ID NO: 2569495 - DNA, 17 bp, Homo sapiens
tgaatcacgtaaagcta

SEQ ID NO: 2569496 - DNA, 23 bp, Homo sapiens
tgaatcacgtaaagctagaaatg

SEQ ID NO: 2569497 - DNA, 12 bp, Homo sapiens
tgaatcatgtag

SEQ ID NO: 2569498 - DNA, 14 bp, Homo sapiens
tgaatcatgtagta

SEQ ID NO: 2569499 - DNA, 18 bp, Homo sapiens
tgaatcatgtagtatcaa

SEQ ID NO: 2569500 - DNA, 19 bp, Homo sapiens
tgaatcatgtagtatcaaa

SEQ ID NO: 2569501 - DNA, 15 bp, Homo sapiens
tgaatctaagcagca

SEQ ID NO: 2569502 - DNA, 17 bp, Homo sapiens
tgaatgaaaaatttaag

SEQ ID NO: 2569503 - DNA, 19 bp, Homo sapiens
tgaatgaaaaatttaagca

SEQ ID NO: 2569504 - DNA, 20 bp, Homo sapiens
tgaatgaaaaatttaagcat

SEQ ID NO: 2569505 - DNA, 18 bp, Homo sapiens
tgaatgaaacccccacac

SEQ ID NO: 2569506 - DNA, 16 bp, Homo sapiens
tgaatgaaccttctgg

SEQ ID NO: 2569507 - DNA, 20 bp, Homo sapiens
tgaatgaatggctaagcaaa

SEQ ID NO: 2569508 - DNA, 18 bp, Homo sapiens
tgaatgcaccatggtcaa

SEQ ID NO: 2569509 - DNA, 17 bp, Homo sapiens
tgaatgcctcaatgtga

SEQ ID NO: 2569510 - DNA, 21 bp, Homo sapiens
tgaatgcttataggtggcctc

SEQ ID NO: 2569511 - DNA, 12 bp, Homo sapiens
tgaatgcttttt

SEQ ID NO: 2569512 - DNA, 19 bp, Homo sapiens
tgaatgctttttgaatgtt

SEQ ID NO: 2569513 - DNA, 12 bp, Homo sapiens
tgaatggcctgc

SEQ ID NO: 2569514 - DNA, 14 bp, Homo sapiens
tgaatggtccaggg

SEQ ID NO: 2569515 - DNA, 15 bp, Homo sapiens
tgaatggtccagggt

SEQ ID NO: 2569516 - DNA, 23 bp, Homo sapiens
tgaatggttccatgcctgagggt

SEQ ID NO: 2569517 - DNA, 20 bp, Homo sapiens
tgaatggttttcaaaataaa

SEQ ID NO: 2569518 - DNA, 16 bp, Homo sapiens
tgaatgtattgaactt

SEQ ID NO: 2569519 - DNA, 16 bp, Homo sapiens
tgaatgtcattcacaa

SEQ ID NO: 2569520 - DNA, 23 bp, Homo sapiens
tgaatgtcttttgaatattccca

SEQ ID NO: 2569521 - DNA, 15 bp, Homo sapiens
tgaatgttatttgtt

SEQ ID NO: 2569522 - DNA, 14 bp, Homo sapiens
tgaatgttctgaca

SEQ ID NO: 2569523 - DNA, 15 bp, Homo sapiens
tcttactgcaaatgt

SEQ ID NO: 2569524 - DNA, 15 bp, Homo sapiens
tcttagaaatgaagg

SEQ ID NO: 2569525 - DNA, 18 bp, Homo sapiens
tcttagctgtctgctcag

SEQ ID NO: 2569526 - DNA, 20 bp, Homo sapiens
tcttaggttggcaaaaaggc

SEQ ID NO: 2569527 - DNA, 23 bp, Homo sapiens
tcttaggttggcaaaaaggcagg

SEQ ID NO: 2569528 - DNA, 14 bp, Homo sapiens
tcttagtagatttt

SEQ ID NO: 2569529 - DNA, 16 bp, Homo sapiens
tcttagtggatgttct

SEQ ID NO: 2569530 - DNA, 15 bp, Homo sapiens
tcttagttctcactg

SEQ ID NO: 2569531 - DNA, 21 bp, Homo sapiens
tcttagtttggattcttatgt

SEQ ID NO: 2569532 - DNA, 14 bp, Homo sapiens
tcttataaatatga

SEQ ID NO: 2569533 - DNA, 22 bp, Homo sapiens
ccctggtgtttctagcactggc

SEQ ID NO: 2569534 - DNA, 22 bp, Homo sapiens
ccctggttctgatgatgtgcct

SEQ ID NO: 2569535 - DNA, 12 bp, Homo sapiens
tctgaccacact

SEQ ID NO: 2569536 - DNA, 23 bp, Homo sapiens
tctgaccagtttaacctgatgca

SEQ ID NO: 2569537 - DNA, 15 bp, Homo sapiens
tctgacccatgctgc

SEQ ID NO: 2569538 - DNA, 16 bp, Homo sapiens
tctgacccatgctgcc

SEQ ID NO: 2569539 - DNA, 15 bp, Homo sapiens
tctgacctgcaggcc

SEQ ID NO: 2569540 - DNA, 22 bp, Homo sapiens
tctgactactgggcaaagagtg

SEQ ID NO: 2569541 - DNA, 23 bp, Homo sapiens
tctgactactgggcaaagagtgt

SEQ ID NO: 2569542 - DNA, 14 bp, Homo sapiens
tctgactcacaaga

SEQ ID NO: 2569543 - DNA, 12 bp, Homo sapiens
tctgactctcaa

SEQ ID NO: 2569544 - DNA, 15 bp, Homo sapiens
tctgactctcaaatc

SEQ ID NO: 2569545 - DNA, 14 bp, Homo sapiens
tctgactctgagct

SEQ ID NO: 2569546 - DNA, 14 bp, Homo sapiens
tctgactgtgtgtg

SEQ ID NO: 2569547 - DNA, 13 bp, Homo sapiens
tctgagaactcat

SEQ ID NO: 2569548 - DNA, 18 bp, Homo sapiens
tctgagaattccaaggag

SEQ ID NO: 2569549 - DNA, 16 bp, Homo sapiens
tctgagcaagagctgg

SEQ ID NO: 2569550 - DNA, 12 bp, Homo sapiens
tctgagccagtt

SEQ ID NO: 2569551 - DNA, 16 bp, Homo sapiens
tctgagcccgggctgc

SEQ ID NO: 2569552 - DNA, 17 bp, Homo sapiens
tctgaggaatccagacc

SEQ ID NO: 2569553 - DNA, 21 bp, Homo sapiens
tctgaggaatccagacccggc

SEQ ID NO: 2569554 - DNA, 12 bp, Homo sapiens
tctgaggacatt

SEQ ID NO: 2569555 - DNA, 23 bp, Homo sapiens
tctgaggcctcctctctcagttt

SEQ ID NO: 2569556 - DNA, 22 bp, Homo sapiens
tctgaggctggatcctagcctt

SEQ ID NO: 2569557 - DNA, 14 bp, Homo sapiens
tctgaggcttccag

SEQ ID NO: 2569558 - DNA, 15 bp, Homo sapiens
tctgaggcttccaga

SEQ ID NO: 2569559 - DNA, 18 bp, Homo sapiens
tctgagggaggaggccac

SEQ ID NO: 2569560 - DNA, 22 bp, Homo sapiens
tctgagggaggaggccacctct

SEQ ID NO: 2569561 - DNA, 23 bp, Homo sapiens
tctgagggaggaggccacctctc

SEQ ID NO: 2569562 - DNA, 18 bp, Homo sapiens
tctgagtatctcctcgca

SEQ ID NO: 2569563 - DNA, 24 bp, Homo sapiens
tctgagtgtttttactacagttgt

SEQ ID NO: 2569564 - DNA, 14 bp, Homo sapiens
tctgatacccagag

SEQ ID NO: 2569565 - DNA, 19 bp, Homo sapiens
tctgatattccatgaatgt

SEQ ID NO: 2569566 - DNA, 20 bp, Homo sapiens
tctgatattccatgaatgta

SEQ ID NO: 2569567 - DNA, 21 bp, Homo sapiens
tctgatcatccactgtgccat

SEQ ID NO: 2569568 - DNA, 20 bp, Homo sapiens
tctgatcgtgacgctgaata

SEQ ID NO: 2569569 - DNA, 14 bp, Homo sapiens
tctgatctgtgctt

SEQ ID NO: 2569570 - DNA, 21 bp, Homo sapiens
tctgatgcaagcaagaaacac

SEQ ID NO: 2569571 - DNA, 15 bp, Homo sapiens
tctgatggcttctcc

SEQ ID NO: 2569572 - DNA, 18 bp, Homo sapiens
tctgatggcttctccagg

SEQ ID NO: 2569573 - DNA, 19 bp, Homo sapiens
tctgattcccaagctctgc

SEQ ID NO: 2569574 - DNA, 13 bp, Homo sapiens
tctgattggctca

SEQ ID NO: 2569575 - DNA, 22 bp, Homo sapiens
tctgattgtaacgttgctgtgg

SEQ ID NO: 2569576 - DNA, 20 bp, Homo sapiens
tctgatttgtccctatgcat

SEQ ID NO: 2569577 - DNA, 21 bp, Homo sapiens
tctgcaagaattgaagcagga

SEQ ID NO: 2569578 - DNA, 17 bp, Homo sapiens
tctgcaatcttctcaga

SEQ ID NO: 2569579 - DNA, 19 bp, Homo sapiens
tctgcaatgggcactggga

SEQ ID NO: 2569580 - DNA, 18 bp, Homo sapiens
tctgcaattcccctctgc

SEQ ID NO: 2569581 - DNA, 15 bp, Homo sapiens
tctgcacagatggat

SEQ ID NO: 2569582 - DNA, 17 bp, Homo sapiens
tctgcacagctggcctc

SEQ ID NO: 2569583 - DNA, 12 bp, Homo sapiens
tctgcacatgaa

SEQ ID NO: 2569584 - DNA, 21 bp, Homo sapiens
tctgcacatgcagctgcaccc

SEQ ID NO: 2569585 - DNA, 23 bp, Homo sapiens
tctgcacatgcagctgcaccctc

SEQ ID NO: 2569586 - DNA, 16 bp, Homo sapiens
tctgcacatgtcttgt

SEQ ID NO: 2569587 - DNA, 14 bp, Homo sapiens
tctgcaccctccac

SEQ ID NO: 2569588 - DNA, 16 bp, Homo sapiens
tctgcaccctccaccc

SEQ ID NO: 2569589 - DNA, 18 bp, Homo sapiens
tctgcactactcctctgc

SEQ ID NO: 2569590 - DNA, 23 bp, Homo sapiens
tctgcactactcctctgcagtgc

SEQ ID NO: 2569591 - DNA, 17 bp, Homo sapiens
tctgcactcccctgctg

SEQ ID NO: 2569592 - DNA, 22 bp, Homo sapiens
tctgcactcccctgctgggtgt

SEQ ID NO: 2569593 - DNA, 15 bp, Homo sapiens
tctgcagaaacagaa

SEQ ID NO: 2569594 - DNA, 15 bp, Homo sapiens
tctgcagataaacag

SEQ ID NO: 2569595 - DNA, 18 bp, Homo sapiens
tctgcagataaacagtag

SEQ ID NO: 2569596 - DNA, 17 bp, Homo sapiens
tctgcagcaataaagca

SEQ ID NO: 2569597 - DNA, 20 bp, Homo sapiens
tctgcagctgacctctgttg

SEQ ID NO: 2569598 - DNA, 20 bp, Homo sapiens
tctgcagtcacttcgtggga

SEQ ID NO: 2569599 - DNA, 14 bp, Homo sapiens
tctgcatgcggccc

SEQ ID NO: 2569600 - DNA, 19 bp, Homo sapiens
tctgcatgcggcccagccc

SEQ ID NO: 2569601 - DNA, 17 bp, Homo sapiens
tctgcattttcacccca

SEQ ID NO: 2569602 - DNA, 19 bp, Homo sapiens
tctgccaccaaaggccagg

SEQ ID NO: 2569603 - DNA, 17 bp, Homo sapiens
tctgccaccctacctgt

SEQ ID NO: 2569604 - DNA, 21 bp, Homo sapiens
tctgccaccctacctgttcag

SEQ ID NO: 2569605 - DNA, 21 bp, Homo sapiens
tctgccagaagatcccctcag

SEQ ID NO: 2569606 - DNA, 13 bp, Homo sapiens
tctgccagccagc

SEQ ID NO: 2569607 - DNA, 17 bp, Homo sapiens
tctgccagccagcagcc

SEQ ID NO: 2569608 - DNA, 14 bp, Homo sapiens
tctgccaggccccc

SEQ ID NO: 2569609 - DNA, 12 bp, Homo sapiens
tctgccagggag

SEQ ID NO: 2569610 - DNA, 14 bp, Homo sapiens
tctgccagggagct

SEQ ID NO: 2569611 - DNA, 19 bp, Homo sapiens
tctgcccaaaaatatggtt

SEQ ID NO: 2569612 - DNA, 21 bp, Homo sapiens
tctgcccactccctgcaacct

SEQ ID NO: 2569613 - DNA, 14 bp, Homo sapiens
tctgcccaggggtg

SEQ ID NO: 2569614 - DNA, 20 bp, Homo sapiens
tctgcccatcctgcccctga

SEQ ID NO: 2569615 - DNA, 14 bp, Homo sapiens
tctgccccagaggc

SEQ ID NO: 2569616 - DNA, 17 bp, Homo sapiens
tctgccccagctctggc

SEQ ID NO: 2569617 - DNA, 14 bp, Homo sapiens
tctgccccctgctg

SEQ ID NO: 2569618 - DNA, 12 bp, Homo sapiens
tctgcccctccc

SEQ ID NO: 2569619 - DNA, 10 bp, Homo sapiens
tctgcccggg

SEQ ID NO: 2569620 - DNA, 14 bp, Homo sapiens
tctgccctccaaga

SEQ ID NO: 2569621 - DNA, 15 bp, Homo sapiens
tctgccggccctggg

SEQ ID NO: 2569622 - DNA, 23 bp, Homo sapiens
tctgccggctctttccttgctca

SEQ ID NO: 2569623 - DNA, 15 bp, Homo sapiens
tctgcctctgacaca

SEQ ID NO: 2569624 - DNA, 15 bp, Homo sapiens
tctgcctctgaggga

SEQ ID NO: 2569625 - DNA, 14 bp, Homo sapiens
tctgcctcttctgg

SEQ ID NO: 2569626 - DNA, 15 bp, Homo sapiens
tctgcctcttctggg

SEQ ID NO: 2569627 - DNA, 17 bp, Homo sapiens
tctgcctcttctgggag

SEQ ID NO: 2569628 - DNA, 19 bp, Homo sapiens
tctgcctgaagtcacacag

SEQ ID NO: 2569629 - DNA, 14 bp, Homo sapiens
tctgcctgcccagg

SEQ ID NO: 2569630 - DNA, 16 bp, Homo sapiens
tctgcctgcccaggcc

SEQ ID NO: 2569631 - DNA, 12 bp, Homo sapiens
tctgcctgtctc

SEQ ID NO: 2569632 - DNA, 14 bp, Homo sapiens
tctgcctgtctccc

SEQ ID NO: 2569633 - DNA, 15 bp, Homo sapiens
tctgcctgttataac

SEQ ID NO: 2569634 - DNA, 13 bp, Homo sapiens
tctgccttccttg

SEQ ID NO: 2569635 - DNA, 22 bp, Homo sapiens
tctgctaagctcaaggcgtgag

SEQ ID NO: 2569636 - DNA, 17 bp, Homo sapiens
tctgctacctcactggg

SEQ ID NO: 2569637 - DNA, 21 bp, Homo sapiens
tctgctacgttcctattgtca

SEQ ID NO: 2569638 - DNA, 17 bp, Homo sapiens
tctgctcacatatctgt

SEQ ID NO: 2569639 - DNA, 20 bp, Homo sapiens
tctgctcacatatctgtcat

SEQ ID NO: 2569640 - DNA, 22 bp, Homo sapiens
tctgctcagacagaacccctac

SEQ ID NO: 2569641 - DNA, 15 bp, Homo sapiens
tctgctcatcattct

SEQ ID NO: 2569642 - DNA, 18 bp, Homo sapiens
tctgctcatcattctctg

SEQ ID NO: 2569643 - DNA, 22 bp, Homo sapiens
tctgctcatcattctctgtctc

SEQ ID NO: 2569644 - DNA, 12 bp, Homo sapiens
tctgctccaccc

SEQ ID NO: 2569645 - DNA, 17 bp, Homo sapiens
tctgctccacccttggc

SEQ ID NO: 2569646 - DNA, 20 bp, Homo sapiens
tctgctccacccttggcctg

SEQ ID NO: 2569647 - DNA, 13 bp, Homo sapiens
tctgctcctctcc

SEQ ID NO: 2569648 - DNA, 21 bp, Homo sapiens
tctgctcctctccccagcaag

SEQ ID NO: 2569649 - DNA, 16 bp, Homo sapiens
tctgctctgcgtgtca

SEQ ID NO: 2569650 - DNA, 17 bp, Homo sapiens
tctgctgacagacacag

SEQ ID NO: 2569651 - DNA, 18 bp, Homo sapiens
tctgctgacagacacagg

SEQ ID NO: 2569652 - DNA, 13 bp, Homo sapiens
tctgctgccctcc

SEQ ID NO: 2569653 - DNA, 21 bp, Homo sapiens
tctgctgccgccccacccaga

SEQ ID NO: 2569654 - DNA, 14 bp, Homo sapiens
tctgctgctggctg

SEQ ID NO: 2569655 - DNA, 15 bp, Homo sapiens
tctgctgctggctgg

SEQ ID NO: 2569656 - DNA, 16 bp, Homo sapiens
tctgctggataaaatg

SEQ ID NO: 2569657 - DNA, 12 bp, Homo sapiens
tctgctggccca

SEQ ID NO: 2569658 - DNA, 16 bp, Homo sapiens
tctgctggcctggatc

SEQ ID NO: 2569659 - DNA, 18 bp, Homo sapiens
tctgctggcctggatctc

SEQ ID NO: 2569660 - DNA, 16 bp, Homo sapiens
tctgctggcctggccg

SEQ ID NO: 2569661 - DNA, 14 bp, Homo sapiens
tctgctgtccagac

SEQ ID NO: 2569662 - DNA, 18 bp, Homo sapiens
tctgctgtccagacagcc

SEQ ID NO: 2569663 - DNA, 20 bp, Homo sapiens
tctgcttacaattccctgct

SEQ ID NO: 2569664 - DNA, 21 bp, Homo sapiens
tctgcttacaattccctgctg

SEQ ID NO: 2569665 - DNA, 23 bp, Homo sapiens
tctgcttacaattccctgctgtc

SEQ ID NO: 2569666 - DNA, 16 bp, Homo sapiens
tctgcttaggagagac

SEQ ID NO: 2569667 - DNA, 14 bp, Homo sapiens
tctgcttcagcctc

SEQ ID NO: 2569668 - DNA, 18 bp, Homo sapiens
tctgcttgctcttgtcct

SEQ ID NO: 2569669 - DNA, 20 bp, Homo sapiens
tctgctttgctcttcaagaa

SEQ ID NO: 2569670 - DNA, 19 bp, Homo sapiens
tctggaaaggggggagctg

SEQ ID NO: 2569671 - DNA, 13 bp, Homo sapiens
tctggaagagagg

SEQ ID NO: 2569672 - DNA, 16 bp, Homo sapiens
tctggaatgcagtggt

SEQ ID NO: 2569673 - DNA, 18 bp, Homo sapiens
tctggaccccatctgtga

SEQ ID NO: 2569674 - DNA, 19 bp, Homo sapiens
tctggaccccatctgtgaa

SEQ ID NO: 2569675 - DNA, 15 bp, Homo sapiens
tctggactcctctgt

SEQ ID NO: 2569676 - DNA, 18 bp, Homo sapiens
tctggactcctctgtcca

SEQ ID NO: 2569677 - DNA, 19 bp, Homo sapiens
tctggactgaagcctgcag

SEQ ID NO: 2569678 - DNA, 21 bp, Homo sapiens
tctggactgaagcctgcagga

SEQ ID NO: 2569679 - DNA, 19 bp, Homo sapiens
tctggactgccccagaaaa

SEQ ID NO: 2569680 - DNA, 19 bp, Homo sapiens
tctggacttggcaacagaa

SEQ ID NO: 2569681 - DNA, 14 bp, Homo sapiens
tctggagagctaga

SEQ ID NO: 2569682 - DNA, 20 bp, Homo sapiens
tctggagagctagaacctgg

SEQ ID NO: 2569683 - DNA, 21 bp, Homo sapiens
tctggagagctagaacctgga

SEQ ID NO: 2569684 - DNA, 23 bp, Homo sapiens
tctggagagctagaacctggagg

SEQ ID NO: 2569685 - DNA, 17 bp, Homo sapiens
tctggagtattctataa

SEQ ID NO: 2569686 - DNA, 17 bp, Homo sapiens
tctggatgcatttctct

SEQ ID NO: 2569687 - DNA, 18 bp, Homo sapiens
tctggatggcaccagagg

SEQ ID NO: 2569688 - DNA, 19 bp, Homo sapiens
tctggatggcaccagaggc

SEQ ID NO: 2569689 - DNA, 14 bp, Homo sapiens
tctggattcccagg

SEQ ID NO: 2569690 - DNA, 21 bp, Homo sapiens
tctggattcccaggatgagca

SEQ ID NO: 2569691 - DNA, 16 bp, Homo sapiens
tctggcaacatcttta

SEQ ID NO: 2569692 - DNA, 16 bp, Homo sapiens
tctggcagctcagaga

SEQ ID NO: 2569693 - DNA, 17 bp, Homo sapiens
tctggcagctcagagag

SEQ ID NO: 2569694 - DNA, 21 bp, Homo sapiens
tctggcagctcagagagggtg

SEQ ID NO: 2569695 - DNA, 18 bp, Homo sapiens
tctggcattagaattatt

SEQ ID NO: 2569696 - DNA, 19 bp, Homo sapiens
tctggccaggatggagggg

SEQ ID NO: 2569697 - DNA, 23 bp, Homo sapiens
tctggccctcacccctgccctgg

SEQ ID NO: 2569698 - DNA, 13 bp, Homo sapiens
tctggcctagtcc

SEQ ID NO: 2569699 - DNA, 18 bp, Homo sapiens
tctggcctagtcccttcc

SEQ ID NO: 2569700 - DNA, 14 bp, Homo sapiens
tctggcctcccacc

SEQ ID NO: 2569701 - DNA, 23 bp, Homo sapiens
tctggcctcccacccgatgctgc

SEQ ID NO: 2569702 - DNA, 16 bp, Homo sapiens
tctggctagaggccag

SEQ ID NO: 2569703 - DNA, 17 bp, Homo sapiens
tctggctagaggccagc

SEQ ID NO: 2569704 - DNA, 15 bp, Homo sapiens
tctcactaaacttta

SEQ ID NO: 2569705 - DNA, 17 bp, Homo sapiens
tctcactaaactttacc

SEQ ID NO: 2569706 - DNA, 16 bp, Homo sapiens
tctcactataccagta

SEQ ID NO: 2569707 - DNA, 16 bp, Homo sapiens
tctcactatgttgccc

SEQ ID NO: 2569708 - DNA, 17 bp, Homo sapiens
tctcactatgttgccca

SEQ ID NO: 2569709 - DNA, 21 bp, Homo sapiens
tctcactatgttgcccaggca

SEQ ID NO: 2569710 - DNA, 17 bp, Homo sapiens
tctcactctgtcgccca

SEQ ID NO: 2569711 - DNA, 22 bp, Homo sapiens
tctcactctgtcgcccagtctg

SEQ ID NO: 2569712 - DNA, 23 bp, Homo sapiens
tctcactctgtcgcccagtctgg

SEQ ID NO: 2569713 - DNA, 19 bp, Homo sapiens
tctcactgttgcccaggct

SEQ ID NO: 2569714 - DNA, 15 bp, Homo sapiens
tctcacttttctcca

SEQ ID NO: 2569715 - DNA, 20 bp, Homo sapiens
tctcacttttctccatgagt

SEQ ID NO: 2569716 - DNA, 21 bp, Homo sapiens
tctcagaaggcaaatgacttt

SEQ ID NO: 2569717 - DNA, 13 bp, Homo sapiens
tctcagaagggag

SEQ ID NO: 2569718 - DNA, 20 bp, Homo sapiens
tctcagagctacttgggcca

SEQ ID NO: 2569719 - DNA, 16 bp, Homo sapiens
tctcagatatttatat

SEQ ID NO: 2569720 - DNA, 20 bp, Homo sapiens
tctcagatccttgtttcaaa

SEQ ID NO: 2569721 - DNA, 21 bp, Homo sapiens
tctcaggaaatcaaatatgca

SEQ ID NO: 2569722 - DNA, 23 bp, Homo sapiens
tctcaggagcacaggcagctgga

SEQ ID NO: 2569723 - DNA, 20 bp, Homo sapiens
tctcaggcatgaacatgtac

SEQ ID NO: 2569724 - DNA, 13 bp, Homo sapiens
tctcaggccacct

SEQ ID NO: 2569725 - DNA, 14 bp, Homo sapiens
tctcaggctctgcc

SEQ ID NO: 2569726 - DNA, 17 bp, Homo sapiens
tctcaggctctgccctg

SEQ ID NO: 2569727 - DNA, 19 bp, Homo sapiens
tctcaggctctgccctgcc

SEQ ID NO: 2569728 - DNA, 12 bp, Homo sapiens
tctcagggcctg

SEQ ID NO: 2569729 - DNA, 13 bp, Homo sapiens
tctcagggcctgg

SEQ ID NO: 2569730 - DNA, 14 bp, Homo sapiens
tctcagggcctggt

SEQ ID NO: 2569731 - DNA, 15 bp, Homo sapiens
tctcagggcctggtc

SEQ ID NO: 2569732 - DNA, 13 bp, Homo sapiens
tctcagggctcct

SEQ ID NO: 2569733 - DNA, 20 bp, Homo sapiens
tctcaggggccagaggaact

SEQ ID NO: 2569734 - DNA, 17 bp, Homo sapiens
tctcaggggctgtttga

SEQ ID NO: 2569735 - DNA, 16 bp, Homo sapiens
tctcagggtctctgct

SEQ ID NO: 2569736 - DNA, 19 bp, Homo sapiens
tctcagtcatgcataaata

SEQ ID NO: 2569737 - DNA, 20 bp, Homo sapiens
tctcagtcatgcataaatat

SEQ ID NO: 2569738 - DNA, 21 bp, Homo sapiens
tctcagtcatgcataaatatg

SEQ ID NO: 2569739 - DNA, 15 bp, Homo sapiens
tctcagtctctgagc

SEQ ID NO: 2569740 - DNA, 20 bp, Homo sapiens
tctcagtggcttcatctgtc

SEQ ID NO: 2569741 - DNA, 21 bp, Homo sapiens
tctcagtgtcaatgcagcccc

SEQ ID NO: 2569742 - DNA, 22 bp, Homo sapiens
tctcagtgttgagccttttccc

SEQ ID NO: 2569743 - DNA, 16 bp, Homo sapiens
tctcagttttcataag

SEQ ID NO: 2569744 - DNA, 24 bp, Homo sapiens
tctcatagcattaactaatctatt

SEQ ID NO: 2569745 - DNA, 19 bp, Homo sapiens
tctcataggaaaagtacat

SEQ ID NO: 2569746 - DNA, 24 bp, Homo sapiens
tctcataggaaaagtacatttaat

SEQ ID NO: 2569747 - DNA, 16 bp, Homo sapiens
tctcatcactcccctc

SEQ ID NO: 2569748 - DNA, 15 bp, Homo sapiens
tctcatcagtgtcct

SEQ ID NO: 2569749 - DNA, 19 bp, Homo sapiens
tctcatcccacgcactcca

SEQ ID NO: 2569750 - DNA, 15 bp, Homo sapiens
tctcatccccagggg

SEQ ID NO: 2569751 - DNA, 22 bp, Homo sapiens
tctcatccccaggggtcccagc

SEQ ID NO: 2569752 - DNA, 13 bp, Homo sapiens
tctcatctgtgat

SEQ ID NO: 2569753 - DNA, 17 bp, Homo sapiens
tctcatctgtgattccc

SEQ ID NO: 2569754 - DNA, 14 bp, Homo sapiens
tctcatgaatctgc

SEQ ID NO: 2569755 - DNA, 20 bp, Homo sapiens
tctcatggagaagcagaaat

SEQ ID NO: 2569756 - DNA, 22 bp, Homo sapiens
tctcatggagaagcagaaatac

SEQ ID NO: 2569757 - DNA, 16 bp, Homo sapiens
tctcatggagaagtta

SEQ ID NO: 2569758 - DNA, 16 bp, Homo sapiens
tctcatgtgatccttt

SEQ ID NO: 2569759 - DNA, 19 bp, Homo sapiens
tctcattccaacagtgagt

SEQ ID NO: 2569760 - DNA, 16 bp, Homo sapiens
tctcatttgtcacaca

SEQ ID NO: 2569761 - DNA, 24 bp, Homo sapiens
tctccaaatgagatctaagccttt

SEQ ID NO: 2569762 - DNA, 16 bp, Homo sapiens
tctccaagaatgctga

SEQ ID NO: 2569763 - DNA, 17 bp, Homo sapiens
tctccaagaatgctgaa

SEQ ID NO: 2569764 - DNA, 18 bp, Homo sapiens
tctccaagaatgctgaaa

SEQ ID NO: 2569765 - DNA, 15 bp, Homo sapiens
tctccaagcaggaca

SEQ ID NO: 2569766 - DNA, 16 bp, Homo sapiens
tctccaagggcttctg

SEQ ID NO: 2569767 - DNA, 22 bp, Homo sapiens
tctccaagggcttctgcaccct

SEQ ID NO: 2569768 - DNA, 22 bp, Homo sapiens
tctccacacacagctgggctgt

SEQ ID NO: 2569769 - DNA, 17 bp, Homo sapiens
tctccaccctgctctcc

SEQ ID NO: 2569770 - DNA, 19 bp, Homo sapiens
tctccacctgccagggaca

SEQ ID NO: 2569771 - DNA, 22 bp, Homo sapiens
tctccacctgccagggacagag

SEQ ID NO: 2569772 - DNA, 20 bp, Homo sapiens
tctccagacccccacccctt

SEQ ID NO: 2569773 - DNA, 12 bp, Homo sapiens
tctccagccagc

SEQ ID NO: 2569774 - DNA, 13 bp, Homo sapiens
tctccagccagca

SEQ ID NO: 2569775 - DNA, 15 bp, Homo sapiens
tctccagccagcaat

SEQ ID NO: 2569776 - DNA, 13 bp, Homo sapiens
tctccagcccctg

SEQ ID NO: 2569777 - DNA, 22 bp, Homo sapiens
tctccagcccctggatgcagcc

SEQ ID NO: 2569778 - DNA, 21 bp, Homo sapiens
tctccagctgggctctgcaat

SEQ ID NO: 2569779 - DNA, 13 bp, Homo sapiens
tctccaggatcca

SEQ ID NO: 2569780 - DNA, 19 bp, Homo sapiens
tctccaggattgaagagca

SEQ ID NO: 2569781 - DNA, 17 bp, Homo sapiens
tctccaggcacccttct

SEQ ID NO: 2569782 - DNA, 21 bp, Homo sapiens
tctccagggagtcccctcccc

SEQ ID NO: 2569783 - DNA, 18 bp, Homo sapiens
tctccagtggttgctgtt

SEQ ID NO: 2569784 - DNA, 15 bp, Homo sapiens
tctccagttttcagt

SEQ ID NO: 2569785 - DNA, 14 bp, Homo sapiens
tctccatatgttac

SEQ ID NO: 2569786 - DNA, 15 bp, Homo sapiens
tctccatatgttaca

SEQ ID NO: 2569787 - DNA, 11 bp, Homo sapiens
tctccatctct

SEQ ID NO: 2569788 - DNA, 18 bp, Homo sapiens
tctccatctctctggccc

SEQ ID NO: 2569789 - DNA, 14 bp, Homo sapiens
tctccatctgtttg

SEQ ID NO: 2569790 - DNA, 15 bp, Homo sapiens
tctccatggccacct

SEQ ID NO: 2569791 - DNA, 20 bp, Homo sapiens
tctccatggccaccttttca

SEQ ID NO: 2569792 - DNA, 16 bp, Homo sapiens
tctccatgtttgatgt

SEQ ID NO: 2569793 - DNA, 15 bp, Homo sapiens
tctcccacccctgcc

SEQ ID NO: 2569794 - DNA, 21 bp, Homo sapiens
tctcccagataatgtgaaaat

SEQ ID NO: 2569795 - DNA, 11 bp, Homo sapiens
tctcccaggaa

SEQ ID NO: 2569796 - DNA, 13 bp, Homo sapiens
tctcccaggccag

SEQ ID NO: 2569797 - DNA, 18 bp, Homo sapiens
tctcccaggccaggctcc

SEQ ID NO: 2569798 - DNA, 19 bp, Homo sapiens
tctcccagtctacccagag

SEQ ID NO: 2569799 - DNA, 23 bp, Homo sapiens
tctcccatccagtgtctcacagc

SEQ ID NO: 2569800 - DNA, 15 bp, Homo sapiens
tctcccatccccctg

SEQ ID NO: 2569801 - DNA, 19 bp, Homo sapiens
tctcccatccccctgccct

SEQ ID NO: 2569802 - DNA, 13 bp, Homo sapiens
tctccccacacta

SEQ ID NO: 2569803 - DNA, 23 bp, Homo sapiens
tctccccagcaagtgagagctgg

SEQ ID NO: 2569804 - DNA, 12 bp, Homo sapiens
tctcccccagcc

SEQ ID NO: 2569805 - DNA, 15 bp, Homo sapiens
tctcccccagcccca

SEQ ID NO: 2569806 - DNA, 12 bp, Homo sapiens
tctccccctggg

SEQ ID NO: 2569807 - DNA, 16 bp, Homo sapiens
tctcccctcaaagtct

SEQ ID NO: 2569808 - DNA, 12 bp, Homo sapiens
tctccctcccct

SEQ ID NO: 2569809 - DNA, 21 bp, Homo sapiens
tctccctcttctcaagtgcct

SEQ ID NO: 2569810 - DNA, 14 bp, Homo sapiens
tcctgctgctgtgt

SEQ ID NO: 2569811 - DNA, 22 bp, Homo sapiens
tcctggaaaggctcagtctcag

SEQ ID NO: 2569812 - DNA, 17 bp, Homo sapiens
tcctggacactcagacc

SEQ ID NO: 2569813 - DNA, 22 bp, Homo sapiens
tcctggacatcctcttctgctt

SEQ ID NO: 2569814 - DNA, 19 bp, Homo sapiens
tcctggagcagaccacccc

SEQ ID NO: 2569815 - DNA, 20 bp, Homo sapiens
tcctggcaatagtgtgttct

SEQ ID NO: 2569816 - DNA, 21 bp, Homo sapiens
tcctggcaatagtgtgttctg

SEQ ID NO: 2569817 - DNA, 16 bp, Homo sapiens
tcctggcacccggccc

SEQ ID NO: 2569818 - DNA, 23 bp, Homo sapiens
tcctggcacccggcccctgctgg

SEQ ID NO: 2569819 - DNA, 13 bp, Homo sapiens
tcctggcactgct

SEQ ID NO: 2569820 - DNA, 15 bp, Homo sapiens
tcctggcagaatgct

SEQ ID NO: 2569821 - DNA, 13 bp, Homo sapiens
tcctggccctctg

SEQ ID NO: 2569822 - DNA, 12 bp, Homo sapiens
tcctggcctcaa

SEQ ID NO: 2569823 - DNA, 23 bp, Homo sapiens
tcctggctcttgatacccccctc

SEQ ID NO: 2569824 - DNA, 16 bp, Homo sapiens
tcctgggaaatattcc

SEQ ID NO: 2569825 - DNA, 20 bp, Homo sapiens
tcctgggaaatattccctag

SEQ ID NO: 2569826 - DNA, 18 bp, Homo sapiens
tcctgggagaacctcagg

SEQ ID NO: 2569827 - DNA, 18 bp, Homo sapiens
tcctgggagtgagctggt

SEQ ID NO: 2569828 - DNA, 13 bp, Homo sapiens
tcctgggatgtgg

SEQ ID NO: 2569829 - DNA, 11 bp, Homo sapiens
tcctgggcaca

SEQ ID NO: 2569830 - DNA, 19 bp, Homo sapiens
tcctgggcgccctggaagc

SEQ ID NO: 2569831 - DNA, 12 bp, Homo sapiens
tcctgggctcag

SEQ ID NO: 2569832 - DNA, 21 bp, Homo sapiens
tcctggggcctcggagcctca

SEQ ID NO: 2569833 - DNA, 16 bp, Homo sapiens
tcctggggctcccttc

SEQ ID NO: 2569834 - DNA, 15 bp, Homo sapiens
tcctgggtggtctgc

SEQ ID NO: 2569835 - DNA, 15 bp, Homo sapiens
tcctggtacccagcc

SEQ ID NO: 2569836 - DNA, 13 bp, Homo sapiens
tcctggtagaata

SEQ ID NO: 2569837 - DNA, 16 bp, Homo sapiens
tcctggtgggtccagg

SEQ ID NO: 2569838 - DNA, 17 bp, Homo sapiens
tcctggtgggtccaggg

SEQ ID NO: 2569839 - DNA, 19 bp, Homo sapiens
tcctggtgggtccaggggc

SEQ ID NO: 2569840 - DNA, 21 bp, Homo sapiens
tcctggtgtcacttactgttt

SEQ ID NO: 2569841 - DNA, 14 bp, Homo sapiens
tcctggtgtgaagg

SEQ ID NO: 2569842 - DNA, 19 bp, Homo sapiens
tcctgtaaatggtgtacat

SEQ ID NO: 2569843 - DNA, 20 bp, Homo sapiens
tcctgtaaatggtgtacata

SEQ ID NO: 2569844 - DNA, 20 bp, Homo sapiens
tcctgtaacacaagccacag

SEQ ID NO: 2569845 - DNA, 21 bp, Homo sapiens
tcctgtaacacaagccacaga

SEQ ID NO: 2569846 - DNA, 16 bp, Homo sapiens
tcctgtacactgaata

SEQ ID NO: 2569847 - DNA, 17 bp, Homo sapiens
tcctgtacactgaatat

SEQ ID NO: 2569848 - DNA, 20 bp, Homo sapiens
tcctgtacctcttgagcctt

SEQ ID NO: 2569849 - DNA, 20 bp, Homo sapiens
tcctgtagacctagggagga

SEQ ID NO: 2569850 - DNA, 21 bp, Homo sapiens
tcctgtagcatcttctggagt

SEQ ID NO: 2569851 - DNA, 21 bp, Homo sapiens
tcctgtagccttctgtaggaa

SEQ ID NO: 2569852 - DNA, 22 bp, Homo sapiens
tcctgtagccttctgtaggaat

SEQ ID NO: 2569853 - DNA, 23 bp, Homo sapiens
tcctgtagttgcgtggactctgc

SEQ ID NO: 2569854 - DNA, 15 bp, Homo sapiens
tcctgtattcacccg

SEQ ID NO: 2569855 - DNA, 22 bp, Homo sapiens
tcctgtccacacccagctcagc

SEQ ID NO: 2569856 - DNA, 11 bp, Homo sapiens
tcctgtcctcc

SEQ ID NO: 2569857 - DNA, 21 bp, Homo sapiens
tcctgtcctcccatcccctgg

SEQ ID NO: 2569858 - DNA, 23 bp, Homo sapiens
tcctgtcctttacacattcggct

SEQ ID NO: 2569859 - DNA, 17 bp, Homo sapiens
tcctgtctgccagccag

SEQ ID NO: 2569860 - DNA, 12 bp, Homo sapiens
tcctgtcttccc

SEQ ID NO: 2569861 - DNA, 17 bp, Homo sapiens
tcctgtcttcccagggt

SEQ ID NO: 2569862 - DNA, 22 bp, Homo sapiens
tcctgtctttctgagcacactt

SEQ ID NO: 2569863 - DNA, 15 bp, Homo sapiens
tcctgtgacatgtaa

SEQ ID NO: 2569864 - DNA, 18 bp, Homo sapiens
tcctgtgacatgtaacag

SEQ ID NO: 2569865 - DNA, 18 bp, Homo sapiens
tcctgtgacttcagctct

SEQ ID NO: 2569866 - DNA, 15 bp, Homo sapiens
tcctgtgcatgggtg

SEQ ID NO: 2569867 - DNA, 14 bp, Homo sapiens
tcctgtggcaggca

SEQ ID NO: 2569868 - DNA, 15 bp, Homo sapiens
tcctgtggcaggcag

SEQ ID NO: 2569869 - DNA, 20 bp, Homo sapiens
tcctgtggcaggcagcgcca

SEQ ID NO: 2569870 - DNA, 23 bp, Homo sapiens
tcctgtgtaatcatttcttgggc

SEQ ID NO: 2569871 - DNA, 13 bp, Homo sapiens
tcctgtgtacagg

SEQ ID NO: 2569872 - DNA, 19 bp, Homo sapiens
tcctgtgtttctagggaaa

SEQ ID NO: 2569873 - DNA, 18 bp, Homo sapiens
tcctgttacttacctaaa

SEQ ID NO: 2569874 - DNA, 20 bp, Homo sapiens
tcgtgggatctgcccctccc

SEQ ID NO: 2569875 - DNA, 15 bp, Homo sapiens
tcgtgggtgtgtgta

SEQ ID NO: 2569876 - DNA, 15 bp, Homo sapiens
tcgtggtaggactgt

SEQ ID NO: 2569877 - DNA, 17 bp, Homo sapiens
tcgttgactttagggac

SEQ ID NO: 2569878 - DNA, 16 bp, Homo sapiens
tcgtttcaaaaacaca

SEQ ID NO: 2569879 - DNA, 12 bp, Homo sapiens
tcgtttctgtat

SEQ ID NO: 2569880 - DNA, 18 bp, Homo sapiens
tctaaaaaacagaggcca

SEQ ID NO: 2569881 - DNA, 23 bp, Homo sapiens
tctaaaaggttcagggaaccgtt

SEQ ID NO: 2569882 - DNA, 13 bp, Homo sapiens
tctaaaatgagtt

SEQ ID NO: 2569883 - DNA, 13 bp, Homo sapiens
tctaaaggctacc

SEQ ID NO: 2569884 - DNA, 13 bp, Homo sapiens
tctaaatagccaa

SEQ ID NO: 2569885 - DNA, 21 bp, Homo sapiens
tctaaatagccaacacccatc

SEQ ID NO: 2569886 - DNA, 23 bp, Homo sapiens
tctaaatgcatatcctgagccat

SEQ ID NO: 2569887 - DNA, 14 bp, Homo sapiens
tctaaattgaataa

SEQ ID NO: 2569888 - DNA, 15 bp, Homo sapiens
tctaaattgaataat

SEQ ID NO: 2569889 - DNA, 23 bp, Homo sapiens
tctaaccctaggcatcacatgct

SEQ ID NO: 2569890 - DNA, 14 bp, Homo sapiens
tctaaccctcccat

SEQ ID NO: 2569891 - DNA, 13 bp, Homo sapiens
tctaactcagcaa

SEQ ID NO: 2569892 - DNA, 16 bp, Homo sapiens
tctaacttcaccatat

SEQ ID NO: 2569893 - DNA, 21 bp, Homo sapiens
tctaagattcatccatttatt

SEQ ID NO: 2569894 - DNA, 18 bp, Homo sapiens
tctaagcctttccataag

SEQ ID NO: 2569895 - DNA, 20 bp, Homo sapiens
tctaaggatgtcacagggcc

SEQ ID NO: 2569896 - DNA, 19 bp, Homo sapiens
tctaagtaaaaccacagca

SEQ ID NO: 2569897 - DNA, 14 bp, Homo sapiens
tctaagtctttcca

SEQ ID NO: 2569898 - DNA, 18 bp, Homo sapiens
tctaatattaaaaatatg

SEQ ID NO: 2569899 - DNA, 20 bp, Homo sapiens
tctaatgggtatttaaacaa

SEQ ID NO: 2569900 - DNA, 14 bp, Homo sapiens
tctaatgtcttcat

SEQ ID NO: 2569901 - DNA, 20 bp, Homo sapiens
tctaattctaaggaatatga

SEQ ID NO: 2569902 - DNA, 15 bp, Homo sapiens
tctaattttggatgg

SEQ ID NO: 2569903 - DNA, 14 bp, Homo sapiens
tctacacagagcag

SEQ ID NO: 2569904 - DNA, 16 bp, Homo sapiens
tctacagagcttccct

SEQ ID NO: 2569905 - DNA, 19 bp, Homo sapiens
tctacagagcttccctgac

SEQ ID NO: 2569906 - DNA, 15 bp, Homo sapiens
tctacagaggccatg

SEQ ID NO: 2569907 - DNA, 15 bp, Homo sapiens
tctacatattcttta

SEQ ID NO: 2569908 - DNA, 20 bp, Homo sapiens
tctaccaagctatcctggct

SEQ ID NO: 2569909 - DNA, 16 bp, Homo sapiens
tctaccagactgtgta

SEQ ID NO: 2569910 - DNA, 18 bp, Homo sapiens
tctaccatttcagagagg

SEQ ID NO: 2569911 - DNA, 20 bp, Homo sapiens
tctacccagcgagccctggt

SEQ ID NO: 2569912 - DNA, 16 bp, Homo sapiens
tctaccctcccacccc

SEQ ID NO: 2569913 - DNA, 21 bp, Homo sapiens
tctaccctcttagaaaaacca

SEQ ID NO: 2569914 - DNA, 19 bp, Homo sapiens
tctaccctggcactataat

SEQ ID NO: 2569915 - DNA, 15 bp, Homo sapiens
tctacctcaggcagc

SEQ ID NO: 2569916 - DNA, 14 bp, Homo sapiens
tctaccttctgtag

SEQ ID NO: 2569917 - DNA, 17 bp, Homo sapiens
tctaccttgaggtcttt

SEQ ID NO: 2569918 - DNA, 16 bp, Homo sapiens
tctacgctctcctttc

SEQ ID NO: 2569919 - DNA, 17 bp, Homo sapiens
tctacgctctcctttct

SEQ ID NO: 2569920 - DNA, 12 bp, Homo sapiens
tctactaaaaat

SEQ ID NO: 2569921 - DNA, 14 bp, Homo sapiens
tctactcagaaatt

SEQ ID NO: 2569922 - DNA, 21 bp, Homo sapiens
tctactcagaaatttttattt

SEQ ID NO: 2569923 - DNA, 18 bp, Homo sapiens
tctactctagggaaaaac

SEQ ID NO: 2569924 - DNA, 13 bp, Homo sapiens
tctactctcccat

SEQ ID NO: 2569925 - DNA, 22 bp, Homo sapiens
tctactgaggtgctatgttctt

SEQ ID NO: 2569926 - DNA, 13 bp, Homo sapiens
tctagaacacagg

SEQ ID NO: 2569927 - DNA, 20 bp, Homo sapiens
tctagaagttgtttgtcatc

SEQ ID NO: 2569928 - DNA, 13 bp, Homo sapiens
tctagacaaccct

SEQ ID NO: 2569929 - DNA, 24 bp, Homo sapiens
tctagactcaaggttcccagagat

SEQ ID NO: 2569930 - DNA, 14 bp, Homo sapiens
tctagactttctgt

SEQ ID NO: 2569931 - DNA, 13 bp, Homo sapiens
tctagagaagagg

SEQ ID NO: 2569932 - DNA, 16 bp, Homo sapiens
tctagagaagaggctg

SEQ ID NO: 2569933 - DNA, 16 bp, Homo sapiens
tctagagatagtacat

SEQ ID NO: 2569934 - DNA, 13 bp, Homo sapiens
tctagatactgta

SEQ ID NO: 2569935 - DNA, 15 bp, Homo sapiens
tctagattgagagaa

SEQ ID NO: 2569936 - DNA, 23 bp, Homo sapiens
tctagcaatcacaacactggctg

SEQ ID NO: 2569937 - DNA, 16 bp, Homo sapiens
tctagcactggcctgc

SEQ ID NO: 2569938 - DNA, 17 bp, Homo sapiens
tctagcactggcctgca

SEQ ID NO: 2569939 - DNA, 16 bp, Homo sapiens
tctagctagaaatatg

SEQ ID NO: 2569940 - DNA, 20 bp, Homo sapiens
tctaggaagaattttaaaaa

SEQ ID NO: 2569941 - DNA, 12 bp, Homo sapiens
tctaggaagact

SEQ ID NO: 2569942 - DNA, 15 bp, Homo sapiens
tctaggaagactttg

SEQ ID NO: 2569943 - DNA, 19 bp, Homo sapiens
tctaggaagactttggaaa

SEQ ID NO: 2569944 - DNA, 22 bp, Homo sapiens
tctagggaaaaaccagcgtgtg

SEQ ID NO: 2569945 - DNA, 15 bp, Homo sapiens
tctagggacccctcc

SEQ ID NO: 2569946 - DNA, 19 bp, Homo sapiens
tctaggggtcaggctccat

SEQ ID NO: 2569947 - DNA, 19 bp, Homo sapiens
tctaggtttaactcagatc

SEQ ID NO: 2569948 - DNA, 20 bp, Homo sapiens
tctagtctcctttgcactga

SEQ ID NO: 2569949 - DNA, 16 bp, Homo sapiens
tctagtgcagctgatt

SEQ ID NO: 2569950 - DNA, 19 bp, Homo sapiens
tctagtgcagctgatttta

SEQ ID NO: 2569951 - DNA, 20 bp, Homo sapiens
tctagtgccctccacagccg

SEQ ID NO: 2569952 - DNA, 14 bp, Homo sapiens
tctagtgctgtgaa

SEQ ID NO: 2569953 - DNA, 16 bp, Homo sapiens
tctagtgctgtgaaaa

SEQ ID NO: 2569954 - DNA, 19 bp, Homo sapiens
tctagtgctgtgaaaaaaa

SEQ ID NO: 2569955 - DNA, 23 bp, Homo sapiens
tctagtgctgtgaaaaaaaaaat

SEQ ID NO: 2569956 - DNA, 18 bp, Homo sapiens
tctagtggtctttgtaag

SEQ ID NO: 2569957 - DNA, 21 bp, Homo sapiens
tctagtggtctttgtaagagt

SEQ ID NO: 2569958 - DNA, 22 bp, Homo sapiens
tctagtggtctttgtaagagtg

SEQ ID NO: 2569959 - DNA, 18 bp, Homo sapiens
tctagttgcttgtaaaat

SEQ ID NO: 2569960 - DNA, 21 bp, Homo sapiens
tctagtttgattaaattcttg

SEQ ID NO: 2569961 - DNA, 15 bp, Homo sapiens
tctagtttgcattcc

SEQ ID NO: 2569962 - DNA, 18 bp, Homo sapiens
tctagtttgcattcctga

SEQ ID NO: 2569963 - DNA, 16 bp, Homo sapiens
tctataaattgtccgt

SEQ ID NO: 2569964 - DNA, 19 bp, Homo sapiens
tctataatcccagcacttt

SEQ ID NO: 2569965 - DNA, 21 bp, Homo sapiens
tctataatcccagcactttgg

SEQ ID NO: 2569966 - DNA, 21 bp, Homo sapiens
tctataggaacatatgaaaat

SEQ ID NO: 2569967 - DNA, 18 bp, Homo sapiens
tctatatataattctgta

SEQ ID NO: 2569968 - DNA, 16 bp, Homo sapiens
tctatatatgtgtatg

SEQ ID NO: 2569969 - DNA, 12 bp, Homo sapiens
tctatatgaatt

SEQ ID NO: 2569970 - DNA, 13 bp, Homo sapiens
tcccttttacata

SEQ ID NO: 2569971 - DNA, 17 bp, Homo sapiens
tcccttttacatactgc

SEQ ID NO: 2569972 - DNA, 23 bp, Homo sapiens
tcccttttgcggatgggaggggt

SEQ ID NO: 2569973 - DNA, 22 bp, Homo sapiens
tccgaaaaatcctcttcctctg

SEQ ID NO: 2569974 - DNA, 15 bp, Homo sapiens
tccgaacctcctctg

SEQ ID NO: 2569975 - DNA, 20 bp, Homo sapiens
tccgacaaccgatgctccag

SEQ ID NO: 2569976 - DNA, 20 bp, Homo sapiens
tccgacagccccctctgccg

SEQ ID NO: 2569977 - DNA, 17 bp, Homo sapiens
tccgaccagacaccttg

SEQ ID NO: 2569978 - DNA, 17 bp, Homo sapiens
tccgagagagcacccct

SEQ ID NO: 2569979 - DNA, 19 bp, Homo sapiens
tccgagccggggagtttct

SEQ ID NO: 2569980 - DNA, 14 bp, Homo sapiens
tccgaggcagggtc

SEQ ID NO: 2569981 - DNA, 18 bp, Homo sapiens
tccgccagggcccacacc

SEQ ID NO: 2569982 - DNA, 21 bp, Homo sapiens
tccgcccacaggaagcctgca

SEQ ID NO: 2569983 - DNA, 15 bp, Homo sapiens
tccgccctgctcctc

SEQ ID NO: 2569984 - DNA, 17 bp, Homo sapiens
tccgccctgctcctccc

SEQ ID NO: 2569985 - DNA, 17 bp, Homo sapiens
tccgccttcactccggt

SEQ ID NO: 2569986 - DNA, 20 bp, Homo sapiens
tccgctttctacccagcgag

SEQ ID NO: 2569987 - DNA, 17 bp, Homo sapiens
tccggattggcttgtgt

SEQ ID NO: 2569988 - DNA, 18 bp, Homo sapiens
tccggcagttctgggtgc

SEQ ID NO: 2569989 - DNA, 14 bp, Homo sapiens
tccggcccccagag

SEQ ID NO: 2569990 - DNA, 18 bp, Homo sapiens
tccggcccccagagcgcc

SEQ ID NO: 2569991 - DNA, 23 bp, Homo sapiens
tccggccctcctaccctgcgccc

SEQ ID NO: 2569992 - DNA, 15 bp, Homo sapiens
tccggcgtcagcctc

SEQ ID NO: 2569993 - DNA, 18 bp, Homo sapiens
tccggcgtcagcctccag

SEQ ID NO: 2569994 - DNA, 16 bp, Homo sapiens
tccggctcctgtgctt

SEQ ID NO: 2569995 - DNA, 17 bp, Homo sapiens
tccggctcctgtgcttt

SEQ ID NO: 2569996 - DNA, 21 bp, Homo sapiens
tccgggacctggtgctgcctc

SEQ ID NO: 2569997 - DNA, 22 bp, Homo sapiens
tccgggggcagctctggagggg

SEQ ID NO: 2569998 - DNA, 22 bp, Homo sapiens
tccgtaacccaactctcctgga

SEQ ID NO: 2569999 - DNA, 20 bp, Homo sapiens
tccgtagccagctgctcccc

SEQ ID NO: 2570000 - DNA, 14 bp, Homo sapiens
tccgtatttcagac

SEQ ID NO: 2570001 - DNA, 21 bp, Homo sapiens
tccgtgcctccaccaccactg

SEQ ID NO: 2570002 - DNA, 24 bp, Homo sapiens
tccgtgcttgtttgctcacctggg

SEQ ID NO: 2570003 - DNA, 22 bp, Homo sapiens
tcctaaaacaaaagctcatcca

SEQ ID NO: 2570004 - DNA, 15 bp, Homo sapiens
tcctaaaacaaatag

SEQ ID NO: 2570005 - DNA, 16 bp, Homo sapiens
tcctaacacagcatgt

SEQ ID NO: 2570006 - DNA, 16 bp, Homo sapiens
tcctaagagtgctggg

SEQ ID NO: 2570007 - DNA, 17 bp, Homo sapiens
tcctaagagtgctgggc

SEQ ID NO: 2570008 - DNA, 21 bp, Homo sapiens
tcctaagctattcagtaataa

SEQ ID NO: 2570009 - DNA, 16 bp, Homo sapiens
tcctaaggacacacta

SEQ ID NO: 2570010 - DNA, 20 bp, Homo sapiens
tcctacaagagcagcctgtg

SEQ ID NO: 2570011 - DNA, 23 bp, Homo sapiens
tcctacaagagcagcctgtggca

SEQ ID NO: 2570012 - DNA, 17 bp, Homo sapiens
tcctacagccccttttt

SEQ ID NO: 2570013 - DNA, 15 bp, Homo sapiens
tcctaccaatgcatg

SEQ ID NO: 2570014 - DNA, 16 bp, Homo sapiens
tcctaccaatgcatgc

SEQ ID NO: 2570015 - DNA, 21 bp, Homo sapiens
tcctaccaatgcatgcagcca

SEQ ID NO: 2570016 - DNA, 21 bp, Homo sapiens
tcctacccacacctctgccag

SEQ ID NO: 2570017 - DNA, 19 bp, Homo sapiens
tcctaccccaattccttgt

SEQ ID NO: 2570018 - DNA, 21 bp, Homo sapiens
tcctaccctcgggcccacctg

SEQ ID NO: 2570019 - DNA, 20 bp, Homo sapiens
tcctaccctgcgcccagtcc

SEQ ID NO: 2570020 - DNA, 20 bp, Homo sapiens
tcctacgtcaaacatgaagt

SEQ ID NO: 2570021 - DNA, 13 bp, Homo sapiens
tcctactctgtgt

SEQ ID NO: 2570022 - DNA, 14 bp, Homo sapiens
tcctactctgtgtc

SEQ ID NO: 2570023 - DNA, 16 bp, Homo sapiens
tcctagaaattcccca

SEQ ID NO: 2570024 - DNA, 20 bp, Homo sapiens
tcctagaagttactgaatgc

SEQ ID NO: 2570025 - DNA, 19 bp, Homo sapiens
tcctagagaacgcagccct

SEQ ID NO: 2570026 - DNA, 23 bp, Homo sapiens
tcctagagaacgcagccctagag

SEQ ID NO: 2570027 - DNA, 13 bp, Homo sapiens
tcctagatgctct

SEQ ID NO: 2570028 - DNA, 20 bp, Homo sapiens
tcctagcactttgggaggcc

SEQ ID NO: 2570029 - DNA, 14 bp, Homo sapiens
tcctagcagagaga

SEQ ID NO: 2570030 - DNA, 17 bp, Homo sapiens
tcctagccactcaggag

SEQ ID NO: 2570031 - DNA, 18 bp, Homo sapiens
tcctagccttatcctctg

SEQ ID NO: 2570032 - DNA, 22 bp, Homo sapiens
tcctagccttatcctctgatct

SEQ ID NO: 2570033 - DNA, 16 bp, Homo sapiens
tcctagctgcacaggg

SEQ ID NO: 2570034 - DNA, 20 bp, Homo sapiens
tcctagctgcacagggcagc

SEQ ID NO: 2570035 - DNA, 14 bp, Homo sapiens
tcctaggcatttgc

SEQ ID NO: 2570036 - DNA, 19 bp, Homo sapiens
tcctaggcatttgctgaat

SEQ ID NO: 2570037 - DNA, 13 bp, Homo sapiens
tcctaggccacac

SEQ ID NO: 2570038 - DNA, 13 bp, Homo sapiens
tcccccttctccc

SEQ ID NO: 2570039 - DNA, 13 bp, Homo sapiens
tcccccttgccac

SEQ ID NO: 2570040 - DNA, 17 bp, Homo sapiens
tcccccttgccacccca

SEQ ID NO: 2570041 - DNA, 18 bp, Homo sapiens
tccccgagtttccccaga

SEQ ID NO: 2570042 - DNA, 21 bp, Homo sapiens
tccccgcaccccccaagctgt

SEQ ID NO: 2570043 - DNA, 21 bp, Homo sapiens
tccccggccctaccagcgccc

SEQ ID NO: 2570044 - DNA, 12 bp, Homo sapiens
tccccggcctca

SEQ ID NO: 2570045 - DNA, 23 bp, Homo sapiens
tcccctaccccctcctctctgcc

SEQ ID NO: 2570046 - DNA, 17 bp, Homo sapiens
tcccctagtaagtgcct

SEQ ID NO: 2570047 - DNA, 18 bp, Homo sapiens
tcccctagtaagtgcctt

SEQ ID NO: 2570048 - DNA, 19 bp, Homo sapiens
tcccctatggggatggtcc

SEQ ID NO: 2570049 - DNA, 14 bp, Homo sapiens
tcccctcaaagtct

SEQ ID NO: 2570050 - DNA, 17 bp, Homo sapiens
tcccctcaaagtctgca

SEQ ID NO: 2570051 - DNA, 16 bp, Homo sapiens
tcccctcaggactgca

SEQ ID NO: 2570052 - DNA, 12 bp, Homo sapiens
tcccctccactg

SEQ ID NO: 2570053 - DNA, 14 bp, Homo sapiens
tcccctcccatctg

SEQ ID NO: 2570054 - DNA, 21 bp, Homo sapiens
tcccctccctggctcccatga

SEQ ID NO: 2570055 - DNA, 13 bp, Homo sapiens
tcccctccctggg

SEQ ID NO: 2570056 - DNA, 14 bp, Homo sapiens
tcccctccctgtca

SEQ ID NO: 2570057 - DNA, 14 bp, Homo sapiens
tcccctcctcactc

SEQ ID NO: 2570058 - DNA, 14 bp, Homo sapiens
tcccctcctctccc

SEQ ID NO: 2570059 - DNA, 12 bp, Homo sapiens
tcccctccttgc

SEQ ID NO: 2570060 - DNA, 18 bp, Homo sapiens
tcccctccttgcctcctg

SEQ ID NO: 2570061 - DNA, 22 bp, Homo sapiens
tcccctccttgcctcctgtgta

SEQ ID NO: 2570062 - DNA, 14 bp, Homo sapiens
tcccctccttgggc

SEQ ID NO: 2570063 - DNA, 18 bp, Homo sapiens
tcccctccttgggcactt

SEQ ID NO: 2570064 - DNA, 13 bp, Homo sapiens
tcccctctgctgc

SEQ ID NO: 2570065 - DNA, 14 bp, Homo sapiens
tcccctctgctgct

SEQ ID NO: 2570066 - DNA, 20 bp, Homo sapiens
tcccctctgctgctgtccct

SEQ ID NO: 2570067 - DNA, 21 bp, Homo sapiens
tcccctgattacaccagcctc

SEQ ID NO: 2570068 - DNA, 20 bp, Homo sapiens
tcccctgccagggcagggcc

SEQ ID NO: 2570069 - DNA, 23 bp, Homo sapiens
tcccctgcccccagaccttttat

SEQ ID NO: 2570070 - DNA, 14 bp, Homo sapiens
tcccctgctgggtg

SEQ ID NO: 2570071 - DNA, 20 bp, Homo sapiens
tcccctgctgggtgtggcgc

SEQ ID NO: 2570072 - DNA, 21 bp, Homo sapiens
tcccctgctgggtgtggcgca

SEQ ID NO: 2570073 - DNA, 19 bp, Homo sapiens
tcccctggggacagcaagg

SEQ ID NO: 2570074 - DNA, 19 bp, Homo sapiens
tccccttccatcccagagg

SEQ ID NO: 2570075 - DNA, 15 bp, Homo sapiens
tccccttctcatcac

SEQ ID NO: 2570076 - DNA, 14 bp, Homo sapiens
tccccttgagctga

SEQ ID NO: 2570077 - DNA, 15 bp, Homo sapiens
tccccttgagctgag

SEQ ID NO: 2570078 - DNA, 15 bp, Homo sapiens
tccccttgcccaggg

SEQ ID NO: 2570079 - DNA, 23 bp, Homo sapiens
tccccttgcccttgccctgacct

SEQ ID NO: 2570080 - DNA, 20 bp, Homo sapiens
tccccttttcttttctaccc

SEQ ID NO: 2570081 - DNA, 20 bp, Homo sapiens
tcccgaatagctgggactac

SEQ ID NO: 2570082 - DNA, 22 bp, Homo sapiens
tcccgagcacctccacatcctc

SEQ ID NO: 2570083 - DNA, 16 bp, Homo sapiens
tcccgagtagctggga

SEQ ID NO: 2570084 - DNA, 20 bp, Homo sapiens
tcccgagtagctgggactac

SEQ ID NO: 2570085 - DNA, 21 bp, Homo sapiens
tcccgccccttcccactcacc

SEQ ID NO: 2570086 - DNA, 21 bp, Homo sapiens
tcccgcctcttcttcttcaga

SEQ ID NO: 2570087 - DNA, 15 bp, Homo sapiens
tcccgctgctgctgc

SEQ ID NO: 2570088 - DNA, 18 bp, Homo sapiens
tcccgggccctcccttgg

SEQ ID NO: 2570089 - DNA, 23 bp, Homo sapiens
tcccgtggaacgtttttcctgtt

SEQ ID NO: 2570090 - DNA, 23 bp, Homo sapiens
tcccgtttagagttatttaggct

SEQ ID NO: 2570091 - DNA, 18 bp, Homo sapiens
tccctaaagaaaaaaaat

SEQ ID NO: 2570092 - DNA, 14 bp, Homo sapiens
tccctaatgctgca

SEQ ID NO: 2570093 - DNA, 13 bp, Homo sapiens
tccctaccacctc

SEQ ID NO: 2570094 - DNA, 20 bp, Homo sapiens
tccctaccccctaagagcca

SEQ ID NO: 2570095 - DNA, 13 bp, Homo sapiens
tccctacctcagg

SEQ ID NO: 2570096 - DNA, 19 bp, Homo sapiens
tccctagaaacttccaaat

SEQ ID NO: 2570097 - DNA, 15 bp, Homo sapiens
tccctaggagaccaa

SEQ ID NO: 2570098 - DNA, 20 bp, Homo sapiens
tattaaaaatctcaaatttc

SEQ ID NO: 2570099 - DNA, 12 bp, Homo sapiens
tattaaaactca

SEQ ID NO: 2570100 - DNA, 16 bp, Homo sapiens
tattaaaactcatttt

SEQ ID NO: 2570101 - DNA, 20 bp, Homo sapiens
tattaaaataagcactgtgc

SEQ ID NO: 2570102 - DNA, 22 bp, Homo sapiens
tattaaaatatggctataaata

SEQ ID NO: 2570103 - DNA, 22 bp, Homo sapiens
tattaaaatgattgtaaaatag

SEQ ID NO: 2570104 - DNA, 23 bp, Homo sapiens
tattaaacagatttttacaaatg

SEQ ID NO: 2570105 - DNA, 21 bp, Homo sapiens
tattaaacgtatgcatgtgaa

SEQ ID NO: 2570106 - DNA, 22 bp, Homo sapiens
tattaaacgtatgcatgtgaag

SEQ ID NO: 2570107 - DNA, 12 bp, Homo sapiens
tattaaatacag

SEQ ID NO: 2570108 - DNA, 23 bp, Homo sapiens
tattaaatatatgattagccagg

SEQ ID NO: 2570109 - DNA, 16 bp, Homo sapiens
tattaagaaagactat

SEQ ID NO: 2570110 - DNA, 16 bp, Homo sapiens
tattaagaatgaaata

SEQ ID NO: 2570111 - DNA, 15 bp, Homo sapiens
tattaagatggattc

SEQ ID NO: 2570112 - DNA, 15 bp, Homo sapiens
tattaagatttccaa

SEQ ID NO: 2570113 - DNA, 14 bp, Homo sapiens
tattaaggaagaca

SEQ ID NO: 2570114 - DNA, 20 bp, Homo sapiens
tattaatgcactttctatcc

SEQ ID NO: 2570115 - DNA, 13 bp, Homo sapiens
tattacactgtat

SEQ ID NO: 2570116 - DNA, 17 bp, Homo sapiens
tattacactgtatttgt

SEQ ID NO: 2570117 - DNA, 19 bp, Homo sapiens
tattacactgtatttgtat

SEQ ID NO: 2570118 - DNA, 21 bp, Homo sapiens
tattacactgtatttgtatct

SEQ ID NO: 2570119 - DNA, 11 bp, Homo sapiens
tattacctctg

SEQ ID NO: 2570120 - DNA, 13 bp, Homo sapiens
tattacctctgat

SEQ ID NO: 2570121 - DNA, 22 bp, Homo sapiens
tattactatgactgctccccag

SEQ ID NO: 2570122 - DNA, 13 bp, Homo sapiens
tattacttctgct

SEQ ID NO: 2570123 - DNA, 14 bp, Homo sapiens
tattacttctgcta

SEQ ID NO: 2570124 - DNA, 16 bp, Homo sapiens
tattagagcattgaat

SEQ ID NO: 2570125 - DNA, 15 bp, Homo sapiens
tattagagtgtcttt

SEQ ID NO: 2570126 - DNA, 13 bp, Homo sapiens
tattagatgtgat

SEQ ID NO: 2570127 - DNA, 14 bp, Homo sapiens
tattagatgtgatt

SEQ ID NO: 2570128 - DNA, 16 bp, Homo sapiens
tattagatgtgattta

SEQ ID NO: 2570129 - DNA, 20 bp, Homo sapiens
tattagatgtgatttaatag

SEQ ID NO: 2570130 - DNA, 23 bp, Homo sapiens
tattagatgtgatttaatagtgt

SEQ ID NO: 2570131 - DNA, 16 bp, Homo sapiens
tattagtcttggggca

SEQ ID NO: 2570132 - DNA, 16 bp, Homo sapiens
tattagtgtatgcttt

SEQ ID NO: 2570133 - DNA, 16 bp, Homo sapiens
tattataaattatgtt

SEQ ID NO: 2570134 - DNA, 14 bp, Homo sapiens
tattataattgtat

SEQ ID NO: 2570135 - DNA, 13 bp, Homo sapiens
tattatacctttt

SEQ ID NO: 2570136 - DNA, 15 bp, Homo sapiens
tattatactaagaaa

SEQ ID NO: 2570137 - DNA, 15 bp, Homo sapiens
tattatactgtatta

SEQ ID NO: 2570138 - DNA, 15 bp, Homo sapiens
tattatcaacaatag

SEQ ID NO: 2570139 - DNA, 22 bp, Homo sapiens
tattatcatgcaaatgctgtat

SEQ ID NO: 2570140 - DNA, 24 bp, Homo sapiens
tattatgcccagtttctgcctctg

SEQ ID NO: 2570141 - DNA, 21 bp, Homo sapiens
tattatggaagattttaaatt

SEQ ID NO: 2570142 - DNA, 19 bp, Homo sapiens
tattattagttttgattta

SEQ ID NO: 2570143 - DNA, 14 bp, Homo sapiens
tattattgaaattg

SEQ ID NO: 2570144 - DNA, 16 bp, Homo sapiens
tattattgaaattgta

SEQ ID NO: 2570145 - DNA, 15 bp, Homo sapiens
tattattgtgtgtta

SEQ ID NO: 2570146 - DNA, 13 bp, Homo sapiens
tattatttatata

SEQ ID NO: 2570147 - DNA, 20 bp, Homo sapiens
tattatttctaggaagaatt

SEQ ID NO: 2570148 - DNA, 14 bp, Homo sapiens
tattatttgtgttt

SEQ ID NO: 2570149 - DNA, 15 bp, Homo sapiens
tattattttcacctg

SEQ ID NO: 2570150 - DNA, 14 bp, Homo sapiens
tattattttccaaa

SEQ ID NO: 2570151 - DNA, 17 bp, Homo sapiens
tattcaattcctctggg

SEQ ID NO: 2570152 - DNA, 14 bp, Homo sapiens
tattcagacaagca

SEQ ID NO: 2570153 - DNA, 14 bp, Homo sapiens
tattcagcttcatt

SEQ ID NO: 2570154 - DNA, 14 bp, Homo sapiens
tattcaggaagctc

SEQ ID NO: 2570155 - DNA, 12 bp, Homo sapiens
tattcaggactt

SEQ ID NO: 2570156 - DNA, 18 bp, Homo sapiens
tattcagtgctgtggcct

SEQ ID NO: 2570157 - DNA, 21 bp, Homo sapiens
tattcagtgctgtggcctggg

SEQ ID NO: 2570158 - DNA, 15 bp, Homo sapiens
tattcagtgtcactg

SEQ ID NO: 2570159 - DNA, 17 bp, Homo sapiens
tattcagttcccagaat

SEQ ID NO: 2570160 - DNA, 21 bp, Homo sapiens
tattcatattttctttcaaaa

SEQ ID NO: 2570161 - DNA, 13 bp, Homo sapiens
tattcatgtaaac

SEQ ID NO: 2570162 - DNA, 20 bp, Homo sapiens
tattcattgaagtcagatgt

SEQ ID NO: 2570163 - DNA, 17 bp, Homo sapiens
tattcatttaaaatgat

SEQ ID NO: 2570164 - DNA, 22 bp, Homo sapiens
tattccatgaatgtatcaggaa

SEQ ID NO: 2570165 - DNA, 23 bp, Homo sapiens
tattcccaagctctagtgggaag

SEQ ID NO: 2570166 - DNA, 21 bp, Homo sapiens
tattccctagaaacttccaaa

SEQ ID NO: 2570167 - DNA, 21 bp, Homo sapiens
tattcctatatagtttattga

SEQ ID NO: 2570168 - DNA, 17 bp, Homo sapiens
tattcctgtatgttgtc

SEQ ID NO: 2570169 - DNA, 22 bp, Homo sapiens
tattcctgtggatgtaaagtga

SEQ ID NO: 2570170 - DNA, 19 bp, Homo sapiens
tattccttttgtgtacagt

SEQ ID NO: 2570171 - DNA, 14 bp, Homo sapiens
tattctatatgaat

SEQ ID NO: 2570172 - DNA, 22 bp, Homo sapiens
tattctgtagattctgtggaac

SEQ ID NO: 2570173 - DNA, 14 bp, Homo sapiens
tattcttcataaca

SEQ ID NO: 2570174 - DNA, 13 bp, Homo sapiens
tattcttctcttc

SEQ ID NO: 2570175 - DNA, 22 bp, Homo sapiens
tattctttgatgttaacacatt

SEQ ID NO: 2570176 - DNA, 20 bp, Homo sapiens
tattgaaattgtacatattt

SEQ ID NO: 2570177 - DNA, 18 bp, Homo sapiens
tattgaacttggaaagaa

SEQ ID NO: 2570178 - DNA, 14 bp, Homo sapiens
tattgaactttttt

SEQ ID NO: 2570179 - DNA, 16 bp, Homo sapiens
tattgaagcattttat

SEQ ID NO: 2570180 - DNA, 20 bp, Homo sapiens
tattgaatataatatatttg

SEQ ID NO: 2570181 - DNA, 21 bp, Homo sapiens
tattgaatataatatatttgt

SEQ ID NO: 2570182 - DNA, 17 bp, Homo sapiens
tattgaatctatttaag

SEQ ID NO: 2570183 - DNA, 12 bp, Homo sapiens
tattgaatgttt

SEQ ID NO: 2570184 - DNA, 18 bp, Homo sapiens
tattgagaattttaaatt

SEQ ID NO: 2570185 - DNA, 20 bp, Homo sapiens
tattgatatgcttatacact

SEQ ID NO: 2570186 - DNA, 21 bp, Homo sapiens
tattgatatgcttatacactt

SEQ ID NO: 2570187 - DNA, 22 bp, Homo sapiens
tattgcaaaggttccaactgta

SEQ ID NO: 2570188 - DNA, 23 bp, Homo sapiens
tattgcaaaggttccaactgtat

SEQ ID NO: 2570189 - DNA, 14 bp, Homo sapiens
tattgcccacgctg

SEQ ID NO: 2570190 - DNA, 16 bp, Homo sapiens
tattggaattaacctg

SEQ ID NO: 2570191 - DNA, 21 bp, Homo sapiens
tattggaattaacctggtgct

SEQ ID NO: 2570192 - DNA, 23 bp, Homo sapiens
tattggaattaacctggtgctgg

SEQ ID NO: 2570193 - DNA, 16 bp, Homo sapiens
tattggggtctgaccc

SEQ ID NO: 2570194 - DNA, 20 bp, Homo sapiens
tattgggttcattattggaa

SEQ ID NO: 2570195 - DNA, 15 bp, Homo sapiens
tattggtaacatcct

SEQ ID NO: 2570196 - DNA, 18 bp, Homo sapiens
tattggtaacatcctttc

SEQ ID NO: 2570197 - DNA, 22 bp, Homo sapiens
tattggtaacatcctttctatt

SEQ ID NO: 2570198 - DNA, 12 bp, Homo sapiens
tattgtacactt

SEQ ID NO: 2570199 - DNA, 20 bp, Homo sapiens
tattgtacacttttttgggg

SEQ ID NO: 2570200 - DNA, 14 bp, Homo sapiens
tattgtacagtttt

SEQ ID NO: 2570201 - DNA, 17 bp, Homo sapiens
tattgtaccttttaaca

SEQ ID NO: 2570202 - DNA, 15 bp, Homo sapiens
tattgtatttattcc

SEQ ID NO: 2570203 - DNA, 16 bp, Homo sapiens
tattgtcagatatttt

SEQ ID NO: 2570204 - DNA, 17 bp, Homo sapiens
tattgtgaagtacatat

SEQ ID NO: 2570205 - DNA, 17 bp, Homo sapiens
tattgtgatttgactgt

SEQ ID NO: 2570206 - DNA, 19 bp, Homo sapiens
tattgtgatttgactgttt

SEQ ID NO: 2570207 - DNA, 17 bp, Homo sapiens
tattgtgtgttatttaa

SEQ ID NO: 2570208 - DNA, 13 bp, Homo sapiens
tattgttccaaga

SEQ ID NO: 2570209 - DNA, 18 bp, Homo sapiens
tattgttccaagacattg

SEQ ID NO: 2570210 - DNA, 20 bp, Homo sapiens
tattgttccaagacattgtc

SEQ ID NO: 2570211 - DNA, 21 bp, Homo sapiens
tattgttccaagacattgtca

SEQ ID NO: 2570212 - DNA, 17 bp, Homo sapiens
tattgttcccagtgaca

SEQ ID NO: 2570213 - DNA, 17 bp, Homo sapiens
tattgtttaaaatcatt

SEQ ID NO: 2570214 - DNA, 18 bp, Homo sapiens
tattgtttcaattgcatc

SEQ ID NO: 2570215 - DNA, 20 bp, Homo sapiens
tattgtttctttaagaaagt

SEQ ID NO: 2570216 - DNA, 20 bp, Homo sapiens
tattgttttcagtgtacatg

SEQ ID NO: 2570217 - DNA, 13 bp, Homo sapiens
tatttaaaagatt

SEQ ID NO: 2570218 - DNA, 18 bp, Homo sapiens
tatttaaagacaaagaca

SEQ ID NO: 2570219 - DNA, 22 bp, Homo sapiens
tatttaaagacagggaagagca

SEQ ID NO: 2570220 - DNA, 22 bp, Homo sapiens
tatttaaatattaaatatgtta

SEQ ID NO: 2570221 - DNA, 20 bp, Homo sapiens
tatttaagataattataata

SEQ ID NO: 2570222 - DNA, 10 bp, Homo sapiens
tatttaataa

SEQ ID NO: 2570223 - DNA, 19 bp, Homo sapiens
tatctagatactgtatcat

SEQ ID NO: 2570224 - DNA, 19 bp, Homo sapiens
tatctagtgcagctgattt

SEQ ID NO: 2570225 - DNA, 17 bp, Homo sapiens
tatctagtttaattaat

SEQ ID NO: 2570226 - DNA, 22 bp, Homo sapiens
tatctagtttaattaatctgta

SEQ ID NO: 2570227 - DNA, 13 bp, Homo sapiens
tatctatatatgt

SEQ ID NO: 2570228 - DNA, 15 bp, Homo sapiens
tatctatatatgtgt

SEQ ID NO: 2570229 - DNA, 16 bp, Homo sapiens
tatctatatatgtgta

SEQ ID NO: 2570230 - DNA, 17 bp, Homo sapiens
tatctatatatgtgtat

SEQ ID NO: 2570231 - DNA, 22 bp, Homo sapiens
tatctatatatgtgtatgtacg

SEQ ID NO: 2570232 - DNA, 13 bp, Homo sapiens
tatctcccccagc

SEQ ID NO: 2570233 - DNA, 18 bp, Homo sapiens
tatctcctcgcaagctgg

SEQ ID NO: 2570234 - DNA, 20 bp, Homo sapiens
tatctctatttaatatttat

SEQ ID NO: 2570235 - DNA, 20 bp, Homo sapiens
tatctctctctctttttgga

SEQ ID NO: 2570236 - DNA, 15 bp, Homo sapiens
tatctctgaagcatg

SEQ ID NO: 2570237 - DNA, 23 bp, Homo sapiens
tatctctgtgtgcacaaatattt

SEQ ID NO: 2570238 - DNA, 23 bp, Homo sapiens
tatctcttttgaatccatgcttg

SEQ ID NO: 2570239 - DNA, 18 bp, Homo sapiens
tatctgacatctctgcaa

SEQ ID NO: 2570240 - DNA, 22 bp, Homo sapiens
tatctgctgtccagacagcctg

SEQ ID NO: 2570241 - DNA, 18 bp, Homo sapiens
tatctggacaagccaact

SEQ ID NO: 2570242 - DNA, 19 bp, Homo sapiens
tatctgggtgcatgatctt

SEQ ID NO: 2570243 - DNA, 21 bp, Homo sapiens
tatctgtcatttgagcagggc

SEQ ID NO: 2570244 - DNA, 17 bp, Homo sapiens
tatctgtgcgtgaaaca

SEQ ID NO: 2570245 - DNA, 20 bp, Homo sapiens
tatctgtgcgtgaaacacac

SEQ ID NO: 2570246 - DNA, 17 bp, Homo sapiens
tatctgtgtttttgaaa

SEQ ID NO: 2570247 - DNA, 20 bp, Homo sapiens
tatctgttctttaatttatt

SEQ ID NO: 2570248 - DNA, 15 bp, Homo sapiens
tatcttgctctgtaa

SEQ ID NO: 2570249 - DNA, 20 bp, Homo sapiens
tatcttggactgacatttag

SEQ ID NO: 2570250 - DNA, 14 bp, Homo sapiens
tatcttgtttttcc

SEQ ID NO: 2570251 - DNA, 23 bp, Homo sapiens
tatcttttctattgtttattctt

SEQ ID NO: 2570252 - DNA, 22 bp, Homo sapiens
tatctttttgcttacagtttta

SEQ ID NO: 2570253 - DNA, 18 bp, Homo sapiens
tatgaaaaacaaaaataa

SEQ ID NO: 2570254 - DNA, 22 bp, Homo sapiens
tatgaaatttaatatagctatt

SEQ ID NO: 2570255 - DNA, 17 bp, Homo sapiens
tatgaacatattgttga

SEQ ID NO: 2570256 - DNA, 19 bp, Homo sapiens
tatgaacatattgttgaaa

SEQ ID NO: 2570257 - DNA, 20 bp, Homo sapiens
tatgaagaaaaaatacattt

SEQ ID NO: 2570258 - DNA, 17 bp, Homo sapiens
tatgaagaactgaggag

SEQ ID NO: 2570259 - DNA, 24 bp, Homo sapiens
tatgaagctcacctgttgcttaca

SEQ ID NO: 2570260 - DNA, 16 bp, Homo sapiens
tatgaatacagggcat

SEQ ID NO: 2570261 - DNA, 12 bp, Homo sapiens
tatgaatctatt

SEQ ID NO: 2570262 - DNA, 18 bp, Homo sapiens
tatgaatctattatactg

SEQ ID NO: 2570263 - DNA, 19 bp, Homo sapiens
tatgaatgcccccagctgg

SEQ ID NO: 2570264 - DNA, 18 bp, Homo sapiens
tatgaattgaattatctt

SEQ ID NO: 2570265 - DNA, 19 bp, Homo sapiens
tatgaatttaaatataatt

SEQ ID NO: 2570266 - DNA, 20 bp, Homo sapiens
tatgaatttaaatataattc

SEQ ID NO: 2570267 - DNA, 22 bp, Homo sapiens
tatgacacatgcaaggtcattt

SEQ ID NO: 2570268 - DNA, 15 bp, Homo sapiens
tatgacagttatact

SEQ ID NO: 2570269 - DNA, 24 bp, Homo sapiens
tatgacatcacttgtacaaaataa

SEQ ID NO: 2570270 - DNA, 18 bp, Homo sapiens
tatgaccttctaggaagc

SEQ ID NO: 2570271 - DNA, 19 bp, Homo sapiens
tatgacggaagaacataga

SEQ ID NO: 2570272 - DNA, 16 bp, Homo sapiens
tatgactaaagagaga

SEQ ID NO: 2570273 - DNA, 18 bp, Homo sapiens
tatgactaaagagagaat

SEQ ID NO: 2570274 - DNA, 20 bp, Homo sapiens
tatgactaaagagagaatgt

SEQ ID NO: 2570275 - DNA, 16 bp, Homo sapiens
tatgactcccaaattt

SEQ ID NO: 2570276 - DNA, 16 bp, Homo sapiens
tatgacttcattaata

SEQ ID NO: 2570277 - DNA, 23 bp, Homo sapiens
tatgagaaaagaggcgtctgtat

SEQ ID NO: 2570278 - DNA, 19 bp, Homo sapiens
tatgagccagacaaatgga

SEQ ID NO: 2570279 - DNA, 12 bp, Homo sapiens
tatgagctgagg

SEQ ID NO: 2570280 - DNA, 16 bp, Homo sapiens
tatgagctgagggggg

SEQ ID NO: 2570281 - DNA, 17 bp, Homo sapiens
tatgaggacttgtgtct

SEQ ID NO: 2570282 - DNA, 23 bp, Homo sapiens
tatgaggacttgtgtctctgtgc

SEQ ID NO: 2570283 - DNA, 15 bp, Homo sapiens
tatgaggcatttgtt

SEQ ID NO: 2570284 - DNA, 15 bp, Homo sapiens
tatgaggtctaggaa

SEQ ID NO: 2570285 - DNA, 17 bp, Homo sapiens
tatgagtcaatgtgcag

SEQ ID NO: 2570286 - DNA, 21 bp, Homo sapiens
tatgagtttttgatagcttta

SEQ ID NO: 2570287 - DNA, 22 bp, Homo sapiens
tatgatattttctgtgcctgaa

SEQ ID NO: 2570288 - DNA, 23 bp, Homo sapiens
tatgatcacggctcactgcagcc

SEQ ID NO: 2570289 - DNA, 15 bp, Homo sapiens
tatgatcccagcact

SEQ ID NO: 2570290 - DNA, 19 bp, Homo sapiens
tatgatctcaggttctcct

SEQ ID NO: 2570291 - DNA, 22 bp, Homo sapiens
tatgatgatacaagattagaag

SEQ ID NO: 2570292 - DNA, 15 bp, Homo sapiens
tatgatgctgttgcc

SEQ ID NO: 2570293 - DNA, 14 bp, Homo sapiens
tatgatttaaaaca

SEQ ID NO: 2570294 - DNA, 14 bp, Homo sapiens
tatgatttatagtt

SEQ ID NO: 2570295 - DNA, 15 bp, Homo sapiens
tatgatttatagttt

SEQ ID NO: 2570296 - DNA, 17 bp, Homo sapiens
tatgatttggaaaataa

SEQ ID NO: 2570297 - DNA, 17 bp, Homo sapiens
tatgatttttttttcat

SEQ ID NO: 2570298 - DNA, 19 bp, Homo sapiens
tatgatttttttttcatac

SEQ ID NO: 2570299 - DNA, 12 bp, Homo sapiens
tatgcaaagcac

SEQ ID NO: 2570300 - DNA, 13 bp, Homo sapiens
tatgcacacattt

SEQ ID NO: 2570301 - DNA, 13 bp, Homo sapiens
tatgcacatatgg

SEQ ID NO: 2570302 - DNA, 18 bp, Homo sapiens
tatgcaccttgtgtctgt

SEQ ID NO: 2570303 - DNA, 20 bp, Homo sapiens
tatgcaccttgtgtctgtac

SEQ ID NO: 2570304 - DNA, 19 bp, Homo sapiens
tatgcacttataattttcc

SEQ ID NO: 2570305 - DNA, 22 bp, Homo sapiens
tatgcacttataattttcctaa

SEQ ID NO: 2570306 - DNA, 14 bp, Homo sapiens
tatgcagaatgttt

SEQ ID NO: 2570307 - DNA, 15 bp, Homo sapiens
tatgcataaagtcag

SEQ ID NO: 2570308 - DNA, 18 bp, Homo sapiens
tatgcatgaagtaatatg

SEQ ID NO: 2570309 - DNA, 20 bp, Homo sapiens
tatgcatggaaacctgaaaa

SEQ ID NO: 2570310 - DNA, 21 bp, Homo sapiens
tatgcatttaaatacagtctt

SEQ ID NO: 2570311 - DNA, 22 bp, Homo sapiens
tatgccatagcaagattgctta

SEQ ID NO: 2570312 - DNA, 17 bp, Homo sapiens
tatgccatgatggaaat

SEQ ID NO: 2570313 - DNA, 20 bp, Homo sapiens
tatgcccagtttctgcctct

SEQ ID NO: 2570314 - DNA, 15 bp, Homo sapiens
tatgcctctcctttg

SEQ ID NO: 2570315 - DNA, 18 bp, Homo sapiens
tatgcctctcctttgtat

SEQ ID NO: 2570316 - DNA, 20 bp, Homo sapiens
tatgcctctcctttgtatat

SEQ ID NO: 2570317 - DNA, 21 bp, Homo sapiens
tatgcctctcctttgtatatt

SEQ ID NO: 2570318 - DNA, 16 bp, Homo sapiens
tatgctgccaaatttt

SEQ ID NO: 2570319 - DNA, 15 bp, Homo sapiens
tatgcttactgatat

SEQ ID NO: 2570320 - DNA, 21 bp, Homo sapiens
tatgcttactgatatatttta

SEQ ID NO: 2570321 - DNA, 17 bp, Homo sapiens
tatgcttagtaatgcta

SEQ ID NO: 2570322 - DNA, 15 bp, Homo sapiens
tatgcttatacactt

SEQ ID NO: 2570323 - DNA, 19 bp, Homo sapiens
tatgcttattttaaaattt

SEQ ID NO: 2570324 - DNA, 17 bp, Homo sapiens
tatggaactctctccac

SEQ ID NO: 2570325 - DNA, 15 bp, Homo sapiens
tatggaacttctaat

SEQ ID NO: 2570326 - DNA, 17 bp, Homo sapiens
tatggaacttctaatat

SEQ ID NO: 2570327 - DNA, 17 bp, Homo sapiens
tatggaatacagtgtta

SEQ ID NO: 2570328 - DNA, 23 bp, Homo sapiens
tatggaatacagtgttattttct

SEQ ID NO: 2570329 - DNA, 21 bp, Homo sapiens
tatggacggtgctccaggcag

SEQ ID NO: 2570330 - DNA, 17 bp, Homo sapiens
tatggagctcagagagg

SEQ ID NO: 2570331 - DNA, 15 bp, Homo sapiens
tatggaggatggaga

SEQ ID NO: 2570332 - DNA, 19 bp, Homo sapiens
tatggatgattcagaaatt

SEQ ID NO: 2570333 - DNA, 21 bp, Homo sapiens
tatggattttctattgttact

SEQ ID NO: 2570334 - DNA, 14 bp, Homo sapiens
tatggcaaaaatgg

SEQ ID NO: 2570335 - DNA, 23 bp, Homo sapiens
tatggcagaagacaccagagcag

SEQ ID NO: 2570336 - DNA, 13 bp, Homo sapiens
tatggcagtgtct

SEQ ID NO: 2570337 - DNA, 16 bp, Homo sapiens
tatggcagtgtctttc

SEQ ID NO: 2570338 - DNA, 22 bp, Homo sapiens
tatggccctggcctagcatacg

SEQ ID NO: 2570339 - DNA, 17 bp, Homo sapiens
tatggctagaatatcct

SEQ ID NO: 2570340 - DNA, 21 bp, Homo sapiens
tatggctagaatatcctactt

SEQ ID NO: 2570341 - DNA, 17 bp, Homo sapiens
tatggctcactatgaat

SEQ ID NO: 2570342 - DNA, 23 bp, Homo sapiens
tatggcttttgtgcattatctag

SEQ ID NO: 2570343 - DNA, 16 bp, Homo sapiens
tatgggaatcaagatt

SEQ ID NO: 2570344 - DNA, 15 bp, Homo sapiens
tatgggcaaaaaact

SEQ ID NO: 2570345 - DNA, 17 bp, Homo sapiens
tatgggcattgtagtta

SEQ ID NO: 2570346 - DNA, 17 bp, Homo sapiens
tatggggatagatgtgt

SEQ ID NO: 2570347 - DNA, 18 bp, Homo sapiens
tatggggatagatgtgtg

SEQ ID NO: 2570348 - DNA, 19 bp, Homo sapiens
tatggggatagatgtgtgg

SEQ ID NO: 2570349 - DNA, 15 bp, Homo sapiens
tatggtcatagccca

SEQ ID NO: 2570350 - DNA, 19 bp, Homo sapiens
tatggtgtttctccctctc

SEQ ID NO: 2570351 - DNA, 20 bp, Homo sapiens
tatggttgatagtttacctg

SEQ ID NO: 2570352 - DNA, 19 bp, Homo sapiens
tatgtaaaataaaattatg

SEQ ID NO: 2570353 - DNA, 14 bp, Homo sapiens
tatgtaaacataat

SEQ ID NO: 2570354 - DNA, 23 bp, Homo sapiens
tatgtaaactgcattagaaatta

SEQ ID NO: 2570355 - DNA, 13 bp, Homo sapiens
tatgtaaatgtat

SEQ ID NO: 2570356 - DNA, 24 bp, Homo sapiens
tatgtaactgcattgagaactgca

SEQ ID NO: 2570357 - DNA, 16 bp, Homo sapiens
tatgtaataatgtgaa

SEQ ID NO: 2570358 - DNA, 18 bp, Homo sapiens
tatgtacgtttgtatgtg

SEQ ID NO: 2570359 - DNA, 21 bp, Homo sapiens
tatgtacgtttgtatgtgtgt

SEQ ID NO: 2570360 - DNA, 22 bp, Homo sapiens
tatgtacgtttgtatgtgtgta

SEQ ID NO: 2570361 - DNA, 12 bp, Homo sapiens
tatgtagatgtg

SEQ ID NO: 2570362 - DNA, 17 bp, Homo sapiens
tatgtagatgtgcattt

SEQ ID NO: 2570363 - DNA, 13 bp, Homo sapiens
tatgtatgtgtgt

SEQ ID NO: 2570364 - DNA, 13 bp, Homo sapiens
tatgtatgtttac

SEQ ID NO: 2570365 - DNA, 17 bp, Homo sapiens
tatgtccactgtgtata

SEQ ID NO: 2570366 - DNA, 13 bp, Homo sapiens
tatgtcctaagga

SEQ ID NO: 2570367 - DNA, 10 bp, Homo sapiens
tatgtctgtt

SEQ ID NO: 2570368 - DNA, 19 bp, Homo sapiens
tatgtcttggacactgtac

SEQ ID NO: 2570369 - DNA, 12 bp, Homo sapiens
tatgtgaatgat

SEQ ID NO: 2570370 - DNA, 13 bp, Homo sapiens
tatgtgagtgtgt

SEQ ID NO: 2570371 - DNA, 21 bp, Homo sapiens
tatgtgcactgtcactttgct

SEQ ID NO: 2570372 - DNA, 14 bp, Homo sapiens
gttgcacccagccc

SEQ ID NO: 2570373 - DNA, 18 bp, Homo sapiens
gttgcacccagccctggt

SEQ ID NO: 2570374 - DNA, 15 bp, Homo sapiens
gttgcagtgagctga

SEQ ID NO: 2570375 - DNA, 13 bp, Homo sapiens
gttgccagtcacc

SEQ ID NO: 2570376 - DNA, 14 bp, Homo sapiens
gttgccagtcaccc

SEQ ID NO: 2570377 - DNA, 18 bp, Homo sapiens
gttgccagtcaccccggc

SEQ ID NO: 2570378 - DNA, 12 bp, Homo sapiens
gttgcccaggca

SEQ ID NO: 2570379 - DNA, 15 bp, Homo sapiens
gttgcccaggcaggt

SEQ ID NO: 2570380 - DNA, 19 bp, Homo sapiens
gttgcccaggcaggtcttg

SEQ ID NO: 2570381 - DNA, 13 bp, Homo sapiens
gttgcccaggctg

SEQ ID NO: 2570382 - DNA, 23 bp, Homo sapiens
gttgcgtggactctgcacatgtc

SEQ ID NO: 2570383 - DNA, 20 bp, Homo sapiens
gttgctcaaatctattcaga

SEQ ID NO: 2570384 - DNA, 22 bp, Homo sapiens
gttgctgtgggaacgagagggg

SEQ ID NO: 2570385 - DNA, 14 bp, Homo sapiens
gttgcttacaattt

SEQ ID NO: 2570386 - DNA, 22 bp, Homo sapiens
gttggaaaagaatacagaaaga

SEQ ID NO: 2570387 - DNA, 16 bp, Homo sapiens
gttggacccgctctgg

SEQ ID NO: 2570388 - DNA, 12 bp, Homo sapiens
gttggagcctgc

SEQ ID NO: 2570389 - DNA, 14 bp, Homo sapiens
gttggcaaaaaggc

SEQ ID NO: 2570390 - DNA, 18 bp, Homo sapiens
gttggcaaaaaggcagga

SEQ ID NO: 2570391 - DNA, 19 bp, Homo sapiens
gttggcactcacagacctg

SEQ ID NO: 2570392 - DNA, 17 bp, Homo sapiens
gttggccaggctggtct

SEQ ID NO: 2570393 - DNA, 17 bp, Homo sapiens
gttggcccaagctcttg

SEQ ID NO: 2570394 - DNA, 20 bp, Homo sapiens
gttggcccctgcccggctgc

SEQ ID NO: 2570395 - DNA, 13 bp, Homo sapiens
gttggctggcctt

SEQ ID NO: 2570396 - DNA, 19 bp, Homo sapiens
gttgggaatgaggcttgct

SEQ ID NO: 2570397 - DNA, 21 bp, Homo sapiens
gttgggagaatgtcagtatgt

SEQ ID NO: 2570398 - DNA, 16 bp, Homo sapiens
gttgggagcactggag

SEQ ID NO: 2570399 - DNA, 14 bp, Homo sapiens
gttgggaggattct

SEQ ID NO: 2570400 - DNA, 18 bp, Homo sapiens
gttgggattcctgaccca

SEQ ID NO: 2570401 - DNA, 23 bp, Homo sapiens
gttgggattcctgacccaggccg

SEQ ID NO: 2570402 - DNA, 22 bp, Homo sapiens
gttgggcagggtgaccctgaag

SEQ ID NO: 2570403 - DNA, 16 bp, Homo sapiens
gttgggcccagatctg

SEQ ID NO: 2570404 - DNA, 13 bp, Homo sapiens
gttgggctggtgt

SEQ ID NO: 2570405 - DNA, 16 bp, Homo sapiens
gttggtcggtgggttg

SEQ ID NO: 2570406 - DNA, 16 bp, Homo sapiens
gttgtaaacaggaagc

SEQ ID NO: 2570407 - DNA, 21 bp, Homo sapiens
gttgtaactaggctcagagat

SEQ ID NO: 2570408 - DNA, 16 bp, Homo sapiens
gttgtacatttatgat

SEQ ID NO: 2570409 - DNA, 18 bp, Homo sapiens
gttgtacatttatgattt

SEQ ID NO: 2570410 - DNA, 23 bp, Homo sapiens
gttgtacatttatgatttaataa

SEQ ID NO: 2570411 - DNA, 13 bp, Homo sapiens
gttgtagaatgta

SEQ ID NO: 2570412 - DNA, 16 bp, Homo sapiens
gttgtataaatttatt

SEQ ID NO: 2570413 - DNA, 19 bp, Homo sapiens
gttgtataaatttatttac

SEQ ID NO: 2570414 - DNA, 18 bp, Homo sapiens
gttgtatcagcacgtgtg

SEQ ID NO: 2570415 - DNA, 23 bp, Homo sapiens
gttgtatgcctttaaatctgtga

SEQ ID NO: 2570416 - DNA, 14 bp, Homo sapiens
gttgtattctttga

SEQ ID NO: 2570417 - DNA, 22 bp, Homo sapiens
gttgtcaagtctctgctggccc

SEQ ID NO: 2570418 - DNA, 19 bp, Homo sapiens
gttgtcaatattaaataca

SEQ ID NO: 2570419 - DNA, 21 bp, Homo sapiens
gttgtcaatattaaatacaga

SEQ ID NO: 2570420 - DNA, 23 bp, Homo sapiens
gttgtcaatattaaatacagaca

SEQ ID NO: 2570421 - DNA, 22 bp, Homo sapiens
gttgtgaggcctggccaggcac

SEQ ID NO: 2570422 - DNA, 16 bp, Homo sapiens
gttgtgcccctttcca

SEQ ID NO: 2570423 - DNA, 21 bp, Homo sapiens
gttgtggagagtgcaacagta

SEQ ID NO: 2570424 - DNA, 16 bp, Homo sapiens
gttgtgtgtgggagtg

SEQ ID NO: 2570425 - DNA, 12 bp, Homo sapiens
gttgtgttgtca

SEQ ID NO: 2570426 - DNA, 14 bp, Homo sapiens
gttgtgttgtcacc

SEQ ID NO: 2570427 - DNA, 18 bp, Homo sapiens
gttgttaatgaaaatgtc

SEQ ID NO: 2570428 - DNA, 15 bp, Homo sapiens
gttgttacattttta

SEQ ID NO: 2570429 - DNA, 16 bp, Homo sapiens
gttgttgttaaatatc

SEQ ID NO: 2570430 - DNA, 24 bp, Homo sapiens
gttgttgttaatgaaaatgtcaga

SEQ ID NO: 2570431 - DNA, 11 bp, Homo sapiens
gttgtttcttt

SEQ ID NO: 2570432 - DNA, 22 bp, Homo sapiens
gttgtttgatgcattaaaagaa

SEQ ID NO: 2570433 - DNA, 18 bp, Homo sapiens
gtttaaacttctctgaag

SEQ ID NO: 2570434 - DNA, 23 bp, Homo sapiens
gtttaaacttctctgaagggagg

SEQ ID NO: 2570435 - DNA, 15 bp, Homo sapiens
gtttaaagagaggtt

SEQ ID NO: 2570436 - DNA, 14 bp, Homo sapiens
gtttaaataaagta

SEQ ID NO: 2570437 - DNA, 15 bp, Homo sapiens
gtttaaataaagtat

SEQ ID NO: 2570438 - DNA, 16 bp, Homo sapiens
gtttaaataaagtatc

SEQ ID NO: 2570439 - DNA, 17 bp, Homo sapiens
gtttaaataaagtatca

SEQ ID NO: 2570440 - DNA, 22 bp, Homo sapiens
gtttaaataaagtatcatgcat

SEQ ID NO: 2570441 - DNA, 12 bp, Homo sapiens
gtttaactcaga

SEQ ID NO: 2570442 - DNA, 19 bp, Homo sapiens
gtttaactcagatcactac

SEQ ID NO: 2570443 - DNA, 23 bp, Homo sapiens
gtttaagaaaaaataacacacat

SEQ ID NO: 2570444 - DNA, 20 bp, Homo sapiens
gtttaagactgtaatgaatc

SEQ ID NO: 2570445 - DNA, 23 bp, Homo sapiens
gtttaaggaatatgggagaaata

SEQ ID NO: 2570446 - DNA, 12 bp, Homo sapiens
gtttaatattta

SEQ ID NO: 2570447 - DNA, 15 bp, Homo sapiens
gtttaatatttaaac

SEQ ID NO: 2570448 - DNA, 18 bp, Homo sapiens
gtttacaagccccccctt

SEQ ID NO: 2570449 - DNA, 23 bp, Homo sapiens
gtttacaagtgtatatcagaaaa

SEQ ID NO: 2570450 - DNA, 23 bp, Homo sapiens
gtttacagcactactctgtgcca

SEQ ID NO: 2570451 - DNA, 16 bp, Homo sapiens
gtttacctgtgaaata

SEQ ID NO: 2570452 - DNA, 17 bp, Homo sapiens
gtttacttttcagggca

SEQ ID NO: 2570453 - DNA, 17 bp, Homo sapiens
gtttagaaagcttgccc

SEQ ID NO: 2570454 - DNA, 18 bp, Homo sapiens
gtttagtaaggctgtgta

SEQ ID NO: 2570455 - DNA, 18 bp, Homo sapiens
gtttagtggctcaacatt

SEQ ID NO: 2570456 - DNA, 21 bp, Homo sapiens
gtttatagagggccaagactt

SEQ ID NO: 2570457 - DNA, 15 bp, Homo sapiens
gtttatcattcaagt

SEQ ID NO: 2570458 - DNA, 13 bp, Homo sapiens
gtttatgagccag

SEQ ID NO: 2570459 - DNA, 13 bp, Homo sapiens
gtttatggcctca

SEQ ID NO: 2570460 - DNA, 19 bp, Homo sapiens
gtttatttatcagtgacag

SEQ ID NO: 2570461 - DNA, 14 bp, Homo sapiens
gtttattttatatt

SEQ ID NO: 2570462 - DNA, 23 bp, Homo sapiens
gtttcaaaataaaaaccaagaag

SEQ ID NO: 2570463 - DNA, 19 bp, Homo sapiens
gtttcaatgtgattctaat

SEQ ID NO: 2570464 - DNA, 17 bp, Homo sapiens
gtttcaattgcatctcc

SEQ ID NO: 2570465 - DNA, 22 bp, Homo sapiens
gtttcaattgcatctcccagat

SEQ ID NO: 2570466 - DNA, 19 bp, Homo sapiens
gtttcacggtgccaggttt

SEQ ID NO: 2570467 - DNA, 20 bp, Homo sapiens
gtttcactgacttagaacca

SEQ ID NO: 2570468 - DNA, 13 bp, Homo sapiens
gtttcagaaatgt

SEQ ID NO: 2570469 - DNA, 18 bp, Homo sapiens
gtttcagaaatgtgttat

SEQ ID NO: 2570470 - DNA, 16 bp, Homo sapiens
gtttcagatatatatc

SEQ ID NO: 2570471 - DNA, 19 bp, Homo sapiens
gtttcattctcctgcctgt

SEQ ID NO: 2570472 - DNA, 19 bp, Homo sapiens
gtttcatttctactgtgac

SEQ ID NO: 2570473 - DNA, 16 bp, Homo sapiens
gtttccaacctggagt

SEQ ID NO: 2570474 - DNA, 20 bp, Homo sapiens
gtttcctcattcctgaaaga

SEQ ID NO: 2570475 - DNA, 20 bp, Homo sapiens
gtttcctttcatttactgtg

SEQ ID NO: 2570476 - DNA, 16 bp, Homo sapiens
gtttcgtttctgtata

SEQ ID NO: 2570477 - DNA, 19 bp, Homo sapiens
gtttctaaaggctaccttt

SEQ ID NO: 2570478 - DNA, 16 bp, Homo sapiens
gtttctacctcccaga

SEQ ID NO: 2570479 - DNA, 18 bp, Homo sapiens
gtttctagctagaaatat

SEQ ID NO: 2570480 - DNA, 23 bp, Homo sapiens
gtttctagctagaaatatgattt

SEQ ID NO: 2570481 - DNA, 15 bp, Homo sapiens
gtttctagggaaatg

SEQ ID NO: 2570482 - DNA, 18 bp, Homo sapiens
gtttctagggaaatgaaa

SEQ ID NO: 2570483 - DNA, 22 bp, Homo sapiens
gtttctatgacacatgcaaggt

SEQ ID NO: 2570484 - DNA, 19 bp, Homo sapiens
gtttctatgtgtagggcgg

SEQ ID NO: 2570485 - DNA, 21 bp, Homo sapiens
gtttctcagatccttgtttca

SEQ ID NO: 2570486 - DNA, 14 bp, Homo sapiens
gtttctccccctgg

SEQ ID NO: 2570487 - DNA, 20 bp, Homo sapiens
gtttctccctctcactgtct

SEQ ID NO: 2570488 - DNA, 22 bp, Homo sapiens
gtttctccctctcactgtctga

SEQ ID NO: 2570489 - DNA, 21 bp, Homo sapiens
gtttctgaaaattaacactgc

SEQ ID NO: 2570490 - DNA, 13 bp, Homo sapiens
gtttctgactctg

SEQ ID NO: 2570491 - DNA, 20 bp, Homo sapiens
gtttctggtctctaggctgg

SEQ ID NO: 2570492 - DNA, 17 bp, Homo sapiens
gtttctgtcaggagagc

SEQ ID NO: 2570493 - DNA, 21 bp, Homo sapiens
gtttctgtcaggagagcagcg

SEQ ID NO: 2570494 - DNA, 13 bp, Homo sapiens
gtttctgtgcatg

SEQ ID NO: 2570495 - DNA, 13 bp, Homo sapiens
gtttcttagcttt

SEQ ID NO: 2570496 - DNA, 23 bp, Homo sapiens
gtttcttcatccggcagcctgga

SEQ ID NO: 2570497 - DNA, 13 bp, Homo sapiens
gtttcttccaaag

SEQ ID NO: 2570498 - DNA, 16 bp, Homo sapiens
gtttgaaacaaagaag

SEQ ID NO: 2570499 - DNA, 12 bp, Homo sapiens
gtttgaacttca

SEQ ID NO: 2570500 - DNA, 17 bp, Homo sapiens
gtttgaaggaggtgagg

SEQ ID NO: 2570501 - DNA, 15 bp, Homo sapiens
gtttgagaagcactg

SEQ ID NO: 2570502 - DNA, 17 bp, Homo sapiens
gtttgagatggacacac

SEQ ID NO: 2570503 - DNA, 23 bp, Homo sapiens
gtttgaggatatattttcacttt

SEQ ID NO: 2570504 - DNA, 16 bp, Homo sapiens
gtttgaggctgcagcg

SEQ ID NO: 2570505 - DNA, 19 bp, Homo sapiens
gtttgaggtttttaagcct

SEQ ID NO: 2570506 - DNA, 20 bp, Homo sapiens
gtttgatgcattaaaagaaa

SEQ ID NO: 2570507 - DNA, 17 bp, Homo sapiens
gtttgattaaattcttg

SEQ ID NO: 2570508 - DNA, 22 bp, Homo sapiens
gtttgattaaattcttgcaaag

SEQ ID NO: 2570509 - DNA, 19 bp, Homo sapiens
gtttgcactgtatgctgga

SEQ ID NO: 2570510 - DNA, 20 bp, Homo sapiens
gtttgcactgtatgctggac

SEQ ID NO: 2570511 - DNA, 12 bp, Homo sapiens
gtttgcattcct

SEQ ID NO: 2570512 - DNA, 15 bp, Homo sapiens
gtttgccatactttg

SEQ ID NO: 2570513 - DNA, 20 bp, Homo sapiens
gtttgctatcttaattttgg

SEQ ID NO: 2570514 - DNA, 18 bp, Homo sapiens
gtttgcttattgttccaa

SEQ ID NO: 2570515 - DNA, 17 bp, Homo sapiens
gtttgcttcataaatga

SEQ ID NO: 2570516 - DNA, 12 bp, Homo sapiens
gtggcactgcca

SEQ ID NO: 2570517 - DNA, 20 bp, Homo sapiens
gtggcagataatcagcctct

SEQ ID NO: 2570518 - DNA, 21 bp, Homo sapiens
gtggcagataatcagcctctt

SEQ ID NO: 2570519 - DNA, 13 bp, Homo sapiens
gtggcagccctgt

SEQ ID NO: 2570520 - DNA, 14 bp, Homo sapiens
gtggcagccctgta

SEQ ID NO: 2570521 - DNA, 14 bp, Homo sapiens
gtggcagctgcggt

SEQ ID NO: 2570522 - DNA, 17 bp, Homo sapiens
gtggcagctgcggtcca

SEQ ID NO: 2570523 - DNA, 22 bp, Homo sapiens
gtggcagctgcggtccacccag

SEQ ID NO: 2570524 - DNA, 13 bp, Homo sapiens
gtggcagctgctt

SEQ ID NO: 2570525 - DNA, 13 bp, Homo sapiens
gtggcaggaccag

SEQ ID NO: 2570526 - DNA, 13 bp, Homo sapiens
gtggcagggctca

SEQ ID NO: 2570527 - DNA, 23 bp, Homo sapiens
gtggcaggtggaggtgtcaggct

SEQ ID NO: 2570528 - DNA, 21 bp, Homo sapiens
gtggcagtgggagctgcctgt

SEQ ID NO: 2570529 - DNA, 15 bp, Homo sapiens
gtggcatagcccaga

SEQ ID NO: 2570530 - DNA, 17 bp, Homo sapiens
gtggcatgtggcctgtg

SEQ ID NO: 2570531 - DNA, 22 bp, Homo sapiens
gtggcatgttcatcgtataaca

SEQ ID NO: 2570532 - DNA, 13 bp, Homo sapiens
gtggccactcagc

SEQ ID NO: 2570533 - DNA, 17 bp, Homo sapiens
gtggccagagctgggag

SEQ ID NO: 2570534 - DNA, 23 bp, Homo sapiens
gtggccagagctgggaggcatgg

SEQ ID NO: 2570535 - DNA, 11 bp, Homo sapiens
gtggccagccc

SEQ ID NO: 2570536 - DNA, 15 bp, Homo sapiens
gtggccagcccggct

SEQ ID NO: 2570537 - DNA, 11 bp, Homo sapiens
gtggcccttgc

SEQ ID NO: 2570538 - DNA, 17 bp, Homo sapiens
gtggccgcccaaggccc

SEQ ID NO: 2570539 - DNA, 9 bp, Homo sapiens
gtggcctca

SEQ ID NO: 2570540 - DNA, 12 bp, Homo sapiens
gtggcctcagaa

SEQ ID NO: 2570541 - DNA, 13 bp, Homo sapiens
gtggcctcagaat

SEQ ID NO: 2570542 - DNA, 22 bp, Homo sapiens
gtggcctcccaactcaccccag

SEQ ID NO: 2570543 - DNA, 22 bp, Homo sapiens
gtggcctcgggacacctgccct

SEQ ID NO: 2570544 - DNA, 19 bp, Homo sapiens
gtggcctctttgtctaaaa

SEQ ID NO: 2570545 - DNA, 18 bp, Homo sapiens
gtggcctggccaggagct

SEQ ID NO: 2570546 - DNA, 21 bp, Homo sapiens
gtggcctggccaggagctctt

SEQ ID NO: 2570547 - DNA, 14 bp, Homo sapiens
gtggcctgggcaag

SEQ ID NO: 2570548 - DNA, 12 bp, Homo sapiens
gtggccttcccc

SEQ ID NO: 2570549 - DNA, 17 bp, Homo sapiens
gtggccttccccagcct

SEQ ID NO: 2570550 - DNA, 20 bp, Homo sapiens
gtggccttccccagcctctt

SEQ ID NO: 2570551 - DNA, 20 bp, Homo sapiens
gtggctcacgtgtgtgactc

SEQ ID NO: 2570552 - DNA, 15 bp, Homo sapiens
gtggctccagcacca

SEQ ID NO: 2570553 - DNA, 12 bp, Homo sapiens
gtggctcccctc

SEQ ID NO: 2570554 - DNA, 13 bp, Homo sapiens
gtggctccttccc

SEQ ID NO: 2570555 - DNA, 18 bp, Homo sapiens
gtggctgaggaggcctcc

SEQ ID NO: 2570556 - DNA, 15 bp, Homo sapiens
gtggctgcagcagcg

SEQ ID NO: 2570557 - DNA, 13 bp, Homo sapiens
gtggctgctgccc

SEQ ID NO: 2570558 - DNA, 22 bp, Homo sapiens
gtggcttaaaacaacactcaca

SEQ ID NO: 2570559 - DNA, 19 bp, Homo sapiens
gtggcttcattagagcagg

SEQ ID NO: 2570560 - DNA, 20 bp, Homo sapiens
gtggcttcattagagcaggc

SEQ ID NO: 2570561 - DNA, 21 bp, Homo sapiens
gtggcttcattagagcaggcg

SEQ ID NO: 2570562 - DNA, 16 bp, Homo sapiens
gtggctttcagcctct

SEQ ID NO: 2570563 - DNA, 18 bp, Homo sapiens
gtggctttcagcctctgg

SEQ ID NO: 2570564 - DNA, 18 bp, Homo sapiens
gtggctttgcattttaaa

SEQ ID NO: 2570565 - DNA, 22 bp, Homo sapiens
gtggctttgcattttaaaaatg

SEQ ID NO: 2570566 - DNA, 23 bp, Homo sapiens
gtgggaaagattactttttcttt

SEQ ID NO: 2570567 - DNA, 17 bp, Homo sapiens
gtgggaacgactgggca

SEQ ID NO: 2570568 - DNA, 20 bp, Homo sapiens
gtgggaacgagaggggaaga

SEQ ID NO: 2570569 - DNA, 13 bp, Homo sapiens
gtgggagaggtct

SEQ ID NO: 2570570 - DNA, 12 bp, Homo sapiens
gtgggagctgag

SEQ ID NO: 2570571 - DNA, 15 bp, Homo sapiens
gtgggagctgcctgt

SEQ ID NO: 2570572 - DNA, 13 bp, Homo sapiens
gtgggagggagca

SEQ ID NO: 2570573 - DNA, 14 bp, Homo sapiens
gtgggagggagcag

SEQ ID NO: 2570574 - DNA, 15 bp, Homo sapiens
gtgggagggagcaga

SEQ ID NO: 2570575 - DNA, 19 bp, Homo sapiens
gtgggagggagcagacagg

SEQ ID NO: 2570576 - DNA, 16 bp, Homo sapiens
gtgggaggggcaggct

SEQ ID NO: 2570577 - DNA, 14 bp, Homo sapiens
gtgggagtgggccc

SEQ ID NO: 2570578 - DNA, 12 bp, Homo sapiens
gtgggcaggtgg

SEQ ID NO: 2570579 - DNA, 17 bp, Homo sapiens
gtgggccagtgtgggaa

SEQ ID NO: 2570580 - DNA, 21 bp, Homo sapiens
gtgggcccaggaccagctggg

SEQ ID NO: 2570581 - DNA, 12 bp, Homo sapiens
gtgggcctctgg

SEQ ID NO: 2570582 - DNA, 17 bp, Homo sapiens
gtgggccttgctgggga

SEQ ID NO: 2570583 - DNA, 19 bp, Homo sapiens
gtgggcggcacagccttct

SEQ ID NO: 2570584 - DNA, 17 bp, Homo sapiens
gtgggcgtggtcactgc

SEQ ID NO: 2570585 - DNA, 12 bp, Homo sapiens
gtgggctaagca

SEQ ID NO: 2570586 - DNA, 15 bp, Homo sapiens
gtgggctccctgact

SEQ ID NO: 2570587 - DNA, 14 bp, Homo sapiens
gtgggctgagccct

SEQ ID NO: 2570588 - DNA, 15 bp, Homo sapiens
gtgggctgagccctg

SEQ ID NO: 2570589 - DNA, 22 bp, Homo sapiens
gtgggctggtgacccagtcaga

SEQ ID NO: 2570590 - DNA, 13 bp, Homo sapiens
gtgggctgtgagt

SEQ ID NO: 2570591 - DNA, 17 bp, Homo sapiens
gtggggagactgggctg

SEQ ID NO: 2570592 - DNA, 11 bp, Homo sapiens
gtggggagggg

SEQ ID NO: 2570593 - DNA, 15 bp, Homo sapiens
gtggggattgcccat

SEQ ID NO: 2570594 - DNA, 16 bp, Homo sapiens
gtggggatttctccca

SEQ ID NO: 2570595 - DNA, 17 bp, Homo sapiens
gtggggctcgccatgcc

SEQ ID NO: 2570596 - DNA, 16 bp, Homo sapiens
gtgggggtctgtgtgt

SEQ ID NO: 2570597 - DNA, 23 bp, Homo sapiens
gtgggggtgcagatgaggttgct

SEQ ID NO: 2570598 - DNA, 22 bp, Homo sapiens
gtgggggtggaataaaatacta

SEQ ID NO: 2570599 - DNA, 17 bp, Homo sapiens
gtggggtcactctggca

SEQ ID NO: 2570600 - DNA, 20 bp, Homo sapiens
gtggggtcactctggcagct

SEQ ID NO: 2570601 - DNA, 20 bp, Homo sapiens
gtgggtagatcacgagatca

SEQ ID NO: 2570602 - DNA, 20 bp, Homo sapiens
gtgggtccaggggcccctcc

SEQ ID NO: 2570603 - DNA, 22 bp, Homo sapiens
gtgggtccatgggcagagccca

SEQ ID NO: 2570604 - DNA, 16 bp, Homo sapiens
gtgggtctgtgtgtgt

SEQ ID NO: 2570605 - DNA, 16 bp, Homo sapiens
gtgggttattctggag

SEQ ID NO: 2570606 - DNA, 14 bp, Homo sapiens
gtggtaccctctgg

SEQ ID NO: 2570607 - DNA, 16 bp, Homo sapiens
gtggtatcctgtgaca

SEQ ID NO: 2570608 - DNA, 12 bp, Homo sapiens
gtggtatgtgtg

SEQ ID NO: 2570609 - DNA, 14 bp, Homo sapiens
gtggtcactgctgt

SEQ ID NO: 2570610 - DNA, 15 bp, Homo sapiens
gtggtcactgctgtc

SEQ ID NO: 2570611 - DNA, 17 bp, Homo sapiens
gtggtcccaccccacac

SEQ ID NO: 2570612 - DNA, 15 bp, Homo sapiens
gtggtcctgagacct

SEQ ID NO: 2570613 - DNA, 17 bp, Homo sapiens
gtggtctccttggaaat

SEQ ID NO: 2570614 - DNA, 24 bp, Homo sapiens
gtggtctgaatgttctgacattaa

SEQ ID NO: 2570615 - DNA, 15 bp, Homo sapiens
gtggtctttgtaaga

SEQ ID NO: 2570616 - DNA, 15 bp, Homo sapiens
gtggtgaagaaaact

SEQ ID NO: 2570617 - DNA, 18 bp, Homo sapiens
gtggtgctcagttgtaga

SEQ ID NO: 2570618 - DNA, 22 bp, Homo sapiens
gtggtggagccagtaaacagag

SEQ ID NO: 2570619 - DNA, 17 bp, Homo sapiens
gtggtggcagggcctag

SEQ ID NO: 2570620 - DNA, 18 bp, Homo sapiens
gtggtgggacagggaccc

SEQ ID NO: 2570621 - DNA, 20 bp, Homo sapiens
gtggtggggaggggcgctgg

SEQ ID NO: 2570622 - DNA, 22 bp, Homo sapiens
gtggtggggaggggcgctggcc

SEQ ID NO: 2570623 - DNA, 22 bp, Homo sapiens
gtggttatttctcaacaaagca

SEQ ID NO: 2570624 - DNA, 18 bp, Homo sapiens
gtggttccccaccgaagt

SEQ ID NO: 2570625 - DNA, 16 bp, Homo sapiens
gtggttttcccctccc

SEQ ID NO: 2570626 - DNA, 18 bp, Homo sapiens
gtggttttcccctccctg

SEQ ID NO: 2570627 - DNA, 20 bp, Homo sapiens
gtggttttcccctccctggg

SEQ ID NO: 2570628 - DNA, 24 bp, Homo sapiens
gtggttttcccctccctgggttca

SEQ ID NO: 2570629 - DNA, 15 bp, Homo sapiens
gtgtaaaccaaagcc

SEQ ID NO: 2570630 - DNA, 22 bp, Homo sapiens
gtgtaaaccaaagccctaaaat

SEQ ID NO: 2570631 - DNA, 13 bp, Homo sapiens
gtgtaaagttagt

SEQ ID NO: 2570632 - DNA, 19 bp, Homo sapiens
gtgtaaagttagtctactc

SEQ ID NO: 2570633 - DNA, 15 bp, Homo sapiens
gtgtaatcaataaac

SEQ ID NO: 2570634 - DNA, 12 bp, Homo sapiens
tcagcctcttaa

SEQ ID NO: 2570635 - DNA, 21 bp, Homo sapiens
tcagcctcttaaagctgcctg

SEQ ID NO: 2570636 - DNA, 22 bp, Homo sapiens
tcagcctcttaaagctgcctgt

SEQ ID NO: 2570637 - DNA, 19 bp, Homo sapiens
tcagcctgctccagctgtt

SEQ ID NO: 2570638 - DNA, 12 bp, Homo sapiens
tcagcctgggca

SEQ ID NO: 2570639 - DNA, 22 bp, Homo sapiens
tcagccttccccctcccagggc

SEQ ID NO: 2570640 - DNA, 24 bp, Homo sapiens
tcagccttccccctcccagggcca

SEQ ID NO: 2570641 - DNA, 22 bp, Homo sapiens
tcagccttccccttgcccaggg

SEQ ID NO: 2570642 - DNA, 18 bp, Homo sapiens
tcagcgatgtatgcagct

SEQ ID NO: 2570643 - DNA, 21 bp, Homo sapiens
tcagcgatgtatgcagctatc

SEQ ID NO: 2570644 - DNA, 22 bp, Homo sapiens
tcagcggccccttgactctggg

SEQ ID NO: 2570645 - DNA, 15 bp, Homo sapiens
tcagcggggacagct

SEQ ID NO: 2570646 - DNA, 17 bp, Homo sapiens
tcagcggggacagctcc

SEQ ID NO: 2570647 - DNA, 19 bp, Homo sapiens
tcagcggggacagctcctt

SEQ ID NO: 2570648 - DNA, 21 bp, Homo sapiens
tcagcggggacagctccttct

SEQ ID NO: 2570649 - DNA, 18 bp, Homo sapiens
tcagctaaagcccaacct

SEQ ID NO: 2570650 - DNA, 15 bp, Homo sapiens
tcagctactaatgat

SEQ ID NO: 2570651 - DNA, 21 bp, Homo sapiens
tatttatctgtagtaaactat

SEQ ID NO: 2570652 - DNA, 22 bp, Homo sapiens
tatttattaaatgcccagcccc

SEQ ID NO: 2570653 - DNA, 21 bp, Homo sapiens
tatttattcagcttcatttgt

SEQ ID NO: 2570654 - DNA, 24 bp, Homo sapiens
tatttattcagcttcatttgtgtc

SEQ ID NO: 2570655 - DNA, 14 bp, Homo sapiens
tatttatttaaatt

SEQ ID NO: 2570656 - DNA, 12 bp, Homo sapiens
tatttatttaat

SEQ ID NO: 2570657 - DNA, 13 bp, Homo sapiens
tatttatttactg

SEQ ID NO: 2570658 - DNA, 17 bp, Homo sapiens
tatttatttactgagct

SEQ ID NO: 2570659 - DNA, 22 bp, Homo sapiens
tatttcaatttccaagagctga

SEQ ID NO: 2570660 - DNA, 21 bp, Homo sapiens
tatttcatcatattatacaga

SEQ ID NO: 2570661 - DNA, 21 bp, Homo sapiens
tatttcatgctgggaatgaga

SEQ ID NO: 2570662 - DNA, 21 bp, Homo sapiens
tatttccccaacatgtaataa

SEQ ID NO: 2570663 - DNA, 21 bp, Homo sapiens
tatttccccaggggaaaatga

SEQ ID NO: 2570664 - DNA, 19 bp, Homo sapiens
tatttccttaaactgtgtg

SEQ ID NO: 2570665 - DNA, 15 bp, Homo sapiens
tatttcgaaagctgc

SEQ ID NO: 2570666 - DNA, 19 bp, Homo sapiens
tatttctaggaagaatttt

SEQ ID NO: 2570667 - DNA, 22 bp, Homo sapiens
tatttctaggaagaattttaaa

SEQ ID NO: 2570668 - DNA, 11 bp, Homo sapiens
tatttctgaga

SEQ ID NO: 2570669 - DNA, 20 bp, Homo sapiens
tatttcttaaacaaatgtat

SEQ ID NO: 2570670 - DNA, 14 bp, Homo sapiens
tatttctttgttat

SEQ ID NO: 2570671 - DNA, 19 bp, Homo sapiens
tatttgaaaacatataaag

SEQ ID NO: 2570672 - DNA, 19 bp, Homo sapiens
tatttgaaactgaatgttt

SEQ ID NO: 2570673 - DNA, 14 bp, Homo sapiens
tatttgaaggccag

SEQ ID NO: 2570674 - DNA, 14 bp, Homo sapiens
tatttgagaatata

SEQ ID NO: 2570675 - DNA, 23 bp, Homo sapiens
tatttgcagttcacctgcactta

SEQ ID NO: 2570676 - DNA, 15 bp, Homo sapiens
tatttgcatatgtat

SEQ ID NO: 2570677 - DNA, 11 bp, Homo sapiens
tatttggaatt

SEQ ID NO: 2570678 - DNA, 14 bp, Homo sapiens
tatttggaatttat

SEQ ID NO: 2570679 - DNA, 23 bp, Homo sapiens
tatttgtaaaagaacagtaaaca

SEQ ID NO: 2570680 - DNA, 17 bp, Homo sapiens
tatttgtaaatttatgt

SEQ ID NO: 2570681 - DNA, 15 bp, Homo sapiens
tatttgtatctctga

SEQ ID NO: 2570682 - DNA, 15 bp, Homo sapiens
tatttgtctttcagg

SEQ ID NO: 2570683 - DNA, 20 bp, Homo sapiens
tatttgtgactaattgtata

SEQ ID NO: 2570684 - DNA, 17 bp, Homo sapiens
tatttgtgtaatagaaa

SEQ ID NO: 2570685 - DNA, 13 bp, Homo sapiens
tatttgtgtattt

SEQ ID NO: 2570686 - DNA, 21 bp, Homo sapiens
tatttgtgttttaatttaaac

SEQ ID NO: 2570687 - DNA, 18 bp, Homo sapiens
tatttgttattttcagta

SEQ ID NO: 2570688 - DNA, 14 bp, Homo sapiens
tatttgttttcatg

SEQ ID NO: 2570689 - DNA, 18 bp, Homo sapiens
tattttaaaatctgtcac

SEQ ID NO: 2570690 - DNA, 13 bp, Homo sapiens
tattttaaaatga

SEQ ID NO: 2570691 - DNA, 12 bp, Homo sapiens
tattttaaacaa

SEQ ID NO: 2570692 - DNA, 14 bp, Homo sapiens
tattttaaacaaaa

SEQ ID NO: 2570693 - DNA, 19 bp, Homo sapiens
tattttaatttatgagttt

SEQ ID NO: 2570694 - DNA, 18 bp, Homo sapiens
tattttagtttctgttct

SEQ ID NO: 2570695 - DNA, 17 bp, Homo sapiens
tattttattatgcatga

SEQ ID NO: 2570696 - DNA, 22 bp, Homo sapiens
tattttcaaattgtatctagtg

SEQ ID NO: 2570697 - DNA, 18 bp, Homo sapiens
tattttcatacagcatta

SEQ ID NO: 2570698 - DNA, 15 bp, Homo sapiens
tattttcattgtaaa

SEQ ID NO: 2570699 - DNA, 16 bp, Homo sapiens
tattttcattgtaaaa

SEQ ID NO: 2570700 - DNA, 22 bp, Homo sapiens
tattttccaaaagtggcctctt

SEQ ID NO: 2570701 - DNA, 22 bp, Homo sapiens
tattttccaagtgtgcatattg

SEQ ID NO: 2570702 - DNA, 16 bp, Homo sapiens
tattttccatgaaaat

SEQ ID NO: 2570703 - DNA, 21 bp, Homo sapiens
tattttctgtgcctgaatatt

SEQ ID NO: 2570704 - DNA, 14 bp, Homo sapiens
tattttctttgaaa

SEQ ID NO: 2570705 - DNA, 16 bp, Homo sapiens
tattttgaatcaataa

SEQ ID NO: 2570706 - DNA, 17 bp, Homo sapiens
tattttgattattgtat

SEQ ID NO: 2570707 - DNA, 14 bp, Homo sapiens
tattttgcacagtt

SEQ ID NO: 2570708 - DNA, 14 bp, Homo sapiens
tattttgctggaat

SEQ ID NO: 2570709 - DNA, 20 bp, Homo sapiens
tattttgctttgtgattttt

SEQ ID NO: 2570710 - DNA, 20 bp, Homo sapiens
tattttgtaaactcaaaata

SEQ ID NO: 2570711 - DNA, 18 bp, Homo sapiens
tatttttactgccactct

SEQ ID NO: 2570712 - DNA, 17 bp, Homo sapiens
tatttttatttgtttgt

SEQ ID NO: 2570713 - DNA, 13 bp, Homo sapiens
tatttttcatatt

SEQ ID NO: 2570714 - DNA, 15 bp, Homo sapiens
tatttttcatattgt

SEQ ID NO: 2570715 - DNA, 14 bp, Homo sapiens
tatttttctaaggt

SEQ ID NO: 2570716 - DNA, 21 bp, Homo sapiens
tattttttaagtatttatata

SEQ ID NO: 2570717 - DNA, 15 bp, Homo sapiens
tattttttaattatt

SEQ ID NO: 2570718 - DNA, 13 bp, Homo sapiens
tattttttattgt

SEQ ID NO: 2570719 - DNA, 12 bp, Homo sapiens
tattttttcaga

SEQ ID NO: 2570720 - DNA, 14 bp, Homo sapiens
tattttttcagacc

SEQ ID NO: 2570721 - DNA, 23 bp, Homo sapiens
tatttttttctaccttgaggtct

SEQ ID NO: 2570722 - DNA, 13 bp, Homo sapiens
tatttttttctga

SEQ ID NO: 2570723 - DNA, 14 bp, Homo sapiens
tcaaaaaaacacta

SEQ ID NO: 2570724 - DNA, 14 bp, Homo sapiens
tcaaaaaaagaaaa

SEQ ID NO: 2570725 - DNA, 13 bp, Homo sapiens
tcaaaaaatgagc

SEQ ID NO: 2570726 - DNA, 16 bp, Homo sapiens
tcaaaaatataactta

SEQ ID NO: 2570727 - DNA, 20 bp, Homo sapiens
tcaaaacctttcaaatatca

SEQ ID NO: 2570728 - DNA, 13 bp, Homo sapiens
tcaaaactgcact

SEQ ID NO: 2570729 - DNA, 15 bp, Homo sapiens
tcaaaagacaattct

SEQ ID NO: 2570730 - DNA, 16 bp, Homo sapiens
tcaaaagacaattctt

SEQ ID NO: 2570731 - DNA, 18 bp, Homo sapiens
tcaaaagacaattcttta

SEQ ID NO: 2570732 - DNA, 23 bp, Homo sapiens
tcaaaagacaattctttatacaa

SEQ ID NO: 2570733 - DNA, 14 bp, Homo sapiens
tcaaaagtattttc

SEQ ID NO: 2570734 - DNA, 14 bp, Homo sapiens
tcaaacaaagccag

SEQ ID NO: 2570735 - DNA, 16 bp, Homo sapiens
tcaaacaaagccagaa

SEQ ID NO: 2570736 - DNA, 17 bp, Homo sapiens
tcaaacaacactggtgt

SEQ ID NO: 2570737 - DNA, 16 bp, Homo sapiens
tcaaacacaaatgcag

SEQ ID NO: 2570738 - DNA, 14 bp, Homo sapiens
tcaaacactgcagg

SEQ ID NO: 2570739 - DNA, 22 bp, Homo sapiens
tcaaacagtacactatcttaat

SEQ ID NO: 2570740 - DNA, 20 bp, Homo sapiens
tcaaacagtaggttggcagt

SEQ ID NO: 2570741 - DNA, 21 bp, Homo sapiens
tcaaaccataaacttcatggt

SEQ ID NO: 2570742 - DNA, 19 bp, Homo sapiens
tcaaaccccgaccacctgc

SEQ ID NO: 2570743 - DNA, 16 bp, Homo sapiens
tcaaacgtgaaaatgc

SEQ ID NO: 2570744 - DNA, 22 bp, Homo sapiens
tcaaactcttgacctcaggtga

SEQ ID NO: 2570745 - DNA, 19 bp, Homo sapiens
tcaaactggggcctccctg

SEQ ID NO: 2570746 - DNA, 20 bp, Homo sapiens
tcaaactgtagaaatgatga

SEQ ID NO: 2570747 - DNA, 14 bp, Homo sapiens
tcaaacttccagtc

SEQ ID NO: 2570748 - DNA, 22 bp, Homo sapiens
tcaaacttccagtgcaacactg

SEQ ID NO: 2570749 - DNA, 13 bp, Homo sapiens
tcaaactttacta

SEQ ID NO: 2570750 - DNA, 12 bp, Homo sapiens
tcaaagaaatgc

SEQ ID NO: 2570751 - DNA, 12 bp, Homo sapiens
tcaaagaaggaa

SEQ ID NO: 2570752 - DNA, 15 bp, Homo sapiens
tcaaagcaaggaaac

SEQ ID NO: 2570753 - DNA, 14 bp, Homo sapiens
tcaaagcaatgcat

SEQ ID NO: 2570754 - DNA, 15 bp, Homo sapiens
tcaaagcaatgcatt

SEQ ID NO: 2570755 - DNA, 16 bp, Homo sapiens
tcaaagcaatgcattt

SEQ ID NO: 2570756 - DNA, 17 bp, Homo sapiens
tcaaagcaatgcatttt

SEQ ID NO: 2570757 - DNA, 22 bp, Homo sapiens
tcaaagcaccaaaataagaaaa

SEQ ID NO: 2570758 - DNA, 10 bp, Homo sapiens
tcaaagcaga

SEQ ID NO: 2570759 - DNA, 12 bp, Homo sapiens
tcaaagccagcg

SEQ ID NO: 2570760 - DNA, 23 bp, Homo sapiens
tcaaagccagcgtcctcctctgt

SEQ ID NO: 2570761 - DNA, 20 bp, Homo sapiens
tcaaagcttgaagatcgtta

SEQ ID NO: 2570762 - DNA, 15 bp, Homo sapiens
tcaaaggacaaagtg

SEQ ID NO: 2570763 - DNA, 19 bp, Homo sapiens
tcaaaggcacagtgaaggc

SEQ ID NO: 2570764 - DNA, 20 bp, Homo sapiens
tcaaagtgtaaacaccatag

SEQ ID NO: 2570765 - DNA, 22 bp, Homo sapiens
tcaaagttttgaaaagctatta

SEQ ID NO: 2570766 - DNA, 14 bp, Homo sapiens
tcaaatattagatg

SEQ ID NO: 2570767 - DNA, 15 bp, Homo sapiens
tcaaatattagatgt

SEQ ID NO: 2570768 - DNA, 16 bp, Homo sapiens
tcaaatattagatgtg

SEQ ID NO: 2570769 - DNA, 17 bp, Homo sapiens
tcaaatctattcagaca

SEQ ID NO: 2570770 - DNA, 16 bp, Homo sapiens
tcaaatctccagtatt

SEQ ID NO: 2570771 - DNA, 15 bp, Homo sapiens
tcaaatgacccaaag

SEQ ID NO: 2570772 - DNA, 17 bp, Homo sapiens
tcaaatgacccaaagac

SEQ ID NO: 2570773 - DNA, 14 bp, Homo sapiens
tcaaatgctcagac

SEQ ID NO: 2570774 - DNA, 16 bp, Homo sapiens
tcaaattcttctgaac

SEQ ID NO: 2570775 - DNA, 15 bp, Homo sapiens
tcaaatttctaaatc

SEQ ID NO: 2570776 - DNA, 16 bp, Homo sapiens
tcaaatttctaaatct

SEQ ID NO: 2570777 - DNA, 18 bp, Homo sapiens
tcaacaaaaattgtccct

SEQ ID NO: 2570778 - DNA, 14 bp, Homo sapiens
tcaacaaactattt

SEQ ID NO: 2570779 - DNA, 14 bp, Homo sapiens
tcaacaaagcacag

SEQ ID NO: 2570780 - DNA, 15 bp, Homo sapiens
tcaacaaagcacagt

SEQ ID NO: 2570781 - DNA, 18 bp, Homo sapiens
tcaacaaagcacagtgtt

SEQ ID NO: 2570782 - DNA, 23 bp, Homo sapiens
tcaacaaagcacagtgttaaatg

SEQ ID NO: 2570783 - DNA, 20 bp, Homo sapiens
tcaacaagggagagacctca

SEQ ID NO: 2570784 - DNA, 22 bp, Homo sapiens
tcaacaagggagagacctcatc

SEQ ID NO: 2570785 - DNA, 23 bp, Homo sapiens
tcaacacttaagggttttagaaa

SEQ ID NO: 2570786 - DNA, 19 bp, Homo sapiens
tcataagactttgggatag

SEQ ID NO: 2570787 - DNA, 18 bp, Homo sapiens
tcataagatatttttcat

SEQ ID NO: 2570788 - DNA, 21 bp, Homo sapiens
tcataagatatttttcatgat

SEQ ID NO: 2570789 - DNA, 19 bp, Homo sapiens
tcataataaatatctgtac

SEQ ID NO: 2570790 - DNA, 14 bp, Homo sapiens
tcataatgtgaagt

SEQ ID NO: 2570791 - DNA, 19 bp, Homo sapiens
tcataatgtgaagtgttaa

SEQ ID NO: 2570792 - DNA, 14 bp, Homo sapiens
tcatacccaccccc

SEQ ID NO: 2570793 - DNA, 18 bp, Homo sapiens
tcatacctatcatcttaa

SEQ ID NO: 2570794 - DNA, 23 bp, Homo sapiens
tcatagaaatgtaacttttgtaa

SEQ ID NO: 2570795 - DNA, 14 bp, Homo sapiens
tcatagcattaact

SEQ ID NO: 2570796 - DNA, 12 bp, Homo sapiens
tcatagctgaga

SEQ ID NO: 2570797 - DNA, 17 bp, Homo sapiens
tcatagctgagattcct

SEQ ID NO: 2570798 - DNA, 20 bp, Homo sapiens
tcataggaagggaccaaggc

SEQ ID NO: 2570799 - DNA, 17 bp, Homo sapiens
tcatagggtctcttcag

SEQ ID NO: 2570800 - DNA, 20 bp, Homo sapiens
tcatagggtctcttcaggtt

SEQ ID NO: 2570801 - DNA, 18 bp, Homo sapiens
tcatagtatggtggctgg

SEQ ID NO: 2570802 - DNA, 21 bp, Homo sapiens
tcatagtatggtggctgggtt

SEQ ID NO: 2570803 - DNA, 18 bp, Homo sapiens
tcatataagattcatatt

SEQ ID NO: 2570804 - DNA, 22 bp, Homo sapiens
tcatatatggggggccaacacc

SEQ ID NO: 2570805 - DNA, 18 bp, Homo sapiens
tcatatcccctatttaac

SEQ ID NO: 2570806 - DNA, 20 bp, Homo sapiens
tcatatgacattcatgcctg

SEQ ID NO: 2570807 - DNA, 17 bp, Homo sapiens
tcatatggcccagtgtc

SEQ ID NO: 2570808 - DNA, 15 bp, Homo sapiens
tcatatgttgctcag

SEQ ID NO: 2570809 - DNA, 14 bp, Homo sapiens
tcatattgaatata

SEQ ID NO: 2570810 - DNA, 20 bp, Homo sapiens
tcatattgtgccaatatgta

SEQ ID NO: 2570811 - DNA, 16 bp, Homo sapiens
tcatatttacttctta

SEQ ID NO: 2570812 - DNA, 21 bp, Homo sapiens
tcatatttacttcttatacat

SEQ ID NO: 2570813 - DNA, 12 bp, Homo sapiens
tcatattttgat

SEQ ID NO: 2570814 - DNA, 16 bp, Homo sapiens
tcatattttgattatt

SEQ ID NO: 2570815 - DNA, 23 bp, Homo sapiens
tcatattttgtatatatctgctt

SEQ ID NO: 2570816 - DNA, 17 bp, Homo sapiens
tcatcaaccctaaaaag

SEQ ID NO: 2570817 - DNA, 15 bp, Homo sapiens
tcatcaactgaatga

SEQ ID NO: 2570818 - DNA, 19 bp, Homo sapiens
tcatcaagactggaaggtg

SEQ ID NO: 2570819 - DNA, 15 bp, Homo sapiens
tcatcaaggcactgc

SEQ ID NO: 2570820 - DNA, 21 bp, Homo sapiens
tcatcaaggcactgcctgatg

SEQ ID NO: 2570821 - DNA, 19 bp, Homo sapiens
tcatcaccaacgtctgtgc

SEQ ID NO: 2570822 - DNA, 21 bp, Homo sapiens
tcatcaccaacgtctgtgcca

SEQ ID NO: 2570823 - DNA, 15 bp, Homo sapiens
tcatcactggatgaa

SEQ ID NO: 2570824 - DNA, 17 bp, Homo sapiens
tcatcacttttcagtga

SEQ ID NO: 2570825 - DNA, 14 bp, Homo sapiens
tcatcagcatacct

SEQ ID NO: 2570826 - DNA, 22 bp, Homo sapiens
tcatcaggatgaacccaggacg

SEQ ID NO: 2570827 - DNA, 17 bp, Homo sapiens
tcatcaggggcctgcag

SEQ ID NO: 2570828 - DNA, 19 bp, Homo sapiens
tcatcataaaataaagtat

SEQ ID NO: 2570829 - DNA, 14 bp, Homo sapiens
tcatcatcctaagc

SEQ ID NO: 2570830 - DNA, 14 bp, Homo sapiens
tcatcattccttga

SEQ ID NO: 2570831 - DNA, 20 bp, Homo sapiens
tcatcattctctgtctcatc

SEQ ID NO: 2570832 - DNA, 19 bp, Homo sapiens
tcatcattgtatatatgtg

SEQ ID NO: 2570833 - DNA, 15 bp, Homo sapiens
tcatccaatcctcac

SEQ ID NO: 2570834 - DNA, 18 bp, Homo sapiens
tcatccaatcctcactgg

SEQ ID NO: 2570835 - DNA, 12 bp, Homo sapiens
tcatccacccca

SEQ ID NO: 2570836 - DNA, 17 bp, Homo sapiens
tcatccactgtgccatg

SEQ ID NO: 2570837 - DNA, 21 bp, Homo sapiens
tcatccagggctctgaccagt

SEQ ID NO: 2570838 - DNA, 11 bp, Homo sapiens
tcatccatcat

SEQ ID NO: 2570839 - DNA, 14 bp, Homo sapiens
tcatcccatgtaca

SEQ ID NO: 2570840 - DNA, 12 bp, Homo sapiens
tcatccccaggg

SEQ ID NO: 2570841 - DNA, 20 bp, Homo sapiens
tcatccccaggggtcccagc

SEQ ID NO: 2570842 - DNA, 21 bp, Homo sapiens
tcatccccaggggtcccagcc

SEQ ID NO: 2570843 - DNA, 21 bp, Homo sapiens
tcatcccgagcacctccacat

SEQ ID NO: 2570844 - DNA, 18 bp, Homo sapiens
tcatccctaatgctgcag

SEQ ID NO: 2570845 - DNA, 14 bp, Homo sapiens
tcatccgaggcagg

SEQ ID NO: 2570846 - DNA, 17 bp, Homo sapiens
tcatccggcagcctgga

SEQ ID NO: 2570847 - DNA, 19 bp, Homo sapiens
tcatccggcagcctggatg

SEQ ID NO: 2570848 - DNA, 18 bp, Homo sapiens
tcatcctcatacccaccc

SEQ ID NO: 2570849 - DNA, 16 bp, Homo sapiens
tcatcctgactctgcc

SEQ ID NO: 2570850 - DNA, 17 bp, Homo sapiens
tcatcctgactctgccc

SEQ ID NO: 2570851 - DNA, 20 bp, Homo sapiens
tcatcctgactctgccccct

SEQ ID NO: 2570852 - DNA, 23 bp, Homo sapiens
tcatctataaagaagaacttgca

SEQ ID NO: 2570853 - DNA, 16 bp, Homo sapiens
tcatctatttctgaga

SEQ ID NO: 2570854 - DNA, 20 bp, Homo sapiens
tcatctcaggcctccctcaa

SEQ ID NO: 2570855 - DNA, 15 bp, Homo sapiens
tcatctcctgccttc

SEQ ID NO: 2570856 - DNA, 18 bp, Homo sapiens
tcatctcctgccttcctc

SEQ ID NO: 2570857 - DNA, 22 bp, Homo sapiens
tcatctggataggagcctgctg

SEQ ID NO: 2570858 - DNA, 19 bp, Homo sapiens
tcatctggcaacatcttta

SEQ ID NO: 2570859 - DNA, 23 bp, Homo sapiens
tcatctggcaacatctttatccg

SEQ ID NO: 2570860 - DNA, 16 bp, Homo sapiens
tcatctgggaaagaca

SEQ ID NO: 2570861 - DNA, 16 bp, Homo sapiens
tcatctgggggagtgg

SEQ ID NO: 2570862 - DNA, 20 bp, Homo sapiens
tcatctgggggagtggaata

SEQ ID NO: 2570863 - DNA, 17 bp, Homo sapiens
tcatctgtccctccggg

SEQ ID NO: 2570864 - DNA, 19 bp, Homo sapiens
tcatctgtgtgaaaatggg

SEQ ID NO: 2570865 - DNA, 13 bp, Homo sapiens
tcatcttctcagc

SEQ ID NO: 2570866 - DNA, 18 bp, Homo sapiens
tcatcttctcagctccca

SEQ ID NO: 2570867 - DNA, 19 bp, Homo sapiens
tcatcttctcagctcccat

SEQ ID NO: 2570868 - DNA, 22 bp, Homo sapiens
tcatcttggtactactagatgt

SEQ ID NO: 2570869 - DNA, 23 bp, Homo sapiens
tcatgaacatgttcctgaattct

SEQ ID NO: 2570870 - DNA, 19 bp, Homo sapiens
tcatgaagatatttttcca

SEQ ID NO: 2570871 - DNA, 13 bp, Homo sapiens
tcatgaagcccaa

SEQ ID NO: 2570872 - DNA, 16 bp, Homo sapiens
tcatgaatctgcaatg

SEQ ID NO: 2570873 - DNA, 16 bp, Homo sapiens
tcatgatccaactaat

SEQ ID NO: 2570874 - DNA, 18 bp, Homo sapiens
tcatgatcttgtgacata

SEQ ID NO: 2570875 - DNA, 21 bp, Homo sapiens
tcatgattttgaaatcatgaa

SEQ ID NO: 2570876 - DNA, 11 bp, Homo sapiens
tcatgattttt

SEQ ID NO: 2570877 - DNA, 17 bp, Homo sapiens
tcatgcaaaggctggga

SEQ ID NO: 2570878 - DNA, 20 bp, Homo sapiens
tcatgcaaatgctgtattct

SEQ ID NO: 2570879 - DNA, 14 bp, Homo sapiens
tcatgcataaatat

SEQ ID NO: 2570880 - DNA, 16 bp, Homo sapiens
tcatgcatctccacct

SEQ ID NO: 2570881 - DNA, 12 bp, Homo sapiens
tcatgccagcta

SEQ ID NO: 2570882 - DNA, 21 bp, Homo sapiens
tcatggaatggttataaaagt

SEQ ID NO: 2570883 - DNA, 22 bp, Homo sapiens
tcatggaatggttataaaagtg

SEQ ID NO: 2570884 - DNA, 20 bp, Homo sapiens
tcatggcctattatattaaa

SEQ ID NO: 2570885 - DNA, 22 bp, Homo sapiens
tcatggctgtgccctcttgatg

SEQ ID NO: 2570886 - DNA, 17 bp, Homo sapiens
tcatgggatagcacgtg

SEQ ID NO: 2570887 - DNA, 14 bp, Homo sapiens
tcatggtgtaataa

SEQ ID NO: 2570888 - DNA, 21 bp, Homo sapiens
tcatggtgtaataagacataa

SEQ ID NO: 2570889 - DNA, 18 bp, Homo sapiens
tcatgtaagctgaaaata

SEQ ID NO: 2570890 - DNA, 16 bp, Homo sapiens
tcatgtagtatcaaat

SEQ ID NO: 2570891 - DNA, 15 bp, Homo sapiens
tcatgtatcatctgg

SEQ ID NO: 2570892 - DNA, 16 bp, Homo sapiens
tcatgtcaacttctgg

SEQ ID NO: 2570893 - DNA, 13 bp, Homo sapiens
tcatgtctggcta

SEQ ID NO: 2570894 - DNA, 19 bp, Homo sapiens
tcatgtggaatataaagat

SEQ ID NO: 2570895 - DNA, 21 bp, Homo sapiens
tcatgtgtaatcaataaacga

SEQ ID NO: 2570896 - DNA, 21 bp, Homo sapiens
tcatgttccttcaagatcatg

SEQ ID NO: 2570897 - DNA, 11 bp, Homo sapiens
tcatgttctta

SEQ ID NO: 2570898 - DNA, 16 bp, Homo sapiens
tcatgtttaagaaatt

SEQ ID NO: 2570899 - DNA, 15 bp, Homo sapiens
tcatgtttcttaaat

SEQ ID NO: 2570900 - DNA, 14 bp, Homo sapiens
tcatttatgaaaag

SEQ ID NO: 2570901 - DNA, 19 bp, Homo sapiens
tcatttcaaatacatcttt

SEQ ID NO: 2570902 - DNA, 12 bp, Homo sapiens
tcatttcaggat

SEQ ID NO: 2570903 - DNA, 16 bp, Homo sapiens
tcatttcattcctaac

SEQ ID NO: 2570904 - DNA, 18 bp, Homo sapiens
tcatttctactgtgactg

SEQ ID NO: 2570905 - DNA, 19 bp, Homo sapiens
tcatttctactgtgactga

SEQ ID NO: 2570906 - DNA, 17 bp, Homo sapiens
tcatttctatttctcct

SEQ ID NO: 2570907 - DNA, 16 bp, Homo sapiens
tcatttgatgctaaat

SEQ ID NO: 2570908 - DNA, 21 bp, Homo sapiens
tcatttgcccttaaggacaaa

SEQ ID NO: 2570909 - DNA, 15 bp, Homo sapiens
tcatttgttggaatg

SEQ ID NO: 2570910 - DNA, 14 bp, Homo sapiens
tcattttaattatt

SEQ ID NO: 2570911 - DNA, 15 bp, Homo sapiens
tcattttatgttaag

SEQ ID NO: 2570912 - DNA, 21 bp, Homo sapiens
tcattttgttgcttttgtgaa

SEQ ID NO: 2570913 - DNA, 12 bp, Homo sapiens
tcatttttaatc

SEQ ID NO: 2570914 - DNA, 19 bp, Homo sapiens
tcatttttaatcatgaaat

SEQ ID NO: 2570915 - DNA, 23 bp, Homo sapiens
tcatttttgtacagtttgctgta

SEQ ID NO: 2570916 - DNA, 13 bp, Homo sapiens
tcattttttctta

SEQ ID NO: 2570917 - DNA, 13 bp, Homo sapiens
tcattttttttaa

SEQ ID NO: 2570918 - DNA, 18 bp, Homo sapiens
tcattttttttaagaaaa

SEQ ID NO: 2570919 - DNA, 13 bp, Homo sapiens
tccaaaaaaatac

SEQ ID NO: 2570920 - DNA, 16 bp, Homo sapiens
tccaaaagattgctga

SEQ ID NO: 2570921 - DNA, 19 bp, Homo sapiens
tccaaaagattgctgaaat

SEQ ID NO: 2570922 - DNA, 21 bp, Homo sapiens
tccaaacctcctgttagctgt

SEQ ID NO: 2570923 - DNA, 19 bp, Homo sapiens
tccaaagcacattgaaaga

SEQ ID NO: 2570924 - DNA, 19 bp, Homo sapiens
tccaaaggaggctggcagg

SEQ ID NO: 2570925 - DNA, 13 bp, Homo sapiens
tccaaagtacact

SEQ ID NO: 2570926 - DNA, 16 bp, Homo sapiens
tccaaagtacactgtt

SEQ ID NO: 2570927 - DNA, 13 bp, Homo sapiens
tccaaataaaaac

SEQ ID NO: 2570928 - DNA, 19 bp, Homo sapiens
tccaaatgaatgaccttgt

SEQ ID NO: 2570929 - DNA, 18 bp, Homo sapiens
tccaacaaagggttttaa

SEQ ID NO: 2570930 - DNA, 17 bp, Homo sapiens
tccaacaccacagacac

SEQ ID NO: 2570931 - DNA, 16 bp, Homo sapiens
tccaacaggagctggg

SEQ ID NO: 2570932 - DNA, 14 bp, Homo sapiens
tccaaccccaactc

SEQ ID NO: 2570933 - DNA, 15 bp, Homo sapiens
tccaaccccaactcc

SEQ ID NO: 2570934 - DNA, 16 bp, Homo sapiens
tccaaccccaactcca

SEQ ID NO: 2570935 - DNA, 19 bp, Homo sapiens
tccaaccccaactccagta

SEQ ID NO: 2570936 - DNA, 14 bp, Homo sapiens
tccaacgtggccca

SEQ ID NO: 2570937 - DNA, 18 bp, Homo sapiens
tccaactgtgttcattag

SEQ ID NO: 2570938 - DNA, 15 bp, Homo sapiens
tccaacttcatttga

SEQ ID NO: 2570939 - DNA, 14 bp, Homo sapiens
tccaagaagcccag

SEQ ID NO: 2570940 - DNA, 19 bp, Homo sapiens
tccaagaagcccaggaaag

SEQ ID NO: 2570941 - DNA, 20 bp, Homo sapiens
tccaagaagcccaggaaagg

SEQ ID NO: 2570942 - DNA, 13 bp, Homo sapiens
tccaagaatgctg

SEQ ID NO: 2570943 - DNA, 14 bp, Homo sapiens
tccaagaatgctga

SEQ ID NO: 2570944 - DNA, 18 bp, Homo sapiens
tccaagacagtatacagt

SEQ ID NO: 2570945 - DNA, 17 bp, Homo sapiens
tccaagacatgtctgtt

SEQ ID NO: 2570946 - DNA, 22 bp, Homo sapiens
tccaagacatgtctgttctaca

SEQ ID NO: 2570947 - DNA, 15 bp, Homo sapiens
tccaagacattgtca

SEQ ID NO: 2570948 - DNA, 20 bp, Homo sapiens
tccaagaccttctccttcac

SEQ ID NO: 2570949 - DNA, 17 bp, Homo sapiens
tccaagagtctgatgat

SEQ ID NO: 2570950 - DNA, 18 bp, Homo sapiens
tccaagatattttaaaat

SEQ ID NO: 2570951 - DNA, 22 bp, Homo sapiens
tccaagatattttaaaatctgt

SEQ ID NO: 2570952 - DNA, 23 bp, Homo sapiens
tccaagcataccaacacgagcag

SEQ ID NO: 2570953 - DNA, 15 bp, Homo sapiens
tccaagccagcggga

SEQ ID NO: 2570954 - DNA, 14 bp, Homo sapiens
tccaagctcccagg

SEQ ID NO: 2570955 - DNA, 20 bp, Homo sapiens
tccaagctggtcccactcag

SEQ ID NO: 2570956 - DNA, 16 bp, Homo sapiens
tccaaggagaaacaga

SEQ ID NO: 2570957 - DNA, 19 bp, Homo sapiens
tccaaggagaaacagagac

SEQ ID NO: 2570958 - DNA, 22 bp, Homo sapiens
tccaaggagaaacagagacagg

SEQ ID NO: 2570959 - DNA, 19 bp, Homo sapiens
tccaagggcttctgcaccc

SEQ ID NO: 2570960 - DNA, 18 bp, Homo sapiens
tccaagggtactaaggaa

SEQ ID NO: 2570961 - DNA, 17 bp, Homo sapiens
tccaagtctcagtggct

SEQ ID NO: 2570962 - DNA, 13 bp, Homo sapiens
tccaagtgtgcat

SEQ ID NO: 2570963 - DNA, 14 bp, Homo sapiens
tccaatcctcactg

SEQ ID NO: 2570964 - DNA, 15 bp, Homo sapiens
tccaatcctcactgg

SEQ ID NO: 2570965 - DNA, 14 bp, Homo sapiens
tccaatcctgcccc

SEQ ID NO: 2570966 - DNA, 21 bp, Homo sapiens
tccaatgtctttttaagctta

SEQ ID NO: 2570967 - DNA, 21 bp, Homo sapiens
tccaattgttgacagttctga

SEQ ID NO: 2570968 - DNA, 18 bp, Homo sapiens
tccaattttctggaatac

SEQ ID NO: 2570969 - DNA, 14 bp, Homo sapiens
tccacaaattatta

SEQ ID NO: 2570970 - DNA, 20 bp, Homo sapiens
tccacaaattattaatgaaa

SEQ ID NO: 2570971 - DNA, 21 bp, Homo sapiens
tccacaaattattaatgaaaa

SEQ ID NO: 2570972 - DNA, 17 bp, Homo sapiens
tccacaagttaaataaa

SEQ ID NO: 2570973 - DNA, 23 bp, Homo sapiens
tccacacacagaggaagagcagg

SEQ ID NO: 2570974 - DNA, 20 bp, Homo sapiens
tccacacacagctgggctgt

SEQ ID NO: 2570975 - DNA, 21 bp, Homo sapiens
tccacacacagctgggctgtg

SEQ ID NO: 2570976 - DNA, 15 bp, Homo sapiens
tccacacacgcagga

SEQ ID NO: 2570977 - DNA, 17 bp, Homo sapiens
tccacaccaagcagcaa

SEQ ID NO: 2570978 - DNA, 13 bp, Homo sapiens
tccacacccccac

SEQ ID NO: 2570979 - DNA, 20 bp, Homo sapiens
tccacaccctctcccaggac

SEQ ID NO: 2570980 - DNA, 15 bp, Homo sapiens
tccacagccatccca

SEQ ID NO: 2570981 - DNA, 22 bp, Homo sapiens
tccacagccatcccagccttgg

SEQ ID NO: 2570982 - DNA, 18 bp, Homo sapiens
tccacagccgcagcctcc

SEQ ID NO: 2570983 - DNA, 13 bp, Homo sapiens
tccacagttcagt

SEQ ID NO: 2570984 - DNA, 15 bp, Homo sapiens
tccacagttcagtgg

SEQ ID NO: 2570985 - DNA, 22 bp, Homo sapiens
tccacagttcgacctgcggctg

SEQ ID NO: 2570986 - DNA, 13 bp, Homo sapiens
tccacatcctcca

SEQ ID NO: 2570987 - DNA, 19 bp, Homo sapiens
tccacatctacgtttttgg

SEQ ID NO: 2570988 - DNA, 15 bp, Homo sapiens
tccacatgggagccg

SEQ ID NO: 2570989 - DNA, 14 bp, Homo sapiens
tccacattgtttta

SEQ ID NO: 2570990 - DNA, 23 bp, Homo sapiens
tccaccaccactggccaccaggc

SEQ ID NO: 2570991 - DNA, 16 bp, Homo sapiens
tccaccacctccctca

SEQ ID NO: 2570992 - DNA, 15 bp, Homo sapiens
tccaccagcctgcac

SEQ ID NO: 2570993 - DNA, 18 bp, Homo sapiens
tccaccatcaagccacca

SEQ ID NO: 2570994 - DNA, 17 bp, Homo sapiens
tccacccacctcagcct

SEQ ID NO: 2570995 - DNA, 12 bp, Homo sapiens
tccacccaggag

SEQ ID NO: 2570996 - DNA, 16 bp, Homo sapiens
tccaccctctgagctt

SEQ ID NO: 2570997 - DNA, 13 bp, Homo sapiens
tccacccttggcc

SEQ ID NO: 2570998 - DNA, 15 bp, Homo sapiens
tccacccttggcctg

SEQ ID NO: 2570999 - DNA, 14 bp, Homo sapiens
tccacctacatgag

SEQ ID NO: 2571000 - DNA, 13 bp, Homo sapiens
tccacctccttct

SEQ ID NO: 2571001 - DNA, 13 bp, Homo sapiens
tccacctgccagg

SEQ ID NO: 2571002 - DNA, 18 bp, Homo sapiens
tccacctgctcccaggcc

SEQ ID NO: 2571003 - DNA, 15 bp, Homo sapiens
tccaccttcccatgc

SEQ ID NO: 2571004 - DNA, 18 bp, Homo sapiens
tccacgactgtctccatg

SEQ ID NO: 2571005 - DNA, 15 bp, Homo sapiens
tccacggagccactc

SEQ ID NO: 2571006 - DNA, 20 bp, Homo sapiens
tccacggagccactcctctg

SEQ ID NO: 2571007 - DNA, 21 bp, Homo sapiens
tccacggagccactcctctga

SEQ ID NO: 2571008 - DNA, 22 bp, Homo sapiens
tccacggagccactcctctgac

SEQ ID NO: 2571009 - DNA, 20 bp, Homo sapiens
tccacggctctaggtggggc

SEQ ID NO: 2571010 - DNA, 18 bp, Homo sapiens
tccacggtctgttcttga

SEQ ID NO: 2571011 - DNA, 21 bp, Homo sapiens
tccacgttctgctcatcattc

SEQ ID NO: 2571012 - DNA, 11 bp, Homo sapiens
tccactaaccc

SEQ ID NO: 2571013 - DNA, 13 bp, Homo sapiens
tccactcccagtg

SEQ ID NO: 2571014 - DNA, 15 bp, Homo sapiens
tccactcccagtgct

SEQ ID NO: 2571015 - DNA, 20 bp, Homo sapiens
tccactctaccctcccaccc

SEQ ID NO: 2571016 - DNA, 13 bp, Homo sapiens
tccactgagctcc

SEQ ID NO: 2571017 - DNA, 10 bp, Homo sapiens
tccactggac

SEQ ID NO: 2571018 - DNA, 17 bp, Homo sapiens
tccactggacttgagct

SEQ ID NO: 2571019 - DNA, 13 bp, Homo sapiens
tccactttgttct

SEQ ID NO: 2571020 - DNA, 20 bp, Homo sapiens
tccactttgttggaaagcag

SEQ ID NO: 2571021 - DNA, 21 bp, Homo sapiens
tccagaaacggccattcagca

SEQ ID NO: 2571022 - DNA, 19 bp, Homo sapiens
tccagaagaatattcagga

SEQ ID NO: 2571023 - DNA, 20 bp, Homo sapiens
tccagaagaatattcaggac

SEQ ID NO: 2571024 - DNA, 21 bp, Homo sapiens
tccagaagaatattcaggact

SEQ ID NO: 2571025 - DNA, 18 bp, Homo sapiens
tccagaagcctctggcta

SEQ ID NO: 2571026 - DNA, 23 bp, Homo sapiens
tccagaaggggtttggtctggga

SEQ ID NO: 2571027 - DNA, 15 bp, Homo sapiens
tccagaagtgtgatt

SEQ ID NO: 2571028 - DNA, 22 bp, Homo sapiens
tccagaataaaacgcaaagggc

SEQ ID NO: 2571029 - DNA, 24 bp, Homo sapiens
tccagacaaaccagaagcaacaga

SEQ ID NO: 2571030 - DNA, 15 bp, Homo sapiens
tccagacagcctgta

SEQ ID NO: 2571031 - DNA, 16 bp, Homo sapiens
tccagacccccacccc

SEQ ID NO: 2571032 - DNA, 21 bp, Homo sapiens
tccagacccccagcaaccctc

SEQ ID NO: 2571033 - DNA, 14 bp, Homo sapiens
tccagacccggctg

SEQ ID NO: 2571034 - DNA, 19 bp, Homo sapiens
tccagacccggctgcgtgg

SEQ ID NO: 2571035 - DNA, 14 bp, Homo sapiens
tccagactctctgt

SEQ ID NO: 2571036 - DNA, 19 bp, Homo sapiens
tccagagagagaagtgccc

SEQ ID NO: 2571037 - DNA, 23 bp, Homo sapiens
tccagagagagaagtgcccctgc

SEQ ID NO: 2571038 - DNA, 18 bp, Homo sapiens
tccagatttacactggga

SEQ ID NO: 2571039 - DNA, 19 bp, Homo sapiens
tccagatttacactgggag

SEQ ID NO: 2571040 - DNA, 23 bp, Homo sapiens
tccagcaccatccgccagggccc

SEQ ID NO: 2571041 - DNA, 15 bp, Homo sapiens
tccagccagggctgc

SEQ ID NO: 2571042 - DNA, 22 bp, Homo sapiens
tccagcccctggatgcagcctc

SEQ ID NO: 2571043 - DNA, 21 bp, Homo sapiens
tccagccctggctgaaggact

SEQ ID NO: 2571044 - DNA, 18 bp, Homo sapiens
tccagccgccattgccac

SEQ ID NO: 2571045 - DNA, 22 bp, Homo sapiens
tccagccgccattgccaccagg

SEQ ID NO: 2571046 - DNA, 12 bp, Homo sapiens
tccagcctagag

SEQ ID NO: 2571047 - DNA, 11 bp, Homo sapiens
tccagcctggg

SEQ ID NO: 2571048 - DNA, 17 bp, Homo sapiens
tccagcctgggcgacag

SEQ ID NO: 2571049 - DNA, 20 bp, Homo sapiens
tccagctataacagtaggga

SEQ ID NO: 2571050 - DNA, 14 bp, Homo sapiens
tccagctcaccagc

SEQ ID NO: 2571051 - DNA, 18 bp, Homo sapiens
atgcctgtccagcctggg

SEQ ID NO: 2571052 - DNA, 18 bp, Homo sapiens
atgccttccagcaccctg

SEQ ID NO: 2571053 - DNA, 14 bp, Homo sapiens
atgcctttgagaca

SEQ ID NO: 2571054 - DNA, 19 bp, Homo sapiens
atgcctttgagacagtttc

SEQ ID NO: 2571055 - DNA, 20 bp, Homo sapiens
atgcctttgagacagtttct

SEQ ID NO: 2571056 - DNA, 11 bp, Homo sapiens
tcactgctgtc

SEQ ID NO: 2571057 - DNA, 12 bp, Homo sapiens
tcactgctgtca

SEQ ID NO: 2571058 - DNA, 16 bp, Homo sapiens
tcactgctgtcatcaa

SEQ ID NO: 2571059 - DNA, 15 bp, Homo sapiens
tcactgcttaacttc

SEQ ID NO: 2571060 - DNA, 20 bp, Homo sapiens
tcactgcttaacttcacata

SEQ ID NO: 2571061 - DNA, 13 bp, Homo sapiens
tcactggagccca

SEQ ID NO: 2571062 - DNA, 22 bp, Homo sapiens
tcactggagttacattaatgtt

SEQ ID NO: 2571063 - DNA, 16 bp, Homo sapiens
ctgcctgtagcagtga

SEQ ID NO: 2571064 - DNA, 17 bp, Homo sapiens
ctgcctgtagttaggaa

SEQ ID NO: 2571065 - DNA, 18 bp, Homo sapiens
ctgcctgtagttaggaaa

SEQ ID NO: 2571066 - DNA, 19 bp, Homo sapiens
ctgcctgtagttaggaaat

SEQ ID NO: 2571067 - DNA, 22 bp, Homo sapiens
ctgcctgtagttaggaaataaa

SEQ ID NO: 2571068 - DNA, 18 bp, Homo sapiens
ctgcctgtccctctcagg

SEQ ID NO: 2571069 - DNA, 23 bp, Homo sapiens
ctgcctgtccctctcaggcatgc

SEQ ID NO: 2571070 - DNA, 12 bp, Homo sapiens
ctgcctgtctcc

SEQ ID NO: 2571071 - DNA, 13 bp, Homo sapiens
ctgcctgtctgtc

SEQ ID NO: 2571072 - DNA, 15 bp, Homo sapiens
ctgcctgttcagctc

SEQ ID NO: 2571073 - DNA, 23 bp, Homo sapiens
ctgccttagtctcagtttgtgtg

SEQ ID NO: 2571074 - DNA, 18 bp, Homo sapiens
ctgccttcctcctgggcc

SEQ ID NO: 2571075 - DNA, 21 bp, Homo sapiens
ctgccttcctcctgggccctc

SEQ ID NO: 2571076 - DNA, 13 bp, Homo sapiens
ctgccttccttgc

SEQ ID NO: 2571077 - DNA, 14 bp, Homo sapiens
ctgccttccttgct

SEQ ID NO: 2571078 - DNA, 16 bp, Homo sapiens
ctgccttctgtcctgg

SEQ ID NO: 2571079 - DNA, 15 bp, Homo sapiens
ctgccttcttctttt

SEQ ID NO: 2571080 - DNA, 22 bp, Homo sapiens
ctgccttcttctttttgctgtt

SEQ ID NO: 2571081 - DNA, 14 bp, Homo sapiens
ctgccttgtgtaca

SEQ ID NO: 2571082 - DNA, 21 bp, Homo sapiens
ctgcctttgctcctcccatgt

SEQ ID NO: 2571083 - DNA, 14 bp, Homo sapiens
ctgcgatcttcaga

SEQ ID NO: 2571084 - DNA, 17 bp, Homo sapiens
ctgcgatcttcagagca

SEQ ID NO: 2571085 - DNA, 17 bp, Homo sapiens
ctgcgattttgcctgtg

SEQ ID NO: 2571086 - DNA, 20 bp, Homo sapiens
ctgcgcccaccccgctctgc

SEQ ID NO: 2571087 - DNA, 22 bp, Homo sapiens
ctgcgcccaccccgctctgcat

SEQ ID NO: 2571088 - DNA, 19 bp, Homo sapiens
ctgcgcccagtccttccac

SEQ ID NO: 2571089 - DNA, 14 bp, Homo sapiens
ctgcggaaaaggaa

SEQ ID NO: 2571090 - DNA, 20 bp, Homo sapiens
ctgcggagtgaagaggggca

SEQ ID NO: 2571091 - DNA, 22 bp, Homo sapiens
ctgcggagtgaagaggggcagc

SEQ ID NO: 2571092 - DNA, 15 bp, Homo sapiens
ctgcggcctgctgga

SEQ ID NO: 2571093 - DNA, 17 bp, Homo sapiens
ctgcggctgctgtgtgc

SEQ ID NO: 2571094 - DNA, 17 bp, Homo sapiens
ctgcgggatggtcctgg

SEQ ID NO: 2571095 - DNA, 20 bp, Homo sapiens
ctgcgggatggtcctggggc

SEQ ID NO: 2571096 - DNA, 18 bp, Homo sapiens
ctgcggtgctatctcccc

SEQ ID NO: 2571097 - DNA, 19 bp, Homo sapiens
ctgcggtgctatctccccc

SEQ ID NO: 2571098 - DNA, 13 bp, Homo sapiens
ctgcgtctgtgtt

SEQ ID NO: 2571099 - DNA, 21 bp, Homo sapiens
ctgctaacttggagccccagt

SEQ ID NO: 2571100 - DNA, 16 bp, Homo sapiens
ctgctaattccccaga

SEQ ID NO: 2571101 - DNA, 15 bp, Homo sapiens
ctgctacaaagaaga

SEQ ID NO: 2571102 - DNA, 17 bp, Homo sapiens
ctgctacaaagaagaca

SEQ ID NO: 2571103 - DNA, 20 bp, Homo sapiens
ctgctacaaagaagacatgt

SEQ ID NO: 2571104 - DNA, 22 bp, Homo sapiens
ctgctacaaagaagacatgttt

SEQ ID NO: 2571105 - DNA, 17 bp, Homo sapiens
ctgctactctgttcctt

SEQ ID NO: 2571106 - DNA, 14 bp, Homo sapiens
ctgctagcacttgg

SEQ ID NO: 2571107 - DNA, 18 bp, Homo sapiens
ctgctaggcgagtgccag

SEQ ID NO: 2571108 - DNA, 19 bp, Homo sapiens
ctgctaggcgagtgccagg

SEQ ID NO: 2571109 - DNA, 21 bp, Homo sapiens
ctgctaggtgggccagcccct

SEQ ID NO: 2571110 - DNA, 23 bp, Homo sapiens
ctgctaggtgggccagcccctcc

SEQ ID NO: 2571111 - DNA, 20 bp, Homo sapiens
ctgctcaagaagacatggag

SEQ ID NO: 2571112 - DNA, 23 bp, Homo sapiens
ctgctcaagaagacatggagact

SEQ ID NO: 2571113 - DNA, 14 bp, Homo sapiens
ctgctcacatatct

SEQ ID NO: 2571114 - DNA, 19 bp, Homo sapiens
ctgctcacatatctgtcat

SEQ ID NO: 2571115 - DNA, 12 bp, Homo sapiens
ctgctcatcatt

SEQ ID NO: 2571116 - DNA, 18 bp, Homo sapiens
ctgctcatcattctctgt

SEQ ID NO: 2571117 - DNA, 19 bp, Homo sapiens
ctgctccacagccatccca

SEQ ID NO: 2571118 - DNA, 11 bp, Homo sapiens
ctgctccacca

SEQ ID NO: 2571119 - DNA, 13 bp, Homo sapiens
ctgctccaccaca

SEQ ID NO: 2571120 - DNA, 12 bp, Homo sapiens
ctgctccaccct

SEQ ID NO: 2571121 - DNA, 17 bp, Homo sapiens
ctgctccacccttggcc

SEQ ID NO: 2571122 - DNA, 20 bp, Homo sapiens
ctgctccacccttggcctgt

SEQ ID NO: 2571123 - DNA, 15 bp, Homo sapiens
ctgctcccagcagcc

SEQ ID NO: 2571124 - DNA, 17 bp, Homo sapiens
ctgctccccagccctgg

SEQ ID NO: 2571125 - DNA, 19 bp, Homo sapiens
ctgctccccagccctggct

SEQ ID NO: 2571126 - DNA, 14 bp, Homo sapiens
ctgctcctctccag

SEQ ID NO: 2571127 - DNA, 17 bp, Homo sapiens
ctgctcctctccccagc

SEQ ID NO: 2571128 - DNA, 13 bp, Homo sapiens
ctgctcctggagc

SEQ ID NO: 2571129 - DNA, 19 bp, Homo sapiens
ctgctcctggagcctttga

SEQ ID NO: 2571130 - DNA, 19 bp, Homo sapiens
ctgctctccgaccagacac

SEQ ID NO: 2571131 - DNA, 20 bp, Homo sapiens
ctgctctcctcttgccactg

SEQ ID NO: 2571132 - DNA, 21 bp, Homo sapiens
ctgctctcctcttgccactgc

SEQ ID NO: 2571133 - DNA, 21 bp, Homo sapiens
ctgctctgaattagtccttgc

SEQ ID NO: 2571134 - DNA, 12 bp, Homo sapiens
ctgctctggtta

SEQ ID NO: 2571135 - DNA, 13 bp, Homo sapiens
ctgctgaaacaac

SEQ ID NO: 2571136 - DNA, 15 bp, Homo sapiens
ctgctgaagctgcct

SEQ ID NO: 2571137 - DNA, 23 bp, Homo sapiens
ctgctgacagacacaggcccggc

SEQ ID NO: 2571138 - DNA, 22 bp, Homo sapiens
ctgctgacccagcctgttttaa

SEQ ID NO: 2571139 - DNA, 18 bp, Homo sapiens
ctgctgactgttttctct

SEQ ID NO: 2571140 - DNA, 21 bp, Homo sapiens
ctgctgactgttttctcttga

SEQ ID NO: 2571141 - DNA, 18 bp, Homo sapiens
ctgctgagggaccagcca

SEQ ID NO: 2571142 - DNA, 19 bp, Homo sapiens
ctgctgcaaggcctttctg

SEQ ID NO: 2571143 - DNA, 22 bp, Homo sapiens
ctgctgcaaggcctttctgtgt

SEQ ID NO: 2571144 - DNA, 13 bp, Homo sapiens
ctgctgcagttgc

SEQ ID NO: 2571145 - DNA, 22 bp, Homo sapiens
ctgctgccatggcgtgtccctc

SEQ ID NO: 2571146 - DNA, 13 bp, Homo sapiens
ctgctgccctcca

SEQ ID NO: 2571147 - DNA, 14 bp, Homo sapiens
ctgctgccgcctcc

SEQ ID NO: 2571148 - DNA, 21 bp, Homo sapiens
ctgctgcgcccttaccttccc

SEQ ID NO: 2571149 - DNA, 16 bp, Homo sapiens
ctgctgctgctgcgcc

SEQ ID NO: 2571150 - DNA, 14 bp, Homo sapiens
ctgctgctgctgtg

SEQ ID NO: 2571151 - DNA, 13 bp, Homo sapiens
ctgctgctggctg

SEQ ID NO: 2571152 - DNA, 14 bp, Homo sapiens
ctgctgctgtccct

SEQ ID NO: 2571153 - DNA, 13 bp, Homo sapiens
ctgctgctgtgtt

SEQ ID NO: 2571154 - DNA, 20 bp, Homo sapiens
ctgctgctttttgaggtggc

SEQ ID NO: 2571155 - DNA, 15 bp, Homo sapiens
ctgctggaaacagac

SEQ ID NO: 2571156 - DNA, 21 bp, Homo sapiens
ctgctggatcacagctgcttt

SEQ ID NO: 2571157 - DNA, 15 bp, Homo sapiens
ctgctggcccagcca

SEQ ID NO: 2571158 - DNA, 22 bp, Homo sapiens
ctgctggcccagccaaaccctg

SEQ ID NO: 2571159 - DNA, 12 bp, Homo sapiens
ctgctggcctgg

SEQ ID NO: 2571160 - DNA, 14 bp, Homo sapiens
ctgctggcctggat

SEQ ID NO: 2571161 - DNA, 13 bp, Homo sapiens
ctgctggcctggc

SEQ ID NO: 2571162 - DNA, 15 bp, Homo sapiens
ctgctggcgcctctg

SEQ ID NO: 2571163 - DNA, 16 bp, Homo sapiens
ctgctggcgcctctgc

SEQ ID NO: 2571164 - DNA, 18 bp, Homo sapiens
ctgctggcgcctctgcaa

SEQ ID NO: 2571165 - DNA, 20 bp, Homo sapiens
ctgctggcgcctctgcaagg

SEQ ID NO: 2571166 - DNA, 12 bp, Homo sapiens
ctgctggctctt

SEQ ID NO: 2571167 - DNA, 16 bp, Homo sapiens
ctgctggcttgcagtg

SEQ ID NO: 2571168 - DNA, 15 bp, Homo sapiens
ctgctggtcacagcc

SEQ ID NO: 2571169 - DNA, 16 bp, Homo sapiens
ctgctggtcacagcct

SEQ ID NO: 2571170 - DNA, 18 bp, Homo sapiens
ctgctggtgcagagctga

SEQ ID NO: 2571171 - DNA, 14 bp, Homo sapiens
ctgctgtccagaca

SEQ ID NO: 2571172 - DNA, 19 bp, Homo sapiens
ctgctgtccagacagcctg

SEQ ID NO: 2571173 - DNA, 20 bp, Homo sapiens
ctgctgtccagacagcctgt

SEQ ID NO: 2571174 - DNA, 17 bp, Homo sapiens
ctgctgtccctccccct

SEQ ID NO: 2571175 - DNA, 14 bp, Homo sapiens
ctgctgtgtgcctt

SEQ ID NO: 2571176 - DNA, 17 bp, Homo sapiens
ctgcttaacttcacata

SEQ ID NO: 2571177 - DNA, 20 bp, Homo sapiens
ctgcttacaattccctgctg

SEQ ID NO: 2571178 - DNA, 22 bp, Homo sapiens
ctgcttacaattccctgctgtc

SEQ ID NO: 2571179 - DNA, 15 bp, Homo sapiens
ctgcttaggagagac

SEQ ID NO: 2571180 - DNA, 19 bp, Homo sapiens
ctgcttcaaatatttccct

SEQ ID NO: 2571181 - DNA, 13 bp, Homo sapiens
ctgcttcagcctc

SEQ ID NO: 2571182 - DNA, 19 bp, Homo sapiens
ctgcttcagtgtatggaaa

SEQ ID NO: 2571183 - DNA, 19 bp, Homo sapiens
ctgcttccagtgaggctct

SEQ ID NO: 2571184 - DNA, 21 bp, Homo sapiens
ctgcttccagtgaggctctgc

SEQ ID NO: 2571185 - DNA, 18 bp, Homo sapiens
ctgcttcccatcctaccc

SEQ ID NO: 2571186 - DNA, 24 bp, Homo sapiens
ctgcttcccatcctaccctcgggc

SEQ ID NO: 2571187 - DNA, 14 bp, Homo sapiens
ctgcttccctctgc

SEQ ID NO: 2571188 - DNA, 18 bp, Homo sapiens
ctgcttccctctgcctgt

SEQ ID NO: 2571189 - DNA, 19 bp, Homo sapiens
ctgcttcctgtctttggga

SEQ ID NO: 2571190 - DNA, 12 bp, Homo sapiens
ctgcttgaggaa

SEQ ID NO: 2571191 - DNA, 16 bp, Homo sapiens
ctgcttgaggaaaaca

SEQ ID NO: 2571192 - DNA, 20 bp, Homo sapiens
ctgcttgatttttgcctctt

SEQ ID NO: 2571193 - DNA, 12 bp, Homo sapiens
ctgctttccaca

SEQ ID NO: 2571194 - DNA, 14 bp, Homo sapiens
ctgctttcccctgt

SEQ ID NO: 2571195 - DNA, 18 bp, Homo sapiens
ctgctttcccctgtgggg

SEQ ID NO: 2571196 - DNA, 16 bp, Homo sapiens
ctgctttctccattgt

SEQ ID NO: 2571197 - DNA, 17 bp, Homo sapiens
ctgcttttcactgctgc

SEQ ID NO: 2571198 - DNA, 19 bp, Homo sapiens
ctgctttttaaagaatgct

SEQ ID NO: 2571199 - DNA, 22 bp, Homo sapiens
ctggaaaagggtcttgggaaat

SEQ ID NO: 2571200 - DNA, 21 bp, Homo sapiens
ctggaaaggctcagtctcagg

SEQ ID NO: 2571201 - DNA, 23 bp, Homo sapiens
ctggaaaggctcagtctcaggag

SEQ ID NO: 2571202 - DNA, 21 bp, Homo sapiens
ctggaacagattcacactgtc

SEQ ID NO: 2571203 - DNA, 15 bp, Homo sapiens
ctggaaccatcagaa

SEQ ID NO: 2571204 - DNA, 14 bp, Homo sapiens
ctggaagcacagct

SEQ ID NO: 2571205 - DNA, 15 bp, Homo sapiens
ctggaagcacagctt

SEQ ID NO: 2571206 - DNA, 22 bp, Homo sapiens
ctggaagccggcggcccaagcc

SEQ ID NO: 2571207 - DNA, 15 bp, Homo sapiens
ctggaagggctagaa

SEQ ID NO: 2571208 - DNA, 13 bp, Homo sapiens
ctgggctgttggc

SEQ ID NO: 2571209 - DNA, 14 bp, Homo sapiens
ctgggctgttggca

SEQ ID NO: 2571210 - DNA, 15 bp, Homo sapiens
ctgggctgttggcac

SEQ ID NO: 2571211 - DNA, 15 bp, Homo sapiens
ctgggcttcagtggc

SEQ ID NO: 2571212 - DNA, 19 bp, Homo sapiens
ctgggcttcagtggcagct

SEQ ID NO: 2571213 - DNA, 20 bp, Homo sapiens
ctgggcttggggcttcctaa

SEQ ID NO: 2571214 - DNA, 23 bp, Homo sapiens
ctgggctttttttttctctttct

SEQ ID NO: 2571215 - DNA, 22 bp, Homo sapiens
ctggggaaataacagctgtggc

SEQ ID NO: 2571216 - DNA, 22 bp, Homo sapiens
ctggggacctggtaccctcctg

SEQ ID NO: 2571217 - DNA, 22 bp, Homo sapiens
ctggggacggggggccccagtc

SEQ ID NO: 2571218 - DNA, 20 bp, Homo sapiens
ctggggagtgggacagagtc

SEQ ID NO: 2571219 - DNA, 16 bp, Homo sapiens
ctggggatgtctctca

SEQ ID NO: 2571220 - DNA, 17 bp, Homo sapiens
ctggggatgtctctcat

SEQ ID NO: 2571221 - DNA, 22 bp, Homo sapiens
ctggggatgtgggagggagcag

SEQ ID NO: 2571222 - DNA, 17 bp, Homo sapiens
ctggggccacacagaaa

SEQ ID NO: 2571223 - DNA, 18 bp, Homo sapiens
ctggggccacacagaaac

SEQ ID NO: 2571224 - DNA, 20 bp, Homo sapiens
ctggggcctcggagcctcat

SEQ ID NO: 2571225 - DNA, 18 bp, Homo sapiens
ctggggcgggcccctcat

SEQ ID NO: 2571226 - DNA, 14 bp, Homo sapiens
ctggggcgtgggga

SEQ ID NO: 2571227 - DNA, 19 bp, Homo sapiens
ctggggctcctttctccag

SEQ ID NO: 2571228 - DNA, 23 bp, Homo sapiens
ctggggctcctttctccagccag

SEQ ID NO: 2571229 - DNA, 13 bp, Homo sapiens
ctgggggagtgga

SEQ ID NO: 2571230 - DNA, 17 bp, Homo sapiens
ctgggggccatgagctc

SEQ ID NO: 2571231 - DNA, 20 bp, Homo sapiens
ctgggggccatgagctccag

SEQ ID NO: 2571232 - DNA, 23 bp, Homo sapiens
ctgggggccatgagctccagacc

SEQ ID NO: 2571233 - DNA, 22 bp, Homo sapiens
ctgggggggattgtaaaatggt

SEQ ID NO: 2571234 - DNA, 23 bp, Homo sapiens
ctgggggttctttcttcctctgc

SEQ ID NO: 2571235 - DNA, 16 bp, Homo sapiens
ctggggtccagggagc

SEQ ID NO: 2571236 - DNA, 13 bp, Homo sapiens
ctggggtccccca

SEQ ID NO: 2571237 - DNA, 18 bp, Homo sapiens
ctggggtgccgcctgccc

SEQ ID NO: 2571238 - DNA, 14 bp, Homo sapiens
ctgggtacttgtgg

SEQ ID NO: 2571239 - DNA, 19 bp, Homo sapiens
ctgggtacttgtggacaca

SEQ ID NO: 2571240 - DNA, 23 bp, Homo sapiens
ctgggtacttgtggacacagctc

SEQ ID NO: 2571241 - DNA, 13 bp, Homo sapiens
ctgggtagctgta

SEQ ID NO: 2571242 - DNA, 15 bp, Homo sapiens
ctgggtagctgtaag

SEQ ID NO: 2571243 - DNA, 14 bp, Homo sapiens
ctgggtccaaataa

SEQ ID NO: 2571244 - DNA, 19 bp, Homo sapiens
ctgggtccaaataaaaact

SEQ ID NO: 2571245 - DNA, 20 bp, Homo sapiens
ctgggtccaaataaaaacta

SEQ ID NO: 2571246 - DNA, 18 bp, Homo sapiens
ctgggtccttgcacccct

SEQ ID NO: 2571247 - DNA, 23 bp, Homo sapiens
ctgggtccttgcacccctcactc

SEQ ID NO: 2571248 - DNA, 22 bp, Homo sapiens
ctgggtctcgctttgttgccca

SEQ ID NO: 2571249 - DNA, 16 bp, Homo sapiens
ctgggtctgtgtctct

SEQ ID NO: 2571250 - DNA, 20 bp, Homo sapiens
ctgggtgcatgatcttgagc

SEQ ID NO: 2571251 - DNA, 21 bp, Homo sapiens
ctgggtgcccaagctcagaag

SEQ ID NO: 2571252 - DNA, 15 bp, Homo sapiens
ctgggtgctggctgc

SEQ ID NO: 2571253 - DNA, 15 bp, Homo sapiens
ctgggtggcactgcc

SEQ ID NO: 2571254 - DNA, 16 bp, Homo sapiens
ctgggtggcactgcca

SEQ ID NO: 2571255 - DNA, 21 bp, Homo sapiens
ctgggtggcactgccatgcag

SEQ ID NO: 2571256 - DNA, 13 bp, Homo sapiens
ctgggtggcctcg

SEQ ID NO: 2571257 - DNA, 15 bp, Homo sapiens
ctgggtgggtggtgg

SEQ ID NO: 2571258 - DNA, 19 bp, Homo sapiens
ctgggtgggtggtggggag

SEQ ID NO: 2571259 - DNA, 20 bp, Homo sapiens
ctgggtgggtggtggggagg

SEQ ID NO: 2571260 - DNA, 19 bp, Homo sapiens
ctgggtggtaccctctgga

SEQ ID NO: 2571261 - DNA, 13 bp, Homo sapiens
ctgggtggtctgc

SEQ ID NO: 2571262 - DNA, 14 bp, Homo sapiens
ctgggtgtggcgca

SEQ ID NO: 2571263 - DNA, 15 bp, Homo sapiens
ctgggttcactgcaa

SEQ ID NO: 2571264 - DNA, 20 bp, Homo sapiens
ctgggttcactgcaacctcc

SEQ ID NO: 2571265 - DNA, 23 bp, Homo sapiens
ctgggttcagaaatgctgcctgc

SEQ ID NO: 2571266 - DNA, 15 bp, Homo sapiens
ctgggttctacccag

SEQ ID NO: 2571267 - DNA, 19 bp, Homo sapiens
ctgggttctacccaggtgc

SEQ ID NO: 2571268 - DNA, 18 bp, Homo sapiens
ctgggtttaaggggagag

SEQ ID NO: 2571269 - DNA, 22 bp, Homo sapiens
ctgggtttattacatggcagtg

SEQ ID NO: 2571270 - DNA, 18 bp, Homo sapiens
ctgggtttggaccccagc

SEQ ID NO: 2571271 - DNA, 20 bp, Homo sapiens
ctgggttttgtattctctga

SEQ ID NO: 2571272 - DNA, 16 bp, Homo sapiens
ctggtaaactatttgt

SEQ ID NO: 2571273 - DNA, 13 bp, Homo sapiens
ctggtacccagcc

SEQ ID NO: 2571274 - DNA, 14 bp, Homo sapiens
ctggtacccagcca

SEQ ID NO: 2571275 - DNA, 21 bp, Homo sapiens
ctggtacccagccatctgccc

SEQ ID NO: 2571276 - DNA, 14 bp, Homo sapiens
ctggtactcaagcc

SEQ ID NO: 2571277 - DNA, 23 bp, Homo sapiens
ctggtagatagaaataaatagct

SEQ ID NO: 2571278 - DNA, 13 bp, Homo sapiens
ctggtagctcagg

SEQ ID NO: 2571279 - DNA, 15 bp, Homo sapiens
ctggtagctcaggtg

SEQ ID NO: 2571280 - DNA, 21 bp, Homo sapiens
ctggtagttagtagcatgttg

SEQ ID NO: 2571281 - DNA, 15 bp, Homo sapiens
ctggtattcctgcct

SEQ ID NO: 2571282 - DNA, 17 bp, Homo sapiens
ctggtattcctgcctcc

SEQ ID NO: 2571283 - DNA, 23 bp, Homo sapiens
ctggtcaaacaaactctctgaac

SEQ ID NO: 2571284 - DNA, 15 bp, Homo sapiens
ctggtcacagcctcc

SEQ ID NO: 2571285 - DNA, 16 bp, Homo sapiens
ctggtcacagcctcct

SEQ ID NO: 2571286 - DNA, 18 bp, Homo sapiens
ctggtcacaggactctgc

SEQ ID NO: 2571287 - DNA, 19 bp, Homo sapiens
ctggtcacaggactctgcc

SEQ ID NO: 2571288 - DNA, 20 bp, Homo sapiens
ctggtcacaggactctgcct

SEQ ID NO: 2571289 - DNA, 22 bp, Homo sapiens
ctggtccaaaagattgctgaaa

SEQ ID NO: 2571290 - DNA, 22 bp, Homo sapiens
ctggtccagggaagctggccga

SEQ ID NO: 2571291 - DNA, 15 bp, Homo sapiens
ctggtccatagagag

SEQ ID NO: 2571292 - DNA, 21 bp, Homo sapiens
ctggtccatagagagcaagac

SEQ ID NO: 2571293 - DNA, 18 bp, Homo sapiens
ctggtcccactcagtcca

SEQ ID NO: 2571294 - DNA, 22 bp, Homo sapiens
ctggtccggacactcctagaga

SEQ ID NO: 2571295 - DNA, 16 bp, Homo sapiens
ctggtccttccaggcc

SEQ ID NO: 2571296 - DNA, 17 bp, Homo sapiens
ctggtccttccaggccc

SEQ ID NO: 2571297 - DNA, 13 bp, Homo sapiens
ctggtctcagcag

SEQ ID NO: 2571298 - DNA, 14 bp, Homo sapiens
ctggtctcagcagc

SEQ ID NO: 2571299 - DNA, 21 bp, Homo sapiens
ctggtctcagcagcgaccacc

SEQ ID NO: 2571300 - DNA, 16 bp, Homo sapiens
ctggtctcctcagcct

SEQ ID NO: 2571301 - DNA, 17 bp, Homo sapiens
ctggtctcctcagcctc

SEQ ID NO: 2571302 - DNA, 12 bp, Homo sapiens
ctggtctctggt

SEQ ID NO: 2571303 - DNA, 20 bp, Homo sapiens
ctggtcttgtggaattggga

SEQ ID NO: 2571304 - DNA, 15 bp, Homo sapiens
ctggtgaagctcact

SEQ ID NO: 2571305 - DNA, 20 bp, Homo sapiens
ctggtgaagctcacttctgg

SEQ ID NO: 2571306 - DNA, 21 bp, Homo sapiens
ctggtgactgcgatcttcaga

SEQ ID NO: 2571307 - DNA, 15 bp, Homo sapiens
ctggtgactttcctc

SEQ ID NO: 2571308 - DNA, 15 bp, Homo sapiens
ctggtgaggccttgc

SEQ ID NO: 2571309 - DNA, 20 bp, Homo sapiens
ctggtgagtcttggcggcag

SEQ ID NO: 2571310 - DNA, 21 bp, Homo sapiens
ctggtgagtcttggcggcagc

SEQ ID NO: 2571311 - DNA, 14 bp, Homo sapiens
ctggtgcattacag

SEQ ID NO: 2571312 - DNA, 20 bp, Homo sapiens
ctggtgccaatttcaagttc

SEQ ID NO: 2571313 - DNA, 14 bp, Homo sapiens
ctggtgccagcctt

SEQ ID NO: 2571314 - DNA, 12 bp, Homo sapiens
ctggtgcctcac

SEQ ID NO: 2571315 - DNA, 22 bp, Homo sapiens
ctggtgctataggctggagaag

SEQ ID NO: 2571316 - DNA, 14 bp, Homo sapiens
ctggtgctgctgct

SEQ ID NO: 2571317 - DNA, 12 bp, Homo sapiens
ctggtgctgtgg

SEQ ID NO: 2571318 - DNA, 16 bp, Homo sapiens
ctggtggacagtcctg

SEQ ID NO: 2571319 - DNA, 19 bp, Homo sapiens
ctggtggacagtcctggga

SEQ ID NO: 2571320 - DNA, 23 bp, Homo sapiens
ctggtggagaaagcactgacctg

SEQ ID NO: 2571321 - DNA, 13 bp, Homo sapiens
ctggtggcagctc

SEQ ID NO: 2571322 - DNA, 16 bp, Homo sapiens
ctggtggcagctcacc

SEQ ID NO: 2571323 - DNA, 18 bp, Homo sapiens
ctggtggcagctcacctc

SEQ ID NO: 2571324 - DNA, 21 bp, Homo sapiens
ctggtggcagctcacctctcc

SEQ ID NO: 2571325 - DNA, 15 bp, Homo sapiens
ctggtggcagctgcg

SEQ ID NO: 2571326 - DNA, 17 bp, Homo sapiens
ctggtgggcctcctctg

SEQ ID NO: 2571327 - DNA, 22 bp, Homo sapiens
ctggtggggtgtgttccaactg

SEQ ID NO: 2571328 - DNA, 21 bp, Homo sapiens
ctggtggtttcacggtgccag

SEQ ID NO: 2571329 - DNA, 15 bp, Homo sapiens
ctggtgtcacttact

SEQ ID NO: 2571330 - DNA, 17 bp, Homo sapiens
ctggtgtcctgaccacc

SEQ ID NO: 2571331 - DNA, 18 bp, Homo sapiens
ctggtgtcctgaccaccc

SEQ ID NO: 2571332 - DNA, 20 bp, Homo sapiens
ctggtgtcctgaccaccctc

SEQ ID NO: 2571333 - DNA, 23 bp, Homo sapiens
ctggtgtctgctttctccattgt

SEQ ID NO: 2571334 - DNA, 17 bp, Homo sapiens
ctggtgtgacctgaggg

SEQ ID NO: 2571335 - DNA, 24 bp, Homo sapiens
ctggtgtttctagcactggcctgc

SEQ ID NO: 2571336 - DNA, 14 bp, Homo sapiens
ctggttagaaatgc

SEQ ID NO: 2571337 - DNA, 23 bp, Homo sapiens
ctggttagaaatgcagaatccta

SEQ ID NO: 2571338 - DNA, 20 bp, Homo sapiens
ctggttcagggttggcccct

SEQ ID NO: 2571339 - DNA, 18 bp, Homo sapiens
ctggttcccgtttctcca

SEQ ID NO: 2571340 - DNA, 15 bp, Homo sapiens
ctggttgctgtgtgg

SEQ ID NO: 2571341 - DNA, 14 bp, Homo sapiens
ctggttgtcatttt

SEQ ID NO: 2571342 - DNA, 20 bp, Homo sapiens
ctggttttgtaagatgctgg

SEQ ID NO: 2571343 - DNA, 19 bp, Homo sapiens
ctgtaaaaaaaaaaaagtt

SEQ ID NO: 2571344 - DNA, 15 bp, Homo sapiens
ctgtaaaaactgtgg

SEQ ID NO: 2571345 - DNA, 23 bp, Homo sapiens
ctgtaaaatatacttaaatggaa

SEQ ID NO: 2571346 - DNA, 22 bp, Homo sapiens
ctgtaaacccctttagtggctt

SEQ ID NO: 2571347 - DNA, 15 bp, Homo sapiens
ctgtaaagaaagaga

SEQ ID NO: 2571348 - DNA, 19 bp, Homo sapiens
ctgtaaagaaagagagaaa

SEQ ID NO: 2571349 - DNA, 22 bp, Homo sapiens
ctgtaaagaaagagagaaaata

SEQ ID NO: 2571350 - DNA, 20 bp, Homo sapiens
ctgtaaagagacctacctca

SEQ ID NO: 2571351 - DNA, 15 bp, Homo sapiens
ctgttaaaagatgaa

SEQ ID NO: 2571352 - DNA, 16 bp, Homo sapiens
ctgttaaaagatgaaa

SEQ ID NO: 2571353 - DNA, 23 bp, Homo sapiens
ctgttaaaagatgaaaatatttg

SEQ ID NO: 2571354 - DNA, 16 bp, Homo sapiens
ctgttaatagttcagg

SEQ ID NO: 2571355 - DNA, 17 bp, Homo sapiens
ctgttactgtcttcagt

SEQ ID NO: 2571356 - DNA, 19 bp, Homo sapiens
ctgttacttacctaaacag

SEQ ID NO: 2571357 - DNA, 21 bp, Homo sapiens
ctgttacttgaaataccagtg

SEQ ID NO: 2571358 - DNA, 13 bp, Homo sapiens
ctgttagtcattt

SEQ ID NO: 2571359 - DNA, 14 bp, Homo sapiens
ctgttagtcatttg

SEQ ID NO: 2571360 - DNA, 15 bp, Homo sapiens
ctgttatataaatgg

SEQ ID NO: 2571361 - DNA, 17 bp, Homo sapiens
ctgttatttctattttt

SEQ ID NO: 2571362 - DNA, 16 bp, Homo sapiens
ctgttcacttttcctc

SEQ ID NO: 2571363 - DNA, 15 bp, Homo sapiens
ctgttcagctccagc

SEQ ID NO: 2571364 - DNA, 22 bp, Homo sapiens
ctgttcagctccagctcaccag

SEQ ID NO: 2571365 - DNA, 16 bp, Homo sapiens
ctgttcagtgtcccgg

SEQ ID NO: 2571366 - DNA, 12 bp, Homo sapiens
ctgttcagttac

SEQ ID NO: 2571367 - DNA, 15 bp, Homo sapiens
ctgttcagttacaga

SEQ ID NO: 2571368 - DNA, 18 bp, Homo sapiens
ctgttcagttacagaaag

SEQ ID NO: 2571369 - DNA, 19 bp, Homo sapiens
ctgttcagttacagaaagt

SEQ ID NO: 2571370 - DNA, 17 bp, Homo sapiens
ctgttccagcctgccct

SEQ ID NO: 2571371 - DNA, 15 bp, Homo sapiens
ctgttccccctgtgc

SEQ ID NO: 2571372 - DNA, 23 bp, Homo sapiens
ctgttcccctagtaagtgccttc

SEQ ID NO: 2571373 - DNA, 16 bp, Homo sapiens
ctgttccttagacctt

SEQ ID NO: 2571374 - DNA, 19 bp, Homo sapiens
ctgttctacatagatgctt

SEQ ID NO: 2571375 - DNA, 20 bp, Homo sapiens
ctgttctacatagatgctta

SEQ ID NO: 2571376 - DNA, 13 bp, Homo sapiens
ctgttctctgccc

SEQ ID NO: 2571377 - DNA, 16 bp, Homo sapiens
ctgttctctgccctcc

SEQ ID NO: 2571378 - DNA, 11 bp, Homo sapiens
ctgttctggaa

SEQ ID NO: 2571379 - DNA, 11 bp, Homo sapiens
ctgttctgtgt

SEQ ID NO: 2571380 - DNA, 13 bp, Homo sapiens
ctgttctgtgtct

SEQ ID NO: 2571381 - DNA, 13 bp, Homo sapiens
ctgttcttggggc

SEQ ID NO: 2571382 - DNA, 16 bp, Homo sapiens
ctgttctttaatttat

SEQ ID NO: 2571383 - DNA, 21 bp, Homo sapiens
ctgttctttccaaagtacact

SEQ ID NO: 2571384 - DNA, 14 bp, Homo sapiens
ctgttctttctggc

SEQ ID NO: 2571385 - DNA, 23 bp, Homo sapiens
ctgttctttctggctatgcattt

SEQ ID NO: 2571386 - DNA, 12 bp, Homo sapiens
ctgttgaaaatt

SEQ ID NO: 2571387 - DNA, 19 bp, Homo sapiens
ctgttgattgctaaatgta

SEQ ID NO: 2571388 - DNA, 22 bp, Homo sapiens
ctgttgattgctaaatgtaaca

SEQ ID NO: 2571389 - DNA, 19 bp, Homo sapiens
ctgttgcaaactcagcctc

SEQ ID NO: 2571390 - DNA, 17 bp, Homo sapiens
ctgttgcacccagccct

SEQ ID NO: 2571391 - DNA, 20 bp, Homo sapiens
ctgttgcacccagccctggt

SEQ ID NO: 2571392 - DNA, 12 bp, Homo sapiens
ctgttgcccagg

SEQ ID NO: 2571393 - DNA, 17 bp, Homo sapiens
ctgttgcccaggctggc

SEQ ID NO: 2571394 - DNA, 18 bp, Homo sapiens
ctgttgcgtaactggctg

SEQ ID NO: 2571395 - DNA, 23 bp, Homo sapiens
ctgttgcgtaactggctgtgttc

SEQ ID NO: 2571396 - DNA, 11 bp, Homo sapiens
ctgttgctcaa

SEQ ID NO: 2571397 - DNA, 21 bp, Homo sapiens
ctgttgctcaaatctattcag

SEQ ID NO: 2571398 - DNA, 22 bp, Homo sapiens
ctgttggacccgctctggacca

SEQ ID NO: 2571399 - DNA, 18 bp, Homo sapiens
ctgttggcactcacagac

SEQ ID NO: 2571400 - DNA, 22 bp, Homo sapiens
ctgttggcactcacagacctgg

SEQ ID NO: 2571401 - DNA, 12 bp, Homo sapiens
ctgttggccagt

SEQ ID NO: 2571402 - DNA, 14 bp, Homo sapiens
ctgttggctggggg

SEQ ID NO: 2571403 - DNA, 19 bp, Homo sapiens
ctgttggctgggggcctca

SEQ ID NO: 2571404 - DNA, 22 bp, Homo sapiens
ctgttggctgggggcctcagtg

SEQ ID NO: 2571405 - DNA, 14 bp, Homo sapiens
ctgttggttccaag

SEQ ID NO: 2571406 - DNA, 17 bp, Homo sapiens
ctgttgtacatttatga

SEQ ID NO: 2571407 - DNA, 18 bp, Homo sapiens
ctgttgtacatttatgat

SEQ ID NO: 2571408 - DNA, 19 bp, Homo sapiens
ctgttgtacatttatgatt

SEQ ID NO: 2571409 - DNA, 22 bp, Homo sapiens
ctgttgtacatttatgatttaa

SEQ ID NO: 2571410 - DNA, 16 bp, Homo sapiens
ctgttgtcctatggga

SEQ ID NO: 2571411 - DNA, 19 bp, Homo sapiens
ctgttgtgacctgaagttc

SEQ ID NO: 2571412 - DNA, 20 bp, Homo sapiens
ctgttgtgacctgaagttca

SEQ ID NO: 2571413 - DNA, 23 bp, Homo sapiens
ctgttgttgttaatgaaaatgtc

SEQ ID NO: 2571414 - DNA, 20 bp, Homo sapiens
ctgttgttttgttttaaata

SEQ ID NO: 2571415 - DNA, 20 bp, Homo sapiens
ctgtttaaatgtttttctat

SEQ ID NO: 2571416 - DNA, 14 bp, Homo sapiens
ctgtttatggcctc

SEQ ID NO: 2571417 - DNA, 19 bp, Homo sapiens
ctgtttatggcctcagctg

SEQ ID NO: 2571418 - DNA, 16 bp, Homo sapiens
ctgtttattttatatt

SEQ ID NO: 2571419 - DNA, 15 bp, Homo sapiens
ctgtttcccagcagt

SEQ ID NO: 2571420 - DNA, 13 bp, Homo sapiens
ctgtttctctgct

SEQ ID NO: 2571421 - DNA, 17 bp, Homo sapiens
ctgtttctgcttgctct

SEQ ID NO: 2571422 - DNA, 23 bp, Homo sapiens
ctgtttggaggagcaaaggctga

SEQ ID NO: 2571423 - DNA, 20 bp, Homo sapiens
ctgtttgggcccctctccca

SEQ ID NO: 2571424 - DNA, 22 bp, Homo sapiens
ctgttttaaatttatttcaaaa

SEQ ID NO: 2571425 - DNA, 14 bp, Homo sapiens
ctgttttatgactt

SEQ ID NO: 2571426 - DNA, 17 bp, Homo sapiens
ctgttttctcttgagag

SEQ ID NO: 2571427 - DNA, 14 bp, Homo sapiens
ctgttttctgtttc

SEQ ID NO: 2571428 - DNA, 12 bp, Homo sapiens
ctgttttcttct

SEQ ID NO: 2571429 - DNA, 18 bp, Homo sapiens
ctgttttcttctattcca

SEQ ID NO: 2571430 - DNA, 17 bp, Homo sapiens
ctgtttttaagctgttt

SEQ ID NO: 2571431 - DNA, 19 bp, Homo sapiens
ctgtttttaagctgtttcc

SEQ ID NO: 2571432 - DNA, 13 bp, Homo sapiens
ctgtttttcacat

SEQ ID NO: 2571433 - DNA, 15 bp, Homo sapiens
ctgtttttcacattt

SEQ ID NO: 2571434 - DNA, 21 bp, Homo sapiens
ctgtttttcagggaggtggct

SEQ ID NO: 2571435 - DNA, 17 bp, Homo sapiens
ctgttttttcctgagct

SEQ ID NO: 2571436 - DNA, 18 bp, Homo sapiens
ctgttttttcctgagctt

SEQ ID NO: 2571437 - DNA, 15 bp, Homo sapiens
cttaaaaaaatgaca

SEQ ID NO: 2571438 - DNA, 17 bp, Homo sapiens
cttaaaaaaatgacaga

SEQ ID NO: 2571439 - DNA, 18 bp, Homo sapiens
cttaaaaaacttgtaaat

SEQ ID NO: 2571440 - DNA, 17 bp, Homo sapiens
cttaaaaatgtaaatat

SEQ ID NO: 2571441 - DNA, 18 bp, Homo sapiens
cttaaaaatgtaaatatt

SEQ ID NO: 2571442 - DNA, 18 bp, Homo sapiens
cttaaaatagaaataagt

SEQ ID NO: 2571443 - DNA, 17 bp, Homo sapiens
cttaaaatatatttcag

SEQ ID NO: 2571444 - DNA, 18 bp, Homo sapiens
cttaaaatattcctgcat

SEQ ID NO: 2571445 - DNA, 20 bp, Homo sapiens
cttaaaatattcctgcattt

SEQ ID NO: 2571446 - DNA, 13 bp, Homo sapiens
cttaaacaaaaat

SEQ ID NO: 2571447 - DNA, 15 bp, Homo sapiens
cttaaaccttcagtt

SEQ ID NO: 2571448 - DNA, 14 bp, Homo sapiens
cttaaactgtgtgg

SEQ ID NO: 2571449 - DNA, 15 bp, Homo sapiens
cttaaactgtgtgga

SEQ ID NO: 2571450 - DNA, 12 bp, Homo sapiens
cttaaagaaagt

SEQ ID NO: 2571451 - DNA, 22 bp, Homo sapiens
cttaaagaaagtcgaattaata

SEQ ID NO: 2571452 - DNA, 23 bp, Homo sapiens
cttaaagctgcctgtagttagga

SEQ ID NO: 2571453 - DNA, 18 bp, Homo sapiens
cttaaaggtgtcttcctc

SEQ ID NO: 2571454 - DNA, 14 bp, Homo sapiens
cttaaagtcagtaa

SEQ ID NO: 2571455 - DNA, 19 bp, Homo sapiens
cttaaataatgtgaaactg

SEQ ID NO: 2571456 - DNA, 21 bp, Homo sapiens
cttaaatgaaagcatgtggca

SEQ ID NO: 2571457 - DNA, 17 bp, Homo sapiens
cttaaattttaatttat

SEQ ID NO: 2571458 - DNA, 13 bp, Homo sapiens
cttaacatattta

SEQ ID NO: 2571459 - DNA, 17 bp, Homo sapiens
cttaacattctgtaaaa

SEQ ID NO: 2571460 - DNA, 16 bp, Homo sapiens
cttaactggagcccca

SEQ ID NO: 2571461 - DNA, 16 bp, Homo sapiens
cttaacttcacatatt

SEQ ID NO: 2571462 - DNA, 17 bp, Homo sapiens
cttaacttcacatattg

SEQ ID NO: 2571463 - DNA, 17 bp, Homo sapiens
cttaagccatcttggta

SEQ ID NO: 2571464 - DNA, 20 bp, Homo sapiens
cttaaggacaaaaatgaact

SEQ ID NO: 2571465 - DNA, 21 bp, Homo sapiens
cttaaggatggagccagctct

SEQ ID NO: 2571466 - DNA, 15 bp, Homo sapiens
cttaaggggcagctt

SEQ ID NO: 2571467 - DNA, 16 bp, Homo sapiens
cttaatagtatttatg

SEQ ID NO: 2571468 - DNA, 14 bp, Homo sapiens
cttaatatgttaac

SEQ ID NO: 2571469 - DNA, 16 bp, Homo sapiens
cttaatctaaatggaa

SEQ ID NO: 2571470 - DNA, 17 bp, Homo sapiens
cttaatcttttcacaaa

SEQ ID NO: 2571471 - DNA, 12 bp, Homo sapiens
cttaatgagata

SEQ ID NO: 2571472 - DNA, 14 bp, Homo sapiens
cttaatgagatagt

SEQ ID NO: 2571473 - DNA, 18 bp, Homo sapiens
cttaatgccactaaattg

SEQ ID NO: 2571474 - DNA, 12 bp, Homo sapiens
cttaatgtttat

SEQ ID NO: 2571475 - DNA, 23 bp, Homo sapiens
cttaatgtttattcctgataata

SEQ ID NO: 2571476 - DNA, 17 bp, Homo sapiens
cttaattaaaagaatat

SEQ ID NO: 2571477 - DNA, 19 bp, Homo sapiens
cttaattaaaagaatattt

SEQ ID NO: 2571478 - DNA, 18 bp, Homo sapiens
cttaattattatttgtgt

SEQ ID NO: 2571479 - DNA, 19 bp, Homo sapiens
cttaattcctttctcatcc

SEQ ID NO: 2571480 - DNA, 20 bp, Homo sapiens
cttaattcttagctcattct

SEQ ID NO: 2571481 - DNA, 11 bp, Homo sapiens
cttaattttgg

SEQ ID NO: 2571482 - DNA, 20 bp, Homo sapiens
cttaattttggttgtattct

SEQ ID NO: 2571483 - DNA, 20 bp, Homo sapiens
cttacaatttttttaatttt

SEQ ID NO: 2571484 - DNA, 19 bp, Homo sapiens
cttacacatctcagaccct

SEQ ID NO: 2571485 - DNA, 14 bp, Homo sapiens
cttacatgcatttg

SEQ ID NO: 2571486 - DNA, 20 bp, Homo sapiens
cttacattttactttttcct

SEQ ID NO: 2571487 - DNA, 14 bp, Homo sapiens
cttacatttttaca

SEQ ID NO: 2571488 - DNA, 13 bp, Homo sapiens
cttaccaggaagc

SEQ ID NO: 2571489 - DNA, 13 bp, Homo sapiens
cttaccattaaag

SEQ ID NO: 2571490 - DNA, 17 bp, Homo sapiens
cttaccctcacctgtca

SEQ ID NO: 2571491 - DNA, 17 bp, Homo sapiens
cttaccctcatgttctt

SEQ ID NO: 2571492 - DNA, 18 bp, Homo sapiens
cttaccctcatgttctta

SEQ ID NO: 2571493 - DNA, 22 bp, Homo sapiens
cttacctaaacagatataaatg

SEQ ID NO: 2571494 - DNA, 13 bp, Homo sapiens
cttacctcggtgc

SEQ ID NO: 2571495 - DNA, 13 bp, Homo sapiens
cttacctcttccg

SEQ ID NO: 2571496 - DNA, 14 bp, Homo sapiens
catgcatgtgcttg

SEQ ID NO: 2571497 - DNA, 14 bp, Homo sapiens
catgcattcataca

SEQ ID NO: 2571498 - DNA, 17 bp, Homo sapiens
catgcattgttgaggtg

SEQ ID NO: 2571499 - DNA, 20 bp, Homo sapiens
catgcattgttgaggtggtc

SEQ ID NO: 2571500 - DNA, 19 bp, Homo sapiens
catgcattttgcagcagtg

SEQ ID NO: 2571501 - DNA, 20 bp, Homo sapiens
catgcattttgcagcagtga

SEQ ID NO: 2571502 - DNA, 21 bp, Homo sapiens
catgccaccatggccagccaa

SEQ ID NO: 2571503 - DNA, 19 bp, Homo sapiens
catgccactacactccagc

SEQ ID NO: 2571504 - DNA, 17 bp, Homo sapiens
catgcccacctgcccat

SEQ ID NO: 2571505 - DNA, 23 bp, Homo sapiens
catgcccccctcaaacctcctct

SEQ ID NO: 2571506 - DNA, 13 bp, Homo sapiens
catgcctgagggt

SEQ ID NO: 2571507 - DNA, 20 bp, Homo sapiens
catgcctgagggtggagact

SEQ ID NO: 2571508 - DNA, 14 bp, Homo sapiens
catgcctggcttcg

SEQ ID NO: 2571509 - DNA, 18 bp, Homo sapiens
catgcctgtccagcctgg

SEQ ID NO: 2571510 - DNA, 23 bp, Homo sapiens
catgcctgtccagcctgggcagc

SEQ ID NO: 2571511 - DNA, 13 bp, Homo sapiens
catgcgcacaagg

SEQ ID NO: 2571512 - DNA, 16 bp, Homo sapiens
catgcggagaacaaat

SEQ ID NO: 2571513 - DNA, 13 bp, Homo sapiens
catgcggcccagc

SEQ ID NO: 2571514 - DNA, 21 bp, Homo sapiens
catgcggcccagcccggctcc

SEQ ID NO: 2571515 - DNA, 14 bp, Homo sapiens
catgctaattatat

SEQ ID NO: 2571516 - DNA, 16 bp, Homo sapiens
catgctatctctgtgt

SEQ ID NO: 2571517 - DNA, 15 bp, Homo sapiens
catgctcagccctga

SEQ ID NO: 2571518 - DNA, 13 bp, Homo sapiens
catgctcctggcc

SEQ ID NO: 2571519 - DNA, 13 bp, Homo sapiens
catgctgaaggga

SEQ ID NO: 2571520 - DNA, 14 bp, Homo sapiens
catgctgccctgtg

SEQ ID NO: 2571521 - DNA, 18 bp, Homo sapiens
catgctgccctgtgagta

SEQ ID NO: 2571522 - DNA, 14 bp, Homo sapiens
catgctgcctccag

SEQ ID NO: 2571523 - DNA, 22 bp, Homo sapiens
catgctggaggtgacatctctt

SEQ ID NO: 2571524 - DNA, 20 bp, Homo sapiens
catgctgggaagacgcctga

SEQ ID NO: 2571525 - DNA, 23 bp, Homo sapiens
catgctgggaagacgcctgagct

SEQ ID NO: 2571526 - DNA, 18 bp, Homo sapiens
catgctgggttctgcaca

SEQ ID NO: 2571527 - DNA, 19 bp, Homo sapiens
catgctgggttctgcacag

SEQ ID NO: 2571528 - DNA, 14 bp, Homo sapiens
catgctgtgtgact

SEQ ID NO: 2571529 - DNA, 17 bp, Homo sapiens
catgctgttgattgcta

SEQ ID NO: 2571530 - DNA, 16 bp, Homo sapiens
catggaactcattcct

SEQ ID NO: 2571531 - DNA, 17 bp, Homo sapiens
catggaactcattcctg

SEQ ID NO: 2571532 - DNA, 21 bp, Homo sapiens
catggaactcattcctgcctg

SEQ ID NO: 2571533 - DNA, 16 bp, Homo sapiens
catggaataacatgta

SEQ ID NO: 2571534 - DNA, 21 bp, Homo sapiens
catggaatgcttgaaaaatgt

SEQ ID NO: 2571535 - DNA, 15 bp, Homo sapiens
catggaatggttata

SEQ ID NO: 2571536 - DNA, 22 bp, Homo sapiens
catggaatggttataaaagtga

SEQ ID NO: 2571537 - DNA, 14 bp, Homo sapiens
catggacacccctt

SEQ ID NO: 2571538 - DNA, 22 bp, Homo sapiens
catggacaccccttatccagga

SEQ ID NO: 2571539 - DNA, 19 bp, Homo sapiens
catggacactccagtgcca

SEQ ID NO: 2571540 - DNA, 18 bp, Homo sapiens
catggacatgatcttctt

SEQ ID NO: 2571541 - DNA, 21 bp, Homo sapiens
catggactctacactgtgaac

SEQ ID NO: 2571542 - DNA, 15 bp, Homo sapiens
catggacttccactg

SEQ ID NO: 2571543 - DNA, 13 bp, Homo sapiens
catggactttgtt

SEQ ID NO: 2571544 - DNA, 13 bp, Homo sapiens
catggagagctgg

SEQ ID NO: 2571545 - DNA, 16 bp, Homo sapiens
catggagccccagccc

SEQ ID NO: 2571546 - DNA, 17 bp, Homo sapiens
catggagccccagcccc

SEQ ID NO: 2571547 - DNA, 12 bp, Homo sapiens
catggatgtttt

SEQ ID NO: 2571548 - DNA, 19 bp, Homo sapiens
catggcaccaaagccacca

SEQ ID NO: 2571549 - DNA, 20 bp, Homo sapiens
catggcaccaaagccaccag

SEQ ID NO: 2571550 - DNA, 22 bp, Homo sapiens
catggcaccttcagactttgct

SEQ ID NO: 2571551 - DNA, 23 bp, Homo sapiens
catggcaccttcagactttgctt

SEQ ID NO: 2571552 - DNA, 18 bp, Homo sapiens
catggcacttgcatctgt

SEQ ID NO: 2571553 - DNA, 19 bp, Homo sapiens
catggcatcacctccacca

SEQ ID NO: 2571554 - DNA, 18 bp, Homo sapiens
catggccaccttttcagc

SEQ ID NO: 2571555 - DNA, 12 bp, Homo sapiens
catggcccctct

SEQ ID NO: 2571556 - DNA, 18 bp, Homo sapiens
catggcccctctgacctg

SEQ ID NO: 2571557 - DNA, 22 bp, Homo sapiens
catggccctcattaatgacact

SEQ ID NO: 2571558 - DNA, 14 bp, Homo sapiens
catggccctcccag

SEQ ID NO: 2571559 - DNA, 12 bp, Homo sapiens
catggccctggg

SEQ ID NO: 2571560 - DNA, 16 bp, Homo sapiens
catggcctatgcacat

SEQ ID NO: 2571561 - DNA, 15 bp, Homo sapiens
catggctccagtctg

SEQ ID NO: 2571562 - DNA, 23 bp, Homo sapiens
catggctgggaactgcagacctg

SEQ ID NO: 2571563 - DNA, 24 bp, Homo sapiens
catggctgggaactgcagacctgt

SEQ ID NO: 2571564 - DNA, 14 bp, Homo sapiens
catggctgtgagga

SEQ ID NO: 2571565 - DNA, 20 bp, Homo sapiens
catggcttaatgtttattcc

SEQ ID NO: 2571566 - DNA, 18 bp, Homo sapiens
catggcttgccacagctc

SEQ ID NO: 2571567 - DNA, 19 bp, Homo sapiens
catgggaagacgaggccct

SEQ ID NO: 2571568 - DNA, 22 bp, Homo sapiens
catgggagccgggtctgcctct

SEQ ID NO: 2571569 - DNA, 17 bp, Homo sapiens
catgggcagagcccaag

SEQ ID NO: 2571570 - DNA, 17 bp, Homo sapiens
catgggcccaggaatgc

SEQ ID NO: 2571571 - DNA, 18 bp, Homo sapiens
catgggcctcctgtgtgt

SEQ ID NO: 2571572 - DNA, 16 bp, Homo sapiens
catgggcttcactgta

SEQ ID NO: 2571573 - DNA, 23 bp, Homo sapiens
catgggcttcactgtataaatag

SEQ ID NO: 2571574 - DNA, 15 bp, Homo sapiens
catggggtgggcctc

SEQ ID NO: 2571575 - DNA, 19 bp, Homo sapiens
catggggttggctgggccc

SEQ ID NO: 2571576 - DNA, 16 bp, Homo sapiens
catggtcggaaaacat

SEQ ID NO: 2571577 - DNA, 19 bp, Homo sapiens
catggtcggaaaacatgct

SEQ ID NO: 2571578 - DNA, 23 bp, Homo sapiens
catggtcggaaaacatgctacac

SEQ ID NO: 2571579 - DNA, 19 bp, Homo sapiens
catggtgaaaatgtactga

SEQ ID NO: 2571580 - DNA, 21 bp, Homo sapiens
catggtgaaaatgtactgaga

SEQ ID NO: 2571581 - DNA, 21 bp, Homo sapiens
catggtgcagttgacagcagg

SEQ ID NO: 2571582 - DNA, 13 bp, Homo sapiens
catggtgtaataa

SEQ ID NO: 2571583 - DNA, 18 bp, Homo sapiens
catggtgtaataagacat

SEQ ID NO: 2571584 - DNA, 12 bp, Homo sapiens
catggtgtctgg

SEQ ID NO: 2571585 - DNA, 18 bp, Homo sapiens
catggtgtgatcgtctga

SEQ ID NO: 2571586 - DNA, 14 bp, Homo sapiens
catgtaaaagagtc

SEQ ID NO: 2571587 - DNA, 21 bp, Homo sapiens
catgtaaacaaaatttagttt

SEQ ID NO: 2571588 - DNA, 15 bp, Homo sapiens
catgtaacagaaagg

SEQ ID NO: 2571589 - DNA, 23 bp, Homo sapiens
catgtaagctgaaaatatggcaa

SEQ ID NO: 2571590 - DNA, 12 bp, Homo sapiens
catgtaataaaa

SEQ ID NO: 2571591 - DNA, 23 bp, Homo sapiens
catgtactgagccttgtaattct

SEQ ID NO: 2571592 - DNA, 22 bp, Homo sapiens
catgtactgtagtttttcttca

SEQ ID NO: 2571593 - DNA, 18 bp, Homo sapiens
catgtaggaagtaggaag

SEQ ID NO: 2571594 - DNA, 21 bp, Homo sapiens
catgtagtatcaaatattaga

SEQ ID NO: 2571595 - DNA, 18 bp, Homo sapiens
catgtatgtcttggacac

SEQ ID NO: 2571596 - DNA, 22 bp, Homo sapiens
catgtatgtcttggacactgta

SEQ ID NO: 2571597 - DNA, 12 bp, Homo sapiens
catgtatgtttt

SEQ ID NO: 2571598 - DNA, 19 bp, Homo sapiens
catgtattggcctggaggt

SEQ ID NO: 2571599 - DNA, 15 bp, Homo sapiens
catgtatttatctct

SEQ ID NO: 2571600 - DNA, 18 bp, Homo sapiens
catgtatttgtttgcata

SEQ ID NO: 2571601 - DNA, 20 bp, Homo sapiens
catgtcaccgtggaccttcc

SEQ ID NO: 2571602 - DNA, 14 bp, Homo sapiens
catgtcactgtggt

SEQ ID NO: 2571603 - DNA, 16 bp, Homo sapiens
catgtcactgtggtcc

SEQ ID NO: 2571604 - DNA, 19 bp, Homo sapiens
catgtccaagaagcccagg

SEQ ID NO: 2571605 - DNA, 20 bp, Homo sapiens
catgtccccaaacctgcaag

SEQ ID NO: 2571606 - DNA, 17 bp, Homo sapiens
catgtccctacacccct

SEQ ID NO: 2571607 - DNA, 22 bp, Homo sapiens
catgtcgcgctcagcatgcatc

SEQ ID NO: 2571608 - DNA, 14 bp, Homo sapiens
catgtcggcctcta

SEQ ID NO: 2571609 - DNA, 14 bp, Homo sapiens
catgtcgtgaccaa

SEQ ID NO: 2571610 - DNA, 16 bp, Homo sapiens
catgtctattcagctt

SEQ ID NO: 2571611 - DNA, 14 bp, Homo sapiens
catgtcttgtacat

SEQ ID NO: 2571612 - DNA, 17 bp, Homo sapiens
catgtgaaaatcaaata

SEQ ID NO: 2571613 - DNA, 19 bp, Homo sapiens
catgtgaaaatcaaataca

SEQ ID NO: 2571614 - DNA, 21 bp, Homo sapiens
catgtgaaaccttttttaaga

SEQ ID NO: 2571615 - DNA, 15 bp, Homo sapiens
catgtgaacccggga

SEQ ID NO: 2571616 - DNA, 21 bp, Homo sapiens
catgtgactcctatgatctca

SEQ ID NO: 2571617 - DNA, 12 bp, Homo sapiens
catgtgactctg

SEQ ID NO: 2571618 - DNA, 16 bp, Homo sapiens
catgtgatccttttat

SEQ ID NO: 2571619 - DNA, 18 bp, Homo sapiens
catgtgatccttttatgt

SEQ ID NO: 2571620 - DNA, 22 bp, Homo sapiens
catgtgccaggtttttggtctg

SEQ ID NO: 2571621 - DNA, 14 bp, Homo sapiens
catgtgcctgatcc

SEQ ID NO: 2571622 - DNA, 18 bp, Homo sapiens
catgtggaaagtgaattt

SEQ ID NO: 2571623 - DNA, 22 bp, Homo sapiens
catgtggaaagtgaatttgaat

SEQ ID NO: 2571624 - DNA, 21 bp, Homo sapiens
catgtggtgggacagggaccc

SEQ ID NO: 2571625 - DNA, 16 bp, Homo sapiens
catgtgtaatcaataa

SEQ ID NO: 2571626 - DNA, 18 bp, Homo sapiens
catgtgtaatcaataaac

SEQ ID NO: 2571627 - DNA, 23 bp, Homo sapiens
catgtgtaatcaataaacgattt

SEQ ID NO: 2571628 - DNA, 17 bp, Homo sapiens
catgtgtgagtgtgtgc

SEQ ID NO: 2571629 - DNA, 19 bp, Homo sapiens
catgtgtgcgagtgtgtgc

SEQ ID NO: 2571630 - DNA, 18 bp, Homo sapiens
catgtgtgctcttcttct

SEQ ID NO: 2571631 - DNA, 21 bp, Homo sapiens
catgtgtgtccacgactgtct

SEQ ID NO: 2571632 - DNA, 23 bp, Homo sapiens
catgtgtgtccacgactgtctcc

SEQ ID NO: 2571633 - DNA, 21 bp, Homo sapiens
catgtgtgtgcaagtgtgtgc

SEQ ID NO: 2571634 - DNA, 16 bp, Homo sapiens
catgttacataagata

SEQ ID NO: 2571635 - DNA, 17 bp, Homo sapiens
catgttacctcctataa

SEQ ID NO: 2571636 - DNA, 14 bp, Homo sapiens
catgttaggaaaat

SEQ ID NO: 2571637 - DNA, 19 bp, Homo sapiens
catgttaggaaaatttcac

SEQ ID NO: 2571638 - DNA, 22 bp, Homo sapiens
catgttatatattttttgtagg

SEQ ID NO: 2571639 - DNA, 13 bp, Homo sapiens
catgttccttcaa

SEQ ID NO: 2571640 - DNA, 15 bp, Homo sapiens
catgttgctgaggag

SEQ ID NO: 2571641 - DNA, 12 bp, Homo sapiens
catgttggccag

SEQ ID NO: 2571642 - DNA, 22 bp, Homo sapiens
catgttggtcaaaagctggatt

SEQ ID NO: 2571643 - DNA, 13 bp, Homo sapiens
catgtttcatgtt

SEQ ID NO: 2571644 - DNA, 12 bp, Homo sapiens
catgttttaaca

SEQ ID NO: 2571645 - DNA, 16 bp, Homo sapiens
catgttttaacaaaaa

SEQ ID NO: 2571646 - DNA, 12 bp, Homo sapiens
tccataatcact

SEQ ID NO: 2571647 - DNA, 23 bp, Homo sapiens
tccataatctggactcctctgtc

SEQ ID NO: 2571648 - DNA, 16 bp, Homo sapiens
tccataatgctactgt

SEQ ID NO: 2571649 - DNA, 17 bp, Homo sapiens
tccataattatgacagt

SEQ ID NO: 2571650 - DNA, 21 bp, Homo sapiens
tccataattatgacagttata

SEQ ID NO: 2571651 - DNA, 13 bp, Homo sapiens
tccatactcagga

SEQ ID NO: 2571652 - DNA, 22 bp, Homo sapiens
tccatagcctaatccctgggca

SEQ ID NO: 2571653 - DNA, 19 bp, Homo sapiens
tccatataaatattagaaa

SEQ ID NO: 2571654 - DNA, 24 bp, Homo sapiens
tccatatgacctcatgcatctcca

SEQ ID NO: 2571655 - DNA, 18 bp, Homo sapiens
tccatcagttagagctga

SEQ ID NO: 2571656 - DNA, 13 bp, Homo sapiens
tccatcatcatgt

SEQ ID NO: 2571657 - DNA, 12 bp, Homo sapiens
tccatcatgtcc

SEQ ID NO: 2571658 - DNA, 15 bp, Homo sapiens
tccatcatgtcccca

SEQ ID NO: 2571659 - DNA, 17 bp, Homo sapiens
tccatctctctggccct

SEQ ID NO: 2571660 - DNA, 14 bp, Homo sapiens
tccatcttcagctt

SEQ ID NO: 2571661 - DNA, 11 bp, Homo sapiens
tccatgaaaac

SEQ ID NO: 2571662 - DNA, 21 bp, Homo sapiens
tccatgaaaacgttttattgt

SEQ ID NO: 2571663 - DNA, 22 bp, Homo sapiens
tccatgaaaacgttttattgtg

SEQ ID NO: 2571664 - DNA, 20 bp, Homo sapiens
tccatgaagaccacatccac

SEQ ID NO: 2571665 - DNA, 23 bp, Homo sapiens
tccatgaagaccacatccacaca

SEQ ID NO: 2571666 - DNA, 13 bp, Homo sapiens
tccatgaagatgt

SEQ ID NO: 2571667 - DNA, 12 bp, Homo sapiens
tccatgaatgta

SEQ ID NO: 2571668 - DNA, 15 bp, Homo sapiens
tccatgaatgtatca

SEQ ID NO: 2571669 - DNA, 21 bp, Homo sapiens
tccatgaatgtatcaggaaat

SEQ ID NO: 2571670 - DNA, 14 bp, Homo sapiens
tccatgatgctggg

SEQ ID NO: 2571671 - DNA, 15 bp, Homo sapiens
tccatgatgctggga

SEQ ID NO: 2571672 - DNA, 14 bp, Homo sapiens
tccatgatggaata

SEQ ID NO: 2571673 - DNA, 12 bp, Homo sapiens
tccatgatggag

SEQ ID NO: 2571674 - DNA, 12 bp, Homo sapiens
tccatgcctgag

SEQ ID NO: 2571675 - DNA, 14 bp, Homo sapiens
tccatgcctgaggg

SEQ ID NO: 2571676 - DNA, 15 bp, Homo sapiens
tccatgcctgagggt

SEQ ID NO: 2571677 - DNA, 18 bp, Homo sapiens
tccatgcgtgtttctgac

SEQ ID NO: 2571678 - DNA, 20 bp, Homo sapiens
tccatgcgtgtttctgactc

SEQ ID NO: 2571679 - DNA, 15 bp, Homo sapiens
tccatgctgcctcca

SEQ ID NO: 2571680 - DNA, 23 bp, Homo sapiens
tccatggaatgcttgaaaaatgt

SEQ ID NO: 2571681 - DNA, 15 bp, Homo sapiens
tccatggactttgtt

SEQ ID NO: 2571682 - DNA, 15 bp, Homo sapiens
tccatggcttcctcc

SEQ ID NO: 2571683 - DNA, 18 bp, Homo sapiens
tccatgggagaaaataga

SEQ ID NO: 2571684 - DNA, 15 bp, Homo sapiens
tccatgggcagagcc

SEQ ID NO: 2571685 - DNA, 16 bp, Homo sapiens
tccatgggcagagccc

SEQ ID NO: 2571686 - DNA, 16 bp, Homo sapiens
tccatgtactgtagtt

SEQ ID NO: 2571687 - DNA, 17 bp, Homo sapiens
tccatgtcgcctctgca

SEQ ID NO: 2571688 - DNA, 21 bp, Homo sapiens
tccatgtcggcctctaacccc

SEQ ID NO: 2571689 - DNA, 19 bp, Homo sapiens
tccatgtgccccctctacc

SEQ ID NO: 2571690 - DNA, 14 bp, Homo sapiens
tccatgtgtgtgca

SEQ ID NO: 2571691 - DNA, 19 bp, Homo sapiens
tccatgttagtttttactt

SEQ ID NO: 2571692 - DNA, 14 bp, Homo sapiens
tccattaggatttg

SEQ ID NO: 2571693 - DNA, 15 bp, Homo sapiens
tccattatcatgtgt

SEQ ID NO: 2571694 - DNA, 12 bp, Homo sapiens
tccattatttat

SEQ ID NO: 2571695 - DNA, 15 bp, Homo sapiens
tccattatttatatt

SEQ ID NO: 2571696 - DNA, 13 bp, Homo sapiens
tccattctggaag

SEQ ID NO: 2571697 - DNA, 16 bp, Homo sapiens
tccattggatctcatt

SEQ ID NO: 2571698 - DNA, 20 bp, Homo sapiens
tccattgtttgaaacaaaga

SEQ ID NO: 2571699 - DNA, 21 bp, Homo sapiens
tccatttcatctatttctgag

SEQ ID NO: 2571700 - DNA, 14 bp, Homo sapiens
tccatttctcatgt

SEQ ID NO: 2571701 - DNA, 17 bp, Homo sapiens
tccatttctcatgtttt

SEQ ID NO: 2571702 - DNA, 20 bp, Homo sapiens
tcccaaaagcccattcattc

SEQ ID NO: 2571703 - DNA, 16 bp, Homo sapiens
tcccaaagtgctggga

SEQ ID NO: 2571704 - DNA, 21 bp, Homo sapiens
tcccaaagtgctgggattaca

SEQ ID NO: 2571705 - DNA, 11 bp, Homo sapiens
tcccaacagga

SEQ ID NO: 2571706 - DNA, 20 bp, Homo sapiens
tcccaacaggaggacaattc

SEQ ID NO: 2571707 - DNA, 22 bp, Homo sapiens
tcccaacaggaggacaattcat

SEQ ID NO: 2571708 - DNA, 16 bp, Homo sapiens
tcccaactcaccccag

SEQ ID NO: 2571709 - DNA, 19 bp, Homo sapiens
tcccaactcaccccagccc

SEQ ID NO: 2571710 - DNA, 14 bp, Homo sapiens
tcccaacttgtaaa

SEQ ID NO: 2571711 - DNA, 13 bp, Homo sapiens
tcccaagctctgc

SEQ ID NO: 2571712 - DNA, 14 bp, Homo sapiens
tcccaagctctgct

SEQ ID NO: 2571713 - DNA, 18 bp, Homo sapiens
tcccaagctgggccccag

SEQ ID NO: 2571714 - DNA, 12 bp, Homo sapiens
tcccaaggaaag

SEQ ID NO: 2571715 - DNA, 18 bp, Homo sapiens
tcccaagggatggtgccc

SEQ ID NO: 2571716 - DNA, 15 bp, Homo sapiens
tcccaagtctacaga

SEQ ID NO: 2571717 - DNA, 16 bp, Homo sapiens
tcccaagtggtgccta

SEQ ID NO: 2571718 - DNA, 18 bp, Homo sapiens
tcccaagttttaggacaa

SEQ ID NO: 2571719 - DNA, 23 bp, Homo sapiens
tcccaagttttaggacaaacagc

SEQ ID NO: 2571720 - DNA, 15 bp, Homo sapiens
tcccaattaggaagt

SEQ ID NO: 2571721 - DNA, 19 bp, Homo sapiens
tcccaattaggaagtgtaa

SEQ ID NO: 2571722 - DNA, 16 bp, Homo sapiens
tcccacaaaggagagc

SEQ ID NO: 2571723 - DNA, 18 bp, Homo sapiens
tcccacaccgtgtaaacc

SEQ ID NO: 2571724 - DNA, 17 bp, Homo sapiens
tcccacacctccacagt

SEQ ID NO: 2571725 - DNA, 19 bp, Homo sapiens
tcccacccaccgccacaat

SEQ ID NO: 2571726 - DNA, 11 bp, Homo sapiens
tcccaccccac

SEQ ID NO: 2571727 - DNA, 22 bp, Homo sapiens
tcccaccccattttctgtgggc

SEQ ID NO: 2571728 - DNA, 18 bp, Homo sapiens
tcccacccccacccccag

SEQ ID NO: 2571729 - DNA, 23 bp, Homo sapiens
tcccacccccacccccagctcaa

SEQ ID NO: 2571730 - DNA, 20 bp, Homo sapiens
tcccacccccatctctccct

SEQ ID NO: 2571731 - DNA, 20 bp, Homo sapiens
tcccacccccttctctgctc

SEQ ID NO: 2571732 - DNA, 21 bp, Homo sapiens
tcccacccccttctctgctcc

SEQ ID NO: 2571733 - DNA, 15 bp, Homo sapiens
tcccacccgatgctg

SEQ ID NO: 2571734 - DNA, 16 bp, Homo sapiens
tcccacccgatgctgc

SEQ ID NO: 2571735 - DNA, 13 bp, Homo sapiens
tcccacctcagcc

SEQ ID NO: 2571736 - DNA, 18 bp, Homo sapiens
tcccacctctctcactcc

SEQ ID NO: 2571737 - DNA, 20 bp, Homo sapiens
tcccacctctctcactcctt

SEQ ID NO: 2571738 - DNA, 21 bp, Homo sapiens
tcccacgaatttgctggggaa

SEQ ID NO: 2571739 - DNA, 17 bp, Homo sapiens
tcccactcaagccaagc

SEQ ID NO: 2571740 - DNA, 18 bp, Homo sapiens
tcccactcaagccaagca

SEQ ID NO: 2571741 - DNA, 20 bp, Homo sapiens
tcccactgcctcaggttcct

SEQ ID NO: 2571742 - DNA, 23 bp, Homo sapiens
tcccactgcctcaggttcctatg

SEQ ID NO: 2571743 - DNA, 23 bp, Homo sapiens
tcccacttggcatcagctggcgt

SEQ ID NO: 2571744 - DNA, 12 bp, Homo sapiens
tcccagaaatta

SEQ ID NO: 2571745 - DNA, 19 bp, Homo sapiens
tcccagaacacactccatc

SEQ ID NO: 2571746 - DNA, 12 bp, Homo sapiens
tcccagaatcaa

SEQ ID NO: 2571747 - DNA, 13 bp, Homo sapiens
tcccagcactttg

SEQ ID NO: 2571748 - DNA, 21 bp, Homo sapiens
tcccagcactttgggaggcca

SEQ ID NO: 2571749 - DNA, 21 bp, Homo sapiens
tcccagcactttgggaggcct

SEQ ID NO: 2571750 - DNA, 22 bp, Homo sapiens
tcccagcactttgggaggccta

SEQ ID NO: 2571751 - DNA, 13 bp, Homo sapiens
tcccagccacccc

SEQ ID NO: 2571752 - DNA, 14 bp, Homo sapiens
tcccagccaccccg

SEQ ID NO: 2571753 - DNA, 22 bp, Homo sapiens
tcccagccactcgggaggctga

SEQ ID NO: 2571754 - DNA, 15 bp, Homo sapiens
tcccagccctatgga

SEQ ID NO: 2571755 - DNA, 13 bp, Homo sapiens
tcccagccttggc

SEQ ID NO: 2571756 - DNA, 22 bp, Homo sapiens
tcccagctactcaagaggctga

SEQ ID NO: 2571757 - DNA, 21 bp, Homo sapiens
tcccagctactcagaagcctg

SEQ ID NO: 2571758 - DNA, 21 bp, Homo sapiens
tcccagctctagacaaccctg

SEQ ID NO: 2571759 - DNA, 20 bp, Homo sapiens
tcccagctgtgctctggaca

SEQ ID NO: 2571760 - DNA, 11 bp, Homo sapiens
tcccaggaact

SEQ ID NO: 2571761 - DNA, 15 bp, Homo sapiens
tcccaggagacagtt

SEQ ID NO: 2571762 - DNA, 22 bp, Homo sapiens
tcccaggagtggaggaggcctg

SEQ ID NO: 2571763 - DNA, 22 bp, Homo sapiens
tcccaggatgagcatcccagga

SEQ ID NO: 2571764 - DNA, 18 bp, Homo sapiens
tcccaggcattccccagg

SEQ ID NO: 2571765 - DNA, 19 bp, Homo sapiens
tcccaggcattccccagga

SEQ ID NO: 2571766 - DNA, 20 bp, Homo sapiens
tcccaggcattccccaggag

SEQ ID NO: 2571767 - DNA, 18 bp, Homo sapiens
tcccaggccagtaaggga

SEQ ID NO: 2571768 - DNA, 15 bp, Homo sapiens
tcccaggctggggct

SEQ ID NO: 2571769 - DNA, 16 bp, Homo sapiens
tcccaggctggggctg

SEQ ID NO: 2571770 - DNA, 20 bp, Homo sapiens
tcccagggccagggccctgc

SEQ ID NO: 2571771 - DNA, 17 bp, Homo sapiens
tcccaggggaccacacc

SEQ ID NO: 2571772 - DNA, 18 bp, Homo sapiens
tcccaggggaccacacct

SEQ ID NO: 2571773 - DNA, 17 bp, Homo sapiens
tcccagtacctcctgtc

SEQ ID NO: 2571774 - DNA, 17 bp, Homo sapiens
tcccagtctacccagag

SEQ ID NO: 2571775 - DNA, 16 bp, Homo sapiens
tcccagtggctgctgc

SEQ ID NO: 2571776 - DNA, 22 bp, Homo sapiens
tcccagtggctgctgcccaggc

SEQ ID NO: 2571777 - DNA, 15 bp, Homo sapiens
tcccagtgggagggg

SEQ ID NO: 2571778 - DNA, 20 bp, Homo sapiens
tcccagtgggaggggcaggc

SEQ ID NO: 2571779 - DNA, 22 bp, Homo sapiens
tcccagtgggaggggcaggctg

SEQ ID NO: 2571780 - DNA, 22 bp, Homo sapiens
tcccataattttcttcatgcaa

SEQ ID NO: 2571781 - DNA, 15 bp, Homo sapiens
tcccataggcccagt

SEQ ID NO: 2571782 - DNA, 14 bp, Homo sapiens
tcccatcaaaactc

SEQ ID NO: 2571783 - DNA, 14 bp, Homo sapiens
tcccatccccctgc

SEQ ID NO: 2571784 - DNA, 15 bp, Homo sapiens
tcccatccccctgcc

SEQ ID NO: 2571785 - DNA, 18 bp, Homo sapiens
tcccatccccctgccctc

SEQ ID NO: 2571786 - DNA, 19 bp, Homo sapiens
tcccatccccctgccctcg

SEQ ID NO: 2571787 - DNA, 15 bp, Homo sapiens
tcccatcccctggac

SEQ ID NO: 2571788 - DNA, 20 bp, Homo sapiens
tcccatcctaccctcgggcc

SEQ ID NO: 2571789 - DNA, 23 bp, Homo sapiens
tcccatctcacacatgagcatca

SEQ ID NO: 2571790 - DNA, 17 bp, Homo sapiens
tcccatctgggagtccc

SEQ ID NO: 2571791 - DNA, 20 bp, Homo sapiens
tccctgcacttgcagactct

SEQ ID NO: 2571792 - DNA, 14 bp, Homo sapiens
tccctgcatttctg

SEQ ID NO: 2571793 - DNA, 16 bp, Homo sapiens
tccctgccaatggact

SEQ ID NO: 2571794 - DNA, 13 bp, Homo sapiens
tccctggaaggtg

SEQ ID NO: 2571795 - DNA, 19 bp, Homo sapiens
tccctggagccagactctg

SEQ ID NO: 2571796 - DNA, 10 bp, Homo sapiens
tccctggagt

SEQ ID NO: 2571797 - DNA, 15 bp, Homo sapiens
tccctggcctttcat

SEQ ID NO: 2571798 - DNA, 24 bp, Homo sapiens
tccctggcctttcatattttagct

SEQ ID NO: 2571799 - DNA, 14 bp, Homo sapiens
tccctggctcccat

SEQ ID NO: 2571800 - DNA, 18 bp, Homo sapiens
tccctggctgccctggcc

SEQ ID NO: 2571801 - DNA, 23 bp, Homo sapiens
tccctggctgccctggccctgag

SEQ ID NO: 2571802 - DNA, 21 bp, Homo sapiens
tccctggtaataagtactgtg

SEQ ID NO: 2571803 - DNA, 19 bp, Homo sapiens
tccctggtcccttggagac

SEQ ID NO: 2571804 - DNA, 16 bp, Homo sapiens
tccctggtggcagctc

SEQ ID NO: 2571805 - DNA, 22 bp, Homo sapiens
tccctggtggcagctcacctct

SEQ ID NO: 2571806 - DNA, 12 bp, Homo sapiens
tccctggttctg

SEQ ID NO: 2571807 - DNA, 17 bp, Homo sapiens
tccctggttctgatgat

SEQ ID NO: 2571808 - DNA, 14 bp, Homo sapiens
tccctgtaacctct

SEQ ID NO: 2571809 - DNA, 23 bp, Homo sapiens
tccctgtaacctcttcagaggcc

SEQ ID NO: 2571810 - DNA, 20 bp, Homo sapiens
tccctgtattttctttctct

SEQ ID NO: 2571811 - DNA, 12 bp, Homo sapiens
tccctgtcccag

SEQ ID NO: 2571812 - DNA, 16 bp, Homo sapiens
tccctgtcggcctggt

SEQ ID NO: 2571813 - DNA, 21 bp, Homo sapiens
tccctgttgacgaagtctctt

SEQ ID NO: 2571814 - DNA, 15 bp, Homo sapiens
tccctgtttaatatt

SEQ ID NO: 2571815 - DNA, 16 bp, Homo sapiens
tccctgtttaatattt

SEQ ID NO: 2571816 - DNA, 21 bp, Homo sapiens
tccctgtttaatatttaaaca

SEQ ID NO: 2571817 - DNA, 19 bp, Homo sapiens
tccctgttttctgagcccg

SEQ ID NO: 2571818 - DNA, 18 bp, Homo sapiens
tcccttcagtaccctctc

SEQ ID NO: 2571819 - DNA, 18 bp, Homo sapiens
tcccttccacacccccac

SEQ ID NO: 2571820 - DNA, 17 bp, Homo sapiens
tcccttcccacctctct

SEQ ID NO: 2571821 - DNA, 17 bp, Homo sapiens
tcccttcccccataagc

SEQ ID NO: 2571822 - DNA, 21 bp, Homo sapiens
tcccttctccatctctctggc

SEQ ID NO: 2571823 - DNA, 21 bp, Homo sapiens
tcccttgaccaggcctgggcc

SEQ ID NO: 2571824 - DNA, 20 bp, Homo sapiens
tcccttggaaacctgccctg

SEQ ID NO: 2571825 - DNA, 13 bp, Homo sapiens
tcccttggcctca

SEQ ID NO: 2571826 - DNA, 17 bp, Homo sapiens
tcccttgggttctgata

SEQ ID NO: 2571827 - DNA, 16 bp, Homo sapiens
tcccttgtgcgtgggt

SEQ ID NO: 2571828 - DNA, 13 bp, Homo sapiens
tcccttgtgtgtg

SEQ ID NO: 2571829 - DNA, 21 bp, Homo sapiens
tccctttcacaaaattttatt

SEQ ID NO: 2571830 - DNA, 18 bp, Homo sapiens
tccctttccttccatccc

SEQ ID NO: 2571831 - DNA, 23 bp, Homo sapiens
tccctttccttccatccctaccc

SEQ ID NO: 2571832 - DNA, 16 bp, Homo sapiens
tccctttgacgccatc

SEQ ID NO: 2571833 - DNA, 22 bp, Homo sapiens
tccctttgacgccatcccagcc

SEQ ID NO: 2571834 - DNA, 23 bp, Homo sapiens
tccctttgacgccatcccagccc

SEQ ID NO: 2571835 - DNA, 15 bp, Homo sapiens
tcccttttgcatcat

SEQ ID NO: 2571836 - DNA, 20 bp, Homo sapiens
tccctttttatatcccattt

SEQ ID NO: 2571837 - DNA, 21 bp, Homo sapiens
tccctttttccttgtccccac

SEQ ID NO: 2571838 - DNA, 20 bp, Homo sapiens
tcccttttttggctgctgaa

SEQ ID NO: 2571839 - DNA, 23 bp, Homo sapiens
tccgaaaaatcctcttcctctga

SEQ ID NO: 2571840 - DNA, 17 bp, Homo sapiens
tccgaacctcctctgtg

SEQ ID NO: 2571841 - DNA, 18 bp, Homo sapiens
tccgaacctcctctgtga

SEQ ID NO: 2571842 - DNA, 22 bp, Homo sapiens
tccgaacctcctctgtgaagca

SEQ ID NO: 2571843 - DNA, 20 bp, Homo sapiens
tccgaccactaattgccaag

SEQ ID NO: 2571844 - DNA, 24 bp, Homo sapiens
tccgagccggggagtttctttcct

SEQ ID NO: 2571845 - DNA, 12 bp, Homo sapiens
tccgaggcaggg

SEQ ID NO: 2571846 - DNA, 15 bp, Homo sapiens
tccgatccttcctcc

SEQ ID NO: 2571847 - DNA, 19 bp, Homo sapiens
tccgccagggcccacaccc

SEQ ID NO: 2571848 - DNA, 20 bp, Homo sapiens
tccgccctgctcctccctgg

SEQ ID NO: 2571849 - DNA, 14 bp, Homo sapiens
tccgctggaggtgg

SEQ ID NO: 2571850 - DNA, 18 bp, Homo sapiens
tccgctttctacccagcg

SEQ ID NO: 2571851 - DNA, 18 bp, Homo sapiens
tccggacactcctagaga

SEQ ID NO: 2571852 - DNA, 15 bp, Homo sapiens
tccggagatgtagca

SEQ ID NO: 2571853 - DNA, 21 bp, Homo sapiens
tccggcctgatgacagagcga

SEQ ID NO: 2571854 - DNA, 17 bp, Homo sapiens
tccggcgtcagcctcca

SEQ ID NO: 2571855 - DNA, 21 bp, Homo sapiens
tccggcgtcagcctccagcct

SEQ ID NO: 2571856 - DNA, 20 bp, Homo sapiens
tccgggtttgagatggacac

SEQ ID NO: 2571857 - DNA, 22 bp, Homo sapiens
tccgggtttgagatggacacac

SEQ ID NO: 2571858 - DNA, 12 bp, Homo sapiens
tccggtgtgcct

SEQ ID NO: 2571859 - DNA, 17 bp, Homo sapiens
tccggtgtgcctgcagc

SEQ ID NO: 2571860 - DNA, 18 bp, Homo sapiens
tccggtgtgcctgcagcc

SEQ ID NO: 2571861 - DNA, 21 bp, Homo sapiens
tccgtagccagctgctcccca

SEQ ID NO: 2571862 - DNA, 15 bp, Homo sapiens
tccgtatttcagact

SEQ ID NO: 2571863 - DNA, 22 bp, Homo sapiens
tccgtctaagtcatgagctgag

SEQ ID NO: 2571864 - DNA, 13 bp, Homo sapiens
tccgttaaaatac

SEQ ID NO: 2571865 - DNA, 22 bp, Homo sapiens
tcctaaaataagggcagagtca

SEQ ID NO: 2571866 - DNA, 23 bp, Homo sapiens
tcctaaaataagggcagagtcac

SEQ ID NO: 2571867 - DNA, 15 bp, Homo sapiens
tcctaaatgcagtga

SEQ ID NO: 2571868 - DNA, 19 bp, Homo sapiens
tcctaaatgcagtgaattg

SEQ ID NO: 2571869 - DNA, 20 bp, Homo sapiens
tcctaagctattcagtaata

SEQ ID NO: 2571870 - DNA, 12 bp, Homo sapiens
tcctaaggacac

SEQ ID NO: 2571871 - DNA, 16 bp, Homo sapiens
tcctaattttgagaaa

SEQ ID NO: 2571872 - DNA, 18 bp, Homo sapiens
tcctacaagagcagcctg

SEQ ID NO: 2571873 - DNA, 19 bp, Homo sapiens
tcctacaagagcagcctgt

SEQ ID NO: 2571874 - DNA, 14 bp, Homo sapiens
tcctaccaatgcat

SEQ ID NO: 2571875 - DNA, 17 bp, Homo sapiens
tcctaccaatgcatgca

SEQ ID NO: 2571876 - DNA, 15 bp, Homo sapiens
tcctacccaaccact

SEQ ID NO: 2571877 - DNA, 15 bp, Homo sapiens
tcctacccacacctc

SEQ ID NO: 2571878 - DNA, 22 bp, Homo sapiens
tcctacccacacctctgccaga

SEQ ID NO: 2571879 - DNA, 18 bp, Homo sapiens
tcctaccccaattccttg

SEQ ID NO: 2571880 - DNA, 21 bp, Homo sapiens
tcctaccccaattccttgtag

SEQ ID NO: 2571881 - DNA, 13 bp, Homo sapiens
tcctacctcagcc

SEQ ID NO: 2571882 - DNA, 21 bp, Homo sapiens
tcctagaaattccccaccctg

SEQ ID NO: 2571883 - DNA, 18 bp, Homo sapiens
tcctagagaacgcagccc

SEQ ID NO: 2571884 - DNA, 18 bp, Homo sapiens
tcctagagacagaagcag

SEQ ID NO: 2571885 - DNA, 18 bp, Homo sapiens
tcctagcacacacttttg

SEQ ID NO: 2571886 - DNA, 19 bp, Homo sapiens
tcctagcacacacttttgg

SEQ ID NO: 2571887 - DNA, 13 bp, Homo sapiens
tcctagccactca

SEQ ID NO: 2571888 - DNA, 20 bp, Homo sapiens
tcctagccttatcctctgat

SEQ ID NO: 2571889 - DNA, 21 bp, Homo sapiens
tcctagccttatcctctgatc

SEQ ID NO: 2571890 - DNA, 17 bp, Homo sapiens
tcctagctgcacagggc

SEQ ID NO: 2571891 - DNA, 19 bp, Homo sapiens
tcctaggcaggacatgctg

SEQ ID NO: 2571892 - DNA, 18 bp, Homo sapiens
tcctagtctccctcacag

SEQ ID NO: 2571893 - DNA, 18 bp, Homo sapiens
tcctatacgcagcgtgct

SEQ ID NO: 2571894 - DNA, 13 bp, Homo sapiens
tcctatatgcact

SEQ ID NO: 2571895 - DNA, 20 bp, Homo sapiens
tcctatggctggccactgca

SEQ ID NO: 2571896 - DNA, 22 bp, Homo sapiens
tcctattcagttcccagaatca

SEQ ID NO: 2571897 - DNA, 14 bp, Homo sapiens
tcctattctcacca

SEQ ID NO: 2571898 - DNA, 17 bp, Homo sapiens
tcctattctcaccagga

SEQ ID NO: 2571899 - DNA, 15 bp, Homo sapiens
tcctattgtgatttg

SEQ ID NO: 2571900 - DNA, 19 bp, Homo sapiens
tcctattgtgatttgactg

SEQ ID NO: 2571901 - DNA, 16 bp, Homo sapiens
tcctatttgttttcat

SEQ ID NO: 2571902 - DNA, 17 bp, Homo sapiens
tcctatttgttttcatg

SEQ ID NO: 2571903 - DNA, 20 bp, Homo sapiens
tcctcaaaacttcagacata

SEQ ID NO: 2571904 - DNA, 23 bp, Homo sapiens
tcctcaactcacctaatgtttat

SEQ ID NO: 2571905 - DNA, 14 bp, Homo sapiens
tcctcaaggggcca

SEQ ID NO: 2571906 - DNA, 21 bp, Homo sapiens
tcctcacctctggactggcta

SEQ ID NO: 2571907 - DNA, 23 bp, Homo sapiens
tcctcacctctggactggctaga

SEQ ID NO: 2571908 - DNA, 14 bp, Homo sapiens
tcctcactcccagt

SEQ ID NO: 2571909 - DNA, 12 bp, Homo sapiens
tcctcactccct

SEQ ID NO: 2571910 - DNA, 17 bp, Homo sapiens
tcctcactcccttccca

SEQ ID NO: 2571911 - DNA, 16 bp, Homo sapiens
tcctcactcccttcta

SEQ ID NO: 2571912 - DNA, 14 bp, Homo sapiens
tcctcactgggtgg

SEQ ID NO: 2571913 - DNA, 15 bp, Homo sapiens
tcctcactgggtggg

SEQ ID NO: 2571914 - DNA, 21 bp, Homo sapiens
tcctcacttccatacagctct

SEQ ID NO: 2571915 - DNA, 22 bp, Homo sapiens
tcctcaggtggccagcctggat

SEQ ID NO: 2571916 - DNA, 22 bp, Homo sapiens
tcctcatacccacccccaccca

SEQ ID NO: 2571917 - DNA, 23 bp, Homo sapiens
tcctcatacccacccccacccaa

SEQ ID NO: 2571918 - DNA, 22 bp, Homo sapiens
tcctcatagtatggtggctggg

SEQ ID NO: 2571919 - DNA, 15 bp, Homo sapiens
tcctcatatggccca

SEQ ID NO: 2571920 - DNA, 16 bp, Homo sapiens
tcctcatccagggctc

SEQ ID NO: 2571921 - DNA, 14 bp, Homo sapiens
tcctcatcccgtgt

SEQ ID NO: 2571922 - DNA, 17 bp, Homo sapiens
tcctccaaaggccccct

SEQ ID NO: 2571923 - DNA, 23 bp, Homo sapiens
tcctccaaaggccccctacgcca

SEQ ID NO: 2571924 - DNA, 17 bp, Homo sapiens
tcctccaagaatctatc

SEQ ID NO: 2571925 - DNA, 20 bp, Homo sapiens
tcctccacctgccgtggact

SEQ ID NO: 2571926 - DNA, 20 bp, Homo sapiens
tcctccagaagcctctggct

SEQ ID NO: 2571927 - DNA, 14 bp, Homo sapiens
tcctccagcttctg

SEQ ID NO: 2571928 - DNA, 20 bp, Homo sapiens
tcctccaggtttttcaatta

SEQ ID NO: 2571929 - DNA, 22 bp, Homo sapiens
tcctccaggtttttcaattaaa

SEQ ID NO: 2571930 - DNA, 16 bp, Homo sapiens
tcctccatactcagga

SEQ ID NO: 2571931 - DNA, 12 bp, Homo sapiens
tcctccatggga

SEQ ID NO: 2571932 - DNA, 17 bp, Homo sapiens
tcctcccaagtggtgcc

SEQ ID NO: 2571933 - DNA, 16 bp, Homo sapiens
tcctcccacctcagcc

SEQ ID NO: 2571934 - DNA, 18 bp, Homo sapiens
tcggggcatgctggggca

SEQ ID NO: 2571935 - DNA, 12 bp, Homo sapiens
tcgtagctttcc

SEQ ID NO: 2571936 - DNA, 17 bp, Homo sapiens
tcgtatagctgtattga

SEQ ID NO: 2571937 - DNA, 21 bp, Homo sapiens
tcgtcatgttggccaggctgg

SEQ ID NO: 2571938 - DNA, 14 bp, Homo sapiens
tcgtcgcacagtct

SEQ ID NO: 2571939 - DNA, 19 bp, Homo sapiens
tcgtcggggggacagctcc

SEQ ID NO: 2571940 - DNA, 14 bp, Homo sapiens
tcgtgaaaccctgt

SEQ ID NO: 2571941 - DNA, 19 bp, Homo sapiens
tcgtgaagtatactgtatt

SEQ ID NO: 2571942 - DNA, 17 bp, Homo sapiens
tcgtgacgctgaataaa

SEQ ID NO: 2571943 - DNA, 21 bp, Homo sapiens
tcgtgacgctgaataaatgtc

SEQ ID NO: 2571944 - DNA, 22 bp, Homo sapiens
tcgtgacgctgaataaatgtct

SEQ ID NO: 2571945 - DNA, 19 bp, Homo sapiens
tcgtggagatgtcttcgta

SEQ ID NO: 2571946 - DNA, 21 bp, Homo sapiens
tcgtggcagataatcagcctc

SEQ ID NO: 2571947 - DNA, 23 bp, Homo sapiens
tcgtggcagataatcagcctctt

SEQ ID NO: 2571948 - DNA, 19 bp, Homo sapiens
tcgtggccttccccagcct

SEQ ID NO: 2571949 - DNA, 14 bp, Homo sapiens
tcgtggtaggactg

SEQ ID NO: 2571950 - DNA, 20 bp, Homo sapiens
tcgtggtaggactgtagaaa

SEQ ID NO: 2571951 - DNA, 14 bp, Homo sapiens
tcgtgtatcctggg

SEQ ID NO: 2571952 - DNA, 15 bp, Homo sapiens
tcgtgtatcctgggg

SEQ ID NO: 2571953 - DNA, 18 bp, Homo sapiens
tcgtgtatcctggggctc

SEQ ID NO: 2571954 - DNA, 22 bp, Homo sapiens
tcgtgtatcctggggctccctt

SEQ ID NO: 2571955 - DNA, 19 bp, Homo sapiens
tcgttagtatctaacatgt

SEQ ID NO: 2571956 - DNA, 15 bp, Homo sapiens
tcgttatgtgtgtat

SEQ ID NO: 2571957 - DNA, 16 bp, Homo sapiens
tcgttgactttaggga

SEQ ID NO: 2571958 - DNA, 19 bp, Homo sapiens
tcgtttattttcaagaata

SEQ ID NO: 2571959 - DNA, 13 bp, Homo sapiens
tcgtttctgtata

SEQ ID NO: 2571960 - DNA, 11 bp, Homo sapiens
tctaaaacaat

SEQ ID NO: 2571961 - DNA, 15 bp, Homo sapiens
tctaaaacaataaaa

SEQ ID NO: 2571962 - DNA, 16 bp, Homo sapiens
tctaaaaggttcaggg

SEQ ID NO: 2571963 - DNA, 14 bp, Homo sapiens
tctaaacattaatc

SEQ ID NO: 2571964 - DNA, 18 bp, Homo sapiens
tctaaaggctacctttgt

SEQ ID NO: 2571965 - DNA, 19 bp, Homo sapiens
tctaaagtgtgttgttgct

SEQ ID NO: 2571966 - DNA, 22 bp, Homo sapiens
tctaaatctccaaaataaaact

SEQ ID NO: 2571967 - DNA, 14 bp, Homo sapiens
tctaaatgcatatc

SEQ ID NO: 2571968 - DNA, 17 bp, Homo sapiens
tctaaccccaggccccg

SEQ ID NO: 2571969 - DNA, 20 bp, Homo sapiens
tctaaccctcccatggcacc

SEQ ID NO: 2571970 - DNA, 21 bp, Homo sapiens
tctaaccctcccatggcacct

SEQ ID NO: 2571971 - DNA, 13 bp, Homo sapiens
tctaacctcatct

SEQ ID NO: 2571972 - DNA, 18 bp, Homo sapiens
tctaacctcatcttcttc

SEQ ID NO: 2571973 - DNA, 19 bp, Homo sapiens
tctaactagaaatctgcca

SEQ ID NO: 2571974 - DNA, 14 bp, Homo sapiens
tctaagcagcattt

SEQ ID NO: 2571975 - DNA, 16 bp, Homo sapiens
tctaagtatttgaaac

SEQ ID NO: 2571976 - DNA, 14 bp, Homo sapiens
tctaatacctctgt

SEQ ID NO: 2571977 - DNA, 17 bp, Homo sapiens
tctaatattaaaaatat

SEQ ID NO: 2571978 - DNA, 14 bp, Homo sapiens
tctaatgtgtgaat

SEQ ID NO: 2571979 - DNA, 20 bp, Homo sapiens
tctaattggaagaaattcct

SEQ ID NO: 2571980 - DNA, 22 bp, Homo sapiens
tctaattggaagaaattcctgt

SEQ ID NO: 2571981 - DNA, 22 bp, Homo sapiens
tctaatttatcttgtctctggg

SEQ ID NO: 2571982 - DNA, 23 bp, Homo sapiens
tctaatttatcttgtctctgggc

SEQ ID NO: 2571983 - DNA, 19 bp, Homo sapiens
tctaatttcaaaaatataa

SEQ ID NO: 2571984 - DNA, 16 bp, Homo sapiens
tctaattttggatgga

SEQ ID NO: 2571985 - DNA, 16 bp, Homo sapiens
tctaatttttaagcaa

SEQ ID NO: 2571986 - DNA, 15 bp, Homo sapiens
tctacactcatctta

SEQ ID NO: 2571987 - DNA, 14 bp, Homo sapiens
tctacactgtgaac

SEQ ID NO: 2571988 - DNA, 12 bp, Homo sapiens
tctacactgtgc

SEQ ID NO: 2571989 - DNA, 15 bp, Homo sapiens
tctacactgtgctga

SEQ ID NO: 2571990 - DNA, 18 bp, Homo sapiens
tctacagagcttccctga

SEQ ID NO: 2571991 - DNA, 16 bp, Homo sapiens
tctacagaggccatgg

SEQ ID NO: 2571992 - DNA, 21 bp, Homo sapiens
tctacagaggccatgggcctc

SEQ ID NO: 2571993 - DNA, 16 bp, Homo sapiens
tctacatactatggaa

SEQ ID NO: 2571994 - DNA, 16 bp, Homo sapiens
tctacatattctttaa

SEQ ID NO: 2571995 - DNA, 15 bp, Homo sapiens
tctacatcttctgcc

SEQ ID NO: 2571996 - DNA, 22 bp, Homo sapiens
tctacatcttttttcacaaatt

SEQ ID NO: 2571997 - DNA, 13 bp, Homo sapiens
tctaccagactgt

SEQ ID NO: 2571998 - DNA, 15 bp, Homo sapiens
tctaccctcccaccc

SEQ ID NO: 2571999 - DNA, 21 bp, Homo sapiens
tctaccctggcactataatgt

SEQ ID NO: 2572000 - DNA, 12 bp, Homo sapiens
tctacctgaggg

SEQ ID NO: 2572001 - DNA, 12 bp, Homo sapiens
tctacctgccac

SEQ ID NO: 2572002 - DNA, 14 bp, Homo sapiens
tctacctgccactc

SEQ ID NO: 2572003 - DNA, 15 bp, Homo sapiens
tctacgctctccttt

SEQ ID NO: 2572004 - DNA, 19 bp, Homo sapiens
tctactaaaaatacaaaaa

SEQ ID NO: 2572005 - DNA, 14 bp, Homo sapiens
tctactcatatata

SEQ ID NO: 2572006 - DNA, 18 bp, Homo sapiens
tctactcatatatatcta

SEQ ID NO: 2572007 - DNA, 17 bp, Homo sapiens
tctactcctacctcagc

SEQ ID NO: 2572008 - DNA, 22 bp, Homo sapiens
tctactcctacctcagcctaga

SEQ ID NO: 2572009 - DNA, 18 bp, Homo sapiens
tctactcttaagccatct

SEQ ID NO: 2572010 - DNA, 19 bp, Homo sapiens
tctactgaggtgctatgtt

SEQ ID NO: 2572011 - DNA, 23 bp, Homo sapiens
tctactggtcttgtggaattggg

SEQ ID NO: 2572012 - DNA, 21 bp, Homo sapiens
tctactttattaattgttttg

SEQ ID NO: 2572013 - DNA, 20 bp, Homo sapiens
tctactttgaagtcatacca

SEQ ID NO: 2572014 - DNA, 20 bp, Homo sapiens
tctagaacatccctgccagc

SEQ ID NO: 2572015 - DNA, 18 bp, Homo sapiens
tctagaacttgaccccct

SEQ ID NO: 2572016 - DNA, 20 bp, Homo sapiens
tctagaagactgtcagcttc

SEQ ID NO: 2572017 - DNA, 21 bp, Homo sapiens
tctagaagactgtcagcttcc

SEQ ID NO: 2572018 - DNA, 14 bp, Homo sapiens
tctagacactgcca

SEQ ID NO: 2572019 - DNA, 24 bp, Homo sapiens
tctagatactgtatcatgacaaag

SEQ ID NO: 2572020 - DNA, 23 bp, Homo sapiens
tctagattaccccctcattgttt

SEQ ID NO: 2572021 - DNA, 15 bp, Homo sapiens
tctagcaaatgttat

SEQ ID NO: 2572022 - DNA, 16 bp, Homo sapiens
tctagcaaatgttatg

SEQ ID NO: 2572023 - DNA, 23 bp, Homo sapiens
tctagccactttggtcccgtgca

SEQ ID NO: 2572024 - DNA, 17 bp, Homo sapiens
tctagctggtggtttca

SEQ ID NO: 2572025 - DNA, 18 bp, Homo sapiens
tctagctgttgagctgtt

SEQ ID NO: 2572026 - DNA, 16 bp, Homo sapiens
tctaggaagactttgg

SEQ ID NO: 2572027 - DNA, 21 bp, Homo sapiens
tctaggaagactttggaaaga

SEQ ID NO: 2572028 - DNA, 13 bp, Homo sapiens
tctagggaaatga

SEQ ID NO: 2572029 - DNA, 17 bp, Homo sapiens
tctagggaaatgaaaga

SEQ ID NO: 2572030 - DNA, 20 bp, Homo sapiens
tctaggtaggggcccacttc

SEQ ID NO: 2572031 - DNA, 23 bp, Homo sapiens
tctaggtgcccttggaggccagc

SEQ ID NO: 2572032 - DNA, 17 bp, Homo sapiens
tctaggtggcaaggctg

SEQ ID NO: 2572033 - DNA, 14 bp, Homo sapiens
tctaggttctaaaa

SEQ ID NO: 2572034 - DNA, 22 bp, Homo sapiens
tctagtctcctttgcactgagg

SEQ ID NO: 2572035 - DNA, 14 bp, Homo sapiens
tctagtgcagctga

SEQ ID NO: 2572036 - DNA, 13 bp, Homo sapiens
tctagtgctgtga

SEQ ID NO: 2572037 - DNA, 15 bp, Homo sapiens
tctagtgctgtgaaa

SEQ ID NO: 2572038 - DNA, 23 bp, Homo sapiens
tctagttgtttgattcagacagc

SEQ ID NO: 2572039 - DNA, 13 bp, Homo sapiens
tctagtttgcatt

SEQ ID NO: 2572040 - DNA, 20 bp, Homo sapiens
tctataatcccagcactttg

SEQ ID NO: 2572041 - DNA, 17 bp, Homo sapiens
tctatagcaccagggct

SEQ ID NO: 2572042 - DNA, 14 bp, Homo sapiens
tctatatataattc

SEQ ID NO: 2572043 - DNA, 21 bp, Homo sapiens
tctatatataattctgtacat

SEQ ID NO: 2572044 - DNA, 23 bp, Homo sapiens
tctatatataattctgtacatag

SEQ ID NO: 2572045 - DNA, 15 bp, Homo sapiens
tctatatatgtgtat

SEQ ID NO: 2572046 - DNA, 14 bp, Homo sapiens
tctatatgaattta

SEQ ID NO: 2572047 - DNA, 15 bp, Homo sapiens
tctatcaagtattat

SEQ ID NO: 2572048 - DNA, 21 bp, Homo sapiens
tctatcaagtattataccttt

SEQ ID NO: 2572049 - DNA, 16 bp, Homo sapiens
tctatcatttttgtac

SEQ ID NO: 2572050 - DNA, 15 bp, Homo sapiens
tctatccacagagag

SEQ ID NO: 2572051 - DNA, 17 bp, Homo sapiens
tctatccacagagagtc

SEQ ID NO: 2572052 - DNA, 14 bp, Homo sapiens
tctatcctctgtaa

SEQ ID NO: 2572053 - DNA, 20 bp, Homo sapiens
tctatcttgctctgtaatct

SEQ ID NO: 2572054 - DNA, 18 bp, Homo sapiens
tctatgaagtatataatg

SEQ ID NO: 2572055 - DNA, 17 bp, Homo sapiens
tctatgacacatgcaag

SEQ ID NO: 2572056 - DNA, 12 bp, Homo sapiens
tctatgagaaaa

SEQ ID NO: 2572057 - DNA, 15 bp, Homo sapiens
tctatgatgctgttg

SEQ ID NO: 2572058 - DNA, 19 bp, Homo sapiens
tctatgggactcaatgcac

SEQ ID NO: 2572059 - DNA, 18 bp, Homo sapiens
tctattaagatttccaag

SEQ ID NO: 2572060 - DNA, 14 bp, Homo sapiens
tctattatactgta

SEQ ID NO: 2572061 - DNA, 15 bp, Homo sapiens
tctattatactgtat

SEQ ID NO: 2572062 - DNA, 22 bp, Homo sapiens
tctattatactgtattaagagt

SEQ ID NO: 2572063 - DNA, 13 bp, Homo sapiens
tctattgaaaaat

SEQ ID NO: 2572064 - DNA, 16 bp, Homo sapiens
tctattgatgtacagt

SEQ ID NO: 2572065 - DNA, 16 bp, Homo sapiens
tctattgggttcatta

SEQ ID NO: 2572066 - DNA, 22 bp, Homo sapiens
tctattgggttcattattggaa

SEQ ID NO: 2572067 - DNA, 12 bp, Homo sapiens
tctattgttact

SEQ ID NO: 2572068 - DNA, 12 bp, Homo sapiens
tctatttaatat

SEQ ID NO: 2572069 - DNA, 13 bp, Homo sapiens
tctatttaatatt

SEQ ID NO: 2572070 - DNA, 15 bp, Homo sapiens
tctatttatttactg

SEQ ID NO: 2572071 - DNA, 17 bp, Homo sapiens
tctatttctatgagaaa

SEQ ID NO: 2572072 - DNA, 14 bp, Homo sapiens
tctatttctcctcc

SEQ ID NO: 2572073 - DNA, 12 bp, Homo sapiens
tctatttctgag

SEQ ID NO: 2572074 - DNA, 13 bp, Homo sapiens
tctatttctgaga

SEQ ID NO: 2572075 - DNA, 20 bp, Homo sapiens
tctatttctgagaaggtcct

SEQ ID NO: 2572076 - DNA, 12 bp, Homo sapiens
tctatttggaat

SEQ ID NO: 2572077 - DNA, 20 bp, Homo sapiens
tctcaaaccaagcaaaggaa

SEQ ID NO: 2572078 - DNA, 19 bp, Homo sapiens
tctcaaacctgtttaaata

SEQ ID NO: 2572079 - DNA, 19 bp, Homo sapiens
catgcagatggggctcccg

SEQ ID NO: 2572080 - DNA, 17 bp, Homo sapiens
catgcagccactgtgct

SEQ ID NO: 2572081 - DNA, 16 bp, Homo sapiens
catgcagcccatgccc

SEQ ID NO: 2572082 - DNA, 22 bp, Homo sapiens
catgcagcccatgcccacctgc

SEQ ID NO: 2572083 - DNA, 15 bp, Homo sapiens
catgcagccgtgatc

SEQ ID NO: 2572084 - DNA, 15 bp, Homo sapiens
catgcatacttcaaa

SEQ ID NO: 2572085 - DNA, 15 bp, Homo sapiens
catgcatctccacct

SEQ ID NO: 2572086 - DNA, 17 bp, Homo sapiens
catgcatctccacctgc

SEQ ID NO: 2572087 - DNA, 18 bp, Homo sapiens
catgcatctccacctgct

SEQ ID NO: 2572088 - DNA, 16 bp, Homo sapiens
catgcatgtcctgtaa

SEQ ID NO: 2572089 - DNA, 17 bp, Homo sapiens
cagtgtttcccataatt

SEQ ID NO: 2572090 - DNA, 21 bp, Homo sapiens
cagtgtttcccataattttct

SEQ ID NO: 2572091 - DNA, 20 bp, Homo sapiens
cagtgtttttgtaaagtgtg

SEQ ID NO: 2572092 - DNA, 15 bp, Homo sapiens
cagttaaaaaaaatt

SEQ ID NO: 2572093 - DNA, 19 bp, Homo sapiens
cagttaaaaaaaattttaa

SEQ ID NO: 2572094 - DNA, 20 bp, Homo sapiens
cagttaactttcagaagaga

SEQ ID NO: 2572095 - DNA, 20 bp, Homo sapiens
cagttactcagaattctcta

SEQ ID NO: 2572096 - DNA, 15 bp, Homo sapiens
cagttagcaaacttt

SEQ ID NO: 2572097 - DNA, 16 bp, Homo sapiens
cagttagcaaactttg

SEQ ID NO: 2572098 - DNA, 19 bp, Homo sapiens
cagttcaatctcccgctgc

SEQ ID NO: 2572099 - DNA, 23 bp, Homo sapiens
cagttcagaatcacttctgagaa

SEQ ID NO: 2572100 - DNA, 20 bp, Homo sapiens
cagttcaggagtcccaagga

SEQ ID NO: 2572101 - DNA, 23 bp, Homo sapiens
cagttcagtaataaactgtgttt

SEQ ID NO: 2572102 - DNA, 16 bp, Homo sapiens
cagttcagtacctgga

SEQ ID NO: 2572103 - DNA, 19 bp, Homo sapiens
cagttcagtacctggagga

SEQ ID NO: 2572104 - DNA, 21 bp, Homo sapiens
cagttcagtacctggaggagg

SEQ ID NO: 2572105 - DNA, 19 bp, Homo sapiens
cagttcagtggcagggctc

SEQ ID NO: 2572106 - DNA, 18 bp, Homo sapiens
cagttcattgcactttga

SEQ ID NO: 2572107 - DNA, 17 bp, Homo sapiens
cagttcccccaacctca

SEQ ID NO: 2572108 - DNA, 19 bp, Homo sapiens
cagttcccccaacctcaga

SEQ ID NO: 2572109 - DNA, 15 bp, Homo sapiens
cagttcctttcaatg

SEQ ID NO: 2572110 - DNA, 17 bp, Homo sapiens
cagttctagtctctctg

SEQ ID NO: 2572111 - DNA, 15 bp, Homo sapiens
cagttctgctcctct

SEQ ID NO: 2572112 - DNA, 17 bp, Homo sapiens
cagttctgggtgctccc

SEQ ID NO: 2572113 - DNA, 17 bp, Homo sapiens
cagttcttcgggaagag

SEQ ID NO: 2572114 - DNA, 19 bp, Homo sapiens
cagttcttcgggaagagag

SEQ ID NO: 2572115 - DNA, 18 bp, Homo sapiens
cagttgaaaagactccaa

SEQ ID NO: 2572116 - DNA, 22 bp, Homo sapiens
cagttgaaaagactccaaagaa

SEQ ID NO: 2572117 - DNA, 20 bp, Homo sapiens
cagttgaatgacaacagaag

SEQ ID NO: 2572118 - DNA, 21 bp, Homo sapiens
cagttgaatgacaacagaagc

SEQ ID NO: 2572119 - DNA, 16 bp, Homo sapiens
cagttgacagcaggtg

SEQ ID NO: 2572120 - DNA, 15 bp, Homo sapiens
cagttgcaataatac

SEQ ID NO: 2572121 - DNA, 16 bp, Homo sapiens
cagttggccagagagc

SEQ ID NO: 2572122 - DNA, 17 bp, Homo sapiens
cagttgggagcactgga

SEQ ID NO: 2572123 - DNA, 18 bp, Homo sapiens
cagttgggagcactggag

SEQ ID NO: 2572124 - DNA, 21 bp, Homo sapiens
cagttgggagcactggagtgc

SEQ ID NO: 2572125 - DNA, 21 bp, Homo sapiens
cagttggtcccccttccatgg

SEQ ID NO: 2572126 - DNA, 15 bp, Homo sapiens
cagttgtagaatgta

SEQ ID NO: 2572127 - DNA, 17 bp, Homo sapiens
cagttgtagaatgtatt

SEQ ID NO: 2572128 - DNA, 13 bp, Homo sapiens
cagtttatcattc

SEQ ID NO: 2572129 - DNA, 14 bp, Homo sapiens
cagtttatcattca

SEQ ID NO: 2572130 - DNA, 15 bp, Homo sapiens
cagtttcaggtgttt

SEQ ID NO: 2572131 - DNA, 18 bp, Homo sapiens
cagtttcttagcttttta

SEQ ID NO: 2572132 - DNA, 16 bp, Homo sapiens
cagtttgagacaggag

SEQ ID NO: 2572133 - DNA, 19 bp, Homo sapiens
cagtttgctgtactagaga

SEQ ID NO: 2572134 - DNA, 16 bp, Homo sapiens
cagtttgtgtgtctta

SEQ ID NO: 2572135 - DNA, 21 bp, Homo sapiens
cagtttgtgtgtcttaattat

SEQ ID NO: 2572136 - DNA, 23 bp, Homo sapiens
cagtttgttagtatgaggcattt

SEQ ID NO: 2572137 - DNA, 16 bp, Homo sapiens
cagttttaactagaat

SEQ ID NO: 2572138 - DNA, 15 bp, Homo sapiens
cagttttactctgct

SEQ ID NO: 2572139 - DNA, 12 bp, Homo sapiens
cagttttccatg

SEQ ID NO: 2572140 - DNA, 13 bp, Homo sapiens
cagttttccatga

SEQ ID NO: 2572141 - DNA, 15 bp, Homo sapiens
cagttttccatgaaa

SEQ ID NO: 2572142 - DNA, 13 bp, Homo sapiens
cagttttccttct

SEQ ID NO: 2572143 - DNA, 22 bp, Homo sapiens
cagttttccttctcatctgtga

SEQ ID NO: 2572144 - DNA, 19 bp, Homo sapiens
cataaaataaagtatatat

SEQ ID NO: 2572145 - DNA, 22 bp, Homo sapiens
cataaaattttctactcttttt

SEQ ID NO: 2572146 - DNA, 20 bp, Homo sapiens
cataaaccttaagtaagcaa

SEQ ID NO: 2572147 - DNA, 13 bp, Homo sapiens
cataaactgactt

SEQ ID NO: 2572148 - DNA, 15 bp, Homo sapiens
cataaactgacttta

SEQ ID NO: 2572149 - DNA, 17 bp, Homo sapiens
cataaactgactttatc

SEQ ID NO: 2572150 - DNA, 12 bp, Homo sapiens
cataaacttcat

SEQ ID NO: 2572151 - DNA, 11 bp, Homo sapiens
cataaagaagc

SEQ ID NO: 2572152 - DNA, 12 bp, Homo sapiens
cataaagaagca

SEQ ID NO: 2572153 - DNA, 20 bp, Homo sapiens
cataaaggtggtatgtgtgt

SEQ ID NO: 2572154 - DNA, 22 bp, Homo sapiens
cataaaggtggtatgtgtgtgt

SEQ ID NO: 2572155 - DNA, 12 bp, Homo sapiens
cataaatatgca

SEQ ID NO: 2572156 - DNA, 13 bp, Homo sapiens
cataaatgaagca

SEQ ID NO: 2572157 - DNA, 13 bp, Homo sapiens
cataaatgaattt

SEQ ID NO: 2572158 - DNA, 15 bp, Homo sapiens
cataacaattcctct

SEQ ID NO: 2572159 - DNA, 17 bp, Homo sapiens
cataacgtttttccttt

SEQ ID NO: 2572160 - DNA, 21 bp, Homo sapiens
cataacgtttttcctttaaaa

SEQ ID NO: 2572161 - DNA, 19 bp, Homo sapiens
cataagaaaactaagaaat

SEQ ID NO: 2572162 - DNA, 12 bp, Homo sapiens
cataagaatgaa

SEQ ID NO: 2572163 - DNA, 18 bp, Homo sapiens
cataatctgtacaatgaa

SEQ ID NO: 2572164 - DNA, 13 bp, Homo sapiens
cataatcttctgc

SEQ ID NO: 2572165 - DNA, 21 bp, Homo sapiens
cataatgcgtgcataccactt

SEQ ID NO: 2572166 - DNA, 15 bp, Homo sapiens
cataatgctactgtc

SEQ ID NO: 2572167 - DNA, 15 bp, Homo sapiens
cataatgtataaaga

SEQ ID NO: 2572168 - DNA, 14 bp, Homo sapiens
cataatgtattgtt

SEQ ID NO: 2572169 - DNA, 12 bp, Homo sapiens
cataatgtgaag

SEQ ID NO: 2572170 - DNA, 13 bp, Homo sapiens
cataatgtgaagt

SEQ ID NO: 2572171 - DNA, 15 bp, Homo sapiens
cataatgtgaagtgt

SEQ ID NO: 2572172 - DNA, 15 bp, Homo sapiens
cataattatgacagt

SEQ ID NO: 2572173 - DNA, 17 bp, Homo sapiens
cataattatgacagtta

SEQ ID NO: 2572174 - DNA, 17 bp, Homo sapiens
cataattcttgtatatt

SEQ ID NO: 2572175 - DNA, 15 bp, Homo sapiens
cataatttgtacata

SEQ ID NO: 2572176 - DNA, 13 bp, Homo sapiens
catacaaggccca

SEQ ID NO: 2572177 - DNA, 15 bp, Homo sapiens
catacacacacacac

SEQ ID NO: 2572178 - DNA, 23 bp, Homo sapiens
catacacacacacacacagccac

SEQ ID NO: 2572179 - DNA, 18 bp, Homo sapiens
catacagcattacaaatt

SEQ ID NO: 2572180 - DNA, 23 bp, Homo sapiens
catacaggaaggtagaaatatct

SEQ ID NO: 2572181 - DNA, 21 bp, Homo sapiens
catacatttataatgtttgct

SEQ ID NO: 2572182 - DNA, 23 bp, Homo sapiens
catacatttataatgtttgctat

SEQ ID NO: 2572183 - DNA, 14 bp, Homo sapiens
cataccaatgaaaa

SEQ ID NO: 2572184 - DNA, 12 bp, Homo sapiens
catacccacccc

SEQ ID NO: 2572185 - DNA, 17 bp, Homo sapiens
catacccacccccaccc

SEQ ID NO: 2572186 - DNA, 18 bp, Homo sapiens
catacgcaccacatctct

SEQ ID NO: 2572187 - DNA, 15 bp, Homo sapiens
catacgtacacattt

SEQ ID NO: 2572188 - DNA, 16 bp, Homo sapiens
catacgtacacatttt

SEQ ID NO: 2572189 - DNA, 17 bp, Homo sapiens
catacgtacacatttta

SEQ ID NO: 2572190 - DNA, 11 bp, Homo sapiens
catactctgct

SEQ ID NO: 2572191 - DNA, 15 bp, Homo sapiens
catactggcctggac

SEQ ID NO: 2572192 - DNA, 18 bp, Homo sapiens
catactggcctggactgt

SEQ ID NO: 2572193 - DNA, 18 bp, Homo sapiens
catactgtgctggagcca

SEQ ID NO: 2572194 - DNA, 20 bp, Homo sapiens
catacttatctctctgtgct

SEQ ID NO: 2572195 - DNA, 16 bp, Homo sapiens
catacttcaaaagtat

SEQ ID NO: 2572196 - DNA, 17 bp, Homo sapiens
catacttcaaaagtatt

SEQ ID NO: 2572197 - DNA, 22 bp, Homo sapiens
catactttcatcctgactctgc

SEQ ID NO: 2572198 - DNA, 19 bp, Homo sapiens
catagagagggagaagaag

SEQ ID NO: 2572199 - DNA, 22 bp, Homo sapiens
catagagagggagaagaagtca

SEQ ID NO: 2572200 - DNA, 17 bp, Homo sapiens
catagagatcatccttt

SEQ ID NO: 2572201 - DNA, 17 bp, Homo sapiens
catagaggtgagggaag

SEQ ID NO: 2572202 - DNA, 21 bp, Homo sapiens
catagaggtgagggaagcctg

SEQ ID NO: 2572203 - DNA, 15 bp, Homo sapiens
catagagtttaacac

SEQ ID NO: 2572204 - DNA, 18 bp, Homo sapiens
catagattccctgagcag

SEQ ID NO: 2572205 - DNA, 15 bp, Homo sapiens
catagcaagacacat

SEQ ID NO: 2572206 - DNA, 19 bp, Homo sapiens
catagcagagaatgaaagg

SEQ ID NO: 2572207 - DNA, 15 bp, Homo sapiens
catagccaggaaact

SEQ ID NO: 2572208 - DNA, 20 bp, Homo sapiens
catagctatcaagtgtgctt

SEQ ID NO: 2572209 - DNA, 18 bp, Homo sapiens
catagctccttctctctt

SEQ ID NO: 2572210 - DNA, 13 bp, Homo sapiens
catagcttccatg

SEQ ID NO: 2572211 - DNA, 15 bp, Homo sapiens
cataggcctgggtgc

SEQ ID NO: 2572212 - DNA, 16 bp, Homo sapiens
cataggtatttcaaaa

SEQ ID NO: 2572213 - DNA, 15 bp, Homo sapiens
cataggtcactggct

SEQ ID NO: 2572214 - DNA, 16 bp, Homo sapiens
cataggtcactggctc

SEQ ID NO: 2572215 - DNA, 18 bp, Homo sapiens
cataggtcactggctctc

SEQ ID NO: 2572216 - DNA, 18 bp, Homo sapiens
catagtaccaatcatttt

SEQ ID NO: 2572217 - DNA, 21 bp, Homo sapiens
catagtactctttgtagcaaa

SEQ ID NO: 2572218 - DNA, 20 bp, Homo sapiens
catataacttatattgtaag

SEQ ID NO: 2572219 - DNA, 21 bp, Homo sapiens
catataagtttgaaggaaaca

SEQ ID NO: 2572220 - DNA, 24 bp, Homo sapiens
catataagtttgaaggaaacagtt

SEQ ID NO: 2572221 - DNA, 23 bp, Homo sapiens
catatcaaaaagtattaaaacta

SEQ ID NO: 2572222 - DNA, 16 bp, Homo sapiens
catatccaccacctcc

SEQ ID NO: 2572223 - DNA, 18 bp, Homo sapiens
catatcccctatttaaca

SEQ ID NO: 2572224 - DNA, 14 bp, Homo sapiens
catatcctgagcca

SEQ ID NO: 2572225 - DNA, 18 bp, Homo sapiens
catatgaaaatacaactt

SEQ ID NO: 2572226 - DNA, 14 bp, Homo sapiens
catatgagtgtgga

SEQ ID NO: 2572227 - DNA, 15 bp, Homo sapiens
catatggactctgca

SEQ ID NO: 2572228 - DNA, 20 bp, Homo sapiens
catatggattttctattgtt

SEQ ID NO: 2572229 - DNA, 23 bp, Homo sapiens
catatggattttctattgttact

SEQ ID NO: 2572230 - DNA, 15 bp, Homo sapiens
catatggcccagtgt

SEQ ID NO: 2572231 - DNA, 16 bp, Homo sapiens
catatggcccagtgtc

SEQ ID NO: 2572232 - DNA, 20 bp, Homo sapiens
catatggcccagtgtcaagt

SEQ ID NO: 2572233 - DNA, 17 bp, Homo sapiens
catatgtgaatatggac

SEQ ID NO: 2572234 - DNA, 23 bp, Homo sapiens
tagataacaagacctcagtgcct

SEQ ID NO: 2572235 - DNA, 16 bp, Homo sapiens
tagatcacgagatcaa

SEQ ID NO: 2572236 - DNA, 18 bp, Homo sapiens
tagatccacacacagagg

SEQ ID NO: 2572237 - DNA, 15 bp, Homo sapiens
tagatcccccagact

SEQ ID NO: 2572238 - DNA, 21 bp, Homo sapiens
tagatgagattgttttatcat

SEQ ID NO: 2572239 - DNA, 10 bp, Homo sapiens
tagatgctga

SEQ ID NO: 2572240 - DNA, 17 bp, Homo sapiens
tagatgggaatgaagct

SEQ ID NO: 2572241 - DNA, 18 bp, Homo sapiens
tagatgggaatgaagctt

SEQ ID NO: 2572242 - DNA, 19 bp, Homo sapiens
tagatgggaatgaagcttg

SEQ ID NO: 2572243 - DNA, 23 bp, Homo sapiens
tagatgggaatgaagcttgtgta

SEQ ID NO: 2572244 - DNA, 15 bp, Homo sapiens
tagatggtgaaattt

SEQ ID NO: 2572245 - DNA, 19 bp, Homo sapiens
tagatggtttgagcctgag

SEQ ID NO: 2572246 - DNA, 20 bp, Homo sapiens
tagatgtagataaactcaga

SEQ ID NO: 2572247 - DNA, 12 bp, Homo sapiens
tagatgtatata

SEQ ID NO: 2572248 - DNA, 22 bp, Homo sapiens
tagatgtgcatttttgtgaaat

SEQ ID NO: 2572249 - DNA, 21 bp, Homo sapiens
tagatgttctaagtctttcca

SEQ ID NO: 2572250 - DNA, 18 bp, Homo sapiens
tagattaagagatgggtt

SEQ ID NO: 2572251 - DNA, 20 bp, Homo sapiens
tagattagatcttttaagcc

SEQ ID NO: 2572252 - DNA, 15 bp, Homo sapiens
tagattagctctgga

SEQ ID NO: 2572253 - DNA, 21 bp, Homo sapiens
tagattgaaaacttttctcag

SEQ ID NO: 2572254 - DNA, 23 bp, Homo sapiens
tagattgaaaacttttctcagat

SEQ ID NO: 2572255 - DNA, 14 bp, Homo sapiens
tagatttatttcat

SEQ ID NO: 2572256 - DNA, 15 bp, Homo sapiens
tagattttctttaaa

SEQ ID NO: 2572257 - DNA, 12 bp, Homo sapiens
tagcaaacagag

SEQ ID NO: 2572258 - DNA, 17 bp, Homo sapiens
tagcaagacacatccct

SEQ ID NO: 2572259 - DNA, 24 bp, Homo sapiens
tagcaagattgcttaaaatagcaa

SEQ ID NO: 2572260 - DNA, 18 bp, Homo sapiens
tagcacagaccctgccct

SEQ ID NO: 2572261 - DNA, 13 bp, Homo sapiens
tagcaccagggct

SEQ ID NO: 2572262 - DNA, 15 bp, Homo sapiens
tagcactggcctgca

SEQ ID NO: 2572263 - DNA, 19 bp, Homo sapiens
tagcagagaatgaaagggc

SEQ ID NO: 2572264 - DNA, 19 bp, Homo sapiens
tagcaggagaggagagcca

SEQ ID NO: 2572265 - DNA, 21 bp, Homo sapiens
tagcaggagaggagagccaga

SEQ ID NO: 2572266 - DNA, 22 bp, Homo sapiens
tagcaggagaggagagccagag

SEQ ID NO: 2572267 - DNA, 20 bp, Homo sapiens
tagcagggcatggctgggaa

SEQ ID NO: 2572268 - DNA, 17 bp, Homo sapiens
tagcatacgtacacatt

SEQ ID NO: 2572269 - DNA, 13 bp, Homo sapiens
tagcatcttctgg

SEQ ID NO: 2572270 - DNA, 23 bp, Homo sapiens
tagcatcttctggagtctccagt

SEQ ID NO: 2572271 - DNA, 21 bp, Homo sapiens
tagcatgtgtttggttctggg

SEQ ID NO: 2572272 - DNA, 17 bp, Homo sapiens
tagcatgtttgctgaac

SEQ ID NO: 2572273 - DNA, 20 bp, Homo sapiens
tagcattgtgaactgacagg

SEQ ID NO: 2572274 - DNA, 16 bp, Homo sapiens
tagccaaacccttgtc

SEQ ID NO: 2572275 - DNA, 23 bp, Homo sapiens
tagccaaggtgggctgagccctg

SEQ ID NO: 2572276 - DNA, 18 bp, Homo sapiens
tagccaatatttttctta

SEQ ID NO: 2572277 - DNA, 19 bp, Homo sapiens
tagccacatccctttgaaa

SEQ ID NO: 2572278 - DNA, 14 bp, Homo sapiens
tagccaccaactct

SEQ ID NO: 2572279 - DNA, 22 bp, Homo sapiens
tagccaccaactcttgcaggtc

SEQ ID NO: 2572280 - DNA, 13 bp, Homo sapiens
tagccactcagga

SEQ ID NO: 2572281 - DNA, 23 bp, Homo sapiens
tagccacttaccttcaataaagt

SEQ ID NO: 2572282 - DNA, 21 bp, Homo sapiens
tagccactttggtcccgtgca

SEQ ID NO: 2572283 - DNA, 22 bp, Homo sapiens
tagccaggatcatggtgtaata

SEQ ID NO: 2572284 - DNA, 14 bp, Homo sapiens
tagcccaaaaccaa

SEQ ID NO: 2572285 - DNA, 18 bp, Homo sapiens
tagcccaatgaaatgaat

SEQ ID NO: 2572286 - DNA, 19 bp, Homo sapiens
tagcccaggtcctctgata

SEQ ID NO: 2572287 - DNA, 13 bp, Homo sapiens
tagccccataatt

SEQ ID NO: 2572288 - DNA, 18 bp, Homo sapiens
tagcccccacccacttcc

SEQ ID NO: 2572289 - DNA, 19 bp, Homo sapiens
tagcccccaggctgctgga

SEQ ID NO: 2572290 - DNA, 15 bp, Homo sapiens
tagcccgaatacaaa

SEQ ID NO: 2572291 - DNA, 12 bp, Homo sapiens
tagcccgcctgc

SEQ ID NO: 2572292 - DNA, 15 bp, Homo sapiens
tagcccgcctgccag

SEQ ID NO: 2572293 - DNA, 14 bp, Homo sapiens
tagccctttctgtg

SEQ ID NO: 2572294 - DNA, 14 bp, Homo sapiens
tagccgacctcagc

SEQ ID NO: 2572295 - DNA, 16 bp, Homo sapiens
tagccgacctcagcct

SEQ ID NO: 2572296 - DNA, 19 bp, Homo sapiens
tagcctccttcgcaggcat

SEQ ID NO: 2572297 - DNA, 22 bp, Homo sapiens
tagtcccttcccctccctggct

SEQ ID NO: 2572298 - DNA, 21 bp, Homo sapiens
tagtctactcttaagccatct

SEQ ID NO: 2572299 - DNA, 21 bp, Homo sapiens
tagtctcctttgcactgaggg

SEQ ID NO: 2572300 - DNA, 12 bp, Homo sapiens
tagtctggtttc

SEQ ID NO: 2572301 - DNA, 14 bp, Homo sapiens
tagtgatcacagca

SEQ ID NO: 2572302 - DNA, 18 bp, Homo sapiens
tagtgatctgaacagaaa

SEQ ID NO: 2572303 - DNA, 12 bp, Homo sapiens
tagtgcagctga

SEQ ID NO: 2572304 - DNA, 14 bp, Homo sapiens
tagtgcagctgatt

SEQ ID NO: 2572305 - DNA, 19 bp, Homo sapiens
tagtgcagctgattttaac

SEQ ID NO: 2572306 - DNA, 20 bp, Homo sapiens
tagtgcagctgattttaaca

SEQ ID NO: 2572307 - DNA, 22 bp, Homo sapiens
tagtgcctgagagtatttaggc

SEQ ID NO: 2572308 - DNA, 14 bp, Homo sapiens
tagtgcggacaagt

SEQ ID NO: 2572309 - DNA, 21 bp, Homo sapiens
tagtgcttaaaaatcattgat

SEQ ID NO: 2572310 - DNA, 23 bp, Homo sapiens
tagtgctttccttttttaaaaat

SEQ ID NO: 2572311 - DNA, 17 bp, Homo sapiens
tagtggattactgccat

SEQ ID NO: 2572312 - DNA, 23 bp, Homo sapiens
tagtggattactgccattcactt

SEQ ID NO: 2572313 - DNA, 20 bp, Homo sapiens
tagtggcttaaaacaacact

SEQ ID NO: 2572314 - DNA, 19 bp, Homo sapiens
tagtggtctttgtaagagt

SEQ ID NO: 2572315 - DNA, 13 bp, Homo sapiens
tagtgtaaaataa

SEQ ID NO: 2572316 - DNA, 18 bp, Homo sapiens
tagtgtggaaattaagaa

SEQ ID NO: 2572317 - DNA, 20 bp, Homo sapiens
tagtgtgttctgattagaaa

SEQ ID NO: 2572318 - DNA, 15 bp, Homo sapiens
tagtgtttctgtgca

SEQ ID NO: 2572319 - DNA, 17 bp, Homo sapiens
tagtgtttctgtgcatg

SEQ ID NO: 2572320 - DNA, 20 bp, Homo sapiens
tagtgtttgggtatattcat

SEQ ID NO: 2572321 - DNA, 17 bp, Homo sapiens
tagttactgttgtgacc

SEQ ID NO: 2572322 - DNA, 15 bp, Homo sapiens
tagttaggatagcat

SEQ ID NO: 2572323 - DNA, 18 bp, Homo sapiens
tagttcaggtaacaggca

SEQ ID NO: 2572324 - DNA, 20 bp, Homo sapiens
tagttctcactgttccctct

SEQ ID NO: 2572325 - DNA, 17 bp, Homo sapiens
tagttgagccccaagtc

SEQ ID NO: 2572326 - DNA, 16 bp, Homo sapiens
tagttgcaattgaatt

SEQ ID NO: 2572327 - DNA, 21 bp, Homo sapiens
tagttgtaccgcaatgtgact

SEQ ID NO: 2572328 - DNA, 18 bp, Homo sapiens
tagttgtgaccttagtgt

SEQ ID NO: 2572329 - DNA, 17 bp, Homo sapiens
tagttgtgggtgggaga

SEQ ID NO: 2572330 - DNA, 20 bp, Homo sapiens
tagttgtttgattcagacag

SEQ ID NO: 2572331 - DNA, 21 bp, Homo sapiens
tagttgtttgattcagacagc

SEQ ID NO: 2572332 - DNA, 14 bp, Homo sapiens
tagtttctgttctg

SEQ ID NO: 2572333 - DNA, 13 bp, Homo sapiens
tagtttggttcac

SEQ ID NO: 2572334 - DNA, 17 bp, Homo sapiens
tagtttgtacatgcatt

SEQ ID NO: 2572335 - DNA, 20 bp, Homo sapiens
tagttttacttttaaactgt

SEQ ID NO: 2572336 - DNA, 14 bp, Homo sapiens
tagttttagttgca

SEQ ID NO: 2572337 - DNA, 16 bp, Homo sapiens
tagttttagttgcaga

SEQ ID NO: 2572338 - DNA, 17 bp, Homo sapiens
tagttttagttgcagaa

SEQ ID NO: 2572339 - DNA, 17 bp, Homo sapiens
tagtttttgtaatttat

SEQ ID NO: 2572340 - DNA, 15 bp, Homo sapiens
tagtttttgttctta

SEQ ID NO: 2572341 - DNA, 21 bp, Homo sapiens
tagtttttgttcttaattgca

SEQ ID NO: 2572342 - DNA, 11 bp, Homo sapiens
tataaaaacaa

SEQ ID NO: 2572343 - DNA, 20 bp, Homo sapiens
tataaaaggcaaatgtgtac

SEQ ID NO: 2572344 - DNA, 17 bp, Homo sapiens
tataaacatcacacaca

SEQ ID NO: 2572345 - DNA, 11 bp, Homo sapiens
tataaacttta

SEQ ID NO: 2572346 - DNA, 13 bp, Homo sapiens
tataaactttaga

SEQ ID NO: 2572347 - DNA, 15 bp, Homo sapiens
tataaagaacaaggt

SEQ ID NO: 2572348 - DNA, 15 bp, Homo sapiens
tataaagtaaagcta

SEQ ID NO: 2572349 - DNA, 15 bp, Homo sapiens
tataaatatatttaa

SEQ ID NO: 2572350 - DNA, 19 bp, Homo sapiens
tataaatcgcttttgataa

SEQ ID NO: 2572351 - DNA, 14 bp, Homo sapiens
tataaatgctattt

SEQ ID NO: 2572352 - DNA, 14 bp, Homo sapiens
tataaattatgttt

SEQ ID NO: 2572353 - DNA, 22 bp, Homo sapiens
tataaattatgtttatataaat

SEQ ID NO: 2572354 - DNA, 22 bp, Homo sapiens
tataaatttatttactgctagt

SEQ ID NO: 2572355 - DNA, 21 bp, Homo sapiens
tataaattttttttgtttcat

SEQ ID NO: 2572356 - DNA, 12 bp, Homo sapiens
tataacaggtta

SEQ ID NO: 2572357 - DNA, 14 bp, Homo sapiens
tataactagtcctt

SEQ ID NO: 2572358 - DNA, 19 bp, Homo sapiens
tataactatgttgataaaa

SEQ ID NO: 2572359 - DNA, 18 bp, Homo sapiens
tataactcatcataaaat

SEQ ID NO: 2572360 - DNA, 19 bp, Homo sapiens
tataactcatcataaaata

SEQ ID NO: 2572361 - DNA, 20 bp, Homo sapiens
tataacttaaaaatgtaaat

SEQ ID NO: 2572362 - DNA, 15 bp, Homo sapiens
tataacttcttaaaa

SEQ ID NO: 2572363 - DNA, 16 bp, Homo sapiens
tataacttcttaaaag

SEQ ID NO: 2572364 - DNA, 13 bp, Homo sapiens
tataacttgtcta

SEQ ID NO: 2572365 - DNA, 19 bp, Homo sapiens
tataacttgtctaaataag

SEQ ID NO: 2572366 - DNA, 16 bp, Homo sapiens
tataaggaaagcaata

SEQ ID NO: 2572367 - DNA, 17 bp, Homo sapiens
tataaggtttaaaaaga

SEQ ID NO: 2572368 - DNA, 21 bp, Homo sapiens
tataataaaaggaaaagcaaa

SEQ ID NO: 2572369 - DNA, 16 bp, Homo sapiens
tataataaatgtacat

SEQ ID NO: 2572370 - DNA, 18 bp, Homo sapiens
tataatcccagcactttg

SEQ ID NO: 2572371 - DNA, 20 bp, Homo sapiens
tataatcttccatacttctt

SEQ ID NO: 2572372 - DNA, 18 bp, Homo sapiens
tataatgaatgaaacatt

SEQ ID NO: 2572373 - DNA, 16 bp, Homo sapiens
tataatggagttaacg

SEQ ID NO: 2572374 - DNA, 15 bp, Homo sapiens
tataatggttgactg

SEQ ID NO: 2572375 - DNA, 20 bp, Homo sapiens
tataatgtaagctctactga

SEQ ID NO: 2572376 - DNA, 17 bp, Homo sapiens
tataatgttgttattta

SEQ ID NO: 2572377 - DNA, 19 bp, Homo sapiens
tataatgttgttatttaaa

SEQ ID NO: 2572378 - DNA, 18 bp, Homo sapiens
tataattacatatttgca

SEQ ID NO: 2572379 - DNA, 13 bp, Homo sapiens
tataattccctat

SEQ ID NO: 2572380 - DNA, 15 bp, Homo sapiens
tataattctgtacat

SEQ ID NO: 2572381 - DNA, 22 bp, Homo sapiens
tataattctgtacatagcctat

SEQ ID NO: 2572382 - DNA, 22 bp, Homo sapiens
tataatttaacttcagagggaa

SEQ ID NO: 2572383 - DNA, 11 bp, Homo sapiens
tataatttaat

SEQ ID NO: 2572384 - DNA, 17 bp, Homo sapiens
tataattttatgaatgt

SEQ ID NO: 2572385 - DNA, 12 bp, Homo sapiens
tatacaacagtg

SEQ ID NO: 2572386 - DNA, 15 bp, Homo sapiens
tatacaacagtgcta

SEQ ID NO: 2572387 - DNA, 20 bp, Homo sapiens
tatacaacagtgctaaaaat

SEQ ID NO: 2572388 - DNA, 21 bp, Homo sapiens
tatacaacagtgctaaaaatg

SEQ ID NO: 2572389 - DNA, 12 bp, Homo sapiens
tatacacacagc

SEQ ID NO: 2572390 - DNA, 18 bp, Homo sapiens
tatacagtaactttatgt

SEQ ID NO: 2572391 - DNA, 20 bp, Homo sapiens
tatacagtaactttatgtgt

SEQ ID NO: 2572392 - DNA, 14 bp, Homo sapiens
tatacataaacaag

SEQ ID NO: 2572393 - DNA, 11 bp, Homo sapiens
tatacatgcca

SEQ ID NO: 2572394 - DNA, 16 bp, Homo sapiens
attttactttttcctg

SEQ ID NO: 2572395 - DNA, 16 bp, Homo sapiens
attttaggtgttgatt

SEQ ID NO: 2572396 - DNA, 21 bp, Homo sapiens
attttaggtgttgattttctg

SEQ ID NO: 2572397 - DNA, 23 bp, Homo sapiens
attttagtgacagctctgcctgt

SEQ ID NO: 2572398 - DNA, 15 bp, Homo sapiens
attttagtttctgtt

SEQ ID NO: 2572399 - DNA, 16 bp, Homo sapiens
attttagtttctgttc

SEQ ID NO: 2572400 - DNA, 18 bp, Homo sapiens
attttagtttctgttctg

SEQ ID NO: 2572401 - DNA, 23 bp, Homo sapiens
attttagtttctgttctgtggaa

SEQ ID NO: 2572402 - DNA, 20 bp, Homo sapiens
attttataaatcgcttttga

SEQ ID NO: 2572403 - DNA, 23 bp, Homo sapiens
attttataaatcgcttttgataa

SEQ ID NO: 2572404 - DNA, 18 bp, Homo sapiens
attttatagctcagttta

SEQ ID NO: 2572405 - DNA, 22 bp, Homo sapiens
attttatagctcagtttatcca

SEQ ID NO: 2572406 - DNA, 15 bp, Homo sapiens
attttatatgcttac

SEQ ID NO: 2572407 - DNA, 23 bp, Homo sapiens
attttatatgcttactgatatat

SEQ ID NO: 2572408 - DNA, 20 bp, Homo sapiens
attttatattagaagtgtta

SEQ ID NO: 2572409 - DNA, 19 bp, Homo sapiens
attttatctttcgcacagc

SEQ ID NO: 2572410 - DNA, 21 bp, Homo sapiens
attttatgccttttatttctt

SEQ ID NO: 2572411 - DNA, 12 bp, Homo sapiens
attttatgcttt

SEQ ID NO: 2572412 - DNA, 17 bp, Homo sapiens
attttattatgcatgaa

SEQ ID NO: 2572413 - DNA, 23 bp, Homo sapiens
attttatttcctggacatcctct

SEQ ID NO: 2572414 - DNA, 18 bp, Homo sapiens
attttattttattatgca

SEQ ID NO: 2572415 - DNA, 17 bp, Homo sapiens
attttatttttttctac

SEQ ID NO: 2572416 - DNA, 14 bp, Homo sapiens
attttcaagaaact

SEQ ID NO: 2572417 - DNA, 22 bp, Homo sapiens
attttcaagaaactgaggaatt

SEQ ID NO: 2572418 - DNA, 24 bp, Homo sapiens
attttcaagaataatcacgctttc

SEQ ID NO: 2572419 - DNA, 19 bp, Homo sapiens
attttcaagtaattgtgaa

SEQ ID NO: 2572420 - DNA, 16 bp, Homo sapiens
attttcaccccaccct

SEQ ID NO: 2572421 - DNA, 13 bp, Homo sapiens
attttcactgtag

SEQ ID NO: 2572422 - DNA, 21 bp, Homo sapiens
attttcagtagggctacaaaa

SEQ ID NO: 2572423 - DNA, 20 bp, Homo sapiens
attttccccccactctcccc

SEQ ID NO: 2572424 - DNA, 22 bp, Homo sapiens
attttcccccttttctgcattt

SEQ ID NO: 2572425 - DNA, 13 bp, Homo sapiens
attttccctgcta

SEQ ID NO: 2572426 - DNA, 15 bp, Homo sapiens
attttcctccccagc

SEQ ID NO: 2572427 - DNA, 14 bp, Homo sapiens
attttccttttcaa

SEQ ID NO: 2572428 - DNA, 18 bp, Homo sapiens
attttctagactttctgt

SEQ ID NO: 2572429 - DNA, 16 bp, Homo sapiens
attttctattgttact

SEQ ID NO: 2572430 - DNA, 15 bp, Homo sapiens
attttctcccaggaa

SEQ ID NO: 2572431 - DNA, 23 bp, Homo sapiens
attttctcccaggaagctttgat

SEQ ID NO: 2572432 - DNA, 18 bp, Homo sapiens
attttctggaatacatga

SEQ ID NO: 2572433 - DNA, 22 bp, Homo sapiens
attttctggaatacatgaaata

SEQ ID NO: 2572434 - DNA, 17 bp, Homo sapiens
attttctggtagataga

SEQ ID NO: 2572435 - DNA, 19 bp, Homo sapiens
attttctgtgggcaggcct

SEQ ID NO: 2572436 - DNA, 19 bp, Homo sapiens
attttctttaaaagaatgg

SEQ ID NO: 2572437 - DNA, 16 bp, Homo sapiens
attttctttctgtaac

SEQ ID NO: 2572438 - DNA, 20 bp, Homo sapiens
attttcttttctttcaactt

SEQ ID NO: 2572439 - DNA, 16 bp, Homo sapiens
attttcttttgtaaat

SEQ ID NO: 2572440 - DNA, 19 bp, Homo sapiens
attttcttttgtaaatgtt

SEQ ID NO: 2572441 - DNA, 12 bp, Homo sapiens
attttgaatcaa

SEQ ID NO: 2572442 - DNA, 18 bp, Homo sapiens
attttgacactatatctg

SEQ ID NO: 2572443 - DNA, 16 bp, Homo sapiens
attttgcagcagtgag

SEQ ID NO: 2572444 - DNA, 16 bp, Homo sapiens
attttgcatttgaata

SEQ ID NO: 2572445 - DNA, 18 bp, Homo sapiens
attttgcctcttttctct

SEQ ID NO: 2572446 - DNA, 13 bp, Homo sapiens
attttgcctgtgt

SEQ ID NO: 2572447 - DNA, 17 bp, Homo sapiens
attttgctattgtaaat

SEQ ID NO: 2572448 - DNA, 19 bp, Homo sapiens
attttgctattgtaaatat

SEQ ID NO: 2572449 - DNA, 21 bp, Homo sapiens
attttgctattgtaaatatgt

SEQ ID NO: 2572450 - DNA, 23 bp, Homo sapiens
attttgctattgtaaatatgttt

SEQ ID NO: 2572451 - DNA, 14 bp, Homo sapiens
attttggaaaataa

SEQ ID NO: 2572452 - DNA, 20 bp, Homo sapiens
attttggaaaataaattatt

SEQ ID NO: 2572453 - DNA, 20 bp, Homo sapiens
attttggaagttttcaggac

SEQ ID NO: 2572454 - DNA, 14 bp, Homo sapiens
attttggagaaatt

SEQ ID NO: 2572455 - DNA, 16 bp, Homo sapiens
attttgggaatctttt

SEQ ID NO: 2572456 - DNA, 22 bp, Homo sapiens
caacctgttacctactttgact

SEQ ID NO: 2572457 - DNA, 23 bp, Homo sapiens
caacctgttacctactttgactt

SEQ ID NO: 2572458 - DNA, 15 bp, Homo sapiens
caacgtagcttctac

SEQ ID NO: 2572459 - DNA, 19 bp, Homo sapiens
caactataagcccactgtt

SEQ ID NO: 2572460 - DNA, 19 bp, Homo sapiens
caactatattatcatgcaa

SEQ ID NO: 2572461 - DNA, 17 bp, Homo sapiens
caactatgatttggaaa

SEQ ID NO: 2572462 - DNA, 18 bp, Homo sapiens
caactatgatttggaaaa

SEQ ID NO: 2572463 - DNA, 23 bp, Homo sapiens
caactcagtccctaaaaacacag

SEQ ID NO: 2572464 - DNA, 17 bp, Homo sapiens
caactccagtagcttgg

SEQ ID NO: 2572465 - DNA, 14 bp, Homo sapiens
caactcctgtctaa

SEQ ID NO: 2572466 - DNA, 19 bp, Homo sapiens
caactcgctttaggtcagc

SEQ ID NO: 2572467 - DNA, 16 bp, Homo sapiens
caactctttgagaaac

SEQ ID NO: 2572468 - DNA, 17 bp, Homo sapiens
caactgaggcagacagc

SEQ ID NO: 2572469 - DNA, 20 bp, Homo sapiens
caactgaggcagacagcagc

SEQ ID NO: 2572470 - DNA, 15 bp, Homo sapiens
caactgcctactcca

SEQ ID NO: 2572471 - DNA, 13 bp, Homo sapiens
caactgggcccaa

SEQ ID NO: 2572472 - DNA, 15 bp, Homo sapiens
caactgtatatattc

SEQ ID NO: 2572473 - DNA, 21 bp, Homo sapiens
caactgtctcgatgcaatgaa

SEQ ID NO: 2572474 - DNA, 23 bp, Homo sapiens
caactgtctcgatgcaatgaaca

SEQ ID NO: 2572475 - DNA, 19 bp, Homo sapiens
caactgttgattgcaggaa

SEQ ID NO: 2572476 - DNA, 23 bp, Homo sapiens
caacttcccagttcaggagtccc

SEQ ID NO: 2572477 - DNA, 14 bp, Homo sapiens
caacttcttcagag

SEQ ID NO: 2572478 - DNA, 13 bp, Homo sapiens
caacttgagggcc

SEQ ID NO: 2572479 - DNA, 16 bp, Homo sapiens
caacttgagggcccag

SEQ ID NO: 2572480 - DNA, 22 bp, Homo sapiens
caacttgcatccaactccagga

SEQ ID NO: 2572481 - DNA, 13 bp, Homo sapiens
caacttggctttc

SEQ ID NO: 2572482 - DNA, 16 bp, Homo sapiens
caacttgtaaatacac

SEQ ID NO: 2572483 - DNA, 16 bp, Homo sapiens
caacttgtaaatgtgg

SEQ ID NO: 2572484 - DNA, 19 bp, Homo sapiens
caacttgtctttttctgga

SEQ ID NO: 2572485 - DNA, 18 bp, Homo sapiens
caactttaagcagctctt

SEQ ID NO: 2572486 - DNA, 16 bp, Homo sapiens
caactttctgtaaact

SEQ ID NO: 2572487 - DNA, 23 bp, Homo sapiens
caactttctgtaaactcaaaact

SEQ ID NO: 2572488 - DNA, 19 bp, Homo sapiens
caagaaactgaggaatttt

SEQ ID NO: 2572489 - DNA, 12 bp, Homo sapiens
caagaaagtcca

SEQ ID NO: 2572490 - DNA, 15 bp, Homo sapiens
caagaaatccctgtt

SEQ ID NO: 2572491 - DNA, 13 bp, Homo sapiens
tacggacaccccc

SEQ ID NO: 2572492 - DNA, 14 bp, Homo sapiens
tacggacaccccct

SEQ ID NO: 2572493 - DNA, 12 bp, Homo sapiens
tacgtacacatt

SEQ ID NO: 2572494 - DNA, 13 bp, Homo sapiens
tacgtacacattt

SEQ ID NO: 2572495 - DNA, 15 bp, Homo sapiens
tacgtctgacaggca

SEQ ID NO: 2572496 - DNA, 16 bp, Homo sapiens
tacgtctgacaggcaa

SEQ ID NO: 2572497 - DNA, 15 bp, Homo sapiens
tacgttgtgcatttg

SEQ ID NO: 2572498 - DNA, 13 bp, Homo sapiens
tacgtttgtatgt

SEQ ID NO: 2572499 - DNA, 20 bp, Homo sapiens
tactaaaagttcttctccaa

SEQ ID NO: 2572500 - DNA, 23 bp, Homo sapiens
tactaacaatcagctccttcctg

SEQ ID NO: 2572501 - DNA, 18 bp, Homo sapiens
tactaaggagtaatctgt

SEQ ID NO: 2572502 - DNA, 12 bp, Homo sapiens
tactacagtcct

SEQ ID NO: 2572503 - DNA, 17 bp, Homo sapiens
tactacagtcctcccat

SEQ ID NO: 2572504 - DNA, 20 bp, Homo sapiens
tactacagtttgttagtatg

SEQ ID NO: 2572505 - DNA, 17 bp, Homo sapiens
tactactagatgtcttt

SEQ ID NO: 2572506 - DNA, 18 bp, Homo sapiens
tactactagatgtcttta

SEQ ID NO: 2572507 - DNA, 20 bp, Homo sapiens
tactactgtggaaaaatatt

SEQ ID NO: 2572508 - DNA, 14 bp, Homo sapiens
tactagaagatgaa

SEQ ID NO: 2572509 - DNA, 19 bp, Homo sapiens
tactagatgtctttaggca

SEQ ID NO: 2572510 - DNA, 23 bp, Homo sapiens
tactaggcttaatacctgggtga

SEQ ID NO: 2572511 - DNA, 21 bp, Homo sapiens
tactagggatccctcatctgt

SEQ ID NO: 2572512 - DNA, 14 bp, Homo sapiens
tactagttacacat

SEQ ID NO: 2572513 - DNA, 20 bp, Homo sapiens
tactatcatgtcaaacgtga

SEQ ID NO: 2572514 - DNA, 11 bp, Homo sapiens
tactatttaaa

SEQ ID NO: 2572515 - DNA, 14 bp, Homo sapiens
tactattttacttc

SEQ ID NO: 2572516 - DNA, 19 bp, Homo sapiens
tactcaagaggctgaggca

SEQ ID NO: 2572517 - DNA, 20 bp, Homo sapiens
tactcactttctagattaag

SEQ ID NO: 2572518 - DNA, 16 bp, Homo sapiens
tactcagaattctcta

SEQ ID NO: 2572519 - DNA, 21 bp, Homo sapiens
tactcataatgtgaagtgtta

SEQ ID NO: 2572520 - DNA, 19 bp, Homo sapiens
tactcatatatatctatct

SEQ ID NO: 2572521 - DNA, 11 bp, Homo sapiens
tactcatgtgt

SEQ ID NO: 2572522 - DNA, 13 bp, Homo sapiens
tactcatgtgtat

SEQ ID NO: 2572523 - DNA, 14 bp, Homo sapiens
tactcattcaggga

SEQ ID NO: 2572524 - DNA, 20 bp, Homo sapiens
tactcattcatttattcatt

SEQ ID NO: 2572525 - DNA, 14 bp, Homo sapiens
tactcccagacacc

SEQ ID NO: 2572526 - DNA, 16 bp, Homo sapiens
tactcccatctgtgaa

SEQ ID NO: 2572527 - DNA, 17 bp, Homo sapiens
tactcctctttacactg

SEQ ID NO: 2572528 - DNA, 23 bp, Homo sapiens
tactctcctggaaatattaagaa

SEQ ID NO: 2572529 - DNA, 14 bp, Homo sapiens
tactcttaagccat

SEQ ID NO: 2572530 - DNA, 15 bp, Homo sapiens
tactcttaagtttct

SEQ ID NO: 2572531 - DNA, 20 bp, Homo sapiens
tactcttaagtttctcagct

SEQ ID NO: 2572532 - DNA, 21 bp, Homo sapiens
tactcttaggaagagaaacca

SEQ ID NO: 2572533 - DNA, 12 bp, Homo sapiens
tactcttccgaa

SEQ ID NO: 2572534 - DNA, 14 bp, Homo sapiens
tactctttttgttt

SEQ ID NO: 2572535 - DNA, 19 bp, Homo sapiens
tactgagccttgtaattct

SEQ ID NO: 2572536 - DNA, 14 bp, Homo sapiens
tactgagcttctct

SEQ ID NO: 2572537 - DNA, 18 bp, Homo sapiens
tactgagcttctctgtga

SEQ ID NO: 2572538 - DNA, 22 bp, Homo sapiens
tactgaggcctaaaagtaaaca

SEQ ID NO: 2572539 - DNA, 23 bp, Homo sapiens
tactgagggaccaactgggccca

SEQ ID NO: 2572540 - DNA, 16 bp, Homo sapiens
tactgataaagaaaga

SEQ ID NO: 2572541 - DNA, 14 bp, Homo sapiens
tactgatatatttt

SEQ ID NO: 2572542 - DNA, 17 bp, Homo sapiens
tactgatttttgtaaga

SEQ ID NO: 2572543 - DNA, 15 bp, Homo sapiens
tactgatttttgtga

SEQ ID NO: 2572544 - DNA, 18 bp, Homo sapiens
tactgcaaatgtcatcag

SEQ ID NO: 2572545 - DNA, 20 bp, Homo sapiens
tactgcagcctttgcctccc

SEQ ID NO: 2572546 - DNA, 22 bp, Homo sapiens
tactgcagcctttgcctccccg

SEQ ID NO: 2572547 - DNA, 21 bp, Homo sapiens
tactgcatactttttaaatgt

SEQ ID NO: 2572548 - DNA, 17 bp, Homo sapiens
tactgcatatgaaagga

SEQ ID NO: 2572549 - DNA, 15 bp, Homo sapiens
tactgccagatgctg

SEQ ID NO: 2572550 - DNA, 17 bp, Homo sapiens
tactgccagatgctgat

SEQ ID NO: 2572551 - DNA, 19 bp, Homo sapiens
tactgcccggggcagctgc

SEQ ID NO: 2572552 - DNA, 18 bp, Homo sapiens
tactggaagttttgcatt

SEQ ID NO: 2572553 - DNA, 23 bp, Homo sapiens
tactggaagttttgcatttatgg

SEQ ID NO: 2572554 - DNA, 14 bp, Homo sapiens
tactggagaagtct

SEQ ID NO: 2572555 - DNA, 13 bp, Homo sapiens
tactggtccaaaa

SEQ ID NO: 2572556 - DNA, 18 bp, Homo sapiens
tactggtccaaaagattg

SEQ ID NO: 2572557 - DNA, 18 bp, Homo sapiens
tactgtaaagaaagagag

SEQ ID NO: 2572558 - DNA, 19 bp, Homo sapiens
tactgtaaagaaagagaga

SEQ ID NO: 2572559 - DNA, 13 bp, Homo sapiens
cttctgcaccctc

SEQ ID NO: 2572560 - DNA, 14 bp, Homo sapiens
cttctgcaccctcc

SEQ ID NO: 2572561 - DNA, 17 bp, Homo sapiens
cttctgcaccctccacc

SEQ ID NO: 2572562 - DNA, 19 bp, Homo sapiens
cttctgcaccctccaccct

SEQ ID NO: 2572563 - DNA, 17 bp, Homo sapiens
cttctgccatattctgt

SEQ ID NO: 2572564 - DNA, 20 bp, Homo sapiens
cttctgccatttctgagatc

SEQ ID NO: 2572565 - DNA, 19 bp, Homo sapiens
cttctgccggccctggggc

SEQ ID NO: 2572566 - DNA, 14 bp, Homo sapiens
cttctgccttctca

SEQ ID NO: 2572567 - DNA, 13 bp, Homo sapiens
cttctgctccacc

SEQ ID NO: 2572568 - DNA, 14 bp, Homo sapiens
cttctgctccaccc

SEQ ID NO: 2572569 - DNA, 19 bp, Homo sapiens
cttctgctccacccttggc

SEQ ID NO: 2572570 - DNA, 21 bp, Homo sapiens
cttctgctccacccttggcct

SEQ ID NO: 2572571 - DNA, 15 bp, Homo sapiens
cttctgcttaggaga

SEQ ID NO: 2572572 - DNA, 13 bp, Homo sapiens
cttctgcttcagc

SEQ ID NO: 2572573 - DNA, 14 bp, Homo sapiens
cttctggagccctt

SEQ ID NO: 2572574 - DNA, 18 bp, Homo sapiens
cttctggagtctccagtg

SEQ ID NO: 2572575 - DNA, 17 bp, Homo sapiens
cttctggcacttggaga

SEQ ID NO: 2572576 - DNA, 14 bp, Homo sapiens
cttctggcctccca

SEQ ID NO: 2572577 - DNA, 16 bp, Homo sapiens
cttctggcctcccaca

SEQ ID NO: 2572578 - DNA, 14 bp, Homo sapiens
cttctggcttcctt

SEQ ID NO: 2572579 - DNA, 23 bp, Homo sapiens
cttctgggagggcagcagggcta

SEQ ID NO: 2572580 - DNA, 17 bp, Homo sapiens
cttctggtactctccta

SEQ ID NO: 2572581 - DNA, 18 bp, Homo sapiens
cttctggtactctcctag

SEQ ID NO: 2572582 - DNA, 14 bp, Homo sapiens
cttctgtacgtctg

SEQ ID NO: 2572583 - DNA, 18 bp, Homo sapiens
cttctgtacgtctgacag

SEQ ID NO: 2572584 - DNA, 20 bp, Homo sapiens
cttctgtacgtctgacaggc

SEQ ID NO: 2572585 - DNA, 22 bp, Homo sapiens
cttctgtcttcacaacagatta

SEQ ID NO: 2572586 - DNA, 19 bp, Homo sapiens
cttctgtgagacccccaca

SEQ ID NO: 2572587 - DNA, 14 bp, Homo sapiens
cttctgttttctgt

SEQ ID NO: 2572588 - DNA, 15 bp, Homo sapiens
cttctgttttctgtt

SEQ ID NO: 2572589 - DNA, 17 bp, Homo sapiens
cttctgttttctgtttc

SEQ ID NO: 2572590 - DNA, 13 bp, Homo sapiens
cttcttaaagagt

SEQ ID NO: 2572591 - DNA, 13 bp, Homo sapiens
cttcttacatgca

SEQ ID NO: 2572592 - DNA, 16 bp, Homo sapiens
cttcttcacccagcta

SEQ ID NO: 2572593 - DNA, 23 bp, Homo sapiens
cttcttcacccagctaatctgta

SEQ ID NO: 2572594 - DNA, 23 bp, Homo sapiens
cttcttcagagactcctgcaggc

SEQ ID NO: 2572595 - DNA, 12 bp, Homo sapiens
cttcttctcccc

SEQ ID NO: 2572596 - DNA, 18 bp, Homo sapiens
cttcttctttttgctgtt

SEQ ID NO: 2572597 - DNA, 22 bp, Homo sapiens
cttcttgaaattttaacctatg

SEQ ID NO: 2572598 - DNA, 20 bp, Homo sapiens
cttctttatactgtaattta

SEQ ID NO: 2572599 - DNA, 14 bp, Homo sapiens
cttctttcctcttc

SEQ ID NO: 2572600 - DNA, 19 bp, Homo sapiens
cttctttgataatgttaaa

SEQ ID NO: 2572601 - DNA, 13 bp, Homo sapiens
cttctttgcttgc

SEQ ID NO: 2572602 - DNA, 18 bp, Homo sapiens
cttctttgggtaaacgtg

SEQ ID NO: 2572603 - DNA, 13 bp, Homo sapiens
cttcttttactca

SEQ ID NO: 2572604 - DNA, 14 bp, Homo sapiens
cttcttttcacatt

SEQ ID NO: 2572605 - DNA, 17 bp, Homo sapiens
cttcttttcacattctt

SEQ ID NO: 2572606 - DNA, 20 bp, Homo sapiens
cttcttttcacattcttata

SEQ ID NO: 2572607 - DNA, 12 bp, Homo sapiens
cttcttttgagc

SEQ ID NO: 2572608 - DNA, 13 bp, Homo sapiens
cttcttttgctct

SEQ ID NO: 2572609 - DNA, 16 bp, Homo sapiens
cttcttttttttcatt

SEQ ID NO: 2572610 - DNA, 21 bp, Homo sapiens
cttgaaaaatgtgcaaaacag

SEQ ID NO: 2572611 - DNA, 14 bp, Homo sapiens
cttgaaaacactgt

SEQ ID NO: 2572612 - DNA, 23 bp, Homo sapiens
cttgaaaacactgttctctgccc

SEQ ID NO: 2572613 - DNA, 20 bp, Homo sapiens
cttgaaaattttattaaaaa

SEQ ID NO: 2572614 - DNA, 13 bp, Homo sapiens
cttgaaagaaaat

SEQ ID NO: 2572615 - DNA, 22 bp, Homo sapiens
cttgaaataccagtgaaccaaa

SEQ ID NO: 2572616 - DNA, 14 bp, Homo sapiens
cttgaaattttaac

SEQ ID NO: 2572617 - DNA, 16 bp, Homo sapiens
cttgaaattttaacct

SEQ ID NO: 2572618 - DNA, 19 bp, Homo sapiens
cttgaacactcatgctgaa

SEQ ID NO: 2572619 - DNA, 20 bp, Homo sapiens
cttgaacccgggaggcagag

SEQ ID NO: 2572620 - DNA, 17 bp, Homo sapiens
cttgaactcctggcctc

SEQ ID NO: 2572621 - DNA, 15 bp, Homo sapiens
cttgaactttgacct

SEQ ID NO: 2572622 - DNA, 20 bp, Homo sapiens
cttgaagatcgttagtatct

SEQ ID NO: 2572623 - DNA, 21 bp, Homo sapiens
cttgaagccactgaagctggg

SEQ ID NO: 2572624 - DNA, 17 bp, Homo sapiens
cttgaattgtaactgtt

SEQ ID NO: 2572625 - DNA, 17 bp, Homo sapiens
cttgacagaacactgtc

SEQ ID NO: 2572626 - DNA, 12 bp, Homo sapiens
cttgacagggca

SEQ ID NO: 2572627 - DNA, 14 bp, Homo sapiens
cttgacagggcaca

SEQ ID NO: 2572628 - DNA, 15 bp, Homo sapiens
cttgacagggcacac

SEQ ID NO: 2572629 - DNA, 20 bp, Homo sapiens
cttgacagggcacaccgggc

SEQ ID NO: 2572630 - DNA, 12 bp, Homo sapiens
cttgaccaagca

SEQ ID NO: 2572631 - DNA, 17 bp, Homo sapiens
cttgaccaagcaggaag

SEQ ID NO: 2572632 - DNA, 18 bp, Homo sapiens
cttgaccaagcaggaagc

SEQ ID NO: 2572633 - DNA, 23 bp, Homo sapiens
cttgaccaagcaggaagctcaga

SEQ ID NO: 2572634 - DNA, 22 bp, Homo sapiens
cttgaccagcagatcccagctc

SEQ ID NO: 2572635 - DNA, 23 bp, Homo sapiens
cttgaccagcagatcccagctca

SEQ ID NO: 2572636 - DNA, 15 bp, Homo sapiens
cttgaccaggcctgg

SEQ ID NO: 2572637 - DNA, 17 bp, Homo sapiens
cttgaccaggcctgggc

SEQ ID NO: 2572638 - DNA, 17 bp, Homo sapiens
cttgaccattctccacc

SEQ ID NO: 2572639 - DNA, 23 bp, Homo sapiens
cttgaccattctccacctgccag

SEQ ID NO: 2572640 - DNA, 13 bp, Homo sapiens
cttgagacagctt

SEQ ID NO: 2572641 - DNA, 17 bp, Homo sapiens
cttgagactgttttgaa

SEQ ID NO: 2572642 - DNA, 14 bp, Homo sapiens
cttgagagggtgga

SEQ ID NO: 2572643 - DNA, 15 bp, Homo sapiens
cttgagatgtcttct

SEQ ID NO: 2572644 - DNA, 19 bp, Homo sapiens
cttgagcaagttccttctg

SEQ ID NO: 2572645 - DNA, 12 bp, Homo sapiens
cttgagcctggg

SEQ ID NO: 2572646 - DNA, 16 bp, Homo sapiens
cttgagcctgggaggt

SEQ ID NO: 2572647 - DNA, 20 bp, Homo sapiens
cttgagccttgaactttgac

SEQ ID NO: 2572648 - DNA, 10 bp, Homo sapiens
cttgagctga

SEQ ID NO: 2572649 - DNA, 12 bp, Homo sapiens
cttgagcttggc

SEQ ID NO: 2572650 - DNA, 13 bp, Homo sapiens
cttgaggaaacaa

SEQ ID NO: 2572651 - DNA, 21 bp, Homo sapiens
cttgaggaaacaacagcttta

SEQ ID NO: 2572652 - DNA, 16 bp, Homo sapiens
cttgagggagcttagc

SEQ ID NO: 2572653 - DNA, 17 bp, Homo sapiens
cttgagggcccagagca

SEQ ID NO: 2572654 - DNA, 18 bp, Homo sapiens
cttgagggcccagagcag

SEQ ID NO: 2572655 - DNA, 15 bp, Homo sapiens
cttgagggttgggct

SEQ ID NO: 2572656 - DNA, 20 bp, Homo sapiens
cttgagggttgggctggtgt

SEQ ID NO: 2572657 - DNA, 14 bp, Homo sapiens
cttgaggtcttttg

SEQ ID NO: 2572658 - DNA, 18 bp, Homo sapiens
cttgaggtcttttgacat

SEQ ID NO: 2572659 - DNA, 21 bp, Homo sapiens
cttgagtggggttatctctgt

SEQ ID NO: 2572660 - DNA, 18 bp, Homo sapiens
cttgagttgattcagctc

SEQ ID NO: 2572661 - DNA, 16 bp, Homo sapiens
cttgataaagggccaa

SEQ ID NO: 2572662 - DNA, 18 bp, Homo sapiens
cttgatacccccctctgt

SEQ ID NO: 2572663 - DNA, 23 bp, Homo sapiens
cttgatactaaaagttcttctcc

SEQ ID NO: 2572664 - DNA, 21 bp, Homo sapiens
cttgatgcatgcactgttccc

SEQ ID NO: 2572665 - DNA, 22 bp, Homo sapiens
cttgatgccagtaggctcaact

SEQ ID NO: 2572666 - DNA, 15 bp, Homo sapiens
cttgatgtgccattt

SEQ ID NO: 2572667 - DNA, 14 bp, Homo sapiens
cttgattttgcaaa

SEQ ID NO: 2572668 - DNA, 15 bp, Homo sapiens
cttgcaaaaagggtc

SEQ ID NO: 2572669 - DNA, 22 bp, Homo sapiens
cttgcaaagtatccctactgta

SEQ ID NO: 2572670 - DNA, 18 bp, Homo sapiens
cttgcaagaatcagtgca

SEQ ID NO: 2572671 - DNA, 14 bp, Homo sapiens
cttgcaatggcagc

SEQ ID NO: 2572672 - DNA, 16 bp, Homo sapiens
cttgcaatggcagcct

SEQ ID NO: 2572673 - DNA, 17 bp, Homo sapiens
cttgcaatggcagcctt

SEQ ID NO: 2572674 - DNA, 19 bp, Homo sapiens
cttgcacactcccctgcac

SEQ ID NO: 2572675 - DNA, 22 bp, Homo sapiens
cttgcacactcccctgcactgg

SEQ ID NO: 2572676 - DNA, 18 bp, Homo sapiens
cttgcacccctcactctg

SEQ ID NO: 2572677 - DNA, 20 bp, Homo sapiens
cttgcacccctcactctggc

SEQ ID NO: 2572678 - DNA, 17 bp, Homo sapiens
cttgcacccgcctctcc

SEQ ID NO: 2572679 - DNA, 21 bp, Homo sapiens
cttgcagactctacagaggcc

SEQ ID NO: 2572680 - DNA, 18 bp, Homo sapiens
cttgcagcactcacacag

SEQ ID NO: 2572681 - DNA, 17 bp, Homo sapiens
cttgcagtagattttct

SEQ ID NO: 2572682 - DNA, 20 bp, Homo sapiens
cttgcataataagctaaaga

SEQ ID NO: 2572683 - DNA, 22 bp, Homo sapiens
cttgcataataagctaaagagg

SEQ ID NO: 2572684 - DNA, 20 bp, Homo sapiens
cttgcatcgtggagacaggg

SEQ ID NO: 2572685 - DNA, 17 bp, Homo sapiens
cttgcatgaggctagtg

SEQ ID NO: 2572686 - DNA, 12 bp, Homo sapiens
cttgcattccca

SEQ ID NO: 2572687 - DNA, 20 bp, Homo sapiens
cttgcatttttgcaggagca

SEQ ID NO: 2572688 - DNA, 22 bp, Homo sapiens
cttgccaatgaggtctgaaatg

SEQ ID NO: 2572689 - DNA, 23 bp, Homo sapiens
cttgccaatgaggtctgaaatgg

SEQ ID NO: 2572690 - DNA, 20 bp, Homo sapiens
cttgccacagctcttgagga

SEQ ID NO: 2572691 - DNA, 22 bp, Homo sapiens
cttgccaccccaccctccctgg

SEQ ID NO: 2572692 - DNA, 17 bp, Homo sapiens
cttgccactagggctct

SEQ ID NO: 2572693 - DNA, 14 bp, Homo sapiens
cttgccactgcctc

SEQ ID NO: 2572694 - DNA, 15 bp, Homo sapiens
cttgccactgcctct

SEQ ID NO: 2572695 - DNA, 14 bp, Homo sapiens
cttgcccagggctc

SEQ ID NO: 2572696 - DNA, 18 bp, Homo sapiens
cttgcccggattctggga

SEQ ID NO: 2572697 - DNA, 20 bp, Homo sapiens
cttgcccggattctgggagg

SEQ ID NO: 2572698 - DNA, 12 bp, Homo sapiens
cttgccctgacc

SEQ ID NO: 2572699 - DNA, 13 bp, Homo sapiens
cttgccctgacct

SEQ ID NO: 2572700 - DNA, 17 bp, Homo sapiens
cttgcccttgccctgac

SEQ ID NO: 2572701 - DNA, 18 bp, Homo sapiens
cttgccgtctacctgagg

SEQ ID NO: 2572702 - DNA, 18 bp, Homo sapiens
cttgcctagggcctggtc

SEQ ID NO: 2572703 - DNA, 12 bp, Homo sapiens
cttgcctcctgt

SEQ ID NO: 2572704 - DNA, 16 bp, Homo sapiens
gaaaacgttttattgt

SEQ ID NO: 2572705 - DNA, 18 bp, Homo sapiens
gaaaactgaaaatctaat

SEQ ID NO: 2572706 - DNA, 11 bp, Homo sapiens
gaaaagaaaaa

SEQ ID NO: 2572707 - DNA, 19 bp, Homo sapiens
gaaaagaaaaaaaaagaaa

SEQ ID NO: 2572708 - DNA, 15 bp, Homo sapiens
gaaaagagatatttt

SEQ ID NO: 2572709 - DNA, 14 bp, Homo sapiens
gaaaagatgtagat

SEQ ID NO: 2572710 - DNA, 20 bp, Homo sapiens
gaaaagcggacatcagctgg

SEQ ID NO: 2572711 - DNA, 14 bp, Homo sapiens
gaaaagctattagc

SEQ ID NO: 2572712 - DNA, 22 bp, Homo sapiens
gaaaagctattagccaggatca

SEQ ID NO: 2572713 - DNA, 13 bp, Homo sapiens
gaaaagctgctga

SEQ ID NO: 2572714 - DNA, 11 bp, Homo sapiens
gaaaaggcagg

SEQ ID NO: 2572715 - DNA, 19 bp, Homo sapiens
gaaaagggaagttgtgcct

SEQ ID NO: 2572716 - DNA, 14 bp, Homo sapiens
gaaaagtacattta

SEQ ID NO: 2572717 - DNA, 16 bp, Homo sapiens
gaaaagtgaatgctca

SEQ ID NO: 2572718 - DNA, 16 bp, Homo sapiens
gaaaataaaaaaaaga

SEQ ID NO: 2572719 - DNA, 17 bp, Homo sapiens
gaaaataaaaaaaagaa

SEQ ID NO: 2572720 - DNA, 18 bp, Homo sapiens
gaaaataaaaaaaagaaa

SEQ ID NO: 2572721 - DNA, 22 bp, Homo sapiens
gaaaataaaaaaaagaaaaaag

SEQ ID NO: 2572722 - DNA, 23 bp, Homo sapiens
gaaaataaatcaatgctataact

SEQ ID NO: 2572723 - DNA, 18 bp, Homo sapiens
gaaaataatcattcttat

SEQ ID NO: 2572724 - DNA, 16 bp, Homo sapiens
gaaaatataaccagcc

SEQ ID NO: 2572725 - DNA, 14 bp, Homo sapiens
gaaaatatactgta

SEQ ID NO: 2572726 - DNA, 15 bp, Homo sapiens
gaaaatcaaatacat

SEQ ID NO: 2572727 - DNA, 22 bp, Homo sapiens
gaaaatcagcctgctccagctg

SEQ ID NO: 2572728 - DNA, 22 bp, Homo sapiens
gaaaatctacactccagtgaga

SEQ ID NO: 2572729 - DNA, 16 bp, Homo sapiens
gaaaatgaatccctct

SEQ ID NO: 2572730 - DNA, 20 bp, Homo sapiens
gaaaatgcaacaacatgtat

SEQ ID NO: 2572731 - DNA, 21 bp, Homo sapiens
gaaaatgcattgtatcgatgt

SEQ ID NO: 2572732 - DNA, 18 bp, Homo sapiens
gaaaatggtccaggagaa

SEQ ID NO: 2572733 - DNA, 23 bp, Homo sapiens
gaaaatgtcagaaaccagttatg

SEQ ID NO: 2572734 - DNA, 20 bp, Homo sapiens
gaaaatgtttttctgccagg

SEQ ID NO: 2572735 - DNA, 15 bp, Homo sapiens
gaaaattaacactgc

SEQ ID NO: 2572736 - DNA, 15 bp, Homo sapiens
gaaaattatttgcat

SEQ ID NO: 2572737 - DNA, 17 bp, Homo sapiens
gaaaattattttaaaca

SEQ ID NO: 2572738 - DNA, 17 bp, Homo sapiens
gaaaattcaaaaagtgt

SEQ ID NO: 2572739 - DNA, 14 bp, Homo sapiens
gaaaattttaaaaa

SEQ ID NO: 2572740 - DNA, 19 bp, Homo sapiens
gaaacaaaaacactaaaaa

SEQ ID NO: 2572741 - DNA, 12 bp, Homo sapiens
gaaacaaagaag

SEQ ID NO: 2572742 - DNA, 14 bp, Homo sapiens
gaaacaaagaaggt

SEQ ID NO: 2572743 - DNA, 20 bp, Homo sapiens
gaaacaactctttgagaaac

SEQ ID NO: 2572744 - DNA, 14 bp, Homo sapiens
gaaacacaatattt

SEQ ID NO: 2572745 - DNA, 19 bp, Homo sapiens
gaaacacactgaggcaggg

SEQ ID NO: 2572746 - DNA, 19 bp, Homo sapiens
gaaacaccctcacactggg

SEQ ID NO: 2572747 - DNA, 21 bp, Homo sapiens
gaaacaccttctctggagcca

SEQ ID NO: 2572748 - DNA, 15 bp, Homo sapiens
gaaacactggggctg

SEQ ID NO: 2572749 - DNA, 22 bp, Homo sapiens
gaaacaggaccacaaaaatgaa

SEQ ID NO: 2572750 - DNA, 19 bp, Homo sapiens
gaaacatcagttactctga

SEQ ID NO: 2572751 - DNA, 20 bp, Homo sapiens
gaaacatgactcgtatatgt

SEQ ID NO: 2572752 - DNA, 14 bp, Homo sapiens
gaaaccacagctgc

SEQ ID NO: 2572753 - DNA, 20 bp, Homo sapiens
gaaaccacagctgctggaga

SEQ ID NO: 2572754 - DNA, 14 bp, Homo sapiens
gaaaccagggcctg

SEQ ID NO: 2572755 - DNA, 21 bp, Homo sapiens
gaaacccagactgaacttacc

SEQ ID NO: 2572756 - DNA, 23 bp, Homo sapiens
gaaacccagctctggtccataga

SEQ ID NO: 2572757 - DNA, 16 bp, Homo sapiens
gaaacccgacagaggg

SEQ ID NO: 2572758 - DNA, 14 bp, Homo sapiens
gaaaccctgtctct

SEQ ID NO: 2572759 - DNA, 18 bp, Homo sapiens
gaaacctgaaaaaaagtt

SEQ ID NO: 2572760 - DNA, 20 bp, Homo sapiens
gaaaccttattgtacctctc

SEQ ID NO: 2572761 - DNA, 17 bp, Homo sapiens
gaaacctttagggcagc

SEQ ID NO: 2572762 - DNA, 23 bp, Homo sapiens
gaaactcataatagacttcccac

SEQ ID NO: 2572763 - DNA, 15 bp, Homo sapiens
gaaactcttatctca

SEQ ID NO: 2572764 - DNA, 17 bp, Homo sapiens
gaaactggcactgaatt

SEQ ID NO: 2572765 - DNA, 18 bp, Homo sapiens
gaaactgtagtctcagga

SEQ ID NO: 2572766 - DNA, 21 bp, Homo sapiens
gaaactgttcccacctgctgg

SEQ ID NO: 2572767 - DNA, 15 bp, Homo sapiens
gaaacttacacacaa

SEQ ID NO: 2572768 - DNA, 12 bp, Homo sapiens
gaaacttatttt

SEQ ID NO: 2572769 - DNA, 22 bp, Homo sapiens
gaaactttattcaagtaaaaat

SEQ ID NO: 2572770 - DNA, 21 bp, Homo sapiens
gaaagaaaataccaaggaaca

SEQ ID NO: 2572771 - DNA, 16 bp, Homo sapiens
gaaagaaaatatgcat

SEQ ID NO: 2572772 - DNA, 17 bp, Homo sapiens
gaaagaaaatatgcatc

SEQ ID NO: 2572773 - DNA, 23 bp, Homo sapiens
gaaagaaagttgcacggctgctg

SEQ ID NO: 2572774 - DNA, 19 bp, Homo sapiens
gaaagaacatggacttgta

SEQ ID NO: 2572775 - DNA, 11 bp, Homo sapiens
gaaagaagaga

SEQ ID NO: 2572776 - DNA, 21 bp, Homo sapiens
gaaagacatccataaagaagc

SEQ ID NO: 2572777 - DNA, 14 bp, Homo sapiens
gaaagagaaggtgg

SEQ ID NO: 2572778 - DNA, 11 bp, Homo sapiens
gaaagagagaa

SEQ ID NO: 2572779 - DNA, 12 bp, Homo sapiens
gaaagagagaaa

SEQ ID NO: 2572780 - DNA, 13 bp, Homo sapiens
gaaagagagaaaa

SEQ ID NO: 2572781 - DNA, 17 bp, Homo sapiens
gaaagagagaaaataaa

SEQ ID NO: 2572782 - DNA, 20 bp, Homo sapiens
gaaagagagaaaataaaaag

SEQ ID NO: 2572783 - DNA, 20 bp, Homo sapiens
gaaagaggcagcttgaaact

SEQ ID NO: 2572784 - DNA, 14 bp, Homo sapiens
gaaagcaataaatg

SEQ ID NO: 2572785 - DNA, 23 bp, Homo sapiens
gaaagcacaggtgggcttcccag

SEQ ID NO: 2572786 - DNA, 13 bp, Homo sapiens
gaaagcagaacag

SEQ ID NO: 2572787 - DNA, 14 bp, Homo sapiens
gaaagcagaacagt

SEQ ID NO: 2572788 - DNA, 22 bp, Homo sapiens
gaaagcagaacagtgattacca

SEQ ID NO: 2572789 - DNA, 22 bp, Homo sapiens
gaaagcagatacctcaccctgc

SEQ ID NO: 2572790 - DNA, 19 bp, Homo sapiens
gaaagcagctcaaaggcac

SEQ ID NO: 2572791 - DNA, 18 bp, Homo sapiens
gaaagcatcacctcaggc

SEQ ID NO: 2572792 - DNA, 13 bp, Homo sapiens
gaaagccacctct

SEQ ID NO: 2572793 - DNA, 20 bp, Homo sapiens
gaaagccacctctccctcaa

SEQ ID NO: 2572794 - DNA, 20 bp, Homo sapiens
gaaagccagtgactccagga

SEQ ID NO: 2572795 - DNA, 20 bp, Homo sapiens
gaaagcccagaaaaggacag

SEQ ID NO: 2572796 - DNA, 18 bp, Homo sapiens
gaaagccccagcactaac

SEQ ID NO: 2572797 - DNA, 22 bp, Homo sapiens
gaaaggaagctccactgtcacc

SEQ ID NO: 2572798 - DNA, 11 bp, Homo sapiens
gaaaggagact

SEQ ID NO: 2572799 - DNA, 15 bp, Homo sapiens
gaaaggagtagaaaa

SEQ ID NO: 2572800 - DNA, 17 bp, Homo sapiens
gaaaggcattctctgaa

SEQ ID NO: 2572801 - DNA, 16 bp, Homo sapiens
gaaaggccagctggca

SEQ ID NO: 2572802 - DNA, 14 bp, Homo sapiens
gaaaggctccagga

SEQ ID NO: 2572803 - DNA, 16 bp, Homo sapiens
gaaaggctccaggagc

SEQ ID NO: 2572804 - DNA, 17 bp, Homo sapiens
gaaaggctccaggagca

SEQ ID NO: 2572805 - DNA, 19 bp, Homo sapiens
gaaaggctccaggagcagc

SEQ ID NO: 2572806 - DNA, 20 bp, Homo sapiens
gaaaggctccaggagcagcc

SEQ ID NO: 2572807 - DNA, 21 bp, Homo sapiens
gaaaggctccaggagcagcca

SEQ ID NO: 2572808 - DNA, 22 bp, Homo sapiens
gaaaggctccaggagcagccac

SEQ ID NO: 2572809 - DNA, 17 bp, Homo sapiens
gaaaggctctgaaagcc

SEQ ID NO: 2572810 - DNA, 19 bp, Homo sapiens
gaaagggacttggaagctc

SEQ ID NO: 2572811 - DNA, 15 bp, Homo sapiens
gaaagggcccagaga

SEQ ID NO: 2572812 - DNA, 17 bp, Homo sapiens
gaaaggggggagctggg

SEQ ID NO: 2572813 - DNA, 22 bp, Homo sapiens
gaaagggggtcccagtgggagg

SEQ ID NO: 2572814 - DNA, 16 bp, Homo sapiens
gaaagggtgctgcttc

SEQ ID NO: 2572815 - DNA, 18 bp, Homo sapiens
gaaaggttaccctgtaac

SEQ ID NO: 2572816 - DNA, 13 bp, Homo sapiens
gaaaggttctgcc

SEQ ID NO: 2572817 - DNA, 20 bp, Homo sapiens
gaaaggtttgagaagcactg

SEQ ID NO: 2572818 - DNA, 22 bp, Homo sapiens
gaaagtacttctccaccctgct

SEQ ID NO: 2572819 - DNA, 16 bp, Homo sapiens
gaaagtgaaagtccag

SEQ ID NO: 2572820 - DNA, 19 bp, Homo sapiens
gaaagtgaagcaaatcaga

SEQ ID NO: 2572821 - DNA, 13 bp, Homo sapiens
gaaagtgaatttg

SEQ ID NO: 2572822 - DNA, 17 bp, Homo sapiens
gaaagtgaatttgaatg

SEQ ID NO: 2572823 - DNA, 23 bp, Homo sapiens
gaaagtgaatttgaatgaaaaat

SEQ ID NO: 2572824 - DNA, 22 bp, Homo sapiens
gaaagtgatttctagaaagcct

SEQ ID NO: 2572825 - DNA, 18 bp, Homo sapiens
gaaagtggtgctcagttg

SEQ ID NO: 2572826 - DNA, 20 bp, Homo sapiens
gaaagtggtgctcagttgta

SEQ ID NO: 2572827 - DNA, 23 bp, Homo sapiens
gaaagtgtaaagcattccaacaa

SEQ ID NO: 2572828 - DNA, 16 bp, Homo sapiens
gaaataaaacctttca

SEQ ID NO: 2572829 - DNA, 15 bp, Homo sapiens
gaaataaatagctat

SEQ ID NO: 2572830 - DNA, 21 bp, Homo sapiens
gaaataaatgtatcatagaaa

SEQ ID NO: 2572831 - DNA, 16 bp, Homo sapiens
gaaataacaatgttaa

SEQ ID NO: 2572832 - DNA, 19 bp, Homo sapiens
gaaataatgtacatctggc

SEQ ID NO: 2572833 - DNA, 21 bp, Homo sapiens
gaaatacaattctacattgtc

SEQ ID NO: 2572834 - DNA, 19 bp, Homo sapiens
gaaatacacaagtaaacat

SEQ ID NO: 2572835 - DNA, 17 bp, Homo sapiens
gaaatacatggacaata

SEQ ID NO: 2572836 - DNA, 15 bp, Homo sapiens
gaaatactatttaaa

SEQ ID NO: 2572837 - DNA, 19 bp, Homo sapiens
gaaatactgtttgaggttt

SEQ ID NO: 2572838 - DNA, 19 bp, Homo sapiens
gaaatagaaaaaccctgcc

SEQ ID NO: 2572839 - DNA, 20 bp, Homo sapiens
gaaatagaaaaaccctgccc

SEQ ID NO: 2572840 - DNA, 20 bp, Homo sapiens
gaaatagaaatttccagaga

SEQ ID NO: 2572841 - DNA, 19 bp, Homo sapiens
gaaatagacagtatattta

SEQ ID NO: 2572842 - DNA, 17 bp, Homo sapiens
gaaatatacacacagca

SEQ ID NO: 2572843 - DNA, 17 bp, Homo sapiens
gaaatataggaacttaa

SEQ ID NO: 2572844 - DNA, 14 bp, Homo sapiens
gaaatatgatttta

SEQ ID NO: 2572845 - DNA, 18 bp, Homo sapiens
gaaatatgcacaatagca

SEQ ID NO: 2572846 - DNA, 16 bp, Homo sapiens
gaaatattgctggggt

SEQ ID NO: 2572847 - DNA, 13 bp, Homo sapiens
gaaatatttattt

SEQ ID NO: 2572848 - DNA, 22 bp, Homo sapiens
gaattttgtttggacttctttt

SEQ ID NO: 2572849 - DNA, 16 bp, Homo sapiens
gaatttttcattgata

SEQ ID NO: 2572850 - DNA, 20 bp, Homo sapiens
gaatttttttcatcttctct

SEQ ID NO: 2572851 - DNA, 16 bp, Homo sapiens
gacaaaaagtttccat

SEQ ID NO: 2572852 - DNA, 21 bp, Homo sapiens
gacaaaaatgaactgaagttt

SEQ ID NO: 2572853 - DNA, 22 bp, Homo sapiens
gacaaacacctcccaggagaca

SEQ ID NO: 2572854 - DNA, 22 bp, Homo sapiens
gacaaagatgatttaaaaggga

SEQ ID NO: 2572855 - DNA, 20 bp, Homo sapiens
gacaaattctgtttcttgag

SEQ ID NO: 2572856 - DNA, 19 bp, Homo sapiens
gacaacactgggaaacaga

SEQ ID NO: 2572857 - DNA, 20 bp, Homo sapiens
gacaaccctgcaaaggactg

SEQ ID NO: 2572858 - DNA, 15 bp, Homo sapiens
gacaacgaggaagcc

SEQ ID NO: 2572859 - DNA, 18 bp, Homo sapiens
gacaactttgccagcttt

SEQ ID NO: 2572860 - DNA, 15 bp, Homo sapiens
gacaagaaatccctg

SEQ ID NO: 2572861 - DNA, 16 bp, Homo sapiens
gacaagaaatccctgt

SEQ ID NO: 2572862 - DNA, 16 bp, Homo sapiens
gacaagcactgctagg

SEQ ID NO: 2572863 - DNA, 12 bp, Homo sapiens
gacaagcagagg

SEQ ID NO: 2572864 - DNA, 15 bp, Homo sapiens
gacaagccccaggca

SEQ ID NO: 2572865 - DNA, 16 bp, Homo sapiens
gacaagccccaggcag

SEQ ID NO: 2572866 - DNA, 21 bp, Homo sapiens
gacaaggattgctactgtcct

SEQ ID NO: 2572867 - DNA, 22 bp, Homo sapiens
gacaaggttcttcccttttaca

SEQ ID NO: 2572868 - DNA, 14 bp, Homo sapiens
gacaataaaacatt

SEQ ID NO: 2572869 - DNA, 15 bp, Homo sapiens
gacaataatctcact

SEQ ID NO: 2572870 - DNA, 21 bp, Homo sapiens
gacaatcatgaaatatgcatc

SEQ ID NO: 2572871 - DNA, 21 bp, Homo sapiens
gacaatgacttactgtacatg

SEQ ID NO: 2572872 - DNA, 12 bp, Homo sapiens
gacaatgtgaaa

SEQ ID NO: 2572873 - DNA, 13 bp, Homo sapiens
gacaattcatgaa

SEQ ID NO: 2572874 - DNA, 12 bp, Homo sapiens
gacaatttatta

SEQ ID NO: 2572875 - DNA, 13 bp, Homo sapiens
gacaatttattat

SEQ ID NO: 2572876 - DNA, 12 bp, Homo sapiens
gacacacacacg

SEQ ID NO: 2572877 - DNA, 20 bp, Homo sapiens
gacacacacacgcacgcaca

SEQ ID NO: 2572878 - DNA, 21 bp, Homo sapiens
gacacacacacgcacgcacac

SEQ ID NO: 2572879 - DNA, 14 bp, Homo sapiens
gacacacagctctg

SEQ ID NO: 2572880 - DNA, 11 bp, Homo sapiens
gacacagcagc

SEQ ID NO: 2572881 - DNA, 15 bp, Homo sapiens
gacacagcagcttca

SEQ ID NO: 2572882 - DNA, 18 bp, Homo sapiens
gacacagcagcttcacca

SEQ ID NO: 2572883 - DNA, 21 bp, Homo sapiens
gacacagcagcttcaccagag

SEQ ID NO: 2572884 - DNA, 22 bp, Homo sapiens
gacacagcagcttcaccagagc

SEQ ID NO: 2572885 - DNA, 14 bp, Homo sapiens
gacacagctcttct

SEQ ID NO: 2572886 - DNA, 17 bp, Homo sapiens
gacacagctcttctcca

SEQ ID NO: 2572887 - DNA, 22 bp, Homo sapiens
gacacagctttatcaccagaga

SEQ ID NO: 2572888 - DNA, 17 bp, Homo sapiens
gacacaggatgaaggca

SEQ ID NO: 2572889 - DNA, 17 bp, Homo sapiens
gacacaggcccggctcc

SEQ ID NO: 2572890 - DNA, 20 bp, Homo sapiens
gacacaggcccggctccagg

SEQ ID NO: 2572891 - DNA, 19 bp, Homo sapiens
gacaccagccaggctctgt

SEQ ID NO: 2572892 - DNA, 22 bp, Homo sapiens
gacaccatcttttgtgagatgt

SEQ ID NO: 2572893 - DNA, 14 bp, Homo sapiens
gacacccaaagggt

SEQ ID NO: 2572894 - DNA, 19 bp, Homo sapiens
gacacccatgtttctctgg

SEQ ID NO: 2572895 - DNA, 10 bp, Homo sapiens
gacacccggc

SEQ ID NO: 2572896 - DNA, 15 bp, Homo sapiens
gacaccttgacaggg

SEQ ID NO: 2572897 - DNA, 17 bp, Homo sapiens
gacaccttgacagggca

SEQ ID NO: 2572898 - DNA, 17 bp, Homo sapiens
gacacctttgcaggcat

SEQ ID NO: 2572899 - DNA, 23 bp, Homo sapiens
gacacgctcttctattttattcc

SEQ ID NO: 2572900 - DNA, 15 bp, Homo sapiens
gacactaaccacgct

SEQ ID NO: 2572901 - DNA, 16 bp, Homo sapiens
gacactaaccacgctg

SEQ ID NO: 2572902 - DNA, 20 bp, Homo sapiens
gacactaaccacgctggacc

SEQ ID NO: 2572903 - DNA, 18 bp, Homo sapiens
gacactaagttatagtat

SEQ ID NO: 2572904 - DNA, 20 bp, Homo sapiens
gacactaagttatagtatat

SEQ ID NO: 2572905 - DNA, 16 bp, Homo sapiens
gacactagaagatttt

SEQ ID NO: 2572906 - DNA, 15 bp, Homo sapiens
gacactcagacctga

SEQ ID NO: 2572907 - DNA, 12 bp, Homo sapiens
gacactccagtg

SEQ ID NO: 2572908 - DNA, 16 bp, Homo sapiens
gacactccagtgccag

SEQ ID NO: 2572909 - DNA, 15 bp, Homo sapiens
gacactcccttgggc

SEQ ID NO: 2572910 - DNA, 15 bp, Homo sapiens
gacactctggctggt

SEQ ID NO: 2572911 - DNA, 15 bp, Homo sapiens
gacactggcccctca

SEQ ID NO: 2572912 - DNA, 18 bp, Homo sapiens
gacacttcagagagctgg

SEQ ID NO: 2572913 - DNA, 23 bp, Homo sapiens
gacacttgccttcttcacccagc

SEQ ID NO: 2572914 - DNA, 23 bp, Homo sapiens
gacactttaattaccaacctgtt

SEQ ID NO: 2572915 - DNA, 20 bp, Homo sapiens
gacagaaagcagaacagtga

SEQ ID NO: 2572916 - DNA, 21 bp, Homo sapiens
gacagaaagcagaacagtgat

SEQ ID NO: 2572917 - DNA, 15 bp, Homo sapiens
gacagaagcagctct

SEQ ID NO: 2572918 - DNA, 16 bp, Homo sapiens
gacagaagcagctctt

SEQ ID NO: 2572919 - DNA, 13 bp, Homo sapiens
gacagaagcaggc

SEQ ID NO: 2572920 - DNA, 16 bp, Homo sapiens
gacagacacaggcccg

SEQ ID NO: 2572921 - DNA, 23 bp, Homo sapiens
gacagacacttctaaatgaagtg

SEQ ID NO: 2572922 - DNA, 18 bp, Homo sapiens
gacagaccacatctttat

SEQ ID NO: 2572923 - DNA, 22 bp, Homo sapiens
gacagaccacatctttatctgt

SEQ ID NO: 2572924 - DNA, 16 bp, Homo sapiens
gacagactcctgagga

SEQ ID NO: 2572925 - DNA, 23 bp, Homo sapiens
gacagactcctgaggacagctgt

SEQ ID NO: 2572926 - DNA, 21 bp, Homo sapiens
gacagagcaagtgagaccctg

SEQ ID NO: 2572927 - DNA, 13 bp, Homo sapiens
gacagagccatgc

SEQ ID NO: 2572928 - DNA, 15 bp, Homo sapiens
gacagaggcctgccc

SEQ ID NO: 2572929 - DNA, 13 bp, Homo sapiens
gacagagggaaga

SEQ ID NO: 2572930 - DNA, 16 bp, Homo sapiens
gacagagggaagaaaa

SEQ ID NO: 2572931 - DNA, 13 bp, Homo sapiens
gacagagggggtg

SEQ ID NO: 2572932 - DNA, 15 bp, Homo sapiens
gacagagggggtggc

SEQ ID NO: 2572933 - DNA, 18 bp, Homo sapiens
gacagagggggtggcctc

SEQ ID NO: 2572934 - DNA, 21 bp, Homo sapiens
gacagagtctcactgttgccc

SEQ ID NO: 2572935 - DNA, 19 bp, Homo sapiens
gacagagtgagactctgtc

SEQ ID NO: 2572936 - DNA, 14 bp, Homo sapiens
gacagatcaagctg

SEQ ID NO: 2572937 - DNA, 17 bp, Homo sapiens
gacagatcaagctgtga

SEQ ID NO: 2572938 - DNA, 23 bp, Homo sapiens
gacagatcaagctgtgagacagt

SEQ ID NO: 2572939 - DNA, 21 bp, Homo sapiens
gacagatctctgctttggaaa

SEQ ID NO: 2572940 - DNA, 23 bp, Homo sapiens
gacagatctctgctttggaaatc

SEQ ID NO: 2572941 - DNA, 17 bp, Homo sapiens
gacagatgtcagccgag

SEQ ID NO: 2572942 - DNA, 19 bp, Homo sapiens
gacagcaacggggaggcca

SEQ ID NO: 2572943 - DNA, 14 bp, Homo sapiens
gacagcagctcagg

SEQ ID NO: 2572944 - DNA, 16 bp, Homo sapiens
gacagcagctcaggca

SEQ ID NO: 2572945 - DNA, 13 bp, Homo sapiens
gacagccacggcc

SEQ ID NO: 2572946 - DNA, 19 bp, Homo sapiens
gacagccacggccaggcca

SEQ ID NO: 2572947 - DNA, 17 bp, Homo sapiens
gacagcccgggctctgc

SEQ ID NO: 2572948 - DNA, 23 bp, Homo sapiens
gacagcccgggctctgcctccca

SEQ ID NO: 2572949 - DNA, 18 bp, Homo sapiens
gacagctccctctgcctg

SEQ ID NO: 2572950 - DNA, 14 bp, Homo sapiens
gacagctccttctg

SEQ ID NO: 2572951 - DNA, 17 bp, Homo sapiens
gacagctccttctgtcc

SEQ ID NO: 2572952 - DNA, 18 bp, Homo sapiens
gacagctccttctgtcct

SEQ ID NO: 2572953 - DNA, 13 bp, Homo sapiens
gacagctgcctgg

SEQ ID NO: 2572954 - DNA, 17 bp, Homo sapiens
gacagctgcctgggatc

SEQ ID NO: 2572955 - DNA, 21 bp, Homo sapiens
gacagctgcctgggatccctc

SEQ ID NO: 2572956 - DNA, 22 bp, Homo sapiens
gacagcttctcatcctgcaggc

SEQ ID NO: 2572957 - DNA, 23 bp, Homo sapiens
gacaggacagtgcttcagcctga

SEQ ID NO: 2572958 - DNA, 13 bp, Homo sapiens
gacaggacctgac

SEQ ID NO: 2572959 - DNA, 20 bp, Homo sapiens
gacaggacgggcttgggctt

SEQ ID NO: 2572960 - DNA, 21 bp, Homo sapiens
gacaggagacctggcactgga

SEQ ID NO: 2572961 - DNA, 17 bp, Homo sapiens
gacaggagggcaagggc

SEQ ID NO: 2572962 - DNA, 21 bp, Homo sapiens
gacaggcaagcacctcctgcc

SEQ ID NO: 2572963 - DNA, 14 bp, Homo sapiens
gacaggcaatgctg

SEQ ID NO: 2572964 - DNA, 18 bp, Homo sapiens
gacaggcaatgctggctg

SEQ ID NO: 2572965 - DNA, 19 bp, Homo sapiens
gacaggcaatgctggctgt

SEQ ID NO: 2572966 - DNA, 13 bp, Homo sapiens
gacaggcagcaga

SEQ ID NO: 2572967 - DNA, 15 bp, Homo sapiens
gacaggcagcctgga

SEQ ID NO: 2572968 - DNA, 20 bp, Homo sapiens
gacaggcatgttctctgagg

SEQ ID NO: 2572969 - DNA, 16 bp, Homo sapiens
gacaggcccaagagat

SEQ ID NO: 2572970 - DNA, 21 bp, Homo sapiens
gacaggcccaagagatgaaga

SEQ ID NO: 2572971 - DNA, 22 bp, Homo sapiens
gacaggcccaagagatgaagag

SEQ ID NO: 2572972 - DNA, 14 bp, Homo sapiens
gacagggatgagca

SEQ ID NO: 2572973 - DNA, 17 bp, Homo sapiens
gacagggctggcccagc

SEQ ID NO: 2572974 - DNA, 15 bp, Homo sapiens
gacagtatacagtcc

SEQ ID NO: 2572975 - DNA, 22 bp, Homo sapiens
gacagtatgagtcaatgtgcag

SEQ ID NO: 2572976 - DNA, 15 bp, Homo sapiens
gacagtatttgtggg

SEQ ID NO: 2572977 - DNA, 16 bp, Homo sapiens
gacagtccagcctgga

SEQ ID NO: 2572978 - DNA, 14 bp, Homo sapiens
gacagtccctgcca

SEQ ID NO: 2572979 - DNA, 16 bp, Homo sapiens
gacagtccctgccaat

SEQ ID NO: 2572980 - DNA, 14 bp, Homo sapiens
gacagtcctgggag

SEQ ID NO: 2572981 - DNA, 23 bp, Homo sapiens
gacagtctttgggtacctatttt

SEQ ID NO: 2572982 - DNA, 21 bp, Homo sapiens
gacagtgagactctgtctcag

SEQ ID NO: 2572983 - DNA, 16 bp, Homo sapiens
gacagtgatctccata

SEQ ID NO: 2572984 - DNA, 19 bp, Homo sapiens
gacagtgcttcagcctgag

SEQ ID NO: 2572985 - DNA, 13 bp, Homo sapiens
gacagtgggaaat

SEQ ID NO: 2572986 - DNA, 17 bp, Homo sapiens
gacagttcatatgtacc

SEQ ID NO: 2572987 - DNA, 14 bp, Homo sapiens
gacagttctgaaga

SEQ ID NO: 2572988 - DNA, 22 bp, Homo sapiens
gacagttttccttctcatctgt

SEQ ID NO: 2572989 - DNA, 16 bp, Homo sapiens
gacataatttcactga

SEQ ID NO: 2572990 - DNA, 16 bp, Homo sapiens
gacatactaaccagca

SEQ ID NO: 2572991 - DNA, 22 bp, Homo sapiens
gacatagagagggagaagaagt

SEQ ID NO: 2572992 - DNA, 14 bp, Homo sapiens
gagacttgctctct

SEQ ID NO: 2572993 - DNA, 22 bp, Homo sapiens
gagacttttaatcagacaaagt

SEQ ID NO: 2572994 - DNA, 14 bp, Homo sapiens
gagagaaaaacaaa

SEQ ID NO: 2572995 - DNA, 16 bp, Homo sapiens
gagagaaaataaaaag

SEQ ID NO: 2572996 - DNA, 11 bp, Homo sapiens
gagagaaagaa

SEQ ID NO: 2572997 - DNA, 13 bp, Homo sapiens
gagagaagtgccc

SEQ ID NO: 2572998 - DNA, 18 bp, Homo sapiens
gagagaagtgcccctgct

SEQ ID NO: 2572999 - DNA, 16 bp, Homo sapiens
gagagaccaggcaaag

SEQ ID NO: 2573000 - DNA, 20 bp, Homo sapiens
gagagacgtgtacatagtgt

SEQ ID NO: 2573001 - DNA, 12 bp, Homo sapiens
gagagaggggaa

SEQ ID NO: 2573002 - DNA, 17 bp, Homo sapiens
gagagcaggctggcagc

SEQ ID NO: 2573003 - DNA, 16 bp, Homo sapiens
gagagccaccaagagg

SEQ ID NO: 2573004 - DNA, 22 bp, Homo sapiens
gagagccagagaagtgacaggg

SEQ ID NO: 2573005 - DNA, 14 bp, Homo sapiens
gagagcccagaggt

SEQ ID NO: 2573006 - DNA, 21 bp, Homo sapiens
gagagcccagaggtaacagaa

SEQ ID NO: 2573007 - DNA, 15 bp, Homo sapiens
gagagcccgggagct

SEQ ID NO: 2573008 - DNA, 14 bp, Homo sapiens
gagagcctgctgca

SEQ ID NO: 2573009 - DNA, 15 bp, Homo sapiens
gagagccttccaggg

SEQ ID NO: 2573010 - DNA, 18 bp, Homo sapiens
gagagccttccaggggtg

SEQ ID NO: 2573011 - DNA, 16 bp, Homo sapiens
gagagcgcctgcccct

SEQ ID NO: 2573012 - DNA, 17 bp, Homo sapiens
gagagctagaacctaga

SEQ ID NO: 2573013 - DNA, 23 bp, Homo sapiens
gagagctggggaagcttcttaaa

SEQ ID NO: 2573014 - DNA, 20 bp, Homo sapiens
gagagctgggtgtcaagagg

SEQ ID NO: 2573015 - DNA, 17 bp, Homo sapiens
gagagctggtgcccgga

SEQ ID NO: 2573016 - DNA, 19 bp, Homo sapiens
gagaggaatgcctgtgtga

SEQ ID NO: 2573017 - DNA, 19 bp, Homo sapiens
gagaggagagccagagaag

SEQ ID NO: 2573018 - DNA, 13 bp, Homo sapiens
gagaggaggcaac

SEQ ID NO: 2573019 - DNA, 15 bp, Homo sapiens
gagaggagttcaatg

SEQ ID NO: 2573020 - DNA, 14 bp, Homo sapiens
gagaggatgagagc

SEQ ID NO: 2573021 - DNA, 16 bp, Homo sapiens
gagaggcagagaaaga

SEQ ID NO: 2573022 - DNA, 15 bp, Homo sapiens
gagagggagaagaag

SEQ ID NO: 2573023 - DNA, 21 bp, Homo sapiens
gagagggcatgcgcacaaggc

SEQ ID NO: 2573024 - DNA, 18 bp, Homo sapiens
gagaggggaagagtgtac

SEQ ID NO: 2573025 - DNA, 20 bp, Homo sapiens
gagaggggaagagtgtactg

SEQ ID NO: 2573026 - DNA, 21 bp, Homo sapiens
gagaggggaagagtgtactgg

SEQ ID NO: 2573027 - DNA, 16 bp, Homo sapiens
gagaggggaagggcca

SEQ ID NO: 2573028 - DNA, 22 bp, Homo sapiens
gagaggggacaaaacccacctt

SEQ ID NO: 2573029 - DNA, 13 bp, Homo sapiens
gagagggtgacaa

SEQ ID NO: 2573030 - DNA, 14 bp, Homo sapiens
gagagggtgggagt

SEQ ID NO: 2573031 - DNA, 21 bp, Homo sapiens
gagagggtgggagtgggccca

SEQ ID NO: 2573032 - DNA, 13 bp, Homo sapiens
gagaggtgccagc

SEQ ID NO: 2573033 - DNA, 21 bp, Homo sapiens
gagaggtgccagcaactgaat

SEQ ID NO: 2573034 - DNA, 20 bp, Homo sapiens
gagagtcccactgcctcagg

SEQ ID NO: 2573035 - DNA, 21 bp, Homo sapiens
gagagtcccactgcctcaggt

SEQ ID NO: 2573036 - DNA, 15 bp, Homo sapiens
gagagtcccagagca

SEQ ID NO: 2573037 - DNA, 15 bp, Homo sapiens
gagagtcctctggat

SEQ ID NO: 2573038 - DNA, 14 bp, Homo sapiens
gagagtctgtctca

SEQ ID NO: 2573039 - DNA, 15 bp, Homo sapiens
gagataatatgagaa

SEQ ID NO: 2573040 - DNA, 12 bp, Homo sapiens
gagatagcattg

SEQ ID NO: 2573041 - DNA, 18 bp, Homo sapiens
gagatatctgagggagga

SEQ ID NO: 2573042 - DNA, 22 bp, Homo sapiens
gagatatctgagggaggaggcc

SEQ ID NO: 2573043 - DNA, 17 bp, Homo sapiens
gagatattttaaaatga

SEQ ID NO: 2573044 - DNA, 23 bp, Homo sapiens
gagatcaaccccttcgctcctgt

SEQ ID NO: 2573045 - DNA, 16 bp, Homo sapiens
gagatcacgccactgc

SEQ ID NO: 2573046 - DNA, 18 bp, Homo sapiens
gagatcacgccactgcac

SEQ ID NO: 2573047 - DNA, 16 bp, Homo sapiens
gagatcatcctttcca

SEQ ID NO: 2573048 - DNA, 20 bp, Homo sapiens
gagatcatcctttccagcat

SEQ ID NO: 2573049 - DNA, 17 bp, Homo sapiens
gagatcccgcctcttct

SEQ ID NO: 2573050 - DNA, 21 bp, Homo sapiens
gagatctaagcctttccataa

SEQ ID NO: 2573051 - DNA, 21 bp, Homo sapiens
gagatgaaatcttacagctgg

SEQ ID NO: 2573052 - DNA, 20 bp, Homo sapiens
gagatgaagcaaacacatta

SEQ ID NO: 2573053 - DNA, 13 bp, Homo sapiens
gagatgactgagt

SEQ ID NO: 2573054 - DNA, 21 bp, Homo sapiens
gagatgactgagtcctcgtag

SEQ ID NO: 2573055 - DNA, 20 bp, Homo sapiens
gagatggaagttgcagtgag

SEQ ID NO: 2573056 - DNA, 23 bp, Homo sapiens
gagatggatcaatcaaacccggc

SEQ ID NO: 2573057 - DNA, 17 bp, Homo sapiens
gagatgtaaaaggtatt

SEQ ID NO: 2573058 - DNA, 16 bp, Homo sapiens
gagatgtaattgtttt

SEQ ID NO: 2573059 - DNA, 15 bp, Homo sapiens
gagatgtagcaaaac

SEQ ID NO: 2573060 - DNA, 15 bp, Homo sapiens
gagattacctcctga

SEQ ID NO: 2573061 - DNA, 18 bp, Homo sapiens
gagattgcaccactgcac

SEQ ID NO: 2573062 - DNA, 17 bp, Homo sapiens
gagattggacggcctga

SEQ ID NO: 2573063 - DNA, 23 bp, Homo sapiens
gagattgttgtttgccatacttt

SEQ ID NO: 2573064 - DNA, 13 bp, Homo sapiens
gagatttacaact

SEQ ID NO: 2573065 - DNA, 13 bp, Homo sapiens
gagcaaaggctga

SEQ ID NO: 2573066 - DNA, 14 bp, Homo sapiens
gagcaaagtgaggg

SEQ ID NO: 2573067 - DNA, 15 bp, Homo sapiens
gagcaaatgtttctg

SEQ ID NO: 2573068 - DNA, 20 bp, Homo sapiens
gagcaacagagtgagaccct

SEQ ID NO: 2573069 - DNA, 18 bp, Homo sapiens
gagcaagacgctgtgctg

SEQ ID NO: 2573070 - DNA, 12 bp, Homo sapiens
gagcaagactct

SEQ ID NO: 2573071 - DNA, 13 bp, Homo sapiens
gagcaagagctgg

SEQ ID NO: 2573072 - DNA, 20 bp, Homo sapiens
gagcacactttagtggccga

SEQ ID NO: 2573073 - DNA, 14 bp, Homo sapiens
gagcacaggcagct

SEQ ID NO: 2573074 - DNA, 15 bp, Homo sapiens
gagcacaggcagctg

SEQ ID NO: 2573075 - DNA, 13 bp, Homo sapiens
gagcaccagggga

SEQ ID NO: 2573076 - DNA, 12 bp, Homo sapiens
gagcacctgctt

SEQ ID NO: 2573077 - DNA, 23 bp, Homo sapiens
gagcacctgcttcatgctcagcc

SEQ ID NO: 2573078 - DNA, 17 bp, Homo sapiens
gagcaccttagacagtc

SEQ ID NO: 2573079 - DNA, 19 bp, Homo sapiens
gagcaccttcctcacttcc

SEQ ID NO: 2573080 - DNA, 15 bp, Homo sapiens
gagcactaaggtgtg

SEQ ID NO: 2573081 - DNA, 20 bp, Homo sapiens
gagcactcccaagtctacag

SEQ ID NO: 2573082 - DNA, 23 bp, Homo sapiens
gagcagaacggagccccaggcct

SEQ ID NO: 2573083 - DNA, 14 bp, Homo sapiens
gagcagacaggagg

SEQ ID NO: 2573084 - DNA, 15 bp, Homo sapiens
gagcagacaggagga

SEQ ID NO: 2573085 - DNA, 21 bp, Homo sapiens
gagcagacaggaggaatcatg

SEQ ID NO: 2573086 - DNA, 19 bp, Homo sapiens
gagcagagaccatccctga

SEQ ID NO: 2573087 - DNA, 21 bp, Homo sapiens
gagcagagaccatccctgaag

SEQ ID NO: 2573088 - DNA, 14 bp, Homo sapiens
gagcagatgcagag

SEQ ID NO: 2573089 - DNA, 17 bp, Homo sapiens
gagcagcctcagaacaa

SEQ ID NO: 2573090 - DNA, 17 bp, Homo sapiens
gagcagctttaaactca

SEQ ID NO: 2573091 - DNA, 22 bp, Homo sapiens
gagcagctttaaactcagggac

SEQ ID NO: 2573092 - DNA, 20 bp, Homo sapiens
gagcaggctggcagctctcc

SEQ ID NO: 2573093 - DNA, 13 bp, Homo sapiens
gagcaggggcagg

SEQ ID NO: 2573094 - DNA, 16 bp, Homo sapiens
gagcaggggcagggtg

SEQ ID NO: 2573095 - DNA, 16 bp, Homo sapiens
gagcagtcctgcctca

SEQ ID NO: 2573096 - DNA, 21 bp, Homo sapiens
gagcagtgaatgattcagtgt

SEQ ID NO: 2573097 - DNA, 17 bp, Homo sapiens
gagcagtgtcttccata

SEQ ID NO: 2573098 - DNA, 21 bp, Homo sapiens
gagcagtttctgtcctgctgg

SEQ ID NO: 2573099 - DNA, 15 bp, Homo sapiens
gagcatcaggccagg

SEQ ID NO: 2573100 - DNA, 16 bp, Homo sapiens
gagcatcaggccaggc

SEQ ID NO: 2573101 - DNA, 20 bp, Homo sapiens
gagcatcaggccaggccctc

SEQ ID NO: 2573102 - DNA, 22 bp, Homo sapiens
gagcatcaggccaggccctctg

SEQ ID NO: 2573103 - DNA, 22 bp, Homo sapiens
gagcatctcttgaggccaggag

SEQ ID NO: 2573104 - DNA, 21 bp, Homo sapiens
gagcatgcctggatggggctg

SEQ ID NO: 2573105 - DNA, 16 bp, Homo sapiens
gagcatggctgtgagg

SEQ ID NO: 2573106 - DNA, 17 bp, Homo sapiens
gagcatttagggcaagg

SEQ ID NO: 2573107 - DNA, 23 bp, Homo sapiens
gagccaagggttcagagactcag

SEQ ID NO: 2573108 - DNA, 18 bp, Homo sapiens
gagccaccgcgcccagcc

SEQ ID NO: 2573109 - DNA, 14 bp, Homo sapiens
gagccactaactag

SEQ ID NO: 2573110 - DNA, 14 bp, Homo sapiens
gagccactcctctg

SEQ ID NO: 2573111 - DNA, 14 bp, Homo sapiens
gagccagagaagtg

SEQ ID NO: 2573112 - DNA, 21 bp, Homo sapiens
gagccagcagcctggctctcc

SEQ ID NO: 2573113 - DNA, 15 bp, Homo sapiens
gagccagcctgctcc

SEQ ID NO: 2573114 - DNA, 22 bp, Homo sapiens
gagccaggtaatgagggactgg

SEQ ID NO: 2573115 - DNA, 18 bp, Homo sapiens
gagccagtaaacagagga

SEQ ID NO: 2573116 - DNA, 23 bp, Homo sapiens
gagccattttggggggcccccct

SEQ ID NO: 2573117 - DNA, 14 bp, Homo sapiens
gagccattttgtga

SEQ ID NO: 2573118 - DNA, 16 bp, Homo sapiens
gagccattttgtgaat

SEQ ID NO: 2573119 - DNA, 11 bp, Homo sapiens
gagcccacgcc

SEQ ID NO: 2573120 - DNA, 20 bp, Homo sapiens
gagcccactgcccaccccct

SEQ ID NO: 2573121 - DNA, 23 bp, Homo sapiens
gagcccactgcccaccccctcaa

SEQ ID NO: 2573122 - DNA, 21 bp, Homo sapiens
gagcccagaggtaacagaaca

SEQ ID NO: 2573123 - DNA, 23 bp, Homo sapiens
gagcccagaggtaacagaacagc

SEQ ID NO: 2573124 - DNA, 22 bp, Homo sapiens
gagcccagccattaccatggag

SEQ ID NO: 2573125 - DNA, 15 bp, Homo sapiens
gagccccaagtcctg

SEQ ID NO: 2573126 - DNA, 16 bp, Homo sapiens
gagccccagctaccct

SEQ ID NO: 2573127 - DNA, 17 bp, Homo sapiens
gagccccaggcctctgt

SEQ ID NO: 2573128 - DNA, 12 bp, Homo sapiens
gagccccagtgc

SEQ ID NO: 2573129 - DNA, 18 bp, Homo sapiens
gagccccatcagctccag

SEQ ID NO: 2573130 - DNA, 16 bp, Homo sapiens
gagccccattcctggg

SEQ ID NO: 2573131 - DNA, 22 bp, Homo sapiens
gagcccccccaacactgtgccc

SEQ ID NO: 2573132 - DNA, 22 bp, Homo sapiens
gagcccccgccccgccccacat

SEQ ID NO: 2573133 - DNA, 12 bp, Homo sapiens
gagcccctgggt

SEQ ID NO: 2573134 - DNA, 11 bp, Homo sapiens
gagccccttcc

SEQ ID NO: 2573135 - DNA, 17 bp, Homo sapiens
gagcccgcacccccacc

SEQ ID NO: 2573136 - DNA, 20 bp, Homo sapiens
gagcccgcacccccaccctt

SEQ ID NO: 2573137 - DNA, 15 bp, Homo sapiens
gatagcacagaccct

SEQ ID NO: 2573138 - DNA, 16 bp, Homo sapiens
gatagcacagaccctg

SEQ ID NO: 2573139 - DNA, 18 bp, Homo sapiens
gatagcacagaccctgcc

SEQ ID NO: 2573140 - DNA, 22 bp, Homo sapiens
gatagcacagaccctgccctgt

SEQ ID NO: 2573141 - DNA, 15 bp, Homo sapiens
gatagcattgtgaac

SEQ ID NO: 2573142 - DNA, 22 bp, Homo sapiens
gatagcatttttgatttatgca

SEQ ID NO: 2573143 - DNA, 23 bp, Homo sapiens
gatagcttcaccccaatcccagc

SEQ ID NO: 2573144 - DNA, 18 bp, Homo sapiens
gataggaatgtgaaagca

SEQ ID NO: 2573145 - DNA, 12 bp, Homo sapiens
gataggctctgc

SEQ ID NO: 2573146 - DNA, 14 bp, Homo sapiens
gataggctctgcac

SEQ ID NO: 2573147 - DNA, 12 bp, Homo sapiens
gatagttactgt

SEQ ID NO: 2573148 - DNA, 14 bp, Homo sapiens
gatagttactgttg

SEQ ID NO: 2573149 - DNA, 16 bp, Homo sapiens
gatataaatggctggt

SEQ ID NO: 2573150 - DNA, 18 bp, Homo sapiens
gatatacttttttcttat

SEQ ID NO: 2573151 - DNA, 18 bp, Homo sapiens
gatatatgctctgcatgt

SEQ ID NO: 2573152 - DNA, 14 bp, Homo sapiens
gatatattttacaa

SEQ ID NO: 2573153 - DNA, 16 bp, Homo sapiens
gatatctgagggagga

SEQ ID NO: 2573154 - DNA, 21 bp, Homo sapiens
gatatctgagggaggaggcca

SEQ ID NO: 2573155 - DNA, 23 bp, Homo sapiens
gatatctgagggaggaggccacc

SEQ ID NO: 2573156 - DNA, 15 bp, Homo sapiens
gatatcttgaaatga

SEQ ID NO: 2573157 - DNA, 15 bp, Homo sapiens
gatatgaaaaatatg

SEQ ID NO: 2573158 - DNA, 18 bp, Homo sapiens
gatatgcagttttcctta

SEQ ID NO: 2573159 - DNA, 12 bp, Homo sapiens
gatatggagccc

SEQ ID NO: 2573160 - DNA, 14 bp, Homo sapiens
gatatggcagaaga

SEQ ID NO: 2573161 - DNA, 20 bp, Homo sapiens
gatatgtacctaacgaagta

SEQ ID NO: 2573162 - DNA, 21 bp, Homo sapiens
gatattccatgaatgtatcag

SEQ ID NO: 2573163 - DNA, 17 bp, Homo sapiens
gatattgtgaagtacat

SEQ ID NO: 2573164 - DNA, 21 bp, Homo sapiens
gatattttctgtgcctgaata

SEQ ID NO: 2573165 - DNA, 20 bp, Homo sapiens
gatattttcttccaagcaaa

SEQ ID NO: 2573166 - DNA, 15 bp, Homo sapiens
gatattttgctttgt

SEQ ID NO: 2573167 - DNA, 16 bp, Homo sapiens
gatattttgctttgtg

SEQ ID NO: 2573168 - DNA, 21 bp, Homo sapiens
gatattttttcagaaatatgt

SEQ ID NO: 2573169 - DNA, 20 bp, Homo sapiens
gatcaaaaggttaataaagt

SEQ ID NO: 2573170 - DNA, 14 bp, Homo sapiens
gatcaaatacttta

SEQ ID NO: 2573171 - DNA, 19 bp, Homo sapiens
gatcaaatactttaaagga

SEQ ID NO: 2573172 - DNA, 23 bp, Homo sapiens
gatcaaattcatttttttcactg

SEQ ID NO: 2573173 - DNA, 14 bp, Homo sapiens
gatcaagctgtgag

SEQ ID NO: 2573174 - DNA, 14 bp, Homo sapiens
gatcaataaaatgt

SEQ ID NO: 2573175 - DNA, 22 bp, Homo sapiens
gatcaatggcgcagtgcctctg

SEQ ID NO: 2573176 - DNA, 23 bp, Homo sapiens
gatcaatggcgcagtgcctctgg

SEQ ID NO: 2573177 - DNA, 15 bp, Homo sapiens
gatcaattaaatgta

SEQ ID NO: 2573178 - DNA, 17 bp, Homo sapiens
gatcacagagacattcc

SEQ ID NO: 2573179 - DNA, 13 bp, Homo sapiens
gatcacagctgct

SEQ ID NO: 2573180 - DNA, 19 bp, Homo sapiens
gatcacagcttcagccagg

SEQ ID NO: 2573181 - DNA, 13 bp, Homo sapiens
gatcacagggccc

SEQ ID NO: 2573182 - DNA, 20 bp, Homo sapiens
gatcacagggccccagaagg

SEQ ID NO: 2573183 - DNA, 14 bp, Homo sapiens
gatcacctgaggtt

SEQ ID NO: 2573184 - DNA, 13 bp, Homo sapiens
gatcacgccactg

SEQ ID NO: 2573185 - DNA, 18 bp, Homo sapiens
gatcacgccactgcacta

SEQ ID NO: 2573186 - DNA, 13 bp, Homo sapiens
gatcactggagcc

SEQ ID NO: 2573187 - DNA, 14 bp, Homo sapiens
gatcactggagccc

SEQ ID NO: 2573188 - DNA, 15 bp, Homo sapiens
gatcagaacagcaga

SEQ ID NO: 2573189 - DNA, 23 bp, Homo sapiens
gatcagattgcatgtgactctga

SEQ ID NO: 2573190 - DNA, 17 bp, Homo sapiens
gatcagctgtttgtcat

SEQ ID NO: 2573191 - DNA, 19 bp, Homo sapiens
gatcatatacgtgaaaatt

SEQ ID NO: 2573192 - DNA, 21 bp, Homo sapiens
gatcatcctttccagcatgag

SEQ ID NO: 2573193 - DNA, 12 bp, Homo sapiens
gatcatgcattg

SEQ ID NO: 2573194 - DNA, 14 bp, Homo sapiens
gatcatggcatcca

SEQ ID NO: 2573195 - DNA, 14 bp, Homo sapiens
gatcatggtgtaat

SEQ ID NO: 2573196 - DNA, 15 bp, Homo sapiens
gatcatggtgtaata

SEQ ID NO: 2573197 - DNA, 20 bp, Homo sapiens
gatcatggtgtaataagaca

SEQ ID NO: 2573198 - DNA, 23 bp, Homo sapiens
gatcatggtgtaataagacataa

SEQ ID NO: 2573199 - DNA, 18 bp, Homo sapiens
gatcattttccccccact

SEQ ID NO: 2573200 - DNA, 23 bp, Homo sapiens
gatcattttccccccactctccc

SEQ ID NO: 2573201 - DNA, 20 bp, Homo sapiens
gatccaactaatgccttact

SEQ ID NO: 2573202 - DNA, 12 bp, Homo sapiens
gatccaagctgg

SEQ ID NO: 2573203 - DNA, 15 bp, Homo sapiens
gatccacacacagag

SEQ ID NO: 2573204 - DNA, 18 bp, Homo sapiens
gatccacccacctcagcc

SEQ ID NO: 2573205 - DNA, 18 bp, Homo sapiens
gatccacctgtctcagcc

SEQ ID NO: 2573206 - DNA, 19 bp, Homo sapiens
gatccacctgtctcagcct

SEQ ID NO: 2573207 - DNA, 17 bp, Homo sapiens
gatcccagctcacgtca

SEQ ID NO: 2573208 - DNA, 20 bp, Homo sapiens
gatccccaagtgtgaacaaa

SEQ ID NO: 2573209 - DNA, 14 bp, Homo sapiens
gatccccagctgtt

SEQ ID NO: 2573210 - DNA, 13 bp, Homo sapiens
gatcccctcagga

SEQ ID NO: 2573211 - DNA, 14 bp, Homo sapiens
gatcccctcaggac

SEQ ID NO: 2573212 - DNA, 23 bp, Homo sapiens
gatccctctacagagcttccctg

SEQ ID NO: 2573213 - DNA, 20 bp, Homo sapiens
gatccctgttacccagagaa

SEQ ID NO: 2573214 - DNA, 18 bp, Homo sapiens
gatcctaagggctcaccg

SEQ ID NO: 2573215 - DNA, 19 bp, Homo sapiens
gatcctcacaaccacctaa

SEQ ID NO: 2573216 - DNA, 23 bp, Homo sapiens
gatcctcatatggcccagtgtca

SEQ ID NO: 2573217 - DNA, 11 bp, Homo sapiens
gatcctccagg

SEQ ID NO: 2573218 - DNA, 16 bp, Homo sapiens
gatcctcccacctcag

SEQ ID NO: 2573219 - DNA, 20 bp, Homo sapiens
gatcctcccacctcagcctc

SEQ ID NO: 2573220 - DNA, 21 bp, Homo sapiens
gatcctcccacctcagcctcc

SEQ ID NO: 2573221 - DNA, 14 bp, Homo sapiens
gatccttttatgtt

SEQ ID NO: 2573222 - DNA, 18 bp, Homo sapiens
gatcgtctgactggtgtt

SEQ ID NO: 2573223 - DNA, 16 bp, Homo sapiens
gatcgtgacgctgaat

SEQ ID NO: 2573224 - DNA, 22 bp, Homo sapiens
gatcgtgacgctgaataaatgt

SEQ ID NO: 2573225 - DNA, 18 bp, Homo sapiens
gatcgtgctaaattttca

SEQ ID NO: 2573226 - DNA, 20 bp, Homo sapiens
gatctaggaagactttggaa

SEQ ID NO: 2573227 - DNA, 18 bp, Homo sapiens
gatctaggtttaactcag

SEQ ID NO: 2573228 - DNA, 18 bp, Homo sapiens
gatctcaggggctgtttg

SEQ ID NO: 2573229 - DNA, 20 bp, Homo sapiens
gatctccaaggaccaggtta

SEQ ID NO: 2573230 - DNA, 19 bp, Homo sapiens
gatctccatggcttcctcc

SEQ ID NO: 2573231 - DNA, 13 bp, Homo sapiens
gatctcctgacct

SEQ ID NO: 2573232 - DNA, 14 bp, Homo sapiens
gatctctcaggagc

SEQ ID NO: 2573233 - DNA, 22 bp, Homo sapiens
gatctctcaggagcacaggcag

SEQ ID NO: 2573234 - DNA, 20 bp, Homo sapiens
gatctgcagggggtgtgtct

SEQ ID NO: 2573235 - DNA, 13 bp, Homo sapiens
gatctgcccctcc

SEQ ID NO: 2573236 - DNA, 17 bp, Homo sapiens
gatctggggctctggga

SEQ ID NO: 2573237 - DNA, 18 bp, Homo sapiens
gatctggggctctgggat

SEQ ID NO: 2573238 - DNA, 18 bp, Homo sapiens
gatctgggttcactgcaa

SEQ ID NO: 2573239 - DNA, 20 bp, Homo sapiens
gatctgggttcactgcaacc

SEQ ID NO: 2573240 - DNA, 15 bp, Homo sapiens
gatctgtatatacaa

SEQ ID NO: 2573241 - DNA, 18 bp, Homo sapiens
gatctgtgctttccagct

SEQ ID NO: 2573242 - DNA, 19 bp, Homo sapiens
gatctgtttttaaaaatca

SEQ ID NO: 2573243 - DNA, 23 bp, Homo sapiens
gatctgtttttaaaaatcataaa

SEQ ID NO: 2573244 - DNA, 13 bp, Homo sapiens
gatcttaaatttt

SEQ ID NO: 2573245 - DNA, 19 bp, Homo sapiens
gatcttaaattttgtgata

SEQ ID NO: 2573246 - DNA, 15 bp, Homo sapiens
gatcttcaatggctt

SEQ ID NO: 2573247 - DNA, 12 bp, Homo sapiens
gatctttcagga

SEQ ID NO: 2573248 - DNA, 16 bp, Homo sapiens
gatctttgcagacagg

SEQ ID NO: 2573249 - DNA, 21 bp, Homo sapiens
gatctttggacagaagcagct

SEQ ID NO: 2573250 - DNA, 16 bp, Homo sapiens
gatcttttcaagttaa

SEQ ID NO: 2573251 - DNA, 22 bp, Homo sapiens
gatgaacccaggacgcttctga

SEQ ID NO: 2573252 - DNA, 22 bp, Homo sapiens
gatgaactcttagaaatgaagg

SEQ ID NO: 2573253 - DNA, 17 bp, Homo sapiens
gatgaacttattctgta

SEQ ID NO: 2573254 - DNA, 13 bp, Homo sapiens
gatgaactttctc

SEQ ID NO: 2573255 - DNA, 14 bp, Homo sapiens
gatgaagagtgaga

SEQ ID NO: 2573256 - DNA, 16 bp, Homo sapiens
gatgaattaaatttaa

SEQ ID NO: 2573257 - DNA, 19 bp, Homo sapiens
gatgacaaatggagaagaa

SEQ ID NO: 2573258 - DNA, 14 bp, Homo sapiens
gatgacattgctaa

SEQ ID NO: 2573259 - DNA, 16 bp, Homo sapiens
gatgacattgctaaga

SEQ ID NO: 2573260 - DNA, 21 bp, Homo sapiens
gatgacattgctaagatgctc

SEQ ID NO: 2573261 - DNA, 23 bp, Homo sapiens
gatgaccctgcgaaggggccctg

SEQ ID NO: 2573262 - DNA, 15 bp, Homo sapiens
gatgacctggataac

SEQ ID NO: 2573263 - DNA, 14 bp, Homo sapiens
gatgactgagtcct

SEQ ID NO: 2573264 - DNA, 22 bp, Homo sapiens
gatgagaaaggttgaagcacca

SEQ ID NO: 2573265 - DNA, 23 bp, Homo sapiens
gatgagacttccaaacctgacag

SEQ ID NO: 2573266 - DNA, 14 bp, Homo sapiens
gatgagagcccaga

SEQ ID NO: 2573267 - DNA, 17 bp, Homo sapiens
gatgagagcccagaggt

SEQ ID NO: 2573268 - DNA, 18 bp, Homo sapiens
gatgagagcccagaggta

SEQ ID NO: 2573269 - DNA, 17 bp, Homo sapiens
gatgagcatggagctgg

SEQ ID NO: 2573270 - DNA, 12 bp, Homo sapiens
gatgagcattta

SEQ ID NO: 2573271 - DNA, 23 bp, Homo sapiens
gatgagccgctgtgagcccctgg

SEQ ID NO: 2573272 - DNA, 21 bp, Homo sapiens
gatgatacaagattagaagct

SEQ ID NO: 2573273 - DNA, 14 bp, Homo sapiens
gatgatcctaggca

SEQ ID NO: 2573274 - DNA, 15 bp, Homo sapiens
gatgatctactcaga

SEQ ID NO: 2573275 - DNA, 20 bp, Homo sapiens
gatgatctttgcagacaggc

SEQ ID NO: 2573276 - DNA, 21 bp, Homo sapiens
gatgatctttgcagacaggca

SEQ ID NO: 2573277 - DNA, 21 bp, Homo sapiens
gatgatgaaatgaggtcagag

SEQ ID NO: 2573278 - DNA, 19 bp, Homo sapiens
gatgatgggaattgtgtga

SEQ ID NO: 2573279 - DNA, 22 bp, Homo sapiens
gatgatttcttgaaaagggtgt

SEQ ID NO: 2573280 - DNA, 14 bp, Homo sapiens
gatgcaaggaccag

SEQ ID NO: 2573281 - DNA, 22 bp, Homo sapiens
gcagggcatctcctgtgcatgg

SEQ ID NO: 2573282 - DNA, 17 bp, Homo sapiens
gcagggctaccctgagc

SEQ ID NO: 2573283 - DNA, 23 bp, Homo sapiens
gcagggctaccctgagctgaggc

SEQ ID NO: 2573284 - DNA, 22 bp, Homo sapiens
gcagggctcagcggggacagct

SEQ ID NO: 2573285 - DNA, 12 bp, Homo sapiens
gcagggctcagg

SEQ ID NO: 2573286 - DNA, 13 bp, Homo sapiens
gcagggctcagga

SEQ ID NO: 2573287 - DNA, 16 bp, Homo sapiens
gcagggctctgcccca

SEQ ID NO: 2573288 - DNA, 19 bp, Homo sapiens
gcaggggcgtggagggcgt

SEQ ID NO: 2573289 - DNA, 20 bp, Homo sapiens
gcaggggcttgttgcaggct

SEQ ID NO: 2573290 - DNA, 15 bp, Homo sapiens
gcagggtcttttcat

SEQ ID NO: 2573291 - DNA, 23 bp, Homo sapiens
gcagggtcttttcatctgggaaa

SEQ ID NO: 2573292 - DNA, 15 bp, Homo sapiens
gcagggtggtgctgg

SEQ ID NO: 2573293 - DNA, 17 bp, Homo sapiens
gcagggtggtgctggga

SEQ ID NO: 2573294 - DNA, 19 bp, Homo sapiens
gcagggtggtgctgggact

SEQ ID NO: 2573295 - DNA, 22 bp, Homo sapiens
gcaggtccagggtttgagttca

SEQ ID NO: 2573296 - DNA, 19 bp, Homo sapiens
gcaggtgaccttctgggaa

SEQ ID NO: 2573297 - DNA, 15 bp, Homo sapiens
gcaggtgcctccagg

SEQ ID NO: 2573298 - DNA, 15 bp, Homo sapiens
gcaggtgctgctgcg

SEQ ID NO: 2573299 - DNA, 20 bp, Homo sapiens
gcaggttgaggggctcctgg

SEQ ID NO: 2573300 - DNA, 22 bp, Homo sapiens
gcagtagaaggtcggaggcttg

SEQ ID NO: 2573301 - DNA, 18 bp, Homo sapiens
gcagtagattttctttaa

SEQ ID NO: 2573302 - DNA, 12 bp, Homo sapiens
gcagtagtctct

SEQ ID NO: 2573303 - DNA, 15 bp, Homo sapiens
gcagtatgaaaataa

SEQ ID NO: 2573304 - DNA, 13 bp, Homo sapiens
gcagtattgagca

SEQ ID NO: 2573305 - DNA, 24 bp, Homo sapiens
gcagtcacgtggaggagcagtgca

SEQ ID NO: 2573306 - DNA, 22 bp, Homo sapiens
gcagtcgtcgcacagtctctct

SEQ ID NO: 2573307 - DNA, 21 bp, Homo sapiens
gcagtgaaaacaagtgctggc

SEQ ID NO: 2573308 - DNA, 14 bp, Homo sapiens
gcagtgaattgtga

SEQ ID NO: 2573309 - DNA, 20 bp, Homo sapiens
gcagtgagaaaaagctcctg

SEQ ID NO: 2573310 - DNA, 21 bp, Homo sapiens
gcagtgagaaaaagctcctgt

SEQ ID NO: 2573311 - DNA, 23 bp, Homo sapiens
gcagtgagaaaaagctcctgtcc

SEQ ID NO: 2573312 - DNA, 16 bp, Homo sapiens
gcagtgatatggcaga

SEQ ID NO: 2573313 - DNA, 19 bp, Homo sapiens
gcagtgatatggcagaaga

SEQ ID NO: 2573314 - DNA, 22 bp, Homo sapiens
gcagtgatatggcagaagacac

SEQ ID NO: 2573315 - DNA, 18 bp, Homo sapiens
gcagtgcaggcacagtat

SEQ ID NO: 2573316 - DNA, 17 bp, Homo sapiens
gcagtgcctctggtctg

SEQ ID NO: 2573317 - DNA, 22 bp, Homo sapiens
gcagtgccttccataattatga

SEQ ID NO: 2573318 - DNA, 15 bp, Homo sapiens
gcagtgccttgggga

SEQ ID NO: 2573319 - DNA, 15 bp, Homo sapiens
gcagtgggagctgcc

SEQ ID NO: 2573320 - DNA, 19 bp, Homo sapiens
gcagtggtgcgatctgggt

SEQ ID NO: 2573321 - DNA, 18 bp, Homo sapiens
gcagtgtagcccacactt

SEQ ID NO: 2573322 - DNA, 11 bp, Homo sapiens
gcagtgtcttc

SEQ ID NO: 2573323 - DNA, 15 bp, Homo sapiens
gcagtgtgaggccag

SEQ ID NO: 2573324 - DNA, 13 bp, Homo sapiens
gcagttacatgca

SEQ ID NO: 2573325 - DNA, 18 bp, Homo sapiens
gcagttacatgcatactt

SEQ ID NO: 2573326 - DNA, 21 bp, Homo sapiens
gcagttacatgcatacttcaa

SEQ ID NO: 2573327 - DNA, 23 bp, Homo sapiens
gcagttcccccaacctcagactt

SEQ ID NO: 2573328 - DNA, 16 bp, Homo sapiens
gcagttctagtttgca

SEQ ID NO: 2573329 - DNA, 15 bp, Homo sapiens
gcagttgaaaagact

SEQ ID NO: 2573330 - DNA, 21 bp, Homo sapiens
gcagttgaaaagactccaaag

SEQ ID NO: 2573331 - DNA, 23 bp, Homo sapiens
gcagttgccagtcaccccggcca

SEQ ID NO: 2573332 - DNA, 14 bp, Homo sapiens
gcagttggccagag

SEQ ID NO: 2573333 - DNA, 14 bp, Homo sapiens
gcagtttatcattc

SEQ ID NO: 2573334 - DNA, 15 bp, Homo sapiens
gcagtttatcattca

SEQ ID NO: 2573335 - DNA, 22 bp, Homo sapiens
gcagtttttcagagtggaatgc

SEQ ID NO: 2573336 - DNA, 16 bp, Homo sapiens
gcataacaattcctct

SEQ ID NO: 2573337 - DNA, 17 bp, Homo sapiens
gcataacaattcctcta

SEQ ID NO: 2573338 - DNA, 14 bp, Homo sapiens
gcataataagctaa

SEQ ID NO: 2573339 - DNA, 18 bp, Homo sapiens
gcataataagctaaagag

SEQ ID NO: 2573340 - DNA, 14 bp, Homo sapiens
gcatacacacacac

SEQ ID NO: 2573341 - DNA, 23 bp, Homo sapiens
gcatacacacacacacacagcca

SEQ ID NO: 2573342 - DNA, 15 bp, Homo sapiens
gcataccacttttgt

SEQ ID NO: 2573343 - DNA, 16 bp, Homo sapiens
gcataccacttttgtt

SEQ ID NO: 2573344 - DNA, 18 bp, Homo sapiens
gcatacgtacacatttta

SEQ ID NO: 2573345 - DNA, 14 bp, Homo sapiens
gcatacttcaaaag

SEQ ID NO: 2573346 - DNA, 22 bp, Homo sapiens
gcatagaggtaccagcaatatg

SEQ ID NO: 2573347 - DNA, 16 bp, Homo sapiens
gcatagcaagacacat

SEQ ID NO: 2573348 - DNA, 22 bp, Homo sapiens
gcataggcctgggtgctggctg

SEQ ID NO: 2573349 - DNA, 20 bp, Homo sapiens
gcatagtattccattgtgtg

SEQ ID NO: 2573350 - DNA, 21 bp, Homo sapiens
gcatagtattccattgtgtga

SEQ ID NO: 2573351 - DNA, 23 bp, Homo sapiens
gcatagtattccattgtgtgagt

SEQ ID NO: 2573352 - DNA, 21 bp, Homo sapiens
gcatatcagtctctgagggct

SEQ ID NO: 2573353 - DNA, 16 bp, Homo sapiens
gcatatcctgagccat

SEQ ID NO: 2573354 - DNA, 15 bp, Homo sapiens
gcatatgtatgactc

SEQ ID NO: 2573355 - DNA, 20 bp, Homo sapiens
gcatattcaggaagctcagg

SEQ ID NO: 2573356 - DNA, 15 bp, Homo sapiens
gcatattcctttcta

SEQ ID NO: 2573357 - DNA, 20 bp, Homo sapiens
gcatattcctttctatcatt

SEQ ID NO: 2573358 - DNA, 18 bp, Homo sapiens
gcatattgtacacttttt

SEQ ID NO: 2573359 - DNA, 19 bp, Homo sapiens
gcatattgtacactttttt

SEQ ID NO: 2573360 - DNA, 20 bp, Homo sapiens
gcatattgtacacttttttg

SEQ ID NO: 2573361 - DNA, 15 bp, Homo sapiens
gcatattgttattat

SEQ ID NO: 2573362 - DNA, 13 bp, Homo sapiens
gcatcaaaagaca

SEQ ID NO: 2573363 - DNA, 16 bp, Homo sapiens
gcatcaaaagacaatt

SEQ ID NO: 2573364 - DNA, 19 bp, Homo sapiens
gcatcaaaagacaattctt

SEQ ID NO: 2573365 - DNA, 21 bp, Homo sapiens
gcatcaaaagacaattcttta

SEQ ID NO: 2573366 - DNA, 14 bp, Homo sapiens
gcatcacctcaggc

SEQ ID NO: 2573367 - DNA, 15 bp, Homo sapiens
gcatcacctcaggcc

SEQ ID NO: 2573368 - DNA, 15 bp, Homo sapiens
gcatcacctccacca

SEQ ID NO: 2573369 - DNA, 20 bp, Homo sapiens
gcatcaccttaggcagggaa

SEQ ID NO: 2573370 - DNA, 22 bp, Homo sapiens
gcatcagctgctgaaacaacaa

SEQ ID NO: 2573371 - DNA, 23 bp, Homo sapiens
gcatcagctgctgaaacaacaaa

SEQ ID NO: 2573372 - DNA, 17 bp, Homo sapiens
gcatcagctggcgtcat

SEQ ID NO: 2573373 - DNA, 16 bp, Homo sapiens
gcatcaggccaggccc

SEQ ID NO: 2573374 - DNA, 23 bp, Homo sapiens
gcatcaggccaggccctctgccc

SEQ ID NO: 2573375 - DNA, 22 bp, Homo sapiens
gcatcattatttgcagagacag

SEQ ID NO: 2573376 - DNA, 20 bp, Homo sapiens
gcatcattcttgttaattat

SEQ ID NO: 2573377 - DNA, 20 bp, Homo sapiens
gcatcattttgcattcaaat

SEQ ID NO: 2573378 - DNA, 15 bp, Homo sapiens
gcatccaaaggtgct

SEQ ID NO: 2573379 - DNA, 16 bp, Homo sapiens
gcatcccaggggacca

SEQ ID NO: 2573380 - DNA, 15 bp, Homo sapiens
gcatcccagtggcct

SEQ ID NO: 2573381 - DNA, 16 bp, Homo sapiens
gcatcccagtggcctc

SEQ ID NO: 2573382 - DNA, 20 bp, Homo sapiens
gcatccccttggctgtgagg

SEQ ID NO: 2573383 - DNA, 18 bp, Homo sapiens
gcatccctgaggagccag

SEQ ID NO: 2573384 - DNA, 15 bp, Homo sapiens
gcatcctccaagaat

SEQ ID NO: 2573385 - DNA, 21 bp, Homo sapiens
gcatcctggcacccggcccct

SEQ ID NO: 2573386 - DNA, 18 bp, Homo sapiens
gcatctccacctgctccc

SEQ ID NO: 2573387 - DNA, 12 bp, Homo sapiens
gcatctccagga

SEQ ID NO: 2573388 - DNA, 14 bp, Homo sapiens
gcatctccaggaag

SEQ ID NO: 2573389 - DNA, 13 bp, Homo sapiens
gcatctcccagat

SEQ ID NO: 2573390 - DNA, 17 bp, Homo sapiens
gcatctcttgaggccag

SEQ ID NO: 2573391 - DNA, 17 bp, Homo sapiens
gcatctgactcacaaga

SEQ ID NO: 2573392 - DNA, 18 bp, Homo sapiens
gcatctgcccctccccca

SEQ ID NO: 2573393 - DNA, 23 bp, Homo sapiens
gcatcttactgaaggtaaaattg

SEQ ID NO: 2573394 - DNA, 21 bp, Homo sapiens
gcatcttccagaagtgtgatt

SEQ ID NO: 2573395 - DNA, 13 bp, Homo sapiens
gcatctttgcctt

SEQ ID NO: 2573396 - DNA, 20 bp, Homo sapiens
gcatgaagtaatatgcacac

SEQ ID NO: 2573397 - DNA, 21 bp, Homo sapiens
gcatgaagtaatatgcacaca

SEQ ID NO: 2573398 - DNA, 23 bp, Homo sapiens
gcatgaagtaatatgcacacatt

SEQ ID NO: 2573399 - DNA, 15 bp, Homo sapiens
gcatgacaagcccca

SEQ ID NO: 2573400 - DNA, 22 bp, Homo sapiens
gcatgaggaactagccaccaac

SEQ ID NO: 2573401 - DNA, 20 bp, Homo sapiens
gcatgatgttaaccagaata

SEQ ID NO: 2573402 - DNA, 15 bp, Homo sapiens
gcatgcattttgcag

SEQ ID NO: 2573403 - DNA, 15 bp, Homo sapiens
gcatgcctggatggg

SEQ ID NO: 2573404 - DNA, 14 bp, Homo sapiens
gcatgcgcacaagg

SEQ ID NO: 2573405 - DNA, 13 bp, Homo sapiens
gcatgcggcccag

SEQ ID NO: 2573406 - DNA, 19 bp, Homo sapiens
gcatgcggcccagcccggc

SEQ ID NO: 2573407 - DNA, 18 bp, Homo sapiens
gcatggagtgtgtattgt

SEQ ID NO: 2573408 - DNA, 19 bp, Homo sapiens
gcatggagtgtgtattgtt

SEQ ID NO: 2573409 - DNA, 22 bp, Homo sapiens
gcatggagtgtgtattgttccc

SEQ ID NO: 2573410 - DNA, 24 bp, Homo sapiens
gcatggagtgtgtattgttcccag

SEQ ID NO: 2573411 - DNA, 20 bp, Homo sapiens
gcatggatatagttttactt

SEQ ID NO: 2573412 - DNA, 21 bp, Homo sapiens
gcatggatgttttagccattg

SEQ ID NO: 2573413 - DNA, 12 bp, Homo sapiens
gcatggccctgg

SEQ ID NO: 2573414 - DNA, 13 bp, Homo sapiens
gcatggccctggg

SEQ ID NO: 2573415 - DNA, 17 bp, Homo sapiens
gcatggctccagaaatg

SEQ ID NO: 2573416 - DNA, 18 bp, Homo sapiens
gcatggctccagaaatgt

SEQ ID NO: 2573417 - DNA, 14 bp, Homo sapiens
gcatggctccagtc

SEQ ID NO: 2573418 - DNA, 15 bp, Homo sapiens
gcatggctccagtct

SEQ ID NO: 2573419 - DNA, 15 bp, Homo sapiens
gcatgggcactccct

SEQ ID NO: 2573420 - DNA, 22 bp, Homo sapiens
gcatggggataaaggagaaggc

SEQ ID NO: 2573421 - DNA, 15 bp, Homo sapiens
gcatggggtgggcct

SEQ ID NO: 2573422 - DNA, 18 bp, Homo sapiens
gcatggggtgggcctctg

SEQ ID NO: 2573423 - DNA, 19 bp, Homo sapiens
gcatggggtgggcctctgg

SEQ ID NO: 2573424 - DNA, 17 bp, Homo sapiens
gccccaccccaggtcct

SEQ ID NO: 2573425 - DNA, 20 bp, Homo sapiens
gccccacctttattaaaatc

SEQ ID NO: 2573426 - DNA, 13 bp, Homo sapiens
gccccactgggga

SEQ ID NO: 2573427 - DNA, 14 bp, Homo sapiens
gccccactggggaa

SEQ ID NO: 2573428 - DNA, 15 bp, Homo sapiens
gccccactggggaaa

SEQ ID NO: 2573429 - DNA, 18 bp, Homo sapiens
gccccagaaggcagggaa

SEQ ID NO: 2573430 - DNA, 11 bp, Homo sapiens
gccccagagac

SEQ ID NO: 2573431 - DNA, 15 bp, Homo sapiens
gccccagagactcag

SEQ ID NO: 2573432 - DNA, 12 bp, Homo sapiens
gccccagagctg

SEQ ID NO: 2573433 - DNA, 13 bp, Homo sapiens
gccccagagctgt

SEQ ID NO: 2573434 - DNA, 17 bp, Homo sapiens
gccccagataccagccc

SEQ ID NO: 2573435 - DNA, 20 bp, Homo sapiens
gccccagataccagcccctg

SEQ ID NO: 2573436 - DNA, 12 bp, Homo sapiens
gccccagcacta

SEQ ID NO: 2573437 - DNA, 14 bp, Homo sapiens
gccccagcccaccc

SEQ ID NO: 2573438 - DNA, 15 bp, Homo sapiens
gccccagcccaccct

SEQ ID NO: 2573439 - DNA, 16 bp, Homo sapiens
gccccagcccaccctc

SEQ ID NO: 2573440 - DNA, 21 bp, Homo sapiens
gccccagcccaccctcctgtc

SEQ ID NO: 2573441 - DNA, 13 bp, Homo sapiens
gccccagctctgg

SEQ ID NO: 2573442 - DNA, 15 bp, Homo sapiens
gccccaggcaggctg

SEQ ID NO: 2573443 - DNA, 16 bp, Homo sapiens
gccccagggctaccct

SEQ ID NO: 2573444 - DNA, 16 bp, Homo sapiens
gccccagggtcttccc

SEQ ID NO: 2573445 - DNA, 20 bp, Homo sapiens
gccccagggtcttccctacc

SEQ ID NO: 2573446 - DNA, 21 bp, Homo sapiens
gccccagggtcttccctacct

SEQ ID NO: 2573447 - DNA, 23 bp, Homo sapiens
gccccagggtcttccctacctca

SEQ ID NO: 2573448 - DNA, 17 bp, Homo sapiens
gccccagtcagcctctc

SEQ ID NO: 2573449 - DNA, 23 bp, Homo sapiens
gccccagtcagcctctctcccag

SEQ ID NO: 2573450 - DNA, 13 bp, Homo sapiens
gccccagtgccca

SEQ ID NO: 2573451 - DNA, 14 bp, Homo sapiens
gccccagtgcccac

SEQ ID NO: 2573452 - DNA, 15 bp, Homo sapiens
gccccagtgcccaca

SEQ ID NO: 2573453 - DNA, 17 bp, Homo sapiens
gccccagtgcccacagg

SEQ ID NO: 2573454 - DNA, 21 bp, Homo sapiens
gccccagtgcccacaggatca

SEQ ID NO: 2573455 - DNA, 18 bp, Homo sapiens
gccccagttcaatctccc

SEQ ID NO: 2573456 - DNA, 14 bp, Homo sapiens
gccccatgcctgtc

SEQ ID NO: 2573457 - DNA, 17 bp, Homo sapiens
gccccatgcctgtccag

SEQ ID NO: 2573458 - DNA, 23 bp, Homo sapiens
gccccatgcctgtccagcctggg

SEQ ID NO: 2573459 - DNA, 17 bp, Homo sapiens
gccccattctgcctgcc

SEQ ID NO: 2573460 - DNA, 15 bp, Homo sapiens
gcccccaaataagaa

SEQ ID NO: 2573461 - DNA, 14 bp, Homo sapiens
gcccccaagcctgc

SEQ ID NO: 2573462 - DNA, 23 bp, Homo sapiens
gcccccacagaaagactgagctc

SEQ ID NO: 2573463 - DNA, 21 bp, Homo sapiens
gcccccaccactaggactctg

SEQ ID NO: 2573464 - DNA, 13 bp, Homo sapiens
gcccccacctcca

SEQ ID NO: 2573465 - DNA, 14 bp, Homo sapiens
gcccccacctccac

SEQ ID NO: 2573466 - DNA, 15 bp, Homo sapiens
gcccccacctccacc

SEQ ID NO: 2573467 - DNA, 19 bp, Homo sapiens
gcccccactgcctttgacc

SEQ ID NO: 2573468 - DNA, 12 bp, Homo sapiens
gcccccactggt

SEQ ID NO: 2573469 - DNA, 20 bp, Homo sapiens
gcccccagggcacttcacag

SEQ ID NO: 2573470 - DNA, 13 bp, Homo sapiens
gccccccacccca

SEQ ID NO: 2573471 - DNA, 17 bp, Homo sapiens
gcccccccaacactgtg

SEQ ID NO: 2573472 - DNA, 23 bp, Homo sapiens
gcccccccaacactgtgccctgg

SEQ ID NO: 2573473 - DNA, 13 bp, Homo sapiens
gcccccgagctgg

SEQ ID NO: 2573474 - DNA, 13 bp, Homo sapiens
gcccccgccccgc

SEQ ID NO: 2573475 - DNA, 20 bp, Homo sapiens
gcccccgctgtaatgaaaca

SEQ ID NO: 2573476 - DNA, 17 bp, Homo sapiens
gccccctcctctcccat

SEQ ID NO: 2573477 - DNA, 23 bp, Homo sapiens
gccccctggtggacagtcctggg

SEQ ID NO: 2573478 - DNA, 15 bp, Homo sapiens
gcccccttctcccac

SEQ ID NO: 2573479 - DNA, 18 bp, Homo sapiens
gcccccttctcccacact

SEQ ID NO: 2573480 - DNA, 18 bp, Homo sapiens
gccccctttcagatgtct

SEQ ID NO: 2573481 - DNA, 18 bp, Homo sapiens
gccccctttgggcccagg

SEQ ID NO: 2573482 - DNA, 17 bp, Homo sapiens
gccccgaggacccagac

SEQ ID NO: 2573483 - DNA, 22 bp, Homo sapiens
gccccgaggacccagacccagt

SEQ ID NO: 2573484 - DNA, 15 bp, Homo sapiens
gccccgaggccttct

SEQ ID NO: 2573485 - DNA, 22 bp, Homo sapiens
gccccgccccacattccgacaa

SEQ ID NO: 2573486 - DNA, 17 bp, Homo sapiens
gccccggccctgggctc

SEQ ID NO: 2573487 - DNA, 19 bp, Homo sapiens
gccccgtgtcctgcctgtc

SEQ ID NO: 2573488 - DNA, 16 bp, Homo sapiens
gcccctaccccacacc

SEQ ID NO: 2573489 - DNA, 20 bp, Homo sapiens
gcccctcacctgggcacctg

SEQ ID NO: 2573490 - DNA, 14 bp, Homo sapiens
gcccctcagggtcc

SEQ ID NO: 2573491 - DNA, 19 bp, Homo sapiens
gcccctcagggtccctggt

SEQ ID NO: 2573492 - DNA, 18 bp, Homo sapiens
gcccctccagcttgtgga

SEQ ID NO: 2573493 - DNA, 15 bp, Homo sapiens
gcccctcccacacac

SEQ ID NO: 2573494 - DNA, 12 bp, Homo sapiens
gcccctcccacc

SEQ ID NO: 2573495 - DNA, 13 bp, Homo sapiens
gcccctcccacca

SEQ ID NO: 2573496 - DNA, 12 bp, Homo sapiens
gcccctccccca

SEQ ID NO: 2573497 - DNA, 15 bp, Homo sapiens
gcccctcccccaacc

SEQ ID NO: 2573498 - DNA, 23 bp, Homo sapiens
gcccctcccccaacccccacccc

SEQ ID NO: 2573499 - DNA, 21 bp, Homo sapiens
gcccctctcccgccagactgt

SEQ ID NO: 2573500 - DNA, 16 bp, Homo sapiens
gcccctctgcccagct

SEQ ID NO: 2573501 - DNA, 19 bp, Homo sapiens
gcccctctgcccagcttgg

SEQ ID NO: 2573502 - DNA, 20 bp, Homo sapiens
gcccctctgcccagcttggg

SEQ ID NO: 2573503 - DNA, 18 bp, Homo sapiens
gcccctcttgccccccac

SEQ ID NO: 2573504 - DNA, 16 bp, Homo sapiens
gcccctgaacaagaat

SEQ ID NO: 2573505 - DNA, 20 bp, Homo sapiens
gcccctgcatccccttggct

SEQ ID NO: 2573506 - DNA, 14 bp, Homo sapiens
gcccctgccccgtc

SEQ ID NO: 2573507 - DNA, 15 bp, Homo sapiens
gcccctgccccgtca

SEQ ID NO: 2573508 - DNA, 22 bp, Homo sapiens
gcccctgccccgtcaccatctc

SEQ ID NO: 2573509 - DNA, 13 bp, Homo sapiens
gcccctgcccggc

SEQ ID NO: 2573510 - DNA, 13 bp, Homo sapiens
gcccctgctgcct

SEQ ID NO: 2573511 - DNA, 19 bp, Homo sapiens
gcccctgctgcctccccaa

SEQ ID NO: 2573512 - DNA, 21 bp, Homo sapiens
gcccctgctggttcagggttg

SEQ ID NO: 2573513 - DNA, 22 bp, Homo sapiens
gcccctgggtgggtggtgggga

SEQ ID NO: 2573514 - DNA, 17 bp, Homo sapiens
gccccttagcccccacc

SEQ ID NO: 2573515 - DNA, 16 bp, Homo sapiens
gccccttccccatggg

SEQ ID NO: 2573516 - DNA, 20 bp, Homo sapiens
gccccttccttgctctgcac

SEQ ID NO: 2573517 - DNA, 20 bp, Homo sapiens
gccccttctgacccatgctg

SEQ ID NO: 2573518 - DNA, 18 bp, Homo sapiens
gcccctttttactcccct

SEQ ID NO: 2573519 - DNA, 13 bp, Homo sapiens
gcccgaatacaaa

SEQ ID NO: 2573520 - DNA, 12 bp, Homo sapiens
gcccgagctggt

SEQ ID NO: 2573521 - DNA, 15 bp, Homo sapiens
gcccgcacccccacc

SEQ ID NO: 2573522 - DNA, 17 bp, Homo sapiens
gcccgcacccccaccct

SEQ ID NO: 2573523 - DNA, 19 bp, Homo sapiens
gcccgcacccccacccttt

SEQ ID NO: 2573524 - DNA, 21 bp, Homo sapiens
gcccgcacccccaccctttgg

SEQ ID NO: 2573525 - DNA, 19 bp, Homo sapiens
gcccgcatgcggcccagga

SEQ ID NO: 2573526 - DNA, 13 bp, Homo sapiens
gcccgcccactgt

SEQ ID NO: 2573527 - DNA, 14 bp, Homo sapiens
gcccgcccactgtc

SEQ ID NO: 2573528 - DNA, 18 bp, Homo sapiens
gcccgcctgccagtccta

SEQ ID NO: 2573529 - DNA, 23 bp, Homo sapiens
gcccgcctgccagtcctagctgc

SEQ ID NO: 2573530 - DNA, 18 bp, Homo sapiens
gcccgcctggcagaactg

SEQ ID NO: 2573531 - DNA, 17 bp, Homo sapiens
gcccgctgagtggactg

SEQ ID NO: 2573532 - DNA, 12 bp, Homo sapiens
gcccgctgggct

SEQ ID NO: 2573533 - DNA, 18 bp, Homo sapiens
gcccgctgggctgagccc

SEQ ID NO: 2573534 - DNA, 21 bp, Homo sapiens
gcccggagattggacggcctg

SEQ ID NO: 2573535 - DNA, 18 bp, Homo sapiens
gcccggcctgctcccagc

SEQ ID NO: 2573536 - DNA, 22 bp, Homo sapiens
gcccggcctgctcccagcagcc

SEQ ID NO: 2573537 - DNA, 17 bp, Homo sapiens
gcccggcgcccctgcca

SEQ ID NO: 2573538 - DNA, 15 bp, Homo sapiens
gcccggctccaggct

SEQ ID NO: 2573539 - DNA, 17 bp, Homo sapiens
gcccggctccaggctcc

SEQ ID NO: 2573540 - DNA, 18 bp, Homo sapiens
gcccggctccaggctcct

SEQ ID NO: 2573541 - DNA, 18 bp, Homo sapiens
gcccgggcgcggccagcc

SEQ ID NO: 2573542 - DNA, 12 bp, Homo sapiens
gcccgggctctg

SEQ ID NO: 2573543 - DNA, 20 bp, Homo sapiens
gcccgggctctgcctcccat

SEQ ID NO: 2573544 - DNA, 23 bp, Homo sapiens
gcccgggctctgcctcccatcac

SEQ ID NO: 2573545 - DNA, 14 bp, Homo sapiens
gcccgggctgcctg

SEQ ID NO: 2573546 - DNA, 15 bp, Homo sapiens
gcccgggctgcctgg

SEQ ID NO: 2573547 - DNA, 17 bp, Homo sapiens
gcccgggctgcctgggc

SEQ ID NO: 2573548 - DNA, 18 bp, Homo sapiens
gcccgggctgcctgggct

SEQ ID NO: 2573549 - DNA, 18 bp, Homo sapiens
gcccgtcatgttcctcaa

SEQ ID NO: 2573550 - DNA, 15 bp, Homo sapiens
gcccgtctctctccc

SEQ ID NO: 2573551 - DNA, 19 bp, Homo sapiens
gccctaaaattccactgcg

SEQ ID NO: 2573552 - DNA, 16 bp, Homo sapiens
gccctacagaggtctc

SEQ ID NO: 2573553 - DNA, 20 bp, Homo sapiens
gccctacagaggtctctgcc

SEQ ID NO: 2573554 - DNA, 13 bp, Homo sapiens
gccctaccagcgc

SEQ ID NO: 2573555 - DNA, 16 bp, Homo sapiens
gccctagagcctgcct

SEQ ID NO: 2573556 - DNA, 17 bp, Homo sapiens
gccctagagcctgcctg

SEQ ID NO: 2573557 - DNA, 13 bp, Homo sapiens
gccctagctccac

SEQ ID NO: 2573558 - DNA, 13 bp, Homo sapiens
gccctatggatgt

SEQ ID NO: 2573559 - DNA, 19 bp, Homo sapiens
gccctcaaaatgacagcca

SEQ ID NO: 2573560 - DNA, 19 bp, Homo sapiens
gccctcaggggacttgaat

SEQ ID NO: 2573561 - DNA, 18 bp, Homo sapiens
gccctcatggcccctctg

SEQ ID NO: 2573562 - DNA, 15 bp, Homo sapiens
gccctccaaaagcac

SEQ ID NO: 2573563 - DNA, 23 bp, Homo sapiens
gccctccaagaccttctccttca

SEQ ID NO: 2573564 - DNA, 16 bp, Homo sapiens
gccctccatcccgaca

SEQ ID NO: 2573565 - DNA, 22 bp, Homo sapiens
gccctccatcccgacatggacc

SEQ ID NO: 2573566 - DNA, 21 bp, Homo sapiens
gccctcccaggctctcaacag

SEQ ID NO: 2573567 - DNA, 15 bp, Homo sapiens
gccctccccagagca

SEQ ID NO: 2573568 - DNA, 19 bp, Homo sapiens
gccctccccagagcactgg

SEQ ID NO: 2573569 - DNA, 17 bp, Homo sapiens
gcgcggggagcccgtcg

SEQ ID NO: 2573570 - DNA, 15 bp, Homo sapiens
gcgcgtccccctgcc

SEQ ID NO: 2573571 - DNA, 13 bp, Homo sapiens
gcgctacccactt

SEQ ID NO: 2573572 - DNA, 14 bp, Homo sapiens
gcgctggcccagcc

SEQ ID NO: 2573573 - DNA, 19 bp, Homo sapiens
gcgctggcccagccggcct

SEQ ID NO: 2573574 - DNA, 19 bp, Homo sapiens
gcgctggccgggaccccga

SEQ ID NO: 2573575 - DNA, 19 bp, Homo sapiens
gcggaatgaaccacatctt

SEQ ID NO: 2573576 - DNA, 16 bp, Homo sapiens
gcggacagccacggcc

SEQ ID NO: 2573577 - DNA, 15 bp, Homo sapiens
gcggacgttccagcc

SEQ ID NO: 2573578 - DNA, 18 bp, Homo sapiens
gcggagaaccttgtgcct

SEQ ID NO: 2573579 - DNA, 19 bp, Homo sapiens
gcggagaaccttgtgcctg

SEQ ID NO: 2573580 - DNA, 19 bp, Homo sapiens
gcggagacggagtcccacc

SEQ ID NO: 2573581 - DNA, 16 bp, Homo sapiens
gcggagcttgcagtga

SEQ ID NO: 2573582 - DNA, 16 bp, Homo sapiens
gcggcattaaagccat

SEQ ID NO: 2573583 - DNA, 13 bp, Homo sapiens
gcggccagccccg

SEQ ID NO: 2573584 - DNA, 17 bp, Homo sapiens
gcggccagccccggccc

SEQ ID NO: 2573585 - DNA, 19 bp, Homo sapiens
gcggccagccccggccctg

SEQ ID NO: 2573586 - DNA, 13 bp, Homo sapiens
gcggcccagcccg

SEQ ID NO: 2573587 - DNA, 14 bp, Homo sapiens
gcggcccctcccac

SEQ ID NO: 2573588 - DNA, 16 bp, Homo sapiens
gcggctgagagcccca

SEQ ID NO: 2573589 - DNA, 22 bp, Homo sapiens
gcggctgagagccccagctgac

SEQ ID NO: 2573590 - DNA, 23 bp, Homo sapiens
gcggctgagagccccagctgaca

SEQ ID NO: 2573591 - DNA, 13 bp, Homo sapiens
gcgggaaggaggg

SEQ ID NO: 2573592 - DNA, 15 bp, Homo sapiens
gcgggacctgtggct

SEQ ID NO: 2573593 - DNA, 20 bp, Homo sapiens
gcgggaggatgttctgggac

SEQ ID NO: 2573594 - DNA, 16 bp, Homo sapiens
gcgggatggtcctggg

SEQ ID NO: 2573595 - DNA, 17 bp, Homo sapiens
gcgggatggtcctgggg

SEQ ID NO: 2573596 - DNA, 20 bp, Homo sapiens
gcgggcacctatagtcccag

SEQ ID NO: 2573597 - DNA, 13 bp, Homo sapiens
gcgggccaaggac

SEQ ID NO: 2573598 - DNA, 17 bp, Homo sapiens
gcgggccaaggactgcc

SEQ ID NO: 2573599 - DNA, 15 bp, Homo sapiens
gcgggccagccaggc

SEQ ID NO: 2573600 - DNA, 19 bp, Homo sapiens
gcgggccagccaggcgggc

SEQ ID NO: 2573601 - DNA, 20 bp, Homo sapiens
gcgggcgcctgtagtcccag

SEQ ID NO: 2573602 - DNA, 14 bp, Homo sapiens
gcggggacagctcc

SEQ ID NO: 2573603 - DNA, 19 bp, Homo sapiens
gcggggacagctccttctg

SEQ ID NO: 2573604 - DNA, 12 bp, Homo sapiens
gcggggccttgc

SEQ ID NO: 2573605 - DNA, 17 bp, Homo sapiens
gcggggcgaagcccagg

SEQ ID NO: 2573606 - DNA, 15 bp, Homo sapiens
gcgggtgggggtgga

SEQ ID NO: 2573607 - DNA, 13 bp, Homo sapiens
gcggtccacccag

SEQ ID NO: 2573608 - DNA, 19 bp, Homo sapiens
gcggtccacccaggagccc

SEQ ID NO: 2573609 - DNA, 20 bp, Homo sapiens
gcggtccacccaggagcccc

SEQ ID NO: 2573610 - DNA, 23 bp, Homo sapiens
gcggtccacccaggagccccgag

SEQ ID NO: 2573611 - DNA, 22 bp, Homo sapiens
gcggtcccctccgccaggcgag

SEQ ID NO: 2573612 - DNA, 19 bp, Homo sapiens
gcggtgagaggggaacaga

SEQ ID NO: 2573613 - DNA, 14 bp, Homo sapiens
gcggtttggggagc

SEQ ID NO: 2573614 - DNA, 11 bp, Homo sapiens
gcgtcagcctc

SEQ ID NO: 2573615 - DNA, 20 bp, Homo sapiens
gcgtcagcctccagcctctg

SEQ ID NO: 2573616 - DNA, 19 bp, Homo sapiens
gcgtccgcgcgccagcaca

SEQ ID NO: 2573617 - DNA, 15 bp, Homo sapiens
gcgtcctcctctgtg

SEQ ID NO: 2573618 - DNA, 17 bp, Homo sapiens
gcgtcgccctcccaggc

SEQ ID NO: 2573619 - DNA, 11 bp, Homo sapiens
gcgtgaaacac

SEQ ID NO: 2573620 - DNA, 23 bp, Homo sapiens
gcgtgaaacacaccaggctgtgg

SEQ ID NO: 2573621 - DNA, 23 bp, Homo sapiens
gcgtgaacccgggaggcggagct

SEQ ID NO: 2573622 - DNA, 13 bp, Homo sapiens
gcgtgaaggccga

SEQ ID NO: 2573623 - DNA, 16 bp, Homo sapiens
gcgtgagccactgcac

SEQ ID NO: 2573624 - DNA, 18 bp, Homo sapiens
gcgtgagccactgcaccg

SEQ ID NO: 2573625 - DNA, 20 bp, Homo sapiens
gcgtgatcaaagccacactc

SEQ ID NO: 2573626 - DNA, 23 bp, Homo sapiens
gcgtgatctcggctcactgcaac

SEQ ID NO: 2573627 - DNA, 20 bp, Homo sapiens
gcgtgcacacaccagagccc

SEQ ID NO: 2573628 - DNA, 18 bp, Homo sapiens
gcgtgctccagcctggct

SEQ ID NO: 2573629 - DNA, 18 bp, Homo sapiens
gcgtggactctgcacatg

SEQ ID NO: 2573630 - DNA, 15 bp, Homo sapiens
gcgtggagctgcctg

SEQ ID NO: 2573631 - DNA, 17 bp, Homo sapiens
gcgtggtcactgctgtc

SEQ ID NO: 2573632 - DNA, 15 bp, Homo sapiens
gcgtggttcctttct

SEQ ID NO: 2573633 - DNA, 12 bp, Homo sapiens
gcgtgtgtagag

SEQ ID NO: 2573634 - DNA, 22 bp, Homo sapiens
gcgtgtgtagagttaagaagct

SEQ ID NO: 2573635 - DNA, 17 bp, Homo sapiens
gcgtgtgtccatgtgtg

SEQ ID NO: 2573636 - DNA, 18 bp, Homo sapiens
gcgtgtgtccatgtgtgt

SEQ ID NO: 2573637 - DNA, 23 bp, Homo sapiens
gcgtgtgtccatgtgtgtgcaag

SEQ ID NO: 2573638 - DNA, 18 bp, Homo sapiens
gcgttccatgatgctggg

SEQ ID NO: 2573639 - DNA, 11 bp, Homo sapiens
gctaaaaatgg

SEQ ID NO: 2573640 - DNA, 13 bp, Homo sapiens
gctaaagaaaaag

SEQ ID NO: 2573641 - DNA, 16 bp, Homo sapiens
gctaaagcccagagac

SEQ ID NO: 2573642 - DNA, 19 bp, Homo sapiens
gctaaatggtcgcccagga

SEQ ID NO: 2573643 - DNA, 13 bp, Homo sapiens
gctaaatgtgaat

SEQ ID NO: 2573644 - DNA, 20 bp, Homo sapiens
gctaacacacagctcccata

SEQ ID NO: 2573645 - DNA, 15 bp, Homo sapiens
gctaacactggcccc

SEQ ID NO: 2573646 - DNA, 14 bp, Homo sapiens
gctaacattttaaa

SEQ ID NO: 2573647 - DNA, 21 bp, Homo sapiens
gctaacattttaaataaaaga

SEQ ID NO: 2573648 - DNA, 21 bp, Homo sapiens
gctaactagcttggaaactgg

SEQ ID NO: 2573649 - DNA, 23 bp, Homo sapiens
gctaagagggagggagggctcca

SEQ ID NO: 2573650 - DNA, 12 bp, Homo sapiens
gctaagatgctc

SEQ ID NO: 2573651 - DNA, 17 bp, Homo sapiens
gctaaggacatttccca

SEQ ID NO: 2573652 - DNA, 20 bp, Homo sapiens
gctaaggacatttcccaggg

SEQ ID NO: 2573653 - DNA, 20 bp, Homo sapiens
gctaaggcgtggagctgcct

SEQ ID NO: 2573654 - DNA, 21 bp, Homo sapiens
gctaaggcgtggagctgcctg

SEQ ID NO: 2573655 - DNA, 13 bp, Homo sapiens
gctaagtgaaaag

SEQ ID NO: 2573656 - DNA, 18 bp, Homo sapiens
gctaagtgaaaaggtcat

SEQ ID NO: 2573657 - DNA, 18 bp, Homo sapiens
gctaagtgatcctcccac

SEQ ID NO: 2573658 - DNA, 23 bp, Homo sapiens
gctaagtgatcctcccacctcag

SEQ ID NO: 2573659 - DNA, 15 bp, Homo sapiens
gctaatcagtgtctc

SEQ ID NO: 2573660 - DNA, 16 bp, Homo sapiens
gctaatcagtgtctca

SEQ ID NO: 2573661 - DNA, 17 bp, Homo sapiens
gctaatcagtgtctcac

SEQ ID NO: 2573662 - DNA, 19 bp, Homo sapiens
gctaatcagtgtctcacac

SEQ ID NO: 2573663 - DNA, 20 bp, Homo sapiens
gctaatttatcctgaaattt

SEQ ID NO: 2573664 - DNA, 17 bp, Homo sapiens
gctacaaaaacacagca

SEQ ID NO: 2573665 - DNA, 15 bp, Homo sapiens
gctacaaagaagaca

SEQ ID NO: 2573666 - DNA, 20 bp, Homo sapiens
gctacaaatactcttaggaa

SEQ ID NO: 2573667 - DNA, 17 bp, Homo sapiens
gctacaacttcagcagt

SEQ ID NO: 2573668 - DNA, 15 bp, Homo sapiens
gctacaattttctcc

SEQ ID NO: 2573669 - DNA, 13 bp, Homo sapiens
gctacacactgca

SEQ ID NO: 2573670 - DNA, 17 bp, Homo sapiens
gctacacccttttccag

SEQ ID NO: 2573671 - DNA, 19 bp, Homo sapiens
gctacaggaagcaccccat

SEQ ID NO: 2573672 - DNA, 20 bp, Homo sapiens
gctacaggaagcaccccatg

SEQ ID NO: 2573673 - DNA, 21 bp, Homo sapiens
gctacaggaagcaccccatgc

SEQ ID NO: 2573674 - DNA, 12 bp, Homo sapiens
gctacaggttac

SEQ ID NO: 2573675 - DNA, 18 bp, Homo sapiens
gctaccctttttctccag

SEQ ID NO: 2573676 - DNA, 20 bp, Homo sapiens
gctaccctttttctccagct

SEQ ID NO: 2573677 - DNA, 17 bp, Homo sapiens
gctacctcaagggggac

SEQ ID NO: 2573678 - DNA, 20 bp, Homo sapiens
gctacctttgtattctctcc

SEQ ID NO: 2573679 - DNA, 18 bp, Homo sapiens
gctacgtacatgtgaggc

SEQ ID NO: 2573680 - DNA, 14 bp, Homo sapiens
gctactaatgatgt

SEQ ID NO: 2573681 - DNA, 19 bp, Homo sapiens
gctactcagaagcctgagg

SEQ ID NO: 2573682 - DNA, 18 bp, Homo sapiens
gctactctgttccttcac

SEQ ID NO: 2573683 - DNA, 20 bp, Homo sapiens
gctactgatttcctttggag

SEQ ID NO: 2573684 - DNA, 16 bp, Homo sapiens
gctactgatttttgtg

SEQ ID NO: 2573685 - DNA, 12 bp, Homo sapiens
gctactgtctca

SEQ ID NO: 2573686 - DNA, 21 bp, Homo sapiens
gctactgtctcactgaaacat

SEQ ID NO: 2573687 - DNA, 17 bp, Homo sapiens
gctacttaattcctttc

SEQ ID NO: 2573688 - DNA, 19 bp, Homo sapiens
gctacttcctcctccccac

SEQ ID NO: 2573689 - DNA, 18 bp, Homo sapiens
gctacttgggccatagct

SEQ ID NO: 2573690 - DNA, 11 bp, Homo sapiens
gctagaaatga

SEQ ID NO: 2573691 - DNA, 20 bp, Homo sapiens
gctagaacctagaagggcta

SEQ ID NO: 2573692 - DNA, 19 bp, Homo sapiens
gctagaacctggagagcta

SEQ ID NO: 2573693 - DNA, 20 bp, Homo sapiens
gctagaacctggagagctag

SEQ ID NO: 2573694 - DNA, 20 bp, Homo sapiens
gctagaacctgtagagctag

SEQ ID NO: 2573695 - DNA, 13 bp, Homo sapiens
gctagaggcctga

SEQ ID NO: 2573696 - DNA, 13 bp, Homo sapiens
gctagagtcctca

SEQ ID NO: 2573697 - DNA, 16 bp, Homo sapiens
gctagagtcctcactc

SEQ ID NO: 2573698 - DNA, 20 bp, Homo sapiens
gctagagtcctcactcccag

SEQ ID NO: 2573699 - DNA, 19 bp, Homo sapiens
gctaggaacactccttcac

SEQ ID NO: 2573700 - DNA, 12 bp, Homo sapiens
gctaggaatgaa

SEQ ID NO: 2573701 - DNA, 15 bp, Homo sapiens
gctaggcctggccag

SEQ ID NO: 2573702 - DNA, 16 bp, Homo sapiens
gctaggcctggccaga

SEQ ID NO: 2573703 - DNA, 23 bp, Homo sapiens
gctaggcctggccagatgcacca

SEQ ID NO: 2573704 - DNA, 18 bp, Homo sapiens
gctaggcgagtgccagga

SEQ ID NO: 2573705 - DNA, 14 bp, Homo sapiens
gctaggtgggccag

SEQ ID NO: 2573706 - DNA, 15 bp, Homo sapiens
gctataaatatataa

SEQ ID NO: 2573707 - DNA, 18 bp, Homo sapiens
gctataacagtagggatg

SEQ ID NO: 2573708 - DNA, 19 bp, Homo sapiens
gctatagacccgaggaaac

SEQ ID NO: 2573709 - DNA, 16 bp, Homo sapiens
gctatagctacaggaa

SEQ ID NO: 2573710 - DNA, 19 bp, Homo sapiens
gctataggctggagaagct

SEQ ID NO: 2573711 - DNA, 18 bp, Homo sapiens
gctataggtgctacaaaa

SEQ ID NO: 2573712 - DNA, 15 bp, Homo sapiens
gctatatctatatat

SEQ ID NO: 2573713 - DNA, 13 bp, Homo sapiens
gctatcacacagt

SEQ ID NO: 2573714 - DNA, 16 bp, Homo sapiens
gctggtagctcaggtg

SEQ ID NO: 2573715 - DNA, 13 bp, Homo sapiens
gctggtagttagt

SEQ ID NO: 2573716 - DNA, 13 bp, Homo sapiens
gctggtcacagcc

SEQ ID NO: 2573717 - DNA, 15 bp, Homo sapiens
gctggtcacagcctc

SEQ ID NO: 2573718 - DNA, 19 bp, Homo sapiens
gctggtctcaaactcctga

SEQ ID NO: 2573719 - DNA, 20 bp, Homo sapiens
gctggtctcaaactcctgac

SEQ ID NO: 2573720 - DNA, 18 bp, Homo sapiens
gctggtgagtgatgcggc

SEQ ID NO: 2573721 - DNA, 23 bp, Homo sapiens
gctggtgccagccttcctctgca

SEQ ID NO: 2573722 - DNA, 15 bp, Homo sapiens
gctggtgctgtggcc

SEQ ID NO: 2573723 - DNA, 18 bp, Homo sapiens
gctggtgtcacctgaaga

SEQ ID NO: 2573724 - DNA, 17 bp, Homo sapiens
gctggtgtcctgaccac

SEQ ID NO: 2573725 - DNA, 22 bp, Homo sapiens
gctggtgtcctgaccaccctcc

SEQ ID NO: 2573726 - DNA, 21 bp, Homo sapiens
gctggttagaggttccctttg

SEQ ID NO: 2573727 - DNA, 16 bp, Homo sapiens
gctggttgctgtgtgg

SEQ ID NO: 2573728 - DNA, 18 bp, Homo sapiens
gctggttggagagctaga

SEQ ID NO: 2573729 - DNA, 20 bp, Homo sapiens
gctggttttgtaagatgctg

SEQ ID NO: 2573730 - DNA, 22 bp, Homo sapiens
gctggttttgtaagatgctggg

SEQ ID NO: 2573731 - DNA, 18 bp, Homo sapiens
gctgtaaggcatgaagga

SEQ ID NO: 2573732 - DNA, 21 bp, Homo sapiens
gctgtaatgaaacaccttctc

SEQ ID NO: 2573733 - DNA, 20 bp, Homo sapiens
gctgtacttcgtcttctaat

SEQ ID NO: 2573734 - DNA, 23 bp, Homo sapiens
gctgtatcccatgagcctcagca

SEQ ID NO: 2573735 - DNA, 16 bp, Homo sapiens
gctgtatcttgttttt

SEQ ID NO: 2573736 - DNA, 18 bp, Homo sapiens
gctgtatcttgtttttcc

SEQ ID NO: 2573737 - DNA, 17 bp, Homo sapiens
gctgtattaagccactt

SEQ ID NO: 2573738 - DNA, 18 bp, Homo sapiens
gctgtcaagttcctttgg

SEQ ID NO: 2573739 - DNA, 18 bp, Homo sapiens
gctgtcataagaatgaat

SEQ ID NO: 2573740 - DNA, 12 bp, Homo sapiens
gctgtccagaca

SEQ ID NO: 2573741 - DNA, 14 bp, Homo sapiens
gctgtccagacagc

SEQ ID NO: 2573742 - DNA, 15 bp, Homo sapiens
gctgtccagacagcc

SEQ ID NO: 2573743 - DNA, 18 bp, Homo sapiens
gctgtccagacagcctgt

SEQ ID NO: 2573744 - DNA, 22 bp, Homo sapiens
gctgtccagacagcctgtatct

SEQ ID NO: 2573745 - DNA, 13 bp, Homo sapiens
gctgtccctcact

SEQ ID NO: 2573746 - DNA, 13 bp, Homo sapiens
gctgtcctaggcc

SEQ ID NO: 2573747 - DNA, 14 bp, Homo sapiens
gctgtcctaggcca

SEQ ID NO: 2573748 - DNA, 17 bp, Homo sapiens
gctgtctccatgtttga

SEQ ID NO: 2573749 - DNA, 18 bp, Homo sapiens
gctgtctgatctgtgctt

SEQ ID NO: 2573750 - DNA, 22 bp, Homo sapiens
gctgtctgatctgtgctttcca

SEQ ID NO: 2573751 - DNA, 13 bp, Homo sapiens
gctgtctggccag

SEQ ID NO: 2573752 - DNA, 20 bp, Homo sapiens
gctgtcttctcaggctctgc

SEQ ID NO: 2573753 - DNA, 20 bp, Homo sapiens
gctgtgaatttgtgtaagga

SEQ ID NO: 2573754 - DNA, 17 bp, Homo sapiens
gctgtgacttctccagg

SEQ ID NO: 2573755 - DNA, 23 bp, Homo sapiens
gctgtgagacagtgggaaatatt

SEQ ID NO: 2573756 - DNA, 18 bp, Homo sapiens
gctgtgagtgtaagtgtg

SEQ ID NO: 2573757 - DNA, 16 bp, Homo sapiens
gctgtgccctcttgat

SEQ ID NO: 2573758 - DNA, 16 bp, Homo sapiens
gctgtgcggatctctg

SEQ ID NO: 2573759 - DNA, 18 bp, Homo sapiens
gctgtgcggatctctgga

SEQ ID NO: 2573760 - DNA, 14 bp, Homo sapiens
gctgtgctatgaat

SEQ ID NO: 2573761 - DNA, 16 bp, Homo sapiens
gctgtgctctggacag

SEQ ID NO: 2573762 - DNA, 19 bp, Homo sapiens
gctgtgctgccctgcccac

SEQ ID NO: 2573763 - DNA, 22 bp, Homo sapiens
gctgtgctgccctgcccacctg

SEQ ID NO: 2573764 - DNA, 14 bp, Homo sapiens
gctgtggccagggt

SEQ ID NO: 2573765 - DNA, 17 bp, Homo sapiens
gctgtggccagggtgag

SEQ ID NO: 2573766 - DNA, 21 bp, Homo sapiens
gctgtggccagggtgagagct

SEQ ID NO: 2573767 - DNA, 14 bp, Homo sapiens
gctgtggcctgggc

SEQ ID NO: 2573768 - DNA, 21 bp, Homo sapiens
gctgtggggctggtagctcag

SEQ ID NO: 2573769 - DNA, 12 bp, Homo sapiens
gctgtgtaaagt

SEQ ID NO: 2573770 - DNA, 13 bp, Homo sapiens
gctgttcagctgg

SEQ ID NO: 2573771 - DNA, 14 bp, Homo sapiens
gctgttcagctggt

SEQ ID NO: 2573772 - DNA, 16 bp, Homo sapiens
gctgttggcactcaca

SEQ ID NO: 2573773 - DNA, 22 bp, Homo sapiens
gctgttggcactcacagacctg

SEQ ID NO: 2573774 - DNA, 13 bp, Homo sapiens
gctgttggctggg

SEQ ID NO: 2573775 - DNA, 20 bp, Homo sapiens
gctgttggctgggggcctca

SEQ ID NO: 2573776 - DNA, 15 bp, Homo sapiens
gctgttgtacattta

SEQ ID NO: 2573777 - DNA, 18 bp, Homo sapiens
gctgttgtccctctgcta

SEQ ID NO: 2573778 - DNA, 15 bp, Homo sapiens
gctgtttactaggga

SEQ ID NO: 2573779 - DNA, 16 bp, Homo sapiens
gctgtttatggcctca

SEQ ID NO: 2573780 - DNA, 17 bp, Homo sapiens
gctgtttatggcctcag

SEQ ID NO: 2573781 - DNA, 13 bp, Homo sapiens
gctgtttccatag

SEQ ID NO: 2573782 - DNA, 11 bp, Homo sapiens
gctgtttcctt

SEQ ID NO: 2573783 - DNA, 21 bp, Homo sapiens
gctgttttagttaaatttctg

SEQ ID NO: 2573784 - DNA, 17 bp, Homo sapiens
gctgttttccctgacct

SEQ ID NO: 2573785 - DNA, 19 bp, Homo sapiens
gctgttttgtggatttttg

SEQ ID NO: 2573786 - DNA, 22 bp, Homo sapiens
gcttaaaggtgtcttcctccca

SEQ ID NO: 2573787 - DNA, 14 bp, Homo sapiens
gcttaacttcacat

SEQ ID NO: 2573788 - DNA, 15 bp, Homo sapiens
gcttaagcagaagca

SEQ ID NO: 2573789 - DNA, 12 bp, Homo sapiens
gcttaatgaaaa

SEQ ID NO: 2573790 - DNA, 14 bp, Homo sapiens
gcttaatgtttatt

SEQ ID NO: 2573791 - DNA, 12 bp, Homo sapiens
gcttacaatttt

SEQ ID NO: 2573792 - DNA, 21 bp, Homo sapiens
gcttacaatttttttaatttt

SEQ ID NO: 2573793 - DNA, 23 bp, Homo sapiens
gcttacaatttttttaattttgt

SEQ ID NO: 2573794 - DNA, 19 bp, Homo sapiens
gcttacatttttacaataa

SEQ ID NO: 2573795 - DNA, 17 bp, Homo sapiens
gcttactaagctttgcc

SEQ ID NO: 2573796 - DNA, 20 bp, Homo sapiens
gcttactttggaatacattt

SEQ ID NO: 2573797 - DNA, 14 bp, Homo sapiens
gcttagacctcagc

SEQ ID NO: 2573798 - DNA, 18 bp, Homo sapiens
gcttagacctcagcctgt

SEQ ID NO: 2573799 - DNA, 16 bp, Homo sapiens
gcttagagaatgttct

SEQ ID NO: 2573800 - DNA, 12 bp, Homo sapiens
gcttagagcagt

SEQ ID NO: 2573801 - DNA, 18 bp, Homo sapiens
gcttagcaggagaggaga

SEQ ID NO: 2573802 - DNA, 22 bp, Homo sapiens
gcttagcaggagaggagagcca

SEQ ID NO: 2573803 - DNA, 17 bp, Homo sapiens
gcttagctttgctctgc

SEQ ID NO: 2573804 - DNA, 18 bp, Homo sapiens
gcttagctttgctctgcc

SEQ ID NO: 2573805 - DNA, 12 bp, Homo sapiens
gcttaggagaga

SEQ ID NO: 2573806 - DNA, 13 bp, Homo sapiens
gcttaggagagac

SEQ ID NO: 2573807 - DNA, 22 bp, Homo sapiens
gcttaggatgtgtgcatgtgtg

SEQ ID NO: 2573808 - DNA, 19 bp, Homo sapiens
gcttagtcactgagacagc

SEQ ID NO: 2573809 - DNA, 12 bp, Homo sapiens
gcttatacactt

SEQ ID NO: 2573810 - DNA, 20 bp, Homo sapiens
gcttatacacttacacttta

SEQ ID NO: 2573811 - DNA, 16 bp, Homo sapiens
gcttcaaaatagagaa

SEQ ID NO: 2573812 - DNA, 18 bp, Homo sapiens
gcttcaaccttgagacag

SEQ ID NO: 2573813 - DNA, 20 bp, Homo sapiens
gcttcaccccaatcccagct

SEQ ID NO: 2573814 - DNA, 22 bp, Homo sapiens
gcttcaccctgaatggttccat

SEQ ID NO: 2573815 - DNA, 17 bp, Homo sapiens
gcttcactgtataaata

SEQ ID NO: 2573816 - DNA, 15 bp, Homo sapiens
gcttcagccaggagc

SEQ ID NO: 2573817 - DNA, 23 bp, Homo sapiens
gcttcagggcgcacagcatgaga

SEQ ID NO: 2573818 - DNA, 20 bp, Homo sapiens
gcttcaggttatcgaaataa

SEQ ID NO: 2573819 - DNA, 21 bp, Homo sapiens
gcttcaggttatcgaaataac

SEQ ID NO: 2573820 - DNA, 23 bp, Homo sapiens
gcttcaggttatcgaaataacaa

SEQ ID NO: 2573821 - DNA, 17 bp, Homo sapiens
gcttcagtggcagctgc

SEQ ID NO: 2573822 - DNA, 19 bp, Homo sapiens
gcttcagtttcctggtctg

SEQ ID NO: 2573823 - DNA, 14 bp, Homo sapiens
gcttcataaatgaa

SEQ ID NO: 2573824 - DNA, 15 bp, Homo sapiens
gcttcattagagcag

SEQ ID NO: 2573825 - DNA, 17 bp, Homo sapiens
gcttcatttcctgtgtc

SEQ ID NO: 2573826 - DNA, 21 bp, Homo sapiens
gcttccaaggcagaagcagca

SEQ ID NO: 2573827 - DNA, 18 bp, Homo sapiens
gcttccagtgaggctctg

SEQ ID NO: 2573828 - DNA, 19 bp, Homo sapiens
gcttccagtgaggctctgc

SEQ ID NO: 2573829 - DNA, 20 bp, Homo sapiens
gcttccagtgaggctctgcc

SEQ ID NO: 2573830 - DNA, 21 bp, Homo sapiens
gcttccagtgaggctctgccc

SEQ ID NO: 2573831 - DNA, 23 bp, Homo sapiens
gcttccagtgaggctctgccctt

SEQ ID NO: 2573832 - DNA, 12 bp, Homo sapiens
gcttccattcca

SEQ ID NO: 2573833 - DNA, 17 bp, Homo sapiens
gcttccatttgtgtgtg

SEQ ID NO: 2573834 - DNA, 19 bp, Homo sapiens
gcttcccagtggctgctgc

SEQ ID NO: 2573835 - DNA, 20 bp, Homo sapiens
gcttcccagtggctgctgcc

SEQ ID NO: 2573836 - DNA, 22 bp, Homo sapiens
gcttcccagtggctgctgccca

SEQ ID NO: 2573837 - DNA, 18 bp, Homo sapiens
gcttcccctctctcctcc

SEQ ID NO: 2573838 - DNA, 23 bp, Homo sapiens
gcttccctctgcctgtccctctc

SEQ ID NO: 2573839 - DNA, 18 bp, Homo sapiens
gcttcctagaagttactg

SEQ ID NO: 2573840 - DNA, 23 bp, Homo sapiens
gcttcctagaagttactgaatgc

SEQ ID NO: 2573841 - DNA, 13 bp, Homo sapiens
gcttcctcctgcg

SEQ ID NO: 2573842 - DNA, 18 bp, Homo sapiens
gcttcctgacaatcaact

SEQ ID NO: 2573843 - DNA, 12 bp, Homo sapiens
gcttcctttctt

SEQ ID NO: 2573844 - DNA, 17 bp, Homo sapiens
gcttctaccatgaacag

SEQ ID NO: 2573845 - DNA, 14 bp, Homo sapiens
gcttctatcccagg

SEQ ID NO: 2573846 - DNA, 18 bp, Homo sapiens
gcttctatcccaggaggt

SEQ ID NO: 2573847 - DNA, 14 bp, Homo sapiens
gcttctctctgtgg

SEQ ID NO: 2573848 - DNA, 16 bp, Homo sapiens
gcttctctctgtggga

SEQ ID NO: 2573849 - DNA, 13 bp, Homo sapiens
gcttctgcaccct

SEQ ID NO: 2573850 - DNA, 18 bp, Homo sapiens
gcttctgcaccctccacc

SEQ ID NO: 2573851 - DNA, 13 bp, Homo sapiens
gcttctggagccc

SEQ ID NO: 2573852 - DNA, 17 bp, Homo sapiens
gcttctggtactctcct

SEQ ID NO: 2573853 - DNA, 19 bp, Homo sapiens
gcttctggtactctcctag

SEQ ID NO: 2573854 - DNA, 19 bp, Homo sapiens
gcttcttaatcttttcaca

SEQ ID NO: 2573855 - DNA, 23 bp, Homo sapiens
gcttcttaatcttttcacaaata

SEQ ID NO: 2573856 - DNA, 16 bp, Homo sapiens
gcttctttcattttct

SEQ ID NO: 2573857 - DNA, 17 bp, Homo sapiens
gcttgaaaaatgtgcaa

SEQ ID NO: 2573858 - DNA, 17 bp, Homo sapiens
ggaccttgaactgggta

SEQ ID NO: 2573859 - DNA, 14 bp, Homo sapiens
ggacgactctgacc

SEQ ID NO: 2573860 - DNA, 14 bp, Homo sapiens
ggacgcctgggggt

SEQ ID NO: 2573861 - DNA, 13 bp, Homo sapiens
ggacgcttctgaa

SEQ ID NO: 2573862 - DNA, 18 bp, Homo sapiens
ggacggcattcctgctta

SEQ ID NO: 2573863 - DNA, 21 bp, Homo sapiens
ggacggcctgatgctccctcc

SEQ ID NO: 2573864 - DNA, 15 bp, Homo sapiens
ggacggctgggcaca

SEQ ID NO: 2573865 - DNA, 19 bp, Homo sapiens
ggacggggggccccagtca

SEQ ID NO: 2573866 - DNA, 21 bp, Homo sapiens
ggacggggggccccagtcagc

SEQ ID NO: 2573867 - DNA, 16 bp, Homo sapiens
ggacgtccctgcccat

SEQ ID NO: 2573868 - DNA, 13 bp, Homo sapiens
ggacgttccagcc

SEQ ID NO: 2573869 - DNA, 21 bp, Homo sapiens
ggacgttccagccggcatggc

SEQ ID NO: 2573870 - DNA, 20 bp, Homo sapiens
ggactacaggtgtgagtcac

SEQ ID NO: 2573871 - DNA, 17 bp, Homo sapiens
ggactagaacctggagg

SEQ ID NO: 2573872 - DNA, 18 bp, Homo sapiens
ggactagagggacctctc

SEQ ID NO: 2573873 - DNA, 19 bp, Homo sapiens
ggactagagggacctctcc

SEQ ID NO: 2573874 - DNA, 15 bp, Homo sapiens
ggactatagcccagg

SEQ ID NO: 2573875 - DNA, 15 bp, Homo sapiens
ggactcagccctgag

SEQ ID NO: 2573876 - DNA, 16 bp, Homo sapiens
ggactcagccctgagg

SEQ ID NO: 2573877 - DNA, 20 bp, Homo sapiens
ggactcaggatgcccagggc

SEQ ID NO: 2573878 - DNA, 20 bp, Homo sapiens
ggactcagggccatgcctgc

SEQ ID NO: 2573879 - DNA, 19 bp, Homo sapiens
ggactccagactctctgtg

SEQ ID NO: 2573880 - DNA, 22 bp, Homo sapiens
ggactccctcctcacctctgga

SEQ ID NO: 2573881 - DNA, 14 bp, Homo sapiens
ggactcctctgtcc

SEQ ID NO: 2573882 - DNA, 18 bp, Homo sapiens
ggactctcagtctctgag

SEQ ID NO: 2573883 - DNA, 11 bp, Homo sapiens
ggactctgagg

SEQ ID NO: 2573884 - DNA, 15 bp, Homo sapiens
ggactctgcacatga

SEQ ID NO: 2573885 - DNA, 11 bp, Homo sapiens
ggactctgcct

SEQ ID NO: 2573886 - DNA, 16 bp, Homo sapiens
ggactcttgctctttc

SEQ ID NO: 2573887 - DNA, 18 bp, Homo sapiens
ggactcttgctctttcta

SEQ ID NO: 2573888 - DNA, 12 bp, Homo sapiens
ggactgagccag

SEQ ID NO: 2573889 - DNA, 18 bp, Homo sapiens
ggactgagccagtcccag

SEQ ID NO: 2573890 - DNA, 18 bp, Homo sapiens
ggactgctaaataaaatt

SEQ ID NO: 2573891 - DNA, 14 bp, Homo sapiens
ggactggaaccagg

SEQ ID NO: 2573892 - DNA, 17 bp, Homo sapiens
ggactggaaccagggag

SEQ ID NO: 2573893 - DNA, 22 bp, Homo sapiens
ggactggaaccagggagaccga

SEQ ID NO: 2573894 - DNA, 20 bp, Homo sapiens
ggactggctagagtcctcac

SEQ ID NO: 2573895 - DNA, 23 bp, Homo sapiens
ggactggggatgtgggagggagc

SEQ ID NO: 2573896 - DNA, 11 bp, Homo sapiens
ggactgggttt

SEQ ID NO: 2573897 - DNA, 18 bp, Homo sapiens
ggactgggtttggacccc

SEQ ID NO: 2573898 - DNA, 23 bp, Homo sapiens
ggactgggtttggaccccagctg

SEQ ID NO: 2573899 - DNA, 15 bp, Homo sapiens
ggactgtcatagaaa

SEQ ID NO: 2573900 - DNA, 20 bp, Homo sapiens
ggactgtctttcagatacat

SEQ ID NO: 2573901 - DNA, 20 bp, Homo sapiens
ggactgtgacaggcagcaga

SEQ ID NO: 2573902 - DNA, 17 bp, Homo sapiens
ggacttaacggctccag

SEQ ID NO: 2573903 - DNA, 21 bp, Homo sapiens
ggacttcacgaagtgttgcat

SEQ ID NO: 2573904 - DNA, 17 bp, Homo sapiens
ggacttcttttcacatt

SEQ ID NO: 2573905 - DNA, 23 bp, Homo sapiens
ggacttgaaagcatccatgtgtg

SEQ ID NO: 2573906 - DNA, 19 bp, Homo sapiens
ggacttgcaaaaagggtca

SEQ ID NO: 2573907 - DNA, 17 bp, Homo sapiens
ggacttggaagctccgc

SEQ ID NO: 2573908 - DNA, 14 bp, Homo sapiens
ggacttgtatattt

SEQ ID NO: 2573909 - DNA, 16 bp, Homo sapiens
ggacttgtgtctctgt

SEQ ID NO: 2573910 - DNA, 16 bp, Homo sapiens
ggactttccaccccct

SEQ ID NO: 2573911 - DNA, 21 bp, Homo sapiens
ggactttccaccccctccctg

SEQ ID NO: 2573912 - DNA, 19 bp, Homo sapiens
ggagaaacccttgaaaaga

SEQ ID NO: 2573913 - DNA, 14 bp, Homo sapiens
ggagaaattgacag

SEQ ID NO: 2573914 - DNA, 18 bp, Homo sapiens
ggagaaccttgtgcctgg

SEQ ID NO: 2573915 - DNA, 13 bp, Homo sapiens
ggagaagaagtca

SEQ ID NO: 2573916 - DNA, 16 bp, Homo sapiens
ggagaagccattgtct

SEQ ID NO: 2573917 - DNA, 14 bp, Homo sapiens
ggagaaggatctag

SEQ ID NO: 2573918 - DNA, 20 bp, Homo sapiens
ggagaaggatctagaatgtg

SEQ ID NO: 2573919 - DNA, 14 bp, Homo sapiens
ggagaatcatgtga

SEQ ID NO: 2573920 - DNA, 18 bp, Homo sapiens
ggagacaagaaatccctg

SEQ ID NO: 2573921 - DNA, 16 bp, Homo sapiens
ggagactaagccctgt

SEQ ID NO: 2573922 - DNA, 13 bp, Homo sapiens
ggagactcctagg

SEQ ID NO: 2573923 - DNA, 16 bp, Homo sapiens
ggagactcctaggcag

SEQ ID NO: 2573924 - DNA, 16 bp, Homo sapiens
ggagactctgtggggc

SEQ ID NO: 2573925 - DNA, 15 bp, Homo sapiens
ggagactgcttccca

SEQ ID NO: 2573926 - DNA, 20 bp, Homo sapiens
ggagactgggctgagggagc

SEQ ID NO: 2573927 - DNA, 12 bp, Homo sapiens
ggagagagggga

SEQ ID NO: 2573928 - DNA, 14 bp, Homo sapiens
ggagagaggggaat

SEQ ID NO: 2573929 - DNA, 21 bp, Homo sapiens
ggagagaggggaataatagaa

SEQ ID NO: 2573930 - DNA, 13 bp, Homo sapiens
ggagagcaggctg

SEQ ID NO: 2573931 - DNA, 16 bp, Homo sapiens
ggagagcaggctggca

SEQ ID NO: 2573932 - DNA, 15 bp, Homo sapiens
ggagagccagagaag

SEQ ID NO: 2573933 - DNA, 16 bp, Homo sapiens
ggagagccagagaagt

SEQ ID NO: 2573934 - DNA, 11 bp, Homo sapiens
ggagagcccag

SEQ ID NO: 2573935 - DNA, 17 bp, Homo sapiens
ggagagccttccagggg

SEQ ID NO: 2573936 - DNA, 18 bp, Homo sapiens
ggagagccttccaggggt

SEQ ID NO: 2573937 - DNA, 22 bp, Homo sapiens
ggagagccttccaggggtggga

SEQ ID NO: 2573938 - DNA, 16 bp, Homo sapiens
ggagagctagaacctg

SEQ ID NO: 2573939 - DNA, 18 bp, Homo sapiens
ggagagctagaacctgga

SEQ ID NO: 2573940 - DNA, 22 bp, Homo sapiens
ggagagctagaacctggagggc

SEQ ID NO: 2573941 - DNA, 21 bp, Homo sapiens
ggagagctagcagcagggagg

SEQ ID NO: 2573942 - DNA, 15 bp, Homo sapiens
ggagagctggtgccc

SEQ ID NO: 2573943 - DNA, 13 bp, Homo sapiens
ggagaggagagcc

SEQ ID NO: 2573944 - DNA, 15 bp, Homo sapiens
ggagaggagagccag

SEQ ID NO: 2573945 - DNA, 13 bp, Homo sapiens
ggagaggatgaga

SEQ ID NO: 2573946 - DNA, 13 bp, Homo sapiens
ggagaggccatga

SEQ ID NO: 2573947 - DNA, 21 bp, Homo sapiens
ggagaggctagaaccaagaag

SEQ ID NO: 2573948 - DNA, 22 bp, Homo sapiens
ggagaggggaagggccagtctg

SEQ ID NO: 2573949 - DNA, 18 bp, Homo sapiens
ggagaggtcttttttaaa

SEQ ID NO: 2573950 - DNA, 23 bp, Homo sapiens
ggagaggtcttttttaaaaggaa

SEQ ID NO: 2573951 - DNA, 20 bp, Homo sapiens
ggagagtacagtgagccaag

SEQ ID NO: 2573952 - DNA, 22 bp, Homo sapiens
ggagatatctgagggaggaggc

SEQ ID NO: 2573953 - DNA, 12 bp, Homo sapiens
ggagatgtcttc

SEQ ID NO: 2573954 - DNA, 13 bp, Homo sapiens
ggagatgtcttcg

SEQ ID NO: 2573955 - DNA, 22 bp, Homo sapiens
ggagatgtcttcgtacagttct

SEQ ID NO: 2573956 - DNA, 17 bp, Homo sapiens
ggagattggacggcctg

SEQ ID NO: 2573957 - DNA, 16 bp, Homo sapiens
ggagattttaggtgtt

SEQ ID NO: 2573958 - DNA, 20 bp, Homo sapiens
ggagcaaaatcgatgcagtg

SEQ ID NO: 2573959 - DNA, 20 bp, Homo sapiens
ggagcaaatgtttctgcagt

SEQ ID NO: 2573960 - DNA, 22 bp, Homo sapiens
ggagcaacttgttcgtgggtca

SEQ ID NO: 2573961 - DNA, 13 bp, Homo sapiens
ggagcacaggcag

SEQ ID NO: 2573962 - DNA, 13 bp, Homo sapiens
ggagcactggagt

SEQ ID NO: 2573963 - DNA, 17 bp, Homo sapiens
ggagcagagctctgccg

SEQ ID NO: 2573964 - DNA, 14 bp, Homo sapiens
ggagcagtgcaggc

SEQ ID NO: 2573965 - DNA, 17 bp, Homo sapiens
ggagcagtgtcttccat

SEQ ID NO: 2573966 - DNA, 21 bp, Homo sapiens
ggagcatctcttgaggccagg

SEQ ID NO: 2573967 - DNA, 16 bp, Homo sapiens
ggagcatctgactcac

SEQ ID NO: 2573968 - DNA, 16 bp, Homo sapiens
ggagcatgggcctggc

SEQ ID NO: 2573969 - DNA, 15 bp, Homo sapiens
ggagcatttggagag

SEQ ID NO: 2573970 - DNA, 16 bp, Homo sapiens
ggagccactcctctga

SEQ ID NO: 2573971 - DNA, 21 bp, Homo sapiens
ggagccactcctctgactcag

SEQ ID NO: 2573972 - DNA, 18 bp, Homo sapiens
ggagccagtaaacagagg

SEQ ID NO: 2573973 - DNA, 16 bp, Homo sapiens
ggagcccagctctgaa

SEQ ID NO: 2573974 - DNA, 13 bp, Homo sapiens
ggagccccagccc

SEQ ID NO: 2573975 - DNA, 15 bp, Homo sapiens
ggagccccagccccc

SEQ ID NO: 2573976 - DNA, 17 bp, Homo sapiens
ggagccccagctaccct

SEQ ID NO: 2573977 - DNA, 20 bp, Homo sapiens
ggagccccaggcctctgtgt

SEQ ID NO: 2573978 - DNA, 23 bp, Homo sapiens
ggagccccaggcctctgtgtcct

SEQ ID NO: 2573979 - DNA, 12 bp, Homo sapiens
ggagccccaggg

SEQ ID NO: 2573980 - DNA, 13 bp, Homo sapiens
ggagccccagggt

SEQ ID NO: 2573981 - DNA, 14 bp, Homo sapiens
ggagccccagggtc

SEQ ID NO: 2573982 - DNA, 14 bp, Homo sapiens
ggagcccctgggtg

SEQ ID NO: 2573983 - DNA, 15 bp, Homo sapiens
ggagcccctgggtgg

SEQ ID NO: 2573984 - DNA, 21 bp, Homo sapiens
ggagcccctgggtgggtggtg

SEQ ID NO: 2573985 - DNA, 16 bp, Homo sapiens
ggagcccgcaccccca

SEQ ID NO: 2573986 - DNA, 18 bp, Homo sapiens
ggagcccgcacccccacc

SEQ ID NO: 2573987 - DNA, 16 bp, Homo sapiens
ggagcccgtctcagtg

SEQ ID NO: 2573988 - DNA, 16 bp, Homo sapiens
ggagccggtggcggtg

SEQ ID NO: 2573989 - DNA, 11 bp, Homo sapiens
ggagcctgcag

SEQ ID NO: 2573990 - DNA, 13 bp, Homo sapiens
ggagcctgcaggg

SEQ ID NO: 2573991 - DNA, 21 bp, Homo sapiens
ggagcctgcagggtggtgctg

SEQ ID NO: 2573992 - DNA, 22 bp, Homo sapiens
ggagcctgctggtcacagcctc

SEQ ID NO: 2573993 - DNA, 14 bp, Homo sapiens
ggagcggaaagcag

SEQ ID NO: 2573994 - DNA, 16 bp, Homo sapiens
ggagctaacactggcc

SEQ ID NO: 2573995 - DNA, 14 bp, Homo sapiens
ggagctcagagagg

SEQ ID NO: 2573996 - DNA, 17 bp, Homo sapiens
ggagctcagagagggca

SEQ ID NO: 2573997 - DNA, 20 bp, Homo sapiens
ggagctcctctcctggagga

SEQ ID NO: 2573998 - DNA, 17 bp, Homo sapiens
ggagctcttcaggcctc

SEQ ID NO: 2573999 - DNA, 18 bp, Homo sapiens
ggagctcttcaggcctcc

SEQ ID NO: 2574000 - DNA, 20 bp, Homo sapiens
ggagctcttcaggcctccct

SEQ ID NO: 2574001 - DNA, 15 bp, Homo sapiens
ggagctgctggcttg

SEQ ID NO: 2574002 - DNA, 15 bp, Homo sapiens
ggagctggccccgcc

SEQ ID NO: 2574003 - DNA, 16 bp, Homo sapiens
ggagctggccccgccg

SEQ ID NO: 2574004 - DNA, 16 bp, Homo sapiens
ggccttccccagcctc

SEQ ID NO: 2574005 - DNA, 14 bp, Homo sapiens
ggccttcctgccct

SEQ ID NO: 2574006 - DNA, 15 bp, Homo sapiens
ggccttctctgaagg

SEQ ID NO: 2574007 - DNA, 23 bp, Homo sapiens
ggcctttgagcccacaaagcctt

SEQ ID NO: 2574008 - DNA, 13 bp, Homo sapiens
ggcctttggcttc

SEQ ID NO: 2574009 - DNA, 14 bp, Homo sapiens
ggcctttggcttca

SEQ ID NO: 2574010 - DNA, 19 bp, Homo sapiens
ggcgaccccgtcacagcct

SEQ ID NO: 2574011 - DNA, 20 bp, Homo sapiens
ggcgaccccgtcacagcctc

SEQ ID NO: 2574012 - DNA, 19 bp, Homo sapiens
ggcgaggcagaggacagat

SEQ ID NO: 2574013 - DNA, 16 bp, Homo sapiens
ggcgagtcactgcctc

SEQ ID NO: 2574014 - DNA, 17 bp, Homo sapiens
ggcgatccacctgtctc

SEQ ID NO: 2574015 - DNA, 18 bp, Homo sapiens
ggcgatccacctgtctca

SEQ ID NO: 2574016 - DNA, 23 bp, Homo sapiens
ggcgcagcatattcaggaagctc

SEQ ID NO: 2574017 - DNA, 24 bp, Homo sapiens
ggcgcagcatattcaggaagctca

SEQ ID NO: 2574018 - DNA, 12 bp, Homo sapiens
ggcgccctggaa

SEQ ID NO: 2574019 - DNA, 14 bp, Homo sapiens
ggcgccctggaagc

SEQ ID NO: 2574020 - DNA, 16 bp, Homo sapiens
ggcgcggccagccccg

SEQ ID NO: 2574021 - DNA, 11 bp, Homo sapiens
ggcgctggccc

SEQ ID NO: 2574022 - DNA, 14 bp, Homo sapiens
ggcgctggcccagc

SEQ ID NO: 2574023 - DNA, 15 bp, Homo sapiens
ggcgctggcccagcc

SEQ ID NO: 2574024 - DNA, 19 bp, Homo sapiens
ggcgctggcccagccggcc

SEQ ID NO: 2574025 - DNA, 20 bp, Homo sapiens
ggcgctggcccagccggcct

SEQ ID NO: 2574026 - DNA, 20 bp, Homo sapiens
ggcggagagtacagtgagcc

SEQ ID NO: 2574027 - DNA, 20 bp, Homo sapiens
ggcggagctggccccgccgc

SEQ ID NO: 2574028 - DNA, 21 bp, Homo sapiens
ggcggagcttgcagtgagccg

SEQ ID NO: 2574029 - DNA, 20 bp, Homo sapiens
ggcggatgttgaagtgagct

SEQ ID NO: 2574030 - DNA, 16 bp, Homo sapiens
ggcggcagcagccatc

SEQ ID NO: 2574031 - DNA, 17 bp, Homo sapiens
ggcggccatgatggtgc

SEQ ID NO: 2574032 - DNA, 14 bp, Homo sapiens
ggcggctgagagcc

SEQ ID NO: 2574033 - DNA, 12 bp, Homo sapiens
ggcgggccagcc

SEQ ID NO: 2574034 - DNA, 13 bp, Homo sapiens
ggcgggccagcca

SEQ ID NO: 2574035 - DNA, 17 bp, Homo sapiens
ggcgggccagccaggcg

SEQ ID NO: 2574036 - DNA, 14 bp, Homo sapiens
ggcgggcggtcagg

SEQ ID NO: 2574037 - DNA, 18 bp, Homo sapiens
ggcgtcagcctccagcct

SEQ ID NO: 2574038 - DNA, 20 bp, Homo sapiens
ggcgtcagcctccagcctct

SEQ ID NO: 2574039 - DNA, 22 bp, Homo sapiens
ggcgtcagcctccagcctctgt

SEQ ID NO: 2574040 - DNA, 21 bp, Homo sapiens
ggcgtccgcgcgccagcacag

SEQ ID NO: 2574041 - DNA, 16 bp, Homo sapiens
ggcgtctgtatatttt

SEQ ID NO: 2574042 - DNA, 15 bp, Homo sapiens
ggcgtctgtcttcaa

SEQ ID NO: 2574043 - DNA, 17 bp, Homo sapiens
ggcgtggtcaagcactc

SEQ ID NO: 2574044 - DNA, 15 bp, Homo sapiens
ggcgtggtcactgct

SEQ ID NO: 2574045 - DNA, 17 bp, Homo sapiens
ggcgtggtcactgctgt

SEQ ID NO: 2574046 - DNA, 18 bp, Homo sapiens
ggcgtggtcactgctgtc

SEQ ID NO: 2574047 - DNA, 16 bp, Homo sapiens
ggcgtggtggcgggca

SEQ ID NO: 2574048 - DNA, 23 bp, Homo sapiens
ggctaattcccagagtgtgaaac

SEQ ID NO: 2574049 - DNA, 12 bp, Homo sapiens
ggctaccctccc

SEQ ID NO: 2574050 - DNA, 19 bp, Homo sapiens
ggctaccctgagctgaggc

SEQ ID NO: 2574051 - DNA, 13 bp, Homo sapiens
ggctacctttgta

SEQ ID NO: 2574052 - DNA, 14 bp, Homo sapiens
ggctacctttgtat

SEQ ID NO: 2574053 - DNA, 18 bp, Homo sapiens
ggctactgcagctttaca

SEQ ID NO: 2574054 - DNA, 23 bp, Homo sapiens
ggctactgcagctttacatgcaa

SEQ ID NO: 2574055 - DNA, 21 bp, Homo sapiens
ggctagaaccaagaagggcta

SEQ ID NO: 2574056 - DNA, 16 bp, Homo sapiens
ggctagaacctggaga

SEQ ID NO: 2574057 - DNA, 14 bp, Homo sapiens
ggctagaacctggc

SEQ ID NO: 2574058 - DNA, 13 bp, Homo sapiens
ggctagaatctgg

SEQ ID NO: 2574059 - DNA, 14 bp, Homo sapiens
ggctagaatctgga

SEQ ID NO: 2574060 - DNA, 16 bp, Homo sapiens
ggctagaggccagccc

SEQ ID NO: 2574061 - DNA, 18 bp, Homo sapiens
ggctagaggccagcccca

SEQ ID NO: 2574062 - DNA, 18 bp, Homo sapiens
ggctagagtcctcactcc

SEQ ID NO: 2574063 - DNA, 15 bp, Homo sapiens
ggctagatcatgaag

SEQ ID NO: 2574064 - DNA, 20 bp, Homo sapiens
ggctagtatcaaaagaaaga

SEQ ID NO: 2574065 - DNA, 23 bp, Homo sapiens
ggctagtgtggtgtttcctggca

SEQ ID NO: 2574066 - DNA, 15 bp, Homo sapiens
ggctagttgggcttc

SEQ ID NO: 2574067 - DNA, 16 bp, Homo sapiens
ggctagttgggcttcc

SEQ ID NO: 2574068 - DNA, 23 bp, Homo sapiens
ggctataggtgctacaaaaacac

SEQ ID NO: 2574069 - DNA, 19 bp, Homo sapiens
ggctatgggggcactgagg

SEQ ID NO: 2574070 - DNA, 21 bp, Homo sapiens
ggctcaagtcctcttttctga

SEQ ID NO: 2574071 - DNA, 19 bp, Homo sapiens
ggctcacccaagcaaggcc

SEQ ID NO: 2574072 - DNA, 17 bp, Homo sapiens
ggctcacccccttctcc

SEQ ID NO: 2574073 - DNA, 21 bp, Homo sapiens
ggctcacgcctatgatcccag

SEQ ID NO: 2574074 - DNA, 18 bp, Homo sapiens
ggctcacgcctgtaatcc

SEQ ID NO: 2574075 - DNA, 13 bp, Homo sapiens
ggctcactgcagc

SEQ ID NO: 2574076 - DNA, 17 bp, Homo sapiens
ggctcactgcagcctca

SEQ ID NO: 2574077 - DNA, 18 bp, Homo sapiens
ggctcagagatgtgcacc

SEQ ID NO: 2574078 - DNA, 13 bp, Homo sapiens
ggctcagatctca

SEQ ID NO: 2574079 - DNA, 19 bp, Homo sapiens
ggctcagcaaaagatgctt

SEQ ID NO: 2574080 - DNA, 11 bp, Homo sapiens
ggctcagcctg

SEQ ID NO: 2574081 - DNA, 22 bp, Homo sapiens
ggctcagggaggttaagtgact

SEQ ID NO: 2574082 - DNA, 14 bp, Homo sapiens
ggctccagaaatgt

SEQ ID NO: 2574083 - DNA, 10 bp, Homo sapiens
ggctccagac

SEQ ID NO: 2574084 - DNA, 12 bp, Homo sapiens
ggctccaggctc

SEQ ID NO: 2574085 - DNA, 24 bp, Homo sapiens
ggctccagtctgctgccctccatc

SEQ ID NO: 2574086 - DNA, 20 bp, Homo sapiens
ggctccctgtaacctcttca

SEQ ID NO: 2574087 - DNA, 18 bp, Homo sapiens
ggctcccttcccacctct

SEQ ID NO: 2574088 - DNA, 20 bp, Homo sapiens
ggctcccttcccacctctct

SEQ ID NO: 2574089 - DNA, 22 bp, Homo sapiens
ggctcccttcccacctctctca

SEQ ID NO: 2574090 - DNA, 18 bp, Homo sapiens
ggctcctgccttctgtcc

SEQ ID NO: 2574091 - DNA, 19 bp, Homo sapiens
ggctcctgccttctgtcct

SEQ ID NO: 2574092 - DNA, 17 bp, Homo sapiens
ggctcctttctccagcc

SEQ ID NO: 2574093 - DNA, 17 bp, Homo sapiens
ggctcgccatgccgggg

SEQ ID NO: 2574094 - DNA, 22 bp, Homo sapiens
ggctcgcctcaggaatgggctg

SEQ ID NO: 2574095 - DNA, 18 bp, Homo sapiens
ggctcgttgactggctgt

SEQ ID NO: 2574096 - DNA, 19 bp, Homo sapiens
ggctctacaactgagtcct

SEQ ID NO: 2574097 - DNA, 12 bp, Homo sapiens
ggctctccaagt

SEQ ID NO: 2574098 - DNA, 18 bp, Homo sapiens
ggctctccaagtgccaga

SEQ ID NO: 2574099 - DNA, 20 bp, Homo sapiens
ggctctgcaattcccctctg

SEQ ID NO: 2574100 - DNA, 19 bp, Homo sapiens
ggctctgccaccctacctg

SEQ ID NO: 2574101 - DNA, 20 bp, Homo sapiens
ggctctgccccagctctggc

SEQ ID NO: 2574102 - DNA, 15 bp, Homo sapiens
ggctctgcccttggt

SEQ ID NO: 2574103 - DNA, 23 bp, Homo sapiens
ggctctgggatagctgacccagc

SEQ ID NO: 2574104 - DNA, 12 bp, Homo sapiens
ggctctgtgctg

SEQ ID NO: 2574105 - DNA, 19 bp, Homo sapiens
ggctctgtgctgaccctcc

SEQ ID NO: 2574106 - DNA, 24 bp, Homo sapiens
ggctcttccaggctgggagagcct

SEQ ID NO: 2574107 - DNA, 16 bp, Homo sapiens
ggctcttctccccaga

SEQ ID NO: 2574108 - DNA, 13 bp, Homo sapiens
ggctcttctgact

SEQ ID NO: 2574109 - DNA, 19 bp, Homo sapiens
ggctcttgatacccccctc

SEQ ID NO: 2574110 - DNA, 20 bp, Homo sapiens
ggctcttgatacccccctct

SEQ ID NO: 2574111 - DNA, 13 bp, Homo sapiens
ggctctttccttg

SEQ ID NO: 2574112 - DNA, 16 bp, Homo sapiens
ggctctttccttgctc

SEQ ID NO: 2574113 - DNA, 17 bp, Homo sapiens
ggctctttccttgctca

SEQ ID NO: 2574114 - DNA, 16 bp, Homo sapiens
ggctgaaccctgtgct

SEQ ID NO: 2574115 - DNA, 21 bp, Homo sapiens
ggctgaaccctgtgctggtgt

SEQ ID NO: 2574116 - DNA, 16 bp, Homo sapiens
ggctgaatagcagaag

SEQ ID NO: 2574117 - DNA, 14 bp, Homo sapiens
ggctgacatctgtg

SEQ ID NO: 2574118 - DNA, 22 bp, Homo sapiens
ggctgaccccaaagagcctgga

SEQ ID NO: 2574119 - DNA, 20 bp, Homo sapiens
ggctgaccttcctcgcagag

SEQ ID NO: 2574120 - DNA, 12 bp, Homo sapiens
ggctgagactgg

SEQ ID NO: 2574121 - DNA, 17 bp, Homo sapiens
ggctgagagccccagct

SEQ ID NO: 2574122 - DNA, 19 bp, Homo sapiens
ggctgagagccccagctga

SEQ ID NO: 2574123 - DNA, 13 bp, Homo sapiens
ggctgagccccta

SEQ ID NO: 2574124 - DNA, 16 bp, Homo sapiens
ggctgagcccctaccc

SEQ ID NO: 2574125 - DNA, 12 bp, Homo sapiens
ggctgagccctg

SEQ ID NO: 2574126 - DNA, 16 bp, Homo sapiens
ggctgagccctggcag

SEQ ID NO: 2574127 - DNA, 17 bp, Homo sapiens
ggctgaggaaaggccag

SEQ ID NO: 2574128 - DNA, 15 bp, Homo sapiens
ggctgaggaggcctc

SEQ ID NO: 2574129 - DNA, 19 bp, Homo sapiens
ggctgaggaggcctccatc

SEQ ID NO: 2574130 - DNA, 21 bp, Homo sapiens
ggctgaggatttcaagcctgc

SEQ ID NO: 2574131 - DNA, 13 bp, Homo sapiens
ggctgaggtggga

SEQ ID NO: 2574132 - DNA, 15 bp, Homo sapiens
ggctgaggtgggagg

SEQ ID NO: 2574133 - DNA, 22 bp, Homo sapiens
ggctgcaaagggtatcaggtgc

SEQ ID NO: 2574134 - DNA, 23 bp, Homo sapiens
ggctgcaaagggtatcaggtgct

SEQ ID NO: 2574135 - DNA, 17 bp, Homo sapiens
ggctgcaccggctggcc

SEQ ID NO: 2574136 - DNA, 20 bp, Homo sapiens
ggctgcagcagcggtggcct

SEQ ID NO: 2574137 - DNA, 17 bp, Homo sapiens
ggctgcagggagtccga

SEQ ID NO: 2574138 - DNA, 12 bp, Homo sapiens
ggctgccctgcc

SEQ ID NO: 2574139 - DNA, 13 bp, Homo sapiens
ggctgccctgcca

SEQ ID NO: 2574140 - DNA, 14 bp, Homo sapiens
ggctgccctggccc

SEQ ID NO: 2574141 - DNA, 21 bp, Homo sapiens
ggctgccgggttctagtctcc

SEQ ID NO: 2574142 - DNA, 14 bp, Homo sapiens
ggctgcctgggctg

SEQ ID NO: 2574143 - DNA, 15 bp, Homo sapiens
ggctgcctgggctgt

SEQ ID NO: 2574144 - DNA, 15 bp, Homo sapiens
ggctgctcagggctg

SEQ ID NO: 2574145 - DNA, 13 bp, Homo sapiens
ggctgctgaagct

SEQ ID NO: 2574146 - DNA, 14 bp, Homo sapiens
ggctgctgaaggct

SEQ ID NO: 2574147 - DNA, 12 bp, Homo sapiens
ggctgctgccca

SEQ ID NO: 2574148 - DNA, 14 bp, Homo sapiens
ggctgctggcgcct

SEQ ID NO: 2574149 - DNA, 16 bp, Homo sapiens
ggtctttcatggggtg

SEQ ID NO: 2574150 - DNA, 19 bp, Homo sapiens
ggtctttcctatcatggag

SEQ ID NO: 2574151 - DNA, 21 bp, Homo sapiens
ggtcttttgacatgtggaaag

SEQ ID NO: 2574152 - DNA, 14 bp, Homo sapiens
ggtgaaagggagct

SEQ ID NO: 2574153 - DNA, 16 bp, Homo sapiens
ggtgaagggagagcca

SEQ ID NO: 2574154 - DNA, 18 bp, Homo sapiens
ggtgaagtgaagacaatg

SEQ ID NO: 2574155 - DNA, 15 bp, Homo sapiens
ggtgaccttctggga

SEQ ID NO: 2574156 - DNA, 18 bp, Homo sapiens
ggtgacgcctgccctccc

SEQ ID NO: 2574157 - DNA, 16 bp, Homo sapiens
ggtgagaggggaacag

SEQ ID NO: 2574158 - DNA, 16 bp, Homo sapiens
ggtgagatgcagctgg

SEQ ID NO: 2574159 - DNA, 19 bp, Homo sapiens
ggtgagcccatggccctcc

SEQ ID NO: 2574160 - DNA, 14 bp, Homo sapiens
ggtgaggcaggctt

SEQ ID NO: 2574161 - DNA, 15 bp, Homo sapiens
ggtgaggccttgctc

SEQ ID NO: 2574162 - DNA, 18 bp, Homo sapiens
ggtgatccacccacctca

SEQ ID NO: 2574163 - DNA, 15 bp, Homo sapiens
ggtgatttcagagag

SEQ ID NO: 2574164 - DNA, 18 bp, Homo sapiens
ggtgcaaagttccctact

SEQ ID NO: 2574165 - DNA, 23 bp, Homo sapiens
ggtgcaacccaaggactgaggga

SEQ ID NO: 2574166 - DNA, 16 bp, Homo sapiens
ggtgcagagtgcccag

SEQ ID NO: 2574167 - DNA, 19 bp, Homo sapiens
ggtgcagagtgcccagaac

SEQ ID NO: 2574168 - DNA, 20 bp, Homo sapiens
ggtgcagttgacagcaggtg

SEQ ID NO: 2574169 - DNA, 22 bp, Homo sapiens
ggtgccaatggaacctcctttc

SEQ ID NO: 2574170 - DNA, 17 bp, Homo sapiens
ggtgccagcaactgaat

SEQ ID NO: 2574171 - DNA, 20 bp, Homo sapiens
ggtgccagccttcctctgca

SEQ ID NO: 2574172 - DNA, 15 bp, Homo sapiens
ggtgccagttatggc

SEQ ID NO: 2574173 - DNA, 20 bp, Homo sapiens
ggtgccccctcctctcccat

SEQ ID NO: 2574174 - DNA, 19 bp, Homo sapiens
ggtgccctgttctctacca

SEQ ID NO: 2574175 - DNA, 22 bp, Homo sapiens
ggtgcccttggaggccagccag

SEQ ID NO: 2574176 - DNA, 14 bp, Homo sapiens
ggtgccgcctgccc

SEQ ID NO: 2574177 - DNA, 14 bp, Homo sapiens
ggtgcctgaggtct

SEQ ID NO: 2574178 - DNA, 13 bp, Homo sapiens
ggtgcctgtccca

SEQ ID NO: 2574179 - DNA, 22 bp, Homo sapiens
ggtgcggctgtgcagcctgtcc

SEQ ID NO: 2574180 - DNA, 21 bp, Homo sapiens
ggtgctaaatggtcgcccagg

SEQ ID NO: 2574181 - DNA, 23 bp, Homo sapiens
ggtgctacaaaaacacagcaagg

SEQ ID NO: 2574182 - DNA, 22 bp, Homo sapiens
ggtgctacacccttttccagct

SEQ ID NO: 2574183 - DNA, 23 bp, Homo sapiens
ggtgctacacccttttccagctg

SEQ ID NO: 2574184 - DNA, 17 bp, Homo sapiens
ggtgctataggctggag

SEQ ID NO: 2574185 - DNA, 19 bp, Homo sapiens
ggtgctataggctggagaa

SEQ ID NO: 2574186 - DNA, 16 bp, Homo sapiens
ggtgctatctccccca

SEQ ID NO: 2574187 - DNA, 22 bp, Homo sapiens
ggtgctatctcccccagcccca

SEQ ID NO: 2574188 - DNA, 12 bp, Homo sapiens
ggtgctgggact

SEQ ID NO: 2574189 - DNA, 15 bp, Homo sapiens
ggtggaaggaggcgc

SEQ ID NO: 2574190 - DNA, 19 bp, Homo sapiens
ggtggaaggcccgaggggc

SEQ ID NO: 2574191 - DNA, 13 bp, Homo sapiens
ggtggacacacaa

SEQ ID NO: 2574192 - DNA, 14 bp, Homo sapiens
ggtggacccaggga

SEQ ID NO: 2574193 - DNA, 12 bp, Homo sapiens
ggtggagaagcc

SEQ ID NO: 2574194 - DNA, 14 bp, Homo sapiens
ggtggagaagccat

SEQ ID NO: 2574195 - DNA, 21 bp, Homo sapiens
ggtggagccagtaaacagagg

SEQ ID NO: 2574196 - DNA, 23 bp, Homo sapiens
ggtggagggccacatgggaggct

SEQ ID NO: 2574197 - DNA, 18 bp, Homo sapiens
ggtggcacaggccccctt

SEQ ID NO: 2574198 - DNA, 14 bp, Homo sapiens
ggtggcaccagcag

SEQ ID NO: 2574199 - DNA, 20 bp, Homo sapiens
ggtggcaccagcagcctgga

SEQ ID NO: 2574200 - DNA, 20 bp, Homo sapiens
ggtggcactgagccccccca

SEQ ID NO: 2574201 - DNA, 13 bp, Homo sapiens
ggtggcactgcca

SEQ ID NO: 2574202 - DNA, 16 bp, Homo sapiens
ggtggcactttttcat

SEQ ID NO: 2574203 - DNA, 13 bp, Homo sapiens
ggtggcagctcac

SEQ ID NO: 2574204 - DNA, 16 bp, Homo sapiens
ggtggcagtgggagct

SEQ ID NO: 2574205 - DNA, 19 bp, Homo sapiens
ggtggcagtgggagctgcc

SEQ ID NO: 2574206 - DNA, 21 bp, Homo sapiens
ggtggcgactctatagactct

SEQ ID NO: 2574207 - DNA, 22 bp, Homo sapiens
ggtggctggagacgggtgggcg

SEQ ID NO: 2574208 - DNA, 13 bp, Homo sapiens
ggtgggacaccct

SEQ ID NO: 2574209 - DNA, 15 bp, Homo sapiens
ggtgggagagcccag

SEQ ID NO: 2574210 - DNA, 15 bp, Homo sapiens
ggtgggatcctccag

SEQ ID NO: 2574211 - DNA, 14 bp, Homo sapiens
ggtgggcaggtggt

SEQ ID NO: 2574212 - DNA, 12 bp, Homo sapiens
ggtgggcccagg

SEQ ID NO: 2574213 - DNA, 22 bp, Homo sapiens
ggtgggcccaggaccagctggg

SEQ ID NO: 2574214 - DNA, 23 bp, Homo sapiens
ggtgggcccaggaccagctgggg

SEQ ID NO: 2574215 - DNA, 13 bp, Homo sapiens
ggtgggcctctgg

SEQ ID NO: 2574216 - DNA, 15 bp, Homo sapiens
ggtgggccttgctgg

SEQ ID NO: 2574217 - DNA, 11 bp, Homo sapiens
ggtggggaggg

SEQ ID NO: 2574218 - DNA, 12 bp, Homo sapiens
ggtggggcggga

SEQ ID NO: 2574219 - DNA, 16 bp, Homo sapiens
ggtggggcgggaaagc

SEQ ID NO: 2574220 - DNA, 17 bp, Homo sapiens
ggtggggcgggaaagcc

SEQ ID NO: 2574221 - DNA, 20 bp, Homo sapiens
ggtggggggatcacaaggtc

SEQ ID NO: 2574222 - DNA, 23 bp, Homo sapiens
ggtggggtcactctggcagctca

SEQ ID NO: 2574223 - DNA, 23 bp, Homo sapiens
ggtggggtcctggagcagaccac

SEQ ID NO: 2574224 - DNA, 17 bp, Homo sapiens
ggtgggtccatgggcag

SEQ ID NO: 2574225 - DNA, 16 bp, Homo sapiens
ggtggtaccctctgga

SEQ ID NO: 2574226 - DNA, 14 bp, Homo sapiens
ggtggtggatctgt

SEQ ID NO: 2574227 - DNA, 18 bp, Homo sapiens
ggtggttttctgttcttt

SEQ ID NO: 2574228 - DNA, 16 bp, Homo sapiens
ggtgtaataagacata

SEQ ID NO: 2574229 - DNA, 17 bp, Homo sapiens
ggtgtatttattttcct

SEQ ID NO: 2574230 - DNA, 19 bp, Homo sapiens
ggtgtcaagagggtctgag

SEQ ID NO: 2574231 - DNA, 12 bp, Homo sapiens
ggtgtcctgacc

SEQ ID NO: 2574232 - DNA, 16 bp, Homo sapiens
ggtgtctgcacccagg

SEQ ID NO: 2574233 - DNA, 23 bp, Homo sapiens
ggtgtctgtgttccaaccactga

SEQ ID NO: 2574234 - DNA, 15 bp, Homo sapiens
ggtgtgcctgcagcc

SEQ ID NO: 2574235 - DNA, 21 bp, Homo sapiens
ggtgtgcggcctttggcttca

SEQ ID NO: 2574236 - DNA, 13 bp, Homo sapiens
ggtgtgctctgat

SEQ ID NO: 2574237 - DNA, 14 bp, Homo sapiens
ggtgtggagaagcg

SEQ ID NO: 2574238 - DNA, 23 bp, Homo sapiens
ggtgtgtccccctctgtccaggc

SEQ ID NO: 2574239 - DNA, 18 bp, Homo sapiens
ggtgtgttccaactgccc

SEQ ID NO: 2574240 - DNA, 17 bp, Homo sapiens
ggtgttgacatgtgctt

SEQ ID NO: 2574241 - DNA, 17 bp, Homo sapiens
ggtgttgtatgccttta

SEQ ID NO: 2574242 - DNA, 22 bp, Homo sapiens
ggtgtttctccctctcactgtc

SEQ ID NO: 2574243 - DNA, 15 bp, Homo sapiens
ggttaaggctgagga

SEQ ID NO: 2574244 - DNA, 13 bp, Homo sapiens
ggttaagtctgtt

SEQ ID NO: 2574245 - DNA, 16 bp, Homo sapiens
ggttaagtctgtttta

SEQ ID NO: 2574246 - DNA, 14 bp, Homo sapiens
ggttacaacagatt

SEQ ID NO: 2574247 - DNA, 21 bp, Homo sapiens
ggttacaacagatttgtgaac

SEQ ID NO: 2574248 - DNA, 16 bp, Homo sapiens
ggttaggatttaacag

SEQ ID NO: 2574249 - DNA, 17 bp, Homo sapiens
ggttaggcattgtggga

SEQ ID NO: 2574250 - DNA, 21 bp, Homo sapiens
ggttatattttactactgtgg

SEQ ID NO: 2574251 - DNA, 18 bp, Homo sapiens
ggttatcaaaaatttcat

SEQ ID NO: 2574252 - DNA, 24 bp, Homo sapiens
ggttatttctcaacaaagcacagt

SEQ ID NO: 2574253 - DNA, 13 bp, Homo sapiens
ggttcaaagatat

SEQ ID NO: 2574254 - DNA, 15 bp, Homo sapiens
ggttcaccagcctct

SEQ ID NO: 2574255 - DNA, 15 bp, Homo sapiens
ggttcatctgagcaa

SEQ ID NO: 2574256 - DNA, 17 bp, Homo sapiens
ggttcattattggaatt

SEQ ID NO: 2574257 - DNA, 19 bp, Homo sapiens
ggttcattattggaattaa

SEQ ID NO: 2574258 - DNA, 13 bp, Homo sapiens
ggttccatgcctg

SEQ ID NO: 2574259 - DNA, 16 bp, Homo sapiens
ggttccatgcctgagg

SEQ ID NO: 2574260 - DNA, 18 bp, Homo sapiens
ggttccatgcctgagggt

SEQ ID NO: 2574261 - DNA, 16 bp, Homo sapiens
ggttcccccagccctg

SEQ ID NO: 2574262 - DNA, 17 bp, Homo sapiens
ggttcccgtttctccac

SEQ ID NO: 2574263 - DNA, 17 bp, Homo sapiens
ggttccctttccttcca

SEQ ID NO: 2574264 - DNA, 22 bp, Homo sapiens
ggttccctttccttccatccct

SEQ ID NO: 2574265 - DNA, 21 bp, Homo sapiens
ggttccctttgacgccatccc

SEQ ID NO: 2574266 - DNA, 21 bp, Homo sapiens
ggttccgcttggagcagaggg

SEQ ID NO: 2574267 - DNA, 22 bp, Homo sapiens
ggttccgcttggagcagagggg

SEQ ID NO: 2574268 - DNA, 23 bp, Homo sapiens
ggttccgcttggagcagaggggc

SEQ ID NO: 2574269 - DNA, 22 bp, Homo sapiens
ggttcctatggctggccactgc

SEQ ID NO: 2574270 - DNA, 21 bp, Homo sapiens
ggttctgatgatgtgcctggg

SEQ ID NO: 2574271 - DNA, 12 bp, Homo sapiens
ggttctggctgc

SEQ ID NO: 2574272 - DNA, 12 bp, Homo sapiens
ggttctggggcc

SEQ ID NO: 2574273 - DNA, 17 bp, Homo sapiens
ggttctggggccccttt

SEQ ID NO: 2574274 - DNA, 18 bp, Homo sapiens
ggttcttagttctcactg

SEQ ID NO: 2574275 - DNA, 13 bp, Homo sapiens
ggttcttcccttt

SEQ ID NO: 2574276 - DNA, 15 bp, Homo sapiens
ggttctttgttttaa

SEQ ID NO: 2574277 - DNA, 16 bp, Homo sapiens
ggttgactttcaggta

SEQ ID NO: 2574278 - DNA, 13 bp, Homo sapiens
ggttgagaaatga

SEQ ID NO: 2574279 - DNA, 11 bp, Homo sapiens
ggttgaggaaa

SEQ ID NO: 2574280 - DNA, 14 bp, Homo sapiens
ggttgatcacactc

SEQ ID NO: 2574281 - DNA, 14 bp, Homo sapiens
ggttgcaaccactg

SEQ ID NO: 2574282 - DNA, 13 bp, Homo sapiens
ggttgcagggagc

SEQ ID NO: 2574283 - DNA, 18 bp, Homo sapiens
ggttgctggttgctgtgt

SEQ ID NO: 2574284 - DNA, 22 bp, Homo sapiens
ggttgctgttgatgaggcctct

SEQ ID NO: 2574285 - DNA, 22 bp, Homo sapiens
ggttggaagtgagggtcagaga

SEQ ID NO: 2574286 - DNA, 15 bp, Homo sapiens
ggttggagagctaga

SEQ ID NO: 2574287 - DNA, 18 bp, Homo sapiens
ggttggcaaaaaggcagg

SEQ ID NO: 2574288 - DNA, 11 bp, Homo sapiens
ggttggctggc

SEQ ID NO: 2574289 - DNA, 19 bp, Homo sapiens
ggttgtattctttgatgtt

SEQ ID NO: 2574290 - DNA, 21 bp, Homo sapiens
ggttgtctgtttttgtaactt

SEQ ID NO: 2574291 - DNA, 13 bp, Homo sapiens
ggttgtgaggcct

SEQ ID NO: 2574292 - DNA, 16 bp, Homo sapiens
ggttgtgaggcctggc

SEQ ID NO: 2574293 - DNA, 22 bp, Homo sapiens
ggttgtgaggcctggccaggca

SEQ ID NO: 2574294 - DNA, 23 bp, Homo sapiens
gtcctgatggtcagctcccttct

SEQ ID NO: 2574295 - DNA, 13 bp, Homo sapiens
gtcctgcctggcc

SEQ ID NO: 2574296 - DNA, 13 bp, Homo sapiens
gtcctgctgcagt

SEQ ID NO: 2574297 - DNA, 16 bp, Homo sapiens
gtcctgctgcagttgc

SEQ ID NO: 2574298 - DNA, 17 bp, Homo sapiens
gtcctgctgcagttgcc

SEQ ID NO: 2574299 - DNA, 11 bp, Homo sapiens
gtcctggctcc

SEQ ID NO: 2574300 - DNA, 14 bp, Homo sapiens
gtcctggctcctga

SEQ ID NO: 2574301 - DNA, 21 bp, Homo sapiens
gtcctgggagaacctcaggct

SEQ ID NO: 2574302 - DNA, 14 bp, Homo sapiens
gtcctgggcgccct

SEQ ID NO: 2574303 - DNA, 17 bp, Homo sapiens
gtcctgggcgccctgga

SEQ ID NO: 2574304 - DNA, 20 bp, Homo sapiens
gtcctgggcgccctggaagc

SEQ ID NO: 2574305 - DNA, 22 bp, Homo sapiens
gtcctggggcctcggagcctca

SEQ ID NO: 2574306 - DNA, 16 bp, Homo sapiens
gtcctggggctctgtg

SEQ ID NO: 2574307 - DNA, 17 bp, Homo sapiens
gtcctggggctctgtgc

SEQ ID NO: 2574308 - DNA, 15 bp, Homo sapiens
gtcctgtggcaggca

SEQ ID NO: 2574309 - DNA, 16 bp, Homo sapiens
gtcctgtggcaggcag

SEQ ID NO: 2574310 - DNA, 21 bp, Homo sapiens
gtcctgtgttttttctgccac

SEQ ID NO: 2574311 - DNA, 20 bp, Homo sapiens
gtccttaatgatccgttcca

SEQ ID NO: 2574312 - DNA, 21 bp, Homo sapiens
gtccttaccagcagagcacct

SEQ ID NO: 2574313 - DNA, 21 bp, Homo sapiens
gtccttcacctcactgaaaac

SEQ ID NO: 2574314 - DNA, 22 bp, Homo sapiens
gtccttccaggcccccaccact

SEQ ID NO: 2574315 - DNA, 16 bp, Homo sapiens
gtccttgcacccctca

SEQ ID NO: 2574316 - DNA, 13 bp, Homo sapiens
gtcctttatgtgg

SEQ ID NO: 2574317 - DNA, 18 bp, Homo sapiens
gtcctttccaaggcttct

SEQ ID NO: 2574318 - DNA, 11 bp, Homo sapiens
gtcctttccct

SEQ ID NO: 2574319 - DNA, 17 bp, Homo sapiens
gtccttttgtaccatgg

SEQ ID NO: 2574320 - DNA, 22 bp, Homo sapiens
gtccttttgtaccatggtgtga

SEQ ID NO: 2574321 - DNA, 12 bp, Homo sapiens
gtcgagacactt

SEQ ID NO: 2574322 - DNA, 14 bp, Homo sapiens
gtcgaggacaggga

SEQ ID NO: 2574323 - DNA, 16 bp, Homo sapiens
gtcgaggacagggagg

SEQ ID NO: 2574324 - DNA, 12 bp, Homo sapiens
gtcgaggcagga

SEQ ID NO: 2574325 - DNA, 14 bp, Homo sapiens
gtcgaggggctctc

SEQ ID NO: 2574326 - DNA, 19 bp, Homo sapiens
gtcgaggggctctcagctc

SEQ ID NO: 2574327 - DNA, 12 bp, Homo sapiens
gtcgcccaggag

SEQ ID NO: 2574328 - DNA, 20 bp, Homo sapiens
gtcgcccaggctggagtgca

SEQ ID NO: 2574329 - DNA, 15 bp, Homo sapiens
gtcgccctcccaggc

SEQ ID NO: 2574330 - DNA, 17 bp, Homo sapiens
gtcgccttagcatgttt

SEQ ID NO: 2574331 - DNA, 16 bp, Homo sapiens
gtcggaggcttgggac

SEQ ID NO: 2574332 - DNA, 17 bp, Homo sapiens
gtcgtcgcacagtctct

SEQ ID NO: 2574333 - DNA, 21 bp, Homo sapiens
gtcgtgcctccttccacctcc

SEQ ID NO: 2574334 - DNA, 13 bp, Homo sapiens
gtctaaaacaata

SEQ ID NO: 2574335 - DNA, 20 bp, Homo sapiens
gtctaaaatttttaaggact

SEQ ID NO: 2574336 - DNA, 20 bp, Homo sapiens
gtctaaggatgctaaacctt

SEQ ID NO: 2574337 - DNA, 21 bp, Homo sapiens
gtctacccagagaagcccctt

SEQ ID NO: 2574338 - DNA, 15 bp, Homo sapiens
gtctacctgaggggc

SEQ ID NO: 2574339 - DNA, 20 bp, Homo sapiens
gtctacctgaggggcctctt

SEQ ID NO: 2574340 - DNA, 13 bp, Homo sapiens
gtctattcagctt

SEQ ID NO: 2574341 - DNA, 16 bp, Homo sapiens
gtctatttaagcctca

SEQ ID NO: 2574342 - DNA, 14 bp, Homo sapiens
gtctcaaaaaaaca

SEQ ID NO: 2574343 - DNA, 16 bp, Homo sapiens
gtctcaaactcctgac

SEQ ID NO: 2574344 - DNA, 22 bp, Homo sapiens
gtctcaaactcttgacctcagg

SEQ ID NO: 2574345 - DNA, 19 bp, Homo sapiens
gtctcacagtgttgcccag

SEQ ID NO: 2574346 - DNA, 23 bp, Homo sapiens
gtctcacgggcatgggcactccc

SEQ ID NO: 2574347 - DNA, 20 bp, Homo sapiens
gtctcactatgttgcccagg

SEQ ID NO: 2574348 - DNA, 23 bp, Homo sapiens
gtctcactatgttgcccaggcag

SEQ ID NO: 2574349 - DNA, 13 bp, Homo sapiens
gtctcactgttgc

SEQ ID NO: 2574350 - DNA, 22 bp, Homo sapiens
gtctcagcagcgaccacccctg

SEQ ID NO: 2574351 - DNA, 23 bp, Homo sapiens
gtctcagtccatgaagatgtaga

SEQ ID NO: 2574352 - DNA, 18 bp, Homo sapiens
gtctcagtttgtgtgtct

SEQ ID NO: 2574353 - DNA, 16 bp, Homo sapiens
gtctcatccatcatca

SEQ ID NO: 2574354 - DNA, 14 bp, Homo sapiens
gtctcatccccagg

SEQ ID NO: 2574355 - DNA, 23 bp, Homo sapiens
gtctccacacacagctgggctgt

SEQ ID NO: 2574356 - DNA, 19 bp, Homo sapiens
gtctccagtggttgctgtt

SEQ ID NO: 2574357 - DNA, 19 bp, Homo sapiens
gtctcccttctcccatgag

SEQ ID NO: 2574358 - DNA, 21 bp, Homo sapiens
gtctcctcactcccttctacc

SEQ ID NO: 2574359 - DNA, 17 bp, Homo sapiens
gtctcctcagcctcctc

SEQ ID NO: 2574360 - DNA, 22 bp, Homo sapiens
gtctccttaacactgagctgtc

SEQ ID NO: 2574361 - DNA, 15 bp, Homo sapiens
gtctcctttgcactg

SEQ ID NO: 2574362 - DNA, 18 bp, Homo sapiens
gtctcctttgcaggctca

SEQ ID NO: 2574363 - DNA, 13 bp, Homo sapiens
gtctcgctctgtc

SEQ ID NO: 2574364 - DNA, 19 bp, Homo sapiens
gtctcgtggtaggactgta

SEQ ID NO: 2574365 - DNA, 16 bp, Homo sapiens
gtctctagccactttg

SEQ ID NO: 2574366 - DNA, 15 bp, Homo sapiens
gtctctaggctgggg

SEQ ID NO: 2574367 - DNA, 14 bp, Homo sapiens
gtctctagtgctgt

SEQ ID NO: 2574368 - DNA, 15 bp, Homo sapiens
gtctctctctctcta

SEQ ID NO: 2574369 - DNA, 15 bp, Homo sapiens
gtctctgaagtgaaa

SEQ ID NO: 2574370 - DNA, 17 bp, Homo sapiens
gtctctgccggctcttt

SEQ ID NO: 2574371 - DNA, 18 bp, Homo sapiens
gtctctgcctccctcacc

SEQ ID NO: 2574372 - DNA, 16 bp, Homo sapiens
gtctctgctggcccag

SEQ ID NO: 2574373 - DNA, 17 bp, Homo sapiens
gtctctgctggcccagc

SEQ ID NO: 2574374 - DNA, 14 bp, Homo sapiens
gtctctgtgctttg

SEQ ID NO: 2574375 - DNA, 11 bp, Homo sapiens
gtctcttcaga

SEQ ID NO: 2574376 - DNA, 13 bp, Homo sapiens
gtctcttcccctc

SEQ ID NO: 2574377 - DNA, 22 bp, Homo sapiens
gtctcttctgagctatttcatc

SEQ ID NO: 2574378 - DNA, 18 bp, Homo sapiens
gtctctttaatcttcagt

SEQ ID NO: 2574379 - DNA, 14 bp, Homo sapiens
gtctgaagcagatg

SEQ ID NO: 2574380 - DNA, 14 bp, Homo sapiens
gtctgaaggctggg

SEQ ID NO: 2574381 - DNA, 17 bp, Homo sapiens
gtctgaatgttctgaca

SEQ ID NO: 2574382 - DNA, 15 bp, Homo sapiens
gtctgacccactgct

SEQ ID NO: 2574383 - DNA, 21 bp, Homo sapiens
gtctgaggaatccagacccgg

SEQ ID NO: 2574384 - DNA, 14 bp, Homo sapiens
gtctgagtcatggc

SEQ ID NO: 2574385 - DNA, 21 bp, Homo sapiens
gtctgagtcatggccgggtgg

SEQ ID NO: 2574386 - DNA, 21 bp, Homo sapiens
gtctgatcgtgacgctgaata

SEQ ID NO: 2574387 - DNA, 22 bp, Homo sapiens
gtctgatctgtgctttccagct

SEQ ID NO: 2574388 - DNA, 20 bp, Homo sapiens
gtctgattggctcacccaag

SEQ ID NO: 2574389 - DNA, 22 bp, Homo sapiens
gtctgatttcaggatactctgt

SEQ ID NO: 2574390 - DNA, 22 bp, Homo sapiens
gtctgcaactttaagcagctct

SEQ ID NO: 2574391 - DNA, 15 bp, Homo sapiens
gtctgcaagaacctg

SEQ ID NO: 2574392 - DNA, 18 bp, Homo sapiens
gtctgcaagtcagaggat

SEQ ID NO: 2574393 - DNA, 19 bp, Homo sapiens
gtctgcaagtcagaggatg

SEQ ID NO: 2574394 - DNA, 13 bp, Homo sapiens
gtctgcacccagg

SEQ ID NO: 2574395 - DNA, 22 bp, Homo sapiens
gtctgcactctaaccctaggca

SEQ ID NO: 2574396 - DNA, 17 bp, Homo sapiens
gtctgccacacaaacgt

SEQ ID NO: 2574397 - DNA, 14 bp, Homo sapiens
gtctgccagccagc

SEQ ID NO: 2574398 - DNA, 11 bp, Homo sapiens
gtctgcctctt

SEQ ID NO: 2574399 - DNA, 23 bp, Homo sapiens
gtctgctcagacagaacccctac

SEQ ID NO: 2574400 - DNA, 13 bp, Homo sapiens
gtctgctgccctc

SEQ ID NO: 2574401 - DNA, 15 bp, Homo sapiens
gtctgctgccctcca

SEQ ID NO: 2574402 - DNA, 18 bp, Homo sapiens
gtctggaatgcagtggta

SEQ ID NO: 2574403 - DNA, 22 bp, Homo sapiens
gtctggagaagctcccaggaac

SEQ ID NO: 2574404 - DNA, 21 bp, Homo sapiens
gtctgggacttccttgctctc

SEQ ID NO: 2574405 - DNA, 18 bp, Homo sapiens
gtctggtctcctcagcct

SEQ ID NO: 2574406 - DNA, 17 bp, Homo sapiens
gtctggtttcaccgagg

SEQ ID NO: 2574407 - DNA, 22 bp, Homo sapiens
gtctggtttcaccgaggacatg

SEQ ID NO: 2574408 - DNA, 14 bp, Homo sapiens
gtctggtttctaga

SEQ ID NO: 2574409 - DNA, 21 bp, Homo sapiens
gtctggttttaacaatttcct

SEQ ID NO: 2574410 - DNA, 14 bp, Homo sapiens
gtctgtagagggcc

SEQ ID NO: 2574411 - DNA, 17 bp, Homo sapiens
gtctgtagagggccctg

SEQ ID NO: 2574412 - DNA, 16 bp, Homo sapiens
gtctgtcccggggtcc

SEQ ID NO: 2574413 - DNA, 24 bp, Homo sapiens
gtctgtcccggggtcctgtggcag

SEQ ID NO: 2574414 - DNA, 21 bp, Homo sapiens
gtctgtggctttcagcctctg

SEQ ID NO: 2574415 - DNA, 17 bp, Homo sapiens
gtctgtgtgcaagtgtg

SEQ ID NO: 2574416 - DNA, 16 bp, Homo sapiens
gtctgtgtgtgtgtat

SEQ ID NO: 2574417 - DNA, 20 bp, Homo sapiens
gtctgtgtgtgtgtatgtgg

SEQ ID NO: 2574418 - DNA, 11 bp, Homo sapiens
gtctgtgtgtt

SEQ ID NO: 2574419 - DNA, 21 bp, Homo sapiens
gtctgtgtgtttatgtgtgtg

SEQ ID NO: 2574420 - DNA, 20 bp, Homo sapiens
gtctgtgttccaaccactga

SEQ ID NO: 2574421 - DNA, 16 bp, Homo sapiens
gtctgttatgctgtga

SEQ ID NO: 2574422 - DNA, 12 bp, Homo sapiens
gtctgttttcct

SEQ ID NO: 2574423 - DNA, 14 bp, Homo sapiens
gtctgttttccttt

SEQ ID NO: 2574424 - DNA, 16 bp, Homo sapiens
gtctgttttcctttct

SEQ ID NO: 2574425 - DNA, 20 bp, Homo sapiens
gtctgttttcctttctcacc

SEQ ID NO: 2574426 - DNA, 21 bp, Homo sapiens
gtctgttttcctttctcaccg

SEQ ID NO: 2574427 - DNA, 12 bp, Homo sapiens
gtcttaaaataa

SEQ ID NO: 2574428 - DNA, 23 bp, Homo sapiens
gtcttaagccttttgctcacaaa

SEQ ID NO: 2574429 - DNA, 19 bp, Homo sapiens
gtcttaattaaaagaatat

SEQ ID NO: 2574430 - DNA, 18 bp, Homo sapiens
gtcttaattattatttgt

SEQ ID NO: 2574431 - DNA, 14 bp, Homo sapiens
gtcttatttattat

SEQ ID NO: 2574432 - DNA, 13 bp, Homo sapiens
gtcttcagcctag

SEQ ID NO: 2574433 - DNA, 21 bp, Homo sapiens
gtcttcattaagccctcttcc

SEQ ID NO: 2574434 - DNA, 22 bp, Homo sapiens
gtcttcattaagccctcttcca

SEQ ID NO: 2574435 - DNA, 16 bp, Homo sapiens
gtcttcatttcattgt

SEQ ID NO: 2574436 - DNA, 15 bp, Homo sapiens
gtcttccatttgcaa

SEQ ID NO: 2574437 - DNA, 13 bp, Homo sapiens
gtcttcctcccaa

SEQ ID NO: 2574438 - DNA, 18 bp, Homo sapiens
gtcttcctgaaatgcagt

SEQ ID NO: 2574439 - DNA, 23 bp, Homo sapiens
gtgtaatcatttcttgggccctc

SEQ ID NO: 2574440 - DNA, 15 bp, Homo sapiens
gtgtaatttctttgc

SEQ ID NO: 2574441 - DNA, 16 bp, Homo sapiens
gtgtacagtcttgtat

SEQ ID NO: 2574442 - DNA, 14 bp, Homo sapiens
gtgtacataactga

SEQ ID NO: 2574443 - DNA, 23 bp, Homo sapiens
gtgtagaagcattccttctttga

SEQ ID NO: 2574444 - DNA, 15 bp, Homo sapiens
gtgtagagttaagaa

SEQ ID NO: 2574445 - DNA, 14 bp, Homo sapiens
gtgtagccaaggtc

SEQ ID NO: 2574446 - DNA, 16 bp, Homo sapiens
gtgtagccttgcccgg

SEQ ID NO: 2574447 - DNA, 17 bp, Homo sapiens
gtgtagccttgcccgga

SEQ ID NO: 2574448 - DNA, 15 bp, Homo sapiens
gtgtagttgaactga

SEQ ID NO: 2574449 - DNA, 18 bp, Homo sapiens
gtgtatagaagtagatta

SEQ ID NO: 2574450 - DNA, 16 bp, Homo sapiens
gtgtatccattatcat

SEQ ID NO: 2574451 - DNA, 22 bp, Homo sapiens
gtgtatcccccccctgtatagt

SEQ ID NO: 2574452 - DNA, 13 bp, Homo sapiens
gtgtatcctgggg

SEQ ID NO: 2574453 - DNA, 20 bp, Homo sapiens
gtgtatcctggggctccctt

SEQ ID NO: 2574454 - DNA, 18 bp, Homo sapiens
gtgtatcgtaaccagcca

SEQ ID NO: 2574455 - DNA, 18 bp, Homo sapiens
gtgtatgtttgcacactt

SEQ ID NO: 2574456 - DNA, 12 bp, Homo sapiens
gtgtattgttcc

SEQ ID NO: 2574457 - DNA, 17 bp, Homo sapiens
gtgtatttaacagggag

SEQ ID NO: 2574458 - DNA, 18 bp, Homo sapiens
gtgtatttaacagggagg

SEQ ID NO: 2574459 - DNA, 21 bp, Homo sapiens
gtgtatttattttcctcccca

SEQ ID NO: 2574460 - DNA, 17 bp, Homo sapiens
gtgtatttttttactaa

SEQ ID NO: 2574461 - DNA, 23 bp, Homo sapiens
gtgtatttttttactaatagaca

SEQ ID NO: 2574462 - DNA, 15 bp, Homo sapiens
gtgtcaacttcaaca

SEQ ID NO: 2574463 - DNA, 16 bp, Homo sapiens
gtgtcaagttgtgctt

SEQ ID NO: 2574464 - DNA, 23 bp, Homo sapiens
gtgtcactactcacagtctcttt

SEQ ID NO: 2574465 - DNA, 23 bp, Homo sapiens
gtgtcatatatggggggccaaca

SEQ ID NO: 2574466 - DNA, 16 bp, Homo sapiens
gtgtcatcagaagata

SEQ ID NO: 2574467 - DNA, 19 bp, Homo sapiens
gtgtccaaaggaagacgtg

SEQ ID NO: 2574468 - DNA, 20 bp, Homo sapiens
gtgtcccaaaaagaaaggag

SEQ ID NO: 2574469 - DNA, 19 bp, Homo sapiens
gtgtcccatgacccacccc

SEQ ID NO: 2574470 - DNA, 18 bp, Homo sapiens
gtgtccccctctgtccag

SEQ ID NO: 2574471 - DNA, 18 bp, Homo sapiens
gtgtccctgcacttgcag

SEQ ID NO: 2574472 - DNA, 23 bp, Homo sapiens
gtgtccctgcacttgcagactct

SEQ ID NO: 2574473 - DNA, 14 bp, Homo sapiens
gtgtcctaggagta

SEQ ID NO: 2574474 - DNA, 16 bp, Homo sapiens
gtgtcctgaccaccct

SEQ ID NO: 2574475 - DNA, 18 bp, Homo sapiens
gtgtcctgaccaccctcc

SEQ ID NO: 2574476 - DNA, 17 bp, Homo sapiens
gtgtctaaaaacaccaa

SEQ ID NO: 2574477 - DNA, 14 bp, Homo sapiens
gtgtctacagagaa

SEQ ID NO: 2574478 - DNA, 21 bp, Homo sapiens
gtgtctcggagggattcccct

SEQ ID NO: 2574479 - DNA, 21 bp, Homo sapiens
gtgtctcttggtcctgctgca

SEQ ID NO: 2574480 - DNA, 22 bp, Homo sapiens
gtgtctcttggtcctgctgcag

SEQ ID NO: 2574481 - DNA, 22 bp, Homo sapiens
gtgtctcttttctctttctcct

SEQ ID NO: 2574482 - DNA, 16 bp, Homo sapiens
gtgtctgtacacgtgt

SEQ ID NO: 2574483 - DNA, 14 bp, Homo sapiens
gtgtctgtatttat

SEQ ID NO: 2574484 - DNA, 22 bp, Homo sapiens
gtgtcttaattaaaagaatatt

SEQ ID NO: 2574485 - DNA, 14 bp, Homo sapiens
gtgtcttaattatt

SEQ ID NO: 2574486 - DNA, 15 bp, Homo sapiens
gtgtcttaattatta

SEQ ID NO: 2574487 - DNA, 15 bp, Homo sapiens
gtgtcttcctcccaa

SEQ ID NO: 2574488 - DNA, 17 bp, Homo sapiens
gtgtcttgcaatggcag

SEQ ID NO: 2574489 - DNA, 18 bp, Homo sapiens
gtgtcttgcaatggcagc

SEQ ID NO: 2574490 - DNA, 21 bp, Homo sapiens
gtgtcttgcaatggcagcctt

SEQ ID NO: 2574491 - DNA, 13 bp, Homo sapiens
gtgtgaaaatggg

SEQ ID NO: 2574492 - DNA, 18 bp, Homo sapiens
gtgtgaaagtcagatgcc

SEQ ID NO: 2574493 - DNA, 18 bp, Homo sapiens
gtgtgaaggtcctgctat

SEQ ID NO: 2574494 - DNA, 22 bp, Homo sapiens
gtgtgacaaggattgctactgt

SEQ ID NO: 2574495 - DNA, 13 bp, Homo sapiens
gtgtgagcagtga

SEQ ID NO: 2574496 - DNA, 15 bp, Homo sapiens
gtgtgaggccagggc

SEQ ID NO: 2574497 - DNA, 17 bp, Homo sapiens
gtgtgaggccagggcag

SEQ ID NO: 2574498 - DNA, 17 bp, Homo sapiens
gtgtgagtaagagctgg

SEQ ID NO: 2574499 - DNA, 20 bp, Homo sapiens
gtgtgagtcaccaagcccag

SEQ ID NO: 2574500 - DNA, 14 bp, Homo sapiens
gtgtgatcgtctga

SEQ ID NO: 2574501 - DNA, 16 bp, Homo sapiens
gtgtgcaagtatgtga

SEQ ID NO: 2574502 - DNA, 18 bp, Homo sapiens
gtgtgcatattgtacact

SEQ ID NO: 2574503 - DNA, 21 bp, Homo sapiens
gtgtgcatattgtacactttt

SEQ ID NO: 2574504 - DNA, 12 bp, Homo sapiens
gtgtgcatgtgt

SEQ ID NO: 2574505 - DNA, 16 bp, Homo sapiens
gtgtgcattgctgtga

SEQ ID NO: 2574506 - DNA, 21 bp, Homo sapiens
gtgtgccatagagtttaacac

SEQ ID NO: 2574507 - DNA, 13 bp, Homo sapiens
gtgtgcctgcagc

SEQ ID NO: 2574508 - DNA, 18 bp, Homo sapiens
gtgtgcctgcagccccgc

SEQ ID NO: 2574509 - DNA, 16 bp, Homo sapiens
gtgtgcgtgtttgcac

SEQ ID NO: 2574510 - DNA, 13 bp, Homo sapiens
gtgtgctcttctt

SEQ ID NO: 2574511 - DNA, 17 bp, Homo sapiens
gtgtgctcttcttcttt

SEQ ID NO: 2574512 - DNA, 14 bp, Homo sapiens
gtgtgctggaggac

SEQ ID NO: 2574513 - DNA, 16 bp, Homo sapiens
gtgtggactgtgatgc

SEQ ID NO: 2574514 - DNA, 15 bp, Homo sapiens
gtgtggccccttcac

SEQ ID NO: 2574515 - DNA, 14 bp, Homo sapiens
gtgtggctccttcc

SEQ ID NO: 2574516 - DNA, 14 bp, Homo sapiens
gtgtgggctgtgtc

SEQ ID NO: 2574517 - DNA, 15 bp, Homo sapiens
gtgtggtgtttcctg

SEQ ID NO: 2574518 - DNA, 14 bp, Homo sapiens
gtgtgtaatttaaa

SEQ ID NO: 2574519 - DNA, 17 bp, Homo sapiens
gtgtgtagacaaatatt

SEQ ID NO: 2574520 - DNA, 15 bp, Homo sapiens
gtgtgtattgttccc

SEQ ID NO: 2574521 - DNA, 19 bp, Homo sapiens
gtgtgtccacgactgtctc

SEQ ID NO: 2574522 - DNA, 18 bp, Homo sapiens
gtgtgtccccctctgtcc

SEQ ID NO: 2574523 - DNA, 21 bp, Homo sapiens
gtgtgtcttaattattatttg

SEQ ID NO: 2574524 - DNA, 21 bp, Homo sapiens
gtgtgtgcgcctacaggagtg

SEQ ID NO: 2574525 - DNA, 16 bp, Homo sapiens
gtgtgtgggagtgtgt

SEQ ID NO: 2574526 - DNA, 14 bp, Homo sapiens
gtgtgtgtatgtgg

SEQ ID NO: 2574527 - DNA, 14 bp, Homo sapiens
gtgtgtgtgtcctt

SEQ ID NO: 2574528 - DNA, 13 bp, Homo sapiens
gtgtgtgtgtgtg

SEQ ID NO: 2574529 - DNA, 15 bp, Homo sapiens
gtgtgtgtgtgtgtg

SEQ ID NO: 2574530 - DNA, 18 bp, Homo sapiens
gtgtgttctgattagaaa

SEQ ID NO: 2574531 - DNA, 13 bp, Homo sapiens
gtgtgttgtcttg

SEQ ID NO: 2574532 - DNA, 18 bp, Homo sapiens
gtgtgttgtcttgaaaga

SEQ ID NO: 2574533 - DNA, 14 bp, Homo sapiens
gtgtgttgtgtgtg

SEQ ID NO: 2574534 - DNA, 17 bp, Homo sapiens
gtgtgttgtgtgtggga

SEQ ID NO: 2574535 - DNA, 16 bp, Homo sapiens
gtgtgtttatgtgtgt

SEQ ID NO: 2574536 - DNA, 15 bp, Homo sapiens
gtgtgtttctgatct

SEQ ID NO: 2574537 - DNA, 14 bp, Homo sapiens
gtgtgtttgtgtga

SEQ ID NO: 2574538 - DNA, 20 bp, Homo sapiens
gtgtgttttgagagtatatt

SEQ ID NO: 2574539 - DNA, 19 bp, Homo sapiens
gtgttaatactagttgtga

SEQ ID NO: 2574540 - DNA, 16 bp, Homo sapiens
gtgttagggaagggcc

SEQ ID NO: 2574541 - DNA, 22 bp, Homo sapiens
gtgttagggaagggcctgccac

SEQ ID NO: 2574542 - DNA, 16 bp, Homo sapiens
gtgttatttaaagaag

SEQ ID NO: 2574543 - DNA, 17 bp, Homo sapiens
gtgttatttaaatgagt

SEQ ID NO: 2574544 - DNA, 12 bp, Homo sapiens
gtgttcatacat

SEQ ID NO: 2574545 - DNA, 22 bp, Homo sapiens
gtgttccccttccactgagggc

SEQ ID NO: 2574546 - DNA, 21 bp, Homo sapiens
gtgttgccttgaaccacttcc

SEQ ID NO: 2574547 - DNA, 18 bp, Homo sapiens
gtgttgcgtgtcgtgggt

SEQ ID NO: 2574548 - DNA, 18 bp, Homo sapiens
gtgttggcccaagctctt

SEQ ID NO: 2574549 - DNA, 14 bp, Homo sapiens
gtgttgtatgcctt

SEQ ID NO: 2574550 - DNA, 15 bp, Homo sapiens
gtgttgtgtgtggga

SEQ ID NO: 2574551 - DNA, 16 bp, Homo sapiens
gtgtttaaataaagta

SEQ ID NO: 2574552 - DNA, 15 bp, Homo sapiens
gtgtttagttgcaga

SEQ ID NO: 2574553 - DNA, 10 bp, Homo sapiens
gtgtttattt

SEQ ID NO: 2574554 - DNA, 15 bp, Homo sapiens
gtgtttctagggaaa

SEQ ID NO: 2574555 - DNA, 17 bp, Homo sapiens
gtgtttctattgacttc

SEQ ID NO: 2574556 - DNA, 13 bp, Homo sapiens
gtgtttctccctc

SEQ ID NO: 2574557 - DNA, 16 bp, Homo sapiens
gtgtttctttagtttt

SEQ ID NO: 2574558 - DNA, 22 bp, Homo sapiens
gtgtttgcacgttatggtgttt

SEQ ID NO: 2574559 - DNA, 14 bp, Homo sapiens
gtgttttcataata

SEQ ID NO: 2574560 - DNA, 19 bp, Homo sapiens
gtgttttctgaataacatt

SEQ ID NO: 2574561 - DNA, 19 bp, Homo sapiens
gtgtttttctgcttttgaa

SEQ ID NO: 2574562 - DNA, 14 bp, Homo sapiens
gttaaaagaggttt

SEQ ID NO: 2574563 - DNA, 14 bp, Homo sapiens
gttaaacattgaag

SEQ ID NO: 2574564 - DNA, 15 bp, Homo sapiens
gttaaagctgccggc

SEQ ID NO: 2574565 - DNA, 21 bp, Homo sapiens
gttaaatagagtatatgcact

SEQ ID NO: 2574566 - DNA, 12 bp, Homo sapiens
gttaaatattta

SEQ ID NO: 2574567 - DNA, 15 bp, Homo sapiens
gttaaatatttacat

SEQ ID NO: 2574568 - DNA, 16 bp, Homo sapiens
gttaaatatttacata

SEQ ID NO: 2574569 - DNA, 18 bp, Homo sapiens
gttaaatgaaattgtaaa

SEQ ID NO: 2574570 - DNA, 14 bp, Homo sapiens
gttaaatttgtaag

SEQ ID NO: 2574571 - DNA, 15 bp, Homo sapiens
gttaaatttgtaagt

SEQ ID NO: 2574572 - DNA, 16 bp, Homo sapiens
gttaaatttgtaagtt

SEQ ID NO: 2574573 - DNA, 17 bp, Homo sapiens
gttaaatttgtaagttt

SEQ ID NO: 2574574 - DNA, 14 bp, Homo sapiens
gttaacaatgatat

SEQ ID NO: 2574575 - DNA, 19 bp, Homo sapiens
gttaacacattttgtataa

SEQ ID NO: 2574576 - DNA, 23 bp, Homo sapiens
gttaacacattttgtataattgt

SEQ ID NO: 2574577 - DNA, 21 bp, Homo sapiens
gttaactattttattttctaa

SEQ ID NO: 2574578 - DNA, 13 bp, Homo sapiens
gttaagaagctgt

SEQ ID NO: 2574579 - DNA, 15 bp, Homo sapiens
gttaagaagctgttg

SEQ ID NO: 2574580 - DNA, 18 bp, Homo sapiens
gttaagcattaccactca

SEQ ID NO: 2574581 - DNA, 19 bp, Homo sapiens
gttaaggaaactcttatct

SEQ ID NO: 2574582 - DNA, 13 bp, Homo sapiens
gttaagggaagga

SEQ ID NO: 2574583 - DNA, 22 bp, Homo sapiens
gttaagttgatggtgatgaaat

SEQ ID NO: 2574584 - DNA, 12 bp, Homo sapiens
gttaataaaagt

SEQ ID NO: 2574585 - DNA, 13 bp, Homo sapiens
taaaacctttcaa

SEQ ID NO: 2574586 - DNA, 16 bp, Homo sapiens
taaaacctttcaaatt

SEQ ID NO: 2574587 - DNA, 21 bp, Homo sapiens
taaaacctttcaaatttcaca

SEQ ID NO: 2574588 - DNA, 17 bp, Homo sapiens
taaaactgaagtctgaa

SEQ ID NO: 2574589 - DNA, 19 bp, Homo sapiens
taaaactgaagtctgaaat

SEQ ID NO: 2574590 - DNA, 20 bp, Homo sapiens
taaaactgaagtctgaaatt

SEQ ID NO: 2574591 - DNA, 16 bp, Homo sapiens
taaaactttgctgcca

SEQ ID NO: 2574592 - DNA, 12 bp, Homo sapiens
taaaacttttta

SEQ ID NO: 2574593 - DNA, 15 bp, Homo sapiens
taaaactttttaaaa

SEQ ID NO: 2574594 - DNA, 17 bp, Homo sapiens
taaaagaaaataaaaaa

SEQ ID NO: 2574595 - DNA, 21 bp, Homo sapiens
taaaagaaagcctcagagaat

SEQ ID NO: 2574596 - DNA, 17 bp, Homo sapiens
taaaagaacagtaaaca

SEQ ID NO: 2574597 - DNA, 16 bp, Homo sapiens
taaaagaatattttaa

SEQ ID NO: 2574598 - DNA, 11 bp, Homo sapiens
taaaagacaaa

SEQ ID NO: 2574599 - DNA, 20 bp, Homo sapiens
taaaagacaaatcaaagcag

SEQ ID NO: 2574600 - DNA, 22 bp, Homo sapiens
taaaagacaaatcaaagcagat

SEQ ID NO: 2574601 - DNA, 23 bp, Homo sapiens
taaaagacactgtttacaagaaa

SEQ ID NO: 2574602 - DNA, 13 bp, Homo sapiens
taaaagacttttt

SEQ ID NO: 2574603 - DNA, 16 bp, Homo sapiens
taaaagagatttcaag

SEQ ID NO: 2574604 - DNA, 19 bp, Homo sapiens
taaaagaggtttttcttaa

SEQ ID NO: 2574605 - DNA, 14 bp, Homo sapiens
taaaagatacagtt

SEQ ID NO: 2574606 - DNA, 13 bp, Homo sapiens
taaaagatcgcag

SEQ ID NO: 2574607 - DNA, 14 bp, Homo sapiens
taaaagatgaaaat

SEQ ID NO: 2574608 - DNA, 11 bp, Homo sapiens
taaaagcagca

SEQ ID NO: 2574609 - DNA, 21 bp, Homo sapiens
taaaagcagcatctgctaata

SEQ ID NO: 2574610 - DNA, 21 bp, Homo sapiens
taaaaggaaatctcaccccat

SEQ ID NO: 2574611 - DNA, 15 bp, Homo sapiens
taaaaggccaaacct

SEQ ID NO: 2574612 - DNA, 19 bp, Homo sapiens
taaaagggattacccaagc

SEQ ID NO: 2574613 - DNA, 20 bp, Homo sapiens
taaaagggattacccaagca

SEQ ID NO: 2574614 - DNA, 21 bp, Homo sapiens
taaaaggttcagggaaccgtt

SEQ ID NO: 2574615 - DNA, 13 bp, Homo sapiens
taaaagtaaacat

SEQ ID NO: 2574616 - DNA, 15 bp, Homo sapiens
taaaagtgatcaata

SEQ ID NO: 2574617 - DNA, 18 bp, Homo sapiens
taaaagtgtgagcagtga

SEQ ID NO: 2574618 - DNA, 12 bp, Homo sapiens
taaaagttactt

SEQ ID NO: 2574619 - DNA, 18 bp, Homo sapiens
taaaagtttcaatgtgat

SEQ ID NO: 2574620 - DNA, 21 bp, Homo sapiens
taaaataaaaattctgaatgt

SEQ ID NO: 2574621 - DNA, 20 bp, Homo sapiens
taaaataagcactgtgctaa

SEQ ID NO: 2574622 - DNA, 21 bp, Homo sapiens
taaaataccagccagtaaatg

SEQ ID NO: 2574623 - DNA, 12 bp, Homo sapiens
taaaatactatt

SEQ ID NO: 2574624 - DNA, 15 bp, Homo sapiens
taaaatactattttt

SEQ ID NO: 2574625 - DNA, 15 bp, Homo sapiens
taaaatagccactta

SEQ ID NO: 2574626 - DNA, 21 bp, Homo sapiens
taaaatagccacttaccttca

SEQ ID NO: 2574627 - DNA, 12 bp, Homo sapiens
taaaatatttat

SEQ ID NO: 2574628 - DNA, 20 bp, Homo sapiens
taaaatattttgaatcaata

SEQ ID NO: 2574629 - DNA, 22 bp, Homo sapiens
taaaatcatttctgcatcagct

SEQ ID NO: 2574630 - DNA, 15 bp, Homo sapiens
taaaatcctcaatcc

SEQ ID NO: 2574631 - DNA, 13 bp, Homo sapiens
taaaatctgtcac

SEQ ID NO: 2574632 - DNA, 14 bp, Homo sapiens
taaaatgaaattac

SEQ ID NO: 2574633 - DNA, 17 bp, Homo sapiens
taaaatgaggacatgtt

SEQ ID NO: 2574634 - DNA, 22 bp, Homo sapiens
taaaatgattgtaaaatagctt

SEQ ID NO: 2574635 - DNA, 14 bp, Homo sapiens
taaaatgattttat

SEQ ID NO: 2574636 - DNA, 15 bp, Homo sapiens
taaaatgattttatc

SEQ ID NO: 2574637 - DNA, 18 bp, Homo sapiens
taaaatgtgatttttctg

SEQ ID NO: 2574638 - DNA, 16 bp, Homo sapiens
taaaattaaagctgaa

SEQ ID NO: 2574639 - DNA, 15 bp, Homo sapiens
taaaattgtgatgtg

SEQ ID NO: 2574640 - DNA, 16 bp, Homo sapiens
taaaattgtgatgtgt

SEQ ID NO: 2574641 - DNA, 19 bp, Homo sapiens
taaacaaatgtatgattac

SEQ ID NO: 2574642 - DNA, 21 bp, Homo sapiens
taaacaaattcatattctgtc

SEQ ID NO: 2574643 - DNA, 22 bp, Homo sapiens
taaacaaattcatattctgtct

SEQ ID NO: 2574644 - DNA, 18 bp, Homo sapiens
taaacaagaccacgtttc

SEQ ID NO: 2574645 - DNA, 20 bp, Homo sapiens
taaacaagaccacgtttcta

SEQ ID NO: 2574646 - DNA, 22 bp, Homo sapiens
taaacaagaccacgtttctaaa

SEQ ID NO: 2574647 - DNA, 18 bp, Homo sapiens
taaacaatatcagacttt

SEQ ID NO: 2574648 - DNA, 20 bp, Homo sapiens
taaacagatttttacaaatg

SEQ ID NO: 2574649 - DNA, 22 bp, Homo sapiens
taaacagcagtgttccccatct

SEQ ID NO: 2574650 - DNA, 18 bp, Homo sapiens
taaacaggagacaggaag

SEQ ID NO: 2574651 - DNA, 12 bp, Homo sapiens
taaacaggccca

SEQ ID NO: 2574652 - DNA, 14 bp, Homo sapiens
taaacaggcccagc

SEQ ID NO: 2574653 - DNA, 23 bp, Homo sapiens
taaacagtgagcctgaattttgt

SEQ ID NO: 2574654 - DNA, 12 bp, Homo sapiens
taaacatgtgtt

SEQ ID NO: 2574655 - DNA, 22 bp, Homo sapiens
taaacattaatcaatcatctgt

SEQ ID NO: 2574656 - DNA, 18 bp, Homo sapiens
taaacattgaagtaatga

SEQ ID NO: 2574657 - DNA, 15 bp, Homo sapiens
taaaccttaagtaag

SEQ ID NO: 2574658 - DNA, 16 bp, Homo sapiens
taaaccttagtactga

SEQ ID NO: 2574659 - DNA, 13 bp, Homo sapiens
taaacggattatt

SEQ ID NO: 2574660 - DNA, 16 bp, Homo sapiens
taaacggattattttt

SEQ ID NO: 2574661 - DNA, 17 bp, Homo sapiens
taaacggattatttttt

SEQ ID NO: 2574662 - DNA, 18 bp, Homo sapiens
taaacggattattttttc

SEQ ID NO: 2574663 - DNA, 20 bp, Homo sapiens
taaacggattattttttcag

SEQ ID NO: 2574664 - DNA, 17 bp, Homo sapiens
taaacgtgcagactatg

SEQ ID NO: 2574665 - DNA, 14 bp, Homo sapiens
taaactatattttc

SEQ ID NO: 2574666 - DNA, 13 bp, Homo sapiens
taaactatcagtt

SEQ ID NO: 2574667 - DNA, 21 bp, Homo sapiens
taaactatcttggtgaatttt

SEQ ID NO: 2574668 - DNA, 23 bp, Homo sapiens
taaactcaaaatatttgtacata

SEQ ID NO: 2574669 - DNA, 11 bp, Homo sapiens
taaactcaggg

SEQ ID NO: 2574670 - DNA, 15 bp, Homo sapiens
taaactcctgtcctt

SEQ ID NO: 2574671 - DNA, 15 bp, Homo sapiens
taaactctaaacatt

SEQ ID NO: 2574672 - DNA, 14 bp, Homo sapiens
taaactgactttat

SEQ ID NO: 2574673 - DNA, 16 bp, Homo sapiens
taaactgactttatcc

SEQ ID NO: 2574674 - DNA, 18 bp, Homo sapiens
taaactgtgtacataact

SEQ ID NO: 2574675 - DNA, 22 bp, Homo sapiens
taaactgtgtattccaagacat

SEQ ID NO: 2574676 - DNA, 14 bp, Homo sapiens
taaacttaatctaa

SEQ ID NO: 2574677 - DNA, 18 bp, Homo sapiens
taaacttaatctaaatgg

SEQ ID NO: 2574678 - DNA, 22 bp, Homo sapiens
taaacttagtgcggacaagttt

SEQ ID NO: 2574679 - DNA, 14 bp, Homo sapiens
taaacttctctgaa

SEQ ID NO: 2574680 - DNA, 21 bp, Homo sapiens
taaacttctctgaagggaggt

SEQ ID NO: 2574681 - DNA, 22 bp, Homo sapiens
taaactttaccttttttataca

SEQ ID NO: 2574682 - DNA, 18 bp, Homo sapiens
taaactttagagtagcat

SEQ ID NO: 2574683 - DNA, 18 bp, Homo sapiens
taaacttttttttgagaa

SEQ ID NO: 2574684 - DNA, 12 bp, Homo sapiens
taaagaaaactg

SEQ ID NO: 2574685 - DNA, 21 bp, Homo sapiens
taaagaaagagagaaaataaa

SEQ ID NO: 2574686 - DNA, 22 bp, Homo sapiens
taaagaaagagagaaaataaaa

SEQ ID NO: 2574687 - DNA, 11 bp, Homo sapiens
taaagaaagtc

SEQ ID NO: 2574688 - DNA, 13 bp, Homo sapiens
taaagaagcaata

SEQ ID NO: 2574689 - DNA, 14 bp, Homo sapiens
taaagaaggtttca

SEQ ID NO: 2574690 - DNA, 15 bp, Homo sapiens
taaagaataatatgc

SEQ ID NO: 2574691 - DNA, 9 bp, Homo sapiens
taaagacag

SEQ ID NO: 2574692 - DNA, 15 bp, Homo sapiens
taaagacagaggcag

SEQ ID NO: 2574693 - DNA, 21 bp, Homo sapiens
taaagacagggaagagcagaa

SEQ ID NO: 2574694 - DNA, 15 bp, Homo sapiens
taaagactggctttt

SEQ ID NO: 2574695 - DNA, 15 bp, Homo sapiens
taaagagacctacct

SEQ ID NO: 2574696 - DNA, 19 bp, Homo sapiens
taaagagacctacctcagg

SEQ ID NO: 2574697 - DNA, 20 bp, Homo sapiens
taaagagacctacctcaggt

SEQ ID NO: 2574698 - DNA, 21 bp, Homo sapiens
taaagatatttttatctttat

SEQ ID NO: 2574699 - DNA, 22 bp, Homo sapiens
taaagatttatcaaatcagtca

SEQ ID NO: 2574700 - DNA, 20 bp, Homo sapiens
taaagcaactgttatgaaat

SEQ ID NO: 2574701 - DNA, 15 bp, Homo sapiens
taaagcattccaaca

SEQ ID NO: 2574702 - DNA, 16 bp, Homo sapiens
taaagcctgcttttta

SEQ ID NO: 2574703 - DNA, 15 bp, Homo sapiens
taaagctagaaatga

SEQ ID NO: 2574704 - DNA, 16 bp, Homo sapiens
taaagctgcctgtagt

SEQ ID NO: 2574705 - DNA, 21 bp, Homo sapiens
taaagctgcctgtagttagga

SEQ ID NO: 2574706 - DNA, 17 bp, Homo sapiens
taaaggagaaggcatga

SEQ ID NO: 2574707 - DNA, 22 bp, Homo sapiens
taaaggagaaggcatgaaattg

SEQ ID NO: 2574708 - DNA, 20 bp, Homo sapiens
taaaggagttaagagtagca

SEQ ID NO: 2574709 - DNA, 17 bp, Homo sapiens
taaaggatgttggtgtt

SEQ ID NO: 2574710 - DNA, 15 bp, Homo sapiens
taaaggctacctttg

SEQ ID NO: 2574711 - DNA, 19 bp, Homo sapiens
taaaggctacctttgtatt

SEQ ID NO: 2574712 - DNA, 20 bp, Homo sapiens
taaaggtggtgaggcaataa

SEQ ID NO: 2574713 - DNA, 22 bp, Homo sapiens
taaaggttacaagcctgcacaa

SEQ ID NO: 2574714 - DNA, 13 bp, Homo sapiens
taaagtaaagcta

SEQ ID NO: 2574715 - DNA, 15 bp, Homo sapiens
taaagtaaagctaaa

SEQ ID NO: 2574716 - DNA, 17 bp, Homo sapiens
taaagtaaagctaaaat

SEQ ID NO: 2574717 - DNA, 21 bp, Homo sapiens
taaagtagattagatctttta

SEQ ID NO: 2574718 - DNA, 15 bp, Homo sapiens
taaagtatcatgcat

SEQ ID NO: 2574719 - DNA, 13 bp, Homo sapiens
taaagtatgtaaa

SEQ ID NO: 2574720 - DNA, 16 bp, Homo sapiens
taaagtatgtaaacag

SEQ ID NO: 2574721 - DNA, 22 bp, Homo sapiens
taaagtatgtaaacaggagaca

SEQ ID NO: 2574722 - DNA, 13 bp, Homo sapiens
taaagtattcttc

SEQ ID NO: 2574723 - DNA, 17 bp, Homo sapiens
taaagtcaggtccaatt

SEQ ID NO: 2574724 - DNA, 13 bp, Homo sapiens
taaagtcccaggt

SEQ ID NO: 2574725 - DNA, 20 bp, Homo sapiens
taaagtgagctctatgggca

SEQ ID NO: 2574726 - DNA, 15 bp, Homo sapiens
taaagtgatatttcc

SEQ ID NO: 2574727 - DNA, 21 bp, Homo sapiens
taaagtgggttattctggagt

SEQ ID NO: 2574728 - DNA, 22 bp, Homo sapiens
taaagtgggttattctggagtt

SEQ ID NO: 2574729 - DNA, 16 bp, Homo sapiens
taaagtgtaaatcctt

SEQ ID NO: 2574730 - DNA, 14 bp, Homo sapiens
tacatggaataaca

SEQ ID NO: 2574731 - DNA, 16 bp, Homo sapiens
tacatggcagagtttg

SEQ ID NO: 2574732 - DNA, 16 bp, Homo sapiens
tacatggttgtgacct

SEQ ID NO: 2574733 - DNA, 13 bp, Homo sapiens
tacatgtagtagt

SEQ ID NO: 2574734 - DNA, 19 bp, Homo sapiens
tacatgtgccgaatgtgca

SEQ ID NO: 2574735 - DNA, 16 bp, Homo sapiens
tacatgtggcccaaca

SEQ ID NO: 2574736 - DNA, 19 bp, Homo sapiens
tacattggctggtaacagt

SEQ ID NO: 2574737 - DNA, 17 bp, Homo sapiens
tacatttatgatttaat

SEQ ID NO: 2574738 - DNA, 18 bp, Homo sapiens
tacatttatgatttaata

SEQ ID NO: 2574739 - DNA, 23 bp, Homo sapiens
tacatttatgatttaataaaata

SEQ ID NO: 2574740 - DNA, 21 bp, Homo sapiens
tacatttccaaattcacaagt

SEQ ID NO: 2574741 - DNA, 22 bp, Homo sapiens
tacatttcttagactacattta

SEQ ID NO: 2574742 - DNA, 19 bp, Homo sapiens
tacatttttaagtgctgca

SEQ ID NO: 2574743 - DNA, 15 bp, Homo sapiens
tacatttttacaata

SEQ ID NO: 2574744 - DNA, 16 bp, Homo sapiens
tacatttttacaataa

SEQ ID NO: 2574745 - DNA, 12 bp, Homo sapiens
taccaacctgtt

SEQ ID NO: 2574746 - DNA, 13 bp, Homo sapiens
taccaactttctg

SEQ ID NO: 2574747 - DNA, 13 bp, Homo sapiens
taccaatgaaaaa

SEQ ID NO: 2574748 - DNA, 12 bp, Homo sapiens
taccacagcagc

SEQ ID NO: 2574749 - DNA, 13 bp, Homo sapiens
taccacagtgtct

SEQ ID NO: 2574750 - DNA, 14 bp, Homo sapiens
taccacagtgtctg

SEQ ID NO: 2574751 - DNA, 14 bp, Homo sapiens
taccacccccacac

SEQ ID NO: 2574752 - DNA, 18 bp, Homo sapiens
taccaccccttcctgtcc

SEQ ID NO: 2574753 - DNA, 19 bp, Homo sapiens
taccaccccttcctgtccc

SEQ ID NO: 2574754 - DNA, 10 bp, Homo sapiens
taccacctcc

SEQ ID NO: 2574755 - DNA, 14 bp, Homo sapiens
taccactcaggcca

SEQ ID NO: 2574756 - DNA, 23 bp, Homo sapiens
taccagacggttcaccagcctct

SEQ ID NO: 2574757 - DNA, 15 bp, Homo sapiens
taccagataaaatta

SEQ ID NO: 2574758 - DNA, 18 bp, Homo sapiens
taccagatgatgggggag

SEQ ID NO: 2574759 - DNA, 14 bp, Homo sapiens
taccagcagagcac

SEQ ID NO: 2574760 - DNA, 13 bp, Homo sapiens
taccagcgaggag

SEQ ID NO: 2574761 - DNA, 20 bp, Homo sapiens
taccagcgaggaggctccag

SEQ ID NO: 2574762 - DNA, 19 bp, Homo sapiens
taccagcgcccgctgggct

SEQ ID NO: 2574763 - DNA, 16 bp, Homo sapiens
taccaggaactataaa

SEQ ID NO: 2574764 - DNA, 14 bp, Homo sapiens
taccaggtgttcta

SEQ ID NO: 2574765 - DNA, 15 bp, Homo sapiens
taccaggttgaaaga

SEQ ID NO: 2574766 - DNA, 16 bp, Homo sapiens
taccaggttgaaagac

SEQ ID NO: 2574767 - DNA, 15 bp, Homo sapiens
taccagtgaaccaaa

SEQ ID NO: 2574768 - DNA, 11 bp, Homo sapiens
taccagtgtgg

SEQ ID NO: 2574769 - DNA, 20 bp, Homo sapiens
taccatgagaagagggcctg

SEQ ID NO: 2574770 - DNA, 12 bp, Homo sapiens
taccatttcaga

SEQ ID NO: 2574771 - DNA, 15 bp, Homo sapiens
taccatttcagagag

SEQ ID NO: 2574772 - DNA, 13 bp, Homo sapiens
tacccaaccactc

SEQ ID NO: 2574773 - DNA, 21 bp, Homo sapiens
tacccacttctaaatagcaat

SEQ ID NO: 2574774 - DNA, 13 bp, Homo sapiens
tacccagagcatt

SEQ ID NO: 2574775 - DNA, 16 bp, Homo sapiens
tacccagccatctgcc

SEQ ID NO: 2574776 - DNA, 16 bp, Homo sapiens
tacccagcgagccctg

SEQ ID NO: 2574777 - DNA, 15 bp, Homo sapiens
tacccatatcccctc

SEQ ID NO: 2574778 - DNA, 22 bp, Homo sapiens
taccccaccctcagcacccctt

SEQ ID NO: 2574779 - DNA, 15 bp, Homo sapiens
taccccatcattcat

SEQ ID NO: 2574780 - DNA, 19 bp, Homo sapiens
taccccttagcctccctga

SEQ ID NO: 2574781 - DNA, 18 bp, Homo sapiens
tacccctttctggctctc

SEQ ID NO: 2574782 - DNA, 20 bp, Homo sapiens
tacccgggaagggggctggg

SEQ ID NO: 2574783 - DNA, 23 bp, Homo sapiens
tacccgggaagggggctgggaca

SEQ ID NO: 2574784 - DNA, 22 bp, Homo sapiens
taccctcaggacaatgtctgaa

SEQ ID NO: 2574785 - DNA, 16 bp, Homo sapiens
taccctcatgttctta

SEQ ID NO: 2574786 - DNA, 15 bp, Homo sapiens
taccctcccaccccc

SEQ ID NO: 2574787 - DNA, 17 bp, Homo sapiens
taccctcgggcccacct

SEQ ID NO: 2574788 - DNA, 20 bp, Homo sapiens
taccctctcagctccaggtg

SEQ ID NO: 2574789 - DNA, 20 bp, Homo sapiens
taccctgcgattttgcctgt

SEQ ID NO: 2574790 - DNA, 20 bp, Homo sapiens
taccctggcactataatgta

SEQ ID NO: 2574791 - DNA, 18 bp, Homo sapiens
taccctttttctccagct

SEQ ID NO: 2574792 - DNA, 23 bp, Homo sapiens
tacctaaaaggaaatctcacccc

SEQ ID NO: 2574793 - DNA, 13 bp, Homo sapiens
tacctactttgac

SEQ ID NO: 2574794 - DNA, 14 bp, Homo sapiens
tacctactttgact

SEQ ID NO: 2574795 - DNA, 19 bp, Homo sapiens
tacctataaagtaaagcta

SEQ ID NO: 2574796 - DNA, 20 bp, Homo sapiens
tacctattttcattgtaaaa

SEQ ID NO: 2574797 - DNA, 15 bp, Homo sapiens
tacctcaccctgcta

SEQ ID NO: 2574798 - DNA, 15 bp, Homo sapiens
tacctcactggggtc

SEQ ID NO: 2574799 - DNA, 12 bp, Homo sapiens
tacctcagccta

SEQ ID NO: 2574800 - DNA, 14 bp, Homo sapiens
tacctcaggttgct

SEQ ID NO: 2574801 - DNA, 13 bp, Homo sapiens
tacctcctgagaa

SEQ ID NO: 2574802 - DNA, 14 bp, Homo sapiens
tacctcctgagaaa

SEQ ID NO: 2574803 - DNA, 15 bp, Homo sapiens
tacctctgatacctc

SEQ ID NO: 2574804 - DNA, 15 bp, Homo sapiens
tacctcttagctgag

SEQ ID NO: 2574805 - DNA, 16 bp, Homo sapiens
tacctcttagctgagt

SEQ ID NO: 2574806 - DNA, 13 bp, Homo sapiens
tacctcttggctg

SEQ ID NO: 2574807 - DNA, 19 bp, Homo sapiens
tacctctttattttttgat

SEQ ID NO: 2574808 - DNA, 13 bp, Homo sapiens
tacctgaaaacac

SEQ ID NO: 2574809 - DNA, 12 bp, Homo sapiens
tacctgagacca

SEQ ID NO: 2574810 - DNA, 13 bp, Homo sapiens
tacctgagaccag

SEQ ID NO: 2574811 - DNA, 18 bp, Homo sapiens
tacctgattttttttcct

SEQ ID NO: 2574812 - DNA, 16 bp, Homo sapiens
tacctgccactcacac

SEQ ID NO: 2574813 - DNA, 22 bp, Homo sapiens
tacctgccactcacacagccag

SEQ ID NO: 2574814 - DNA, 10 bp, Homo sapiens
tacctgtccc

SEQ ID NO: 2574815 - DNA, 13 bp, Homo sapiens
tacctgtccccct

SEQ ID NO: 2574816 - DNA, 14 bp, Homo sapiens
tacctgtccccctg

SEQ ID NO: 2574817 - DNA, 16 bp, Homo sapiens
tacctgtccccctgac

SEQ ID NO: 2574818 - DNA, 21 bp, Homo sapiens
tacctgttcagtgtcccgggc

SEQ ID NO: 2574819 - DNA, 21 bp, Homo sapiens
taccttagattagctctggac

SEQ ID NO: 2574820 - DNA, 13 bp, Homo sapiens
taccttcaataaa

SEQ ID NO: 2574821 - DNA, 16 bp, Homo sapiens
taccttcaataaagta

SEQ ID NO: 2574822 - DNA, 18 bp, Homo sapiens
taccttgtgacccagcac

SEQ ID NO: 2574823 - DNA, 23 bp, Homo sapiens
tacgcactacatgtggtttatag

SEQ ID NO: 2574824 - DNA, 22 bp, Homo sapiens
tacgccaggggaaaatcagcct

SEQ ID NO: 2574825 - DNA, 16 bp, Homo sapiens
tacgtacatgtgaggc

SEQ ID NO: 2574826 - DNA, 18 bp, Homo sapiens
tacgtcaaacatgaagtg

SEQ ID NO: 2574827 - DNA, 14 bp, Homo sapiens
tacgtctgacaggc

SEQ ID NO: 2574828 - DNA, 13 bp, Homo sapiens
tacgtctgggaga

SEQ ID NO: 2574829 - DNA, 15 bp, Homo sapiens
tacgttattgttgac

SEQ ID NO: 2574830 - DNA, 15 bp, Homo sapiens
tacgttcctattgtc

SEQ ID NO: 2574831 - DNA, 13 bp, Homo sapiens
tacgttgtgcatt

SEQ ID NO: 2574832 - DNA, 14 bp, Homo sapiens
tacgttgtgcattt

SEQ ID NO: 2574833 - DNA, 14 bp, Homo sapiens
tacgtttgtatgtg

SEQ ID NO: 2574834 - DNA, 14 bp, Homo sapiens
tactaaaaatgcaa

SEQ ID NO: 2574835 - DNA, 17 bp, Homo sapiens
tactaaccagcagaaat

SEQ ID NO: 2574836 - DNA, 14 bp, Homo sapiens
tactaaggaatctt

SEQ ID NO: 2574837 - DNA, 16 bp, Homo sapiens
tactaatgatgttttc

SEQ ID NO: 2574838 - DNA, 13 bp, Homo sapiens
tactacaaaattt

SEQ ID NO: 2574839 - DNA, 22 bp, Homo sapiens
tactacagtcctcccatctcac

SEQ ID NO: 2574840 - DNA, 17 bp, Homo sapiens
tactactcctgtaggaa

SEQ ID NO: 2574841 - DNA, 22 bp, Homo sapiens
tactactgtggaaaaatattta

SEQ ID NO: 2574842 - DNA, 22 bp, Homo sapiens
tactagaagatgaatacaaaca

SEQ ID NO: 2574843 - DNA, 21 bp, Homo sapiens
tactagttgtgaccttagtgt

SEQ ID NO: 2574844 - DNA, 13 bp, Homo sapiens
tactatgtatcaa

SEQ ID NO: 2574845 - DNA, 21 bp, Homo sapiens
tactatttaaagcctcctcat

SEQ ID NO: 2574846 - DNA, 19 bp, Homo sapiens
tactattttacttctagag

SEQ ID NO: 2574847 - DNA, 15 bp, Homo sapiens
tactatttttactgc

SEQ ID NO: 2574848 - DNA, 23 bp, Homo sapiens
tactcaaccctctcaggtgacca

SEQ ID NO: 2574849 - DNA, 22 bp, Homo sapiens
tactcaatgttactatctgctt

SEQ ID NO: 2574850 - DNA, 15 bp, Homo sapiens
tactcacagtctctt

SEQ ID NO: 2574851 - DNA, 19 bp, Homo sapiens
tactcagaagcctgaggct

SEQ ID NO: 2574852 - DNA, 22 bp, Homo sapiens
tactcagaattctctagtttga

SEQ ID NO: 2574853 - DNA, 19 bp, Homo sapiens
tactcataatgtgaagtgt

SEQ ID NO: 2574854 - DNA, 21 bp, Homo sapiens
tactcatatatatctatctta

SEQ ID NO: 2574855 - DNA, 22 bp, Homo sapiens
tactcatgtgtatgggcaaaaa

SEQ ID NO: 2574856 - DNA, 17 bp, Homo sapiens
tactcccatctgtgaaa

SEQ ID NO: 2574857 - DNA, 16 bp, Homo sapiens
tactccccttgagctg

SEQ ID NO: 2574858 - DNA, 22 bp, Homo sapiens
tactccctcaaagcacacgtca

SEQ ID NO: 2574859 - DNA, 14 bp, Homo sapiens
tactcctctgcagt

SEQ ID NO: 2574860 - DNA, 16 bp, Homo sapiens
tactcctctgcagtgc

SEQ ID NO: 2574861 - DNA, 22 bp, Homo sapiens
tactcctctgcagtgccttggg

SEQ ID NO: 2574862 - DNA, 16 bp, Homo sapiens
tactcctgcaaaattt

SEQ ID NO: 2574863 - DNA, 22 bp, Homo sapiens
tactcctgcaaaattttatagc

SEQ ID NO: 2574864 - DNA, 13 bp, Homo sapiens
tactctactgata

SEQ ID NO: 2574865 - DNA, 14 bp, Homo sapiens
tactctcctagaga

SEQ ID NO: 2574866 - DNA, 19 bp, Homo sapiens
tactctgaagggcatcatg

SEQ ID NO: 2574867 - DNA, 17 bp, Homo sapiens
tactcttcttgaaattt

SEQ ID NO: 2574868 - DNA, 22 bp, Homo sapiens
tactctttgagatagaagaact

SEQ ID NO: 2574869 - DNA, 17 bp, Homo sapiens
tactgaaggtaaaattg

SEQ ID NO: 2574870 - DNA, 17 bp, Homo sapiens
tactgactgagaatata

SEQ ID NO: 2574871 - DNA, 20 bp, Homo sapiens
tactgagaaaagcctctcca

SEQ ID NO: 2574872 - DNA, 19 bp, Homo sapiens
tactgagagtgaacaaatt

SEQ ID NO: 2574873 - DNA, 15 bp, Homo sapiens
tactgagccttgtaa

SEQ ID NO: 2574874 - DNA, 18 bp, Homo sapiens
tactgagccttgtaattc

SEQ ID NO: 2574875 - DNA, 15 bp, Homo sapiens
tactgaggtgctatg

SEQ ID NO: 2574876 - DNA, 13 bp, Homo sapiens
tataaataggaga

SEQ ID NO: 2574877 - DNA, 17 bp, Homo sapiens
tataaataggagaggat

SEQ ID NO: 2574878 - DNA, 19 bp, Homo sapiens
tataaataggagaggatga

SEQ ID NO: 2574879 - DNA, 15 bp, Homo sapiens
tataaatcaatgtca

SEQ ID NO: 2574880 - DNA, 20 bp, Homo sapiens
tataaatcgcttttgataat

SEQ ID NO: 2574881 - DNA, 17 bp, Homo sapiens
tataaattttttttgtt

SEQ ID NO: 2574882 - DNA, 15 bp, Homo sapiens
tataacaggttattt

SEQ ID NO: 2574883 - DNA, 20 bp, Homo sapiens
tataaccacaaagcacagtt

SEQ ID NO: 2574884 - DNA, 20 bp, Homo sapiens
tataaccagtgttgtggatt

SEQ ID NO: 2574885 - DNA, 22 bp, Homo sapiens
tataaccagtgttgtggattta

SEQ ID NO: 2574886 - DNA, 16 bp, Homo sapiens
tataactcatcataaa

SEQ ID NO: 2574887 - DNA, 17 bp, Homo sapiens
tataactcatcataaaa

SEQ ID NO: 2574888 - DNA, 22 bp, Homo sapiens
tataacttaaaaaaatgacaga

SEQ ID NO: 2574889 - DNA, 22 bp, Homo sapiens
tataacttatattgtaagaaat

SEQ ID NO: 2574890 - DNA, 20 bp, Homo sapiens
tataagaagctttcagtatt

SEQ ID NO: 2574891 - DNA, 13 bp, Homo sapiens
tataagtttgaag

SEQ ID NO: 2574892 - DNA, 12 bp, Homo sapiens
tataataaaagg

SEQ ID NO: 2574893 - DNA, 14 bp, Homo sapiens
tataataaaaggaa

SEQ ID NO: 2574894 - DNA, 15 bp, Homo sapiens
tataatactgtattt

SEQ ID NO: 2574895 - DNA, 17 bp, Homo sapiens
tataatatactatattt

SEQ ID NO: 2574896 - DNA, 15 bp, Homo sapiens
tataatatatttgtg

SEQ ID NO: 2574897 - DNA, 14 bp, Homo sapiens
tataatgaagcttt

SEQ ID NO: 2574898 - DNA, 17 bp, Homo sapiens
tataatggtttcaaaga

SEQ ID NO: 2574899 - DNA, 23 bp, Homo sapiens
tataatggtttcaaagattcaaa

SEQ ID NO: 2574900 - DNA, 17 bp, Homo sapiens
tataattctactttgag

SEQ ID NO: 2574901 - DNA, 12 bp, Homo sapiens
tataattctgta

SEQ ID NO: 2574902 - DNA, 15 bp, Homo sapiens
tataattctgtaaat

SEQ ID NO: 2574903 - DNA, 13 bp, Homo sapiens
tataattctgtac

SEQ ID NO: 2574904 - DNA, 18 bp, Homo sapiens
tataattctgtactgatt

SEQ ID NO: 2574905 - DNA, 18 bp, Homo sapiens
tataattgtatcagaggc

SEQ ID NO: 2574906 - DNA, 16 bp, Homo sapiens
tataatttaatgcatg

SEQ ID NO: 2574907 - DNA, 22 bp, Homo sapiens
tataattttatgaatgtctttg

SEQ ID NO: 2574908 - DNA, 15 bp, Homo sapiens
tataattttttaaag

SEQ ID NO: 2574909 - DNA, 13 bp, Homo sapiens
tatacaacagtgc

SEQ ID NO: 2574910 - DNA, 14 bp, Homo sapiens
tatacaacagtgct

SEQ ID NO: 2574911 - DNA, 16 bp, Homo sapiens
tatacaacagtgctaa

SEQ ID NO: 2574912 - DNA, 21 bp, Homo sapiens
tatacacttacactttatgca

SEQ ID NO: 2574913 - DNA, 16 bp, Homo sapiens
tatacattctttatct

SEQ ID NO: 2574914 - DNA, 19 bp, Homo sapiens
tataccatggtgaattaat

SEQ ID NO: 2574915 - DNA, 18 bp, Homo sapiens
tatacgataaataacttt

SEQ ID NO: 2574916 - DNA, 17 bp, Homo sapiens
tatacgtgtagctatat

SEQ ID NO: 2574917 - DNA, 19 bp, Homo sapiens
tatacgtgtagctatatct

SEQ ID NO: 2574918 - DNA, 16 bp, Homo sapiens
tatactatatttatgg

SEQ ID NO: 2574919 - DNA, 16 bp, Homo sapiens
tatactgcatactttt

SEQ ID NO: 2574920 - DNA, 16 bp, Homo sapiens
tatactggagaagtct

SEQ ID NO: 2574921 - DNA, 12 bp, Homo sapiens
tatactgtaaag

SEQ ID NO: 2574922 - DNA, 13 bp, Homo sapiens
tatactgtaaaga

SEQ ID NO: 2574923 - DNA, 15 bp, Homo sapiens
tatactgtaatttag

SEQ ID NO: 2574924 - DNA, 22 bp, Homo sapiens
tatactgtaatttagttattga

SEQ ID NO: 2574925 - DNA, 14 bp, Homo sapiens
tatagaaacacgaa

SEQ ID NO: 2574926 - DNA, 11 bp, Homo sapiens
tatagaaatgc

SEQ ID NO: 2574927 - DNA, 15 bp, Homo sapiens
tatagaatatttatt

SEQ ID NO: 2574928 - DNA, 22 bp, Homo sapiens
tatagagatgtttttaaaagtt

SEQ ID NO: 2574929 - DNA, 22 bp, Homo sapiens
tatagatgcaagatatttatat

SEQ ID NO: 2574930 - DNA, 15 bp, Homo sapiens
tatagattataactt

SEQ ID NO: 2574931 - DNA, 16 bp, Homo sapiens
tatagattataacttg

SEQ ID NO: 2574932 - DNA, 13 bp, Homo sapiens
tatagcaatccat

SEQ ID NO: 2574933 - DNA, 16 bp, Homo sapiens
tatagctacaggaagc

SEQ ID NO: 2574934 - DNA, 13 bp, Homo sapiens
tatagctattttt

SEQ ID NO: 2574935 - DNA, 14 bp, Homo sapiens
tatagctgtattga

SEQ ID NO: 2574936 - DNA, 19 bp, Homo sapiens
tataggaacatatgaaaat

SEQ ID NO: 2574937 - DNA, 12 bp, Homo sapiens
tataggaattga

SEQ ID NO: 2574938 - DNA, 14 bp, Homo sapiens
tataggaattgacc

SEQ ID NO: 2574939 - DNA, 19 bp, Homo sapiens
tataggaattgacccacaa

SEQ ID NO: 2574940 - DNA, 13 bp, Homo sapiens
tatagtatatctg

SEQ ID NO: 2574941 - DNA, 18 bp, Homo sapiens
tatagtgatgtaatcttg

SEQ ID NO: 2574942 - DNA, 17 bp, Homo sapiens
tatagttaggatagcat

SEQ ID NO: 2574943 - DNA, 19 bp, Homo sapiens
tatagttaggatagcattt

SEQ ID NO: 2574944 - DNA, 15 bp, Homo sapiens
tatagtttgtacatg

SEQ ID NO: 2574945 - DNA, 17 bp, Homo sapiens
tatagttttacttttaa

SEQ ID NO: 2574946 - DNA, 22 bp, Homo sapiens
tatagttttacttttaaactgt

SEQ ID NO: 2574947 - DNA, 20 bp, Homo sapiens
tatataaaaagaaaagataa

SEQ ID NO: 2574948 - DNA, 22 bp, Homo sapiens
tatataagatggaagcttccag

SEQ ID NO: 2574949 - DNA, 19 bp, Homo sapiens
tatataatggtttcaaaga

SEQ ID NO: 2574950 - DNA, 17 bp, Homo sapiens
tatataattctgtacat

SEQ ID NO: 2574951 - DNA, 19 bp, Homo sapiens
tatatacaacctgcttggg

SEQ ID NO: 2574952 - DNA, 17 bp, Homo sapiens
tatatacaataacataa

SEQ ID NO: 2574953 - DNA, 18 bp, Homo sapiens
tatatacgcatctataaa

SEQ ID NO: 2574954 - DNA, 13 bp, Homo sapiens
tatatagagatgt

SEQ ID NO: 2574955 - DNA, 14 bp, Homo sapiens
tatatagagatgtt

SEQ ID NO: 2574956 - DNA, 16 bp, Homo sapiens
tatatagagatgtttt

SEQ ID NO: 2574957 - DNA, 21 bp, Homo sapiens
tatatagattataacttgtct

SEQ ID NO: 2574958 - DNA, 12 bp, Homo sapiens
tatataggtttt

SEQ ID NO: 2574959 - DNA, 20 bp, Homo sapiens
tatatataattctgtacata

SEQ ID NO: 2574960 - DNA, 12 bp, Homo sapiens
tatatatagaat

SEQ ID NO: 2574961 - DNA, 22 bp, Homo sapiens
tatatatcatattggtattcac

SEQ ID NO: 2574962 - DNA, 16 bp, Homo sapiens
tatatatgtgtatgta

SEQ ID NO: 2574963 - DNA, 14 bp, Homo sapiens
tatatattttaatt

SEQ ID NO: 2574964 - DNA, 13 bp, Homo sapiens
tatatcagaaaag

SEQ ID NO: 2574965 - DNA, 23 bp, Homo sapiens
tatatcagcctgagtctcctgtg

SEQ ID NO: 2574966 - DNA, 16 bp, Homo sapiens
tatatccatgtactgt

SEQ ID NO: 2574967 - DNA, 17 bp, Homo sapiens
tatatccatgtactgta

SEQ ID NO: 2574968 - DNA, 14 bp, Homo sapiens
tatatcccagaaat

SEQ ID NO: 2574969 - DNA, 13 bp, Homo sapiens
tatatctaaattg

SEQ ID NO: 2574970 - DNA, 17 bp, Homo sapiens
tatatctaaattgaata

SEQ ID NO: 2574971 - DNA, 13 bp, Homo sapiens
tatatctatatat

SEQ ID NO: 2574972 - DNA, 22 bp, Homo sapiens
tatatctatatataattctgta

SEQ ID NO: 2574973 - DNA, 16 bp, Homo sapiens
tatatctctcatgcat

SEQ ID NO: 2574974 - DNA, 15 bp, Homo sapiens
tatatctgtatataa

SEQ ID NO: 2574975 - DNA, 15 bp, Homo sapiens
tatatgatttatagt

SEQ ID NO: 2574976 - DNA, 16 bp, Homo sapiens
tatatgatttatagtt

SEQ ID NO: 2574977 - DNA, 19 bp, Homo sapiens
tatatggatgattcagaaa

SEQ ID NO: 2574978 - DNA, 16 bp, Homo sapiens
tatatggcaagaaagc

SEQ ID NO: 2574979 - DNA, 19 bp, Homo sapiens
tatatgtacttgtcaaaga

SEQ ID NO: 2574980 - DNA, 12 bp, Homo sapiens
tatatgtatgtg

SEQ ID NO: 2574981 - DNA, 19 bp, Homo sapiens
tatatgtgtgtgtatgttt

SEQ ID NO: 2574982 - DNA, 15 bp, Homo sapiens
tatatgtgtgtttaa

SEQ ID NO: 2574983 - DNA, 16 bp, Homo sapiens
tatatgtgtgtttaaa

SEQ ID NO: 2574984 - DNA, 23 bp, Homo sapiens
tatatgtgtgtttaaataaagta

SEQ ID NO: 2574985 - DNA, 18 bp, Homo sapiens
tatatgtgtttttcacat

SEQ ID NO: 2574986 - DNA, 23 bp, Homo sapiens
tatattagcatttagtccaatgt

SEQ ID NO: 2574987 - DNA, 14 bp, Homo sapiens
tatattcatatatt

SEQ ID NO: 2574988 - DNA, 18 bp, Homo sapiens
tatattggtaacatcctt

SEQ ID NO: 2574989 - DNA, 20 bp, Homo sapiens
tatattgtaagaaatactgt

SEQ ID NO: 2574990 - DNA, 19 bp, Homo sapiens
tatattgtcagatattttt

SEQ ID NO: 2574991 - DNA, 21 bp, Homo sapiens
tatatttagattgttaaaata

SEQ ID NO: 2574992 - DNA, 16 bp, Homo sapiens
tatatttagttatagt

SEQ ID NO: 2574993 - DNA, 12 bp, Homo sapiens
tatatttataac

SEQ ID NO: 2574994 - DNA, 16 bp, Homo sapiens
tatatttataactcat

SEQ ID NO: 2574995 - DNA, 23 bp, Homo sapiens
tatatttataactcatcataaaa

SEQ ID NO: 2574996 - DNA, 16 bp, Homo sapiens
tatatttcactatttt

SEQ ID NO: 2574997 - DNA, 12 bp, Homo sapiens
tatatttgtaca

SEQ ID NO: 2574998 - DNA, 13 bp, Homo sapiens
tatatttgtacaa

SEQ ID NO: 2574999 - DNA, 16 bp, Homo sapiens
tatatttgtgtattta

SEQ ID NO: 2575000 - DNA, 12 bp, Homo sapiens
tatattttggga

SEQ ID NO: 2575001 - DNA, 15 bp, Homo sapiens
tatatttttaagata

SEQ ID NO: 2575002 - DNA, 19 bp, Homo sapiens
tatatttttggttgtcaat

SEQ ID NO: 2575003 - DNA, 12 bp, Homo sapiens
tatatttttgtc

SEQ ID NO: 2575004 - DNA, 19 bp, Homo sapiens
tatattttttgttaaatga

SEQ ID NO: 2575005 - DNA, 20 bp, Homo sapiens
tatcaaacagaattttaaag

SEQ ID NO: 2575006 - DNA, 18 bp, Homo sapiens
tatcaaatattagatgtg

SEQ ID NO: 2575007 - DNA, 20 bp, Homo sapiens
tatcaaatattagatgtgat

SEQ ID NO: 2575008 - DNA, 21 bp, Homo sapiens
tatcaacactgttactttcgt

SEQ ID NO: 2575009 - DNA, 13 bp, Homo sapiens
tatcaatagtcaa

SEQ ID NO: 2575010 - DNA, 18 bp, Homo sapiens
tatcaatcagtataattc

SEQ ID NO: 2575011 - DNA, 20 bp, Homo sapiens
tatcacaaatcttaacttga

SEQ ID NO: 2575012 - DNA, 17 bp, Homo sapiens
tatcacacttctgtgag

SEQ ID NO: 2575013 - DNA, 12 bp, Homo sapiens
tatcacatgtat

SEQ ID NO: 2575014 - DNA, 17 bp, Homo sapiens
tatcacatgtatgtttt

SEQ ID NO: 2575015 - DNA, 12 bp, Homo sapiens
tatcacatgttt

SEQ ID NO: 2575016 - DNA, 18 bp, Homo sapiens
tatcacatgttttctctg

SEQ ID NO: 2575017 - DNA, 18 bp, Homo sapiens
tatcacccagaagaaaat

SEQ ID NO: 2575018 - DNA, 14 bp, Homo sapiens
tatcagaagaccac

SEQ ID NO: 2575019 - DNA, 23 bp, Homo sapiens
tatcagaagaccacaaaaattga

SEQ ID NO: 2575020 - DNA, 15 bp, Homo sapiens
tatcagcacgtgtgg

SEQ ID NO: 2575021 - DNA, 13 bp, Homo sapiens
tatcagcctgagt

SEQ ID NO: 2575022 - DNA, 22 bp, Homo sapiens
tcaaagccagcgtcctcctctg

SEQ ID NO: 2575023 - DNA, 14 bp, Homo sapiens
tcaaagcttgaaga

SEQ ID NO: 2575024 - DNA, 15 bp, Homo sapiens
tcaaagctttttcca

SEQ ID NO: 2575025 - DNA, 16 bp, Homo sapiens
tcaaagctttttccag

SEQ ID NO: 2575026 - DNA, 17 bp, Homo sapiens
tcaaagttttgaaaagc

SEQ ID NO: 2575027 - DNA, 19 bp, Homo sapiens
tcaaagttttgaaaagcta

SEQ ID NO: 2575028 - DNA, 13 bp, Homo sapiens
tcaaatacatctt

SEQ ID NO: 2575029 - DNA, 23 bp, Homo sapiens
tcaaatactttaaaggaaaaaat

SEQ ID NO: 2575030 - DNA, 14 bp, Homo sapiens
tcaaatatgcaaag

SEQ ID NO: 2575031 - DNA, 16 bp, Homo sapiens
tcaaatatgcaaagca

SEQ ID NO: 2575032 - DNA, 17 bp, Homo sapiens
tcaaatatgcaaagcac

SEQ ID NO: 2575033 - DNA, 18 bp, Homo sapiens
tcaaatatgcaaagcact

SEQ ID NO: 2575034 - DNA, 19 bp, Homo sapiens
tcaaatatgcaaagcactg

SEQ ID NO: 2575035 - DNA, 20 bp, Homo sapiens
tcaaatcaagaaacttaagg

SEQ ID NO: 2575036 - DNA, 13 bp, Homo sapiens
tcaaatctattca

SEQ ID NO: 2575037 - DNA, 18 bp, Homo sapiens
tcaaatctattcagacaa

SEQ ID NO: 2575038 - DNA, 19 bp, Homo sapiens
tcaaatgacccaaagacca

SEQ ID NO: 2575039 - DNA, 21 bp, Homo sapiens
tcaaatgacccaaagaccaat

SEQ ID NO: 2575040 - DNA, 19 bp, Homo sapiens
tcaaatgctcagaccagct

SEQ ID NO: 2575041 - DNA, 20 bp, Homo sapiens
tcaaatggaagacacattga

SEQ ID NO: 2575042 - DNA, 20 bp, Homo sapiens
tcaaattcatttttttcact

SEQ ID NO: 2575043 - DNA, 15 bp, Homo sapiens
tcaacaaaaattgtc

SEQ ID NO: 2575044 - DNA, 19 bp, Homo sapiens
tcaacaagggagagacctc

SEQ ID NO: 2575045 - DNA, 18 bp, Homo sapiens
tcaacaggagaattttac

SEQ ID NO: 2575046 - DNA, 15 bp, Homo sapiens
tcaacatcaatgttc

SEQ ID NO: 2575047 - DNA, 16 bp, Homo sapiens
tcaacatcaatgttca

SEQ ID NO: 2575048 - DNA, 18 bp, Homo sapiens
tcaacatcaatgttcatt

SEQ ID NO: 2575049 - DNA, 23 bp, Homo sapiens
tcaacatcaatgttcattgtaat

SEQ ID NO: 2575050 - DNA, 16 bp, Homo sapiens
tcaacatttacatgta

SEQ ID NO: 2575051 - DNA, 17 bp, Homo sapiens
tcaaccaatgccaaaaa

SEQ ID NO: 2575052 - DNA, 23 bp, Homo sapiens
tcaaccactgtaaaatgaaatta

SEQ ID NO: 2575053 - DNA, 14 bp, Homo sapiens
tcaaccctggagag

SEQ ID NO: 2575054 - DNA, 21 bp, Homo sapiens
tcaacccttttgtctgcctct

SEQ ID NO: 2575055 - DNA, 15 bp, Homo sapiens
tcaacctaccacccc

SEQ ID NO: 2575056 - DNA, 22 bp, Homo sapiens
tcaacctaccaccccttcctgt

SEQ ID NO: 2575057 - DNA, 13 bp, Homo sapiens
tcaacctgcctga

SEQ ID NO: 2575058 - DNA, 18 bp, Homo sapiens
tcaaccttgagacagctt

SEQ ID NO: 2575059 - DNA, 19 bp, Homo sapiens
tcaacgcttaaaggtgtct

SEQ ID NO: 2575060 - DNA, 20 bp, Homo sapiens
tcaacgcttaaaggtgtctt

SEQ ID NO: 2575061 - DNA, 22 bp, Homo sapiens
tcaacgcttaaaggtgtcttcc

SEQ ID NO: 2575062 - DNA, 19 bp, Homo sapiens
tcaactaaaaaaaaaaaag

SEQ ID NO: 2575063 - DNA, 19 bp, Homo sapiens
tcaactcacctaatgttta

SEQ ID NO: 2575064 - DNA, 19 bp, Homo sapiens
tcaactcataagactttgg

SEQ ID NO: 2575065 - DNA, 15 bp, Homo sapiens
tcaactcatggagat

SEQ ID NO: 2575066 - DNA, 24 bp, Homo sapiens
tcaactgaccagcctccatgctgc

SEQ ID NO: 2575067 - DNA, 12 bp, Homo sapiens
tcaactgggctg

SEQ ID NO: 2575068 - DNA, 19 bp, Homo sapiens
tcaacttgcatccaactcc

SEQ ID NO: 2575069 - DNA, 22 bp, Homo sapiens
tcaactttcttttgattagtgt

SEQ ID NO: 2575070 - DNA, 18 bp, Homo sapiens
tcaagaaaaattattgta

SEQ ID NO: 2575071 - DNA, 21 bp, Homo sapiens
tcaagaaaaattattgtataa

SEQ ID NO: 2575072 - DNA, 12 bp, Homo sapiens
tcaagaaactga

SEQ ID NO: 2575073 - DNA, 22 bp, Homo sapiens
tcaagaaactgaggaattttct

SEQ ID NO: 2575074 - DNA, 21 bp, Homo sapiens
tcaagaaagcttcaaactgca

SEQ ID NO: 2575075 - DNA, 23 bp, Homo sapiens
tcaagaagaagatggattggtgt

SEQ ID NO: 2575076 - DNA, 21 bp, Homo sapiens
tcaagaataatcacgctttcc

SEQ ID NO: 2575077 - DNA, 17 bp, Homo sapiens
tcaagacattaaatcta

SEQ ID NO: 2575078 - DNA, 20 bp, Homo sapiens
tcaagacattaaatctatga

SEQ ID NO: 2575079 - DNA, 19 bp, Homo sapiens
tcaagactggaaggtgggg

SEQ ID NO: 2575080 - DNA, 13 bp, Homo sapiens
tcaagagctgccc

SEQ ID NO: 2575081 - DNA, 12 bp, Homo sapiens
tcaagaggctga

SEQ ID NO: 2575082 - DNA, 18 bp, Homo sapiens
tcaagattttgaatgctt

SEQ ID NO: 2575083 - DNA, 21 bp, Homo sapiens
tcaagcaaacagcttcacaaa

SEQ ID NO: 2575084 - DNA, 16 bp, Homo sapiens
tcaagcagattggaga

SEQ ID NO: 2575085 - DNA, 16 bp, Homo sapiens
tcaagccaatcccctc

SEQ ID NO: 2575086 - DNA, 20 bp, Homo sapiens
tcaagccaccaacatactcc

SEQ ID NO: 2575087 - DNA, 16 bp, Homo sapiens
tcaagcccgcggggac

SEQ ID NO: 2575088 - DNA, 14 bp, Homo sapiens
tcaagcctgcctag

SEQ ID NO: 2575089 - DNA, 21 bp, Homo sapiens
tcaagcgattcttctgcttca

SEQ ID NO: 2575090 - DNA, 16 bp, Homo sapiens
tcaagctagaaggcca

SEQ ID NO: 2575091 - DNA, 18 bp, Homo sapiens
tcaaggacttgaaagcat

SEQ ID NO: 2575092 - DNA, 19 bp, Homo sapiens
tcaaggacttgaaagcatc

SEQ ID NO: 2575093 - DNA, 16 bp, Homo sapiens
tcaaggcactgcctga

SEQ ID NO: 2575094 - DNA, 23 bp, Homo sapiens
tcaagtaagaagacatgaaccaa

SEQ ID NO: 2575095 - DNA, 21 bp, Homo sapiens
tcaagtattatacctttttta

SEQ ID NO: 2575096 - DNA, 23 bp, Homo sapiens
tcaagtattataccttttttaga

SEQ ID NO: 2575097 - DNA, 15 bp, Homo sapiens
tcaagtcacctcctt

SEQ ID NO: 2575098 - DNA, 18 bp, Homo sapiens
tcaagtccttacctcttc

SEQ ID NO: 2575099 - DNA, 12 bp, Homo sapiens
tcaagtcttccc

SEQ ID NO: 2575100 - DNA, 23 bp, Homo sapiens
tcaagtgaaaaaggaggaagaga

SEQ ID NO: 2575101 - DNA, 19 bp, Homo sapiens
tcaagtgaatctaaaagct

SEQ ID NO: 2575102 - DNA, 17 bp, Homo sapiens
tcaagtgattctcctgc

SEQ ID NO: 2575103 - DNA, 20 bp, Homo sapiens
tcaagtgattctcctgcctc

SEQ ID NO: 2575104 - DNA, 18 bp, Homo sapiens
tcaagtgggatctgtcac

SEQ ID NO: 2575105 - DNA, 15 bp, Homo sapiens
tcaagtgtcatatgt

SEQ ID NO: 2575106 - DNA, 14 bp, Homo sapiens
tcaagttaaagtga

SEQ ID NO: 2575107 - DNA, 13 bp, Homo sapiens
tcaagttgtgctt

SEQ ID NO: 2575108 - DNA, 17 bp, Homo sapiens
tcaagttgtgcttgttt

SEQ ID NO: 2575109 - DNA, 22 bp, Homo sapiens
tcaagttgtgcttgtttacagc

SEQ ID NO: 2575110 - DNA, 16 bp, Homo sapiens
tcaagtttttcagaaa

SEQ ID NO: 2575111 - DNA, 13 bp, Homo sapiens
tcaataaaatcat

SEQ ID NO: 2575112 - DNA, 16 bp, Homo sapiens
tcaataaaatcatgta

SEQ ID NO: 2575113 - DNA, 14 bp, Homo sapiens
tcaataaaatgtga

SEQ ID NO: 2575114 - DNA, 19 bp, Homo sapiens
tcaataaaatgtgattttt

SEQ ID NO: 2575115 - DNA, 13 bp, Homo sapiens
tcaataaagtatc

SEQ ID NO: 2575116 - DNA, 18 bp, Homo sapiens
tcaataatatattttctg

SEQ ID NO: 2575117 - DNA, 19 bp, Homo sapiens
tcaataatatattttctgt

SEQ ID NO: 2575118 - DNA, 20 bp, Homo sapiens
tcaataatatattttctgtt

SEQ ID NO: 2575119 - DNA, 19 bp, Homo sapiens
tcaatacagtacaggcagc

SEQ ID NO: 2575120 - DNA, 20 bp, Homo sapiens
tcaatacagtacaggcagca

SEQ ID NO: 2575121 - DNA, 16 bp, Homo sapiens
tcaatattaaatacag

SEQ ID NO: 2575122 - DNA, 17 bp, Homo sapiens
tcaatattaaatacaga

SEQ ID NO: 2575123 - DNA, 19 bp, Homo sapiens
tcaatattaaatacagaca

SEQ ID NO: 2575124 - DNA, 22 bp, Homo sapiens
tcaatattcctgaatgaaatat

SEQ ID NO: 2575125 - DNA, 15 bp, Homo sapiens
tcaatattgtcattc

SEQ ID NO: 2575126 - DNA, 13 bp, Homo sapiens
tcaatatttaaac

SEQ ID NO: 2575127 - DNA, 12 bp, Homo sapiens
tcaatatttatt

SEQ ID NO: 2575128 - DNA, 15 bp, Homo sapiens
tcaatctctcttaga

SEQ ID NO: 2575129 - DNA, 16 bp, Homo sapiens
tcaatctgtaaactgt

SEQ ID NO: 2575130 - DNA, 18 bp, Homo sapiens
tcaatgacagagccttct

SEQ ID NO: 2575131 - DNA, 10 bp, Homo sapiens
tcaatgatct

SEQ ID NO: 2575132 - DNA, 11 bp, Homo sapiens
tcaatgatcta

SEQ ID NO: 2575133 - DNA, 13 bp, Homo sapiens
tcaatgatctagg

SEQ ID NO: 2575134 - DNA, 17 bp, Homo sapiens
tcaatgatctaggttta

SEQ ID NO: 2575135 - DNA, 21 bp, Homo sapiens
tcaatgatctaggtttaactc

SEQ ID NO: 2575136 - DNA, 20 bp, Homo sapiens
tcaatggatttgatgctgtt

SEQ ID NO: 2575137 - DNA, 22 bp, Homo sapiens
tcaatggctgctgaagctgcct

SEQ ID NO: 2575138 - DNA, 14 bp, Homo sapiens
tcaatgggcaatga

SEQ ID NO: 2575139 - DNA, 21 bp, Homo sapiens
tcaatgtgattctaatgtctt

SEQ ID NO: 2575140 - DNA, 13 bp, Homo sapiens
tcaatgttcattg

SEQ ID NO: 2575141 - DNA, 24 bp, Homo sapiens
tcaatgttcattgtaatgttactg

SEQ ID NO: 2575142 - DNA, 23 bp, Homo sapiens
tcaatgtttatgcaaggaaggaa

SEQ ID NO: 2575143 - DNA, 18 bp, Homo sapiens
tcaatgtttcttctaggt

SEQ ID NO: 2575144 - DNA, 15 bp, Homo sapiens
tcaatgttttcagtt

SEQ ID NO: 2575145 - DNA, 12 bp, Homo sapiens
tcaattaaatgt

SEQ ID NO: 2575146 - DNA, 14 bp, Homo sapiens
tcaattaaatgtag

SEQ ID NO: 2575147 - DNA, 16 bp, Homo sapiens
tcaattaaatgtaggt

SEQ ID NO: 2575148 - DNA, 11 bp, Homo sapiens
tcaattaataa

SEQ ID NO: 2575149 - DNA, 17 bp, Homo sapiens
tcaattcctgggcccca

SEQ ID NO: 2575150 - DNA, 16 bp, Homo sapiens
tcaattgcatctccca

SEQ ID NO: 2575151 - DNA, 21 bp, Homo sapiens
tcaatttaaacccattttagt

SEQ ID NO: 2575152 - DNA, 14 bp, Homo sapiens
tcaatttctcccca

SEQ ID NO: 2575153 - DNA, 23 bp, Homo sapiens
tcaatttttcttatttcatttct

SEQ ID NO: 2575154 - DNA, 16 bp, Homo sapiens
tcacaacaacctggtc

SEQ ID NO: 2575155 - DNA, 14 bp, Homo sapiens
tcacaagaagacca

SEQ ID NO: 2575156 - DNA, 22 bp, Homo sapiens
tcacaaggcattcaagtgtaca

SEQ ID NO: 2575157 - DNA, 22 bp, Homo sapiens
tcacaagtgaaaaacatccaga

SEQ ID NO: 2575158 - DNA, 20 bp, Homo sapiens
tcacaataaaaatggctcag

SEQ ID NO: 2575159 - DNA, 20 bp, Homo sapiens
tcacacacaggcaactgagg

SEQ ID NO: 2575160 - DNA, 20 bp, Homo sapiens
tcacacagccaggtgccttg

SEQ ID NO: 2575161 - DNA, 23 bp, Homo sapiens
tcacacagccaggtgccttggag

SEQ ID NO: 2575162 - DNA, 21 bp, Homo sapiens
tcacacaggacccccttcccc

SEQ ID NO: 2575163 - DNA, 22 bp, Homo sapiens
tcacacaggacccccttcccct

SEQ ID NO: 2575164 - DNA, 23 bp, Homo sapiens
tcacacagtgggtggtggatctg

SEQ ID NO: 2575165 - DNA, 13 bp, Homo sapiens
tcagtctctgagc

SEQ ID NO: 2575166 - DNA, 17 bp, Homo sapiens
tcagtctctgagcagtg

SEQ ID NO: 2575167 - DNA, 20 bp, Homo sapiens
tcagtctctgagcagtgaat

SEQ ID NO: 2575168 - DNA, 24 bp, Homo sapiens
tcagtctgattcccaagctctgct

SEQ ID NO: 2575169 - DNA, 16 bp, Homo sapiens
tcagtctggtgggagg

SEQ ID NO: 2575170 - DNA, 22 bp, Homo sapiens
tcagtctttaatctgagaggcc

SEQ ID NO: 2575171 - DNA, 17 bp, Homo sapiens
tcagtgaggcccaggga

SEQ ID NO: 2575172 - DNA, 15 bp, Homo sapiens
tcagtgcagcccgtg

SEQ ID NO: 2575173 - DNA, 23 bp, Homo sapiens
tcagtgcagcccgtgtggcccct

SEQ ID NO: 2575174 - DNA, 22 bp, Homo sapiens
tcagtgccaataaaatttagga

SEQ ID NO: 2575175 - DNA, 12 bp, Homo sapiens
tcagtgccacta

SEQ ID NO: 2575176 - DNA, 13 bp, Homo sapiens
tcagtgctccctc

SEQ ID NO: 2575177 - DNA, 17 bp, Homo sapiens
tcagtgctgtggcctgg

SEQ ID NO: 2575178 - DNA, 21 bp, Homo sapiens
tcagtggaagaagcagatgag

SEQ ID NO: 2575179 - DNA, 21 bp, Homo sapiens
tcagtggactttccaccccct

SEQ ID NO: 2575180 - DNA, 23 bp, Homo sapiens
tcagtggactttccaccccctcc

SEQ ID NO: 2575181 - DNA, 15 bp, Homo sapiens
tcagtggcagctgct

SEQ ID NO: 2575182 - DNA, 14 bp, Homo sapiens
tcagtggcagggct

SEQ ID NO: 2575183 - DNA, 15 bp, Homo sapiens
tcagtggcagggctc

SEQ ID NO: 2575184 - DNA, 16 bp, Homo sapiens
tcagtggcagggctca

SEQ ID NO: 2575185 - DNA, 19 bp, Homo sapiens
tcagtggcagggctcagga

SEQ ID NO: 2575186 - DNA, 14 bp, Homo sapiens
tcagtgtaatttct

SEQ ID NO: 2575187 - DNA, 11 bp, Homo sapiens
tcagtgtacat

SEQ ID NO: 2575188 - DNA, 20 bp, Homo sapiens
tcagtgtcatttatgaaaag

SEQ ID NO: 2575189 - DNA, 17 bp, Homo sapiens
tcagtgttaaatgtgat

SEQ ID NO: 2575190 - DNA, 17 bp, Homo sapiens
tcagttactctgaaggg

SEQ ID NO: 2575191 - DNA, 22 bp, Homo sapiens
tcagttagagctgacacaaacc

SEQ ID NO: 2575192 - DNA, 17 bp, Homo sapiens
tcagttcccagaatcaa

SEQ ID NO: 2575193 - DNA, 15 bp, Homo sapiens
tcagttcccttggcc

SEQ ID NO: 2575194 - DNA, 23 bp, Homo sapiens
tcagttgagcttcatataccagc

SEQ ID NO: 2575195 - DNA, 16 bp, Homo sapiens
tcagttgcaataatac

SEQ ID NO: 2575196 - DNA, 18 bp, Homo sapiens
tcagttgtagaatgtatt

SEQ ID NO: 2575197 - DNA, 23 bp, Homo sapiens
tcagtttatccaaggtgtaactc

SEQ ID NO: 2575198 - DNA, 18 bp, Homo sapiens
tcagtttgtcctgtagag

SEQ ID NO: 2575199 - DNA, 15 bp, Homo sapiens
tcagtttgtgtgtct

SEQ ID NO: 2575200 - DNA, 19 bp, Homo sapiens
tcagttttatcattttcaa

SEQ ID NO: 2575201 - DNA, 15 bp, Homo sapiens
tcataaactgtgtgc

SEQ ID NO: 2575202 - DNA, 11 bp, Homo sapiens
tcataaatgaa

SEQ ID NO: 2575203 - DNA, 17 bp, Homo sapiens
tcataactttcattaaa

SEQ ID NO: 2575204 - DNA, 20 bp, Homo sapiens
tcataagtattatgtctctt

SEQ ID NO: 2575205 - DNA, 20 bp, Homo sapiens
tcataagtatttcaaattgg

SEQ ID NO: 2575206 - DNA, 15 bp, Homo sapiens
tcataatgtgaagtg

SEQ ID NO: 2575207 - DNA, 17 bp, Homo sapiens
tcataatgtgaagtgtt

SEQ ID NO: 2575208 - DNA, 15 bp, Homo sapiens
tcatacccaccccca

SEQ ID NO: 2575209 - DNA, 15 bp, Homo sapiens
tcatacgtccaccat

SEQ ID NO: 2575210 - DNA, 17 bp, Homo sapiens
tcatactgtgctggagc

SEQ ID NO: 2575211 - DNA, 18 bp, Homo sapiens
tcatactgtgctggagcc

SEQ ID NO: 2575212 - DNA, 13 bp, Homo sapiens
tcatagaaatgta

SEQ ID NO: 2575213 - DNA, 13 bp, Homo sapiens
tcatagctaagaa

SEQ ID NO: 2575214 - DNA, 21 bp, Homo sapiens
tcataggaagggaccaaggca

SEQ ID NO: 2575215 - DNA, 19 bp, Homo sapiens
tcatagggaagacctgctg

SEQ ID NO: 2575216 - DNA, 21 bp, Homo sapiens
tcatagggtctcttcaggttc

SEQ ID NO: 2575217 - DNA, 16 bp, Homo sapiens
tcataggtatttcaaa

SEQ ID NO: 2575218 - DNA, 18 bp, Homo sapiens
tcataggtcactggctct

SEQ ID NO: 2575219 - DNA, 23 bp, Homo sapiens
tcataggtcactggctctccaag

SEQ ID NO: 2575220 - DNA, 16 bp, Homo sapiens
tcataggttgccaata

SEQ ID NO: 2575221 - DNA, 15 bp, Homo sapiens
tcatagtatggtggc

SEQ ID NO: 2575222 - DNA, 16 bp, Homo sapiens
tcatataaaagctatg

SEQ ID NO: 2575223 - DNA, 20 bp, Homo sapiens
tcatataaaagctatggtga

SEQ ID NO: 2575224 - DNA, 15 bp, Homo sapiens
tcatataataaatgt

SEQ ID NO: 2575225 - DNA, 16 bp, Homo sapiens
tcatataataaatgta

SEQ ID NO: 2575226 - DNA, 14 bp, Homo sapiens
tcatatatatctat

SEQ ID NO: 2575227 - DNA, 18 bp, Homo sapiens
tcatatatggggggccaa

SEQ ID NO: 2575228 - DNA, 22 bp, Homo sapiens
tcatatgtaccatgtacatgaa

SEQ ID NO: 2575229 - DNA, 13 bp, Homo sapiens
tcatatgttgctc

SEQ ID NO: 2575230 - DNA, 14 bp, Homo sapiens
tcatatgttgctca

SEQ ID NO: 2575231 - DNA, 18 bp, Homo sapiens
tcatatgttgctcagtct

SEQ ID NO: 2575232 - DNA, 15 bp, Homo sapiens
tcatatttacttctt

SEQ ID NO: 2575233 - DNA, 22 bp, Homo sapiens
tcatatttacttcttatacatt

SEQ ID NO: 2575234 - DNA, 23 bp, Homo sapiens
tcatatttacttcttatacattt

SEQ ID NO: 2575235 - DNA, 22 bp, Homo sapiens
tcatcaactgaatgaggtcagc

SEQ ID NO: 2575236 - DNA, 11 bp, Homo sapiens
tcatcaagact

SEQ ID NO: 2575237 - DNA, 16 bp, Homo sapiens
tcatcaaggcactgcc

SEQ ID NO: 2575238 - DNA, 17 bp, Homo sapiens
tcatcaaggcactgcct

SEQ ID NO: 2575239 - DNA, 23 bp, Homo sapiens
tcatcaattgaatggtcagcgtt

SEQ ID NO: 2575240 - DNA, 20 bp, Homo sapiens
tcatcaccaacgtctgtgcc

SEQ ID NO: 2575241 - DNA, 16 bp, Homo sapiens
tcatcactcccctcca

SEQ ID NO: 2575242 - DNA, 15 bp, Homo sapiens
tcatcagaagataac

SEQ ID NO: 2575243 - DNA, 21 bp, Homo sapiens
tcatcagcatacctttattgt

SEQ ID NO: 2575244 - DNA, 16 bp, Homo sapiens
tcatcagccaccatcc

SEQ ID NO: 2575245 - DNA, 18 bp, Homo sapiens
tcatcagccaccatccta

SEQ ID NO: 2575246 - DNA, 14 bp, Homo sapiens
tcatcagtattgaa

SEQ ID NO: 2575247 - DNA, 15 bp, Homo sapiens
tcatcatacatgact

SEQ ID NO: 2575248 - DNA, 14 bp, Homo sapiens
tcatcatattatac

SEQ ID NO: 2575249 - DNA, 17 bp, Homo sapiens
tcatcattccttgagaa

SEQ ID NO: 2575250 - DNA, 13 bp, Homo sapiens
tcatcattctctg

SEQ ID NO: 2575251 - DNA, 19 bp, Homo sapiens
tcatcattctctgtctcat

SEQ ID NO: 2575252 - DNA, 20 bp, Homo sapiens
tcatccaatcctcactgggt

SEQ ID NO: 2575253 - DNA, 22 bp, Homo sapiens
tcatccaatcctcactgggtgg

SEQ ID NO: 2575254 - DNA, 20 bp, Homo sapiens
tcatccaccccatccctccc

SEQ ID NO: 2575255 - DNA, 14 bp, Homo sapiens
tcatccactgtgcc

SEQ ID NO: 2575256 - DNA, 18 bp, Homo sapiens
tcatccactgtgccatgt

SEQ ID NO: 2575257 - DNA, 19 bp, Homo sapiens
tcatccactgtgccatgtg

SEQ ID NO: 2575258 - DNA, 21 bp, Homo sapiens
tcatccactgtgccatgtgcc

SEQ ID NO: 2575259 - DNA, 23 bp, Homo sapiens
tcatccactgtgccatgtgccag

SEQ ID NO: 2575260 - DNA, 12 bp, Homo sapiens
tcatccatcatc

SEQ ID NO: 2575261 - DNA, 18 bp, Homo sapiens
tcatcccacgcactccat

SEQ ID NO: 2575262 - DNA, 15 bp, Homo sapiens
tcatcctaagctatt

SEQ ID NO: 2575263 - DNA, 12 bp, Homo sapiens
tcatcctgcagg

SEQ ID NO: 2575264 - DNA, 16 bp, Homo sapiens
tcatcctttccagcat

SEQ ID NO: 2575265 - DNA, 18 bp, Homo sapiens
tcatcgcgtcctcctacc

SEQ ID NO: 2575266 - DNA, 22 bp, Homo sapiens
tcatctccagggagtcccctcc

SEQ ID NO: 2575267 - DNA, 23 bp, Homo sapiens
tcatctccagggagtcccctccc

SEQ ID NO: 2575268 - DNA, 13 bp, Homo sapiens
tcatctccatcag

SEQ ID NO: 2575269 - DNA, 16 bp, Homo sapiens
tcatctccatcagctg

SEQ ID NO: 2575270 - DNA, 17 bp, Homo sapiens
tcatctccatcagctgt

SEQ ID NO: 2575271 - DNA, 22 bp, Homo sapiens
tcatctcctgccttcctcctgg

SEQ ID NO: 2575272 - DNA, 23 bp, Homo sapiens
tcatctcctgccttcctcctggg

SEQ ID NO: 2575273 - DNA, 15 bp, Homo sapiens
tcatctctcctccaa

SEQ ID NO: 2575274 - DNA, 13 bp, Homo sapiens
tcatctggaacca

SEQ ID NO: 2575275 - DNA, 23 bp, Homo sapiens
tcatctggataggagcctgctgg

SEQ ID NO: 2575276 - DNA, 12 bp, Homo sapiens
tcatctgggaaa

SEQ ID NO: 2575277 - DNA, 18 bp, Homo sapiens
tcatctgggaaagacatc

SEQ ID NO: 2575278 - DNA, 18 bp, Homo sapiens
tcatctgggggagtggaa

SEQ ID NO: 2575279 - DNA, 12 bp, Homo sapiens
tcatctgtccct

SEQ ID NO: 2575280 - DNA, 18 bp, Homo sapiens
tcatctgtccctccggga

SEQ ID NO: 2575281 - DNA, 17 bp, Homo sapiens
tcatctgtgtgaaaatg

SEQ ID NO: 2575282 - DNA, 17 bp, Homo sapiens
tcatctgtttttctttt

SEQ ID NO: 2575283 - DNA, 16 bp, Homo sapiens
tcatcttactgtacct

SEQ ID NO: 2575284 - DNA, 21 bp, Homo sapiens
tcatcttgaccaagcaggaag

SEQ ID NO: 2575285 - DNA, 11 bp, Homo sapiens
tcatgaaaatt

SEQ ID NO: 2575286 - DNA, 14 bp, Homo sapiens
tcatgaaatatgca

SEQ ID NO: 2575287 - DNA, 18 bp, Homo sapiens
tcatgaacttcgcatcaa

SEQ ID NO: 2575288 - DNA, 21 bp, Homo sapiens
tcatgaacttcgcatcaaaag

SEQ ID NO: 2575289 - DNA, 20 bp, Homo sapiens
tcatgaattcttatgcttat

SEQ ID NO: 2575290 - DNA, 19 bp, Homo sapiens
tcatgacaaagactgagta

SEQ ID NO: 2575291 - DNA, 17 bp, Homo sapiens
tcatgacatgttatata

SEQ ID NO: 2575292 - DNA, 19 bp, Homo sapiens
tcatgacatgttatatatt

SEQ ID NO: 2575293 - DNA, 16 bp, Homo sapiens
tcatgagctgagcagg

SEQ ID NO: 2575294 - DNA, 17 bp, Homo sapiens
tcatgatcttgtgacat

SEQ ID NO: 2575295 - DNA, 22 bp, Homo sapiens
tcatgattcacccccaaacagt

SEQ ID NO: 2575296 - DNA, 19 bp, Homo sapiens
tcatgcataaatatgcagt

SEQ ID NO: 2575297 - DNA, 20 bp, Homo sapiens
tcatgcatctccacctgctc

SEQ ID NO: 2575298 - DNA, 22 bp, Homo sapiens
tcatgcatctccacctgctccc

SEQ ID NO: 2575299 - DNA, 15 bp, Homo sapiens
tcatgcatggaaatt

SEQ ID NO: 2575300 - DNA, 19 bp, Homo sapiens
tcatgccaccatggccagc

SEQ ID NO: 2575301 - DNA, 13 bp, Homo sapiens
tcatgcccccctc

SEQ ID NO: 2575302 - DNA, 13 bp, Homo sapiens
tcatgcctggctt

SEQ ID NO: 2575303 - DNA, 13 bp, Homo sapiens
tcatgctgaaagc

SEQ ID NO: 2575304 - DNA, 14 bp, Homo sapiens
tcatgctgaaagcc

SEQ ID NO: 2575305 - DNA, 23 bp, Homo sapiens
tcatggagtgacggtcccacact

SEQ ID NO: 2575306 - DNA, 18 bp, Homo sapiens
tcatggcccctctgacct

SEQ ID NO: 2575307 - DNA, 14 bp, Homo sapiens
tcatggggtccaag

SEQ ID NO: 2575308 - DNA, 23 bp, Homo sapiens
tcatggtgggttcaggggactca

SEQ ID NO: 2575309 - DNA, 17 bp, Homo sapiens
tctggtgacaccagcct

SEQ ID NO: 2575310 - DNA, 16 bp, Homo sapiens
tctggtgactttcctc

SEQ ID NO: 2575311 - DNA, 15 bp, Homo sapiens
tctggttttaacaat

SEQ ID NO: 2575312 - DNA, 15 bp, Homo sapiens
tctgtaaactcaaaa

SEQ ID NO: 2575313 - DNA, 22 bp, Homo sapiens
tctgtaaactgtgtattccaag

SEQ ID NO: 2575314 - DNA, 15 bp, Homo sapiens
tctgtaatctcgttt

SEQ ID NO: 2575315 - DNA, 13 bp, Homo sapiens
tctgtacacgtgt

SEQ ID NO: 2575316 - DNA, 18 bp, Homo sapiens
tctgtacatagcctatat

SEQ ID NO: 2575317 - DNA, 20 bp, Homo sapiens
tctgtagggtaattagtaac

SEQ ID NO: 2575318 - DNA, 14 bp, Homo sapiens
tctgtagtgagata

SEQ ID NO: 2575319 - DNA, 23 bp, Homo sapiens
tctgtagttttatcacatgtatg

SEQ ID NO: 2575320 - DNA, 15 bp, Homo sapiens
tctgtatacaaccct

SEQ ID NO: 2575321 - DNA, 14 bp, Homo sapiens
tctgtatactgtgg

SEQ ID NO: 2575322 - DNA, 14 bp, Homo sapiens
tctgtatataaaat

SEQ ID NO: 2575323 - DNA, 12 bp, Homo sapiens
tctgtatctctc

SEQ ID NO: 2575324 - DNA, 13 bp, Homo sapiens
tctgtatctctct

SEQ ID NO: 2575325 - DNA, 15 bp, Homo sapiens
tctgtatttaatttt

SEQ ID NO: 2575326 - DNA, 14 bp, Homo sapiens
tctgtcaatgaaaa

SEQ ID NO: 2575327 - DNA, 16 bp, Homo sapiens
tctgtcacccaggctg

SEQ ID NO: 2575328 - DNA, 17 bp, Homo sapiens
tctgtcactgcaggcac

SEQ ID NO: 2575329 - DNA, 13 bp, Homo sapiens
tctgtcacttaat

SEQ ID NO: 2575330 - DNA, 18 bp, Homo sapiens
tctgtcagatgggaagac

SEQ ID NO: 2575331 - DNA, 19 bp, Homo sapiens
tctgtcagatgggaagaca

SEQ ID NO: 2575332 - DNA, 21 bp, Homo sapiens
tctgtcagcgcaggtttagtt

SEQ ID NO: 2575333 - DNA, 16 bp, Homo sapiens
tctgtcaggagagcag

SEQ ID NO: 2575334 - DNA, 22 bp, Homo sapiens
tctgtcatgaacatgttcctga

SEQ ID NO: 2575335 - DNA, 15 bp, Homo sapiens
tctgtcatttgagca

SEQ ID NO: 2575336 - DNA, 17 bp, Homo sapiens
tctgtcccacttggcat

SEQ ID NO: 2575337 - DNA, 15 bp, Homo sapiens
tctgtcccttggagc

SEQ ID NO: 2575338 - DNA, 19 bp, Homo sapiens
tctgtcctactctgtgtca

SEQ ID NO: 2575339 - DNA, 21 bp, Homo sapiens
tctgtcctgggagtgagctgg

SEQ ID NO: 2575340 - DNA, 17 bp, Homo sapiens
tctgtcctggtgtcact

SEQ ID NO: 2575341 - DNA, 19 bp, Homo sapiens
tctgtcgccttagcatgtt

SEQ ID NO: 2575342 - DNA, 22 bp, Homo sapiens
tctgtcgccttagcatgtttgc

SEQ ID NO: 2575343 - DNA, 21 bp, Homo sapiens
tctgtctcaaaaaataaaaat

SEQ ID NO: 2575344 - DNA, 14 bp, Homo sapiens
tctgtctccttaac

SEQ ID NO: 2575345 - DNA, 14 bp, Homo sapiens
tctgtctctgcctc

SEQ ID NO: 2575346 - DNA, 17 bp, Homo sapiens
tctgtctctgcctccct

SEQ ID NO: 2575347 - DNA, 13 bp, Homo sapiens
tctgtctgccctt

SEQ ID NO: 2575348 - DNA, 15 bp, Homo sapiens
tctgtcttcacaaca

SEQ ID NO: 2575349 - DNA, 17 bp, Homo sapiens
tctgtgaaatgctggca

SEQ ID NO: 2575350 - DNA, 20 bp, Homo sapiens
tctgtgaaatgctggcattt

SEQ ID NO: 2575351 - DNA, 12 bp, Homo sapiens
tctgtgaataag

SEQ ID NO: 2575352 - DNA, 16 bp, Homo sapiens
tctgtgaccaatgtct

SEQ ID NO: 2575353 - DNA, 17 bp, Homo sapiens
tctgtgagattcattca

SEQ ID NO: 2575354 - DNA, 16 bp, Homo sapiens
tctgtgatgatcctca

SEQ ID NO: 2575355 - DNA, 19 bp, Homo sapiens
tctgtgcatggtggcacca

SEQ ID NO: 2575356 - DNA, 22 bp, Homo sapiens
tctgtgcgtgaaacacaccagg

SEQ ID NO: 2575357 - DNA, 14 bp, Homo sapiens
tctgtgctcctcct

SEQ ID NO: 2575358 - DNA, 16 bp, Homo sapiens
tctgtgctttccagct

SEQ ID NO: 2575359 - DNA, 21 bp, Homo sapiens
tctgtgctttccagctcaccc

SEQ ID NO: 2575360 - DNA, 16 bp, Homo sapiens
tctgtgtacaaagaaa

SEQ ID NO: 2575361 - DNA, 17 bp, Homo sapiens
tctgtgtcaggtggggc

SEQ ID NO: 2575362 - DNA, 20 bp, Homo sapiens
tctgtgtcaggtggggcagc

SEQ ID NO: 2575363 - DNA, 11 bp, Homo sapiens
tctgtgtctct

SEQ ID NO: 2575364 - DNA, 12 bp, Homo sapiens
tctgtgtctctt

SEQ ID NO: 2575365 - DNA, 12 bp, Homo sapiens
tctgtgtcttgt

SEQ ID NO: 2575366 - DNA, 19 bp, Homo sapiens
tctgtgtgtgtgtatgtgg

SEQ ID NO: 2575367 - DNA, 14 bp, Homo sapiens
tctgtgttttgaat

SEQ ID NO: 2575368 - DNA, 16 bp, Homo sapiens
tctgtgtttttgaaat

SEQ ID NO: 2575369 - DNA, 21 bp, Homo sapiens
tctgttaccatgtcactgtgg

SEQ ID NO: 2575370 - DNA, 15 bp, Homo sapiens
tctgttatataaatg

SEQ ID NO: 2575371 - DNA, 22 bp, Homo sapiens
tctgttcacttttcctccctca

SEQ ID NO: 2575372 - DNA, 12 bp, Homo sapiens
tctgttcagtgt

SEQ ID NO: 2575373 - DNA, 17 bp, Homo sapiens
tctgttcagtgtaaata

SEQ ID NO: 2575374 - DNA, 13 bp, Homo sapiens
tctgttccttcac

SEQ ID NO: 2575375 - DNA, 12 bp, Homo sapiens
tctgttctgtgg

SEQ ID NO: 2575376 - DNA, 22 bp, Homo sapiens
tctgttctgtggaaagtgtaaa

SEQ ID NO: 2575377 - DNA, 16 bp, Homo sapiens
tctgttgcccaggctg

SEQ ID NO: 2575378 - DNA, 12 bp, Homo sapiens
tctgttggccag

SEQ ID NO: 2575379 - DNA, 14 bp, Homo sapiens
tctgttgtcattgc

SEQ ID NO: 2575380 - DNA, 16 bp, Homo sapiens
tctgtttagataatac

SEQ ID NO: 2575381 - DNA, 14 bp, Homo sapiens
tctgtttgacaaac

SEQ ID NO: 2575382 - DNA, 13 bp, Homo sapiens
tctgttttccttt

SEQ ID NO: 2575383 - DNA, 16 bp, Homo sapiens
tctgttttgcctgaag

SEQ ID NO: 2575384 - DNA, 16 bp, Homo sapiens
tctgtttttaaaaatc

SEQ ID NO: 2575385 - DNA, 18 bp, Homo sapiens
tcttaaaaaataaaaact

SEQ ID NO: 2575386 - DNA, 20 bp, Homo sapiens
tcttaaaacattatgagttt

SEQ ID NO: 2575387 - DNA, 23 bp, Homo sapiens
tcttaaaagttgtgattccagat

SEQ ID NO: 2575388 - DNA, 19 bp, Homo sapiens
tcttaaaatatatttcaga

SEQ ID NO: 2575389 - DNA, 20 bp, Homo sapiens
tcttaaagaaaacccacccc

SEQ ID NO: 2575390 - DNA, 21 bp, Homo sapiens
tcttaaagctgcctgtagtta

SEQ ID NO: 2575391 - DNA, 15 bp, Homo sapiens
tcttaaataataaag

SEQ ID NO: 2575392 - DNA, 12 bp, Homo sapiens
tcttaagccatc

SEQ ID NO: 2575393 - DNA, 23 bp, Homo sapiens
tcttaagccatcttggtaaattt

SEQ ID NO: 2575394 - DNA, 16 bp, Homo sapiens
tcttaaggggcagctt

SEQ ID NO: 2575395 - DNA, 17 bp, Homo sapiens
tcttaatcttttcacaa

SEQ ID NO: 2575396 - DNA, 19 bp, Homo sapiens
tcttaatcttttcacaaat

SEQ ID NO: 2575397 - DNA, 23 bp, Homo sapiens
tcttaatttaatcttttttatgt

SEQ ID NO: 2575398 - DNA, 17 bp, Homo sapiens
tcttaattttggttgta

SEQ ID NO: 2575399 - DNA, 21 bp, Homo sapiens
tcttaattttggttgtattct

SEQ ID NO: 2575400 - DNA, 14 bp, Homo sapiens
tcttacaaacatgt

SEQ ID NO: 2575401 - DNA, 19 bp, Homo sapiens
tcttacgcccaacccttcc

SEQ ID NO: 2575402 - DNA, 13 bp, Homo sapiens
tcttactgcaaat

SEQ ID NO: 2575403 - DNA, 14 bp, Homo sapiens
tcttactgcaaatg

SEQ ID NO: 2575404 - DNA, 22 bp, Homo sapiens
tcttactgcaaatgtcatcaga

SEQ ID NO: 2575405 - DNA, 20 bp, Homo sapiens
tcttagactacatttagaga

SEQ ID NO: 2575406 - DNA, 18 bp, Homo sapiens
tcttagacttctgctttc

SEQ ID NO: 2575407 - DNA, 23 bp, Homo sapiens
tcttagacttgaaatactactta

SEQ ID NO: 2575408 - DNA, 14 bp, Homo sapiens
tcttagatgtatat

SEQ ID NO: 2575409 - DNA, 15 bp, Homo sapiens
tcttagatgtatata

SEQ ID NO: 2575410 - DNA, 12 bp, Homo sapiens
tcttagctgagt

SEQ ID NO: 2575411 - DNA, 17 bp, Homo sapiens
tcttagctttttaattg

SEQ ID NO: 2575412 - DNA, 21 bp, Homo sapiens
tcttagctttttaattgttgt

SEQ ID NO: 2575413 - DNA, 22 bp, Homo sapiens
tcttagctttttaattgttgtt

SEQ ID NO: 2575414 - DNA, 15 bp, Homo sapiens
tcttaggaagagaaa

SEQ ID NO: 2575415 - DNA, 14 bp, Homo sapiens
tcttaggagcagag

SEQ ID NO: 2575416 - DNA, 14 bp, Homo sapiens
tcttagtgcctgag

SEQ ID NO: 2575417 - DNA, 18 bp, Homo sapiens
tcttagtgcctgagagta

SEQ ID NO: 2575418 - DNA, 16 bp, Homo sapiens
tcttagtttggattct

SEQ ID NO: 2575419 - DNA, 23 bp, Homo sapiens
tcttagtttggattcttatgtag

SEQ ID NO: 2575420 - DNA, 14 bp, Homo sapiens
tcttatacatttga

SEQ ID NO: 2575421 - DNA, 20 bp, Homo sapiens
tcttatagaatatttattac

SEQ ID NO: 2575422 - DNA, 13 bp, Homo sapiens
tcttatcaagcag

SEQ ID NO: 2575423 - DNA, 22 bp, Homo sapiens
tcttatctcagtcatgcataaa

SEQ ID NO: 2575424 - DNA, 15 bp, Homo sapiens
tcttatcttctgcaa

SEQ ID NO: 2575425 - DNA, 17 bp, Homo sapiens
tcttatgcttataatat

SEQ ID NO: 2575426 - DNA, 14 bp, Homo sapiens
tcttatgggctggg

SEQ ID NO: 2575427 - DNA, 15 bp, Homo sapiens
tcttatgggctgggt

SEQ ID NO: 2575428 - DNA, 18 bp, Homo sapiens
tcttatgggctgggttct

SEQ ID NO: 2575429 - DNA, 22 bp, Homo sapiens
tcttattagaacaggcaagtga

SEQ ID NO: 2575430 - DNA, 17 bp, Homo sapiens
tcttattcagtaaaaaa

SEQ ID NO: 2575431 - DNA, 19 bp, Homo sapiens
tcttcaacatcaatgttca

SEQ ID NO: 2575432 - DNA, 23 bp, Homo sapiens
tcttcacctgattcaactaaaaa

SEQ ID NO: 2575433 - DNA, 14 bp, Homo sapiens
tcttcacggcagga

SEQ ID NO: 2575434 - DNA, 18 bp, Homo sapiens
tcttcactctctgaagat

SEQ ID NO: 2575435 - DNA, 16 bp, Homo sapiens
tcttcagagcaggggt

SEQ ID NO: 2575436 - DNA, 12 bp, Homo sapiens
tcttcagagctg

SEQ ID NO: 2575437 - DNA, 13 bp, Homo sapiens
tcttcagagctga

SEQ ID NO: 2575438 - DNA, 19 bp, Homo sapiens
tcttcagatacaaactgca

SEQ ID NO: 2575439 - DNA, 23 bp, Homo sapiens
tcttcagatctctaacttcacca

SEQ ID NO: 2575440 - DNA, 21 bp, Homo sapiens
tcttcagcctagccgacctca

SEQ ID NO: 2575441 - DNA, 23 bp, Homo sapiens
tcttcagcctagccgacctcagc

SEQ ID NO: 2575442 - DNA, 14 bp, Homo sapiens
tcttcaggcctccc

SEQ ID NO: 2575443 - DNA, 14 bp, Homo sapiens
tcttcaggttctta

SEQ ID NO: 2575444 - DNA, 16 bp, Homo sapiens
tcttcagtaagccgtg

SEQ ID NO: 2575445 - DNA, 21 bp, Homo sapiens
tcttcatacctacatgtattt

SEQ ID NO: 2575446 - DNA, 15 bp, Homo sapiens
tcttcatactttttt

SEQ ID NO: 2575447 - DNA, 18 bp, Homo sapiens
tcttcatccggcagcctg

SEQ ID NO: 2575448 - DNA, 21 bp, Homo sapiens
tcttcatttcattgtatgatg

SEQ ID NO: 2575449 - DNA, 22 bp, Homo sapiens
tcttcatttcattgtatgatgt

SEQ ID NO: 2575450 - DNA, 24 bp, Homo sapiens
tcttccaagcaaaggtgaagagac

SEQ ID NO: 2575451 - DNA, 17 bp, Homo sapiens
tcttccaggctgggaga

SEQ ID NO: 2575452 - DNA, 18 bp, Homo sapiens
tcttccagtcttcctgac

SEQ ID NO: 2575453 - DNA, 21 bp, Homo sapiens
tcttccagtcttcctgacact

SEQ ID NO: 2575454 - DNA, 19 bp, Homo sapiens
tgaacccattttgagtgac

SEQ ID NO: 2575455 - DNA, 18 bp, Homo sapiens
tgaacccgggaggcagag

SEQ ID NO: 2575456 - DNA, 15 bp, Homo sapiens
tgaacccttgcttgc

SEQ ID NO: 2575457 - DNA, 20 bp, Homo sapiens
tgaacctaccttcatttcag

SEQ ID NO: 2575458 - DNA, 21 bp, Homo sapiens
tgaactacgcttgctcatttt

SEQ ID NO: 2575459 - DNA, 14 bp, Homo sapiens
tgaactcaaactga

SEQ ID NO: 2575460 - DNA, 16 bp, Homo sapiens
tgaactcaaactgagg

SEQ ID NO: 2575461 - DNA, 17 bp, Homo sapiens
tgaactcagccaagcac

SEQ ID NO: 2575462 - DNA, 18 bp, Homo sapiens
tgaactcagccaagcaca

SEQ ID NO: 2575463 - DNA, 11 bp, Homo sapiens
tgaactcctgg

SEQ ID NO: 2575464 - DNA, 14 bp, Homo sapiens
tgaactcctggcct

SEQ ID NO: 2575465 - DNA, 17 bp, Homo sapiens
tgaactcctggcctcaa

SEQ ID NO: 2575466 - DNA, 21 bp, Homo sapiens
tgaactcttaatcaaatagca

SEQ ID NO: 2575467 - DNA, 12 bp, Homo sapiens
tgaactcttaga

SEQ ID NO: 2575468 - DNA, 23 bp, Homo sapiens
tgaactgacaggcagcctggaca

SEQ ID NO: 2575469 - DNA, 19 bp, Homo sapiens
tgaactgatagttactgtt

SEQ ID NO: 2575470 - DNA, 21 bp, Homo sapiens
tgaactgatagttactgttgt

SEQ ID NO: 2575471 - DNA, 23 bp, Homo sapiens
tgaactgatagttactgttgtga

SEQ ID NO: 2575472 - DNA, 17 bp, Homo sapiens
tgaacttaaataaatgt

SEQ ID NO: 2575473 - DNA, 18 bp, Homo sapiens
tgaacttcgcatcaaaag

SEQ ID NO: 2575474 - DNA, 21 bp, Homo sapiens
tgaacttcgcatcaaaagaca

SEQ ID NO: 2575475 - DNA, 16 bp, Homo sapiens
tgaactttgacctctg

SEQ ID NO: 2575476 - DNA, 19 bp, Homo sapiens
tgaactttgacctctgcag

SEQ ID NO: 2575477 - DNA, 22 bp, Homo sapiens
tgaactttgacctctgcagcaa

SEQ ID NO: 2575478 - DNA, 15 bp, Homo sapiens
tgaagaaaaaataca

SEQ ID NO: 2575479 - DNA, 18 bp, Homo sapiens
tgaagaaaaaatacattt

SEQ ID NO: 2575480 - DNA, 15 bp, Homo sapiens
tgaagaaaatcactt

SEQ ID NO: 2575481 - DNA, 21 bp, Homo sapiens
tgaagaaaatcacttaggaaa

SEQ ID NO: 2575482 - DNA, 13 bp, Homo sapiens
tgaagaacagtaa

SEQ ID NO: 2575483 - DNA, 15 bp, Homo sapiens
tgaagaacagtaact

SEQ ID NO: 2575484 - DNA, 20 bp, Homo sapiens
tgaagaacagtaactgccat

SEQ ID NO: 2575485 - DNA, 21 bp, Homo sapiens
tgaagaatctgtttcccagca

SEQ ID NO: 2575486 - DNA, 11 bp, Homo sapiens
tgaagacaatg

SEQ ID NO: 2575487 - DNA, 23 bp, Homo sapiens
tgaagacaatgacttactgtaca

SEQ ID NO: 2575488 - DNA, 14 bp, Homo sapiens
tgaagacaggacag

SEQ ID NO: 2575489 - DNA, 14 bp, Homo sapiens
tgaagacaggatgg

SEQ ID NO: 2575490 - DNA, 23 bp, Homo sapiens
tgaagagaaccgagcaaagatca

SEQ ID NO: 2575491 - DNA, 22 bp, Homo sapiens
tgaagagaagggcagggctgag

SEQ ID NO: 2575492 - DNA, 16 bp, Homo sapiens
tgaagagatccttctg

SEQ ID NO: 2575493 - DNA, 16 bp, Homo sapiens
tgaagaggcgggccag

SEQ ID NO: 2575494 - DNA, 18 bp, Homo sapiens
tgaagaggcgggccagcc

SEQ ID NO: 2575495 - DNA, 17 bp, Homo sapiens
tgaagagggagaaggga

SEQ ID NO: 2575496 - DNA, 15 bp, Homo sapiens
tgaagaggggcagcc

SEQ ID NO: 2575497 - DNA, 20 bp, Homo sapiens
tgaagaggggcagcccttgc

SEQ ID NO: 2575498 - DNA, 16 bp, Homo sapiens
tgaagaggtgagagta

SEQ ID NO: 2575499 - DNA, 17 bp, Homo sapiens
tgaagagtgagagggca

SEQ ID NO: 2575500 - DNA, 19 bp, Homo sapiens
tgaagagtgggtttcacaa

SEQ ID NO: 2575501 - DNA, 19 bp, Homo sapiens
tgaagatcgttagtatcta

SEQ ID NO: 2575502 - DNA, 17 bp, Homo sapiens
tgaagatggcatcctgt

SEQ ID NO: 2575503 - DNA, 22 bp, Homo sapiens
tgaagatggcatcctgtgaagt

SEQ ID NO: 2575504 - DNA, 18 bp, Homo sapiens
tgaagattctcctgtgct

SEQ ID NO: 2575505 - DNA, 21 bp, Homo sapiens
tgaagattctttcccaattca

SEQ ID NO: 2575506 - DNA, 18 bp, Homo sapiens
tgaagcaaagcaccagct

SEQ ID NO: 2575507 - DNA, 19 bp, Homo sapiens
tgaagcagatgcaaagagg

SEQ ID NO: 2575508 - DNA, 19 bp, Homo sapiens
tgaagcatgtttcatgttt

SEQ ID NO: 2575509 - DNA, 15 bp, Homo sapiens
tgaagcattttataa

SEQ ID NO: 2575510 - DNA, 16 bp, Homo sapiens
tgaagccctccaaaag

SEQ ID NO: 2575511 - DNA, 22 bp, Homo sapiens
tgaagctctggtgacaccagcc

SEQ ID NO: 2575512 - DNA, 16 bp, Homo sapiens
tgaagctgcctgcttt

SEQ ID NO: 2575513 - DNA, 23 bp, Homo sapiens
tgaagctttatacgtgtagctat

SEQ ID NO: 2575514 - DNA, 16 bp, Homo sapiens
tgaaggaaacagttaa

SEQ ID NO: 2575515 - DNA, 22 bp, Homo sapiens
tgaaggagccccattcctggga

SEQ ID NO: 2575516 - DNA, 23 bp, Homo sapiens
tgaaggagccccattcctgggaa

SEQ ID NO: 2575517 - DNA, 16 bp, Homo sapiens
tgaaggccccgcccag

SEQ ID NO: 2575518 - DNA, 19 bp, Homo sapiens
tgaaggccccgcccaggct

SEQ ID NO: 2575519 - DNA, 20 bp, Homo sapiens
tgaaggctcgagcatgcctg

SEQ ID NO: 2575520 - DNA, 21 bp, Homo sapiens
tgaaggctcgagcatgcctgg

SEQ ID NO: 2575521 - DNA, 16 bp, Homo sapiens
tgaaggctgggttctg

SEQ ID NO: 2575522 - DNA, 20 bp, Homo sapiens
tgaaggctgggttctgatcc

SEQ ID NO: 2575523 - DNA, 13 bp, Homo sapiens
tgaaggcttctct

SEQ ID NO: 2575524 - DNA, 15 bp, Homo sapiens
tgaaggcttctctct

SEQ ID NO: 2575525 - DNA, 17 bp, Homo sapiens
tgaagggagagccagct

SEQ ID NO: 2575526 - DNA, 21 bp, Homo sapiens
tgaaggtaaaattgaaaggca

SEQ ID NO: 2575527 - DNA, 22 bp, Homo sapiens
tgaaggtcactcttcctgcaag

SEQ ID NO: 2575528 - DNA, 20 bp, Homo sapiens
tgaaggttaggatttaacag

SEQ ID NO: 2575529 - DNA, 18 bp, Homo sapiens
tgaaggtttctgaaaatt

SEQ ID NO: 2575530 - DNA, 13 bp, Homo sapiens
tgaagtaagcaaa

SEQ ID NO: 2575531 - DNA, 14 bp, Homo sapiens
tgaagtaagcaaag

SEQ ID NO: 2575532 - DNA, 13 bp, Homo sapiens
tgaagtacatatt

SEQ ID NO: 2575533 - DNA, 20 bp, Homo sapiens
tgaagtacatattaggaaaa

SEQ ID NO: 2575534 - DNA, 18 bp, Homo sapiens
tgaagtacccgttcacat

SEQ ID NO: 2575535 - DNA, 22 bp, Homo sapiens
tgaagtatataatggtttcaaa

SEQ ID NO: 2575536 - DNA, 17 bp, Homo sapiens
tgaagtatttctcactc

SEQ ID NO: 2575537 - DNA, 13 bp, Homo sapiens
tgaagtcacacag

SEQ ID NO: 2575538 - DNA, 13 bp, Homo sapiens
tgaagtctgaaat

SEQ ID NO: 2575539 - DNA, 16 bp, Homo sapiens
tgaagtgcatccaaag

SEQ ID NO: 2575540 - DNA, 17 bp, Homo sapiens
tgaagtgttaatactag

SEQ ID NO: 2575541 - DNA, 14 bp, Homo sapiens
tgaagttagaattc

SEQ ID NO: 2575542 - DNA, 15 bp, Homo sapiens
tgaagttagaattcc

SEQ ID NO: 2575543 - DNA, 19 bp, Homo sapiens
tgaagttagaattccttca

SEQ ID NO: 2575544 - DNA, 21 bp, Homo sapiens
tgaagttagaattccttcagg

SEQ ID NO: 2575545 - DNA, 14 bp, Homo sapiens
tgaagtttcacatg

SEQ ID NO: 2575546 - DNA, 21 bp, Homo sapiens
tgaagtttccttggctggtgc

SEQ ID NO: 2575547 - DNA, 15 bp, Homo sapiens
tgaataaaattattt

SEQ ID NO: 2575548 - DNA, 17 bp, Homo sapiens
tgaataaagttgaagct

SEQ ID NO: 2575549 - DNA, 12 bp, Homo sapiens
tgaataatacag

SEQ ID NO: 2575550 - DNA, 14 bp, Homo sapiens
tgaataatttccca

SEQ ID NO: 2575551 - DNA, 17 bp, Homo sapiens
tgaatacaaacaatgga

SEQ ID NO: 2575552 - DNA, 22 bp, Homo sapiens
tgaatacaaacaatggaaactg

SEQ ID NO: 2575553 - DNA, 21 bp, Homo sapiens
tgaatatacagcaggtgctca

SEQ ID NO: 2575554 - DNA, 19 bp, Homo sapiens
tgaatatttatatttcact

SEQ ID NO: 2575555 - DNA, 19 bp, Homo sapiens
tgaatcaataatatatttt

SEQ ID NO: 2575556 - DNA, 16 bp, Homo sapiens
tgaatcacctaggggt

SEQ ID NO: 2575557 - DNA, 19 bp, Homo sapiens
tgaatcatggtttttctta

SEQ ID NO: 2575558 - DNA, 21 bp, Homo sapiens
tgaatcatgtagtatcaaata

SEQ ID NO: 2575559 - DNA, 15 bp, Homo sapiens
tgaatccaaactaat

SEQ ID NO: 2575560 - DNA, 16 bp, Homo sapiens
tgaatccaaactaatc

SEQ ID NO: 2575561 - DNA, 20 bp, Homo sapiens
tgaatcccacccacatgtga

SEQ ID NO: 2575562 - DNA, 21 bp, Homo sapiens
tgaatcccacgcttctctttg

SEQ ID NO: 2575563 - DNA, 10 bp, Homo sapiens
tgaatcctac

SEQ ID NO: 2575564 - DNA, 15 bp, Homo sapiens
tgaatcgcttctctt

SEQ ID NO: 2575565 - DNA, 19 bp, Homo sapiens
tgaatctattatactgtat

SEQ ID NO: 2575566 - DNA, 16 bp, Homo sapiens
tgaatcttggtgtcta

SEQ ID NO: 2575567 - DNA, 18 bp, Homo sapiens
tgaatgaaaaatttaagc

SEQ ID NO: 2575568 - DNA, 15 bp, Homo sapiens
tgaatgacaaagagt

SEQ ID NO: 2575569 - DNA, 15 bp, Homo sapiens
tgaatgacaacagaa

SEQ ID NO: 2575570 - DNA, 22 bp, Homo sapiens
tgaatgaggtcagcatgtctat

SEQ ID NO: 2575571 - DNA, 22 bp, Homo sapiens
tgaatgaggtcccaggcagaga

SEQ ID NO: 2575572 - DNA, 16 bp, Homo sapiens
tgaatgattcagtgtt

SEQ ID NO: 2575573 - DNA, 19 bp, Homo sapiens
tgaatgcaccatggtcaaa

SEQ ID NO: 2575574 - DNA, 15 bp, Homo sapiens
tgaatgcataaaatg

SEQ ID NO: 2575575 - DNA, 13 bp, Homo sapiens
tgaatgcggccca

SEQ ID NO: 2575576 - DNA, 15 bp, Homo sapiens
tgaatggattggatt

SEQ ID NO: 2575577 - DNA, 19 bp, Homo sapiens
tgaatgggcaaaactgaat

SEQ ID NO: 2575578 - DNA, 20 bp, Homo sapiens
tgaatggtatggaactctct

SEQ ID NO: 2575579 - DNA, 18 bp, Homo sapiens
tgaatgtatgtgcactgt

SEQ ID NO: 2575580 - DNA, 17 bp, Homo sapiens
tgaatgttctgacatta

SEQ ID NO: 2575581 - DNA, 20 bp, Homo sapiens
tgaatgttctgacattaaca

SEQ ID NO: 2575582 - DNA, 21 bp, Homo sapiens
tgaatgttctgacattaacag

SEQ ID NO: 2575583 - DNA, 23 bp, Homo sapiens
tgaatgttctgacattaacagtt

SEQ ID NO: 2575584 - DNA, 21 bp, Homo sapiens
tgaatgttgtctgtttgttct

SEQ ID NO: 2575585 - DNA, 19 bp, Homo sapiens
tgaatgtttacactctttg

SEQ ID NO: 2575586 - DNA, 22 bp, Homo sapiens
tgaatgtttacactctttgtaa

SEQ ID NO: 2575587 - DNA, 11 bp, Homo sapiens
tgaattaaatt

SEQ ID NO: 2575588 - DNA, 22 bp, Homo sapiens
tgaattcttggttgaggaaaca

SEQ ID NO: 2575589 - DNA, 17 bp, Homo sapiens
tgaattgtgaccaagtt

SEQ ID NO: 2575590 - DNA, 12 bp, Homo sapiens
tgaatttaaata

SEQ ID NO: 2575591 - DNA, 13 bp, Homo sapiens
tgaatttctaaaa

SEQ ID NO: 2575592 - DNA, 13 bp, Homo sapiens
tgaatttgaatga

SEQ ID NO: 2575593 - DNA, 17 bp, Homo sapiens
tgaatttgaatgaaaaa

SEQ ID NO: 2575594 - DNA, 19 bp, Homo sapiens
tgaatttgaatgaaaaatt

SEQ ID NO: 2575595 - DNA, 14 bp, Homo sapiens
tgaatttggagact

SEQ ID NO: 2575596 - DNA, 21 bp, Homo sapiens
tgaatttggcctgcactaatt

SEQ ID NO: 2575597 - DNA, 14 bp, Homo sapiens
tgaattttctgtgt

SEQ ID NO: 2575598 - DNA, 17 bp, Homo sapiens
tgagccccaagtcctga

SEQ ID NO: 2575599 - DNA, 22 bp, Homo sapiens
tgagccccaagtcctgaagagg

SEQ ID NO: 2575600 - DNA, 20 bp, Homo sapiens
tgagcccccccaacactgtg

SEQ ID NO: 2575601 - DNA, 22 bp, Homo sapiens
tgagcccccccaacactgtgcc

SEQ ID NO: 2575602 - DNA, 21 bp, Homo sapiens
tgagcccctaccccacaccag

SEQ ID NO: 2575603 - DNA, 15 bp, Homo sapiens
tgagcccctggaggc

SEQ ID NO: 2575604 - DNA, 15 bp, Homo sapiens
tgagcccctggtcct

SEQ ID NO: 2575605 - DNA, 12 bp, Homo sapiens
tgagccccttcc

SEQ ID NO: 2575606 - DNA, 14 bp, Homo sapiens
tgagccccttcctt

SEQ ID NO: 2575607 - DNA, 17 bp, Homo sapiens
tgagcccggatgcttct

SEQ ID NO: 2575608 - DNA, 13 bp, Homo sapiens
tgagcccgggctg

SEQ ID NO: 2575609 - DNA, 17 bp, Homo sapiens
tgagcccgggctgcctg

SEQ ID NO: 2575610 - DNA, 18 bp, Homo sapiens
tgagcccgggctgcctgg

SEQ ID NO: 2575611 - DNA, 20 bp, Homo sapiens
tgagcccgggctgcctgggc

SEQ ID NO: 2575612 - DNA, 19 bp, Homo sapiens
tgagccgagatcacgccac

SEQ ID NO: 2575613 - DNA, 21 bp, Homo sapiens
tgagccgagatcacgccactg

SEQ ID NO: 2575614 - DNA, 22 bp, Homo sapiens
tgagccgagatcacgccactgc

SEQ ID NO: 2575615 - DNA, 21 bp, Homo sapiens
tgagccgctgtgagcccctgg

SEQ ID NO: 2575616 - DNA, 16 bp, Homo sapiens
tgagcctacgctgaag

SEQ ID NO: 2575617 - DNA, 14 bp, Homo sapiens
tgagccttcagtct

SEQ ID NO: 2575618 - DNA, 19 bp, Homo sapiens
tgagccttgaactttgacc

SEQ ID NO: 2575619 - DNA, 13 bp, Homo sapiens
tgagccttgtaat

SEQ ID NO: 2575620 - DNA, 13 bp, Homo sapiens
tgagcgacagtga

SEQ ID NO: 2575621 - DNA, 14 bp, Homo sapiens
tgagcgacagtgag

SEQ ID NO: 2575622 - DNA, 22 bp, Homo sapiens
tgagcgaggagatgctccttgg

SEQ ID NO: 2575623 - DNA, 23 bp, Homo sapiens
tgagcgaggagatgctccttggg

SEQ ID NO: 2575624 - DNA, 23 bp, Homo sapiens
tgagcgattattatctaaagtgt

SEQ ID NO: 2575625 - DNA, 19 bp, Homo sapiens
tgagctagaagctggagga

SEQ ID NO: 2575626 - DNA, 19 bp, Homo sapiens
tgagctatttccattccag

SEQ ID NO: 2575627 - DNA, 21 bp, Homo sapiens
tgagctatttccattccagaa

SEQ ID NO: 2575628 - DNA, 14 bp, Homo sapiens
tgagctccagaccc

SEQ ID NO: 2575629 - DNA, 20 bp, Homo sapiens
tgagctccagacccccagca

SEQ ID NO: 2575630 - DNA, 16 bp, Homo sapiens
tgagctccccaaaaac

SEQ ID NO: 2575631 - DNA, 16 bp, Homo sapiens
tgagctcctctgggca

SEQ ID NO: 2575632 - DNA, 21 bp, Homo sapiens
tgagctggaaggagtgagagg

SEQ ID NO: 2575633 - DNA, 22 bp, Homo sapiens
tgagctggggacctggtaccct

SEQ ID NO: 2575634 - DNA, 16 bp, Homo sapiens
tgagcttagtgaaatt

SEQ ID NO: 2575635 - DNA, 14 bp, Homo sapiens
tgagcttggccaga

SEQ ID NO: 2575636 - DNA, 15 bp, Homo sapiens
tgagcttggccagaa

SEQ ID NO: 2575637 - DNA, 18 bp, Homo sapiens
tgaggaagccgctggggc

SEQ ID NO: 2575638 - DNA, 21 bp, Homo sapiens
tgaggaagccgctggggccag

SEQ ID NO: 2575639 - DNA, 20 bp, Homo sapiens
tgaggaaggcaggaagagag

SEQ ID NO: 2575640 - DNA, 21 bp, Homo sapiens
tgaggaatccagacccggctg

SEQ ID NO: 2575641 - DNA, 16 bp, Homo sapiens
tgaggaatgatgaagc

SEQ ID NO: 2575642 - DNA, 22 bp, Homo sapiens
tgaggaatttcacctgtaaacc

SEQ ID NO: 2575643 - DNA, 14 bp, Homo sapiens
tgaggaattttctt

SEQ ID NO: 2575644 - DNA, 14 bp, Homo sapiens
tgaggacagctgtc

SEQ ID NO: 2575645 - DNA, 15 bp, Homo sapiens
tgaggacagctgtcc

SEQ ID NO: 2575646 - DNA, 17 bp, Homo sapiens
tgaggacagctgtcctc

SEQ ID NO: 2575647 - DNA, 21 bp, Homo sapiens
tgaggacatgtttttgttttc

SEQ ID NO: 2575648 - DNA, 14 bp, Homo sapiens
tgaggagccccagc

SEQ ID NO: 2575649 - DNA, 12 bp, Homo sapiens
tgaggagctgct

SEQ ID NO: 2575650 - DNA, 14 bp, Homo sapiens
tgaggagctgctgg

SEQ ID NO: 2575651 - DNA, 16 bp, Homo sapiens
tgaggagctgctggct

SEQ ID NO: 2575652 - DNA, 17 bp, Homo sapiens
tgaggagctgctggctt

SEQ ID NO: 2575653 - DNA, 17 bp, Homo sapiens
tgaggaggcctccatct

SEQ ID NO: 2575654 - DNA, 20 bp, Homo sapiens
tgaggatatattttcacttt

SEQ ID NO: 2575655 - DNA, 14 bp, Homo sapiens
tgaggatgaggccg

SEQ ID NO: 2575656 - DNA, 13 bp, Homo sapiens
tgaggatttcaag

SEQ ID NO: 2575657 - DNA, 14 bp, Homo sapiens
tgaggcaagagaat

SEQ ID NO: 2575658 - DNA, 13 bp, Homo sapiens
tgaggcagacagc

SEQ ID NO: 2575659 - DNA, 15 bp, Homo sapiens
tgaggcagacagcag

SEQ ID NO: 2575660 - DNA, 17 bp, Homo sapiens
tgaggcagacagcagct

SEQ ID NO: 2575661 - DNA, 22 bp, Homo sapiens
tgaggccactgctgcttctcca

SEQ ID NO: 2575662 - DNA, 20 bp, Homo sapiens
tgaggcccagagggcctgca

SEQ ID NO: 2575663 - DNA, 22 bp, Homo sapiens
tgaggcccagagggcctgcaag

SEQ ID NO: 2575664 - DNA, 23 bp, Homo sapiens
tgaggcccagagggcctgcaagg

SEQ ID NO: 2575665 - DNA, 14 bp, Homo sapiens
tgaggcccagggag

SEQ ID NO: 2575666 - DNA, 16 bp, Homo sapiens
tgaggcccttctctcc

SEQ ID NO: 2575667 - DNA, 19 bp, Homo sapiens
tgaggcccttctctccagc

SEQ ID NO: 2575668 - DNA, 23 bp, Homo sapiens
tgaggcccttctctccagcccct

SEQ ID NO: 2575669 - DNA, 18 bp, Homo sapiens
tgaggccgctagaggcct

SEQ ID NO: 2575670 - DNA, 22 bp, Homo sapiens
tgaggcctccagcttcaggcag

SEQ ID NO: 2575671 - DNA, 15 bp, Homo sapiens
tgaggcctcttggac

SEQ ID NO: 2575672 - DNA, 17 bp, Homo sapiens
tgaggcctggccaggca

SEQ ID NO: 2575673 - DNA, 23 bp, Homo sapiens
tgaggcgggtggatcacctgagg

SEQ ID NO: 2575674 - DNA, 17 bp, Homo sapiens
tgaggctagtgtggtgt

SEQ ID NO: 2575675 - DNA, 21 bp, Homo sapiens
tgaggctctgacccagtgaga

SEQ ID NO: 2575676 - DNA, 12 bp, Homo sapiens
tgaggctgggaa

SEQ ID NO: 2575677 - DNA, 10 bp, Homo sapiens
tgaggctgta

SEQ ID NO: 2575678 - DNA, 23 bp, Homo sapiens
tgaggcttagctttgctctgcca

SEQ ID NO: 2575679 - DNA, 21 bp, Homo sapiens
tgaggcttgctgagaggggct

SEQ ID NO: 2575680 - DNA, 13 bp, Homo sapiens
tgagggactctga

SEQ ID NO: 2575681 - DNA, 18 bp, Homo sapiens
tgagggccaagaaagagt

SEQ ID NO: 2575682 - DNA, 12 bp, Homo sapiens
tgagggcccaga

SEQ ID NO: 2575683 - DNA, 18 bp, Homo sapiens
tgagggcccagagcagga

SEQ ID NO: 2575684 - DNA, 20 bp, Homo sapiens
tgagggcccagagcaggaag

SEQ ID NO: 2575685 - DNA, 15 bp, Homo sapiens
tgagggcccctctgc

SEQ ID NO: 2575686 - DNA, 21 bp, Homo sapiens
tgagggcccctctgcccagct

SEQ ID NO: 2575687 - DNA, 22 bp, Homo sapiens
tgaggggcatctgcccctcccc

SEQ ID NO: 2575688 - DNA, 13 bp, Homo sapiens
tgaggggcctctt

SEQ ID NO: 2575689 - DNA, 22 bp, Homo sapiens
tgaggggctggccttcctgccc

SEQ ID NO: 2575690 - DNA, 20 bp, Homo sapiens
tgaggggggccgtgcccagg

SEQ ID NO: 2575691 - DNA, 14 bp, Homo sapiens
tgaggggtccctga

SEQ ID NO: 2575692 - DNA, 19 bp, Homo sapiens
tgagggtccccacctggga

SEQ ID NO: 2575693 - DNA, 20 bp, Homo sapiens
tgaggtcaagtaagaagaca

SEQ ID NO: 2575694 - DNA, 16 bp, Homo sapiens
tgaggtcaggagttcc

SEQ ID NO: 2575695 - DNA, 23 bp, Homo sapiens
tgaggtccagccctggctgaagg

SEQ ID NO: 2575696 - DNA, 15 bp, Homo sapiens
tgaggtcccaggcag

SEQ ID NO: 2575697 - DNA, 19 bp, Homo sapiens
tgaggtcccaggcagagaa

SEQ ID NO: 2575698 - DNA, 14 bp, Homo sapiens
tgaggtctgttctt

SEQ ID NO: 2575699 - DNA, 22 bp, Homo sapiens
tgaggtcttttgacatgtggaa

SEQ ID NO: 2575700 - DNA, 17 bp, Homo sapiens
tgaggtgaaagggagct

SEQ ID NO: 2575701 - DNA, 15 bp, Homo sapiens
tgaggtgctatgttc

SEQ ID NO: 2575702 - DNA, 14 bp, Homo sapiens
tgaggtggcacttt

SEQ ID NO: 2575703 - DNA, 18 bp, Homo sapiens
tgaggtggcactttttca

SEQ ID NO: 2575704 - DNA, 20 bp, Homo sapiens
tgaggtggcactttttcatt

SEQ ID NO: 2575705 - DNA, 21 bp, Homo sapiens
tgaggtggcactttttcattt

SEQ ID NO: 2575706 - DNA, 16 bp, Homo sapiens
tgaggtgggcccagga

SEQ ID NO: 2575707 - DNA, 20 bp, Homo sapiens
tgaggtgggcccaggaccag

SEQ ID NO: 2575708 - DNA, 22 bp, Homo sapiens
tgaggtggtctgaatgttctga

SEQ ID NO: 2575709 - DNA, 16 bp, Homo sapiens
tgaggttgctagagaa

SEQ ID NO: 2575710 - DNA, 19 bp, Homo sapiens
tgagtaagaaatgctgccc

SEQ ID NO: 2575711 - DNA, 17 bp, Homo sapiens
tgagtactacagtcctc

SEQ ID NO: 2575712 - DNA, 21 bp, Homo sapiens
tgagtactacagtcctcccat

SEQ ID NO: 2575713 - DNA, 22 bp, Homo sapiens
tgagtactacagtcctcccatc

SEQ ID NO: 2575714 - DNA, 21 bp, Homo sapiens
tgagtatcctttcagtgttat

SEQ ID NO: 2575715 - DNA, 15 bp, Homo sapiens
tgagtatctcctcgc

SEQ ID NO: 2575716 - DNA, 15 bp, Homo sapiens
tgagtcaaaaaatct

SEQ ID NO: 2575717 - DNA, 22 bp, Homo sapiens
tgagtcaccctacctgtgcctg

SEQ ID NO: 2575718 - DNA, 14 bp, Homo sapiens
tgagtccttaaaca

SEQ ID NO: 2575719 - DNA, 15 bp, Homo sapiens
tgagtccttgaaaat

SEQ ID NO: 2575720 - DNA, 15 bp, Homo sapiens
tgagtcgaggacagg

SEQ ID NO: 2575721 - DNA, 16 bp, Homo sapiens
tgagtcgaggacaggg

SEQ ID NO: 2575722 - DNA, 19 bp, Homo sapiens
tgagtcgtacagaaagctg

SEQ ID NO: 2575723 - DNA, 14 bp, Homo sapiens
tgagtgagcatgcc

SEQ ID NO: 2575724 - DNA, 13 bp, Homo sapiens
tgagtggactgga

SEQ ID NO: 2575725 - DNA, 20 bp, Homo sapiens
tgagtggactggagtggagc

SEQ ID NO: 2575726 - DNA, 21 bp, Homo sapiens
tgagtggggttatctctgtgt

SEQ ID NO: 2575727 - DNA, 15 bp, Homo sapiens
tgagtgtaagtgtga

SEQ ID NO: 2575728 - DNA, 12 bp, Homo sapiens
tgagtgtggaag

SEQ ID NO: 2575729 - DNA, 20 bp, Homo sapiens
tgagttatatgttcactgtc

SEQ ID NO: 2575730 - DNA, 19 bp, Homo sapiens
tgagttctcagggctcctg

SEQ ID NO: 2575731 - DNA, 23 bp, Homo sapiens
tgagttgacttgacagaacactg

SEQ ID NO: 2575732 - DNA, 16 bp, Homo sapiens
tgagttgatagcacag

SEQ ID NO: 2575733 - DNA, 20 bp, Homo sapiens
tgagttgatagcacagaccc

SEQ ID NO: 2575734 - DNA, 21 bp, Homo sapiens
tgagttgatagcacagaccct

SEQ ID NO: 2575735 - DNA, 16 bp, Homo sapiens
tgagttgattcagctc

SEQ ID NO: 2575736 - DNA, 16 bp, Homo sapiens
tgagttggctgggaat

SEQ ID NO: 2575737 - DNA, 17 bp, Homo sapiens
tgagttggctgggaata

SEQ ID NO: 2575738 - DNA, 18 bp, Homo sapiens
tgagttgttgccctgggt

SEQ ID NO: 2575739 - DNA, 19 bp, Homo sapiens
tgagtttctctcacattac

SEQ ID NO: 2575740 - DNA, 22 bp, Homo sapiens
tgagtttgcttatgtaatctca

SEQ ID NO: 2575741 - DNA, 17 bp, Homo sapiens
tgagttttcttctgtga

SEQ ID NO: 2575742 - DNA, 12 bp, Homo sapiens
tgcattatctag

SEQ ID NO: 2575743 - DNA, 14 bp, Homo sapiens
tgcattcacccaga

SEQ ID NO: 2575744 - DNA, 16 bp, Homo sapiens
tgcattgaatatatta

SEQ ID NO: 2575745 - DNA, 18 bp, Homo sapiens
tgcattgtatcgatgtta

SEQ ID NO: 2575746 - DNA, 15 bp, Homo sapiens
tgcatttaaaacaga

SEQ ID NO: 2575747 - DNA, 17 bp, Homo sapiens
tgcatttaaaacagaca

SEQ ID NO: 2575748 - DNA, 19 bp, Homo sapiens
tgcatttaaaacagacact

SEQ ID NO: 2575749 - DNA, 16 bp, Homo sapiens
tgcatttaaaagatac

SEQ ID NO: 2575750 - DNA, 16 bp, Homo sapiens
tgcatttaaatacagt

SEQ ID NO: 2575751 - DNA, 19 bp, Homo sapiens
tgcatttgaggtctgttct

SEQ ID NO: 2575752 - DNA, 20 bp, Homo sapiens
tgcatttgaggtctgttctt

SEQ ID NO: 2575753 - DNA, 16 bp, Homo sapiens
tgcatttggtcaagat

SEQ ID NO: 2575754 - DNA, 16 bp, Homo sapiens
tgcattttgctattgt

SEQ ID NO: 2575755 - DNA, 19 bp, Homo sapiens
tgcattttgctattgtaaa

SEQ ID NO: 2575756 - DNA, 22 bp, Homo sapiens
tgcattttgctattgtaaatat

SEQ ID NO: 2575757 - DNA, 19 bp, Homo sapiens
tgcatttttgtgaaatgaa

SEQ ID NO: 2575758 - DNA, 21 bp, Homo sapiens
tgccaaagctagggtggccct

SEQ ID NO: 2575759 - DNA, 22 bp, Homo sapiens
tgccaaagctagggtggccctt

SEQ ID NO: 2575760 - DNA, 21 bp, Homo sapiens
tgccaacactcaagaagcagg

SEQ ID NO: 2575761 - DNA, 23 bp, Homo sapiens
tgccaactgttgtaactaggctc

SEQ ID NO: 2575762 - DNA, 17 bp, Homo sapiens
tgccaagcactgtgctc

SEQ ID NO: 2575763 - DNA, 15 bp, Homo sapiens
tgccaagctcaggac

SEQ ID NO: 2575764 - DNA, 22 bp, Homo sapiens
tgccaaggccagagtggcctgg

SEQ ID NO: 2575765 - DNA, 21 bp, Homo sapiens
tgccaagggctttgttttgca

SEQ ID NO: 2575766 - DNA, 15 bp, Homo sapiens
tgccaagttgtttga

SEQ ID NO: 2575767 - DNA, 14 bp, Homo sapiens
tgccaatggaacct

SEQ ID NO: 2575768 - DNA, 13 bp, Homo sapiens
tgccaatggacta

SEQ ID NO: 2575769 - DNA, 19 bp, Homo sapiens
tgccaatttttgccttcat

SEQ ID NO: 2575770 - DNA, 20 bp, Homo sapiens
tgccacacagagtggtcttt

SEQ ID NO: 2575771 - DNA, 13 bp, Homo sapiens
tgccacaccctcc

SEQ ID NO: 2575772 - DNA, 22 bp, Homo sapiens
tgccacaccctcccccgccact

SEQ ID NO: 2575773 - DNA, 16 bp, Homo sapiens
tgccacagagcgggga

SEQ ID NO: 2575774 - DNA, 12 bp, Homo sapiens
tgccacagctct

SEQ ID NO: 2575775 - DNA, 12 bp, Homo sapiens
tgccaccaggag

SEQ ID NO: 2575776 - DNA, 19 bp, Homo sapiens
tgccaccatcctgctgctg

SEQ ID NO: 2575777 - DNA, 17 bp, Homo sapiens
tgccacccaccagggcg

SEQ ID NO: 2575778 - DNA, 14 bp, Homo sapiens
tgccaccccaccct

SEQ ID NO: 2575779 - DNA, 16 bp, Homo sapiens
tgccaccccaccctcc

SEQ ID NO: 2575780 - DNA, 21 bp, Homo sapiens
tgccaccccaccctccctgga

SEQ ID NO: 2575781 - DNA, 23 bp, Homo sapiens
tgccaccccaccctccctggagt

SEQ ID NO: 2575782 - DNA, 12 bp, Homo sapiens
tgccaccctacc

SEQ ID NO: 2575783 - DNA, 16 bp, Homo sapiens
tgccaccctcatgctg

SEQ ID NO: 2575784 - DNA, 19 bp, Homo sapiens
tgccaccctggggagaaag

SEQ ID NO: 2575785 - DNA, 22 bp, Homo sapiens
tgccactacggaatagttggct

SEQ ID NO: 2575786 - DNA, 15 bp, Homo sapiens
tgccactagggctct

SEQ ID NO: 2575787 - DNA, 18 bp, Homo sapiens
tgccactcacacagccag

SEQ ID NO: 2575788 - DNA, 19 bp, Homo sapiens
tgccactcacacagccagg

SEQ ID NO: 2575789 - DNA, 22 bp, Homo sapiens
tgccactcacacagccaggtgc

SEQ ID NO: 2575790 - DNA, 19 bp, Homo sapiens
tgccactgcccgagctggt

SEQ ID NO: 2575791 - DNA, 20 bp, Homo sapiens
tgccactgcccgagctggtg

SEQ ID NO: 2575792 - DNA, 21 bp, Homo sapiens
tgccactgcccgagctggtgc

SEQ ID NO: 2575793 - DNA, 12 bp, Homo sapiens
tgccacttttta

SEQ ID NO: 2575794 - DNA, 14 bp, Homo sapiens
tgccagaacagttt

SEQ ID NO: 2575795 - DNA, 18 bp, Homo sapiens
tgccagaacagtttgtac

SEQ ID NO: 2575796 - DNA, 19 bp, Homo sapiens
tgccagaacagtttgtaca

SEQ ID NO: 2575797 - DNA, 12 bp, Homo sapiens
tgccagacatgt

SEQ ID NO: 2575798 - DNA, 21 bp, Homo sapiens
tgccagagacggaagcctttt

SEQ ID NO: 2575799 - DNA, 17 bp, Homo sapiens
tgccagaggtgggcagg

SEQ ID NO: 2575800 - DNA, 20 bp, Homo sapiens
tgccagaggtgggcaggtgg

SEQ ID NO: 2575801 - DNA, 21 bp, Homo sapiens
tgccagatgcctttatggctg

SEQ ID NO: 2575802 - DNA, 12 bp, Homo sapiens
tgccagatgctg

SEQ ID NO: 2575803 - DNA, 22 bp, Homo sapiens
tgccagatgctgatgttcagtg

SEQ ID NO: 2575804 - DNA, 14 bp, Homo sapiens
tgccagcaactgaa

SEQ ID NO: 2575805 - DNA, 14 bp, Homo sapiens
tgccagccttcctc

SEQ ID NO: 2575806 - DNA, 17 bp, Homo sapiens
tgccagccttcctctgc

SEQ ID NO: 2575807 - DNA, 19 bp, Homo sapiens
tgccagcttttcctccctt

SEQ ID NO: 2575808 - DNA, 20 bp, Homo sapiens
tgccaggaccagtcaacctg

SEQ ID NO: 2575809 - DNA, 22 bp, Homo sapiens
tgccaggactccccaggccagg

SEQ ID NO: 2575810 - DNA, 18 bp, Homo sapiens
tgccaggatggaatgatg

SEQ ID NO: 2575811 - DNA, 10 bp, Homo sapiens
tgccaggcat

SEQ ID NO: 2575812 - DNA, 14 bp, Homo sapiens
tgccaggcatggtg

SEQ ID NO: 2575813 - DNA, 11 bp, Homo sapiens
tgccagggaca

SEQ ID NO: 2575814 - DNA, 12 bp, Homo sapiens
tgccagggcagg

SEQ ID NO: 2575815 - DNA, 23 bp, Homo sapiens
tgccagggtttcgagaagctgct

SEQ ID NO: 2575816 - DNA, 18 bp, Homo sapiens
tgccaggtttttggtctg

SEQ ID NO: 2575817 - DNA, 22 bp, Homo sapiens
tgccaggtttttggtctgaccc

SEQ ID NO: 2575818 - DNA, 22 bp, Homo sapiens
tgccagtaggctcaactaggga

SEQ ID NO: 2575819 - DNA, 15 bp, Homo sapiens
tgccagtcaccccgg

SEQ ID NO: 2575820 - DNA, 22 bp, Homo sapiens
tgccagtcaccccggccacctg

SEQ ID NO: 2575821 - DNA, 23 bp, Homo sapiens
tgccagtcaccccggccacctgc

SEQ ID NO: 2575822 - DNA, 19 bp, Homo sapiens
tgccagttttgtttccttt

SEQ ID NO: 2575823 - DNA, 18 bp, Homo sapiens
tgccatactttgtctgaa

SEQ ID NO: 2575824 - DNA, 18 bp, Homo sapiens
tgccatagagtttaacac

SEQ ID NO: 2575825 - DNA, 16 bp, Homo sapiens
tgccatagtcacatgg

SEQ ID NO: 2575826 - DNA, 16 bp, Homo sapiens
tgccatattctgttgg

SEQ ID NO: 2575827 - DNA, 15 bp, Homo sapiens
tgccatcatctcctg

SEQ ID NO: 2575828 - DNA, 16 bp, Homo sapiens
tgccatcatctcctgc

SEQ ID NO: 2575829 - DNA, 16 bp, Homo sapiens
tgccatcatgtttaca

SEQ ID NO: 2575830 - DNA, 15 bp, Homo sapiens
tgccatccaggttca

SEQ ID NO: 2575831 - DNA, 20 bp, Homo sapiens
tgccatggacagaagaaggc

SEQ ID NO: 2575832 - DNA, 20 bp, Homo sapiens
tgccatgggcttcactgtat

SEQ ID NO: 2575833 - DNA, 16 bp, Homo sapiens
tgccatgtgaagaggg

SEQ ID NO: 2575834 - DNA, 14 bp, Homo sapiens
tgccatgtgccagg

SEQ ID NO: 2575835 - DNA, 15 bp, Homo sapiens
tgccatgtgccaggt

SEQ ID NO: 2575836 - DNA, 15 bp, Homo sapiens
tgccatgttggccag

SEQ ID NO: 2575837 - DNA, 17 bp, Homo sapiens
tgccatgttggccaggc

SEQ ID NO: 2575838 - DNA, 23 bp, Homo sapiens
tgccattatccctgaatccccct

SEQ ID NO: 2575839 - DNA, 18 bp, Homo sapiens
tgcccaacctgctctcct

SEQ ID NO: 2575840 - DNA, 22 bp, Homo sapiens
tgcccaacctgctctcctcttg

SEQ ID NO: 2575841 - DNA, 20 bp, Homo sapiens
tgcccaatatgcagttctgc

SEQ ID NO: 2575842 - DNA, 22 bp, Homo sapiens
tgcccaatatgcagttctgcag

SEQ ID NO: 2575843 - DNA, 15 bp, Homo sapiens
tgcccaattggagga

SEQ ID NO: 2575844 - DNA, 19 bp, Homo sapiens
tgcccacaggatcagtctg

SEQ ID NO: 2575845 - DNA, 16 bp, Homo sapiens
tgcccacatcccaggc

SEQ ID NO: 2575846 - DNA, 23 bp, Homo sapiens
tgcccacatcccaggcttcaccc

SEQ ID NO: 2575847 - DNA, 24 bp, Homo sapiens
tgcccaccccctcaagccaatccc

SEQ ID NO: 2575848 - DNA, 19 bp, Homo sapiens
tgcccacccgtggagatgg

SEQ ID NO: 2575849 - DNA, 20 bp, Homo sapiens
tgcccacccgtggagatggg

SEQ ID NO: 2575850 - DNA, 13 bp, Homo sapiens
tgcccactccctg

SEQ ID NO: 2575851 - DNA, 15 bp, Homo sapiens
tgcccactccctgca

SEQ ID NO: 2575852 - DNA, 21 bp, Homo sapiens
tgcccagagggcccaggcagg

SEQ ID NO: 2575853 - DNA, 21 bp, Homo sapiens
tgcccagctagctgcagagcc

SEQ ID NO: 2575854 - DNA, 20 bp, Homo sapiens
tgcccagcttgggcccagct

SEQ ID NO: 2575855 - DNA, 23 bp, Homo sapiens
tgcccagcttgggcccagctggg

SEQ ID NO: 2575856 - DNA, 13 bp, Homo sapiens
tgcccaggcaggt

SEQ ID NO: 2575857 - DNA, 15 bp, Homo sapiens
tgcccaggcaggtct

SEQ ID NO: 2575858 - DNA, 15 bp, Homo sapiens
tgcccaggcccagac

SEQ ID NO: 2575859 - DNA, 12 bp, Homo sapiens
tgcccaggcccc

SEQ ID NO: 2575860 - DNA, 15 bp, Homo sapiens
tgcccaggcctgcct

SEQ ID NO: 2575861 - DNA, 18 bp, Homo sapiens
tgcccaggctggagtgca

SEQ ID NO: 2575862 - DNA, 19 bp, Homo sapiens
tgcccaggctggcgtgcag

SEQ ID NO: 2575863 - DNA, 23 bp, Homo sapiens
tgcccaggctggcgtgcagtggt

SEQ ID NO: 2575864 - DNA, 19 bp, Homo sapiens
tgcccagggccactctgcc

SEQ ID NO: 2575865 - DNA, 21 bp, Homo sapiens
tgcccagggccactctgcctc

SEQ ID NO: 2575866 - DNA, 18 bp, Homo sapiens
tgcccagggctcagcctg

SEQ ID NO: 2575867 - DNA, 14 bp, Homo sapiens
tgcccaggggagcc

SEQ ID NO: 2575868 - DNA, 17 bp, Homo sapiens
tgcccaggggagccctc

SEQ ID NO: 2575869 - DNA, 19 bp, Homo sapiens
tgcccaggggtgccccctc

SEQ ID NO: 2575870 - DNA, 20 bp, Homo sapiens
tgcccaggtttctggtctct

SEQ ID NO: 2575871 - DNA, 21 bp, Homo sapiens
tgcccagtcgatatctcactt

SEQ ID NO: 2575872 - DNA, 20 bp, Homo sapiens
tgcccatcacagggttgggc

SEQ ID NO: 2575873 - DNA, 23 bp, Homo sapiens
tgcccatcacagggttgggccca

SEQ ID NO: 2575874 - DNA, 13 bp, Homo sapiens
tgcccatccctgg

SEQ ID NO: 2575875 - DNA, 15 bp, Homo sapiens
tgcccatgccaccgc

SEQ ID NO: 2575876 - DNA, 16 bp, Homo sapiens
tgcccatgggagctgg

SEQ ID NO: 2575877 - DNA, 14 bp, Homo sapiens
tgccccaaacaaat

SEQ ID NO: 2575878 - DNA, 21 bp, Homo sapiens
tgccccacctttattaaaatc

SEQ ID NO: 2575879 - DNA, 15 bp, Homo sapiens
tgccccagagctgtt

SEQ ID NO: 2575880 - DNA, 23 bp, Homo sapiens
tgccccagagctgtttatggcct

SEQ ID NO: 2575881 - DNA, 16 bp, Homo sapiens
tgccccagaggcctct

SEQ ID NO: 2575882 - DNA, 13 bp, Homo sapiens
tgccccagccaga

SEQ ID NO: 2575883 - DNA, 13 bp, Homo sapiens
tgccccagctctg

SEQ ID NO: 2575884 - DNA, 14 bp, Homo sapiens
tgccccagctctgg

SEQ ID NO: 2575885 - DNA, 15 bp, Homo sapiens
tgccccagggctccc

SEQ ID NO: 2575886 - DNA, 12 bp, Homo sapiens
tgcttgaggaaa

SEQ ID NO: 2575887 - DNA, 16 bp, Homo sapiens
tgcttgaggaaaacaa

SEQ ID NO: 2575888 - DNA, 16 bp, Homo sapiens
tgcttgcagtagattt

SEQ ID NO: 2575889 - DNA, 15 bp, Homo sapiens
tgcttgcctctctgt

SEQ ID NO: 2575890 - DNA, 15 bp, Homo sapiens
tgcttggaggaagga

SEQ ID NO: 2575891 - DNA, 19 bp, Homo sapiens
tgcttgggtggagaagcca

SEQ ID NO: 2575892 - DNA, 14 bp, Homo sapiens
tgcttgtacataat

SEQ ID NO: 2575893 - DNA, 22 bp, Homo sapiens
tgcttgtacataatgcgtgcat

SEQ ID NO: 2575894 - DNA, 19 bp, Homo sapiens
tgcttgttccctctccctg

SEQ ID NO: 2575895 - DNA, 22 bp, Homo sapiens
tgcttgttgggattcctgaccc

SEQ ID NO: 2575896 - DNA, 23 bp, Homo sapiens
tgcttgttgggattcctgaccca

SEQ ID NO: 2575897 - DNA, 14 bp, Homo sapiens
tgcttgtttacagc

SEQ ID NO: 2575898 - DNA, 19 bp, Homo sapiens
tgctttcatcttggtcaca

SEQ ID NO: 2575899 - DNA, 20 bp, Homo sapiens
tgctttccacacctggcact

SEQ ID NO: 2575900 - DNA, 21 bp, Homo sapiens
tgctttccgtggcactgcata

SEQ ID NO: 2575901 - DNA, 18 bp, Homo sapiens
tgctttcgaactgctagt

SEQ ID NO: 2575902 - DNA, 18 bp, Homo sapiens
tgctttctccattgtaaa

SEQ ID NO: 2575903 - DNA, 15 bp, Homo sapiens
tgctttctttcgttt

SEQ ID NO: 2575904 - DNA, 14 bp, Homo sapiens
tgctttgaagcagt

SEQ ID NO: 2575905 - DNA, 15 bp, Homo sapiens
tgctttgaagcagtt

SEQ ID NO: 2575906 - DNA, 19 bp, Homo sapiens
tgctttgaagcagttgtgt

SEQ ID NO: 2575907 - DNA, 18 bp, Homo sapiens
tgctttgactcacctgtt

SEQ ID NO: 2575908 - DNA, 13 bp, Homo sapiens
tgctttgcccagc

SEQ ID NO: 2575909 - DNA, 14 bp, Homo sapiens
tgctttgtgatttt

SEQ ID NO: 2575910 - DNA, 16 bp, Homo sapiens
tgctttgtgatttttg

SEQ ID NO: 2575911 - DNA, 13 bp, Homo sapiens
tgcttttctgtct

SEQ ID NO: 2575912 - DNA, 17 bp, Homo sapiens
tgcttttggtctgtgtg

SEQ ID NO: 2575913 - DNA, 18 bp, Homo sapiens
tggaaaaatgagagaagg

SEQ ID NO: 2575914 - DNA, 19 bp, Homo sapiens
tggaaaagaatacagaaag

SEQ ID NO: 2575915 - DNA, 15 bp, Homo sapiens
tggaaaaggaagact

SEQ ID NO: 2575916 - DNA, 19 bp, Homo sapiens
tggaaaagggtcttgggaa

SEQ ID NO: 2575917 - DNA, 21 bp, Homo sapiens
tggaaaagggtcttgggaaat

SEQ ID NO: 2575918 - DNA, 15 bp, Homo sapiens
tggaaaataaattat

SEQ ID NO: 2575919 - DNA, 16 bp, Homo sapiens
tggaaaataaattatt

SEQ ID NO: 2575920 - DNA, 21 bp, Homo sapiens
tggaaacccttaggacagggt

SEQ ID NO: 2575921 - DNA, 15 bp, Homo sapiens
tggaaacctgaaaaa

SEQ ID NO: 2575922 - DNA, 14 bp, Homo sapiens
tggaaacctgccct

SEQ ID NO: 2575923 - DNA, 17 bp, Homo sapiens
tggaaacctgccctgcc

SEQ ID NO: 2575924 - DNA, 21 bp, Homo sapiens
tggaaacctgccctgcctgag

SEQ ID NO: 2575925 - DNA, 24 bp, Homo sapiens
tggaaacctgccctgcctgagggc

SEQ ID NO: 2575926 - DNA, 18 bp, Homo sapiens
tggaaactctttaacttc

SEQ ID NO: 2575927 - DNA, 19 bp, Homo sapiens
tggaaagacagcttctcat

SEQ ID NO: 2575928 - DNA, 21 bp, Homo sapiens
tggaaagacttttccaaccct

SEQ ID NO: 2575929 - DNA, 14 bp, Homo sapiens
tggaaagcctctgc

SEQ ID NO: 2575930 - DNA, 18 bp, Homo sapiens
tggaaagcctctgctgcc

SEQ ID NO: 2575931 - DNA, 20 bp, Homo sapiens
tggaaagctcctagcagaga

SEQ ID NO: 2575932 - DNA, 13 bp, Homo sapiens
tggaaaggctcag

SEQ ID NO: 2575933 - DNA, 17 bp, Homo sapiens
tggaaaggctcagtctc

SEQ ID NO: 2575934 - DNA, 20 bp, Homo sapiens
tggaaaggctcagtctcagg

SEQ ID NO: 2575935 - DNA, 16 bp, Homo sapiens
tggaaagtgtaaagca

SEQ ID NO: 2575936 - DNA, 21 bp, Homo sapiens
tggaaagtgtaaagcattcca

SEQ ID NO: 2575937 - DNA, 23 bp, Homo sapiens
tggaaataaatgtatcatagaaa

SEQ ID NO: 2575938 - DNA, 22 bp, Homo sapiens
tggaaatacagttgttggcctc

SEQ ID NO: 2575939 - DNA, 21 bp, Homo sapiens
tggaaatagaaatttccagag

SEQ ID NO: 2575940 - DNA, 23 bp, Homo sapiens
tggaaatattcatgcttcttcct

SEQ ID NO: 2575941 - DNA, 17 bp, Homo sapiens
tggaaatgggcagagca

SEQ ID NO: 2575942 - DNA, 20 bp, Homo sapiens
tggaaattaagaagaaacta

SEQ ID NO: 2575943 - DNA, 17 bp, Homo sapiens
tggaaattcccttcatc

SEQ ID NO: 2575944 - DNA, 22 bp, Homo sapiens
tggaaattcccttcatctggaa

SEQ ID NO: 2575945 - DNA, 21 bp, Homo sapiens
tggaaatttgttataatgaat

SEQ ID NO: 2575946 - DNA, 23 bp, Homo sapiens
tggaaatttgttataatgaatga

SEQ ID NO: 2575947 - DNA, 21 bp, Homo sapiens
tggaacaatctaaaagtttaa

SEQ ID NO: 2575948 - DNA, 22 bp, Homo sapiens
tggaacacctaccaaaaaataa

SEQ ID NO: 2575949 - DNA, 19 bp, Homo sapiens
tggaacagattcacactgt

SEQ ID NO: 2575950 - DNA, 23 bp, Homo sapiens
tggaacagattcacactgtctgg

SEQ ID NO: 2575951 - DNA, 21 bp, Homo sapiens
tggaacccttttggcccccga

SEQ ID NO: 2575952 - DNA, 17 bp, Homo sapiens
tggaaccgcaggaagct

SEQ ID NO: 2575953 - DNA, 20 bp, Homo sapiens
tggaaccgcaggaagctgct

SEQ ID NO: 2575954 - DNA, 12 bp, Homo sapiens
tggaacctcctt

SEQ ID NO: 2575955 - DNA, 15 bp, Homo sapiens
tggaagacacattga

SEQ ID NO: 2575956 - DNA, 15 bp, Homo sapiens
tggaagaggggacag

SEQ ID NO: 2575957 - DNA, 19 bp, Homo sapiens
tggaagcatattgttatta

SEQ ID NO: 2575958 - DNA, 18 bp, Homo sapiens
tggaagctgccctgccca

SEQ ID NO: 2575959 - DNA, 14 bp, Homo sapiens
tggaaggaggcgca

SEQ ID NO: 2575960 - DNA, 17 bp, Homo sapiens
tggaagggtttgtggct

SEQ ID NO: 2575961 - DNA, 21 bp, Homo sapiens
tggaaggtttgtatattgtca

SEQ ID NO: 2575962 - DNA, 20 bp, Homo sapiens
tggaagtaaccatttgcact

SEQ ID NO: 2575963 - DNA, 18 bp, Homo sapiens
tggaagtgagggtcagag

SEQ ID NO: 2575964 - DNA, 21 bp, Homo sapiens
tggaagtgagggtcagagagg

SEQ ID NO: 2575965 - DNA, 20 bp, Homo sapiens
tggaagtgtgggtctgtgtg

SEQ ID NO: 2575966 - DNA, 23 bp, Homo sapiens
tggaagtgtgggtctgtgtgtgt

SEQ ID NO: 2575967 - DNA, 16 bp, Homo sapiens
tggaagttgcatggca

SEQ ID NO: 2575968 - DNA, 15 bp, Homo sapiens
tggaagttttcagga

SEQ ID NO: 2575969 - DNA, 15 bp, Homo sapiens
tggaataaaatacta

SEQ ID NO: 2575970 - DNA, 19 bp, Homo sapiens
tggaataacatgtaattaa

SEQ ID NO: 2575971 - DNA, 14 bp, Homo sapiens
tggaatacagtgtt

SEQ ID NO: 2575972 - DNA, 22 bp, Homo sapiens
tggaatacagtgttattttctt

SEQ ID NO: 2575973 - DNA, 15 bp, Homo sapiens
tggaatacatgaaat

SEQ ID NO: 2575974 - DNA, 20 bp, Homo sapiens
tggaatagtatcctccaggt

SEQ ID NO: 2575975 - DNA, 21 bp, Homo sapiens
tggaatagtatcctccaggtt

SEQ ID NO: 2575976 - DNA, 18 bp, Homo sapiens
tggaatataaggaaagca

SEQ ID NO: 2575977 - DNA, 15 bp, Homo sapiens
tggaatatataacca

SEQ ID NO: 2575978 - DNA, 23 bp, Homo sapiens
tggaatattcccctatctctaga

SEQ ID NO: 2575979 - DNA, 17 bp, Homo sapiens
tggaatgcttcctagaa

SEQ ID NO: 2575980 - DNA, 24 bp, Homo sapiens
tggaatgcttcctagaagttactg

SEQ ID NO: 2575981 - DNA, 18 bp, Homo sapiens
tggaatgcttcttctcag

SEQ ID NO: 2575982 - DNA, 13 bp, Homo sapiens
tggaatgcttgaa

SEQ ID NO: 2575983 - DNA, 16 bp, Homo sapiens
tggaattaacctggtg

SEQ ID NO: 2575984 - DNA, 20 bp, Homo sapiens
tggaattaacctggtgctgg

SEQ ID NO: 2575985 - DNA, 12 bp, Homo sapiens
tggaatttttca

SEQ ID NO: 2575986 - DNA, 16 bp, Homo sapiens
tggacaaggaggtctg

SEQ ID NO: 2575987 - DNA, 16 bp, Homo sapiens
tggacaatcatgaaat

SEQ ID NO: 2575988 - DNA, 18 bp, Homo sapiens
tggacacagctcttctcc

SEQ ID NO: 2575989 - DNA, 18 bp, Homo sapiens
tggacaccaggagtccct

SEQ ID NO: 2575990 - DNA, 20 bp, Homo sapiens
tggacaccccttatccagga

SEQ ID NO: 2575991 - DNA, 15 bp, Homo sapiens
tggacactcagacct

SEQ ID NO: 2575992 - DNA, 16 bp, Homo sapiens
tggacagaagcagctc

SEQ ID NO: 2575993 - DNA, 17 bp, Homo sapiens
tggacagaagcagctct

SEQ ID NO: 2575994 - DNA, 16 bp, Homo sapiens
tggacaggcatgttct

SEQ ID NO: 2575995 - DNA, 23 bp, Homo sapiens
tggacaggcatgttctctgagga

SEQ ID NO: 2575996 - DNA, 15 bp, Homo sapiens
tggacagtcctggga

SEQ ID NO: 2575997 - DNA, 18 bp, Homo sapiens
tggacatcctcttctgct

SEQ ID NO: 2575998 - DNA, 18 bp, Homo sapiens
tggacatgaagattcttt

SEQ ID NO: 2575999 - DNA, 15 bp, Homo sapiens
tggacattgtctgcg

SEQ ID NO: 2576000 - DNA, 21 bp, Homo sapiens
tggaccaaccctgtttcctga

SEQ ID NO: 2576001 - DNA, 12 bp, Homo sapiens
tggaccactgca

SEQ ID NO: 2576002 - DNA, 20 bp, Homo sapiens
tggaccactgcatgagcttt

SEQ ID NO: 2576003 - DNA, 15 bp, Homo sapiens
tggaccactgggcaa

SEQ ID NO: 2576004 - DNA, 19 bp, Homo sapiens
tggaccactgggcaatgat

SEQ ID NO: 2576005 - DNA, 20 bp, Homo sapiens
tggacccagggatgacatgt

SEQ ID NO: 2576006 - DNA, 19 bp, Homo sapiens
tggaccccagctgggaggc

SEQ ID NO: 2576007 - DNA, 20 bp, Homo sapiens
tggaccccagctgggaggca

SEQ ID NO: 2576008 - DNA, 18 bp, Homo sapiens
tggaccccatctgtgaat

SEQ ID NO: 2576009 - DNA, 19 bp, Homo sapiens
tggaccctgaggcccagag

SEQ ID NO: 2576010 - DNA, 20 bp, Homo sapiens
tggaccctgaggcccagagg

SEQ ID NO: 2576011 - DNA, 16 bp, Homo sapiens
tggacctctgctctga

SEQ ID NO: 2576012 - DNA, 18 bp, Homo sapiens
tggacctgcctcctgcct

SEQ ID NO: 2576013 - DNA, 12 bp, Homo sapiens
tggaccttcctg

SEQ ID NO: 2576014 - DNA, 14 bp, Homo sapiens
tggaccttcctgcc

SEQ ID NO: 2576015 - DNA, 19 bp, Homo sapiens
tggaccttcctgccaccag

SEQ ID NO: 2576016 - DNA, 16 bp, Homo sapiens
tggaccttgagaccac

SEQ ID NO: 2576017 - DNA, 15 bp, Homo sapiens
tggacggctgggcac

SEQ ID NO: 2576018 - DNA, 14 bp, Homo sapiens
tggacggtgctcca

SEQ ID NO: 2576019 - DNA, 16 bp, Homo sapiens
tggacggtgctccagg

SEQ ID NO: 2576020 - DNA, 17 bp, Homo sapiens
tggacggtgctccaggc

SEQ ID NO: 2576021 - DNA, 20 bp, Homo sapiens
tggacggtgctccaggcagg

SEQ ID NO: 2576022 - DNA, 19 bp, Homo sapiens
tggactaacttgtctttgg

SEQ ID NO: 2576023 - DNA, 24 bp, Homo sapiens
tggactacccacgttctcacaccc

SEQ ID NO: 2576024 - DNA, 21 bp, Homo sapiens
tggactagagggacctctccc

SEQ ID NO: 2576025 - DNA, 21 bp, Homo sapiens
tggactccagactctctgtga

SEQ ID NO: 2576026 - DNA, 20 bp, Homo sapiens
tggactccagcctgcctggc

SEQ ID NO: 2576027 - DNA, 17 bp, Homo sapiens
tggactccggccctcct

SEQ ID NO: 2576028 - DNA, 15 bp, Homo sapiens
tggactctgcacatg

SEQ ID NO: 2576029 - DNA, 15 bp, Homo sapiens
tgggcaaagcctagt

SEQ ID NO: 2576030 - DNA, 21 bp, Homo sapiens
tgggcaacccccagcctgcta

SEQ ID NO: 2576031 - DNA, 14 bp, Homo sapiens
tgggcaaggaggcc

SEQ ID NO: 2576032 - DNA, 19 bp, Homo sapiens
tgggcaatgatggcaattt

SEQ ID NO: 2576033 - DNA, 14 bp, Homo sapiens
tgggcacccaccct

SEQ ID NO: 2576034 - DNA, 16 bp, Homo sapiens
tgggcaccccactgca

SEQ ID NO: 2576035 - DNA, 15 bp, Homo sapiens
tgggcactgggatga

SEQ ID NO: 2576036 - DNA, 15 bp, Homo sapiens
tgggcactttttaat

SEQ ID NO: 2576037 - DNA, 15 bp, Homo sapiens
tgggcagaagggaga

SEQ ID NO: 2576038 - DNA, 12 bp, Homo sapiens
tgggcagagcag

SEQ ID NO: 2576039 - DNA, 14 bp, Homo sapiens
tgggcagagcagag

SEQ ID NO: 2576040 - DNA, 17 bp, Homo sapiens
tgggcagagcagagacc

SEQ ID NO: 2576041 - DNA, 22 bp, Homo sapiens
tgggcagagcagagaccatccc

SEQ ID NO: 2576042 - DNA, 21 bp, Homo sapiens
tgggcagatctaccccttact

SEQ ID NO: 2576043 - DNA, 22 bp, Homo sapiens
tgggcagatctaccccttactt

SEQ ID NO: 2576044 - DNA, 18 bp, Homo sapiens
tgggcagcatagcaagac

SEQ ID NO: 2576045 - DNA, 14 bp, Homo sapiens
tgggcagccaggct

SEQ ID NO: 2576046 - DNA, 16 bp, Homo sapiens
tgggcagccaggctgc

SEQ ID NO: 2576047 - DNA, 22 bp, Homo sapiens
tgggcaggactcagctccccag

SEQ ID NO: 2576048 - DNA, 23 bp, Homo sapiens
tgggcaggactcagctccccaga

SEQ ID NO: 2576049 - DNA, 16 bp, Homo sapiens
tgggcaggtggtggca

SEQ ID NO: 2576050 - DNA, 21 bp, Homo sapiens
tgggcaggtggtggcactgag

SEQ ID NO: 2576051 - DNA, 16 bp, Homo sapiens
tgggcatagatgcagg

SEQ ID NO: 2576052 - DNA, 22 bp, Homo sapiens
tgggcatggggtgggcctctgg

SEQ ID NO: 2576053 - DNA, 17 bp, Homo sapiens
tgggcattgatggggaa

SEQ ID NO: 2576054 - DNA, 23 bp, Homo sapiens
tgggcattgatggggaaggaggc

SEQ ID NO: 2576055 - DNA, 13 bp, Homo sapiens
tgggcattgcttt

SEQ ID NO: 2576056 - DNA, 15 bp, Homo sapiens
tgggcatttgtgagg

SEQ ID NO: 2576057 - DNA, 16 bp, Homo sapiens
tgggccaactcacctg

SEQ ID NO: 2576058 - DNA, 18 bp, Homo sapiens
tgggccagcccctcccac

SEQ ID NO: 2576059 - DNA, 22 bp, Homo sapiens
tgggccagcccctcccaccaca

SEQ ID NO: 2576060 - DNA, 14 bp, Homo sapiens
tgggccagtgtggg

SEQ ID NO: 2576061 - DNA, 15 bp, Homo sapiens
tgggcccagctgggc

SEQ ID NO: 2576062 - DNA, 20 bp, Homo sapiens
tgggcccaggaccagctggg

SEQ ID NO: 2576063 - DNA, 12 bp, Homo sapiens
tgggcccaggga

SEQ ID NO: 2576064 - DNA, 13 bp, Homo sapiens
tgggccccagccc

SEQ ID NO: 2576065 - DNA, 14 bp, Homo sapiens
tgggccccagccca

SEQ ID NO: 2576066 - DNA, 15 bp, Homo sapiens
tgggccccagcccac

SEQ ID NO: 2576067 - DNA, 22 bp, Homo sapiens
tgggccccagcccaccctcctg

SEQ ID NO: 2576068 - DNA, 15 bp, Homo sapiens
tgggccccagccttc

SEQ ID NO: 2576069 - DNA, 19 bp, Homo sapiens
tgggcccctcatctgctca

SEQ ID NO: 2576070 - DNA, 16 bp, Homo sapiens
tgggccctctctgctc

SEQ ID NO: 2576071 - DNA, 21 bp, Homo sapiens
tgggccggcttcatgccagct

SEQ ID NO: 2576072 - DNA, 16 bp, Homo sapiens
tgggcctcaaggactt

SEQ ID NO: 2576073 - DNA, 23 bp, Homo sapiens
tgggcctcaaggacttgaaagca

SEQ ID NO: 2576074 - DNA, 22 bp, Homo sapiens
tgggcctcctgtgtgtgcgcct

SEQ ID NO: 2576075 - DNA, 14 bp, Homo sapiens
tgggcctgcttcct

SEQ ID NO: 2576076 - DNA, 12 bp, Homo sapiens
tgggccttgctg

SEQ ID NO: 2576077 - DNA, 17 bp, Homo sapiens
tgggcgccctggaagcc

SEQ ID NO: 2576078 - DNA, 16 bp, Homo sapiens
tgggcggctgagagcc

SEQ ID NO: 2576079 - DNA, 22 bp, Homo sapiens
tgggctaagtgatcctcccacc

SEQ ID NO: 2576080 - DNA, 11 bp, Homo sapiens
tgggctccctg

SEQ ID NO: 2576081 - DNA, 15 bp, Homo sapiens
tgggctccctgactg

SEQ ID NO: 2576082 - DNA, 14 bp, Homo sapiens
tgggctcccttccc

SEQ ID NO: 2576083 - DNA, 15 bp, Homo sapiens
tgggctcccttccca

SEQ ID NO: 2576084 - DNA, 19 bp, Homo sapiens
tgggctcccttcccacctc

SEQ ID NO: 2576085 - DNA, 21 bp, Homo sapiens
tgggctcccttcccacctctc

SEQ ID NO: 2576086 - DNA, 17 bp, Homo sapiens
tgggctcccttgtgcgt

SEQ ID NO: 2576087 - DNA, 15 bp, Homo sapiens
tgggctctgccccag

SEQ ID NO: 2576088 - DNA, 19 bp, Homo sapiens
tgggctctgccccagctct

SEQ ID NO: 2576089 - DNA, 20 bp, Homo sapiens
tgggctctgccccagctctg

SEQ ID NO: 2576090 - DNA, 16 bp, Homo sapiens
tgggctctgggagcag

SEQ ID NO: 2576091 - DNA, 14 bp, Homo sapiens
tgggctgagactgg

SEQ ID NO: 2576092 - DNA, 14 bp, Homo sapiens
tgggctgagcccct

SEQ ID NO: 2576093 - DNA, 17 bp, Homo sapiens
tgggctgagccctggca

SEQ ID NO: 2576094 - DNA, 11 bp, Homo sapiens
tgggctgaggg

SEQ ID NO: 2576095 - DNA, 12 bp, Homo sapiens
tgggctgaggga

SEQ ID NO: 2576096 - DNA, 21 bp, Homo sapiens
tgggctgcagcagaggcactg

SEQ ID NO: 2576097 - DNA, 17 bp, Homo sapiens
tgggctgctacccagaa

SEQ ID NO: 2576098 - DNA, 18 bp, Homo sapiens
tgggctggaacagattca

SEQ ID NO: 2576099 - DNA, 19 bp, Homo sapiens
tgggctggtggctcccgga

SEQ ID NO: 2576100 - DNA, 12 bp, Homo sapiens
tgggctgtgagt

SEQ ID NO: 2576101 - DNA, 22 bp, Homo sapiens
tgggctgtgagtgtaagtgtga

SEQ ID NO: 2576102 - DNA, 17 bp, Homo sapiens
tgggctgttggcactca

SEQ ID NO: 2576103 - DNA, 15 bp, Homo sapiens
tgggcttcagtggca

SEQ ID NO: 2576104 - DNA, 18 bp, Homo sapiens
tgggcttcagtggcagct

SEQ ID NO: 2576105 - DNA, 19 bp, Homo sapiens
tgggcttcagtggcagctg

SEQ ID NO: 2576106 - DNA, 21 bp, Homo sapiens
tgggcttcagtggcagctgct

SEQ ID NO: 2576107 - DNA, 22 bp, Homo sapiens
tgggcttcagtggcagctgctt

SEQ ID NO: 2576108 - DNA, 19 bp, Homo sapiens
tgggcttccatttgtgtgt

SEQ ID NO: 2576109 - DNA, 12 bp, Homo sapiens
tgggcttcccag

SEQ ID NO: 2576110 - DNA, 23 bp, Homo sapiens
tgggcttcccagtggctgctgcc

SEQ ID NO: 2576111 - DNA, 14 bp, Homo sapiens
tgggcttgttttct

SEQ ID NO: 2576112 - DNA, 15 bp, Homo sapiens
tggggaacaagggtg

SEQ ID NO: 2576113 - DNA, 16 bp, Homo sapiens
tggggaagactgtggc

SEQ ID NO: 2576114 - DNA, 18 bp, Homo sapiens
tggggaagcttcttaaat

SEQ ID NO: 2576115 - DNA, 14 bp, Homo sapiens
tggggaatttcctc

SEQ ID NO: 2576116 - DNA, 18 bp, Homo sapiens
tggggagcccgtctcagt

SEQ ID NO: 2576117 - DNA, 17 bp, Homo sapiens
tggggagggccgtaccc

SEQ ID NO: 2576118 - DNA, 12 bp, Homo sapiens
tggggaggggcg

SEQ ID NO: 2576119 - DNA, 19 bp, Homo sapiens
tggggaggggcgctggccc

SEQ ID NO: 2576120 - DNA, 15 bp, Homo sapiens
tggggatataatact

SEQ ID NO: 2576121 - DNA, 18 bp, Homo sapiens
tggggatctcaggggctg

SEQ ID NO: 2576122 - DNA, 14 bp, Homo sapiens
tggggatgtgggag

SEQ ID NO: 2576123 - DNA, 16 bp, Homo sapiens
tggggcagcttgaggg

SEQ ID NO: 2576124 - DNA, 17 bp, Homo sapiens
tggggcagtagaaggtc

SEQ ID NO: 2576125 - DNA, 17 bp, Homo sapiens
tggggccacacagaaac

SEQ ID NO: 2576126 - DNA, 12 bp, Homo sapiens
tggggccctgcc

SEQ ID NO: 2576127 - DNA, 12 bp, Homo sapiens
tggggcctctgt

SEQ ID NO: 2576128 - DNA, 17 bp, Homo sapiens
tggggcctggacctgcc

SEQ ID NO: 2576129 - DNA, 15 bp, Homo sapiens
tggggcctggagcag

SEQ ID NO: 2576130 - DNA, 18 bp, Homo sapiens
tggggcggtgagagggga

SEQ ID NO: 2576131 - DNA, 14 bp, Homo sapiens
tggggctcccgccc

SEQ ID NO: 2576132 - DNA, 13 bp, Homo sapiens
tggggctcgccat

SEQ ID NO: 2576133 - DNA, 13 bp, Homo sapiens
tggggctctggga

SEQ ID NO: 2576134 - DNA, 17 bp, Homo sapiens
tggggctctgtgcaggg

SEQ ID NO: 2576135 - DNA, 20 bp, Homo sapiens
tggggctgcaccggctggcc

SEQ ID NO: 2576136 - DNA, 22 bp, Homo sapiens
tggggctgcaccggctggcctg

SEQ ID NO: 2576137 - DNA, 13 bp, Homo sapiens
tggggctgctggc

SEQ ID NO: 2576138 - DNA, 14 bp, Homo sapiens
tggggctggcacaa

SEQ ID NO: 2576139 - DNA, 17 bp, Homo sapiens
tgggggaaatggtgcct

SEQ ID NO: 2576140 - DNA, 13 bp, Homo sapiens
tgggggagagcag

SEQ ID NO: 2576141 - DNA, 17 bp, Homo sapiens
tgggggagagcaggctg

SEQ ID NO: 2576142 - DNA, 19 bp, Homo sapiens
tgggggagagcaggctggc

SEQ ID NO: 2576143 - DNA, 20 bp, Homo sapiens
tgggggatcacagcctctga

SEQ ID NO: 2576144 - DNA, 20 bp, Homo sapiens
tgggggatgactagaggcag

SEQ ID NO: 2576145 - DNA, 11 bp, Homo sapiens
tgggggatgta

SEQ ID NO: 2576146 - DNA, 13 bp, Homo sapiens
tgggggccatgag

SEQ ID NO: 2576147 - DNA, 14 bp, Homo sapiens
tgggggctggcctc

SEQ ID NO: 2576148 - DNA, 15 bp, Homo sapiens
tggggggccaacacc

SEQ ID NO: 2576149 - DNA, 17 bp, Homo sapiens
tggggggccaacaccag

SEQ ID NO: 2576150 - DNA, 19 bp, Homo sapiens
tggggggctgaggtgggag

SEQ ID NO: 2576151 - DNA, 18 bp, Homo sapiens
tgggggtagagctgatcc

SEQ ID NO: 2576152 - DNA, 17 bp, Homo sapiens
tgggggtagcagctgga

SEQ ID NO: 2576153 - DNA, 18 bp, Homo sapiens
tgggggtagcagctggac

SEQ ID NO: 2576154 - DNA, 14 bp, Homo sapiens
tgggggtctgtgtg

SEQ ID NO: 2576155 - DNA, 18 bp, Homo sapiens
tgggggtctgtgtgttta

SEQ ID NO: 2576156 - DNA, 15 bp, Homo sapiens
tgggggtggaataaa

SEQ ID NO: 2576157 - DNA, 16 bp, Homo sapiens
tggggtacccactgct

SEQ ID NO: 2576158 - DNA, 18 bp, Homo sapiens
tggggtagctagaggaac

SEQ ID NO: 2576159 - DNA, 21 bp, Homo sapiens
tggggtaggaggatgggctcg

SEQ ID NO: 2576160 - DNA, 21 bp, Homo sapiens
tggggtatttggggcttattt

SEQ ID NO: 2576161 - DNA, 18 bp, Homo sapiens
tggggtcactctggcagc

SEQ ID NO: 2576162 - DNA, 20 bp, Homo sapiens
tggggtcactctggcagctc

SEQ ID NO: 2576163 - DNA, 18 bp, Homo sapiens
tggggtcagccagggcca

SEQ ID NO: 2576164 - DNA, 19 bp, Homo sapiens
tggggtcagccagggccag

SEQ ID NO: 2576165 - DNA, 16 bp, Homo sapiens
tggggtcctggggcct

SEQ ID NO: 2576166 - DNA, 21 bp, Homo sapiens
tggggtctcacagtgttgccc

SEQ ID NO: 2576167 - DNA, 17 bp, Homo sapiens
tggggtgaggaccactc

SEQ ID NO: 2576168 - DNA, 13 bp, Homo sapiens
tggggtgggagag

SEQ ID NO: 2576169 - DNA, 18 bp, Homo sapiens
tggggttatctctgtgtt

SEQ ID NO: 2576170 - DNA, 20 bp, Homo sapiens
tggggttcgtggaaagggtg

SEQ ID NO: 2576171 - DNA, 16 bp, Homo sapiens
tggggttgcaaccact

SEQ ID NO: 2576172 - DNA, 19 bp, Homo sapiens
tggggttgggattgggggc

SEQ ID NO: 2576173 - DNA, 18 bp, Homo sapiens
tgggtaatcgatggggga

SEQ ID NO: 2576174 - DNA, 18 bp, Homo sapiens
tgggtacttgtggacaca

SEQ ID NO: 2576175 - DNA, 16 bp, Homo sapiens
tgtacatgaaaacaca

SEQ ID NO: 2576176 - DNA, 19 bp, Homo sapiens
tgtacatgaaaacacattt

SEQ ID NO: 2576177 - DNA, 20 bp, Homo sapiens
tgtacatgaaaacacatttt

SEQ ID NO: 2576178 - DNA, 22 bp, Homo sapiens
tgtacatgaagaagctaaatcc

SEQ ID NO: 2576179 - DNA, 21 bp, Homo sapiens
tgtacatggaataacatgtaa

SEQ ID NO: 2576180 - DNA, 15 bp, Homo sapiens
tgtacatgtgtagcc

SEQ ID NO: 2576181 - DNA, 14 bp, Homo sapiens
tgtacattaattac

SEQ ID NO: 2576182 - DNA, 15 bp, Homo sapiens
tgtacattctaaaat

SEQ ID NO: 2576183 - DNA, 21 bp, Homo sapiens
tgtacatttccaaattcacaa

SEQ ID NO: 2576184 - DNA, 20 bp, Homo sapiens
tgtaccagcccagatgtttt

SEQ ID NO: 2576185 - DNA, 21 bp, Homo sapiens
tgtaccatgaaacaaagctgc

SEQ ID NO: 2576186 - DNA, 17 bp, Homo sapiens
tgtaccatgtacatgaa

SEQ ID NO: 2576187 - DNA, 15 bp, Homo sapiens
tgtaccgcaatgtga

SEQ ID NO: 2576188 - DNA, 23 bp, Homo sapiens
tgtacctcttgagccttgaactt

SEQ ID NO: 2576189 - DNA, 18 bp, Homo sapiens
tgtacctgcccccaatcc

SEQ ID NO: 2576190 - DNA, 22 bp, Homo sapiens
tgtaccttttgaggagccccag

SEQ ID NO: 2576191 - DNA, 16 bp, Homo sapiens
tgtacgtttgtatgtg

SEQ ID NO: 2576192 - DNA, 20 bp, Homo sapiens
tgtacgtttgtatgtgtgta

SEQ ID NO: 2576193 - DNA, 19 bp, Homo sapiens
tgtactagagatctggttt

SEQ ID NO: 2576194 - DNA, 14 bp, Homo sapiens
tgtactcttccgaa

SEQ ID NO: 2576195 - DNA, 17 bp, Homo sapiens
tgtactgagccttgtaa

SEQ ID NO: 2576196 - DNA, 19 bp, Homo sapiens
tgtactgagccttgtaatt

SEQ ID NO: 2576197 - DNA, 22 bp, Homo sapiens
tgtactgatttttgtaagacaa

SEQ ID NO: 2576198 - DNA, 15 bp, Homo sapiens
tgtactgttctgtgt

SEQ ID NO: 2576199 - DNA, 19 bp, Homo sapiens
tgtactgttctgtgtcttt

SEQ ID NO: 2576200 - DNA, 14 bp, Homo sapiens
tgtacttcaagtta

SEQ ID NO: 2576201 - DNA, 16 bp, Homo sapiens
tgtacttgatgacaga

SEQ ID NO: 2576202 - DNA, 16 bp, Homo sapiens
tgtacttttaaggcag

SEQ ID NO: 2576203 - DNA, 15 bp, Homo sapiens
tgtactttttccaga

SEQ ID NO: 2576204 - DNA, 18 bp, Homo sapiens
tgtagaaaagggaactga

SEQ ID NO: 2576205 - DNA, 13 bp, Homo sapiens
tgtagaagcattc

SEQ ID NO: 2576206 - DNA, 15 bp, Homo sapiens
tgtagaagcattcct

SEQ ID NO: 2576207 - DNA, 16 bp, Homo sapiens
tgtagaagcattcctt

SEQ ID NO: 2576208 - DNA, 16 bp, Homo sapiens
tgtagaatgatttcat

SEQ ID NO: 2576209 - DNA, 14 bp, Homo sapiens
tgtagagcttctgg

SEQ ID NO: 2576210 - DNA, 16 bp, Homo sapiens
tgtagaggagaaactg

SEQ ID NO: 2576211 - DNA, 18 bp, Homo sapiens
tgtagaggagaaactgga

SEQ ID NO: 2576212 - DNA, 17 bp, Homo sapiens
tgtagagttaagaagct

SEQ ID NO: 2576213 - DNA, 22 bp, Homo sapiens
tgtagatattgtgaagtacata

SEQ ID NO: 2576214 - DNA, 22 bp, Homo sapiens
tgtagcaaaattcttaagtatg

SEQ ID NO: 2576215 - DNA, 11 bp, Homo sapiens
tgtagccatgg

SEQ ID NO: 2576216 - DNA, 15 bp, Homo sapiens
tgtagccatgggacc

SEQ ID NO: 2576217 - DNA, 16 bp, Homo sapiens
tgtagccatgggacca

SEQ ID NO: 2576218 - DNA, 14 bp, Homo sapiens
tgtagcccacactt

SEQ ID NO: 2576219 - DNA, 23 bp, Homo sapiens
tgtagcctggatattattcttgt

SEQ ID NO: 2576220 - DNA, 13 bp, Homo sapiens
tgtagcctgtgca

SEQ ID NO: 2576221 - DNA, 14 bp, Homo sapiens
tgtagcctgtgcat

SEQ ID NO: 2576222 - DNA, 20 bp, Homo sapiens
tgtagcctgtgcatgtatgt

SEQ ID NO: 2576223 - DNA, 22 bp, Homo sapiens
tgtagcctgtgcatgtatgtct

SEQ ID NO: 2576224 - DNA, 14 bp, Homo sapiens
tgtagctggtttcc

SEQ ID NO: 2576225 - DNA, 15 bp, Homo sapiens
tgtagctttgctctt

SEQ ID NO: 2576226 - DNA, 19 bp, Homo sapiens
tgtaggaagagtagcattt

SEQ ID NO: 2576227 - DNA, 20 bp, Homo sapiens
tgtaggcataaagtcagggg

SEQ ID NO: 2576228 - DNA, 12 bp, Homo sapiens
tgtagggaactc

SEQ ID NO: 2576229 - DNA, 19 bp, Homo sapiens
tgtaggggacgagaaagat

SEQ ID NO: 2576230 - DNA, 16 bp, Homo sapiens
tgtagggttataataa

SEQ ID NO: 2576231 - DNA, 17 bp, Homo sapiens
tgtaggtatgaataagt

SEQ ID NO: 2576232 - DNA, 19 bp, Homo sapiens
tgtaggtgtctgcacccag

SEQ ID NO: 2576233 - DNA, 20 bp, Homo sapiens
tgtaggtgtctgcacccagg

SEQ ID NO: 2576234 - DNA, 15 bp, Homo sapiens
tgtagtaaagaaatt

SEQ ID NO: 2576235 - DNA, 19 bp, Homo sapiens
tgtagtaaagccgttgttt

SEQ ID NO: 2576236 - DNA, 14 bp, Homo sapiens
tgtagtagtctcat

SEQ ID NO: 2576237 - DNA, 15 bp, Homo sapiens
tgtagtcccagccac

SEQ ID NO: 2576238 - DNA, 23 bp, Homo sapiens
tgtagtcctagccactcaggagg

SEQ ID NO: 2576239 - DNA, 14 bp, Homo sapiens
tgtagttaggaaat

SEQ ID NO: 2576240 - DNA, 19 bp, Homo sapiens
tgtagttcttgtctgattg

SEQ ID NO: 2576241 - DNA, 19 bp, Homo sapiens
tgtagtttacctctttaaa

SEQ ID NO: 2576242 - DNA, 20 bp, Homo sapiens
tgtagttttatcacatgtat

SEQ ID NO: 2576243 - DNA, 21 bp, Homo sapiens
tgtataaatctttcttttgat

SEQ ID NO: 2576244 - DNA, 18 bp, Homo sapiens
tgtataacttcttaaaag

SEQ ID NO: 2576245 - DNA, 22 bp, Homo sapiens
tgtataagattagaatgaaaat

SEQ ID NO: 2576246 - DNA, 20 bp, Homo sapiens
tgtatagatgcaagatattt

SEQ ID NO: 2576247 - DNA, 16 bp, Homo sapiens
tgtataggtagatgtt

SEQ ID NO: 2576248 - DNA, 15 bp, Homo sapiens
tgtatagtactggca

SEQ ID NO: 2576249 - DNA, 17 bp, Homo sapiens
tgtatatacgcatctat

SEQ ID NO: 2576250 - DNA, 12 bp, Homo sapiens
tgtatatatgtg

SEQ ID NO: 2576251 - DNA, 15 bp, Homo sapiens
tgtatatatgtgtgt

SEQ ID NO: 2576252 - DNA, 19 bp, Homo sapiens
tgtatatatgtgtgtttaa

SEQ ID NO: 2576253 - DNA, 22 bp, Homo sapiens
tgtatatatttcctatattgtt

SEQ ID NO: 2576254 - DNA, 14 bp, Homo sapiens
tgtatatcagaaaa

SEQ ID NO: 2576255 - DNA, 16 bp, Homo sapiens
tgtatattatttctag

SEQ ID NO: 2576256 - DNA, 22 bp, Homo sapiens
tgtatattatttctaggaagaa

SEQ ID NO: 2576257 - DNA, 19 bp, Homo sapiens
tgtatattgtcagatattt

SEQ ID NO: 2576258 - DNA, 15 bp, Homo sapiens
tgtatcacaaatctt

SEQ ID NO: 2576259 - DNA, 20 bp, Homo sapiens
tgtatccattatcatgtgta

SEQ ID NO: 2576260 - DNA, 16 bp, Homo sapiens
tgtatcccatgagcct

SEQ ID NO: 2576261 - DNA, 19 bp, Homo sapiens
tgtatcccatgagcctcag

SEQ ID NO: 2576262 - DNA, 20 bp, Homo sapiens
tgtatcctgaggctgagaga

SEQ ID NO: 2576263 - DNA, 15 bp, Homo sapiens
tgtatcctggggctc

SEQ ID NO: 2576264 - DNA, 19 bp, Homo sapiens
tgtatcctggggctccctt

SEQ ID NO: 2576265 - DNA, 15 bp, Homo sapiens
tgtatcggatgcttt

SEQ ID NO: 2576266 - DNA, 19 bp, Homo sapiens
tgtatcgtaaccagccaga

SEQ ID NO: 2576267 - DNA, 18 bp, Homo sapiens
tgtatcgtatagctgtat

SEQ ID NO: 2576268 - DNA, 21 bp, Homo sapiens
tgtatcgtatagctgtattga

SEQ ID NO: 2576269 - DNA, 22 bp, Homo sapiens
tgtatcgtatagctgtattgaa

SEQ ID NO: 2576270 - DNA, 21 bp, Homo sapiens
tgtatctagtgcagctgattt

SEQ ID NO: 2576271 - DNA, 21 bp, Homo sapiens
tgtatctctgaagcatgtttc

SEQ ID NO: 2576272 - DNA, 23 bp, Homo sapiens
tgtatctctgaagcatgtttcat

SEQ ID NO: 2576273 - DNA, 22 bp, Homo sapiens
tgtatgaaagatggctgtgcct

SEQ ID NO: 2576274 - DNA, 15 bp, Homo sapiens
tgtatgactaaagag

SEQ ID NO: 2576275 - DNA, 16 bp, Homo sapiens
tgtatgactaaagaga

SEQ ID NO: 2576276 - DNA, 20 bp, Homo sapiens
tgtatgactaaagagagaat

SEQ ID NO: 2576277 - DNA, 18 bp, Homo sapiens
tgtatgcagctatctggt

SEQ ID NO: 2576278 - DNA, 20 bp, Homo sapiens
tgtatgccaagtgagaagat

SEQ ID NO: 2576279 - DNA, 12 bp, Homo sapiens
tgtatgccttta

SEQ ID NO: 2576280 - DNA, 12 bp, Homo sapiens
tgtatgctggac

SEQ ID NO: 2576281 - DNA, 18 bp, Homo sapiens
tgtatggaatacagtgtt

SEQ ID NO: 2576282 - DNA, 14 bp, Homo sapiens
tgtatgggcaaaaa

SEQ ID NO: 2576283 - DNA, 16 bp, Homo sapiens
tgtatgtgcactgtca

SEQ ID NO: 2576284 - DNA, 19 bp, Homo sapiens
tgtatgtgcactgtcactt

SEQ ID NO: 2576285 - DNA, 14 bp, Homo sapiens
tgtatgtttgcaca

SEQ ID NO: 2576286 - DNA, 19 bp, Homo sapiens
tgtatgttttggtatctgt

SEQ ID NO: 2576287 - DNA, 17 bp, Homo sapiens
tgtatgttttttttctg

SEQ ID NO: 2576288 - DNA, 17 bp, Homo sapiens
tgtattaagagtgaaaa

SEQ ID NO: 2576289 - DNA, 21 bp, Homo sapiens
tgtattaatattcattgtata

SEQ ID NO: 2576290 - DNA, 21 bp, Homo sapiens
tgtattaggtgtcatttccat

SEQ ID NO: 2576291 - DNA, 22 bp, Homo sapiens
tgtattcattgaagtcagatgt

SEQ ID NO: 2576292 - DNA, 13 bp, Homo sapiens
tgtattccaagac

SEQ ID NO: 2576293 - DNA, 15 bp, Homo sapiens
tgtattccaagacat

SEQ ID NO: 2576294 - DNA, 19 bp, Homo sapiens
tgtattctctcctgtacct

SEQ ID NO: 2576295 - DNA, 20 bp, Homo sapiens
tgtattctctcctgtacctc

SEQ ID NO: 2576296 - DNA, 15 bp, Homo sapiens
tgtattgaatcatgt

SEQ ID NO: 2576297 - DNA, 19 bp, Homo sapiens
tgtattgcatatatacata

SEQ ID NO: 2576298 - DNA, 13 bp, Homo sapiens
tgtattggcctgg

SEQ ID NO: 2576299 - DNA, 14 bp, Homo sapiens
tgtatttattccat

SEQ ID NO: 2576300 - DNA, 18 bp, Homo sapiens
tgtatttatttaaaagat

SEQ ID NO: 2576301 - DNA, 12 bp, Homo sapiens
tgtatttgtgac

SEQ ID NO: 2576302 - DNA, 14 bp, Homo sapiens
tgtatttgtgacta

SEQ ID NO: 2576303 - DNA, 15 bp, Homo sapiens
tgtatttgtttgcat

SEQ ID NO: 2576304 - DNA, 17 bp, Homo sapiens
tgtattttccaagtgtg

SEQ ID NO: 2576305 - DNA, 20 bp, Homo sapiens
tgtattttccaagtgtgcat

SEQ ID NO: 2576306 - DNA, 23 bp, Homo sapiens
tgtattttccaagtgtgcatatt

SEQ ID NO: 2576307 - DNA, 14 bp, Homo sapiens
tgtattttgtattg

SEQ ID NO: 2576308 - DNA, 14 bp, Homo sapiens
tgtcaaagaaggtt

SEQ ID NO: 2576309 - DNA, 14 bp, Homo sapiens
tgtcaacttctggc

SEQ ID NO: 2576310 - DNA, 18 bp, Homo sapiens
tgtcaacttctggctcct

SEQ ID NO: 2576311 - DNA, 19 bp, Homo sapiens
tgtcaagaagatgatcaga

SEQ ID NO: 2576312 - DNA, 17 bp, Homo sapiens
tgtcaagtctctgctgg

SEQ ID NO: 2576313 - DNA, 14 bp, Homo sapiens
tgtcaagttgtgct

SEQ ID NO: 2576314 - DNA, 16 bp, Homo sapiens
tgtcaagttgtgcttg

SEQ ID NO: 2576315 - DNA, 13 bp, Homo sapiens
tgtcaatattaaa

SEQ ID NO: 2576316 - DNA, 14 bp, Homo sapiens
tgtcaatattaaat

SEQ ID NO: 2576317 - DNA, 23 bp, Homo sapiens
tgtcaatattaaatacagacact

SEQ ID NO: 2576318 - DNA, 14 bp, Homo sapiens
tgtcacaatcctaa

SEQ ID NO: 2576319 - DNA, 19 bp, Homo sapiens
tgtcacaatcctaacacat

SEQ ID NO: 2576320 - DNA, 14 bp, Homo sapiens
tgttataactctgc

SEQ ID NO: 2576321 - DNA, 18 bp, Homo sapiens
tgttataactctgcacta

SEQ ID NO: 2576322 - DNA, 18 bp, Homo sapiens
tgttataggttgttggat

SEQ ID NO: 2576323 - DNA, 14 bp, Homo sapiens
tgttatataaatgg

SEQ ID NO: 2576324 - DNA, 21 bp, Homo sapiens
tgttatgaaataaagaaattg

SEQ ID NO: 2576325 - DNA, 15 bp, Homo sapiens
tgttatgctgtgaca

SEQ ID NO: 2576326 - DNA, 17 bp, Homo sapiens
tgttatgtagataacaa

SEQ ID NO: 2576327 - DNA, 21 bp, Homo sapiens
tgttattagagattacctcct

SEQ ID NO: 2576328 - DNA, 12 bp, Homo sapiens
tgttattatata

SEQ ID NO: 2576329 - DNA, 22 bp, Homo sapiens
tgttattattacttatttttga

SEQ ID NO: 2576330 - DNA, 17 bp, Homo sapiens
tgttatttagactcatc

SEQ ID NO: 2576331 - DNA, 14 bp, Homo sapiens
tgttatttatatat

SEQ ID NO: 2576332 - DNA, 22 bp, Homo sapiens
tgttatttctatttttgtagaa

SEQ ID NO: 2576333 - DNA, 13 bp, Homo sapiens
tgttatttctcag

SEQ ID NO: 2576334 - DNA, 22 bp, Homo sapiens
tgttcacactctcacatgttta

SEQ ID NO: 2576335 - DNA, 19 bp, Homo sapiens
tgttcacttttcctccctc

SEQ ID NO: 2576336 - DNA, 15 bp, Homo sapiens
tgttcagctccagct

SEQ ID NO: 2576337 - DNA, 16 bp, Homo sapiens
tgttcagctccagctc

SEQ ID NO: 2576338 - DNA, 20 bp, Homo sapiens
tgttcagctccagctcacca

SEQ ID NO: 2576339 - DNA, 21 bp, Homo sapiens
tgttcagctccagctcaccag

SEQ ID NO: 2576340 - DNA, 11 bp, Homo sapiens
tgttcagctgg

SEQ ID NO: 2576341 - DNA, 13 bp, Homo sapiens
tgttcagtgtaat

SEQ ID NO: 2576342 - DNA, 15 bp, Homo sapiens
tgttcagtgtaattt

SEQ ID NO: 2576343 - DNA, 22 bp, Homo sapiens
tgttcagtgtaatttctttgcc

SEQ ID NO: 2576344 - DNA, 16 bp, Homo sapiens
tgttcagttacagaaa

SEQ ID NO: 2576345 - DNA, 19 bp, Homo sapiens
tgttcatcatcctaagcta

SEQ ID NO: 2576346 - DNA, 18 bp, Homo sapiens
tgttcattgtaatgttac

SEQ ID NO: 2576347 - DNA, 21 bp, Homo sapiens
tgttcattgtaatgttactga

SEQ ID NO: 2576348 - DNA, 22 bp, Homo sapiens
tgttcattgtaatgttactgat

SEQ ID NO: 2576349 - DNA, 17 bp, Homo sapiens
tgttccaaatgaatgtt

SEQ ID NO: 2576350 - DNA, 15 bp, Homo sapiens
tgttccaagacattg

SEQ ID NO: 2576351 - DNA, 18 bp, Homo sapiens
tgttccaagacattgtca

SEQ ID NO: 2576352 - DNA, 20 bp, Homo sapiens
tgttccaagacattgtcaat

SEQ ID NO: 2576353 - DNA, 21 bp, Homo sapiens
tgttccaagacattgtcaata

SEQ ID NO: 2576354 - DNA, 21 bp, Homo sapiens
tgttcccaccaggctgctcag

SEQ ID NO: 2576355 - DNA, 22 bp, Homo sapiens
tgttcccagtgacacttcagag

SEQ ID NO: 2576356 - DNA, 16 bp, Homo sapiens
tgttcccattcttgca

SEQ ID NO: 2576357 - DNA, 18 bp, Homo sapiens
tgttccccatggccactt

SEQ ID NO: 2576358 - DNA, 20 bp, Homo sapiens
tgttccccttccactgaggg

SEQ ID NO: 2576359 - DNA, 15 bp, Homo sapiens
tgttcctacagcccc

SEQ ID NO: 2576360 - DNA, 15 bp, Homo sapiens
tgttcctacgggctt

SEQ ID NO: 2576361 - DNA, 14 bp, Homo sapiens
tgttcctagtgaaa

SEQ ID NO: 2576362 - DNA, 18 bp, Homo sapiens
tgttccttcacatcctgt

SEQ ID NO: 2576363 - DNA, 15 bp, Homo sapiens
tgttctaagaagtga

SEQ ID NO: 2576364 - DNA, 21 bp, Homo sapiens
tgttctatttcagtgccaata

SEQ ID NO: 2576365 - DNA, 15 bp, Homo sapiens
tgttctctcttctcc

SEQ ID NO: 2576366 - DNA, 13 bp, Homo sapiens
tgttctctgagga

SEQ ID NO: 2576367 - DNA, 16 bp, Homo sapiens
tgttctctgaggacac

SEQ ID NO: 2576368 - DNA, 14 bp, Homo sapiens
tgttctctgccctc

SEQ ID NO: 2576369 - DNA, 15 bp, Homo sapiens
tgttctctgccctcc

SEQ ID NO: 2576370 - DNA, 19 bp, Homo sapiens
tgttctctgccctccaaga

SEQ ID NO: 2576371 - DNA, 15 bp, Homo sapiens
tgttctgacattaac

SEQ ID NO: 2576372 - DNA, 16 bp, Homo sapiens
tgttctgacattaaca

SEQ ID NO: 2576373 - DNA, 16 bp, Homo sapiens
tgttctgattagaaat

SEQ ID NO: 2576374 - DNA, 22 bp, Homo sapiens
tgttctgattagaaatgaccaa

SEQ ID NO: 2576375 - DNA, 13 bp, Homo sapiens
tgttctggctctt

SEQ ID NO: 2576376 - DNA, 21 bp, Homo sapiens
tgttctggctcttccaggctg

SEQ ID NO: 2576377 - DNA, 12 bp, Homo sapiens
tgttctgggaca

SEQ ID NO: 2576378 - DNA, 13 bp, Homo sapiens
tgttctgtggaaa

SEQ ID NO: 2576379 - DNA, 17 bp, Homo sapiens
tgttctgtggaaagtgt

SEQ ID NO: 2576380 - DNA, 19 bp, Homo sapiens
tgttctgtggaaagtgtaa

SEQ ID NO: 2576381 - DNA, 20 bp, Homo sapiens
tgttctgtggaaagtgtaaa

SEQ ID NO: 2576382 - DNA, 13 bp, Homo sapiens
tgttctgtgtctt

SEQ ID NO: 2576383 - DNA, 14 bp, Homo sapiens
tgttctgtgtcttt

SEQ ID NO: 2576384 - DNA, 17 bp, Homo sapiens
tgttcttacctgtatgt

SEQ ID NO: 2576385 - DNA, 22 bp, Homo sapiens
tgttcttacctgtatgtctcca

SEQ ID NO: 2576386 - DNA, 13 bp, Homo sapiens
tgttcttgaagca

SEQ ID NO: 2576387 - DNA, 13 bp, Homo sapiens
tgttcttgaattt

SEQ ID NO: 2576388 - DNA, 20 bp, Homo sapiens
tgttcttggtttgtaaatta

SEQ ID NO: 2576389 - DNA, 14 bp, Homo sapiens
tgttctttccaaag

SEQ ID NO: 2576390 - DNA, 20 bp, Homo sapiens
tgttctttccaaagtacact

SEQ ID NO: 2576391 - DNA, 16 bp, Homo sapiens
tgttctttctggagtc

SEQ ID NO: 2576392 - DNA, 23 bp, Homo sapiens
tgttctttctggctatgcatttg

SEQ ID NO: 2576393 - DNA, 13 bp, Homo sapiens
tgttctttgggga

SEQ ID NO: 2576394 - DNA, 17 bp, Homo sapiens
tgttctttttattgaat

SEQ ID NO: 2576395 - DNA, 22 bp, Homo sapiens
tgttgaaaattattttaaacaa

SEQ ID NO: 2576396 - DNA, 11 bp, Homo sapiens
tgttgaaagat

SEQ ID NO: 2576397 - DNA, 24 bp, Homo sapiens
tgttgaaaggtaatttgagagaaa

SEQ ID NO: 2576398 - DNA, 16 bp, Homo sapiens
tgttgacgaagtctct

SEQ ID NO: 2576399 - DNA, 13 bp, Homo sapiens
tgttgacttattt

SEQ ID NO: 2576400 - DNA, 22 bp, Homo sapiens
tgttgacttattttctctgtgt

SEQ ID NO: 2576401 - DNA, 13 bp, Homo sapiens
tgttgagctgttt

SEQ ID NO: 2576402 - DNA, 20 bp, Homo sapiens
tgttgaggtggtctgaatgt

SEQ ID NO: 2576403 - DNA, 21 bp, Homo sapiens
tgttgaggtggtctgaatgtt

SEQ ID NO: 2576404 - DNA, 16 bp, Homo sapiens
tgttgattattagcca

SEQ ID NO: 2576405 - DNA, 12 bp, Homo sapiens
tgttgattgcta

SEQ ID NO: 2576406 - DNA, 14 bp, Homo sapiens
tgttgattgctaaa

SEQ ID NO: 2576407 - DNA, 15 bp, Homo sapiens
tgttgcacccagccc

SEQ ID NO: 2576408 - DNA, 17 bp, Homo sapiens
tgttgcatggatgtttt

SEQ ID NO: 2576409 - DNA, 14 bp, Homo sapiens
tgttgcatgggcta

SEQ ID NO: 2576410 - DNA, 13 bp, Homo sapiens
tgttgcccaggca

SEQ ID NO: 2576411 - DNA, 19 bp, Homo sapiens
tgttgcccaggcaggtctt

SEQ ID NO: 2576412 - DNA, 13 bp, Homo sapiens
tgttgcccaggct

SEQ ID NO: 2576413 - DNA, 14 bp, Homo sapiens
tgttgcccaggctg

SEQ ID NO: 2576414 - DNA, 21 bp, Homo sapiens
tgttgcccaggctggagtgca

SEQ ID NO: 2576415 - DNA, 13 bp, Homo sapiens
tgttgccctgagt

SEQ ID NO: 2576416 - DNA, 12 bp, Homo sapiens
tgttgccctggg

SEQ ID NO: 2576417 - DNA, 22 bp, Homo sapiens
tgttgccttgaaccacttccct

SEQ ID NO: 2576418 - DNA, 15 bp, Homo sapiens
tgttgcttacaattt

SEQ ID NO: 2576419 - DNA, 19 bp, Homo sapiens
tgttggacccgctctggac

SEQ ID NO: 2576420 - DNA, 14 bp, Homo sapiens
tgttggatcttcaa

SEQ ID NO: 2576421 - DNA, 20 bp, Homo sapiens
tgttggatttgtttaaaagg

SEQ ID NO: 2576422 - DNA, 20 bp, Homo sapiens
tgttggcctccggcctcccc

SEQ ID NO: 2576423 - DNA, 14 bp, Homo sapiens
tgttgggactgcta

SEQ ID NO: 2576424 - DNA, 18 bp, Homo sapiens
tgttgggagtgaggatgt

SEQ ID NO: 2576425 - DNA, 14 bp, Homo sapiens
tgttggttccaagc

SEQ ID NO: 2576426 - DNA, 14 bp, Homo sapiens
tgttgtaaatattt

SEQ ID NO: 2576427 - DNA, 16 bp, Homo sapiens
tgttgtacatttatga

SEQ ID NO: 2576428 - DNA, 17 bp, Homo sapiens
tgttgtacatttatgat

SEQ ID NO: 2576429 - DNA, 18 bp, Homo sapiens
tgttgtacatttatgatt

SEQ ID NO: 2576430 - DNA, 23 bp, Homo sapiens
tgttgtacatttatgatttaata

SEQ ID NO: 2576431 - DNA, 13 bp, Homo sapiens
tgttgtataaatt

SEQ ID NO: 2576432 - DNA, 13 bp, Homo sapiens
tgttgtcagctga

SEQ ID NO: 2576433 - DNA, 11 bp, Homo sapiens
tgttgtcattg

SEQ ID NO: 2576434 - DNA, 17 bp, Homo sapiens
tgttgtctgtttgttct

SEQ ID NO: 2576435 - DNA, 16 bp, Homo sapiens
tgttgtcttgaaagat

SEQ ID NO: 2576436 - DNA, 15 bp, Homo sapiens
tgttgtgtgtgggag

SEQ ID NO: 2576437 - DNA, 18 bp, Homo sapiens
tgttgttaatgaaaatgt

SEQ ID NO: 2576438 - DNA, 14 bp, Homo sapiens
tgttgtttctttct

SEQ ID NO: 2576439 - DNA, 20 bp, Homo sapiens
tgttgttttgttttaaatac

SEQ ID NO: 2576440 - DNA, 14 bp, Homo sapiens
tgtttaaaaggatt

SEQ ID NO: 2576441 - DNA, 12 bp, Homo sapiens
tgtttaaagaga

SEQ ID NO: 2576442 - DNA, 21 bp, Homo sapiens
tgtttaaagagaggttataga

SEQ ID NO: 2576443 - DNA, 12 bp, Homo sapiens
tgtttaaataaa

SEQ ID NO: 2576444 - DNA, 14 bp, Homo sapiens
tgtttaaataaagt

SEQ ID NO: 2576445 - DNA, 17 bp, Homo sapiens
tgtttaaataaagtatc

SEQ ID NO: 2576446 - DNA, 22 bp, Homo sapiens
tgtttaaataaagtatcatgca

SEQ ID NO: 2576447 - DNA, 20 bp, Homo sapiens
tgtttaatattgagaaagaa

SEQ ID NO: 2576448 - DNA, 14 bp, Homo sapiens
tgtttaatatttaa

SEQ ID NO: 2576449 - DNA, 17 bp, Homo sapiens
tgtttaatatttaaaca

SEQ ID NO: 2576450 - DNA, 15 bp, Homo sapiens
tgtttacaagaaaaa

SEQ ID NO: 2576451 - DNA, 14 bp, Homo sapiens
tgtttacagaggac

SEQ ID NO: 2576452 - DNA, 21 bp, Homo sapiens
tgtttacagaggacagtattt

SEQ ID NO: 2576453 - DNA, 21 bp, Homo sapiens
tgtttacagcactactctgtg

SEQ ID NO: 2576454 - DNA, 22 bp, Homo sapiens
tgtttacagcactactctgtgc

SEQ ID NO: 2576455 - DNA, 23 bp, Homo sapiens
tgtttacagcactactctgtgcc

SEQ ID NO: 2576456 - DNA, 15 bp, Homo sapiens
tgtttacttaaagat

SEQ ID NO: 2576457 - DNA, 19 bp, Homo sapiens
tgtttacttaaagatttat

SEQ ID NO: 2576458 - DNA, 16 bp, Homo sapiens
tgtttagaagaagtgt

SEQ ID NO: 2576459 - DNA, 19 bp, Homo sapiens
tgtttagaagaagtgtgtc

SEQ ID NO: 2576460 - DNA, 20 bp, Homo sapiens
tgtttagataatacaccact

SEQ ID NO: 2576461 - DNA, 16 bp, Homo sapiens
tgtttataaacattgt

SEQ ID NO: 2576462 - DNA, 14 bp, Homo sapiens
tgtttatgagccag

SEQ ID NO: 2576463 - DNA, 16 bp, Homo sapiens
tgtttatgagccagac

SEQ ID NO: 2576464 - DNA, 14 bp, Homo sapiens
tgtttatggcctca

SEQ ID NO: 2576465 - DNA, 24 bp, Homo sapiens
tgtttatggcctcagctgcctcac

SEQ ID NO: 2576466 - DNA, 16 bp, Homo sapiens
ttaacagttttccatg

SEQ ID NO: 2576467 - DNA, 19 bp, Homo sapiens
ttaacagttttccatgaaa

SEQ ID NO: 2576468 - DNA, 17 bp, Homo sapiens
ttaacatatttactaag

SEQ ID NO: 2576469 - DNA, 14 bp, Homo sapiens
ttaacatttcaagg

SEQ ID NO: 2576470 - DNA, 13 bp, Homo sapiens
ttaaccagaataa

SEQ ID NO: 2576471 - DNA, 17 bp, Homo sapiens
ttaaccattaaaactga

SEQ ID NO: 2576472 - DNA, 20 bp, Homo sapiens
ttaacctatgatattttctg

SEQ ID NO: 2576473 - DNA, 15 bp, Homo sapiens
ttaacctcagtgtca

SEQ ID NO: 2576474 - DNA, 23 bp, Homo sapiens
ttaactaatctattgggttcatt

SEQ ID NO: 2576475 - DNA, 19 bp, Homo sapiens
ttaactattttattttcta

SEQ ID NO: 2576476 - DNA, 14 bp, Homo sapiens
ttaactcagatcac

SEQ ID NO: 2576477 - DNA, 18 bp, Homo sapiens
ttaacttaacattctgta

SEQ ID NO: 2576478 - DNA, 22 bp, Homo sapiens
ttaacttcagagggaaagtaaa

SEQ ID NO: 2576479 - DNA, 14 bp, Homo sapiens
ttaacttctctgga

SEQ ID NO: 2576480 - DNA, 14 bp, Homo sapiens
ttaacttttataaa

SEQ ID NO: 2576481 - DNA, 22 bp, Homo sapiens
ttaacttttataaactttacct

SEQ ID NO: 2576482 - DNA, 23 bp, Homo sapiens
ttaacttttataaactttacctt

SEQ ID NO: 2576483 - DNA, 19 bp, Homo sapiens
ttaagaaaaaggatgcaca

SEQ ID NO: 2576484 - DNA, 14 bp, Homo sapiens
ttaagaatgaaata

SEQ ID NO: 2576485 - DNA, 20 bp, Homo sapiens
ttaagaatgaaatactgttt

SEQ ID NO: 2576486 - DNA, 13 bp, Homo sapiens
ttaagacgtgttt

SEQ ID NO: 2576487 - DNA, 16 bp, Homo sapiens
ttaagacgtgtttgtg

SEQ ID NO: 2576488 - DNA, 21 bp, Homo sapiens
ttaagactgagcacctgcttc

SEQ ID NO: 2576489 - DNA, 14 bp, Homo sapiens
ttaagatatgatgt

SEQ ID NO: 2576490 - DNA, 17 bp, Homo sapiens
ttaagatggattctcag

SEQ ID NO: 2576491 - DNA, 21 bp, Homo sapiens
ttaagatggattctcagatat

SEQ ID NO: 2576492 - DNA, 23 bp, Homo sapiens
ttaagatggattctcagatattt

SEQ ID NO: 2576493 - DNA, 16 bp, Homo sapiens
ttaagatttttctcaa

SEQ ID NO: 2576494 - DNA, 17 bp, Homo sapiens
ttaagatttttctcaaa

SEQ ID NO: 2576495 - DNA, 21 bp, Homo sapiens
ttaagatttttctcaaagttt

SEQ ID NO: 2576496 - DNA, 22 bp, Homo sapiens
ttaagcactacataaactgact

SEQ ID NO: 2576497 - DNA, 13 bp, Homo sapiens
ttaagcagctctt

SEQ ID NO: 2576498 - DNA, 20 bp, Homo sapiens
ttaagcagctcttgctaatc

SEQ ID NO: 2576499 - DNA, 20 bp, Homo sapiens
ttaagcattgggtgggtaaa

SEQ ID NO: 2576500 - DNA, 12 bp, Homo sapiens
ttaagcattgtt

SEQ ID NO: 2576501 - DNA, 14 bp, Homo sapiens
ttaagcattgtttg

SEQ ID NO: 2576502 - DNA, 22 bp, Homo sapiens
ttaagcctcatatttaaagaca

SEQ ID NO: 2576503 - DNA, 12 bp, Homo sapiens
ttaagcttattt

SEQ ID NO: 2576504 - DNA, 18 bp, Homo sapiens
ttaaggatgcttgtacat

SEQ ID NO: 2576505 - DNA, 15 bp, Homo sapiens
ttaaggattttatgc

SEQ ID NO: 2576506 - DNA, 17 bp, Homo sapiens
ttaagtatctgacatct

SEQ ID NO: 2576507 - DNA, 14 bp, Homo sapiens
ttaagtatcttttt

SEQ ID NO: 2576508 - DNA, 19 bp, Homo sapiens
ttaagtatcttttttcaaa

SEQ ID NO: 2576509 - DNA, 11 bp, Homo sapiens
ttaagtattta

SEQ ID NO: 2576510 - DNA, 16 bp, Homo sapiens
ttaagtatttatatat

SEQ ID NO: 2576511 - DNA, 19 bp, Homo sapiens
ttaagtatttatatattta

SEQ ID NO: 2576512 - DNA, 19 bp, Homo sapiens
ttaagtctaaatatttcct

SEQ ID NO: 2576513 - DNA, 20 bp, Homo sapiens
ttaagtctgttttatgactt

SEQ ID NO: 2576514 - DNA, 16 bp, Homo sapiens
ttaagtgatgaacatt

SEQ ID NO: 2576515 - DNA, 17 bp, Homo sapiens
ttaagtgcgtgtgtaga

SEQ ID NO: 2576516 - DNA, 19 bp, Homo sapiens
ttaagtgcgtgtgtagagt

SEQ ID NO: 2576517 - DNA, 21 bp, Homo sapiens
ttaagtgcgtgtgtagagtta

SEQ ID NO: 2576518 - DNA, 21 bp, Homo sapiens
ttaagtgttgtaaatatttat

SEQ ID NO: 2576519 - DNA, 18 bp, Homo sapiens
ttaagttagggaatggca

SEQ ID NO: 2576520 - DNA, 16 bp, Homo sapiens
ttaagttgtttgcatg

SEQ ID NO: 2576521 - DNA, 11 bp, Homo sapiens
ttaagtttctc

SEQ ID NO: 2576522 - DNA, 14 bp, Homo sapiens
ttaataaaaaggca

SEQ ID NO: 2576523 - DNA, 16 bp, Homo sapiens
ttaataaaataattct

SEQ ID NO: 2576524 - DNA, 20 bp, Homo sapiens
ttaataaattatttattatt

SEQ ID NO: 2576525 - DNA, 21 bp, Homo sapiens
ttaataacattaccttactgt

SEQ ID NO: 2576526 - DNA, 14 bp, Homo sapiens
ttaataataaattc

SEQ ID NO: 2576527 - DNA, 19 bp, Homo sapiens
ttaatactataaataatat

SEQ ID NO: 2576528 - DNA, 14 bp, Homo sapiens
ttaatagtgttaat

SEQ ID NO: 2576529 - DNA, 16 bp, Homo sapiens
ttaatagtgttaatca

SEQ ID NO: 2576530 - DNA, 18 bp, Homo sapiens
ttaatagtgttaatcaat

SEQ ID NO: 2576531 - DNA, 17 bp, Homo sapiens
ttaatatagctattttt

SEQ ID NO: 2576532 - DNA, 11 bp, Homo sapiens
ttaatattaaa

SEQ ID NO: 2576533 - DNA, 12 bp, Homo sapiens
ttaatatttaaa

SEQ ID NO: 2576534 - DNA, 16 bp, Homo sapiens
ttaatatttaaacagc

SEQ ID NO: 2576535 - DNA, 17 bp, Homo sapiens
ttaatatttaaacagca

SEQ ID NO: 2576536 - DNA, 19 bp, Homo sapiens
ttaatatttgctgacagct

SEQ ID NO: 2576537 - DNA, 20 bp, Homo sapiens
ttaatcaatttaaacccatt

SEQ ID NO: 2576538 - DNA, 20 bp, Homo sapiens
ttaatcaggtcctcagagaa

SEQ ID NO: 2576539 - DNA, 21 bp, Homo sapiens
ttaatcatctataaagaagaa

SEQ ID NO: 2576540 - DNA, 23 bp, Homo sapiens
ttaatcattaggtgtgactgaat

SEQ ID NO: 2576541 - DNA, 18 bp, Homo sapiens
ttaatccagaataactag

SEQ ID NO: 2576542 - DNA, 15 bp, Homo sapiens
ttaatctaaatggaa

SEQ ID NO: 2576543 - DNA, 22 bp, Homo sapiens
ttaatcttcagttttatcttta

SEQ ID NO: 2576544 - DNA, 17 bp, Homo sapiens
ttaatctttctttacct

SEQ ID NO: 2576545 - DNA, 21 bp, Homo sapiens
ttaatctttctttacctgaga

SEQ ID NO: 2576546 - DNA, 18 bp, Homo sapiens
ttaatcttttcacaaata

SEQ ID NO: 2576547 - DNA, 19 bp, Homo sapiens
ttaatcttttcacaaataa

SEQ ID NO: 2576548 - DNA, 14 bp, Homo sapiens
ttaatgaagaaagt

SEQ ID NO: 2576549 - DNA, 20 bp, Homo sapiens
ttaatgcatgttaggaaaat

SEQ ID NO: 2576550 - DNA, 15 bp, Homo sapiens
ttaatgcttctttca

SEQ ID NO: 2576551 - DNA, 22 bp, Homo sapiens
ttaatggccggctggaaatgct

SEQ ID NO: 2576552 - DNA, 21 bp, Homo sapiens
ttaatgggggtagcagctgga

SEQ ID NO: 2576553 - DNA, 15 bp, Homo sapiens
ttaatgtagccatgg

SEQ ID NO: 2576554 - DNA, 14 bp, Homo sapiens
ttaatgtgctgtgt

SEQ ID NO: 2576555 - DNA, 22 bp, Homo sapiens
ttaatgtgctgtgtaaagttag

SEQ ID NO: 2576556 - DNA, 23 bp, Homo sapiens
ttaattataccatggtgaattaa

SEQ ID NO: 2576557 - DNA, 14 bp, Homo sapiens
ttaattattatttg

SEQ ID NO: 2576558 - DNA, 14 bp, Homo sapiens
ttaattattgtaca

SEQ ID NO: 2576559 - DNA, 15 bp, Homo sapiens
ttaattcatgtttct

SEQ ID NO: 2576560 - DNA, 19 bp, Homo sapiens
ttaattccaatatgatgac

SEQ ID NO: 2576561 - DNA, 21 bp, Homo sapiens
ttaattccatgaatcgcttct

SEQ ID NO: 2576562 - DNA, 19 bp, Homo sapiens
ttaattgttgtttctttct

SEQ ID NO: 2576563 - DNA, 15 bp, Homo sapiens
ttaatttatgagttt

SEQ ID NO: 2576564 - DNA, 18 bp, Homo sapiens
ttaatttatgagtttttg

SEQ ID NO: 2576565 - DNA, 17 bp, Homo sapiens
ttaattttgtattttcc

SEQ ID NO: 2576566 - DNA, 12 bp, Homo sapiens
ttacaaacatgt

SEQ ID NO: 2576567 - DNA, 13 bp, Homo sapiens
ttacaacagattt

SEQ ID NO: 2576568 - DNA, 18 bp, Homo sapiens
ttacaacagatttgtgaa

SEQ ID NO: 2576569 - DNA, 19 bp, Homo sapiens
ttacaacagatttgtgaac

SEQ ID NO: 2576570 - DNA, 17 bp, Homo sapiens
ttacaagcccccccttc

SEQ ID NO: 2576571 - DNA, 20 bp, Homo sapiens
ttacaagcccccccttccac

SEQ ID NO: 2576572 - DNA, 13 bp, Homo sapiens
ttacaattgaaat

SEQ ID NO: 2576573 - DNA, 15 bp, Homo sapiens
ttacaattgaaatga

SEQ ID NO: 2576574 - DNA, 15 bp, Homo sapiens
ttacaattttttatc

SEQ ID NO: 2576575 - DNA, 16 bp, Homo sapiens
ttacacaaaacaaatg

SEQ ID NO: 2576576 - DNA, 21 bp, Homo sapiens
ttacacaaaacaaatgccaca

SEQ ID NO: 2576577 - DNA, 15 bp, Homo sapiens
ttacacatttttcag

SEQ ID NO: 2576578 - DNA, 17 bp, Homo sapiens
ttacacatttttcagat

SEQ ID NO: 2576579 - DNA, 23 bp, Homo sapiens
ttacacatttttcagatataaaa

SEQ ID NO: 2576580 - DNA, 23 bp, Homo sapiens
ttacacgtggaggaatgctcccc

SEQ ID NO: 2576581 - DNA, 15 bp, Homo sapiens
ttacactctttgtaa

SEQ ID NO: 2576582 - DNA, 22 bp, Homo sapiens
ttacactggaggagagaagaat

SEQ ID NO: 2576583 - DNA, 13 bp, Homo sapiens
ttacactttatgc

SEQ ID NO: 2576584 - DNA, 20 bp, Homo sapiens
ttacactttatgcacaaaat

SEQ ID NO: 2576585 - DNA, 19 bp, Homo sapiens
ttacagaaagtggtgctca

SEQ ID NO: 2576586 - DNA, 16 bp, Homo sapiens
ttacagaggaagttat

SEQ ID NO: 2576587 - DNA, 20 bp, Homo sapiens
ttacagctgggtggcactgc

SEQ ID NO: 2576588 - DNA, 11 bp, Homo sapiens
ttacagctgtg

SEQ ID NO: 2576589 - DNA, 17 bp, Homo sapiens
ttacaggcacaaaatga

SEQ ID NO: 2576590 - DNA, 20 bp, Homo sapiens
ttacagtgaaaatgtaagct

SEQ ID NO: 2576591 - DNA, 20 bp, Homo sapiens
ttacataagataaatgtgct

SEQ ID NO: 2576592 - DNA, 22 bp, Homo sapiens
ttacatatttgcatatgtatga

SEQ ID NO: 2576593 - DNA, 13 bp, Homo sapiens
ttacatcattttt

SEQ ID NO: 2576594 - DNA, 14 bp, Homo sapiens
ttacatcatttttg

SEQ ID NO: 2576595 - DNA, 13 bp, Homo sapiens
ttacatccttaaa

SEQ ID NO: 2576596 - DNA, 21 bp, Homo sapiens
ttacatctgttttaaatttat

SEQ ID NO: 2576597 - DNA, 15 bp, Homo sapiens
ttacatgcatacttc

SEQ ID NO: 2576598 - DNA, 22 bp, Homo sapiens
ttacatgcatacttcaaaagta

SEQ ID NO: 2576599 - DNA, 14 bp, Homo sapiens
ttacattaatgtta

SEQ ID NO: 2576600 - DNA, 16 bp, Homo sapiens
ttacatttccaaatga

SEQ ID NO: 2576601 - DNA, 20 bp, Homo sapiens
ttacatttttaagtgctgca

SEQ ID NO: 2576602 - DNA, 14 bp, Homo sapiens
ttacatttttacaa

SEQ ID NO: 2576603 - DNA, 15 bp, Homo sapiens
ttacatttttacaat

SEQ ID NO: 2576604 - DNA, 13 bp, Homo sapiens
ttaccaagaagcc

SEQ ID NO: 2576605 - DNA, 14 bp, Homo sapiens
ttaccaagaagcct

SEQ ID NO: 2576606 - DNA, 17 bp, Homo sapiens
ttaccacagacatacta

SEQ ID NO: 2576607 - DNA, 15 bp, Homo sapiens
ttaccacccccacac

SEQ ID NO: 2576608 - DNA, 14 bp, Homo sapiens
ttaccactcaggca

SEQ ID NO: 2576609 - DNA, 22 bp, Homo sapiens
ttaccagacggttcaccagcct

SEQ ID NO: 2576610 - DNA, 23 bp, Homo sapiens
ttaccagcctccgtatttcagac

SEQ ID NO: 2576611 - DNA, 17 bp, Homo sapiens
ttcataactttcattaa

SEQ ID NO: 2576612 - DNA, 12 bp, Homo sapiens
ttcatacaaggc

SEQ ID NO: 2576613 - DNA, 19 bp, Homo sapiens
ttcatagggtctcttcagg

SEQ ID NO: 2576614 - DNA, 13 bp, Homo sapiens
ttcatatgttgct

SEQ ID NO: 2576615 - DNA, 18 bp, Homo sapiens
ttcatatgttgctcagtc

SEQ ID NO: 2576616 - DNA, 14 bp, Homo sapiens
ttcatattgtgcca

SEQ ID NO: 2576617 - DNA, 17 bp, Homo sapiens
ttcatctctcagaaggg

SEQ ID NO: 2576618 - DNA, 12 bp, Homo sapiens
ttcatctggaac

SEQ ID NO: 2576619 - DNA, 17 bp, Homo sapiens
ttcatctggaaccatca

SEQ ID NO: 2576620 - DNA, 19 bp, Homo sapiens
ttcatctggcaacatcttt

SEQ ID NO: 2576621 - DNA, 18 bp, Homo sapiens
ttcatctgggaaagacat

SEQ ID NO: 2576622 - DNA, 16 bp, Homo sapiens
ttcatcttttgtatag

SEQ ID NO: 2576623 - DNA, 21 bp, Homo sapiens
ttcatgaacttcgcatcaaaa

SEQ ID NO: 2576624 - DNA, 22 bp, Homo sapiens
ttcatgaacttcgcatcaaaag

SEQ ID NO: 2576625 - DNA, 20 bp, Homo sapiens
ttcatgcaaggggaaaatct

SEQ ID NO: 2576626 - DNA, 14 bp, Homo sapiens
ttcatgcatggaaa

SEQ ID NO: 2576627 - DNA, 15 bp, Homo sapiens
ttcatgcatggaaat

SEQ ID NO: 2576628 - DNA, 21 bp, Homo sapiens
ttcatgccaattagcaattga

SEQ ID NO: 2576629 - DNA, 21 bp, Homo sapiens
ttcatgccagctacttcctcc

SEQ ID NO: 2576630 - DNA, 18 bp, Homo sapiens
ttcatgctatctctgtgt

SEQ ID NO: 2576631 - DNA, 14 bp, Homo sapiens
ttcatgctcagccc

SEQ ID NO: 2576632 - DNA, 19 bp, Homo sapiens
ttcatggtgaaaatgtact

SEQ ID NO: 2576633 - DNA, 18 bp, Homo sapiens
ttcatgtaaactgtgcac

SEQ ID NO: 2576634 - DNA, 19 bp, Homo sapiens
ttcatgtaaactgtgcacc

SEQ ID NO: 2576635 - DNA, 18 bp, Homo sapiens
ttcatgttttaacaaaaa

SEQ ID NO: 2576636 - DNA, 18 bp, Homo sapiens
ttcattaataataaattc

SEQ ID NO: 2576637 - DNA, 14 bp, Homo sapiens
ttcattatctcaaa

SEQ ID NO: 2576638 - DNA, 16 bp, Homo sapiens
ttcattccattctgga

SEQ ID NO: 2576639 - DNA, 13 bp, Homo sapiens
ttcattctcctgc

SEQ ID NO: 2576640 - DNA, 20 bp, Homo sapiens
ttcattgcccccagggcact

SEQ ID NO: 2576641 - DNA, 14 bp, Homo sapiens
ttcattgtatgatg

SEQ ID NO: 2576642 - DNA, 16 bp, Homo sapiens
ttcattgtatgatgtg

SEQ ID NO: 2576643 - DNA, 14 bp, Homo sapiens
ttcatttaaaatga

SEQ ID NO: 2576644 - DNA, 16 bp, Homo sapiens
ttcatttaaaatgatt

SEQ ID NO: 2576645 - DNA, 13 bp, Homo sapiens
ttcatttactgtg

SEQ ID NO: 2576646 - DNA, 15 bp, Homo sapiens
ttcatttcctgtgtc

SEQ ID NO: 2576647 - DNA, 13 bp, Homo sapiens
ttcatttgtgtca

SEQ ID NO: 2576648 - DNA, 18 bp, Homo sapiens
ttcatttttaatcatgaa

SEQ ID NO: 2576649 - DNA, 13 bp, Homo sapiens
ttccaaaaaaata

SEQ ID NO: 2576650 - DNA, 19 bp, Homo sapiens
ttccaaagcacattgaaag

SEQ ID NO: 2576651 - DNA, 15 bp, Homo sapiens
ttccaaataaaatga

SEQ ID NO: 2576652 - DNA, 15 bp, Homo sapiens
ttccaaattcacaag

SEQ ID NO: 2576653 - DNA, 12 bp, Homo sapiens
ttccaacaccac

SEQ ID NO: 2576654 - DNA, 20 bp, Homo sapiens
ttccaacaccacagacacac

SEQ ID NO: 2576655 - DNA, 19 bp, Homo sapiens
ttccaaccctcatcaccaa

SEQ ID NO: 2576656 - DNA, 22 bp, Homo sapiens
ttccaactgtatatattcccaa

SEQ ID NO: 2576657 - DNA, 21 bp, Homo sapiens
ttccaagacatgtctgttcta

SEQ ID NO: 2576658 - DNA, 12 bp, Homo sapiens
ttccaagacatt

SEQ ID NO: 2576659 - DNA, 14 bp, Homo sapiens
ttccaagacattgt

SEQ ID NO: 2576660 - DNA, 19 bp, Homo sapiens
ttccaagacattgtcaata

SEQ ID NO: 2576661 - DNA, 20 bp, Homo sapiens
ttccaagtgtgcatattgta

SEQ ID NO: 2576662 - DNA, 13 bp, Homo sapiens
ttccaatgtctgc

SEQ ID NO: 2576663 - DNA, 11 bp, Homo sapiens
ttccacaaaat

SEQ ID NO: 2576664 - DNA, 13 bp, Homo sapiens
ttccacaccccca

SEQ ID NO: 2576665 - DNA, 15 bp, Homo sapiens
ttccacacccccacc

SEQ ID NO: 2576666 - DNA, 22 bp, Homo sapiens
ttccacacccccaccccttgct

SEQ ID NO: 2576667 - DNA, 16 bp, Homo sapiens
ttccacatataaagct

SEQ ID NO: 2576668 - DNA, 11 bp, Homo sapiens
ttccaccagcc

SEQ ID NO: 2576669 - DNA, 14 bp, Homo sapiens
ttccaccccctccc

SEQ ID NO: 2576670 - DNA, 13 bp, Homo sapiens
ttccaccctggaa

SEQ ID NO: 2576671 - DNA, 13 bp, Homo sapiens
ttccacctccctc

SEQ ID NO: 2576672 - DNA, 14 bp, Homo sapiens
ttccacctccctcc

SEQ ID NO: 2576673 - DNA, 15 bp, Homo sapiens
ttccacgctgtctcc

SEQ ID NO: 2576674 - DNA, 19 bp, Homo sapiens
ttccacgtgttttattcct

SEQ ID NO: 2576675 - DNA, 15 bp, Homo sapiens
ttccactactgctac

SEQ ID NO: 2576676 - DNA, 12 bp, Homo sapiens
ttccactgagct

SEQ ID NO: 2576677 - DNA, 13 bp, Homo sapiens
ttccactgagctc

SEQ ID NO: 2576678 - DNA, 15 bp, Homo sapiens
ttccactgagctcca

SEQ ID NO: 2576679 - DNA, 15 bp, Homo sapiens
ttccactgagggcag

SEQ ID NO: 2576680 - DNA, 19 bp, Homo sapiens
ttccacttataggaattga

SEQ ID NO: 2576681 - DNA, 15 bp, Homo sapiens
ttccactttgttctt

SEQ ID NO: 2576682 - DNA, 20 bp, Homo sapiens
ttccacttttttttgtatgt

SEQ ID NO: 2576683 - DNA, 18 bp, Homo sapiens
ttccagaaaaccccagca

SEQ ID NO: 2576684 - DNA, 19 bp, Homo sapiens
ttccagaatatctgggatt

SEQ ID NO: 2576685 - DNA, 16 bp, Homo sapiens
ttccagaggggttgag

SEQ ID NO: 2576686 - DNA, 18 bp, Homo sapiens
ttccagataaccagctgt

SEQ ID NO: 2576687 - DNA, 12 bp, Homo sapiens
ttccagccaggg

SEQ ID NO: 2576688 - DNA, 15 bp, Homo sapiens
ttccagccagggctg

SEQ ID NO: 2576689 - DNA, 16 bp, Homo sapiens
ttccagccagggctgc

SEQ ID NO: 2576690 - DNA, 14 bp, Homo sapiens
ttccagctcctgta

SEQ ID NO: 2576691 - DNA, 18 bp, Homo sapiens
ttccagctggatgagaat

SEQ ID NO: 2576692 - DNA, 17 bp, Homo sapiens
ttccaggctgggagagc

SEQ ID NO: 2576693 - DNA, 21 bp, Homo sapiens
ttccaggggtgggacaccctg

SEQ ID NO: 2576694 - DNA, 17 bp, Homo sapiens
ttccaggtatctccagg

SEQ ID NO: 2576695 - DNA, 19 bp, Homo sapiens
ttccaggtatctccaggat

SEQ ID NO: 2576696 - DNA, 18 bp, Homo sapiens
ttccagtctctgcatgta

SEQ ID NO: 2576697 - DNA, 20 bp, Homo sapiens
ttccagtgaggctctgccct

SEQ ID NO: 2576698 - DNA, 21 bp, Homo sapiens
ttccagtgaggctctgccctt

SEQ ID NO: 2576699 - DNA, 21 bp, Homo sapiens
ttccagtgcaacactgaagct

SEQ ID NO: 2576700 - DNA, 20 bp, Homo sapiens
ttccatatggattttctatt

SEQ ID NO: 2576701 - DNA, 14 bp, Homo sapiens
ttccatattcatgt

SEQ ID NO: 2576702 - DNA, 15 bp, Homo sapiens
ttccatattcatgta

SEQ ID NO: 2576703 - DNA, 12 bp, Homo sapiens
ttccatcatgtc

SEQ ID NO: 2576704 - DNA, 17 bp, Homo sapiens
ttccatcatgtccccaa

SEQ ID NO: 2576705 - DNA, 15 bp, Homo sapiens
ttccatccctacccc

SEQ ID NO: 2576706 - DNA, 22 bp, Homo sapiens
ttccatgaaaacgttttattgt

SEQ ID NO: 2576707 - DNA, 15 bp, Homo sapiens
ttccatgaaaatgca

SEQ ID NO: 2576708 - DNA, 18 bp, Homo sapiens
ttccatgaagaccacatc

SEQ ID NO: 2576709 - DNA, 16 bp, Homo sapiens
ttccatgaaggcagag

SEQ ID NO: 2576710 - DNA, 12 bp, Homo sapiens
ttccatgaatgt

SEQ ID NO: 2576711 - DNA, 17 bp, Homo sapiens
ttccatgagtcccctgt

SEQ ID NO: 2576712 - DNA, 23 bp, Homo sapiens
ttccatgcctgagggtggagact

SEQ ID NO: 2576713 - DNA, 14 bp, Homo sapiens
ttccatggactttg

SEQ ID NO: 2576714 - DNA, 12 bp, Homo sapiens
ttccatggggta

SEQ ID NO: 2576715 - DNA, 21 bp, Homo sapiens
ttccatggtgtgatcgtctga

SEQ ID NO: 2576716 - DNA, 16 bp, Homo sapiens
ttccattatgattctt

SEQ ID NO: 2576717 - DNA, 16 bp, Homo sapiens
ttccattccagaatat

SEQ ID NO: 2576718 - DNA, 20 bp, Homo sapiens
ttccattgtttggagacatt

SEQ ID NO: 2576719 - DNA, 13 bp, Homo sapiens
ttccatttgcaag

SEQ ID NO: 2576720 - DNA, 14 bp, Homo sapiens
ttccatttgtgtgt

SEQ ID NO: 2576721 - DNA, 11 bp, Homo sapiens
ttcccaaaagc

SEQ ID NO: 2576722 - DNA, 23 bp, Homo sapiens
ttcccaatagcaacgtagcttct

SEQ ID NO: 2576723 - DNA, 16 bp, Homo sapiens
ttcccacacctccaca

SEQ ID NO: 2576724 - DNA, 15 bp, Homo sapiens
ttcccactcaccccg

SEQ ID NO: 2576725 - DNA, 18 bp, Homo sapiens
ttcccagagcaaaataat

SEQ ID NO: 2576726 - DNA, 21 bp, Homo sapiens
ttcccagagtgtgaaacttcc

SEQ ID NO: 2576727 - DNA, 22 bp, Homo sapiens
ttcccagcagtggactcaaaac

SEQ ID NO: 2576728 - DNA, 14 bp, Homo sapiens
ttcccagggaagtg

SEQ ID NO: 2576729 - DNA, 23 bp, Homo sapiens
ttcccagtgacacttcagagagc

SEQ ID NO: 2576730 - DNA, 14 bp, Homo sapiens
ttcccagtggctgc

SEQ ID NO: 2576731 - DNA, 15 bp, Homo sapiens
ttcccagtggctgct

SEQ ID NO: 2576732 - DNA, 16 bp, Homo sapiens
ttcccagtggctgctg

SEQ ID NO: 2576733 - DNA, 20 bp, Homo sapiens
ttcccagtggctgctgccca

SEQ ID NO: 2576734 - DNA, 21 bp, Homo sapiens
ttcccagtggctgctgcccag

SEQ ID NO: 2576735 - DNA, 18 bp, Homo sapiens
ttcccataattttcttca

SEQ ID NO: 2576736 - DNA, 21 bp, Homo sapiens
ttcccataccacccaatgctg

SEQ ID NO: 2576737 - DNA, 20 bp, Homo sapiens
ttcccatgacccaggctggg

SEQ ID NO: 2576738 - DNA, 14 bp, Homo sapiens
ttcccatttcagct

SEQ ID NO: 2576739 - DNA, 15 bp, Homo sapiens
ttcccatttcagctg

SEQ ID NO: 2576740 - DNA, 13 bp, Homo sapiens
ttccccaacagtg

SEQ ID NO: 2576741 - DNA, 18 bp, Homo sapiens
ttccccaaccacttcatt

SEQ ID NO: 2576742 - DNA, 17 bp, Homo sapiens
ttccccactgacagcct

SEQ ID NO: 2576743 - DNA, 18 bp, Homo sapiens
ttccccactgcctgccca

SEQ ID NO: 2576744 - DNA, 15 bp, Homo sapiens
ttccccaggaggcca

SEQ ID NO: 2576745 - DNA, 16 bp, Homo sapiens
ttccccaggaggccag

SEQ ID NO: 2576746 - DNA, 17 bp, Homo sapiens
ttccccaggaggccagc

SEQ ID NO: 2576747 - DNA, 18 bp, Homo sapiens
ttcccccaacctcagact

SEQ ID NO: 2576748 - DNA, 13 bp, Homo sapiens
ttcccccagccct

SEQ ID NO: 2576749 - DNA, 14 bp, Homo sapiens
ttcccccagccctg

SEQ ID NO: 2576750 - DNA, 15 bp, Homo sapiens
ttcccccagccctgt

SEQ ID NO: 2576751 - DNA, 20 bp, Homo sapiens
ttcccccagccctgtggaag

SEQ ID NO: 2576752 - DNA, 18 bp, Homo sapiens
ttccccccactctcccca

SEQ ID NO: 2576753 - DNA, 15 bp, Homo sapiens
ttccccctcccaggg

SEQ ID NO: 2576754 - DNA, 19 bp, Homo sapiens
ttcccccttttctgcattt

SEQ ID NO: 2576755 - DNA, 16 bp, Homo sapiens
ttcccctccctggctc

SEQ ID NO: 2576756 - DNA, 17 bp, Homo sapiens
ttcccctccctggctcc

SEQ ID NO: 2576757 - DNA, 17 bp, Homo sapiens
ttcccctccttctccct

SEQ ID NO: 2576758 - DNA, 22 bp, Homo sapiens
ttgagaaatgaataatttccca

SEQ ID NO: 2576759 - DNA, 19 bp, Homo sapiens
ttgagaaatgcatattgta

SEQ ID NO: 2576760 - DNA, 16 bp, Homo sapiens
ttgagaagttttgtac

SEQ ID NO: 2576761 - DNA, 13 bp, Homo sapiens
ttgagaattttaa

SEQ ID NO: 2576762 - DNA, 12 bp, Homo sapiens
ttgagacagttt

SEQ ID NO: 2576763 - DNA, 17 bp, Homo sapiens
ttgagacagtttcttag

SEQ ID NO: 2576764 - DNA, 19 bp, Homo sapiens
ttgagacagtttcttagct

SEQ ID NO: 2576765 - DNA, 15 bp, Homo sapiens
ttgagaccagcctgg

SEQ ID NO: 2576766 - DNA, 16 bp, Homo sapiens
ttgagagaccaggcaa

SEQ ID NO: 2576767 - DNA, 19 bp, Homo sapiens
ttgagaggccctggggttc

SEQ ID NO: 2576768 - DNA, 15 bp, Homo sapiens
ttgagatcagcctgg

SEQ ID NO: 2576769 - DNA, 16 bp, Homo sapiens
ttgagatcagcctggg

SEQ ID NO: 2576770 - DNA, 17 bp, Homo sapiens
ttgagatgtatttcaac

SEQ ID NO: 2576771 - DNA, 18 bp, Homo sapiens
ttgagcaactttcttaca

SEQ ID NO: 2576772 - DNA, 12 bp, Homo sapiens
ttgagcagggct

SEQ ID NO: 2576773 - DNA, 13 bp, Homo sapiens
ttgagccaggcct

SEQ ID NO: 2576774 - DNA, 18 bp, Homo sapiens
ttgagccccaagtcctga

SEQ ID NO: 2576775 - DNA, 14 bp, Homo sapiens
ttgagcctgggagg

SEQ ID NO: 2576776 - DNA, 14 bp, Homo sapiens
ttgagccttgaact

SEQ ID NO: 2576777 - DNA, 15 bp, Homo sapiens
ttgagccttgaactt

SEQ ID NO: 2576778 - DNA, 16 bp, Homo sapiens
ttgagccttgaacttt

SEQ ID NO: 2576779 - DNA, 19 bp, Homo sapiens
ttgagctctgcagcccagg

SEQ ID NO: 2576780 - DNA, 12 bp, Homo sapiens
ttgagctgtttt

SEQ ID NO: 2576781 - DNA, 14 bp, Homo sapiens
ttgagggcccagag

SEQ ID NO: 2576782 - DNA, 21 bp, Homo sapiens
ttgagggcccagagcaggaag

SEQ ID NO: 2576783 - DNA, 16 bp, Homo sapiens
ttgaggggctcctgga

SEQ ID NO: 2576784 - DNA, 22 bp, Homo sapiens
ttgagtcattatccttgctatg

SEQ ID NO: 2576785 - DNA, 14 bp, Homo sapiens
ttgagtctgtgcca

SEQ ID NO: 2576786 - DNA, 14 bp, Homo sapiens
ttgagtgctctgat

SEQ ID NO: 2576787 - DNA, 19 bp, Homo sapiens
ttgagtggatgatgtttcg

SEQ ID NO: 2576788 - DNA, 16 bp, Homo sapiens
ttgagttcaggtagct

SEQ ID NO: 2576789 - DNA, 20 bp, Homo sapiens
ttgagttgattcagctctgc

SEQ ID NO: 2576790 - DNA, 19 bp, Homo sapiens
ttgagttttcagtggggca

SEQ ID NO: 2576791 - DNA, 12 bp, Homo sapiens
ttgagttttgtt

SEQ ID NO: 2576792 - DNA, 21 bp, Homo sapiens
ttgagttttgttttaaaatta

SEQ ID NO: 2576793 - DNA, 12 bp, Homo sapiens
ttgataaagtaa

SEQ ID NO: 2576794 - DNA, 13 bp, Homo sapiens
ttgataaagtttc

SEQ ID NO: 2576795 - DNA, 14 bp, Homo sapiens
ttgataaagtttct

SEQ ID NO: 2576796 - DNA, 17 bp, Homo sapiens
ttgataaagtttctcag

SEQ ID NO: 2576797 - DNA, 18 bp, Homo sapiens
ttgataaattccactgga

SEQ ID NO: 2576798 - DNA, 15 bp, Homo sapiens
ttgatacccccctct

SEQ ID NO: 2576799 - DNA, 15 bp, Homo sapiens
ttgatactacagttt

SEQ ID NO: 2576800 - DNA, 16 bp, Homo sapiens
ttgatacttgttcaaa

SEQ ID NO: 2576801 - DNA, 18 bp, Homo sapiens
ttgatataaataaaacat

SEQ ID NO: 2576802 - DNA, 22 bp, Homo sapiens
ttgatatgaaaaatatgatatt

SEQ ID NO: 2576803 - DNA, 17 bp, Homo sapiens
ttgatcaaattcatttt

SEQ ID NO: 2576804 - DNA, 21 bp, Homo sapiens
ttgatccctgttacccagaga

SEQ ID NO: 2576805 - DNA, 14 bp, Homo sapiens
ttgatgaggcctct

SEQ ID NO: 2576806 - DNA, 15 bp, Homo sapiens
ttgatgctggagagg

SEQ ID NO: 2576807 - DNA, 18 bp, Homo sapiens
ttgatgctggagaggtta

SEQ ID NO: 2576808 - DNA, 14 bp, Homo sapiens
ttgatggggaagga

SEQ ID NO: 2576809 - DNA, 23 bp, Homo sapiens
ttgatggtgatgaaatgtaaata

SEQ ID NO: 2576810 - DNA, 13 bp, Homo sapiens
ttgatgtttgtgg

SEQ ID NO: 2576811 - DNA, 16 bp, Homo sapiens
ttgatgtttgtggcct

SEQ ID NO: 2576812 - DNA, 17 bp, Homo sapiens
ttgatgtttgtggcctc

SEQ ID NO: 2576813 - DNA, 23 bp, Homo sapiens
ttgatgttttaaggatgcttgta

SEQ ID NO: 2576814 - DNA, 13 bp, Homo sapiens
ttgattaaattct

SEQ ID NO: 2576815 - DNA, 16 bp, Homo sapiens
ttgattaaattcttgc

SEQ ID NO: 2576816 - DNA, 13 bp, Homo sapiens
ttgattatgcata

SEQ ID NO: 2576817 - DNA, 17 bp, Homo sapiens
ttgattcagacagctgc

SEQ ID NO: 2576818 - DNA, 15 bp, Homo sapiens
ttgattgctaaatgt

SEQ ID NO: 2576819 - DNA, 23 bp, Homo sapiens
ttgattgctaaatgtaacagtct

SEQ ID NO: 2576820 - DNA, 19 bp, Homo sapiens
ttgatttatgcatggaaac

SEQ ID NO: 2576821 - DNA, 23 bp, Homo sapiens
ttgattttacaattgaaatgact

SEQ ID NO: 2576822 - DNA, 14 bp, Homo sapiens
ttgattttctgttg

SEQ ID NO: 2576823 - DNA, 17 bp, Homo sapiens
ttgcaaaagactaattt

SEQ ID NO: 2576824 - DNA, 15 bp, Homo sapiens
ttgcaaaatttccag

SEQ ID NO: 2576825 - DNA, 16 bp, Homo sapiens
ttgcaaaatttccagt

SEQ ID NO: 2576826 - DNA, 23 bp, Homo sapiens
ttgcaaatgcccttacacttact

SEQ ID NO: 2576827 - DNA, 13 bp, Homo sapiens
ttgcaacacacag

SEQ ID NO: 2576828 - DNA, 12 bp, Homo sapiens
ttgcaaccactg

SEQ ID NO: 2576829 - DNA, 14 bp, Homo sapiens
ttgcaagaatcagt

SEQ ID NO: 2576830 - DNA, 12 bp, Homo sapiens
ttgcaaggaagc

SEQ ID NO: 2576831 - DNA, 13 bp, Homo sapiens
ttgcaaggaagcc

SEQ ID NO: 2576832 - DNA, 14 bp, Homo sapiens
ttgcaataatactt

SEQ ID NO: 2576833 - DNA, 19 bp, Homo sapiens
ttgcacaaaccaattaaac

SEQ ID NO: 2576834 - DNA, 21 bp, Homo sapiens
ttgcacaatattgaacttttt

SEQ ID NO: 2576835 - DNA, 17 bp, Homo sapiens
ttgcacactcccctgca

SEQ ID NO: 2576836 - DNA, 16 bp, Homo sapiens
ttgcacccagccctgg

SEQ ID NO: 2576837 - DNA, 13 bp, Homo sapiens
ttgcacccctcac

SEQ ID NO: 2576838 - DNA, 22 bp, Homo sapiens
ttgcacccctcactctggcctc

SEQ ID NO: 2576839 - DNA, 15 bp, Homo sapiens
ttgcacccctcccat

SEQ ID NO: 2576840 - DNA, 15 bp, Homo sapiens
ttgcacggctgctga

SEQ ID NO: 2576841 - DNA, 15 bp, Homo sapiens
ttgcactaaagtatg

SEQ ID NO: 2576842 - DNA, 19 bp, Homo sapiens
ttgcactctaaaaggttca

SEQ ID NO: 2576843 - DNA, 15 bp, Homo sapiens
ttgcagaaacatttt

SEQ ID NO: 2576844 - DNA, 18 bp, Homo sapiens
ttgcagattcatttttct

SEQ ID NO: 2576845 - DNA, 14 bp, Homo sapiens
ttgcagcagtgagt

SEQ ID NO: 2576846 - DNA, 18 bp, Homo sapiens
ttgcagcgattaataaca

SEQ ID NO: 2576847 - DNA, 19 bp, Homo sapiens
ttgcagcgattaataacag

SEQ ID NO: 2576848 - DNA, 23 bp, Homo sapiens
ttgcaggagcagtatcatgaagc

SEQ ID NO: 2576849 - DNA, 18 bp, Homo sapiens
ttgcagggagcatggctg

SEQ ID NO: 2576850 - DNA, 18 bp, Homo sapiens
ttgcaggtggaactcagt

SEQ ID NO: 2576851 - DNA, 17 bp, Homo sapiens
ttgcagtagattttctt

SEQ ID NO: 2576852 - DNA, 16 bp, Homo sapiens
ttgcagttcagcacca

SEQ ID NO: 2576853 - DNA, 23 bp, Homo sapiens
ttgcagtttatcattcaagtgta

SEQ ID NO: 2576854 - DNA, 15 bp, Homo sapiens
ttgcataataagcta

SEQ ID NO: 2576855 - DNA, 22 bp, Homo sapiens
ttgcatagtaccaatcatttta

SEQ ID NO: 2576856 - DNA, 20 bp, Homo sapiens
ttgcatctcccagataatgt

SEQ ID NO: 2576857 - DNA, 19 bp, Homo sapiens
ttgcatggcatcacctcca

SEQ ID NO: 2576858 - DNA, 19 bp, Homo sapiens
ttgcatggctccagaaatg

SEQ ID NO: 2576859 - DNA, 15 bp, Homo sapiens
ttgcatgtggatcaa

SEQ ID NO: 2576860 - DNA, 17 bp, Homo sapiens
ttgcatgttccactaac

SEQ ID NO: 2576861 - DNA, 11 bp, Homo sapiens
ttgcattcaaa

SEQ ID NO: 2576862 - DNA, 21 bp, Homo sapiens
ttgcatttaaaacagacactg

SEQ ID NO: 2576863 - DNA, 17 bp, Homo sapiens
ttgcattttaaaaatga

SEQ ID NO: 2576864 - DNA, 21 bp, Homo sapiens
ttgccaatgaggtctgaaatg

SEQ ID NO: 2576865 - DNA, 19 bp, Homo sapiens
ttgccaccccaccctccct

SEQ ID NO: 2576866 - DNA, 21 bp, Homo sapiens
ttgccaccccaccctccctgg

SEQ ID NO: 2576867 - DNA, 22 bp, Homo sapiens
ttgccaccccaccctccctgga

SEQ ID NO: 2576868 - DNA, 13 bp, Homo sapiens
ttgccaccctcat

SEQ ID NO: 2576869 - DNA, 15 bp, Homo sapiens
ttgccagaaagcata

SEQ ID NO: 2576870 - DNA, 20 bp, Homo sapiens
ttgccagaaagcataaaatt

SEQ ID NO: 2576871 - DNA, 12 bp, Homo sapiens
ttgccaggctag

SEQ ID NO: 2576872 - DNA, 13 bp, Homo sapiens
ttgccagtcaccc

SEQ ID NO: 2576873 - DNA, 20 bp, Homo sapiens
ttgccatgggcttcactgta

SEQ ID NO: 2576874 - DNA, 16 bp, Homo sapiens
ttgccatgttggccag

SEQ ID NO: 2576875 - DNA, 20 bp, Homo sapiens
ttgccatgttggccaggctg

SEQ ID NO: 2576876 - DNA, 23 bp, Homo sapiens
ttgcccacgctggagtgcagtga

SEQ ID NO: 2576877 - DNA, 14 bp, Homo sapiens
ttgcccaggcaggt

SEQ ID NO: 2576878 - DNA, 11 bp, Homo sapiens
ttgcccaggct

SEQ ID NO: 2576879 - DNA, 12 bp, Homo sapiens
ttgcccaggctg

SEQ ID NO: 2576880 - DNA, 18 bp, Homo sapiens
ttgcccaggctggtctca

SEQ ID NO: 2576881 - DNA, 17 bp, Homo sapiens
ttgcccagggctcagcc

SEQ ID NO: 2576882 - DNA, 12 bp, Homo sapiens
ttgccccccacc

SEQ ID NO: 2576883 - DNA, 23 bp, Homo sapiens
ttgccccggccccggccccagcc

SEQ ID NO: 2576884 - DNA, 13 bp, Homo sapiens
ttgcccctgagac

SEQ ID NO: 2576885 - DNA, 12 bp, Homo sapiens
ttgccctgacct

SEQ ID NO: 2576886 - DNA, 21 bp, Homo sapiens
ttgccctgacctcccagccct

SEQ ID NO: 2576887 - DNA, 16 bp, Homo sapiens
ttgcccttcacagtgt

SEQ ID NO: 2576888 - DNA, 14 bp, Homo sapiens
ttgcccttccctgt

SEQ ID NO: 2576889 - DNA, 19 bp, Homo sapiens
ttgcccttccctgtccctc

SEQ ID NO: 2576890 - DNA, 18 bp, Homo sapiens
ttgcccttgccctgacct

SEQ ID NO: 2576891 - DNA, 21 bp, Homo sapiens
ttgccgcgtcgccctcccagg

SEQ ID NO: 2576892 - DNA, 22 bp, Homo sapiens
ttgccgcgtcgccctcccaggc

SEQ ID NO: 2576893 - DNA, 13 bp, Homo sapiens
ttgccgtctacct

SEQ ID NO: 2576894 - DNA, 15 bp, Homo sapiens
ttgcctctctgtttg

SEQ ID NO: 2576895 - DNA, 19 bp, Homo sapiens
ttgcctgcagagagaagcc

SEQ ID NO: 2576896 - DNA, 12 bp, Homo sapiens
ttgcctgcaggc

SEQ ID NO: 2576897 - DNA, 12 bp, Homo sapiens
ttgcctgtgcca

SEQ ID NO: 2576898 - DNA, 16 bp, Homo sapiens
ttgccttaactggagc

SEQ ID NO: 2576899 - DNA, 17 bp, Homo sapiens
ttgccttattaaagttc

SEQ ID NO: 2576900 - DNA, 23 bp, Homo sapiens
ttgcctttagtgatcacagcagc

SEQ ID NO: 2576901 - DNA, 11 bp, Homo sapiens
ttgcctttctc

SEQ ID NO: 2576902 - DNA, 17 bp, Homo sapiens
ttgcctttgttttgatg

SEQ ID NO: 2576903 - DNA, 16 bp, Homo sapiens
ttgcgtatgtctgtta

SEQ ID NO: 2576904 - DNA, 21 bp, Homo sapiens
tttatggtttcccccttctac

SEQ ID NO: 2576905 - DNA, 18 bp, Homo sapiens
tttatgtgtgaggagctg

SEQ ID NO: 2576906 - DNA, 22 bp, Homo sapiens
tttatgtgtgaggagctgctgg

SEQ ID NO: 2576907 - DNA, 14 bp, Homo sapiens
tttattaaaatctt

SEQ ID NO: 2576908 - DNA, 22 bp, Homo sapiens
tttattaaaatgattgtaaaat

SEQ ID NO: 2576909 - DNA, 23 bp, Homo sapiens
tttattaaaatgattgtaaaata

SEQ ID NO: 2576910 - DNA, 13 bp, Homo sapiens
tttattacctctg

SEQ ID NO: 2576911 - DNA, 14 bp, Homo sapiens
tttattacctctga

SEQ ID NO: 2576912 - DNA, 20 bp, Homo sapiens
tttattacctctgatacctc

SEQ ID NO: 2576913 - DNA, 13 bp, Homo sapiens
tttattactgatt

SEQ ID NO: 2576914 - DNA, 17 bp, Homo sapiens
tttattattttcacctg

SEQ ID NO: 2576915 - DNA, 17 bp, Homo sapiens
tttattcagcttcattt

SEQ ID NO: 2576916 - DNA, 22 bp, Homo sapiens
tttattcagcttcatttgtgtc

SEQ ID NO: 2576917 - DNA, 16 bp, Homo sapiens
tttattcctgtatgtt

SEQ ID NO: 2576918 - DNA, 14 bp, Homo sapiens
tttattccttgtga

SEQ ID NO: 2576919 - DNA, 12 bp, Homo sapiens
tttattgacaat

SEQ ID NO: 2576920 - DNA, 24 bp, Homo sapiens
tttattgcatctgggtagctgtaa

SEQ ID NO: 2576921 - DNA, 17 bp, Homo sapiens
tttattgcttgatactt

SEQ ID NO: 2576922 - DNA, 13 bp, Homo sapiens
tttattgtataaa

SEQ ID NO: 2576923 - DNA, 19 bp, Homo sapiens
tttatttagttccttgagt

SEQ ID NO: 2576924 - DNA, 14 bp, Homo sapiens
tttatttattaaga

SEQ ID NO: 2576925 - DNA, 21 bp, Homo sapiens
tttattttcttttgtaaatgt

SEQ ID NO: 2576926 - DNA, 15 bp, Homo sapiens
tttatttttcatatt

SEQ ID NO: 2576927 - DNA, 17 bp, Homo sapiens
tttatttttcatattgt

SEQ ID NO: 2576928 - DNA, 20 bp, Homo sapiens
tttatttttcatattgtgcc

SEQ ID NO: 2576929 - DNA, 17 bp, Homo sapiens
tttatttttcatttagt

SEQ ID NO: 2576930 - DNA, 22 bp, Homo sapiens
tttatttttccatttacaacaa

SEQ ID NO: 2576931 - DNA, 15 bp, Homo sapiens
tttatttttctaaaa

SEQ ID NO: 2576932 - DNA, 14 bp, Homo sapiens
tttattttttaagt

SEQ ID NO: 2576933 - DNA, 15 bp, Homo sapiens
tttcaaaaacacagt

SEQ ID NO: 2576934 - DNA, 13 bp, Homo sapiens
tttcaaaaacatt

SEQ ID NO: 2576935 - DNA, 16 bp, Homo sapiens
tttcaaaaatataact

SEQ ID NO: 2576936 - DNA, 17 bp, Homo sapiens
tttcaaaaatataactt

SEQ ID NO: 2576937 - DNA, 18 bp, Homo sapiens
tttcaaaaccttttgaaa

SEQ ID NO: 2576938 - DNA, 20 bp, Homo sapiens
tttcaaaactcatttcctat

SEQ ID NO: 2576939 - DNA, 20 bp, Homo sapiens
tttcaaaataaaaaccaaga

SEQ ID NO: 2576940 - DNA, 20 bp, Homo sapiens
tttcaaactcctgactttgt

SEQ ID NO: 2576941 - DNA, 15 bp, Homo sapiens
tttcaaactttacta

SEQ ID NO: 2576942 - DNA, 22 bp, Homo sapiens
tttcaaactttactatggccct

SEQ ID NO: 2576943 - DNA, 17 bp, Homo sapiens
tttcaaagggagagaga

SEQ ID NO: 2576944 - DNA, 19 bp, Homo sapiens
tttcaaatagggtctaact

SEQ ID NO: 2576945 - DNA, 23 bp, Homo sapiens
tttcaacaagtagctaaagtctg

SEQ ID NO: 2576946 - DNA, 17 bp, Homo sapiens
tttcaagaaactgagga

SEQ ID NO: 2576947 - DNA, 20 bp, Homo sapiens
tttcaagacattaaatctat

SEQ ID NO: 2576948 - DNA, 21 bp, Homo sapiens
tttcaagtgaatctaaaagct

SEQ ID NO: 2576949 - DNA, 22 bp, Homo sapiens
tttcaagttccaagttgctaat

SEQ ID NO: 2576950 - DNA, 17 bp, Homo sapiens
tttcaatattttccttc

SEQ ID NO: 2576951 - DNA, 21 bp, Homo sapiens
tttcaatggtttgcaaggaag

SEQ ID NO: 2576952 - DNA, 18 bp, Homo sapiens
tttcaattaaacggatta

SEQ ID NO: 2576953 - DNA, 21 bp, Homo sapiens
tttcaattaaacggattattt

SEQ ID NO: 2576954 - DNA, 14 bp, Homo sapiens
tttcaatttccaag

SEQ ID NO: 2576955 - DNA, 19 bp, Homo sapiens
tttcaatttccaagagctg

SEQ ID NO: 2576956 - DNA, 13 bp, Homo sapiens
tttcacaacagat

SEQ ID NO: 2576957 - DNA, 13 bp, Homo sapiens
tttcacagttttt

SEQ ID NO: 2576958 - DNA, 16 bp, Homo sapiens
tttcacatagctgtct

SEQ ID NO: 2576959 - DNA, 13 bp, Homo sapiens
tttcacattctta

SEQ ID NO: 2576960 - DNA, 15 bp, Homo sapiens
tttcacattcttata

SEQ ID NO: 2576961 - DNA, 13 bp, Homo sapiens
tttcacctgtaaa

SEQ ID NO: 2576962 - DNA, 14 bp, Homo sapiens
tttcacctgtaaac

SEQ ID NO: 2576963 - DNA, 17 bp, Homo sapiens
tttcacctgtaaacctg

SEQ ID NO: 2576964 - DNA, 23 bp, Homo sapiens
tttcacctgtttttaagctgttt

SEQ ID NO: 2576965 - DNA, 23 bp, Homo sapiens
tttcactccggagtgagaagctt

SEQ ID NO: 2576966 - DNA, 23 bp, Homo sapiens
tttcactggccacagttgtttga

SEQ ID NO: 2576967 - DNA, 24 bp, Homo sapiens
tttcactgtagaatgatttcatgc

SEQ ID NO: 2576968 - DNA, 12 bp, Homo sapiens
tttcactttaga

SEQ ID NO: 2576969 - DNA, 20 bp, Homo sapiens
tttcagaaatatgtggtttc

SEQ ID NO: 2576970 - DNA, 13 bp, Homo sapiens
tttcagaaatgtg

SEQ ID NO: 2576971 - DNA, 19 bp, Homo sapiens
tttcagaacctcttcccca

SEQ ID NO: 2576972 - DNA, 15 bp, Homo sapiens
tttcagatatatatc

SEQ ID NO: 2576973 - DNA, 16 bp, Homo sapiens
tttcagatgcttctgg

SEQ ID NO: 2576974 - DNA, 12 bp, Homo sapiens
tttcagatgtct

SEQ ID NO: 2576975 - DNA, 23 bp, Homo sapiens
tttcagcacctacagtgtacagt

SEQ ID NO: 2576976 - DNA, 16 bp, Homo sapiens
tttcaggaccttttga

SEQ ID NO: 2576977 - DNA, 13 bp, Homo sapiens
tttcaggatactc

SEQ ID NO: 2576978 - DNA, 20 bp, Homo sapiens
tttcagtattagtgatgtca

SEQ ID NO: 2576979 - DNA, 21 bp, Homo sapiens
tttcagtattttggagaaatt

SEQ ID NO: 2576980 - DNA, 17 bp, Homo sapiens
tttcagtgaaagcatca

SEQ ID NO: 2576981 - DNA, 13 bp, Homo sapiens
tttcagtgtacat

SEQ ID NO: 2576982 - DNA, 21 bp, Homo sapiens
tttcagttgatcactggcaat

SEQ ID NO: 2576983 - DNA, 15 bp, Homo sapiens
tttcagttttcagga

SEQ ID NO: 2576984 - DNA, 14 bp, Homo sapiens
tttcatacacttat

SEQ ID NO: 2576985 - DNA, 20 bp, Homo sapiens
tttcatagattgagaagttt

SEQ ID NO: 2576986 - DNA, 13 bp, Homo sapiens
tttcatattttag

SEQ ID NO: 2576987 - DNA, 16 bp, Homo sapiens
tttcatcatattatac

SEQ ID NO: 2576988 - DNA, 23 bp, Homo sapiens
tttcatccctatgggattcagtg

SEQ ID NO: 2576989 - DNA, 18 bp, Homo sapiens
tttcatctatttctgaga

SEQ ID NO: 2576990 - DNA, 15 bp, Homo sapiens
tttcatctgggaaag

SEQ ID NO: 2576991 - DNA, 19 bp, Homo sapiens
tttcatgctatctctgtgt

SEQ ID NO: 2576992 - DNA, 19 bp, Homo sapiens
tttcatgtaaactgtgcac

SEQ ID NO: 2576993 - DNA, 21 bp, Homo sapiens
tttcattaatacagggcattt

SEQ ID NO: 2576994 - DNA, 13 bp, Homo sapiens
tttcattattagt

SEQ ID NO: 2576995 - DNA, 15 bp, Homo sapiens
tttcattctcctgcc

SEQ ID NO: 2576996 - DNA, 13 bp, Homo sapiens
tttcattcttctc

SEQ ID NO: 2576997 - DNA, 22 bp, Homo sapiens
tttcattgactatcaaactgaa

SEQ ID NO: 2576998 - DNA, 21 bp, Homo sapiens
tttcattgatatgaaaaatat

SEQ ID NO: 2576999 - DNA, 22 bp, Homo sapiens
tttcattgatatgaaaaatatg

SEQ ID NO: 2577000 - DNA, 18 bp, Homo sapiens
tttcattgtatgatgtgt

SEQ ID NO: 2577001 - DNA, 20 bp, Homo sapiens
tttcattgtatgatgtgttg

SEQ ID NO: 2577002 - DNA, 14 bp, Homo sapiens
tttcatttactgtg

SEQ ID NO: 2577003 - DNA, 17 bp, Homo sapiens
tttcatttactgtggct

SEQ ID NO: 2577004 - DNA, 14 bp, Homo sapiens
tttcatttcaactg

SEQ ID NO: 2577005 - DNA, 13 bp, Homo sapiens
tttccaaaggcat

SEQ ID NO: 2577006 - DNA, 15 bp, Homo sapiens
tttccaaataaaatg

SEQ ID NO: 2577007 - DNA, 15 bp, Homo sapiens
tttccaacaccacag

SEQ ID NO: 2577008 - DNA, 23 bp, Homo sapiens
tttccaacaccacagacacacac

SEQ ID NO: 2577009 - DNA, 13 bp, Homo sapiens
tttccaagagctg

SEQ ID NO: 2577010 - DNA, 17 bp, Homo sapiens
tttccacacctggcact

SEQ ID NO: 2577011 - DNA, 20 bp, Homo sapiens
tttccacataaggaaactgg

SEQ ID NO: 2577012 - DNA, 23 bp, Homo sapiens
tttccacataaggaaactgggtt

SEQ ID NO: 2577013 - DNA, 15 bp, Homo sapiens
tttccaccccctccc

SEQ ID NO: 2577014 - DNA, 22 bp, Homo sapiens
tttccaccccctccctggcctg

SEQ ID NO: 2577015 - DNA, 23 bp, Homo sapiens
tttccacggagccactcctctga

SEQ ID NO: 2577016 - DNA, 13 bp, Homo sapiens
tttccactactgc

SEQ ID NO: 2577017 - DNA, 12 bp, Homo sapiens
tttccagtgcaa

SEQ ID NO: 2577018 - DNA, 18 bp, Homo sapiens
tttccatatggattttct

SEQ ID NO: 2577019 - DNA, 17 bp, Homo sapiens
tttccatgaagtttgaa

SEQ ID NO: 2577020 - DNA, 19 bp, Homo sapiens
tttccatgcgtgtttctga

SEQ ID NO: 2577021 - DNA, 21 bp, Homo sapiens
tttccattatttatattagtt

SEQ ID NO: 2577022 - DNA, 13 bp, Homo sapiens
tttccattccaga

SEQ ID NO: 2577023 - DNA, 14 bp, Homo sapiens
tttccattgtttga

SEQ ID NO: 2577024 - DNA, 20 bp, Homo sapiens
tttcccacaccgtgtaaacc

SEQ ID NO: 2577025 - DNA, 13 bp, Homo sapiens
tttccccccactc

SEQ ID NO: 2577026 - DNA, 20 bp, Homo sapiens
tttcccctgcccccagacct

SEQ ID NO: 2577027 - DNA, 21 bp, Homo sapiens
tttcccctgtggggatctcag

SEQ ID NO: 2577028 - DNA, 14 bp, Homo sapiens
tttccctcgctggg

SEQ ID NO: 2577029 - DNA, 13 bp, Homo sapiens
tttccctgacctc

SEQ ID NO: 2577030 - DNA, 16 bp, Homo sapiens
tttccctgcctctcat

SEQ ID NO: 2577031 - DNA, 17 bp, Homo sapiens
tttcctaaatgcagtga

SEQ ID NO: 2577032 - DNA, 13 bp, Homo sapiens
tttcctaaatgtt

SEQ ID NO: 2577033 - DNA, 23 bp, Homo sapiens
tttcctaataaagttctgtactc

SEQ ID NO: 2577034 - DNA, 24 bp, Homo sapiens
tttcctactctcaggatcaagaaa

SEQ ID NO: 2577035 - DNA, 14 bp, Homo sapiens
tttcctccccagca

SEQ ID NO: 2577036 - DNA, 13 bp, Homo sapiens
tttcctccctcag

SEQ ID NO: 2577037 - DNA, 22 bp, Homo sapiens
tttcctcccttgggttctgata

SEQ ID NO: 2577038 - DNA, 22 bp, Homo sapiens
tttcctcttagtcgagccaagt

SEQ ID NO: 2577039 - DNA, 22 bp, Homo sapiens
tttcctcttctattttgtaaac

SEQ ID NO: 2577040 - DNA, 18 bp, Homo sapiens
tttcctgagcttggccag

SEQ ID NO: 2577041 - DNA, 16 bp, Homo sapiens
tttcctggacactcag

SEQ ID NO: 2577042 - DNA, 19 bp, Homo sapiens
tttcctggcactgcttcca

SEQ ID NO: 2577043 - DNA, 23 bp, Homo sapiens
tttcctggcactgcttccagtga

SEQ ID NO: 2577044 - DNA, 14 bp, Homo sapiens
tttcctggtgccaa

SEQ ID NO: 2577045 - DNA, 19 bp, Homo sapiens
tttcctgtagccttctgta

SEQ ID NO: 2577046 - DNA, 18 bp, Homo sapiens
tttccttctcatctgtga

SEQ ID NO: 2577047 - DNA, 12 bp, Homo sapiens
tttccttgctca

SEQ ID NO: 2577048 - DNA, 22 bp, Homo sapiens
tttttacctaccacagtgtctg

SEQ ID NO: 2577049 - DNA, 13 bp, Homo sapiens
tttttactgccac

SEQ ID NO: 2577050 - DNA, 14 bp, Homo sapiens
tttttagatcaaat

SEQ ID NO: 2577051 - DNA, 21 bp, Homo sapiens
tttttagatcaaatactttaa

SEQ ID NO: 2577052 - DNA, 14 bp, Homo sapiens
tttttatatataca

SEQ ID NO: 2577053 - DNA, 15 bp, Homo sapiens
tttttatatttagtt

SEQ ID NO: 2577054 - DNA, 20 bp, Homo sapiens
tttttatcgtcactgcttaa

SEQ ID NO: 2577055 - DNA, 14 bp, Homo sapiens
tttttatctttata

SEQ ID NO: 2577056 - DNA, 20 bp, Homo sapiens
tttttatggcttttgtgcat

SEQ ID NO: 2577057 - DNA, 22 bp, Homo sapiens
tttttatggcttttgtgcatta

SEQ ID NO: 2577058 - DNA, 19 bp, Homo sapiens
tttttcaaagatgtgttgc

SEQ ID NO: 2577059 - DNA, 16 bp, Homo sapiens
tttttcaatatttatt

SEQ ID NO: 2577060 - DNA, 19 bp, Homo sapiens
tttttcaattaaacggatt

SEQ ID NO: 2577061 - DNA, 18 bp, Homo sapiens
tttttcatgttttaacaa

SEQ ID NO: 2577062 - DNA, 21 bp, Homo sapiens
tttttccacataaggaaactg

SEQ ID NO: 2577063 - DNA, 16 bp, Homo sapiens
tttttccttcccttct

SEQ ID NO: 2577064 - DNA, 16 bp, Homo sapiens
tttttctcaaagtttt

SEQ ID NO: 2577065 - DNA, 14 bp, Homo sapiens
tttttctgcttttg

SEQ ID NO: 2577066 - DNA, 13 bp, Homo sapiens
tttttctttataa

SEQ ID NO: 2577067 - DNA, 20 bp, Homo sapiens
tttttgaggctatgaatata

SEQ ID NO: 2577068 - DNA, 21 bp, Homo sapiens
tttttgataaagtttctcaga

SEQ ID NO: 2577069 - DNA, 22 bp, Homo sapiens
tttttgcaccccatgctgttga

SEQ ID NO: 2577070 - DNA, 17 bp, Homo sapiens
tttttgcatttaaaaca

SEQ ID NO: 2577071 - DNA, 14 bp, Homo sapiens
tttttgccttcatt

SEQ ID NO: 2577072 - DNA, 21 bp, Homo sapiens
tttttggagaaggttatcaaa

SEQ ID NO: 2577073 - DNA, 14 bp, Homo sapiens
tttttgtaaagtgt

SEQ ID NO: 2577074 - DNA, 12 bp, Homo sapiens
tttttgtactgt

SEQ ID NO: 2577075 - DNA, 12 bp, Homo sapiens
tttttgtcatca

SEQ ID NO: 2577076 - DNA, 20 bp, Homo sapiens
tttttgttcttaattgcact

SEQ ID NO: 2577077 - DNA, 17 bp, Homo sapiens
ttttttaagtatttata

SEQ ID NO: 2577078 - DNA, 12 bp, Homo sapiens
ttttttaatttt

SEQ ID NO: 2577079 - DNA, 13 bp, Homo sapiens
ttttttatgctaa

SEQ ID NO: 2577080 - DNA, 12 bp, Homo sapiens
ttttttcagacc

SEQ ID NO: 2577081 - DNA, 12 bp, Homo sapiens
ttttttctgaat

SEQ ID NO: 2577082 - DNA, 23 bp, Homo sapiens
ttttttggggatatgcttagtaa

SEQ ID NO: 2577083 - DNA, 13 bp, Homo sapiens
ttttttgtattat

SEQ ID NO: 2577084 - DNA, 11 bp, Homo sapiens
tttttttacta

SEQ ID NO: 2577085 - DNA, 10 bp, Homo sapiens
tttttttcca

SEQ ID NO: 2577086 - DNA, 13 bp, Homo sapiens
aaactcttatctc

SEQ ID NO: 2577087 - DNA, 14 bp, Homo sapiens
aaactgaagccaga

SEQ ID NO: 2577088 - DNA, 16 bp, Homo sapiens
aaactgaatgaaaccc

SEQ ID NO: 2577089 - DNA, 14 bp, Homo sapiens
aaactgaggaattt

SEQ ID NO: 2577090 - DNA, 15 bp, Homo sapiens
aaactgccagcaacg

SEQ ID NO: 2577091 - DNA, 16 bp, Homo sapiens
aaactggggcctccct

SEQ ID NO: 2577092 - DNA, 22 bp, Homo sapiens
aaactggtttgttgcagccaaa

SEQ ID NO: 2577093 - DNA, 15 bp, Homo sapiens
aaactgtagtctcag

SEQ ID NO: 2577094 - DNA, 16 bp, Homo sapiens
aaactgtagtctcagg

SEQ ID NO: 2577095 - DNA, 19 bp, Homo sapiens
aaactgtgtattccaagac

SEQ ID NO: 2577096 - DNA, 14 bp, Homo sapiens
aaacttacacacaa

SEQ ID NO: 2577097 - DNA, 13 bp, Homo sapiens
aaacttatttttt

SEQ ID NO: 2577098 - DNA, 22 bp, Homo sapiens
aaacttgatgtgttatctctta

SEQ ID NO: 2577099 - DNA, 16 bp, Homo sapiens
aaacttgtaatttttt

SEQ ID NO: 2577100 - DNA, 20 bp, Homo sapiens
aaacttgtaatttttttaat

SEQ ID NO: 2577101 - DNA, 14 bp, Homo sapiens
aaactttacctttt

SEQ ID NO: 2577102 - DNA, 12 bp, Homo sapiens
aaacttttctca

SEQ ID NO: 2577103 - DNA, 14 bp, Homo sapiens
aaacttttctcaga

SEQ ID NO: 2577104 - DNA, 18 bp, Homo sapiens
aaagaaaaaaaagaaagc

SEQ ID NO: 2577105 - DNA, 13 bp, Homo sapiens
aaagaaaaaaaat

SEQ ID NO: 2577106 - DNA, 14 bp, Homo sapiens
aaagaaaagataaa

SEQ ID NO: 2577107 - DNA, 21 bp, Homo sapiens
aaagaaaataaaaaaaagaaa

SEQ ID NO: 2577108 - DNA, 20 bp, Homo sapiens
aaagaaacccgacagaggga

SEQ ID NO: 2577109 - DNA, 23 bp, Homo sapiens
aaagaaacccgacagagggaaga

SEQ ID NO: 2577110 - DNA, 13 bp, Homo sapiens
aaagaaagagaga

SEQ ID NO: 2577111 - DNA, 15 bp, Homo sapiens
aaagaaagagagaaa

SEQ ID NO: 2577112 - DNA, 15 bp, Homo sapiens
aaagaaatgtaaggg

SEQ ID NO: 2577113 - DNA, 18 bp, Homo sapiens
aaagaacatggacttgta

SEQ ID NO: 2577114 - DNA, 22 bp, Homo sapiens
aaagaacatggacttgtatatt

SEQ ID NO: 2577115 - DNA, 22 bp, Homo sapiens
aaagaaccaaaagttttcctga

SEQ ID NO: 2577116 - DNA, 23 bp, Homo sapiens
aaagaaccaacaacctcaactgc

SEQ ID NO: 2577117 - DNA, 17 bp, Homo sapiens
aaagaagaaacgtctat

SEQ ID NO: 2577118 - DNA, 17 bp, Homo sapiens
aaagaagaacttgcatg

SEQ ID NO: 2577119 - DNA, 19 bp, Homo sapiens
aaagaagacaacattaaaa

SEQ ID NO: 2577120 - DNA, 14 bp, Homo sapiens
aaagaagacatgtt

SEQ ID NO: 2577121 - DNA, 21 bp, Homo sapiens
aaagaagacatgttttagaca

SEQ ID NO: 2577122 - DNA, 22 bp, Homo sapiens
aaagaaggtttgtgtttttctg

SEQ ID NO: 2577123 - DNA, 18 bp, Homo sapiens
aaagaagtggggacagag

SEQ ID NO: 2577124 - DNA, 15 bp, Homo sapiens
aaagaagtttgatat

SEQ ID NO: 2577125 - DNA, 17 bp, Homo sapiens
aaagaatacagaaagat

SEQ ID NO: 2577126 - DNA, 22 bp, Homo sapiens
aaagaatgagaaggagtcagaa

SEQ ID NO: 2577127 - DNA, 17 bp, Homo sapiens
aaagacaaattctgttt

SEQ ID NO: 2577128 - DNA, 19 bp, Homo sapiens
aaagacaattctttataca

SEQ ID NO: 2577129 - DNA, 9 bp, Homo sapiens
aaagacaga

SEQ ID NO: 2577130 - DNA, 13 bp, Homo sapiens
aaagacagaagcc

SEQ ID NO: 2577131 - DNA, 18 bp, Homo sapiens
aaagacatccataaagaa

SEQ ID NO: 2577132 - DNA, 19 bp, Homo sapiens
aaagacattctgacatctt

SEQ ID NO: 2577133 - DNA, 15 bp, Homo sapiens
aaagaccatttttcc

SEQ ID NO: 2577134 - DNA, 23 bp, Homo sapiens
aaagacgaccagcatttaaccaa

SEQ ID NO: 2577135 - DNA, 23 bp, Homo sapiens
aaagactaatttaaaaaataact

SEQ ID NO: 2577136 - DNA, 15 bp, Homo sapiens
aaagactcagtgttc

SEQ ID NO: 2577137 - DNA, 15 bp, Homo sapiens
aaagactccaaagaa

SEQ ID NO: 2577138 - DNA, 19 bp, Homo sapiens
aaagactgaccaatattgt

SEQ ID NO: 2577139 - DNA, 16 bp, Homo sapiens
aaagactgagctcaag

SEQ ID NO: 2577140 - DNA, 12 bp, Homo sapiens
aaagactggctt

SEQ ID NO: 2577141 - DNA, 14 bp, Homo sapiens
aaagactgtacaaa

SEQ ID NO: 2577142 - DNA, 20 bp, Homo sapiens
aaagacttagtatattttct

SEQ ID NO: 2577143 - DNA, 19 bp, Homo sapiens
aaagacttttccaaccctc

SEQ ID NO: 2577144 - DNA, 12 bp, Homo sapiens
aaagagaaaaga

SEQ ID NO: 2577145 - DNA, 13 bp, Homo sapiens
aaagagaaaagaa

SEQ ID NO: 2577146 - DNA, 15 bp, Homo sapiens
aaagagaagtattat

SEQ ID NO: 2577147 - DNA, 18 bp, Homo sapiens
aaagagacctacctcagg

SEQ ID NO: 2577148 - DNA, 15 bp, Homo sapiens
aaagagagaaaataa

SEQ ID NO: 2577149 - DNA, 22 bp, Homo sapiens
aaagagagaaaataaaaagtta

SEQ ID NO: 2577150 - DNA, 16 bp, Homo sapiens
aaagagatattttaaa

SEQ ID NO: 2577151 - DNA, 12 bp, Homo sapiens
aaagaggaaaga

SEQ ID NO: 2577152 - DNA, 16 bp, Homo sapiens
aaagaggctgaaagag

SEQ ID NO: 2577153 - DNA, 19 bp, Homo sapiens
aaagaggtttttcttaaat

SEQ ID NO: 2577154 - DNA, 16 bp, Homo sapiens
aaagagttcttaagga

SEQ ID NO: 2577155 - DNA, 13 bp, Homo sapiens
aaagataaagatg

SEQ ID NO: 2577156 - DNA, 15 bp, Homo sapiens
aaagataaagatgat

SEQ ID NO: 2577157 - DNA, 21 bp, Homo sapiens
aaagataaattatatcaattt

SEQ ID NO: 2577158 - DNA, 20 bp, Homo sapiens
aaagatacgactttattttc

SEQ ID NO: 2577159 - DNA, 17 bp, Homo sapiens
aaagatattttgctttg

SEQ ID NO: 2577160 - DNA, 14 bp, Homo sapiens
aaagatcaaaataa

SEQ ID NO: 2577161 - DNA, 15 bp, Homo sapiens
aaagatcaaaataaa

SEQ ID NO: 2577162 - DNA, 16 bp, Homo sapiens
aaagatcaaaataaaa

SEQ ID NO: 2577163 - DNA, 17 bp, Homo sapiens
aaagatcaaaataaaaa

SEQ ID NO: 2577164 - DNA, 20 bp, Homo sapiens
aaagatcaaaataaaaagtg

SEQ ID NO: 2577165 - DNA, 15 bp, Homo sapiens
aaagatcatgtaaaa

SEQ ID NO: 2577166 - DNA, 17 bp, Homo sapiens
aaagatgcttctcactg

SEQ ID NO: 2577167 - DNA, 19 bp, Homo sapiens
aaagattcaggtatgttgc

SEQ ID NO: 2577168 - DNA, 23 bp, Homo sapiens
aaagattgaagtattttgctgga

SEQ ID NO: 2577169 - DNA, 20 bp, Homo sapiens
aaagcaaggaaactatgtaa

SEQ ID NO: 2577170 - DNA, 22 bp, Homo sapiens
aaagcaataatggtcccatcca

SEQ ID NO: 2577171 - DNA, 14 bp, Homo sapiens
aaagcaatatgcat

SEQ ID NO: 2577172 - DNA, 14 bp, Homo sapiens
aaagcacagtgtta

SEQ ID NO: 2577173 - DNA, 20 bp, Homo sapiens
aaagcacagtgttaaatgaa

SEQ ID NO: 2577174 - DNA, 21 bp, Homo sapiens
aaagcacagtgttaaatgaaa

SEQ ID NO: 2577175 - DNA, 15 bp, Homo sapiens
aaagcacagtttgaa

SEQ ID NO: 2577176 - DNA, 17 bp, Homo sapiens
aaagcaccaaaataaga

SEQ ID NO: 2577177 - DNA, 22 bp, Homo sapiens
aaagcaccagcttctccaggct

SEQ ID NO: 2577178 - DNA, 16 bp, Homo sapiens
aaagcagaacagtgat

SEQ ID NO: 2577179 - DNA, 22 bp, Homo sapiens
aaagcagatacctcaccctgct

SEQ ID NO: 2577180 - DNA, 17 bp, Homo sapiens
aaagcagtaactgacaa

SEQ ID NO: 2577181 - DNA, 16 bp, Homo sapiens
aaagcatcacttggga

SEQ ID NO: 2577182 - DNA, 14 bp, Homo sapiens
aaagcatgaatggt

SEQ ID NO: 2577183 - DNA, 13 bp, Homo sapiens
aaagcatgtctca

SEQ ID NO: 2577184 - DNA, 20 bp, Homo sapiens
aaagcattgtaaatgtgctt

SEQ ID NO: 2577185 - DNA, 16 bp, Homo sapiens
aaagcatttactttga

SEQ ID NO: 2577186 - DNA, 17 bp, Homo sapiens
aaagccaaactctgcca

SEQ ID NO: 2577187 - DNA, 19 bp, Homo sapiens
aaagccaataacacacagc

SEQ ID NO: 2577188 - DNA, 16 bp, Homo sapiens
aaagccagtgactcca

SEQ ID NO: 2577189 - DNA, 13 bp, Homo sapiens
aaagcctgttccc

SEQ ID NO: 2577190 - DNA, 19 bp, Homo sapiens
aaagcggacatcagctggt

SEQ ID NO: 2577191 - DNA, 17 bp, Homo sapiens
aaagctaaaatgatttt

SEQ ID NO: 2577192 - DNA, 20 bp, Homo sapiens
aaagctgatctggtttgact

SEQ ID NO: 2577193 - DNA, 13 bp, Homo sapiens
aaagctgctgaca

SEQ ID NO: 2577194 - DNA, 23 bp, Homo sapiens
aaagctgtggccagcttgttatt

SEQ ID NO: 2577195 - DNA, 19 bp, Homo sapiens
aaagcttctatcccaggag

SEQ ID NO: 2577196 - DNA, 22 bp, Homo sapiens
aaaggaaagagggaggtaagga

SEQ ID NO: 2577197 - DNA, 12 bp, Homo sapiens
aaaggaagacta

SEQ ID NO: 2577198 - DNA, 17 bp, Homo sapiens
aaaggaatcatttctat

SEQ ID NO: 2577199 - DNA, 19 bp, Homo sapiens
aaaggacagagtatgaaca

SEQ ID NO: 2577200 - DNA, 12 bp, Homo sapiens
aaaggactctgg

SEQ ID NO: 2577201 - DNA, 15 bp, Homo sapiens
aaaggactctggggt

SEQ ID NO: 2577202 - DNA, 22 bp, Homo sapiens
aaaggactgttttttcctgagc

SEQ ID NO: 2577203 - DNA, 19 bp, Homo sapiens
aaaggagagaagagagaaa

SEQ ID NO: 2577204 - DNA, 21 bp, Homo sapiens
aaaggagagctagcagcaggg

SEQ ID NO: 2577205 - DNA, 12 bp, Homo sapiens
aaaggatatttt

SEQ ID NO: 2577206 - DNA, 16 bp, Homo sapiens
aaaggcaaatgtgtac

SEQ ID NO: 2577207 - DNA, 17 bp, Homo sapiens
aaaggcaaatgtgtaca

SEQ ID NO: 2577208 - DNA, 14 bp, Homo sapiens
aaaggcaagcactt

SEQ ID NO: 2577209 - DNA, 17 bp, Homo sapiens
aaaggcaccatctaata

SEQ ID NO: 2577210 - DNA, 15 bp, Homo sapiens
aaaggccaaacctct

SEQ ID NO: 2577211 - DNA, 12 bp, Homo sapiens
aaaggccagctg

SEQ ID NO: 2577212 - DNA, 19 bp, Homo sapiens
aaaggctccaggagcagcc

SEQ ID NO: 2577213 - DNA, 20 bp, Homo sapiens
aaaggctccaggagcagcca

SEQ ID NO: 2577214 - DNA, 21 bp, Homo sapiens
aaaggctccaggagcagccac

SEQ ID NO: 2577215 - DNA, 17 bp, Homo sapiens
aaagggagagagagagg

SEQ ID NO: 2577216 - DNA, 20 bp, Homo sapiens
aaagggagcagaactgaacc

SEQ ID NO: 2577217 - DNA, 18 bp, Homo sapiens
aaagggagctatcaggaa

SEQ ID NO: 2577218 - DNA, 19 bp, Homo sapiens
aaagggattacccaagcaa

SEQ ID NO: 2577219 - DNA, 19 bp, Homo sapiens
aaagggtgaagctatttat

SEQ ID NO: 2577220 - DNA, 14 bp, Homo sapiens
aaagggtgtactta

SEQ ID NO: 2577221 - DNA, 16 bp, Homo sapiens
aaagggttttaatgta

SEQ ID NO: 2577222 - DNA, 14 bp, Homo sapiens
aaaggtataatttt

SEQ ID NO: 2577223 - DNA, 16 bp, Homo sapiens
aaaggtataattttat

SEQ ID NO: 2577224 - DNA, 20 bp, Homo sapiens
aaaggtattttaatcaccaa

SEQ ID NO: 2577225 - DNA, 21 bp, Homo sapiens
aaaggtggtatgtgtgtgtat

SEQ ID NO: 2577226 - DNA, 18 bp, Homo sapiens
aaaggtggtgaggcaata

SEQ ID NO: 2577227 - DNA, 14 bp, Homo sapiens
aaagtaaggtgcag

SEQ ID NO: 2577228 - DNA, 18 bp, Homo sapiens
aaagtacactgtttcaaa

SEQ ID NO: 2577229 - DNA, 20 bp, Homo sapiens
aaagtacactgtttcaaact

SEQ ID NO: 2577230 - DNA, 13 bp, Homo sapiens
aaagtacatttaa

SEQ ID NO: 2577231 - DNA, 16 bp, Homo sapiens
aaccatcattataaac

SEQ ID NO: 2577232 - DNA, 20 bp, Homo sapiens
aaccatctgtccctgcctca

SEQ ID NO: 2577233 - DNA, 15 bp, Homo sapiens
aaccatgaagacagg

SEQ ID NO: 2577234 - DNA, 21 bp, Homo sapiens
aaccatgaagagatttttcat

SEQ ID NO: 2577235 - DNA, 22 bp, Homo sapiens
aaccatgagaccactgttatca

SEQ ID NO: 2577236 - DNA, 22 bp, Homo sapiens
aaccatggctgaaggaaaccag

SEQ ID NO: 2577237 - DNA, 20 bp, Homo sapiens
aaccattttttttcagcaga

SEQ ID NO: 2577238 - DNA, 13 bp, Homo sapiens
aacccaaatgttc

SEQ ID NO: 2577239 - DNA, 22 bp, Homo sapiens
aacccaaggtgggtagatcacg

SEQ ID NO: 2577240 - DNA, 19 bp, Homo sapiens
aacccacaggcccacagta

SEQ ID NO: 2577241 - DNA, 10 bp, Homo sapiens
aacccagctc

SEQ ID NO: 2577242 - DNA, 13 bp, Homo sapiens
aacccagctctgg

SEQ ID NO: 2577243 - DNA, 14 bp, Homo sapiens
aacccagctctggt

SEQ ID NO: 2577244 - DNA, 20 bp, Homo sapiens
aacccaggagcatccacctc

SEQ ID NO: 2577245 - DNA, 15 bp, Homo sapiens
aacccatgagattca

SEQ ID NO: 2577246 - DNA, 14 bp, Homo sapiens
aaccccagcatcct

SEQ ID NO: 2577247 - DNA, 14 bp, Homo sapiens
aaccccaggccccg

SEQ ID NO: 2577248 - DNA, 12 bp, Homo sapiens
aaccccagttct

SEQ ID NO: 2577249 - DNA, 19 bp, Homo sapiens
aaccccagttctgctcctc

SEQ ID NO: 2577250 - DNA, 23 bp, Homo sapiens
aaccccagttctgctcctctcca

SEQ ID NO: 2577251 - DNA, 13 bp, Homo sapiens
aacccccacacac

SEQ ID NO: 2577252 - DNA, 13 bp, Homo sapiens
aacccccacccca

SEQ ID NO: 2577253 - DNA, 13 bp, Homo sapiens
aacccccagcctg

SEQ ID NO: 2577254 - DNA, 15 bp, Homo sapiens
aacccccagcctgct

SEQ ID NO: 2577255 - DNA, 21 bp, Homo sapiens
aacccctacatgaaacagaaa

SEQ ID NO: 2577256 - DNA, 20 bp, Homo sapiens
aacccgacagagggaagaaa

SEQ ID NO: 2577257 - DNA, 13 bp, Homo sapiens
aaccctccctcag

SEQ ID NO: 2577258 - DNA, 16 bp, Homo sapiens
aaccctccctcagccc

SEQ ID NO: 2577259 - DNA, 17 bp, Homo sapiens
aaccctccctcagcccc

SEQ ID NO: 2577260 - DNA, 17 bp, Homo sapiens
aaccctgcaaaggactg

SEQ ID NO: 2577261 - DNA, 16 bp, Homo sapiens
aaccctgcgtggggac

SEQ ID NO: 2577262 - DNA, 19 bp, Homo sapiens
aaccctgcgtggggacagg

SEQ ID NO: 2577263 - DNA, 21 bp, Homo sapiens
aaccctgtgctggtgtcctga

SEQ ID NO: 2577264 - DNA, 22 bp, Homo sapiens
aaccctgttttatactgtactt

SEQ ID NO: 2577265 - DNA, 21 bp, Homo sapiens
aacccttaccccttagcctcc

SEQ ID NO: 2577266 - DNA, 13 bp, Homo sapiens
aacccttgtcagt

SEQ ID NO: 2577267 - DNA, 15 bp, Homo sapiens
aaccgagcaaagatc

SEQ ID NO: 2577268 - DNA, 22 bp, Homo sapiens
aaccgagcaaagatcaaaataa

SEQ ID NO: 2577269 - DNA, 15 bp, Homo sapiens
aaccgatgctccagc

SEQ ID NO: 2577270 - DNA, 15 bp, Homo sapiens
aaccgcaggaagctg

SEQ ID NO: 2577271 - DNA, 16 bp, Homo sapiens
aaccgtctgttatgct

SEQ ID NO: 2577272 - DNA, 22 bp, Homo sapiens
aaccgtctgttatgctgtgaca

SEQ ID NO: 2577273 - DNA, 15 bp, Homo sapiens
aaccgttattataat

SEQ ID NO: 2577274 - DNA, 21 bp, Homo sapiens
aacctaaaataattggttctt

SEQ ID NO: 2577275 - DNA, 18 bp, Homo sapiens
aacctaccaccccttcct

SEQ ID NO: 2577276 - DNA, 14 bp, Homo sapiens
aacctagaagggct

SEQ ID NO: 2577277 - DNA, 12 bp, Homo sapiens
aacctagcccct

SEQ ID NO: 2577278 - DNA, 22 bp, Homo sapiens
aacctattttgaaaaattccta

SEQ ID NO: 2577279 - DNA, 17 bp, Homo sapiens
aacctcaactgcctact

SEQ ID NO: 2577280 - DNA, 18 bp, Homo sapiens
aacctcaactgcctactc

SEQ ID NO: 2577281 - DNA, 19 bp, Homo sapiens
aacctcacgcacctcccat

SEQ ID NO: 2577282 - DNA, 21 bp, Homo sapiens
aacctcagctctgggagagga

SEQ ID NO: 2577283 - DNA, 18 bp, Homo sapiens
aacctcagtgtcatttat

SEQ ID NO: 2577284 - DNA, 19 bp, Homo sapiens
aacctccgcctcccgggtt

SEQ ID NO: 2577285 - DNA, 13 bp, Homo sapiens
aacctcctctgtg

SEQ ID NO: 2577286 - DNA, 15 bp, Homo sapiens
aacctcctctgtgaa

SEQ ID NO: 2577287 - DNA, 14 bp, Homo sapiens
aacctcgctggact

SEQ ID NO: 2577288 - DNA, 18 bp, Homo sapiens
aacctctcacttcaccct

SEQ ID NO: 2577289 - DNA, 21 bp, Homo sapiens
aacctctcctcatgttctgct

SEQ ID NO: 2577290 - DNA, 15 bp, Homo sapiens
aacctctgttcagtg

SEQ ID NO: 2577291 - DNA, 16 bp, Homo sapiens
aacctctgttcagtgt

SEQ ID NO: 2577292 - DNA, 18 bp, Homo sapiens
aacctcttcagaggccct

SEQ ID NO: 2577293 - DNA, 12 bp, Homo sapiens
aacctcttcccc

SEQ ID NO: 2577294 - DNA, 14 bp, Homo sapiens
aacctcttccccag

SEQ ID NO: 2577295 - DNA, 11 bp, Homo sapiens
aacctgaaaaa

SEQ ID NO: 2577296 - DNA, 19 bp, Homo sapiens
aacctgacaaaaaaaaagt

SEQ ID NO: 2577297 - DNA, 16 bp, Homo sapiens
aacctgacccctgctc

SEQ ID NO: 2577298 - DNA, 20 bp, Homo sapiens
aacctgaccgtgggcggggc

SEQ ID NO: 2577299 - DNA, 15 bp, Homo sapiens
aacctgatgctgact

SEQ ID NO: 2577300 - DNA, 19 bp, Homo sapiens
aacctgccagggagacaga

SEQ ID NO: 2577301 - DNA, 19 bp, Homo sapiens
aacctggcaagctagaacc

SEQ ID NO: 2577302 - DNA, 22 bp, Homo sapiens
aacctgggtccaaataaaaact

SEQ ID NO: 2577303 - DNA, 11 bp, Homo sapiens
aacctggtgct

SEQ ID NO: 2577304 - DNA, 14 bp, Homo sapiens
aacctggtgctgga

SEQ ID NO: 2577305 - DNA, 21 bp, Homo sapiens
aacctgttacctactttgact

SEQ ID NO: 2577306 - DNA, 21 bp, Homo sapiens
aacctgttgatagcaagtgaa

SEQ ID NO: 2577307 - DNA, 16 bp, Homo sapiens
aaccttattgtacctc

SEQ ID NO: 2577308 - DNA, 18 bp, Homo sapiens
aaccttattgtacctctc

SEQ ID NO: 2577309 - DNA, 19 bp, Homo sapiens
aaccttattgtacctctct

SEQ ID NO: 2577310 - DNA, 16 bp, Homo sapiens
aaccttgagacagctt

SEQ ID NO: 2577311 - DNA, 23 bp, Homo sapiens
aaccttgcctttctcgattttat

SEQ ID NO: 2577312 - DNA, 21 bp, Homo sapiens
aaccttggtgtagttgaactg

SEQ ID NO: 2577313 - DNA, 19 bp, Homo sapiens
aaccttgtctctatgccag

SEQ ID NO: 2577314 - DNA, 21 bp, Homo sapiens
aaccttgtgcctggctcagag

SEQ ID NO: 2577315 - DNA, 18 bp, Homo sapiens
aaccttgttatttctcag

SEQ ID NO: 2577316 - DNA, 19 bp, Homo sapiens
aacctttagggcagcttgc

SEQ ID NO: 2577317 - DNA, 18 bp, Homo sapiens
aacctttcaaatttcaca

SEQ ID NO: 2577318 - DNA, 23 bp, Homo sapiens
aaccttttttaagatttttctca

SEQ ID NO: 2577319 - DNA, 23 bp, Homo sapiens
aacgacaaagccaaactctgcca

SEQ ID NO: 2577320 - DNA, 18 bp, Homo sapiens
aacgatttaattctcttg

SEQ ID NO: 2577321 - DNA, 13 bp, Homo sapiens
aacgatttagaaa

SEQ ID NO: 2577322 - DNA, 20 bp, Homo sapiens
aacgcaaagggctgaaagcc

SEQ ID NO: 2577323 - DNA, 13 bp, Homo sapiens
aacgcagccctag

SEQ ID NO: 2577324 - DNA, 21 bp, Homo sapiens
aacgcagccctagagcctgcc

SEQ ID NO: 2577325 - DNA, 21 bp, Homo sapiens
aacgcatggagtgtgtattgt

SEQ ID NO: 2577326 - DNA, 22 bp, Homo sapiens
aacgccccagataccagcccct

SEQ ID NO: 2577327 - DNA, 19 bp, Homo sapiens
aacggagagcgcctgcccc

SEQ ID NO: 2577328 - DNA, 20 bp, Homo sapiens
aacgtgatgatcagctgttt

SEQ ID NO: 2577329 - DNA, 13 bp, Homo sapiens
aacgtggcccaga

SEQ ID NO: 2577330 - DNA, 15 bp, Homo sapiens
aacgttttattgtgt

SEQ ID NO: 2577331 - DNA, 23 bp, Homo sapiens
aacgttttctgtttggaggagca

SEQ ID NO: 2577332 - DNA, 13 bp, Homo sapiens
aactaaactttca

SEQ ID NO: 2577333 - DNA, 17 bp, Homo sapiens
aactaaactttcacacc

SEQ ID NO: 2577334 - DNA, 17 bp, Homo sapiens
aactaagcccccgctgt

SEQ ID NO: 2577335 - DNA, 14 bp, Homo sapiens
aactaataaaagca

SEQ ID NO: 2577336 - DNA, 15 bp, Homo sapiens
aactaataaaagcat

SEQ ID NO: 2577337 - DNA, 20 bp, Homo sapiens
aactaatctattgggttcat

SEQ ID NO: 2577338 - DNA, 15 bp, Homo sapiens
aactagaatttgatt

SEQ ID NO: 2577339 - DNA, 17 bp, Homo sapiens
aactatgaactacaaag

SEQ ID NO: 2577340 - DNA, 22 bp, Homo sapiens
aactattaagaggcagaaaatt

SEQ ID NO: 2577341 - DNA, 23 bp, Homo sapiens
aactatttatctgtgtttttgaa

SEQ ID NO: 2577342 - DNA, 20 bp, Homo sapiens
aactatttcttatatatgtg

SEQ ID NO: 2577343 - DNA, 19 bp, Homo sapiens
aactcaaaacttaacatat

SEQ ID NO: 2577344 - DNA, 17 bp, Homo sapiens
aactcaaactcttaaaa

SEQ ID NO: 2577345 - DNA, 22 bp, Homo sapiens
aactcaaatgcttggcttctca

SEQ ID NO: 2577346 - DNA, 20 bp, Homo sapiens
aactcaatattttccatgaa

SEQ ID NO: 2577347 - DNA, 21 bp, Homo sapiens
aactcaccatgtaaaagagtc

SEQ ID NO: 2577348 - DNA, 18 bp, Homo sapiens
aactcaccccagccccaa

SEQ ID NO: 2577349 - DNA, 21 bp, Homo sapiens
aactcacctaatgtttatgag

SEQ ID NO: 2577350 - DNA, 20 bp, Homo sapiens
aactcacctgctggcccctc

SEQ ID NO: 2577351 - DNA, 21 bp, Homo sapiens
aactcacctgctggcccctca

SEQ ID NO: 2577352 - DNA, 19 bp, Homo sapiens
aactcagatcactactgca

SEQ ID NO: 2577353 - DNA, 17 bp, Homo sapiens
aactcagccaagcacag

SEQ ID NO: 2577354 - DNA, 22 bp, Homo sapiens
aactcagcctcaataagccttg

SEQ ID NO: 2577355 - DNA, 13 bp, Homo sapiens
aactcagggacag

SEQ ID NO: 2577356 - DNA, 22 bp, Homo sapiens
aactcagtcattagactcctcc

SEQ ID NO: 2577357 - DNA, 22 bp, Homo sapiens
aactcatactgtgctggagcca

SEQ ID NO: 2577358 - DNA, 15 bp, Homo sapiens
aactcatcataaaat

SEQ ID NO: 2577359 - DNA, 19 bp, Homo sapiens
aactccaccttgcggggat

SEQ ID NO: 2577360 - DNA, 16 bp, Homo sapiens
aactcctgacagtctt

SEQ ID NO: 2577361 - DNA, 21 bp, Homo sapiens
aactctaattcccattttgca

SEQ ID NO: 2577362 - DNA, 17 bp, Homo sapiens
aactctcctctgctgct

SEQ ID NO: 2577363 - DNA, 22 bp, Homo sapiens
aactctcctctgctgctggctg

SEQ ID NO: 2577364 - DNA, 16 bp, Homo sapiens
aactctgcattctagt

SEQ ID NO: 2577365 - DNA, 22 bp, Homo sapiens
aactctgggctgctacccagaa

SEQ ID NO: 2577366 - DNA, 21 bp, Homo sapiens
aactcttcaatctcttgcact

SEQ ID NO: 2577367 - DNA, 19 bp, Homo sapiens
aactctttgaatgacaaag

SEQ ID NO: 2577368 - DNA, 17 bp, Homo sapiens
aactctttttgggctcc

SEQ ID NO: 2577369 - DNA, 23 bp, Homo sapiens
aactctttttgggctcctttttc

SEQ ID NO: 2577370 - DNA, 19 bp, Homo sapiens
aactgaaaacaagccatga

SEQ ID NO: 2577371 - DNA, 12 bp, Homo sapiens
aactgaaaagac

SEQ ID NO: 2577372 - DNA, 19 bp, Homo sapiens
aactgaaaatctaatatta

SEQ ID NO: 2577373 - DNA, 15 bp, Homo sapiens
aactgaagtctgaaa

SEQ ID NO: 2577374 - DNA, 22 bp, Homo sapiens
aaggacacagatgaaacacaaa

SEQ ID NO: 2577375 - DNA, 12 bp, Homo sapiens
aaggaccaggac

SEQ ID NO: 2577376 - DNA, 20 bp, Homo sapiens
aaggacccctcaccttgcaa

SEQ ID NO: 2577377 - DNA, 12 bp, Homo sapiens
aaggactctggg

SEQ ID NO: 2577378 - DNA, 21 bp, Homo sapiens
aaggactgtgacaggcagcag

SEQ ID NO: 2577379 - DNA, 19 bp, Homo sapiens
aaggagaaacagagacagg

SEQ ID NO: 2577380 - DNA, 17 bp, Homo sapiens
aaggagccccattcctg

SEQ ID NO: 2577381 - DNA, 22 bp, Homo sapiens
aaggagctcactgtggtgtctg

SEQ ID NO: 2577382 - DNA, 23 bp, Homo sapiens
aaggaggcgcactttcctcctgg

SEQ ID NO: 2577383 - DNA, 20 bp, Homo sapiens
aaggaggggatagagagaga

SEQ ID NO: 2577384 - DNA, 17 bp, Homo sapiens
aaggaggggctgtaaaa

SEQ ID NO: 2577385 - DNA, 19 bp, Homo sapiens
aaggagtaatctgtgtaca

SEQ ID NO: 2577386 - DNA, 20 bp, Homo sapiens
aaggagtcagacattttaag

SEQ ID NO: 2577387 - DNA, 19 bp, Homo sapiens
aaggagtgagatcattttc

SEQ ID NO: 2577388 - DNA, 13 bp, Homo sapiens
aaggatacaaaag

SEQ ID NO: 2577389 - DNA, 21 bp, Homo sapiens
aaggatacaaaagcatgtgag

SEQ ID NO: 2577390 - DNA, 21 bp, Homo sapiens
aaggatctctcaggagcacag

SEQ ID NO: 2577391 - DNA, 22 bp, Homo sapiens
aaggatctctcaggagcacagg

SEQ ID NO: 2577392 - DNA, 23 bp, Homo sapiens
aaggatctgtttttaaaaatcat

SEQ ID NO: 2577393 - DNA, 23 bp, Homo sapiens
aaggatgatctaggaagactttg

SEQ ID NO: 2577394 - DNA, 16 bp, Homo sapiens
aaggatgcttgtacat

SEQ ID NO: 2577395 - DNA, 15 bp, Homo sapiens
aaggatgtacatttc

SEQ ID NO: 2577396 - DNA, 14 bp, Homo sapiens
aaggatgtcacagg

SEQ ID NO: 2577397 - DNA, 15 bp, Homo sapiens
aaggatgtcacaggg

SEQ ID NO: 2577398 - DNA, 16 bp, Homo sapiens
aaggatgtgggggaag

SEQ ID NO: 2577399 - DNA, 16 bp, Homo sapiens
aaggattcatgtggaa

SEQ ID NO: 2577400 - DNA, 14 bp, Homo sapiens
aaggattgtaaaaa

SEQ ID NO: 2577401 - DNA, 22 bp, Homo sapiens
aaggattttatgctttaaacat

SEQ ID NO: 2577402 - DNA, 18 bp, Homo sapiens
aaggcaaatgtgtacatg

SEQ ID NO: 2577403 - DNA, 18 bp, Homo sapiens
aaggcaagcacttgtggg

SEQ ID NO: 2577404 - DNA, 22 bp, Homo sapiens
aaggcaatgccatcctcaaaca

SEQ ID NO: 2577405 - DNA, 12 bp, Homo sapiens
aaggcactgcct

SEQ ID NO: 2577406 - DNA, 17 bp, Homo sapiens
aaggcagaaagcaaaat

SEQ ID NO: 2577407 - DNA, 19 bp, Homo sapiens
aaggcagaaagcaaaatta

SEQ ID NO: 2577408 - DNA, 14 bp, Homo sapiens
aaggcagaagcagc

SEQ ID NO: 2577409 - DNA, 14 bp, Homo sapiens
aaggcagccaccag

SEQ ID NO: 2577410 - DNA, 16 bp, Homo sapiens
aaggcaggtgcctcca

SEQ ID NO: 2577411 - DNA, 20 bp, Homo sapiens
aaggcaggtgcctccaggtg

SEQ ID NO: 2577412 - DNA, 19 bp, Homo sapiens
aaggcatatcagtctctga

SEQ ID NO: 2577413 - DNA, 16 bp, Homo sapiens
aaggcatgttcctctg

SEQ ID NO: 2577414 - DNA, 21 bp, Homo sapiens
aaggccaattcctatacgcag

SEQ ID NO: 2577415 - DNA, 17 bp, Homo sapiens
aaggccagagtggcctg

SEQ ID NO: 2577416 - DNA, 20 bp, Homo sapiens
aaggccagagtggcctggcc

SEQ ID NO: 2577417 - DNA, 22 bp, Homo sapiens
aaggccagagtggcctggccag

SEQ ID NO: 2577418 - DNA, 19 bp, Homo sapiens
aaggccagctggcagcaga

SEQ ID NO: 2577419 - DNA, 14 bp, Homo sapiens
aaggccatcagagc

SEQ ID NO: 2577420 - DNA, 15 bp, Homo sapiens
aaggccccagagact

SEQ ID NO: 2577421 - DNA, 14 bp, Homo sapiens
aaggccccctacgc

SEQ ID NO: 2577422 - DNA, 18 bp, Homo sapiens
aaggccgaagctctggct

SEQ ID NO: 2577423 - DNA, 14 bp, Homo sapiens
aaggccgagaagca

SEQ ID NO: 2577424 - DNA, 18 bp, Homo sapiens
aaggccgagaagcaagaa

SEQ ID NO: 2577425 - DNA, 17 bp, Homo sapiens
aaggcctggcccacagc

SEQ ID NO: 2577426 - DNA, 15 bp, Homo sapiens
aaggccttaatatgt

SEQ ID NO: 2577427 - DNA, 12 bp, Homo sapiens
aaggccttctcc

SEQ ID NO: 2577428 - DNA, 13 bp, Homo sapiens
aaggctacctttg

SEQ ID NO: 2577429 - DNA, 23 bp, Homo sapiens
aaggctatggggatagatgtgtg

SEQ ID NO: 2577430 - DNA, 15 bp, Homo sapiens
aaggctccaggagca

SEQ ID NO: 2577431 - DNA, 16 bp, Homo sapiens
aaggctccaggagcag

SEQ ID NO: 2577432 - DNA, 18 bp, Homo sapiens
aaggctccaggagcagcc

SEQ ID NO: 2577433 - DNA, 16 bp, Homo sapiens
aaggctgaccaagaga

SEQ ID NO: 2577434 - DNA, 17 bp, Homo sapiens
aaggctgaccaagagag

SEQ ID NO: 2577435 - DNA, 19 bp, Homo sapiens
aaggctgaggaaaggccag

SEQ ID NO: 2577436 - DNA, 23 bp, Homo sapiens
aaggctgatgccaagttgtttga

SEQ ID NO: 2577437 - DNA, 18 bp, Homo sapiens
aaggctggagtgcagtgg

SEQ ID NO: 2577438 - DNA, 14 bp, Homo sapiens
aaggctgggggaag

SEQ ID NO: 2577439 - DNA, 22 bp, Homo sapiens
aaggctgtccttacccatctgc

SEQ ID NO: 2577440 - DNA, 16 bp, Homo sapiens
aaggctgtgctccctg

SEQ ID NO: 2577441 - DNA, 16 bp, Homo sapiens
aagggaaaagtctctt

SEQ ID NO: 2577442 - DNA, 12 bp, Homo sapiens
aagggaaataga

SEQ ID NO: 2577443 - DNA, 14 bp, Homo sapiens
aagggaaatatcat

SEQ ID NO: 2577444 - DNA, 16 bp, Homo sapiens
aagggaaatatcattt

SEQ ID NO: 2577445 - DNA, 18 bp, Homo sapiens
aagggaaggaactctggc

SEQ ID NO: 2577446 - DNA, 20 bp, Homo sapiens
aagggacatgttttgataaa

SEQ ID NO: 2577447 - DNA, 17 bp, Homo sapiens
aagggagcagaactgaa

SEQ ID NO: 2577448 - DNA, 19 bp, Homo sapiens
aagggatatataagatgga

SEQ ID NO: 2577449 - DNA, 21 bp, Homo sapiens
aagggatggaaaaggaagact

SEQ ID NO: 2577450 - DNA, 20 bp, Homo sapiens
aagggattttagtcacacgt

SEQ ID NO: 2577451 - DNA, 18 bp, Homo sapiens
aagggcaaaattcccagg

SEQ ID NO: 2577452 - DNA, 19 bp, Homo sapiens
aagggcagaacactaacct

SEQ ID NO: 2577453 - DNA, 15 bp, Homo sapiens
aagggcagagtcaca

SEQ ID NO: 2577454 - DNA, 22 bp, Homo sapiens
aagggccagtcctgcctggcca

SEQ ID NO: 2577455 - DNA, 19 bp, Homo sapiens
aagggctagaacctggagg

SEQ ID NO: 2577456 - DNA, 22 bp, Homo sapiens
aaggggaatgtttgcctctgcc

SEQ ID NO: 2577457 - DNA, 23 bp, Homo sapiens
aaggggaatgtttgcctctgcct

SEQ ID NO: 2577458 - DNA, 14 bp, Homo sapiens
aaggggaggcagcc

SEQ ID NO: 2577459 - DNA, 16 bp, Homo sapiens
aaggggaggcagccgg

SEQ ID NO: 2577460 - DNA, 14 bp, Homo sapiens
aaggggcagtggtg

SEQ ID NO: 2577461 - DNA, 17 bp, Homo sapiens
aaggggcagtggtggtt

SEQ ID NO: 2577462 - DNA, 15 bp, Homo sapiens
aaggggggagctggg

SEQ ID NO: 2577463 - DNA, 13 bp, Homo sapiens
aagggtaaagaag

SEQ ID NO: 2577464 - DNA, 16 bp, Homo sapiens
aagggtcttgggaaat

SEQ ID NO: 2577465 - DNA, 13 bp, Homo sapiens
aagggtgtctgag

SEQ ID NO: 2577466 - DNA, 17 bp, Homo sapiens
aagggttctggctgccc

SEQ ID NO: 2577467 - DNA, 19 bp, Homo sapiens
aagggttttccaccctgga

SEQ ID NO: 2577468 - DNA, 20 bp, Homo sapiens
aaggtagaaatatctgaaaa

SEQ ID NO: 2577469 - DNA, 19 bp, Homo sapiens
aaggtatcagttgcaataa

SEQ ID NO: 2577470 - DNA, 18 bp, Homo sapiens
aaggtattaaattgatgt

SEQ ID NO: 2577471 - DNA, 20 bp, Homo sapiens
aaggtcggaggcttgggacc

SEQ ID NO: 2577472 - DNA, 23 bp, Homo sapiens
aaggtgcagttcccccaacctca

SEQ ID NO: 2577473 - DNA, 20 bp, Homo sapiens
aaggtggactggaaggggcc

SEQ ID NO: 2577474 - DNA, 22 bp, Homo sapiens
aaggtgggccttgctacctcaa

SEQ ID NO: 2577475 - DNA, 19 bp, Homo sapiens
aaggtgggctgagccctgg

SEQ ID NO: 2577476 - DNA, 20 bp, Homo sapiens
aaggtgggctgagccctggc

SEQ ID NO: 2577477 - DNA, 23 bp, Homo sapiens
aaggtggggtatttaccacagca

SEQ ID NO: 2577478 - DNA, 20 bp, Homo sapiens
aaggtggtgggggtgcagat

SEQ ID NO: 2577479 - DNA, 17 bp, Homo sapiens
aaggtgtaactctaatt

SEQ ID NO: 2577480 - DNA, 20 bp, Homo sapiens
aaggtgtcttcctcccaagt

SEQ ID NO: 2577481 - DNA, 16 bp, Homo sapiens
aaggttaagccctgag

SEQ ID NO: 2577482 - DNA, 18 bp, Homo sapiens
aaggttaccaagaagcct

SEQ ID NO: 2577483 - DNA, 18 bp, Homo sapiens
aaggttaggatttaacag

SEQ ID NO: 2577484 - DNA, 17 bp, Homo sapiens
aaggttctcataggaaa

SEQ ID NO: 2577485 - DNA, 22 bp, Homo sapiens
aaggttgacaataaatgtgctt

SEQ ID NO: 2577486 - DNA, 13 bp, Homo sapiens
aaggttgtattgc

SEQ ID NO: 2577487 - DNA, 23 bp, Homo sapiens
aaggtttaaacttctctgaaggg

SEQ ID NO: 2577488 - DNA, 22 bp, Homo sapiens
aaggtttcgtttctgtatacaa

SEQ ID NO: 2577489 - DNA, 13 bp, Homo sapiens
aaggtttggtgtg

SEQ ID NO: 2577490 - DNA, 17 bp, Homo sapiens
aaggtttgtatattgtc

SEQ ID NO: 2577491 - DNA, 13 bp, Homo sapiens
aaggttttctcca

SEQ ID NO: 2577492 - DNA, 12 bp, Homo sapiens
aagtaaagctaa

SEQ ID NO: 2577493 - DNA, 20 bp, Homo sapiens
aagtaagaaagtgaagcaaa

SEQ ID NO: 2577494 - DNA, 15 bp, Homo sapiens
aagtaagaagacatg

SEQ ID NO: 2577495 - DNA, 13 bp, Homo sapiens
aagtaagcaaaga

SEQ ID NO: 2577496 - DNA, 19 bp, Homo sapiens
aagtaagcaacagcataac

SEQ ID NO: 2577497 - DNA, 23 bp, Homo sapiens
aagtaagcccttgaagatatctt

SEQ ID NO: 2577498 - DNA, 20 bp, Homo sapiens
aagtaagtaccactcaggcc

SEQ ID NO: 2577499 - DNA, 15 bp, Homo sapiens
aagtaatatgcacac

SEQ ID NO: 2577500 - DNA, 17 bp, Homo sapiens
aagtaatatgcacacat

SEQ ID NO: 2577501 - DNA, 18 bp, Homo sapiens
aagtaatcccgccaccta

SEQ ID NO: 2577502 - DNA, 16 bp, Homo sapiens
aagtaatcctagggaa

SEQ ID NO: 2577503 - DNA, 21 bp, Homo sapiens
aagtaatgaatttttatgata

SEQ ID NO: 2577504 - DNA, 13 bp, Homo sapiens
aagtaattatcgg

SEQ ID NO: 2577505 - DNA, 23 bp, Homo sapiens
aagtacactgtttcaaactttac

SEQ ID NO: 2577506 - DNA, 13 bp, Homo sapiens
aagtacatttaat

SEQ ID NO: 2577507 - DNA, 15 bp, Homo sapiens
aagtacgttattgtt

SEQ ID NO: 2577508 - DNA, 15 bp, Homo sapiens
aagtactatgtatca

SEQ ID NO: 2577509 - DNA, 21 bp, Homo sapiens
aagtacttctccaccctgctc

SEQ ID NO: 2577510 - DNA, 23 bp, Homo sapiens
aagtacttctccaccctgctctc

SEQ ID NO: 2577511 - DNA, 21 bp, Homo sapiens
aagtagaagtcttagatgtat

SEQ ID NO: 2577512 - DNA, 15 bp, Homo sapiens
aagtaggaaaaataa

SEQ ID NO: 2577513 - DNA, 23 bp, Homo sapiens
aagtaggactttcctaaatgttt

SEQ ID NO: 2577514 - DNA, 14 bp, Homo sapiens
aagtaggcaggacc

SEQ ID NO: 2577515 - DNA, 13 bp, Homo sapiens
aagtagtaaaaat

SEQ ID NO: 2577516 - DNA, 17 bp, Homo sapiens
aagtagtgtatcacagt

SEQ ID NO: 2577517 - DNA, 12 bp, Homo sapiens
aagtatactgta

SEQ ID NO: 2577518 - DNA, 22 bp, Homo sapiens
aatgaaaaatttaagcattgtt

SEQ ID NO: 2577519 - DNA, 13 bp, Homo sapiens
aatgaaaatgtca

SEQ ID NO: 2577520 - DNA, 14 bp, Homo sapiens
aatgaaaatgtcag

SEQ ID NO: 2577521 - DNA, 23 bp, Homo sapiens
aatgaaaatgtcagaaaccagtt

SEQ ID NO: 2577522 - DNA, 17 bp, Homo sapiens
aatgaaacattttgtca

SEQ ID NO: 2577523 - DNA, 14 bp, Homo sapiens
aatgaaacccccac

SEQ ID NO: 2577524 - DNA, 18 bp, Homo sapiens
aatgaaacccccacacac

SEQ ID NO: 2577525 - DNA, 21 bp, Homo sapiens
aatgaaagactgtacaaagta

SEQ ID NO: 2577526 - DNA, 17 bp, Homo sapiens
aatgaaagcatgtctca

SEQ ID NO: 2577527 - DNA, 22 bp, Homo sapiens
aatgaaagcatgtggcatgttc

SEQ ID NO: 2577528 - DNA, 13 bp, Homo sapiens
aatgaaatactgt

SEQ ID NO: 2577529 - DNA, 12 bp, Homo sapiens
aatgaaatatct

SEQ ID NO: 2577530 - DNA, 18 bp, Homo sapiens
aatgaaatgctctccttt

SEQ ID NO: 2577531 - DNA, 21 bp, Homo sapiens
aatgaacccccatgatgtaag

SEQ ID NO: 2577532 - DNA, 22 bp, Homo sapiens
aatgaacccccatgatgtaagt

SEQ ID NO: 2577533 - DNA, 22 bp, Homo sapiens
aatgaagcagctttaaacaaat

SEQ ID NO: 2577534 - DNA, 19 bp, Homo sapiens
aatgaagcttgtgtatcca

SEQ ID NO: 2577535 - DNA, 22 bp, Homo sapiens
aatgaaggcgggcctgcaagcc

SEQ ID NO: 2577536 - DNA, 21 bp, Homo sapiens
aatgaaggttaggatttaaca

SEQ ID NO: 2577537 - DNA, 16 bp, Homo sapiens
aatgaagtatttctca

SEQ ID NO: 2577538 - DNA, 15 bp, Homo sapiens
aatgaataataatta

SEQ ID NO: 2577539 - DNA, 21 bp, Homo sapiens
aatgaataataattatccaga

SEQ ID NO: 2577540 - DNA, 18 bp, Homo sapiens
aatgaatcctacacacct

SEQ ID NO: 2577541 - DNA, 17 bp, Homo sapiens
aatgaatgcataaaatg

SEQ ID NO: 2577542 - DNA, 17 bp, Homo sapiens
aatgaatttttatgata

SEQ ID NO: 2577543 - DNA, 15 bp, Homo sapiens
aatgacaacagaagc

SEQ ID NO: 2577544 - DNA, 11 bp, Homo sapiens
aatgacagagc

SEQ ID NO: 2577545 - DNA, 16 bp, Homo sapiens
aatgacagagccagtg

SEQ ID NO: 2577546 - DNA, 18 bp, Homo sapiens
aatgacatcaccacagtt

SEQ ID NO: 2577547 - DNA, 16 bp, Homo sapiens
aatgacctcaagatgt

SEQ ID NO: 2577548 - DNA, 24 bp, Homo sapiens
aatgactaaaaatattataactta

SEQ ID NO: 2577549 - DNA, 14 bp, Homo sapiens
aatgacttactgta

SEQ ID NO: 2577550 - DNA, 17 bp, Homo sapiens
aatgagaaggcagccac

SEQ ID NO: 2577551 - DNA, 17 bp, Homo sapiens
aatgagaggttcctaag

SEQ ID NO: 2577552 - DNA, 17 bp, Homo sapiens
aatgagatcaggctctg

SEQ ID NO: 2577553 - DNA, 12 bp, Homo sapiens
aatgagcctggc

SEQ ID NO: 2577554 - DNA, 22 bp, Homo sapiens
aatgagctcgcatttgtcaatg

SEQ ID NO: 2577555 - DNA, 14 bp, Homo sapiens
aatgaggacatgtt

SEQ ID NO: 2577556 - DNA, 14 bp, Homo sapiens
aatgagggactgga

SEQ ID NO: 2577557 - DNA, 19 bp, Homo sapiens
aatgaggtcagcatgtcta

SEQ ID NO: 2577558 - DNA, 18 bp, Homo sapiens
aatgatatagccagaaaa

SEQ ID NO: 2577559 - DNA, 16 bp, Homo sapiens
aatgatccccagctgt

SEQ ID NO: 2577560 - DNA, 19 bp, Homo sapiens
aatgatctaggtttaactc

SEQ ID NO: 2577561 - DNA, 23 bp, Homo sapiens
aatgatctaggtttaactcagat

SEQ ID NO: 2577562 - DNA, 17 bp, Homo sapiens
aatgatcttttcaagtt

SEQ ID NO: 2577563 - DNA, 15 bp, Homo sapiens
aatgatggacccaat

SEQ ID NO: 2577564 - DNA, 18 bp, Homo sapiens
aatgatgtccagaagaat

SEQ ID NO: 2577565 - DNA, 22 bp, Homo sapiens
aatgattcagtgttaaatgtga

SEQ ID NO: 2577566 - DNA, 20 bp, Homo sapiens
aatgattttatctgtgaatt

SEQ ID NO: 2577567 - DNA, 21 bp, Homo sapiens
aatgcaaaaattagccgggcg

SEQ ID NO: 2577568 - DNA, 16 bp, Homo sapiens
aatgcaaatcctatgt

SEQ ID NO: 2577569 - DNA, 18 bp, Homo sapiens
aatgcaacaacatgtata

SEQ ID NO: 2577570 - DNA, 14 bp, Homo sapiens
aatgcacacaaaac

SEQ ID NO: 2577571 - DNA, 15 bp, Homo sapiens
aatgcacacaaaaca

SEQ ID NO: 2577572 - DNA, 13 bp, Homo sapiens
aatgcacactagc

SEQ ID NO: 2577573 - DNA, 19 bp, Homo sapiens
aatgcactttgttctggct

SEQ ID NO: 2577574 - DNA, 14 bp, Homo sapiens
aatgcagcgtgaag

SEQ ID NO: 2577575 - DNA, 23 bp, Homo sapiens
aatgcagggattgctgccacttt

SEQ ID NO: 2577576 - DNA, 16 bp, Homo sapiens
aatgcataaaatgtta

SEQ ID NO: 2577577 - DNA, 13 bp, Homo sapiens
aatgcatattgta

SEQ ID NO: 2577578 - DNA, 16 bp, Homo sapiens
aatgcatctgtcctca

SEQ ID NO: 2577579 - DNA, 22 bp, Homo sapiens
aatgcattataggatcatttgt

SEQ ID NO: 2577580 - DNA, 23 bp, Homo sapiens
aatgcattataggatcatttgtt

SEQ ID NO: 2577581 - DNA, 17 bp, Homo sapiens
aatgcattattttgaat

SEQ ID NO: 2577582 - DNA, 21 bp, Homo sapiens
aatgcattgtatcgatgttat

SEQ ID NO: 2577583 - DNA, 23 bp, Homo sapiens
aatgccaacttgtccttttgtac

SEQ ID NO: 2577584 - DNA, 12 bp, Homo sapiens
aatgcccagccc

SEQ ID NO: 2577585 - DNA, 13 bp, Homo sapiens
aatgcccagcccc

SEQ ID NO: 2577586 - DNA, 23 bp, Homo sapiens
aatgcccagccccttctgaccca

SEQ ID NO: 2577587 - DNA, 18 bp, Homo sapiens
aatgcccccagctggccc

SEQ ID NO: 2577588 - DNA, 19 bp, Homo sapiens
aatgcccgtaatgcttaga

SEQ ID NO: 2577589 - DNA, 16 bp, Homo sapiens
aatgcctgagtgcctg

SEQ ID NO: 2577590 - DNA, 17 bp, Homo sapiens
aatgcctgagtgcctgg

SEQ ID NO: 2577591 - DNA, 19 bp, Homo sapiens
aatgcctttgagacagttt

SEQ ID NO: 2577592 - DNA, 23 bp, Homo sapiens
aatgcgtgcataccacttttgtt

SEQ ID NO: 2577593 - DNA, 11 bp, Homo sapiens
aatgctccccc

SEQ ID NO: 2577594 - DNA, 14 bp, Homo sapiens
aatgctcccccatc

SEQ ID NO: 2577595 - DNA, 22 bp, Homo sapiens
aatgctcccccatcctcccctt

SEQ ID NO: 2577596 - DNA, 13 bp, Homo sapiens
aatgctctccttt

SEQ ID NO: 2577597 - DNA, 20 bp, Homo sapiens
aatgctctggggtcttttta

SEQ ID NO: 2577598 - DNA, 18 bp, Homo sapiens
aatgctgaaaaaacacct

SEQ ID NO: 2577599 - DNA, 12 bp, Homo sapiens
aatgctgcagat

SEQ ID NO: 2577600 - DNA, 12 bp, Homo sapiens
aatgctgcctgc

SEQ ID NO: 2577601 - DNA, 14 bp, Homo sapiens
aatgctgcctgcct

SEQ ID NO: 2577602 - DNA, 15 bp, Homo sapiens
aatgctggttttcct

SEQ ID NO: 2577603 - DNA, 22 bp, Homo sapiens
aatgctggttttcctaaatgca

SEQ ID NO: 2577604 - DNA, 23 bp, Homo sapiens
aatgctggttttcctaaatgcag

SEQ ID NO: 2577605 - DNA, 17 bp, Homo sapiens
aatgctgtcaactatga

SEQ ID NO: 2577606 - DNA, 23 bp, Homo sapiens
aatgcttcctagaagttactgaa

SEQ ID NO: 2577607 - DNA, 16 bp, Homo sapiens
aatgcttcttctcagg

SEQ ID NO: 2577608 - DNA, 11 bp, Homo sapiens
aatgctttttg

SEQ ID NO: 2577609 - DNA, 17 bp, Homo sapiens
aatgctttttgaatgtt

SEQ ID NO: 2577610 - DNA, 19 bp, Homo sapiens
aatggaaaacagactcagg

SEQ ID NO: 2577611 - DNA, 13 bp, Homo sapiens
aatggaaactgaa

SEQ ID NO: 2577612 - DNA, 17 bp, Homo sapiens
aatggaaactgaatgct

SEQ ID NO: 2577613 - DNA, 21 bp, Homo sapiens
aatggaaatgggcagagcaga

SEQ ID NO: 2577614 - DNA, 14 bp, Homo sapiens
aatggaaccactct

SEQ ID NO: 2577615 - DNA, 16 bp, Homo sapiens
aatggaacctcctttc

SEQ ID NO: 2577616 - DNA, 22 bp, Homo sapiens
aatggaacctcctttctcttct

SEQ ID NO: 2577617 - DNA, 14 bp, Homo sapiens
aatggactcaaact

SEQ ID NO: 2577618 - DNA, 17 bp, Homo sapiens
aatggactggaagggga

SEQ ID NO: 2577619 - DNA, 16 bp, Homo sapiens
aatggattggattatt

SEQ ID NO: 2577620 - DNA, 21 bp, Homo sapiens
aatggattggattatttaata

SEQ ID NO: 2577621 - DNA, 22 bp, Homo sapiens
aatggattggattatttaataa

SEQ ID NO: 2577622 - DNA, 17 bp, Homo sapiens
aatggcacagcccaaag

SEQ ID NO: 2577623 - DNA, 20 bp, Homo sapiens
aatggcacagcccaaagaag

SEQ ID NO: 2577624 - DNA, 12 bp, Homo sapiens
aatggcagcctt

SEQ ID NO: 2577625 - DNA, 20 bp, Homo sapiens
aatggcctgccttgaagcca

SEQ ID NO: 2577626 - DNA, 18 bp, Homo sapiens
aatggcgcagtgcctctg

SEQ ID NO: 2577627 - DNA, 18 bp, Homo sapiens
aatggcgtgatctcggct

SEQ ID NO: 2577628 - DNA, 18 bp, Homo sapiens
aatgggacttcttttcac

SEQ ID NO: 2577629 - DNA, 17 bp, Homo sapiens
aatgggcttagagcagt

SEQ ID NO: 2577630 - DNA, 17 bp, Homo sapiens
aatggggatcacagaga

SEQ ID NO: 2577631 - DNA, 16 bp, Homo sapiens
aatggtataaatttca

SEQ ID NO: 2577632 - DNA, 19 bp, Homo sapiens
aatggtccaggagaaggcc

SEQ ID NO: 2577633 - DNA, 19 bp, Homo sapiens
aatggtcccatccaggcag

SEQ ID NO: 2577634 - DNA, 16 bp, Homo sapiens
aatggtgtacataatg

SEQ ID NO: 2577635 - DNA, 17 bp, Homo sapiens
aatggtgtttttttaat

SEQ ID NO: 2577636 - DNA, 13 bp, Homo sapiens
aatggttaaaaga

SEQ ID NO: 2577637 - DNA, 17 bp, Homo sapiens
aatggttataaaagtga

SEQ ID NO: 2577638 - DNA, 17 bp, Homo sapiens
aatggttgactgggttt

SEQ ID NO: 2577639 - DNA, 14 bp, Homo sapiens
aatggtttgaatat

SEQ ID NO: 2577640 - DNA, 23 bp, Homo sapiens
aatggtttgaatataaacactat

SEQ ID NO: 2577641 - DNA, 16 bp, Homo sapiens
aatgtaacttttgtaa

SEQ ID NO: 2577642 - DNA, 15 bp, Homo sapiens
aatgtaagctctact

SEQ ID NO: 2577643 - DNA, 15 bp, Homo sapiens
aatgtaagctgttta

SEQ ID NO: 2577644 - DNA, 15 bp, Homo sapiens
aatgtaatgatcata

SEQ ID NO: 2577645 - DNA, 12 bp, Homo sapiens
aatgtactgcat

SEQ ID NO: 2577646 - DNA, 21 bp, Homo sapiens
aatgtagctggtttcctcatt

SEQ ID NO: 2577647 - DNA, 13 bp, Homo sapiens
aatgtatcaggaa

SEQ ID NO: 2577648 - DNA, 16 bp, Homo sapiens
aatgtatcatagaaat

SEQ ID NO: 2577649 - DNA, 18 bp, Homo sapiens
aatgtatcatagaaatgt

SEQ ID NO: 2577650 - DNA, 22 bp, Homo sapiens
aatgtatcatagaaatgtaact

SEQ ID NO: 2577651 - DNA, 14 bp, Homo sapiens
aatgtatgtgtaag

SEQ ID NO: 2577652 - DNA, 19 bp, Homo sapiens
aatgtatgtgtaagtattc

SEQ ID NO: 2577653 - DNA, 14 bp, Homo sapiens
aatgtattattctg

SEQ ID NO: 2577654 - DNA, 18 bp, Homo sapiens
aatgtattgaacttggaa

SEQ ID NO: 2577655 - DNA, 14 bp, Homo sapiens
aatgtattgtacct

SEQ ID NO: 2577656 - DNA, 16 bp, Homo sapiens
aatgtattgtaccttt

SEQ ID NO: 2577657 - DNA, 14 bp, Homo sapiens
aatgtcacaggcag

SEQ ID NO: 2577658 - DNA, 19 bp, Homo sapiens
aatgtcacaggcaggtcca

SEQ ID NO: 2577659 - DNA, 17 bp, Homo sapiens
aatgtcacttaaaggct

SEQ ID NO: 2577660 - DNA, 18 bp, Homo sapiens
aatgtcagatacaatgta

SEQ ID NO: 2577661 - DNA, 19 bp, Homo sapiens
aatgtcattaaaataaata

SEQ ID NO: 2577662 - DNA, 15 bp, Homo sapiens
aatgtctaaatgctg

SEQ ID NO: 2577663 - DNA, 23 bp, Homo sapiens
acacttgtgtgtgggctgtgagt

SEQ ID NO: 2577664 - DNA, 20 bp, Homo sapiens
acacttttcatgtgtgattt

SEQ ID NO: 2577665 - DNA, 15 bp, Homo sapiens
acagaaaatatactg

SEQ ID NO: 2577666 - DNA, 16 bp, Homo sapiens
acagaaaatatactgt

SEQ ID NO: 2577667 - DNA, 19 bp, Homo sapiens
acagaaagcagaacagtga

SEQ ID NO: 2577668 - DNA, 13 bp, Homo sapiens
acagaaagctgcc

SEQ ID NO: 2577669 - DNA, 24 bp, Homo sapiens
acagaaagggcaacaataaaatag

SEQ ID NO: 2577670 - DNA, 18 bp, Homo sapiens
acagaaagtggtgctcag

SEQ ID NO: 2577671 - DNA, 19 bp, Homo sapiens
acagaaagtggtgctcagt

SEQ ID NO: 2577672 - DNA, 17 bp, Homo sapiens
acagaaatgtacagcaa

SEQ ID NO: 2577673 - DNA, 12 bp, Homo sapiens
acagaacactgt

SEQ ID NO: 2577674 - DNA, 14 bp, Homo sapiens
acagaacagcttca

SEQ ID NO: 2577675 - DNA, 17 bp, Homo sapiens
acagaacagcttcaggt

SEQ ID NO: 2577676 - DNA, 19 bp, Homo sapiens
acagaaccttgttatttct

SEQ ID NO: 2577677 - DNA, 18 bp, Homo sapiens
acagaactctttcaaaac

SEQ ID NO: 2577678 - DNA, 20 bp, Homo sapiens
acagaactctttcaaaacct

SEQ ID NO: 2577679 - DNA, 19 bp, Homo sapiens
acagaagcaggctggaggt

SEQ ID NO: 2577680 - DNA, 19 bp, Homo sapiens
acagaagcttcagaagttt

SEQ ID NO: 2577681 - DNA, 13 bp, Homo sapiens
acagaagcttcca

SEQ ID NO: 2577682 - DNA, 14 bp, Homo sapiens
acagacacacacac

SEQ ID NO: 2577683 - DNA, 11 bp, Homo sapiens
acagacacagg

SEQ ID NO: 2577684 - DNA, 14 bp, Homo sapiens
acagacacaggccc

SEQ ID NO: 2577685 - DNA, 15 bp, Homo sapiens
acagacacaggcccg

SEQ ID NO: 2577686 - DNA, 22 bp, Homo sapiens
acagacacaggcccggctccag

SEQ ID NO: 2577687 - DNA, 23 bp, Homo sapiens
acagacacaggcccggctccagg

SEQ ID NO: 2577688 - DNA, 18 bp, Homo sapiens
acagacactaagttatag

SEQ ID NO: 2577689 - DNA, 21 bp, Homo sapiens
acagacactcccacttggcat

SEQ ID NO: 2577690 - DNA, 16 bp, Homo sapiens
acagacagacacacac

SEQ ID NO: 2577691 - DNA, 18 bp, Homo sapiens
acagacatactaaccagc

SEQ ID NO: 2577692 - DNA, 17 bp, Homo sapiens
acagacattctgccagg

SEQ ID NO: 2577693 - DNA, 21 bp, Homo sapiens
acagaccacatctttatctgt

SEQ ID NO: 2577694 - DNA, 18 bp, Homo sapiens
acagaccctgccctgtgg

SEQ ID NO: 2577695 - DNA, 19 bp, Homo sapiens
acagacctggagcccctgg

SEQ ID NO: 2577696 - DNA, 20 bp, Homo sapiens
acagacgtatgcttatttta

SEQ ID NO: 2577697 - DNA, 23 bp, Homo sapiens
acagactgcgatttgtcccaggt

SEQ ID NO: 2577698 - DNA, 14 bp, Homo sapiens
acagactggaagca

SEQ ID NO: 2577699 - DNA, 16 bp, Homo sapiens
acagacttctccagac

SEQ ID NO: 2577700 - DNA, 17 bp, Homo sapiens
acagacttctccagacc

SEQ ID NO: 2577701 - DNA, 19 bp, Homo sapiens
acagagaaagaggaagctt

SEQ ID NO: 2577702 - DNA, 16 bp, Homo sapiens
acagagaagacaaaat

SEQ ID NO: 2577703 - DNA, 14 bp, Homo sapiens
acagagacctcctg

SEQ ID NO: 2577704 - DNA, 14 bp, Homo sapiens
acagagaggagaaa

SEQ ID NO: 2577705 - DNA, 18 bp, Homo sapiens
acagagaggagaaacaca

SEQ ID NO: 2577706 - DNA, 20 bp, Homo sapiens
acagagaggagaaacacatc

SEQ ID NO: 2577707 - DNA, 22 bp, Homo sapiens
acagagagtcccactgcctcag

SEQ ID NO: 2577708 - DNA, 21 bp, Homo sapiens
acagagcaagtgagaccctgt

SEQ ID NO: 2577709 - DNA, 18 bp, Homo sapiens
acagagcccacgccccca

SEQ ID NO: 2577710 - DNA, 23 bp, Homo sapiens
acagagccttctgaggacattcc

SEQ ID NO: 2577711 - DNA, 15 bp, Homo sapiens
acagagctctccagc

SEQ ID NO: 2577712 - DNA, 18 bp, Homo sapiens
acagagctctccagctcc

SEQ ID NO: 2577713 - DNA, 14 bp, Homo sapiens
acagagcttccctg

SEQ ID NO: 2577714 - DNA, 20 bp, Homo sapiens
acagaggaagaatttgttat

SEQ ID NO: 2577715 - DNA, 17 bp, Homo sapiens
acagaggaagagcaggc

SEQ ID NO: 2577716 - DNA, 18 bp, Homo sapiens
acagaggaagagcaggca

SEQ ID NO: 2577717 - DNA, 23 bp, Homo sapiens
acagaggccatgggcctcctgtg

SEQ ID NO: 2577718 - DNA, 19 bp, Homo sapiens
acagagtctcactgttgcc

SEQ ID NO: 2577719 - DNA, 13 bp, Homo sapiens
acagagtctgggt

SEQ ID NO: 2577720 - DNA, 21 bp, Homo sapiens
acagagtgagactctgtctca

SEQ ID NO: 2577721 - DNA, 19 bp, Homo sapiens
acagagtggtctttctgga

SEQ ID NO: 2577722 - DNA, 20 bp, Homo sapiens
acagagttttcactcttatt

SEQ ID NO: 2577723 - DNA, 19 bp, Homo sapiens
acagataagcaagagagat

SEQ ID NO: 2577724 - DNA, 21 bp, Homo sapiens
acagataagcaagagagatgt

SEQ ID NO: 2577725 - DNA, 20 bp, Homo sapiens
acagatactcctccaaggtt

SEQ ID NO: 2577726 - DNA, 21 bp, Homo sapiens
acagatagtatctagcaatca

SEQ ID NO: 2577727 - DNA, 14 bp, Homo sapiens
acagatcaagctgt

SEQ ID NO: 2577728 - DNA, 17 bp, Homo sapiens
acagatctcctggcaaa

SEQ ID NO: 2577729 - DNA, 19 bp, Homo sapiens
acagatgaaacacaaacaa

SEQ ID NO: 2577730 - DNA, 17 bp, Homo sapiens
acagatgccccagagct

SEQ ID NO: 2577731 - DNA, 16 bp, Homo sapiens
acagatggatttgcct

SEQ ID NO: 2577732 - DNA, 16 bp, Homo sapiens
acagatgggcaaatta

SEQ ID NO: 2577733 - DNA, 15 bp, Homo sapiens
acagattcacactgt

SEQ ID NO: 2577734 - DNA, 19 bp, Homo sapiens
acagattcacactgtctgg

SEQ ID NO: 2577735 - DNA, 22 bp, Homo sapiens
acagatttgtgaactcagccaa

SEQ ID NO: 2577736 - DNA, 22 bp, Homo sapiens
acagattttggggttgtgttgt

SEQ ID NO: 2577737 - DNA, 17 bp, Homo sapiens
acagcaaggagatttac

SEQ ID NO: 2577738 - DNA, 18 bp, Homo sapiens
acagcaagggtgatggga

SEQ ID NO: 2577739 - DNA, 16 bp, Homo sapiens
acagcaagtcagggtt

SEQ ID NO: 2577740 - DNA, 13 bp, Homo sapiens
acagcacagagaa

SEQ ID NO: 2577741 - DNA, 21 bp, Homo sapiens
acagcacagagaagacaaaat

SEQ ID NO: 2577742 - DNA, 14 bp, Homo sapiens
acagcactactctg

SEQ ID NO: 2577743 - DNA, 19 bp, Homo sapiens
acagcactggctctctcca

SEQ ID NO: 2577744 - DNA, 15 bp, Homo sapiens
acagcagaggttctt

SEQ ID NO: 2577745 - DNA, 18 bp, Homo sapiens
acagcagcccctgcacaa

SEQ ID NO: 2577746 - DNA, 14 bp, Homo sapiens
acagcagctcaggc

SEQ ID NO: 2577747 - DNA, 15 bp, Homo sapiens
acagcagctcaggca

SEQ ID NO: 2577748 - DNA, 16 bp, Homo sapiens
acagcagcttcaccag

SEQ ID NO: 2577749 - DNA, 22 bp, Homo sapiens
acagcagcttcaccagagcatt

SEQ ID NO: 2577750 - DNA, 18 bp, Homo sapiens
acagcagttgaaaagact

SEQ ID NO: 2577751 - DNA, 23 bp, Homo sapiens
acagcagttgaaaagactccaaa

SEQ ID NO: 2577752 - DNA, 15 bp, Homo sapiens
acagcataacaaggt

SEQ ID NO: 2577753 - DNA, 13 bp, Homo sapiens
acagcatgtgtat

SEQ ID NO: 2577754 - DNA, 10 bp, Homo sapiens
acagccacac

SEQ ID NO: 2577755 - DNA, 11 bp, Homo sapiens
acagccacaca

SEQ ID NO: 2577756 - DNA, 16 bp, Homo sapiens
acagccacacacacag

SEQ ID NO: 2577757 - DNA, 19 bp, Homo sapiens
acagccacacacacagaaa

SEQ ID NO: 2577758 - DNA, 21 bp, Homo sapiens
acagccacacacacagaaaat

SEQ ID NO: 2577759 - DNA, 16 bp, Homo sapiens
acagccacggccaggc

SEQ ID NO: 2577760 - DNA, 19 bp, Homo sapiens
acagccacggccaggccag

SEQ ID NO: 2577761 - DNA, 15 bp, Homo sapiens
acagccagactggca

SEQ ID NO: 2577762 - DNA, 15 bp, Homo sapiens
acagccaggtgcctt

SEQ ID NO: 2577763 - DNA, 16 bp, Homo sapiens
acagccatcccagcct

SEQ ID NO: 2577764 - DNA, 18 bp, Homo sapiens
acagccatcccagccttg

SEQ ID NO: 2577765 - DNA, 19 bp, Homo sapiens
acagccatcccagccttgg

SEQ ID NO: 2577766 - DNA, 16 bp, Homo sapiens
acagcccaaagaagga

SEQ ID NO: 2577767 - DNA, 18 bp, Homo sapiens
acagcccaaagaaggaaa

SEQ ID NO: 2577768 - DNA, 19 bp, Homo sapiens
acagcccgggctctgcctc

SEQ ID NO: 2577769 - DNA, 21 bp, Homo sapiens
acagcccgggctctgcctccc

SEQ ID NO: 2577770 - DNA, 23 bp, Homo sapiens
acagcccgggctctgcctcccat

SEQ ID NO: 2577771 - DNA, 21 bp, Homo sapiens
acagccctgtcagtgcagccc

SEQ ID NO: 2577772 - DNA, 23 bp, Homo sapiens
acagccgctcctgtctgccagcc

SEQ ID NO: 2577773 - DNA, 17 bp, Homo sapiens
acagccgtcagccaaat

SEQ ID NO: 2577774 - DNA, 20 bp, Homo sapiens
acagccgtcagccaaatgta

SEQ ID NO: 2577775 - DNA, 21 bp, Homo sapiens
acagcctcccctgccagggca

SEQ ID NO: 2577776 - DNA, 22 bp, Homo sapiens
acagcctcccctgccagggcag

SEQ ID NO: 2577777 - DNA, 19 bp, Homo sapiens
acagcctcctctgtctgcc

SEQ ID NO: 2577778 - DNA, 17 bp, Homo sapiens
acagcgagactccgtct

SEQ ID NO: 2577779 - DNA, 15 bp, Homo sapiens
acagcgagaggcaga

SEQ ID NO: 2577780 - DNA, 19 bp, Homo sapiens
acagcgagaggcagagaaa

SEQ ID NO: 2577781 - DNA, 16 bp, Homo sapiens
acagcggcccctgcat

SEQ ID NO: 2577782 - DNA, 19 bp, Homo sapiens
acagcggcccctgcatccc

SEQ ID NO: 2577783 - DNA, 15 bp, Homo sapiens
acagctaacacacag

SEQ ID NO: 2577784 - DNA, 19 bp, Homo sapiens
acagctaacacacagctcc

SEQ ID NO: 2577785 - DNA, 16 bp, Homo sapiens
acagctaatgggacac

SEQ ID NO: 2577786 - DNA, 16 bp, Homo sapiens
acagctatgggagccc

SEQ ID NO: 2577787 - DNA, 21 bp, Homo sapiens
acagctatgggagccccaggg

SEQ ID NO: 2577788 - DNA, 23 bp, Homo sapiens
acagctcaagtcttccctgatca

SEQ ID NO: 2577789 - DNA, 21 bp, Homo sapiens
acagctcagctttttgtcttt

SEQ ID NO: 2577790 - DNA, 16 bp, Homo sapiens
acagctccctctgcct

SEQ ID NO: 2577791 - DNA, 17 bp, Homo sapiens
acagctctgtcctggga

SEQ ID NO: 2577792 - DNA, 18 bp, Homo sapiens
acagctcttctccaggct

SEQ ID NO: 2577793 - DNA, 16 bp, Homo sapiens
acagctgcctgcagta

SEQ ID NO: 2577794 - DNA, 13 bp, Homo sapiens
acagctgggctgt

SEQ ID NO: 2577795 - DNA, 15 bp, Homo sapiens
acagctgtttaagat

SEQ ID NO: 2577796 - DNA, 17 bp, Homo sapiens
acagctgtttaagatgg

SEQ ID NO: 2577797 - DNA, 19 bp, Homo sapiens
acagctgtttaagatgggc

SEQ ID NO: 2577798 - DNA, 22 bp, Homo sapiens
acagcttcagccaggagctggg

SEQ ID NO: 2577799 - DNA, 15 bp, Homo sapiens
acagcttcaggttat

SEQ ID NO: 2577800 - DNA, 20 bp, Homo sapiens
acagcttcaggttatcgaaa

SEQ ID NO: 2577801 - DNA, 19 bp, Homo sapiens
acagcttcatttcctgtgt

SEQ ID NO: 2577802 - DNA, 17 bp, Homo sapiens
acagctttatcaccaga

SEQ ID NO: 2577803 - DNA, 17 bp, Homo sapiens
acaggaaaagctgctga

SEQ ID NO: 2577804 - DNA, 18 bp, Homo sapiens
acaggaaaagctgctgac

SEQ ID NO: 2577805 - DNA, 20 bp, Homo sapiens
acaggaaaagctgctgacag

SEQ ID NO: 2577806 - DNA, 13 bp, Homo sapiens
accatgtcactgt

SEQ ID NO: 2577807 - DNA, 16 bp, Homo sapiens
accatgtgcctgatcc

SEQ ID NO: 2577808 - DNA, 20 bp, Homo sapiens
accattaaaactgaagtctg

SEQ ID NO: 2577809 - DNA, 23 bp, Homo sapiens
accattaaaactgaagtctgaaa

SEQ ID NO: 2577810 - DNA, 19 bp, Homo sapiens
accattctccacctgccag

SEQ ID NO: 2577811 - DNA, 20 bp, Homo sapiens
accattctccacctgccagg

SEQ ID NO: 2577812 - DNA, 18 bp, Homo sapiens
accattgaattcttggtt

SEQ ID NO: 2577813 - DNA, 20 bp, Homo sapiens
accatttcagagaggccttt

SEQ ID NO: 2577814 - DNA, 22 bp, Homo sapiens
accattttttaaggaaacaata

SEQ ID NO: 2577815 - DNA, 13 bp, Homo sapiens
acccaactctcct

SEQ ID NO: 2577816 - DNA, 15 bp, Homo sapiens
acccaactctcctgg

SEQ ID NO: 2577817 - DNA, 15 bp, Homo sapiens
acccaagcaaggcca

SEQ ID NO: 2577818 - DNA, 14 bp, Homo sapiens
acccaagcttggca

SEQ ID NO: 2577819 - DNA, 18 bp, Homo sapiens
acccaagcttggcagccg

SEQ ID NO: 2577820 - DNA, 13 bp, Homo sapiens
acccaagggcctg

SEQ ID NO: 2577821 - DNA, 20 bp, Homo sapiens
acccacaaaagtacaattta

SEQ ID NO: 2577822 - DNA, 21 bp, Homo sapiens
acccacaagaaatgaaagcag

SEQ ID NO: 2577823 - DNA, 13 bp, Homo sapiens
acccacaagtgcc

SEQ ID NO: 2577824 - DNA, 18 bp, Homo sapiens
acccacaggcccacagta

SEQ ID NO: 2577825 - DNA, 16 bp, Homo sapiens
acccacatgtgacaca

SEQ ID NO: 2577826 - DNA, 15 bp, Homo sapiens
acccaccaccatgcc

SEQ ID NO: 2577827 - DNA, 15 bp, Homo sapiens
acccacccccaccca

SEQ ID NO: 2577828 - DNA, 12 bp, Homo sapiens
acccacccctgt

SEQ ID NO: 2577829 - DNA, 13 bp, Homo sapiens
acccacccctgtg

SEQ ID NO: 2577830 - DNA, 15 bp, Homo sapiens
acccacccctgtgct

SEQ ID NO: 2577831 - DNA, 22 bp, Homo sapiens
acccaccgtccgccctgctcct

SEQ ID NO: 2577832 - DNA, 15 bp, Homo sapiens
acccacctcagcctc

SEQ ID NO: 2577833 - DNA, 16 bp, Homo sapiens
acccacctcagcctcc

SEQ ID NO: 2577834 - DNA, 20 bp, Homo sapiens
acccactgcttttggtctgt

SEQ ID NO: 2577835 - DNA, 16 bp, Homo sapiens
acccacttccctgggc

SEQ ID NO: 2577836 - DNA, 22 bp, Homo sapiens
acccagacagctccctctgcct

SEQ ID NO: 2577837 - DNA, 22 bp, Homo sapiens
acccagagaagccccttcccca

SEQ ID NO: 2577838 - DNA, 14 bp, Homo sapiens
acccagatcctcac

SEQ ID NO: 2577839 - DNA, 16 bp, Homo sapiens
acccagcccacttctg

SEQ ID NO: 2577840 - DNA, 18 bp, Homo sapiens
acccagcccacttctgcc

SEQ ID NO: 2577841 - DNA, 14 bp, Homo sapiens
acccagccccaggg

SEQ ID NO: 2577842 - DNA, 17 bp, Homo sapiens
acccagccccttgagaa

SEQ ID NO: 2577843 - DNA, 21 bp, Homo sapiens
acccagccccttgagaaacct

SEQ ID NO: 2577844 - DNA, 12 bp, Homo sapiens
acccagccctgg

SEQ ID NO: 2577845 - DNA, 14 bp, Homo sapiens
acccagccctggtc

SEQ ID NO: 2577846 - DNA, 15 bp, Homo sapiens
acccagcctgtttta

SEQ ID NO: 2577847 - DNA, 23 bp, Homo sapiens
acccagcgagccctggtggcagt

SEQ ID NO: 2577848 - DNA, 15 bp, Homo sapiens
acccagctctggtcc

SEQ ID NO: 2577849 - DNA, 22 bp, Homo sapiens
acccaggagcatccacctcctt

SEQ ID NO: 2577850 - DNA, 19 bp, Homo sapiens
acccaggagggagggggct

SEQ ID NO: 2577851 - DNA, 23 bp, Homo sapiens
acccaggccgcagctcttgccct

SEQ ID NO: 2577852 - DNA, 19 bp, Homo sapiens
acccaggctggagtgcagt

SEQ ID NO: 2577853 - DNA, 14 bp, Homo sapiens
acccaggctgggca

SEQ ID NO: 2577854 - DNA, 17 bp, Homo sapiens
acccagttgccatctgc

SEQ ID NO: 2577855 - DNA, 18 bp, Homo sapiens
acccagttgccatctgcg

SEQ ID NO: 2577856 - DNA, 21 bp, Homo sapiens
acccatatcccctctcccccc

SEQ ID NO: 2577857 - DNA, 20 bp, Homo sapiens
acccatctgcacccccctgg

SEQ ID NO: 2577858 - DNA, 13 bp, Homo sapiens
acccatctgggct

SEQ ID NO: 2577859 - DNA, 20 bp, Homo sapiens
acccatgaggcaatgtcagg

SEQ ID NO: 2577860 - DNA, 13 bp, Homo sapiens
acccatgctgccc

SEQ ID NO: 2577861 - DNA, 14 bp, Homo sapiens
acccatgtgccaag

SEQ ID NO: 2577862 - DNA, 17 bp, Homo sapiens
acccattccatttatct

SEQ ID NO: 2577863 - DNA, 19 bp, Homo sapiens
acccattccatttatcttt

SEQ ID NO: 2577864 - DNA, 17 bp, Homo sapiens
acccattcctatttctt

SEQ ID NO: 2577865 - DNA, 20 bp, Homo sapiens
acccattttgagtgactcga

SEQ ID NO: 2577866 - DNA, 18 bp, Homo sapiens
accccaaacaccttccag

SEQ ID NO: 2577867 - DNA, 20 bp, Homo sapiens
accccaaacaccttccagct

SEQ ID NO: 2577868 - DNA, 14 bp, Homo sapiens
accccaaacctcca

SEQ ID NO: 2577869 - DNA, 15 bp, Homo sapiens
accccaaagagcctg

SEQ ID NO: 2577870 - DNA, 16 bp, Homo sapiens
accccaaagccccttg

SEQ ID NO: 2577871 - DNA, 15 bp, Homo sapiens
accccaactccagta

SEQ ID NO: 2577872 - DNA, 17 bp, Homo sapiens
accccaattccttgtag

SEQ ID NO: 2577873 - DNA, 16 bp, Homo sapiens
accccacacacgccag

SEQ ID NO: 2577874 - DNA, 16 bp, Homo sapiens
accccacaccaggccg

SEQ ID NO: 2577875 - DNA, 21 bp, Homo sapiens
accccacacttgttccagctc

SEQ ID NO: 2577876 - DNA, 21 bp, Homo sapiens
accccaccctagtttccctga

SEQ ID NO: 2577877 - DNA, 13 bp, Homo sapiens
accccaccctcag

SEQ ID NO: 2577878 - DNA, 21 bp, Homo sapiens
accccaccctcagcacccctt

SEQ ID NO: 2577879 - DNA, 13 bp, Homo sapiens
accccaccctccc

SEQ ID NO: 2577880 - DNA, 16 bp, Homo sapiens
accccaccctccctgg

SEQ ID NO: 2577881 - DNA, 17 bp, Homo sapiens
accccaccctccctgga

SEQ ID NO: 2577882 - DNA, 18 bp, Homo sapiens
accccaccctccctggag

SEQ ID NO: 2577883 - DNA, 19 bp, Homo sapiens
accccaccctccctggagt

SEQ ID NO: 2577884 - DNA, 20 bp, Homo sapiens
accccaccctccctggagtg

SEQ ID NO: 2577885 - DNA, 19 bp, Homo sapiens
accccacccttcccctcct

SEQ ID NO: 2577886 - DNA, 13 bp, Homo sapiens
accccagccccaa

SEQ ID NO: 2577887 - DNA, 14 bp, Homo sapiens
accccagctcccta

SEQ ID NO: 2577888 - DNA, 23 bp, Homo sapiens
accccagctccctaggagaccaa

SEQ ID NO: 2577889 - DNA, 12 bp, Homo sapiens
accccagctggg

SEQ ID NO: 2577890 - DNA, 13 bp, Homo sapiens
accccagctggga

SEQ ID NO: 2577891 - DNA, 14 bp, Homo sapiens
accccagctgggag

SEQ ID NO: 2577892 - DNA, 15 bp, Homo sapiens
accccagctgggagg

SEQ ID NO: 2577893 - DNA, 14 bp, Homo sapiens
accccaggccccga

SEQ ID NO: 2577894 - DNA, 15 bp, Homo sapiens
accccaggccccgag

SEQ ID NO: 2577895 - DNA, 16 bp, Homo sapiens
accccagtggccactc

SEQ ID NO: 2577896 - DNA, 23 bp, Homo sapiens
accccagtggccactcagcttcc

SEQ ID NO: 2577897 - DNA, 19 bp, Homo sapiens
accccagttctgctcctct

SEQ ID NO: 2577898 - DNA, 18 bp, Homo sapiens
accccatctctacaaaaa

SEQ ID NO: 2577899 - DNA, 17 bp, Homo sapiens
accccatgctgttgatt

SEQ ID NO: 2577900 - DNA, 21 bp, Homo sapiens
acccccacacacacacacatg

SEQ ID NO: 2577901 - DNA, 19 bp, Homo sapiens
acccccacccccagctcaa

SEQ ID NO: 2577902 - DNA, 16 bp, Homo sapiens
acccccaccccttgct

SEQ ID NO: 2577903 - DNA, 11 bp, Homo sapiens
acccccaccct

SEQ ID NO: 2577904 - DNA, 12 bp, Homo sapiens
acccccagctca

SEQ ID NO: 2577905 - DNA, 14 bp, Homo sapiens
acccccagctttgc

SEQ ID NO: 2577906 - DNA, 16 bp, Homo sapiens
acccccagctttgcta

SEQ ID NO: 2577907 - DNA, 12 bp, Homo sapiens
acccccctcatt

SEQ ID NO: 2577908 - DNA, 15 bp, Homo sapiens
acccccctgggctga

SEQ ID NO: 2577909 - DNA, 13 bp, Homo sapiens
acccccgccccct

SEQ ID NO: 2577910 - DNA, 14 bp, Homo sapiens
acccccgccccctg

SEQ ID NO: 2577911 - DNA, 21 bp, Homo sapiens
acccccgccccctgccctccc

SEQ ID NO: 2577912 - DNA, 16 bp, Homo sapiens
accccctcattgttta

SEQ ID NO: 2577913 - DNA, 16 bp, Homo sapiens
accccctccctggcct

SEQ ID NO: 2577914 - DNA, 20 bp, Homo sapiens
accccctccctggcctgttc

SEQ ID NO: 2577915 - DNA, 16 bp, Homo sapiens
accccctcctctctgc

SEQ ID NO: 2577916 - DNA, 18 bp, Homo sapiens
acccccttctactgagcc

SEQ ID NO: 2577917 - DNA, 19 bp, Homo sapiens
acccccttctactgagcct

SEQ ID NO: 2577918 - DNA, 14 bp, Homo sapiens
acccccttctctgc

SEQ ID NO: 2577919 - DNA, 17 bp, Homo sapiens
acccccttctctgctcc

SEQ ID NO: 2577920 - DNA, 19 bp, Homo sapiens
acccccttctctgctccac

SEQ ID NO: 2577921 - DNA, 18 bp, Homo sapiens
accccgaccacctgccca

SEQ ID NO: 2577922 - DNA, 19 bp, Homo sapiens
accccgcctgccctcatgg

SEQ ID NO: 2577923 - DNA, 22 bp, Homo sapiens
accccgctctgcatgcggccca

SEQ ID NO: 2577924 - DNA, 15 bp, Homo sapiens
accccggccacctgc

SEQ ID NO: 2577925 - DNA, 13 bp, Homo sapiens
accccgggcgggt

SEQ ID NO: 2577926 - DNA, 18 bp, Homo sapiens
accccgggctctctgctg

SEQ ID NO: 2577927 - DNA, 20 bp, Homo sapiens
accccgtcgaggggctctca

SEQ ID NO: 2577928 - DNA, 22 bp, Homo sapiens
acccctcaccttgcaacacaca

SEQ ID NO: 2577929 - DNA, 17 bp, Homo sapiens
acccctcactctggcct

SEQ ID NO: 2577930 - DNA, 11 bp, Homo sapiens
acccctcccat

SEQ ID NO: 2577931 - DNA, 15 bp, Homo sapiens
acccctcctcccttt

SEQ ID NO: 2577932 - DNA, 16 bp, Homo sapiens
acccctccttccttga

SEQ ID NO: 2577933 - DNA, 21 bp, Homo sapiens
acccctccttccttgaccagc

SEQ ID NO: 2577934 - DNA, 22 bp, Homo sapiens
acccctccttccttgaccagca

SEQ ID NO: 2577935 - DNA, 13 bp, Homo sapiens
acccctctggcca

SEQ ID NO: 2577936 - DNA, 11 bp, Homo sapiens
acccctgcccc

SEQ ID NO: 2577937 - DNA, 19 bp, Homo sapiens
acccctgcccccacttcct

SEQ ID NO: 2577938 - DNA, 13 bp, Homo sapiens
acccctgccctgg

SEQ ID NO: 2577939 - DNA, 18 bp, Homo sapiens
acccctgcctccaccctc

SEQ ID NO: 2577940 - DNA, 12 bp, Homo sapiens
acccctggcctc

SEQ ID NO: 2577941 - DNA, 18 bp, Homo sapiens
acccctgtggagcccgca

SEQ ID NO: 2577942 - DNA, 15 bp, Homo sapiens
accccttagcctccc

SEQ ID NO: 2577943 - DNA, 16 bp, Homo sapiens
accccttagcctccct

SEQ ID NO: 2577944 - DNA, 17 bp, Homo sapiens
accccttagcctccctg

SEQ ID NO: 2577945 - DNA, 17 bp, Homo sapiens
accccttatccaggact

SEQ ID NO: 2577946 - DNA, 18 bp, Homo sapiens
accccttatccaggactc

SEQ ID NO: 2577947 - DNA, 14 bp, Homo sapiens
accccttccccact

SEQ ID NO: 2577948 - DNA, 15 bp, Homo sapiens
accccttccccactg

SEQ ID NO: 2577949 - DNA, 22 bp, Homo sapiens
accccttccccactgcctgccc

SEQ ID NO: 2577950 - DNA, 21 bp, Homo sapiens
acccgacagagggaagaaaag

SEQ ID NO: 2577951 - DNA, 17 bp, Homo sapiens
acccgaggctgcccact

SEQ ID NO: 2577952 - DNA, 12 bp, Homo sapiens
accttggctgca

SEQ ID NO: 2577953 - DNA, 13 bp, Homo sapiens
accttgtgtctgt

SEQ ID NO: 2577954 - DNA, 15 bp, Homo sapiens
accttgtgtctgtac

SEQ ID NO: 2577955 - DNA, 22 bp, Homo sapiens
accttgttatttctcagacttt

SEQ ID NO: 2577956 - DNA, 16 bp, Homo sapiens
accttgttcacactct

SEQ ID NO: 2577957 - DNA, 21 bp, Homo sapiens
accttgttcacactctcacat

SEQ ID NO: 2577958 - DNA, 22 bp, Homo sapiens
accttgttgcatgatgtatttt

SEQ ID NO: 2577959 - DNA, 19 bp, Homo sapiens
accttgttggagcctgcag

SEQ ID NO: 2577960 - DNA, 18 bp, Homo sapiens
accttgttgttgttaaat

SEQ ID NO: 2577961 - DNA, 21 bp, Homo sapiens
acctttagggcagcttgcccc

SEQ ID NO: 2577962 - DNA, 15 bp, Homo sapiens
acctttatggtttct

SEQ ID NO: 2577963 - DNA, 14 bp, Homo sapiens
acctttattaaaat

SEQ ID NO: 2577964 - DNA, 18 bp, Homo sapiens
acctttattaaaatctta

SEQ ID NO: 2577965 - DNA, 15 bp, Homo sapiens
acctttcacatagag

SEQ ID NO: 2577966 - DNA, 23 bp, Homo sapiens
acctttccaaagttaacagattt

SEQ ID NO: 2577967 - DNA, 19 bp, Homo sapiens
acctttgtattctctcctg

SEQ ID NO: 2577968 - DNA, 20 bp, Homo sapiens
accttttaacacctgatgtg

SEQ ID NO: 2577969 - DNA, 14 bp, Homo sapiens
accttttaactcac

SEQ ID NO: 2577970 - DNA, 14 bp, Homo sapiens
accttttattacat

SEQ ID NO: 2577971 - DNA, 17 bp, Homo sapiens
accttttgaggagcccc

SEQ ID NO: 2577972 - DNA, 21 bp, Homo sapiens
accttttgaggagccccagct

SEQ ID NO: 2577973 - DNA, 16 bp, Homo sapiens
accttttttaagattt

SEQ ID NO: 2577974 - DNA, 14 bp, Homo sapiens
acgaagtgttgcat

SEQ ID NO: 2577975 - DNA, 14 bp, Homo sapiens
acgacaaggaaagg

SEQ ID NO: 2577976 - DNA, 17 bp, Homo sapiens
acgaccacagggtctgc

SEQ ID NO: 2577977 - DNA, 13 bp, Homo sapiens
acgacctttacct

SEQ ID NO: 2577978 - DNA, 15 bp, Homo sapiens
acgactgcccggcag

SEQ ID NO: 2577979 - DNA, 12 bp, Homo sapiens
acgactgtctcc

SEQ ID NO: 2577980 - DNA, 15 bp, Homo sapiens
acgagaaagatcatt

SEQ ID NO: 2577981 - DNA, 12 bp, Homo sapiens
acgaggaagccc

SEQ ID NO: 2577982 - DNA, 11 bp, Homo sapiens
acgaggccctc

SEQ ID NO: 2577983 - DNA, 19 bp, Homo sapiens
acgaggccctcgggcccag

SEQ ID NO: 2577984 - DNA, 21 bp, Homo sapiens
acgaggccctcgggcccagcc

SEQ ID NO: 2577985 - DNA, 22 bp, Homo sapiens
acgaggccctcgggcccagccc

SEQ ID NO: 2577986 - DNA, 23 bp, Homo sapiens
acgaggccctcgggcccagcccc

SEQ ID NO: 2577987 - DNA, 21 bp, Homo sapiens
acgatgtggaaaaatgagaga

SEQ ID NO: 2577988 - DNA, 14 bp, Homo sapiens
acgatttctgttta

SEQ ID NO: 2577989 - DNA, 23 bp, Homo sapiens
acgatttctgtttagataataca

SEQ ID NO: 2577990 - DNA, 17 bp, Homo sapiens
acgcaaagggctgaaag

SEQ ID NO: 2577991 - DNA, 21 bp, Homo sapiens
acgcaaagggctgaaagccat

SEQ ID NO: 2577992 - DNA, 17 bp, Homo sapiens
acgcacagccaaggact

SEQ ID NO: 2577993 - DNA, 16 bp, Homo sapiens
acgcactccatgagca

SEQ ID NO: 2577994 - DNA, 18 bp, Homo sapiens
acgcagccctagagcctg

SEQ ID NO: 2577995 - DNA, 21 bp, Homo sapiens
acgcagccctagagcctgcct

SEQ ID NO: 2577996 - DNA, 17 bp, Homo sapiens
acgcaggaactcccagc

SEQ ID NO: 2577997 - DNA, 19 bp, Homo sapiens
acgcaggcccccaggtgcc

SEQ ID NO: 2577998 - DNA, 13 bp, Homo sapiens
acgccacctcgcc

SEQ ID NO: 2577999 - DNA, 20 bp, Homo sapiens
acgccactgcactccagcct

SEQ ID NO: 2578000 - DNA, 22 bp, Homo sapiens
acgccagattctttcctgaggc

SEQ ID NO: 2578001 - DNA, 23 bp, Homo sapiens
acgccagattctttcctgaggct

SEQ ID NO: 2578002 - DNA, 23 bp, Homo sapiens
acgccaggggaaaatcagcctgc

SEQ ID NO: 2578003 - DNA, 17 bp, Homo sapiens
acgccatcccagcccca

SEQ ID NO: 2578004 - DNA, 21 bp, Homo sapiens
acgccccagataccagcccct

SEQ ID NO: 2578005 - DNA, 14 bp, Homo sapiens
acgcccccactggt

SEQ ID NO: 2578006 - DNA, 13 bp, Homo sapiens
acgccctattttt

SEQ ID NO: 2578007 - DNA, 20 bp, Homo sapiens
acgccggggacagaggcctg

SEQ ID NO: 2578008 - DNA, 16 bp, Homo sapiens
acgcctatgatcccag

SEQ ID NO: 2578009 - DNA, 15 bp, Homo sapiens
acgcctcccactggg

SEQ ID NO: 2578010 - DNA, 22 bp, Homo sapiens
acgcctgccctccccagagcac

SEQ ID NO: 2578011 - DNA, 15 bp, Homo sapiens
acgcctgcctcccct

SEQ ID NO: 2578012 - DNA, 13 bp, Homo sapiens
acgctacccggga

SEQ ID NO: 2578013 - DNA, 21 bp, Homo sapiens
acgctacccgggaagggggct

SEQ ID NO: 2578014 - DNA, 23 bp, Homo sapiens
acgctcctccctctgaggctgta

SEQ ID NO: 2578015 - DNA, 12 bp, Homo sapiens
acgctgaataaa

SEQ ID NO: 2578016 - DNA, 13 bp, Homo sapiens
acgctgaataaat

SEQ ID NO: 2578017 - DNA, 19 bp, Homo sapiens
acgctgaataaatgtcttt

SEQ ID NO: 2578018 - DNA, 16 bp, Homo sapiens
acgctggagtgcagtg

SEQ ID NO: 2578019 - DNA, 11 bp, Homo sapiens
acgctgtctcc

SEQ ID NO: 2578020 - DNA, 19 bp, Homo sapiens
acgctgtctccagaccccc

SEQ ID NO: 2578021 - DNA, 12 bp, Homo sapiens
acgctgtgctgc

SEQ ID NO: 2578022 - DNA, 16 bp, Homo sapiens
acgctgtgctgccctg

SEQ ID NO: 2578023 - DNA, 15 bp, Homo sapiens
acggaagagccttgc

SEQ ID NO: 2578024 - DNA, 16 bp, Homo sapiens
acggacaccccctcgc

SEQ ID NO: 2578025 - DNA, 19 bp, Homo sapiens
acggacactcaaaagctgg

SEQ ID NO: 2578026 - DNA, 19 bp, Homo sapiens
acggacgaaccttgaaaac

SEQ ID NO: 2578027 - DNA, 14 bp, Homo sapiens
acggagatgtttca

SEQ ID NO: 2578028 - DNA, 21 bp, Homo sapiens
acggagccactcctctgactc

SEQ ID NO: 2578029 - DNA, 21 bp, Homo sapiens
acggagccccaggcctctgtg

SEQ ID NO: 2578030 - DNA, 13 bp, Homo sapiens
acggagtctcgct

SEQ ID NO: 2578031 - DNA, 16 bp, Homo sapiens
acggatgattggatta

SEQ ID NO: 2578032 - DNA, 21 bp, Homo sapiens
acggattattttttcagaccg

SEQ ID NO: 2578033 - DNA, 21 bp, Homo sapiens
acggcaggacaacgaggaagc

SEQ ID NO: 2578034 - DNA, 15 bp, Homo sapiens
acggccactggccat

SEQ ID NO: 2578035 - DNA, 14 bp, Homo sapiens
acggccgctccagg

SEQ ID NO: 2578036 - DNA, 18 bp, Homo sapiens
acggcctgatgctccctc

SEQ ID NO: 2578037 - DNA, 20 bp, Homo sapiens
acggcctgatgctccctccc

SEQ ID NO: 2578038 - DNA, 22 bp, Homo sapiens
acggcctgatgctccctcccct

SEQ ID NO: 2578039 - DNA, 17 bp, Homo sapiens
acggctcactgcagcct

SEQ ID NO: 2578040 - DNA, 18 bp, Homo sapiens
acggctcactgcagcctc

SEQ ID NO: 2578041 - DNA, 17 bp, Homo sapiens
acggctctaggtggggc

SEQ ID NO: 2578042 - DNA, 19 bp, Homo sapiens
acggctctaggtggggcgg

SEQ ID NO: 2578043 - DNA, 15 bp, Homo sapiens
acgggaccgggccgc

SEQ ID NO: 2578044 - DNA, 15 bp, Homo sapiens
acgggactgacgcaa

SEQ ID NO: 2578045 - DNA, 14 bp, Homo sapiens
acggggaggccaag

SEQ ID NO: 2578046 - DNA, 16 bp, Homo sapiens
acggggggccccagtc

SEQ ID NO: 2578047 - DNA, 23 bp, Homo sapiens
acggggggccccagtcagcctct

SEQ ID NO: 2578048 - DNA, 14 bp, Homo sapiens
acggggtccttcaa

SEQ ID NO: 2578049 - DNA, 18 bp, Homo sapiens
acggtctgttcttgaagc

SEQ ID NO: 2578050 - DNA, 18 bp, Homo sapiens
acggtgctccaggcaggc

SEQ ID NO: 2578051 - DNA, 19 bp, Homo sapiens
acggtgggcatttgtgagg

SEQ ID NO: 2578052 - DNA, 21 bp, Homo sapiens
acggtgggccttgctggggac

SEQ ID NO: 2578053 - DNA, 16 bp, Homo sapiens
acggttcaccagcctc

SEQ ID NO: 2578054 - DNA, 19 bp, Homo sapiens
acggttcaccagcctctct

SEQ ID NO: 2578055 - DNA, 17 bp, Homo sapiens
acgtaaagctagaaatg

SEQ ID NO: 2578056 - DNA, 18 bp, Homo sapiens
acgtaaagctagaaatga

SEQ ID NO: 2578057 - DNA, 18 bp, Homo sapiens
acgtaaccacggaaaaga

SEQ ID NO: 2578058 - DNA, 13 bp, Homo sapiens
acgtacacatttt

SEQ ID NO: 2578059 - DNA, 20 bp, Homo sapiens
acgtacgtatcagcggcccc

SEQ ID NO: 2578060 - DNA, 16 bp, Homo sapiens
acgtacttagcagcta

SEQ ID NO: 2578061 - DNA, 14 bp, Homo sapiens
acgtatgcatgtga

SEQ ID NO: 2578062 - DNA, 21 bp, Homo sapiens
acgtcactggaccactgggca

SEQ ID NO: 2578063 - DNA, 14 bp, Homo sapiens
acgtctgacaggca

SEQ ID NO: 2578064 - DNA, 15 bp, Homo sapiens
acgtctgacaggcaa

SEQ ID NO: 2578065 - DNA, 17 bp, Homo sapiens
acgtctgggagaaattg

SEQ ID NO: 2578066 - DNA, 16 bp, Homo sapiens
acgtgacagtgcctgg

SEQ ID NO: 2578067 - DNA, 14 bp, Homo sapiens
acgtgagagtgtct

SEQ ID NO: 2578068 - DNA, 15 bp, Homo sapiens
acgtgagagtgtctt

SEQ ID NO: 2578069 - DNA, 23 bp, Homo sapiens
acgtgagccaggtaatgagggac

SEQ ID NO: 2578070 - DNA, 21 bp, Homo sapiens
acgtgcacctgtactcaggag

SEQ ID NO: 2578071 - DNA, 17 bp, Homo sapiens
acgtgccttttgcaccc

SEQ ID NO: 2578072 - DNA, 16 bp, Homo sapiens
acgtggagagctggtg

SEQ ID NO: 2578073 - DNA, 19 bp, Homo sapiens
acgtggagagctggtgccc

SEQ ID NO: 2578074 - DNA, 16 bp, Homo sapiens
acgtggagctcttggc

SEQ ID NO: 2578075 - DNA, 15 bp, Homo sapiens
acgtggcccagagaa

SEQ ID NO: 2578076 - DNA, 11 bp, Homo sapiens
acgtgggagac

SEQ ID NO: 2578077 - DNA, 15 bp, Homo sapiens
acgtgtgatttttct

SEQ ID NO: 2578078 - DNA, 21 bp, Homo sapiens
acgttaagggaaggaactctg

SEQ ID NO: 2578079 - DNA, 12 bp, Homo sapiens
acgttacatttt

SEQ ID NO: 2578080 - DNA, 16 bp, Homo sapiens
acgttatggtgtttct

SEQ ID NO: 2578081 - DNA, 11 bp, Homo sapiens
acgttccagcc

SEQ ID NO: 2578082 - DNA, 21 bp, Homo sapiens
acgttcctattgtcattaaag

SEQ ID NO: 2578083 - DNA, 17 bp, Homo sapiens
acgttctcacacccacc

SEQ ID NO: 2578084 - DNA, 16 bp, Homo sapiens
acgttgagcccctgga

SEQ ID NO: 2578085 - DNA, 11 bp, Homo sapiens
acgttgctgtg

SEQ ID NO: 2578086 - DNA, 15 bp, Homo sapiens
acgttgtgcatttgg

SEQ ID NO: 2578087 - DNA, 18 bp, Homo sapiens
acgtttacaagccccccc

SEQ ID NO: 2578088 - DNA, 16 bp, Homo sapiens
acgtttacttatctta

SEQ ID NO: 2578089 - DNA, 15 bp, Homo sapiens
acgtttcctgagaag

SEQ ID NO: 2578090 - DNA, 16 bp, Homo sapiens
acgtttctaaaggcta

SEQ ID NO: 2578091 - DNA, 15 bp, Homo sapiens
acgttttattgtgtt

SEQ ID NO: 2578092 - DNA, 13 bp, Homo sapiens
acgtttttccttt

SEQ ID NO: 2578093 - DNA, 14 bp, Homo sapiens
acgtttttccttta

SEQ ID NO: 2578094 - DNA, 12 bp, Homo sapiens
actaaaaataca

SEQ ID NO: 2578095 - DNA, 23 bp, Homo sapiens
actaaactggtttgttgcagcca

SEQ ID NO: 2578096 - DNA, 15 bp, Homo sapiens
actaaactttcacac

SEQ ID NO: 2578097 - DNA, 12 bp, Homo sapiens
actaaagagaga

SEQ ID NO: 2578098 - DNA, 23 bp, Homo sapiens
actgaattataagaggctgataa

SEQ ID NO: 2578099 - DNA, 18 bp, Homo sapiens
actgacagcctcccaccc

SEQ ID NO: 2578100 - DNA, 17 bp, Homo sapiens
actgacattgttggcca

SEQ ID NO: 2578101 - DNA, 20 bp, Homo sapiens
actgaccaatattgtacagt

SEQ ID NO: 2578102 - DNA, 15 bp, Homo sapiens
actgagacagcccgg

SEQ ID NO: 2578103 - DNA, 23 bp, Homo sapiens
actgagacagcccgggctctgcc

SEQ ID NO: 2578104 - DNA, 20 bp, Homo sapiens
actgagatccttccttttga

SEQ ID NO: 2578105 - DNA, 15 bp, Homo sapiens
actgagcccccccaa

SEQ ID NO: 2578106 - DNA, 13 bp, Homo sapiens
actgagctcctct

SEQ ID NO: 2578107 - DNA, 21 bp, Homo sapiens
actgagctcctctgggcagga

SEQ ID NO: 2578108 - DNA, 15 bp, Homo sapiens
actgaggaccagcca

SEQ ID NO: 2578109 - DNA, 21 bp, Homo sapiens
actgagggaccaactgggccc

SEQ ID NO: 2578110 - DNA, 12 bp, Homo sapiens
actgagggcagt

SEQ ID NO: 2578111 - DNA, 23 bp, Homo sapiens
actgagggcagtcgatagagctg

SEQ ID NO: 2578112 - DNA, 12 bp, Homo sapiens
actgagggccac

SEQ ID NO: 2578113 - DNA, 17 bp, Homo sapiens
actgaggggaggggagc

SEQ ID NO: 2578114 - DNA, 21 bp, Homo sapiens
actgaggggtctccaggagga

SEQ ID NO: 2578115 - DNA, 13 bp, Homo sapiens
actgataaagatg

SEQ ID NO: 2578116 - DNA, 21 bp, Homo sapiens
actgataaagatgagtgagca

SEQ ID NO: 2578117 - DNA, 17 bp, Homo sapiens
actgatagttactgttg

SEQ ID NO: 2578118 - DNA, 16 bp, Homo sapiens
actgatatattttaca

SEQ ID NO: 2578119 - DNA, 17 bp, Homo sapiens
actgatatattttacaa

SEQ ID NO: 2578120 - DNA, 12 bp, Homo sapiens
actgatgggcaa

SEQ ID NO: 2578121 - DNA, 22 bp, Homo sapiens
actgatgggcaacccccagcct

SEQ ID NO: 2578122 - DNA, 20 bp, Homo sapiens
actgatgtatgaggaatttc

SEQ ID NO: 2578123 - DNA, 20 bp, Homo sapiens
actgcaacttgtaaatgtgg

SEQ ID NO: 2578124 - DNA, 21 bp, Homo sapiens
actgcaatcctgtctttctga

SEQ ID NO: 2578125 - DNA, 17 bp, Homo sapiens
actgcaattaaagtgat

SEQ ID NO: 2578126 - DNA, 15 bp, Homo sapiens
actgcacagagctct

SEQ ID NO: 2578127 - DNA, 16 bp, Homo sapiens
actgcacagcgtcctg

SEQ ID NO: 2578128 - DNA, 18 bp, Homo sapiens
actgcacagcgtcctgtc

SEQ ID NO: 2578129 - DNA, 15 bp, Homo sapiens
actgcactccagcct

SEQ ID NO: 2578130 - DNA, 18 bp, Homo sapiens
actgcactccagcctggg

SEQ ID NO: 2578131 - DNA, 19 bp, Homo sapiens
actgcactccagcctgggc

SEQ ID NO: 2578132 - DNA, 20 bp, Homo sapiens
actgcactccagcctgggca

SEQ ID NO: 2578133 - DNA, 16 bp, Homo sapiens
actgcagacctgtcct

SEQ ID NO: 2578134 - DNA, 23 bp, Homo sapiens
actgcagacctgtcctcctggtg

SEQ ID NO: 2578135 - DNA, 22 bp, Homo sapiens
actgcagcctcaacctcctggg

SEQ ID NO: 2578136 - DNA, 15 bp, Homo sapiens
actgcagctttacat

SEQ ID NO: 2578137 - DNA, 16 bp, Homo sapiens
actgcagggactgcca

SEQ ID NO: 2578138 - DNA, 18 bp, Homo sapiens
actgcagggactgccagt

SEQ ID NO: 2578139 - DNA, 21 bp, Homo sapiens
actgcagtgaaagacaagctg

SEQ ID NO: 2578140 - DNA, 22 bp, Homo sapiens
actgcagtgaaagacaagctgc

SEQ ID NO: 2578141 - DNA, 13 bp, Homo sapiens
actgcatactttt

SEQ ID NO: 2578142 - DNA, 16 bp, Homo sapiens
actgcatactttttaa

SEQ ID NO: 2578143 - DNA, 20 bp, Homo sapiens
actgcatactttttaaatgt

SEQ ID NO: 2578144 - DNA, 16 bp, Homo sapiens
actgcattagaaatta

SEQ ID NO: 2578145 - DNA, 17 bp, Homo sapiens
actgccagatgctgatg

SEQ ID NO: 2578146 - DNA, 23 bp, Homo sapiens
actgccagatgctgatgttcagt

SEQ ID NO: 2578147 - DNA, 21 bp, Homo sapiens
actgcccgagctggtgcatta

SEQ ID NO: 2578148 - DNA, 22 bp, Homo sapiens
actgcccggcagggtcctagaa

SEQ ID NO: 2578149 - DNA, 18 bp, Homo sapiens
actgccgaccgaggctgg

SEQ ID NO: 2578150 - DNA, 22 bp, Homo sapiens
actgccgaccgaggctggagct

SEQ ID NO: 2578151 - DNA, 14 bp, Homo sapiens
actgcctactgcat

SEQ ID NO: 2578152 - DNA, 12 bp, Homo sapiens
actgcctcaggt

SEQ ID NO: 2578153 - DNA, 17 bp, Homo sapiens
actgcctctccctggcc

SEQ ID NO: 2578154 - DNA, 18 bp, Homo sapiens
actgcctctccctggccc

SEQ ID NO: 2578155 - DNA, 19 bp, Homo sapiens
actgcctctccctggccct

SEQ ID NO: 2578156 - DNA, 15 bp, Homo sapiens
actgcctcttcctcc

SEQ ID NO: 2578157 - DNA, 23 bp, Homo sapiens
actgcctgcccacccgtggagat

SEQ ID NO: 2578158 - DNA, 18 bp, Homo sapiens
actgccttgaatatcccc

SEQ ID NO: 2578159 - DNA, 22 bp, Homo sapiens
actgccttgaatatcccctccc

SEQ ID NO: 2578160 - DNA, 18 bp, Homo sapiens
actgccttggcttcaggg

SEQ ID NO: 2578161 - DNA, 16 bp, Homo sapiens
actgcctttggcagag

SEQ ID NO: 2578162 - DNA, 22 bp, Homo sapiens
actgcgggatggtcctggggct

SEQ ID NO: 2578163 - DNA, 14 bp, Homo sapiens
actgctaaataaaa

SEQ ID NO: 2578164 - DNA, 17 bp, Homo sapiens
actgctaaataaaattt

SEQ ID NO: 2578165 - DNA, 18 bp, Homo sapiens
actgctaggcgagtgcca

SEQ ID NO: 2578166 - DNA, 21 bp, Homo sapiens
actgctaggcgagtgccagga

SEQ ID NO: 2578167 - DNA, 20 bp, Homo sapiens
actgctaggtgggccagccc

SEQ ID NO: 2578168 - DNA, 21 bp, Homo sapiens
actgctaggtgggccagcccc

SEQ ID NO: 2578169 - DNA, 23 bp, Homo sapiens
actgctcatcattccttgagaaa

SEQ ID NO: 2578170 - DNA, 19 bp, Homo sapiens
actgctccccagccctggc

SEQ ID NO: 2578171 - DNA, 15 bp, Homo sapiens
actgcttcccatcct

SEQ ID NO: 2578172 - DNA, 16 bp, Homo sapiens
actgcttcccatccta

SEQ ID NO: 2578173 - DNA, 17 bp, Homo sapiens
actgcttcccatcctac

SEQ ID NO: 2578174 - DNA, 15 bp, Homo sapiens
actgcttgaggaaaa

SEQ ID NO: 2578175 - DNA, 18 bp, Homo sapiens
actgcttgtgtttttaac

SEQ ID NO: 2578176 - DNA, 17 bp, Homo sapiens
actgctttctttcgttt

SEQ ID NO: 2578177 - DNA, 16 bp, Homo sapiens
actgcttttggtctgt

SEQ ID NO: 2578178 - DNA, 20 bp, Homo sapiens
actgcttttggtctgtgtga

SEQ ID NO: 2578179 - DNA, 15 bp, Homo sapiens
actggaagcacagct

SEQ ID NO: 2578180 - DNA, 13 bp, Homo sapiens
actggaagttttg

SEQ ID NO: 2578181 - DNA, 21 bp, Homo sapiens
actggactcaggatgcccagg

SEQ ID NO: 2578182 - DNA, 18 bp, Homo sapiens
actggactccggccctcc

SEQ ID NO: 2578183 - DNA, 22 bp, Homo sapiens
actggacttgagcttggcagct

SEQ ID NO: 2578184 - DNA, 18 bp, Homo sapiens
actggagcatctgactca

SEQ ID NO: 2578185 - DNA, 13 bp, Homo sapiens
actggagcccagg

SEQ ID NO: 2578186 - DNA, 16 bp, Homo sapiens
actggagcccaggagt

SEQ ID NO: 2578187 - DNA, 18 bp, Homo sapiens
actggaggagagaagaat

SEQ ID NO: 2578188 - DNA, 20 bp, Homo sapiens
actggaggagagaagaatga

SEQ ID NO: 2578189 - DNA, 21 bp, Homo sapiens
actggaggtcacattcaggaa

SEQ ID NO: 2578190 - DNA, 23 bp, Homo sapiens
actggaggtcacattcaggaaga

SEQ ID NO: 2578191 - DNA, 18 bp, Homo sapiens
actggagtgcagggagga

SEQ ID NO: 2578192 - DNA, 17 bp, Homo sapiens
actggagtggagcattg

SEQ ID NO: 2578193 - DNA, 15 bp, Homo sapiens
actggagttacatta

SEQ ID NO: 2578194 - DNA, 13 bp, Homo sapiens
actggagttctat

SEQ ID NO: 2578195 - DNA, 10 bp, Homo sapiens
actggatgaa

SEQ ID NO: 2578196 - DNA, 11 bp, Homo sapiens
actggatgaaa

SEQ ID NO: 2578197 - DNA, 17 bp, Homo sapiens
actggatgcagaaacag

SEQ ID NO: 2578198 - DNA, 15 bp, Homo sapiens
actggattaaactta

SEQ ID NO: 2578199 - DNA, 22 bp, Homo sapiens
actggcacagttttctgagaaa

SEQ ID NO: 2578200 - DNA, 21 bp, Homo sapiens
actggcattgtccctgtgcct

SEQ ID NO: 2578201 - DNA, 15 bp, Homo sapiens
actggccaccaggct

SEQ ID NO: 2578202 - DNA, 21 bp, Homo sapiens
actggccaccaggctggcgca

SEQ ID NO: 2578203 - DNA, 12 bp, Homo sapiens
actggcccctgg

SEQ ID NO: 2578204 - DNA, 22 bp, Homo sapiens
actggcctgcacggtgggcctt

SEQ ID NO: 2578205 - DNA, 21 bp, Homo sapiens
actggctagagtcctcactcc

SEQ ID NO: 2578206 - DNA, 20 bp, Homo sapiens
actggctctccaagtgccag

SEQ ID NO: 2578207 - DNA, 17 bp, Homo sapiens
actggctctctccagga

SEQ ID NO: 2578208 - DNA, 17 bp, Homo sapiens
actggctggctgcagtg

SEQ ID NO: 2578209 - DNA, 14 bp, Homo sapiens
actggcttttatta

SEQ ID NO: 2578210 - DNA, 18 bp, Homo sapiens
actggcttttattaatgc

SEQ ID NO: 2578211 - DNA, 20 bp, Homo sapiens
actggcttttattaatgcac

SEQ ID NO: 2578212 - DNA, 22 bp, Homo sapiens
actgggaagataggctctgcac

SEQ ID NO: 2578213 - DNA, 19 bp, Homo sapiens
actgggagaggtgccagca

SEQ ID NO: 2578214 - DNA, 23 bp, Homo sapiens
actgggagaggtgccagcaactg

SEQ ID NO: 2578215 - DNA, 13 bp, Homo sapiens
actgggcaatgat

SEQ ID NO: 2578216 - DNA, 13 bp, Homo sapiens
actgggccctgcc

SEQ ID NO: 2578217 - DNA, 21 bp, Homo sapiens
actgggctgaacactccaatt

SEQ ID NO: 2578218 - DNA, 15 bp, Homo sapiens
actggggctggcaca

SEQ ID NO: 2578219 - DNA, 17 bp, Homo sapiens
actgggtacttgtggac

SEQ ID NO: 2578220 - DNA, 20 bp, Homo sapiens
actgggtacttgtggacaca

SEQ ID NO: 2578221 - DNA, 18 bp, Homo sapiens
actgggtggggtgaggac

SEQ ID NO: 2578222 - DNA, 14 bp, Homo sapiens
actgggttcctgca

SEQ ID NO: 2578223 - DNA, 20 bp, Homo sapiens
actgggttgactttcaggta

SEQ ID NO: 2578224 - DNA, 22 bp, Homo sapiens
actgggtttggaccccagctgg

SEQ ID NO: 2578225 - DNA, 22 bp, Homo sapiens
actggtccaaaagattgctgaa

SEQ ID NO: 2578226 - DNA, 21 bp, Homo sapiens
actggtgactgcgatcttcag

SEQ ID NO: 2578227 - DNA, 21 bp, Homo sapiens
actggtgttatcaccgtgggc

SEQ ID NO: 2578228 - DNA, 13 bp, Homo sapiens
actgtaaagaaag

SEQ ID NO: 2578229 - DNA, 18 bp, Homo sapiens
actgtaaagaaagagaga

SEQ ID NO: 2578230 - DNA, 19 bp, Homo sapiens
actgtaaagaaagagagaa

SEQ ID NO: 2578231 - DNA, 21 bp, Homo sapiens
actgtaaagaaagagagaaaa

SEQ ID NO: 2578232 - DNA, 17 bp, Homo sapiens
actgtaaagagacctac

SEQ ID NO: 2578233 - DNA, 23 bp, Homo sapiens
actgtaaagagacctacctcagg

SEQ ID NO: 2578234 - DNA, 22 bp, Homo sapiens
actgtaactgtgtcatgattca

SEQ ID NO: 2578235 - DNA, 13 bp, Homo sapiens
actgtacaaagta

SEQ ID NO: 2578236 - DNA, 16 bp, Homo sapiens
actgtacaaagtagaa

SEQ ID NO: 2578237 - DNA, 19 bp, Homo sapiens
actgtacatgaaaacacat

SEQ ID NO: 2578238 - DNA, 21 bp, Homo sapiens
actgtacatgaaaacacattt

SEQ ID NO: 2578239 - DNA, 17 bp, Homo sapiens
actgtagcctggatatt

SEQ ID NO: 2578240 - DNA, 13 bp, Homo sapiens
actgtataaatag

SEQ ID NO: 2578241 - DNA, 12 bp, Homo sapiens
agaaggctcttc

SEQ ID NO: 2578242 - DNA, 18 bp, Homo sapiens
agaaggctcttctgacta

SEQ ID NO: 2578243 - DNA, 14 bp, Homo sapiens
agaagggagaagga

SEQ ID NO: 2578244 - DNA, 11 bp, Homo sapiens
agaagggaggc

SEQ ID NO: 2578245 - DNA, 19 bp, Homo sapiens
agaagggccagtcctgcct

SEQ ID NO: 2578246 - DNA, 23 bp, Homo sapiens
agaagggctagaacctggagagc

SEQ ID NO: 2578247 - DNA, 21 bp, Homo sapiens
agaagggctagaacctggagg

SEQ ID NO: 2578248 - DNA, 16 bp, Homo sapiens
agaagggttatatttt

SEQ ID NO: 2578249 - DNA, 19 bp, Homo sapiens
agaagggttatattttact

SEQ ID NO: 2578250 - DNA, 23 bp, Homo sapiens
agaagggttttccaccctggaat

SEQ ID NO: 2578251 - DNA, 22 bp, Homo sapiens
agaaggtgggttttcatcaaga

SEQ ID NO: 2578252 - DNA, 18 bp, Homo sapiens
agaaggttaccaagaagc

SEQ ID NO: 2578253 - DNA, 20 bp, Homo sapiens
agaagtagattaagagccat

SEQ ID NO: 2578254 - DNA, 14 bp, Homo sapiens
agaagtgacaggga

SEQ ID NO: 2578255 - DNA, 18 bp, Homo sapiens
agaagtgacagggaagct

SEQ ID NO: 2578256 - DNA, 13 bp, Homo sapiens
agaagtgcccctg

SEQ ID NO: 2578257 - DNA, 19 bp, Homo sapiens
agaagtgcccctgctgcct

SEQ ID NO: 2578258 - DNA, 23 bp, Homo sapiens
agaagtgtgattgggaataaata

SEQ ID NO: 2578259 - DNA, 15 bp, Homo sapiens
agaagttaagcaaca

SEQ ID NO: 2578260 - DNA, 19 bp, Homo sapiens
agaagttaagcaacatcta

SEQ ID NO: 2578261 - DNA, 19 bp, Homo sapiens
agaagttgatatagaacag

SEQ ID NO: 2578262 - DNA, 22 bp, Homo sapiens
agaagtttgagatcagcctggg

SEQ ID NO: 2578263 - DNA, 11 bp, Homo sapiens
agaagtttttg

SEQ ID NO: 2578264 - DNA, 19 bp, Homo sapiens
agaagtttttgtactgtaa

SEQ ID NO: 2578265 - DNA, 21 bp, Homo sapiens
agaagtttttgtactgtaaag

SEQ ID NO: 2578266 - DNA, 18 bp, Homo sapiens
agaataagtcatgttcct

SEQ ID NO: 2578267 - DNA, 21 bp, Homo sapiens
agaataagtcatgttccttca

SEQ ID NO: 2578268 - DNA, 19 bp, Homo sapiens
agaataagttattgcagtt

SEQ ID NO: 2578269 - DNA, 21 bp, Homo sapiens
agaataagttattgcagttta

SEQ ID NO: 2578270 - DNA, 22 bp, Homo sapiens
agaataatatgctgccaaattt

SEQ ID NO: 2578271 - DNA, 23 bp, Homo sapiens
agaataatatgctgccaaatttt

SEQ ID NO: 2578272 - DNA, 17 bp, Homo sapiens
agaataatcacgctttc

SEQ ID NO: 2578273 - DNA, 16 bp, Homo sapiens
agaatacaaacatatt

SEQ ID NO: 2578274 - DNA, 15 bp, Homo sapiens
agaatataattatcg

SEQ ID NO: 2578275 - DNA, 17 bp, Homo sapiens
agaatataattatcgga

SEQ ID NO: 2578276 - DNA, 13 bp, Homo sapiens
agaatattcagga

SEQ ID NO: 2578277 - DNA, 19 bp, Homo sapiens
agaatatttattacctctg

SEQ ID NO: 2578278 - DNA, 13 bp, Homo sapiens
agaatcaaagcaa

SEQ ID NO: 2578279 - DNA, 19 bp, Homo sapiens
agaatcaaagcaatgcatt

SEQ ID NO: 2578280 - DNA, 23 bp, Homo sapiens
agaatcaacatttctcaataatt

SEQ ID NO: 2578281 - DNA, 13 bp, Homo sapiens
agaatcagcctag

SEQ ID NO: 2578282 - DNA, 22 bp, Homo sapiens
agaatcagtctatccacagaga

SEQ ID NO: 2578283 - DNA, 14 bp, Homo sapiens
agaatcatacttag

SEQ ID NO: 2578284 - DNA, 22 bp, Homo sapiens
agaatccacccatcctaccaat

SEQ ID NO: 2578285 - DNA, 20 bp, Homo sapiens
agaatcctggccctctgtgt

SEQ ID NO: 2578286 - DNA, 17 bp, Homo sapiens
agaatgaaaattgtatg

SEQ ID NO: 2578287 - DNA, 19 bp, Homo sapiens
agaatgaaagagtaaagga

SEQ ID NO: 2578288 - DNA, 15 bp, Homo sapiens
agaatgaacaaattg

SEQ ID NO: 2578289 - DNA, 12 bp, Homo sapiens
agaatgagcctc

SEQ ID NO: 2578290 - DNA, 13 bp, Homo sapiens
agaatgatttcat

SEQ ID NO: 2578291 - DNA, 18 bp, Homo sapiens
agaatgctggttttccta

SEQ ID NO: 2578292 - DNA, 17 bp, Homo sapiens
agaatgggcagttacat

SEQ ID NO: 2578293 - DNA, 19 bp, Homo sapiens
agaatgggcagttacatgc

SEQ ID NO: 2578294 - DNA, 23 bp, Homo sapiens
agaatggttgccttaaagaaagt

SEQ ID NO: 2578295 - DNA, 14 bp, Homo sapiens
agaatgtagccatt

SEQ ID NO: 2578296 - DNA, 12 bp, Homo sapiens
agaatgtattgt

SEQ ID NO: 2578297 - DNA, 14 bp, Homo sapiens
agaatgtattgtac

SEQ ID NO: 2578298 - DNA, 17 bp, Homo sapiens
agaatgtattgtacctt

SEQ ID NO: 2578299 - DNA, 21 bp, Homo sapiens
agaatgtattgtaccttttaa

SEQ ID NO: 2578300 - DNA, 13 bp, Homo sapiens
agaatgtcagtat

SEQ ID NO: 2578301 - DNA, 15 bp, Homo sapiens
agaatgtcagtatgt

SEQ ID NO: 2578302 - DNA, 17 bp, Homo sapiens
agaatgtcagtatgtgg

SEQ ID NO: 2578303 - DNA, 17 bp, Homo sapiens
agaattaaaaatgaaat

SEQ ID NO: 2578304 - DNA, 15 bp, Homo sapiens
agaattaacacatga

SEQ ID NO: 2578305 - DNA, 20 bp, Homo sapiens
agaattccctctctctgact

SEQ ID NO: 2578306 - DNA, 20 bp, Homo sapiens
agaattccttcagggtgatg

SEQ ID NO: 2578307 - DNA, 18 bp, Homo sapiens
agaattctctagtttgat

SEQ ID NO: 2578308 - DNA, 20 bp, Homo sapiens
agaattctgctacctcactg

SEQ ID NO: 2578309 - DNA, 16 bp, Homo sapiens
agaattcttacatgtt

SEQ ID NO: 2578310 - DNA, 19 bp, Homo sapiens
agaattcttacatgttttc

SEQ ID NO: 2578311 - DNA, 23 bp, Homo sapiens
agaattcttacatgttttctttg

SEQ ID NO: 2578312 - DNA, 14 bp, Homo sapiens
agaattctttcaag

SEQ ID NO: 2578313 - DNA, 20 bp, Homo sapiens
agaattgatatacacggatg

SEQ ID NO: 2578314 - DNA, 22 bp, Homo sapiens
agaattgatcattttcccccca

SEQ ID NO: 2578315 - DNA, 22 bp, Homo sapiens
agaattgctgattcttgagttt

SEQ ID NO: 2578316 - DNA, 21 bp, Homo sapiens
agaattggagagtaaaaactg

SEQ ID NO: 2578317 - DNA, 18 bp, Homo sapiens
agaattggctgaactcat

SEQ ID NO: 2578318 - DNA, 21 bp, Homo sapiens
agaatttattcaattcctctg

SEQ ID NO: 2578319 - DNA, 21 bp, Homo sapiens
agaatttcttggtaagaagcc

SEQ ID NO: 2578320 - DNA, 17 bp, Homo sapiens
agaatttgagtgctctg

SEQ ID NO: 2578321 - DNA, 17 bp, Homo sapiens
agaattttaaaaatgaa

SEQ ID NO: 2578322 - DNA, 18 bp, Homo sapiens
agaattttaaaaatgaat

SEQ ID NO: 2578323 - DNA, 19 bp, Homo sapiens
agacaaacacctcccagga

SEQ ID NO: 2578324 - DNA, 16 bp, Homo sapiens
agacaaaccagaagca

SEQ ID NO: 2578325 - DNA, 18 bp, Homo sapiens
agacaaatactcatgtgt

SEQ ID NO: 2578326 - DNA, 17 bp, Homo sapiens
agacaaattctgtttct

SEQ ID NO: 2578327 - DNA, 18 bp, Homo sapiens
agacaaattctgtttctt

SEQ ID NO: 2578328 - DNA, 21 bp, Homo sapiens
agacaaccctgcaaaggactg

SEQ ID NO: 2578329 - DNA, 18 bp, Homo sapiens
agacaagaaatccctgtt

SEQ ID NO: 2578330 - DNA, 21 bp, Homo sapiens
agacaatgacttactgtacat

SEQ ID NO: 2578331 - DNA, 23 bp, Homo sapiens
agacaatgacttactgtacatga

SEQ ID NO: 2578332 - DNA, 14 bp, Homo sapiens
agacaattctttat

SEQ ID NO: 2578333 - DNA, 22 bp, Homo sapiens
agacacacacacgcacgcacac

SEQ ID NO: 2578334 - DNA, 18 bp, Homo sapiens
agacacagaagaggctgg

SEQ ID NO: 2578335 - DNA, 12 bp, Homo sapiens
agacacagactg

SEQ ID NO: 2578336 - DNA, 17 bp, Homo sapiens
agacacaggcccggctc

SEQ ID NO: 2578337 - DNA, 20 bp, Homo sapiens
agacacaggcccggctccag

SEQ ID NO: 2578338 - DNA, 22 bp, Homo sapiens
agacacaggcccggctccaggc

SEQ ID NO: 2578339 - DNA, 15 bp, Homo sapiens
agacaccagagcaga

SEQ ID NO: 2578340 - DNA, 19 bp, Homo sapiens
agacaccttgacagggcac

SEQ ID NO: 2578341 - DNA, 20 bp, Homo sapiens
agacactgaaatatacacac

SEQ ID NO: 2578342 - DNA, 15 bp, Homo sapiens
agacactggcccctc

SEQ ID NO: 2578343 - DNA, 20 bp, Homo sapiens
agacacttctaaatgaagtg

SEQ ID NO: 2578344 - DNA, 13 bp, Homo sapiens
agacacttgcctt

SEQ ID NO: 2578345 - DNA, 19 bp, Homo sapiens
agacagaagcaggctggag

SEQ ID NO: 2578346 - DNA, 20 bp, Homo sapiens
agacagaagcaggctggagg

SEQ ID NO: 2578347 - DNA, 14 bp, Homo sapiens
agacagacacacac

SEQ ID NO: 2578348 - DNA, 16 bp, Homo sapiens
agacagacacacacac

SEQ ID NO: 2578349 - DNA, 16 bp, Homo sapiens
agacagagacctcctg

SEQ ID NO: 2578350 - DNA, 19 bp, Homo sapiens
agacagagacctcctgcct

SEQ ID NO: 2578351 - DNA, 11 bp, Homo sapiens
agacagagtct

SEQ ID NO: 2578352 - DNA, 19 bp, Homo sapiens
agacagagtctcactgttg

SEQ ID NO: 2578353 - DNA, 14 bp, Homo sapiens
agacagatgcccca

SEQ ID NO: 2578354 - DNA, 16 bp, Homo sapiens
agacagatgccccaga

SEQ ID NO: 2578355 - DNA, 15 bp, Homo sapiens
agacagcccgggctc

SEQ ID NO: 2578356 - DNA, 22 bp, Homo sapiens
agacagcccgggctctgcctcc

SEQ ID NO: 2578357 - DNA, 20 bp, Homo sapiens
agacagcctgtatcttgggg

SEQ ID NO: 2578358 - DNA, 18 bp, Homo sapiens
agacagctccctctgcct

SEQ ID NO: 2578359 - DNA, 12 bp, Homo sapiens
agacagctgcct

SEQ ID NO: 2578360 - DNA, 15 bp, Homo sapiens
agacaggaccaggga

SEQ ID NO: 2578361 - DNA, 16 bp, Homo sapiens
agacaggcccaagaga

SEQ ID NO: 2578362 - DNA, 18 bp, Homo sapiens
agacaggcccaagagatg

SEQ ID NO: 2578363 - DNA, 23 bp, Homo sapiens
agacaggcccaagagatgaagag

SEQ ID NO: 2578364 - DNA, 21 bp, Homo sapiens
agacagtatacagtcctgtgg

SEQ ID NO: 2578365 - DNA, 17 bp, Homo sapiens
agacagtatatttatag

SEQ ID NO: 2578366 - DNA, 22 bp, Homo sapiens
agacagtatgagtcaatgtgca

SEQ ID NO: 2578367 - DNA, 15 bp, Homo sapiens
agacagtccagcctg

SEQ ID NO: 2578368 - DNA, 14 bp, Homo sapiens
agacagtccctgcc

SEQ ID NO: 2578369 - DNA, 15 bp, Homo sapiens
agacagtccctgcca

SEQ ID NO: 2578370 - DNA, 17 bp, Homo sapiens
agacagtccctgccaat

SEQ ID NO: 2578371 - DNA, 17 bp, Homo sapiens
agacagtgatctccata

SEQ ID NO: 2578372 - DNA, 21 bp, Homo sapiens
agacagtgatctccatatgtt

SEQ ID NO: 2578373 - DNA, 13 bp, Homo sapiens
agacagtgggaaa

SEQ ID NO: 2578374 - DNA, 14 bp, Homo sapiens
agacagtgggaaat

SEQ ID NO: 2578375 - DNA, 15 bp, Homo sapiens
agacagtttcttagc

SEQ ID NO: 2578376 - DNA, 22 bp, Homo sapiens
agacagtttcttagctttttaa

SEQ ID NO: 2578377 - DNA, 20 bp, Homo sapiens
agacataacgtttttccttt

SEQ ID NO: 2578378 - DNA, 22 bp, Homo sapiens
agacatactccttccatcaaat

SEQ ID NO: 2578379 - DNA, 19 bp, Homo sapiens
agacataggccatgaaaaa

SEQ ID NO: 2578380 - DNA, 18 bp, Homo sapiens
agacatccatgtttgtaa

SEQ ID NO: 2578381 - DNA, 21 bp, Homo sapiens
agacatccatgtttgtaaaac

SEQ ID NO: 2578382 - DNA, 22 bp, Homo sapiens
agacatccatgtttgtaaaact

SEQ ID NO: 2578383 - DNA, 17 bp, Homo sapiens
agacatgaatgcacact

SEQ ID NO: 2578384 - DNA, 22 bp, Homo sapiens
agaggtaaaagtgtgagcagtg

SEQ ID NO: 2578385 - DNA, 18 bp, Homo sapiens
agaggtaacagaacagct

SEQ ID NO: 2578386 - DNA, 22 bp, Homo sapiens
agaggtctctgccggctctttc

SEQ ID NO: 2578387 - DNA, 19 bp, Homo sapiens
agaggtcttttttaaaagg

SEQ ID NO: 2578388 - DNA, 14 bp, Homo sapiens
agaggtgggcaggt

SEQ ID NO: 2578389 - DNA, 16 bp, Homo sapiens
agaggttaaggtgcaa

SEQ ID NO: 2578390 - DNA, 17 bp, Homo sapiens
agaggttatctgtccca

SEQ ID NO: 2578391 - DNA, 13 bp, Homo sapiens
agaggttcaaaga

SEQ ID NO: 2578392 - DNA, 18 bp, Homo sapiens
agaggttttaaagtgatt

SEQ ID NO: 2578393 - DNA, 12 bp, Homo sapiens
agaggttttgtt

SEQ ID NO: 2578394 - DNA, 19 bp, Homo sapiens
agaggttttgttgttttat

SEQ ID NO: 2578395 - DNA, 12 bp, Homo sapiens
agaggtttttct

SEQ ID NO: 2578396 - DNA, 22 bp, Homo sapiens
agagtagatggtgaaatttatt

SEQ ID NO: 2578397 - DNA, 12 bp, Homo sapiens
agagtagcaagt

SEQ ID NO: 2578398 - DNA, 22 bp, Homo sapiens
agagtagcaagttctagagaag

SEQ ID NO: 2578399 - DNA, 23 bp, Homo sapiens
agagtagcaagttctagagaaga

SEQ ID NO: 2578400 - DNA, 15 bp, Homo sapiens
agagtagcatttcat

SEQ ID NO: 2578401 - DNA, 14 bp, Homo sapiens
agagtagtccaggt

SEQ ID NO: 2578402 - DNA, 21 bp, Homo sapiens
agagtatggagctcagagagg

SEQ ID NO: 2578403 - DNA, 20 bp, Homo sapiens
agagtcacacgggggcagct

SEQ ID NO: 2578404 - DNA, 21 bp, Homo sapiens
agagtcacacgggggcagctg

SEQ ID NO: 2578405 - DNA, 18 bp, Homo sapiens
agagtcatattttgatta

SEQ ID NO: 2578406 - DNA, 13 bp, Homo sapiens
agagtcatctcca

SEQ ID NO: 2578407 - DNA, 19 bp, Homo sapiens
agagtcatctccatcagct

SEQ ID NO: 2578408 - DNA, 13 bp, Homo sapiens
agagtcccactgc

SEQ ID NO: 2578409 - DNA, 14 bp, Homo sapiens
agagtcctgcacag

SEQ ID NO: 2578410 - DNA, 21 bp, Homo sapiens
agagtcctgcacagttttctg

SEQ ID NO: 2578411 - DNA, 20 bp, Homo sapiens
agagtctcactgttgcccag

SEQ ID NO: 2578412 - DNA, 12 bp, Homo sapiens
agagtctgtctc

SEQ ID NO: 2578413 - DNA, 16 bp, Homo sapiens
agagtgagactctgtc

SEQ ID NO: 2578414 - DNA, 17 bp, Homo sapiens
agagtgcaacagtagca

SEQ ID NO: 2578415 - DNA, 17 bp, Homo sapiens
agagtgcgccgagtctg

SEQ ID NO: 2578416 - DNA, 15 bp, Homo sapiens
agagtggcctggcca

SEQ ID NO: 2578417 - DNA, 17 bp, Homo sapiens
agagtggcctggccagg

SEQ ID NO: 2578418 - DNA, 18 bp, Homo sapiens
agagtgggggagagcagg

SEQ ID NO: 2578419 - DNA, 20 bp, Homo sapiens
agagtgggggagagcaggct

SEQ ID NO: 2578420 - DNA, 19 bp, Homo sapiens
agagtggggtaggttggga

SEQ ID NO: 2578421 - DNA, 18 bp, Homo sapiens
agagtgtagaagcattcc

SEQ ID NO: 2578422 - DNA, 22 bp, Homo sapiens
agagtgtagaagcattccttct

SEQ ID NO: 2578423 - DNA, 20 bp, Homo sapiens
agagtgtcttcacggcagga

SEQ ID NO: 2578424 - DNA, 14 bp, Homo sapiens
agagtgtctttcca

SEQ ID NO: 2578425 - DNA, 22 bp, Homo sapiens
agagttaacaatgatatatgga

SEQ ID NO: 2578426 - DNA, 12 bp, Homo sapiens
agagttaagaag

SEQ ID NO: 2578427 - DNA, 15 bp, Homo sapiens
agagttaagaagctg

SEQ ID NO: 2578428 - DNA, 18 bp, Homo sapiens
agagttaagaagctgttg

SEQ ID NO: 2578429 - DNA, 20 bp, Homo sapiens
agagttaatatatagaaggg

SEQ ID NO: 2578430 - DNA, 19 bp, Homo sapiens
agagttccccatgcagaca

SEQ ID NO: 2578431 - DNA, 22 bp, Homo sapiens
agagttcctgcggagtgaagag

SEQ ID NO: 2578432 - DNA, 19 bp, Homo sapiens
agagttgtgcacatggctt

SEQ ID NO: 2578433 - DNA, 12 bp, Homo sapiens
agagttgttaca

SEQ ID NO: 2578434 - DNA, 18 bp, Homo sapiens
agagtttgtgtgttgtct

SEQ ID NO: 2578435 - DNA, 13 bp, Homo sapiens
agagttttgtctt

SEQ ID NO: 2578436 - DNA, 22 bp, Homo sapiens
agataaaattatagatgggaat

SEQ ID NO: 2578437 - DNA, 13 bp, Homo sapiens
agataaactcaga

SEQ ID NO: 2578438 - DNA, 15 bp, Homo sapiens
agataaagatgatct

SEQ ID NO: 2578439 - DNA, 19 bp, Homo sapiens
agataactgttatttataa

SEQ ID NO: 2578440 - DNA, 22 bp, Homo sapiens
agataagaatgctggttttcct

SEQ ID NO: 2578441 - DNA, 20 bp, Homo sapiens
agataagcaagagagatgtt

SEQ ID NO: 2578442 - DNA, 22 bp, Homo sapiens
agataagcaagagagatgtttt

SEQ ID NO: 2578443 - DNA, 15 bp, Homo sapiens
agataatatgagaat

SEQ ID NO: 2578444 - DNA, 14 bp, Homo sapiens
agataatcagcctc

SEQ ID NO: 2578445 - DNA, 18 bp, Homo sapiens
agataatgtgaaaatggt

SEQ ID NO: 2578446 - DNA, 13 bp, Homo sapiens
agatacaatgtat

SEQ ID NO: 2578447 - DNA, 19 bp, Homo sapiens
agatacaggaaaagctgct

SEQ ID NO: 2578448 - DNA, 20 bp, Homo sapiens
agatacaggaaaagctgctg

SEQ ID NO: 2578449 - DNA, 14 bp, Homo sapiens
agataccagcgagg

SEQ ID NO: 2578450 - DNA, 19 bp, Homo sapiens
agataccagcgaggaggct

SEQ ID NO: 2578451 - DNA, 14 bp, Homo sapiens
agatacctcaccct

SEQ ID NO: 2578452 - DNA, 16 bp, Homo sapiens
agatacgactttattt

SEQ ID NO: 2578453 - DNA, 15 bp, Homo sapiens
agatagaaataaata

SEQ ID NO: 2578454 - DNA, 18 bp, Homo sapiens
agatagaaataaatagct

SEQ ID NO: 2578455 - DNA, 22 bp, Homo sapiens
agatagaaataaatagctatat

SEQ ID NO: 2578456 - DNA, 13 bp, Homo sapiens
agatagaatttcc

SEQ ID NO: 2578457 - DNA, 22 bp, Homo sapiens
agataggctctgcacagatgga

SEQ ID NO: 2578458 - DNA, 18 bp, Homo sapiens
agatagtacataaaggtg

SEQ ID NO: 2578459 - DNA, 23 bp, Homo sapiens
agatagttttgccagaacagttt

SEQ ID NO: 2578460 - DNA, 20 bp, Homo sapiens
agatatatttttaagataat

SEQ ID NO: 2578461 - DNA, 21 bp, Homo sapiens
agatatatttttaagataata

SEQ ID NO: 2578462 - DNA, 15 bp, Homo sapiens
agatattaccagttt

SEQ ID NO: 2578463 - DNA, 22 bp, Homo sapiens
agatattgtcagagttctgctc

SEQ ID NO: 2578464 - DNA, 21 bp, Homo sapiens
agatattgtgaagtacatatt

SEQ ID NO: 2578465 - DNA, 13 bp, Homo sapiens
agatatttatata

SEQ ID NO: 2578466 - DNA, 14 bp, Homo sapiens
agatatttatatat

SEQ ID NO: 2578467 - DNA, 20 bp, Homo sapiens
agatatttatatttttattt

SEQ ID NO: 2578468 - DNA, 23 bp, Homo sapiens
agatatttatatttttattttat

SEQ ID NO: 2578469 - DNA, 23 bp, Homo sapiens
agatatttattgtttatttatca

SEQ ID NO: 2578470 - DNA, 21 bp, Homo sapiens
agatattttgctttgtgattt

SEQ ID NO: 2578471 - DNA, 13 bp, Homo sapiens
agatatttttcat

SEQ ID NO: 2578472 - DNA, 19 bp, Homo sapiens
agatatttttccatttttt

SEQ ID NO: 2578473 - DNA, 14 bp, Homo sapiens
agatcaaatacttt

SEQ ID NO: 2578474 - DNA, 14 bp, Homo sapiens
agatcaaatttcac

SEQ ID NO: 2578475 - DNA, 16 bp, Homo sapiens
agatcaaggagaggag

SEQ ID NO: 2578476 - DNA, 15 bp, Homo sapiens
agatcaccagcccgg

SEQ ID NO: 2578477 - DNA, 22 bp, Homo sapiens
agatcacgccactgcactccag

SEQ ID NO: 2578478 - DNA, 19 bp, Homo sapiens
agatcactttctcagtttt

SEQ ID NO: 2578479 - DNA, 21 bp, Homo sapiens
agatcatccagaagttcctca

SEQ ID NO: 2578480 - DNA, 13 bp, Homo sapiens
agatcatcctttc

SEQ ID NO: 2578481 - DNA, 16 bp, Homo sapiens
agatcatcctttccag

SEQ ID NO: 2578482 - DNA, 13 bp, Homo sapiens
agatcccagctca

SEQ ID NO: 2578483 - DNA, 22 bp, Homo sapiens
agatcccgcctcttcttcttca

SEQ ID NO: 2578484 - DNA, 15 bp, Homo sapiens
agatccttgtttcaa

SEQ ID NO: 2578485 - DNA, 18 bp, Homo sapiens
agatccttgtttcaaaca

SEQ ID NO: 2578486 - DNA, 14 bp, Homo sapiens
agatcgcagtttgc

SEQ ID NO: 2578487 - DNA, 15 bp, Homo sapiens
agatcgcagtttgcc

SEQ ID NO: 2578488 - DNA, 18 bp, Homo sapiens
agatctctgctttggaaa

SEQ ID NO: 2578489 - DNA, 23 bp, Homo sapiens
agatctctgctttggaaatcaca

SEQ ID NO: 2578490 - DNA, 21 bp, Homo sapiens
agatctgcagggggtgtgtct

SEQ ID NO: 2578491 - DNA, 17 bp, Homo sapiens
agatctggacttggcaa

SEQ ID NO: 2578492 - DNA, 18 bp, Homo sapiens
agatctggttttgctatt

SEQ ID NO: 2578493 - DNA, 12 bp, Homo sapiens
agatctgtgccc

SEQ ID NO: 2578494 - DNA, 13 bp, Homo sapiens
agatcttaaattt

SEQ ID NO: 2578495 - DNA, 21 bp, Homo sapiens
agatctttcaggaaagacgga

SEQ ID NO: 2578496 - DNA, 14 bp, Homo sapiens
agatgaaacacaaa

SEQ ID NO: 2578497 - DNA, 23 bp, Homo sapiens
agatgaaagaggaggtttggggt

SEQ ID NO: 2578498 - DNA, 19 bp, Homo sapiens
agatgaactcttagaaatg

SEQ ID NO: 2578499 - DNA, 19 bp, Homo sapiens
agatgaagagtgagagggc

SEQ ID NO: 2578500 - DNA, 17 bp, Homo sapiens
agatgaagcaaacacat

SEQ ID NO: 2578501 - DNA, 11 bp, Homo sapiens
agatgacaaaa

SEQ ID NO: 2578502 - DNA, 14 bp, Homo sapiens
agatgactgagtcc

SEQ ID NO: 2578503 - DNA, 13 bp, Homo sapiens
agatgatcatttg

SEQ ID NO: 2578504 - DNA, 19 bp, Homo sapiens
agatgatgatgatctttaa

SEQ ID NO: 2578505 - DNA, 19 bp, Homo sapiens
agatgatttaaaagggaag

SEQ ID NO: 2578506 - DNA, 18 bp, Homo sapiens
agatgcaaagaggcaaga

SEQ ID NO: 2578507 - DNA, 18 bp, Homo sapiens
agatgcaaggaccaggac

SEQ ID NO: 2578508 - DNA, 18 bp, Homo sapiens
agatgcaatgtgctactg

SEQ ID NO: 2578509 - DNA, 12 bp, Homo sapiens
agatgcagagag

SEQ ID NO: 2578510 - DNA, 17 bp, Homo sapiens
agatgcagagagccatt

SEQ ID NO: 2578511 - DNA, 20 bp, Homo sapiens
agatgcagagagccattttg

SEQ ID NO: 2578512 - DNA, 13 bp, Homo sapiens
agatgcagctgga

SEQ ID NO: 2578513 - DNA, 22 bp, Homo sapiens
agatgcattcttggttggctgg

SEQ ID NO: 2578514 - DNA, 23 bp, Homo sapiens
agatgctctatcttgctctgtaa

SEQ ID NO: 2578515 - DNA, 17 bp, Homo sapiens
agatgctgatgttcagt

SEQ ID NO: 2578516 - DNA, 19 bp, Homo sapiens
agatgctgatgttcagtgt

SEQ ID NO: 2578517 - DNA, 22 bp, Homo sapiens
agatgctgatgttcagtgtaat

SEQ ID NO: 2578518 - DNA, 16 bp, Homo sapiens
agatgcttctgggaga

SEQ ID NO: 2578519 - DNA, 17 bp, Homo sapiens
agatgcttttctgtctc

SEQ ID NO: 2578520 - DNA, 17 bp, Homo sapiens
agatggaaccgcaggaa

SEQ ID NO: 2578521 - DNA, 18 bp, Homo sapiens
agatggaaccgcaggaag

SEQ ID NO: 2578522 - DNA, 21 bp, Homo sapiens
agatggaaccgcaggaagctg

SEQ ID NO: 2578523 - DNA, 16 bp, Homo sapiens
agatggaagcttccag

SEQ ID NO: 2578524 - DNA, 22 bp, Homo sapiens
agatggaagttgcagtgagctg

SEQ ID NO: 2578525 - DNA, 23 bp, Homo sapiens
agatggaagttgcagtgagctga

SEQ ID NO: 2578526 - DNA, 17 bp, Homo sapiens
agatggagttcttgtgc

SEQ ID NO: 2578527 - DNA, 19 bp, Homo sapiens
agatggagttcttgtgcca

SEQ ID NO: 2578528 - DNA, 21 bp, Homo sapiens
agcccggcctgctcccagcag

SEQ ID NO: 2578529 - DNA, 16 bp, Homo sapiens
agcccggcgcccctgc

SEQ ID NO: 2578530 - DNA, 21 bp, Homo sapiens
agcccggcgcccctgccacct

SEQ ID NO: 2578531 - DNA, 13 bp, Homo sapiens
agcccgggctgcc

SEQ ID NO: 2578532 - DNA, 17 bp, Homo sapiens
agcccgggctgcctggg

SEQ ID NO: 2578533 - DNA, 20 bp, Homo sapiens
agcccgggctgcctgggctg

SEQ ID NO: 2578534 - DNA, 14 bp, Homo sapiens
agcccgtctcagtg

SEQ ID NO: 2578535 - DNA, 15 bp, Homo sapiens
agcccgtctcagtgt

SEQ ID NO: 2578536 - DNA, 16 bp, Homo sapiens
agccctaaggatctct

SEQ ID NO: 2578537 - DNA, 21 bp, Homo sapiens
agccctaaggatctctcagga

SEQ ID NO: 2578538 - DNA, 14 bp, Homo sapiens
agccctagagcctg

SEQ ID NO: 2578539 - DNA, 16 bp, Homo sapiens
agccctagggtggaga

SEQ ID NO: 2578540 - DNA, 12 bp, Homo sapiens
agccctatggat

SEQ ID NO: 2578541 - DNA, 13 bp, Homo sapiens
agccctcaaagtg

SEQ ID NO: 2578542 - DNA, 24 bp, Homo sapiens
agccctccgccattctcaagccct

SEQ ID NO: 2578543 - DNA, 12 bp, Homo sapiens
agccctcttcca

SEQ ID NO: 2578544 - DNA, 16 bp, Homo sapiens
agccctcttccatcat

SEQ ID NO: 2578545 - DNA, 17 bp, Homo sapiens
agccctcttccatcatg

SEQ ID NO: 2578546 - DNA, 23 bp, Homo sapiens
agccctcttccatcatgtcccca

SEQ ID NO: 2578547 - DNA, 17 bp, Homo sapiens
agccctgactggtgcta

SEQ ID NO: 2578548 - DNA, 12 bp, Homo sapiens
agccctgctggc

SEQ ID NO: 2578549 - DNA, 21 bp, Homo sapiens
agccctgctggccgcctcacc

SEQ ID NO: 2578550 - DNA, 18 bp, Homo sapiens
agccctggagccaactgc

SEQ ID NO: 2578551 - DNA, 21 bp, Homo sapiens
agccctggagccaactgctgc

SEQ ID NO: 2578552 - DNA, 13 bp, Homo sapiens
agccctggctgaa

SEQ ID NO: 2578553 - DNA, 15 bp, Homo sapiens
agccctggctgaagg

SEQ ID NO: 2578554 - DNA, 16 bp, Homo sapiens
agccctggtctcagca

SEQ ID NO: 2578555 - DNA, 16 bp, Homo sapiens
agccctggtggcagtg

SEQ ID NO: 2578556 - DNA, 21 bp, Homo sapiens
agccctggtggcagtgggagc

SEQ ID NO: 2578557 - DNA, 17 bp, Homo sapiens
agccctgtcgagacact

SEQ ID NO: 2578558 - DNA, 18 bp, Homo sapiens
agccctgtcgagacactt

SEQ ID NO: 2578559 - DNA, 21 bp, Homo sapiens
agccctgtcgagacacttgcc

SEQ ID NO: 2578560 - DNA, 23 bp, Homo sapiens
agccctgtcgagacacttgcctt

SEQ ID NO: 2578561 - DNA, 16 bp, Homo sapiens
agcccttagcagggaa

SEQ ID NO: 2578562 - DNA, 16 bp, Homo sapiens
agcccttgaagatatc

SEQ ID NO: 2578563 - DNA, 17 bp, Homo sapiens
agcccttgagctcccca

SEQ ID NO: 2578564 - DNA, 20 bp, Homo sapiens
agcccttgagctccccaaaa

SEQ ID NO: 2578565 - DNA, 21 bp, Homo sapiens
agccctttacttgacctccta

SEQ ID NO: 2578566 - DNA, 12 bp, Homo sapiens
agccctttctgt

SEQ ID NO: 2578567 - DNA, 17 bp, Homo sapiens
agccctttctgtgtgca

SEQ ID NO: 2578568 - DNA, 21 bp, Homo sapiens
agccctttgggaggctgaggc

SEQ ID NO: 2578569 - DNA, 17 bp, Homo sapiens
agccgactccactttca

SEQ ID NO: 2578570 - DNA, 23 bp, Homo sapiens
agccgactgcacagcggcccctg

SEQ ID NO: 2578571 - DNA, 18 bp, Homo sapiens
agccgagatcacgccact

SEQ ID NO: 2578572 - DNA, 21 bp, Homo sapiens
agccgagatcacgccactgca

SEQ ID NO: 2578573 - DNA, 19 bp, Homo sapiens
agccgagattgcaccactg

SEQ ID NO: 2578574 - DNA, 16 bp, Homo sapiens
agccgagccgggcctg

SEQ ID NO: 2578575 - DNA, 21 bp, Homo sapiens
agccgagccgggcctggggct

SEQ ID NO: 2578576 - DNA, 22 bp, Homo sapiens
agccgccattgccaccaggaga

SEQ ID NO: 2578577 - DNA, 16 bp, Homo sapiens
agccgctcctgtctgc

SEQ ID NO: 2578578 - DNA, 22 bp, Homo sapiens
agccgctcctgtctgccagcca

SEQ ID NO: 2578579 - DNA, 13 bp, Homo sapiens
agccgctggggcc

SEQ ID NO: 2578580 - DNA, 22 bp, Homo sapiens
agccgctggggccagttggtcc

SEQ ID NO: 2578581 - DNA, 22 bp, Homo sapiens
agccgctgtgagcccctggtcc

SEQ ID NO: 2578582 - DNA, 23 bp, Homo sapiens
agccggcctctctggcctcccac

SEQ ID NO: 2578583 - DNA, 19 bp, Homo sapiens
agccgggcctggggctcct

SEQ ID NO: 2578584 - DNA, 20 bp, Homo sapiens
agccggggagtttctttcct

SEQ ID NO: 2578585 - DNA, 22 bp, Homo sapiens
agccgggtctgcctcttctggg

SEQ ID NO: 2578586 - DNA, 19 bp, Homo sapiens
agccgtcagccaaatgtaa

SEQ ID NO: 2578587 - DNA, 20 bp, Homo sapiens
agccgtcagccaaatgtaat

SEQ ID NO: 2578588 - DNA, 15 bp, Homo sapiens
agcctaatacaacat

SEQ ID NO: 2578589 - DNA, 23 bp, Homo sapiens
agcctaatccctgggcattgctt

SEQ ID NO: 2578590 - DNA, 17 bp, Homo sapiens
agcctacctgctctcca

SEQ ID NO: 2578591 - DNA, 17 bp, Homo sapiens
agcctagccgacctcag

SEQ ID NO: 2578592 - DNA, 19 bp, Homo sapiens
agcctagccgacctcagcc

SEQ ID NO: 2578593 - DNA, 14 bp, Homo sapiens
agcctaggggtcag

SEQ ID NO: 2578594 - DNA, 23 bp, Homo sapiens
agcctagtgaaggcttctctctg

SEQ ID NO: 2578595 - DNA, 14 bp, Homo sapiens
agcctagttcatcc

SEQ ID NO: 2578596 - DNA, 23 bp, Homo sapiens
agcctagttcatccaatcctcac

SEQ ID NO: 2578597 - DNA, 18 bp, Homo sapiens
agcctatatttacagtga

SEQ ID NO: 2578598 - DNA, 17 bp, Homo sapiens
agcctcaacctcctggg

SEQ ID NO: 2578599 - DNA, 19 bp, Homo sapiens
agcctcaacctcctgggct

SEQ ID NO: 2578600 - DNA, 18 bp, Homo sapiens
agcctcaataagccttgt

SEQ ID NO: 2578601 - DNA, 19 bp, Homo sapiens
agcctcaataagccttgtc

SEQ ID NO: 2578602 - DNA, 17 bp, Homo sapiens
agcctcacagtccttac

SEQ ID NO: 2578603 - DNA, 22 bp, Homo sapiens
agcctcacttgaatgtgtcact

SEQ ID NO: 2578604 - DNA, 13 bp, Homo sapiens
agcctcagcatcc

SEQ ID NO: 2578605 - DNA, 16 bp, Homo sapiens
agcctcagcatcctgg

SEQ ID NO: 2578606 - DNA, 12 bp, Homo sapiens
agcctcagccat

SEQ ID NO: 2578607 - DNA, 14 bp, Homo sapiens
agcctcatatttaa

SEQ ID NO: 2578608 - DNA, 16 bp, Homo sapiens
agcctcatatttaaag

SEQ ID NO: 2578609 - DNA, 21 bp, Homo sapiens
agcctccaagctccatctcca

SEQ ID NO: 2578610 - DNA, 12 bp, Homo sapiens
agcctccagcct

SEQ ID NO: 2578611 - DNA, 14 bp, Homo sapiens
agcctccagcctct

SEQ ID NO: 2578612 - DNA, 17 bp, Homo sapiens
agcctccatgctgcctc

SEQ ID NO: 2578613 - DNA, 15 bp, Homo sapiens
agcctccatttagtt

SEQ ID NO: 2578614 - DNA, 20 bp, Homo sapiens
agcctccatttagttctttg

SEQ ID NO: 2578615 - DNA, 17 bp, Homo sapiens
agcctcccaaagtgctg

SEQ ID NO: 2578616 - DNA, 18 bp, Homo sapiens
agcctcccaaagtgctgg

SEQ ID NO: 2578617 - DNA, 19 bp, Homo sapiens
agcctcccaaagtgctggg

SEQ ID NO: 2578618 - DNA, 22 bp, Homo sapiens
agcctcccacgactgcccggca

SEQ ID NO: 2578619 - DNA, 18 bp, Homo sapiens
agcctcccgaatagctgg

SEQ ID NO: 2578620 - DNA, 17 bp, Homo sapiens
agcctcccgagtagctg

SEQ ID NO: 2578621 - DNA, 13 bp, Homo sapiens
agcctccctctga

SEQ ID NO: 2578622 - DNA, 11 bp, Homo sapiens
agcctccctga

SEQ ID NO: 2578623 - DNA, 12 bp, Homo sapiens
agcctccctgaa

SEQ ID NO: 2578624 - DNA, 23 bp, Homo sapiens
agcctccggagtagctgggacca

SEQ ID NO: 2578625 - DNA, 17 bp, Homo sapiens
agcctccgtatttcaga

SEQ ID NO: 2578626 - DNA, 13 bp, Homo sapiens
agcctcctctctc

SEQ ID NO: 2578627 - DNA, 12 bp, Homo sapiens
agcctcctctgt

SEQ ID NO: 2578628 - DNA, 18 bp, Homo sapiens
agcctcctctgtctgccc

SEQ ID NO: 2578629 - DNA, 21 bp, Homo sapiens
agcctcctctgtctgcccttc

SEQ ID NO: 2578630 - DNA, 21 bp, Homo sapiens
agcctctagggacccctcctc

SEQ ID NO: 2578631 - DNA, 13 bp, Homo sapiens
agcctctcccctg

SEQ ID NO: 2578632 - DNA, 22 bp, Homo sapiens
agcctctggcattagaattatt

SEQ ID NO: 2578633 - DNA, 12 bp, Homo sapiens
agcctctggcta

SEQ ID NO: 2578634 - DNA, 14 bp, Homo sapiens
agcctctggctaga

SEQ ID NO: 2578635 - DNA, 22 bp, Homo sapiens
agcctcttaaagctgcctgtag

SEQ ID NO: 2578636 - DNA, 15 bp, Homo sapiens
agcctgagtctcctg

SEQ ID NO: 2578637 - DNA, 21 bp, Homo sapiens
agcctgcagggtggtgctggg

SEQ ID NO: 2578638 - DNA, 22 bp, Homo sapiens
agcctgcagggtggtgctggga

SEQ ID NO: 2578639 - DNA, 18 bp, Homo sapiens
agcctgcaggtgctgctg

SEQ ID NO: 2578640 - DNA, 22 bp, Homo sapiens
agcctgcaggtgctgctgcgtg

SEQ ID NO: 2578641 - DNA, 14 bp, Homo sapiens
agcctgcctggagc

SEQ ID NO: 2578642 - DNA, 15 bp, Homo sapiens
agcctgcctggagcg

SEQ ID NO: 2578643 - DNA, 11 bp, Homo sapiens
agcctgctgca

SEQ ID NO: 2578644 - DNA, 14 bp, Homo sapiens
agcctgctttttaa

SEQ ID NO: 2578645 - DNA, 20 bp, Homo sapiens
agcctggaacatcatcaagg

SEQ ID NO: 2578646 - DNA, 11 bp, Homo sapiens
agcctggagaa

SEQ ID NO: 2578647 - DNA, 16 bp, Homo sapiens
agcctggccccatggt

SEQ ID NO: 2578648 - DNA, 23 bp, Homo sapiens
agcctggctcccacaggcagctt

SEQ ID NO: 2578649 - DNA, 21 bp, Homo sapiens
agcctggcttctggagccctt

SEQ ID NO: 2578650 - DNA, 18 bp, Homo sapiens
agcctgggcaacagagca

SEQ ID NO: 2578651 - DNA, 17 bp, Homo sapiens
agcctgggcagcatagc

SEQ ID NO: 2578652 - DNA, 20 bp, Homo sapiens
agcctgggcagcatagcaag

SEQ ID NO: 2578653 - DNA, 11 bp, Homo sapiens
agcctggtgcc

SEQ ID NO: 2578654 - DNA, 15 bp, Homo sapiens
agcctggtgctgctg

SEQ ID NO: 2578655 - DNA, 11 bp, Homo sapiens
agcctggtggg

SEQ ID NO: 2578656 - DNA, 16 bp, Homo sapiens
agcctggtgggcctcc

SEQ ID NO: 2578657 - DNA, 21 bp, Homo sapiens
agcctggtgggcctcctctgt

SEQ ID NO: 2578658 - DNA, 22 bp, Homo sapiens
agcctggtgggcctcctctgtc

SEQ ID NO: 2578659 - DNA, 16 bp, Homo sapiens
agcctgtatcttgggg

SEQ ID NO: 2578660 - DNA, 17 bp, Homo sapiens
agcctgtcctgggctgg

SEQ ID NO: 2578661 - DNA, 18 bp, Homo sapiens
agcctgtcctgggctggt

SEQ ID NO: 2578662 - DNA, 18 bp, Homo sapiens
agcctgtgcctctgggac

SEQ ID NO: 2578663 - DNA, 19 bp, Homo sapiens
agcctgtgcctctgggact

SEQ ID NO: 2578664 - DNA, 22 bp, Homo sapiens
agcctgtggcatctttgccttg

SEQ ID NO: 2578665 - DNA, 14 bp, Homo sapiens
agcctgttcccctc

SEQ ID NO: 2578666 - DNA, 20 bp, Homo sapiens
agcctgttcccctcactgga

SEQ ID NO: 2578667 - DNA, 14 bp, Homo sapiens
agcctgttggaccc

SEQ ID NO: 2578668 - DNA, 22 bp, Homo sapiens
agccttagaagtcacacagtat

SEQ ID NO: 2578669 - DNA, 18 bp, Homo sapiens
agccttatcaagtgtctt

SEQ ID NO: 2578670 - DNA, 14 bp, Homo sapiens
agccttatcctctg

SEQ ID NO: 2578671 - DNA, 18 bp, Homo sapiens
agccttatcctctgatct

SEQ ID NO: 2578672 - DNA, 12 bp, Homo sapiens
aggactctcagg

SEQ ID NO: 2578673 - DNA, 14 bp, Homo sapiens
aggactctgcctcc

SEQ ID NO: 2578674 - DNA, 18 bp, Homo sapiens
aggactgagggactctga

SEQ ID NO: 2578675 - DNA, 13 bp, Homo sapiens
aggactgccgacc

SEQ ID NO: 2578676 - DNA, 21 bp, Homo sapiens
aggactgccgaccgaggctgg

SEQ ID NO: 2578677 - DNA, 18 bp, Homo sapiens
aggactgtgacaggcagc

SEQ ID NO: 2578678 - DNA, 20 bp, Homo sapiens
aggactgtgacaggcagcag

SEQ ID NO: 2578679 - DNA, 19 bp, Homo sapiens
aggacttgaaagcatccat

SEQ ID NO: 2578680 - DNA, 13 bp, Homo sapiens
aggacttgtgtct

SEQ ID NO: 2578681 - DNA, 16 bp, Homo sapiens
aggacttgtgtctctg

SEQ ID NO: 2578682 - DNA, 12 bp, Homo sapiens
aggagaaacaca

SEQ ID NO: 2578683 - DNA, 14 bp, Homo sapiens
aggagaaacacatc

SEQ ID NO: 2578684 - DNA, 14 bp, Homo sapiens
aggagaaacagaga

SEQ ID NO: 2578685 - DNA, 15 bp, Homo sapiens
aggagaatgagcctc

SEQ ID NO: 2578686 - DNA, 19 bp, Homo sapiens
aggagacacaacaactcct

SEQ ID NO: 2578687 - DNA, 21 bp, Homo sapiens
aggagacctggcactggatgc

SEQ ID NO: 2578688 - DNA, 11 bp, Homo sapiens
aggagagcagc

SEQ ID NO: 2578689 - DNA, 12 bp, Homo sapiens
aggagagcagcg

SEQ ID NO: 2578690 - DNA, 21 bp, Homo sapiens
aggagagccagagaagtgaca

SEQ ID NO: 2578691 - DNA, 13 bp, Homo sapiens
aggagagcctgct

SEQ ID NO: 2578692 - DNA, 18 bp, Homo sapiens
aggagagcctgctgcatg

SEQ ID NO: 2578693 - DNA, 20 bp, Homo sapiens
aggagagcctgctgcatggg

SEQ ID NO: 2578694 - DNA, 15 bp, Homo sapiens
aggagaggagagcca

SEQ ID NO: 2578695 - DNA, 13 bp, Homo sapiens
aggagaggatgag

SEQ ID NO: 2578696 - DNA, 17 bp, Homo sapiens
aggagaggatgagagcc

SEQ ID NO: 2578697 - DNA, 23 bp, Homo sapiens
aggagaggatgagagcccagagg

SEQ ID NO: 2578698 - DNA, 18 bp, Homo sapiens
aggagaggggcacagggt

SEQ ID NO: 2578699 - DNA, 19 bp, Homo sapiens
aggagaggggcagaacagc

SEQ ID NO: 2578700 - DNA, 16 bp, Homo sapiens
aggagatgctccttgg

SEQ ID NO: 2578701 - DNA, 18 bp, Homo sapiens
aggagatgctccttgggc

SEQ ID NO: 2578702 - DNA, 14 bp, Homo sapiens
aggagatgggcctt

SEQ ID NO: 2578703 - DNA, 15 bp, Homo sapiens
aggagcaaaggctga

SEQ ID NO: 2578704 - DNA, 15 bp, Homo sapiens
aggagcacaggcagc

SEQ ID NO: 2578705 - DNA, 13 bp, Homo sapiens
aggagcagccaca

SEQ ID NO: 2578706 - DNA, 14 bp, Homo sapiens
aggagcagccacat

SEQ ID NO: 2578707 - DNA, 19 bp, Homo sapiens
aggagcagcctcagaacaa

SEQ ID NO: 2578708 - DNA, 21 bp, Homo sapiens
aggagcatttggagagaaggc

SEQ ID NO: 2578709 - DNA, 18 bp, Homo sapiens
aggagccccattcctggg

SEQ ID NO: 2578710 - DNA, 17 bp, Homo sapiens
aggagccccgaggcctt

SEQ ID NO: 2578711 - DNA, 14 bp, Homo sapiens
aggagcctgctggt

SEQ ID NO: 2578712 - DNA, 16 bp, Homo sapiens
aggagcgggacctgtg

SEQ ID NO: 2578713 - DNA, 17 bp, Homo sapiens
aggagctgctggcttgc

SEQ ID NO: 2578714 - DNA, 20 bp, Homo sapiens
aggagctgggcagaaggcca

SEQ ID NO: 2578715 - DNA, 22 bp, Homo sapiens
aggaggaatcatgtcaggcctg

SEQ ID NO: 2578716 - DNA, 23 bp, Homo sapiens
aggaggaatcatgtcaggcctgt

SEQ ID NO: 2578717 - DNA, 14 bp, Homo sapiens
aggaggacaattca

SEQ ID NO: 2578718 - DNA, 21 bp, Homo sapiens
aggaggaggtttaggtcaaga

SEQ ID NO: 2578719 - DNA, 14 bp, Homo sapiens
aggaggatgggctc

SEQ ID NO: 2578720 - DNA, 22 bp, Homo sapiens
aggaggatgggctcgcccacca

SEQ ID NO: 2578721 - DNA, 21 bp, Homo sapiens
aggaggattgcttgagcccag

SEQ ID NO: 2578722 - DNA, 23 bp, Homo sapiens
aggaggccacctctccaagggct

SEQ ID NO: 2578723 - DNA, 12 bp, Homo sapiens
aggaggcccctg

SEQ ID NO: 2578724 - DNA, 17 bp, Homo sapiens
aggaggcccctggccca

SEQ ID NO: 2578725 - DNA, 16 bp, Homo sapiens
aggaggccggggccgg

SEQ ID NO: 2578726 - DNA, 12 bp, Homo sapiens
aggaggcctcca

SEQ ID NO: 2578727 - DNA, 15 bp, Homo sapiens
aggaggcctccatct

SEQ ID NO: 2578728 - DNA, 13 bp, Homo sapiens
aggaggctccaga

SEQ ID NO: 2578729 - DNA, 17 bp, Homo sapiens
aggaggctgaggcagga

SEQ ID NO: 2578730 - DNA, 13 bp, Homo sapiens
aggaggctggcag

SEQ ID NO: 2578731 - DNA, 16 bp, Homo sapiens
aggaggctggcaggta

SEQ ID NO: 2578732 - DNA, 13 bp, Homo sapiens
aggaggctggctt

SEQ ID NO: 2578733 - DNA, 23 bp, Homo sapiens
aggagggagacactggcccctca

SEQ ID NO: 2578734 - DNA, 18 bp, Homo sapiens
aggagggtcaggaaggat

SEQ ID NO: 2578735 - DNA, 13 bp, Homo sapiens
aggaggtgaggga

SEQ ID NO: 2578736 - DNA, 18 bp, Homo sapiens
aggaggtttaggtcaaga

SEQ ID NO: 2578737 - DNA, 24 bp, Homo sapiens
aggagtctgcacatgcagctgcac

SEQ ID NO: 2578738 - DNA, 22 bp, Homo sapiens
aggagtgaaacctttagggcag

SEQ ID NO: 2578739 - DNA, 23 bp, Homo sapiens
aggagtgaaacctttagggcagc

SEQ ID NO: 2578740 - DNA, 14 bp, Homo sapiens
aggagtgagatcat

SEQ ID NO: 2578741 - DNA, 21 bp, Homo sapiens
aggagtgagatcattttctta

SEQ ID NO: 2578742 - DNA, 12 bp, Homo sapiens
aggagttcaatg

SEQ ID NO: 2578743 - DNA, 15 bp, Homo sapiens
aggagttcaatgatc

SEQ ID NO: 2578744 - DNA, 17 bp, Homo sapiens
aggagttcaatgatcta

SEQ ID NO: 2578745 - DNA, 19 bp, Homo sapiens
aggagttcctaaccagcct

SEQ ID NO: 2578746 - DNA, 16 bp, Homo sapiens
aggagtttgagaccag

SEQ ID NO: 2578747 - DNA, 19 bp, Homo sapiens
aggagtttgagaccagcct

SEQ ID NO: 2578748 - DNA, 19 bp, Homo sapiens
aggagtttgaggctgcagc

SEQ ID NO: 2578749 - DNA, 14 bp, Homo sapiens
aggatacatgtgcc

SEQ ID NO: 2578750 - DNA, 13 bp, Homo sapiens
aggatactctgtc

SEQ ID NO: 2578751 - DNA, 18 bp, Homo sapiens
aggatatattttcacttt

SEQ ID NO: 2578752 - DNA, 18 bp, Homo sapiens
aggatcacagtgctgaga

SEQ ID NO: 2578753 - DNA, 14 bp, Homo sapiens
aggatcactggagc

SEQ ID NO: 2578754 - DNA, 15 bp, Homo sapiens
aggatcactggagcc

SEQ ID NO: 2578755 - DNA, 22 bp, Homo sapiens
aggatcactggagcccaggagt

SEQ ID NO: 2578756 - DNA, 16 bp, Homo sapiens
aggatcagattgcatg

SEQ ID NO: 2578757 - DNA, 17 bp, Homo sapiens
aggatcatggtgtaata

SEQ ID NO: 2578758 - DNA, 15 bp, Homo sapiens
aggatccctctctgg

SEQ ID NO: 2578759 - DNA, 17 bp, Homo sapiens
aggatccctctctggat

SEQ ID NO: 2578760 - DNA, 22 bp, Homo sapiens
aggatctctcaggagcacaggc

SEQ ID NO: 2578761 - DNA, 17 bp, Homo sapiens
aggatctcttgagcctg

SEQ ID NO: 2578762 - DNA, 21 bp, Homo sapiens
aggatctcttgagcctgggag

SEQ ID NO: 2578763 - DNA, 20 bp, Homo sapiens
aggatctgtttttaaaaatc

SEQ ID NO: 2578764 - DNA, 22 bp, Homo sapiens
aggatgaatgaggtcccaggca

SEQ ID NO: 2578765 - DNA, 20 bp, Homo sapiens
aggatgaatgtatgtgcact

SEQ ID NO: 2578766 - DNA, 21 bp, Homo sapiens
aggatgaggccgctagaggcc

SEQ ID NO: 2578767 - DNA, 13 bp, Homo sapiens
aggatgcccaggg

SEQ ID NO: 2578768 - DNA, 17 bp, Homo sapiens
aggatgctaaaccttag

SEQ ID NO: 2578769 - DNA, 23 bp, Homo sapiens
aggatgcttgtacataatgcgtg

SEQ ID NO: 2578770 - DNA, 16 bp, Homo sapiens
aggatggagagagggg

SEQ ID NO: 2578771 - DNA, 17 bp, Homo sapiens
aggatggagccagctct

SEQ ID NO: 2578772 - DNA, 15 bp, Homo sapiens
aggatggccagtgtc

SEQ ID NO: 2578773 - DNA, 18 bp, Homo sapiens
aggatggccagtgtctgt

SEQ ID NO: 2578774 - DNA, 13 bp, Homo sapiens
aggatggcctggc

SEQ ID NO: 2578775 - DNA, 17 bp, Homo sapiens
aggatggcctggccagg

SEQ ID NO: 2578776 - DNA, 19 bp, Homo sapiens
aggatgggggctggcctct

SEQ ID NO: 2578777 - DNA, 17 bp, Homo sapiens
aggatgtcacagggcca

SEQ ID NO: 2578778 - DNA, 20 bp, Homo sapiens
aggatgttctgggacacagt

SEQ ID NO: 2578779 - DNA, 14 bp, Homo sapiens
aggatgtttttcat

SEQ ID NO: 2578780 - DNA, 14 bp, Homo sapiens
aggattattggaaa

SEQ ID NO: 2578781 - DNA, 13 bp, Homo sapiens
aggattctatgag

SEQ ID NO: 2578782 - DNA, 16 bp, Homo sapiens
aggatttcaagcctgc

SEQ ID NO: 2578783 - DNA, 19 bp, Homo sapiens
aggatttcatgatttcatt

SEQ ID NO: 2578784 - DNA, 20 bp, Homo sapiens
aggatttcatgatttcattt

SEQ ID NO: 2578785 - DNA, 11 bp, Homo sapiens
aggattttatg

SEQ ID NO: 2578786 - DNA, 15 bp, Homo sapiens
aggattttatgcttt

SEQ ID NO: 2578787 - DNA, 17 bp, Homo sapiens
aggatttttttctgagc

SEQ ID NO: 2578788 - DNA, 22 bp, Homo sapiens
aggcaaacccatcaacaaaaat

SEQ ID NO: 2578789 - DNA, 14 bp, Homo sapiens
aggcaaatgcccaa

SEQ ID NO: 2578790 - DNA, 14 bp, Homo sapiens
aggcaaatgtgtac

SEQ ID NO: 2578791 - DNA, 14 bp, Homo sapiens
aggcaactgaggca

SEQ ID NO: 2578792 - DNA, 13 bp, Homo sapiens
aggcaagaggggt

SEQ ID NO: 2578793 - DNA, 24 bp, Homo sapiens
aggcaagaggggtggagactgctt

SEQ ID NO: 2578794 - DNA, 20 bp, Homo sapiens
aggcaagcacctcctgcctc

SEQ ID NO: 2578795 - DNA, 14 bp, Homo sapiens
aggcaaggcaggtg

SEQ ID NO: 2578796 - DNA, 22 bp, Homo sapiens
aggcaaggcaggtgcctccagg

SEQ ID NO: 2578797 - DNA, 17 bp, Homo sapiens
aggcaagtgaagaaaag

SEQ ID NO: 2578798 - DNA, 18 bp, Homo sapiens
aggcaagtttctagctag

SEQ ID NO: 2578799 - DNA, 14 bp, Homo sapiens
aggcaataaaaatc

SEQ ID NO: 2578800 - DNA, 14 bp, Homo sapiens
aggcaatgctggct

SEQ ID NO: 2578801 - DNA, 16 bp, Homo sapiens
aggcaatgctggctgt

SEQ ID NO: 2578802 - DNA, 19 bp, Homo sapiens
aggcaatgtcaggaacaga

SEQ ID NO: 2578803 - DNA, 13 bp, Homo sapiens
aggcacaaaatga

SEQ ID NO: 2578804 - DNA, 17 bp, Homo sapiens
aggcacaaaatgatgga

SEQ ID NO: 2578805 - DNA, 15 bp, Homo sapiens
aggcacacttcttct

SEQ ID NO: 2578806 - DNA, 13 bp, Homo sapiens
aggcacatggagg

SEQ ID NO: 2578807 - DNA, 14 bp, Homo sapiens
aggcacatggagga

SEQ ID NO: 2578808 - DNA, 15 bp, Homo sapiens
aggcacccaccatca

SEQ ID NO: 2578809 - DNA, 20 bp, Homo sapiens
aggcacccaccatcatgtct

SEQ ID NO: 2578810 - DNA, 21 bp, Homo sapiens
aggcacccaccatcatgtctg

SEQ ID NO: 2578811 - DNA, 20 bp, Homo sapiens
aggcaccccctggagagaag

SEQ ID NO: 2578812 - DNA, 20 bp, Homo sapiens
aggcacccttctttcctctt

SEQ ID NO: 2578813 - DNA, 15 bp, Homo sapiens
aggcaccgagaatgt

SEQ ID NO: 2578814 - DNA, 19 bp, Homo sapiens
aggcacctcacagaaatga

SEQ ID NO: 2578815 - DNA, 19 bp, Homo sapiens
aggcaccttagtggctttt

SEQ ID NO: 2578816 - DNA, 14 bp, Homo sapiens
aggcactgctgccc

SEQ ID NO: 2578817 - DNA, 14 bp, Homo sapiens
aggcagaaagcaaa

SEQ ID NO: 2578818 - DNA, 17 bp, Homo sapiens
agggtggtgacctctgc

SEQ ID NO: 2578819 - DNA, 16 bp, Homo sapiens
agggtggtgctgggac

SEQ ID NO: 2578820 - DNA, 23 bp, Homo sapiens
agggtggtgctgggactgagcca

SEQ ID NO: 2578821 - DNA, 17 bp, Homo sapiens
agggtggtggagccagt

SEQ ID NO: 2578822 - DNA, 17 bp, Homo sapiens
agggttaagaaaagaga

SEQ ID NO: 2578823 - DNA, 18 bp, Homo sapiens
agggttactatgcacaat

SEQ ID NO: 2578824 - DNA, 13 bp, Homo sapiens
agggttagggagg

SEQ ID NO: 2578825 - DNA, 15 bp, Homo sapiens
agggttagggagggg

SEQ ID NO: 2578826 - DNA, 13 bp, Homo sapiens
agggttataataa

SEQ ID NO: 2578827 - DNA, 18 bp, Homo sapiens
agggttcaaaatgtctgt

SEQ ID NO: 2578828 - DNA, 18 bp, Homo sapiens
agggttcagagactcagg

SEQ ID NO: 2578829 - DNA, 15 bp, Homo sapiens
agggttcccccagcc

SEQ ID NO: 2578830 - DNA, 14 bp, Homo sapiens
agggttctggctgc

SEQ ID NO: 2578831 - DNA, 17 bp, Homo sapiens
agggttgaccccagagg

SEQ ID NO: 2578832 - DNA, 21 bp, Homo sapiens
agggttgagttacttcctatc

SEQ ID NO: 2578833 - DNA, 13 bp, Homo sapiens
agggttggcccct

SEQ ID NO: 2578834 - DNA, 15 bp, Homo sapiens
agggttgggctggtg

SEQ ID NO: 2578835 - DNA, 14 bp, Homo sapiens
agggtttgtggctg

SEQ ID NO: 2578836 - DNA, 17 bp, Homo sapiens
agggttttaatgtagat

SEQ ID NO: 2578837 - DNA, 19 bp, Homo sapiens
agggttttccaccctggaa

SEQ ID NO: 2578838 - DNA, 22 bp, Homo sapiens
agggttttgccatgttggccag

SEQ ID NO: 2578839 - DNA, 23 bp, Homo sapiens
agggttttgccatgttggccagg

SEQ ID NO: 2578840 - DNA, 17 bp, Homo sapiens
aggtaaaagtgtgagca

SEQ ID NO: 2578841 - DNA, 13 bp, Homo sapiens
aggtaacagaaca

SEQ ID NO: 2578842 - DNA, 23 bp, Homo sapiens
aggtaacagaacagcttcaggtt

SEQ ID NO: 2578843 - DNA, 14 bp, Homo sapiens
aggtaacaggcaga

SEQ ID NO: 2578844 - DNA, 17 bp, Homo sapiens
aggtaaggaatacctgt

SEQ ID NO: 2578845 - DNA, 14 bp, Homo sapiens
aggtaatgagggac

SEQ ID NO: 2578846 - DNA, 12 bp, Homo sapiens
aggtacactctt

SEQ ID NO: 2578847 - DNA, 22 bp, Homo sapiens
aggtaccagcaatatgtaaata

SEQ ID NO: 2578848 - DNA, 21 bp, Homo sapiens
aggtacccctttctggctctc

SEQ ID NO: 2578849 - DNA, 19 bp, Homo sapiens
aggtacctttcacatagag

SEQ ID NO: 2578850 - DNA, 13 bp, Homo sapiens
aggtactctcctg

SEQ ID NO: 2578851 - DNA, 20 bp, Homo sapiens
aggtagagtttgaaggaggt

SEQ ID NO: 2578852 - DNA, 19 bp, Homo sapiens
aggtagctgcccctggctc

SEQ ID NO: 2578853 - DNA, 19 bp, Homo sapiens
aggtaggagaattgcttga

SEQ ID NO: 2578854 - DNA, 11 bp, Homo sapiens
aggtataattt

SEQ ID NO: 2578855 - DNA, 15 bp, Homo sapiens
aggtataattttatg

SEQ ID NO: 2578856 - DNA, 21 bp, Homo sapiens
aggtatcattttctgcattta

SEQ ID NO: 2578857 - DNA, 13 bp, Homo sapiens
aggtatctccagg

SEQ ID NO: 2578858 - DNA, 20 bp, Homo sapiens
aggtatgaccttctaggaag

SEQ ID NO: 2578859 - DNA, 22 bp, Homo sapiens
aggtatggaagggtttgtggct

SEQ ID NO: 2578860 - DNA, 14 bp, Homo sapiens
aggtatgttgcctt

SEQ ID NO: 2578861 - DNA, 19 bp, Homo sapiens
aggtcaagaagaagatgga

SEQ ID NO: 2578862 - DNA, 19 bp, Homo sapiens
aggtcaagtaagaagacat

SEQ ID NO: 2578863 - DNA, 12 bp, Homo sapiens
aggtcaccagca

SEQ ID NO: 2578864 - DNA, 21 bp, Homo sapiens
aggtcactcttcctgcaagga

SEQ ID NO: 2578865 - DNA, 23 bp, Homo sapiens
aggtcactcttcctgcaaggact

SEQ ID NO: 2578866 - DNA, 14 bp, Homo sapiens
aggtcactggctct

SEQ ID NO: 2578867 - DNA, 15 bp, Homo sapiens
aggtcactggctctc

SEQ ID NO: 2578868 - DNA, 18 bp, Homo sapiens
aggtcactggctctccaa

SEQ ID NO: 2578869 - DNA, 13 bp, Homo sapiens
aggtcagagcctg

SEQ ID NO: 2578870 - DNA, 21 bp, Homo sapiens
aggtcaggagttagaggccag

SEQ ID NO: 2578871 - DNA, 20 bp, Homo sapiens
aggtcatacaatccattctt

SEQ ID NO: 2578872 - DNA, 18 bp, Homo sapiens
aggtcatggaatggaaac

SEQ ID NO: 2578873 - DNA, 23 bp, Homo sapiens
aggtcattttttttaagaaaaag

SEQ ID NO: 2578874 - DNA, 11 bp, Homo sapiens
aggtcccaggc

SEQ ID NO: 2578875 - DNA, 21 bp, Homo sapiens
aggtcctctacttaatgagat

SEQ ID NO: 2578876 - DNA, 20 bp, Homo sapiens
aggtcctgcagtctggctga

SEQ ID NO: 2578877 - DNA, 13 bp, Homo sapiens
aggtctcacgggc

SEQ ID NO: 2578878 - DNA, 12 bp, Homo sapiens
aggtctcctctt

SEQ ID NO: 2578879 - DNA, 13 bp, Homo sapiens
aggtctcctctta

SEQ ID NO: 2578880 - DNA, 14 bp, Homo sapiens
aggtctcctcttaa

SEQ ID NO: 2578881 - DNA, 15 bp, Homo sapiens
aggtctctgccggct

SEQ ID NO: 2578882 - DNA, 12 bp, Homo sapiens
aggtctcttccc

SEQ ID NO: 2578883 - DNA, 13 bp, Homo sapiens
aggtctcttcccc

SEQ ID NO: 2578884 - DNA, 15 bp, Homo sapiens
aggtctcttgaggga

SEQ ID NO: 2578885 - DNA, 21 bp, Homo sapiens
aggtctgaaatggaggtcctt

SEQ ID NO: 2578886 - DNA, 20 bp, Homo sapiens
aggtctgacacgtctgccta

SEQ ID NO: 2578887 - DNA, 22 bp, Homo sapiens
aggtctggagaagctcccagga

SEQ ID NO: 2578888 - DNA, 13 bp, Homo sapiens
aggtctgttcttt

SEQ ID NO: 2578889 - DNA, 16 bp, Homo sapiens
aggtcttgaactcctg

SEQ ID NO: 2578890 - DNA, 23 bp, Homo sapiens
aggtcttgaactcctggcctcaa

SEQ ID NO: 2578891 - DNA, 19 bp, Homo sapiens
aggtcttggagctgagcct

SEQ ID NO: 2578892 - DNA, 16 bp, Homo sapiens
aggtgaaagggagcta

SEQ ID NO: 2578893 - DNA, 20 bp, Homo sapiens
aggtgaccaaaatccccttc

SEQ ID NO: 2578894 - DNA, 22 bp, Homo sapiens
aggtgaccaaaatccccttctc

SEQ ID NO: 2578895 - DNA, 19 bp, Homo sapiens
aggtgaccaaatcagtgtg

SEQ ID NO: 2578896 - DNA, 22 bp, Homo sapiens
aggtgactgggccctgcctctg

SEQ ID NO: 2578897 - DNA, 16 bp, Homo sapiens
aggtgagaagcagagg

SEQ ID NO: 2578898 - DNA, 23 bp, Homo sapiens
aggtgagaagcagaggaaggaga

SEQ ID NO: 2578899 - DNA, 14 bp, Homo sapiens
aggtgatccaccca

SEQ ID NO: 2578900 - DNA, 21 bp, Homo sapiens
aggtgatccacccacctcagc

SEQ ID NO: 2578901 - DNA, 18 bp, Homo sapiens
aggtgcacaagctccaag

SEQ ID NO: 2578902 - DNA, 19 bp, Homo sapiens
aggtgcagagtgcccagaa

SEQ ID NO: 2578903 - DNA, 16 bp, Homo sapiens
aggtgcagttccccca

SEQ ID NO: 2578904 - DNA, 21 bp, Homo sapiens
aggtgcatctggggaactaga

SEQ ID NO: 2578905 - DNA, 15 bp, Homo sapiens
aggtgccagcaactg

SEQ ID NO: 2578906 - DNA, 20 bp, Homo sapiens
aggtgccagcaactgaataa

SEQ ID NO: 2578907 - DNA, 19 bp, Homo sapiens
aggtgcccttggaggccag

SEQ ID NO: 2578908 - DNA, 16 bp, Homo sapiens
aggtgcctccaggtgt

SEQ ID NO: 2578909 - DNA, 18 bp, Homo sapiens
aggtgcctccaggtgtgc

SEQ ID NO: 2578910 - DNA, 19 bp, Homo sapiens
aggtgctacaaaaacacag

SEQ ID NO: 2578911 - DNA, 21 bp, Homo sapiens
aggtgctacaaaaacacagca

SEQ ID NO: 2578912 - DNA, 16 bp, Homo sapiens
aggtgctgccatccag

SEQ ID NO: 2578913 - DNA, 14 bp, Homo sapiens
aggtggacacacaa

SEQ ID NO: 2578914 - DNA, 16 bp, Homo sapiens
aggtggactggaaggg

SEQ ID NO: 2578915 - DNA, 18 bp, Homo sapiens
aggtggagcaaagtgagg

SEQ ID NO: 2578916 - DNA, 20 bp, Homo sapiens
aggtggaggctgcagtgagc

SEQ ID NO: 2578917 - DNA, 16 bp, Homo sapiens
aggtggcaaggctgtg

SEQ ID NO: 2578918 - DNA, 14 bp, Homo sapiens
aggtggcagccctg

SEQ ID NO: 2578919 - DNA, 19 bp, Homo sapiens
aggtggcaggaccaggact

SEQ ID NO: 2578920 - DNA, 17 bp, Homo sapiens
aggtggctctccagtta

SEQ ID NO: 2578921 - DNA, 15 bp, Homo sapiens
aggtgggatcctcca

SEQ ID NO: 2578922 - DNA, 16 bp, Homo sapiens
aggtgggatcctccag

SEQ ID NO: 2578923 - DNA, 15 bp, Homo sapiens
aggtgggccagcccc

SEQ ID NO: 2578924 - DNA, 16 bp, Homo sapiens
aggtgggccagcccct

SEQ ID NO: 2578925 - DNA, 17 bp, Homo sapiens
aggtgggccagcccctc

SEQ ID NO: 2578926 - DNA, 22 bp, Homo sapiens
aggtgggccagcccctcccacc

SEQ ID NO: 2578927 - DNA, 13 bp, Homo sapiens
aggtgggcccagg

SEQ ID NO: 2578928 - DNA, 22 bp, Homo sapiens
aggtgggcccaggaccagctgg

SEQ ID NO: 2578929 - DNA, 23 bp, Homo sapiens
aggtgggcccaggaccagctggg

SEQ ID NO: 2578930 - DNA, 22 bp, Homo sapiens
aggtgggcgtggtcactgctgt

SEQ ID NO: 2578931 - DNA, 16 bp, Homo sapiens
aggtgggctgagccct

SEQ ID NO: 2578932 - DNA, 17 bp, Homo sapiens
aggtgggctgagccctg

SEQ ID NO: 2578933 - DNA, 18 bp, Homo sapiens
aggtgggctgagccctgg

SEQ ID NO: 2578934 - DNA, 13 bp, Homo sapiens
aggtggggacagg

SEQ ID NO: 2578935 - DNA, 17 bp, Homo sapiens
aggtggggacagggatg

SEQ ID NO: 2578936 - DNA, 19 bp, Homo sapiens
aggtggggagactgggctg

SEQ ID NO: 2578937 - DNA, 21 bp, Homo sapiens
aggtggggagactgggctgag

SEQ ID NO: 2578938 - DNA, 11 bp, Homo sapiens
aggtggggagg

SEQ ID NO: 2578939 - DNA, 23 bp, Homo sapiens
aggtggggagggggtttgggggc

SEQ ID NO: 2578940 - DNA, 13 bp, Homo sapiens
aggtggggcagct

SEQ ID NO: 2578941 - DNA, 22 bp, Homo sapiens
aggtggggtatttaccacagca

SEQ ID NO: 2578942 - DNA, 22 bp, Homo sapiens
aggtggggttgggattgggggc

SEQ ID NO: 2578943 - DNA, 15 bp, Homo sapiens
aggtggtatgtgtgt

SEQ ID NO: 2578944 - DNA, 15 bp, Homo sapiens
aggtggtctgaatgt

SEQ ID NO: 2578945 - DNA, 19 bp, Homo sapiens
aggtggtctgaatgttctg

SEQ ID NO: 2578946 - DNA, 19 bp, Homo sapiens
aggtggtggcactgagccc

SEQ ID NO: 2578947 - DNA, 20 bp, Homo sapiens
aggtggtggcactgagcccc

SEQ ID NO: 2578948 - DNA, 17 bp, Homo sapiens
aggtgtgaaccaccaca

SEQ ID NO: 2578949 - DNA, 18 bp, Homo sapiens
aggtgtgactgaatttct

SEQ ID NO: 2578950 - DNA, 14 bp, Homo sapiens
aggtgtgggggctg

SEQ ID NO: 2578951 - DNA, 22 bp, Homo sapiens
aggtgttcaagaccagcctgac

SEQ ID NO: 2578952 - DNA, 20 bp, Homo sapiens
aggtgttctacactcatctt

SEQ ID NO: 2578953 - DNA, 13 bp, Homo sapiens
aggtgtttaaaga

SEQ ID NO: 2578954 - DNA, 18 bp, Homo sapiens
aggtgtttaaagagaggt

SEQ ID NO: 2578955 - DNA, 16 bp, Homo sapiens
aggttaaggctgagga

SEQ ID NO: 2578956 - DNA, 15 bp, Homo sapiens
aggttaataaagtaa

SEQ ID NO: 2578957 - DNA, 14 bp, Homo sapiens
aggttacaacagat

SEQ ID NO: 2578958 - DNA, 22 bp, Homo sapiens
aggttacaacagatttgtgaac

SEQ ID NO: 2578959 - DNA, 15 bp, Homo sapiens
aggttacaagcctgc

SEQ ID NO: 2578960 - DNA, 18 bp, Homo sapiens
aggttagaacctagaagg

SEQ ID NO: 2578961 - DNA, 20 bp, Homo sapiens
aggttagaacctagaagggc

SEQ ID NO: 2578962 - DNA, 13 bp, Homo sapiens
agtgtaaagcatt

SEQ ID NO: 2578963 - DNA, 14 bp, Homo sapiens
agtgtaaagcattc

SEQ ID NO: 2578964 - DNA, 14 bp, Homo sapiens
agtgtaaatccttt

SEQ ID NO: 2578965 - DNA, 13 bp, Homo sapiens
agtgtaacagctg

SEQ ID NO: 2578966 - DNA, 14 bp, Homo sapiens
agtgtaacagctga

SEQ ID NO: 2578967 - DNA, 13 bp, Homo sapiens
agtgtaagtgtga

SEQ ID NO: 2578968 - DNA, 15 bp, Homo sapiens
agtgtagaagcattc

SEQ ID NO: 2578969 - DNA, 16 bp, Homo sapiens
agtgtagaagcattcc

SEQ ID NO: 2578970 - DNA, 23 bp, Homo sapiens
agtgtagatcagagcagcagtga

SEQ ID NO: 2578971 - DNA, 16 bp, Homo sapiens
agtgtatggaaataaa

SEQ ID NO: 2578972 - DNA, 21 bp, Homo sapiens
agtgtccaaagcagggtctgg

SEQ ID NO: 2578973 - DNA, 15 bp, Homo sapiens
agtgtcccctccact

SEQ ID NO: 2578974 - DNA, 21 bp, Homo sapiens
agtgtcccctccactgtcaca

SEQ ID NO: 2578975 - DNA, 18 bp, Homo sapiens
agtgtcttaattaaaaga

SEQ ID NO: 2578976 - DNA, 13 bp, Homo sapiens
agtgtgaacaaaa

SEQ ID NO: 2578977 - DNA, 12 bp, Homo sapiens
agtgtgaagtta

SEQ ID NO: 2578978 - DNA, 20 bp, Homo sapiens
agtgtgaagttagaattcct

SEQ ID NO: 2578979 - DNA, 19 bp, Homo sapiens
agtgtgcatattgtacact

SEQ ID NO: 2578980 - DNA, 21 bp, Homo sapiens
agtgtggctcccctctattta

SEQ ID NO: 2578981 - DNA, 23 bp, Homo sapiens
agtgtgggtctgtgtgtgtgtat

SEQ ID NO: 2578982 - DNA, 20 bp, Homo sapiens
agtgtggtgtttcctggcac

SEQ ID NO: 2578983 - DNA, 19 bp, Homo sapiens
agtgtgtatgtgcgtgtgt

SEQ ID NO: 2578984 - DNA, 20 bp, Homo sapiens
agtgtgtatgtgcgtgtgtg

SEQ ID NO: 2578985 - DNA, 18 bp, Homo sapiens
agtgtgtccaagtgtgtg

SEQ ID NO: 2578986 - DNA, 17 bp, Homo sapiens
agtgtgtgcatgtgtgt

SEQ ID NO: 2578987 - DNA, 23 bp, Homo sapiens
agtgtgtgcatgtgtgtgctcag

SEQ ID NO: 2578988 - DNA, 13 bp, Homo sapiens
agtgtgttctgat

SEQ ID NO: 2578989 - DNA, 19 bp, Homo sapiens
agtgtgtttccttcagtgc

SEQ ID NO: 2578990 - DNA, 16 bp, Homo sapiens
agtgttaatactagtt

SEQ ID NO: 2578991 - DNA, 18 bp, Homo sapiens
agtgttccctttcctact

SEQ ID NO: 2578992 - DNA, 16 bp, Homo sapiens
agtgttcctatttggg

SEQ ID NO: 2578993 - DNA, 20 bp, Homo sapiens
agtgttcctatttggggctt

SEQ ID NO: 2578994 - DNA, 19 bp, Homo sapiens
agtgttgtggatttaacag

SEQ ID NO: 2578995 - DNA, 22 bp, Homo sapiens
agtgtttatttttcatattgtg

SEQ ID NO: 2578996 - DNA, 16 bp, Homo sapiens
agtgtttcccataatt

SEQ ID NO: 2578997 - DNA, 13 bp, Homo sapiens
agtgtttctgtgc

SEQ ID NO: 2578998 - DNA, 13 bp, Homo sapiens
agtgtttctgtta

SEQ ID NO: 2578999 - DNA, 18 bp, Homo sapiens
agtgtttttgtaaagtgt

SEQ ID NO: 2579000 - DNA, 12 bp, Homo sapiens
agttaaataaat

SEQ ID NO: 2579001 - DNA, 21 bp, Homo sapiens
agttaaatagagtatatgcac

SEQ ID NO: 2579002 - DNA, 16 bp, Homo sapiens
agttaacaatgatata

SEQ ID NO: 2579003 - DNA, 17 bp, Homo sapiens
agttaacgggtgaataa

SEQ ID NO: 2579004 - DNA, 21 bp, Homo sapiens
agttaacgggtgaataataaa

SEQ ID NO: 2579005 - DNA, 14 bp, Homo sapiens
agttaactttcaga

SEQ ID NO: 2579006 - DNA, 20 bp, Homo sapiens
agttaagaagctgttgtaca

SEQ ID NO: 2579007 - DNA, 14 bp, Homo sapiens
agttaagagtagca

SEQ ID NO: 2579008 - DNA, 21 bp, Homo sapiens
agttaatatatcccagaaatt

SEQ ID NO: 2579009 - DNA, 20 bp, Homo sapiens
agttaatgatggttgatggg

SEQ ID NO: 2579010 - DNA, 13 bp, Homo sapiens
agttacacatttt

SEQ ID NO: 2579011 - DNA, 19 bp, Homo sapiens
agttacacatttttcagat

SEQ ID NO: 2579012 - DNA, 20 bp, Homo sapiens
agttacatgcatacttcaaa

SEQ ID NO: 2579013 - DNA, 16 bp, Homo sapiens
agttacattaatgtta

SEQ ID NO: 2579014 - DNA, 16 bp, Homo sapiens
agttactctgaagggc

SEQ ID NO: 2579015 - DNA, 15 bp, Homo sapiens
agttacttcctatca

SEQ ID NO: 2579016 - DNA, 19 bp, Homo sapiens
agttagaattccttcaggg

SEQ ID NO: 2579017 - DNA, 22 bp, Homo sapiens
agttagcaaactttgtatgtca

SEQ ID NO: 2579018 - DNA, 13 bp, Homo sapiens
agttaggaaataa

SEQ ID NO: 2579019 - DNA, 15 bp, Homo sapiens
agttaggaaataaaa

SEQ ID NO: 2579020 - DNA, 20 bp, Homo sapiens
agttaggaaataaaaccttt

SEQ ID NO: 2579021 - DNA, 16 bp, Homo sapiens
agttaggatagcattt

SEQ ID NO: 2579022 - DNA, 18 bp, Homo sapiens
agttaggctattcacaac

SEQ ID NO: 2579023 - DNA, 14 bp, Homo sapiens
agttagtagcatgt

SEQ ID NO: 2579024 - DNA, 15 bp, Homo sapiens
agttagtagcatgtt

SEQ ID NO: 2579025 - DNA, 21 bp, Homo sapiens
agttataagtagcaggccaag

SEQ ID NO: 2579026 - DNA, 19 bp, Homo sapiens
agttatagatgtctaggta

SEQ ID NO: 2579027 - DNA, 18 bp, Homo sapiens
agttatagtttcagatat

SEQ ID NO: 2579028 - DNA, 21 bp, Homo sapiens
agttatataggttttgtttgc

SEQ ID NO: 2579029 - DNA, 22 bp, Homo sapiens
agttatataggttttgtttgct

SEQ ID NO: 2579030 - DNA, 20 bp, Homo sapiens
agttatgatttttttttcat

SEQ ID NO: 2579031 - DNA, 18 bp, Homo sapiens
agttatggcctatacact

SEQ ID NO: 2579032 - DNA, 17 bp, Homo sapiens
agttattgacaaactct

SEQ ID NO: 2579033 - DNA, 18 bp, Homo sapiens
agttattgacaaactctc

SEQ ID NO: 2579034 - DNA, 19 bp, Homo sapiens
agttattgcagtttatcat

SEQ ID NO: 2579035 - DNA, 12 bp, Homo sapiens
agttattgtaca

SEQ ID NO: 2579036 - DNA, 22 bp, Homo sapiens
agttattgtacagctgtttaag

SEQ ID NO: 2579037 - DNA, 18 bp, Homo sapiens
agttcaaattcttctgaa

SEQ ID NO: 2579038 - DNA, 14 bp, Homo sapiens
agttcaatgatcta

SEQ ID NO: 2579039 - DNA, 14 bp, Homo sapiens
agttcaatggctgc

SEQ ID NO: 2579040 - DNA, 14 bp, Homo sapiens
agttcaccattaaa

SEQ ID NO: 2579041 - DNA, 22 bp, Homo sapiens
agttcacttcatcttctcagct

SEQ ID NO: 2579042 - DNA, 15 bp, Homo sapiens
agttcagcaccaccc

SEQ ID NO: 2579043 - DNA, 18 bp, Homo sapiens
agttcagcaccaccctag

SEQ ID NO: 2579044 - DNA, 20 bp, Homo sapiens
agttcaggagtcccaaggaa

SEQ ID NO: 2579045 - DNA, 16 bp, Homo sapiens
agttcagtacctggag

SEQ ID NO: 2579046 - DNA, 11 bp, Homo sapiens
agttcagtggc

SEQ ID NO: 2579047 - DNA, 13 bp, Homo sapiens
agttcagtggcag

SEQ ID NO: 2579048 - DNA, 18 bp, Homo sapiens
agttcagtggcagggctc

SEQ ID NO: 2579049 - DNA, 23 bp, Homo sapiens
agttcagtggcagggctcaggat

SEQ ID NO: 2579050 - DNA, 20 bp, Homo sapiens
agttcatagggtctcttcag

SEQ ID NO: 2579051 - DNA, 23 bp, Homo sapiens
agttcatgtttgcttcataaatg

SEQ ID NO: 2579052 - DNA, 15 bp, Homo sapiens
agttccactgagctc

SEQ ID NO: 2579053 - DNA, 12 bp, Homo sapiens
agttcccagaat

SEQ ID NO: 2579054 - DNA, 14 bp, Homo sapiens
agttcccagaatca

SEQ ID NO: 2579055 - DNA, 15 bp, Homo sapiens
agttcccagaatcaa

SEQ ID NO: 2579056 - DNA, 15 bp, Homo sapiens
agttcccccaacctc

SEQ ID NO: 2579057 - DNA, 18 bp, Homo sapiens
agttcccccaacctcaga

SEQ ID NO: 2579058 - DNA, 15 bp, Homo sapiens
agttcccttggcctc

SEQ ID NO: 2579059 - DNA, 18 bp, Homo sapiens
agttcccttggcctcaga

SEQ ID NO: 2579060 - DNA, 16 bp, Homo sapiens
agttccgatttcccag

SEQ ID NO: 2579061 - DNA, 18 bp, Homo sapiens
agttcctgaacctgatgc

SEQ ID NO: 2579062 - DNA, 23 bp, Homo sapiens
agttcctgtcccttctcttaatt

SEQ ID NO: 2579063 - DNA, 20 bp, Homo sapiens
agttccttgatctgtatata

SEQ ID NO: 2579064 - DNA, 18 bp, Homo sapiens
agttcgagaccagcctgg

SEQ ID NO: 2579065 - DNA, 22 bp, Homo sapiens
agttctacctcaggcagctcaa

SEQ ID NO: 2579066 - DNA, 14 bp, Homo sapiens
agttctagagaaga

SEQ ID NO: 2579067 - DNA, 16 bp, Homo sapiens
agttctagagaagagg

SEQ ID NO: 2579068 - DNA, 18 bp, Homo sapiens
agttctcactgttccctc

SEQ ID NO: 2579069 - DNA, 15 bp, Homo sapiens
agttctcagggctcc

SEQ ID NO: 2579070 - DNA, 13 bp, Homo sapiens
agttctgaagaat

SEQ ID NO: 2579071 - DNA, 14 bp, Homo sapiens
agttctgagtgttt

SEQ ID NO: 2579072 - DNA, 15 bp, Homo sapiens
agttctgagtgtttt

SEQ ID NO: 2579073 - DNA, 22 bp, Homo sapiens
agttctgagtgtttttactaca

SEQ ID NO: 2579074 - DNA, 16 bp, Homo sapiens
agttctgcagataaac

SEQ ID NO: 2579075 - DNA, 18 bp, Homo sapiens
agttctgctcctctccag

SEQ ID NO: 2579076 - DNA, 20 bp, Homo sapiens
agttcttagttgctgtatgt

SEQ ID NO: 2579077 - DNA, 21 bp, Homo sapiens
agttcttagttgctgtatgtc

SEQ ID NO: 2579078 - DNA, 17 bp, Homo sapiens
agttcttcgggaagaga

SEQ ID NO: 2579079 - DNA, 22 bp, Homo sapiens
agttcttgtctgattggctcac

SEQ ID NO: 2579080 - DNA, 12 bp, Homo sapiens
agttcttgtgcc

SEQ ID NO: 2579081 - DNA, 13 bp, Homo sapiens
agttcttgtgcca

SEQ ID NO: 2579082 - DNA, 19 bp, Homo sapiens
agttgaatgacaacagaag

SEQ ID NO: 2579083 - DNA, 21 bp, Homo sapiens
agttgaatgacaacagaagct

SEQ ID NO: 2579084 - DNA, 16 bp, Homo sapiens
agttgagccccaagtc

SEQ ID NO: 2579085 - DNA, 20 bp, Homo sapiens
agttgagtcgtcatcacttt

SEQ ID NO: 2579086 - DNA, 19 bp, Homo sapiens
agttgatagcacagaccct

SEQ ID NO: 2579087 - DNA, 17 bp, Homo sapiens
agttgatatagaacagt

SEQ ID NO: 2579088 - DNA, 19 bp, Homo sapiens
agttgatatagaacagtgc

SEQ ID NO: 2579089 - DNA, 13 bp, Homo sapiens
agttgattcagct

SEQ ID NO: 2579090 - DNA, 14 bp, Homo sapiens
agttgattcagctc

SEQ ID NO: 2579091 - DNA, 15 bp, Homo sapiens
agttgattcagctct

SEQ ID NO: 2579092 - DNA, 23 bp, Homo sapiens
agttgattttacaattgaaatga

SEQ ID NO: 2579093 - DNA, 18 bp, Homo sapiens
agttgcaattgaattaaa

SEQ ID NO: 2579094 - DNA, 15 bp, Homo sapiens
agttgcactgatatt

SEQ ID NO: 2579095 - DNA, 11 bp, Homo sapiens
agttgcagaaa

SEQ ID NO: 2579096 - DNA, 23 bp, Homo sapiens
agttgcagactcagtttgtcaga

SEQ ID NO: 2579097 - DNA, 20 bp, Homo sapiens
agttgcgtggactctgcaca

SEQ ID NO: 2579098 - DNA, 16 bp, Homo sapiens
agttgctgcaaacctg

SEQ ID NO: 2579099 - DNA, 19 bp, Homo sapiens
agttggagtgagtgtggct

SEQ ID NO: 2579100 - DNA, 18 bp, Homo sapiens
agttggctggatgaaatt

SEQ ID NO: 2579101 - DNA, 16 bp, Homo sapiens
agttgggagcactgga

SEQ ID NO: 2579102 - DNA, 13 bp, Homo sapiens
agttgggcttcct

SEQ ID NO: 2579103 - DNA, 11 bp, Homo sapiens
agttggtcccc

SEQ ID NO: 2579104 - DNA, 13 bp, Homo sapiens
agttggtccccct

SEQ ID NO: 2579105 - DNA, 17 bp, Homo sapiens
agttggtcccccttcca

SEQ ID NO: 2579106 - DNA, 13 bp, Homo sapiens
agttgtagaatgt

SEQ ID NO: 2579107 - DNA, 17 bp, Homo sapiens
atagtggcttaaaacaa

SEQ ID NO: 2579108 - DNA, 20 bp, Homo sapiens
atagtgggcaccccactgca

SEQ ID NO: 2579109 - DNA, 16 bp, Homo sapiens
atagtggggagacttc

SEQ ID NO: 2579110 - DNA, 15 bp, Homo sapiens
atagtggtgtgattt

SEQ ID NO: 2579111 - DNA, 23 bp, Homo sapiens
atagtgtggaaattaagaagaaa

SEQ ID NO: 2579112 - DNA, 14 bp, Homo sapiens
atagtgtgttctga

SEQ ID NO: 2579113 - DNA, 15 bp, Homo sapiens
atagtgtgttctgat

SEQ ID NO: 2579114 - DNA, 23 bp, Homo sapiens
atagtgtgttctgattagaaatg

SEQ ID NO: 2579115 - DNA, 15 bp, Homo sapiens
atagtgttaatcaat

SEQ ID NO: 2579116 - DNA, 16 bp, Homo sapiens
atagtgttaatcaatt

SEQ ID NO: 2579117 - DNA, 20 bp, Homo sapiens
atagttactccagtgccaac

SEQ ID NO: 2579118 - DNA, 23 bp, Homo sapiens
atagttaggatagcatttttgat

SEQ ID NO: 2579119 - DNA, 17 bp, Homo sapiens
atagttcccatgttaaa

SEQ ID NO: 2579120 - DNA, 22 bp, Homo sapiens
atagttccctagtctattcatt

SEQ ID NO: 2579121 - DNA, 22 bp, Homo sapiens
atagttggctaggacccctcca

SEQ ID NO: 2579122 - DNA, 16 bp, Homo sapiens
atagtttactatttta

SEQ ID NO: 2579123 - DNA, 17 bp, Homo sapiens
atataaaaagaaaagat

SEQ ID NO: 2579124 - DNA, 22 bp, Homo sapiens
atataaaaagaaaagataaaga

SEQ ID NO: 2579125 - DNA, 13 bp, Homo sapiens
atataaaggaaaa

SEQ ID NO: 2579126 - DNA, 18 bp, Homo sapiens
atataaatggctggtttt

SEQ ID NO: 2579127 - DNA, 17 bp, Homo sapiens
atataaatggttaaaag

SEQ ID NO: 2579128 - DNA, 16 bp, Homo sapiens
atataacttatattgt

SEQ ID NO: 2579129 - DNA, 17 bp, Homo sapiens
atataatatatttgtgt

SEQ ID NO: 2579130 - DNA, 15 bp, Homo sapiens
atataatggtttcaa

SEQ ID NO: 2579131 - DNA, 17 bp, Homo sapiens
atataattctgtaaatg

SEQ ID NO: 2579132 - DNA, 14 bp, Homo sapiens
atataattctgtac

SEQ ID NO: 2579133 - DNA, 22 bp, Homo sapiens
atataattctgtacatagccta

SEQ ID NO: 2579134 - DNA, 16 bp, Homo sapiens
atatacaataacataa

SEQ ID NO: 2579135 - DNA, 16 bp, Homo sapiens
atatacagtaacttta

SEQ ID NO: 2579136 - DNA, 18 bp, Homo sapiens
atatacattcaaacttaa

SEQ ID NO: 2579137 - DNA, 21 bp, Homo sapiens
atatactgtaaagaaagagag

SEQ ID NO: 2579138 - DNA, 23 bp, Homo sapiens
atatactgtaaagaaagagagaa

SEQ ID NO: 2579139 - DNA, 14 bp, Homo sapiens
atatagagatgttt

SEQ ID NO: 2579140 - DNA, 22 bp, Homo sapiens
atatagagatgtttttaaaagt

SEQ ID NO: 2579141 - DNA, 23 bp, Homo sapiens
atatagatcagttataagtagca

SEQ ID NO: 2579142 - DNA, 18 bp, Homo sapiens
atatagattataacttgt

SEQ ID NO: 2579143 - DNA, 18 bp, Homo sapiens
atatagttttacttttaa

SEQ ID NO: 2579144 - DNA, 19 bp, Homo sapiens
atatataaaaagaaaagat

SEQ ID NO: 2579145 - DNA, 13 bp, Homo sapiens
atatatagaatct

SEQ ID NO: 2579146 - DNA, 20 bp, Homo sapiens
atatatatgtgtgtgtatgt

SEQ ID NO: 2579147 - DNA, 13 bp, Homo sapiens
atatatattttaa

SEQ ID NO: 2579148 - DNA, 20 bp, Homo sapiens
atatatcatattggtattca

SEQ ID NO: 2579149 - DNA, 16 bp, Homo sapiens
atatatcccagaaatt

SEQ ID NO: 2579150 - DNA, 19 bp, Homo sapiens
atatatctaaattgaataa

SEQ ID NO: 2579151 - DNA, 20 bp, Homo sapiens
atatatctgctgtccagaca

SEQ ID NO: 2579152 - DNA, 15 bp, Homo sapiens
atatatctgcttcag

SEQ ID NO: 2579153 - DNA, 12 bp, Homo sapiens
atatatgtgaac

SEQ ID NO: 2579154 - DNA, 18 bp, Homo sapiens
atatatgtgaacatttat

SEQ ID NO: 2579155 - DNA, 14 bp, Homo sapiens
atatatgtgatgat

SEQ ID NO: 2579156 - DNA, 15 bp, Homo sapiens
atatatgtgtatgta

SEQ ID NO: 2579157 - DNA, 19 bp, Homo sapiens
atatatgtgtgtgtatgtt

SEQ ID NO: 2579158 - DNA, 23 bp, Homo sapiens
atatatgtgtgtttaaataaagt

SEQ ID NO: 2579159 - DNA, 15 bp, Homo sapiens
atatatgtgtttttc

SEQ ID NO: 2579160 - DNA, 15 bp, Homo sapiens
atatattcccaatag

SEQ ID NO: 2579161 - DNA, 10 bp, Homo sapiens
atatatttat

SEQ ID NO: 2579162 - DNA, 12 bp, Homo sapiens
atatatttataa

SEQ ID NO: 2579163 - DNA, 14 bp, Homo sapiens
atatatttataact

SEQ ID NO: 2579164 - DNA, 15 bp, Homo sapiens
atatatttataactc

SEQ ID NO: 2579165 - DNA, 21 bp, Homo sapiens
atatatttataactcatcata

SEQ ID NO: 2579166 - DNA, 14 bp, Homo sapiens
atatatttcagata

SEQ ID NO: 2579167 - DNA, 13 bp, Homo sapiens
atatattttaatt

SEQ ID NO: 2579168 - DNA, 16 bp, Homo sapiens
atatattttacaattt

SEQ ID NO: 2579169 - DNA, 15 bp, Homo sapiens
atatattttctgttt

SEQ ID NO: 2579170 - DNA, 14 bp, Homo sapiens
atatatttttaaga

SEQ ID NO: 2579171 - DNA, 14 bp, Homo sapiens
atatatttttcaca

SEQ ID NO: 2579172 - DNA, 15 bp, Homo sapiens
atatatttttggttg

SEQ ID NO: 2579173 - DNA, 21 bp, Homo sapiens
atatcagcctgagtctcctgt

SEQ ID NO: 2579174 - DNA, 19 bp, Homo sapiens
atatcatattggtattcac

SEQ ID NO: 2579175 - DNA, 17 bp, Homo sapiens
atatcatcagtattgaa

SEQ ID NO: 2579176 - DNA, 23 bp, Homo sapiens
atatcatttattttttacattat

SEQ ID NO: 2579177 - DNA, 12 bp, Homo sapiens
atatccatgtac

SEQ ID NO: 2579178 - DNA, 13 bp, Homo sapiens
atatctaaattga

SEQ ID NO: 2579179 - DNA, 14 bp, Homo sapiens
atatctatatataa

SEQ ID NO: 2579180 - DNA, 16 bp, Homo sapiens
atatctatatataatt

SEQ ID NO: 2579181 - DNA, 17 bp, Homo sapiens
atatctatatataattc

SEQ ID NO: 2579182 - DNA, 23 bp, Homo sapiens
atatctatatataattctgtaca

SEQ ID NO: 2579183 - DNA, 20 bp, Homo sapiens
atatctatcttatatagttt

SEQ ID NO: 2579184 - DNA, 18 bp, Homo sapiens
atatctgctgtccagaca

SEQ ID NO: 2579185 - DNA, 15 bp, Homo sapiens
atatcttgaaatgaa

SEQ ID NO: 2579186 - DNA, 16 bp, Homo sapiens
atatgaaaatacaact

SEQ ID NO: 2579187 - DNA, 16 bp, Homo sapiens
atatgaagacataaac

SEQ ID NO: 2579188 - DNA, 19 bp, Homo sapiens
atatgacattcatgcctgg

SEQ ID NO: 2579189 - DNA, 23 bp, Homo sapiens
atatgacggaagaacatagaact

SEQ ID NO: 2579190 - DNA, 13 bp, Homo sapiens
atatgactcacat

SEQ ID NO: 2579191 - DNA, 20 bp, Homo sapiens
atatgagctttatgtaataa

SEQ ID NO: 2579192 - DNA, 17 bp, Homo sapiens
atatgagtttcatagct

SEQ ID NO: 2579193 - DNA, 16 bp, Homo sapiens
atatgatattgcatat

SEQ ID NO: 2579194 - DNA, 13 bp, Homo sapiens
atatgatttatag

SEQ ID NO: 2579195 - DNA, 14 bp, Homo sapiens
atatgatttatagt

SEQ ID NO: 2579196 - DNA, 16 bp, Homo sapiens
atatgattttatttga

SEQ ID NO: 2579197 - DNA, 16 bp, Homo sapiens
atatgcaaagcactga

SEQ ID NO: 2579198 - DNA, 23 bp, Homo sapiens
atatgcaaagcactgacttctaa

SEQ ID NO: 2579199 - DNA, 17 bp, Homo sapiens
atatgcaccttgtgtct

SEQ ID NO: 2579200 - DNA, 13 bp, Homo sapiens
atatgcacttata

SEQ ID NO: 2579201 - DNA, 14 bp, Homo sapiens
atatgcacttataa

SEQ ID NO: 2579202 - DNA, 16 bp, Homo sapiens
atatgcagttttcctt

SEQ ID NO: 2579203 - DNA, 17 bp, Homo sapiens
atatgcagttttcctta

SEQ ID NO: 2579204 - DNA, 19 bp, Homo sapiens
atatgcctctcctttgtat

SEQ ID NO: 2579205 - DNA, 17 bp, Homo sapiens
atatgctctgcatgtta

SEQ ID NO: 2579206 - DNA, 20 bp, Homo sapiens
atatgctctgcatgttacat

SEQ ID NO: 2579207 - DNA, 14 bp, Homo sapiens
atatgcttatacac

SEQ ID NO: 2579208 - DNA, 16 bp, Homo sapiens
atatgcttatacactt

SEQ ID NO: 2579209 - DNA, 21 bp, Homo sapiens
atatgcttatacacttacact

SEQ ID NO: 2579210 - DNA, 16 bp, Homo sapiens
atatggactctgcaca

SEQ ID NO: 2579211 - DNA, 16 bp, Homo sapiens
atatggcaaaaatggc

SEQ ID NO: 2579212 - DNA, 15 bp, Homo sapiens
atatggcaagaaagc

SEQ ID NO: 2579213 - DNA, 19 bp, Homo sapiens
atatggcaagaaagctggt

SEQ ID NO: 2579214 - DNA, 15 bp, Homo sapiens
atatggcctcaagat

SEQ ID NO: 2579215 - DNA, 15 bp, Homo sapiens
atatgggacattttt

SEQ ID NO: 2579216 - DNA, 14 bp, Homo sapiens
atatgggagaaata

SEQ ID NO: 2579217 - DNA, 18 bp, Homo sapiens
atatggggggccaacacc

SEQ ID NO: 2579218 - DNA, 23 bp, Homo sapiens
atatggggggccaacaccaggga

SEQ ID NO: 2579219 - DNA, 17 bp, Homo sapiens
atatgggttcttttttg

SEQ ID NO: 2579220 - DNA, 15 bp, Homo sapiens
atatgtaaaataaaa

SEQ ID NO: 2579221 - DNA, 19 bp, Homo sapiens
atatgtacttgtcaaagaa

SEQ ID NO: 2579222 - DNA, 20 bp, Homo sapiens
atatgtacttgtcaaagaag

SEQ ID NO: 2579223 - DNA, 14 bp, Homo sapiens
atatgtattgtaaa

SEQ ID NO: 2579224 - DNA, 13 bp, Homo sapiens
atatgtgaacatt

SEQ ID NO: 2579225 - DNA, 16 bp, Homo sapiens
atatgtgaacatttat

SEQ ID NO: 2579226 - DNA, 21 bp, Homo sapiens
atatgtgaatcctcttcttta

SEQ ID NO: 2579227 - DNA, 20 bp, Homo sapiens
atatgtgtgtttaaataaag

SEQ ID NO: 2579228 - DNA, 12 bp, Homo sapiens
atatgttcaact

SEQ ID NO: 2579229 - DNA, 14 bp, Homo sapiens
atatgttcactgtc

SEQ ID NO: 2579230 - DNA, 22 bp, Homo sapiens
atatgtttaccttttaattaat

SEQ ID NO: 2579231 - DNA, 14 bp, Homo sapiens
atatgttttttaga

SEQ ID NO: 2579232 - DNA, 17 bp, Homo sapiens
atatgttttttagatca

SEQ ID NO: 2579233 - DNA, 21 bp, Homo sapiens
atatgttttttagatcaaata

SEQ ID NO: 2579234 - DNA, 13 bp, Homo sapiens
atattaaatacag

SEQ ID NO: 2579235 - DNA, 20 bp, Homo sapiens
atattaaatacagacactaa

SEQ ID NO: 2579236 - DNA, 15 bp, Homo sapiens
atattaagaaagact

SEQ ID NO: 2579237 - DNA, 14 bp, Homo sapiens
atattaatattcct

SEQ ID NO: 2579238 - DNA, 17 bp, Homo sapiens
atattaccacagacata

SEQ ID NO: 2579239 - DNA, 19 bp, Homo sapiens
atattaccacagacatact

SEQ ID NO: 2579240 - DNA, 18 bp, Homo sapiens
atattagatgtgatttaa

SEQ ID NO: 2579241 - DNA, 17 bp, Homo sapiens
atattataacttaaaaa

SEQ ID NO: 2579242 - DNA, 22 bp, Homo sapiens
atattataatttttttcaatat

SEQ ID NO: 2579243 - DNA, 20 bp, Homo sapiens
atattatactaagaaaagat

SEQ ID NO: 2579244 - DNA, 16 bp, Homo sapiens
atattatggaagattt

SEQ ID NO: 2579245 - DNA, 19 bp, Homo sapiens
atattattagttttgattt

SEQ ID NO: 2579246 - DNA, 22 bp, Homo sapiens
atattattagttttgatttaat

SEQ ID NO: 2579247 - DNA, 13 bp, Homo sapiens
atattatttctag

SEQ ID NO: 2579248 - DNA, 16 bp, Homo sapiens
atattcaggaagctca

SEQ ID NO: 2579249 - DNA, 19 bp, Homo sapiens
atattcaggaagctcaggg

SEQ ID NO: 2579250 - DNA, 19 bp, Homo sapiens
atattcatgtaaacaaaat

SEQ ID NO: 2579251 - DNA, 22 bp, Homo sapiens
atattcatgtaaacaaaattta

SEQ ID NO: 2579252 - DNA, 20 bp, Homo sapiens
atctctcctccaagacactg

SEQ ID NO: 2579253 - DNA, 23 bp, Homo sapiens
atctctctactcctacctcagcc

SEQ ID NO: 2579254 - DNA, 20 bp, Homo sapiens
atctctgcaccctggggcct

SEQ ID NO: 2579255 - DNA, 17 bp, Homo sapiens
atctctgctttggaaat

SEQ ID NO: 2579256 - DNA, 17 bp, Homo sapiens
atctctgtgtgcacaaa

SEQ ID NO: 2579257 - DNA, 22 bp, Homo sapiens
atctcttcctacccaaccactc

SEQ ID NO: 2579258 - DNA, 18 bp, Homo sapiens
atctcttgagcctgggag

SEQ ID NO: 2579259 - DNA, 14 bp, Homo sapiens
atctgaaaatgtga

SEQ ID NO: 2579260 - DNA, 15 bp, Homo sapiens
atctgacatctctgc

SEQ ID NO: 2579261 - DNA, 18 bp, Homo sapiens
atctgatgcaagcaagaa

SEQ ID NO: 2579262 - DNA, 15 bp, Homo sapiens
atctgcacccccctg

SEQ ID NO: 2579263 - DNA, 18 bp, Homo sapiens
atctgcacccccctgggc

SEQ ID NO: 2579264 - DNA, 21 bp, Homo sapiens
atctgcacccccctgggctga

SEQ ID NO: 2579265 - DNA, 19 bp, Homo sapiens
atctgcccaggggtgcccc

SEQ ID NO: 2579266 - DNA, 21 bp, Homo sapiens
atctgcccaggggtgccccct

SEQ ID NO: 2579267 - DNA, 12 bp, Homo sapiens
atctgcccctcc

SEQ ID NO: 2579268 - DNA, 17 bp, Homo sapiens
atctgcccctcccccaa

SEQ ID NO: 2579269 - DNA, 21 bp, Homo sapiens
atctgcgtgacaataaaacat

SEQ ID NO: 2579270 - DNA, 13 bp, Homo sapiens
atctgctcctccc

SEQ ID NO: 2579271 - DNA, 11 bp, Homo sapiens
atctgctgtcc

SEQ ID NO: 2579272 - DNA, 16 bp, Homo sapiens
atctgctgtccagaca

SEQ ID NO: 2579273 - DNA, 17 bp, Homo sapiens
atctgctgtccagacag

SEQ ID NO: 2579274 - DNA, 18 bp, Homo sapiens
atctgctgtccagacagc

SEQ ID NO: 2579275 - DNA, 12 bp, Homo sapiens
atctgcttcagt

SEQ ID NO: 2579276 - DNA, 22 bp, Homo sapiens
atctggaccccatctgtgaata

SEQ ID NO: 2579277 - DNA, 22 bp, Homo sapiens
atctggactcctctgtccaggc

SEQ ID NO: 2579278 - DNA, 20 bp, Homo sapiens
atctggagagctagaacctg

SEQ ID NO: 2579279 - DNA, 17 bp, Homo sapiens
atctggataggagcctg

SEQ ID NO: 2579280 - DNA, 18 bp, Homo sapiens
atctggataggagcctgc

SEQ ID NO: 2579281 - DNA, 22 bp, Homo sapiens
atctggataggagcctgctggt

SEQ ID NO: 2579282 - DNA, 22 bp, Homo sapiens
atctgggaaaataccccatcat

SEQ ID NO: 2579283 - DNA, 14 bp, Homo sapiens
atctgggaaagaca

SEQ ID NO: 2579284 - DNA, 22 bp, Homo sapiens
atctgggattcccaccaaggtc

SEQ ID NO: 2579285 - DNA, 18 bp, Homo sapiens
atctgggcatagatgcag

SEQ ID NO: 2579286 - DNA, 16 bp, Homo sapiens
atctggggctctggga

SEQ ID NO: 2579287 - DNA, 16 bp, Homo sapiens
atctgggggagtggaa

SEQ ID NO: 2579288 - DNA, 14 bp, Homo sapiens
atctgggtccttgc

SEQ ID NO: 2579289 - DNA, 18 bp, Homo sapiens
atctgggtccttgcaccc

SEQ ID NO: 2579290 - DNA, 21 bp, Homo sapiens
atctgggtgcatgatcttgag

SEQ ID NO: 2579291 - DNA, 16 bp, Homo sapiens
atctggtgactttcct

SEQ ID NO: 2579292 - DNA, 14 bp, Homo sapiens
atctgtaaactgtg

SEQ ID NO: 2579293 - DNA, 15 bp, Homo sapiens
atctgtacaatgaac

SEQ ID NO: 2579294 - DNA, 17 bp, Homo sapiens
atctgtacttcttcgat

SEQ ID NO: 2579295 - DNA, 17 bp, Homo sapiens
atctgtagggctggacc

SEQ ID NO: 2579296 - DNA, 20 bp, Homo sapiens
atctgtatatacaataacat

SEQ ID NO: 2579297 - DNA, 14 bp, Homo sapiens
atctgtatctctct

SEQ ID NO: 2579298 - DNA, 15 bp, Homo sapiens
atctgtatttaattt

SEQ ID NO: 2579299 - DNA, 17 bp, Homo sapiens
atctgtcacaccagcca

SEQ ID NO: 2579300 - DNA, 21 bp, Homo sapiens
atctgtccaaaggaggctggc

SEQ ID NO: 2579301 - DNA, 14 bp, Homo sapiens
atctgtccaaggaa

SEQ ID NO: 2579302 - DNA, 16 bp, Homo sapiens
atctgtccctgcctca

SEQ ID NO: 2579303 - DNA, 21 bp, Homo sapiens
atctgtgaaatgctggcattt

SEQ ID NO: 2579304 - DNA, 13 bp, Homo sapiens
atctgtgaataag

SEQ ID NO: 2579305 - DNA, 17 bp, Homo sapiens
atctgtgaattcagatt

SEQ ID NO: 2579306 - DNA, 22 bp, Homo sapiens
atctgtgcaaatccttgatact

SEQ ID NO: 2579307 - DNA, 15 bp, Homo sapiens
atctgtgccccatgc

SEQ ID NO: 2579308 - DNA, 16 bp, Homo sapiens
atctgtgcgtgaaaca

SEQ ID NO: 2579309 - DNA, 19 bp, Homo sapiens
atctgtgcgtgaaacacac

SEQ ID NO: 2579310 - DNA, 15 bp, Homo sapiens
atctgtgctttccag

SEQ ID NO: 2579311 - DNA, 16 bp, Homo sapiens
atctgtgtacaaagaa

SEQ ID NO: 2579312 - DNA, 12 bp, Homo sapiens
atctgtgtcttg

SEQ ID NO: 2579313 - DNA, 13 bp, Homo sapiens
atctgtgtcttgt

SEQ ID NO: 2579314 - DNA, 14 bp, Homo sapiens
atctgtgtcttgtt

SEQ ID NO: 2579315 - DNA, 15 bp, Homo sapiens
atctgtgtcttgttt

SEQ ID NO: 2579316 - DNA, 17 bp, Homo sapiens
atctgtgtgaaaatggg

SEQ ID NO: 2579317 - DNA, 18 bp, Homo sapiens
atctgttgcaaactcagc

SEQ ID NO: 2579318 - DNA, 16 bp, Homo sapiens
atcttaaggggcagct

SEQ ID NO: 2579319 - DNA, 18 bp, Homo sapiens
atcttaattttggttgta

SEQ ID NO: 2579320 - DNA, 16 bp, Homo sapiens
atcttagtatttgcat

SEQ ID NO: 2579321 - DNA, 21 bp, Homo sapiens
atcttagtgcctgagagtatt

SEQ ID NO: 2579322 - DNA, 14 bp, Homo sapiens
atcttagtttggat

SEQ ID NO: 2579323 - DNA, 22 bp, Homo sapiens
atcttagtttggattcttatgt

SEQ ID NO: 2579324 - DNA, 23 bp, Homo sapiens
atcttattttcatgtatatgtgt

SEQ ID NO: 2579325 - DNA, 15 bp, Homo sapiens
atcttcaatggcttt

SEQ ID NO: 2579326 - DNA, 21 bp, Homo sapiens
atcttcaccagaggaatcact

SEQ ID NO: 2579327 - DNA, 15 bp, Homo sapiens
atcttcagcttcttc

SEQ ID NO: 2579328 - DNA, 19 bp, Homo sapiens
atcttccaactcaaactct

SEQ ID NO: 2579329 - DNA, 21 bp, Homo sapiens
atcttccctagagggttcctg

SEQ ID NO: 2579330 - DNA, 16 bp, Homo sapiens
atcttctgccttctca

SEQ ID NO: 2579331 - DNA, 18 bp, Homo sapiens
atcttctggagtctccag

SEQ ID NO: 2579332 - DNA, 17 bp, Homo sapiens
atcttctttataattct

SEQ ID NO: 2579333 - DNA, 17 bp, Homo sapiens
atcttgacattcaaggc

SEQ ID NO: 2579334 - DNA, 17 bp, Homo sapiens
atcttgaccaagcagga

SEQ ID NO: 2579335 - DNA, 23 bp, Homo sapiens
atcttgaccaagcaggaagctca

SEQ ID NO: 2579336 - DNA, 21 bp, Homo sapiens
atcttgataccacctatatag

SEQ ID NO: 2579337 - DNA, 15 bp, Homo sapiens
atcttgctctgtaat

SEQ ID NO: 2579338 - DNA, 22 bp, Homo sapiens
atcttgctctgtaatctcgttt

SEQ ID NO: 2579339 - DNA, 23 bp, Homo sapiens
atcttgctttttttcaccaatat

SEQ ID NO: 2579340 - DNA, 21 bp, Homo sapiens
atcttggactgacatttagcg

SEQ ID NO: 2579341 - DNA, 22 bp, Homo sapiens
atcttggggacatctctttgaa

SEQ ID NO: 2579342 - DNA, 23 bp, Homo sapiens
atcttggggacatctctttgaat

SEQ ID NO: 2579343 - DNA, 15 bp, Homo sapiens
atctttaaaatacac

SEQ ID NO: 2579344 - DNA, 11 bp, Homo sapiens
atctttcctgt

SEQ ID NO: 2579345 - DNA, 12 bp, Homo sapiens
atctttcctgtc

SEQ ID NO: 2579346 - DNA, 17 bp, Homo sapiens
atctttcgcacagcagt

SEQ ID NO: 2579347 - DNA, 18 bp, Homo sapiens
atctttcgcacagcagtt

SEQ ID NO: 2579348 - DNA, 19 bp, Homo sapiens
atctttcttctattttatt

SEQ ID NO: 2579349 - DNA, 22 bp, Homo sapiens
atctttcttctattttattccc

SEQ ID NO: 2579350 - DNA, 17 bp, Homo sapiens
atctttgcagacaggca

SEQ ID NO: 2579351 - DNA, 18 bp, Homo sapiens
atctttgcagacaggcaa

SEQ ID NO: 2579352 - DNA, 14 bp, Homo sapiens
atctttgccaccct

SEQ ID NO: 2579353 - DNA, 20 bp, Homo sapiens
atctttgccttgggctgctc

SEQ ID NO: 2579354 - DNA, 13 bp, Homo sapiens
atcttttctattt

SEQ ID NO: 2579355 - DNA, 13 bp, Homo sapiens
atctttttctaac

SEQ ID NO: 2579356 - DNA, 23 bp, Homo sapiens
atcttttttagcataaaattttc

SEQ ID NO: 2579357 - DNA, 20 bp, Homo sapiens
atcttttttttattccacat

SEQ ID NO: 2579358 - DNA, 20 bp, Homo sapiens
atgaaaaacaaaaataacat

SEQ ID NO: 2579359 - DNA, 13 bp, Homo sapiens
atgaaaaattctc

SEQ ID NO: 2579360 - DNA, 19 bp, Homo sapiens
atgaaaaatttaagcattg

SEQ ID NO: 2579361 - DNA, 22 bp, Homo sapiens
atgaaaaatttaagcattgttt

SEQ ID NO: 2579362 - DNA, 14 bp, Homo sapiens
atgaaaacacattt

SEQ ID NO: 2579363 - DNA, 18 bp, Homo sapiens
atgaaaacgttttattgt

SEQ ID NO: 2579364 - DNA, 12 bp, Homo sapiens
atgaaaactcat

SEQ ID NO: 2579365 - DNA, 20 bp, Homo sapiens
atgaaaatgcaacaacatgt

SEQ ID NO: 2579366 - DNA, 15 bp, Homo sapiens
atgaaaatgtcagaa

SEQ ID NO: 2579367 - DNA, 14 bp, Homo sapiens
atgaaaatgtcttg

SEQ ID NO: 2579368 - DNA, 16 bp, Homo sapiens
atgaaaatgtcttgtg

SEQ ID NO: 2579369 - DNA, 18 bp, Homo sapiens
atgaaacccccacacaca

SEQ ID NO: 2579370 - DNA, 16 bp, Homo sapiens
atgaaagactgtacaa

SEQ ID NO: 2579371 - DNA, 20 bp, Homo sapiens
atgaaagactgtacaaagta

SEQ ID NO: 2579372 - DNA, 19 bp, Homo sapiens
atgaaagatggctgtgcct

SEQ ID NO: 2579373 - DNA, 15 bp, Homo sapiens
atgaaagcagggact

SEQ ID NO: 2579374 - DNA, 18 bp, Homo sapiens
atgaaagcatgtggcatg

SEQ ID NO: 2579375 - DNA, 22 bp, Homo sapiens
atgaaagctcctcgagggcagg

SEQ ID NO: 2579376 - DNA, 18 bp, Homo sapiens
atgaaagggcccagagag

SEQ ID NO: 2579377 - DNA, 19 bp, Homo sapiens
atgaaagggcccagagagg

SEQ ID NO: 2579378 - DNA, 14 bp, Homo sapiens
atgaaataaagaaa

SEQ ID NO: 2579379 - DNA, 22 bp, Homo sapiens
atgaaataactccttcttgtag

SEQ ID NO: 2579380 - DNA, 15 bp, Homo sapiens
atgaaatatctgtat

SEQ ID NO: 2579381 - DNA, 17 bp, Homo sapiens
atgaaatttaatatagc

SEQ ID NO: 2579382 - DNA, 21 bp, Homo sapiens
atgaaatttaatatagctatt

SEQ ID NO: 2579383 - DNA, 20 bp, Homo sapiens
atgaaattttccaatgtctg

SEQ ID NO: 2579384 - DNA, 22 bp, Homo sapiens
atgaaattttctagactttctg

SEQ ID NO: 2579385 - DNA, 16 bp, Homo sapiens
atgaacacttaataaa

SEQ ID NO: 2579386 - DNA, 13 bp, Homo sapiens
atgaacctggagg

SEQ ID NO: 2579387 - DNA, 21 bp, Homo sapiens
atgaaccttctggcctcccac

SEQ ID NO: 2579388 - DNA, 15 bp, Homo sapiens
atgaacggtgagcat

SEQ ID NO: 2579389 - DNA, 14 bp, Homo sapiens
atgaactcaacttt

SEQ ID NO: 2579390 - DNA, 16 bp, Homo sapiens
atgaactcttaatcaa

SEQ ID NO: 2579391 - DNA, 20 bp, Homo sapiens
atgaactcttagaaatgaag

SEQ ID NO: 2579392 - DNA, 15 bp, Homo sapiens
atgaactgaagtttc

SEQ ID NO: 2579393 - DNA, 17 bp, Homo sapiens
atgaactgaagtttcac

SEQ ID NO: 2579394 - DNA, 19 bp, Homo sapiens
atgaactgaagtttcacat

SEQ ID NO: 2579395 - DNA, 20 bp, Homo sapiens
atgaacttcgcatcaaaaga

SEQ ID NO: 2579396 - DNA, 16 bp, Homo sapiens
atggttttcaaaataa

SEQ ID NO: 2579397 - DNA, 21 bp, Homo sapiens
atgtaaaagagtcatctggta

SEQ ID NO: 2579398 - DNA, 23 bp, Homo sapiens
atgtaaaaggccaaacctctgtt

SEQ ID NO: 2579399 - DNA, 17 bp, Homo sapiens
atgtaaaatgttgaata

SEQ ID NO: 2579400 - DNA, 13 bp, Homo sapiens
atgtaaaatgttt

SEQ ID NO: 2579401 - DNA, 16 bp, Homo sapiens
atgtaaagtgatattt

SEQ ID NO: 2579402 - DNA, 13 bp, Homo sapiens
atgtaacagaaag

SEQ ID NO: 2579403 - DNA, 21 bp, Homo sapiens
atgtaacagccaggagtgtta

SEQ ID NO: 2579404 - DNA, 18 bp, Homo sapiens
atgtaacttttgtaagac

SEQ ID NO: 2579405 - DNA, 17 bp, Homo sapiens
atgtaagctctactgag

SEQ ID NO: 2579406 - DNA, 17 bp, Homo sapiens
atgtaagctgaaaatat

SEQ ID NO: 2579407 - DNA, 15 bp, Homo sapiens
atgtaagctgtttat

SEQ ID NO: 2579408 - DNA, 21 bp, Homo sapiens
atgtaagggaaactgccagca

SEQ ID NO: 2579409 - DNA, 15 bp, Homo sapiens
atgtaatcaatgttt

SEQ ID NO: 2579410 - DNA, 23 bp, Homo sapiens
atgtaatctgatggcttctccag

SEQ ID NO: 2579411 - DNA, 15 bp, Homo sapiens
atgtaattgaataaa

SEQ ID NO: 2579412 - DNA, 11 bp, Homo sapiens
atgtaattgtt

SEQ ID NO: 2579413 - DNA, 14 bp, Homo sapiens
atgtacagtctgtc

SEQ ID NO: 2579414 - DNA, 16 bp, Homo sapiens
atgtacagtctgtcat

SEQ ID NO: 2579415 - DNA, 19 bp, Homo sapiens
atgtacatttctgaaatga

SEQ ID NO: 2579416 - DNA, 22 bp, Homo sapiens
atgtactctactgatatctaaa

SEQ ID NO: 2579417 - DNA, 14 bp, Homo sapiens
atgtactgagattt

SEQ ID NO: 2579418 - DNA, 18 bp, Homo sapiens
atgtactgagccttgtaa

SEQ ID NO: 2579419 - DNA, 17 bp, Homo sapiens
atgtacttgtcaaagaa

SEQ ID NO: 2579420 - DNA, 18 bp, Homo sapiens
atgtacttgtcaaagaag

SEQ ID NO: 2579421 - DNA, 19 bp, Homo sapiens
atgtagataaactcagaaa

SEQ ID NO: 2579422 - DNA, 22 bp, Homo sapiens
atgtagatattgtgaagtacat

SEQ ID NO: 2579423 - DNA, 23 bp, Homo sapiens
atgtagatattgtgaagtacata

SEQ ID NO: 2579424 - DNA, 17 bp, Homo sapiens
atgtagatgtgcatttt

SEQ ID NO: 2579425 - DNA, 17 bp, Homo sapiens
atgtagatttatttcat

SEQ ID NO: 2579426 - DNA, 14 bp, Homo sapiens
atgtaggaagtagg

SEQ ID NO: 2579427 - DNA, 17 bp, Homo sapiens
atgtaggcattctggag

SEQ ID NO: 2579428 - DNA, 16 bp, Homo sapiens
atgtagtaagtaaatt

SEQ ID NO: 2579429 - DNA, 17 bp, Homo sapiens
atgtagtataaagaaaa

SEQ ID NO: 2579430 - DNA, 19 bp, Homo sapiens
atgtagtataaagaaaagt

SEQ ID NO: 2579431 - DNA, 15 bp, Homo sapiens
atgtatcaatgagta

SEQ ID NO: 2579432 - DNA, 13 bp, Homo sapiens
atgtatcaggaaa

SEQ ID NO: 2579433 - DNA, 16 bp, Homo sapiens
atgtatcatagaaatg

SEQ ID NO: 2579434 - DNA, 17 bp, Homo sapiens
atgtatcatagaaatgt

SEQ ID NO: 2579435 - DNA, 12 bp, Homo sapiens
atgtatcatctg

SEQ ID NO: 2579436 - DNA, 14 bp, Homo sapiens
atgtatgcagctat

SEQ ID NO: 2579437 - DNA, 17 bp, Homo sapiens
atgtatgcagctatctg

SEQ ID NO: 2579438 - DNA, 20 bp, Homo sapiens
atgtatggaatacagtgtta

SEQ ID NO: 2579439 - DNA, 21 bp, Homo sapiens
atgtatggaatacagtgttat

SEQ ID NO: 2579440 - DNA, 13 bp, Homo sapiens
atgtatgtttaca

SEQ ID NO: 2579441 - DNA, 17 bp, Homo sapiens
atgtatgtttacatatc

SEQ ID NO: 2579442 - DNA, 18 bp, Homo sapiens
atgtatgtttacatatca

SEQ ID NO: 2579443 - DNA, 17 bp, Homo sapiens
atgtattaatattcatt

SEQ ID NO: 2579444 - DNA, 20 bp, Homo sapiens
atgtattattctgcagcatg

SEQ ID NO: 2579445 - DNA, 13 bp, Homo sapiens
atgtattggcctg

SEQ ID NO: 2579446 - DNA, 16 bp, Homo sapiens
atgtatttatttaaaa

SEQ ID NO: 2579447 - DNA, 18 bp, Homo sapiens
atgtatttatttaaaaga

SEQ ID NO: 2579448 - DNA, 17 bp, Homo sapiens
atgtatttttgtaccct

SEQ ID NO: 2579449 - DNA, 20 bp, Homo sapiens
atgtcaaagagaaaacttat

SEQ ID NO: 2579450 - DNA, 17 bp, Homo sapiens
atgtcaactgacctaaa

SEQ ID NO: 2579451 - DNA, 18 bp, Homo sapiens
atgtcaacttctggctcc

SEQ ID NO: 2579452 - DNA, 19 bp, Homo sapiens
atgtcaacttctggctcct

SEQ ID NO: 2579453 - DNA, 23 bp, Homo sapiens
atgtcaccgtggaccttcctgcc

SEQ ID NO: 2579454 - DNA, 16 bp, Homo sapiens
atgtcactgtggtcct

SEQ ID NO: 2579455 - DNA, 14 bp, Homo sapiens
atgtcagatacaat

SEQ ID NO: 2579456 - DNA, 16 bp, Homo sapiens
atgtcagatacaatgt

SEQ ID NO: 2579457 - DNA, 17 bp, Homo sapiens
atgtcaggaacagaagg

SEQ ID NO: 2579458 - DNA, 19 bp, Homo sapiens
atgtcaggaacagaaggat

SEQ ID NO: 2579459 - DNA, 20 bp, Homo sapiens
atgtcaggaacagaaggatg

SEQ ID NO: 2579460 - DNA, 17 bp, Homo sapiens
atgtcagtaccttcaaa

SEQ ID NO: 2579461 - DNA, 14 bp, Homo sapiens
atgtcagtatgtgg

SEQ ID NO: 2579462 - DNA, 17 bp, Homo sapiens
atgtcatatattactag

SEQ ID NO: 2579463 - DNA, 17 bp, Homo sapiens
atgtcattaaaataaat

SEQ ID NO: 2579464 - DNA, 13 bp, Homo sapiens
atgtcatttcctt

SEQ ID NO: 2579465 - DNA, 16 bp, Homo sapiens
atgtccaagaagccca

SEQ ID NO: 2579466 - DNA, 18 bp, Homo sapiens
atgtccaagaagcccagg

SEQ ID NO: 2579467 - DNA, 16 bp, Homo sapiens
atgtccactgtgtata

SEQ ID NO: 2579468 - DNA, 21 bp, Homo sapiens
atgtccagaagaatattcagg

SEQ ID NO: 2579469 - DNA, 19 bp, Homo sapiens
atgtccccaaacctgcaag

SEQ ID NO: 2579470 - DNA, 14 bp, Homo sapiens
atgtcccttctcat

SEQ ID NO: 2579471 - DNA, 15 bp, Homo sapiens
atgtcctcaccacat

SEQ ID NO: 2579472 - DNA, 17 bp, Homo sapiens
atgtcctcaccacatgc

SEQ ID NO: 2579473 - DNA, 17 bp, Homo sapiens
atgtcctccttgttcta

SEQ ID NO: 2579474 - DNA, 19 bp, Homo sapiens
atgtcgtgaccaactagac

SEQ ID NO: 2579475 - DNA, 22 bp, Homo sapiens
atgtcgtgaccaactagacatt

SEQ ID NO: 2579476 - DNA, 19 bp, Homo sapiens
atgtctaaatgctgaaaaa

SEQ ID NO: 2579477 - DNA, 12 bp, Homo sapiens
atgtctatttaa

SEQ ID NO: 2579478 - DNA, 13 bp, Homo sapiens
atgtctatttaag

SEQ ID NO: 2579479 - DNA, 15 bp, Homo sapiens
atgtctatttaagcc

SEQ ID NO: 2579480 - DNA, 23 bp, Homo sapiens
atgtctatttaagcctcatattt

SEQ ID NO: 2579481 - DNA, 17 bp, Homo sapiens
atgtctcaggtccctgc

SEQ ID NO: 2579482 - DNA, 15 bp, Homo sapiens
atgtctcgtggtagg

SEQ ID NO: 2579483 - DNA, 17 bp, Homo sapiens
atgtctgaactctccag

SEQ ID NO: 2579484 - DNA, 15 bp, Homo sapiens
atgtctgccacacaa

SEQ ID NO: 2579485 - DNA, 19 bp, Homo sapiens
atgtctgtagctcctcaac

SEQ ID NO: 2579486 - DNA, 16 bp, Homo sapiens
atgtctgttgatgact

SEQ ID NO: 2579487 - DNA, 22 bp, Homo sapiens
atgtcttcatacctacatgtat

SEQ ID NO: 2579488 - DNA, 17 bp, Homo sapiens
atgtcttcatttcattg

SEQ ID NO: 2579489 - DNA, 18 bp, Homo sapiens
atgtcttcatttcattgt

SEQ ID NO: 2579490 - DNA, 20 bp, Homo sapiens
atgtcttcatttcattgtat

SEQ ID NO: 2579491 - DNA, 20 bp, Homo sapiens
atgtcttcgtacagttcttc

SEQ ID NO: 2579492 - DNA, 20 bp, Homo sapiens
atgtcttctgtattcactta

SEQ ID NO: 2579493 - DNA, 13 bp, Homo sapiens
atgtcttggacac

SEQ ID NO: 2579494 - DNA, 16 bp, Homo sapiens
atgtcttggacactgt

SEQ ID NO: 2579495 - DNA, 11 bp, Homo sapiens
atgtcttgtgt

SEQ ID NO: 2579496 - DNA, 15 bp, Homo sapiens
atgtcttttgaatat

SEQ ID NO: 2579497 - DNA, 16 bp, Homo sapiens
atgtctttttaagctt

SEQ ID NO: 2579498 - DNA, 22 bp, Homo sapiens
atgtcttttttttaatgtgctg

SEQ ID NO: 2579499 - DNA, 13 bp, Homo sapiens
atgtgaaaccttt

SEQ ID NO: 2579500 - DNA, 15 bp, Homo sapiens
atgtgaaaccttttt

SEQ ID NO: 2579501 - DNA, 18 bp, Homo sapiens
atgtgaaaccttttttaa

SEQ ID NO: 2579502 - DNA, 19 bp, Homo sapiens
atgtgaaaccttttttaag

SEQ ID NO: 2579503 - DNA, 22 bp, Homo sapiens
atgtgaaaccttttttaagatt

SEQ ID NO: 2579504 - DNA, 12 bp, Homo sapiens
atgtgaaagcac

SEQ ID NO: 2579505 - DNA, 15 bp, Homo sapiens
atgtgaacacatcag

SEQ ID NO: 2579506 - DNA, 13 bp, Homo sapiens
atgtgaagtgtta

SEQ ID NO: 2579507 - DNA, 19 bp, Homo sapiens
atgtgaagtgttaatacta

SEQ ID NO: 2579508 - DNA, 20 bp, Homo sapiens
atgtgacaattttgtacaaa

SEQ ID NO: 2579509 - DNA, 21 bp, Homo sapiens
atgtgacaattttgtacaaat

SEQ ID NO: 2579510 - DNA, 12 bp, Homo sapiens
atgtgactctga

SEQ ID NO: 2579511 - DNA, 13 bp, Homo sapiens
atgtgactctgaa

SEQ ID NO: 2579512 - DNA, 21 bp, Homo sapiens
atgtgatacccatagcttcca

SEQ ID NO: 2579513 - DNA, 16 bp, Homo sapiens
atgtgatccttttatg

SEQ ID NO: 2579514 - DNA, 18 bp, Homo sapiens
atgtgatccttttatgtt

SEQ ID NO: 2579515 - DNA, 19 bp, Homo sapiens
atgtgatgaatactgtatt

SEQ ID NO: 2579516 - DNA, 20 bp, Homo sapiens
atgtgatttaatagtgttaa

SEQ ID NO: 2579517 - DNA, 20 bp, Homo sapiens
atgtgattttaactctgtct

SEQ ID NO: 2579518 - DNA, 16 bp, Homo sapiens
atgtgcaagtgtatgc

SEQ ID NO: 2579519 - DNA, 22 bp, Homo sapiens
atgtgcacccatgggctctgac

SEQ ID NO: 2579520 - DNA, 19 bp, Homo sapiens
atgtgcaggtttgttacat

SEQ ID NO: 2579521 - DNA, 23 bp, Homo sapiens
atgtgcagtgtagcccacacttg

SEQ ID NO: 2579522 - DNA, 13 bp, Homo sapiens
atgtgccaaggtg

SEQ ID NO: 2579523 - DNA, 17 bp, Homo sapiens
atgtgccgaatgtgcag

SEQ ID NO: 2579524 - DNA, 21 bp, Homo sapiens
atgtgccgtgttattgtatta

SEQ ID NO: 2579525 - DNA, 15 bp, Homo sapiens
atgtgcgtgtgtgca

SEQ ID NO: 2579526 - DNA, 18 bp, Homo sapiens
atgtgcgtgtgtgcaagt

SEQ ID NO: 2579527 - DNA, 20 bp, Homo sapiens
atgtgcgtgtgtgcaagtgt

SEQ ID NO: 2579528 - DNA, 14 bp, Homo sapiens
atgtgctactgatt

SEQ ID NO: 2579529 - DNA, 20 bp, Homo sapiens
atgtgctactgattgtttca

SEQ ID NO: 2579530 - DNA, 18 bp, Homo sapiens
atgtgctatactgcatac

SEQ ID NO: 2579531 - DNA, 13 bp, Homo sapiens
atgtgctgtgtaa

SEQ ID NO: 2579532 - DNA, 14 bp, Homo sapiens
atgtgctgtgtaaa

SEQ ID NO: 2579533 - DNA, 18 bp, Homo sapiens
atgtgctgtgtaaagtta

SEQ ID NO: 2579534 - DNA, 15 bp, Homo sapiens
atgtggaaagtgaat

SEQ ID NO: 2579535 - DNA, 16 bp, Homo sapiens
atgtggaaagtgaatt

SEQ ID NO: 2579536 - DNA, 15 bp, Homo sapiens
atgtggaagtgtggg

SEQ ID NO: 2579537 - DNA, 17 bp, Homo sapiens
atgtggctgcagcagcg

SEQ ID NO: 2579538 - DNA, 11 bp, Homo sapiens
atgtgggaggg

SEQ ID NO: 2579539 - DNA, 16 bp, Homo sapiens
atgtgggggtctgtgt

SEQ ID NO: 2579540 - DNA, 18 bp, Homo sapiens
atgtgggggtctgtgtgt

SEQ ID NO: 2579541 - DNA, 15 bp, Homo sapiens
atttctactgtgact

SEQ ID NO: 2579542 - DNA, 17 bp, Homo sapiens
atttctactgtgactga

SEQ ID NO: 2579543 - DNA, 18 bp, Homo sapiens
atttctactgtgactgat

SEQ ID NO: 2579544 - DNA, 21 bp, Homo sapiens
atttctagaacatccctgcca

SEQ ID NO: 2579545 - DNA, 15 bp, Homo sapiens
atttctaggaagaat

SEQ ID NO: 2579546 - DNA, 16 bp, Homo sapiens
atttctatttatttac

SEQ ID NO: 2579547 - DNA, 17 bp, Homo sapiens
atttctatttatttact

SEQ ID NO: 2579548 - DNA, 14 bp, Homo sapiens
atttctcactgaga

SEQ ID NO: 2579549 - DNA, 12 bp, Homo sapiens
atttctccccag

SEQ ID NO: 2579550 - DNA, 15 bp, Homo sapiens
atttctcctttgata

SEQ ID NO: 2579551 - DNA, 18 bp, Homo sapiens
atttctcttactgcaaat

SEQ ID NO: 2579552 - DNA, 18 bp, Homo sapiens
atttctgaagtggactct

SEQ ID NO: 2579553 - DNA, 16 bp, Homo sapiens
atttctgtgggagaat

SEQ ID NO: 2579554 - DNA, 21 bp, Homo sapiens
atttctgtttagataatacac

SEQ ID NO: 2579555 - DNA, 17 bp, Homo sapiens
atttcttgggccctcct

SEQ ID NO: 2579556 - DNA, 18 bp, Homo sapiens
atttcttgggccctcctg

SEQ ID NO: 2579557 - DNA, 19 bp, Homo sapiens
atttcttggtaagaagccg

SEQ ID NO: 2579558 - DNA, 21 bp, Homo sapiens
atttctttgcctgttcagtta

SEQ ID NO: 2579559 - DNA, 23 bp, Homo sapiens
atttctttgcctgttcagttaca

SEQ ID NO: 2579560 - DNA, 20 bp, Homo sapiens
atttcttttgccgttattaa

SEQ ID NO: 2579561 - DNA, 17 bp, Homo sapiens
atttgaaaataattgtt

SEQ ID NO: 2579562 - DNA, 18 bp, Homo sapiens
atttgaaaataattgttc

SEQ ID NO: 2579563 - DNA, 14 bp, Homo sapiens
atttgaaaattttg

SEQ ID NO: 2579564 - DNA, 14 bp, Homo sapiens
atttgaaagaaagg

SEQ ID NO: 2579565 - DNA, 15 bp, Homo sapiens
atttgaaatttagct

SEQ ID NO: 2579566 - DNA, 23 bp, Homo sapiens
atttgaaggtctgcaagaacctg

SEQ ID NO: 2579567 - DNA, 11 bp, Homo sapiens
atttgaatgaa

SEQ ID NO: 2579568 - DNA, 15 bp, Homo sapiens
atttgaatgaaaaat

SEQ ID NO: 2579569 - DNA, 18 bp, Homo sapiens
atttgaatgggtccattt

SEQ ID NO: 2579570 - DNA, 14 bp, Homo sapiens
atttgactgaagat

SEQ ID NO: 2579571 - DNA, 16 bp, Homo sapiens
atttgagaaatgcata

SEQ ID NO: 2579572 - DNA, 17 bp, Homo sapiens
atttgagaaatgcatat

SEQ ID NO: 2579573 - DNA, 14 bp, Homo sapiens
atttgagaatataa

SEQ ID NO: 2579574 - DNA, 18 bp, Homo sapiens
atttgagagaaatatgaa

SEQ ID NO: 2579575 - DNA, 21 bp, Homo sapiens
atttgagatgtatttcaactt

SEQ ID NO: 2579576 - DNA, 18 bp, Homo sapiens
atttgaggtctgttcttt

SEQ ID NO: 2579577 - DNA, 23 bp, Homo sapiens
atttgaggtctgttctttccaaa

SEQ ID NO: 2579578 - DNA, 19 bp, Homo sapiens
atttgagtgttttaagata

SEQ ID NO: 2579579 - DNA, 20 bp, Homo sapiens
atttgatagtattgtgcata

SEQ ID NO: 2579580 - DNA, 13 bp, Homo sapiens
atttgatttctat

SEQ ID NO: 2579581 - DNA, 19 bp, Homo sapiens
atttgcagagacaggacct

SEQ ID NO: 2579582 - DNA, 22 bp, Homo sapiens
atttgcagagacaggacctgac

SEQ ID NO: 2579583 - DNA, 21 bp, Homo sapiens
atttgcataacaattcctcta

SEQ ID NO: 2579584 - DNA, 15 bp, Homo sapiens
atttgcatatgtatg

SEQ ID NO: 2579585 - DNA, 21 bp, Homo sapiens
atttgcatggctccagaaatg

SEQ ID NO: 2579586 - DNA, 21 bp, Homo sapiens
atttgcctgtttctgcttgct

SEQ ID NO: 2579587 - DNA, 16 bp, Homo sapiens
atttggcctgcactaa

SEQ ID NO: 2579588 - DNA, 19 bp, Homo sapiens
atttggcctgcactaattt

SEQ ID NO: 2579589 - DNA, 21 bp, Homo sapiens
atttggggtagctagaggaac

SEQ ID NO: 2579590 - DNA, 21 bp, Homo sapiens
atttggtaaattagtatttat

SEQ ID NO: 2579591 - DNA, 17 bp, Homo sapiens
atttggtggtttcagaa

SEQ ID NO: 2579592 - DNA, 21 bp, Homo sapiens
atttggtggtttcagaaatgt

SEQ ID NO: 2579593 - DNA, 22 bp, Homo sapiens
atttggtttggccatctctgga

SEQ ID NO: 2579594 - DNA, 22 bp, Homo sapiens
atttgtaaaaacagcattgctt

SEQ ID NO: 2579595 - DNA, 23 bp, Homo sapiens
atttgtaaaagaacagtaaacat

SEQ ID NO: 2579596 - DNA, 18 bp, Homo sapiens
atttgtaaatttatgtga

SEQ ID NO: 2579597 - DNA, 17 bp, Homo sapiens
atttgtaacctcagctc

SEQ ID NO: 2579598 - DNA, 19 bp, Homo sapiens
atttgtaacctcagctctg

SEQ ID NO: 2579599 - DNA, 19 bp, Homo sapiens
atttgtacatatgtaaaat

SEQ ID NO: 2579600 - DNA, 15 bp, Homo sapiens
atttgtatcacaaat

SEQ ID NO: 2579601 - DNA, 19 bp, Homo sapiens
atttgtatctctgaagcat

SEQ ID NO: 2579602 - DNA, 21 bp, Homo sapiens
atttgtatctctgaagcatgt

SEQ ID NO: 2579603 - DNA, 22 bp, Homo sapiens
atttgtatctctgaagcatgtt

SEQ ID NO: 2579604 - DNA, 13 bp, Homo sapiens
atttgtcaacaaa

SEQ ID NO: 2579605 - DNA, 20 bp, Homo sapiens
atttgtgaactcagccaagc

SEQ ID NO: 2579606 - DNA, 18 bp, Homo sapiens
atttgtgactaattgtat

SEQ ID NO: 2579607 - DNA, 19 bp, Homo sapiens
atttgtgactaattgtata

SEQ ID NO: 2579608 - DNA, 22 bp, Homo sapiens
atttgtgactaattgtataaca

SEQ ID NO: 2579609 - DNA, 20 bp, Homo sapiens
atttgtgatacaatgctgtg

SEQ ID NO: 2579610 - DNA, 13 bp, Homo sapiens
atttgtgttttaa

SEQ ID NO: 2579611 - DNA, 15 bp, Homo sapiens
atttgttaaatattt

SEQ ID NO: 2579612 - DNA, 12 bp, Homo sapiens
atttgttaatgg

SEQ ID NO: 2579613 - DNA, 14 bp, Homo sapiens
atttgttataatga

SEQ ID NO: 2579614 - DNA, 13 bp, Homo sapiens
atttgtttaaaag

SEQ ID NO: 2579615 - DNA, 14 bp, Homo sapiens
atttgtttaaaagg

SEQ ID NO: 2579616 - DNA, 13 bp, Homo sapiens
atttgtttgaact

SEQ ID NO: 2579617 - DNA, 16 bp, Homo sapiens
atttgtttgaactgat

SEQ ID NO: 2579618 - DNA, 23 bp, Homo sapiens
atttgtttgaactgataaagatg

SEQ ID NO: 2579619 - DNA, 23 bp, Homo sapiens
attttaaaaatgttaaaatgtat

SEQ ID NO: 2579620 - DNA, 17 bp, Homo sapiens
attttaaacaaaataga

SEQ ID NO: 2579621 - DNA, 22 bp, Homo sapiens
attttaaacaaaggttgagatg

SEQ ID NO: 2579622 - DNA, 16 bp, Homo sapiens
attttaaataaaagaa

SEQ ID NO: 2579623 - DNA, 16 bp, Homo sapiens
attttaaattcacaat

SEQ ID NO: 2579624 - DNA, 14 bp, Homo sapiens
attttaacaataac

SEQ ID NO: 2579625 - DNA, 22 bp, Homo sapiens
attttaacaataactactgtgt

SEQ ID NO: 2579626 - DNA, 19 bp, Homo sapiens
attttaagacgtgtttgtg

SEQ ID NO: 2579627 - DNA, 14 bp, Homo sapiens
attttaagtgcttt

SEQ ID NO: 2579628 - DNA, 13 bp, Homo sapiens
attttaatctaat

SEQ ID NO: 2579629 - DNA, 18 bp, Homo sapiens
attttaattatcttttct

SEQ ID NO: 2579630 - DNA, 12 bp, Homo sapiens
attttaatttat

SEQ ID NO: 2579631 - DNA, 21 bp, Homo sapiens
attttacaattgaaatgacta

SEQ ID NO: 2579632 - DNA, 17 bp, Homo sapiens
attttactactgtggaa

SEQ ID NO: 2579633 - DNA, 17 bp, Homo sapiens
attttactttttcctgg

SEQ ID NO: 2579634 - DNA, 15 bp, Homo sapiens
attttaggtgttgat

SEQ ID NO: 2579635 - DNA, 23 bp, Homo sapiens
attttaggtgttgattttctgtt

SEQ ID NO: 2579636 - DNA, 23 bp, Homo sapiens
attttagtcacacgtggtctttc

SEQ ID NO: 2579637 - DNA, 15 bp, Homo sapiens
attttagtcactttt

SEQ ID NO: 2579638 - DNA, 19 bp, Homo sapiens
attttagtttctgttctgt

SEQ ID NO: 2579639 - DNA, 15 bp, Homo sapiens
attttataaatcgct

SEQ ID NO: 2579640 - DNA, 15 bp, Homo sapiens
attttatacattaac

SEQ ID NO: 2579641 - DNA, 21 bp, Homo sapiens
attttatatcaatttaaaaaa

SEQ ID NO: 2579642 - DNA, 18 bp, Homo sapiens
attttatattaaaataag

SEQ ID NO: 2579643 - DNA, 21 bp, Homo sapiens
attttatgaaaggtttacatt

SEQ ID NO: 2579644 - DNA, 17 bp, Homo sapiens
attttatgctttaaaca

SEQ ID NO: 2579645 - DNA, 19 bp, Homo sapiens
attttatggctcactatga

SEQ ID NO: 2579646 - DNA, 14 bp, Homo sapiens
attttattatgcat

SEQ ID NO: 2579647 - DNA, 14 bp, Homo sapiens
attttattgcttga

SEQ ID NO: 2579648 - DNA, 17 bp, Homo sapiens
attttcaagaaactgag

SEQ ID NO: 2579649 - DNA, 20 bp, Homo sapiens
attttcacacaatacaataa

SEQ ID NO: 2579650 - DNA, 22 bp, Homo sapiens
attttcacattcccatctgtca

SEQ ID NO: 2579651 - DNA, 17 bp, Homo sapiens
attttcagcaaactctt

SEQ ID NO: 2579652 - DNA, 23 bp, Homo sapiens
attttcagcccatatttcatcgt

SEQ ID NO: 2579653 - DNA, 22 bp, Homo sapiens
attttcagtagggctacaaaac

SEQ ID NO: 2579654 - DNA, 11 bp, Homo sapiens
attttcagtat

SEQ ID NO: 2579655 - DNA, 14 bp, Homo sapiens
attttcagtatttt

SEQ ID NO: 2579656 - DNA, 22 bp, Homo sapiens
attttcatacagcattacaaat

SEQ ID NO: 2579657 - DNA, 14 bp, Homo sapiens
attttcattgtaaa

SEQ ID NO: 2579658 - DNA, 15 bp, Homo sapiens
attttccaagtgtgc

SEQ ID NO: 2579659 - DNA, 15 bp, Homo sapiens
attttccatgaaaat

SEQ ID NO: 2579660 - DNA, 21 bp, Homo sapiens
attttccatttttatttcaaa

SEQ ID NO: 2579661 - DNA, 14 bp, Homo sapiens
attttccccccact

SEQ ID NO: 2579662 - DNA, 21 bp, Homo sapiens
attttccccccactctcccca

SEQ ID NO: 2579663 - DNA, 20 bp, Homo sapiens
attttcccccttttctgcat

SEQ ID NO: 2579664 - DNA, 21 bp, Homo sapiens
attttcctaataaagttctgt

SEQ ID NO: 2579665 - DNA, 13 bp, Homo sapiens
attttcctcccca

SEQ ID NO: 2579666 - DNA, 20 bp, Homo sapiens
attttctattgttactctgg

SEQ ID NO: 2579667 - DNA, 17 bp, Homo sapiens
attttctcccaggaagc

SEQ ID NO: 2579668 - DNA, 19 bp, Homo sapiens
attttctggaatacatgaa

SEQ ID NO: 2579669 - DNA, 20 bp, Homo sapiens
attttctggtagatagaaat

SEQ ID NO: 2579670 - DNA, 21 bp, Homo sapiens
attttctggtagatagaaata

SEQ ID NO: 2579671 - DNA, 20 bp, Homo sapiens
attttctgtgcctgaatatt

SEQ ID NO: 2579672 - DNA, 21 bp, Homo sapiens
attttctgtgcctgaatattt

SEQ ID NO: 2579673 - DNA, 14 bp, Homo sapiens
attttcttcatgca

SEQ ID NO: 2579674 - DNA, 13 bp, Homo sapiens
attttcttttctt

SEQ ID NO: 2579675 - DNA, 20 bp, Homo sapiens
attttctttttaataaaaag

SEQ ID NO: 2579676 - DNA, 19 bp, Homo sapiens
attttgaaaaattcctatt

SEQ ID NO: 2579677 - DNA, 22 bp, Homo sapiens
attttgaaaaattcctattgtg

SEQ ID NO: 2579678 - DNA, 14 bp, Homo sapiens
attttgaatcaata

SEQ ID NO: 2579679 - DNA, 17 bp, Homo sapiens
attttgaatcaataata

SEQ ID NO: 2579680 - DNA, 19 bp, Homo sapiens
attttgacactatatctgt

SEQ ID NO: 2579681 - DNA, 22 bp, Homo sapiens
attttgagaaagtcttatttat

SEQ ID NO: 2579682 - DNA, 18 bp, Homo sapiens
attttgatccaagctggt

SEQ ID NO: 2579683 - DNA, 15 bp, Homo sapiens
attttgatgttttaa

SEQ ID NO: 2579684 - DNA, 13 bp, Homo sapiens
caagcagccaagc

SEQ ID NO: 2579685 - DNA, 22 bp, Homo sapiens
caagcagccaagctccttggga

SEQ ID NO: 2579686 - DNA, 12 bp, Homo sapiens
caagcaggaagc

SEQ ID NO: 2579687 - DNA, 14 bp, Homo sapiens
caagcaggaagctc

SEQ ID NO: 2579688 - DNA, 17 bp, Homo sapiens
caagcaggaagctcaga

SEQ ID NO: 2579689 - DNA, 14 bp, Homo sapiens
caagcaggacatgg

SEQ ID NO: 2579690 - DNA, 15 bp, Homo sapiens
caagcattctcctgt

SEQ ID NO: 2579691 - DNA, 19 bp, Homo sapiens
caagccaacgacaaagcca

SEQ ID NO: 2579692 - DNA, 18 bp, Homo sapiens
caagccaacttgtaaata

SEQ ID NO: 2579693 - DNA, 13 bp, Homo sapiens
caagccaagcagc

SEQ ID NO: 2579694 - DNA, 14 bp, Homo sapiens
caagccaatcccct

SEQ ID NO: 2579695 - DNA, 17 bp, Homo sapiens
caagcccagcactgctt

SEQ ID NO: 2579696 - DNA, 13 bp, Homo sapiens
caagccccaggca

SEQ ID NO: 2579697 - DNA, 17 bp, Homo sapiens
caagccccaggcaggct

SEQ ID NO: 2579698 - DNA, 18 bp, Homo sapiens
caagccccaggcaggctg

SEQ ID NO: 2579699 - DNA, 14 bp, Homo sapiens
caagcccccccttc

SEQ ID NO: 2579700 - DNA, 16 bp, Homo sapiens
caagcccccccttcca

SEQ ID NO: 2579701 - DNA, 17 bp, Homo sapiens
caagcccccccttccac

SEQ ID NO: 2579702 - DNA, 21 bp, Homo sapiens
caagcccctgctccagaagat

SEQ ID NO: 2579703 - DNA, 17 bp, Homo sapiens
caagccttggctctacc

SEQ ID NO: 2579704 - DNA, 17 bp, Homo sapiens
caagcgattcttctgct

SEQ ID NO: 2579705 - DNA, 17 bp, Homo sapiens
caagcgtgagccactgc

SEQ ID NO: 2579706 - DNA, 17 bp, Homo sapiens
caagctagaacctggag

SEQ ID NO: 2579707 - DNA, 15 bp, Homo sapiens
caagctatcctggct

SEQ ID NO: 2579708 - DNA, 16 bp, Homo sapiens
caagctatcctggctc

SEQ ID NO: 2579709 - DNA, 15 bp, Homo sapiens
caagctcagaaggct

SEQ ID NO: 2579710 - DNA, 17 bp, Homo sapiens
caagctccaagctccca

SEQ ID NO: 2579711 - DNA, 21 bp, Homo sapiens
caagctccaagctcccaggca

SEQ ID NO: 2579712 - DNA, 17 bp, Homo sapiens
caagctctagtgggaag

SEQ ID NO: 2579713 - DNA, 13 bp, Homo sapiens
caagctctgctcc

SEQ ID NO: 2579714 - DNA, 14 bp, Homo sapiens
caagctctgctcct

SEQ ID NO: 2579715 - DNA, 22 bp, Homo sapiens
caagctgcaccctcaggcaggt

SEQ ID NO: 2579716 - DNA, 13 bp, Homo sapiens
caagctggaagca

SEQ ID NO: 2579717 - DNA, 11 bp, Homo sapiens
caagctgggcc

SEQ ID NO: 2579718 - DNA, 12 bp, Homo sapiens
caagctgggccc

SEQ ID NO: 2579719 - DNA, 20 bp, Homo sapiens
caagctgggccccagcccac

SEQ ID NO: 2579720 - DNA, 21 bp, Homo sapiens
caagctggtcccactcagtcc

SEQ ID NO: 2579721 - DNA, 14 bp, Homo sapiens
caagctgtgagaca

SEQ ID NO: 2579722 - DNA, 22 bp, Homo sapiens
caagctgtgagacagtgggaaa

SEQ ID NO: 2579723 - DNA, 22 bp, Homo sapiens
caagcttcagtttcctggtctg

SEQ ID NO: 2579724 - DNA, 13 bp, Homo sapiens
caagcttctttta

SEQ ID NO: 2579725 - DNA, 13 bp, Homo sapiens
caagcttggcagc

SEQ ID NO: 2579726 - DNA, 15 bp, Homo sapiens
caaggaaaggcaaat

SEQ ID NO: 2579727 - DNA, 23 bp, Homo sapiens
caaggaaagggggtcccagtggg

SEQ ID NO: 2579728 - DNA, 17 bp, Homo sapiens
caaggaaggaaagaaag

SEQ ID NO: 2579729 - DNA, 13 bp, Homo sapiens
caaggaccaggac

SEQ ID NO: 2579730 - DNA, 16 bp, Homo sapiens
caaggaccaggactcc

SEQ ID NO: 2579731 - DNA, 20 bp, Homo sapiens
caaggaccaggactccctcc

SEQ ID NO: 2579732 - DNA, 15 bp, Homo sapiens
caaggacccctcacc

SEQ ID NO: 2579733 - DNA, 21 bp, Homo sapiens
caaggactacgttaagggaag

SEQ ID NO: 2579734 - DNA, 18 bp, Homo sapiens
caaggacttgaaagcatc

SEQ ID NO: 2579735 - DNA, 16 bp, Homo sapiens
caaggagaaacagaga

SEQ ID NO: 2579736 - DNA, 14 bp, Homo sapiens
caaggagaggaggc

SEQ ID NO: 2579737 - DNA, 19 bp, Homo sapiens
caaggagttccatgaagac

SEQ ID NO: 2579738 - DNA, 23 bp, Homo sapiens
caaggagttccatgaagaccaca

SEQ ID NO: 2579739 - DNA, 17 bp, Homo sapiens
caaggatagaagtatac

SEQ ID NO: 2579740 - DNA, 15 bp, Homo sapiens
caaggattgctactg

SEQ ID NO: 2579741 - DNA, 19 bp, Homo sapiens
caaggattgctactgtcct

SEQ ID NO: 2579742 - DNA, 20 bp, Homo sapiens
caaggattgctactgtccta

SEQ ID NO: 2579743 - DNA, 12 bp, Homo sapiens
caaggcactgcc

SEQ ID NO: 2579744 - DNA, 13 bp, Homo sapiens
caaggcactgcct

SEQ ID NO: 2579745 - DNA, 15 bp, Homo sapiens
caaggcactgcctga

SEQ ID NO: 2579746 - DNA, 20 bp, Homo sapiens
caaggcaggtgcctccaggt

SEQ ID NO: 2579747 - DNA, 23 bp, Homo sapiens
caaggcaggtgcctccaggtgtg

SEQ ID NO: 2579748 - DNA, 14 bp, Homo sapiens
caaggccagagtgg

SEQ ID NO: 2579749 - DNA, 16 bp, Homo sapiens
caaggccccagagact

SEQ ID NO: 2579750 - DNA, 17 bp, Homo sapiens
caaggccgaagctctgg

SEQ ID NO: 2579751 - DNA, 20 bp, Homo sapiens
caaggccgaagctctggctg

SEQ ID NO: 2579752 - DNA, 22 bp, Homo sapiens
caaggcgtccgcgcgccagcac

SEQ ID NO: 2579753 - DNA, 18 bp, Homo sapiens
caaggctgggggaagaag

SEQ ID NO: 2579754 - DNA, 14 bp, Homo sapiens
caaggctgttgcat

SEQ ID NO: 2579755 - DNA, 18 bp, Homo sapiens
caaggctgttgcatgggc

SEQ ID NO: 2579756 - DNA, 15 bp, Homo sapiens
caagggaaaagtctc

SEQ ID NO: 2579757 - DNA, 16 bp, Homo sapiens
caagggaaaagtctct

SEQ ID NO: 2579758 - DNA, 14 bp, Homo sapiens
caagggccatgctg

SEQ ID NO: 2579759 - DNA, 22 bp, Homo sapiens
caagggcttacacgtggaggaa

SEQ ID NO: 2579760 - DNA, 19 bp, Homo sapiens
caagggcttctgcaccctc

SEQ ID NO: 2579761 - DNA, 20 bp, Homo sapiens
caagggcttctgcaccctcc

SEQ ID NO: 2579762 - DNA, 23 bp, Homo sapiens
caagggcttctgcaccctccacc

SEQ ID NO: 2579763 - DNA, 23 bp, Homo sapiens
caaggggaatgtttgcctctgcc

SEQ ID NO: 2579764 - DNA, 15 bp, Homo sapiens
caagggggactgtct

SEQ ID NO: 2579765 - DNA, 21 bp, Homo sapiens
caagggtgatgggaaagcatt

SEQ ID NO: 2579766 - DNA, 16 bp, Homo sapiens
caagggtggcatccca

SEQ ID NO: 2579767 - DNA, 19 bp, Homo sapiens
caagggttcagagactcag

SEQ ID NO: 2579768 - DNA, 14 bp, Homo sapiens
caaggtcatttttt

SEQ ID NO: 2579769 - DNA, 14 bp, Homo sapiens
caaggtctttggtt

SEQ ID NO: 2579770 - DNA, 19 bp, Homo sapiens
caaggtggccaaattattt

SEQ ID NO: 2579771 - DNA, 19 bp, Homo sapiens
caaggtggctccagcacca

SEQ ID NO: 2579772 - DNA, 12 bp, Homo sapiens
caaggtgggagg

SEQ ID NO: 2579773 - DNA, 23 bp, Homo sapiens
caaggtgggaggattgcttgagc

SEQ ID NO: 2579774 - DNA, 16 bp, Homo sapiens
caaggtgggctgagcc

SEQ ID NO: 2579775 - DNA, 17 bp, Homo sapiens
caaggtgggctgagccc

SEQ ID NO: 2579776 - DNA, 18 bp, Homo sapiens
caaggtgggctgagccct

SEQ ID NO: 2579777 - DNA, 24 bp, Homo sapiens
caaggtgggctgagccctggcagg

SEQ ID NO: 2579778 - DNA, 15 bp, Homo sapiens
caaggttccctctga

SEQ ID NO: 2579779 - DNA, 13 bp, Homo sapiens
caagtaaacattc

SEQ ID NO: 2579780 - DNA, 16 bp, Homo sapiens
caagtaagaagacatg

SEQ ID NO: 2579781 - DNA, 22 bp, Homo sapiens
caagtaatccacctgcctcggc

SEQ ID NO: 2579782 - DNA, 23 bp, Homo sapiens
caagtaattctgctgtctcagcc

SEQ ID NO: 2579783 - DNA, 11 bp, Homo sapiens
caagtaattgt

SEQ ID NO: 2579784 - DNA, 13 bp, Homo sapiens
caagtattatacc

SEQ ID NO: 2579785 - DNA, 22 bp, Homo sapiens
caagtattataccttttttaga

SEQ ID NO: 2579786 - DNA, 17 bp, Homo sapiens
caagtcaagtgaaaaag

SEQ ID NO: 2579787 - DNA, 14 bp, Homo sapiens
caagtcactcccaa

SEQ ID NO: 2579788 - DNA, 22 bp, Homo sapiens
caagtcagaggatggccagtgt

SEQ ID NO: 2579789 - DNA, 20 bp, Homo sapiens
caagtcagctttgccttcca

SEQ ID NO: 2579790 - DNA, 12 bp, Homo sapiens
caagtcatggct

SEQ ID NO: 2579791 - DNA, 17 bp, Homo sapiens
caagtcattttaacttt

SEQ ID NO: 2579792 - DNA, 14 bp, Homo sapiens
caagtccccaagat

SEQ ID NO: 2579793 - DNA, 18 bp, Homo sapiens
caagtccctgactctctg

SEQ ID NO: 2579794 - DNA, 20 bp, Homo sapiens
caagtccctgactctctgtg

SEQ ID NO: 2579795 - DNA, 21 bp, Homo sapiens
caagtccctgactctctgtga

SEQ ID NO: 2579796 - DNA, 23 bp, Homo sapiens
caagtccctgactctctgtgacc

SEQ ID NO: 2579797 - DNA, 11 bp, Homo sapiens
caagtccctgt

SEQ ID NO: 2579798 - DNA, 20 bp, Homo sapiens
caagtccctgttttctgagc

SEQ ID NO: 2579799 - DNA, 21 bp, Homo sapiens
caagtccctgttttctgagcc

SEQ ID NO: 2579800 - DNA, 22 bp, Homo sapiens
caagtccctgttttctgagccc

SEQ ID NO: 2579801 - DNA, 16 bp, Homo sapiens
caagtcctgaagaggc

SEQ ID NO: 2579802 - DNA, 18 bp, Homo sapiens
caagtcctgtgaatttct

SEQ ID NO: 2579803 - DNA, 18 bp, Homo sapiens
caagtctatgatgctgtt

SEQ ID NO: 2579804 - DNA, 20 bp, Homo sapiens
caagtctatgatgctgttgc

SEQ ID NO: 2579805 - DNA, 16 bp, Homo sapiens
caagtctcagtggctt

SEQ ID NO: 2579806 - DNA, 22 bp, Homo sapiens
caagtgaaaaaggaggaagaga

SEQ ID NO: 2579807 - DNA, 14 bp, Homo sapiens
caagtgaagaaaag

SEQ ID NO: 2579808 - DNA, 19 bp, Homo sapiens
caagtgaatttttctctaa

SEQ ID NO: 2579809 - DNA, 15 bp, Homo sapiens
caagtgagagctggg

SEQ ID NO: 2579810 - DNA, 14 bp, Homo sapiens
caagtgattctcct

SEQ ID NO: 2579811 - DNA, 18 bp, Homo sapiens
caagtgattctcctgcct

SEQ ID NO: 2579812 - DNA, 19 bp, Homo sapiens
caagtgattctcctgcctc

SEQ ID NO: 2579813 - DNA, 20 bp, Homo sapiens
caagtgcaggctggcaccgc

SEQ ID NO: 2579814 - DNA, 20 bp, Homo sapiens
caagtgccagaggtgggcag

SEQ ID NO: 2579815 - DNA, 21 bp, Homo sapiens
caagtgccagaggtgggcagg

SEQ ID NO: 2579816 - DNA, 13 bp, Homo sapiens
caagtgccttaat

SEQ ID NO: 2579817 - DNA, 21 bp, Homo sapiens
caagtgctggcaccaccaggc

SEQ ID NO: 2579818 - DNA, 23 bp, Homo sapiens
caagtggcagagcttggactgga

SEQ ID NO: 2579819 - DNA, 16 bp, Homo sapiens
caagtggggctcgcca

SEQ ID NO: 2579820 - DNA, 21 bp, Homo sapiens
caagtggggctcgccatgccg

SEQ ID NO: 2579821 - DNA, 20 bp, Homo sapiens
caagtggtagcaagaagtga

SEQ ID NO: 2579822 - DNA, 14 bp, Homo sapiens
caagtgtatatcag

SEQ ID NO: 2579823 - DNA, 16 bp, Homo sapiens
caagtgtatatcagaa

SEQ ID NO: 2579824 - DNA, 14 bp, Homo sapiens
caagtgtcttccat

SEQ ID NO: 2579825 - DNA, 15 bp, Homo sapiens
caagtgtcttccatc

SEQ ID NO: 2579826 - DNA, 14 bp, Homo sapiens
caagtgtgaacaaa

SEQ ID NO: 2579827 - DNA, 19 bp, Homo sapiens
caagtgtgaacaaaagatg

SEQ ID NO: 2579828 - DNA, 18 bp, Homo sapiens
caagtgtgcatattgtac

SEQ ID NO: 2579829 - DNA, 15 bp, Homo sapiens
cacccttttccagct

SEQ ID NO: 2579830 - DNA, 18 bp, Homo sapiens
caccgacgcgtctcctgt

SEQ ID NO: 2579831 - DNA, 14 bp, Homo sapiens
caccgctccccagc

SEQ ID NO: 2579832 - DNA, 18 bp, Homo sapiens
caccgctccccagcccag

SEQ ID NO: 2579833 - DNA, 21 bp, Homo sapiens
caccgctccccagcccagggt

SEQ ID NO: 2579834 - DNA, 14 bp, Homo sapiens
caccggctggcctg

SEQ ID NO: 2579835 - DNA, 16 bp, Homo sapiens
caccggctggcctggc

SEQ ID NO: 2579836 - DNA, 20 bp, Homo sapiens
caccggctggcctggcccct

SEQ ID NO: 2579837 - DNA, 15 bp, Homo sapiens
caccgggcactcaga

SEQ ID NO: 2579838 - DNA, 18 bp, Homo sapiens
caccgggccacagagaaa

SEQ ID NO: 2579839 - DNA, 19 bp, Homo sapiens
caccgtcatggcttaatgt

SEQ ID NO: 2579840 - DNA, 19 bp, Homo sapiens
caccgtggaccttcctgcc

SEQ ID NO: 2579841 - DNA, 20 bp, Homo sapiens
caccgtggaccttcctgcca

SEQ ID NO: 2579842 - DNA, 23 bp, Homo sapiens
caccgtggaccttcctgccacca

SEQ ID NO: 2579843 - DNA, 16 bp, Homo sapiens
caccgtgtaaaccaaa

SEQ ID NO: 2579844 - DNA, 20 bp, Homo sapiens
cacctaatgtttatgagcca

SEQ ID NO: 2579845 - DNA, 17 bp, Homo sapiens
cacctaccatcagggac

SEQ ID NO: 2579846 - DNA, 22 bp, Homo sapiens
cacctacttttctttcctcaga

SEQ ID NO: 2579847 - DNA, 16 bp, Homo sapiens
cacctagaattggctg

SEQ ID NO: 2579848 - DNA, 14 bp, Homo sapiens
cacctataaaacag

SEQ ID NO: 2579849 - DNA, 18 bp, Homo sapiens
cacctatctcgtgggaga

SEQ ID NO: 2579850 - DNA, 23 bp, Homo sapiens
cacctcaaaataccatgccattt

SEQ ID NO: 2579851 - DNA, 21 bp, Homo sapiens
cacctcacagaaatgagatca

SEQ ID NO: 2579852 - DNA, 22 bp, Homo sapiens
cacctcagagtatggagctcag

SEQ ID NO: 2579853 - DNA, 15 bp, Homo sapiens
cacctcaggccaggt

SEQ ID NO: 2579854 - DNA, 11 bp, Homo sapiens
cacctcagttc

SEQ ID NO: 2579855 - DNA, 20 bp, Homo sapiens
cacctcagttcccttggcct

SEQ ID NO: 2579856 - DNA, 20 bp, Homo sapiens
cacctccacagttcagtggc

SEQ ID NO: 2579857 - DNA, 12 bp, Homo sapiens
cacctcccagga

SEQ ID NO: 2579858 - DNA, 14 bp, Homo sapiens
cacctccccagcct

SEQ ID NO: 2579859 - DNA, 15 bp, Homo sapiens
cacctcccctccttg

SEQ ID NO: 2579860 - DNA, 23 bp, Homo sapiens
cacctcccctccttgcctcctgt

SEQ ID NO: 2579861 - DNA, 19 bp, Homo sapiens
cacctccctgaaccatccc

SEQ ID NO: 2579862 - DNA, 14 bp, Homo sapiens
cacctccctgaccc

SEQ ID NO: 2579863 - DNA, 11 bp, Homo sapiens
cacctcctgcc

SEQ ID NO: 2579864 - DNA, 12 bp, Homo sapiens
cacctctccaag

SEQ ID NO: 2579865 - DNA, 13 bp, Homo sapiens
cacctctccaagg

SEQ ID NO: 2579866 - DNA, 19 bp, Homo sapiens
cacctctctcactccttga

SEQ ID NO: 2579867 - DNA, 17 bp, Homo sapiens
cacctcttctcttcctg

SEQ ID NO: 2579868 - DNA, 15 bp, Homo sapiens
cacctgaggtgggcc

SEQ ID NO: 2579869 - DNA, 20 bp, Homo sapiens
cacctgaggtgggcccagga

SEQ ID NO: 2579870 - DNA, 19 bp, Homo sapiens
cacctgagtcaccctacct

SEQ ID NO: 2579871 - DNA, 23 bp, Homo sapiens
cacctgagtcaccctacctgtgc

SEQ ID NO: 2579872 - DNA, 16 bp, Homo sapiens
cacctgatgtgtacat

SEQ ID NO: 2579873 - DNA, 17 bp, Homo sapiens
cacctgattcaactaaa

SEQ ID NO: 2579874 - DNA, 19 bp, Homo sapiens
cacctgattcaactaaaaa

SEQ ID NO: 2579875 - DNA, 15 bp, Homo sapiens
cacctgccagcctgg

SEQ ID NO: 2579876 - DNA, 17 bp, Homo sapiens
cacctgccagggacaga

SEQ ID NO: 2579877 - DNA, 18 bp, Homo sapiens
cacctgcccatcacaggg

SEQ ID NO: 2579878 - DNA, 22 bp, Homo sapiens
cacctgcccatcacagggttgg

SEQ ID NO: 2579879 - DNA, 21 bp, Homo sapiens
cacctgccccctggtggacag

SEQ ID NO: 2579880 - DNA, 15 bp, Homo sapiens
cacctgcccccttct

SEQ ID NO: 2579881 - DNA, 20 bp, Homo sapiens
cacctgcccccttctcccac

SEQ ID NO: 2579882 - DNA, 23 bp, Homo sapiens
cacctgcctcggcctcccaaagt

SEQ ID NO: 2579883 - DNA, 19 bp, Homo sapiens
cacctgcggtgctatctcc

SEQ ID NO: 2579884 - DNA, 23 bp, Homo sapiens
cacctgcggtgctatctccccca

SEQ ID NO: 2579885 - DNA, 15 bp, Homo sapiens
cacctgctggagtga

SEQ ID NO: 2579886 - DNA, 14 bp, Homo sapiens
cacctgctggcccc

SEQ ID NO: 2579887 - DNA, 15 bp, Homo sapiens
cacctgctggcccct

SEQ ID NO: 2579888 - DNA, 17 bp, Homo sapiens
cacctgctggcccctca

SEQ ID NO: 2579889 - DNA, 18 bp, Homo sapiens
cacctgctggcccctcac

SEQ ID NO: 2579890 - DNA, 20 bp, Homo sapiens
cacctgctggcccctcacct

SEQ ID NO: 2579891 - DNA, 17 bp, Homo sapiens
cacctggcactgctgtg

SEQ ID NO: 2579892 - DNA, 19 bp, Homo sapiens
cacctggccacctgaggtg

SEQ ID NO: 2579893 - DNA, 17 bp, Homo sapiens
cacctggcctctgcact

SEQ ID NO: 2579894 - DNA, 20 bp, Homo sapiens
cacctggcctctgcactccc

SEQ ID NO: 2579895 - DNA, 10 bp, Homo sapiens
cacctggggt

SEQ ID NO: 2579896 - DNA, 18 bp, Homo sapiens
cacctggggtgtgggagg

SEQ ID NO: 2579897 - DNA, 16 bp, Homo sapiens
cacctgtactcaggag

SEQ ID NO: 2579898 - DNA, 15 bp, Homo sapiens
cacctgtactcttcc

SEQ ID NO: 2579899 - DNA, 16 bp, Homo sapiens
cacctgtagtcccagc

SEQ ID NO: 2579900 - DNA, 13 bp, Homo sapiens
cacctgtcaaaca

SEQ ID NO: 2579901 - DNA, 20 bp, Homo sapiens
cacctgtcaaacaaagccag

SEQ ID NO: 2579902 - DNA, 23 bp, Homo sapiens
cacctgtcaaacaaagccagaag

SEQ ID NO: 2579903 - DNA, 14 bp, Homo sapiens
cacctgtcaggcct

SEQ ID NO: 2579904 - DNA, 15 bp, Homo sapiens
cacctgtctcagcct

SEQ ID NO: 2579905 - DNA, 19 bp, Homo sapiens
cacctgtctcagcctccca

SEQ ID NO: 2579906 - DNA, 16 bp, Homo sapiens
cacctgttgcttacaa

SEQ ID NO: 2579907 - DNA, 20 bp, Homo sapiens
cacctgttgcttacaatttt

SEQ ID NO: 2579908 - DNA, 18 bp, Homo sapiens
caccttaccaactttctg

SEQ ID NO: 2579909 - DNA, 23 bp, Homo sapiens
caccttagacagtccctgccaat

SEQ ID NO: 2579910 - DNA, 13 bp, Homo sapiens
caccttagctggc

SEQ ID NO: 2579911 - DNA, 13 bp, Homo sapiens
caccttgacaggg

SEQ ID NO: 2579912 - DNA, 18 bp, Homo sapiens
caccttgacagggcacac

SEQ ID NO: 2579913 - DNA, 21 bp, Homo sapiens
caccttgcaacacacagacac

SEQ ID NO: 2579914 - DNA, 14 bp, Homo sapiens
caccttgcggggat

SEQ ID NO: 2579915 - DNA, 13 bp, Homo sapiens
caccttggctcaa

SEQ ID NO: 2579916 - DNA, 14 bp, Homo sapiens
caccttggctcaag

SEQ ID NO: 2579917 - DNA, 15 bp, Homo sapiens
caccttggctcaagt

SEQ ID NO: 2579918 - DNA, 14 bp, Homo sapiens
caccttggctgcag

SEQ ID NO: 2579919 - DNA, 15 bp, Homo sapiens
caccttggctgcagg

SEQ ID NO: 2579920 - DNA, 18 bp, Homo sapiens
caccttggctgcagggag

SEQ ID NO: 2579921 - DNA, 20 bp, Homo sapiens
caccttgggatgatgcctca

SEQ ID NO: 2579922 - DNA, 20 bp, Homo sapiens
caccttggggcttgactttt

SEQ ID NO: 2579923 - DNA, 21 bp, Homo sapiens
caccttgtgtctgtacacgtg

SEQ ID NO: 2579924 - DNA, 12 bp, Homo sapiens
cacctttattaa

SEQ ID NO: 2579925 - DNA, 14 bp, Homo sapiens
cacctttattaaaa

SEQ ID NO: 2579926 - DNA, 14 bp, Homo sapiens
cacctttcccatct

SEQ ID NO: 2579927 - DNA, 21 bp, Homo sapiens
cacctttttcatacaaggccc

SEQ ID NO: 2579928 - DNA, 13 bp, Homo sapiens
cacgaaatgttat

SEQ ID NO: 2579929 - DNA, 16 bp, Homo sapiens
cacgaaatgttatttt

SEQ ID NO: 2579930 - DNA, 19 bp, Homo sapiens
cacgacctcggctcactgc

SEQ ID NO: 2579931 - DNA, 16 bp, Homo sapiens
cacgactgcccggcag

SEQ ID NO: 2579932 - DNA, 13 bp, Homo sapiens
cacgactgtctcc

SEQ ID NO: 2579933 - DNA, 16 bp, Homo sapiens
cacgactgtctccatg

SEQ ID NO: 2579934 - DNA, 20 bp, Homo sapiens
cacgagcaggctactgtcag

SEQ ID NO: 2579935 - DNA, 22 bp, Homo sapiens
cacgagcaggctactgtcagct

SEQ ID NO: 2579936 - DNA, 20 bp, Homo sapiens
cacgagctgtttactaggga

SEQ ID NO: 2579937 - DNA, 12 bp, Homo sapiens
cacgatttctgt

SEQ ID NO: 2579938 - DNA, 14 bp, Homo sapiens
cacgatttctgttt

SEQ ID NO: 2579939 - DNA, 22 bp, Homo sapiens
cacgcacacacacacacaggag

SEQ ID NO: 2579940 - DNA, 12 bp, Homo sapiens
cacgcacctccc

SEQ ID NO: 2579941 - DNA, 13 bp, Homo sapiens
cacgcacgcacac

SEQ ID NO: 2579942 - DNA, 15 bp, Homo sapiens
cacgcacgcacacac

SEQ ID NO: 2579943 - DNA, 19 bp, Homo sapiens
cacgcaggaactcccagca

SEQ ID NO: 2579944 - DNA, 20 bp, Homo sapiens
cacgcaggaactcccagcaa

SEQ ID NO: 2579945 - DNA, 13 bp, Homo sapiens
cacgccactgcac

SEQ ID NO: 2579946 - DNA, 22 bp, Homo sapiens
cacgccactgcactccagcctg

SEQ ID NO: 2579947 - DNA, 20 bp, Homo sapiens
cacgccagattctttcctga

SEQ ID NO: 2579948 - DNA, 23 bp, Homo sapiens
cacgcccatgtgtgagtgtgtgc

SEQ ID NO: 2579949 - DNA, 19 bp, Homo sapiens
cacgcctatgatcccagca

SEQ ID NO: 2579950 - DNA, 13 bp, Homo sapiens
cacgcctcccact

SEQ ID NO: 2579951 - DNA, 16 bp, Homo sapiens
cacgcctcccactggg

SEQ ID NO: 2579952 - DNA, 18 bp, Homo sapiens
cacgcctcccactggggt

SEQ ID NO: 2579953 - DNA, 14 bp, Homo sapiens
cacgcctgtaatcc

SEQ ID NO: 2579954 - DNA, 16 bp, Homo sapiens
cacgcctgtaatccca

SEQ ID NO: 2579955 - DNA, 18 bp, Homo sapiens
cacgcctgtaatcccagc

SEQ ID NO: 2579956 - DNA, 22 bp, Homo sapiens
cacgcctgtaatcccagcactt

SEQ ID NO: 2579957 - DNA, 16 bp, Homo sapiens
cacgcgtgcacacacc

SEQ ID NO: 2579958 - DNA, 18 bp, Homo sapiens
cacgctggagtgcagtga

SEQ ID NO: 2579959 - DNA, 20 bp, Homo sapiens
cacgctggagtgcagtgagc

SEQ ID NO: 2579960 - DNA, 18 bp, Homo sapiens
cacgctgtctccagaccc

SEQ ID NO: 2579961 - DNA, 14 bp, Homo sapiens
cacgctttctagct

SEQ ID NO: 2579962 - DNA, 16 bp, Homo sapiens
cacggaagagccttgc

SEQ ID NO: 2579963 - DNA, 17 bp, Homo sapiens
cacggagccactcctct

SEQ ID NO: 2579964 - DNA, 19 bp, Homo sapiens
cacggagccactcctctga

SEQ ID NO: 2579965 - DNA, 23 bp, Homo sapiens
cacggagccactcctctgactca

SEQ ID NO: 2579966 - DNA, 21 bp, Homo sapiens
cacggaggcatctgcaccctc

SEQ ID NO: 2579967 - DNA, 23 bp, Homo sapiens
cacggcaggacaacgaggaagcc

SEQ ID NO: 2579968 - DNA, 14 bp, Homo sapiens
cacggccgctccag

SEQ ID NO: 2579969 - DNA, 19 bp, Homo sapiens
cacggccgctccaggggtg

SEQ ID NO: 2579970 - DNA, 15 bp, Homo sapiens
cacggctcactgcag

SEQ ID NO: 2579971 - DNA, 20 bp, Homo sapiens
cacggctcactgcagcctca

SEQ ID NO: 2579972 - DNA, 12 bp, Homo sapiens
cacggctgctga

SEQ ID NO: 2579973 - DNA, 15 bp, Homo sapiens
cacggtagtgcctga

SEQ ID NO: 2579974 - DNA, 17 bp, Homo sapiens
cagatttgtgaactcag

SEQ ID NO: 2579975 - DNA, 15 bp, Homo sapiens
cagattttaattttg

SEQ ID NO: 2579976 - DNA, 22 bp, Homo sapiens
cagattttcagcaaactctttt

SEQ ID NO: 2579977 - DNA, 23 bp, Homo sapiens
cagattttggggttgtgttgtca

SEQ ID NO: 2579978 - DNA, 15 bp, Homo sapiens
cagatttttacaaat

SEQ ID NO: 2579979 - DNA, 19 bp, Homo sapiens
cagcaaagagtgggctgca

SEQ ID NO: 2579980 - DNA, 16 bp, Homo sapiens
cagcaacacaagctgg

SEQ ID NO: 2579981 - DNA, 20 bp, Homo sapiens
cagcaacggggaggccaagt

SEQ ID NO: 2579982 - DNA, 20 bp, Homo sapiens
cagcaactgaataaatacct

SEQ ID NO: 2579983 - DNA, 21 bp, Homo sapiens
cagcaactgaataaatacctc

SEQ ID NO: 2579984 - DNA, 15 bp, Homo sapiens
cagcaacttgtcttt

SEQ ID NO: 2579985 - DNA, 22 bp, Homo sapiens
cagcaagaagatcctaaaacaa

SEQ ID NO: 2579986 - DNA, 19 bp, Homo sapiens
cagcaagggtgatgggaaa

SEQ ID NO: 2579987 - DNA, 14 bp, Homo sapiens
cagcaagtgagagc

SEQ ID NO: 2579988 - DNA, 16 bp, Homo sapiens
cagcaagtgagagctg

SEQ ID NO: 2579989 - DNA, 13 bp, Homo sapiens
cagcaataaagca

SEQ ID NO: 2579990 - DNA, 18 bp, Homo sapiens
cagcaatgacatctcagg

SEQ ID NO: 2579991 - DNA, 21 bp, Homo sapiens
cagcaccatccgccagggccc

SEQ ID NO: 2579992 - DNA, 13 bp, Homo sapiens
cagcaccccttcc

SEQ ID NO: 2579993 - DNA, 19 bp, Homo sapiens
cagcaccccttccatgtgg

SEQ ID NO: 2579994 - DNA, 20 bp, Homo sapiens
cagcacctacagtgtacagt

SEQ ID NO: 2579995 - DNA, 14 bp, Homo sapiens
cagcacgatttctg

SEQ ID NO: 2579996 - DNA, 17 bp, Homo sapiens
cagcactaaagcagtgg

SEQ ID NO: 2579997 - DNA, 19 bp, Homo sapiens
cagcactaaagcagtggac

SEQ ID NO: 2579998 - DNA, 20 bp, Homo sapiens
cagcactaaagcagtggaca

SEQ ID NO: 2579999 - DNA, 10 bp, Homo sapiens
cagcactaac

SEQ ID NO: 2580000 - DNA, 14 bp, Homo sapiens
cagcactactctgt

SEQ ID NO: 2580001 - DNA, 18 bp, Homo sapiens
cagcactgcttgaggaaa

SEQ ID NO: 2580002 - DNA, 14 bp, Homo sapiens
cagcactggctctc

SEQ ID NO: 2580003 - DNA, 19 bp, Homo sapiens
cagcactggctctctccag

SEQ ID NO: 2580004 - DNA, 23 bp, Homo sapiens
cagcactttgggaggccaaggag

SEQ ID NO: 2580005 - DNA, 18 bp, Homo sapiens
cagcactttgggaggcct

SEQ ID NO: 2580006 - DNA, 22 bp, Homo sapiens
cagcactttgggaggcctaggc

SEQ ID NO: 2580007 - DNA, 18 bp, Homo sapiens
cagcactttgggaggctg

SEQ ID NO: 2580008 - DNA, 19 bp, Homo sapiens
cagcactttgggaggctga

SEQ ID NO: 2580009 - DNA, 20 bp, Homo sapiens
cagcactttgggaggctgag

SEQ ID NO: 2580010 - DNA, 22 bp, Homo sapiens
cagcactttgggaggctgaggc

SEQ ID NO: 2580011 - DNA, 19 bp, Homo sapiens
cagcagaaatgccttaccc

SEQ ID NO: 2580012 - DNA, 15 bp, Homo sapiens
cagcagccagctctc

SEQ ID NO: 2580013 - DNA, 18 bp, Homo sapiens
cagcagccagctctcagc

SEQ ID NO: 2580014 - DNA, 18 bp, Homo sapiens
cagcagccatcataggaa

SEQ ID NO: 2580015 - DNA, 21 bp, Homo sapiens
cagcagccatcataggaaggg

SEQ ID NO: 2580016 - DNA, 13 bp, Homo sapiens
cagcagcccctgc

SEQ ID NO: 2580017 - DNA, 16 bp, Homo sapiens
cagcagccctaaggat

SEQ ID NO: 2580018 - DNA, 15 bp, Homo sapiens
cagcagcctggaccc

SEQ ID NO: 2580019 - DNA, 15 bp, Homo sapiens
cagcagcggtggcct

SEQ ID NO: 2580020 - DNA, 16 bp, Homo sapiens
cagcagcggtggcctc

SEQ ID NO: 2580021 - DNA, 15 bp, Homo sapiens
cagcagctcaggcac

SEQ ID NO: 2580022 - DNA, 18 bp, Homo sapiens
cagcagctgaacagccaa

SEQ ID NO: 2580023 - DNA, 16 bp, Homo sapiens
cagcagcttcaccaga

SEQ ID NO: 2580024 - DNA, 17 bp, Homo sapiens
cagcagggcctcaaagt

SEQ ID NO: 2580025 - DNA, 21 bp, Homo sapiens
cagcagggctaccctgagctg

SEQ ID NO: 2580026 - DNA, 20 bp, Homo sapiens
cagcagggtcttttcatctg

SEQ ID NO: 2580027 - DNA, 22 bp, Homo sapiens
cagcagggtcttttcatctggg

SEQ ID NO: 2580028 - DNA, 15 bp, Homo sapiens
cagcagtgaaaacaa

SEQ ID NO: 2580029 - DNA, 22 bp, Homo sapiens
cagcagtgaaaacaagtgctgg

SEQ ID NO: 2580030 - DNA, 23 bp, Homo sapiens
cagcagtgaaaacaagtgctggc

SEQ ID NO: 2580031 - DNA, 19 bp, Homo sapiens
cagcagtgagtctcttcag

SEQ ID NO: 2580032 - DNA, 21 bp, Homo sapiens
cagcagtgagtctcttcagaa

SEQ ID NO: 2580033 - DNA, 22 bp, Homo sapiens
cagcagtgtgaggccagggcag

SEQ ID NO: 2580034 - DNA, 23 bp, Homo sapiens
cagcagtgttccccatctgggtc

SEQ ID NO: 2580035 - DNA, 16 bp, Homo sapiens
cagcatacctgctggt

SEQ ID NO: 2580036 - DNA, 17 bp, Homo sapiens
cagcatattcaggaagc

SEQ ID NO: 2580037 - DNA, 19 bp, Homo sapiens
cagcatattcaggaagctc

SEQ ID NO: 2580038 - DNA, 22 bp, Homo sapiens
cagcatattcaggaagctcagg

SEQ ID NO: 2580039 - DNA, 18 bp, Homo sapiens
cagcatatttatagcaat

SEQ ID NO: 2580040 - DNA, 20 bp, Homo sapiens
cagcatcatggaggtttgaa

SEQ ID NO: 2580041 - DNA, 19 bp, Homo sapiens
cagcatcattttgcattca

SEQ ID NO: 2580042 - DNA, 20 bp, Homo sapiens
cagcatcattttgcattcaa

SEQ ID NO: 2580043 - DNA, 22 bp, Homo sapiens
cagcatcattttgcattcaaat

SEQ ID NO: 2580044 - DNA, 19 bp, Homo sapiens
cagcatcccttgaccaggc

SEQ ID NO: 2580045 - DNA, 22 bp, Homo sapiens
cagcatcccttgaccaggcctg

SEQ ID NO: 2580046 - DNA, 23 bp, Homo sapiens
cagcatgacctgtgaccagcact

SEQ ID NO: 2580047 - DNA, 22 bp, Homo sapiens
cagcatgtgtatttccagtgca

SEQ ID NO: 2580048 - DNA, 17 bp, Homo sapiens
cagcatgttgctgagga

SEQ ID NO: 2580049 - DNA, 18 bp, Homo sapiens
cagcattacaaattgctt

SEQ ID NO: 2580050 - DNA, 15 bp, Homo sapiens
cagcattgctggttc

SEQ ID NO: 2580051 - DNA, 13 bp, Homo sapiens
cagcattgctttc

SEQ ID NO: 2580052 - DNA, 14 bp, Homo sapiens
cagcattgctttct

SEQ ID NO: 2580053 - DNA, 20 bp, Homo sapiens
cagcatttccacaccaagca

SEQ ID NO: 2580054 - DNA, 17 bp, Homo sapiens
cagccaaacccatgagg

SEQ ID NO: 2580055 - DNA, 15 bp, Homo sapiens
cagccaaaccctgtc

SEQ ID NO: 2580056 - DNA, 20 bp, Homo sapiens
cagccaaagataatctctca

SEQ ID NO: 2580057 - DNA, 21 bp, Homo sapiens
cagccaaagcctcctccagcc

SEQ ID NO: 2580058 - DNA, 23 bp, Homo sapiens
cagccaacaggtggcaggaccag

SEQ ID NO: 2580059 - DNA, 13 bp, Homo sapiens
cagccacacacac

SEQ ID NO: 2580060 - DNA, 22 bp, Homo sapiens
cagccacacacacagaaaatat

SEQ ID NO: 2580061 - DNA, 17 bp, Homo sapiens
cagccacattcctgatg

SEQ ID NO: 2580062 - DNA, 17 bp, Homo sapiens
cagccaccccgggctct

SEQ ID NO: 2580063 - DNA, 22 bp, Homo sapiens
cagccaccccgggctctctgct

SEQ ID NO: 2580064 - DNA, 16 bp, Homo sapiens
cagccacctctctttt

SEQ ID NO: 2580065 - DNA, 16 bp, Homo sapiens
cagccacggccaggcc

SEQ ID NO: 2580066 - DNA, 15 bp, Homo sapiens
cagccagactggcac

SEQ ID NO: 2580067 - DNA, 19 bp, Homo sapiens
cagccagagttcctgcgga

SEQ ID NO: 2580068 - DNA, 21 bp, Homo sapiens
cagccagagttcctgcggagt

SEQ ID NO: 2580069 - DNA, 17 bp, Homo sapiens
cagccagatcctcttgg

SEQ ID NO: 2580070 - DNA, 22 bp, Homo sapiens
cagccagcaatgatgtccagaa

SEQ ID NO: 2580071 - DNA, 23 bp, Homo sapiens
cagccagcaatgatgtccagaag

SEQ ID NO: 2580072 - DNA, 19 bp, Homo sapiens
cagccagcagccagctctc

SEQ ID NO: 2580073 - DNA, 17 bp, Homo sapiens
cagccagctctcagcca

SEQ ID NO: 2580074 - DNA, 15 bp, Homo sapiens
cagccaggagctggg

SEQ ID NO: 2580075 - DNA, 18 bp, Homo sapiens
cagccaggcgggctcaag

SEQ ID NO: 2580076 - DNA, 17 bp, Homo sapiens
cagccaggctctgtgct

SEQ ID NO: 2580077 - DNA, 12 bp, Homo sapiens
cagccagggctg

SEQ ID NO: 2580078 - DNA, 15 bp, Homo sapiens
cagccaggtgccttg

SEQ ID NO: 2580079 - DNA, 19 bp, Homo sapiens
cagccagtgacctgaggaa

SEQ ID NO: 2580080 - DNA, 21 bp, Homo sapiens
cagccatacttatctctctgt

SEQ ID NO: 2580081 - DNA, 18 bp, Homo sapiens
cagccatcataggaaggg

SEQ ID NO: 2580082 - DNA, 15 bp, Homo sapiens
cagccatctgcccag

SEQ ID NO: 2580083 - DNA, 17 bp, Homo sapiens
cagccatctgcccaggg

SEQ ID NO: 2580084 - DNA, 21 bp, Homo sapiens
cagccatctgcccaggggtgc

SEQ ID NO: 2580085 - DNA, 20 bp, Homo sapiens
cagccattggctatttaaaa

SEQ ID NO: 2580086 - DNA, 17 bp, Homo sapiens
cagcccacccccctcat

SEQ ID NO: 2580087 - DNA, 19 bp, Homo sapiens
cagcccacccccctcattt

SEQ ID NO: 2580088 - DNA, 24 bp, Homo sapiens
cagcccaccctcctgtcttcccag

SEQ ID NO: 2580089 - DNA, 18 bp, Homo sapiens
cagcccacttctgccata

SEQ ID NO: 2580090 - DNA, 12 bp, Homo sapiens
cagcccagggac

SEQ ID NO: 2580091 - DNA, 18 bp, Homo sapiens
cagcccagggttccccca

SEQ ID NO: 2580092 - DNA, 15 bp, Homo sapiens
cagcccatgcccacc

SEQ ID NO: 2580093 - DNA, 21 bp, Homo sapiens
cagccccaaaactctcctctg

SEQ ID NO: 2580094 - DNA, 11 bp, Homo sapiens
cagccccaccc

SEQ ID NO: 2580095 - DNA, 12 bp, Homo sapiens
cagccccaccca

SEQ ID NO: 2580096 - DNA, 13 bp, Homo sapiens
cagccccatcctc

SEQ ID NO: 2580097 - DNA, 14 bp, Homo sapiens
cagccccatcctct

SEQ ID NO: 2580098 - DNA, 16 bp, Homo sapiens
cagccccatcctctgt

SEQ ID NO: 2580099 - DNA, 16 bp, Homo sapiens
cagccccgcgcctcct

SEQ ID NO: 2580100 - DNA, 15 bp, Homo sapiens
cagccccggccctgg

SEQ ID NO: 2580101 - DNA, 19 bp, Homo sapiens
cagccccgtggggttcctc

SEQ ID NO: 2580102 - DNA, 13 bp, Homo sapiens
cagcccctcccac

SEQ ID NO: 2580103 - DNA, 14 bp, Homo sapiens
cagcccctcccacc

SEQ ID NO: 2580104 - DNA, 11 bp, Homo sapiens
cagcccctctt

SEQ ID NO: 2580105 - DNA, 15 bp, Homo sapiens
cagcccctcttgccc

SEQ ID NO: 2580106 - DNA, 17 bp, Homo sapiens
cagcccctcttgccccc

SEQ ID NO: 2580107 - DNA, 22 bp, Homo sapiens
cagcccctcttgccccccaccc

SEQ ID NO: 2580108 - DNA, 23 bp, Homo sapiens
cagcccctcttgccccccacccc

SEQ ID NO: 2580109 - DNA, 14 bp, Homo sapiens
cagcccctggatgc

SEQ ID NO: 2580110 - DNA, 17 bp, Homo sapiens
cagcccctggatgcagc

SEQ ID NO: 2580111 - DNA, 21 bp, Homo sapiens
cagcccctggatgcagcctca

SEQ ID NO: 2580112 - DNA, 20 bp, Homo sapiens
cagcccctgtatggcactgg

SEQ ID NO: 2580113 - DNA, 17 bp, Homo sapiens
cagccccttctgaccca

SEQ ID NO: 2580114 - DNA, 23 bp, Homo sapiens
cagccccttctgacccatgctgc

SEQ ID NO: 2580115 - DNA, 18 bp, Homo sapiens
cagccccttgagaaacct

SEQ ID NO: 2580116 - DNA, 17 bp, Homo sapiens
cagcccgctgagtggac

SEQ ID NO: 2580117 - DNA, 23 bp, Homo sapiens
caggctctgccctgccctagctc

SEQ ID NO: 2580118 - DNA, 17 bp, Homo sapiens
caggctctgcctcacct

SEQ ID NO: 2580119 - DNA, 19 bp, Homo sapiens
caggctctgtgctgaccct

SEQ ID NO: 2580120 - DNA, 22 bp, Homo sapiens
caggctctgtgctgaccctcct

SEQ ID NO: 2580121 - DNA, 21 bp, Homo sapiens
caggctgccaaggccagagtg

SEQ ID NO: 2580122 - DNA, 22 bp, Homo sapiens
caggctgccaaggccagagtgg

SEQ ID NO: 2580123 - DNA, 11 bp, Homo sapiens
caggctgctgg

SEQ ID NO: 2580124 - DNA, 13 bp, Homo sapiens
caggctgctggcg

SEQ ID NO: 2580125 - DNA, 20 bp, Homo sapiens
caggctgctggcgcctctgc

SEQ ID NO: 2580126 - DNA, 22 bp, Homo sapiens
caggctgctggcgcctctgcaa

SEQ ID NO: 2580127 - DNA, 20 bp, Homo sapiens
caggctggcaccgccttctc

SEQ ID NO: 2580128 - DNA, 15 bp, Homo sapiens
caggctggcagctct

SEQ ID NO: 2580129 - DNA, 16 bp, Homo sapiens
caggctggcagctctc

SEQ ID NO: 2580130 - DNA, 18 bp, Homo sapiens
caggctggcagctctcca

SEQ ID NO: 2580131 - DNA, 18 bp, Homo sapiens
caggctggcgcagccaag

SEQ ID NO: 2580132 - DNA, 18 bp, Homo sapiens
caggctggcgtgcagtgg

SEQ ID NO: 2580133 - DNA, 22 bp, Homo sapiens
caggctgggagagccttccagg

SEQ ID NO: 2580134 - DNA, 23 bp, Homo sapiens
caggctgggagagccttccaggg

SEQ ID NO: 2580135 - DNA, 18 bp, Homo sapiens
caggctgggcaaggaggc

SEQ ID NO: 2580136 - DNA, 14 bp, Homo sapiens
caggctgggcttca

SEQ ID NO: 2580137 - DNA, 19 bp, Homo sapiens
caggctggtctcaaactct

SEQ ID NO: 2580138 - DNA, 14 bp, Homo sapiens
caggctgtatccca

SEQ ID NO: 2580139 - DNA, 17 bp, Homo sapiens
caggctgtgggcctcaa

SEQ ID NO: 2580140 - DNA, 16 bp, Homo sapiens
caggcttagtcactga

SEQ ID NO: 2580141 - DNA, 16 bp, Homo sapiens
caggcttgcctgcagg

SEQ ID NO: 2580142 - DNA, 19 bp, Homo sapiens
cagggaaaagcagctctcc

SEQ ID NO: 2580143 - DNA, 21 bp, Homo sapiens
cagggaaaagcagctctcccc

SEQ ID NO: 2580144 - DNA, 16 bp, Homo sapiens
cagggaaacagctaat

SEQ ID NO: 2580145 - DNA, 22 bp, Homo sapiens
cagggaaacagctaatgggaca

SEQ ID NO: 2580146 - DNA, 15 bp, Homo sapiens
cagggaagctacagg

SEQ ID NO: 2580147 - DNA, 17 bp, Homo sapiens
cagggaagctacaggtt

SEQ ID NO: 2580148 - DNA, 18 bp, Homo sapiens
cagggaagctacaggtta

SEQ ID NO: 2580149 - DNA, 14 bp, Homo sapiens
cagggaagtcccca

SEQ ID NO: 2580150 - DNA, 18 bp, Homo sapiens
cagggaagtccccaggcc

SEQ ID NO: 2580151 - DNA, 16 bp, Homo sapiens
cagggacaccagccag

SEQ ID NO: 2580152 - DNA, 21 bp, Homo sapiens
cagggacaccagccaggctct

SEQ ID NO: 2580153 - DNA, 14 bp, Homo sapiens
cagggacagagcca

SEQ ID NO: 2580154 - DNA, 20 bp, Homo sapiens
cagggacagagggggtggcc

SEQ ID NO: 2580155 - DNA, 12 bp, Homo sapiens
cagggacaggat

SEQ ID NO: 2580156 - DNA, 16 bp, Homo sapiens
cagggaccacaccctg

SEQ ID NO: 2580157 - DNA, 16 bp, Homo sapiens
cagggacccctgccct

SEQ ID NO: 2580158 - DNA, 23 bp, Homo sapiens
cagggactgaaaacctctcctca

SEQ ID NO: 2580159 - DNA, 16 bp, Homo sapiens
cagggagaggccatga

SEQ ID NO: 2580160 - DNA, 19 bp, Homo sapiens
cagggagcatggctgtgag

SEQ ID NO: 2580161 - DNA, 17 bp, Homo sapiens
cagggagcggaaagcag

SEQ ID NO: 2580162 - DNA, 15 bp, Homo sapiens
cagggagctgggaca

SEQ ID NO: 2580163 - DNA, 12 bp, Homo sapiens
cagggaggagag

SEQ ID NO: 2580164 - DNA, 22 bp, Homo sapiens
cagggaggagaggggaagggcc

SEQ ID NO: 2580165 - DNA, 19 bp, Homo sapiens
cagggaggggactatttat

SEQ ID NO: 2580166 - DNA, 23 bp, Homo sapiens
cagggaggttaagtgacttgccc

SEQ ID NO: 2580167 - DNA, 22 bp, Homo sapiens
cagggagtccgaaagggacttg

SEQ ID NO: 2580168 - DNA, 19 bp, Homo sapiens
cagggatcttgcattccca

SEQ ID NO: 2580169 - DNA, 17 bp, Homo sapiens
cagggcacaccgggcac

SEQ ID NO: 2580170 - DNA, 20 bp, Homo sapiens
cagggcacttcacagagtgt

SEQ ID NO: 2580171 - DNA, 12 bp, Homo sapiens
cagggcagagcc

SEQ ID NO: 2580172 - DNA, 17 bp, Homo sapiens
cagggcagctgggccca

SEQ ID NO: 2580173 - DNA, 16 bp, Homo sapiens
cagggcagggctctga

SEQ ID NO: 2580174 - DNA, 18 bp, Homo sapiens
cagggcatctccaggaag

SEQ ID NO: 2580175 - DNA, 17 bp, Homo sapiens
cagggccaacttgaggg

SEQ ID NO: 2580176 - DNA, 16 bp, Homo sapiens
cagggccactctgcct

SEQ ID NO: 2580177 - DNA, 15 bp, Homo sapiens
cagggccagggccct

SEQ ID NO: 2580178 - DNA, 17 bp, Homo sapiens
cagggccatgcctgccc

SEQ ID NO: 2580179 - DNA, 17 bp, Homo sapiens
cagggcccaagtccctg

SEQ ID NO: 2580180 - DNA, 18 bp, Homo sapiens
cagggcccaagtccctgt

SEQ ID NO: 2580181 - DNA, 17 bp, Homo sapiens
cagggcccacaccccct

SEQ ID NO: 2580182 - DNA, 16 bp, Homo sapiens
cagggccccagcacta

SEQ ID NO: 2580183 - DNA, 14 bp, Homo sapiens
cagggccctgcaga

SEQ ID NO: 2580184 - DNA, 16 bp, Homo sapiens
cagggcctcacacggt

SEQ ID NO: 2580185 - DNA, 17 bp, Homo sapiens
cagggcctggaagacag

SEQ ID NO: 2580186 - DNA, 18 bp, Homo sapiens
cagggcctggaagacaga

SEQ ID NO: 2580187 - DNA, 19 bp, Homo sapiens
cagggcctggaagacagag

SEQ ID NO: 2580188 - DNA, 15 bp, Homo sapiens
cagggcctggctcag

SEQ ID NO: 2580189 - DNA, 19 bp, Homo sapiens
cagggcctggctcaggtgg

SEQ ID NO: 2580190 - DNA, 22 bp, Homo sapiens
cagggcctggggagatggagga

SEQ ID NO: 2580191 - DNA, 15 bp, Homo sapiens
cagggctaccctccc

SEQ ID NO: 2580192 - DNA, 18 bp, Homo sapiens
cagggctaccctgagctg

SEQ ID NO: 2580193 - DNA, 19 bp, Homo sapiens
cagggctcacgtgggaacc

SEQ ID NO: 2580194 - DNA, 12 bp, Homo sapiens
cagggctcagcg

SEQ ID NO: 2580195 - DNA, 23 bp, Homo sapiens
cagggctcagcggggacagctcc

SEQ ID NO: 2580196 - DNA, 23 bp, Homo sapiens
cagggctcctgccttctgtcctg

SEQ ID NO: 2580197 - DNA, 13 bp, Homo sapiens
cagggctcctggg

SEQ ID NO: 2580198 - DNA, 19 bp, Homo sapiens
cagggctctgccccagagg

SEQ ID NO: 2580199 - DNA, 21 bp, Homo sapiens
cagggctctgccccagaggcc

SEQ ID NO: 2580200 - DNA, 18 bp, Homo sapiens
cagggctgaggcctctca

SEQ ID NO: 2580201 - DNA, 13 bp, Homo sapiens
cagggctggccca

SEQ ID NO: 2580202 - DNA, 14 bp, Homo sapiens
cagggctggcccag

SEQ ID NO: 2580203 - DNA, 17 bp, Homo sapiens
cagggctggcccagccc

SEQ ID NO: 2580204 - DNA, 21 bp, Homo sapiens
cagggctggcccagccctgct

SEQ ID NO: 2580205 - DNA, 22 bp, Homo sapiens
cagggctggcccagccctgctg

SEQ ID NO: 2580206 - DNA, 16 bp, Homo sapiens
caggggaaaatgaagg

SEQ ID NO: 2580207 - DNA, 15 bp, Homo sapiens
caggggactcagccc

SEQ ID NO: 2580208 - DNA, 23 bp, Homo sapiens
caggggactcagccctgaggtga

SEQ ID NO: 2580209 - DNA, 18 bp, Homo sapiens
caggggagtcccgtcagg

SEQ ID NO: 2580210 - DNA, 20 bp, Homo sapiens
caggggcatgtattggcctg

SEQ ID NO: 2580211 - DNA, 22 bp, Homo sapiens
caggggcatgtattggcctgga

SEQ ID NO: 2580212 - DNA, 15 bp, Homo sapiens
caggggccagaggaa

SEQ ID NO: 2580213 - DNA, 15 bp, Homo sapiens
caggggcccctccag

SEQ ID NO: 2580214 - DNA, 17 bp, Homo sapiens
caggggcccctccagct

SEQ ID NO: 2580215 - DNA, 19 bp, Homo sapiens
caggggcccctccagcttg

SEQ ID NO: 2580216 - DNA, 20 bp, Homo sapiens
caggggcccctccagcttgt

SEQ ID NO: 2580217 - DNA, 20 bp, Homo sapiens
caggggggttgtgaggcctg

SEQ ID NO: 2580218 - DNA, 18 bp, Homo sapiens
caggggtcccagccaccc

SEQ ID NO: 2580219 - DNA, 21 bp, Homo sapiens
caggggtcgtcaccacctctc

SEQ ID NO: 2580220 - DNA, 17 bp, Homo sapiens
caggggtgccccctcct

SEQ ID NO: 2580221 - DNA, 23 bp, Homo sapiens
caggggtgccccctcctctccca

SEQ ID NO: 2580222 - DNA, 14 bp, Homo sapiens
caggggtgggacac

SEQ ID NO: 2580223 - DNA, 15 bp, Homo sapiens
caggggtgggacacc

SEQ ID NO: 2580224 - DNA, 13 bp, Homo sapiens
caggggttcgaga

SEQ ID NO: 2580225 - DNA, 17 bp, Homo sapiens
caggggttcgagaccag

SEQ ID NO: 2580226 - DNA, 13 bp, Homo sapiens
caggggttgcagt

SEQ ID NO: 2580227 - DNA, 22 bp, Homo sapiens
caggggttgcagtgagcggaga

SEQ ID NO: 2580228 - DNA, 20 bp, Homo sapiens
cagggtagcccgcctgccag

SEQ ID NO: 2580229 - DNA, 21 bp, Homo sapiens
cagggtattccagagtgggga

SEQ ID NO: 2580230 - DNA, 17 bp, Homo sapiens
cagggtcccatttctca

SEQ ID NO: 2580231 - DNA, 14 bp, Homo sapiens
cagggtccctggtg

SEQ ID NO: 2580232 - DNA, 21 bp, Homo sapiens
cagggtctcactatgttgccc

SEQ ID NO: 2580233 - DNA, 23 bp, Homo sapiens
cagggtctcactatgttgcccag

SEQ ID NO: 2580234 - DNA, 15 bp, Homo sapiens
cagggtctctgctgc

SEQ ID NO: 2580235 - DNA, 17 bp, Homo sapiens
cagggtctctgctgccg

SEQ ID NO: 2580236 - DNA, 18 bp, Homo sapiens
cagggtctctgctgccgc

SEQ ID NO: 2580237 - DNA, 19 bp, Homo sapiens
cagggtctctgctgccgcc

SEQ ID NO: 2580238 - DNA, 14 bp, Homo sapiens
cagggtctgggcag

SEQ ID NO: 2580239 - DNA, 15 bp, Homo sapiens
cagggtcttttcatc

SEQ ID NO: 2580240 - DNA, 14 bp, Homo sapiens
cagggtgagagctg

SEQ ID NO: 2580241 - DNA, 15 bp, Homo sapiens
cagggtgatgccagg

SEQ ID NO: 2580242 - DNA, 16 bp, Homo sapiens
cagggtggtgctggga

SEQ ID NO: 2580243 - DNA, 20 bp, Homo sapiens
cagggttcccccagccctgt

SEQ ID NO: 2580244 - DNA, 21 bp, Homo sapiens
cagggttcccccagccctgtg

SEQ ID NO: 2580245 - DNA, 18 bp, Homo sapiens
cagggttgatcacactct

SEQ ID NO: 2580246 - DNA, 15 bp, Homo sapiens
cagggttggcccctg

SEQ ID NO: 2580247 - DNA, 16 bp, Homo sapiens
cagggttggcccctgc

SEQ ID NO: 2580248 - DNA, 17 bp, Homo sapiens
cagggttggcccctgcc

SEQ ID NO: 2580249 - DNA, 14 bp, Homo sapiens
cagggttgggccca

SEQ ID NO: 2580250 - DNA, 19 bp, Homo sapiens
cagggtttcgagaagctgc

SEQ ID NO: 2580251 - DNA, 22 bp, Homo sapiens
caggtaatgagggactggaacc

SEQ ID NO: 2580252 - DNA, 15 bp, Homo sapiens
caggtagctgcccct

SEQ ID NO: 2580253 - DNA, 21 bp, Homo sapiens
caggtagctgcccctggctct

SEQ ID NO: 2580254 - DNA, 14 bp, Homo sapiens
caggtatctccagg

SEQ ID NO: 2580255 - DNA, 23 bp, Homo sapiens
caggtatggaagggtttgtggct

SEQ ID NO: 2580256 - DNA, 14 bp, Homo sapiens
caggtatgttgcct

SEQ ID NO: 2580257 - DNA, 16 bp, Homo sapiens
caggtatgttgccttt

SEQ ID NO: 2580258 - DNA, 23 bp, Homo sapiens
caggtcaatacagtacaggcagc

SEQ ID NO: 2580259 - DNA, 15 bp, Homo sapiens
caggtcctcagagaa

SEQ ID NO: 2580260 - DNA, 21 bp, Homo sapiens
caggtcctgcagtctggctga

SEQ ID NO: 2580261 - DNA, 14 bp, Homo sapiens
catcaatgttcatt

SEQ ID NO: 2580262 - DNA, 17 bp, Homo sapiens
catcacagctaacaatt

SEQ ID NO: 2580263 - DNA, 13 bp, Homo sapiens
catcacagggcag

SEQ ID NO: 2580264 - DNA, 15 bp, Homo sapiens
catcacagggcagag

SEQ ID NO: 2580265 - DNA, 15 bp, Homo sapiens
catcaccaacgtctg

SEQ ID NO: 2580266 - DNA, 20 bp, Homo sapiens
catcacccttaccatgtgcc

SEQ ID NO: 2580267 - DNA, 12 bp, Homo sapiens
catcacctcagg

SEQ ID NO: 2580268 - DNA, 18 bp, Homo sapiens
catcacctcaggccaggt

SEQ ID NO: 2580269 - DNA, 17 bp, Homo sapiens
catcaccttaggcaggg

SEQ ID NO: 2580270 - DNA, 20 bp, Homo sapiens
catcaccttaggcagggaag

SEQ ID NO: 2580271 - DNA, 22 bp, Homo sapiens
catcaccttaggcagggaagtg

SEQ ID NO: 2580272 - DNA, 14 bp, Homo sapiens
catcacgcctgtgc

SEQ ID NO: 2580273 - DNA, 15 bp, Homo sapiens
catcactcccctcca

SEQ ID NO: 2580274 - DNA, 12 bp, Homo sapiens
catcacttccct

SEQ ID NO: 2580275 - DNA, 14 bp, Homo sapiens
catcacttgtacaa

SEQ ID NO: 2580276 - DNA, 16 bp, Homo sapiens
catcagagcaaatttg

SEQ ID NO: 2580277 - DNA, 18 bp, Homo sapiens
catcagcacgatttctgt

SEQ ID NO: 2580278 - DNA, 18 bp, Homo sapiens
catcagctgctgaaacaa

SEQ ID NO: 2580279 - DNA, 17 bp, Homo sapiens
catcagctgtaagaaga

SEQ ID NO: 2580280 - DNA, 23 bp, Homo sapiens
catcagcttaggggctgctgacc

SEQ ID NO: 2580281 - DNA, 13 bp, Homo sapiens
catcaggatgaac

SEQ ID NO: 2580282 - DNA, 15 bp, Homo sapiens
catcaggccaggccc

SEQ ID NO: 2580283 - DNA, 23 bp, Homo sapiens
catcaggccaggccctctgccca

SEQ ID NO: 2580284 - DNA, 14 bp, Homo sapiens
catcagggacagga

SEQ ID NO: 2580285 - DNA, 20 bp, Homo sapiens
catcagtattgaagcatttt

SEQ ID NO: 2580286 - DNA, 22 bp, Homo sapiens
catcagtattgaagcattttat

SEQ ID NO: 2580287 - DNA, 15 bp, Homo sapiens
catcagtgctccctc

SEQ ID NO: 2580288 - DNA, 18 bp, Homo sapiens
catcagtggcatggctcc

SEQ ID NO: 2580289 - DNA, 22 bp, Homo sapiens
catcagtggcatggctccagtc

SEQ ID NO: 2580290 - DNA, 18 bp, Homo sapiens
catcagttagagctgaca

SEQ ID NO: 2580291 - DNA, 23 bp, Homo sapiens
catcataaaataaagtatatata

SEQ ID NO: 2580292 - DNA, 22 bp, Homo sapiens
catcataggaagggaccaaggc

SEQ ID NO: 2580293 - DNA, 19 bp, Homo sapiens
catcatcaaggcactgcct

SEQ ID NO: 2580294 - DNA, 20 bp, Homo sapiens
catcatcaaggcactgcctg

SEQ ID NO: 2580295 - DNA, 17 bp, Homo sapiens
catcatcagtggagcca

SEQ ID NO: 2580296 - DNA, 13 bp, Homo sapiens
catcatcccagct

SEQ ID NO: 2580297 - DNA, 15 bp, Homo sapiens
catcatcccagctgc

SEQ ID NO: 2580298 - DNA, 16 bp, Homo sapiens
catcatcctaagctat

SEQ ID NO: 2580299 - DNA, 21 bp, Homo sapiens
catcatggattcattacagct

SEQ ID NO: 2580300 - DNA, 15 bp, Homo sapiens
catcattctctgtct

SEQ ID NO: 2580301 - DNA, 16 bp, Homo sapiens
catcattctctgtctc

SEQ ID NO: 2580302 - DNA, 24 bp, Homo sapiens
catcattctctgtctcatccatca

SEQ ID NO: 2580303 - DNA, 14 bp, Homo sapiens
catcattgtatata

SEQ ID NO: 2580304 - DNA, 18 bp, Homo sapiens
catcatttttccttccct

SEQ ID NO: 2580305 - DNA, 14 bp, Homo sapiens
catccaaggagaaa

SEQ ID NO: 2580306 - DNA, 14 bp, Homo sapiens
catccaatcctcac

SEQ ID NO: 2580307 - DNA, 18 bp, Homo sapiens
catccaatcctcactggg

SEQ ID NO: 2580308 - DNA, 19 bp, Homo sapiens
catccaatcctcactgggt

SEQ ID NO: 2580309 - DNA, 19 bp, Homo sapiens
catccaatctaaccacatc

SEQ ID NO: 2580310 - DNA, 14 bp, Homo sapiens
catccaatgctcaa

SEQ ID NO: 2580311 - DNA, 18 bp, Homo sapiens
catccacattgttttaaa

SEQ ID NO: 2580312 - DNA, 12 bp, Homo sapiens
catccaccccat

SEQ ID NO: 2580313 - DNA, 12 bp, Homo sapiens
catccacctcct

SEQ ID NO: 2580314 - DNA, 13 bp, Homo sapiens
catccacctcctt

SEQ ID NO: 2580315 - DNA, 14 bp, Homo sapiens
catccactctaccc

SEQ ID NO: 2580316 - DNA, 14 bp, Homo sapiens
catccactgtgcca

SEQ ID NO: 2580317 - DNA, 16 bp, Homo sapiens
catccatagtagtatg

SEQ ID NO: 2580318 - DNA, 16 bp, Homo sapiens
catccatgtgtggact

SEQ ID NO: 2580319 - DNA, 18 bp, Homo sapiens
catccatgtgtggactca

SEQ ID NO: 2580320 - DNA, 19 bp, Homo sapiens
catccatgtttgtaaaact

SEQ ID NO: 2580321 - DNA, 22 bp, Homo sapiens
catccatttatttggcatctgt

SEQ ID NO: 2580322 - DNA, 19 bp, Homo sapiens
catcccacgcactccatga

SEQ ID NO: 2580323 - DNA, 13 bp, Homo sapiens
catcccagcccca

SEQ ID NO: 2580324 - DNA, 19 bp, Homo sapiens
catcccaggcttcaccctg

SEQ ID NO: 2580325 - DNA, 20 bp, Homo sapiens
catcccagtggcctcaaccc

SEQ ID NO: 2580326 - DNA, 21 bp, Homo sapiens
catccccaggggtcccagcca

SEQ ID NO: 2580327 - DNA, 15 bp, Homo sapiens
catccccatcctcca

SEQ ID NO: 2580328 - DNA, 12 bp, Homo sapiens
catccccctgcc

SEQ ID NO: 2580329 - DNA, 13 bp, Homo sapiens
catccccctgccc

SEQ ID NO: 2580330 - DNA, 14 bp, Homo sapiens
catccccctgccct

SEQ ID NO: 2580331 - DNA, 19 bp, Homo sapiens
catccccctgccctcgtgg

SEQ ID NO: 2580332 - DNA, 14 bp, Homo sapiens
catcccctggactg

SEQ ID NO: 2580333 - DNA, 14 bp, Homo sapiens
catcccgtgttctc

SEQ ID NO: 2580334 - DNA, 18 bp, Homo sapiens
catccctaatgctgcaga

SEQ ID NO: 2580335 - DNA, 13 bp, Homo sapiens
catccctccccag

SEQ ID NO: 2580336 - DNA, 17 bp, Homo sapiens
catccctgaaggccccg

SEQ ID NO: 2580337 - DNA, 18 bp, Homo sapiens
catccctgaggagccagg

SEQ ID NO: 2580338 - DNA, 23 bp, Homo sapiens
catcccttgaccaggcctgggcc

SEQ ID NO: 2580339 - DNA, 16 bp, Homo sapiens
catccgaggcagggtc

SEQ ID NO: 2580340 - DNA, 23 bp, Homo sapiens
catccgaggcagggtcaggagag

SEQ ID NO: 2580341 - DNA, 15 bp, Homo sapiens
catccgccagggccc

SEQ ID NO: 2580342 - DNA, 16 bp, Homo sapiens
catccggcagcctgga

SEQ ID NO: 2580343 - DNA, 16 bp, Homo sapiens
catccggcccccagag

SEQ ID NO: 2580344 - DNA, 20 bp, Homo sapiens
catcctaatcatccaatgct

SEQ ID NO: 2580345 - DNA, 19 bp, Homo sapiens
catcctaccctcgggccca

SEQ ID NO: 2580346 - DNA, 23 bp, Homo sapiens
catcctaccctcgggcccacctg

SEQ ID NO: 2580347 - DNA, 24 bp, Homo sapiens
catcctatcagcctgtctcttcca

SEQ ID NO: 2580348 - DNA, 19 bp, Homo sapiens
catcctcaaacactgcagg

SEQ ID NO: 2580349 - DNA, 15 bp, Homo sapiens
catcctcatacccac

SEQ ID NO: 2580350 - DNA, 12 bp, Homo sapiens
catcctccagct

SEQ ID NO: 2580351 - DNA, 12 bp, Homo sapiens
catcctcccctt

SEQ ID NO: 2580352 - DNA, 18 bp, Homo sapiens
catcctctgtacagagcc

SEQ ID NO: 2580353 - DNA, 21 bp, Homo sapiens
catcctctgtacagagcccac

SEQ ID NO: 2580354 - DNA, 17 bp, Homo sapiens
catcctgactctgcccc

SEQ ID NO: 2580355 - DNA, 20 bp, Homo sapiens
catcctgactctgccccctg

SEQ ID NO: 2580356 - DNA, 22 bp, Homo sapiens
catcctggcacccggcccctgc

SEQ ID NO: 2580357 - DNA, 15 bp, Homo sapiens
catcctgtcccacca

SEQ ID NO: 2580358 - DNA, 15 bp, Homo sapiens
catcctgtgtttcta

SEQ ID NO: 2580359 - DNA, 14 bp, Homo sapiens
catcctttccagca

SEQ ID NO: 2580360 - DNA, 14 bp, Homo sapiens
catctaataaaaaa

SEQ ID NO: 2580361 - DNA, 14 bp, Homo sapiens
catctagcaaatgt

SEQ ID NO: 2580362 - DNA, 14 bp, Homo sapiens
catctataaagaag

SEQ ID NO: 2580363 - DNA, 15 bp, Homo sapiens
catctatttctgaga

SEQ ID NO: 2580364 - DNA, 16 bp, Homo sapiens
catctatttctgagaa

SEQ ID NO: 2580365 - DNA, 18 bp, Homo sapiens
catctcagaccctttagc

SEQ ID NO: 2580366 - DNA, 20 bp, Homo sapiens
catctcagcctaccatgaga

SEQ ID NO: 2580367 - DNA, 17 bp, Homo sapiens
catctcaggccacctgc

SEQ ID NO: 2580368 - DNA, 20 bp, Homo sapiens
catctcaggccacctgcccc

SEQ ID NO: 2580369 - DNA, 12 bp, Homo sapiens
catctcaggggc

SEQ ID NO: 2580370 - DNA, 23 bp, Homo sapiens
catctcatgtatcatctggatag

SEQ ID NO: 2580371 - DNA, 14 bp, Homo sapiens
catctccaagaatg

SEQ ID NO: 2580372 - DNA, 16 bp, Homo sapiens
catctccaagaatgct

SEQ ID NO: 2580373 - DNA, 23 bp, Homo sapiens
catctccaagaatgctgaaacca

SEQ ID NO: 2580374 - DNA, 19 bp, Homo sapiens
catctccagggagtcccct

SEQ ID NO: 2580375 - DNA, 22 bp, Homo sapiens
catctccagggagtcccctccc

SEQ ID NO: 2580376 - DNA, 19 bp, Homo sapiens
catctcctgtgcatgggtg

SEQ ID NO: 2580377 - DNA, 21 bp, Homo sapiens
catctcgccacccctccttcc

SEQ ID NO: 2580378 - DNA, 19 bp, Homo sapiens
catctctaattggaagaaa

SEQ ID NO: 2580379 - DNA, 18 bp, Homo sapiens
catctctcagaagggagg

SEQ ID NO: 2580380 - DNA, 20 bp, Homo sapiens
catctctccctcccctgcca

SEQ ID NO: 2580381 - DNA, 15 bp, Homo sapiens
catctctctggccct

SEQ ID NO: 2580382 - DNA, 14 bp, Homo sapiens
catctctctttaat

SEQ ID NO: 2580383 - DNA, 15 bp, Homo sapiens
catctctgcaatctt

SEQ ID NO: 2580384 - DNA, 16 bp, Homo sapiens
catctctggatgcctg

SEQ ID NO: 2580385 - DNA, 18 bp, Homo sapiens
catctgactcacaagaag

SEQ ID NO: 2580386 - DNA, 18 bp, Homo sapiens
catctgcacccccctggg

SEQ ID NO: 2580387 - DNA, 20 bp, Homo sapiens
catctgcattttcaccccac

SEQ ID NO: 2580388 - DNA, 13 bp, Homo sapiens
catctgcccaggg

SEQ ID NO: 2580389 - DNA, 21 bp, Homo sapiens
catctgcccaggggtgccccc

SEQ ID NO: 2580390 - DNA, 14 bp, Homo sapiens
catctgcccctccc

SEQ ID NO: 2580391 - DNA, 15 bp, Homo sapiens
catctgcccctcccc

SEQ ID NO: 2580392 - DNA, 16 bp, Homo sapiens
catctgcccctccccc

SEQ ID NO: 2580393 - DNA, 16 bp, Homo sapiens
catctgcgtgacaata

SEQ ID NO: 2580394 - DNA, 20 bp, Homo sapiens
catctgcttacaattccctg

SEQ ID NO: 2580395 - DNA, 22 bp, Homo sapiens
catctgcttacaattccctgct

SEQ ID NO: 2580396 - DNA, 19 bp, Homo sapiens
catctggaaccatcagaaa

SEQ ID NO: 2580397 - DNA, 21 bp, Homo sapiens
catctggaaggggatcccacc

SEQ ID NO: 2580398 - DNA, 16 bp, Homo sapiens
catctggataggagcc

SEQ ID NO: 2580399 - DNA, 18 bp, Homo sapiens
catctggataggagcctg

SEQ ID NO: 2580400 - DNA, 20 bp, Homo sapiens
catctggcaacatctttatc

SEQ ID NO: 2580401 - DNA, 23 bp, Homo sapiens
catctggccgttgatgttggctg

SEQ ID NO: 2580402 - DNA, 18 bp, Homo sapiens
catctgggagtccccttt

SEQ ID NO: 2580403 - DNA, 19 bp, Homo sapiens
catctgggagtcccctttt

SEQ ID NO: 2580404 - DNA, 15 bp, Homo sapiens
catctgggggagtgg

SEQ ID NO: 2580405 - DNA, 18 bp, Homo sapiens
catctgtgaaaggaaaga

SEQ ID NO: 2580406 - DNA, 17 bp, Homo sapiens
catttgagcagggctca

SEQ ID NO: 2580407 - DNA, 22 bp, Homo sapiens
catttgagttattttaattatc

SEQ ID NO: 2580408 - DNA, 20 bp, Homo sapiens
catttgcactggagttctat

SEQ ID NO: 2580409 - DNA, 19 bp, Homo sapiens
catttgcctattcccacac

SEQ ID NO: 2580410 - DNA, 14 bp, Homo sapiens
catttgccttgctg

SEQ ID NO: 2580411 - DNA, 22 bp, Homo sapiens
catttgcgttccatgatgctgg

SEQ ID NO: 2580412 - DNA, 16 bp, Homo sapiens
catttgctttttcacc

SEQ ID NO: 2580413 - DNA, 17 bp, Homo sapiens
catttggggtagctaga

SEQ ID NO: 2580414 - DNA, 22 bp, Homo sapiens
catttggggtagctagaggaac

SEQ ID NO: 2580415 - DNA, 16 bp, Homo sapiens
catttgtgaaatgatg

SEQ ID NO: 2580416 - DNA, 11 bp, Homo sapiens
catttgtgagg

SEQ ID NO: 2580417 - DNA, 15 bp, Homo sapiens
catttgtgaggccca

SEQ ID NO: 2580418 - DNA, 20 bp, Homo sapiens
catttgtttgaactgataaa

SEQ ID NO: 2580419 - DNA, 22 bp, Homo sapiens
catttgtttgaactgataaaga

SEQ ID NO: 2580420 - DNA, 20 bp, Homo sapiens
cattttaaaaaaaaaggcat

SEQ ID NO: 2580421 - DNA, 13 bp, Homo sapiens
cattttaaataaa

SEQ ID NO: 2580422 - DNA, 15 bp, Homo sapiens
cattttaaataaaag

SEQ ID NO: 2580423 - DNA, 15 bp, Homo sapiens
cattttagtcacttt

SEQ ID NO: 2580424 - DNA, 16 bp, Homo sapiens
cattttagtcactttt

SEQ ID NO: 2580425 - DNA, 21 bp, Homo sapiens
cattttataaatcgcttttga

SEQ ID NO: 2580426 - DNA, 23 bp, Homo sapiens
cattttataaatcgcttttgata

SEQ ID NO: 2580427 - DNA, 21 bp, Homo sapiens
cattttattttattatgcatg

SEQ ID NO: 2580428 - DNA, 23 bp, Homo sapiens
cattttattttattatgcatgaa

SEQ ID NO: 2580429 - DNA, 17 bp, Homo sapiens
cattttccccccactct

SEQ ID NO: 2580430 - DNA, 12 bp, Homo sapiens
cattttctgtgg

SEQ ID NO: 2580431 - DNA, 16 bp, Homo sapiens
cattttgcagcagtga

SEQ ID NO: 2580432 - DNA, 22 bp, Homo sapiens
cattttgcagcagtgagtctct

SEQ ID NO: 2580433 - DNA, 18 bp, Homo sapiens
cattttgctaaatgtgaa

SEQ ID NO: 2580434 - DNA, 17 bp, Homo sapiens
cattttgctattgtaaa

SEQ ID NO: 2580435 - DNA, 18 bp, Homo sapiens
cattttggaagttttcag

SEQ ID NO: 2580436 - DNA, 20 bp, Homo sapiens
cattttgtataattgtatcg

SEQ ID NO: 2580437 - DNA, 21 bp, Homo sapiens
cattttgtataattgtatcgt

SEQ ID NO: 2580438 - DNA, 22 bp, Homo sapiens
cattttgtggtcattaagcatt

SEQ ID NO: 2580439 - DNA, 15 bp, Homo sapiens
catttttaagtgctg

SEQ ID NO: 2580440 - DNA, 15 bp, Homo sapiens
catttttacaataaa

SEQ ID NO: 2580441 - DNA, 19 bp, Homo sapiens
catttttagtagagacagg

SEQ ID NO: 2580442 - DNA, 13 bp, Homo sapiens
catttttgtattt

SEQ ID NO: 2580443 - DNA, 17 bp, Homo sapiens
ccaaaaagaccagacta

SEQ ID NO: 2580444 - DNA, 18 bp, Homo sapiens
ccaaaacaaacaaacaga

SEQ ID NO: 2580445 - DNA, 11 bp, Homo sapiens
ccaaaactgtg

SEQ ID NO: 2580446 - DNA, 22 bp, Homo sapiens
ccaaaagattgctgaaatttta

SEQ ID NO: 2580447 - DNA, 18 bp, Homo sapiens
ccaaaagtggcctctttg

SEQ ID NO: 2580448 - DNA, 17 bp, Homo sapiens
ccaaaagttttcctgag

SEQ ID NO: 2580449 - DNA, 18 bp, Homo sapiens
ccaaaagttttcctgaga

SEQ ID NO: 2580450 - DNA, 16 bp, Homo sapiens
ccaaaataagaaaaga

SEQ ID NO: 2580451 - DNA, 18 bp, Homo sapiens
ccaaaataagaaaagatg

SEQ ID NO: 2580452 - DNA, 20 bp, Homo sapiens
ccaaaatcataagatatttt

SEQ ID NO: 2580453 - DNA, 20 bp, Homo sapiens
ccaaaatgttggtcatttta

SEQ ID NO: 2580454 - DNA, 21 bp, Homo sapiens
ccaaaatgttggtcattttat

SEQ ID NO: 2580455 - DNA, 16 bp, Homo sapiens
ccaaaattatttcaga

SEQ ID NO: 2580456 - DNA, 20 bp, Homo sapiens
ccaaacaccttccagctcct

SEQ ID NO: 2580457 - DNA, 22 bp, Homo sapiens
ccaaacaccttccagctcctgt

SEQ ID NO: 2580458 - DNA, 13 bp, Homo sapiens
ccaaacagtgaca

SEQ ID NO: 2580459 - DNA, 11 bp, Homo sapiens
ccaaacctctg

SEQ ID NO: 2580460 - DNA, 14 bp, Homo sapiens
ccaaacctctgttc

SEQ ID NO: 2580461 - DNA, 21 bp, Homo sapiens
ccaaacctctgttcagtgtaa

SEQ ID NO: 2580462 - DNA, 13 bp, Homo sapiens
ccaaactctgcca

SEQ ID NO: 2580463 - DNA, 12 bp, Homo sapiens
ccaaactgccta

SEQ ID NO: 2580464 - DNA, 14 bp, Homo sapiens
ccaaagagcctgga

SEQ ID NO: 2580465 - DNA, 17 bp, Homo sapiens
ccaaagagcctggagaa

SEQ ID NO: 2580466 - DNA, 21 bp, Homo sapiens
ccaaagccaataacacacagc

SEQ ID NO: 2580467 - DNA, 23 bp, Homo sapiens
ccaaagccccttgctctcccctg

SEQ ID NO: 2580468 - DNA, 16 bp, Homo sapiens
ccaaagctaggcctgg

SEQ ID NO: 2580469 - DNA, 22 bp, Homo sapiens
ccaaaggcattttattgcttga

SEQ ID NO: 2580470 - DNA, 21 bp, Homo sapiens
ccaaaggccatggagagctgg

SEQ ID NO: 2580471 - DNA, 23 bp, Homo sapiens
ccaaagtgccactcattcctgta

SEQ ID NO: 2580472 - DNA, 22 bp, Homo sapiens
ccaaagtggtatagaaatgctg

SEQ ID NO: 2580473 - DNA, 23 bp, Homo sapiens
ccaaatcagctgctactactcct

SEQ ID NO: 2580474 - DNA, 16 bp, Homo sapiens
ccaaatcatagtggct

SEQ ID NO: 2580475 - DNA, 22 bp, Homo sapiens
ccaaatggaaatgggcagagca

SEQ ID NO: 2580476 - DNA, 23 bp, Homo sapiens
ccaaattccttggcatgccttcc

SEQ ID NO: 2580477 - DNA, 22 bp, Homo sapiens
ccaaattctttcagtggctacc

SEQ ID NO: 2580478 - DNA, 22 bp, Homo sapiens
ccaaattgctcctaagcttcaa

SEQ ID NO: 2580479 - DNA, 23 bp, Homo sapiens
ccaaatttcatacctatcatctt

SEQ ID NO: 2580480 - DNA, 17 bp, Homo sapiens
ccaaattttctttttat

SEQ ID NO: 2580481 - DNA, 14 bp, Homo sapiens
ccaacaccacagac

SEQ ID NO: 2580482 - DNA, 15 bp, Homo sapiens
ccaacaccacagaca

SEQ ID NO: 2580483 - DNA, 18 bp, Homo sapiens
ccaacaccacagacacac

SEQ ID NO: 2580484 - DNA, 21 bp, Homo sapiens
ccaacaccacagacacacaca

SEQ ID NO: 2580485 - DNA, 13 bp, Homo sapiens
ccaacaccaggga

SEQ ID NO: 2580486 - DNA, 20 bp, Homo sapiens
ccaacaccctgtctaaaaaa

SEQ ID NO: 2580487 - DNA, 14 bp, Homo sapiens
ccaacacgagcagg

SEQ ID NO: 2580488 - DNA, 21 bp, Homo sapiens
ccaacacgagcaggctactgt

SEQ ID NO: 2580489 - DNA, 21 bp, Homo sapiens
ccaacactcaagaagcaggct

SEQ ID NO: 2580490 - DNA, 19 bp, Homo sapiens
ccaacactgtgccctggtg

SEQ ID NO: 2580491 - DNA, 17 bp, Homo sapiens
ccaacagatgcttttct

SEQ ID NO: 2580492 - DNA, 16 bp, Homo sapiens
ccaacaggaggacaat

SEQ ID NO: 2580493 - DNA, 20 bp, Homo sapiens
ccaacaggaggacaattcat

SEQ ID NO: 2580494 - DNA, 14 bp, Homo sapiens
ccaacaggtggcag

SEQ ID NO: 2580495 - DNA, 15 bp, Homo sapiens
ccaacaggtggcagg

SEQ ID NO: 2580496 - DNA, 19 bp, Homo sapiens
ccaacaggtggcaggacca

SEQ ID NO: 2580497 - DNA, 23 bp, Homo sapiens
ccaacaggtggcaggaccaggac

SEQ ID NO: 2580498 - DNA, 13 bp, Homo sapiens
ccaacagtgtgaa

SEQ ID NO: 2580499 - DNA, 14 bp, Homo sapiens
ccaacagtgtgaag

SEQ ID NO: 2580500 - DNA, 17 bp, Homo sapiens
ccaacatactcccatct

SEQ ID NO: 2580501 - DNA, 13 bp, Homo sapiens
ccaacatcaacat

SEQ ID NO: 2580502 - DNA, 17 bp, Homo sapiens
ccaacatcgtgaaaccc

SEQ ID NO: 2580503 - DNA, 20 bp, Homo sapiens
ccaaccaagtggctcccaca

SEQ ID NO: 2580504 - DNA, 18 bp, Homo sapiens
ccaacccccaccccacac

SEQ ID NO: 2580505 - DNA, 18 bp, Homo sapiens
ccaaccccccacctgcca

SEQ ID NO: 2580506 - DNA, 12 bp, Homo sapiens
ccaaccctcatc

SEQ ID NO: 2580507 - DNA, 16 bp, Homo sapiens
ccaaccctgcccctgc

SEQ ID NO: 2580508 - DNA, 12 bp, Homo sapiens
ccaaccctgtct

SEQ ID NO: 2580509 - DNA, 13 bp, Homo sapiens
ccaacgtctgtgc

SEQ ID NO: 2580510 - DNA, 20 bp, Homo sapiens
ccaactaatgccttactctt

SEQ ID NO: 2580511 - DNA, 18 bp, Homo sapiens
ccaactagacattctgtc

SEQ ID NO: 2580512 - DNA, 14 bp, Homo sapiens
ccaactcacctgag

SEQ ID NO: 2580513 - DNA, 12 bp, Homo sapiens
ccaactgctgct

SEQ ID NO: 2580514 - DNA, 13 bp, Homo sapiens
ccaactgctgctt

SEQ ID NO: 2580515 - DNA, 13 bp, Homo sapiens
ccaactgtatata

SEQ ID NO: 2580516 - DNA, 18 bp, Homo sapiens
ccaactgtgttcattaga

SEQ ID NO: 2580517 - DNA, 19 bp, Homo sapiens
ccaacttgagggcccagag

SEQ ID NO: 2580518 - DNA, 14 bp, Homo sapiens
ccaactttctgtaa

SEQ ID NO: 2580519 - DNA, 17 bp, Homo sapiens
ccaactttctgtaaact

SEQ ID NO: 2580520 - DNA, 14 bp, Homo sapiens
ccaagaagcccagg

SEQ ID NO: 2580521 - DNA, 19 bp, Homo sapiens
ccaagaagcccaggaaagg

SEQ ID NO: 2580522 - DNA, 12 bp, Homo sapiens
ccaagaagggct

SEQ ID NO: 2580523 - DNA, 13 bp, Homo sapiens
ccaagaagggcta

SEQ ID NO: 2580524 - DNA, 22 bp, Homo sapiens
ccaagaagggctagaacctgga

SEQ ID NO: 2580525 - DNA, 12 bp, Homo sapiens
ccaagaatctat

SEQ ID NO: 2580526 - DNA, 13 bp, Homo sapiens
ccaagaatgctga

SEQ ID NO: 2580527 - DNA, 14 bp, Homo sapiens
ccaagaatgctgaa

SEQ ID NO: 2580528 - DNA, 18 bp, Homo sapiens
ccaagacagatgccccag

SEQ ID NO: 2580529 - DNA, 19 bp, Homo sapiens
ccaagacctgttggttcca

SEQ ID NO: 2580530 - DNA, 22 bp, Homo sapiens
ccaagacttggcaacagaagca

SEQ ID NO: 2580531 - DNA, 12 bp, Homo sapiens
ccaagagagaaa

SEQ ID NO: 2580532 - DNA, 14 bp, Homo sapiens
ccaagagagaaaga

SEQ ID NO: 2580533 - DNA, 12 bp, Homo sapiens
ccaagagatgaa

SEQ ID NO: 2580534 - DNA, 19 bp, Homo sapiens
ccaagagcagaggcagcga

SEQ ID NO: 2580535 - DNA, 22 bp, Homo sapiens
ccaagagctgaggcaattctaa

SEQ ID NO: 2580536 - DNA, 16 bp, Homo sapiens
ccaagcacagtggtgg

SEQ ID NO: 2580537 - DNA, 20 bp, Homo sapiens
ccaagcacagtggtggcagg

SEQ ID NO: 2580538 - DNA, 14 bp, Homo sapiens
ccaagcactgtgct

SEQ ID NO: 2580539 - DNA, 14 bp, Homo sapiens
ccaagcaggaagct

SEQ ID NO: 2580540 - DNA, 18 bp, Homo sapiens
ccaagcaggaagctcaga

SEQ ID NO: 2580541 - DNA, 20 bp, Homo sapiens
ccaagcaggaagctcagact

SEQ ID NO: 2580542 - DNA, 14 bp, Homo sapiens
ccaagcaggacatg

SEQ ID NO: 2580543 - DNA, 23 bp, Homo sapiens
ccaagcatttaatgtagccatgg

SEQ ID NO: 2580544 - DNA, 18 bp, Homo sapiens
ccaagcccgacttgctgt

SEQ ID NO: 2580545 - DNA, 13 bp, Homo sapiens
ccaagcctgacca

SEQ ID NO: 2580546 - DNA, 15 bp, Homo sapiens
ccaagctagaattcc

SEQ ID NO: 2580547 - DNA, 17 bp, Homo sapiens
ccaagctagaattccct

SEQ ID NO: 2580548 - DNA, 16 bp, Homo sapiens
ccaagctatcctggct

SEQ ID NO: 2580549 - DNA, 18 bp, Homo sapiens
ccaagctcaaagcgtgga

SEQ ID NO: 2580550 - DNA, 14 bp, Homo sapiens
ccaagctcagaagg

SEQ ID NO: 2580551 - DNA, 18 bp, Homo sapiens
ccatgagcctcagcatcc

SEQ ID NO: 2580552 - DNA, 17 bp, Homo sapiens
ccatgagctccagaccc

SEQ ID NO: 2580553 - DNA, 20 bp, Homo sapiens
ccatgagtggcatggccacc

SEQ ID NO: 2580554 - DNA, 22 bp, Homo sapiens
ccatgatggtgctgacctctgg

SEQ ID NO: 2580555 - DNA, 17 bp, Homo sapiens
ccatgatgtggagtggg

SEQ ID NO: 2580556 - DNA, 22 bp, Homo sapiens
ccatgatgtggagtggggcagt

SEQ ID NO: 2580557 - DNA, 21 bp, Homo sapiens
ccatgattaaccacttcagct

SEQ ID NO: 2580558 - DNA, 18 bp, Homo sapiens
ccatgcaatatttcctca

SEQ ID NO: 2580559 - DNA, 12 bp, Homo sapiens
ccatgcagagcg

SEQ ID NO: 2580560 - DNA, 20 bp, Homo sapiens
ccatgccaaagctagggtgg

SEQ ID NO: 2580561 - DNA, 16 bp, Homo sapiens
ccatgcccacctgccc

SEQ ID NO: 2580562 - DNA, 13 bp, Homo sapiens
ccatgcctgaggg

SEQ ID NO: 2580563 - DNA, 16 bp, Homo sapiens
ccatgcctgagggtgg

SEQ ID NO: 2580564 - DNA, 13 bp, Homo sapiens
ccatgcctgtcca

SEQ ID NO: 2580565 - DNA, 18 bp, Homo sapiens
ccatgctcctggcccact

SEQ ID NO: 2580566 - DNA, 16 bp, Homo sapiens
ccatgctgggaagacg

SEQ ID NO: 2580567 - DNA, 21 bp, Homo sapiens
ccatgctgggaagacgcctga

SEQ ID NO: 2580568 - DNA, 13 bp, Homo sapiens
ccatggactttgt

SEQ ID NO: 2580569 - DNA, 12 bp, Homo sapiens
ccatggagcccc

SEQ ID NO: 2580570 - DNA, 13 bp, Homo sapiens
ccatggagcccca

SEQ ID NO: 2580571 - DNA, 15 bp, Homo sapiens
ccatggagccccagc

SEQ ID NO: 2580572 - DNA, 18 bp, Homo sapiens
ccatggcttaatgcttct

SEQ ID NO: 2580573 - DNA, 16 bp, Homo sapiens
ccatgggcagagccca

SEQ ID NO: 2580574 - DNA, 17 bp, Homo sapiens
ccatgggcagagcccaa

SEQ ID NO: 2580575 - DNA, 13 bp, Homo sapiens
ccatgggctctga

SEQ ID NO: 2580576 - DNA, 19 bp, Homo sapiens
ccatgggcttcactgtata

SEQ ID NO: 2580577 - DNA, 11 bp, Homo sapiens
ccatggggaag

SEQ ID NO: 2580578 - DNA, 20 bp, Homo sapiens
ccatggtcggaaaacatgct

SEQ ID NO: 2580579 - DNA, 14 bp, Homo sapiens
ccatggttgagaaa

SEQ ID NO: 2580580 - DNA, 13 bp, Homo sapiens
ccatgtactgtag

SEQ ID NO: 2580581 - DNA, 16 bp, Homo sapiens
ccatgtagaaaatttg

SEQ ID NO: 2580582 - DNA, 19 bp, Homo sapiens
ccatgtagaagctgcatct

SEQ ID NO: 2580583 - DNA, 16 bp, Homo sapiens
ccatgtcgcctctgca

SEQ ID NO: 2580584 - DNA, 17 bp, Homo sapiens
ccatgtcgcctctgcat

SEQ ID NO: 2580585 - DNA, 19 bp, Homo sapiens
ccatgtcgcctctgcattc

SEQ ID NO: 2580586 - DNA, 21 bp, Homo sapiens
ccatgtgcctgatccagcctc

SEQ ID NO: 2580587 - DNA, 14 bp, Homo sapiens
ccatgtgtcctggt

SEQ ID NO: 2580588 - DNA, 10 bp, Homo sapiens
ccatgtgtgt

SEQ ID NO: 2580589 - DNA, 23 bp, Homo sapiens
ccatgttggccaggctggtctca

SEQ ID NO: 2580590 - DNA, 15 bp, Homo sapiens
ccatgtttctctggc

SEQ ID NO: 2580591 - DNA, 13 bp, Homo sapiens
ccatgtttgtaaa

SEQ ID NO: 2580592 - DNA, 23 bp, Homo sapiens
ccattaaaactgaagtctgaaat

SEQ ID NO: 2580593 - DNA, 12 bp, Homo sapiens
ccattaccctca

SEQ ID NO: 2580594 - DNA, 13 bp, Homo sapiens
ccattatcatgtg

SEQ ID NO: 2580595 - DNA, 15 bp, Homo sapiens
ccattatcatgtgta

SEQ ID NO: 2580596 - DNA, 17 bp, Homo sapiens
ccattatgaagaagaga

SEQ ID NO: 2580597 - DNA, 14 bp, Homo sapiens
ccattcattccatt

SEQ ID NO: 2580598 - DNA, 16 bp, Homo sapiens
ccattccagaatatct

SEQ ID NO: 2580599 - DNA, 17 bp, Homo sapiens
ccattccatttatcttt

SEQ ID NO: 2580600 - DNA, 20 bp, Homo sapiens
ccattcctggtacccagcca

SEQ ID NO: 2580601 - DNA, 24 bp, Homo sapiens
ccattcctggtacccagccatctg

SEQ ID NO: 2580602 - DNA, 17 bp, Homo sapiens
ccattctcaagccctgc

SEQ ID NO: 2580603 - DNA, 14 bp, Homo sapiens
ccattctccacctg

SEQ ID NO: 2580604 - DNA, 15 bp, Homo sapiens
ccattctccacctgc

SEQ ID NO: 2580605 - DNA, 16 bp, Homo sapiens
ccattctgcctgccca

SEQ ID NO: 2580606 - DNA, 20 bp, Homo sapiens
ccattctgcctgcccaggcc

SEQ ID NO: 2580607 - DNA, 22 bp, Homo sapiens
ccattctggattttgtcaagca

SEQ ID NO: 2580608 - DNA, 15 bp, Homo sapiens
ccattgccaccagga

SEQ ID NO: 2580609 - DNA, 13 bp, Homo sapiens
ccattgcctcctc

SEQ ID NO: 2580610 - DNA, 13 bp, Homo sapiens
ccattggtgttga

SEQ ID NO: 2580611 - DNA, 12 bp, Homo sapiens
ccattgtgtgag

SEQ ID NO: 2580612 - DNA, 13 bp, Homo sapiens
ccatttaaagctt

SEQ ID NO: 2580613 - DNA, 14 bp, Homo sapiens
ccatttagccacca

SEQ ID NO: 2580614 - DNA, 19 bp, Homo sapiens
ccatttagttctttgttat

SEQ ID NO: 2580615 - DNA, 17 bp, Homo sapiens
ccatttcatctatttct

SEQ ID NO: 2580616 - DNA, 13 bp, Homo sapiens
ccatttcctgaga

SEQ ID NO: 2580617 - DNA, 18 bp, Homo sapiens
ccatttctactctcccat

SEQ ID NO: 2580618 - DNA, 12 bp, Homo sapiens
ccatttctattt

SEQ ID NO: 2580619 - DNA, 17 bp, Homo sapiens
ccatttctatttattta

SEQ ID NO: 2580620 - DNA, 21 bp, Homo sapiens
ccatttgcgttccatgatgct

SEQ ID NO: 2580621 - DNA, 14 bp, Homo sapiens
ccatttgtgtgtgt

SEQ ID NO: 2580622 - DNA, 13 bp, Homo sapiens
ccattttctgtgg

SEQ ID NO: 2580623 - DNA, 17 bp, Homo sapiens
ccattttttaaggaaac

SEQ ID NO: 2580624 - DNA, 19 bp, Homo sapiens
ccattttttaaggaaacaa

SEQ ID NO: 2580625 - DNA, 14 bp, Homo sapiens
cccaaaaccacagc

SEQ ID NO: 2580626 - DNA, 13 bp, Homo sapiens
cccaaaaggcaga

SEQ ID NO: 2580627 - DNA, 18 bp, Homo sapiens
cccaaaaggcagaagcaa

SEQ ID NO: 2580628 - DNA, 21 bp, Homo sapiens
cccaaacaccttccagctcct

SEQ ID NO: 2580629 - DNA, 14 bp, Homo sapiens
cccaaagccagaca

SEQ ID NO: 2580630 - DNA, 23 bp, Homo sapiens
cccaaatggaaatgggcagagca

SEQ ID NO: 2580631 - DNA, 19 bp, Homo sapiens
cccaacaggaggacaattc

SEQ ID NO: 2580632 - DNA, 13 bp, Homo sapiens
cccaacccccacc

SEQ ID NO: 2580633 - DNA, 14 bp, Homo sapiens
cccaacccccaccc

SEQ ID NO: 2580634 - DNA, 16 bp, Homo sapiens
cccaacctcctgacct

SEQ ID NO: 2580635 - DNA, 23 bp, Homo sapiens
cccaacctgctctcctcttgcca

SEQ ID NO: 2580636 - DNA, 16 bp, Homo sapiens
cccaactcaccccagc

SEQ ID NO: 2580637 - DNA, 17 bp, Homo sapiens
cccaactcaccccagcc

SEQ ID NO: 2580638 - DNA, 17 bp, Homo sapiens
cccaagagatgaagagt

SEQ ID NO: 2580639 - DNA, 12 bp, Homo sapiens
cccaagctctgc

SEQ ID NO: 2580640 - DNA, 17 bp, Homo sapiens
cccaagctctgctcctc

SEQ ID NO: 2580641 - DNA, 21 bp, Homo sapiens
cccaagctgggccccagccca

SEQ ID NO: 2580642 - DNA, 22 bp, Homo sapiens
cccaaggaaagccccagcacta

SEQ ID NO: 2580643 - DNA, 17 bp, Homo sapiens
cccaagggaaagaaaag

SEQ ID NO: 2580644 - DNA, 19 bp, Homo sapiens
cccaagggcaaaattccca

SEQ ID NO: 2580645 - DNA, 22 bp, Homo sapiens
cccaagggcaaaattcccaggg

SEQ ID NO: 2580646 - DNA, 23 bp, Homo sapiens
cccaagggcctggcctgagctgg

SEQ ID NO: 2580647 - DNA, 18 bp, Homo sapiens
cccaagtgccagtcttgt

SEQ ID NO: 2580648 - DNA, 15 bp, Homo sapiens
cccaagtggtgccta

SEQ ID NO: 2580649 - DNA, 23 bp, Homo sapiens
cccaagttttaggacaaacagct

SEQ ID NO: 2580650 - DNA, 19 bp, Homo sapiens
cccaatcccagctacctca

SEQ ID NO: 2580651 - DNA, 20 bp, Homo sapiens
cccaatgcactttgttctgg

SEQ ID NO: 2580652 - DNA, 21 bp, Homo sapiens
cccacaaaggagagctagcag

SEQ ID NO: 2580653 - DNA, 20 bp, Homo sapiens
cccacaagaaatgaaagcag

SEQ ID NO: 2580654 - DNA, 22 bp, Homo sapiens
cccacaatcttaaggggcagct

SEQ ID NO: 2580655 - DNA, 10 bp, Homo sapiens
cccacacaca

SEQ ID NO: 2580656 - DNA, 18 bp, Homo sapiens
cccacacacacacacatg

SEQ ID NO: 2580657 - DNA, 20 bp, Homo sapiens
cccacacacacacacatgca

SEQ ID NO: 2580658 - DNA, 15 bp, Homo sapiens
cccacacctccacag

SEQ ID NO: 2580659 - DNA, 15 bp, Homo sapiens
cccacacctctgcca

SEQ ID NO: 2580660 - DNA, 22 bp, Homo sapiens
cccacactggggtgccgcctgc

SEQ ID NO: 2580661 - DNA, 23 bp, Homo sapiens
cccacagaaagactgagctcaag

SEQ ID NO: 2580662 - DNA, 23 bp, Homo sapiens
cccacaggaagcctgcagtcctg

SEQ ID NO: 2580663 - DNA, 19 bp, Homo sapiens
cccacaggacatttctcta

SEQ ID NO: 2580664 - DNA, 20 bp, Homo sapiens
cccacaggacatttctctaa

SEQ ID NO: 2580665 - DNA, 13 bp, Homo sapiens
cccacaggatcag

SEQ ID NO: 2580666 - DNA, 17 bp, Homo sapiens
cccacaggatcagtctg

SEQ ID NO: 2580667 - DNA, 14 bp, Homo sapiens
cccacaggcagctt

SEQ ID NO: 2580668 - DNA, 14 bp, Homo sapiens
cccacatcccaggc

SEQ ID NO: 2580669 - DNA, 20 bp, Homo sapiens
cccacatcccaggcttcacc

SEQ ID NO: 2580670 - DNA, 18 bp, Homo sapiens
cccacatgaggacatgat

SEQ ID NO: 2580671 - DNA, 16 bp, Homo sapiens
cccacatgtgacacat

SEQ ID NO: 2580672 - DNA, 19 bp, Homo sapiens
cccacatgtgacacatatg

SEQ ID NO: 2580673 - DNA, 14 bp, Homo sapiens
cccacattccgaca

SEQ ID NO: 2580674 - DNA, 13 bp, Homo sapiens
cccaccaggctgc

SEQ ID NO: 2580675 - DNA, 16 bp, Homo sapiens
cccaccaggctgctca

SEQ ID NO: 2580676 - DNA, 15 bp, Homo sapiens
cccacccaagggcct

SEQ ID NO: 2580677 - DNA, 18 bp, Homo sapiens
cccacccaagggcctggc

SEQ ID NO: 2580678 - DNA, 22 bp, Homo sapiens
cccacccacaatcctattctcg

SEQ ID NO: 2580679 - DNA, 13 bp, Homo sapiens
cccacccaggagg

SEQ ID NO: 2580680 - DNA, 15 bp, Homo sapiens
cccacccccacccaa

SEQ ID NO: 2580681 - DNA, 13 bp, Homo sapiens
cccacccccctca

SEQ ID NO: 2580682 - DNA, 15 bp, Homo sapiens
cccaccccctcaagc

SEQ ID NO: 2580683 - DNA, 15 bp, Homo sapiens
cccaccccttcccca

SEQ ID NO: 2580684 - DNA, 22 bp, Homo sapiens
cccaccccttccccactgcctg

SEQ ID NO: 2580685 - DNA, 14 bp, Homo sapiens
cccacccgatgctg

SEQ ID NO: 2580686 - DNA, 15 bp, Homo sapiens
cccacccgatgctgc

SEQ ID NO: 2580687 - DNA, 17 bp, Homo sapiens
cccaccctcagcacccc

SEQ ID NO: 2580688 - DNA, 14 bp, Homo sapiens
cccaccctccctgg

SEQ ID NO: 2580689 - DNA, 18 bp, Homo sapiens
cccaccctccctggagtg

SEQ ID NO: 2580690 - DNA, 20 bp, Homo sapiens
cccaccgcagacaggaccag

SEQ ID NO: 2580691 - DNA, 21 bp, Homo sapiens
cccaccgtccgccctgctcct

SEQ ID NO: 2580692 - DNA, 12 bp, Homo sapiens
cccacctcagcc

SEQ ID NO: 2580693 - DNA, 14 bp, Homo sapiens
cccacctcagcctc

SEQ ID NO: 2580694 - DNA, 17 bp, Homo sapiens
cccacctcagcctcccg

SEQ ID NO: 2580695 - DNA, 19 bp, Homo sapiens
cccacctctctcactcctt

SEQ ID NO: 2580696 - DNA, 22 bp, Homo sapiens
cccacctctctcactccttgaa

SEQ ID NO: 2580697 - DNA, 23 bp, Homo sapiens
cccctgggctctgccccagctct

SEQ ID NO: 2580698 - DNA, 21 bp, Homo sapiens
cccctgggtcagtctggtggg

SEQ ID NO: 2580699 - DNA, 20 bp, Homo sapiens
cccctgggtgggtggtgggg

SEQ ID NO: 2580700 - DNA, 19 bp, Homo sapiens
cccctggtggacagtcctg

SEQ ID NO: 2580701 - DNA, 18 bp, Homo sapiens
cccctgtggggatctcag

SEQ ID NO: 2580702 - DNA, 21 bp, Homo sapiens
cccctgtggggatctcagggg

SEQ ID NO: 2580703 - DNA, 14 bp, Homo sapiens
ccccttatccagga

SEQ ID NO: 2580704 - DNA, 17 bp, Homo sapiens
ccccttcacttctgacc

SEQ ID NO: 2580705 - DNA, 13 bp, Homo sapiens
ccccttccatgtg

SEQ ID NO: 2580706 - DNA, 17 bp, Homo sapiens
ccccttcctactcccag

SEQ ID NO: 2580707 - DNA, 19 bp, Homo sapiens
ccccttccttgctctgcac

SEQ ID NO: 2580708 - DNA, 20 bp, Homo sapiens
ccccttccttgctctgcacc

SEQ ID NO: 2580709 - DNA, 14 bp, Homo sapiens
ccccttcgctcctg

SEQ ID NO: 2580710 - DNA, 15 bp, Homo sapiens
ccccttcgctcctgt

SEQ ID NO: 2580711 - DNA, 17 bp, Homo sapiens
ccccttcgctcctgtgt

SEQ ID NO: 2580712 - DNA, 22 bp, Homo sapiens
ccccttctaggtggcaaggctg

SEQ ID NO: 2580713 - DNA, 12 bp, Homo sapiens
ccccttctctgc

SEQ ID NO: 2580714 - DNA, 14 bp, Homo sapiens
ccccttctctgctc

SEQ ID NO: 2580715 - DNA, 13 bp, Homo sapiens
ccccttctgaccc

SEQ ID NO: 2580716 - DNA, 17 bp, Homo sapiens
ccccttgcccttgccct

SEQ ID NO: 2580717 - DNA, 18 bp, Homo sapiens
ccccttgcccttgccctg

SEQ ID NO: 2580718 - DNA, 13 bp, Homo sapiens
ccccttgggcggc

SEQ ID NO: 2580719 - DNA, 23 bp, Homo sapiens
cccctttcctggacactcagacc

SEQ ID NO: 2580720 - DNA, 20 bp, Homo sapiens
cccctttgatgattaattca

SEQ ID NO: 2580721 - DNA, 16 bp, Homo sapiens
cccctttgggcccagg

SEQ ID NO: 2580722 - DNA, 17 bp, Homo sapiens
cccctttgggcccaggg

SEQ ID NO: 2580723 - DNA, 20 bp, Homo sapiens
cccctttgggcccagggaca

SEQ ID NO: 2580724 - DNA, 13 bp, Homo sapiens
cccctttgtgctg

SEQ ID NO: 2580725 - DNA, 16 bp, Homo sapiens
cccctttgtgctgtgg

SEQ ID NO: 2580726 - DNA, 16 bp, Homo sapiens
ccccttttctgcattt

SEQ ID NO: 2580727 - DNA, 15 bp, Homo sapiens
ccccttttcttttct

SEQ ID NO: 2580728 - DNA, 23 bp, Homo sapiens
ccccttttcttttctaccctagc

SEQ ID NO: 2580729 - DNA, 18 bp, Homo sapiens
cccctttttactcccctt

SEQ ID NO: 2580730 - DNA, 18 bp, Homo sapiens
cccgaatagctgggacta

SEQ ID NO: 2580731 - DNA, 12 bp, Homo sapiens
cccgactcctca

SEQ ID NO: 2580732 - DNA, 22 bp, Homo sapiens
cccgagctgggggccatgagct

SEQ ID NO: 2580733 - DNA, 23 bp, Homo sapiens
cccgagctgggggccatgagctc

SEQ ID NO: 2580734 - DNA, 12 bp, Homo sapiens
cccgagctggtg

SEQ ID NO: 2580735 - DNA, 22 bp, Homo sapiens
cccgagctggtgcattacagag

SEQ ID NO: 2580736 - DNA, 15 bp, Homo sapiens
cccgaggcccgcatg

SEQ ID NO: 2580737 - DNA, 21 bp, Homo sapiens
cccgaggccttctctgaagga

SEQ ID NO: 2580738 - DNA, 19 bp, Homo sapiens
cccgaggctgcccactatg

SEQ ID NO: 2580739 - DNA, 14 bp, Homo sapiens
cccgagtagctggg

SEQ ID NO: 2580740 - DNA, 16 bp, Homo sapiens
cccgagtagctgggac

SEQ ID NO: 2580741 - DNA, 13 bp, Homo sapiens
cccgatctttcta

SEQ ID NO: 2580742 - DNA, 23 bp, Homo sapiens
cccgatgctgctttcccctgtgg

SEQ ID NO: 2580743 - DNA, 23 bp, Homo sapiens
cccgccacctatctcgtgggaga

SEQ ID NO: 2580744 - DNA, 16 bp, Homo sapiens
cccgcccactgtcctg

SEQ ID NO: 2580745 - DNA, 20 bp, Homo sapiens
cccgcccactgtcctgggcg

SEQ ID NO: 2580746 - DNA, 20 bp, Homo sapiens
cccgcccaggcttagtcact

SEQ ID NO: 2580747 - DNA, 15 bp, Homo sapiens
cccgccccacattcc

SEQ ID NO: 2580748 - DNA, 21 bp, Homo sapiens
cccgcctctcccgtcagggcc

SEQ ID NO: 2580749 - DNA, 16 bp, Homo sapiens
cccgcctgccagtcct

SEQ ID NO: 2580750 - DNA, 13 bp, Homo sapiens
cccgcctgccctc

SEQ ID NO: 2580751 - DNA, 14 bp, Homo sapiens
cccgcctgccctca

SEQ ID NO: 2580752 - DNA, 17 bp, Homo sapiens
cccgcgcccgcgccctc

SEQ ID NO: 2580753 - DNA, 15 bp, Homo sapiens
cccgcgcctccttcc

SEQ ID NO: 2580754 - DNA, 19 bp, Homo sapiens
cccgcgcgcgtccccctgc

SEQ ID NO: 2580755 - DNA, 22 bp, Homo sapiens
cccgctaagagggagggagggc

SEQ ID NO: 2580756 - DNA, 21 bp, Homo sapiens
cccgctctacatcttctgcct

SEQ ID NO: 2580757 - DNA, 12 bp, Homo sapiens
cccgctgggctg

SEQ ID NO: 2580758 - DNA, 15 bp, Homo sapiens
cccgctgggctgagc

SEQ ID NO: 2580759 - DNA, 21 bp, Homo sapiens
cccgctgggctgagcccctac

SEQ ID NO: 2580760 - DNA, 20 bp, Homo sapiens
cccgctttcttgctggttgt

SEQ ID NO: 2580761 - DNA, 19 bp, Homo sapiens
cccggagattggacggcct

SEQ ID NO: 2580762 - DNA, 16 bp, Homo sapiens
cccggattctgggagg

SEQ ID NO: 2580763 - DNA, 14 bp, Homo sapiens
cccggccacctgcg

SEQ ID NO: 2580764 - DNA, 15 bp, Homo sapiens
cccggccccagccag

SEQ ID NO: 2580765 - DNA, 16 bp, Homo sapiens
cccggccccagccaga

SEQ ID NO: 2580766 - DNA, 18 bp, Homo sapiens
cccggcctcagcacccct

SEQ ID NO: 2580767 - DNA, 17 bp, Homo sapiens
cccggcctgctcccagc

SEQ ID NO: 2580768 - DNA, 15 bp, Homo sapiens
cccggctccaggctc

SEQ ID NO: 2580769 - DNA, 17 bp, Homo sapiens
cccgggccctcccttgg

SEQ ID NO: 2580770 - DNA, 17 bp, Homo sapiens
cccgggctctctgctgt

SEQ ID NO: 2580771 - DNA, 12 bp, Homo sapiens
cccgggctctgc

SEQ ID NO: 2580772 - DNA, 14 bp, Homo sapiens
cccgggctctgcct

SEQ ID NO: 2580773 - DNA, 15 bp, Homo sapiens
cccgggctctgcctc

SEQ ID NO: 2580774 - DNA, 17 bp, Homo sapiens
cccggggtcctgtggca

SEQ ID NO: 2580775 - DNA, 18 bp, Homo sapiens
cccggggtcctgtggcag

SEQ ID NO: 2580776 - DNA, 15 bp, Homo sapiens
cccgtcacagcctca

SEQ ID NO: 2580777 - DNA, 17 bp, Homo sapiens
cccgtcagggcccaagt

SEQ ID NO: 2580778 - DNA, 19 bp, Homo sapiens
cccgtctctctcccatgga

SEQ ID NO: 2580779 - DNA, 12 bp, Homo sapiens
cccgtcttcagc

SEQ ID NO: 2580780 - DNA, 13 bp, Homo sapiens
cccgtcttcagcc

SEQ ID NO: 2580781 - DNA, 21 bp, Homo sapiens
cccgtgaggatgtcactcaga

SEQ ID NO: 2580782 - DNA, 14 bp, Homo sapiens
cccgtgtggcccct

SEQ ID NO: 2580783 - DNA, 17 bp, Homo sapiens
cccgtgtggccccttca

SEQ ID NO: 2580784 - DNA, 22 bp, Homo sapiens
cccgtgtggccccttcacttct

SEQ ID NO: 2580785 - DNA, 19 bp, Homo sapiens
cccgttctgctggcctgga

SEQ ID NO: 2580786 - DNA, 14 bp, Homo sapiens
ccctaaaagcacac

SEQ ID NO: 2580787 - DNA, 12 bp, Homo sapiens
ccctaaactgta

SEQ ID NO: 2580788 - DNA, 21 bp, Homo sapiens
ccctaaggtcattaccacagg

SEQ ID NO: 2580789 - DNA, 17 bp, Homo sapiens
ccctaccacctccccag

SEQ ID NO: 2580790 - DNA, 13 bp, Homo sapiens
ccctacctcaggc

SEQ ID NO: 2580791 - DNA, 16 bp, Homo sapiens
ccctacctcaggcagg

SEQ ID NO: 2580792 - DNA, 19 bp, Homo sapiens
ccctacttcttttgctctt

SEQ ID NO: 2580793 - DNA, 17 bp, Homo sapiens
ccctagaaacttccaaa

SEQ ID NO: 2580794 - DNA, 15 bp, Homo sapiens
ccctagagcctgcct

SEQ ID NO: 2580795 - DNA, 18 bp, Homo sapiens
ccctagccattcctggta

SEQ ID NO: 2580796 - DNA, 17 bp, Homo sapiens
ccctagtaagtgccttc

SEQ ID NO: 2580797 - DNA, 18 bp, Homo sapiens
ccctagtaagtgccttcc

SEQ ID NO: 2580798 - DNA, 16 bp, Homo sapiens
ccctagtcccttcccc

SEQ ID NO: 2580799 - DNA, 22 bp, Homo sapiens
ccctagtcccttcccctccctg

SEQ ID NO: 2580800 - DNA, 19 bp, Homo sapiens
ccctagtgacccggaggcc

SEQ ID NO: 2580801 - DNA, 19 bp, Homo sapiens
ccctagttctacctcaggc

SEQ ID NO: 2580802 - DNA, 23 bp, Homo sapiens
ccctatctaaccctcccatggca

SEQ ID NO: 2580803 - DNA, 18 bp, Homo sapiens
ccctattagagaagagat

SEQ ID NO: 2580804 - DNA, 21 bp, Homo sapiens
ccctatttaacagggtctcta

SEQ ID NO: 2580805 - DNA, 16 bp, Homo sapiens
ccctatttccccaccc

SEQ ID NO: 2580806 - DNA, 20 bp, Homo sapiens
ccctattttttttctgttat

SEQ ID NO: 2580807 - DNA, 19 bp, Homo sapiens
ccctcaacaagggagagac

SEQ ID NO: 2580808 - DNA, 16 bp, Homo sapiens
ccctcaacacctctgc

SEQ ID NO: 2580809 - DNA, 19 bp, Homo sapiens
ccctcaattccccctggcc

SEQ ID NO: 2580810 - DNA, 14 bp, Homo sapiens
ccctcacactggga

SEQ ID NO: 2580811 - DNA, 12 bp, Homo sapiens
ccctcaccaaca

SEQ ID NO: 2580812 - DNA, 23 bp, Homo sapiens
ccctcacctgggcacctggggag

SEQ ID NO: 2580813 - DNA, 21 bp, Homo sapiens
ccctcaccttgcaacacacag

SEQ ID NO: 2580814 - DNA, 18 bp, Homo sapiens
ccctcactgaatgcctca

SEQ ID NO: 2580815 - DNA, 15 bp, Homo sapiens
ccctcagcacccctt

SEQ ID NO: 2580816 - DNA, 18 bp, Homo sapiens
ccctcagcaccccttcca

SEQ ID NO: 2580817 - DNA, 19 bp, Homo sapiens
ccctcagcaccccttccat

SEQ ID NO: 2580818 - DNA, 21 bp, Homo sapiens
ccctcagcaccccttccatgt

SEQ ID NO: 2580819 - DNA, 13 bp, Homo sapiens
ccctcagcccctc

SEQ ID NO: 2580820 - DNA, 17 bp, Homo sapiens
ccctcagcccctcttgc

SEQ ID NO: 2580821 - DNA, 13 bp, Homo sapiens
ccctcaggactgc

SEQ ID NO: 2580822 - DNA, 18 bp, Homo sapiens
ccctcaggcataggcctg

SEQ ID NO: 2580823 - DNA, 22 bp, Homo sapiens
ccctcaggcataggcctgggtg

SEQ ID NO: 2580824 - DNA, 23 bp, Homo sapiens
ccctcaggcataggcctgggtgc

SEQ ID NO: 2580825 - DNA, 18 bp, Homo sapiens
ccctcagggtccctggtg

SEQ ID NO: 2580826 - DNA, 19 bp, Homo sapiens
ccctcagtttccctatctc

SEQ ID NO: 2580827 - DNA, 17 bp, Homo sapiens
ccctcatcccgagcacc

SEQ ID NO: 2580828 - DNA, 20 bp, Homo sapiens
ccctcatcctcatacccacc

SEQ ID NO: 2580829 - DNA, 21 bp, Homo sapiens
ccctcatcgcgtcctcctacc

SEQ ID NO: 2580830 - DNA, 13 bp, Homo sapiens
ccctcatctgtcc

SEQ ID NO: 2580831 - DNA, 14 bp, Homo sapiens
ccctcatctgtccc

SEQ ID NO: 2580832 - DNA, 12 bp, Homo sapiens
ccctcatgctgt

SEQ ID NO: 2580833 - DNA, 16 bp, Homo sapiens
ccctcatggcccctct

SEQ ID NO: 2580834 - DNA, 22 bp, Homo sapiens
ccctcattccaccttcccatgc

SEQ ID NO: 2580835 - DNA, 17 bp, Homo sapiens
ccctccaaaagcactta

SEQ ID NO: 2580836 - DNA, 14 bp, Homo sapiens
ccctcccacagcgc

SEQ ID NO: 2580837 - DNA, 17 bp, Homo sapiens
ccctcccaccacagcag

SEQ ID NO: 2580838 - DNA, 14 bp, Homo sapiens
ccctcccacccacc

SEQ ID NO: 2580839 - DNA, 12 bp, Homo sapiens
ccctcccacccc

SEQ ID NO: 2580840 - DNA, 13 bp, Homo sapiens
ccctcccatctgg

SEQ ID NO: 2580841 - DNA, 16 bp, Homo sapiens
ccctccccgcaccccc

SEQ ID NO: 2580842 - DNA, 12 bp, Homo sapiens
cctataatgaag

SEQ ID NO: 2580843 - DNA, 16 bp, Homo sapiens
cctatcacctcccctc

SEQ ID NO: 2580844 - DNA, 17 bp, Homo sapiens
cctatcacctcccctcc

SEQ ID NO: 2580845 - DNA, 18 bp, Homo sapiens
cctatcacctcccctcct

SEQ ID NO: 2580846 - DNA, 17 bp, Homo sapiens
cctatcagaagtttctc

SEQ ID NO: 2580847 - DNA, 16 bp, Homo sapiens
cctatctcgtgggaga

SEQ ID NO: 2580848 - DNA, 20 bp, Homo sapiens
cctatctttgccaccctcat

SEQ ID NO: 2580849 - DNA, 13 bp, Homo sapiens
cctatgatcccag

SEQ ID NO: 2580850 - DNA, 21 bp, Homo sapiens
cctatgcacatatggactctg

SEQ ID NO: 2580851 - DNA, 21 bp, Homo sapiens
cctatgcatggtgtagatgcc

SEQ ID NO: 2580852 - DNA, 18 bp, Homo sapiens
cctatggctggccactgc

SEQ ID NO: 2580853 - DNA, 19 bp, Homo sapiens
cctatggctggccactgca

SEQ ID NO: 2580854 - DNA, 22 bp, Homo sapiens
cctatggtataatggttgactg

SEQ ID NO: 2580855 - DNA, 20 bp, Homo sapiens
cctatgtgattttaactctg

SEQ ID NO: 2580856 - DNA, 22 bp, Homo sapiens
cctatgtgattttaactctgtc

SEQ ID NO: 2580857 - DNA, 22 bp, Homo sapiens
cctatgtttttgttcaaagcca

SEQ ID NO: 2580858 - DNA, 13 bp, Homo sapiens
cctattgtgattt

SEQ ID NO: 2580859 - DNA, 15 bp, Homo sapiens
cctattgtgatttga

SEQ ID NO: 2580860 - DNA, 17 bp, Homo sapiens
cctatttgccatgggct

SEQ ID NO: 2580861 - DNA, 16 bp, Homo sapiens
cctcaaaagcaccctt

SEQ ID NO: 2580862 - DNA, 22 bp, Homo sapiens
cctcaaacagtaggttggcagt

SEQ ID NO: 2580863 - DNA, 16 bp, Homo sapiens
cctcaaacctcctctt

SEQ ID NO: 2580864 - DNA, 18 bp, Homo sapiens
cctcaaacctcctcttct

SEQ ID NO: 2580865 - DNA, 16 bp, Homo sapiens
cctcaaaggcccgctc

SEQ ID NO: 2580866 - DNA, 14 bp, Homo sapiens
cctcaaagtctgca

SEQ ID NO: 2580867 - DNA, 19 bp, Homo sapiens
cctcaaatgacccaaagac

SEQ ID NO: 2580868 - DNA, 17 bp, Homo sapiens
cctcaaattactttgtg

SEQ ID NO: 2580869 - DNA, 16 bp, Homo sapiens
cctcaaccctccctca

SEQ ID NO: 2580870 - DNA, 19 bp, Homo sapiens
cctcaaccctccctcagcc

SEQ ID NO: 2580871 - DNA, 16 bp, Homo sapiens
cctcaacctcctgggc

SEQ ID NO: 2580872 - DNA, 17 bp, Homo sapiens
cctcaagatgaaggcaa

SEQ ID NO: 2580873 - DNA, 16 bp, Homo sapiens
cctcaagccaatcccc

SEQ ID NO: 2580874 - DNA, 20 bp, Homo sapiens
cctcaaggggccatcctgtc

SEQ ID NO: 2580875 - DNA, 15 bp, Homo sapiens
cctcaataagccttg

SEQ ID NO: 2580876 - DNA, 14 bp, Homo sapiens
cctcaatgtgacca

SEQ ID NO: 2580877 - DNA, 20 bp, Homo sapiens
cctcaattccccctggccac

SEQ ID NO: 2580878 - DNA, 13 bp, Homo sapiens
cctcacactggga

SEQ ID NO: 2580879 - DNA, 17 bp, Homo sapiens
cctcacagtccttacca

SEQ ID NO: 2580880 - DNA, 15 bp, Homo sapiens
cctcacatctttcac

SEQ ID NO: 2580881 - DNA, 13 bp, Homo sapiens
cctcacccctgcc

SEQ ID NO: 2580882 - DNA, 19 bp, Homo sapiens
cctcacccgaggctgccca

SEQ ID NO: 2580883 - DNA, 21 bp, Homo sapiens
cctcacccgaggctgcccact

SEQ ID NO: 2580884 - DNA, 23 bp, Homo sapiens
cctcaccctgagccccttccttg

SEQ ID NO: 2580885 - DNA, 14 bp, Homo sapiens
cctcacctcctcta

SEQ ID NO: 2580886 - DNA, 13 bp, Homo sapiens
cctcacctctgga

SEQ ID NO: 2580887 - DNA, 20 bp, Homo sapiens
cctcacctctggactggcta

SEQ ID NO: 2580888 - DNA, 18 bp, Homo sapiens
cctcaccttgcaacacac

SEQ ID NO: 2580889 - DNA, 18 bp, Homo sapiens
cctcactgaaaacatctg

SEQ ID NO: 2580890 - DNA, 23 bp, Homo sapiens
cctcactggggtcctggggcctc

SEQ ID NO: 2580891 - DNA, 18 bp, Homo sapiens
cctcagaaacactggggc

SEQ ID NO: 2580892 - DNA, 23 bp, Homo sapiens
cctcagaacaaagtgagacagtc

SEQ ID NO: 2580893 - DNA, 22 bp, Homo sapiens
cctcagacttaccaggaagcag

SEQ ID NO: 2580894 - DNA, 13 bp, Homo sapiens
cctcagagtccag

SEQ ID NO: 2580895 - DNA, 17 bp, Homo sapiens
cctcagagtccaggccc

SEQ ID NO: 2580896 - DNA, 14 bp, Homo sapiens
cctcagagtgcaag

SEQ ID NO: 2580897 - DNA, 21 bp, Homo sapiens
cctcagagtgcaagcccctgc

SEQ ID NO: 2580898 - DNA, 15 bp, Homo sapiens
cctcagcaccccttc

SEQ ID NO: 2580899 - DNA, 17 bp, Homo sapiens
cctcagcaccccttcca

SEQ ID NO: 2580900 - DNA, 20 bp, Homo sapiens
cctcagcaccccttccatgt

SEQ ID NO: 2580901 - DNA, 14 bp, Homo sapiens
cctcagcatcctgg

SEQ ID NO: 2580902 - DNA, 16 bp, Homo sapiens
cctcagcatcctggca

SEQ ID NO: 2580903 - DNA, 16 bp, Homo sapiens
cctcagccattcactg

SEQ ID NO: 2580904 - DNA, 19 bp, Homo sapiens
cctcagcccctcttgcccc

SEQ ID NO: 2580905 - DNA, 23 bp, Homo sapiens
cctcagcccctcttgccccccac

SEQ ID NO: 2580906 - DNA, 19 bp, Homo sapiens
cctcagcctagaccctcct

SEQ ID NO: 2580907 - DNA, 22 bp, Homo sapiens
cctcagcctcccgaatagctgg

SEQ ID NO: 2580908 - DNA, 22 bp, Homo sapiens
cctcagccttccccttgcccag

SEQ ID NO: 2580909 - DNA, 12 bp, Homo sapiens
cctcagctctgg

SEQ ID NO: 2580910 - DNA, 20 bp, Homo sapiens
cctcagctctgggagaggat

SEQ ID NO: 2580911 - DNA, 14 bp, Homo sapiens
cctcagctgcctca

SEQ ID NO: 2580912 - DNA, 15 bp, Homo sapiens
cctcagctgcctcac

SEQ ID NO: 2580913 - DNA, 11 bp, Homo sapiens
cctcaggcagg

SEQ ID NO: 2580914 - DNA, 23 bp, Homo sapiens
cctcagggatcttgcattcccag

SEQ ID NO: 2580915 - DNA, 15 bp, Homo sapiens
cctcagggtccctgg

SEQ ID NO: 2580916 - DNA, 17 bp, Homo sapiens
cctcagggtccctggtg

SEQ ID NO: 2580917 - DNA, 16 bp, Homo sapiens
cctcaggtgagaagca

SEQ ID NO: 2580918 - DNA, 18 bp, Homo sapiens
cctcaggtgagaagcaga

SEQ ID NO: 2580919 - DNA, 21 bp, Homo sapiens
cctcaggtggccagcctggat

SEQ ID NO: 2580920 - DNA, 23 bp, Homo sapiens
cctcaggtggccagcctggatct

SEQ ID NO: 2580921 - DNA, 23 bp, Homo sapiens
cctcaggttcctatggctggcca

SEQ ID NO: 2580922 - DNA, 21 bp, Homo sapiens
cctcaggttgctggttgctgt

SEQ ID NO: 2580923 - DNA, 11 bp, Homo sapiens
cctcagtgcca

SEQ ID NO: 2580924 - DNA, 17 bp, Homo sapiens
cctcagttcccttggcc

SEQ ID NO: 2580925 - DNA, 18 bp, Homo sapiens
cctcagttcccttggcct

SEQ ID NO: 2580926 - DNA, 19 bp, Homo sapiens
cctcagttttatcattttc

SEQ ID NO: 2580927 - DNA, 13 bp, Homo sapiens
cctcatacccacc

SEQ ID NO: 2580928 - DNA, 22 bp, Homo sapiens
cctcatagtatggtggctgggt

SEQ ID NO: 2580929 - DNA, 12 bp, Homo sapiens
cctcatatttaa

SEQ ID NO: 2580930 - DNA, 15 bp, Homo sapiens
cctcatcaggatgaa

SEQ ID NO: 2580931 - DNA, 14 bp, Homo sapiens
cctcatccagggct

SEQ ID NO: 2580932 - DNA, 15 bp, Homo sapiens
cctcatccagggctc

SEQ ID NO: 2580933 - DNA, 14 bp, Homo sapiens
cctcatcccgagca

SEQ ID NO: 2580934 - DNA, 14 bp, Homo sapiens
cctcatccgaggca

SEQ ID NO: 2580935 - DNA, 13 bp, Homo sapiens
cctcatctcattc

SEQ ID NO: 2580936 - DNA, 15 bp, Homo sapiens
cctcatcttcttcac

SEQ ID NO: 2580937 - DNA, 18 bp, Homo sapiens
cctcatgcatctccacct

SEQ ID NO: 2580938 - DNA, 18 bp, Homo sapiens
cctcatggcccctctgac

SEQ ID NO: 2580939 - DNA, 22 bp, Homo sapiens
cctcattactttaccaccccca

SEQ ID NO: 2580940 - DNA, 21 bp, Homo sapiens
cctcattccaccttcccatgc

SEQ ID NO: 2580941 - DNA, 19 bp, Homo sapiens
cctcatttatccctcaacc

SEQ ID NO: 2580942 - DNA, 17 bp, Homo sapiens
cctcatttggggtagct

SEQ ID NO: 2580943 - DNA, 21 bp, Homo sapiens
cctccaagctccatctccact

SEQ ID NO: 2580944 - DNA, 22 bp, Homo sapiens
cctccaagctccatctccactc

SEQ ID NO: 2580945 - DNA, 16 bp, Homo sapiens
cctccacatcctccac

SEQ ID NO: 2580946 - DNA, 20 bp, Homo sapiens
cctccacatcctccacgttc

SEQ ID NO: 2580947 - DNA, 17 bp, Homo sapiens
cctccaccaccactggc

SEQ ID NO: 2580948 - DNA, 20 bp, Homo sapiens
cctccaccaccactggccac

SEQ ID NO: 2580949 - DNA, 23 bp, Homo sapiens
cctccaccaccactggccaccag

SEQ ID NO: 2580950 - DNA, 13 bp, Homo sapiens
cctccaccctctg

SEQ ID NO: 2580951 - DNA, 14 bp, Homo sapiens
cctccaccctctga

SEQ ID NO: 2580952 - DNA, 15 bp, Homo sapiens
cctccaccctctgag

SEQ ID NO: 2580953 - DNA, 16 bp, Homo sapiens
cctccaccctgtcccc

SEQ ID NO: 2580954 - DNA, 19 bp, Homo sapiens
cctccaccctgtcccccag

SEQ ID NO: 2580955 - DNA, 15 bp, Homo sapiens
cctccacctgccgtg

SEQ ID NO: 2580956 - DNA, 12 bp, Homo sapiens
cctccactgtca

SEQ ID NO: 2580957 - DNA, 17 bp, Homo sapiens
cctccagaagcctctgg

SEQ ID NO: 2580958 - DNA, 11 bp, Homo sapiens
cctccagcctc

SEQ ID NO: 2580959 - DNA, 21 bp, Homo sapiens
cctccagcttctggtactctc

SEQ ID NO: 2580960 - DNA, 11 bp, Homo sapiens
cctccaggtgc

SEQ ID NO: 2580961 - DNA, 14 bp, Homo sapiens
cctccaggtgtgca

SEQ ID NO: 2580962 - DNA, 12 bp, Homo sapiens
cctccaggtttt

SEQ ID NO: 2580963 - DNA, 20 bp, Homo sapiens
cctccaggtttttcaattaa

SEQ ID NO: 2580964 - DNA, 21 bp, Homo sapiens
cctccatctccaagaatgctg

SEQ ID NO: 2580965 - DNA, 23 bp, Homo sapiens
cctccatctccaagaatgctgaa

SEQ ID NO: 2580966 - DNA, 15 bp, Homo sapiens
cctccatgctgcctc

SEQ ID NO: 2580967 - DNA, 15 bp, Homo sapiens
cctccattctgacca

SEQ ID NO: 2580968 - DNA, 15 bp, Homo sapiens
cctcccaaagtgctg

SEQ ID NO: 2580969 - DNA, 17 bp, Homo sapiens
cctcccaactcacccca

SEQ ID NO: 2580970 - DNA, 21 bp, Homo sapiens
cctcccagatcggatctgttg

SEQ ID NO: 2580971 - DNA, 12 bp, Homo sapiens
cctcccatcacc

SEQ ID NO: 2580972 - DNA, 16 bp, Homo sapiens
cctcccatctcacaca

SEQ ID NO: 2580973 - DNA, 16 bp, Homo sapiens
cctcccatctgggagt

SEQ ID NO: 2580974 - DNA, 21 bp, Homo sapiens
cctccccaaccctgcccctgc

SEQ ID NO: 2580975 - DNA, 12 bp, Homo sapiens
cctccccagcag

SEQ ID NO: 2580976 - DNA, 21 bp, Homo sapiens
cctccccattagagtcagcct

SEQ ID NO: 2580977 - DNA, 19 bp, Homo sapiens
cctcccccaacccccaccc

SEQ ID NO: 2580978 - DNA, 22 bp, Homo sapiens
cctcccccaacccccaccccac

SEQ ID NO: 2580979 - DNA, 16 bp, Homo sapiens
cctcccccgccactcc

SEQ ID NO: 2580980 - DNA, 13 bp, Homo sapiens
cctccccctgcca

SEQ ID NO: 2580981 - DNA, 15 bp, Homo sapiens
cctcccccttctccc

SEQ ID NO: 2580982 - DNA, 21 bp, Homo sapiens
cctccccgcaccccccaagct

SEQ ID NO: 2580983 - DNA, 21 bp, Homo sapiens
cctccccggccctaccagcgc

SEQ ID NO: 2580984 - DNA, 20 bp, Homo sapiens
cctcccctccttgcctcctg

SEQ ID NO: 2580985 - DNA, 18 bp, Homo sapiens
cctcccctgccagggcag

SEQ ID NO: 2580986 - DNA, 14 bp, Homo sapiens
cctcccctgccatt

SEQ ID NO: 2580987 - DNA, 22 bp, Homo sapiens
cctgctctccaagtctcagtgg

SEQ ID NO: 2580988 - DNA, 21 bp, Homo sapiens
cctgctctcctcttgccactg

SEQ ID NO: 2580989 - DNA, 22 bp, Homo sapiens
cctgctctcctcttgccactgc

SEQ ID NO: 2580990 - DNA, 21 bp, Homo sapiens
cctgctgaaggtggggattgc

SEQ ID NO: 2580991 - DNA, 17 bp, Homo sapiens
cctgctgagggaccagc

SEQ ID NO: 2580992 - DNA, 12 bp, Homo sapiens
cctgctgcagtt

SEQ ID NO: 2580993 - DNA, 17 bp, Homo sapiens
cctgctgcagttgccag

SEQ ID NO: 2580994 - DNA, 10 bp, Homo sapiens
cctgctgcat

SEQ ID NO: 2580995 - DNA, 23 bp, Homo sapiens
cctgctgcctccccaaccctgcc

SEQ ID NO: 2580996 - DNA, 20 bp, Homo sapiens
cctgctgctgacccagcctg

SEQ ID NO: 2580997 - DNA, 20 bp, Homo sapiens
cctgctgctgtgtttttgct

SEQ ID NO: 2580998 - DNA, 12 bp, Homo sapiens
cctgctggcccc

SEQ ID NO: 2580999 - DNA, 19 bp, Homo sapiens
cctgctggccgcctcaccc

SEQ ID NO: 2581000 - DNA, 17 bp, Homo sapiens
cctgctgggtaaactgt

SEQ ID NO: 2581001 - DNA, 20 bp, Homo sapiens
cctgctgggtgtggcgcagc

SEQ ID NO: 2581002 - DNA, 14 bp, Homo sapiens
cctgctgtgttccc

SEQ ID NO: 2581003 - DNA, 14 bp, Homo sapiens
cctgcttcatgctc

SEQ ID NO: 2581004 - DNA, 17 bp, Homo sapiens
cctgcttcatgctcagc

SEQ ID NO: 2581005 - DNA, 22 bp, Homo sapiens
cctgcttcctgtctttgggaga

SEQ ID NO: 2581006 - DNA, 20 bp, Homo sapiens
cctgcttgggtggagaagcc

SEQ ID NO: 2581007 - DNA, 23 bp, Homo sapiens
cctgcttgggtggagaagccatt

SEQ ID NO: 2581008 - DNA, 15 bp, Homo sapiens
cctgcttttcactgc

SEQ ID NO: 2581009 - DNA, 19 bp, Homo sapiens
cctgcttttcactgctgca

SEQ ID NO: 2581010 - DNA, 15 bp, Homo sapiens
cctggaaaggctcag

SEQ ID NO: 2581011 - DNA, 20 bp, Homo sapiens
cctggaaaggctcagtctca

SEQ ID NO: 2581012 - DNA, 22 bp, Homo sapiens
cctggaacatcatcaaggcact

SEQ ID NO: 2581013 - DNA, 24 bp, Homo sapiens
cctggaagggctagaacctgtaga

SEQ ID NO: 2581014 - DNA, 21 bp, Homo sapiens
cctggacatgaagattctttc

SEQ ID NO: 2581015 - DNA, 20 bp, Homo sapiens
cctggacatttgccttgctg

SEQ ID NO: 2581016 - DNA, 20 bp, Homo sapiens
cctggacctgcctcctgcct

SEQ ID NO: 2581017 - DNA, 22 bp, Homo sapiens
cctggactagagggacctctcc

SEQ ID NO: 2581018 - DNA, 17 bp, Homo sapiens
cctggactgggaggtag

SEQ ID NO: 2581019 - DNA, 14 bp, Homo sapiens
cctggactgttttc

SEQ ID NO: 2581020 - DNA, 22 bp, Homo sapiens
cctggagagccagaacctggag

SEQ ID NO: 2581021 - DNA, 13 bp, Homo sapiens
cctggagagctag

SEQ ID NO: 2581022 - DNA, 19 bp, Homo sapiens
cctggagagctagaaccta

SEQ ID NO: 2581023 - DNA, 21 bp, Homo sapiens
cctggagagctagaacctaga

SEQ ID NO: 2581024 - DNA, 15 bp, Homo sapiens
cctggagcaggcctt

SEQ ID NO: 2581025 - DNA, 19 bp, Homo sapiens
cctggagcaggccttgcgc

SEQ ID NO: 2581026 - DNA, 13 bp, Homo sapiens
cctggagcccctg

SEQ ID NO: 2581027 - DNA, 18 bp, Homo sapiens
cctggaggattgcaggtg

SEQ ID NO: 2581028 - DNA, 14 bp, Homo sapiens
cctggaggcactga

SEQ ID NO: 2581029 - DNA, 21 bp, Homo sapiens
cctggagggaatgaacctgga

SEQ ID NO: 2581030 - DNA, 15 bp, Homo sapiens
cctggagtataatat

SEQ ID NO: 2581031 - DNA, 18 bp, Homo sapiens
cctggatattattcttgt

SEQ ID NO: 2581032 - DNA, 22 bp, Homo sapiens
cctggatattattcttgtagtt

SEQ ID NO: 2581033 - DNA, 22 bp, Homo sapiens
cctggatctaccagcataaata

SEQ ID NO: 2581034 - DNA, 17 bp, Homo sapiens
cctggatggggctgcac

SEQ ID NO: 2581035 - DNA, 23 bp, Homo sapiens
cctggcaagctagaacctggagg

SEQ ID NO: 2581036 - DNA, 12 bp, Homo sapiens
cctggcaatagt

SEQ ID NO: 2581037 - DNA, 12 bp, Homo sapiens
cctggcacacat

SEQ ID NO: 2581038 - DNA, 15 bp, Homo sapiens
cctggcacacatcag

SEQ ID NO: 2581039 - DNA, 21 bp, Homo sapiens
cctggcacacatcaggagttc

SEQ ID NO: 2581040 - DNA, 18 bp, Homo sapiens
cctggcacccggcccctg

SEQ ID NO: 2581041 - DNA, 19 bp, Homo sapiens
cctggcacccggcccctgc

SEQ ID NO: 2581042 - DNA, 21 bp, Homo sapiens
cctggcacccggcccctgctg

SEQ ID NO: 2581043 - DNA, 22 bp, Homo sapiens
cctggcacccggcccctgctgg

SEQ ID NO: 2581044 - DNA, 18 bp, Homo sapiens
cctggcacggtggctcag

SEQ ID NO: 2581045 - DNA, 17 bp, Homo sapiens
cctggcactgcttccag

SEQ ID NO: 2581046 - DNA, 20 bp, Homo sapiens
cctggcactgcttccagtga

SEQ ID NO: 2581047 - DNA, 17 bp, Homo sapiens
cctggcagaactgagct

SEQ ID NO: 2581048 - DNA, 18 bp, Homo sapiens
cctggcagaactgagctc

SEQ ID NO: 2581049 - DNA, 13 bp, Homo sapiens
cctggcagaatgc

SEQ ID NO: 2581050 - DNA, 21 bp, Homo sapiens
cctggcaggttagaacctaga

SEQ ID NO: 2581051 - DNA, 15 bp, Homo sapiens
cctggccaccacccc

SEQ ID NO: 2581052 - DNA, 13 bp, Homo sapiens
cctggccacctga

SEQ ID NO: 2581053 - DNA, 18 bp, Homo sapiens
cctggccacctgaggtgg

SEQ ID NO: 2581054 - DNA, 21 bp, Homo sapiens
cctggccagatgcaccagccc

SEQ ID NO: 2581055 - DNA, 23 bp, Homo sapiens
cctggccagatgcaccagccctt

SEQ ID NO: 2581056 - DNA, 13 bp, Homo sapiens
cctggccaggagc

SEQ ID NO: 2581057 - DNA, 16 bp, Homo sapiens
cctggccaggagctct

SEQ ID NO: 2581058 - DNA, 21 bp, Homo sapiens
cctggccaggagctcttcagg

SEQ ID NO: 2581059 - DNA, 12 bp, Homo sapiens
cctggccaggca

SEQ ID NO: 2581060 - DNA, 13 bp, Homo sapiens
cctggccaggcac

SEQ ID NO: 2581061 - DNA, 22 bp, Homo sapiens
cctggccaggcagatctgtgcc

SEQ ID NO: 2581062 - DNA, 15 bp, Homo sapiens
cctggccagggcctg

SEQ ID NO: 2581063 - DNA, 20 bp, Homo sapiens
cctggcccagcggcccctcc

SEQ ID NO: 2581064 - DNA, 21 bp, Homo sapiens
cctggcccctcagggtccctg

SEQ ID NO: 2581065 - DNA, 12 bp, Homo sapiens
cctggccgcccc

SEQ ID NO: 2581066 - DNA, 22 bp, Homo sapiens
cctggcctcaagtgattctcct

SEQ ID NO: 2581067 - DNA, 23 bp, Homo sapiens
cctggcctccggcgtcagcctcc

SEQ ID NO: 2581068 - DNA, 12 bp, Homo sapiens
cctggcctctgc

SEQ ID NO: 2581069 - DNA, 14 bp, Homo sapiens
cctggcctctgcac

SEQ ID NO: 2581070 - DNA, 15 bp, Homo sapiens
cctggcctctgcact

SEQ ID NO: 2581071 - DNA, 20 bp, Homo sapiens
cctggcctctgcactcccct

SEQ ID NO: 2581072 - DNA, 11 bp, Homo sapiens
cctggcctgtt

SEQ ID NO: 2581073 - DNA, 16 bp, Homo sapiens
cctggctcccacaggc

SEQ ID NO: 2581074 - DNA, 20 bp, Homo sapiens
cctggctcccacaggcagct

SEQ ID NO: 2581075 - DNA, 21 bp, Homo sapiens
cctggctcccacaggcagctt

SEQ ID NO: 2581076 - DNA, 22 bp, Homo sapiens
cctggctcccatgaccatactg

SEQ ID NO: 2581077 - DNA, 21 bp, Homo sapiens
cctggctccgtccaggagcct

SEQ ID NO: 2581078 - DNA, 15 bp, Homo sapiens
cctggctcctgaggg

SEQ ID NO: 2581079 - DNA, 16 bp, Homo sapiens
cctggctgaaggactg

SEQ ID NO: 2581080 - DNA, 16 bp, Homo sapiens
cctggctgccctggcc

SEQ ID NO: 2581081 - DNA, 17 bp, Homo sapiens
cctggctgccctggccc

SEQ ID NO: 2581082 - DNA, 13 bp, Homo sapiens
cctggcttctcct

SEQ ID NO: 2581083 - DNA, 15 bp, Homo sapiens
cctggcttctggagc

SEQ ID NO: 2581084 - DNA, 17 bp, Homo sapiens
cctggcttctggagccc

SEQ ID NO: 2581085 - DNA, 22 bp, Homo sapiens
cctggcttctggagcccttggg

SEQ ID NO: 2581086 - DNA, 20 bp, Homo sapiens
cctgggacctcccctgaggc

SEQ ID NO: 2581087 - DNA, 14 bp, Homo sapiens
cctgggaggcggag

SEQ ID NO: 2581088 - DNA, 20 bp, Homo sapiens
cctgggaggtcaaggctgca

SEQ ID NO: 2581089 - DNA, 22 bp, Homo sapiens
cctgggaggtcaaggctgcagt

SEQ ID NO: 2581090 - DNA, 16 bp, Homo sapiens
cctgggatccctcatc

SEQ ID NO: 2581091 - DNA, 20 bp, Homo sapiens
cctgggatgtccacagatgc

SEQ ID NO: 2581092 - DNA, 21 bp, Homo sapiens
cctgggatgtggctgcagcag

SEQ ID NO: 2581093 - DNA, 15 bp, Homo sapiens
cctgggcacctgggg

SEQ ID NO: 2581094 - DNA, 23 bp, Homo sapiens
cctgggcagccaggctgccaagg

SEQ ID NO: 2581095 - DNA, 15 bp, Homo sapiens
cctgggcattgcttt

SEQ ID NO: 2581096 - DNA, 17 bp, Homo sapiens
cctgggcattgctttcc

SEQ ID NO: 2581097 - DNA, 11 bp, Homo sapiens
cctgggccctc

SEQ ID NO: 2581098 - DNA, 17 bp, Homo sapiens
cctgggcgccctggaag

SEQ ID NO: 2581099 - DNA, 18 bp, Homo sapiens
cctgggcgccctggaagc

SEQ ID NO: 2581100 - DNA, 22 bp, Homo sapiens
cctgggctcggaggctgccccc

SEQ ID NO: 2581101 - DNA, 14 bp, Homo sapiens
cctgggctctgccc

SEQ ID NO: 2581102 - DNA, 20 bp, Homo sapiens
cctgggctctgccccagctc

SEQ ID NO: 2581103 - DNA, 13 bp, Homo sapiens
cctgggctctggg

SEQ ID NO: 2581104 - DNA, 14 bp, Homo sapiens
cctgggctgttggc

SEQ ID NO: 2581105 - DNA, 16 bp, Homo sapiens
cctgggctgttggcac

SEQ ID NO: 2581106 - DNA, 23 bp, Homo sapiens
cctgggctgttggcactcacaga

SEQ ID NO: 2581107 - DNA, 16 bp, Homo sapiens
cctggggcctggacct

SEQ ID NO: 2581108 - DNA, 17 bp, Homo sapiens
cctggggcgggcccctc

SEQ ID NO: 2581109 - DNA, 20 bp, Homo sapiens
cctggggctaggctggagcc

SEQ ID NO: 2581110 - DNA, 14 bp, Homo sapiens
cctggggctccctt

SEQ ID NO: 2581111 - DNA, 16 bp, Homo sapiens
cctggggctcctttct

SEQ ID NO: 2581112 - DNA, 22 bp, Homo sapiens
cctggggctcctttctccagcc

SEQ ID NO: 2581113 - DNA, 15 bp, Homo sapiens
cctggggctctgtgc

SEQ ID NO: 2581114 - DNA, 15 bp, Homo sapiens
cctggggctgctggc

SEQ ID NO: 2581115 - DNA, 17 bp, Homo sapiens
cctggggctgctggcct

SEQ ID NO: 2581116 - DNA, 18 bp, Homo sapiens
cctgggggttctttcttc

SEQ ID NO: 2581117 - DNA, 20 bp, Homo sapiens
cctggggtgtgggaggcccg

SEQ ID NO: 2581118 - DNA, 20 bp, Homo sapiens
cctgggtaaatgcagcgtga

SEQ ID NO: 2581119 - DNA, 22 bp, Homo sapiens
cctgggtcagtctggtgggagg

SEQ ID NO: 2581120 - DNA, 15 bp, Homo sapiens
cctgggtccaaataa

SEQ ID NO: 2581121 - DNA, 17 bp, Homo sapiens
cctgggtccaaataaaa

SEQ ID NO: 2581122 - DNA, 16 bp, Homo sapiens
cctgggtgctggctgc

SEQ ID NO: 2581123 - DNA, 13 bp, Homo sapiens
cctgggtgggtgg

SEQ ID NO: 2581124 - DNA, 23 bp, Homo sapiens
cctgggtgggtggtggggagggg

SEQ ID NO: 2581125 - DNA, 19 bp, Homo sapiens
cctgggtggtctgcaggca

SEQ ID NO: 2581126 - DNA, 19 bp, Homo sapiens
cctgggttcagaaatgctg

SEQ ID NO: 2581127 - DNA, 21 bp, Homo sapiens
cctgggttttgtattctctga

SEQ ID NO: 2581128 - DNA, 17 bp, Homo sapiens
cctggtacccagccatc

SEQ ID NO: 2581129 - DNA, 19 bp, Homo sapiens
cctggtacccagccatctg

SEQ ID NO: 2581130 - DNA, 12 bp, Homo sapiens
cgcttctgactg

SEQ ID NO: 2581131 - DNA, 14 bp, Homo sapiens
cgcttggagcagag

SEQ ID NO: 2581132 - DNA, 14 bp, Homo sapiens
cgctttcctgaatc

SEQ ID NO: 2581133 - DNA, 14 bp, Homo sapiens
cgctttctacccag

SEQ ID NO: 2581134 - DNA, 16 bp, Homo sapiens
cgctttctacccagcg

SEQ ID NO: 2581135 - DNA, 13 bp, Homo sapiens
cgctttctatgta

SEQ ID NO: 2581136 - DNA, 22 bp, Homo sapiens
cgctttctggaaaagaggagtt

SEQ ID NO: 2581137 - DNA, 20 bp, Homo sapiens
cggaaaacatgctacacact

SEQ ID NO: 2581138 - DNA, 13 bp, Homo sapiens
cggaaagcagctc

SEQ ID NO: 2581139 - DNA, 20 bp, Homo sapiens
cggaagcctttttccccaaa

SEQ ID NO: 2581140 - DNA, 20 bp, Homo sapiens
cggaatgaaccacatcttgc

SEQ ID NO: 2581141 - DNA, 15 bp, Homo sapiens
cggacagccacggcc

SEQ ID NO: 2581142 - DNA, 20 bp, Homo sapiens
cggacagccacggccaggcc

SEQ ID NO: 2581143 - DNA, 23 bp, Homo sapiens
cggagaagagctgttcacagcca

SEQ ID NO: 2581144 - DNA, 19 bp, Homo sapiens
cggagagtacagtgagcca

SEQ ID NO: 2581145 - DNA, 21 bp, Homo sapiens
cggagcctcatccgaggcagg

SEQ ID NO: 2581146 - DNA, 22 bp, Homo sapiens
cggagcctcatccgaggcaggg

SEQ ID NO: 2581147 - DNA, 17 bp, Homo sapiens
cggagctaacactggcc

SEQ ID NO: 2581148 - DNA, 19 bp, Homo sapiens
cggagctaacactggcccc

SEQ ID NO: 2581149 - DNA, 19 bp, Homo sapiens
cggaggctgcccccggccc

SEQ ID NO: 2581150 - DNA, 17 bp, Homo sapiens
cggaggcttgggaccgc

SEQ ID NO: 2581151 - DNA, 20 bp, Homo sapiens
cggaggcttgtcagagctgg

SEQ ID NO: 2581152 - DNA, 21 bp, Homo sapiens
cggaggcttgtcagagctggg

SEQ ID NO: 2581153 - DNA, 23 bp, Homo sapiens
cggaggcttgtcagagctgggag

SEQ ID NO: 2581154 - DNA, 13 bp, Homo sapiens
cggaggttgcagg

SEQ ID NO: 2581155 - DNA, 22 bp, Homo sapiens
cggaggttgggtgggccggctt

SEQ ID NO: 2581156 - DNA, 16 bp, Homo sapiens
cggagtccactcccag

SEQ ID NO: 2581157 - DNA, 14 bp, Homo sapiens
cggagtcccacctt

SEQ ID NO: 2581158 - DNA, 21 bp, Homo sapiens
cggagtcccaccttggctgca

SEQ ID NO: 2581159 - DNA, 22 bp, Homo sapiens
cggagtcccaccttggctgcag

SEQ ID NO: 2581160 - DNA, 19 bp, Homo sapiens
cggagtgagaagctttgcc

SEQ ID NO: 2581161 - DNA, 13 bp, Homo sapiens
cggagttgggggt

SEQ ID NO: 2581162 - DNA, 14 bp, Homo sapiens
cggattattttttc

SEQ ID NO: 2581163 - DNA, 19 bp, Homo sapiens
cggattattttttcagacc

SEQ ID NO: 2581164 - DNA, 19 bp, Homo sapiens
cggcaaccccagttctgct

SEQ ID NO: 2581165 - DNA, 21 bp, Homo sapiens
cggcaaccccagttctgctcc

SEQ ID NO: 2581166 - DNA, 23 bp, Homo sapiens
cggcaaccccagttctgctcctc

SEQ ID NO: 2581167 - DNA, 20 bp, Homo sapiens
cggcacccacaagtgccact

SEQ ID NO: 2581168 - DNA, 17 bp, Homo sapiens
cggcaggttcacaggcg

SEQ ID NO: 2581169 - DNA, 16 bp, Homo sapiens
cggcagttctgggtgc

SEQ ID NO: 2581170 - DNA, 21 bp, Homo sapiens
cggcatgggaaagccacctct

SEQ ID NO: 2581171 - DNA, 15 bp, Homo sapiens
cggcattaaagccat

SEQ ID NO: 2581172 - DNA, 17 bp, Homo sapiens
cggccacctgcggtgct

SEQ ID NO: 2581173 - DNA, 16 bp, Homo sapiens
cggccactggccatct

SEQ ID NO: 2581174 - DNA, 20 bp, Homo sapiens
cggccagccccggccctggg

SEQ ID NO: 2581175 - DNA, 16 bp, Homo sapiens
cggcccaagcccgact

SEQ ID NO: 2581176 - DNA, 17 bp, Homo sapiens
cggcccaggatggcttt

SEQ ID NO: 2581177 - DNA, 18 bp, Homo sapiens
cggccccctggtctctgg

SEQ ID NO: 2581178 - DNA, 16 bp, Homo sapiens
cggcccgatctttcta

SEQ ID NO: 2581179 - DNA, 23 bp, Homo sapiens
cggccctcctaccctgcgcccag

SEQ ID NO: 2581180 - DNA, 22 bp, Homo sapiens
cggccctgggctcggaggctgc

SEQ ID NO: 2581181 - DNA, 14 bp, Homo sapiens
cggcctcagcaccc

SEQ ID NO: 2581182 - DNA, 14 bp, Homo sapiens
cggcctcccaaagt

SEQ ID NO: 2581183 - DNA, 18 bp, Homo sapiens
cggcctctaaccccaggc

SEQ ID NO: 2581184 - DNA, 20 bp, Homo sapiens
cggcctctaaccccaggccc

SEQ ID NO: 2581185 - DNA, 21 bp, Homo sapiens
cggcctctaaccccaggcccc

SEQ ID NO: 2581186 - DNA, 18 bp, Homo sapiens
cggcctctctggcctccc

SEQ ID NO: 2581187 - DNA, 15 bp, Homo sapiens
cggcctgatgctccc

SEQ ID NO: 2581188 - DNA, 14 bp, Homo sapiens
cggcctgctcccag

SEQ ID NO: 2581189 - DNA, 13 bp, Homo sapiens
cggcggagctggc

SEQ ID NO: 2581190 - DNA, 12 bp, Homo sapiens
cggcggcgccgg

SEQ ID NO: 2581191 - DNA, 14 bp, Homo sapiens
cggcgtcagcctcc

SEQ ID NO: 2581192 - DNA, 16 bp, Homo sapiens
cggcgtcagcctccag

SEQ ID NO: 2581193 - DNA, 19 bp, Homo sapiens
cggcgtcagcctccagcct

SEQ ID NO: 2581194 - DNA, 15 bp, Homo sapiens
cggctcactgcagcc

SEQ ID NO: 2581195 - DNA, 18 bp, Homo sapiens
cggctcactgcagcctca

SEQ ID NO: 2581196 - DNA, 12 bp, Homo sapiens
cggctccaggct

SEQ ID NO: 2581197 - DNA, 16 bp, Homo sapiens
cggctccaggctcctt

SEQ ID NO: 2581198 - DNA, 20 bp, Homo sapiens
cggctccccatgtgtcctgg

SEQ ID NO: 2581199 - DNA, 16 bp, Homo sapiens
cggctgagagccccag

SEQ ID NO: 2581200 - DNA, 18 bp, Homo sapiens
cggctgagagccccagct

SEQ ID NO: 2581201 - DNA, 18 bp, Homo sapiens
cggctgcagctcacccag

SEQ ID NO: 2581202 - DNA, 20 bp, Homo sapiens
cggctggaaatgctgggctg

SEQ ID NO: 2581203 - DNA, 22 bp, Homo sapiens
cggctggagaccatgcagagcg

SEQ ID NO: 2581204 - DNA, 23 bp, Homo sapiens
cggctggcagcccacccctcaac

SEQ ID NO: 2581205 - DNA, 19 bp, Homo sapiens
cggctggcctggcccctca

SEQ ID NO: 2581206 - DNA, 22 bp, Homo sapiens
cggctggcctggcccctcaggg

SEQ ID NO: 2581207 - DNA, 16 bp, Homo sapiens
cggctgggcacacgcc

SEQ ID NO: 2581208 - DNA, 17 bp, Homo sapiens
cggctgggcacacgcct

SEQ ID NO: 2581209 - DNA, 23 bp, Homo sapiens
cggctggttttgtaagatgctgg

SEQ ID NO: 2581210 - DNA, 20 bp, Homo sapiens
cgggaacagtgtttcccata

SEQ ID NO: 2581211 - DNA, 12 bp, Homo sapiens
cgggaagagagg

SEQ ID NO: 2581212 - DNA, 12 bp, Homo sapiens
cgggaaggaggg

SEQ ID NO: 2581213 - DNA, 23 bp, Homo sapiens
cgggaaggagggttagggagggg

SEQ ID NO: 2581214 - DNA, 13 bp, Homo sapiens
cgggacctgtggc

SEQ ID NO: 2581215 - DNA, 15 bp, Homo sapiens
cgggagcagtgtctt

SEQ ID NO: 2581216 - DNA, 14 bp, Homo sapiens
cgggagcatctctt

SEQ ID NO: 2581217 - DNA, 22 bp, Homo sapiens
cgggagcatctcttgaggccag

SEQ ID NO: 2581218 - DNA, 20 bp, Homo sapiens
cgggaggctgagacaggaga

SEQ ID NO: 2581219 - DNA, 18 bp, Homo sapiens
cgggatggtcctggggct

SEQ ID NO: 2581220 - DNA, 12 bp, Homo sapiens
cgggccaaggac

SEQ ID NO: 2581221 - DNA, 14 bp, Homo sapiens
cgggccaaggactg

SEQ ID NO: 2581222 - DNA, 17 bp, Homo sapiens
cgggccacagagaaagt

SEQ ID NO: 2581223 - DNA, 14 bp, Homo sapiens
cgggccagccaggc

SEQ ID NO: 2581224 - DNA, 15 bp, Homo sapiens
cgggccagccaggcg

SEQ ID NO: 2581225 - DNA, 16 bp, Homo sapiens
cgggccagccaggcgg

SEQ ID NO: 2581226 - DNA, 17 bp, Homo sapiens
cgggcccacctggccac

SEQ ID NO: 2581227 - DNA, 19 bp, Homo sapiens
cgggcccacctggccacct

SEQ ID NO: 2581228 - DNA, 12 bp, Homo sapiens
cgggcccagccc

SEQ ID NO: 2581229 - DNA, 15 bp, Homo sapiens
cgggcccagccccca

SEQ ID NO: 2581230 - DNA, 18 bp, Homo sapiens
cgggcccagcccccacag

SEQ ID NO: 2581231 - DNA, 17 bp, Homo sapiens
cgggccctcccttggaa

SEQ ID NO: 2581232 - DNA, 19 bp, Homo sapiens
cgggcgagtcactgcctct

SEQ ID NO: 2581233 - DNA, 23 bp, Homo sapiens
cgggcgcctgtagtcccagccac

SEQ ID NO: 2581234 - DNA, 17 bp, Homo sapiens
cgggcgtggtggcgggc

SEQ ID NO: 2581235 - DNA, 15 bp, Homo sapiens
cgggctcagcaaaag

SEQ ID NO: 2581236 - DNA, 19 bp, Homo sapiens
cgggctcagcaaaagatgc

SEQ ID NO: 2581237 - DNA, 14 bp, Homo sapiens
cgggctctctgctg

SEQ ID NO: 2581238 - DNA, 15 bp, Homo sapiens
cgggctgcctgggct

SEQ ID NO: 2581239 - DNA, 20 bp, Homo sapiens
cgggctgggagctctgcaga

SEQ ID NO: 2581240 - DNA, 14 bp, Homo sapiens
cggggacagaggcc

SEQ ID NO: 2581241 - DNA, 19 bp, Homo sapiens
cggggcagctgccagagaa

SEQ ID NO: 2581242 - DNA, 16 bp, Homo sapiens
cggggcatgctggggc

SEQ ID NO: 2581243 - DNA, 17 bp, Homo sapiens
cggggcatgctggggca

SEQ ID NO: 2581244 - DNA, 12 bp, Homo sapiens
cgggggcagctg

SEQ ID NO: 2581245 - DNA, 12 bp, Homo sapiens
cgggggctggcc

SEQ ID NO: 2581246 - DNA, 18 bp, Homo sapiens
cgggggctggcctaggag

SEQ ID NO: 2581247 - DNA, 12 bp, Homo sapiens
cggggggaggga

SEQ ID NO: 2581248 - DNA, 22 bp, Homo sapiens
cggggggccccagtcagcctct

SEQ ID NO: 2581249 - DNA, 17 bp, Homo sapiens
cggggtcctgtggcagg

SEQ ID NO: 2581250 - DNA, 22 bp, Homo sapiens
cgggtcatctgtacctctgcct

SEQ ID NO: 2581251 - DNA, 18 bp, Homo sapiens
cggtcccctccgccaggc

SEQ ID NO: 2581252 - DNA, 21 bp, Homo sapiens
cggtctaaagtgagctctatg

SEQ ID NO: 2581253 - DNA, 19 bp, Homo sapiens
cggtctgcaagtcagagga

SEQ ID NO: 2581254 - DNA, 20 bp, Homo sapiens
cggtgagaggggaacagact

SEQ ID NO: 2581255 - DNA, 21 bp, Homo sapiens
cggtgagaggggaacagactg

SEQ ID NO: 2581256 - DNA, 14 bp, Homo sapiens
cggtgcagtctggg

SEQ ID NO: 2581257 - DNA, 16 bp, Homo sapiens
cggtgcagtctgggtg

SEQ ID NO: 2581258 - DNA, 14 bp, Homo sapiens
cggtgctccaggca

SEQ ID NO: 2581259 - DNA, 13 bp, Homo sapiens
cggtggaggccag

SEQ ID NO: 2581260 - DNA, 20 bp, Homo sapiens
cggtggctcacgcctgtaat

SEQ ID NO: 2581261 - DNA, 20 bp, Homo sapiens
cggtggctcaggcctataac

SEQ ID NO: 2581262 - DNA, 16 bp, Homo sapiens
cggtgtgcaccagggt

SEQ ID NO: 2581263 - DNA, 15 bp, Homo sapiens
cggtgtgcctgcagc

SEQ ID NO: 2581264 - DNA, 17 bp, Homo sapiens
cggtgtgcctgcagccc

SEQ ID NO: 2581265 - DNA, 20 bp, Homo sapiens
cggtgtgcctgcagccccgc

SEQ ID NO: 2581266 - DNA, 21 bp, Homo sapiens
cggtttggggagcagagacac

SEQ ID NO: 2581267 - DNA, 17 bp, Homo sapiens
cgtaaagctagaaatga

SEQ ID NO: 2581268 - DNA, 14 bp, Homo sapiens
cgtaaccagccaga

SEQ ID NO: 2581269 - DNA, 23 bp, Homo sapiens
cgtaaccagccagatcctcttgg

SEQ ID NO: 2581270 - DNA, 12 bp, Homo sapiens
cgtaacccaact

SEQ ID NO: 2581271 - DNA, 14 bp, Homo sapiens
cgtaacccaactct

SEQ ID NO: 2581272 - DNA, 15 bp, Homo sapiens
cgtaactggctgtgt

SEQ ID NO: 2581273 - DNA, 16 bp, Homo sapiens
cgtaagtttaaaggat

SEQ ID NO: 2581274 - DNA, 14 bp, Homo sapiens
cgtaataattatta

SEQ ID NO: 2581275 - DNA, 22 bp, Homo sapiens
ctcagcctcctgagtagctgga

SEQ ID NO: 2581276 - DNA, 20 bp, Homo sapiens
ctcagcctggtgggcctcct

SEQ ID NO: 2581277 - DNA, 14 bp, Homo sapiens
ctcagcctgtgctg

SEQ ID NO: 2581278 - DNA, 15 bp, Homo sapiens
ctcagcggggacagc

SEQ ID NO: 2581279 - DNA, 16 bp, Homo sapiens
ctcagctcagcgccag

SEQ ID NO: 2581280 - DNA, 15 bp, Homo sapiens
ctcagctcccaaggc

SEQ ID NO: 2581281 - DNA, 17 bp, Homo sapiens
ctcagctcccatttcta

SEQ ID NO: 2581282 - DNA, 18 bp, Homo sapiens
ctcagctcccatttctac

SEQ ID NO: 2581283 - DNA, 21 bp, Homo sapiens
ctcagctcccatttctactct

SEQ ID NO: 2581284 - DNA, 12 bp, Homo sapiens
ctcagctcccca

SEQ ID NO: 2581285 - DNA, 16 bp, Homo sapiens
ctcagctctgggagag

SEQ ID NO: 2581286 - DNA, 18 bp, Homo sapiens
ctcagctctgggagagga

SEQ ID NO: 2581287 - DNA, 22 bp, Homo sapiens
ctcagctctgggagaggatttt

SEQ ID NO: 2581288 - DNA, 16 bp, Homo sapiens
ctcagctgcctcactt

SEQ ID NO: 2581289 - DNA, 22 bp, Homo sapiens
ctcagcttcctacccacacctc

SEQ ID NO: 2581290 - DNA, 17 bp, Homo sapiens
ctcagctttttgtcttt

SEQ ID NO: 2581291 - DNA, 17 bp, Homo sapiens
ctcaggaaaacgggacc

SEQ ID NO: 2581292 - DNA, 15 bp, Homo sapiens
ctcaggaagccccca

SEQ ID NO: 2581293 - DNA, 15 bp, Homo sapiens
ctcaggaatgggctg

SEQ ID NO: 2581294 - DNA, 16 bp, Homo sapiens
ctcaggaatgggctgt

SEQ ID NO: 2581295 - DNA, 14 bp, Homo sapiens
ctcaggaccaggca

SEQ ID NO: 2581296 - DNA, 12 bp, Homo sapiens
ctcaggacctag

SEQ ID NO: 2581297 - DNA, 22 bp, Homo sapiens
ctcaggacctgggacctcccct

SEQ ID NO: 2581298 - DNA, 16 bp, Homo sapiens
ctcaggactcctctcc

SEQ ID NO: 2581299 - DNA, 17 bp, Homo sapiens
ctcaggactgcaacagg

SEQ ID NO: 2581300 - DNA, 18 bp, Homo sapiens
ctcaggaggctgaggcag

SEQ ID NO: 2581301 - DNA, 22 bp, Homo sapiens
ctcaggaggctgaggcaggagg

SEQ ID NO: 2581302 - DNA, 19 bp, Homo sapiens
ctcaggatttcgtgggtct

SEQ ID NO: 2581303 - DNA, 16 bp, Homo sapiens
ctcaggccacctgccc

SEQ ID NO: 2581304 - DNA, 23 bp, Homo sapiens
ctcaggcctataaccccagctcc

SEQ ID NO: 2581305 - DNA, 20 bp, Homo sapiens
ctcaggcctgactctcagca

SEQ ID NO: 2581306 - DNA, 20 bp, Homo sapiens
ctcaggcgatccacctgtct

SEQ ID NO: 2581307 - DNA, 19 bp, Homo sapiens
ctcagggacagagccatgc

SEQ ID NO: 2581308 - DNA, 18 bp, Homo sapiens
ctcagggccccagcacta

SEQ ID NO: 2581309 - DNA, 16 bp, Homo sapiens
ctcagggcctggctca

SEQ ID NO: 2581310 - DNA, 20 bp, Homo sapiens
ctcagggcctggctcaggtg

SEQ ID NO: 2581311 - DNA, 15 bp, Homo sapiens
ctcagggctcctgcc

SEQ ID NO: 2581312 - DNA, 18 bp, Homo sapiens
ctcagggtccctggtggc

SEQ ID NO: 2581313 - DNA, 20 bp, Homo sapiens
ctcagggtccctggtggcag

SEQ ID NO: 2581314 - DNA, 22 bp, Homo sapiens
ctcagggtccctggtggcagct

SEQ ID NO: 2581315 - DNA, 14 bp, Homo sapiens
ctcagggtctctgc

SEQ ID NO: 2581316 - DNA, 18 bp, Homo sapiens
ctcagggtctctgctgcc

SEQ ID NO: 2581317 - DNA, 19 bp, Homo sapiens
ctcaggtcagggtgaggat

SEQ ID NO: 2581318 - DNA, 16 bp, Homo sapiens
ctcaggtgagaagcag

SEQ ID NO: 2581319 - DNA, 22 bp, Homo sapiens
ctcaggtggccagcctggatct

SEQ ID NO: 2581320 - DNA, 23 bp, Homo sapiens
ctcaggtggggtcactctggcag

SEQ ID NO: 2581321 - DNA, 17 bp, Homo sapiens
ctcaggtgtccctgcac

SEQ ID NO: 2581322 - DNA, 18 bp, Homo sapiens
ctcaggtgtccctgcact

SEQ ID NO: 2581323 - DNA, 20 bp, Homo sapiens
ctcaggttgctggttgctgt

SEQ ID NO: 2581324 - DNA, 22 bp, Homo sapiens
ctcaggttgctggttgctgtgt

SEQ ID NO: 2581325 - DNA, 23 bp, Homo sapiens
ctcaggttgctggttgctgtgtg

SEQ ID NO: 2581326 - DNA, 19 bp, Homo sapiens
ctcaggttgtagtaaagaa

SEQ ID NO: 2581327 - DNA, 14 bp, Homo sapiens
ctcagtaaaatgaa

SEQ ID NO: 2581328 - DNA, 21 bp, Homo sapiens
ctcagtaagtatctggaggaa

SEQ ID NO: 2581329 - DNA, 18 bp, Homo sapiens
ctcagtcatgcataaata

SEQ ID NO: 2581330 - DNA, 17 bp, Homo sapiens
ctcagtcccccaacaga

SEQ ID NO: 2581331 - DNA, 13 bp, Homo sapiens
ctcagtctccctt

SEQ ID NO: 2581332 - DNA, 14 bp, Homo sapiens
ctcagtctctgagc

SEQ ID NO: 2581333 - DNA, 13 bp, Homo sapiens
ctcagtgccacta

SEQ ID NO: 2581334 - DNA, 16 bp, Homo sapiens
ctcagtggactttcca

SEQ ID NO: 2581335 - DNA, 19 bp, Homo sapiens
ctcagtggactttccaccc

SEQ ID NO: 2581336 - DNA, 18 bp, Homo sapiens
ctcagtggcttcatctgt

SEQ ID NO: 2581337 - DNA, 14 bp, Homo sapiens
ctcagtgtcattta

SEQ ID NO: 2581338 - DNA, 22 bp, Homo sapiens
ctcagtgtcatttatgaaaaga

SEQ ID NO: 2581339 - DNA, 16 bp, Homo sapiens
ctcagtgtgactcctc

SEQ ID NO: 2581340 - DNA, 18 bp, Homo sapiens
ctcagttcatccattcta

SEQ ID NO: 2581341 - DNA, 17 bp, Homo sapiens
ctcagttcccttggcct

SEQ ID NO: 2581342 - DNA, 21 bp, Homo sapiens
ctcagttcccttggcctcaga

SEQ ID NO: 2581343 - DNA, 21 bp, Homo sapiens
ctcagttctagtctctctggg

SEQ ID NO: 2581344 - DNA, 11 bp, Homo sapiens
ctcagttgtag

SEQ ID NO: 2581345 - DNA, 14 bp, Homo sapiens
ctcagttgtagaat

SEQ ID NO: 2581346 - DNA, 12 bp, Homo sapiens
ctcagtttccct

SEQ ID NO: 2581347 - DNA, 16 bp, Homo sapiens
ctcagtttccctatct

SEQ ID NO: 2581348 - DNA, 13 bp, Homo sapiens
ctcataatgtgaa

SEQ ID NO: 2581349 - DNA, 18 bp, Homo sapiens
ctcatacccacccccacc

SEQ ID NO: 2581350 - DNA, 21 bp, Homo sapiens
ctcatacccacccccacccaa

SEQ ID NO: 2581351 - DNA, 17 bp, Homo sapiens
ctcatacgtccaccatg

SEQ ID NO: 2581352 - DNA, 14 bp, Homo sapiens
ctcatagggaagac

SEQ ID NO: 2581353 - DNA, 21 bp, Homo sapiens
ctcatagtatggtggctgggt

SEQ ID NO: 2581354 - DNA, 21 bp, Homo sapiens
ctcatatccagtattgttcct

SEQ ID NO: 2581355 - DNA, 20 bp, Homo sapiens
ctcatatcccctatttaaca

SEQ ID NO: 2581356 - DNA, 21 bp, Homo sapiens
ctcatattttgtatatatctg

SEQ ID NO: 2581357 - DNA, 13 bp, Homo sapiens
ctcatcaactgaa

SEQ ID NO: 2581358 - DNA, 16 bp, Homo sapiens
ctcatcactcccctcc

SEQ ID NO: 2581359 - DNA, 22 bp, Homo sapiens
ctcatcaggatgaacccaggac

SEQ ID NO: 2581360 - DNA, 17 bp, Homo sapiens
ctcatcattctctgtct

SEQ ID NO: 2581361 - DNA, 18 bp, Homo sapiens
ctcatcattctctgtctc

SEQ ID NO: 2581362 - DNA, 19 bp, Homo sapiens
ctcatcattctctgtctca

SEQ ID NO: 2581363 - DNA, 23 bp, Homo sapiens
ctcatcattctctgtctcatcca

SEQ ID NO: 2581364 - DNA, 15 bp, Homo sapiens
ctcatccaccccatc

SEQ ID NO: 2581365 - DNA, 16 bp, Homo sapiens
ctcatccaccccatcc

SEQ ID NO: 2581366 - DNA, 18 bp, Homo sapiens
ctcatccctaatgctgca

SEQ ID NO: 2581367 - DNA, 17 bp, Homo sapiens
ctcatccgaggcagggt

SEQ ID NO: 2581368 - DNA, 14 bp, Homo sapiens
ctcatcctgcaggc

SEQ ID NO: 2581369 - DNA, 15 bp, Homo sapiens
ctcatctctgtccca

SEQ ID NO: 2581370 - DNA, 17 bp, Homo sapiens
ctcatctgctcagcagc

SEQ ID NO: 2581371 - DNA, 18 bp, Homo sapiens
ctcatctgggggagtgga

SEQ ID NO: 2581372 - DNA, 19 bp, Homo sapiens
ctcatctgggggagtggaa

SEQ ID NO: 2581373 - DNA, 15 bp, Homo sapiens
ctcatctgtccctcc

SEQ ID NO: 2581374 - DNA, 17 bp, Homo sapiens
ctcatctgtccctccgg

SEQ ID NO: 2581375 - DNA, 13 bp, Homo sapiens
ctcatgaatctgc

SEQ ID NO: 2581376 - DNA, 19 bp, Homo sapiens
ctcatgatcttgtgacata

SEQ ID NO: 2581377 - DNA, 16 bp, Homo sapiens
ctcatgcaaatcaatt

SEQ ID NO: 2581378 - DNA, 14 bp, Homo sapiens
ctcatgcagccgtg

SEQ ID NO: 2581379 - DNA, 17 bp, Homo sapiens
ctcatgccccctttcag

SEQ ID NO: 2581380 - DNA, 20 bp, Homo sapiens
ctcatggagaagcagaaata

SEQ ID NO: 2581381 - DNA, 17 bp, Homo sapiens
ctcatggcccctctgac

SEQ ID NO: 2581382 - DNA, 16 bp, Homo sapiens
ctcatgtgatcctttt

SEQ ID NO: 2581383 - DNA, 15 bp, Homo sapiens
ctcatgttctgcttt

SEQ ID NO: 2581384 - DNA, 12 bp, Homo sapiens
ctcatgttctta

SEQ ID NO: 2581385 - DNA, 13 bp, Homo sapiens
ctcattaaaaaaa

SEQ ID NO: 2581386 - DNA, 17 bp, Homo sapiens
ctcattacttttgaagt

SEQ ID NO: 2581387 - DNA, 17 bp, Homo sapiens
ctcattaggatggctag

SEQ ID NO: 2581388 - DNA, 17 bp, Homo sapiens
ctcattccaacagtgag

SEQ ID NO: 2581389 - DNA, 18 bp, Homo sapiens
ctcattccaacagtgagt

SEQ ID NO: 2581390 - DNA, 18 bp, Homo sapiens
ctcattccaccttcccat

SEQ ID NO: 2581391 - DNA, 15 bp, Homo sapiens
ctcattccagaggaa

SEQ ID NO: 2581392 - DNA, 17 bp, Homo sapiens
ctcattccagaggaagg

SEQ ID NO: 2581393 - DNA, 17 bp, Homo sapiens
ctcattcctgcctgtct

SEQ ID NO: 2581394 - DNA, 14 bp, Homo sapiens
ctcattcttctgta

SEQ ID NO: 2581395 - DNA, 20 bp, Homo sapiens
ctcattgcttggaattcagc

SEQ ID NO: 2581396 - DNA, 19 bp, Homo sapiens
ctcattgtctgtgtagagt

SEQ ID NO: 2581397 - DNA, 12 bp, Homo sapiens
ctcatttcagga

SEQ ID NO: 2581398 - DNA, 21 bp, Homo sapiens
ctcatttcaggagcagcctca

SEQ ID NO: 2581399 - DNA, 17 bp, Homo sapiens
ctcatttggggtagcta

SEQ ID NO: 2581400 - DNA, 17 bp, Homo sapiens
ctcatttgtcacacact

SEQ ID NO: 2581401 - DNA, 18 bp, Homo sapiens
ctcatttttttaatttat

SEQ ID NO: 2581402 - DNA, 20 bp, Homo sapiens
ctcatttttttaatttatta

SEQ ID NO: 2581403 - DNA, 16 bp, Homo sapiens
ctccaaaactcctgcc

SEQ ID NO: 2581404 - DNA, 15 bp, Homo sapiens
ctccaaaccctcgag

SEQ ID NO: 2581405 - DNA, 22 bp, Homo sapiens
ctccaaacctcctgttagctgt

SEQ ID NO: 2581406 - DNA, 14 bp, Homo sapiens
ctccaagaatgctg

SEQ ID NO: 2581407 - DNA, 15 bp, Homo sapiens
ctccaagaatgctga

SEQ ID NO: 2581408 - DNA, 16 bp, Homo sapiens
ctccaagaccttctcc

SEQ ID NO: 2581409 - DNA, 24 bp, Homo sapiens
ctccaagcaggacatggacaagga

SEQ ID NO: 2581410 - DNA, 16 bp, Homo sapiens
ctccaagtctcagtgg

SEQ ID NO: 2581411 - DNA, 21 bp, Homo sapiens
ctccaagtctcagtggcttca

SEQ ID NO: 2581412 - DNA, 16 bp, Homo sapiens
ctccaagtgccagagg

SEQ ID NO: 2581413 - DNA, 21 bp, Homo sapiens
ctccaagtgccagaggtgggc

SEQ ID NO: 2581414 - DNA, 23 bp, Homo sapiens
ctccacacacagctgggctgtgg

SEQ ID NO: 2581415 - DNA, 18 bp, Homo sapiens
ctccacaccattcaggtc

SEQ ID NO: 2581416 - DNA, 20 bp, Homo sapiens
ctccacaccattcaggtctt

SEQ ID NO: 2581417 - DNA, 13 bp, Homo sapiens
ctccacatcctcc

SEQ ID NO: 2581418 - DNA, 13 bp, Homo sapiens
ctccaccacatcc

SEQ ID NO: 2581419 - DNA, 18 bp, Homo sapiens
ctctcggctccccatgtg

SEQ ID NO: 2581420 - DNA, 22 bp, Homo sapiens
ctctctactcctacctcagcct

SEQ ID NO: 2581421 - DNA, 12 bp, Homo sapiens
ctctctccagga

SEQ ID NO: 2581422 - DNA, 20 bp, Homo sapiens
ctctctcccatggagcccca

SEQ ID NO: 2581423 - DNA, 19 bp, Homo sapiens
ctctctcccctcaaagtct

SEQ ID NO: 2581424 - DNA, 13 bp, Homo sapiens
ctctctcctccct

SEQ ID NO: 2581425 - DNA, 13 bp, Homo sapiens
ctctctctgactc

SEQ ID NO: 2581426 - DNA, 14 bp, Homo sapiens
ctctctctgactct

SEQ ID NO: 2581427 - DNA, 21 bp, Homo sapiens
ctctctcttctgctccaccct

SEQ ID NO: 2581428 - DNA, 14 bp, Homo sapiens
ctctctgactctca

SEQ ID NO: 2581429 - DNA, 12 bp, Homo sapiens
ctctctgctctg

SEQ ID NO: 2581430 - DNA, 17 bp, Homo sapiens
ctctctggccttttcct

SEQ ID NO: 2581431 - DNA, 19 bp, Homo sapiens
ctctctggggccacacaga

SEQ ID NO: 2581432 - DNA, 20 bp, Homo sapiens
ctctctggggccacacagaa

SEQ ID NO: 2581433 - DNA, 16 bp, Homo sapiens
ctctctgtgctgtgga

SEQ ID NO: 2581434 - DNA, 21 bp, Homo sapiens
ctctcttatagaatatttatt

SEQ ID NO: 2581435 - DNA, 16 bp, Homo sapiens
ctctcttctgctccac

SEQ ID NO: 2581436 - DNA, 14 bp, Homo sapiens
ctctcttgcacccg

SEQ ID NO: 2581437 - DNA, 18 bp, Homo sapiens
ctctctttttggaggtgc

SEQ ID NO: 2581438 - DNA, 19 bp, Homo sapiens
ctctctttttggaggtgct

SEQ ID NO: 2581439 - DNA, 12 bp, Homo sapiens
ctctgaaaccag

SEQ ID NO: 2581440 - DNA, 22 bp, Homo sapiens
ctctgaagagtgggtttcacaa

SEQ ID NO: 2581441 - DNA, 18 bp, Homo sapiens
ctctgaagatgatcattt

SEQ ID NO: 2581442 - DNA, 11 bp, Homo sapiens
ctctgaagcat

SEQ ID NO: 2581443 - DNA, 14 bp, Homo sapiens
ctctgaagcatgtt

SEQ ID NO: 2581444 - DNA, 22 bp, Homo sapiens
ctctgaaggacattgcggacag

SEQ ID NO: 2581445 - DNA, 19 bp, Homo sapiens
ctctgaagggcatcatgca

SEQ ID NO: 2581446 - DNA, 23 bp, Homo sapiens
ctctgaagggcatcatgcatctt

SEQ ID NO: 2581447 - DNA, 19 bp, Homo sapiens
ctctgaatttgagatacaa

SEQ ID NO: 2581448 - DNA, 19 bp, Homo sapiens
ctctgacacacagctctgt

SEQ ID NO: 2581449 - DNA, 14 bp, Homo sapiens
ctctgacctgcact

SEQ ID NO: 2581450 - DNA, 14 bp, Homo sapiens
ctctgacctgcagg

SEQ ID NO: 2581451 - DNA, 16 bp, Homo sapiens
ctctgactcagggctc

SEQ ID NO: 2581452 - DNA, 20 bp, Homo sapiens
ctctgactcagggctcctgg

SEQ ID NO: 2581453 - DNA, 18 bp, Homo sapiens
ctctgagaattccaagga

SEQ ID NO: 2581454 - DNA, 21 bp, Homo sapiens
ctctgagatctaaggatgtca

SEQ ID NO: 2581455 - DNA, 16 bp, Homo sapiens
ctctgagcaaatgtgg

SEQ ID NO: 2581456 - DNA, 13 bp, Homo sapiens
ctctgagcagtga

SEQ ID NO: 2581457 - DNA, 13 bp, Homo sapiens
ctctgagctttgc

SEQ ID NO: 2581458 - DNA, 17 bp, Homo sapiens
ctctgagctttgcatgt

SEQ ID NO: 2581459 - DNA, 12 bp, Homo sapiens
ctctgaggacac

SEQ ID NO: 2581460 - DNA, 14 bp, Homo sapiens
ctctgaggacacta

SEQ ID NO: 2581461 - DNA, 15 bp, Homo sapiens
ctctgaggcttccag

SEQ ID NO: 2581462 - DNA, 19 bp, Homo sapiens
ctctgaggcttccagagag

SEQ ID NO: 2581463 - DNA, 13 bp, Homo sapiens
ctctgagggcttc

SEQ ID NO: 2581464 - DNA, 15 bp, Homo sapiens
ctctgaggtgcctgt

SEQ ID NO: 2581465 - DNA, 19 bp, Homo sapiens
ctctgaggtgcctgtccca

SEQ ID NO: 2581466 - DNA, 22 bp, Homo sapiens
ctctgaggtgcctgtcccaccc

SEQ ID NO: 2581467 - DNA, 14 bp, Homo sapiens
ctctgataagagaa

SEQ ID NO: 2581468 - DNA, 15 bp, Homo sapiens
ctctgatcaagtatt

SEQ ID NO: 2581469 - DNA, 19 bp, Homo sapiens
ctctgattttcaaagcttt

SEQ ID NO: 2581470 - DNA, 17 bp, Homo sapiens
ctctgcaatcttctcag

SEQ ID NO: 2581471 - DNA, 18 bp, Homo sapiens
ctctgcaatcttctcaga

SEQ ID NO: 2581472 - DNA, 17 bp, Homo sapiens
ctctgcaatgggcactg

SEQ ID NO: 2581473 - DNA, 15 bp, Homo sapiens
ctctgcaattcccct

SEQ ID NO: 2581474 - DNA, 21 bp, Homo sapiens
ctctgcaattcccctctgctg

SEQ ID NO: 2581475 - DNA, 23 bp, Homo sapiens
ctctgcaattcccctctgctgct

SEQ ID NO: 2581476 - DNA, 19 bp, Homo sapiens
ctctgcacaagctgcaccc

SEQ ID NO: 2581477 - DNA, 14 bp, Homo sapiens
ctctgcacagatgg

SEQ ID NO: 2581478 - DNA, 13 bp, Homo sapiens
ctctgcacatgtc

SEQ ID NO: 2581479 - DNA, 18 bp, Homo sapiens
ctctgcacatgtcttgta

SEQ ID NO: 2581480 - DNA, 16 bp, Homo sapiens
ctctgcacccccatat

SEQ ID NO: 2581481 - DNA, 18 bp, Homo sapiens
ctctgcaccgtactgtgg

SEQ ID NO: 2581482 - DNA, 13 bp, Homo sapiens
ctctgcactactc

SEQ ID NO: 2581483 - DNA, 18 bp, Homo sapiens
ctctgcactcccctgctg

SEQ ID NO: 2581484 - DNA, 13 bp, Homo sapiens
ctctgcagcaata

SEQ ID NO: 2581485 - DNA, 18 bp, Homo sapiens
ctctgcagctgacctctg

SEQ ID NO: 2581486 - DNA, 15 bp, Homo sapiens
ctctgcaggcacctt

SEQ ID NO: 2581487 - DNA, 15 bp, Homo sapiens
ctctgcagtgccttg

SEQ ID NO: 2581488 - DNA, 14 bp, Homo sapiens
ctctgcatctgacc

SEQ ID NO: 2581489 - DNA, 18 bp, Homo sapiens
ctctgcatgcggcccagc

SEQ ID NO: 2581490 - DNA, 22 bp, Homo sapiens
ctctgcatgcggcccagcccgg

SEQ ID NO: 2581491 - DNA, 23 bp, Homo sapiens
ctctgcatgcggcccagcccggc

SEQ ID NO: 2581492 - DNA, 14 bp, Homo sapiens
ctctgcattctagt

SEQ ID NO: 2581493 - DNA, 18 bp, Homo sapiens
ctctgccaccctacctgt

SEQ ID NO: 2581494 - DNA, 22 bp, Homo sapiens
ctctgccaccctacctgttcag

SEQ ID NO: 2581495 - DNA, 14 bp, Homo sapiens
ctctgccagccaca

SEQ ID NO: 2581496 - DNA, 13 bp, Homo sapiens
ctctgcccactcc

SEQ ID NO: 2581497 - DNA, 15 bp, Homo sapiens
ctctgcccactccct

SEQ ID NO: 2581498 - DNA, 17 bp, Homo sapiens
ctctgcccactccctgc

SEQ ID NO: 2581499 - DNA, 13 bp, Homo sapiens
ctctgcccagctt

SEQ ID NO: 2581500 - DNA, 15 bp, Homo sapiens
ctctgcccagcttgg

SEQ ID NO: 2581501 - DNA, 15 bp, Homo sapiens
ctctgccccagaggc

SEQ ID NO: 2581502 - DNA, 22 bp, Homo sapiens
ctctgccccagaggcctctctc

SEQ ID NO: 2581503 - DNA, 18 bp, Homo sapiens
ctctgccccagctctggc

SEQ ID NO: 2581504 - DNA, 19 bp, Homo sapiens
ctctgccccagctctggct

SEQ ID NO: 2581505 - DNA, 16 bp, Homo sapiens
ctctgccctccaagac

SEQ ID NO: 2581506 - DNA, 17 bp, Homo sapiens
ctctgccctgccctagc

SEQ ID NO: 2581507 - DNA, 23 bp, Homo sapiens
ctctgccctgccctagctccaca

SEQ ID NO: 2581508 - DNA, 20 bp, Homo sapiens
ctctgccgcaatacaggaac

SEQ ID NO: 2581509 - DNA, 14 bp, Homo sapiens
ctctgcctccctca

SEQ ID NO: 2581510 - DNA, 20 bp, Homo sapiens
ctctgcctccctcaccctga

SEQ ID NO: 2581511 - DNA, 14 bp, Homo sapiens
ctctgcctcctctt

SEQ ID NO: 2581512 - DNA, 16 bp, Homo sapiens
ctctgcctcctcttca

SEQ ID NO: 2581513 - DNA, 13 bp, Homo sapiens
ctctgcctgtccc

SEQ ID NO: 2581514 - DNA, 16 bp, Homo sapiens
ctctgcctgtccctct

SEQ ID NO: 2581515 - DNA, 18 bp, Homo sapiens
ctctgcctgtccctctca

SEQ ID NO: 2581516 - DNA, 20 bp, Homo sapiens
ctctgcctgtccctctcagg

SEQ ID NO: 2581517 - DNA, 22 bp, Homo sapiens
ctctgcgtgtcacctgtgcttc

SEQ ID NO: 2581518 - DNA, 18 bp, Homo sapiens
ctctgctccaccacatcc

SEQ ID NO: 2581519 - DNA, 17 bp, Homo sapiens
ctctgctcctggagcct

SEQ ID NO: 2581520 - DNA, 16 bp, Homo sapiens
ctctgctgacagacac

SEQ ID NO: 2581521 - DNA, 20 bp, Homo sapiens
ctctgctgacagacacaggc

SEQ ID NO: 2581522 - DNA, 23 bp, Homo sapiens
ctctgctgacagacacaggcccg

SEQ ID NO: 2581523 - DNA, 13 bp, Homo sapiens
ctctgctgccatg

SEQ ID NO: 2581524 - DNA, 15 bp, Homo sapiens
ctctgctgccatggc

SEQ ID NO: 2581525 - DNA, 13 bp, Homo sapiens
ctctgctgccgcc

SEQ ID NO: 2581526 - DNA, 13 bp, Homo sapiens
ctctgctgctggc

SEQ ID NO: 2581527 - DNA, 14 bp, Homo sapiens
ctctgctgctggct

SEQ ID NO: 2581528 - DNA, 11 bp, Homo sapiens
ctctgctgctt

SEQ ID NO: 2581529 - DNA, 14 bp, Homo sapiens
ctctgctggcccag

SEQ ID NO: 2581530 - DNA, 15 bp, Homo sapiens
ctctgctggcctggc

SEQ ID NO: 2581531 - DNA, 16 bp, Homo sapiens
ctctgctggcctggcc

SEQ ID NO: 2581532 - DNA, 13 bp, Homo sapiens
ctctggaccagcc

SEQ ID NO: 2581533 - DNA, 14 bp, Homo sapiens
ctctggactggcta

SEQ ID NO: 2581534 - DNA, 15 bp, Homo sapiens
ctctggactggctag

SEQ ID NO: 2581535 - DNA, 19 bp, Homo sapiens
ctctggaggggtgtggctc

SEQ ID NO: 2581536 - DNA, 19 bp, Homo sapiens
ctctggatgcctgattgcc

SEQ ID NO: 2581537 - DNA, 16 bp, Homo sapiens
ctctggatggcaccag

SEQ ID NO: 2581538 - DNA, 19 bp, Homo sapiens
ctctggatggcaccagagg

SEQ ID NO: 2581539 - DNA, 17 bp, Homo sapiens
ctctggcagctcagaga

SEQ ID NO: 2581540 - DNA, 18 bp, Homo sapiens
ctctggcagctcagagag

SEQ ID NO: 2581541 - DNA, 20 bp, Homo sapiens
ctctggcagctcagagaggg

SEQ ID NO: 2581542 - DNA, 10 bp, Homo sapiens
ctctggccag

SEQ ID NO: 2581543 - DNA, 16 bp, Homo sapiens
ctctggcctcccaccc

SEQ ID NO: 2581544 - DNA, 15 bp, Homo sapiens
ctctggccttttcct

SEQ ID NO: 2581545 - DNA, 22 bp, Homo sapiens
ctctggctagaggccagcccca

SEQ ID NO: 2581546 - DNA, 16 bp, Homo sapiens
ctctggctctcatggg

SEQ ID NO: 2581547 - DNA, 16 bp, Homo sapiens
ctctggctgaaccctg

SEQ ID NO: 2581548 - DNA, 17 bp, Homo sapiens
ctctggctgaaccctgt

SEQ ID NO: 2581549 - DNA, 21 bp, Homo sapiens
ctctggctgaaccctgtgctg

SEQ ID NO: 2581550 - DNA, 22 bp, Homo sapiens
ctctggctggtttggaatgctt

SEQ ID NO: 2581551 - DNA, 12 bp, Homo sapiens
ctctggcttcca

SEQ ID NO: 2581552 - DNA, 22 bp, Homo sapiens
ctctgggaaatgagaaggcagc

SEQ ID NO: 2581553 - DNA, 17 bp, Homo sapiens
ctctgggagaggatttt

SEQ ID NO: 2581554 - DNA, 15 bp, Homo sapiens
ctctgggcaggacct

SEQ ID NO: 2581555 - DNA, 17 bp, Homo sapiens
ctctgggctgccatgtg

SEQ ID NO: 2581556 - DNA, 20 bp, Homo sapiens
ctctggggccacacagaaac

SEQ ID NO: 2581557 - DNA, 16 bp, Homo sapiens
ctctggtccatagaga

SEQ ID NO: 2581558 - DNA, 19 bp, Homo sapiens
ctctggtccatagagagca

SEQ ID NO: 2581559 - DNA, 18 bp, Homo sapiens
ctctggtgacaccagcct

SEQ ID NO: 2581560 - DNA, 19 bp, Homo sapiens
ctctggtgacaccagcctt

SEQ ID NO: 2581561 - DNA, 20 bp, Homo sapiens
ctctggtgacaccagccttt

SEQ ID NO: 2581562 - DNA, 22 bp, Homo sapiens
ctctggtgagtcttggcggcag

SEQ ID NO: 2581563 - DNA, 13 bp, Homo sapiens
ctctggttctttg

SEQ ID NO: 2581564 - DNA, 21 bp, Homo sapiens
ctctgtaatctcgtttcaaaa

SEQ ID NO: 2581565 - DNA, 17 bp, Homo sapiens
ctgccagatgctgatgt

SEQ ID NO: 2581566 - DNA, 20 bp, Homo sapiens
ctgccagccagcagccagct

SEQ ID NO: 2581567 - DNA, 22 bp, Homo sapiens
ctgccagcctggcttctggagc

SEQ ID NO: 2581568 - DNA, 23 bp, Homo sapiens
ctgccagcctggcttctggagcc

SEQ ID NO: 2581569 - DNA, 11 bp, Homo sapiens
ctgccaggcat

SEQ ID NO: 2581570 - DNA, 21 bp, Homo sapiens
ctgccaggcccccaagcctgc

SEQ ID NO: 2581571 - DNA, 22 bp, Homo sapiens
ctgccaggcccccaagcctgca

SEQ ID NO: 2581572 - DNA, 11 bp, Homo sapiens
ctgccagggac

SEQ ID NO: 2581573 - DNA, 20 bp, Homo sapiens
ctgccagggacagagggggt

SEQ ID NO: 2581574 - DNA, 23 bp, Homo sapiens
ctgccagggacagagggggtggc

SEQ ID NO: 2581575 - DNA, 13 bp, Homo sapiens
ctgccagggagct

SEQ ID NO: 2581576 - DNA, 11 bp, Homo sapiens
ctgccagggca

SEQ ID NO: 2581577 - DNA, 15 bp, Homo sapiens
ctgccagggcagggc

SEQ ID NO: 2581578 - DNA, 22 bp, Homo sapiens
ctgccagtccccctgccccagg

SEQ ID NO: 2581579 - DNA, 22 bp, Homo sapiens
ctgccatcatgtttacagagga

SEQ ID NO: 2581580 - DNA, 21 bp, Homo sapiens
ctgccatccaggttcagcttg

SEQ ID NO: 2581581 - DNA, 19 bp, Homo sapiens
ctgccatcttagtttggat

SEQ ID NO: 2581582 - DNA, 22 bp, Homo sapiens
ctgccatcttagtttggattct

SEQ ID NO: 2581583 - DNA, 16 bp, Homo sapiens
ctgccatgcagggcct

SEQ ID NO: 2581584 - DNA, 14 bp, Homo sapiens
ctgccatgccagct

SEQ ID NO: 2581585 - DNA, 19 bp, Homo sapiens
ctgccatgccagcttatct

SEQ ID NO: 2581586 - DNA, 22 bp, Homo sapiens
ctgccatggcgtgtccctctcg

SEQ ID NO: 2581587 - DNA, 15 bp, Homo sapiens
ctgccatttctgaga

SEQ ID NO: 2581588 - DNA, 21 bp, Homo sapiens
ctgccatttgcaccctccgcc

SEQ ID NO: 2581589 - DNA, 19 bp, Homo sapiens
ctgcccaacctgctctcct

SEQ ID NO: 2581590 - DNA, 17 bp, Homo sapiens
ctgcccacattggaccc

SEQ ID NO: 2581591 - DNA, 15 bp, Homo sapiens
ctgcccaccccctca

SEQ ID NO: 2581592 - DNA, 16 bp, Homo sapiens
ctgcccaccccctcaa

SEQ ID NO: 2581593 - DNA, 19 bp, Homo sapiens
ctgcccaccccctcaagcc

SEQ ID NO: 2581594 - DNA, 14 bp, Homo sapiens
ctgcccacctggcc

SEQ ID NO: 2581595 - DNA, 22 bp, Homo sapiens
ctgcccacctggcctctgcact

SEQ ID NO: 2581596 - DNA, 12 bp, Homo sapiens
ctgcccacctgt

SEQ ID NO: 2581597 - DNA, 15 bp, Homo sapiens
ctgcccactccctgc

SEQ ID NO: 2581598 - DNA, 17 bp, Homo sapiens
ctgcccagcctccaagc

SEQ ID NO: 2581599 - DNA, 14 bp, Homo sapiens
ctgcccagcttggg

SEQ ID NO: 2581600 - DNA, 22 bp, Homo sapiens
ctgcccagcttgggcccagctg

SEQ ID NO: 2581601 - DNA, 19 bp, Homo sapiens
ctgcccaggcccctgccac

SEQ ID NO: 2581602 - DNA, 17 bp, Homo sapiens
ctgcccaggcctgcctg

SEQ ID NO: 2581603 - DNA, 18 bp, Homo sapiens
ctgcccaggcctgcctgt

SEQ ID NO: 2581604 - DNA, 19 bp, Homo sapiens
ctgcccaggcctgcctgtt

SEQ ID NO: 2581605 - DNA, 16 bp, Homo sapiens
ctgcccaggggagccc

SEQ ID NO: 2581606 - DNA, 14 bp, Homo sapiens
ctgcccaggggtgc

SEQ ID NO: 2581607 - DNA, 21 bp, Homo sapiens
ctgcccaggggtgccccctcc

SEQ ID NO: 2581608 - DNA, 18 bp, Homo sapiens
ctgcccatctgggaaaat

SEQ ID NO: 2581609 - DNA, 15 bp, Homo sapiens
ctgccccaaacaaat

SEQ ID NO: 2581610 - DNA, 17 bp, Homo sapiens
ctgccccaacctgctga

SEQ ID NO: 2581611 - DNA, 13 bp, Homo sapiens
ctgccccagccag

SEQ ID NO: 2581612 - DNA, 13 bp, Homo sapiens
ctgccccagctct

SEQ ID NO: 2581613 - DNA, 15 bp, Homo sapiens
ctgccccagctctgg

SEQ ID NO: 2581614 - DNA, 19 bp, Homo sapiens
ctgccccagggctcccggc

SEQ ID NO: 2581615 - DNA, 12 bp, Homo sapiens
ctgcccccacga

SEQ ID NO: 2581616 - DNA, 14 bp, Homo sapiens
ctgcccccacttcc

SEQ ID NO: 2581617 - DNA, 16 bp, Homo sapiens
ctgcccccacttcctg

SEQ ID NO: 2581618 - DNA, 23 bp, Homo sapiens
ctgcccccagctcttctccccag

SEQ ID NO: 2581619 - DNA, 16 bp, Homo sapiens
ctgccccccagcctct

SEQ ID NO: 2581620 - DNA, 16 bp, Homo sapiens
ctgcccccggccccct

SEQ ID NO: 2581621 - DNA, 17 bp, Homo sapiens
ctgcccccggccccctg

SEQ ID NO: 2581622 - DNA, 12 bp, Homo sapiens
ctgccccctggt

SEQ ID NO: 2581623 - DNA, 22 bp, Homo sapiens
ctgccccctggtggacagtcct

SEQ ID NO: 2581624 - DNA, 14 bp, Homo sapiens
ctgcccccttctcc

SEQ ID NO: 2581625 - DNA, 19 bp, Homo sapiens
ctgcccccttctcccacac

SEQ ID NO: 2581626 - DNA, 22 bp, Homo sapiens
ctgcccccttctcccacactgc

SEQ ID NO: 2581627 - DNA, 23 bp, Homo sapiens
ctgcccccttctcccacactgct

SEQ ID NO: 2581628 - DNA, 17 bp, Homo sapiens
ctgccccgcccagctgc

SEQ ID NO: 2581629 - DNA, 18 bp, Homo sapiens
ctgccccgtcaccatctc

SEQ ID NO: 2581630 - DNA, 19 bp, Homo sapiens
ctgccccgtcaccatctca

SEQ ID NO: 2581631 - DNA, 23 bp, Homo sapiens
ctgccccgtcaccatctcaggcc

SEQ ID NO: 2581632 - DNA, 11 bp, Homo sapiens
ctgcccctccc

SEQ ID NO: 2581633 - DNA, 14 bp, Homo sapiens
ctgcccctcccaga

SEQ ID NO: 2581634 - DNA, 14 bp, Homo sapiens
ctgcccctccccca

SEQ ID NO: 2581635 - DNA, 15 bp, Homo sapiens
ctgcccctccctgct

SEQ ID NO: 2581636 - DNA, 11 bp, Homo sapiens
ctgcccctggc

SEQ ID NO: 2581637 - DNA, 15 bp, Homo sapiens
ctgcccgagctggtg

SEQ ID NO: 2581638 - DNA, 21 bp, Homo sapiens
ctgcccgagctggtgcattac

SEQ ID NO: 2581639 - DNA, 20 bp, Homo sapiens
ctgcccggggcagctgccag

SEQ ID NO: 2581640 - DNA, 22 bp, Homo sapiens
ctgcccggggcagctgccagag

SEQ ID NO: 2581641 - DNA, 21 bp, Homo sapiens
ctgccctagagcacactgtag

SEQ ID NO: 2581642 - DNA, 22 bp, Homo sapiens
ctgccctagctccacaccctct

SEQ ID NO: 2581643 - DNA, 19 bp, Homo sapiens
ctgccctccaagaccttct

SEQ ID NO: 2581644 - DNA, 14 bp, Homo sapiens
ctgccctccatccc

SEQ ID NO: 2581645 - DNA, 15 bp, Homo sapiens
ctgccctccatcccg

SEQ ID NO: 2581646 - DNA, 10 bp, Homo sapiens
ctgccctccc

SEQ ID NO: 2581647 - DNA, 21 bp, Homo sapiens
ctgccctccccagagcactgg

SEQ ID NO: 2581648 - DNA, 16 bp, Homo sapiens
ctgccctcgtggccag

SEQ ID NO: 2581649 - DNA, 11 bp, Homo sapiens
ctgccctgccc

SEQ ID NO: 2581650 - DNA, 14 bp, Homo sapiens
ctgccctgcccacc

SEQ ID NO: 2581651 - DNA, 15 bp, Homo sapiens
ctgccctgcccacct

SEQ ID NO: 2581652 - DNA, 16 bp, Homo sapiens
ctgccctgcccacctg

SEQ ID NO: 2581653 - DNA, 12 bp, Homo sapiens
ctgccctgcctg

SEQ ID NO: 2581654 - DNA, 21 bp, Homo sapiens
ctgccctgctgccgcctccca

SEQ ID NO: 2581655 - DNA, 14 bp, Homo sapiens
ctgccctggccctg

SEQ ID NO: 2581656 - DNA, 11 bp, Homo sapiens
ctgccctggga

SEQ ID NO: 2581657 - DNA, 14 bp, Homo sapiens
ctgccctggtccag

SEQ ID NO: 2581658 - DNA, 23 bp, Homo sapiens
ctgccctggtccagggaagctgg

SEQ ID NO: 2581659 - DNA, 13 bp, Homo sapiens
ctgccctgtaccc

SEQ ID NO: 2581660 - DNA, 14 bp, Homo sapiens
ctgccctgtgggcc

SEQ ID NO: 2581661 - DNA, 19 bp, Homo sapiens
ctgccctgttgtgtataga

SEQ ID NO: 2581662 - DNA, 23 bp, Homo sapiens
ctgcccttgtcccactcaagcca

SEQ ID NO: 2581663 - DNA, 16 bp, Homo sapiens
ctgccgaccgaggctg

SEQ ID NO: 2581664 - DNA, 21 bp, Homo sapiens
ctgccgaccgaggctggagct

SEQ ID NO: 2581665 - DNA, 22 bp, Homo sapiens
ctgccgaccgaggctggagctg

SEQ ID NO: 2581666 - DNA, 15 bp, Homo sapiens
ctgccgactcctggg

SEQ ID NO: 2581667 - DNA, 14 bp, Homo sapiens
ctgccgcctcccag

SEQ ID NO: 2581668 - DNA, 19 bp, Homo sapiens
ctgccgcctcccagcctgg

SEQ ID NO: 2581669 - DNA, 19 bp, Homo sapiens
ctgccgggttctagtctcc

SEQ ID NO: 2581670 - DNA, 14 bp, Homo sapiens
ctgccgtgtgccct

SEQ ID NO: 2581671 - DNA, 13 bp, Homo sapiens
ctgcctaagccct

SEQ ID NO: 2581672 - DNA, 14 bp, Homo sapiens
ctgcctcacttcct

SEQ ID NO: 2581673 - DNA, 19 bp, Homo sapiens
ctgcctcagcctcccaaag

SEQ ID NO: 2581674 - DNA, 17 bp, Homo sapiens
ctgcctcaggttcctat

SEQ ID NO: 2581675 - DNA, 16 bp, Homo sapiens
ctgcctccaccctctg

SEQ ID NO: 2581676 - DNA, 15 bp, Homo sapiens
ctgcctccccaaccc

SEQ ID NO: 2581677 - DNA, 18 bp, Homo sapiens
ctgcctccccaaccctgc

SEQ ID NO: 2581678 - DNA, 22 bp, Homo sapiens
ctgcctccctcaccctgagccc

SEQ ID NO: 2581679 - DNA, 13 bp, Homo sapiens
ctgcctcctgcct

SEQ ID NO: 2581680 - DNA, 17 bp, Homo sapiens
ctgcctcctgcctgccc

SEQ ID NO: 2581681 - DNA, 14 bp, Homo sapiens
ctgcctcctttgtg

SEQ ID NO: 2581682 - DNA, 17 bp, Homo sapiens
ctgcctcctttgtgagg

SEQ ID NO: 2581683 - DNA, 16 bp, Homo sapiens
ctgcctctccctggcc

SEQ ID NO: 2581684 - DNA, 15 bp, Homo sapiens
ctgcctctgacacac

SEQ ID NO: 2581685 - DNA, 21 bp, Homo sapiens
ctgcctctgacacacagctct

SEQ ID NO: 2581686 - DNA, 14 bp, Homo sapiens
ctgcctctgaggga

SEQ ID NO: 2581687 - DNA, 14 bp, Homo sapiens
ctgcctctgcctgc

SEQ ID NO: 2581688 - DNA, 17 bp, Homo sapiens
ctgcctctgcctgcatt

SEQ ID NO: 2581689 - DNA, 20 bp, Homo sapiens
ctgcctctgtttgacaaacc

SEQ ID NO: 2581690 - DNA, 22 bp, Homo sapiens
ctgcctcttagacttctgcttt

SEQ ID NO: 2581691 - DNA, 23 bp, Homo sapiens
ctgcctcttagacttctgctttc

SEQ ID NO: 2581692 - DNA, 14 bp, Homo sapiens
ctgcctcttctcta

SEQ ID NO: 2581693 - DNA, 22 bp, Homo sapiens
ctgcctcttctgggagggcagc

SEQ ID NO: 2581694 - DNA, 16 bp, Homo sapiens
ctgcctcttctgtggg

SEQ ID NO: 2581695 - DNA, 15 bp, Homo sapiens
ctgcctgaagtcaca

SEQ ID NO: 2581696 - DNA, 20 bp, Homo sapiens
ctgcctgcagtactttacct

SEQ ID NO: 2581697 - DNA, 21 bp, Homo sapiens
ctgcctgcagtactttacctc

SEQ ID NO: 2581698 - DNA, 13 bp, Homo sapiens
ctgcctgcccacc

SEQ ID NO: 2581699 - DNA, 15 bp, Homo sapiens
ctgcctgcccaggcc

SEQ ID NO: 2581700 - DNA, 20 bp, Homo sapiens
ctgcctgcccaggcccctgc

SEQ ID NO: 2581701 - DNA, 21 bp, Homo sapiens
ctgcctgcccaggcccctgcc

SEQ ID NO: 2581702 - DNA, 15 bp, Homo sapiens
ctgcctgcctgtctg

SEQ ID NO: 2581703 - DNA, 18 bp, Homo sapiens
ctgcctgcgcccaccccg

SEQ ID NO: 2581704 - DNA, 20 bp, Homo sapiens
ctgcctgcttttcactgctg

SEQ ID NO: 2581705 - DNA, 22 bp, Homo sapiens
ctgcctgcttttcactgctgca

SEQ ID NO: 2581706 - DNA, 13 bp, Homo sapiens
ctgcctggccagg

SEQ ID NO: 2581707 - DNA, 17 bp, Homo sapiens
ctgcctggccaggcaga

SEQ ID NO: 2581708 - DNA, 21 bp, Homo sapiens
ctgcctggccaggcagatctg

SEQ ID NO: 2581709 - DNA, 22 bp, Homo sapiens
ctgcctggggcgggcccctcat

SEQ ID NO: 2581710 - DNA, 21 bp, Homo sapiens
gaaaagagatattttaaaatg

SEQ ID NO: 2581711 - DNA, 12 bp, Homo sapiens
gaaaagaggagt

SEQ ID NO: 2581712 - DNA, 19 bp, Homo sapiens
gaaaagatacgactttatt

SEQ ID NO: 2581713 - DNA, 18 bp, Homo sapiens
gaaaagatgtagatttat

SEQ ID NO: 2581714 - DNA, 14 bp, Homo sapiens
gaaaagcagctctc

SEQ ID NO: 2581715 - DNA, 20 bp, Homo sapiens
gaaaagctattagccaggat

SEQ ID NO: 2581716 - DNA, 14 bp, Homo sapiens
gaaaagctgaatcc

SEQ ID NO: 2581717 - DNA, 13 bp, Homo sapiens
gaaaaggaagact

SEQ ID NO: 2581718 - DNA, 20 bp, Homo sapiens
gaaaaggaagactagaggct

SEQ ID NO: 2581719 - DNA, 18 bp, Homo sapiens
gaaaagggaactgaacat

SEQ ID NO: 2581720 - DNA, 21 bp, Homo sapiens
gaaaagtaaggtgcagttccc

SEQ ID NO: 2581721 - DNA, 11 bp, Homo sapiens
gaaaataaaaa

SEQ ID NO: 2581722 - DNA, 21 bp, Homo sapiens
gaaaataaaaaaaagaaaaaa

SEQ ID NO: 2581723 - DNA, 12 bp, Homo sapiens
gaaaataaaaag

SEQ ID NO: 2581724 - DNA, 14 bp, Homo sapiens
gaaaataaaaagtt

SEQ ID NO: 2581725 - DNA, 17 bp, Homo sapiens
gaaaataaaaagttaaa

SEQ ID NO: 2581726 - DNA, 13 bp, Homo sapiens
gaaaataattgtt

SEQ ID NO: 2581727 - DNA, 17 bp, Homo sapiens
gaaaataattgttccaa

SEQ ID NO: 2581728 - DNA, 19 bp, Homo sapiens
gaaaatacaacttaaataa

SEQ ID NO: 2581729 - DNA, 15 bp, Homo sapiens
gaaaatatactgtaa

SEQ ID NO: 2581730 - DNA, 18 bp, Homo sapiens
gaaaatatactgtaaaga

SEQ ID NO: 2581731 - DNA, 20 bp, Homo sapiens
gaaaatatactgtaaagaaa

SEQ ID NO: 2581732 - DNA, 15 bp, Homo sapiens
gaaaatatgcatcta

SEQ ID NO: 2581733 - DNA, 18 bp, Homo sapiens
gaaaatattttttatata

SEQ ID NO: 2581734 - DNA, 14 bp, Homo sapiens
gaaaatcaaataca

SEQ ID NO: 2581735 - DNA, 16 bp, Homo sapiens
gaaaatcagcctgctc

SEQ ID NO: 2581736 - DNA, 14 bp, Homo sapiens
gaaaatctaatatt

SEQ ID NO: 2581737 - DNA, 23 bp, Homo sapiens
gaaaatctaatattaaaaatatg

SEQ ID NO: 2581738 - DNA, 18 bp, Homo sapiens
gaaaatgcaacaacatgt

SEQ ID NO: 2581739 - DNA, 18 bp, Homo sapiens
gaaaatgtaagctgttta

SEQ ID NO: 2581740 - DNA, 19 bp, Homo sapiens
gaaaatgtactgagatttt

SEQ ID NO: 2581741 - DNA, 22 bp, Homo sapiens
gaaaatgtcagaaaccagttat

SEQ ID NO: 2581742 - DNA, 23 bp, Homo sapiens
gaaaatgtctattcaaaatatca

SEQ ID NO: 2581743 - DNA, 14 bp, Homo sapiens
gaaaatgtcttgtg

SEQ ID NO: 2581744 - DNA, 16 bp, Homo sapiens
gaaaattatttgcata

SEQ ID NO: 2581745 - DNA, 20 bp, Homo sapiens
gaaaattcaaaaagtgttta

SEQ ID NO: 2581746 - DNA, 21 bp, Homo sapiens
gaaaattcaaaaagtgtttat

SEQ ID NO: 2581747 - DNA, 13 bp, Homo sapiens
gaaacaaagaagg

SEQ ID NO: 2581748 - DNA, 16 bp, Homo sapiens
gaaacacactgaggca

SEQ ID NO: 2581749 - DNA, 21 bp, Homo sapiens
gaaacacactgaggcagggaa

SEQ ID NO: 2581750 - DNA, 23 bp, Homo sapiens
gaaacacactgaggcagggaagt

SEQ ID NO: 2581751 - DNA, 22 bp, Homo sapiens
gaaacactgggcttctagaacc

SEQ ID NO: 2581752 - DNA, 19 bp, Homo sapiens
gaaacagagacaggcccaa

SEQ ID NO: 2581753 - DNA, 19 bp, Homo sapiens
gaaacagaggagagtccca

SEQ ID NO: 2581754 - DNA, 20 bp, Homo sapiens
gaaacagaggagagtcccag

SEQ ID NO: 2581755 - DNA, 15 bp, Homo sapiens
gaaacatggttttga

SEQ ID NO: 2581756 - DNA, 13 bp, Homo sapiens
gaaacattttcat

SEQ ID NO: 2581757 - DNA, 15 bp, Homo sapiens
gaaaccacagctgct

SEQ ID NO: 2581758 - DNA, 17 bp, Homo sapiens
gaaaccacagctgctgg

SEQ ID NO: 2581759 - DNA, 18 bp, Homo sapiens
gaaaccagtgcaacagca

SEQ ID NO: 2581760 - DNA, 21 bp, Homo sapiens
gaaaccattatgaagaagaga

SEQ ID NO: 2581761 - DNA, 14 bp, Homo sapiens
gaaacccagctctg

SEQ ID NO: 2581762 - DNA, 16 bp, Homo sapiens
gaaacccccacacaca

SEQ ID NO: 2581763 - DNA, 17 bp, Homo sapiens
gaaacccccacacacac

SEQ ID NO: 2581764 - DNA, 23 bp, Homo sapiens
gaaacccccacacacacacacat

SEQ ID NO: 2581765 - DNA, 12 bp, Homo sapiens
gaaacctgccct

SEQ ID NO: 2581766 - DNA, 17 bp, Homo sapiens
gaaacctgccctgcctg

SEQ ID NO: 2581767 - DNA, 18 bp, Homo sapiens
gaaacctgccctgcctga

SEQ ID NO: 2581768 - DNA, 13 bp, Homo sapiens
gaaaccttaatat

SEQ ID NO: 2581769 - DNA, 22 bp, Homo sapiens
gaaaccttggtgtagttgaact

SEQ ID NO: 2581770 - DNA, 21 bp, Homo sapiens
gaaacctttagggcagcttgc

SEQ ID NO: 2581771 - DNA, 12 bp, Homo sapiens
gaaactaacaga

SEQ ID NO: 2581772 - DNA, 19 bp, Homo sapiens
gaaactcacctgctggccc

SEQ ID NO: 2581773 - DNA, 20 bp, Homo sapiens
gaaactcacctgctggcccc

SEQ ID NO: 2581774 - DNA, 21 bp, Homo sapiens
gaaactcacctgctggcccct

SEQ ID NO: 2581775 - DNA, 21 bp, Homo sapiens
gaaactccaccttgcggggat

SEQ ID NO: 2581776 - DNA, 14 bp, Homo sapiens
gaaactcttatctc

SEQ ID NO: 2581777 - DNA, 23 bp, Homo sapiens
gaaactcttatctcagtcatgca

SEQ ID NO: 2581778 - DNA, 14 bp, Homo sapiens
gaaactgaatgctc

SEQ ID NO: 2581779 - DNA, 13 bp, Homo sapiens
gaaactgccagca

SEQ ID NO: 2581780 - DNA, 13 bp, Homo sapiens
gaaactggattaa

SEQ ID NO: 2581781 - DNA, 17 bp, Homo sapiens
gaaactgggttcctgca

SEQ ID NO: 2581782 - DNA, 14 bp, Homo sapiens
gaaacttacacaca

SEQ ID NO: 2581783 - DNA, 11 bp, Homo sapiens
gaaacttattt

SEQ ID NO: 2581784 - DNA, 17 bp, Homo sapiens
gaaacttatttttttct

SEQ ID NO: 2581785 - DNA, 21 bp, Homo sapiens
gaaacttatttttttctgatt

SEQ ID NO: 2581786 - DNA, 22 bp, Homo sapiens
gaaagaaacccgacagagggaa

SEQ ID NO: 2581787 - DNA, 15 bp, Homo sapiens
gaaagaagagacagg

SEQ ID NO: 2581788 - DNA, 18 bp, Homo sapiens
gaaagaagtggggacaga

SEQ ID NO: 2581789 - DNA, 16 bp, Homo sapiens
gaaagacagagctggg

SEQ ID NO: 2581790 - DNA, 17 bp, Homo sapiens
gaaagacagcttctcat

SEQ ID NO: 2581791 - DNA, 16 bp, Homo sapiens
gaaagaccatttttcc

SEQ ID NO: 2581792 - DNA, 18 bp, Homo sapiens
gaaagactatctaaatgt

SEQ ID NO: 2581793 - DNA, 22 bp, Homo sapiens
gaaagactattcaaacagtctc

SEQ ID NO: 2581794 - DNA, 19 bp, Homo sapiens
gaaagacttttccaaccct

SEQ ID NO: 2581795 - DNA, 15 bp, Homo sapiens
gaaagagagaaaata

SEQ ID NO: 2581796 - DNA, 16 bp, Homo sapiens
gaaagagagaaaataa

SEQ ID NO: 2581797 - DNA, 15 bp, Homo sapiens
gaaagagtaaaggaa

SEQ ID NO: 2581798 - DNA, 16 bp, Homo sapiens
gaaagagtaggaagac

SEQ ID NO: 2581799 - DNA, 16 bp, Homo sapiens
gaaagatcaaaaggtt

SEQ ID NO: 2581800 - DNA, 23 bp, Homo sapiens
gaaagatggctgtgcctctgcct

SEQ ID NO: 2581801 - DNA, 15 bp, Homo sapiens
gaaagcacaggtggg

SEQ ID NO: 2581802 - DNA, 20 bp, Homo sapiens
gaaagcagctcaaaggcaca

SEQ ID NO: 2581803 - DNA, 19 bp, Homo sapiens
gaaagcatcacctcaggcc

SEQ ID NO: 2581804 - DNA, 15 bp, Homo sapiens
gaaagcatccatgtg

SEQ ID NO: 2581805 - DNA, 17 bp, Homo sapiens
gaaagcatccatgtgtg

SEQ ID NO: 2581806 - DNA, 21 bp, Homo sapiens
gaaagcatgtggcatgttcat

SEQ ID NO: 2581807 - DNA, 22 bp, Homo sapiens
gaaagcatgtggcatgttcatc

SEQ ID NO: 2581808 - DNA, 15 bp, Homo sapiens
gaaagccacctctcc

SEQ ID NO: 2581809 - DNA, 17 bp, Homo sapiens
gaaagccagtgactcca

SEQ ID NO: 2581810 - DNA, 21 bp, Homo sapiens
gaaagcccagaaaaggacaga

SEQ ID NO: 2581811 - DNA, 14 bp, Homo sapiens
gaaagccccagcac

SEQ ID NO: 2581812 - DNA, 15 bp, Homo sapiens
gaaagcctctgctgc

SEQ ID NO: 2581813 - DNA, 16 bp, Homo sapiens
gaaagcctctgctgcc

SEQ ID NO: 2581814 - DNA, 24 bp, Homo sapiens
gaaagcctgttcccctcactggat

SEQ ID NO: 2581815 - DNA, 20 bp, Homo sapiens
gaaagctcctagcagagaga

SEQ ID NO: 2581816 - DNA, 22 bp, Homo sapiens
gaaagctcctcgagggcaggga

SEQ ID NO: 2581817 - DNA, 17 bp, Homo sapiens
gaaagctgcctggtata

SEQ ID NO: 2581818 - DNA, 21 bp, Homo sapiens
gaaagctggtaaactatttgt

SEQ ID NO: 2581819 - DNA, 17 bp, Homo sapiens
gaaagcttcaaactgca

SEQ ID NO: 2581820 - DNA, 18 bp, Homo sapiens
gaaaggaagctccactgt

SEQ ID NO: 2581821 - DNA, 21 bp, Homo sapiens
gaaaggaagtgggactggcac

SEQ ID NO: 2581822 - DNA, 14 bp, Homo sapiens
gaaaggccagctgg

SEQ ID NO: 2581823 - DNA, 19 bp, Homo sapiens
gaaaggccagctggcagca

SEQ ID NO: 2581824 - DNA, 13 bp, Homo sapiens
gaaaggctccagg

SEQ ID NO: 2581825 - DNA, 13 bp, Homo sapiens
gaaagggcccaga

SEQ ID NO: 2581826 - DNA, 16 bp, Homo sapiens
gaaagggcccagagag

SEQ ID NO: 2581827 - DNA, 23 bp, Homo sapiens
gaaagggggtcccagtgggaggg

SEQ ID NO: 2581828 - DNA, 16 bp, Homo sapiens
gaaaggtttacattgt

SEQ ID NO: 2581829 - DNA, 16 bp, Homo sapiens
gaaagtgaatttgaat

SEQ ID NO: 2581830 - DNA, 21 bp, Homo sapiens
gaaagtggccatgccaccctg

SEQ ID NO: 2581831 - DNA, 14 bp, Homo sapiens
gaaagtgtaaagca

SEQ ID NO: 2581832 - DNA, 15 bp, Homo sapiens
gaaagtgtaaagcat

SEQ ID NO: 2581833 - DNA, 17 bp, Homo sapiens
gaaagttccttatgtat

SEQ ID NO: 2581834 - DNA, 18 bp, Homo sapiens
gaaagttgcacggctgct

SEQ ID NO: 2581835 - DNA, 20 bp, Homo sapiens
gaaagttgcacggctgctga

SEQ ID NO: 2581836 - DNA, 14 bp, Homo sapiens
gaaataaaaccttt

SEQ ID NO: 2581837 - DNA, 15 bp, Homo sapiens
gaaataaaacctttc

SEQ ID NO: 2581838 - DNA, 17 bp, Homo sapiens
gaaataaatagctatat

SEQ ID NO: 2581839 - DNA, 18 bp, Homo sapiens
gaaataacaagtcgatga

SEQ ID NO: 2581840 - DNA, 15 bp, Homo sapiens
gaaataacaatgtta

SEQ ID NO: 2581841 - DNA, 11 bp, Homo sapiens
gaaataataaa

SEQ ID NO: 2581842 - DNA, 13 bp, Homo sapiens
gaaataataaatc

SEQ ID NO: 2581843 - DNA, 15 bp, Homo sapiens
gaaataatatgcatt

SEQ ID NO: 2581844 - DNA, 18 bp, Homo sapiens
gaaatacacaagtaaaca

SEQ ID NO: 2581845 - DNA, 17 bp, Homo sapiens
gaaatacatatttccaa

SEQ ID NO: 2581846 - DNA, 21 bp, Homo sapiens
gaaatacatatttccaagaag

SEQ ID NO: 2581847 - DNA, 21 bp, Homo sapiens
gaaatagaaaaaccctgcccc

SEQ ID NO: 2581848 - DNA, 15 bp, Homo sapiens
gaaatagtctgtgtg

SEQ ID NO: 2581849 - DNA, 17 bp, Homo sapiens
gaaatagtctgtgtgaa

SEQ ID NO: 2581850 - DNA, 18 bp, Homo sapiens
gaaatagttcaaagccaa

SEQ ID NO: 2581851 - DNA, 12 bp, Homo sapiens
gaaatatcattt

SEQ ID NO: 2581852 - DNA, 13 bp, Homo sapiens
gaaatatcattta

SEQ ID NO: 2581853 - DNA, 18 bp, Homo sapiens
gaaatatctgaaaatgta

SEQ ID NO: 2581854 - DNA, 20 bp, Homo sapiens
gaaatatctgaaaatgtatg

SEQ ID NO: 2581855 - DNA, 13 bp, Homo sapiens
gaatttcctctat

SEQ ID NO: 2581856 - DNA, 12 bp, Homo sapiens
gaatttcttggt

SEQ ID NO: 2581857 - DNA, 14 bp, Homo sapiens
gaatttgaatgaaa

SEQ ID NO: 2581858 - DNA, 16 bp, Homo sapiens
gaatttgaatgaaaaa

SEQ ID NO: 2581859 - DNA, 19 bp, Homo sapiens
gaatttggagactctgtgg

SEQ ID NO: 2581860 - DNA, 18 bp, Homo sapiens
gaatttgtaacctcagct

SEQ ID NO: 2581861 - DNA, 23 bp, Homo sapiens
gaattttactgtgtttcttttgg

SEQ ID NO: 2581862 - DNA, 17 bp, Homo sapiens
gaattttctgtgttttg

SEQ ID NO: 2581863 - DNA, 23 bp, Homo sapiens
gaattttctttgtgtagctttgc

SEQ ID NO: 2581864 - DNA, 14 bp, Homo sapiens
gaatttttctctaa

SEQ ID NO: 2581865 - DNA, 16 bp, Homo sapiens
gaatttttttcatctt

SEQ ID NO: 2581866 - DNA, 14 bp, Homo sapiens
gacaaacagctcag

SEQ ID NO: 2581867 - DNA, 14 bp, Homo sapiens
gacaaagacaaatt

SEQ ID NO: 2581868 - DNA, 20 bp, Homo sapiens
gacaaagccaaactctgcca

SEQ ID NO: 2581869 - DNA, 23 bp, Homo sapiens
gacaaagcttggaagagcctgca

SEQ ID NO: 2581870 - DNA, 17 bp, Homo sapiens
gacaaaggacatttgtt

SEQ ID NO: 2581871 - DNA, 13 bp, Homo sapiens
gacaaaggcaagc

SEQ ID NO: 2581872 - DNA, 17 bp, Homo sapiens
gacaaatactcatgtgt

SEQ ID NO: 2581873 - DNA, 20 bp, Homo sapiens
gacaaatactcatgtgtatg

SEQ ID NO: 2581874 - DNA, 14 bp, Homo sapiens
gacaaattctgttt

SEQ ID NO: 2581875 - DNA, 16 bp, Homo sapiens
gacaaattctgtttct

SEQ ID NO: 2581876 - DNA, 23 bp, Homo sapiens
gacaacaaattaggttttgtaca

SEQ ID NO: 2581877 - DNA, 17 bp, Homo sapiens
gacaacagaagtcatga

SEQ ID NO: 2581878 - DNA, 22 bp, Homo sapiens
gacaacagaagtcatgaagccc

SEQ ID NO: 2581879 - DNA, 12 bp, Homo sapiens
gacaacattaaa

SEQ ID NO: 2581880 - DNA, 18 bp, Homo sapiens
gacaaccaccgctcccca

SEQ ID NO: 2581881 - DNA, 23 bp, Homo sapiens
gacaaccaccgctccccagccca

SEQ ID NO: 2581882 - DNA, 20 bp, Homo sapiens
gacaaccgatgctccagcca

SEQ ID NO: 2581883 - DNA, 19 bp, Homo sapiens
gacaagcaattagacaaga

SEQ ID NO: 2581884 - DNA, 17 bp, Homo sapiens
gacaagccccaggcagg

SEQ ID NO: 2581885 - DNA, 19 bp, Homo sapiens
gacaaggaaaggcaaatgc

SEQ ID NO: 2581886 - DNA, 21 bp, Homo sapiens
gacaaggatgatctaggaaga

SEQ ID NO: 2581887 - DNA, 18 bp, Homo sapiens
gacaaggattgctactgt

SEQ ID NO: 2581888 - DNA, 13 bp, Homo sapiens
gacaataatttca

SEQ ID NO: 2581889 - DNA, 19 bp, Homo sapiens
gacaataatttcaggtttt

SEQ ID NO: 2581890 - DNA, 17 bp, Homo sapiens
gacaatcaactctaata

SEQ ID NO: 2581891 - DNA, 16 bp, Homo sapiens
gacaatcagtcccctc

SEQ ID NO: 2581892 - DNA, 18 bp, Homo sapiens
gacaatcagtcccctccc

SEQ ID NO: 2581893 - DNA, 20 bp, Homo sapiens
gacaatcatgaaatatgcat

SEQ ID NO: 2581894 - DNA, 20 bp, Homo sapiens
gacaatgacttactgtacat

SEQ ID NO: 2581895 - DNA, 14 bp, Homo sapiens
gacaatgtctgaac

SEQ ID NO: 2581896 - DNA, 13 bp, Homo sapiens
gacaattctttat

SEQ ID NO: 2581897 - DNA, 14 bp, Homo sapiens
gacacaaacctgcc

SEQ ID NO: 2581898 - DNA, 17 bp, Homo sapiens
gacacaaacctgcctgg

SEQ ID NO: 2581899 - DNA, 18 bp, Homo sapiens
gacacaaacctgcctggg

SEQ ID NO: 2581900 - DNA, 20 bp, Homo sapiens
gacacaaacctgcctgggtt

SEQ ID NO: 2581901 - DNA, 18 bp, Homo sapiens
gacacacacacgcacgca

SEQ ID NO: 2581902 - DNA, 22 bp, Homo sapiens
gacacacacacgcacgcacaca

SEQ ID NO: 2581903 - DNA, 23 bp, Homo sapiens
gacacacacacgcacgcacacac

SEQ ID NO: 2581904 - DNA, 17 bp, Homo sapiens
gacacacagctctgtcc

SEQ ID NO: 2581905 - DNA, 18 bp, Homo sapiens
gacacacagctctgtcct

SEQ ID NO: 2581906 - DNA, 19 bp, Homo sapiens
gacacacagctctgtcctg

SEQ ID NO: 2581907 - DNA, 15 bp, Homo sapiens
gacacagatgaaaca

SEQ ID NO: 2581908 - DNA, 20 bp, Homo sapiens
gacacagcagcttcaccaga

SEQ ID NO: 2581909 - DNA, 13 bp, Homo sapiens
gacacagctcttc

SEQ ID NO: 2581910 - DNA, 22 bp, Homo sapiens
gacacagctcttctccaggctg

SEQ ID NO: 2581911 - DNA, 15 bp, Homo sapiens
gacacaggcccggct

SEQ ID NO: 2581912 - DNA, 21 bp, Homo sapiens
gacacaggcccggctccaggc

SEQ ID NO: 2581913 - DNA, 22 bp, Homo sapiens
gacacatatgcaccttgtgtct

SEQ ID NO: 2581914 - DNA, 12 bp, Homo sapiens
gacaccagagca

SEQ ID NO: 2581915 - DNA, 14 bp, Homo sapiens
gacaccagagcaga

SEQ ID NO: 2581916 - DNA, 19 bp, Homo sapiens
gacaccagagcagatgcag

SEQ ID NO: 2581917 - DNA, 15 bp, Homo sapiens
gacaccagccaggct

SEQ ID NO: 2581918 - DNA, 20 bp, Homo sapiens
gacaccagcctttctcccag

SEQ ID NO: 2581919 - DNA, 20 bp, Homo sapiens
gacaccaggagtccctggta

SEQ ID NO: 2581920 - DNA, 21 bp, Homo sapiens
gacaccccttatccaggactc

SEQ ID NO: 2581921 - DNA, 13 bp, Homo sapiens
gacaccctgtgat

SEQ ID NO: 2581922 - DNA, 23 bp, Homo sapiens
gacaccctgtgatggggccctgc

SEQ ID NO: 2581923 - DNA, 16 bp, Homo sapiens
gacaccgccacatggc

SEQ ID NO: 2581924 - DNA, 13 bp, Homo sapiens
gacacctgccctg

SEQ ID NO: 2581925 - DNA, 15 bp, Homo sapiens
gacacggggcagtgg

SEQ ID NO: 2581926 - DNA, 18 bp, Homo sapiens
gacactaaccacgctgga

SEQ ID NO: 2581927 - DNA, 15 bp, Homo sapiens
gacactaacgacttc

SEQ ID NO: 2581928 - DNA, 13 bp, Homo sapiens
gacactatatctg

SEQ ID NO: 2581929 - DNA, 14 bp, Homo sapiens
gacactccagtgcc

SEQ ID NO: 2581930 - DNA, 19 bp, Homo sapiens
gacactccagtgccagcaa

SEQ ID NO: 2581931 - DNA, 22 bp, Homo sapiens
gacactcctagagaacgcagcc

SEQ ID NO: 2581932 - DNA, 19 bp, Homo sapiens
gacactggtattcctgcct

SEQ ID NO: 2581933 - DNA, 13 bp, Homo sapiens
gacactgtacaag

SEQ ID NO: 2581934 - DNA, 19 bp, Homo sapiens
gacactgtttacaagaaaa

SEQ ID NO: 2581935 - DNA, 22 bp, Homo sapiens
gacactgtttacaagaaaaaat

SEQ ID NO: 2581936 - DNA, 15 bp, Homo sapiens
gacacttcagagagc

SEQ ID NO: 2581937 - DNA, 22 bp, Homo sapiens
gacacttgccttcttcacccag

SEQ ID NO: 2581938 - DNA, 14 bp, Homo sapiens
gacacttgtcccca

SEQ ID NO: 2581939 - DNA, 14 bp, Homo sapiens
gacagaaagcagaa

SEQ ID NO: 2581940 - DNA, 15 bp, Homo sapiens
gacagaagcaggctg

SEQ ID NO: 2581941 - DNA, 17 bp, Homo sapiens
gacagaagcaggctgga

SEQ ID NO: 2581942 - DNA, 23 bp, Homo sapiens
gacagacaacactgggaaacaga

SEQ ID NO: 2581943 - DNA, 12 bp, Homo sapiens
gacagacacagg

SEQ ID NO: 2581944 - DNA, 17 bp, Homo sapiens
gacagacacaggcccgg

SEQ ID NO: 2581945 - DNA, 22 bp, Homo sapiens
gacagacacaggcccggctcca

SEQ ID NO: 2581946 - DNA, 20 bp, Homo sapiens
gacagagctggttgggaaga

SEQ ID NO: 2581947 - DNA, 14 bp, Homo sapiens
gacagaggcagccc

SEQ ID NO: 2581948 - DNA, 16 bp, Homo sapiens
gacagaggcagcccca

SEQ ID NO: 2581949 - DNA, 17 bp, Homo sapiens
gacagaggcagccccat

SEQ ID NO: 2581950 - DNA, 20 bp, Homo sapiens
gacagagggaaacacagcag

SEQ ID NO: 2581951 - DNA, 19 bp, Homo sapiens
gacagagggggtggcctcc

SEQ ID NO: 2581952 - DNA, 21 bp, Homo sapiens
gacagagggggtggcctccca

SEQ ID NO: 2581953 - DNA, 23 bp, Homo sapiens
gacagagggggtggcctcccaac

SEQ ID NO: 2581954 - DNA, 13 bp, Homo sapiens
gacagagtctggg

SEQ ID NO: 2581955 - DNA, 16 bp, Homo sapiens
gacagatcaagctgtg

SEQ ID NO: 2581956 - DNA, 19 bp, Homo sapiens
gacagatctctgctttgga

SEQ ID NO: 2581957 - DNA, 14 bp, Homo sapiens
gacagatgccccag

SEQ ID NO: 2581958 - DNA, 18 bp, Homo sapiens
gacagatgccccagagct

SEQ ID NO: 2581959 - DNA, 20 bp, Homo sapiens
gacagatgccccagagctgt

SEQ ID NO: 2581960 - DNA, 15 bp, Homo sapiens
gacagcagctcaggc

SEQ ID NO: 2581961 - DNA, 20 bp, Homo sapiens
gacagcagctcaggcacact

SEQ ID NO: 2581962 - DNA, 14 bp, Homo sapiens
gacagccacggcca

SEQ ID NO: 2581963 - DNA, 17 bp, Homo sapiens
gacagccacggccaggc

SEQ ID NO: 2581964 - DNA, 14 bp, Homo sapiens
gacagcccgggctc

SEQ ID NO: 2581965 - DNA, 16 bp, Homo sapiens
gacagcccgggctctg

SEQ ID NO: 2581966 - DNA, 18 bp, Homo sapiens
gacagcccgggctctgcc

SEQ ID NO: 2581967 - DNA, 19 bp, Homo sapiens
gacagcccgggctctgcct

SEQ ID NO: 2581968 - DNA, 20 bp, Homo sapiens
gacagcccgggctctgcctc

SEQ ID NO: 2581969 - DNA, 21 bp, Homo sapiens
gacagcccgggctctgcctcc

SEQ ID NO: 2581970 - DNA, 22 bp, Homo sapiens
gacagcccgggctctgcctccc

SEQ ID NO: 2581971 - DNA, 16 bp, Homo sapiens
gacagcctcccacccc

SEQ ID NO: 2581972 - DNA, 16 bp, Homo sapiens
gacagctccctctgcc

SEQ ID NO: 2581973 - DNA, 11 bp, Homo sapiens
gacagctcctt

SEQ ID NO: 2581974 - DNA, 14 bp, Homo sapiens
gacagctgcctggg

SEQ ID NO: 2581975 - DNA, 18 bp, Homo sapiens
gacagctgcctgggatcc

SEQ ID NO: 2581976 - DNA, 22 bp, Homo sapiens
gacaggacagtgcttcagcctg

SEQ ID NO: 2581977 - DNA, 18 bp, Homo sapiens
gacaggagacctggcact

SEQ ID NO: 2581978 - DNA, 16 bp, Homo sapiens
gacaggatgggggctg

SEQ ID NO: 2581979 - DNA, 13 bp, Homo sapiens
gacaggcaagcac

SEQ ID NO: 2581980 - DNA, 17 bp, Homo sapiens
gacaggcaagcacctcc

SEQ ID NO: 2581981 - DNA, 14 bp, Homo sapiens
gacaggcagcagag

SEQ ID NO: 2581982 - DNA, 18 bp, Homo sapiens
gacaggcatgttctctga

SEQ ID NO: 2581983 - DNA, 21 bp, Homo sapiens
gacaggcatgttctctgagga

SEQ ID NO: 2581984 - DNA, 15 bp, Homo sapiens
gacagggaagagcag

SEQ ID NO: 2581985 - DNA, 16 bp, Homo sapiens
gacagggaagagcaga

SEQ ID NO: 2581986 - DNA, 14 bp, Homo sapiens
gacagggaagctac

SEQ ID NO: 2581987 - DNA, 13 bp, Homo sapiens
gacagggacccac

SEQ ID NO: 2581988 - DNA, 21 bp, Homo sapiens
gacagggatgagcatggagct

SEQ ID NO: 2581989 - DNA, 15 bp, Homo sapiens
gacagggctggccca

SEQ ID NO: 2581990 - DNA, 18 bp, Homo sapiens
gacagggctggcccagcc

SEQ ID NO: 2581991 - DNA, 19 bp, Homo sapiens
gacagggctggcccagccc

SEQ ID NO: 2581992 - DNA, 20 bp, Homo sapiens
gacagggttttgccatgttg

SEQ ID NO: 2581993 - DNA, 22 bp, Homo sapiens
gacagggttttgccatgttggc

SEQ ID NO: 2581994 - DNA, 21 bp, Homo sapiens
gacagtatgagtcaatgtgca

SEQ ID NO: 2581995 - DNA, 17 bp, Homo sapiens
gacagtccagcctggag

SEQ ID NO: 2581996 - DNA, 20 bp, Homo sapiens
gacagtccctgccaatggac

SEQ ID NO: 2581997 - DNA, 13 bp, Homo sapiens
gacagtcctggga

SEQ ID NO: 2581998 - DNA, 15 bp, Homo sapiens
gacagtcctgggaga

SEQ ID NO: 2581999 - DNA, 13 bp, Homo sapiens
gagagagagaggt

SEQ ID NO: 2582000 - DNA, 15 bp, Homo sapiens
gagagcaacatttta

SEQ ID NO: 2582001 - DNA, 13 bp, Homo sapiens
gagagcaactctg

SEQ ID NO: 2582002 - DNA, 17 bp, Homo sapiens
gagagcaactctgagat

SEQ ID NO: 2582003 - DNA, 21 bp, Homo sapiens
gagagcagctttaaactcagg

SEQ ID NO: 2582004 - DNA, 23 bp, Homo sapiens
gagagcagctttaaactcaggga

SEQ ID NO: 2582005 - DNA, 13 bp, Homo sapiens
gagagcaggctgg

SEQ ID NO: 2582006 - DNA, 14 bp, Homo sapiens
gagagcaggctggc

SEQ ID NO: 2582007 - DNA, 14 bp, Homo sapiens
gagagccattttgt

SEQ ID NO: 2582008 - DNA, 17 bp, Homo sapiens
gagagccattttgtgaa

SEQ ID NO: 2582009 - DNA, 13 bp, Homo sapiens
gagagccccagct

SEQ ID NO: 2582010 - DNA, 15 bp, Homo sapiens
gagagccccagctga

SEQ ID NO: 2582011 - DNA, 20 bp, Homo sapiens
gagagcccggcgcccctgcc

SEQ ID NO: 2582012 - DNA, 16 bp, Homo sapiens
gagagccttccagggg

SEQ ID NO: 2582013 - DNA, 20 bp, Homo sapiens
gagagccttccaggggtggg

SEQ ID NO: 2582014 - DNA, 22 bp, Homo sapiens
gagagcgtgctccagcctggct

SEQ ID NO: 2582015 - DNA, 20 bp, Homo sapiens
gagagctagaacccggcagg

SEQ ID NO: 2582016 - DNA, 16 bp, Homo sapiens
gagagctagaacctgg

SEQ ID NO: 2582017 - DNA, 13 bp, Homo sapiens
gagagctggagcc

SEQ ID NO: 2582018 - DNA, 14 bp, Homo sapiens
gagagctggtgccc

SEQ ID NO: 2582019 - DNA, 16 bp, Homo sapiens
gagagcttaatgataa

SEQ ID NO: 2582020 - DNA, 20 bp, Homo sapiens
gagaggaaaagtaaggtgca

SEQ ID NO: 2582021 - DNA, 13 bp, Homo sapiens
gagaggagagcca

SEQ ID NO: 2582022 - DNA, 16 bp, Homo sapiens
gagaggatgagagccc

SEQ ID NO: 2582023 - DNA, 21 bp, Homo sapiens
gagaggatgagagcccagagg

SEQ ID NO: 2582024 - DNA, 21 bp, Homo sapiens
gagaggccaggtgcaggttgg

SEQ ID NO: 2582025 - DNA, 18 bp, Homo sapiens
gagaggccttttggaatg

SEQ ID NO: 2582026 - DNA, 14 bp, Homo sapiens
gagagggcagaggg

SEQ ID NO: 2582027 - DNA, 16 bp, Homo sapiens
gagagggcaggcatga

SEQ ID NO: 2582028 - DNA, 18 bp, Homo sapiens
gagaggggaagggccagt

SEQ ID NO: 2582029 - DNA, 21 bp, Homo sapiens
gagaggggaataatagaagaa

SEQ ID NO: 2582030 - DNA, 21 bp, Homo sapiens
gagaggggacaaaacccacct

SEQ ID NO: 2582031 - DNA, 20 bp, Homo sapiens
gagagggtgggagtgggccc

SEQ ID NO: 2582032 - DNA, 12 bp, Homo sapiens
gagaggtggagc

SEQ ID NO: 2582033 - DNA, 19 bp, Homo sapiens
gagaggttataggtcactc

SEQ ID NO: 2582034 - DNA, 19 bp, Homo sapiens
gagagtgaacaaatttaca

SEQ ID NO: 2582035 - DNA, 18 bp, Homo sapiens
gagagtgcaacagtagca

SEQ ID NO: 2582036 - DNA, 22 bp, Homo sapiens
gagagttttgtcttgaatgtct

SEQ ID NO: 2582037 - DNA, 16 bp, Homo sapiens
gagatagaagaactgc

SEQ ID NO: 2582038 - DNA, 15 bp, Homo sapiens
gagatagcattgtga

SEQ ID NO: 2582039 - DNA, 16 bp, Homo sapiens
gagatagcattgtgaa

SEQ ID NO: 2582040 - DNA, 23 bp, Homo sapiens
gagatagcattgtgaactgacag

SEQ ID NO: 2582041 - DNA, 22 bp, Homo sapiens
gagatatttacatgaattgcat

SEQ ID NO: 2582042 - DNA, 20 bp, Homo sapiens
gagatcaaccccttcgctcc

SEQ ID NO: 2582043 - DNA, 16 bp, Homo sapiens
gagatcagcctgggca

SEQ ID NO: 2582044 - DNA, 23 bp, Homo sapiens
gagatctaaggatgtcacagggc

SEQ ID NO: 2582045 - DNA, 18 bp, Homo sapiens
gagatgattcagaagggg

SEQ ID NO: 2582046 - DNA, 12 bp, Homo sapiens
gagatgcagagg

SEQ ID NO: 2582047 - DNA, 14 bp, Homo sapiens
gagatgcagaggta

SEQ ID NO: 2582048 - DNA, 23 bp, Homo sapiens
gagatgcattcttggttggctgg

SEQ ID NO: 2582049 - DNA, 23 bp, Homo sapiens
gagatggaacccttttggccccc

SEQ ID NO: 2582050 - DNA, 15 bp, Homo sapiens
gagatgggagctcct

SEQ ID NO: 2582051 - DNA, 14 bp, Homo sapiens
gagatgtaattgtt

SEQ ID NO: 2582052 - DNA, 14 bp, Homo sapiens
gagatgtgcaccca

SEQ ID NO: 2582053 - DNA, 17 bp, Homo sapiens
gagatgtttttaaaagt

SEQ ID NO: 2582054 - DNA, 16 bp, Homo sapiens
gagattagagggaggt

SEQ ID NO: 2582055 - DNA, 21 bp, Homo sapiens
gagattgtgcccctgcactcc

SEQ ID NO: 2582056 - DNA, 15 bp, Homo sapiens
gagatttcaagagat

SEQ ID NO: 2582057 - DNA, 12 bp, Homo sapiens
gagatttttcat

SEQ ID NO: 2582058 - DNA, 22 bp, Homo sapiens
gagcaaaggctgagaacactgt

SEQ ID NO: 2582059 - DNA, 14 bp, Homo sapiens
gagcaaatgtttct

SEQ ID NO: 2582060 - DNA, 19 bp, Homo sapiens
gagcaaatgtttctgcagt

SEQ ID NO: 2582061 - DNA, 13 bp, Homo sapiens
gagcaacatttta

SEQ ID NO: 2582062 - DNA, 21 bp, Homo sapiens
gagcaagacgctgtgctgccc

SEQ ID NO: 2582063 - DNA, 14 bp, Homo sapiens
gagcaagagctggc

SEQ ID NO: 2582064 - DNA, 13 bp, Homo sapiens
gagcacaggcagc

SEQ ID NO: 2582065 - DNA, 20 bp, Homo sapiens
gagcaccttagacagtccct

SEQ ID NO: 2582066 - DNA, 21 bp, Homo sapiens
gagcaccttagacagtccctg

SEQ ID NO: 2582067 - DNA, 22 bp, Homo sapiens
gagcaccttagacagtccctgc

SEQ ID NO: 2582068 - DNA, 17 bp, Homo sapiens
gagcaccttcctcactt

SEQ ID NO: 2582069 - DNA, 20 bp, Homo sapiens
gagcaccttcctcacttcca

SEQ ID NO: 2582070 - DNA, 15 bp, Homo sapiens
gagcactcccaagtc

SEQ ID NO: 2582071 - DNA, 17 bp, Homo sapiens
gagcactgggttgactt

SEQ ID NO: 2582072 - DNA, 17 bp, Homo sapiens
gagcagaagtggagctg

SEQ ID NO: 2582073 - DNA, 17 bp, Homo sapiens
gagcagagaccatccct

SEQ ID NO: 2582074 - DNA, 18 bp, Homo sapiens
gagcagagaccatccctg

SEQ ID NO: 2582075 - DNA, 16 bp, Homo sapiens
gagcagatgcagagag

SEQ ID NO: 2582076 - DNA, 18 bp, Homo sapiens
gagcagatgcagagagcc

SEQ ID NO: 2582077 - DNA, 21 bp, Homo sapiens
gagcagatgcagagagccatt

SEQ ID NO: 2582078 - DNA, 16 bp, Homo sapiens
gagcagcagtgaaaac

SEQ ID NO: 2582079 - DNA, 17 bp, Homo sapiens
gagcagcagtgaaaaca

SEQ ID NO: 2582080 - DNA, 22 bp, Homo sapiens
gagcagccacattcctgatgct

SEQ ID NO: 2582081 - DNA, 13 bp, Homo sapiens
gagcagcctgtgg

SEQ ID NO: 2582082 - DNA, 14 bp, Homo sapiens
gagcagcctgtggc

SEQ ID NO: 2582083 - DNA, 15 bp, Homo sapiens
gagcagcctgtggca

SEQ ID NO: 2582084 - DNA, 22 bp, Homo sapiens
gagcaggaagcattcagagagc

SEQ ID NO: 2582085 - DNA, 19 bp, Homo sapiens
gagcaggactctattttaa

SEQ ID NO: 2582086 - DNA, 16 bp, Homo sapiens
gagcaggaggcccctg

SEQ ID NO: 2582087 - DNA, 19 bp, Homo sapiens
gagcaggcacatggaggag

SEQ ID NO: 2582088 - DNA, 19 bp, Homo sapiens
gagcaggccttgcgctgtt

SEQ ID NO: 2582089 - DNA, 21 bp, Homo sapiens
gagcaggctactgtcagctcc

SEQ ID NO: 2582090 - DNA, 19 bp, Homo sapiens
gagcaggctggcagctctc

SEQ ID NO: 2582091 - DNA, 21 bp, Homo sapiens
gagcaggctggcagctctcca

SEQ ID NO: 2582092 - DNA, 16 bp, Homo sapiens
gagcagggtgctgtgg

SEQ ID NO: 2582093 - DNA, 20 bp, Homo sapiens
gagcagtcctgcctcagcct

SEQ ID NO: 2582094 - DNA, 16 bp, Homo sapiens
gagcagtgcaggcaca

SEQ ID NO: 2582095 - DNA, 11 bp, Homo sapiens
gagcagtgtct

SEQ ID NO: 2582096 - DNA, 18 bp, Homo sapiens
gagcagtgtcttccataa

SEQ ID NO: 2582097 - DNA, 19 bp, Homo sapiens
gagcagtgtcttccataat

SEQ ID NO: 2582098 - DNA, 22 bp, Homo sapiens
gagcagtttctgtcctgctggt

SEQ ID NO: 2582099 - DNA, 12 bp, Homo sapiens
gagcatcaggcc

SEQ ID NO: 2582100 - DNA, 14 bp, Homo sapiens
gagcatccacctcc

SEQ ID NO: 2582101 - DNA, 13 bp, Homo sapiens
gagcatgcctgga

SEQ ID NO: 2582102 - DNA, 21 bp, Homo sapiens
gagcatggggataaaggagaa

SEQ ID NO: 2582103 - DNA, 17 bp, Homo sapiens
gagcattacgtgagcca

SEQ ID NO: 2582104 - DNA, 21 bp, Homo sapiens
gagcattacgtgagccaggta

SEQ ID NO: 2582105 - DNA, 17 bp, Homo sapiens
gagcattgccattccct

SEQ ID NO: 2582106 - DNA, 23 bp, Homo sapiens
gagcatttccaacaccacagaca

SEQ ID NO: 2582107 - DNA, 14 bp, Homo sapiens
gagccaactgctgc

SEQ ID NO: 2582108 - DNA, 21 bp, Homo sapiens
gagccaagatcgcgccactgc

SEQ ID NO: 2582109 - DNA, 18 bp, Homo sapiens
gagccactgcaccgggcc

SEQ ID NO: 2582110 - DNA, 19 bp, Homo sapiens
gagccactgcaccgggcca

SEQ ID NO: 2582111 - DNA, 20 bp, Homo sapiens
gagccactgcaccgggccac

SEQ ID NO: 2582112 - DNA, 18 bp, Homo sapiens
gagccagagaagtgacag

SEQ ID NO: 2582113 - DNA, 22 bp, Homo sapiens
gagccagagaagtgacagggaa

SEQ ID NO: 2582114 - DNA, 12 bp, Homo sapiens
gagccaggcctg

SEQ ID NO: 2582115 - DNA, 21 bp, Homo sapiens
gagccaggcctgggtctgtgt

SEQ ID NO: 2582116 - DNA, 19 bp, Homo sapiens
gagccagggtctcactatg

SEQ ID NO: 2582117 - DNA, 13 bp, Homo sapiens
gagccagtcccag

SEQ ID NO: 2582118 - DNA, 22 bp, Homo sapiens
gagccagttcagtacctggagg

SEQ ID NO: 2582119 - DNA, 22 bp, Homo sapiens
gagccatcggtgaaactaacag

SEQ ID NO: 2582120 - DNA, 22 bp, Homo sapiens
gagccatgatgtggagtggggc

SEQ ID NO: 2582121 - DNA, 22 bp, Homo sapiens
gagccatggaccacgcaggaag

SEQ ID NO: 2582122 - DNA, 21 bp, Homo sapiens
gagccattttggggggccccc

SEQ ID NO: 2582123 - DNA, 13 bp, Homo sapiens
gagcccaccttgg

SEQ ID NO: 2582124 - DNA, 15 bp, Homo sapiens
gagcccacgccccca

SEQ ID NO: 2582125 - DNA, 18 bp, Homo sapiens
gagcccacgcccccactg

SEQ ID NO: 2582126 - DNA, 19 bp, Homo sapiens
gagcccactgcccaccccc

SEQ ID NO: 2582127 - DNA, 11 bp, Homo sapiens
gagcccaggag

SEQ ID NO: 2582128 - DNA, 21 bp, Homo sapiens
gagccccaagtcctgaagagg

SEQ ID NO: 2582129 - DNA, 14 bp, Homo sapiens
gagccccacacgga

SEQ ID NO: 2582130 - DNA, 16 bp, Homo sapiens
gagccccacacggagg

SEQ ID NO: 2582131 - DNA, 16 bp, Homo sapiens
gagccccaggcctctg

SEQ ID NO: 2582132 - DNA, 12 bp, Homo sapiens
gagccccagggt

SEQ ID NO: 2582133 - DNA, 19 bp, Homo sapiens
gagccccagggtcttccct

SEQ ID NO: 2582134 - DNA, 24 bp, Homo sapiens
gagccccagggtcttccctacctc

SEQ ID NO: 2582135 - DNA, 17 bp, Homo sapiens
gagccccagtgccaagc

SEQ ID NO: 2582136 - DNA, 18 bp, Homo sapiens
gagccccattcctgggaa

SEQ ID NO: 2582137 - DNA, 21 bp, Homo sapiens
gagcccccgccccgccccaca

SEQ ID NO: 2582138 - DNA, 15 bp, Homo sapiens
gagcccctaccccac

SEQ ID NO: 2582139 - DNA, 14 bp, Homo sapiens
gagcccctgggtgg

SEQ ID NO: 2582140 - DNA, 13 bp, Homo sapiens
gagcccctggtcc

SEQ ID NO: 2582141 - DNA, 20 bp, Homo sapiens
gagcccctggtcctgagggt

SEQ ID NO: 2582142 - DNA, 13 bp, Homo sapiens
gagccccttcctt

SEQ ID NO: 2582143 - DNA, 19 bp, Homo sapiens
gatagcactgagcaaagca

SEQ ID NO: 2582144 - DNA, 17 bp, Homo sapiens
gatagcattgtgaactg

SEQ ID NO: 2582145 - DNA, 20 bp, Homo sapiens
gatagctttattttttaagt

SEQ ID NO: 2582146 - DNA, 13 bp, Homo sapiens
gataggctctgca

SEQ ID NO: 2582147 - DNA, 14 bp, Homo sapiens
gatagtagcttcct

SEQ ID NO: 2582148 - DNA, 23 bp, Homo sapiens
gatagtggggagacttcttggct

SEQ ID NO: 2582149 - DNA, 20 bp, Homo sapiens
gatagttactgttgtgacct

SEQ ID NO: 2582150 - DNA, 15 bp, Homo sapiens
gatataaataaaaca

SEQ ID NO: 2582151 - DNA, 19 bp, Homo sapiens
gatataactattgcccagg

SEQ ID NO: 2582152 - DNA, 12 bp, Homo sapiens
gatatagaacag

SEQ ID NO: 2582153 - DNA, 16 bp, Homo sapiens
gatatagaacagtgct

SEQ ID NO: 2582154 - DNA, 19 bp, Homo sapiens
gatatagttttacttttaa

SEQ ID NO: 2582155 - DNA, 21 bp, Homo sapiens
gatatagttttacttttaaac

SEQ ID NO: 2582156 - DNA, 24 bp, Homo sapiens
gatatagttttacttttaaactgt

SEQ ID NO: 2582157 - DNA, 23 bp, Homo sapiens
gatatatgctctgcatgttacat

SEQ ID NO: 2582158 - DNA, 16 bp, Homo sapiens
gatatatggataatgc

SEQ ID NO: 2582159 - DNA, 22 bp, Homo sapiens
gatatatgtgtttttcacattt

SEQ ID NO: 2582160 - DNA, 16 bp, Homo sapiens
gatatatttttaagat

SEQ ID NO: 2582161 - DNA, 15 bp, Homo sapiens
gatatatttttcaca

SEQ ID NO: 2582162 - DNA, 17 bp, Homo sapiens
gatatatttttcacagt

SEQ ID NO: 2582163 - DNA, 17 bp, Homo sapiens
gatatcttgaaatgaaa

SEQ ID NO: 2582164 - DNA, 20 bp, Homo sapiens
gatatgatttaaaacatgta

SEQ ID NO: 2582165 - DNA, 16 bp, Homo sapiens
gatatgggacattttt

SEQ ID NO: 2582166 - DNA, 21 bp, Homo sapiens
gatatggtgggtggacagggg

SEQ ID NO: 2582167 - DNA, 16 bp, Homo sapiens
gatattgtgaagtaca

SEQ ID NO: 2582168 - DNA, 16 bp, Homo sapiens
gatatttatatatatt

SEQ ID NO: 2582169 - DNA, 12 bp, Homo sapiens
gatattttcaaa

SEQ ID NO: 2582170 - DNA, 19 bp, Homo sapiens
gatattttcaaattgtatc

SEQ ID NO: 2582171 - DNA, 15 bp, Homo sapiens
gatattttctgtgcc

SEQ ID NO: 2582172 - DNA, 16 bp, Homo sapiens
gatattttttctgaat

SEQ ID NO: 2582173 - DNA, 17 bp, Homo sapiens
gatcaaaataaaaagtg

SEQ ID NO: 2582174 - DNA, 22 bp, Homo sapiens
gatcaaaataaaaagtgacaca

SEQ ID NO: 2582175 - DNA, 22 bp, Homo sapiens
gatcaaaccccgaccacctgcc

SEQ ID NO: 2582176 - DNA, 16 bp, Homo sapiens
gatcaaatactttaaa

SEQ ID NO: 2582177 - DNA, 17 bp, Homo sapiens
gatcaaatactttaaag

SEQ ID NO: 2582178 - DNA, 22 bp, Homo sapiens
gatcaaccccttcgctcctgtg

SEQ ID NO: 2582179 - DNA, 18 bp, Homo sapiens
gatcaatgacagagcctt

SEQ ID NO: 2582180 - DNA, 16 bp, Homo sapiens
gatcaattaaatgtag

SEQ ID NO: 2582181 - DNA, 21 bp, Homo sapiens
gatcacagcttcagccaggag

SEQ ID NO: 2582182 - DNA, 14 bp, Homo sapiens
gatcaccagaataa

SEQ ID NO: 2582183 - DNA, 15 bp, Homo sapiens
gatcaccagaataaa

SEQ ID NO: 2582184 - DNA, 18 bp, Homo sapiens
gatcaccagcccggcctg

SEQ ID NO: 2582185 - DNA, 15 bp, Homo sapiens
gatcacgccactgca

SEQ ID NO: 2582186 - DNA, 15 bp, Homo sapiens
gatcacggctcactg

SEQ ID NO: 2582187 - DNA, 20 bp, Homo sapiens
gatcacggctcactgcagcc

SEQ ID NO: 2582188 - DNA, 12 bp, Homo sapiens
gatcactggagc

SEQ ID NO: 2582189 - DNA, 22 bp, Homo sapiens
gatcactttctcagttttcata

SEQ ID NO: 2582190 - DNA, 23 bp, Homo sapiens
gatcagagccgtggtcctttggg

SEQ ID NO: 2582191 - DNA, 12 bp, Homo sapiens
gatcagcctggg

SEQ ID NO: 2582192 - DNA, 15 bp, Homo sapiens
gatcagcctgggcaa

SEQ ID NO: 2582193 - DNA, 16 bp, Homo sapiens
gatcagctgtttgtca

SEQ ID NO: 2582194 - DNA, 14 bp, Homo sapiens
gatcaggctctgcc

SEQ ID NO: 2582195 - DNA, 14 bp, Homo sapiens
gatcaggtggggag

SEQ ID NO: 2582196 - DNA, 23 bp, Homo sapiens
gatcagtcctttgatcagtataa

SEQ ID NO: 2582197 - DNA, 17 bp, Homo sapiens
gatcataggtatttcaa

SEQ ID NO: 2582198 - DNA, 18 bp, Homo sapiens
gatcataggtatttcaaa

SEQ ID NO: 2582199 - DNA, 17 bp, Homo sapiens
gatcatccactgtgcca

SEQ ID NO: 2582200 - DNA, 19 bp, Homo sapiens
gatcatccactgtgccatg

SEQ ID NO: 2582201 - DNA, 15 bp, Homo sapiens
gatcatgcattgttg

SEQ ID NO: 2582202 - DNA, 21 bp, Homo sapiens
gatcatttgcccttaaggaca

SEQ ID NO: 2582203 - DNA, 19 bp, Homo sapiens
gatcattttccccccactc

SEQ ID NO: 2582204 - DNA, 13 bp, Homo sapiens
gatcattttctta

SEQ ID NO: 2582205 - DNA, 23 bp, Homo sapiens
gatcattttcttatcttctgcaa

SEQ ID NO: 2582206 - DNA, 19 bp, Homo sapiens
gatccaactaatgccttac

SEQ ID NO: 2582207 - DNA, 19 bp, Homo sapiens
gatccaagtttactcaacc

SEQ ID NO: 2582208 - DNA, 18 bp, Homo sapiens
gatccacacacagaggaa

SEQ ID NO: 2582209 - DNA, 22 bp, Homo sapiens
gatcccaccccattttctgtgg

SEQ ID NO: 2582210 - DNA, 23 bp, Homo sapiens
gatcccaggggcccaaggcggcc

SEQ ID NO: 2582211 - DNA, 21 bp, Homo sapiens
gatcccgcctcttcttcttca

SEQ ID NO: 2582212 - DNA, 15 bp, Homo sapiens
gatccctcatcctca

SEQ ID NO: 2582213 - DNA, 14 bp, Homo sapiens
gatccctcatctgt

SEQ ID NO: 2582214 - DNA, 18 bp, Homo sapiens
gatccctgttacccagag

SEQ ID NO: 2582215 - DNA, 23 bp, Homo sapiens
gatcctaatgaatgcataaaatg

SEQ ID NO: 2582216 - DNA, 18 bp, Homo sapiens
gatcctaggcatttgctg

SEQ ID NO: 2582217 - DNA, 18 bp, Homo sapiens
gatcctagttccaccatc

SEQ ID NO: 2582218 - DNA, 19 bp, Homo sapiens
gatcctattctcaccagga

SEQ ID NO: 2582219 - DNA, 20 bp, Homo sapiens
gatcctattctcaccaggaa

SEQ ID NO: 2582220 - DNA, 12 bp, Homo sapiens
gatcctccaggt

SEQ ID NO: 2582221 - DNA, 14 bp, Homo sapiens
gatcctccaggtgc

SEQ ID NO: 2582222 - DNA, 23 bp, Homo sapiens
gatcctgggtggtctgcaggcag

SEQ ID NO: 2582223 - DNA, 19 bp, Homo sapiens
gatcctgtctttaaggaaa

SEQ ID NO: 2582224 - DNA, 20 bp, Homo sapiens
gatcctgtctttaaggaaaa

SEQ ID NO: 2582225 - DNA, 12 bp, Homo sapiens
gatcctgtgaag

SEQ ID NO: 2582226 - DNA, 14 bp, Homo sapiens
gatcgcccccacct

SEQ ID NO: 2582227 - DNA, 21 bp, Homo sapiens
gatcgcggcggagctggcccc

SEQ ID NO: 2582228 - DNA, 17 bp, Homo sapiens
gatcggagcctcctctc

SEQ ID NO: 2582229 - DNA, 19 bp, Homo sapiens
gatcgtgacgctgaataaa

SEQ ID NO: 2582230 - DNA, 20 bp, Homo sapiens
gatcgtgacgctgaataaat

SEQ ID NO: 2582231 - DNA, 15 bp, Homo sapiens
gatcgtgctaaattt

SEQ ID NO: 2582232 - DNA, 18 bp, Homo sapiens
gatctaagcctttccata

SEQ ID NO: 2582233 - DNA, 23 bp, Homo sapiens
gatctaaggatgtcacagggcca

SEQ ID NO: 2582234 - DNA, 18 bp, Homo sapiens
gatctaccagcataaata

SEQ ID NO: 2582235 - DNA, 16 bp, Homo sapiens
gatctagaatgtgttt

SEQ ID NO: 2582236 - DNA, 21 bp, Homo sapiens
gatctagaatgtgttttctga

SEQ ID NO: 2582237 - DNA, 18 bp, Homo sapiens
gatctaggaagactttgg

SEQ ID NO: 2582238 - DNA, 15 bp, Homo sapiens
gatctaggtgaggat

SEQ ID NO: 2582239 - DNA, 15 bp, Homo sapiens
gatctaggtttaact

SEQ ID NO: 2582240 - DNA, 16 bp, Homo sapiens
gatctaggtttaactc

SEQ ID NO: 2582241 - DNA, 20 bp, Homo sapiens
gatctaggtttaactcagat

SEQ ID NO: 2582242 - DNA, 21 bp, Homo sapiens
gatctaggtttaactcagatc

SEQ ID NO: 2582243 - DNA, 16 bp, Homo sapiens
gatctatcaatagtca

SEQ ID NO: 2582244 - DNA, 17 bp, Homo sapiens
gatctcaggggctgttt

SEQ ID NO: 2582245 - DNA, 19 bp, Homo sapiens
gatctcaggggctgtttga

SEQ ID NO: 2582246 - DNA, 13 bp, Homo sapiens
gatctccaaggac

SEQ ID NO: 2582247 - DNA, 17 bp, Homo sapiens
gatctccatatgttaca

SEQ ID NO: 2582248 - DNA, 15 bp, Homo sapiens
gatctctaacttcac

SEQ ID NO: 2582249 - DNA, 13 bp, Homo sapiens
gatctctcaggag

SEQ ID NO: 2582250 - DNA, 16 bp, Homo sapiens
gatctctcaggagcac

SEQ ID NO: 2582251 - DNA, 18 bp, Homo sapiens
gatctctcaggagcacag

SEQ ID NO: 2582252 - DNA, 24 bp, Homo sapiens
gatctctcaggagcacaggcagct

SEQ ID NO: 2582253 - DNA, 12 bp, Homo sapiens
gatctcttgagc

SEQ ID NO: 2582254 - DNA, 12 bp, Homo sapiens
gatctgaacaga

SEQ ID NO: 2582255 - DNA, 19 bp, Homo sapiens
gatctgaacagaaatacca

SEQ ID NO: 2582256 - DNA, 16 bp, Homo sapiens
gatctggtttgactcc

SEQ ID NO: 2582257 - DNA, 14 bp, Homo sapiens
gatctggttttgct

SEQ ID NO: 2582258 - DNA, 17 bp, Homo sapiens
gatctgtcacaccagcc

SEQ ID NO: 2582259 - DNA, 18 bp, Homo sapiens
gatctgtcacaccagcca

SEQ ID NO: 2582260 - DNA, 19 bp, Homo sapiens
gatctgtcacaccagccat

SEQ ID NO: 2582261 - DNA, 15 bp, Homo sapiens
gatctgtccaaggaa

SEQ ID NO: 2582262 - DNA, 13 bp, Homo sapiens
gatctgtgcccca

SEQ ID NO: 2582263 - DNA, 14 bp, Homo sapiens
gatctgttgcaaac

SEQ ID NO: 2582264 - DNA, 21 bp, Homo sapiens
gatctgttgcaaactcagcct

SEQ ID NO: 2582265 - DNA, 14 bp, Homo sapiens
gatcttcagagcag

SEQ ID NO: 2582266 - DNA, 19 bp, Homo sapiens
gatcttgagcaagttcctt

SEQ ID NO: 2582267 - DNA, 19 bp, Homo sapiens
gatcttggcttactgcagc

SEQ ID NO: 2582268 - DNA, 14 bp, Homo sapiens
gatctttaaaatac

SEQ ID NO: 2582269 - DNA, 17 bp, Homo sapiens
gatctttgcagacaggc

SEQ ID NO: 2582270 - DNA, 18 bp, Homo sapiens
gatctttgcagacaggca

SEQ ID NO: 2582271 - DNA, 19 bp, Homo sapiens
gatgaaagagaaggtgggt

SEQ ID NO: 2582272 - DNA, 14 bp, Homo sapiens
gatgaaagaggagg

SEQ ID NO: 2582273 - DNA, 20 bp, Homo sapiens
gatgaaatcttacagctggg

SEQ ID NO: 2582274 - DNA, 15 bp, Homo sapiens
gatgaaatgaggtca

SEQ ID NO: 2582275 - DNA, 16 bp, Homo sapiens
gatgaaatgtaaatac

SEQ ID NO: 2582276 - DNA, 18 bp, Homo sapiens
gatgaactcttagaaatg

SEQ ID NO: 2582277 - DNA, 23 bp, Homo sapiens
gatgaatgaggtcccaggcagag

SEQ ID NO: 2582278 - DNA, 15 bp, Homo sapiens
gatgaatgataaact

SEQ ID NO: 2582279 - DNA, 13 bp, Homo sapiens
gatgaatgtatgt

SEQ ID NO: 2582280 - DNA, 14 bp, Homo sapiens
gatgacagagcgag

SEQ ID NO: 2582281 - DNA, 20 bp, Homo sapiens
gatgacatgcactcagctct

SEQ ID NO: 2582282 - DNA, 15 bp, Homo sapiens
gatgacattgctaag

SEQ ID NO: 2582283 - DNA, 13 bp, Homo sapiens
gatgaccagaaca

SEQ ID NO: 2582284 - DNA, 16 bp, Homo sapiens
gatgactagaggcagg

SEQ ID NO: 2582285 - DNA, 12 bp, Homo sapiens
gatgactgagtc

SEQ ID NO: 2582286 - DNA, 17 bp, Homo sapiens
gatgactgagtcctcgt

SEQ ID NO: 2582287 - DNA, 11 bp, Homo sapiens
gatgagaaagg

SEQ ID NO: 2582288 - DNA, 17 bp, Homo sapiens
gcagcccgtgtggcccc

SEQ ID NO: 2582289 - DNA, 20 bp, Homo sapiens
gcagcccgtgtggccccttc

SEQ ID NO: 2582290 - DNA, 24 bp, Homo sapiens
gcagccctaaggatctctcaggag

SEQ ID NO: 2582291 - DNA, 18 bp, Homo sapiens
gcagccctagagcctgcc

SEQ ID NO: 2582292 - DNA, 22 bp, Homo sapiens
gcagccctagagcctgcctgga

SEQ ID NO: 2582293 - DNA, 15 bp, Homo sapiens
gcagccgtgatcaag

SEQ ID NO: 2582294 - DNA, 19 bp, Homo sapiens
gcagcctcaacctcctggg

SEQ ID NO: 2582295 - DNA, 22 bp, Homo sapiens
gcagcctccctctgacctgcag

SEQ ID NO: 2582296 - DNA, 18 bp, Homo sapiens
gcagcctggacatagaga

SEQ ID NO: 2582297 - DNA, 14 bp, Homo sapiens
gcagcctgtggcat

SEQ ID NO: 2582298 - DNA, 20 bp, Homo sapiens
gcagcgaccacccctgcctc

SEQ ID NO: 2582299 - DNA, 22 bp, Homo sapiens
gcagcgaccgccccctcctcta

SEQ ID NO: 2582300 - DNA, 22 bp, Homo sapiens
gcagcgagctatgatcgcgcca

SEQ ID NO: 2582301 - DNA, 14 bp, Homo sapiens
gcagctagttttct

SEQ ID NO: 2582302 - DNA, 15 bp, Homo sapiens
gcagctcaaaggcac

SEQ ID NO: 2582303 - DNA, 17 bp, Homo sapiens
gcagctcaaaggcacag

SEQ ID NO: 2582304 - DNA, 15 bp, Homo sapiens
gcagctcacctctcc

SEQ ID NO: 2582305 - DNA, 17 bp, Homo sapiens
gcagctcacctctccct

SEQ ID NO: 2582306 - DNA, 18 bp, Homo sapiens
gcagctcagagagggtgg

SEQ ID NO: 2582307 - DNA, 19 bp, Homo sapiens
gcagctcagagagggtggg

SEQ ID NO: 2582308 - DNA, 14 bp, Homo sapiens
gcagctcatctctg

SEQ ID NO: 2582309 - DNA, 15 bp, Homo sapiens
gcagctctccagtca

SEQ ID NO: 2582310 - DNA, 21 bp, Homo sapiens
gcagctctccagtcaggaggc

SEQ ID NO: 2582311 - DNA, 16 bp, Homo sapiens
gcagctcttgcccttc

SEQ ID NO: 2582312 - DNA, 23 bp, Homo sapiens
gcagctcttgcccttccctgtcc

SEQ ID NO: 2582313 - DNA, 13 bp, Homo sapiens
gcagctcttgcta

SEQ ID NO: 2582314 - DNA, 21 bp, Homo sapiens
gcagctgatgttggaagagaa

SEQ ID NO: 2582315 - DNA, 15 bp, Homo sapiens
gcagctgattttaac

SEQ ID NO: 2582316 - DNA, 18 bp, Homo sapiens
gcagctgattttaacaat

SEQ ID NO: 2582317 - DNA, 19 bp, Homo sapiens
gcagctgcggtccacccag

SEQ ID NO: 2582318 - DNA, 22 bp, Homo sapiens
gcagctgcggtccacccaggag

SEQ ID NO: 2582319 - DNA, 23 bp, Homo sapiens
gcagctggaaaagggtcttggga

SEQ ID NO: 2582320 - DNA, 16 bp, Homo sapiens
gcagctggactaccca

SEQ ID NO: 2582321 - DNA, 13 bp, Homo sapiens
gcagcttgccccg

SEQ ID NO: 2582322 - DNA, 20 bp, Homo sapiens
gcagctttaaactcagggac

SEQ ID NO: 2582323 - DNA, 21 bp, Homo sapiens
gcagctttaaccattaaaact

SEQ ID NO: 2582324 - DNA, 15 bp, Homo sapiens
gcaggaactcccagc

SEQ ID NO: 2582325 - DNA, 16 bp, Homo sapiens
gcaggaaggagagcct

SEQ ID NO: 2582326 - DNA, 20 bp, Homo sapiens
gcaggaaggctgagaggaga

SEQ ID NO: 2582327 - DNA, 18 bp, Homo sapiens
gcaggacaacgaggaagc

SEQ ID NO: 2582328 - DNA, 13 bp, Homo sapiens
gcaggaccaggac

SEQ ID NO: 2582329 - DNA, 16 bp, Homo sapiens
gcaggacctcagagtc

SEQ ID NO: 2582330 - DNA, 22 bp, Homo sapiens
gcaggacctcagagtccaggcc

SEQ ID NO: 2582331 - DNA, 16 bp, Homo sapiens
gcaggagaggagagcc

SEQ ID NO: 2582332 - DNA, 17 bp, Homo sapiens
gcaggagaggagagcca

SEQ ID NO: 2582333 - DNA, 16 bp, Homo sapiens
gcaggaggcccctggc

SEQ ID NO: 2582334 - DNA, 22 bp, Homo sapiens
gcaggagggccctacctgattg

SEQ ID NO: 2582335 - DNA, 16 bp, Homo sapiens
gcaggatggcctggcc

SEQ ID NO: 2582336 - DNA, 15 bp, Homo sapiens
gcaggcacatggagg

SEQ ID NO: 2582337 - DNA, 20 bp, Homo sapiens
gcaggcaccttagtggcttt

SEQ ID NO: 2582338 - DNA, 14 bp, Homo sapiens
gcaggcagccaggc

SEQ ID NO: 2582339 - DNA, 15 bp, Homo sapiens
gcaggcagccaggcc

SEQ ID NO: 2582340 - DNA, 22 bp, Homo sapiens
gcaggcagcgccaagcaacctg

SEQ ID NO: 2582341 - DNA, 13 bp, Homo sapiens
gcaggcagggctg

SEQ ID NO: 2582342 - DNA, 16 bp, Homo sapiens
gcaggcatgtcctgga

SEQ ID NO: 2582343 - DNA, 20 bp, Homo sapiens
gcaggccaagagcagaggca

SEQ ID NO: 2582344 - DNA, 22 bp, Homo sapiens
gcaggccaagagcagaggcagc

SEQ ID NO: 2582345 - DNA, 21 bp, Homo sapiens
gcaggccaaggccttctcctc

SEQ ID NO: 2582346 - DNA, 20 bp, Homo sapiens
gcaggccaagtcaggccctt

SEQ ID NO: 2582347 - DNA, 23 bp, Homo sapiens
gcaggcggtgggcacccaccctg

SEQ ID NO: 2582348 - DNA, 16 bp, Homo sapiens
gcaggctggcaccgcc

SEQ ID NO: 2582349 - DNA, 18 bp, Homo sapiens
gcaggctggcaccgcctt

SEQ ID NO: 2582350 - DNA, 21 bp, Homo sapiens
gcagggaaggggaggcagccg

SEQ ID NO: 2582351 - DNA, 19 bp, Homo sapiens
gcagggacttgaacccata

SEQ ID NO: 2582352 - DNA, 22 bp, Homo sapiens
gcagggagaggagtgactgagc

SEQ ID NO: 2582353 - DNA, 21 bp, Homo sapiens
gcagggagcatggctgtgagg

SEQ ID NO: 2582354 - DNA, 22 bp, Homo sapiens
gcagggagccgagatcacgcca

SEQ ID NO: 2582355 - DNA, 19 bp, Homo sapiens
gcagggattgctgccactt

SEQ ID NO: 2582356 - DNA, 14 bp, Homo sapiens
gcagggcatctcct

SEQ ID NO: 2582357 - DNA, 15 bp, Homo sapiens
gcagggcatctcctg

SEQ ID NO: 2582358 - DNA, 21 bp, Homo sapiens
gcagggcctagctgctacaaa

SEQ ID NO: 2582359 - DNA, 16 bp, Homo sapiens
gcagggcctcacacgg

SEQ ID NO: 2582360 - DNA, 20 bp, Homo sapiens
gcagggctaccctgagctga

SEQ ID NO: 2582361 - DNA, 21 bp, Homo sapiens
gcagggctaccctgagctgag

SEQ ID NO: 2582362 - DNA, 22 bp, Homo sapiens
gcagggctaccctgagctgagg

SEQ ID NO: 2582363 - DNA, 12 bp, Homo sapiens
gcagggctcagc

SEQ ID NO: 2582364 - DNA, 14 bp, Homo sapiens
gcagggctcagcgg

SEQ ID NO: 2582365 - DNA, 21 bp, Homo sapiens
gcagggctcagcggggacagc

SEQ ID NO: 2582366 - DNA, 24 bp, Homo sapiens
gcaggggatggcgtggtcaagcac

SEQ ID NO: 2582367 - DNA, 19 bp, Homo sapiens
gcaggggtccttggtgtga

SEQ ID NO: 2582368 - DNA, 17 bp, Homo sapiens
gcagggtctcactctgt

SEQ ID NO: 2582369 - DNA, 21 bp, Homo sapiens
gcagggtcttttcatctggga

SEQ ID NO: 2582370 - DNA, 18 bp, Homo sapiens
gcagggtggtgctgggac

SEQ ID NO: 2582371 - DNA, 16 bp, Homo sapiens
gcaggtaaactcctgt

SEQ ID NO: 2582372 - DNA, 20 bp, Homo sapiens
gcaggtcttgaactcctggc

SEQ ID NO: 2582373 - DNA, 13 bp, Homo sapiens
gcaggtgcctcca

SEQ ID NO: 2582374 - DNA, 21 bp, Homo sapiens
gcaggtgcctccaggtgtgca

SEQ ID NO: 2582375 - DNA, 17 bp, Homo sapiens
gcaggtggcatctctaa

SEQ ID NO: 2582376 - DNA, 20 bp, Homo sapiens
gcaggtggtggcactgagcc

SEQ ID NO: 2582377 - DNA, 22 bp, Homo sapiens
gcaggtggtggcactgagcccc

SEQ ID NO: 2582378 - DNA, 20 bp, Homo sapiens
gcaggttcttcttcctgaag

SEQ ID NO: 2582379 - DNA, 19 bp, Homo sapiens
gcaggttgaggggctcctg

SEQ ID NO: 2582380 - DNA, 23 bp, Homo sapiens
gcagtacctataaagtaaagcta

SEQ ID NO: 2582381 - DNA, 20 bp, Homo sapiens
gcagtagaaataatatgcat

SEQ ID NO: 2582382 - DNA, 21 bp, Homo sapiens
gcagtagaaataatatgcatt

SEQ ID NO: 2582383 - DNA, 18 bp, Homo sapiens
gcagtagagtcatctcca

SEQ ID NO: 2582384 - DNA, 18 bp, Homo sapiens
gcagtgacgtgcacctgt

SEQ ID NO: 2582385 - DNA, 18 bp, Homo sapiens
gcagtgagtctcttcaga

SEQ ID NO: 2582386 - DNA, 20 bp, Homo sapiens
gcagtgagttacagcgagag

SEQ ID NO: 2582387 - DNA, 13 bp, Homo sapiens
gcagtgatgtcac

SEQ ID NO: 2582388 - DNA, 15 bp, Homo sapiens
gcagtgcaggcacag

SEQ ID NO: 2582389 - DNA, 23 bp, Homo sapiens
gcagtgcccctagcttagagcct

SEQ ID NO: 2582390 - DNA, 23 bp, Homo sapiens
gcagtgccttggggaatttcctc

SEQ ID NO: 2582391 - DNA, 15 bp, Homo sapiens
gcagtgcttctcaaa

SEQ ID NO: 2582392 - DNA, 16 bp, Homo sapiens
gcagtgcttctctaca

SEQ ID NO: 2582393 - DNA, 16 bp, Homo sapiens
gcagtgggagctgcct

SEQ ID NO: 2582394 - DNA, 17 bp, Homo sapiens
gcagtgggagctgcctg

SEQ ID NO: 2582395 - DNA, 18 bp, Homo sapiens
gcagtgggagctgcctgt

SEQ ID NO: 2582396 - DNA, 21 bp, Homo sapiens
gcagtggtgcgatctgggttc

SEQ ID NO: 2582397 - DNA, 22 bp, Homo sapiens
gcagtggtgcgatctgggttca

SEQ ID NO: 2582398 - DNA, 19 bp, Homo sapiens
gcagtggtggttttctgtt

SEQ ID NO: 2582399 - DNA, 22 bp, Homo sapiens
gcagtggtggttttctgttctt

SEQ ID NO: 2582400 - DNA, 14 bp, Homo sapiens
gcagtgtcttccat

SEQ ID NO: 2582401 - DNA, 20 bp, Homo sapiens
gcagtgttccccatctgggt

SEQ ID NO: 2582402 - DNA, 17 bp, Homo sapiens
gcagttattaacactaa

SEQ ID NO: 2582403 - DNA, 22 bp, Homo sapiens
gcagttgaaaagactccaaaga

SEQ ID NO: 2582404 - DNA, 22 bp, Homo sapiens
gcagttgaatgacaacagaagc

SEQ ID NO: 2582405 - DNA, 15 bp, Homo sapiens
gcagttgacagcagg

SEQ ID NO: 2582406 - DNA, 17 bp, Homo sapiens
gcagttgacagcaggtg

SEQ ID NO: 2582407 - DNA, 20 bp, Homo sapiens
gcagtttatcattcaagtgt

SEQ ID NO: 2582408 - DNA, 16 bp, Homo sapiens
gcagtttctgtcctgc

SEQ ID NO: 2582409 - DNA, 20 bp, Homo sapiens
gcagtttctgtcctgctggt

SEQ ID NO: 2582410 - DNA, 21 bp, Homo sapiens
gcagtttgcctggtgcagtgg

SEQ ID NO: 2582411 - DNA, 15 bp, Homo sapiens
gcataaaaattagcc

SEQ ID NO: 2582412 - DNA, 14 bp, Homo sapiens
gcataaatatgcag

SEQ ID NO: 2582413 - DNA, 21 bp, Homo sapiens
gcatacacacacacacacagc

SEQ ID NO: 2582414 - DNA, 20 bp, Homo sapiens
gcataccacttttgttcttg

SEQ ID NO: 2582415 - DNA, 15 bp, Homo sapiens
gcatacgtacacatt

SEQ ID NO: 2582416 - DNA, 16 bp, Homo sapiens
gcatacttcaaaagta

SEQ ID NO: 2582417 - DNA, 21 bp, Homo sapiens
gcatacttcaaaagtattttc

SEQ ID NO: 2582418 - DNA, 13 bp, Homo sapiens
gcatactttttaa

SEQ ID NO: 2582419 - DNA, 22 bp, Homo sapiens
gcatagcccagacacagaagag

SEQ ID NO: 2582420 - DNA, 15 bp, Homo sapiens
gcatataacttatat

SEQ ID NO: 2582421 - DNA, 16 bp, Homo sapiens
gcatataacttatatt

SEQ ID NO: 2582422 - DNA, 22 bp, Homo sapiens
gcatatcagtctctgagggctt

SEQ ID NO: 2582423 - DNA, 15 bp, Homo sapiens
gcatattcaggaagc

SEQ ID NO: 2582424 - DNA, 16 bp, Homo sapiens
gcatattcttatgtat

SEQ ID NO: 2582425 - DNA, 19 bp, Homo sapiens
gcatattgctttttctaat

SEQ ID NO: 2582426 - DNA, 12 bp, Homo sapiens
gcatattgtaca

SEQ ID NO: 2582427 - DNA, 21 bp, Homo sapiens
gcatattgtattactagaaga

SEQ ID NO: 2582428 - DNA, 19 bp, Homo sapiens
gcatattgttattatataa

SEQ ID NO: 2582429 - DNA, 22 bp, Homo sapiens
gcatcaaaagacaattctttat

SEQ ID NO: 2582430 - DNA, 23 bp, Homo sapiens
gccaggttctatttggaatttat

SEQ ID NO: 2582431 - DNA, 13 bp, Homo sapiens
gccaggttttctg

SEQ ID NO: 2582432 - DNA, 21 bp, Homo sapiens
gccagtatctatatatgtgta

SEQ ID NO: 2582433 - DNA, 22 bp, Homo sapiens
gccagtatctatatatgtgtat

SEQ ID NO: 2582434 - DNA, 16 bp, Homo sapiens
gccagtcctagctgca

SEQ ID NO: 2582435 - DNA, 18 bp, Homo sapiens
gccagtcctgcctggcca

SEQ ID NO: 2582436 - DNA, 19 bp, Homo sapiens
gccagtcctgcctggccag

SEQ ID NO: 2582437 - DNA, 22 bp, Homo sapiens
gccagtctcactgtgggaaggc

SEQ ID NO: 2582438 - DNA, 16 bp, Homo sapiens
gccagtctgggctgcc

SEQ ID NO: 2582439 - DNA, 20 bp, Homo sapiens
gccagtgacctgaggaagcg

SEQ ID NO: 2582440 - DNA, 15 bp, Homo sapiens
gccagtgactccagg

SEQ ID NO: 2582441 - DNA, 19 bp, Homo sapiens
gccagtgatgctaaaggtt

SEQ ID NO: 2582442 - DNA, 14 bp, Homo sapiens
gccagtggctggat

SEQ ID NO: 2582443 - DNA, 16 bp, Homo sapiens
gccagtgtctgtcccg

SEQ ID NO: 2582444 - DNA, 13 bp, Homo sapiens
gccagtgtgacaa

SEQ ID NO: 2582445 - DNA, 20 bp, Homo sapiens
gccagtgtgatcccaagtgc

SEQ ID NO: 2582446 - DNA, 15 bp, Homo sapiens
gccagttcagtacct

SEQ ID NO: 2582447 - DNA, 20 bp, Homo sapiens
gccagttcagtacctggagg

SEQ ID NO: 2582448 - DNA, 22 bp, Homo sapiens
gccagttcagtacctggaggag

SEQ ID NO: 2582449 - DNA, 16 bp, Homo sapiens
gccagttggtccccct

SEQ ID NO: 2582450 - DNA, 23 bp, Homo sapiens
gccagttggtcccccttccatgg

SEQ ID NO: 2582451 - DNA, 17 bp, Homo sapiens
gccatattttcaccatt

SEQ ID NO: 2582452 - DNA, 17 bp, Homo sapiens
gccatcaacaagagttg

SEQ ID NO: 2582453 - DNA, 20 bp, Homo sapiens
gccatccaaataagaaacct

SEQ ID NO: 2582454 - DNA, 16 bp, Homo sapiens
gccatcccagccccaa

SEQ ID NO: 2582455 - DNA, 16 bp, Homo sapiens
gccatcccagccttgg

SEQ ID NO: 2582456 - DNA, 19 bp, Homo sapiens
gccatcgccgggactccag

SEQ ID NO: 2582457 - DNA, 23 bp, Homo sapiens
gccatcgccgggactccagaacc

SEQ ID NO: 2582458 - DNA, 19 bp, Homo sapiens
gccatctctggatgcctga

SEQ ID NO: 2582459 - DNA, 12 bp, Homo sapiens
gccatctgccca

SEQ ID NO: 2582460 - DNA, 14 bp, Homo sapiens
gccatctgcccagg

SEQ ID NO: 2582461 - DNA, 17 bp, Homo sapiens
gccatctgcccaggggt

SEQ ID NO: 2582462 - DNA, 19 bp, Homo sapiens
gccatctgcccaggggtgc

SEQ ID NO: 2582463 - DNA, 21 bp, Homo sapiens
gccatctgcgtgacaataaaa

SEQ ID NO: 2582464 - DNA, 14 bp, Homo sapiens
gccatcttggtaaa

SEQ ID NO: 2582465 - DNA, 15 bp, Homo sapiens
gccatcttggtaaat

SEQ ID NO: 2582466 - DNA, 18 bp, Homo sapiens
gccatgagctccagaccc

SEQ ID NO: 2582467 - DNA, 19 bp, Homo sapiens
gccatgaggcctcagtgga

SEQ ID NO: 2582468 - DNA, 20 bp, Homo sapiens
gccatgaggcctcagtggac

SEQ ID NO: 2582469 - DNA, 22 bp, Homo sapiens
gccatgatggtgctgacctctg

SEQ ID NO: 2582470 - DNA, 15 bp, Homo sapiens
gccatgatgtggagt

SEQ ID NO: 2582471 - DNA, 18 bp, Homo sapiens
gccatggactctacactg

SEQ ID NO: 2582472 - DNA, 22 bp, Homo sapiens
gccatggactctacactgtgaa

SEQ ID NO: 2582473 - DNA, 22 bp, Homo sapiens
gccatggagagctggagcctgg

SEQ ID NO: 2582474 - DNA, 12 bp, Homo sapiens
gccatgggacca

SEQ ID NO: 2582475 - DNA, 13 bp, Homo sapiens
gccatgggaccaa

SEQ ID NO: 2582476 - DNA, 16 bp, Homo sapiens
gccatgggcctcctgt

SEQ ID NO: 2582477 - DNA, 18 bp, Homo sapiens
gccatgttggccaggctg

SEQ ID NO: 2582478 - DNA, 18 bp, Homo sapiens
gccattaccatggagaca

SEQ ID NO: 2582479 - DNA, 14 bp, Homo sapiens
gccattccaacagc

SEQ ID NO: 2582480 - DNA, 14 bp, Homo sapiens
gccattgcactcca

SEQ ID NO: 2582481 - DNA, 17 bp, Homo sapiens
gccattgccaccaggag

SEQ ID NO: 2582482 - DNA, 18 bp, Homo sapiens
gccattgccaccaggaga

SEQ ID NO: 2582483 - DNA, 19 bp, Homo sapiens
gccattgccaccaggagaa

SEQ ID NO: 2582484 - DNA, 20 bp, Homo sapiens
gccattggctatttaaaact

SEQ ID NO: 2582485 - DNA, 22 bp, Homo sapiens
gccattgtcttcggaaaccttg

SEQ ID NO: 2582486 - DNA, 20 bp, Homo sapiens
gccatttgcaccctccgcct

SEQ ID NO: 2582487 - DNA, 15 bp, Homo sapiens
gccatttgctttttc

SEQ ID NO: 2582488 - DNA, 18 bp, Homo sapiens
gcccaaaaatatggttga

SEQ ID NO: 2582489 - DNA, 16 bp, Homo sapiens
gcccaaagccagacag

SEQ ID NO: 2582490 - DNA, 23 bp, Homo sapiens
gcccaacagacaccatcttttgt

SEQ ID NO: 2582491 - DNA, 16 bp, Homo sapiens
gcccaacccttcccca

SEQ ID NO: 2582492 - DNA, 24 bp, Homo sapiens
gcccaacctgctctcctcttgcca

SEQ ID NO: 2582493 - DNA, 20 bp, Homo sapiens
gcccaagacagatgccccag

SEQ ID NO: 2582494 - DNA, 20 bp, Homo sapiens
gcccaagcccgacttgctgt

SEQ ID NO: 2582495 - DNA, 20 bp, Homo sapiens
gcccaagctcagaaggctct

SEQ ID NO: 2582496 - DNA, 12 bp, Homo sapiens
gcccaagctctt

SEQ ID NO: 2582497 - DNA, 15 bp, Homo sapiens
gcccaattggaggaa

SEQ ID NO: 2582498 - DNA, 20 bp, Homo sapiens
gcccaattggaggaaagcaa

SEQ ID NO: 2582499 - DNA, 18 bp, Homo sapiens
gcccacaggatcagtctg

SEQ ID NO: 2582500 - DNA, 13 bp, Homo sapiens
gcccacccccctc

SEQ ID NO: 2582501 - DNA, 14 bp, Homo sapiens
gcccacccccctca

SEQ ID NO: 2582502 - DNA, 15 bp, Homo sapiens
gcccaccccctcaag

SEQ ID NO: 2582503 - DNA, 15 bp, Homo sapiens
gcccacccctcaaca

SEQ ID NO: 2582504 - DNA, 20 bp, Homo sapiens
gcccacctgcccatcacagg

SEQ ID NO: 2582505 - DNA, 20 bp, Homo sapiens
gcccacctggccacctgagg

SEQ ID NO: 2582506 - DNA, 16 bp, Homo sapiens
gcccaccttggctcaa

SEQ ID NO: 2582507 - DNA, 18 bp, Homo sapiens
gcccaccttggctcaagt

SEQ ID NO: 2582508 - DNA, 14 bp, Homo sapiens
gcccacgcccccac

SEQ ID NO: 2582509 - DNA, 15 bp, Homo sapiens
gcccacgcccccact

SEQ ID NO: 2582510 - DNA, 15 bp, Homo sapiens
gcccacgctggagtg

SEQ ID NO: 2582511 - DNA, 18 bp, Homo sapiens
gcccactatggtcatctt

SEQ ID NO: 2582512 - DNA, 19 bp, Homo sapiens
gcccactccctgcaacctg

SEQ ID NO: 2582513 - DNA, 18 bp, Homo sapiens
gcccactgcccaccccct

SEQ ID NO: 2582514 - DNA, 19 bp, Homo sapiens
gcccactgtcctgggcgcc

SEQ ID NO: 2582515 - DNA, 14 bp, Homo sapiens
gcccacttctgcca

SEQ ID NO: 2582516 - DNA, 22 bp, Homo sapiens
gcccacttgtcccactatctgg

SEQ ID NO: 2582517 - DNA, 19 bp, Homo sapiens
gcccagacccctctggcca

SEQ ID NO: 2582518 - DNA, 14 bp, Homo sapiens
gcccagagcaggaa

SEQ ID NO: 2582519 - DNA, 12 bp, Homo sapiens
gcccagagggcc

SEQ ID NO: 2582520 - DNA, 14 bp, Homo sapiens
gcccagagggcctg

SEQ ID NO: 2582521 - DNA, 20 bp, Homo sapiens
gcccagagggcctgcaaggg

SEQ ID NO: 2582522 - DNA, 21 bp, Homo sapiens
gcccagagggcctgcaaggga

SEQ ID NO: 2582523 - DNA, 14 bp, Homo sapiens
gcccagcattgctg

SEQ ID NO: 2582524 - DNA, 16 bp, Homo sapiens
gcccagcattgctggt

SEQ ID NO: 2582525 - DNA, 20 bp, Homo sapiens
gcccagccattaccatggag

SEQ ID NO: 2582526 - DNA, 15 bp, Homo sapiens
gcccagcccccacag

SEQ ID NO: 2582527 - DNA, 11 bp, Homo sapiens
gcccagcccct

SEQ ID NO: 2582528 - DNA, 12 bp, Homo sapiens
gcccagcccctt

SEQ ID NO: 2582529 - DNA, 13 bp, Homo sapiens
gcccagccccttc

SEQ ID NO: 2582530 - DNA, 20 bp, Homo sapiens
gcccagccccttctgaccca

SEQ ID NO: 2582531 - DNA, 14 bp, Homo sapiens
gcccagcccggctc

SEQ ID NO: 2582532 - DNA, 21 bp, Homo sapiens
gcccagccctgctggccgcct

SEQ ID NO: 2582533 - DNA, 18 bp, Homo sapiens
gcccagccggcctctctg

SEQ ID NO: 2582534 - DNA, 19 bp, Homo sapiens
gcccagccggcctctctgg

SEQ ID NO: 2582535 - DNA, 23 bp, Homo sapiens
gcccagccggcctctctggcctc

SEQ ID NO: 2582536 - DNA, 17 bp, Homo sapiens
gcccagcggcccctccc

SEQ ID NO: 2582537 - DNA, 11 bp, Homo sapiens
gcccagctccc

SEQ ID NO: 2582538 - DNA, 13 bp, Homo sapiens
gcccagctgcacc

SEQ ID NO: 2582539 - DNA, 14 bp, Homo sapiens
gcccagctgcacct

SEQ ID NO: 2582540 - DNA, 14 bp, Homo sapiens
gcccagcttgggcc

SEQ ID NO: 2582541 - DNA, 15 bp, Homo sapiens
gcccagcttgggccc

SEQ ID NO: 2582542 - DNA, 16 bp, Homo sapiens
gcccagcttgggccca

SEQ ID NO: 2582543 - DNA, 13 bp, Homo sapiens
gcccaggaccagc

SEQ ID NO: 2582544 - DNA, 14 bp, Homo sapiens
gcccaggaccagct

SEQ ID NO: 2582545 - DNA, 19 bp, Homo sapiens
gcccaggaccagctggggc

SEQ ID NO: 2582546 - DNA, 12 bp, Homo sapiens
gcccaggcaggt

SEQ ID NO: 2582547 - DNA, 13 bp, Homo sapiens
gcccaggcaggtc

SEQ ID NO: 2582548 - DNA, 16 bp, Homo sapiens
gcccaggcaggtcttg

SEQ ID NO: 2582549 - DNA, 11 bp, Homo sapiens
gcccaggcccc

SEQ ID NO: 2582550 - DNA, 15 bp, Homo sapiens
gcccaggcccctgcc

SEQ ID NO: 2582551 - DNA, 18 bp, Homo sapiens
gcccaggcccctgccacc

SEQ ID NO: 2582552 - DNA, 23 bp, Homo sapiens
gcccaggcccctgccaccctggg

SEQ ID NO: 2582553 - DNA, 22 bp, Homo sapiens
gcccaggccggggtggagcatg

SEQ ID NO: 2582554 - DNA, 11 bp, Homo sapiens
gcccaggctgg

SEQ ID NO: 2582555 - DNA, 15 bp, Homo sapiens
gcccaggctggagtg

SEQ ID NO: 2582556 - DNA, 19 bp, Homo sapiens
gcccaggctggagtgcagt

SEQ ID NO: 2582557 - DNA, 21 bp, Homo sapiens
gcccaggcttagtcactgaga

SEQ ID NO: 2582558 - DNA, 23 bp, Homo sapiens
gcccagggacaccagccaggctc

SEQ ID NO: 2582559 - DNA, 24 bp, Homo sapiens
gcccagggacaccagccaggctct

SEQ ID NO: 2582560 - DNA, 16 bp, Homo sapiens
gcccagggagcggaaa

SEQ ID NO: 2582561 - DNA, 15 bp, Homo sapiens
gcccagggccactct

SEQ ID NO: 2582562 - DNA, 15 bp, Homo sapiens
gcccagggctcagcc

SEQ ID NO: 2582563 - DNA, 17 bp, Homo sapiens
gcccagggctcagcctg

SEQ ID NO: 2582564 - DNA, 18 bp, Homo sapiens
gcccagggctcagcctgg

SEQ ID NO: 2582565 - DNA, 16 bp, Homo sapiens
gcccaggggagccctc

SEQ ID NO: 2582566 - DNA, 20 bp, Homo sapiens
gcccaggggcccacagggaa

SEQ ID NO: 2582567 - DNA, 15 bp, Homo sapiens
gcccaggggtgcccc

SEQ ID NO: 2582568 - DNA, 17 bp, Homo sapiens
gcccaggggtgccccct

SEQ ID NO: 2582569 - DNA, 18 bp, Homo sapiens
gcccaggggtgccccctc

SEQ ID NO: 2582570 - DNA, 19 bp, Homo sapiens
gcccaggggtgccccctcc

SEQ ID NO: 2582571 - DNA, 17 bp, Homo sapiens
gcccaggtttctggtct

SEQ ID NO: 2582572 - DNA, 15 bp, Homo sapiens
gcccagtcctggcct

SEQ ID NO: 2582573 - DNA, 14 bp, Homo sapiens
gcccagtccttcca

SEQ ID NO: 2582574 - DNA, 18 bp, Homo sapiens
gcccagtccttccacctc

SEQ ID NO: 2582575 - DNA, 17 bp, Homo sapiens
gcctgcctggcaggctg

SEQ ID NO: 2582576 - DNA, 17 bp, Homo sapiens
gcctgcctgttcccatt

SEQ ID NO: 2582577 - DNA, 17 bp, Homo sapiens
gcctgctaattccccag

SEQ ID NO: 2582578 - DNA, 15 bp, Homo sapiens
gcctgctcccagcag

SEQ ID NO: 2582579 - DNA, 22 bp, Homo sapiens
gcctgctcccagcagccctaag

SEQ ID NO: 2582580 - DNA, 10 bp, Homo sapiens
gcctgctgca

SEQ ID NO: 2582581 - DNA, 18 bp, Homo sapiens
gcctgctgcatggggtgg

SEQ ID NO: 2582582 - DNA, 17 bp, Homo sapiens
gcctgctggtcacagcc

SEQ ID NO: 2582583 - DNA, 18 bp, Homo sapiens
gcctgctggtcacagcct

SEQ ID NO: 2582584 - DNA, 19 bp, Homo sapiens
gcctgctggtcacagcctc

SEQ ID NO: 2582585 - DNA, 16 bp, Homo sapiens
gcctgcttcctgtctt

SEQ ID NO: 2582586 - DNA, 18 bp, Homo sapiens
gcctgcttttcactgctg

SEQ ID NO: 2582587 - DNA, 20 bp, Homo sapiens
gcctgcttttcactgctgca

SEQ ID NO: 2582588 - DNA, 21 bp, Homo sapiens
gcctgcttttcactgctgcaa

SEQ ID NO: 2582589 - DNA, 22 bp, Homo sapiens
gcctggaagacagagacctcct

SEQ ID NO: 2582590 - DNA, 20 bp, Homo sapiens
gcctggacatttgccttgct

SEQ ID NO: 2582591 - DNA, 11 bp, Homo sapiens
gcctggacctg

SEQ ID NO: 2582592 - DNA, 14 bp, Homo sapiens
gcctggacctgcct

SEQ ID NO: 2582593 - DNA, 16 bp, Homo sapiens
gcctggacctgcctcc

SEQ ID NO: 2582594 - DNA, 13 bp, Homo sapiens
gcctggagaagct

SEQ ID NO: 2582595 - DNA, 18 bp, Homo sapiens
gcctggatggggctgcac

SEQ ID NO: 2582596 - DNA, 22 bp, Homo sapiens
gcctggcagaactgagctcctc

SEQ ID NO: 2582597 - DNA, 19 bp, Homo sapiens
gcctggccacctctctcct

SEQ ID NO: 2582598 - DNA, 14 bp, Homo sapiens
gcctggccagatgc

SEQ ID NO: 2582599 - DNA, 15 bp, Homo sapiens
gcctggccaggagct

SEQ ID NO: 2582600 - DNA, 23 bp, Homo sapiens
gcctggccaggcagatctgtgcc

SEQ ID NO: 2582601 - DNA, 20 bp, Homo sapiens
gcctggcccctcagggtccc

SEQ ID NO: 2582602 - DNA, 13 bp, Homo sapiens
gcctggcctggca

SEQ ID NO: 2582603 - DNA, 21 bp, Homo sapiens
gcctggcgaaaccccatctct

SEQ ID NO: 2582604 - DNA, 14 bp, Homo sapiens
gcctggcttctgga

SEQ ID NO: 2582605 - DNA, 18 bp, Homo sapiens
gcctggcttctggagccc

SEQ ID NO: 2582606 - DNA, 22 bp, Homo sapiens
gcctggcttctggagcccttgg

SEQ ID NO: 2582607 - DNA, 19 bp, Homo sapiens
gcctgggcaacagagcaag

SEQ ID NO: 2582608 - DNA, 12 bp, Homo sapiens
gcctgggcaaga

SEQ ID NO: 2582609 - DNA, 17 bp, Homo sapiens
gcctgggcagccaggct

SEQ ID NO: 2582610 - DNA, 21 bp, Homo sapiens
gcctgggcctcctcacaacat

SEQ ID NO: 2582611 - DNA, 23 bp, Homo sapiens
gcctggggctcctttctccagcc

SEQ ID NO: 2582612 - DNA, 22 bp, Homo sapiens
gcctgggggcagggagaggagt

SEQ ID NO: 2582613 - DNA, 17 bp, Homo sapiens
gcctgggggtgccagga

SEQ ID NO: 2582614 - DNA, 14 bp, Homo sapiens
gcctgggtctgtgt

SEQ ID NO: 2582615 - DNA, 16 bp, Homo sapiens
gcctgggtctgtgtct

SEQ ID NO: 2582616 - DNA, 19 bp, Homo sapiens
gcctgggtctgtgtctctt

SEQ ID NO: 2582617 - DNA, 20 bp, Homo sapiens
gcctgggtgacagagcaaga

SEQ ID NO: 2582618 - DNA, 14 bp, Homo sapiens
gcctgggtgctggc

SEQ ID NO: 2582619 - DNA, 20 bp, Homo sapiens
gcctgggtgctggctgccca

SEQ ID NO: 2582620 - DNA, 15 bp, Homo sapiens
gcctgggtggacatg

SEQ ID NO: 2582621 - DNA, 20 bp, Homo sapiens
gcctgggtttaaggggagag

SEQ ID NO: 2582622 - DNA, 13 bp, Homo sapiens
gcctggtggcagc

SEQ ID NO: 2582623 - DNA, 18 bp, Homo sapiens
gcctgtaatcacagctac

SEQ ID NO: 2582624 - DNA, 18 bp, Homo sapiens
gcctgtaatcccagcact

SEQ ID NO: 2582625 - DNA, 15 bp, Homo sapiens
gcctgtaatcctagc

SEQ ID NO: 2582626 - DNA, 16 bp, Homo sapiens
gcctgtagttaggaaa

SEQ ID NO: 2582627 - DNA, 17 bp, Homo sapiens
gcctgtagttaggaaat

SEQ ID NO: 2582628 - DNA, 18 bp, Homo sapiens
gcctgtagttaggaaata

SEQ ID NO: 2582629 - DNA, 19 bp, Homo sapiens
gcctgtagttaggaaataa

SEQ ID NO: 2582630 - DNA, 12 bp, Homo sapiens
gcctgtccagcc

SEQ ID NO: 2582631 - DNA, 14 bp, Homo sapiens
gcctgtccagcctg

SEQ ID NO: 2582632 - DNA, 20 bp, Homo sapiens
gcctgtcccacccccacccc

SEQ ID NO: 2582633 - DNA, 21 bp, Homo sapiens
gcctgtcccatggacactcca

SEQ ID NO: 2582634 - DNA, 22 bp, Homo sapiens
gcctgtcccatggacactccag

SEQ ID NO: 2582635 - DNA, 14 bp, Homo sapiens
gcctgtccctctca

SEQ ID NO: 2582636 - DNA, 18 bp, Homo sapiens
gcctgtccctctcaggca

SEQ ID NO: 2582637 - DNA, 20 bp, Homo sapiens
gcctgtcctgacctgtctca

SEQ ID NO: 2582638 - DNA, 17 bp, Homo sapiens
gcctgtctcatccccag

SEQ ID NO: 2582639 - DNA, 19 bp, Homo sapiens
gcctgtctcatccccaggg

SEQ ID NO: 2582640 - DNA, 17 bp, Homo sapiens
gcctgtctgtctctcca

SEQ ID NO: 2582641 - DNA, 20 bp, Homo sapiens
gcctgtctgtctctccatct

SEQ ID NO: 2582642 - DNA, 19 bp, Homo sapiens
gcctgtgcctcctcacccc

SEQ ID NO: 2582643 - DNA, 19 bp, Homo sapiens
gcctgtggaatctggagtg

SEQ ID NO: 2582644 - DNA, 24 bp, Homo sapiens
gcctgtggaatctggagtgagggg

SEQ ID NO: 2582645 - DNA, 16 bp, Homo sapiens
gcctgtggcctgtgtc

SEQ ID NO: 2582646 - DNA, 15 bp, Homo sapiens
gcctgtgtcccatga

SEQ ID NO: 2582647 - DNA, 22 bp, Homo sapiens
gcctgtgtgacatcagtggcat

SEQ ID NO: 2582648 - DNA, 22 bp, Homo sapiens
gcctgttagactcttacttttt

SEQ ID NO: 2582649 - DNA, 17 bp, Homo sapiens
gcctgttcagctccagc

SEQ ID NO: 2582650 - DNA, 13 bp, Homo sapiens
gcctgttcagtta

SEQ ID NO: 2582651 - DNA, 15 bp, Homo sapiens
gcctgttcagttaca

SEQ ID NO: 2582652 - DNA, 16 bp, Homo sapiens
gcctgttcagttacag

SEQ ID NO: 2582653 - DNA, 20 bp, Homo sapiens
gcctgttcagttacagaaag

SEQ ID NO: 2582654 - DNA, 24 bp, Homo sapiens
gcctgttcagttacagaaagtggt

SEQ ID NO: 2582655 - DNA, 19 bp, Homo sapiens
gcctgttcccattcttgca

SEQ ID NO: 2582656 - DNA, 23 bp, Homo sapiens
gcctgttcccattcttgcatggc

SEQ ID NO: 2582657 - DNA, 17 bp, Homo sapiens
gcctgttcccctcactg

SEQ ID NO: 2582658 - DNA, 22 bp, Homo sapiens
gcctgttcccctcactggatga

SEQ ID NO: 2582659 - DNA, 18 bp, Homo sapiens
gccttaccctcatgttct

SEQ ID NO: 2582660 - DNA, 20 bp, Homo sapiens
gccttatcaagtgtcttcca

SEQ ID NO: 2582661 - DNA, 19 bp, Homo sapiens
gccttattagagtgtcttt

SEQ ID NO: 2582662 - DNA, 22 bp, Homo sapiens
gccttccacgctgtctccagac

SEQ ID NO: 2582663 - DNA, 21 bp, Homo sapiens
gccttccaggggtgggacacc

SEQ ID NO: 2582664 - DNA, 14 bp, Homo sapiens
gccttccataatta

SEQ ID NO: 2582665 - DNA, 15 bp, Homo sapiens
gccttccataattat

SEQ ID NO: 2582666 - DNA, 19 bp, Homo sapiens
gccttccatgtcggcctct

SEQ ID NO: 2582667 - DNA, 15 bp, Homo sapiens
gccttccccagcctc

SEQ ID NO: 2582668 - DNA, 16 bp, Homo sapiens
gccttccccagcctct

SEQ ID NO: 2582669 - DNA, 18 bp, Homo sapiens
gccttccccctcccaggg

SEQ ID NO: 2582670 - DNA, 14 bp, Homo sapiens
gccttcctcctggg

SEQ ID NO: 2582671 - DNA, 16 bp, Homo sapiens
gccttcctcctgggcc

SEQ ID NO: 2582672 - DNA, 19 bp, Homo sapiens
gccttcctctgcagctgac

SEQ ID NO: 2582673 - DNA, 21 bp, Homo sapiens
gccttcctctgcagctgacct

SEQ ID NO: 2582674 - DNA, 19 bp, Homo sapiens
gccttcctgtttttcacat

SEQ ID NO: 2582675 - DNA, 13 bp, Homo sapiens
gccttccttgcta

SEQ ID NO: 2582676 - DNA, 14 bp, Homo sapiens
gccttctcctcccc

SEQ ID NO: 2582677 - DNA, 17 bp, Homo sapiens
gccttcttctttttgct

SEQ ID NO: 2582678 - DNA, 19 bp, Homo sapiens
gccttgaaccacttccctc

SEQ ID NO: 2582679 - DNA, 20 bp, Homo sapiens
gccttgaccattctccacct

SEQ ID NO: 2582680 - DNA, 22 bp, Homo sapiens
gccttgaccattctccacctgc

SEQ ID NO: 2582681 - DNA, 23 bp, Homo sapiens
gccttgcagcactcacacaggac

SEQ ID NO: 2582682 - DNA, 18 bp, Homo sapiens
gccttgcggtatccgccc

SEQ ID NO: 2582683 - DNA, 19 bp, Homo sapiens
gccttgctacctcaagggg

SEQ ID NO: 2582684 - DNA, 22 bp, Homo sapiens
gccttgctcccaaccccacacg

SEQ ID NO: 2582685 - DNA, 14 bp, Homo sapiens
gccttgggctgctc

SEQ ID NO: 2582686 - DNA, 19 bp, Homo sapiens
gccttggggaatttcctct

SEQ ID NO: 2582687 - DNA, 18 bp, Homo sapiens
gccttggttcccttgtgt

SEQ ID NO: 2582688 - DNA, 17 bp, Homo sapiens
gccttgtaattctaaat

SEQ ID NO: 2582689 - DNA, 17 bp, Homo sapiens
gcctttaaatctgtgat

SEQ ID NO: 2582690 - DNA, 19 bp, Homo sapiens
gcctttagtgatcacagca

SEQ ID NO: 2582691 - DNA, 21 bp, Homo sapiens
gcctttagtgatcacagcagc

SEQ ID NO: 2582692 - DNA, 14 bp, Homo sapiens
gcctttatggtttc

SEQ ID NO: 2582693 - DNA, 21 bp, Homo sapiens
gcctttccataaggaatgtag

SEQ ID NO: 2582694 - DNA, 17 bp, Homo sapiens
gcctttcctgtagcctt

SEQ ID NO: 2582695 - DNA, 18 bp, Homo sapiens
gcctttctcccaggccag

SEQ ID NO: 2582696 - DNA, 23 bp, Homo sapiens
gcctttctcccaggccaggctcc

SEQ ID NO: 2582697 - DNA, 12 bp, Homo sapiens
gcctttctgtgt

SEQ ID NO: 2582698 - DNA, 21 bp, Homo sapiens
gcctttgagacagtttcttag

SEQ ID NO: 2582699 - DNA, 20 bp, Homo sapiens
gcctttggatgaccagaaca

SEQ ID NO: 2582700 - DNA, 13 bp, Homo sapiens
gcctttggcaggt

SEQ ID NO: 2582701 - DNA, 15 bp, Homo sapiens
gcctttggcaggtgc

SEQ ID NO: 2582702 - DNA, 13 bp, Homo sapiens
gcctttggcttca

SEQ ID NO: 2582703 - DNA, 15 bp, Homo sapiens
gcgaaggggccctgg

SEQ ID NO: 2582704 - DNA, 22 bp, Homo sapiens
gcgacagtgagactctgtctca

SEQ ID NO: 2582705 - DNA, 19 bp, Homo sapiens
gcgaccacccctgcctcca

SEQ ID NO: 2582706 - DNA, 15 bp, Homo sapiens
gcgaccttcctcatc

SEQ ID NO: 2582707 - DNA, 21 bp, Homo sapiens
gcgactctatagactctagga

SEQ ID NO: 2582708 - DNA, 15 bp, Homo sapiens
gcgagaggcagagaa

SEQ ID NO: 2582709 - DNA, 15 bp, Homo sapiens
gcgagagtccctgca

SEQ ID NO: 2582710 - DNA, 19 bp, Homo sapiens
gcgaggagatgctccttgg

SEQ ID NO: 2582711 - DNA, 12 bp, Homo sapiens
gcgaggcagagg

SEQ ID NO: 2582712 - DNA, 13 bp, Homo sapiens
gcgaggcagagga

SEQ ID NO: 2582713 - DNA, 14 bp, Homo sapiens
gcgaggcagaggac

SEQ ID NO: 2582714 - DNA, 21 bp, Homo sapiens
gcgagtgccaggactccccag

SEQ ID NO: 2582715 - DNA, 22 bp, Homo sapiens
gcgagtgccaggactccccagg

SEQ ID NO: 2582716 - DNA, 20 bp, Homo sapiens
gcgagtgtgtgcatgtgtgt

SEQ ID NO: 2582717 - DNA, 19 bp, Homo sapiens
gcgatgaatttggagactc

SEQ ID NO: 2582718 - DNA, 23 bp, Homo sapiens
gctgcaaggtggctccagcacca

SEQ ID NO: 2582719 - DNA, 18 bp, Homo sapiens
gctgcacagggcagctgg

SEQ ID NO: 2582720 - DNA, 21 bp, Homo sapiens
gctgcacagggcagctgggcc

SEQ ID NO: 2582721 - DNA, 23 bp, Homo sapiens
gctgcacagggcagctgggccca

SEQ ID NO: 2582722 - DNA, 16 bp, Homo sapiens
gctgcaccctcaggca

SEQ ID NO: 2582723 - DNA, 19 bp, Homo sapiens
gctgcaccctcaggcaggt

SEQ ID NO: 2582724 - DNA, 22 bp, Homo sapiens
gctgcaccggctggcctggccc

SEQ ID NO: 2582725 - DNA, 18 bp, Homo sapiens
gctgcacctgccagcctg

SEQ ID NO: 2582726 - DNA, 21 bp, Homo sapiens
gctgcacctgccagcctggct

SEQ ID NO: 2582727 - DNA, 19 bp, Homo sapiens
gctgcagaaggccaagaat

SEQ ID NO: 2582728 - DNA, 14 bp, Homo sapiens
gctgcagcagaggc

SEQ ID NO: 2582729 - DNA, 12 bp, Homo sapiens
gctgcagcagcg

SEQ ID NO: 2582730 - DNA, 20 bp, Homo sapiens
gctgcagcagcggtggcctc

SEQ ID NO: 2582731 - DNA, 21 bp, Homo sapiens
gctgcagcagcggtggcctct

SEQ ID NO: 2582732 - DNA, 13 bp, Homo sapiens
gctgcagttgcca

SEQ ID NO: 2582733 - DNA, 14 bp, Homo sapiens
gctgcagttgccag

SEQ ID NO: 2582734 - DNA, 22 bp, Homo sapiens
gctgcatcctccaagaatctat

SEQ ID NO: 2582735 - DNA, 14 bp, Homo sapiens
gctgcatgcctggt

SEQ ID NO: 2582736 - DNA, 20 bp, Homo sapiens
gctgcatgcctggtctttcc

SEQ ID NO: 2582737 - DNA, 15 bp, Homo sapiens
gctgccaaattttgg

SEQ ID NO: 2582738 - DNA, 18 bp, Homo sapiens
gctgccagctctgtatca

SEQ ID NO: 2582739 - DNA, 12 bp, Homo sapiens
gctgccatccag

SEQ ID NO: 2582740 - DNA, 18 bp, Homo sapiens
gctgcccaggggagccct

SEQ ID NO: 2582741 - DNA, 14 bp, Homo sapiens
gctgccccaacctg

SEQ ID NO: 2582742 - DNA, 18 bp, Homo sapiens
gctgccccaacctgctga

SEQ ID NO: 2582743 - DNA, 12 bp, Homo sapiens
gctgccccagcc

SEQ ID NO: 2582744 - DNA, 18 bp, Homo sapiens
gctgccccatcagtgctc

SEQ ID NO: 2582745 - DNA, 16 bp, Homo sapiens
gctgcccgtcttcagc

SEQ ID NO: 2582746 - DNA, 21 bp, Homo sapiens
gctgcccgtcttcagcctagc

SEQ ID NO: 2582747 - DNA, 19 bp, Homo sapiens
gctgccctccatcccgaca

SEQ ID NO: 2582748 - DNA, 21 bp, Homo sapiens
gctgccctccttgtccaccca

SEQ ID NO: 2582749 - DNA, 12 bp, Homo sapiens
gctgccctgccc

SEQ ID NO: 2582750 - DNA, 16 bp, Homo sapiens
gctgccctgcccacct

SEQ ID NO: 2582751 - DNA, 23 bp, Homo sapiens
gctgccctgcccacctggcctct

SEQ ID NO: 2582752 - DNA, 14 bp, Homo sapiens
gctgccctggccct

SEQ ID NO: 2582753 - DNA, 19 bp, Homo sapiens
gctgccctggccctgaggt

SEQ ID NO: 2582754 - DNA, 12 bp, Homo sapiens
gctgccctgtga

SEQ ID NO: 2582755 - DNA, 17 bp, Homo sapiens
gctgccgccccacccag

SEQ ID NO: 2582756 - DNA, 15 bp, Homo sapiens
gctgccgcctcccag

SEQ ID NO: 2582757 - DNA, 12 bp, Homo sapiens
gctgcctcactt

SEQ ID NO: 2582758 - DNA, 13 bp, Homo sapiens
gctgcctccccaa

SEQ ID NO: 2582759 - DNA, 19 bp, Homo sapiens
gctgcctccccaaccctgc

SEQ ID NO: 2582760 - DNA, 21 bp, Homo sapiens
gctgcctccccaaccctgccc

SEQ ID NO: 2582761 - DNA, 13 bp, Homo sapiens
gctgcctgcctgt

SEQ ID NO: 2582762 - DNA, 21 bp, Homo sapiens
gctgcctgcgcccaccccgct

SEQ ID NO: 2582763 - DNA, 22 bp, Homo sapiens
gctgcctgcgcccaccccgctc

SEQ ID NO: 2582764 - DNA, 23 bp, Homo sapiens
gctgcctgggctgttggcactca

SEQ ID NO: 2582765 - DNA, 20 bp, Homo sapiens
gctgcctgtagttaggaaat

SEQ ID NO: 2582766 - DNA, 21 bp, Homo sapiens
gctgcggtccacccaggagcc

SEQ ID NO: 2582767 - DNA, 17 bp, Homo sapiens
gctgctacaaagaagac

SEQ ID NO: 2582768 - DNA, 18 bp, Homo sapiens
gctgctacaaagaagaca

SEQ ID NO: 2582769 - DNA, 20 bp, Homo sapiens
gctgctacaaagaagacatg

SEQ ID NO: 2582770 - DNA, 12 bp, Homo sapiens
gctgctacccag

SEQ ID NO: 2582771 - DNA, 19 bp, Homo sapiens
gctgctagcacttggagcc

SEQ ID NO: 2582772 - DNA, 17 bp, Homo sapiens
gctgctccttccttcac

SEQ ID NO: 2582773 - DNA, 13 bp, Homo sapiens
gctgctgaagctg

SEQ ID NO: 2582774 - DNA, 20 bp, Homo sapiens
gctgctgaagctgcctgctt

SEQ ID NO: 2582775 - DNA, 18 bp, Homo sapiens
gctgctgaaggctcgagc

SEQ ID NO: 2582776 - DNA, 21 bp, Homo sapiens
gctgctgcgtggcatagccca

SEQ ID NO: 2582777 - DNA, 12 bp, Homo sapiens
gctgctgctgct

SEQ ID NO: 2582778 - DNA, 20 bp, Homo sapiens
gctgctggatcacagctgct

SEQ ID NO: 2582779 - DNA, 12 bp, Homo sapiens
gctgctggcgcc

SEQ ID NO: 2582780 - DNA, 14 bp, Homo sapiens
gctgctggcgcctc

SEQ ID NO: 2582781 - DNA, 19 bp, Homo sapiens
gctgctggcgcctctgcaa

SEQ ID NO: 2582782 - DNA, 15 bp, Homo sapiens
gctgctgtccctccc

SEQ ID NO: 2582783 - DNA, 12 bp, Homo sapiens
gctgcttccctc

SEQ ID NO: 2582784 - DNA, 15 bp, Homo sapiens
gctgcttccctctgc

SEQ ID NO: 2582785 - DNA, 20 bp, Homo sapiens
gctgcttccctctgcctgtc

SEQ ID NO: 2582786 - DNA, 19 bp, Homo sapiens
gctgcttgtgtccctcctg

SEQ ID NO: 2582787 - DNA, 22 bp, Homo sapiens
gctgcttttccttggggcaggc

SEQ ID NO: 2582788 - DNA, 15 bp, Homo sapiens
gctggaaaagggtct

SEQ ID NO: 2582789 - DNA, 21 bp, Homo sapiens
gctggaacagattcacactgt

SEQ ID NO: 2582790 - DNA, 13 bp, Homo sapiens
gctggaagggtca

SEQ ID NO: 2582791 - DNA, 19 bp, Homo sapiens
gctggaatctggagagcta

SEQ ID NO: 2582792 - DNA, 21 bp, Homo sapiens
gctggaatctggagagctaga

SEQ ID NO: 2582793 - DNA, 23 bp, Homo sapiens
gctggacctatgtcctaaggaca

SEQ ID NO: 2582794 - DNA, 15 bp, Homo sapiens
gctggaccttgaact

SEQ ID NO: 2582795 - DNA, 19 bp, Homo sapiens
gctggacggggactgggga

SEQ ID NO: 2582796 - DNA, 22 bp, Homo sapiens
gctggactctcagtctctgagc

SEQ ID NO: 2582797 - DNA, 12 bp, Homo sapiens
gctggagaagct

SEQ ID NO: 2582798 - DNA, 16 bp, Homo sapiens
gctggagaagctcacc

SEQ ID NO: 2582799 - DNA, 18 bp, Homo sapiens
gctggagacgggtgggcg

SEQ ID NO: 2582800 - DNA, 20 bp, Homo sapiens
gctggagactcctaggcagg

SEQ ID NO: 2582801 - DNA, 21 bp, Homo sapiens
gctggagactcctaggcagga

SEQ ID NO: 2582802 - DNA, 16 bp, Homo sapiens
gctggagcccagggag

SEQ ID NO: 2582803 - DNA, 12 bp, Homo sapiens
gctggagctggc

SEQ ID NO: 2582804 - DNA, 16 bp, Homo sapiens
gctggaggtaaggcct

SEQ ID NO: 2582805 - DNA, 15 bp, Homo sapiens
gctggagtgcagtga

SEQ ID NO: 2582806 - DNA, 17 bp, Homo sapiens
gctggagtgcagtgagc

SEQ ID NO: 2582807 - DNA, 14 bp, Homo sapiens
gctggataaaatga

SEQ ID NO: 2582808 - DNA, 15 bp, Homo sapiens
gctggataaaatgag

SEQ ID NO: 2582809 - DNA, 20 bp, Homo sapiens
gctggatgagaatttgagtg

SEQ ID NO: 2582810 - DNA, 20 bp, Homo sapiens
gctggatgagacttccaaac

SEQ ID NO: 2582811 - DNA, 18 bp, Homo sapiens
gctggatgtctgccaatt

SEQ ID NO: 2582812 - DNA, 21 bp, Homo sapiens
gctggatgtctgccaattttt

SEQ ID NO: 2582813 - DNA, 19 bp, Homo sapiens
gctggcaaagacagaagcc

SEQ ID NO: 2582814 - DNA, 15 bp, Homo sapiens
gctggcaaaggtggc

SEQ ID NO: 2582815 - DNA, 15 bp, Homo sapiens
gctggcagcagagtg

SEQ ID NO: 2582816 - DNA, 13 bp, Homo sapiens
gctggcagctctc

SEQ ID NO: 2582817 - DNA, 17 bp, Homo sapiens
gctggcagctctccagt

SEQ ID NO: 2582818 - DNA, 23 bp, Homo sapiens
gctggcagctctccagtcaggag

SEQ ID NO: 2582819 - DNA, 17 bp, Homo sapiens
gctggcagtcctggaag

SEQ ID NO: 2582820 - DNA, 12 bp, Homo sapiens
gctggccactgc

SEQ ID NO: 2582821 - DNA, 13 bp, Homo sapiens
gctggccactgca

SEQ ID NO: 2582822 - DNA, 20 bp, Homo sapiens
gctggccactgcacagagct

SEQ ID NO: 2582823 - DNA, 13 bp, Homo sapiens
gctggcccagccc

SEQ ID NO: 2582824 - DNA, 14 bp, Homo sapiens
gctggcccagccct

SEQ ID NO: 2582825 - DNA, 17 bp, Homo sapiens
gctggcccagccctgct

SEQ ID NO: 2582826 - DNA, 19 bp, Homo sapiens
gctggcccagccctgctgg

SEQ ID NO: 2582827 - DNA, 16 bp, Homo sapiens
gctggcccagccggcc

SEQ ID NO: 2582828 - DNA, 17 bp, Homo sapiens
gctggcccagccggcct

SEQ ID NO: 2582829 - DNA, 12 bp, Homo sapiens
gctggcccctca

SEQ ID NO: 2582830 - DNA, 23 bp, Homo sapiens
gctggcccctcacctgggcacct

SEQ ID NO: 2582831 - DNA, 15 bp, Homo sapiens
gctggccgagggtcc

SEQ ID NO: 2582832 - DNA, 24 bp, Homo sapiens
gctggccgagggtcctggctcctg

SEQ ID NO: 2582833 - DNA, 23 bp, Homo sapiens
gctggcctctggctctcatgggg

SEQ ID NO: 2582834 - DNA, 14 bp, Homo sapiens
gctggcctggatct

SEQ ID NO: 2582835 - DNA, 15 bp, Homo sapiens
gctggcctggcccct

SEQ ID NO: 2582836 - DNA, 20 bp, Homo sapiens
gctggcctggcccctcaggg

SEQ ID NO: 2582837 - DNA, 14 bp, Homo sapiens
gctggcctggccgg

SEQ ID NO: 2582838 - DNA, 15 bp, Homo sapiens
gctggccttcctgcc

SEQ ID NO: 2582839 - DNA, 16 bp, Homo sapiens
gctggccttcctgccc

SEQ ID NO: 2582840 - DNA, 20 bp, Homo sapiens
gctggcgcagccaaggccga

SEQ ID NO: 2582841 - DNA, 13 bp, Homo sapiens
gctggctcttctg

SEQ ID NO: 2582842 - DNA, 16 bp, Homo sapiens
gctggctcttctgccc

SEQ ID NO: 2582843 - DNA, 13 bp, Homo sapiens
gctggctgcagtg

SEQ ID NO: 2582844 - DNA, 15 bp, Homo sapiens
gctggctgttggctg

SEQ ID NO: 2582845 - DNA, 20 bp, Homo sapiens
gctgggaataagtgccagga

SEQ ID NO: 2582846 - DNA, 19 bp, Homo sapiens
gctgggactacaggcaccc

SEQ ID NO: 2582847 - DNA, 20 bp, Homo sapiens
gctgggactacaggcaccca

SEQ ID NO: 2582848 - DNA, 17 bp, Homo sapiens
gctgggactgagccagt

SEQ ID NO: 2582849 - DNA, 14 bp, Homo sapiens
gctgggactggcca

SEQ ID NO: 2582850 - DNA, 15 bp, Homo sapiens
gctgggactggccag

SEQ ID NO: 2582851 - DNA, 16 bp, Homo sapiens
gctgggactggccagg

SEQ ID NO: 2582852 - DNA, 12 bp, Homo sapiens
gctgggaggcaa

SEQ ID NO: 2582853 - DNA, 21 bp, Homo sapiens
gctgggaggcaagaggggtgg

SEQ ID NO: 2582854 - DNA, 15 bp, Homo sapiens
gctgggaggcatggc

SEQ ID NO: 2582855 - DNA, 17 bp, Homo sapiens
gctgggattacagggat

SEQ ID NO: 2582856 - DNA, 20 bp, Homo sapiens
gctgggcacacgcctcccac

SEQ ID NO: 2582857 - DNA, 13 bp, Homo sapiens
gctgggcagaagg

SEQ ID NO: 2582858 - DNA, 19 bp, Homo sapiens
gctgggcccaaccctgtct

SEQ ID NO: 2582859 - DNA, 20 bp, Homo sapiens
gctgggcccaaccctgtctg

SEQ ID NO: 2582860 - DNA, 14 bp, Homo sapiens
gctgggcccagaag

SEQ ID NO: 2582861 - DNA, 20 bp, Homo sapiens
gctgggccccagcccaccct

SEQ ID NO: 2582862 - DNA, 16 bp, Homo sapiens
gctgggctcccttccc

SEQ ID NO: 2582863 - DNA, 12 bp, Homo sapiens
ggaggagcaggg

SEQ ID NO: 2582864 - DNA, 17 bp, Homo sapiens
ggaggagcttgggggat

SEQ ID NO: 2582865 - DNA, 13 bp, Homo sapiens
ggaggaggccacc

SEQ ID NO: 2582866 - DNA, 23 bp, Homo sapiens
ggaggatcacttgagtccagaag

SEQ ID NO: 2582867 - DNA, 21 bp, Homo sapiens
ggaggatctcttgagcctggg

SEQ ID NO: 2582868 - DNA, 14 bp, Homo sapiens
ggaggatggagaga

SEQ ID NO: 2582869 - DNA, 19 bp, Homo sapiens
ggaggcaagaggggtggag

SEQ ID NO: 2582870 - DNA, 17 bp, Homo sapiens
ggaggcatggccctggg

SEQ ID NO: 2582871 - DNA, 20 bp, Homo sapiens
ggaggccaagtgcaggctgg

SEQ ID NO: 2582872 - DNA, 12 bp, Homo sapiens
ggaggccacctc

SEQ ID NO: 2582873 - DNA, 14 bp, Homo sapiens
ggaggccacctctc

SEQ ID NO: 2582874 - DNA, 18 bp, Homo sapiens
ggaggccacctctccaag

SEQ ID NO: 2582875 - DNA, 12 bp, Homo sapiens
ggaggccagcct

SEQ ID NO: 2582876 - DNA, 17 bp, Homo sapiens
ggaggccccactgggga

SEQ ID NO: 2582877 - DNA, 23 bp, Homo sapiens
ggaggcccctggcccagcggccc

SEQ ID NO: 2582878 - DNA, 22 bp, Homo sapiens
ggaggcggacgttccagccggc

SEQ ID NO: 2582879 - DNA, 18 bp, Homo sapiens
ggaggctccagagggcac

SEQ ID NO: 2582880 - DNA, 19 bp, Homo sapiens
ggaggctgagacaggagaa

SEQ ID NO: 2582881 - DNA, 13 bp, Homo sapiens
ggaggctgccccc

SEQ ID NO: 2582882 - DNA, 15 bp, Homo sapiens
ggagggaattgaggt

SEQ ID NO: 2582883 - DNA, 19 bp, Homo sapiens
ggagggaattgaggtctgc

SEQ ID NO: 2582884 - DNA, 13 bp, Homo sapiens
ggagggacatggc

SEQ ID NO: 2582885 - DNA, 13 bp, Homo sapiens
ggagggagggctc

SEQ ID NO: 2582886 - DNA, 16 bp, Homo sapiens
ggagggccctacctga

SEQ ID NO: 2582887 - DNA, 20 bp, Homo sapiens
ggagggccgtaccccaccct

SEQ ID NO: 2582888 - DNA, 21 bp, Homo sapiens
ggagggccgtaccccaccctc

SEQ ID NO: 2582889 - DNA, 15 bp, Homo sapiens
ggagggcgtgggagc

SEQ ID NO: 2582890 - DNA, 20 bp, Homo sapiens
ggagggctagaacctagaag

SEQ ID NO: 2582891 - DNA, 22 bp, Homo sapiens
ggagggctagaacctggagagc

SEQ ID NO: 2582892 - DNA, 15 bp, Homo sapiens
ggagggctccagaca

SEQ ID NO: 2582893 - DNA, 20 bp, Homo sapiens
ggaggggactatttatgaag

SEQ ID NO: 2582894 - DNA, 12 bp, Homo sapiens
ggaggggcgctg

SEQ ID NO: 2582895 - DNA, 16 bp, Homo sapiens
ggaggggcgctggccc

SEQ ID NO: 2582896 - DNA, 20 bp, Homo sapiens
ggaggggcgctggcccagcc

SEQ ID NO: 2582897 - DNA, 16 bp, Homo sapiens
ggaggggggaggtggg

SEQ ID NO: 2582898 - DNA, 23 bp, Homo sapiens
ggagggggtttgctggggaactg

SEQ ID NO: 2582899 - DNA, 14 bp, Homo sapiens
ggagggtcaggaag

SEQ ID NO: 2582900 - DNA, 20 bp, Homo sapiens
ggagggtcccaagctgggcc

SEQ ID NO: 2582901 - DNA, 19 bp, Homo sapiens
ggagggtgggagagcccag

SEQ ID NO: 2582902 - DNA, 22 bp, Homo sapiens
ggaggtaaggaatacctgtccc

SEQ ID NO: 2582903 - DNA, 20 bp, Homo sapiens
ggaggtagaggttgtggtga

SEQ ID NO: 2582904 - DNA, 22 bp, Homo sapiens
ggaggtattcgtaaggatggga

SEQ ID NO: 2582905 - DNA, 19 bp, Homo sapiens
ggaggtcacattcaggaag

SEQ ID NO: 2582906 - DNA, 20 bp, Homo sapiens
ggaggtcacattcaggaaga

SEQ ID NO: 2582907 - DNA, 16 bp, Homo sapiens
ggaggtcgaggcagga

SEQ ID NO: 2582908 - DNA, 20 bp, Homo sapiens
ggaggtggaggctgcagtga

SEQ ID NO: 2582909 - DNA, 15 bp, Homo sapiens
ggaggtggcagccct

SEQ ID NO: 2582910 - DNA, 17 bp, Homo sapiens
ggaggtggcagccctgt

SEQ ID NO: 2582911 - DNA, 22 bp, Homo sapiens
ggaggtgggatcctccaggtgc

SEQ ID NO: 2582912 - DNA, 17 bp, Homo sapiens
ggaggtggggatgagaa

SEQ ID NO: 2582913 - DNA, 14 bp, Homo sapiens
ggaggtgtcaggct

SEQ ID NO: 2582914 - DNA, 15 bp, Homo sapiens
ggaggtgtcaggctg

SEQ ID NO: 2582915 - DNA, 19 bp, Homo sapiens
ggaggtgtcaggctgctgg

SEQ ID NO: 2582916 - DNA, 17 bp, Homo sapiens
ggaggttaaggctgagg

SEQ ID NO: 2582917 - DNA, 21 bp, Homo sapiens
ggaggttaaggctgaggaaag

SEQ ID NO: 2582918 - DNA, 12 bp, Homo sapiens
ggaggttgcagg

SEQ ID NO: 2582919 - DNA, 15 bp, Homo sapiens
ggaggttgggtgggc

SEQ ID NO: 2582920 - DNA, 20 bp, Homo sapiens
ggaggtttaggtcaagaaga

SEQ ID NO: 2582921 - DNA, 18 bp, Homo sapiens
ggagtaatctgtgtacaa

SEQ ID NO: 2582922 - DNA, 17 bp, Homo sapiens
ggagtacaggtgaagca

SEQ ID NO: 2582923 - DNA, 17 bp, Homo sapiens
ggagtcatctcaaccat

SEQ ID NO: 2582924 - DNA, 15 bp, Homo sapiens
ggagtccactcccag

SEQ ID NO: 2582925 - DNA, 19 bp, Homo sapiens
ggagtccactcccagtgct

SEQ ID NO: 2582926 - DNA, 13 bp, Homo sapiens
ggagtcccctcac

SEQ ID NO: 2582927 - DNA, 16 bp, Homo sapiens
ggagtcccgtcaggac

SEQ ID NO: 2582928 - DNA, 17 bp, Homo sapiens
ggagtgaagaggggcag

SEQ ID NO: 2582929 - DNA, 18 bp, Homo sapiens
ggagtgaagaggggcagc

SEQ ID NO: 2582930 - DNA, 23 bp, Homo sapiens
ggagtgaagaggggcagcccttg

SEQ ID NO: 2582931 - DNA, 11 bp, Homo sapiens
ggagtgacaga

SEQ ID NO: 2582932 - DNA, 16 bp, Homo sapiens
ggagtgacagaggcag

SEQ ID NO: 2582933 - DNA, 14 bp, Homo sapiens
ggagtgagctggtt

SEQ ID NO: 2582934 - DNA, 21 bp, Homo sapiens
ggagtgaggaatagttgagcc

SEQ ID NO: 2582935 - DNA, 23 bp, Homo sapiens
ggagtgaggaatagttgagcccc

SEQ ID NO: 2582936 - DNA, 23 bp, Homo sapiens
ggagtgagttgatagcacagacc

SEQ ID NO: 2582937 - DNA, 15 bp, Homo sapiens
ggagtgcagggagga

SEQ ID NO: 2582938 - DNA, 12 bp, Homo sapiens
ggagtgcagtga

SEQ ID NO: 2582939 - DNA, 15 bp, Homo sapiens
ggagtgcagtgagcc

SEQ ID NO: 2582940 - DNA, 23 bp, Homo sapiens
ggagtggaatagtatcctccagg

SEQ ID NO: 2582941 - DNA, 11 bp, Homo sapiens
ggagtgtgtaa

SEQ ID NO: 2582942 - DNA, 16 bp, Homo sapiens
ggagtgtgtattgttc

SEQ ID NO: 2582943 - DNA, 18 bp, Homo sapiens
ggagtgtgtattgttccc

SEQ ID NO: 2582944 - DNA, 12 bp, Homo sapiens
ggagtgttcccc

SEQ ID NO: 2582945 - DNA, 19 bp, Homo sapiens
ggagttagaggccagcctg

SEQ ID NO: 2582946 - DNA, 13 bp, Homo sapiens
ggagttcaatgat

SEQ ID NO: 2582947 - DNA, 16 bp, Homo sapiens
ggagttcaatgatcta

SEQ ID NO: 2582948 - DNA, 16 bp, Homo sapiens
ggagttctatgctctc

SEQ ID NO: 2582949 - DNA, 23 bp, Homo sapiens
ggagttgatcgcctttcccaggt

SEQ ID NO: 2582950 - DNA, 19 bp, Homo sapiens
ggagtttgaggctgcagcg

SEQ ID NO: 2582951 - DNA, 15 bp, Homo sapiens
ggataaaatgaggtt

SEQ ID NO: 2582952 - DNA, 21 bp, Homo sapiens
ggataaggtacctttcacata

SEQ ID NO: 2582953 - DNA, 13 bp, Homo sapiens
ggatagatgtgtg

SEQ ID NO: 2582954 - DNA, 14 bp, Homo sapiens
ggatagatgtgtgg

SEQ ID NO: 2582955 - DNA, 18 bp, Homo sapiens
ggataggaaaaatgagta

SEQ ID NO: 2582956 - DNA, 15 bp, Homo sapiens
ggatataggagagga

SEQ ID NO: 2582957 - DNA, 20 bp, Homo sapiens
ggatatagttttacttttaa

SEQ ID NO: 2582958 - DNA, 16 bp, Homo sapiens
ggatatgcttagtaat

SEQ ID NO: 2582959 - DNA, 14 bp, Homo sapiens
ggatcactggagcc

SEQ ID NO: 2582960 - DNA, 17 bp, Homo sapiens
ggatcactggagcccag

SEQ ID NO: 2582961 - DNA, 19 bp, Homo sapiens
ggatcactggagcccagga

SEQ ID NO: 2582962 - DNA, 16 bp, Homo sapiens
ggatcagaacagcaga

SEQ ID NO: 2582963 - DNA, 17 bp, Homo sapiens
ggatcagaacagcagag

SEQ ID NO: 2582964 - DNA, 19 bp, Homo sapiens
ggatcatggtgtaataaga

SEQ ID NO: 2582965 - DNA, 14 bp, Homo sapiens
ggatccacacctgg

SEQ ID NO: 2582966 - DNA, 15 bp, Homo sapiens
ggatccacacctggt

SEQ ID NO: 2582967 - DNA, 13 bp, Homo sapiens
ggatccagaaggg

SEQ ID NO: 2582968 - DNA, 22 bp, Homo sapiens
ggatccctcatctgtccctccg

SEQ ID NO: 2582969 - DNA, 20 bp, Homo sapiens
ggatcctattctcaccagga

SEQ ID NO: 2582970 - DNA, 15 bp, Homo sapiens
ggatcctccaggtgc

SEQ ID NO: 2582971 - DNA, 18 bp, Homo sapiens
ggatctaccagcataaat

SEQ ID NO: 2582972 - DNA, 13 bp, Homo sapiens
ggatctcaggggc

SEQ ID NO: 2582973 - DNA, 21 bp, Homo sapiens
ggatctccaaggaccaggtta

SEQ ID NO: 2582974 - DNA, 22 bp, Homo sapiens
ggatctctcaggagcacaggca

SEQ ID NO: 2582975 - DNA, 18 bp, Homo sapiens
ggatctcttgagcctggg

SEQ ID NO: 2582976 - DNA, 17 bp, Homo sapiens
ggatctggagaacctca

SEQ ID NO: 2582977 - DNA, 19 bp, Homo sapiens
ggatctgtcacaccagcca

SEQ ID NO: 2582978 - DNA, 15 bp, Homo sapiens
ggatctgtccaagga

SEQ ID NO: 2582979 - DNA, 16 bp, Homo sapiens
ggatctgtccaaggaa

SEQ ID NO: 2582980 - DNA, 17 bp, Homo sapiens
ggatgaaattttctaga

SEQ ID NO: 2582981 - DNA, 18 bp, Homo sapiens
ggatgaatgaggtcccag

SEQ ID NO: 2582982 - DNA, 16 bp, Homo sapiens
ggatgacatgtgactc

SEQ ID NO: 2582983 - DNA, 12 bp, Homo sapiens
ggatgagaaagg

SEQ ID NO: 2582984 - DNA, 14 bp, Homo sapiens
ggatgagagcccag

SEQ ID NO: 2582985 - DNA, 16 bp, Homo sapiens
ggatgagagcccagag

SEQ ID NO: 2582986 - DNA, 19 bp, Homo sapiens
ggatgagagcccagaggta

SEQ ID NO: 2582987 - DNA, 19 bp, Homo sapiens
ggatgagcatggagctggc

SEQ ID NO: 2582988 - DNA, 20 bp, Homo sapiens
ggatgaggccgctagaggcc

SEQ ID NO: 2582989 - DNA, 18 bp, Homo sapiens
ggatgatctaggaagact

SEQ ID NO: 2582990 - DNA, 20 bp, Homo sapiens
ggatgattcagaaattggaa

SEQ ID NO: 2582991 - DNA, 21 bp, Homo sapiens
ggatgattggaggggggaggt

SEQ ID NO: 2582992 - DNA, 19 bp, Homo sapiens
ggatgcagcctcacagtcc

SEQ ID NO: 2582993 - DNA, 21 bp, Homo sapiens
ggatgcatgttttccagctcc

SEQ ID NO: 2582994 - DNA, 17 bp, Homo sapiens
ggatgcctggtggcagc

SEQ ID NO: 2582995 - DNA, 18 bp, Homo sapiens
ggatgcctggtggcagct

SEQ ID NO: 2582996 - DNA, 20 bp, Homo sapiens
ggatgcctggtggcagctgc

SEQ ID NO: 2582997 - DNA, 21 bp, Homo sapiens
ggatgcctggtggcagctgcg

SEQ ID NO: 2582998 - DNA, 21 bp, Homo sapiens
ggatgccttcccctgggccct

SEQ ID NO: 2582999 - DNA, 21 bp, Homo sapiens
ggatgcttgcctagggcctgg

SEQ ID NO: 2583000 - DNA, 15 bp, Homo sapiens
ggatgcttgtacata

SEQ ID NO: 2583001 - DNA, 14 bp, Homo sapiens
ggatggccagtgtc

SEQ ID NO: 2583002 - DNA, 15 bp, Homo sapiens
ggatggccagtgtct

SEQ ID NO: 2583003 - DNA, 22 bp, Homo sapiens
ggatggccagtgtctgtcccgg

SEQ ID NO: 2583004 - DNA, 18 bp, Homo sapiens
ggatggcgggtgggggtg

SEQ ID NO: 2583005 - DNA, 18 bp, Homo sapiens
ggatgtatatgtcatctc

SEQ ID NO: 2583006 - DNA, 16 bp, Homo sapiens
ggatgtcacagggcca

SEQ ID NO: 2583007 - DNA, 13 bp, Homo sapiens
ggatgtcaccaat

SEQ ID NO: 2583008 - DNA, 21 bp, Homo sapiens
gggaaagacatccataaagaa

SEQ ID NO: 2583009 - DNA, 19 bp, Homo sapiens
gggaaagccagtgactcca

SEQ ID NO: 2583010 - DNA, 22 bp, Homo sapiens
gggaaaggctctgaaagccagc

SEQ ID NO: 2583011 - DNA, 14 bp, Homo sapiens
gggaaataagagag

SEQ ID NO: 2583012 - DNA, 19 bp, Homo sapiens
gggaaccatgaagacagga

SEQ ID NO: 2583013 - DNA, 13 bp, Homo sapiens
gggaacctggaac

SEQ ID NO: 2583014 - DNA, 15 bp, Homo sapiens
gggaactgcagacct

SEQ ID NO: 2583015 - DNA, 20 bp, Homo sapiens
gggaactgcagacctgtcct

SEQ ID NO: 2583016 - DNA, 17 bp, Homo sapiens
gggaagagaggagttca

SEQ ID NO: 2583017 - DNA, 16 bp, Homo sapiens
gggaagagtgtactgg

SEQ ID NO: 2583018 - DNA, 21 bp, Homo sapiens
gggaagctgaggcgggagaat

SEQ ID NO: 2583019 - DNA, 20 bp, Homo sapiens
gggaagcttcttaaatgaga

SEQ ID NO: 2583020 - DNA, 12 bp, Homo sapiens
gggaaggccagc

SEQ ID NO: 2583021 - DNA, 16 bp, Homo sapiens
gggaagggccagtctg

SEQ ID NO: 2583022 - DNA, 18 bp, Homo sapiens
gggaaggggacccccgcc

SEQ ID NO: 2583023 - DNA, 17 bp, Homo sapiens
gggaagggggctgggac

SEQ ID NO: 2583024 - DNA, 19 bp, Homo sapiens
gggaaggtcaccagcacca

SEQ ID NO: 2583025 - DNA, 21 bp, Homo sapiens
gggaaggtggggtcctggagc

SEQ ID NO: 2583026 - DNA, 14 bp, Homo sapiens
gggaagtccccagg

SEQ ID NO: 2583027 - DNA, 23 bp, Homo sapiens
gggaagtccccgagtttccccag

SEQ ID NO: 2583028 - DNA, 19 bp, Homo sapiens
gggaataaatatgcctctc

SEQ ID NO: 2583029 - DNA, 14 bp, Homo sapiens
gggaatgaagcttg

SEQ ID NO: 2583030 - DNA, 17 bp, Homo sapiens
gggaatgcctgagtgcc

SEQ ID NO: 2583031 - DNA, 16 bp, Homo sapiens
gggaatggcacagccc

SEQ ID NO: 2583032 - DNA, 22 bp, Homo sapiens
gggaatggcacagcccaaagaa

SEQ ID NO: 2583033 - DNA, 21 bp, Homo sapiens
gggaatgtaactgctgaaaac

SEQ ID NO: 2583034 - DNA, 20 bp, Homo sapiens
gggaatgtattattctgcag

SEQ ID NO: 2583035 - DNA, 21 bp, Homo sapiens
gggaatgtattattctgcagc

SEQ ID NO: 2583036 - DNA, 22 bp, Homo sapiens
gggaatgtttgggcagaaggga

SEQ ID NO: 2583037 - DNA, 23 bp, Homo sapiens
gggaatgtttgggcagaagggag

SEQ ID NO: 2583038 - DNA, 12 bp, Homo sapiens
gggaatttcctc

SEQ ID NO: 2583039 - DNA, 19 bp, Homo sapiens
gggacaccagccaggctct

SEQ ID NO: 2583040 - DNA, 14 bp, Homo sapiens
gggacacctgccct

SEQ ID NO: 2583041 - DNA, 16 bp, Homo sapiens
gggacacctgccctgc

SEQ ID NO: 2583042 - DNA, 14 bp, Homo sapiens
gggacagaggcctg

SEQ ID NO: 2583043 - DNA, 17 bp, Homo sapiens
gggacagaggcctgccc

SEQ ID NO: 2583044 - DNA, 13 bp, Homo sapiens
gggacagctcctt

SEQ ID NO: 2583045 - DNA, 16 bp, Homo sapiens
gggacagctccttctg

SEQ ID NO: 2583046 - DNA, 17 bp, Homo sapiens
gggacagggctggccca

SEQ ID NO: 2583047 - DNA, 19 bp, Homo sapiens
gggacagggctggcccagc

SEQ ID NO: 2583048 - DNA, 13 bp, Homo sapiens
gggaccaaggacc

SEQ ID NO: 2583049 - DNA, 12 bp, Homo sapiens
gggaccaaggca

SEQ ID NO: 2583050 - DNA, 13 bp, Homo sapiens
gggacccccgccc

SEQ ID NO: 2583051 - DNA, 14 bp, Homo sapiens
gggacccccgcccc

SEQ ID NO: 2583052 - DNA, 17 bp, Homo sapiens
gggacccccgccccctg

SEQ ID NO: 2583053 - DNA, 24 bp, Homo sapiens
gggacccccgccccctgccctccc

SEQ ID NO: 2583054 - DNA, 16 bp, Homo sapiens
gggacctctcccaggg

SEQ ID NO: 2583055 - DNA, 16 bp, Homo sapiens
gggacgtccctgccca

SEQ ID NO: 2583056 - DNA, 17 bp, Homo sapiens
gggactacaggcaccca

SEQ ID NO: 2583057 - DNA, 17 bp, Homo sapiens
gggactcagccctgagg

SEQ ID NO: 2583058 - DNA, 20 bp, Homo sapiens
gggactctgaagcctctggg

SEQ ID NO: 2583059 - DNA, 18 bp, Homo sapiens
gggactgaaaacctctcc

SEQ ID NO: 2583060 - DNA, 19 bp, Homo sapiens
gggactgaaaacctctcct

SEQ ID NO: 2583061 - DNA, 19 bp, Homo sapiens
gggactgagccagtcccag

SEQ ID NO: 2583062 - DNA, 23 bp, Homo sapiens
gggactgccagtccccctgcccc

SEQ ID NO: 2583063 - DNA, 15 bp, Homo sapiens
gggactgctaaataa

SEQ ID NO: 2583064 - DNA, 19 bp, Homo sapiens
gggactggaaccagggaga

SEQ ID NO: 2583065 - DNA, 19 bp, Homo sapiens
gggacttccttgctctccc

SEQ ID NO: 2583066 - DNA, 18 bp, Homo sapiens
gggacttgaatctttcca

SEQ ID NO: 2583067 - DNA, 23 bp, Homo sapiens
gggacttggaagctccgctttct

SEQ ID NO: 2583068 - DNA, 15 bp, Homo sapiens
gggagaaaagacatg

SEQ ID NO: 2583069 - DNA, 16 bp, Homo sapiens
gggagaacctcaggct

SEQ ID NO: 2583070 - DNA, 19 bp, Homo sapiens
gggagaatgtcagtatgtg

SEQ ID NO: 2583071 - DNA, 19 bp, Homo sapiens
gggagacactggcccctca

SEQ ID NO: 2583072 - DNA, 19 bp, Homo sapiens
gggagactgggctgaggga

SEQ ID NO: 2583073 - DNA, 12 bp, Homo sapiens
gggagagcaggc

SEQ ID NO: 2583074 - DNA, 16 bp, Homo sapiens
gggagagcaggctggc

SEQ ID NO: 2583075 - DNA, 15 bp, Homo sapiens
gggagagccttccag

SEQ ID NO: 2583076 - DNA, 19 bp, Homo sapiens
gggagatggagttcttgtg

SEQ ID NO: 2583077 - DNA, 11 bp, Homo sapiens
gggagcactgg

SEQ ID NO: 2583078 - DNA, 14 bp, Homo sapiens
gggagcactggagt

SEQ ID NO: 2583079 - DNA, 15 bp, Homo sapiens
gggagcaggcggtgg

SEQ ID NO: 2583080 - DNA, 11 bp, Homo sapiens
gggagcagtgt

SEQ ID NO: 2583081 - DNA, 20 bp, Homo sapiens
gggagcagtgtcttccataa

SEQ ID NO: 2583082 - DNA, 12 bp, Homo sapiens
gggagccccagg

SEQ ID NO: 2583083 - DNA, 13 bp, Homo sapiens
gggagccccaggg

SEQ ID NO: 2583084 - DNA, 12 bp, Homo sapiens
gggagcccccgc

SEQ ID NO: 2583085 - DNA, 23 bp, Homo sapiens
gggagccctcaggcacctgcact

SEQ ID NO: 2583086 - DNA, 17 bp, Homo sapiens
gggagcgtgggaggcgg

SEQ ID NO: 2583087 - DNA, 21 bp, Homo sapiens
gggagctcctctcctggagga

SEQ ID NO: 2583088 - DNA, 22 bp, Homo sapiens
gggagctgcctgttcagctcca

SEQ ID NO: 2583089 - DNA, 15 bp, Homo sapiens
gggagctgctgccct

SEQ ID NO: 2583090 - DNA, 23 bp, Homo sapiens
gggaggaagcaggttgaggggct

SEQ ID NO: 2583091 - DNA, 19 bp, Homo sapiens
gggaggaatcgaggaacca

SEQ ID NO: 2583092 - DNA, 21 bp, Homo sapiens
gggaggagaggggaagggcca

SEQ ID NO: 2583093 - DNA, 19 bp, Homo sapiens
gggaggatcactggagccc

SEQ ID NO: 2583094 - DNA, 22 bp, Homo sapiens
gggaggatcactggagcccagg

SEQ ID NO: 2583095 - DNA, 22 bp, Homo sapiens
gggaggatgttctgggacacag

SEQ ID NO: 2583096 - DNA, 13 bp, Homo sapiens
gggaggccaagga

SEQ ID NO: 2583097 - DNA, 16 bp, Homo sapiens
gggaggccccactggg

SEQ ID NO: 2583098 - DNA, 20 bp, Homo sapiens
gggaggcggagcttgcagtg

SEQ ID NO: 2583099 - DNA, 13 bp, Homo sapiens
gggagggcagcag

SEQ ID NO: 2583100 - DNA, 18 bp, Homo sapiens
gggagggctccagacaca

SEQ ID NO: 2583101 - DNA, 13 bp, Homo sapiens
gggaggggcaggc

SEQ ID NO: 2583102 - DNA, 14 bp, Homo sapiens
gggaggggcaggct

SEQ ID NO: 2583103 - DNA, 16 bp, Homo sapiens
gggaggggcaggctga

SEQ ID NO: 2583104 - DNA, 10 bp, Homo sapiens
gggaggggcg

SEQ ID NO: 2583105 - DNA, 22 bp, Homo sapiens
gggaggggtaaaattccttagc

SEQ ID NO: 2583106 - DNA, 16 bp, Homo sapiens
gggaggtgaccccagg

SEQ ID NO: 2583107 - DNA, 20 bp, Homo sapiens
gggaggtgggatcctccagg

SEQ ID NO: 2583108 - DNA, 20 bp, Homo sapiens
gggaggtgtttaaagagagg

SEQ ID NO: 2583109 - DNA, 22 bp, Homo sapiens
gggaggtgtttaaagagaggtt

SEQ ID NO: 2583110 - DNA, 15 bp, Homo sapiens
gggagtcccgtcagg

SEQ ID NO: 2583111 - DNA, 17 bp, Homo sapiens
gggagtgacagaggcag

SEQ ID NO: 2583112 - DNA, 14 bp, Homo sapiens
gggagtgagctggt

SEQ ID NO: 2583113 - DNA, 21 bp, Homo sapiens
gggagtgagttgatagcacag

SEQ ID NO: 2583114 - DNA, 15 bp, Homo sapiens
gggagtggagtggaa

SEQ ID NO: 2583115 - DNA, 16 bp, Homo sapiens
gggatagcactgagca

SEQ ID NO: 2583116 - DNA, 13 bp, Homo sapiens
gggatcacaaggt

SEQ ID NO: 2583117 - DNA, 22 bp, Homo sapiens
gggatcacagagacattcctcc

SEQ ID NO: 2583118 - DNA, 20 bp, Homo sapiens
gggatgagcatggagctggc

SEQ ID NO: 2583119 - DNA, 16 bp, Homo sapiens
gggatggtcctggggc

SEQ ID NO: 2583120 - DNA, 12 bp, Homo sapiens
gggatggtgccc

SEQ ID NO: 2583121 - DNA, 17 bp, Homo sapiens
gggatggtggagggcca

SEQ ID NO: 2583122 - DNA, 18 bp, Homo sapiens
gggatggtggagggccac

SEQ ID NO: 2583123 - DNA, 14 bp, Homo sapiens
gggatgtctctcat

SEQ ID NO: 2583124 - DNA, 22 bp, Homo sapiens
gggatgtgaattgcctgcagag

SEQ ID NO: 2583125 - DNA, 14 bp, Homo sapiens
gggattcaggctgc

SEQ ID NO: 2583126 - DNA, 19 bp, Homo sapiens
gggattcctgacccaggcc

SEQ ID NO: 2583127 - DNA, 17 bp, Homo sapiens
gggattgctgccacttt

SEQ ID NO: 2583128 - DNA, 15 bp, Homo sapiens
gggatttctcccagc

SEQ ID NO: 2583129 - DNA, 12 bp, Homo sapiens
gggcacccaccc

SEQ ID NO: 2583130 - DNA, 18 bp, Homo sapiens
gggcacctggggagtggg

SEQ ID NO: 2583131 - DNA, 19 bp, Homo sapiens
gggcactcagaagacactg

SEQ ID NO: 2583132 - DNA, 15 bp, Homo sapiens
gggcagaaagtggcc

SEQ ID NO: 2583133 - DNA, 12 bp, Homo sapiens
gggcagagtcac

SEQ ID NO: 2583134 - DNA, 16 bp, Homo sapiens
gggcagattttcagca

SEQ ID NO: 2583135 - DNA, 14 bp, Homo sapiens
gggcagcagggcta

SEQ ID NO: 2583136 - DNA, 14 bp, Homo sapiens
gggcagccaggctg

SEQ ID NO: 2583137 - DNA, 16 bp, Homo sapiens
gggcagccaggctgcc

SEQ ID NO: 2583138 - DNA, 14 bp, Homo sapiens
gggcagcccttgct

SEQ ID NO: 2583139 - DNA, 16 bp, Homo sapiens
gggcagctgggcccaa

SEQ ID NO: 2583140 - DNA, 19 bp, Homo sapiens
gggcagctgggcccaaccc

SEQ ID NO: 2583141 - DNA, 22 bp, Homo sapiens
gggcaggactcagctccccaga

SEQ ID NO: 2583142 - DNA, 11 bp, Homo sapiens
gggcaggcagt

SEQ ID NO: 2583143 - DNA, 15 bp, Homo sapiens
gggcaggccagagct

SEQ ID NO: 2583144 - DNA, 14 bp, Homo sapiens
gggcagggtgaccc

SEQ ID NO: 2583145 - DNA, 16 bp, Homo sapiens
gggcaggtggtggcac

SEQ ID NO: 2583146 - DNA, 21 bp, Homo sapiens
gggcagtggtaagctctggct

SEQ ID NO: 2583147 - DNA, 17 bp, Homo sapiens
gggcatatccaccacct

SEQ ID NO: 2583148 - DNA, 13 bp, Homo sapiens
gggcatcatgcat

SEQ ID NO: 2583149 - DNA, 13 bp, Homo sapiens
gggcatcctcagg

SEQ ID NO: 2583150 - DNA, 14 bp, Homo sapiens
gggcatctccagga

SEQ ID NO: 2583151 - DNA, 14 bp, Homo sapiens
gggcatctgcccct

SEQ ID NO: 2583152 - DNA, 19 bp, Homo sapiens
gggcatctgcccctccccc

SEQ ID NO: 2583153 - DNA, 20 bp, Homo sapiens
gggcatctgcccctccccca

SEQ ID NO: 2583154 - DNA, 21 bp, Homo sapiens
ggtggtggatctgtccaagga

SEQ ID NO: 2583155 - DNA, 20 bp, Homo sapiens
ggtggtgggaaccatgaaga

SEQ ID NO: 2583156 - DNA, 14 bp, Homo sapiens
ggtgtaataagaca

SEQ ID NO: 2583157 - DNA, 19 bp, Homo sapiens
ggtgtcacctgaagactca

SEQ ID NO: 2583158 - DNA, 19 bp, Homo sapiens
ggtgtcacttactgtttct

SEQ ID NO: 2583159 - DNA, 13 bp, Homo sapiens
ggtgtcaggctgc

SEQ ID NO: 2583160 - DNA, 17 bp, Homo sapiens
ggtgtcaggctgctggc

SEQ ID NO: 2583161 - DNA, 16 bp, Homo sapiens
ggtgtgactgaatttc

SEQ ID NO: 2583162 - DNA, 17 bp, Homo sapiens
ggtgtgcaccagggttg

SEQ ID NO: 2583163 - DNA, 11 bp, Homo sapiens
ggtgtggggga

SEQ ID NO: 2583164 - DNA, 13 bp, Homo sapiens
ggtgtgggggaag

SEQ ID NO: 2583165 - DNA, 17 bp, Homo sapiens
ggtgtttcctggcactg

SEQ ID NO: 2583166 - DNA, 19 bp, Homo sapiens
ggtgtttcctggcactgct

SEQ ID NO: 2583167 - DNA, 18 bp, Homo sapiens
ggtgtttctagcactggc

SEQ ID NO: 2583168 - DNA, 23 bp, Homo sapiens
ggttaaaaaaaggcattgtttga

SEQ ID NO: 2583169 - DNA, 16 bp, Homo sapiens
ggttaagccctgaggg

SEQ ID NO: 2583170 - DNA, 23 bp, Homo sapiens
ggttacaatcattgctgaaaatg

SEQ ID NO: 2583171 - DNA, 16 bp, Homo sapiens
ggttaccaagaagcct

SEQ ID NO: 2583172 - DNA, 21 bp, Homo sapiens
ggttacccagttagctctcaa

SEQ ID NO: 2583173 - DNA, 13 bp, Homo sapiens
ggttagggagggg

SEQ ID NO: 2583174 - DNA, 14 bp, Homo sapiens
ggttataaaagtga

SEQ ID NO: 2583175 - DNA, 22 bp, Homo sapiens
ggttcacaggcgaggcctggag

SEQ ID NO: 2583176 - DNA, 12 bp, Homo sapiens
ggttcaccagcc

SEQ ID NO: 2583177 - DNA, 13 bp, Homo sapiens
ggttcaccagcct

SEQ ID NO: 2583178 - DNA, 15 bp, Homo sapiens
ggttcactaaagcag

SEQ ID NO: 2583179 - DNA, 18 bp, Homo sapiens
ggttcagaaatgctgcct

SEQ ID NO: 2583180 - DNA, 16 bp, Homo sapiens
ggttcagagactcagg

SEQ ID NO: 2583181 - DNA, 16 bp, Homo sapiens
ggttcattattggaat

SEQ ID NO: 2583182 - DNA, 21 bp, Homo sapiens
ggttcccccagccctgtggaa

SEQ ID NO: 2583183 - DNA, 13 bp, Homo sapiens
ggttccctctgag

SEQ ID NO: 2583184 - DNA, 16 bp, Homo sapiens
ggttccctctgagaat

SEQ ID NO: 2583185 - DNA, 22 bp, Homo sapiens
ggttccctttgacgccatccca

SEQ ID NO: 2583186 - DNA, 22 bp, Homo sapiens
ggttcccttttttggctgctga

SEQ ID NO: 2583187 - DNA, 15 bp, Homo sapiens
ggttccgcttggagc

SEQ ID NO: 2583188 - DNA, 18 bp, Homo sapiens
ggttcctatggctggcca

SEQ ID NO: 2583189 - DNA, 23 bp, Homo sapiens
ggttctagtctcctttgcactga

SEQ ID NO: 2583190 - DNA, 16 bp, Homo sapiens
ggttctatttggaatt

SEQ ID NO: 2583191 - DNA, 18 bp, Homo sapiens
ggttctccccctttctct

SEQ ID NO: 2583192 - DNA, 18 bp, Homo sapiens
ggttctggtgtgaactaa

SEQ ID NO: 2583193 - DNA, 14 bp, Homo sapiens
ggttctttcttcct

SEQ ID NO: 2583194 - DNA, 16 bp, Homo sapiens
ggttctttcttcctct

SEQ ID NO: 2583195 - DNA, 17 bp, Homo sapiens
ggttctttggaaggagt

SEQ ID NO: 2583196 - DNA, 19 bp, Homo sapiens
ggttgaagaggtgagcacg

SEQ ID NO: 2583197 - DNA, 14 bp, Homo sapiens
ggttgaagcaccaa

SEQ ID NO: 2583198 - DNA, 11 bp, Homo sapiens
ggttgaataaa

SEQ ID NO: 2583199 - DNA, 15 bp, Homo sapiens
ggttgaccccagagg

SEQ ID NO: 2583200 - DNA, 19 bp, Homo sapiens
ggttgaggggctcctggaa

SEQ ID NO: 2583201 - DNA, 13 bp, Homo sapiens
ggttgaggtttca

SEQ ID NO: 2583202 - DNA, 17 bp, Homo sapiens
ggttgctggttgctgtg

SEQ ID NO: 2583203 - DNA, 19 bp, Homo sapiens
ggttgggagaatgtcagta

SEQ ID NO: 2583204 - DNA, 14 bp, Homo sapiens
ggttgggctggtgt

SEQ ID NO: 2583205 - DNA, 14 bp, Homo sapiens
ggttggtgcacagt

SEQ ID NO: 2583206 - DNA, 16 bp, Homo sapiens
ggttggtgcacagtga

SEQ ID NO: 2583207 - DNA, 17 bp, Homo sapiens
ggttggtgcacagtgat

SEQ ID NO: 2583208 - DNA, 13 bp, Homo sapiens
ggttggtgggggc

SEQ ID NO: 2583209 - DNA, 13 bp, Homo sapiens
ggttgtcaatatt

SEQ ID NO: 2583210 - DNA, 14 bp, Homo sapiens
ggtttaactcagat

SEQ ID NO: 2583211 - DNA, 20 bp, Homo sapiens
ggtttaactcagatcactac

SEQ ID NO: 2583212 - DNA, 15 bp, Homo sapiens
ggtttcagaaatgtg

SEQ ID NO: 2583213 - DNA, 15 bp, Homo sapiens
ggtttcgagaagctg

SEQ ID NO: 2583214 - DNA, 14 bp, Homo sapiens
ggtttctgagctgc

SEQ ID NO: 2583215 - DNA, 18 bp, Homo sapiens
ggtttgaatataaacact

SEQ ID NO: 2583216 - DNA, 19 bp, Homo sapiens
ggtttggaccccagctggg

SEQ ID NO: 2583217 - DNA, 14 bp, Homo sapiens
ggtttggcgggcca

SEQ ID NO: 2583218 - DNA, 19 bp, Homo sapiens
ggtttggggagcagagaca

SEQ ID NO: 2583219 - DNA, 17 bp, Homo sapiens
ggttttaagttgtttgc

SEQ ID NO: 2583220 - DNA, 15 bp, Homo sapiens
ggttttatattttta

SEQ ID NO: 2583221 - DNA, 18 bp, Homo sapiens
ggttttcccctccctggg

SEQ ID NO: 2583222 - DNA, 12 bp, Homo sapiens
ggttttctgttc

SEQ ID NO: 2583223 - DNA, 17 bp, Homo sapiens
ggttttgtaagatgctg

SEQ ID NO: 2583224 - DNA, 17 bp, Homo sapiens
ggttttgtattctctga

SEQ ID NO: 2583225 - DNA, 14 bp, Homo sapiens
ggtttttcaattaa

SEQ ID NO: 2583226 - DNA, 15 bp, Homo sapiens
ggtttttcaattaaa

SEQ ID NO: 2583227 - DNA, 20 bp, Homo sapiens
ggtttttcaattaaacggat

SEQ ID NO: 2583228 - DNA, 23 bp, Homo sapiens
ggtttttgtttgtttcctttgtt

SEQ ID NO: 2583229 - DNA, 18 bp, Homo sapiens
gtaaaaaaaaaaaagtta

SEQ ID NO: 2583230 - DNA, 19 bp, Homo sapiens
gtaaaaacagcattgcttt

SEQ ID NO: 2583231 - DNA, 14 bp, Homo sapiens
gtaaaaataaaatt

SEQ ID NO: 2583232 - DNA, 14 bp, Homo sapiens
gtaaaaccacagca

SEQ ID NO: 2583233 - DNA, 21 bp, Homo sapiens
gtaaaactacacatccctaat

SEQ ID NO: 2583234 - DNA, 20 bp, Homo sapiens
gtaaaaggccaaacctctgt

SEQ ID NO: 2583235 - DNA, 16 bp, Homo sapiens
gtaaaatgttgaataa

SEQ ID NO: 2583236 - DNA, 17 bp, Homo sapiens
gtaaacaaaatttagtt

SEQ ID NO: 2583237 - DNA, 19 bp, Homo sapiens
gtaaacagatggcactttg

SEQ ID NO: 2583238 - DNA, 22 bp, Homo sapiens
gtaaacatgtgttttaattcca

SEQ ID NO: 2583239 - DNA, 13 bp, Homo sapiens
gtaaaccaaagcc

SEQ ID NO: 2583240 - DNA, 22 bp, Homo sapiens
gtaaactatcttggtgaatttt

SEQ ID NO: 2583241 - DNA, 16 bp, Homo sapiens
gtaaactgtggatgat

SEQ ID NO: 2583242 - DNA, 14 bp, Homo sapiens
gtaaagaaagagag

SEQ ID NO: 2583243 - DNA, 18 bp, Homo sapiens
gtaaagaaagagagaaaa

SEQ ID NO: 2583244 - DNA, 22 bp, Homo sapiens
gtaaagaaatttaaaagacact

SEQ ID NO: 2583245 - DNA, 14 bp, Homo sapiens
gtaaagagacctac

SEQ ID NO: 2583246 - DNA, 22 bp, Homo sapiens
gtaaagagacctacctcaggtt

SEQ ID NO: 2583247 - DNA, 23 bp, Homo sapiens
gtaaagagacctacctcaggttg

SEQ ID NO: 2583248 - DNA, 22 bp, Homo sapiens
gtaaagtatcaggatactatat

SEQ ID NO: 2583249 - DNA, 11 bp, Homo sapiens
gtaaagtgtgg

SEQ ID NO: 2583250 - DNA, 20 bp, Homo sapiens
gtaaatagttactccagtgc

SEQ ID NO: 2583251 - DNA, 13 bp, Homo sapiens
gtaaatattctat

SEQ ID NO: 2583252 - DNA, 12 bp, Homo sapiens
gtaaatatttat

SEQ ID NO: 2583253 - DNA, 22 bp, Homo sapiens
gtaaatcctttttctttataaa

SEQ ID NO: 2583254 - DNA, 12 bp, Homo sapiens
gtaaatgatgtg

SEQ ID NO: 2583255 - DNA, 20 bp, Homo sapiens
gtaaatgggggtgcatttga

SEQ ID NO: 2583256 - DNA, 22 bp, Homo sapiens
gtaaattaacttttataaactt

SEQ ID NO: 2583257 - DNA, 23 bp, Homo sapiens
gtaaatttccccaacagtgtgaa

SEQ ID NO: 2583258 - DNA, 17 bp, Homo sapiens
gtaacacaagccacaga

SEQ ID NO: 2583259 - DNA, 23 bp, Homo sapiens
gtaacacagtgccttcaataaat

SEQ ID NO: 2583260 - DNA, 23 bp, Homo sapiens
gtaacagaaagggcaacaataaa

SEQ ID NO: 2583261 - DNA, 14 bp, Homo sapiens
gtaacagaacagct

SEQ ID NO: 2583262 - DNA, 15 bp, Homo sapiens
gtaacagaacagctt

SEQ ID NO: 2583263 - DNA, 18 bp, Homo sapiens
gtaacagaacagcttcag

SEQ ID NO: 2583264 - DNA, 16 bp, Homo sapiens
gtaacagctgaggtct

SEQ ID NO: 2583265 - DNA, 20 bp, Homo sapiens
gtaacaggtctcctcttaaa

SEQ ID NO: 2583266 - DNA, 15 bp, Homo sapiens
gtaacatcagggacc

SEQ ID NO: 2583267 - DNA, 11 bp, Homo sapiens
gtaacatcctt

SEQ ID NO: 2583268 - DNA, 13 bp, Homo sapiens
gtaaccagccaga

SEQ ID NO: 2583269 - DNA, 18 bp, Homo sapiens
gtaacccaactctcctgg

SEQ ID NO: 2583270 - DNA, 17 bp, Homo sapiens
gtaacctcagctctggg

SEQ ID NO: 2583271 - DNA, 18 bp, Homo sapiens
gtaacctcttcagaggcc

SEQ ID NO: 2583272 - DNA, 15 bp, Homo sapiens
gtaacgttgctgtgg

SEQ ID NO: 2583273 - DNA, 19 bp, Homo sapiens
gtaactctaattcccattt

SEQ ID NO: 2583274 - DNA, 18 bp, Homo sapiens
gtaactgcattgagaact

SEQ ID NO: 2583275 - DNA, 17 bp, Homo sapiens
gtaagaaaagtggttgt

SEQ ID NO: 2583276 - DNA, 20 bp, Homo sapiens
gtaagaaacacactgaggca

SEQ ID NO: 2583277 - DNA, 17 bp, Homo sapiens
gtaagaaatactgtaca

SEQ ID NO: 2583278 - DNA, 15 bp, Homo sapiens
gtaagacaaaggttt

SEQ ID NO: 2583279 - DNA, 14 bp, Homo sapiens
gtaagagtgtagaa

SEQ ID NO: 2583280 - DNA, 18 bp, Homo sapiens
gtaaggaatacctgtccc

SEQ ID NO: 2583281 - DNA, 20 bp, Homo sapiens
gtaaggaatacctgtccccc

SEQ ID NO: 2583282 - DNA, 21 bp, Homo sapiens
gtaaggaatacctgtccccct

SEQ ID NO: 2583283 - DNA, 14 bp, Homo sapiens
gtaaggcatgaagg

SEQ ID NO: 2583284 - DNA, 13 bp, Homo sapiens
gtaaggtgcagtt

SEQ ID NO: 2583285 - DNA, 16 bp, Homo sapiens
gtaaggtgcagttccc

SEQ ID NO: 2583286 - DNA, 13 bp, Homo sapiens
gtaagtgccttcc

SEQ ID NO: 2583287 - DNA, 22 bp, Homo sapiens
gtaagtggggttgcaaccactg

SEQ ID NO: 2583288 - DNA, 19 bp, Homo sapiens
gtaataagacataacgttt

SEQ ID NO: 2583289 - DNA, 14 bp, Homo sapiens
gtaatatgcacaca

SEQ ID NO: 2583290 - DNA, 18 bp, Homo sapiens
gtaatatgcacacatttt

SEQ ID NO: 2583291 - DNA, 13 bp, Homo sapiens
gtaatcaataaac

SEQ ID NO: 2583292 - DNA, 17 bp, Homo sapiens
gtaatcaataaacgatt

SEQ ID NO: 2583293 - DNA, 20 bp, Homo sapiens
gtaatcaataaacgatttaa

SEQ ID NO: 2583294 - DNA, 12 bp, Homo sapiens
gtaatcccagct

SEQ ID NO: 2583295 - DNA, 23 bp, Homo sapiens
gtaatcctagcactttgggaggc

SEQ ID NO: 2583296 - DNA, 20 bp, Homo sapiens
gtaatctgtgtacaaagaaa

SEQ ID NO: 2583297 - DNA, 20 bp, Homo sapiens
gtaatgcttagagaatgttc

SEQ ID NO: 2583298 - DNA, 14 bp, Homo sapiens
gtaatgtgaataaa

SEQ ID NO: 2583299 - DNA, 17 bp, Homo sapiens
gtaattaagtactatgt

SEQ ID NO: 2583300 - DNA, 17 bp, Homo sapiens
gtcctcactcccagtcc

SEQ ID NO: 2583301 - DNA, 20 bp, Homo sapiens
gtcctcagagaatttctacc

SEQ ID NO: 2583302 - DNA, 18 bp, Homo sapiens
gtcctccagaagcctctg

SEQ ID NO: 2583303 - DNA, 19 bp, Homo sapiens
gtcctccagaagcctctgg

SEQ ID NO: 2583304 - DNA, 22 bp, Homo sapiens
gtcctccagaagcctctggcta

SEQ ID NO: 2583305 - DNA, 18 bp, Homo sapiens
gtcctcccatcccctgga

SEQ ID NO: 2583306 - DNA, 20 bp, Homo sapiens
gtcctcccatcccctggact

SEQ ID NO: 2583307 - DNA, 12 bp, Homo sapiens
gtcctcccatct

SEQ ID NO: 2583308 - DNA, 14 bp, Homo sapiens
gtcctccccttggg

SEQ ID NO: 2583309 - DNA, 15 bp, Homo sapiens
gtcctcccgggccct

SEQ ID NO: 2583310 - DNA, 22 bp, Homo sapiens
gtcctcccgggccctcccttgg

SEQ ID NO: 2583311 - DNA, 17 bp, Homo sapiens
gtcctcgtagccatctc

SEQ ID NO: 2583312 - DNA, 17 bp, Homo sapiens
gtcctctctggctgggg

SEQ ID NO: 2583313 - DNA, 11 bp, Homo sapiens
gtcctctggat

SEQ ID NO: 2583314 - DNA, 18 bp, Homo sapiens
gtcctctggatggcacca

SEQ ID NO: 2583315 - DNA, 14 bp, Homo sapiens
gtcctcttgcctcc

SEQ ID NO: 2583316 - DNA, 18 bp, Homo sapiens
gtcctcttgcctcctgga

SEQ ID NO: 2583317 - DNA, 21 bp, Homo sapiens
gtcctgaagaggcgggccagc

SEQ ID NO: 2583318 - DNA, 22 bp, Homo sapiens
gtcctgaagaggcgggccagcc

SEQ ID NO: 2583319 - DNA, 23 bp, Homo sapiens
gtcctgaagaggcgggccagcca

SEQ ID NO: 2583320 - DNA, 16 bp, Homo sapiens
gtcctgaccaccctcc

SEQ ID NO: 2583321 - DNA, 19 bp, Homo sapiens
gtcctgaccaccctcccct

SEQ ID NO: 2583322 - DNA, 21 bp, Homo sapiens
gtcctgaccaccctcccctct

SEQ ID NO: 2583323 - DNA, 16 bp, Homo sapiens
gtcctgacctgtctca

SEQ ID NO: 2583324 - DNA, 18 bp, Homo sapiens
gtcctgagggtccccacc

SEQ ID NO: 2583325 - DNA, 17 bp, Homo sapiens
gtcctgatcagagccgt

SEQ ID NO: 2583326 - DNA, 18 bp, Homo sapiens
gtcctgatggtcagctcc

SEQ ID NO: 2583327 - DNA, 19 bp, Homo sapiens
gtcctgatggtcagctccc

SEQ ID NO: 2583328 - DNA, 20 bp, Homo sapiens
gtcctgatggtcagctccct

SEQ ID NO: 2583329 - DNA, 15 bp, Homo sapiens
gtcctgcctcagcct

SEQ ID NO: 2583330 - DNA, 15 bp, Homo sapiens
gtcctgcctggccag

SEQ ID NO: 2583331 - DNA, 19 bp, Homo sapiens
gtcctgcctggccaggcag

SEQ ID NO: 2583332 - DNA, 20 bp, Homo sapiens
gtcctgcctggccaggcaga

SEQ ID NO: 2583333 - DNA, 20 bp, Homo sapiens
gtcctggcctggcttctcct

SEQ ID NO: 2583334 - DNA, 15 bp, Homo sapiens
gtcctgggagtgagc

SEQ ID NO: 2583335 - DNA, 12 bp, Homo sapiens
gtcctgggctgg

SEQ ID NO: 2583336 - DNA, 14 bp, Homo sapiens
gtcctggggcctcg

SEQ ID NO: 2583337 - DNA, 13 bp, Homo sapiens
gtcctggtgtcac

SEQ ID NO: 2583338 - DNA, 16 bp, Homo sapiens
gtcctggtgtcactta

SEQ ID NO: 2583339 - DNA, 21 bp, Homo sapiens
gtcctgtagttgcgtggactc

SEQ ID NO: 2583340 - DNA, 23 bp, Homo sapiens
gtcctgtagttgcgtggactctg

SEQ ID NO: 2583341 - DNA, 15 bp, Homo sapiens
gtcctgtgaatttct

SEQ ID NO: 2583342 - DNA, 21 bp, Homo sapiens
gtcctgtggcaggcagcgcca

SEQ ID NO: 2583343 - DNA, 15 bp, Homo sapiens
gtccttaccagcaga

SEQ ID NO: 2583344 - DNA, 17 bp, Homo sapiens
gtccttaccagcagagc

SEQ ID NO: 2583345 - DNA, 18 bp, Homo sapiens
gtccttaccagcagagca

SEQ ID NO: 2583346 - DNA, 19 bp, Homo sapiens
gtccttaccagcagagcac

SEQ ID NO: 2583347 - DNA, 12 bp, Homo sapiens
gtccttgccctt

SEQ ID NO: 2583348 - DNA, 14 bp, Homo sapiens
gtccttgcttggct

SEQ ID NO: 2583349 - DNA, 14 bp, Homo sapiens
gtccttggtgtgac

SEQ ID NO: 2583350 - DNA, 14 bp, Homo sapiens
gtcctttagtacct

SEQ ID NO: 2583351 - DNA, 22 bp, Homo sapiens
gtcctttatgtggaaaacagaa

SEQ ID NO: 2583352 - DNA, 15 bp, Homo sapiens
gtcgaggggctctca

SEQ ID NO: 2583353 - DNA, 14 bp, Homo sapiens
gtcgatagagctgt

SEQ ID NO: 2583354 - DNA, 14 bp, Homo sapiens
gtcgatgaactatt

SEQ ID NO: 2583355 - DNA, 13 bp, Homo sapiens
gtcgcccagtctg

SEQ ID NO: 2583356 - DNA, 18 bp, Homo sapiens
gtcgccttagcatgtttg

SEQ ID NO: 2583357 - DNA, 13 bp, Homo sapiens
gtcgcgctcagca

SEQ ID NO: 2583358 - DNA, 21 bp, Homo sapiens
gtcggcctctaaccccaggcc

SEQ ID NO: 2583359 - DNA, 23 bp, Homo sapiens
gtcggcctctaaccccaggcccc

SEQ ID NO: 2583360 - DNA, 20 bp, Homo sapiens
gtcgtagccaaggtgggctg

SEQ ID NO: 2583361 - DNA, 17 bp, Homo sapiens
gtcgtggagatgtcttc

SEQ ID NO: 2583362 - DNA, 13 bp, Homo sapiens
gtcgttgtgaggg

SEQ ID NO: 2583363 - DNA, 12 bp, Homo sapiens
gtctaaaaacac

SEQ ID NO: 2583364 - DNA, 16 bp, Homo sapiens
gtctaaataagtttgc

SEQ ID NO: 2583365 - DNA, 14 bp, Homo sapiens
gtctacctgagggg

SEQ ID NO: 2583366 - DNA, 18 bp, Homo sapiens
gtctactcttaagccatc

SEQ ID NO: 2583367 - DNA, 19 bp, Homo sapiens
gtctactcttaagccatct

SEQ ID NO: 2583368 - DNA, 23 bp, Homo sapiens
gtctactcttaagccatcttggt

SEQ ID NO: 2583369 - DNA, 19 bp, Homo sapiens
gtctagcagagcaggggca

SEQ ID NO: 2583370 - DNA, 14 bp, Homo sapiens
gtctatccacagag

SEQ ID NO: 2583371 - DNA, 15 bp, Homo sapiens
gtctatgggactcaa

SEQ ID NO: 2583372 - DNA, 22 bp, Homo sapiens
gtctatgggactcaatgcactg

SEQ ID NO: 2583373 - DNA, 12 bp, Homo sapiens
gtctattcatta

SEQ ID NO: 2583374 - DNA, 13 bp, Homo sapiens
gtctattctagtc

SEQ ID NO: 2583375 - DNA, 17 bp, Homo sapiens
gtctcaaaaaaagaaaa

SEQ ID NO: 2583376 - DNA, 19 bp, Homo sapiens
gtctcaaaaaaagaaaaag

SEQ ID NO: 2583377 - DNA, 15 bp, Homo sapiens
gtctcacactggcgt

SEQ ID NO: 2583378 - DNA, 13 bp, Homo sapiens
gtctcacagccct

SEQ ID NO: 2583379 - DNA, 23 bp, Homo sapiens
gtctcacagtgttgcccaggctg

SEQ ID NO: 2583380 - DNA, 19 bp, Homo sapiens
gtctcactatgttgcccag

SEQ ID NO: 2583381 - DNA, 11 bp, Homo sapiens
gtctcactctg

SEQ ID NO: 2583382 - DNA, 18 bp, Homo sapiens
gtctcactctgtcgccca

SEQ ID NO: 2583383 - DNA, 16 bp, Homo sapiens
gtctcactgttgccca

SEQ ID NO: 2583384 - DNA, 17 bp, Homo sapiens
gtctcactgttgcccag

SEQ ID NO: 2583385 - DNA, 22 bp, Homo sapiens
gtctcagtggcttcatctgtca

SEQ ID NO: 2583386 - DNA, 15 bp, Homo sapiens
gtctcagtttcactt

SEQ ID NO: 2583387 - DNA, 13 bp, Homo sapiens
gtctcatccccag

SEQ ID NO: 2583388 - DNA, 15 bp, Homo sapiens
gtctcatccccaggg

SEQ ID NO: 2583389 - DNA, 20 bp, Homo sapiens
gtctccacacacagctgggc

SEQ ID NO: 2583390 - DNA, 15 bp, Homo sapiens
gtctccagaccccca

SEQ ID NO: 2583391 - DNA, 17 bp, Homo sapiens
gtctcccacgtgggaga

SEQ ID NO: 2583392 - DNA, 14 bp, Homo sapiens
gtctcctcagcctc

SEQ ID NO: 2583393 - DNA, 15 bp, Homo sapiens
gtctcctctcagccc

SEQ ID NO: 2583394 - DNA, 22 bp, Homo sapiens
gtctcctcttaaaaaataaaaa

SEQ ID NO: 2583395 - DNA, 23 bp, Homo sapiens
gtctcctcttaaaaaataaaaac

SEQ ID NO: 2583396 - DNA, 22 bp, Homo sapiens
gtctcctgtgcccacatcccag

SEQ ID NO: 2583397 - DNA, 16 bp, Homo sapiens
gtctcctttgcactga

SEQ ID NO: 2583398 - DNA, 22 bp, Homo sapiens
gtctcctttgcactgagggcca

SEQ ID NO: 2583399 - DNA, 23 bp, Homo sapiens
gtctcctttgcactgagggccac

SEQ ID NO: 2583400 - DNA, 18 bp, Homo sapiens
gtctcgctctgtcaccca

SEQ ID NO: 2583401 - DNA, 17 bp, Homo sapiens
gtctcgctttgttgccc

SEQ ID NO: 2583402 - DNA, 19 bp, Homo sapiens
gtctcgctttgttgcccag

SEQ ID NO: 2583403 - DNA, 13 bp, Homo sapiens
gtctcgtggtagg

SEQ ID NO: 2583404 - DNA, 17 bp, Homo sapiens
gtctctatgccagctca

SEQ ID NO: 2583405 - DNA, 23 bp, Homo sapiens
gtctctatgccagctcagtccca

SEQ ID NO: 2583406 - DNA, 12 bp, Homo sapiens
gtctctctccca

SEQ ID NO: 2583407 - DNA, 17 bp, Homo sapiens
gtctctctcccatggag

SEQ ID NO: 2583408 - DNA, 14 bp, Homo sapiens
gtctctctctctct

SEQ ID NO: 2583409 - DNA, 21 bp, Homo sapiens
gtctctctggggccacacaga

SEQ ID NO: 2583410 - DNA, 21 bp, Homo sapiens
gtctctgaagtgaaactgctt

SEQ ID NO: 2583411 - DNA, 12 bp, Homo sapiens
gtctctgcctcc

SEQ ID NO: 2583412 - DNA, 13 bp, Homo sapiens
gtctctgctgccg

SEQ ID NO: 2583413 - DNA, 14 bp, Homo sapiens
gtctctgctgccgc

SEQ ID NO: 2583414 - DNA, 15 bp, Homo sapiens
gtctctgctggccca

SEQ ID NO: 2583415 - DNA, 16 bp, Homo sapiens
gtctctggcagttctg

SEQ ID NO: 2583416 - DNA, 21 bp, Homo sapiens
gtctctggcagttctggaatg

SEQ ID NO: 2583417 - DNA, 17 bp, Homo sapiens
gtctcttggtcctgctg

SEQ ID NO: 2583418 - DNA, 13 bp, Homo sapiens
gtctcttgtaatc

SEQ ID NO: 2583419 - DNA, 18 bp, Homo sapiens
gtctctttaatgtcacag

SEQ ID NO: 2583420 - DNA, 19 bp, Homo sapiens
gtctctttaatgtcacagg

SEQ ID NO: 2583421 - DNA, 20 bp, Homo sapiens
gtctctttaatgtcacaggc

SEQ ID NO: 2583422 - DNA, 22 bp, Homo sapiens
gtctctttaatgtcacaggcag

SEQ ID NO: 2583423 - DNA, 23 bp, Homo sapiens
gtctcttttctttagagcattgc

SEQ ID NO: 2583424 - DNA, 11 bp, Homo sapiens
gtctgaaatgg

SEQ ID NO: 2583425 - DNA, 19 bp, Homo sapiens
gtctgaaggctgggttctg

SEQ ID NO: 2583426 - DNA, 13 bp, Homo sapiens
gtctgaatgttct

SEQ ID NO: 2583427 - DNA, 20 bp, Homo sapiens
gtctgaatgttctgacatta

SEQ ID NO: 2583428 - DNA, 15 bp, Homo sapiens
gtctgacaggcaatg

SEQ ID NO: 2583429 - DNA, 20 bp, Homo sapiens
gtctgacaggcaatgctggc

SEQ ID NO: 2583430 - DNA, 21 bp, Homo sapiens
gtctgacaggcaatgctggct

SEQ ID NO: 2583431 - DNA, 23 bp, Homo sapiens
gtctgacaggcaatgctggctgt

SEQ ID NO: 2583432 - DNA, 13 bp, Homo sapiens
gtctgacccactg

SEQ ID NO: 2583433 - DNA, 19 bp, Homo sapiens
gtctgaggaatccagaccc

SEQ ID NO: 2583434 - DNA, 15 bp, Homo sapiens
gtctgatctgtgctt

SEQ ID NO: 2583435 - DNA, 18 bp, Homo sapiens
gtctgattcccaagctct

SEQ ID NO: 2583436 - DNA, 15 bp, Homo sapiens
gtctgcaactttaag

SEQ ID NO: 2583437 - DNA, 23 bp, Homo sapiens
gtctgcaactttaagcagctctt

SEQ ID NO: 2583438 - DNA, 17 bp, Homo sapiens
gtctgcaagtcagagga

SEQ ID NO: 2583439 - DNA, 21 bp, Homo sapiens
gtctgcaagtcagaggatggc

SEQ ID NO: 2583440 - DNA, 16 bp, Homo sapiens
gtctgcacatgcagct

SEQ ID NO: 2583441 - DNA, 15 bp, Homo sapiens
gtctgcacccagggg

SEQ ID NO: 2583442 - DNA, 13 bp, Homo sapiens
gtctgcaggcagg

SEQ ID NO: 2583443 - DNA, 21 bp, Homo sapiens
gtctgccaatttttgccttca

SEQ ID NO: 2583444 - DNA, 18 bp, Homo sapiens
gtctgccaccatcctgct

SEQ ID NO: 2583445 - DNA, 23 bp, Homo sapiens
gtgggcctcctctgtccagggcc

SEQ ID NO: 2583446 - DNA, 11 bp, Homo sapiens
gtgggcctctg

SEQ ID NO: 2583447 - DNA, 23 bp, Homo sapiens
gtgggcctctggtttggggcgag

SEQ ID NO: 2583448 - DNA, 15 bp, Homo sapiens
gtgggccttgctggg

SEQ ID NO: 2583449 - DNA, 13 bp, Homo sapiens
gtgggctgagccc

SEQ ID NO: 2583450 - DNA, 15 bp, Homo sapiens
gtgggctgcatctgg

SEQ ID NO: 2583451 - DNA, 16 bp, Homo sapiens
gtgggcttcccagtgg

SEQ ID NO: 2583452 - DNA, 23 bp, Homo sapiens
gtgggcttcccagtggctgctgc

SEQ ID NO: 2583453 - DNA, 19 bp, Homo sapiens
gtggggatctcaggggctg

SEQ ID NO: 2583454 - DNA, 17 bp, Homo sapiens
gtgggggaagacctggc

SEQ ID NO: 2583455 - DNA, 20 bp, Homo sapiens
gtgggggagagcaggctggc

SEQ ID NO: 2583456 - DNA, 14 bp, Homo sapiens
gtgggggtctgtgt

SEQ ID NO: 2583457 - DNA, 15 bp, Homo sapiens
gtgggggtctgtgtg

SEQ ID NO: 2583458 - DNA, 15 bp, Homo sapiens
gtggggtcactctgg

SEQ ID NO: 2583459 - DNA, 22 bp, Homo sapiens
gtggggtcactctggcagctca

SEQ ID NO: 2583460 - DNA, 17 bp, Homo sapiens
gtggggtgaggaccact

SEQ ID NO: 2583461 - DNA, 19 bp, Homo sapiens
gtgggtccaggggcccctc

SEQ ID NO: 2583462 - DNA, 20 bp, Homo sapiens
gtgggtccatgggcagagcc

SEQ ID NO: 2583463 - DNA, 13 bp, Homo sapiens
gtgggtctgtgtg

SEQ ID NO: 2583464 - DNA, 12 bp, Homo sapiens
gtgggtggtgga

SEQ ID NO: 2583465 - DNA, 16 bp, Homo sapiens
gtgggtggtggggagg

SEQ ID NO: 2583466 - DNA, 17 bp, Homo sapiens
gtggtagagtgtgcctg

SEQ ID NO: 2583467 - DNA, 19 bp, Homo sapiens
gtggtatgatcacggctca

SEQ ID NO: 2583468 - DNA, 22 bp, Homo sapiens
gtggtcaggcgtagatcaccag

SEQ ID NO: 2583469 - DNA, 18 bp, Homo sapiens
gtggtccatggaatgctt

SEQ ID NO: 2583470 - DNA, 24 bp, Homo sapiens
gtggtcccaacaggaggacaattc

SEQ ID NO: 2583471 - DNA, 15 bp, Homo sapiens
gtggtcccaccccac

SEQ ID NO: 2583472 - DNA, 13 bp, Homo sapiens
gtggtctgaatgt

SEQ ID NO: 2583473 - DNA, 18 bp, Homo sapiens
gtggtctgaatgttctga

SEQ ID NO: 2583474 - DNA, 23 bp, Homo sapiens
gtggtctgaatgttctgacatta

SEQ ID NO: 2583475 - DNA, 16 bp, Homo sapiens
gtggtctttctggaga

SEQ ID NO: 2583476 - DNA, 19 bp, Homo sapiens
gtggtctttgtaagagtgt

SEQ ID NO: 2583477 - DNA, 14 bp, Homo sapiens
gtggtgacctctgc

SEQ ID NO: 2583478 - DNA, 17 bp, Homo sapiens
gtggtgacctctgcctg

SEQ ID NO: 2583479 - DNA, 23 bp, Homo sapiens
gtggtgagcagaagtggagctgg

SEQ ID NO: 2583480 - DNA, 14 bp, Homo sapiens
gtggtgctgggact

SEQ ID NO: 2583481 - DNA, 19 bp, Homo sapiens
gtggtggaagaggggacag

SEQ ID NO: 2583482 - DNA, 12 bp, Homo sapiens
gtggtggagcca

SEQ ID NO: 2583483 - DNA, 20 bp, Homo sapiens
gtggtggatctgtccaagga

SEQ ID NO: 2583484 - DNA, 18 bp, Homo sapiens
gtggtggcccacgcctgt

SEQ ID NO: 2583485 - DNA, 18 bp, Homo sapiens
gtggtggcgggcgcctgt

SEQ ID NO: 2583486 - DNA, 18 bp, Homo sapiens
gtggtggctcacgcctgt

SEQ ID NO: 2583487 - DNA, 20 bp, Homo sapiens
gtggtggttttctgttcttt

SEQ ID NO: 2583488 - DNA, 20 bp, Homo sapiens
gtggtgtttcctgcaggcca

SEQ ID NO: 2583489 - DNA, 19 bp, Homo sapiens
gtggtgtttcctggcactg

SEQ ID NO: 2583490 - DNA, 16 bp, Homo sapiens
gtggtttcagaaatgt

SEQ ID NO: 2583491 - DNA, 23 bp, Homo sapiens
gtgtaaaacgagaatccacccat

SEQ ID NO: 2583492 - DNA, 18 bp, Homo sapiens
gtgtaaaatattttgaat

SEQ ID NO: 2583493 - DNA, 17 bp, Homo sapiens
gtgtaatcaataaacga

SEQ ID NO: 2583494 - DNA, 13 bp, Homo sapiens
gtgtaatttcttt

SEQ ID NO: 2583495 - DNA, 13 bp, Homo sapiens
gtgtacaaagaaa

SEQ ID NO: 2583496 - DNA, 22 bp, Homo sapiens
gtgtacagtcttgtattaagtt

SEQ ID NO: 2583497 - DNA, 12 bp, Homo sapiens
gtgtacagtgtg

SEQ ID NO: 2583498 - DNA, 19 bp, Homo sapiens
gtgtacatcccatgtaaca

SEQ ID NO: 2583499 - DNA, 22 bp, Homo sapiens
gtgtacatcccatgtaacagaa

SEQ ID NO: 2583500 - DNA, 17 bp, Homo sapiens
gtgtagagttaagaagc

SEQ ID NO: 2583501 - DNA, 14 bp, Homo sapiens
gtgtagctttgctc

SEQ ID NO: 2583502 - DNA, 13 bp, Homo sapiens
gtgtatatcagaa

SEQ ID NO: 2583503 - DNA, 16 bp, Homo sapiens
gtgtatgactaaagag

SEQ ID NO: 2583504 - DNA, 22 bp, Homo sapiens
gtgtatgggtgtgtgtttgtgt

SEQ ID NO: 2583505 - DNA, 22 bp, Homo sapiens
gtgtatgtttgcacacttgtgt

SEQ ID NO: 2583506 - DNA, 20 bp, Homo sapiens
gtgtattccaagacatgtct

SEQ ID NO: 2583507 - DNA, 18 bp, Homo sapiens
gtgtcaagttgtgcttgt

SEQ ID NO: 2583508 - DNA, 23 bp, Homo sapiens
gtgtcaagttgtgcttgtttaca

SEQ ID NO: 2583509 - DNA, 14 bp, Homo sapiens
gtgtcacctgtgct

SEQ ID NO: 2583510 - DNA, 19 bp, Homo sapiens
gtgtcacttactgtttctg

SEQ ID NO: 2583511 - DNA, 16 bp, Homo sapiens
gtgtcagcatagaagt

SEQ ID NO: 2583512 - DNA, 15 bp, Homo sapiens
gtgtcaggctgctgg

SEQ ID NO: 2583513 - DNA, 20 bp, Homo sapiens
gtgtcaggtggggcagcttg

SEQ ID NO: 2583514 - DNA, 13 bp, Homo sapiens
gtgtccaaagcag

SEQ ID NO: 2583515 - DNA, 23 bp, Homo sapiens
gtgtcccatgacccacccctgtg

SEQ ID NO: 2583516 - DNA, 20 bp, Homo sapiens
gtgtcccctccactgtcaca

SEQ ID NO: 2583517 - DNA, 14 bp, Homo sapiens
gtgtccggtccctg

SEQ ID NO: 2583518 - DNA, 17 bp, Homo sapiens
gtgtcctgaccaccctc

SEQ ID NO: 2583519 - DNA, 21 bp, Homo sapiens
gtgtcctgtagttgcgtggac

SEQ ID NO: 2583520 - DNA, 12 bp, Homo sapiens
gtgtccttccct

SEQ ID NO: 2583521 - DNA, 15 bp, Homo sapiens
gtgtccttccctgca

SEQ ID NO: 2583522 - DNA, 20 bp, Homo sapiens
gtgtccttgtgcatgagcta

SEQ ID NO: 2583523 - DNA, 23 bp, Homo sapiens
gtgtcgctctgctggcctggccg

SEQ ID NO: 2583524 - DNA, 18 bp, Homo sapiens
gtgtctcttttctctttc

SEQ ID NO: 2583525 - DNA, 14 bp, Homo sapiens
gtgtctgcacccag

SEQ ID NO: 2583526 - DNA, 15 bp, Homo sapiens
gtgtctgctcagtaa

SEQ ID NO: 2583527 - DNA, 13 bp, Homo sapiens
gtgtctgtattta

SEQ ID NO: 2583528 - DNA, 19 bp, Homo sapiens
gtgtcttcctcccaagtgg

SEQ ID NO: 2583529 - DNA, 19 bp, Homo sapiens
gtgtcttgcaatggcagcc

SEQ ID NO: 2583530 - DNA, 18 bp, Homo sapiens
gtgtcttttttcactaca

SEQ ID NO: 2583531 - DNA, 23 bp, Homo sapiens
gtgtgaaccaccacacccagccc

SEQ ID NO: 2583532 - DNA, 11 bp, Homo sapiens
gtgtgaagtta

SEQ ID NO: 2583533 - DNA, 21 bp, Homo sapiens
gtgtgaagttagaattccttc

SEQ ID NO: 2583534 - DNA, 15 bp, Homo sapiens
gtgtgacatcagtgg

SEQ ID NO: 2583535 - DNA, 21 bp, Homo sapiens
gtgtgaccactgcagaagaca

SEQ ID NO: 2583536 - DNA, 13 bp, Homo sapiens
gtgtgacctgagg

SEQ ID NO: 2583537 - DNA, 15 bp, Homo sapiens
gtgtgacctgagggc

SEQ ID NO: 2583538 - DNA, 18 bp, Homo sapiens
gtgtgaggagctgctggc

SEQ ID NO: 2583539 - DNA, 18 bp, Homo sapiens
gtgtgagtcaccaagccc

SEQ ID NO: 2583540 - DNA, 14 bp, Homo sapiens
gtgtgagtgtgtgc

SEQ ID NO: 2583541 - DNA, 17 bp, Homo sapiens
gtgtgatcccaagtgcc

SEQ ID NO: 2583542 - DNA, 21 bp, Homo sapiens
gtgtgattgggaataaatatg

SEQ ID NO: 2583543 - DNA, 16 bp, Homo sapiens
gtgtgcaagtgtgtgc

SEQ ID NO: 2583544 - DNA, 13 bp, Homo sapiens
gtgtgcagtgaag

SEQ ID NO: 2583545 - DNA, 14 bp, Homo sapiens
gtgtgcatattgta

SEQ ID NO: 2583546 - DNA, 22 bp, Homo sapiens
gtgtgcatattgtacacttttt

SEQ ID NO: 2583547 - DNA, 20 bp, Homo sapiens
gtgtgcatgtgtgtgctcag

SEQ ID NO: 2583548 - DNA, 13 bp, Homo sapiens
gtgtgcctgtctg

SEQ ID NO: 2583549 - DNA, 22 bp, Homo sapiens
gtgtgcctgtctgttacactgg

SEQ ID NO: 2583550 - DNA, 22 bp, Homo sapiens
gtgtgctctgatcatccactgt

SEQ ID NO: 2583551 - DNA, 19 bp, Homo sapiens
gtgtggaaattaagaagaa

SEQ ID NO: 2583552 - DNA, 15 bp, Homo sapiens
gtgtggactgtgatg

SEQ ID NO: 2583553 - DNA, 19 bp, Homo sapiens
gtgtggctcacgtgtgtga

SEQ ID NO: 2583554 - DNA, 15 bp, Homo sapiens
gtgtggctcccctct

SEQ ID NO: 2583555 - DNA, 15 bp, Homo sapiens
gtgtggctgaggagg

SEQ ID NO: 2583556 - DNA, 19 bp, Homo sapiens
gtgtggtgtttcctggcac

SEQ ID NO: 2583557 - DNA, 19 bp, Homo sapiens
gtgtgtagacaaatatttg

SEQ ID NO: 2583558 - DNA, 13 bp, Homo sapiens
gtgtgtagagtta

SEQ ID NO: 2583559 - DNA, 20 bp, Homo sapiens
gtgtgtagagttaagaagct

SEQ ID NO: 2583560 - DNA, 21 bp, Homo sapiens
gtgtgtagagttaagaagctg

SEQ ID NO: 2583561 - DNA, 13 bp, Homo sapiens
gtgtgtatgtggg

SEQ ID NO: 2583562 - DNA, 20 bp, Homo sapiens
gtgtgtcacccttaggccag

SEQ ID NO: 2583563 - DNA, 20 bp, Homo sapiens
gtgtgtccacgactgtctcc

SEQ ID NO: 2583564 - DNA, 10 bp, Homo sapiens
gtgtgtcctt

SEQ ID NO: 2583565 - DNA, 20 bp, Homo sapiens
gtgtgtccttgtgcatgagc

SEQ ID NO: 2583566 - DNA, 15 bp, Homo sapiens
gtgtgtctgctcagt

SEQ ID NO: 2583567 - DNA, 12 bp, Homo sapiens
gtgtgtgtatgt

SEQ ID NO: 2583568 - DNA, 13 bp, Homo sapiens
gtgtgtgtatgtg

SEQ ID NO: 2583569 - DNA, 17 bp, Homo sapiens
gtgtgtgtatgtttgca

SEQ ID NO: 2583570 - DNA, 15 bp, Homo sapiens
gtgtgtgtgcgtgtt

SEQ ID NO: 2583571 - DNA, 13 bp, Homo sapiens
gtgtgtgtgtgcg

SEQ ID NO: 2583572 - DNA, 12 bp, Homo sapiens
gtgtgtgtgtgt

SEQ ID NO: 2583573 - DNA, 14 bp, Homo sapiens
gtgtgtgtgtgtgc

SEQ ID NO: 2583574 - DNA, 17 bp, Homo sapiens
gtgtgtgttgtgtgtgg

SEQ ID NO: 2583575 - DNA, 12 bp, Homo sapiens
gtgtgttgtgtg

SEQ ID NO: 2583576 - DNA, 15 bp, Homo sapiens
gtgtgtttaaataaa

SEQ ID NO: 2583577 - DNA, 16 bp, Homo sapiens
gtgtgtttaaataaag

SEQ ID NO: 2583578 - DNA, 18 bp, Homo sapiens
gtgtgtttaaataaagta

SEQ ID NO: 2583579 - DNA, 19 bp, Homo sapiens
gtgtgtttaaataaagtat

SEQ ID NO: 2583580 - DNA, 22 bp, Homo sapiens
gtgtgtttaaataaagtatcat

SEQ ID NO: 2583581 - DNA, 15 bp, Homo sapiens
gtgtgtttatgtgtg

SEQ ID NO: 2583582 - DNA, 14 bp, Homo sapiens
gtgtgtttgtgatt

SEQ ID NO: 2583583 - DNA, 21 bp, Homo sapiens
gtgtgttttgagagtatatta

SEQ ID NO: 2583584 - DNA, 19 bp, Homo sapiens
gtgttaaatgaaattgtaa

SEQ ID NO: 2583585 - DNA, 21 bp, Homo sapiens
gtgttaaatgtgatgaatact

SEQ ID NO: 2583586 - DNA, 15 bp, Homo sapiens
gtgttaatcaattta

SEQ ID NO: 2583587 - DNA, 16 bp, Homo sapiens
gtgttaatcatttcat

SEQ ID NO: 2583588 - DNA, 16 bp, Homo sapiens
gtgttacctgaaaaca

SEQ ID NO: 2583589 - DNA, 14 bp, Homo sapiens
gtgttactaagttt

SEQ ID NO: 2583590 - DNA, 17 bp, Homo sapiens
gttttctctcggctccc

SEQ ID NO: 2583591 - DNA, 17 bp, Homo sapiens
gttttctgaaaatataa

SEQ ID NO: 2583592 - DNA, 14 bp, Homo sapiens
gttttctgagcccg

SEQ ID NO: 2583593 - DNA, 17 bp, Homo sapiens
gttttctgagcccgggc

SEQ ID NO: 2583594 - DNA, 18 bp, Homo sapiens
gttttctggctggagcct

SEQ ID NO: 2583595 - DNA, 17 bp, Homo sapiens
gttttctgggtgtccaa

SEQ ID NO: 2583596 - DNA, 11 bp, Homo sapiens
gttttctgttc

SEQ ID NO: 2583597 - DNA, 12 bp, Homo sapiens
gttttctgttct

SEQ ID NO: 2583598 - DNA, 14 bp, Homo sapiens
gttttctgttcttt

SEQ ID NO: 2583599 - DNA, 16 bp, Homo sapiens
gttttctgttctttct

SEQ ID NO: 2583600 - DNA, 22 bp, Homo sapiens
gttttgaactaataaaagcata

SEQ ID NO: 2583601 - DNA, 14 bp, Homo sapiens
gttttgataaagta

SEQ ID NO: 2583602 - DNA, 19 bp, Homo sapiens
gttttgataaagtagtaaa

SEQ ID NO: 2583603 - DNA, 22 bp, Homo sapiens
gttttgccatgttggccaggct

SEQ ID NO: 2583604 - DNA, 16 bp, Homo sapiens
gttttggaagctctga

SEQ ID NO: 2583605 - DNA, 21 bp, Homo sapiens
gttttggtatctgttctttaa

SEQ ID NO: 2583606 - DNA, 15 bp, Homo sapiens
gttttgtttgctatc

SEQ ID NO: 2583607 - DNA, 18 bp, Homo sapiens
gttttgtttgctatctta

SEQ ID NO: 2583608 - DNA, 16 bp, Homo sapiens
gtttttaaaagtttca

SEQ ID NO: 2583609 - DNA, 23 bp, Homo sapiens
gtttttaaatagagtttgctatt

SEQ ID NO: 2583610 - DNA, 17 bp, Homo sapiens
gtttttaataaagacag

SEQ ID NO: 2583611 - DNA, 18 bp, Homo sapiens
gtttttaatataaagcct

SEQ ID NO: 2583612 - DNA, 13 bp, Homo sapiens
gtttttacccata

SEQ ID NO: 2583613 - DNA, 14 bp, Homo sapiens
gtttttacccatat

SEQ ID NO: 2583614 - DNA, 16 bp, Homo sapiens
gtttttacccatatcc

SEQ ID NO: 2583615 - DNA, 22 bp, Homo sapiens
gtttttacctaccacagtgtct

SEQ ID NO: 2583616 - DNA, 14 bp, Homo sapiens
gtttttactccagt

SEQ ID NO: 2583617 - DNA, 16 bp, Homo sapiens
gtttttattccttgtg

SEQ ID NO: 2583618 - DNA, 19 bp, Homo sapiens
gtttttcaattaaacggat

SEQ ID NO: 2583619 - DNA, 16 bp, Homo sapiens
gtttttcacattttcc

SEQ ID NO: 2583620 - DNA, 14 bp, Homo sapiens
gtttttcagttttc

SEQ ID NO: 2583621 - DNA, 16 bp, Homo sapiens
gtttttccactactgc

SEQ ID NO: 2583622 - DNA, 17 bp, Homo sapiens
gtttttccactactgct

SEQ ID NO: 2583623 - DNA, 17 bp, Homo sapiens
gtttttctgccagggag

SEQ ID NO: 2583624 - DNA, 16 bp, Homo sapiens
gtttttctgggtggcc

SEQ ID NO: 2583625 - DNA, 19 bp, Homo sapiens
gtttttgaaggcagaaagc

SEQ ID NO: 2583626 - DNA, 18 bp, Homo sapiens
gtttttgatagctttatt

SEQ ID NO: 2583627 - DNA, 23 bp, Homo sapiens
gtttttgttcttaattgcactct

SEQ ID NO: 2583628 - DNA, 17 bp, Homo sapiens
gtttttgtttggagagc

SEQ ID NO: 2583629 - DNA, 15 bp, Homo sapiens
gttttttatgctaat

SEQ ID NO: 2583630 - DNA, 14 bp, Homo sapiens
gttttttttcttct

SEQ ID NO: 2583631 - DNA, 17 bp, Homo sapiens
taaaaaaaaaaaagtta

SEQ ID NO: 2583632 - DNA, 20 bp, Homo sapiens
taaaaaaaaaaaagttatat

SEQ ID NO: 2583633 - DNA, 16 bp, Homo sapiens
taaaaaaaaaggcata

SEQ ID NO: 2583634 - DNA, 17 bp, Homo sapiens
taaaaaaaaatgccttt

SEQ ID NO: 2583635 - DNA, 11 bp, Homo sapiens
taaaaaaaaga

SEQ ID NO: 2583636 - DNA, 20 bp, Homo sapiens
taaaaaaataataataatgt

SEQ ID NO: 2583637 - DNA, 16 bp, Homo sapiens
taaaaaaatttaagtg

SEQ ID NO: 2583638 - DNA, 14 bp, Homo sapiens
taaaaaacaaagaa

SEQ ID NO: 2583639 - DNA, 21 bp, Homo sapiens
taaaaaactatctttttgctt

SEQ ID NO: 2583640 - DNA, 13 bp, Homo sapiens
taaaaaatgtcca

SEQ ID NO: 2583641 - DNA, 17 bp, Homo sapiens
taaaaacagcattgctt

SEQ ID NO: 2583642 - DNA, 20 bp, Homo sapiens
taaaaacagcattgctttct

SEQ ID NO: 2583643 - DNA, 16 bp, Homo sapiens
taaaaactgactcctt

SEQ ID NO: 2583644 - DNA, 18 bp, Homo sapiens
taaaaagaaacaagatgc

SEQ ID NO: 2583645 - DNA, 14 bp, Homo sapiens
taaaaagatcactt

SEQ ID NO: 2583646 - DNA, 12 bp, Homo sapiens
taaaaagttaaa

SEQ ID NO: 2583647 - DNA, 14 bp, Homo sapiens
taaaaataaattca

SEQ ID NO: 2583648 - DNA, 11 bp, Homo sapiens
taaaaatcata

SEQ ID NO: 2583649 - DNA, 20 bp, Homo sapiens
taaaaatcataaactgtgtg

SEQ ID NO: 2583650 - DNA, 15 bp, Homo sapiens
taaaaatcatagtac

SEQ ID NO: 2583651 - DNA, 21 bp, Homo sapiens
taaaaatctcaaatttctaaa

SEQ ID NO: 2583652 - DNA, 14 bp, Homo sapiens
taaaaatgaaatta

SEQ ID NO: 2583653 - DNA, 18 bp, Homo sapiens
taaaaatgaaattattta

SEQ ID NO: 2583654 - DNA, 22 bp, Homo sapiens
taaaaatgaggtactctcctgg

SEQ ID NO: 2583655 - DNA, 16 bp, Homo sapiens
taaaaatgcaaatcct

SEQ ID NO: 2583656 - DNA, 19 bp, Homo sapiens
taaaaatgcaaatcctatg

SEQ ID NO: 2583657 - DNA, 20 bp, Homo sapiens
taaaaatgggacttcttttc

SEQ ID NO: 2583658 - DNA, 23 bp, Homo sapiens
taaaaatgggacttcttttcaca

SEQ ID NO: 2583659 - DNA, 19 bp, Homo sapiens
taaaaatgtaaatattcta

SEQ ID NO: 2583660 - DNA, 20 bp, Homo sapiens
taaaaatgtaaatattctat

SEQ ID NO: 2583661 - DNA, 17 bp, Homo sapiens
taaaacaaaatttgttt

SEQ ID NO: 2583662 - DNA, 15 bp, Homo sapiens
taaaacaacactcac

SEQ ID NO: 2583663 - DNA, 19 bp, Homo sapiens
taaaacacttccataatct

SEQ ID NO: 2583664 - DNA, 15 bp, Homo sapiens
taaaacattttcaca

SEQ ID NO: 2583665 - DNA, 15 bp, Homo sapiens
taaaaccacagcagt

SEQ ID NO: 2583666 - DNA, 19 bp, Homo sapiens
taaaacccatttaaatttt

SEQ ID NO: 2583667 - DNA, 20 bp, Homo sapiens
taaaacctttcaaatttcac

SEQ ID NO: 2583668 - DNA, 18 bp, Homo sapiens
taaaactgaagtctgaaa

SEQ ID NO: 2583669 - DNA, 15 bp, Homo sapiens
taaaactttgctgcc

SEQ ID NO: 2583670 - DNA, 13 bp, Homo sapiens
taaaactttttat

SEQ ID NO: 2583671 - DNA, 14 bp, Homo sapiens
taaaagaaaataaa

SEQ ID NO: 2583672 - DNA, 18 bp, Homo sapiens
taaaagaacagtaaacat

SEQ ID NO: 2583673 - DNA, 23 bp, Homo sapiens
taaaagaatattttaacttcctt

SEQ ID NO: 2583674 - DNA, 18 bp, Homo sapiens
taaaagagatttcaagag

SEQ ID NO: 2583675 - DNA, 20 bp, Homo sapiens
taaaagagatttcaagagat

SEQ ID NO: 2583676 - DNA, 17 bp, Homo sapiens
taaaagatacagttact

SEQ ID NO: 2583677 - DNA, 20 bp, Homo sapiens
taaaagattcatttttaatc

SEQ ID NO: 2583678 - DNA, 11 bp, Homo sapiens
taaaagcacac

SEQ ID NO: 2583679 - DNA, 15 bp, Homo sapiens
taaaagcataaatgc

SEQ ID NO: 2583680 - DNA, 17 bp, Homo sapiens
taaaagcataaatgcaa

SEQ ID NO: 2583681 - DNA, 18 bp, Homo sapiens
taaaagcataaatgcaaa

SEQ ID NO: 2583682 - DNA, 18 bp, Homo sapiens
taaaaggcaaatgtgtac

SEQ ID NO: 2583683 - DNA, 21 bp, Homo sapiens
taaaaggtatgcaatcaaatc

SEQ ID NO: 2583684 - DNA, 22 bp, Homo sapiens
taaaaggtattaaattgatgtt

SEQ ID NO: 2583685 - DNA, 15 bp, Homo sapiens
taaaaggttcaggga

SEQ ID NO: 2583686 - DNA, 13 bp, Homo sapiens
taaaagtgatcaa

SEQ ID NO: 2583687 - DNA, 15 bp, Homo sapiens
taaaagttgtgattc

SEQ ID NO: 2583688 - DNA, 21 bp, Homo sapiens
taaaagttgtgattccagata

SEQ ID NO: 2583689 - DNA, 13 bp, Homo sapiens
taaaagtttcaat

SEQ ID NO: 2583690 - DNA, 15 bp, Homo sapiens
taaaagtttcaatgt

SEQ ID NO: 2583691 - DNA, 13 bp, Homo sapiens
taaaataaataaa

SEQ ID NO: 2583692 - DNA, 16 bp, Homo sapiens
taaaataattctaaag

SEQ ID NO: 2583693 - DNA, 21 bp, Homo sapiens
taaaatacacactcaaatcaa

SEQ ID NO: 2583694 - DNA, 20 bp, Homo sapiens
taaaatactatttttactgc

SEQ ID NO: 2583695 - DNA, 21 bp, Homo sapiens
taaaatagcaacactctatat

SEQ ID NO: 2583696 - DNA, 17 bp, Homo sapiens
taaaatatatttcagat

SEQ ID NO: 2583697 - DNA, 20 bp, Homo sapiens
taaaatatgaagacataaac

SEQ ID NO: 2583698 - DNA, 14 bp, Homo sapiens
taaaatatggctat

SEQ ID NO: 2583699 - DNA, 22 bp, Homo sapiens
taaaatattcctgcatttgtga

SEQ ID NO: 2583700 - DNA, 13 bp, Homo sapiens
taaaatatttatt

SEQ ID NO: 2583701 - DNA, 16 bp, Homo sapiens
taaaatattttgaatc

SEQ ID NO: 2583702 - DNA, 17 bp, Homo sapiens
taaaatatttttgaaag

SEQ ID NO: 2583703 - DNA, 15 bp, Homo sapiens
taaaatcatgtacat

SEQ ID NO: 2583704 - DNA, 19 bp, Homo sapiens
taaaatcatgtacatttct

SEQ ID NO: 2583705 - DNA, 10 bp, Homo sapiens
taaaatcatt

SEQ ID NO: 2583706 - DNA, 18 bp, Homo sapiens
taaaatcatttctgcatc

SEQ ID NO: 2583707 - DNA, 16 bp, Homo sapiens
taaaatcttgaaaatg

SEQ ID NO: 2583708 - DNA, 14 bp, Homo sapiens
taaaatgattgtaa

SEQ ID NO: 2583709 - DNA, 16 bp, Homo sapiens
taaaatgattgtaaaa

SEQ ID NO: 2583710 - DNA, 17 bp, Homo sapiens
taaaatgattgtaaaat

SEQ ID NO: 2583711 - DNA, 17 bp, Homo sapiens
taaaatgattttatctg

SEQ ID NO: 2583712 - DNA, 18 bp, Homo sapiens
taaaatgattttatctgt

SEQ ID NO: 2583713 - DNA, 22 bp, Homo sapiens
taaaatgtattcttaaattcat

SEQ ID NO: 2583714 - DNA, 23 bp, Homo sapiens
taaaatgtattcttaaattcatt

SEQ ID NO: 2583715 - DNA, 22 bp, Homo sapiens
taaaatgttcacttttgacaaa

SEQ ID NO: 2583716 - DNA, 18 bp, Homo sapiens
taaaattaaagctgaaaa

SEQ ID NO: 2583717 - DNA, 15 bp, Homo sapiens
taaaattattttgga

SEQ ID NO: 2583718 - DNA, 14 bp, Homo sapiens
taaaattgcacttt

SEQ ID NO: 2583719 - DNA, 13 bp, Homo sapiens
taaaatttcaaca

SEQ ID NO: 2583720 - DNA, 14 bp, Homo sapiens
taaaatttgttgca

SEQ ID NO: 2583721 - DNA, 17 bp, Homo sapiens
taaaattttatctctta

SEQ ID NO: 2583722 - DNA, 20 bp, Homo sapiens
taaaattttttttcatgttt

SEQ ID NO: 2583723 - DNA, 13 bp, Homo sapiens
taaacaaaggttg

SEQ ID NO: 2583724 - DNA, 17 bp, Homo sapiens
taaacaaattcatattc

SEQ ID NO: 2583725 - DNA, 21 bp, Homo sapiens
taaacagatataaatggctgg

SEQ ID NO: 2583726 - DNA, 13 bp, Homo sapiens
taaacaggcccag

SEQ ID NO: 2583727 - DNA, 15 bp, Homo sapiens
taaacaggcccagca

SEQ ID NO: 2583728 - DNA, 23 bp, Homo sapiens
taaacaggcccagcattgctggt

SEQ ID NO: 2583729 - DNA, 19 bp, Homo sapiens
taaacagggcatctccagg

SEQ ID NO: 2583730 - DNA, 20 bp, Homo sapiens
taaacagtgagcctgaattt

SEQ ID NO: 2583731 - DNA, 15 bp, Homo sapiens
taaacataattcttg

SEQ ID NO: 2583732 - DNA, 20 bp, Homo sapiens
taaacataattcttgtatat

SEQ ID NO: 2583733 - DNA, 16 bp, Homo sapiens
taaacatggttacaat

SEQ ID NO: 2583734 - DNA, 13 bp, Homo sapiens
taaacatgtgttt

SEQ ID NO: 2583735 - DNA, 15 bp, Homo sapiens
taaacatgtgtttta

SEQ ID NO: 2583736 - DNA, 20 bp, Homo sapiens
taatgacatcaccacagttt

SEQ ID NO: 2583737 - DNA, 22 bp, Homo sapiens
taatgatgatgggaattgtgtg

SEQ ID NO: 2583738 - DNA, 11 bp, Homo sapiens
taatgatgttt

SEQ ID NO: 2583739 - DNA, 21 bp, Homo sapiens
taatgcatgttaggaaaattt

SEQ ID NO: 2583740 - DNA, 22 bp, Homo sapiens
taatgccggtgagaataagaga

SEQ ID NO: 2583741 - DNA, 21 bp, Homo sapiens
taatgccttactcttcttgaa

SEQ ID NO: 2583742 - DNA, 19 bp, Homo sapiens
taatgcgtgcataccactt

SEQ ID NO: 2583743 - DNA, 22 bp, Homo sapiens
taatgcgtgcataccacttttg

SEQ ID NO: 2583744 - DNA, 13 bp, Homo sapiens
taatgctactgtc

SEQ ID NO: 2583745 - DNA, 23 bp, Homo sapiens
taatggccggctggaaatgctgg

SEQ ID NO: 2583746 - DNA, 16 bp, Homo sapiens
taatggtaccagataa

SEQ ID NO: 2583747 - DNA, 18 bp, Homo sapiens
taatggtaccagataaaa

SEQ ID NO: 2583748 - DNA, 16 bp, Homo sapiens
taatggtcccatccag

SEQ ID NO: 2583749 - DNA, 14 bp, Homo sapiens
taatgtaaaatgtt

SEQ ID NO: 2583750 - DNA, 16 bp, Homo sapiens
taatgtaagctctact

SEQ ID NO: 2583751 - DNA, 13 bp, Homo sapiens
taatgtactgcat

SEQ ID NO: 2583752 - DNA, 15 bp, Homo sapiens
taatgtcacaggcag

SEQ ID NO: 2583753 - DNA, 23 bp, Homo sapiens
taatgtgaaactggattaaactt

SEQ ID NO: 2583754 - DNA, 14 bp, Homo sapiens
taatgtgctgtgta

SEQ ID NO: 2583755 - DNA, 17 bp, Homo sapiens
taatgttaaatttgtaa

SEQ ID NO: 2583756 - DNA, 15 bp, Homo sapiens
taatgttactgatca

SEQ ID NO: 2583757 - DNA, 18 bp, Homo sapiens
taatgttgttatttaaag

SEQ ID NO: 2583758 - DNA, 15 bp, Homo sapiens
taatgtttatgagcc

SEQ ID NO: 2583759 - DNA, 18 bp, Homo sapiens
taatgtttatgagccaga

SEQ ID NO: 2583760 - DNA, 22 bp, Homo sapiens
taatgtttatgagccagacaaa

SEQ ID NO: 2583761 - DNA, 11 bp, Homo sapiens
taatgtttcct

SEQ ID NO: 2583762 - DNA, 12 bp, Homo sapiens
taatgtttgcta

SEQ ID NO: 2583763 - DNA, 20 bp, Homo sapiens
taattaaaagaatattttaa

SEQ ID NO: 2583764 - DNA, 13 bp, Homo sapiens
taattaaatgctc

SEQ ID NO: 2583765 - DNA, 17 bp, Homo sapiens
taattaagtactatgta

SEQ ID NO: 2583766 - DNA, 20 bp, Homo sapiens
taattaagtactatgtatca

SEQ ID NO: 2583767 - DNA, 15 bp, Homo sapiens
taattaatcatgaat

SEQ ID NO: 2583768 - DNA, 21 bp, Homo sapiens
taattaccaacctgttaccta

SEQ ID NO: 2583769 - DNA, 23 bp, Homo sapiens
taattagttcctcattagcattt

SEQ ID NO: 2583770 - DNA, 17 bp, Homo sapiens
taattatcggaagcagt

SEQ ID NO: 2583771 - DNA, 19 bp, Homo sapiens
taattatcggaagcagtgc

SEQ ID NO: 2583772 - DNA, 19 bp, Homo sapiens
taattatcgggaacagtgt

SEQ ID NO: 2583773 - DNA, 21 bp, Homo sapiens
taattatcgggaacagtgttt

SEQ ID NO: 2583774 - DNA, 23 bp, Homo sapiens
taattatcgggaacagtgtttcc

SEQ ID NO: 2583775 - DNA, 16 bp, Homo sapiens
taattatctaaagtat

SEQ ID NO: 2583776 - DNA, 21 bp, Homo sapiens
taattatgacagttatactgt

SEQ ID NO: 2583777 - DNA, 12 bp, Homo sapiens
taattattattt

SEQ ID NO: 2583778 - DNA, 14 bp, Homo sapiens
taattattatttgt

SEQ ID NO: 2583779 - DNA, 16 bp, Homo sapiens
taattattttggtact

SEQ ID NO: 2583780 - DNA, 20 bp, Homo sapiens
taattattttggtactttta

SEQ ID NO: 2583781 - DNA, 17 bp, Homo sapiens
taattcaccaaagtatt

SEQ ID NO: 2583782 - DNA, 18 bp, Homo sapiens
taattcagcactgatttc

SEQ ID NO: 2583783 - DNA, 21 bp, Homo sapiens
taattcagcactgatttcaca

SEQ ID NO: 2583784 - DNA, 15 bp, Homo sapiens
taattcagctcttga

SEQ ID NO: 2583785 - DNA, 18 bp, Homo sapiens
taattccaatatgatgac

SEQ ID NO: 2583786 - DNA, 16 bp, Homo sapiens
taattcccattttgca

SEQ ID NO: 2583787 - DNA, 21 bp, Homo sapiens
taattcccattttgcaaaatt

SEQ ID NO: 2583788 - DNA, 22 bp, Homo sapiens
taattcctctcactaaacttta

SEQ ID NO: 2583789 - DNA, 11 bp, Homo sapiens
taattctaaag

SEQ ID NO: 2583790 - DNA, 20 bp, Homo sapiens
taattctcatgtgatccttt

SEQ ID NO: 2583791 - DNA, 13 bp, Homo sapiens
taattctgtaaat

SEQ ID NO: 2583792 - DNA, 15 bp, Homo sapiens
taattctgtaaatgt

SEQ ID NO: 2583793 - DNA, 14 bp, Homo sapiens
taattctgtacata

SEQ ID NO: 2583794 - DNA, 15 bp, Homo sapiens
taattctgtactgat

SEQ ID NO: 2583795 - DNA, 18 bp, Homo sapiens
taattgatcaaattcatt

SEQ ID NO: 2583796 - DNA, 12 bp, Homo sapiens
taattgcattca

SEQ ID NO: 2583797 - DNA, 13 bp, Homo sapiens
taattgcattcat

SEQ ID NO: 2583798 - DNA, 18 bp, Homo sapiens
taattgtataacaggtta

SEQ ID NO: 2583799 - DNA, 20 bp, Homo sapiens
taattgttaagatatgatgt

SEQ ID NO: 2583800 - DNA, 16 bp, Homo sapiens
taattgttgctaatct

SEQ ID NO: 2583801 - DNA, 22 bp, Homo sapiens
taattgttgtttctttctagtg

SEQ ID NO: 2583802 - DNA, 19 bp, Homo sapiens
taattgttgtttgtatgta

SEQ ID NO: 2583803 - DNA, 19 bp, Homo sapiens
taatttaaaattgtgatgt

SEQ ID NO: 2583804 - DNA, 11 bp, Homo sapiens
taatttaaaca

SEQ ID NO: 2583805 - DNA, 17 bp, Homo sapiens
taatttaaacacctcct

SEQ ID NO: 2583806 - DNA, 19 bp, Homo sapiens
taatttaaacacctcctca

SEQ ID NO: 2583807 - DNA, 21 bp, Homo sapiens
taatttaatgcatgttaggaa

SEQ ID NO: 2583808 - DNA, 19 bp, Homo sapiens
taatttacaaaaatataaa

SEQ ID NO: 2583809 - DNA, 15 bp, Homo sapiens
taatttagttattga

SEQ ID NO: 2583810 - DNA, 16 bp, Homo sapiens
taatttagttattgat

SEQ ID NO: 2583811 - DNA, 14 bp, Homo sapiens
taatttatgagttt

SEQ ID NO: 2583812 - DNA, 16 bp, Homo sapiens
taatttctttgcctgt

SEQ ID NO: 2583813 - DNA, 17 bp, Homo sapiens
taatttctttgcctgtt

SEQ ID NO: 2583814 - DNA, 15 bp, Homo sapiens
taatttgagagaaat

SEQ ID NO: 2583815 - DNA, 22 bp, Homo sapiens
taatttgaggacaaccattcca

SEQ ID NO: 2583816 - DNA, 14 bp, Homo sapiens
taatttgatgttta

SEQ ID NO: 2583817 - DNA, 21 bp, Homo sapiens
taatttgtacatatgtaaaat

SEQ ID NO: 2583818 - DNA, 14 bp, Homo sapiens
taatttgtgataca

SEQ ID NO: 2583819 - DNA, 13 bp, Homo sapiens
taattttaaataa

SEQ ID NO: 2583820 - DNA, 21 bp, Homo sapiens
taattttctagattttctact

SEQ ID NO: 2583821 - DNA, 14 bp, Homo sapiens
taattttcttcatg

SEQ ID NO: 2583822 - DNA, 15 bp, Homo sapiens
taattttgaataaat

SEQ ID NO: 2583823 - DNA, 12 bp, Homo sapiens
taattttgacac

SEQ ID NO: 2583824 - DNA, 14 bp, Homo sapiens
taattttggttgta

SEQ ID NO: 2583825 - DNA, 21 bp, Homo sapiens
taattttggttgtattctttg

SEQ ID NO: 2583826 - DNA, 22 bp, Homo sapiens
taattttggttgtattctttga

SEQ ID NO: 2583827 - DNA, 21 bp, Homo sapiens
taattttgtattttccaagtg

SEQ ID NO: 2583828 - DNA, 19 bp, Homo sapiens
taattttttagagagctgt

SEQ ID NO: 2583829 - DNA, 14 bp, Homo sapiens
taatttttttaatt

SEQ ID NO: 2583830 - DNA, 15 bp, Homo sapiens
tacaaaaacacagca

SEQ ID NO: 2583831 - DNA, 17 bp, Homo sapiens
tacaaaaatataaaata

SEQ ID NO: 2583832 - DNA, 20 bp, Homo sapiens
tacaaaaatataaaatatga

SEQ ID NO: 2583833 - DNA, 17 bp, Homo sapiens
tacaaacacctggactt

SEQ ID NO: 2583834 - DNA, 12 bp, Homo sapiens
tacaaacatatt

SEQ ID NO: 2583835 - DNA, 17 bp, Homo sapiens
tacaaagaaataacaag

SEQ ID NO: 2583836 - DNA, 19 bp, Homo sapiens
tacaaagaagacatgtttt

SEQ ID NO: 2583837 - DNA, 14 bp, Homo sapiens
tacaaagtagaagt

SEQ ID NO: 2583838 - DNA, 18 bp, Homo sapiens
tacaaagtagaagtctta

SEQ ID NO: 2583839 - DNA, 13 bp, Homo sapiens
tacaaagtgatgt

SEQ ID NO: 2583840 - DNA, 23 bp, Homo sapiens
tacaaatactcttaggaagagaa

SEQ ID NO: 2583841 - DNA, 14 bp, Homo sapiens
tacaacagatttgt

SEQ ID NO: 2583842 - DNA, 13 bp, Homo sapiens
tacaacagtgcta

SEQ ID NO: 2583843 - DNA, 20 bp, Homo sapiens
tacaacagtgctaaaaatgg

SEQ ID NO: 2583844 - DNA, 12 bp, Homo sapiens
tacaacctgctt

SEQ ID NO: 2583845 - DNA, 17 bp, Homo sapiens
tacaagaaaaaatgaat

SEQ ID NO: 2583846 - DNA, 19 bp, Homo sapiens
tacaagagcagcctgtggc

SEQ ID NO: 2583847 - DNA, 23 bp, Homo sapiens
tacaagagcagcctgtggcatct

SEQ ID NO: 2583848 - DNA, 18 bp, Homo sapiens
tacaagccagctggagaa

SEQ ID NO: 2583849 - DNA, 19 bp, Homo sapiens
tacaagcccccccttccac

SEQ ID NO: 2583850 - DNA, 19 bp, Homo sapiens
tacaagcgtgagccactgc

SEQ ID NO: 2583851 - DNA, 21 bp, Homo sapiens
tacaagcgtgagccactgcac

SEQ ID NO: 2583852 - DNA, 17 bp, Homo sapiens
tacaaggaaggtggtgg

SEQ ID NO: 2583853 - DNA, 15 bp, Homo sapiens
tacaagttagaaaac

SEQ ID NO: 2583854 - DNA, 13 bp, Homo sapiens
tacaataaataat

SEQ ID NO: 2583855 - DNA, 16 bp, Homo sapiens
tacaataaataatctg

SEQ ID NO: 2583856 - DNA, 13 bp, Homo sapiens
tacaataacataa

SEQ ID NO: 2583857 - DNA, 12 bp, Homo sapiens
tacaatatttaa

SEQ ID NO: 2583858 - DNA, 16 bp, Homo sapiens
tacaatatttaaaatt

SEQ ID NO: 2583859 - DNA, 22 bp, Homo sapiens
tacaatcattgctgaaaatggt

SEQ ID NO: 2583860 - DNA, 22 bp, Homo sapiens
tacaatgtatttatttaaaaga

SEQ ID NO: 2583861 - DNA, 15 bp, Homo sapiens
tacaattatatcagt

SEQ ID NO: 2583862 - DNA, 19 bp, Homo sapiens
tacaattatatcagtcctc

SEQ ID NO: 2583863 - DNA, 22 bp, Homo sapiens
tacaattatttttacagttctc

SEQ ID NO: 2583864 - DNA, 17 bp, Homo sapiens
tacaattccctgctgtc

SEQ ID NO: 2583865 - DNA, 18 bp, Homo sapiens
tacaattctacattgtca

SEQ ID NO: 2583866 - DNA, 19 bp, Homo sapiens
tacaattttctcccaggaa

SEQ ID NO: 2583867 - DNA, 21 bp, Homo sapiens
tacaattttctcccaggaagc

SEQ ID NO: 2583868 - DNA, 20 bp, Homo sapiens
tacaatttttttaattttgt

SEQ ID NO: 2583869 - DNA, 15 bp, Homo sapiens
tacacaagtaaacat

SEQ ID NO: 2583870 - DNA, 17 bp, Homo sapiens
tacacacacacacacag

SEQ ID NO: 2583871 - DNA, 19 bp, Homo sapiens
tacacacacacacacagcc

SEQ ID NO: 2583872 - DNA, 21 bp, Homo sapiens
tacacacacacacacagccac

SEQ ID NO: 2583873 - DNA, 23 bp, Homo sapiens
tacacacacacacacagccacac

SEQ ID NO: 2583874 - DNA, 21 bp, Homo sapiens
tacacacacacgcgtgcacac

SEQ ID NO: 2583875 - DNA, 15 bp, Homo sapiens
tacacacacatacac

SEQ ID NO: 2583876 - DNA, 17 bp, Homo sapiens
tacacacctaagggaca

SEQ ID NO: 2583877 - DNA, 18 bp, Homo sapiens
tacacaccttatatttac

SEQ ID NO: 2583878 - DNA, 15 bp, Homo sapiens
tacacactgcatgtt

SEQ ID NO: 2583879 - DNA, 22 bp, Homo sapiens
tacacactgcatgtttgtgatt

SEQ ID NO: 2583880 - DNA, 18 bp, Homo sapiens
tacacagaaatacagtta

SEQ ID NO: 2583881 - DNA, 16 bp, Homo sapiens
tactgtctggttttaa

SEQ ID NO: 2583882 - DNA, 15 bp, Homo sapiens
tactgtgaaactggc

SEQ ID NO: 2583883 - DNA, 15 bp, Homo sapiens
tactgtgctggagcc

SEQ ID NO: 2583884 - DNA, 12 bp, Homo sapiens
tactgtggagga

SEQ ID NO: 2583885 - DNA, 23 bp, Homo sapiens
tactgtggaggaaggattgtaaa

SEQ ID NO: 2583886 - DNA, 12 bp, Homo sapiens
tactgttctctt

SEQ ID NO: 2583887 - DNA, 18 bp, Homo sapiens
tactgttctcttcttgaa

SEQ ID NO: 2583888 - DNA, 19 bp, Homo sapiens
tactgtttgtcttctcccc

SEQ ID NO: 2583889 - DNA, 14 bp, Homo sapiens
tacttaaagattta

SEQ ID NO: 2583890 - DNA, 18 bp, Homo sapiens
tacttaaatgaaagcatg

SEQ ID NO: 2583891 - DNA, 17 bp, Homo sapiens
tacttaataaattcaga

SEQ ID NO: 2583892 - DNA, 19 bp, Homo sapiens
tacttaataaattcagata

SEQ ID NO: 2583893 - DNA, 20 bp, Homo sapiens
tacttatttttgacagtgtt

SEQ ID NO: 2583894 - DNA, 14 bp, Homo sapiens
tacttcaaaagtat

SEQ ID NO: 2583895 - DNA, 22 bp, Homo sapiens
tacttcaggggcacttcattga

SEQ ID NO: 2583896 - DNA, 21 bp, Homo sapiens
tacttctagagatagtacata

SEQ ID NO: 2583897 - DNA, 20 bp, Homo sapiens
tacttctccaccctgctctc

SEQ ID NO: 2583898 - DNA, 15 bp, Homo sapiens
tacttctgctacata

SEQ ID NO: 2583899 - DNA, 14 bp, Homo sapiens
tacttcttatacat

SEQ ID NO: 2583900 - DNA, 15 bp, Homo sapiens
tacttcttatacatt

SEQ ID NO: 2583901 - DNA, 18 bp, Homo sapiens
tacttcttcattcaatac

SEQ ID NO: 2583902 - DNA, 14 bp, Homo sapiens
tacttgacctccta

SEQ ID NO: 2583903 - DNA, 23 bp, Homo sapiens
tacttgccttattagagtgtctt

SEQ ID NO: 2583904 - DNA, 18 bp, Homo sapiens
tacttgctggctctcaga

SEQ ID NO: 2583905 - DNA, 21 bp, Homo sapiens
tacttgggagacctgtaatca

SEQ ID NO: 2583906 - DNA, 23 bp, Homo sapiens
tacttgggagacctgtaatcata

SEQ ID NO: 2583907 - DNA, 13 bp, Homo sapiens
tacttgtcaatat

SEQ ID NO: 2583908 - DNA, 18 bp, Homo sapiens
tacttgtggacacagctc

SEQ ID NO: 2583909 - DNA, 13 bp, Homo sapiens
tacttgttcaaaa

SEQ ID NO: 2583910 - DNA, 20 bp, Homo sapiens
tactttaaaggaaaaaatgt

SEQ ID NO: 2583911 - DNA, 16 bp, Homo sapiens
tactttactcattttt

SEQ ID NO: 2583912 - DNA, 20 bp, Homo sapiens
tactttatttatacactgtc

SEQ ID NO: 2583913 - DNA, 22 bp, Homo sapiens
tactttccacttgattttgcaa

SEQ ID NO: 2583914 - DNA, 17 bp, Homo sapiens
tactttcgtacattggc

SEQ ID NO: 2583915 - DNA, 20 bp, Homo sapiens
tactttgccttttgcaaact

SEQ ID NO: 2583916 - DNA, 22 bp, Homo sapiens
tactttgccttttgcaaacttt

SEQ ID NO: 2583917 - DNA, 20 bp, Homo sapiens
tactttggaatacatttctc

SEQ ID NO: 2583918 - DNA, 15 bp, Homo sapiens
tagaaaactgaaaat

SEQ ID NO: 2583919 - DNA, 21 bp, Homo sapiens
tagaaaactgaaaatctaata

SEQ ID NO: 2583920 - DNA, 14 bp, Homo sapiens
tagaaagaagccca

SEQ ID NO: 2583921 - DNA, 23 bp, Homo sapiens
tagaaagaagcccaatattataa

SEQ ID NO: 2583922 - DNA, 23 bp, Homo sapiens
tagaaagcctgttcccctcactg

SEQ ID NO: 2583923 - DNA, 16 bp, Homo sapiens
tagaaataagtggtta

SEQ ID NO: 2583924 - DNA, 22 bp, Homo sapiens
tagaaataagtggttatttctc

SEQ ID NO: 2583925 - DNA, 15 bp, Homo sapiens
tagaaataatatgca

SEQ ID NO: 2583926 - DNA, 19 bp, Homo sapiens
tagaaatgatgatgtggaa

SEQ ID NO: 2583927 - DNA, 19 bp, Homo sapiens
tagaaattacacccaaaga

SEQ ID NO: 2583928 - DNA, 14 bp, Homo sapiens
tagaaatttccaga

SEQ ID NO: 2583929 - DNA, 20 bp, Homo sapiens
tagaaccaccaacaagcaag

SEQ ID NO: 2583930 - DNA, 16 bp, Homo sapiens
tagaaccactatgaag

SEQ ID NO: 2583931 - DNA, 22 bp, Homo sapiens
tagaacccggcaggctagaacc

SEQ ID NO: 2583932 - DNA, 13 bp, Homo sapiens
tagaacctagaag

SEQ ID NO: 2583933 - DNA, 16 bp, Homo sapiens
tagaacctagaagggc

SEQ ID NO: 2583934 - DNA, 23 bp, Homo sapiens
tagaacctagagaagctaaaacc

SEQ ID NO: 2583935 - DNA, 17 bp, Homo sapiens
tagaacctggaagggct

SEQ ID NO: 2583936 - DNA, 13 bp, Homo sapiens
tagaacctggaga

SEQ ID NO: 2583937 - DNA, 22 bp, Homo sapiens
tagaactcagttttaactagaa

SEQ ID NO: 2583938 - DNA, 19 bp, Homo sapiens
tagaactctgaaatgaaga

SEQ ID NO: 2583939 - DNA, 21 bp, Homo sapiens
tagaacttgcagctgatgttg

SEQ ID NO: 2583940 - DNA, 22 bp, Homo sapiens
tagaagaacatccaaggagaaa

SEQ ID NO: 2583941 - DNA, 14 bp, Homo sapiens
tagaagaagtgtgt

SEQ ID NO: 2583942 - DNA, 23 bp, Homo sapiens
tagaagatattagtcttggggca

SEQ ID NO: 2583943 - DNA, 22 bp, Homo sapiens
tagaagccccgttataactcct

SEQ ID NO: 2583944 - DNA, 17 bp, Homo sapiens
tagaagctggaggacta

SEQ ID NO: 2583945 - DNA, 11 bp, Homo sapiens
tagaaggccac

SEQ ID NO: 2583946 - DNA, 16 bp, Homo sapiens
tagaagggttatattt

SEQ ID NO: 2583947 - DNA, 15 bp, Homo sapiens
tagaagtcacacagt

SEQ ID NO: 2583948 - DNA, 17 bp, Homo sapiens
tagaagtcttagatgta

SEQ ID NO: 2583949 - DNA, 18 bp, Homo sapiens
tagaagtcttagatgtat

SEQ ID NO: 2583950 - DNA, 20 bp, Homo sapiens
tagaagtcttagatgtatat

SEQ ID NO: 2583951 - DNA, 16 bp, Homo sapiens
tagaagttactgaatg

SEQ ID NO: 2583952 - DNA, 18 bp, Homo sapiens
tagaagttgtttgtcatc

SEQ ID NO: 2583953 - DNA, 15 bp, Homo sapiens
tagaatataattatc

SEQ ID NO: 2583954 - DNA, 18 bp, Homo sapiens
tagaatataattatcgga

SEQ ID NO: 2583955 - DNA, 16 bp, Homo sapiens
tagaatatcctacttc

SEQ ID NO: 2583956 - DNA, 12 bp, Homo sapiens
tagaatatttat

SEQ ID NO: 2583957 - DNA, 20 bp, Homo sapiens
tagaatatttattacctctg

SEQ ID NO: 2583958 - DNA, 12 bp, Homo sapiens
tagaatgaaaat

SEQ ID NO: 2583959 - DNA, 18 bp, Homo sapiens
tagaattaacacatgatc

SEQ ID NO: 2583960 - DNA, 19 bp, Homo sapiens
tagaattggctgaactcat

SEQ ID NO: 2583961 - DNA, 15 bp, Homo sapiens
tagaatttattcaat

SEQ ID NO: 2583962 - DNA, 13 bp, Homo sapiens
tagaatttgatta

SEQ ID NO: 2583963 - DNA, 16 bp, Homo sapiens
tagaattttaagtgct

SEQ ID NO: 2583964 - DNA, 21 bp, Homo sapiens
tagaattttggtataaagaaa

SEQ ID NO: 2583965 - DNA, 10 bp, Homo sapiens
tagacagagt

SEQ ID NO: 2583966 - DNA, 22 bp, Homo sapiens
tagacagtatgagtcaatgtgc

SEQ ID NO: 2583967 - DNA, 13 bp, Homo sapiens
tagacataacaaa

SEQ ID NO: 2583968 - DNA, 18 bp, Homo sapiens
tagacatttctcttactg

SEQ ID NO: 2583969 - DNA, 23 bp, Homo sapiens
tagacatttctcttactgcaaat

SEQ ID NO: 2583970 - DNA, 14 bp, Homo sapiens
tagaccaaaataaa

SEQ ID NO: 2583971 - DNA, 14 bp, Homo sapiens
tagaccaagcttgt

SEQ ID NO: 2583972 - DNA, 11 bp, Homo sapiens
tagacctcagc

SEQ ID NO: 2583973 - DNA, 21 bp, Homo sapiens
tagactcatcttactgtacct

SEQ ID NO: 2583974 - DNA, 18 bp, Homo sapiens
tagacttcgactcaggat

SEQ ID NO: 2583975 - DNA, 19 bp, Homo sapiens
tagacttctgctttccaca

SEQ ID NO: 2583976 - DNA, 22 bp, Homo sapiens
tagacttctgctttccacacct

SEQ ID NO: 2583977 - DNA, 12 bp, Homo sapiens
tagactttctgt

SEQ ID NO: 2583978 - DNA, 16 bp, Homo sapiens
tagagaacgcagccct

SEQ ID NO: 2583979 - DNA, 14 bp, Homo sapiens
tagagacagaagca

SEQ ID NO: 2583980 - DNA, 18 bp, Homo sapiens
tagagacagaagcaggct

SEQ ID NO: 2583981 - DNA, 13 bp, Homo sapiens
tagagagctattt

SEQ ID NO: 2583982 - DNA, 19 bp, Homo sapiens
tagagatcatcctttccag

SEQ ID NO: 2583983 - DNA, 23 bp, Homo sapiens
tagagatcatcctttccagcatg

SEQ ID NO: 2583984 - DNA, 17 bp, Homo sapiens
tagagatgactgagtcc

SEQ ID NO: 2583985 - DNA, 12 bp, Homo sapiens
tagagatgtttt

SEQ ID NO: 2583986 - DNA, 19 bp, Homo sapiens
tagagatgtttttaaaagt

SEQ ID NO: 2583987 - DNA, 20 bp, Homo sapiens
tagagatgtttttaaaagtt

SEQ ID NO: 2583988 - DNA, 21 bp, Homo sapiens
tagagattacctcctgagaaa

SEQ ID NO: 2583989 - DNA, 19 bp, Homo sapiens
tagagcagccctggagtca

SEQ ID NO: 2583990 - DNA, 22 bp, Homo sapiens
tagagcagtttctgtcctgctg

SEQ ID NO: 2583991 - DNA, 19 bp, Homo sapiens
tagagcattgaattggaga

SEQ ID NO: 2583992 - DNA, 14 bp, Homo sapiens
tagagcctgaggga

SEQ ID NO: 2583993 - DNA, 15 bp, Homo sapiens
tagagctgatccaga

SEQ ID NO: 2583994 - DNA, 18 bp, Homo sapiens
tagagctgatccagagca

SEQ ID NO: 2583995 - DNA, 20 bp, Homo sapiens
tagagctgtattaagccact

SEQ ID NO: 2583996 - DNA, 15 bp, Homo sapiens
tagagcttctggcac

SEQ ID NO: 2583997 - DNA, 22 bp, Homo sapiens
tagaggagaaactggaactctc

SEQ ID NO: 2583998 - DNA, 15 bp, Homo sapiens
tagaggccagcctgg

SEQ ID NO: 2583999 - DNA, 17 bp, Homo sapiens
tagagggttcctgtaga

SEQ ID NO: 2584000 - DNA, 16 bp, Homo sapiens
tagaggtgagggaagc

SEQ ID NO: 2584001 - DNA, 15 bp, Homo sapiens
tagaggttcaaagat

SEQ ID NO: 2584002 - DNA, 19 bp, Homo sapiens
tagaggttttaaagtgatt

SEQ ID NO: 2584003 - DNA, 14 bp, Homo sapiens
tagagtatatgcac

SEQ ID NO: 2584004 - DNA, 13 bp, Homo sapiens
tagagtcagcctt

SEQ ID NO: 2584005 - DNA, 12 bp, Homo sapiens
tagagtgggagc

SEQ ID NO: 2584006 - DNA, 15 bp, Homo sapiens
tagagttaacaatga

SEQ ID NO: 2584007 - DNA, 17 bp, Homo sapiens
tagagttaacaatgata

SEQ ID NO: 2584008 - DNA, 12 bp, Homo sapiens
tagagttaagaa

SEQ ID NO: 2584009 - DNA, 12 bp, Homo sapiens
tagatagaaata

SEQ ID NO: 2584010 - DNA, 14 bp, Homo sapiens
tagatattattcat

SEQ ID NO: 2584011 - DNA, 17 bp, Homo sapiens
tagatcacgagatcaag

SEQ ID NO: 2584012 - DNA, 16 bp, Homo sapiens
tagatccacacacaga

SEQ ID NO: 2584013 - DNA, 19 bp, Homo sapiens
tagatctccaggagaactg

SEQ ID NO: 2584014 - DNA, 15 bp, Homo sapiens
tagatgaactcaact

SEQ ID NO: 2584015 - DNA, 22 bp, Homo sapiens
tagatgctctatgtgcttgtaa

SEQ ID NO: 2584016 - DNA, 20 bp, Homo sapiens
tagatgggcatggggtgggc

SEQ ID NO: 2584017 - DNA, 16 bp, Homo sapiens
tagatgggtctggctg

SEQ ID NO: 2584018 - DNA, 14 bp, Homo sapiens
tagatggtgaaatt

SEQ ID NO: 2584019 - DNA, 21 bp, Homo sapiens
tagatgtctaggtacttcagg

SEQ ID NO: 2584020 - DNA, 21 bp, Homo sapiens
tagatgtgatttaatagtgtt

SEQ ID NO: 2584021 - DNA, 22 bp, Homo sapiens
tagatgttcagattgctttgat

SEQ ID NO: 2584022 - DNA, 21 bp, Homo sapiens
tagattaccccctcattgttt

SEQ ID NO: 2584023 - DNA, 14 bp, Homo sapiens
tagattagctctgg

SEQ ID NO: 2584024 - DNA, 20 bp, Homo sapiens
tagattctacatattcttta

SEQ ID NO: 2584025 - DNA, 16 bp, Homo sapiens
tagattgttaaaataa

SEQ ID NO: 2584026 - DNA, 13 bp, Homo sapiens
tattaatgcactt

SEQ ID NO: 2584027 - DNA, 21 bp, Homo sapiens
tattaattgttttgcactttt

SEQ ID NO: 2584028 - DNA, 17 bp, Homo sapiens
tattacatctttcacat

SEQ ID NO: 2584029 - DNA, 15 bp, Homo sapiens
tattaccatgagaag

SEQ ID NO: 2584030 - DNA, 18 bp, Homo sapiens
tattactgtctggtttta

SEQ ID NO: 2584031 - DNA, 23 bp, Homo sapiens
tattactgtctggttttaacaat

SEQ ID NO: 2584032 - DNA, 23 bp, Homo sapiens
tattacttatttttgacagtgtt

SEQ ID NO: 2584033 - DNA, 12 bp, Homo sapiens
tattagagaaga

SEQ ID NO: 2584034 - DNA, 23 bp, Homo sapiens
tattagccacaaaattgggaaag

SEQ ID NO: 2584035 - DNA, 21 bp, Homo sapiens
tattagccaggtaatgtgaat

SEQ ID NO: 2584036 - DNA, 21 bp, Homo sapiens
tattagtcttggggcaggatg

SEQ ID NO: 2584037 - DNA, 13 bp, Homo sapiens
tattagttaatat

SEQ ID NO: 2584038 - DNA, 15 bp, Homo sapiens
tattataaattatgt

SEQ ID NO: 2584039 - DNA, 18 bp, Homo sapiens
tattataaattatgttta

SEQ ID NO: 2584040 - DNA, 12 bp, Homo sapiens
tattataattta

SEQ ID NO: 2584041 - DNA, 12 bp, Homo sapiens
tattataccttt

SEQ ID NO: 2584042 - DNA, 18 bp, Homo sapiens
tattatactaagaaaaga

SEQ ID NO: 2584043 - DNA, 19 bp, Homo sapiens
tattatactaagaaaagat

SEQ ID NO: 2584044 - DNA, 13 bp, Homo sapiens
tattatactgtat

SEQ ID NO: 2584045 - DNA, 19 bp, Homo sapiens
tattatactgtattaagag

SEQ ID NO: 2584046 - DNA, 17 bp, Homo sapiens
tattatgtctcttctga

SEQ ID NO: 2584047 - DNA, 13 bp, Homo sapiens
tattattactgtt

SEQ ID NO: 2584048 - DNA, 14 bp, Homo sapiens
tattattactgttt

SEQ ID NO: 2584049 - DNA, 12 bp, Homo sapiens
tattattgttct

SEQ ID NO: 2584050 - DNA, 13 bp, Homo sapiens
tattattttccaa

SEQ ID NO: 2584051 - DNA, 19 bp, Homo sapiens
tattcaactcataagactt

SEQ ID NO: 2584052 - DNA, 16 bp, Homo sapiens
tattcaattcctctgg

SEQ ID NO: 2584053 - DNA, 16 bp, Homo sapiens
tattcagcttcatttg

SEQ ID NO: 2584054 - DNA, 17 bp, Homo sapiens
tattcagcttcatttgt

SEQ ID NO: 2584055 - DNA, 19 bp, Homo sapiens
tattcagcttcatttgtgt

SEQ ID NO: 2584056 - DNA, 21 bp, Homo sapiens
tattcagcttcatttgtgtca

SEQ ID NO: 2584057 - DNA, 16 bp, Homo sapiens
tattcaggaagctcag

SEQ ID NO: 2584058 - DNA, 21 bp, Homo sapiens
tattcagttcccagaatcaaa

SEQ ID NO: 2584059 - DNA, 23 bp, Homo sapiens
tattcatagcagcttattcacaa

SEQ ID NO: 2584060 - DNA, 16 bp, Homo sapiens
tattcatagtttaatt

SEQ ID NO: 2584061 - DNA, 14 bp, Homo sapiens
tattcatgcttctt

SEQ ID NO: 2584062 - DNA, 12 bp, Homo sapiens
tattcatttaaa

SEQ ID NO: 2584063 - DNA, 13 bp, Homo sapiens
tattcatttaaaa

SEQ ID NO: 2584064 - DNA, 16 bp, Homo sapiens
tattcatttaaaatga

SEQ ID NO: 2584065 - DNA, 14 bp, Homo sapiens
tattccatatatta

SEQ ID NO: 2584066 - DNA, 17 bp, Homo sapiens
tattccatatttattca

SEQ ID NO: 2584067 - DNA, 16 bp, Homo sapiens
tattccatgaatgtat

SEQ ID NO: 2584068 - DNA, 23 bp, Homo sapiens
tattccatgaatgtatcaggaaa

SEQ ID NO: 2584069 - DNA, 22 bp, Homo sapiens
tattcccaagcccatgagtcct

SEQ ID NO: 2584070 - DNA, 17 bp, Homo sapiens
tattccccattcttcct

SEQ ID NO: 2584071 - DNA, 20 bp, Homo sapiens
tattcccctatctctagaat

SEQ ID NO: 2584072 - DNA, 21 bp, Homo sapiens
tattccctgtacaatatttaa

SEQ ID NO: 2584073 - DNA, 14 bp, Homo sapiens
tattcctgaatgaa

SEQ ID NO: 2584074 - DNA, 11 bp, Homo sapiens
tattcctgcct

SEQ ID NO: 2584075 - DNA, 14 bp, Homo sapiens
tattcctgtatgtt

SEQ ID NO: 2584076 - DNA, 16 bp, Homo sapiens
tattcctttctatcat

SEQ ID NO: 2584077 - DNA, 15 bp, Homo sapiens
tattctatatgaatt

SEQ ID NO: 2584078 - DNA, 17 bp, Homo sapiens
tattctatatgaattta

SEQ ID NO: 2584079 - DNA, 19 bp, Homo sapiens
tattctattaactttaatt

SEQ ID NO: 2584080 - DNA, 14 bp, Homo sapiens
tattctcaccagga

SEQ ID NO: 2584081 - DNA, 15 bp, Homo sapiens
tattctcaccaggaa

SEQ ID NO: 2584082 - DNA, 18 bp, Homo sapiens
tattctctcctgtacctc

SEQ ID NO: 2584083 - DNA, 18 bp, Homo sapiens
tattctctgagctgtgca

SEQ ID NO: 2584084 - DNA, 14 bp, Homo sapiens
tattctgattccac

SEQ ID NO: 2584085 - DNA, 22 bp, Homo sapiens
tattcttctcttccttttatca

SEQ ID NO: 2584086 - DNA, 18 bp, Homo sapiens
tattctttgatgttaaca

SEQ ID NO: 2584087 - DNA, 21 bp, Homo sapiens
tattctttgatgttaacacat

SEQ ID NO: 2584088 - DNA, 12 bp, Homo sapiens
tattgaagcatt

SEQ ID NO: 2584089 - DNA, 15 bp, Homo sapiens
tattgaagcatttta

SEQ ID NO: 2584090 - DNA, 18 bp, Homo sapiens
tattgaatcatgtagtat

SEQ ID NO: 2584091 - DNA, 16 bp, Homo sapiens
tattgaatctatttaa

SEQ ID NO: 2584092 - DNA, 17 bp, Homo sapiens
tattgacaataatttca

SEQ ID NO: 2584093 - DNA, 20 bp, Homo sapiens
tattgatgtacagtctgtca

SEQ ID NO: 2584094 - DNA, 22 bp, Homo sapiens
tattgatgtacagtctgtcatg

SEQ ID NO: 2584095 - DNA, 20 bp, Homo sapiens
tattgcaaaatagcatttgt

SEQ ID NO: 2584096 - DNA, 11 bp, Homo sapiens
tattgcagttt

SEQ ID NO: 2584097 - DNA, 19 bp, Homo sapiens
tattgcagtttatcattca

SEQ ID NO: 2584098 - DNA, 21 bp, Homo sapiens
tattgcttgatacttttgaca

SEQ ID NO: 2584099 - DNA, 21 bp, Homo sapiens
tattgcttgcacaaaccaatt

SEQ ID NO: 2584100 - DNA, 19 bp, Homo sapiens
tattgcttgttggattttt

SEQ ID NO: 2584101 - DNA, 21 bp, Homo sapiens
tattggagggtaaatgatgtg

SEQ ID NO: 2584102 - DNA, 23 bp, Homo sapiens
tattgggtagatattttttctga

SEQ ID NO: 2584103 - DNA, 16 bp, Homo sapiens
tattgggttcattatt

SEQ ID NO: 2584104 - DNA, 18 bp, Homo sapiens
tattgggttcattattgg

SEQ ID NO: 2584105 - DNA, 21 bp, Homo sapiens
tattggtaacatcctttctat

SEQ ID NO: 2584106 - DNA, 15 bp, Homo sapiens
tattgtacacttttt

SEQ ID NO: 2584107 - DNA, 20 bp, Homo sapiens
tattgtacagctgtttaaga

SEQ ID NO: 2584108 - DNA, 11 bp, Homo sapiens
tattgtacctc

SEQ ID NO: 2584109 - DNA, 16 bp, Homo sapiens
tattgtataaactatc

SEQ ID NO: 2584110 - DNA, 18 bp, Homo sapiens
tattgtatttattccata

SEQ ID NO: 2584111 - DNA, 22 bp, Homo sapiens
tattgtcagtatctgtatctct

SEQ ID NO: 2584112 - DNA, 17 bp, Homo sapiens
tattgtccattgtccaa

SEQ ID NO: 2584113 - DNA, 15 bp, Homo sapiens
tattgtgaagtacat

SEQ ID NO: 2584114 - DNA, 18 bp, Homo sapiens
tattgtgatttgactgtt

SEQ ID NO: 2584115 - DNA, 21 bp, Homo sapiens
tattgtgatttgactgttttt

SEQ ID NO: 2584116 - DNA, 17 bp, Homo sapiens
tattgttaactcttgtc

SEQ ID NO: 2584117 - DNA, 15 bp, Homo sapiens
tattgttactctggt

SEQ ID NO: 2584118 - DNA, 17 bp, Homo sapiens
tattgttccaagacatt

SEQ ID NO: 2584119 - DNA, 16 bp, Homo sapiens
tattgtttaaaatcat

SEQ ID NO: 2584120 - DNA, 24 bp, Homo sapiens
tattgtttattctttttaaagtat

SEQ ID NO: 2584121 - DNA, 21 bp, Homo sapiens
tattgtttctggtcactatat

SEQ ID NO: 2584122 - DNA, 12 bp, Homo sapiens
tattgttttcag

SEQ ID NO: 2584123 - DNA, 18 bp, Homo sapiens
tattgttttcagtgtaca

SEQ ID NO: 2584124 - DNA, 15 bp, Homo sapiens
tatttaaaagattca

SEQ ID NO: 2584125 - DNA, 19 bp, Homo sapiens
tatttaaaatttattgctt

SEQ ID NO: 2584126 - DNA, 14 bp, Homo sapiens
tatttaaacatggt

SEQ ID NO: 2584127 - DNA, 17 bp, Homo sapiens
tatttaaagacaaagac

SEQ ID NO: 2584128 - DNA, 14 bp, Homo sapiens
tatttaaagacagg

SEQ ID NO: 2584129 - DNA, 15 bp, Homo sapiens
tatttaacaagatct

SEQ ID NO: 2584130 - DNA, 21 bp, Homo sapiens
tatttaactgccttgtgtaca

SEQ ID NO: 2584131 - DNA, 11 bp, Homo sapiens
tatttaataac

SEQ ID NO: 2584132 - DNA, 17 bp, Homo sapiens
tatttaataacaattgt

SEQ ID NO: 2584133 - DNA, 16 bp, Homo sapiens
tatttactgagcttct

SEQ ID NO: 2584134 - DNA, 21 bp, Homo sapiens
tatttagcatgacaagcccca

SEQ ID NO: 2584135 - DNA, 23 bp, Homo sapiens
tatttataactcatcataaaata

SEQ ID NO: 2584136 - DNA, 17 bp, Homo sapiens
tatttatatatttataa

SEQ ID NO: 2584137 - DNA, 15 bp, Homo sapiens
tatttatatttcact

SEQ ID NO: 2584138 - DNA, 16 bp, Homo sapiens
tatttatctctattta

SEQ ID NO: 2584139 - DNA, 17 bp, Homo sapiens
tatttatctctatttaa

SEQ ID NO: 2584140 - DNA, 20 bp, Homo sapiens
tatttatctgtgcaaatcct

SEQ ID NO: 2584141 - DNA, 20 bp, Homo sapiens
tatttatgcctctgtattta

SEQ ID NO: 2584142 - DNA, 21 bp, Homo sapiens
tatttatgtctatttaagcct

SEQ ID NO: 2584143 - DNA, 14 bp, Homo sapiens
tatttatgtgtgag

SEQ ID NO: 2584144 - DNA, 23 bp, Homo sapiens
tatttattaaatgcccagcccct

SEQ ID NO: 2584145 - DNA, 13 bp, Homo sapiens
tatttattacctc

SEQ ID NO: 2584146 - DNA, 16 bp, Homo sapiens
tatttattacctctga

SEQ ID NO: 2584147 - DNA, 16 bp, Homo sapiens
tatttattgtttattt

SEQ ID NO: 2584148 - DNA, 11 bp, Homo sapiens
tatttatttaa

SEQ ID NO: 2584149 - DNA, 19 bp, Homo sapiens
tatttatttaaaagattca

SEQ ID NO: 2584150 - DNA, 16 bp, Homo sapiens
tatttatttaagctta

SEQ ID NO: 2584151 - DNA, 21 bp, Homo sapiens
tatttatttaataacaattgt

SEQ ID NO: 2584152 - DNA, 13 bp, Homo sapiens
tatttatttatgg

SEQ ID NO: 2584153 - DNA, 18 bp, Homo sapiens
tatttattttcctcccca

SEQ ID NO: 2584154 - DNA, 20 bp, Homo sapiens
tatttcaaaatatacattca

SEQ ID NO: 2584155 - DNA, 14 bp, Homo sapiens
tatttcaaattgga

SEQ ID NO: 2584156 - DNA, 18 bp, Homo sapiens
tatttcaaattggagctt

SEQ ID NO: 2584157 - DNA, 20 bp, Homo sapiens
tatttcatcatattatacag

SEQ ID NO: 2584158 - DNA, 22 bp, Homo sapiens
tatttccctcacctttcccatc

SEQ ID NO: 2584159 - DNA, 15 bp, Homo sapiens
tatttccctcccctg

SEQ ID NO: 2584160 - DNA, 23 bp, Homo sapiens
tatttcctatattgttttcagtg

SEQ ID NO: 2584161 - DNA, 15 bp, Homo sapiens
tatttccttaaactg

SEQ ID NO: 2584162 - DNA, 16 bp, Homo sapiens
tatttctaggaagaat

SEQ ID NO: 2584163 - DNA, 19 bp, Homo sapiens
tatttctctgatttgcaaa

SEQ ID NO: 2584164 - DNA, 21 bp, Homo sapiens
tatttctgagaaggtccttaa

SEQ ID NO: 2584165 - DNA, 19 bp, Homo sapiens
tatttcttatatatgtgaa

SEQ ID NO: 2584166 - DNA, 22 bp, Homo sapiens
tatttgaaaacatataaagcac

SEQ ID NO: 2584167 - DNA, 21 bp, Homo sapiens
tatttgcataacaattcctct

SEQ ID NO: 2584168 - DNA, 15 bp, Homo sapiens
tatttgcatgttacc

SEQ ID NO: 2584169 - DNA, 16 bp, Homo sapiens
tatttgcatgttacct

SEQ ID NO: 2584170 - DNA, 20 bp, Homo sapiens
tatttggaatttatatacaa

SEQ ID NO: 2584171 - DNA, 16 bp, Homo sapiens
tcacctgaagactcat

SEQ ID NO: 2584172 - DNA, 23 bp, Homo sapiens
tcacctgaagactcattcttctg

SEQ ID NO: 2584173 - DNA, 19 bp, Homo sapiens
tcacctgattcaactaaaa

SEQ ID NO: 2584174 - DNA, 11 bp, Homo sapiens
tcacctgctgg

SEQ ID NO: 2584175 - DNA, 16 bp, Homo sapiens
tcacctgctggcccct

SEQ ID NO: 2584176 - DNA, 19 bp, Homo sapiens
tcacctgctggcccctcac

SEQ ID NO: 2584177 - DNA, 18 bp, Homo sapiens
tcacctggggctgctggc

SEQ ID NO: 2584178 - DNA, 22 bp, Homo sapiens
tcacctggggctgctggcctga

SEQ ID NO: 2584179 - DNA, 19 bp, Homo sapiens
tcacctggggtgtgggagg

SEQ ID NO: 2584180 - DNA, 15 bp, Homo sapiens
tcacctgtactcttc

SEQ ID NO: 2584181 - DNA, 14 bp, Homo sapiens
tcacctgtgcttcg

SEQ ID NO: 2584182 - DNA, 18 bp, Homo sapiens
tcacctgttgcttacaat

SEQ ID NO: 2584183 - DNA, 19 bp, Homo sapiens
tcaccttgcaacacacaga

SEQ ID NO: 2584184 - DNA, 14 bp, Homo sapiens
tcacctttcccatc

SEQ ID NO: 2584185 - DNA, 17 bp, Homo sapiens
tcacctttgtccccacc

SEQ ID NO: 2584186 - DNA, 22 bp, Homo sapiens
tcacctttgtccccaccgcaga

SEQ ID NO: 2584187 - DNA, 19 bp, Homo sapiens
tcacgaatattatgcccag

SEQ ID NO: 2584188 - DNA, 20 bp, Homo sapiens
tcacgaatattatgcccagt

SEQ ID NO: 2584189 - DNA, 16 bp, Homo sapiens
tcacgcacctcccatc

SEQ ID NO: 2584190 - DNA, 19 bp, Homo sapiens
tcacgcctgtaatcccagc

SEQ ID NO: 2584191 - DNA, 20 bp, Homo sapiens
tcacgcctgtaatcccagca

SEQ ID NO: 2584192 - DNA, 20 bp, Homo sapiens
tcacgcctgtaatcctagca

SEQ ID NO: 2584193 - DNA, 16 bp, Homo sapiens
tcacgcctgtgcagtg

SEQ ID NO: 2584194 - DNA, 13 bp, Homo sapiens
tcacggctcactg

SEQ ID NO: 2584195 - DNA, 20 bp, Homo sapiens
tcacggctcactgcagcctc

SEQ ID NO: 2584196 - DNA, 20 bp, Homo sapiens
tcacgtaaagctagaaatga

SEQ ID NO: 2584197 - DNA, 13 bp, Homo sapiens
tcacgtcacactt

SEQ ID NO: 2584198 - DNA, 21 bp, Homo sapiens
tcacgtggaggagcagtgcag

SEQ ID NO: 2584199 - DNA, 16 bp, Homo sapiens
tcacgtgtgtgactca

SEQ ID NO: 2584200 - DNA, 13 bp, Homo sapiens
tcactaaacttta

SEQ ID NO: 2584201 - DNA, 19 bp, Homo sapiens
tcactaccctattctctct

SEQ ID NO: 2584202 - DNA, 19 bp, Homo sapiens
tcactactcacagtctctt

SEQ ID NO: 2584203 - DNA, 13 bp, Homo sapiens
tcactataaatgg

SEQ ID NO: 2584204 - DNA, 23 bp, Homo sapiens
tcactatggtgccaatggaacct

SEQ ID NO: 2584205 - DNA, 14 bp, Homo sapiens
tcactccagcctgg

SEQ ID NO: 2584206 - DNA, 13 bp, Homo sapiens
tcactcccctcca

SEQ ID NO: 2584207 - DNA, 21 bp, Homo sapiens
tcactcccttctacctgccac

SEQ ID NO: 2584208 - DNA, 20 bp, Homo sapiens
tcactcctgagacccctggc

SEQ ID NO: 2584209 - DNA, 21 bp, Homo sapiens
tcactcctgagacccctggcc

SEQ ID NO: 2584210 - DNA, 23 bp, Homo sapiens
tcactcctgagacccctggcctc

SEQ ID NO: 2584211 - DNA, 20 bp, Homo sapiens
tcactcctggggcctcttgg

SEQ ID NO: 2584212 - DNA, 14 bp, Homo sapiens
tcactctgctgctt

SEQ ID NO: 2584213 - DNA, 13 bp, Homo sapiens
tcactctggcagc

SEQ ID NO: 2584214 - DNA, 16 bp, Homo sapiens
tcactctgtcgcccag

SEQ ID NO: 2584215 - DNA, 18 bp, Homo sapiens
tcactgaaaacatctgga

SEQ ID NO: 2584216 - DNA, 20 bp, Homo sapiens
tcactgaaaacatctggaag

SEQ ID NO: 2584217 - DNA, 23 bp, Homo sapiens
tcactgaatgcttctgacttcat

SEQ ID NO: 2584218 - DNA, 19 bp, Homo sapiens
tcactgacacaaaaagtag

SEQ ID NO: 2584219 - DNA, 13 bp, Homo sapiens
tcactgagacagc

SEQ ID NO: 2584220 - DNA, 14 bp, Homo sapiens
tcactgagacagcc

SEQ ID NO: 2584221 - DNA, 16 bp, Homo sapiens
tcactgagacagcccg

SEQ ID NO: 2584222 - DNA, 22 bp, Homo sapiens
tcactgagacagcccgggctct

SEQ ID NO: 2584223 - DNA, 14 bp, Homo sapiens
tcactgcagcctca

SEQ ID NO: 2584224 - DNA, 22 bp, Homo sapiens
tcactgcagcctccttctcctg

SEQ ID NO: 2584225 - DNA, 13 bp, Homo sapiens
tcactgcaggcac

SEQ ID NO: 2584226 - DNA, 13 bp, Homo sapiens
tcactgccatata

SEQ ID NO: 2584227 - DNA, 12 bp, Homo sapiens
tcactgcctctc

SEQ ID NO: 2584228 - DNA, 21 bp, Homo sapiens
tcactgcctctccctggccct

SEQ ID NO: 2584229 - DNA, 14 bp, Homo sapiens
tcactgcctttgct

SEQ ID NO: 2584230 - DNA, 12 bp, Homo sapiens
tcactgctgcaa

SEQ ID NO: 2584231 - DNA, 18 bp, Homo sapiens
tcactgctgcaaggcctt

SEQ ID NO: 2584232 - DNA, 10 bp, Homo sapiens
tcactgctgt

SEQ ID NO: 2584233 - DNA, 14 bp, Homo sapiens
tcactggaactcag

SEQ ID NO: 2584234 - DNA, 18 bp, Homo sapiens
tcactggaccactgggca

SEQ ID NO: 2584235 - DNA, 11 bp, Homo sapiens
tcactggagcc

SEQ ID NO: 2584236 - DNA, 19 bp, Homo sapiens
tcactggagttacattaat

SEQ ID NO: 2584237 - DNA, 21 bp, Homo sapiens
tcactggagttacattaatgt

SEQ ID NO: 2584238 - DNA, 21 bp, Homo sapiens
tcactggccacagttgtttga

SEQ ID NO: 2584239 - DNA, 20 bp, Homo sapiens
tcactggcgacacgtagcag

SEQ ID NO: 2584240 - DNA, 22 bp, Homo sapiens
tcactggcgacacgtagcagct

SEQ ID NO: 2584241 - DNA, 16 bp, Homo sapiens
tcactggctctccaag

SEQ ID NO: 2584242 - DNA, 17 bp, Homo sapiens
tcactggctctccaagt

SEQ ID NO: 2584243 - DNA, 20 bp, Homo sapiens
tcactggctctccaagtgcc

SEQ ID NO: 2584244 - DNA, 19 bp, Homo sapiens
tcactggggtcctggggcc

SEQ ID NO: 2584245 - DNA, 21 bp, Homo sapiens
tcactggggtcctggggcctc

SEQ ID NO: 2584246 - DNA, 20 bp, Homo sapiens
tcactgggtggggtgaggac

SEQ ID NO: 2584247 - DNA, 19 bp, Homo sapiens
tcactggtagaccaaaata

SEQ ID NO: 2584248 - DNA, 17 bp, Homo sapiens
tcactgtataaatagga

SEQ ID NO: 2584249 - DNA, 19 bp, Homo sapiens
tcactgtataaataggaga

SEQ ID NO: 2584250 - DNA, 18 bp, Homo sapiens
tcactgtccctcaaatga

SEQ ID NO: 2584251 - DNA, 19 bp, Homo sapiens
tcactgtcctccaagccag

SEQ ID NO: 2584252 - DNA, 20 bp, Homo sapiens
tcactgtctgagagtttagt

SEQ ID NO: 2584253 - DNA, 21 bp, Homo sapiens
tcactgtgggaaggccagctg

SEQ ID NO: 2584254 - DNA, 15 bp, Homo sapiens
tcactgttccctctg

SEQ ID NO: 2584255 - DNA, 17 bp, Homo sapiens
tcactgttccctctgct

SEQ ID NO: 2584256 - DNA, 19 bp, Homo sapiens
tcactgttccctctgctcc

SEQ ID NO: 2584257 - DNA, 20 bp, Homo sapiens
tcactgttgaaaattatttt

SEQ ID NO: 2584258 - DNA, 15 bp, Homo sapiens
tcactgttgcccagg

SEQ ID NO: 2584259 - DNA, 23 bp, Homo sapiens
tcactgttgcccaggctggcgtg

SEQ ID NO: 2584260 - DNA, 14 bp, Homo sapiens
tcactgtttctctg

SEQ ID NO: 2584261 - DNA, 17 bp, Homo sapiens
tcacttacctagattta

SEQ ID NO: 2584262 - DNA, 22 bp, Homo sapiens
tcacttactgtttctgtcagga

SEQ ID NO: 2584263 - DNA, 19 bp, Homo sapiens
tcacttccatacagctcta

SEQ ID NO: 2584264 - DNA, 17 bp, Homo sapiens
tcacttcctacaagagc

SEQ ID NO: 2584265 - DNA, 23 bp, Homo sapiens
tcacttcgcgtgccctcgctgct

SEQ ID NO: 2584266 - DNA, 13 bp, Homo sapiens
tcacttctaaatg

SEQ ID NO: 2584267 - DNA, 23 bp, Homo sapiens
tcacttgaacccgggaggcagag

SEQ ID NO: 2584268 - DNA, 19 bp, Homo sapiens
tcacttgatgtgccatttt

SEQ ID NO: 2584269 - DNA, 14 bp, Homo sapiens
tcacttgtacaaaa

SEQ ID NO: 2584270 - DNA, 15 bp, Homo sapiens
tcacttgtacaaaat

SEQ ID NO: 2584271 - DNA, 17 bp, Homo sapiens
tcacttgtacaaaataa

SEQ ID NO: 2584272 - DNA, 17 bp, Homo sapiens
tcacttgtgcagtgttg

SEQ ID NO: 2584273 - DNA, 20 bp, Homo sapiens
tcactttaattctcatgtga

SEQ ID NO: 2584274 - DNA, 15 bp, Homo sapiens
tcactttagatgctg

SEQ ID NO: 2584275 - DNA, 16 bp, Homo sapiens
tcactttagatgctga

SEQ ID NO: 2584276 - DNA, 18 bp, Homo sapiens
tcactttcacatagatgt

SEQ ID NO: 2584277 - DNA, 14 bp, Homo sapiens
tcactttctagatt

SEQ ID NO: 2584278 - DNA, 17 bp, Homo sapiens
tcactttgctctgggtg

SEQ ID NO: 2584279 - DNA, 22 bp, Homo sapiens
tcacttttagggagagtcatat

SEQ ID NO: 2584280 - DNA, 13 bp, Homo sapiens
tcacttttcagtg

SEQ ID NO: 2584281 - DNA, 18 bp, Homo sapiens
tcacttttcctccctcag

SEQ ID NO: 2584282 - DNA, 13 bp, Homo sapiens
tcacttttttcca

SEQ ID NO: 2584283 - DNA, 15 bp, Homo sapiens
tcacttttttccaca

SEQ ID NO: 2584284 - DNA, 21 bp, Homo sapiens
tcactttttttttccaaaaaa

SEQ ID NO: 2584285 - DNA, 21 bp, Homo sapiens
tcagaaacactggggctggca

SEQ ID NO: 2584286 - DNA, 18 bp, Homo sapiens
tcagaaacatcagttact

SEQ ID NO: 2584287 - DNA, 16 bp, Homo sapiens
tcagaaacttgtgaag

SEQ ID NO: 2584288 - DNA, 14 bp, Homo sapiens
tcagaaatgctgcc

SEQ ID NO: 2584289 - DNA, 17 bp, Homo sapiens
tcagaaatgctgcctgc

SEQ ID NO: 2584290 - DNA, 21 bp, Homo sapiens
tcagaaatgctgcctgcctgt

SEQ ID NO: 2584291 - DNA, 18 bp, Homo sapiens
tcagaaattggaacagaa

SEQ ID NO: 2584292 - DNA, 23 bp, Homo sapiens
tcagaaatttaattcatgtttct

SEQ ID NO: 2584293 - DNA, 22 bp, Homo sapiens
tcagaaccatccatagtagtat

SEQ ID NO: 2584294 - DNA, 18 bp, Homo sapiens
tcagaacctcttccccag

SEQ ID NO: 2584295 - DNA, 15 bp, Homo sapiens
tcagaactagaattt

SEQ ID NO: 2584296 - DNA, 20 bp, Homo sapiens
tcagaagcctgaggctggga

SEQ ID NO: 2584297 - DNA, 13 bp, Homo sapiens
tcagaagggaggc

SEQ ID NO: 2584298 - DNA, 19 bp, Homo sapiens
tcagaagtttctcagctcc

SEQ ID NO: 2584299 - DNA, 17 bp, Homo sapiens
tcagaatctctcttctt

SEQ ID NO: 2584300 - DNA, 12 bp, Homo sapiens
tcagaattctca

SEQ ID NO: 2584301 - DNA, 23 bp, Homo sapiens
tcagaattctctagtttgattaa

SEQ ID NO: 2584302 - DNA, 21 bp, Homo sapiens
tcagaattgatcattttcccc

SEQ ID NO: 2584303 - DNA, 14 bp, Homo sapiens
tcagacagctgcct

SEQ ID NO: 2584304 - DNA, 18 bp, Homo sapiens
tcagacagctgcctggga

SEQ ID NO: 2584305 - DNA, 20 bp, Homo sapiens
tcagacagctgcctgggatc

SEQ ID NO: 2584306 - DNA, 21 bp, Homo sapiens
tcagacatccatgtttgtaaa

SEQ ID NO: 2584307 - DNA, 14 bp, Homo sapiens
tcagaccagctctt

SEQ ID NO: 2584308 - DNA, 23 bp, Homo sapiens
tcagaccataatgttacattatt

SEQ ID NO: 2584309 - DNA, 13 bp, Homo sapiens
tcagactggctgg

SEQ ID NO: 2584310 - DNA, 21 bp, Homo sapiens
tcagactggctggctgcagtg

SEQ ID NO: 2584311 - DNA, 13 bp, Homo sapiens
tcagagaatttct

SEQ ID NO: 2584312 - DNA, 20 bp, Homo sapiens
tcagagacaggaagtcttca

SEQ ID NO: 2584313 - DNA, 23 bp, Homo sapiens
tcagagacaggaagtcttcaggg

SEQ ID NO: 2584314 - DNA, 20 bp, Homo sapiens
tcagagactcctgcaggcag

SEQ ID NO: 2584315 - DNA, 19 bp, Homo sapiens
tcatcgggaatactaggga

SEQ ID NO: 2584316 - DNA, 15 bp, Homo sapiens
tcatctatttctgag

SEQ ID NO: 2584317 - DNA, 17 bp, Homo sapiens
tcatctatttctgagaa

SEQ ID NO: 2584318 - DNA, 18 bp, Homo sapiens
tcatctatttctgagaag

SEQ ID NO: 2584319 - DNA, 16 bp, Homo sapiens
tcatctcattcaaacc

SEQ ID NO: 2584320 - DNA, 21 bp, Homo sapiens
tcatctcctgccttcctcctg

SEQ ID NO: 2584321 - DNA, 23 bp, Homo sapiens
tcatctctcctccaagacactgt

SEQ ID NO: 2584322 - DNA, 17 bp, Homo sapiens
tcatctgctcagcagct

SEQ ID NO: 2584323 - DNA, 14 bp, Homo sapiens
tcatctgggaaaga

SEQ ID NO: 2584324 - DNA, 12 bp, Homo sapiens
tcatcttactgt

SEQ ID NO: 2584325 - DNA, 14 bp, Homo sapiens
tcatcttctcagct

SEQ ID NO: 2584326 - DNA, 15 bp, Homo sapiens
tcatcttctcagctc

SEQ ID NO: 2584327 - DNA, 16 bp, Homo sapiens
tcatcttcttcaccat

SEQ ID NO: 2584328 - DNA, 16 bp, Homo sapiens
tcatcttgaccaagca

SEQ ID NO: 2584329 - DNA, 19 bp, Homo sapiens
tcatcttgaccaagcagga

SEQ ID NO: 2584330 - DNA, 22 bp, Homo sapiens
tcatcttgaccaagcaggaagc

SEQ ID NO: 2584331 - DNA, 15 bp, Homo sapiens
tcatgaacttcgcat

SEQ ID NO: 2584332 - DNA, 12 bp, Homo sapiens
tcatgaagccca

SEQ ID NO: 2584333 - DNA, 21 bp, Homo sapiens
tcatgacatgttatatatttt

SEQ ID NO: 2584334 - DNA, 13 bp, Homo sapiens
tcatgatccaact

SEQ ID NO: 2584335 - DNA, 16 bp, Homo sapiens
tcatgattagcaagtt

SEQ ID NO: 2584336 - DNA, 23 bp, Homo sapiens
tcatgatttcatttcaactgttt

SEQ ID NO: 2584337 - DNA, 13 bp, Homo sapiens
tcatgcaatgaca

SEQ ID NO: 2584338 - DNA, 15 bp, Homo sapiens
tcatgcaatgacatc

SEQ ID NO: 2584339 - DNA, 13 bp, Homo sapiens
tcatgcagccgtg

SEQ ID NO: 2584340 - DNA, 14 bp, Homo sapiens
tcatgcagccgtga

SEQ ID NO: 2584341 - DNA, 20 bp, Homo sapiens
tcatgcataaatatgcagtg

SEQ ID NO: 2584342 - DNA, 18 bp, Homo sapiens
tcatgcatgtcctgtaaa

SEQ ID NO: 2584343 - DNA, 16 bp, Homo sapiens
tcatgccaagcattta

SEQ ID NO: 2584344 - DNA, 22 bp, Homo sapiens
tcatgcccccctcaaacctcct

SEQ ID NO: 2584345 - DNA, 21 bp, Homo sapiens
tcatgccccctttcagatgtc

SEQ ID NO: 2584346 - DNA, 15 bp, Homo sapiens
tcatgcctggcttcg

SEQ ID NO: 2584347 - DNA, 18 bp, Homo sapiens
tcatgcctggcttcgcaa

SEQ ID NO: 2584348 - DNA, 15 bp, Homo sapiens
tcatgctatctctgt

SEQ ID NO: 2584349 - DNA, 11 bp, Homo sapiens
tcatgctgaaa

SEQ ID NO: 2584350 - DNA, 22 bp, Homo sapiens
tcatggcagaaggcaaacccat

SEQ ID NO: 2584351 - DNA, 13 bp, Homo sapiens
tcatggcccctct

SEQ ID NO: 2584352 - DNA, 15 bp, Homo sapiens
tcatggcttaatgtt

SEQ ID NO: 2584353 - DNA, 22 bp, Homo sapiens
tcatggtagagaccgagcctct

SEQ ID NO: 2584354 - DNA, 15 bp, Homo sapiens
tcatggtgtaataag

SEQ ID NO: 2584355 - DNA, 17 bp, Homo sapiens
tcatggtgtaataagac

SEQ ID NO: 2584356 - DNA, 18 bp, Homo sapiens
tcatggtgtaataagaca

SEQ ID NO: 2584357 - DNA, 20 bp, Homo sapiens
tcatggtgtaataagacata

SEQ ID NO: 2584358 - DNA, 13 bp, Homo sapiens
tcatgtaaactgt

SEQ ID NO: 2584359 - DNA, 17 bp, Homo sapiens
tcatgtaaactgtgcac

SEQ ID NO: 2584360 - DNA, 14 bp, Homo sapiens
tcatgtcaggcctg

SEQ ID NO: 2584361 - DNA, 16 bp, Homo sapiens
tcatgtcaggcctgtg

SEQ ID NO: 2584362 - DNA, 19 bp, Homo sapiens
tcatgtcaggcctgtgtgt

SEQ ID NO: 2584363 - DNA, 17 bp, Homo sapiens
tcatgtccccaaacctg

SEQ ID NO: 2584364 - DNA, 15 bp, Homo sapiens
tcatgtgatcctttt

SEQ ID NO: 2584365 - DNA, 20 bp, Homo sapiens
tcatgtgatccttttatgtt

SEQ ID NO: 2584366 - DNA, 18 bp, Homo sapiens
tcatgtggaatataaaga

SEQ ID NO: 2584367 - DNA, 23 bp, Homo sapiens
tcatgtgtaatcaataaacgatt

SEQ ID NO: 2584368 - DNA, 19 bp, Homo sapiens
tcatgtgtatgggcaaaaa

SEQ ID NO: 2584369 - DNA, 16 bp, Homo sapiens
tcatgtgtgctcttct

SEQ ID NO: 2584370 - DNA, 12 bp, Homo sapiens
tcatgtgtgtcc

SEQ ID NO: 2584371 - DNA, 16 bp, Homo sapiens
tcatgtgtgtccacga

SEQ ID NO: 2584372 - DNA, 13 bp, Homo sapiens
tcatgttcctcaa

SEQ ID NO: 2584373 - DNA, 17 bp, Homo sapiens
tcatgttcttaattctt

SEQ ID NO: 2584374 - DNA, 17 bp, Homo sapiens
tcatgtttgcttcataa

SEQ ID NO: 2584375 - DNA, 20 bp, Homo sapiens
tcatgtttgcttcataaatg

SEQ ID NO: 2584376 - DNA, 15 bp, Homo sapiens
tcatgttttaacaaa

SEQ ID NO: 2584377 - DNA, 16 bp, Homo sapiens
tcatgttttaacaaaa

SEQ ID NO: 2584378 - DNA, 14 bp, Homo sapiens
tcatgttttgtgac

SEQ ID NO: 2584379 - DNA, 20 bp, Homo sapiens
tcattaccttttttgataaa

SEQ ID NO: 2584380 - DNA, 13 bp, Homo sapiens
tcattagactcct

SEQ ID NO: 2584381 - DNA, 18 bp, Homo sapiens
tcattagactcctcctcc

SEQ ID NO: 2584382 - DNA, 18 bp, Homo sapiens
tcattaggtgtgactgaa

SEQ ID NO: 2584383 - DNA, 22 bp, Homo sapiens
tcattaggtgtgactgaatttc

SEQ ID NO: 2584384 - DNA, 13 bp, Homo sapiens
tcattataaacgt

SEQ ID NO: 2584385 - DNA, 19 bp, Homo sapiens
tcattatctcaaaactgca

SEQ ID NO: 2584386 - DNA, 16 bp, Homo sapiens
tcattcaatacaagtg

SEQ ID NO: 2584387 - DNA, 23 bp, Homo sapiens
tcattccaccttcccatgccctg

SEQ ID NO: 2584388 - DNA, 15 bp, Homo sapiens
tcattccattctgga

SEQ ID NO: 2584389 - DNA, 12 bp, Homo sapiens
tcattctcctgc

SEQ ID NO: 2584390 - DNA, 15 bp, Homo sapiens
tcattctcctgcctg

SEQ ID NO: 2584391 - DNA, 18 bp, Homo sapiens
tcattcttatttcatgaa

SEQ ID NO: 2584392 - DNA, 14 bp, Homo sapiens
tcattgaagtattt

SEQ ID NO: 2584393 - DNA, 14 bp, Homo sapiens
tcattgacctgagg

SEQ ID NO: 2584394 - DNA, 22 bp, Homo sapiens
tcattgacctgaggcccttctc

SEQ ID NO: 2584395 - DNA, 19 bp, Homo sapiens
tcattgagagttttgtctt

SEQ ID NO: 2584396 - DNA, 13 bp, Homo sapiens
tcattgatatgaa

SEQ ID NO: 2584397 - DNA, 17 bp, Homo sapiens
tcattgatatgaaaaat

SEQ ID NO: 2584398 - DNA, 23 bp, Homo sapiens
tcattgctttgaagcagttgtgt

SEQ ID NO: 2584399 - DNA, 17 bp, Homo sapiens
tcattgtatatatgtgt

SEQ ID NO: 2584400 - DNA, 21 bp, Homo sapiens
tcattgtatatatgtgtgttt

SEQ ID NO: 2584401 - DNA, 14 bp, Homo sapiens
tcattgtatgatgt

SEQ ID NO: 2584402 - DNA, 18 bp, Homo sapiens
tcattgtatgatgtgttg

SEQ ID NO: 2584403 - DNA, 16 bp, Homo sapiens
tcatttaaaatgatta

SEQ ID NO: 2584404 - DNA, 17 bp, Homo sapiens
tcatttaaaatgattag

SEQ ID NO: 2584405 - DNA, 19 bp, Homo sapiens
tcatttagattgaaaactt

SEQ ID NO: 2584406 - DNA, 15 bp, Homo sapiens
tcatttatgaaaaga

SEQ ID NO: 2584407 - DNA, 19 bp, Homo sapiens
tcatttcattgtatgatgt

SEQ ID NO: 2584408 - DNA, 22 bp, Homo sapiens
tcatttcctatgtaactgcatt

SEQ ID NO: 2584409 - DNA, 21 bp, Homo sapiens
tcatttctatttctcctccat

SEQ ID NO: 2584410 - DNA, 16 bp, Homo sapiens
tcatttgaacaactag

SEQ ID NO: 2584411 - DNA, 19 bp, Homo sapiens
tcatttgagcagggctcag

SEQ ID NO: 2584412 - DNA, 20 bp, Homo sapiens
tcatttgctaactagcttgg

SEQ ID NO: 2584413 - DNA, 15 bp, Homo sapiens
tcattttccccccac

SEQ ID NO: 2584414 - DNA, 15 bp, Homo sapiens
tcattttctgcattt

SEQ ID NO: 2584415 - DNA, 21 bp, Homo sapiens
tcattttcttatcttctgcaa

SEQ ID NO: 2584416 - DNA, 16 bp, Homo sapiens
tcattttgcattcaaa

SEQ ID NO: 2584417 - DNA, 19 bp, Homo sapiens
tcatttttagtagagacag

SEQ ID NO: 2584418 - DNA, 12 bp, Homo sapiens
tcatttttgtac

SEQ ID NO: 2584419 - DNA, 21 bp, Homo sapiens
tcatttttgtacagtttgctg

SEQ ID NO: 2584420 - DNA, 20 bp, Homo sapiens
tcatttttgtttctacctcc

SEQ ID NO: 2584421 - DNA, 17 bp, Homo sapiens
tcattttttttaagaaa

SEQ ID NO: 2584422 - DNA, 15 bp, Homo sapiens
tccaaaactcctgcc

SEQ ID NO: 2584423 - DNA, 20 bp, Homo sapiens
tccaaaagattgctgaaatt

SEQ ID NO: 2584424 - DNA, 22 bp, Homo sapiens
tccaaaagattgctgaaatttt

SEQ ID NO: 2584425 - DNA, 13 bp, Homo sapiens
tccaaaagctttt

SEQ ID NO: 2584426 - DNA, 17 bp, Homo sapiens
tccaaaataaaactttt

SEQ ID NO: 2584427 - DNA, 23 bp, Homo sapiens
tccaaaatttgaaatattaaaat

SEQ ID NO: 2584428 - DNA, 14 bp, Homo sapiens
tccaaagaaatgta

SEQ ID NO: 2584429 - DNA, 17 bp, Homo sapiens
tccaaagaaatgtaagg

SEQ ID NO: 2584430 - DNA, 13 bp, Homo sapiens
tccaaagcagggt

SEQ ID NO: 2584431 - DNA, 21 bp, Homo sapiens
tccaaaggccatggagagctg

SEQ ID NO: 2584432 - DNA, 22 bp, Homo sapiens
tccaaaggccatggagagctgg

SEQ ID NO: 2584433 - DNA, 23 bp, Homo sapiens
tccaaaggccatggagagctgga

SEQ ID NO: 2584434 - DNA, 10 bp, Homo sapiens
tccaaataaa

SEQ ID NO: 2584435 - DNA, 17 bp, Homo sapiens
tccaaataaaaactaaa

SEQ ID NO: 2584436 - DNA, 18 bp, Homo sapiens
tccaaataaaaactaaat

SEQ ID NO: 2584437 - DNA, 16 bp, Homo sapiens
tccaaatgaatgacct

SEQ ID NO: 2584438 - DNA, 20 bp, Homo sapiens
tccaaatgaatgttgtctgt

SEQ ID NO: 2584439 - DNA, 19 bp, Homo sapiens
tccaaatgtcctccagaag

SEQ ID NO: 2584440 - DNA, 20 bp, Homo sapiens
tccaaatgtcctccagaagc

SEQ ID NO: 2584441 - DNA, 22 bp, Homo sapiens
tccaacaccacagacacacaca

SEQ ID NO: 2584442 - DNA, 13 bp, Homo sapiens
tccaacagtgagt

SEQ ID NO: 2584443 - DNA, 15 bp, Homo sapiens
tccaacccatgatga

SEQ ID NO: 2584444 - DNA, 17 bp, Homo sapiens
tccaaccccccacctgc

SEQ ID NO: 2584445 - DNA, 14 bp, Homo sapiens
tccaaccctcatca

SEQ ID NO: 2584446 - DNA, 16 bp, Homo sapiens
tccaaccctcatcacc

SEQ ID NO: 2584447 - DNA, 17 bp, Homo sapiens
tccaaccctcatcacca

SEQ ID NO: 2584448 - DNA, 15 bp, Homo sapiens
tccaactaatgcctt

SEQ ID NO: 2584449 - DNA, 13 bp, Homo sapiens
tccaactccagga

SEQ ID NO: 2584450 - DNA, 15 bp, Homo sapiens
tccaagaagcccagg

SEQ ID NO: 2584451 - DNA, 12 bp, Homo sapiens
tccaagaatcta

SEQ ID NO: 2584452 - DNA, 18 bp, Homo sapiens
tccaagaatctatctgct

SEQ ID NO: 2584453 - DNA, 19 bp, Homo sapiens
tccaagaatctatctgctt

SEQ ID NO: 2584454 - DNA, 17 bp, Homo sapiens
tccaagaatgctgaaac

SEQ ID NO: 2584455 - DNA, 11 bp, Homo sapiens
tccaagctggt

SEQ ID NO: 2584456 - DNA, 12 bp, Homo sapiens
tccaagcttttg

SEQ ID NO: 2584457 - DNA, 15 bp, Homo sapiens
tccaaggagaaacag

SEQ ID NO: 2584458 - DNA, 20 bp, Homo sapiens
tccaaggaggggctgtaaaa

SEQ ID NO: 2584459 - DNA, 16 bp, Homo sapiens
tccaaggcagaagcag

SEQ ID NO: 2584460 - DNA, 18 bp, Homo sapiens
tccaagtgccagaggtgg

SEQ ID NO: 2584461 - DNA, 16 bp, Homo sapiens
tccctctgaggctgta

SEQ ID NO: 2584462 - DNA, 11 bp, Homo sapiens
tccctctgcct

SEQ ID NO: 2584463 - DNA, 16 bp, Homo sapiens
tccctctgcctgtccc

SEQ ID NO: 2584464 - DNA, 18 bp, Homo sapiens
tccctctgctcctggagc

SEQ ID NO: 2584465 - DNA, 18 bp, Homo sapiens
tccctctttggctcccct

SEQ ID NO: 2584466 - DNA, 23 bp, Homo sapiens
tccctctttggctcccctgtacc

SEQ ID NO: 2584467 - DNA, 15 bp, Homo sapiens
tccctgaaggccccg

SEQ ID NO: 2584468 - DNA, 18 bp, Homo sapiens
tccctgaaggccccgccc

SEQ ID NO: 2584469 - DNA, 21 bp, Homo sapiens
tccctgaaggccccgcccagg

SEQ ID NO: 2584470 - DNA, 22 bp, Homo sapiens
tccctgaaggccccgcccaggc

SEQ ID NO: 2584471 - DNA, 23 bp, Homo sapiens
tccctgaaggccccgcccaggct

SEQ ID NO: 2584472 - DNA, 21 bp, Homo sapiens
tccctgaatcccccttgccac

SEQ ID NO: 2584473 - DNA, 14 bp, Homo sapiens
tccctgacccgtct

SEQ ID NO: 2584474 - DNA, 17 bp, Homo sapiens
tccctgacctccctcta

SEQ ID NO: 2584475 - DNA, 18 bp, Homo sapiens
tccctgactctctgtgac

SEQ ID NO: 2584476 - DNA, 15 bp, Homo sapiens
tccctgactgggagt

SEQ ID NO: 2584477 - DNA, 11 bp, Homo sapiens
tccctgagcag

SEQ ID NO: 2584478 - DNA, 21 bp, Homo sapiens
tccctgataacaacctggaga

SEQ ID NO: 2584479 - DNA, 17 bp, Homo sapiens
tccctgcatttctgagt

SEQ ID NO: 2584480 - DNA, 14 bp, Homo sapiens
tccctgccaatgga

SEQ ID NO: 2584481 - DNA, 13 bp, Homo sapiens
tccctgccagctc

SEQ ID NO: 2584482 - DNA, 17 bp, Homo sapiens
tccctgcctctcatcaa

SEQ ID NO: 2584483 - DNA, 17 bp, Homo sapiens
tccctgctccacgtctg

SEQ ID NO: 2584484 - DNA, 19 bp, Homo sapiens
tccctgctgtcgtcttagc

SEQ ID NO: 2584485 - DNA, 16 bp, Homo sapiens
tccctgctgtgttccc

SEQ ID NO: 2584486 - DNA, 22 bp, Homo sapiens
tccctggagccagactctggtc

SEQ ID NO: 2584487 - DNA, 11 bp, Homo sapiens
tccctggagtg

SEQ ID NO: 2584488 - DNA, 13 bp, Homo sapiens
tccctggcctgtt

SEQ ID NO: 2584489 - DNA, 14 bp, Homo sapiens
tccctggcctgttc

SEQ ID NO: 2584490 - DNA, 19 bp, Homo sapiens
tccctggctctcagaaggt

SEQ ID NO: 2584491 - DNA, 16 bp, Homo sapiens
tccctggctgccctgg

SEQ ID NO: 2584492 - DNA, 20 bp, Homo sapiens
tccctggctgccctggccct

SEQ ID NO: 2584493 - DNA, 19 bp, Homo sapiens
tccctgggaggaaatttga

SEQ ID NO: 2584494 - DNA, 17 bp, Homo sapiens
tccctgggcattgcttt

SEQ ID NO: 2584495 - DNA, 18 bp, Homo sapiens
tccctgggcattgctttc

SEQ ID NO: 2584496 - DNA, 14 bp, Homo sapiens
tccctggggtgggg

SEQ ID NO: 2584497 - DNA, 15 bp, Homo sapiens
tccctggtggcagct

SEQ ID NO: 2584498 - DNA, 18 bp, Homo sapiens
tccctggtggcagctcac

SEQ ID NO: 2584499 - DNA, 19 bp, Homo sapiens
tccctgtaacctcttcaga

SEQ ID NO: 2584500 - DNA, 21 bp, Homo sapiens
tccctgtaattgttgtttgta

SEQ ID NO: 2584501 - DNA, 21 bp, Homo sapiens
tccctgtattttctttctcta

SEQ ID NO: 2584502 - DNA, 20 bp, Homo sapiens
tccctgtgctgacggaagcc

SEQ ID NO: 2584503 - DNA, 11 bp, Homo sapiens
tccctgtttaa

SEQ ID NO: 2584504 - DNA, 18 bp, Homo sapiens
tccctgtttaatatttaa

SEQ ID NO: 2584505 - DNA, 22 bp, Homo sapiens
tccctgttttctgagcccgggc

SEQ ID NO: 2584506 - DNA, 23 bp, Homo sapiens
tccctgttttctgagcccgggct

SEQ ID NO: 2584507 - DNA, 15 bp, Homo sapiens
tcccttaaacaaaaa

SEQ ID NO: 2584508 - DNA, 16 bp, Homo sapiens
tcccttcagtaccctc

SEQ ID NO: 2584509 - DNA, 19 bp, Homo sapiens
tcccttcagtaccctctca

SEQ ID NO: 2584510 - DNA, 23 bp, Homo sapiens
tcccttcagtaccctctcagctc

SEQ ID NO: 2584511 - DNA, 13 bp, Homo sapiens
tcccttcatctcc

SEQ ID NO: 2584512 - DNA, 18 bp, Homo sapiens
tcccttcatctccaggga

SEQ ID NO: 2584513 - DNA, 16 bp, Homo sapiens
tcccttccacaccccc

SEQ ID NO: 2584514 - DNA, 14 bp, Homo sapiens
tcccttcccacctc

SEQ ID NO: 2584515 - DNA, 16 bp, Homo sapiens
tcccttcccataagct

SEQ ID NO: 2584516 - DNA, 12 bp, Homo sapiens
tcccttcccctc

SEQ ID NO: 2584517 - DNA, 20 bp, Homo sapiens
tcccttcccctccctggctc

SEQ ID NO: 2584518 - DNA, 15 bp, Homo sapiens
tcccttctacctgcc

SEQ ID NO: 2584519 - DNA, 16 bp, Homo sapiens
tcccttctccatctct

SEQ ID NO: 2584520 - DNA, 23 bp, Homo sapiens
tcccttctctgtagggaactctg

SEQ ID NO: 2584521 - DNA, 13 bp, Homo sapiens
tcccttcttggtt

SEQ ID NO: 2584522 - DNA, 12 bp, Homo sapiens
tcccttggcctc

SEQ ID NO: 2584523 - DNA, 15 bp, Homo sapiens
tcccttgtgtgtgtg

SEQ ID NO: 2584524 - DNA, 18 bp, Homo sapiens
tcccttgttctctaagtt

SEQ ID NO: 2584525 - DNA, 22 bp, Homo sapiens
tccctttccaaatgcccagctt

SEQ ID NO: 2584526 - DNA, 14 bp, Homo sapiens
tccctttccttcca

SEQ ID NO: 2584527 - DNA, 13 bp, Homo sapiens
tccctttcttggc

SEQ ID NO: 2584528 - DNA, 17 bp, Homo sapiens
tccctttgcccagaaag

SEQ ID NO: 2584529 - DNA, 17 bp, Homo sapiens
tccctttttccttgtcc

SEQ ID NO: 2584530 - DNA, 17 bp, Homo sapiens
tcccttttttggctgct

SEQ ID NO: 2584531 - DNA, 22 bp, Homo sapiens
tcccttttttggctgctgaagg

SEQ ID NO: 2584532 - DNA, 21 bp, Homo sapiens
tccgaagtatgagggaaaatg

SEQ ID NO: 2584533 - DNA, 13 bp, Homo sapiens
tccgaccagacac

SEQ ID NO: 2584534 - DNA, 21 bp, Homo sapiens
tccgagccggggagtttcttt

SEQ ID NO: 2584535 - DNA, 20 bp, Homo sapiens
tccgaggggcgggacccagg

SEQ ID NO: 2584536 - DNA, 23 bp, Homo sapiens
tccgaggggcgggacccaggcac

SEQ ID NO: 2584537 - DNA, 13 bp, Homo sapiens
tccgccagggccc

SEQ ID NO: 2584538 - DNA, 19 bp, Homo sapiens
tccgccctgctcctccctg

SEQ ID NO: 2584539 - DNA, 22 bp, Homo sapiens
tccgccctgctcctccctggct

SEQ ID NO: 2584540 - DNA, 20 bp, Homo sapiens
tccgctcatacaggaatgaa

SEQ ID NO: 2584541 - DNA, 12 bp, Homo sapiens
tccgctggaggt

SEQ ID NO: 2584542 - DNA, 16 bp, Homo sapiens
tccgctttctacccag

SEQ ID NO: 2584543 - DNA, 15 bp, Homo sapiens
tccggagtagctggg

SEQ ID NO: 2584544 - DNA, 21 bp, Homo sapiens
tccggagtgagaagctttgcc

SEQ ID NO: 2584545 - DNA, 23 bp, Homo sapiens
tccggattggcttgtgtgtttca

SEQ ID NO: 2584546 - DNA, 21 bp, Homo sapiens
tccggccctcctaccctgcgc

SEQ ID NO: 2584547 - DNA, 16 bp, Homo sapiens
tccggcgtcagcctcc

SEQ ID NO: 2584548 - DNA, 22 bp, Homo sapiens
tccggcgtcagcctccagcctc

SEQ ID NO: 2584549 - DNA, 14 bp, Homo sapiens
tccggctcctgtgc

SEQ ID NO: 2584550 - DNA, 22 bp, Homo sapiens
tccggctcctgtgctttccctg

SEQ ID NO: 2584551 - DNA, 17 bp, Homo sapiens
tccggtccctgtcccag

SEQ ID NO: 2584552 - DNA, 18 bp, Homo sapiens
tccggtcgtgtctctggt

SEQ ID NO: 2584553 - DNA, 19 bp, Homo sapiens
tccggtgtgcctgcagccc

SEQ ID NO: 2584554 - DNA, 16 bp, Homo sapiens
tccgtaacccaactct

SEQ ID NO: 2584555 - DNA, 13 bp, Homo sapiens
tccgtatttcaga

SEQ ID NO: 2584556 - DNA, 20 bp, Homo sapiens
tccgtctaagtcatgagctg

SEQ ID NO: 2584557 - DNA, 23 bp, Homo sapiens
tccgtctagttaacatttcaagg

SEQ ID NO: 2584558 - DNA, 16 bp, Homo sapiens
tccgtgcctccaccac

SEQ ID NO: 2584559 - DNA, 15 bp, Homo sapiens
tccgttaaaatacca

SEQ ID NO: 2584560 - DNA, 17 bp, Homo sapiens
tcctaaaataagggcag

SEQ ID NO: 2584561 - DNA, 17 bp, Homo sapiens
tcctaaggacacactaa

SEQ ID NO: 2584562 - DNA, 18 bp, Homo sapiens
tcctaataaagttctgta

SEQ ID NO: 2584563 - DNA, 14 bp, Homo sapiens
tcctaatcatccaa

SEQ ID NO: 2584564 - DNA, 14 bp, Homo sapiens
tcctacaaagatgt

SEQ ID NO: 2584565 - DNA, 22 bp, Homo sapiens
tcctacaagagcagcctgtggc

SEQ ID NO: 2584566 - DNA, 16 bp, Homo sapiens
tcctacacctaactca

SEQ ID NO: 2584567 - DNA, 13 bp, Homo sapiens
tcctacagcccct

SEQ ID NO: 2584568 - DNA, 20 bp, Homo sapiens
tcctacattaattatctagt

SEQ ID NO: 2584569 - DNA, 20 bp, Homo sapiens
tcctaccaatagattcccca

SEQ ID NO: 2584570 - DNA, 16 bp, Homo sapiens
tcctacccaaccactc

SEQ ID NO: 2584571 - DNA, 18 bp, Homo sapiens
tcctacccaccctccttt

SEQ ID NO: 2584572 - DNA, 16 bp, Homo sapiens
tcctaccccaattcct

SEQ ID NO: 2584573 - DNA, 15 bp, Homo sapiens
tcctaccctgcgccc

SEQ ID NO: 2584574 - DNA, 17 bp, Homo sapiens
tcctacctcagcctaga

SEQ ID NO: 2584575 - DNA, 22 bp, Homo sapiens
tcctagaaattccccaccctga

SEQ ID NO: 2584576 - DNA, 17 bp, Homo sapiens
tcctagagaacgcagcc

SEQ ID NO: 2584577 - DNA, 17 bp, Homo sapiens
tcctagcacacactttt

SEQ ID NO: 2584578 - DNA, 15 bp, Homo sapiens
tcctagcagagagac

SEQ ID NO: 2584579 - DNA, 19 bp, Homo sapiens
tcctagccttatcctctga

SEQ ID NO: 2584580 - DNA, 21 bp, Homo sapiens
tcctagcttgggaggcttccc

SEQ ID NO: 2584581 - DNA, 14 bp, Homo sapiens
tcctaggaaaatac

SEQ ID NO: 2584582 - DNA, 18 bp, Homo sapiens
tcctaggagtatcctcat

SEQ ID NO: 2584583 - DNA, 13 bp, Homo sapiens
tcctaggcatttg

SEQ ID NO: 2584584 - DNA, 14 bp, Homo sapiens
tcctagtgaaagag

SEQ ID NO: 2584585 - DNA, 12 bp, Homo sapiens
tcctagttccac

SEQ ID NO: 2584586 - DNA, 14 bp, Homo sapiens
tcctagttccacca

SEQ ID NO: 2584587 - DNA, 21 bp, Homo sapiens
tcctagttccaccatcaagcc

SEQ ID NO: 2584588 - DNA, 22 bp, Homo sapiens
tcctagttccaccatcaagcca

SEQ ID NO: 2584589 - DNA, 20 bp, Homo sapiens
tcctagttttctcctcccag

SEQ ID NO: 2584590 - DNA, 20 bp, Homo sapiens
tcctataattccctatcttt

SEQ ID NO: 2584591 - DNA, 19 bp, Homo sapiens
tcctatacgcagcgtgctt

SEQ ID NO: 2584592 - DNA, 23 bp, Homo sapiens
tcctatattgttttcagtgtaca

SEQ ID NO: 2584593 - DNA, 22 bp, Homo sapiens
tcctatcagcctgtctcttcca

SEQ ID NO: 2584594 - DNA, 18 bp, Homo sapiens
tcctatgtttttgttcaa

SEQ ID NO: 2584595 - DNA, 23 bp, Homo sapiens
tcctattcagttcccagaatcaa

SEQ ID NO: 2584596 - DNA, 17 bp, Homo sapiens
tcctattgtcattaaag

SEQ ID NO: 2584597 - DNA, 18 bp, Homo sapiens
tcctattgtgatttgact

SEQ ID NO: 2584598 - DNA, 20 bp, Homo sapiens
tcctattgtgatttgactgt

SEQ ID NO: 2584599 - DNA, 18 bp, Homo sapiens
tcctatttggggcttgca

SEQ ID NO: 2584600 - DNA, 14 bp, Homo sapiens
tcctatttgttttc

SEQ ID NO: 2584601 - DNA, 17 bp, Homo sapiens
tcctcaacacccaactg

SEQ ID NO: 2584602 - DNA, 18 bp, Homo sapiens
tcctcaagtccccaagat

SEQ ID NO: 2584603 - DNA, 12 bp, Homo sapiens
tcctcaatccag

SEQ ID NO: 2584604 - DNA, 14 bp, Homo sapiens
tcctcaccacatgc

SEQ ID NO: 2584605 - DNA, 22 bp, Homo sapiens
tctccccacactaacctgggtt

SEQ ID NO: 2584606 - DNA, 11 bp, Homo sapiens
tctcccctcaa

SEQ ID NO: 2584607 - DNA, 23 bp, Homo sapiens
tctcccctcaaagtctgcaactt

SEQ ID NO: 2584608 - DNA, 15 bp, Homo sapiens
tctcccctgccctgc

SEQ ID NO: 2584609 - DNA, 20 bp, Homo sapiens
tctcccggaggttgggtggg

SEQ ID NO: 2584610 - DNA, 23 bp, Homo sapiens
tctccctcacagcacagagaaga

SEQ ID NO: 2584611 - DNA, 17 bp, Homo sapiens
tctccctctcactgtct

SEQ ID NO: 2584612 - DNA, 15 bp, Homo sapiens
tctccctcttctcaa

SEQ ID NO: 2584613 - DNA, 11 bp, Homo sapiens
tctcccttgga

SEQ ID NO: 2584614 - DNA, 18 bp, Homo sapiens
tctcccttggattgtccc

SEQ ID NO: 2584615 - DNA, 17 bp, Homo sapiens
tctccgaccagacacct

SEQ ID NO: 2584616 - DNA, 20 bp, Homo sapiens
tctcctcaagtccccaagat

SEQ ID NO: 2584617 - DNA, 14 bp, Homo sapiens
tctcctcagcctcc

SEQ ID NO: 2584618 - DNA, 16 bp, Homo sapiens
tctcctcatgttctgc

SEQ ID NO: 2584619 - DNA, 17 bp, Homo sapiens
tctcctccatactcagg

SEQ ID NO: 2584620 - DNA, 16 bp, Homo sapiens
tctcctccatgggaga

SEQ ID NO: 2584621 - DNA, 15 bp, Homo sapiens
tctcctccccacccg

SEQ ID NO: 2584622 - DNA, 14 bp, Homo sapiens
tctcctcctgccca

SEQ ID NO: 2584623 - DNA, 16 bp, Homo sapiens
tctcctcgcaagctgg

SEQ ID NO: 2584624 - DNA, 14 bp, Homo sapiens
tctcctctgctgct

SEQ ID NO: 2584625 - DNA, 23 bp, Homo sapiens
tctcctcttaaaaaataaaaact

SEQ ID NO: 2584626 - DNA, 15 bp, Homo sapiens
tctcctgcctcagcc

SEQ ID NO: 2584627 - DNA, 17 bp, Homo sapiens
tctcctgcctcagcctc

SEQ ID NO: 2584628 - DNA, 17 bp, Homo sapiens
tctcctggaggattgca

SEQ ID NO: 2584629 - DNA, 13 bp, Homo sapiens
tctcctgtacctc

SEQ ID NO: 2584630 - DNA, 15 bp, Homo sapiens
tctcctgtacctctt

SEQ ID NO: 2584631 - DNA, 17 bp, Homo sapiens
tctcctgtgcatgggtg

SEQ ID NO: 2584632 - DNA, 17 bp, Homo sapiens
tctcctgtgcccacatc

SEQ ID NO: 2584633 - DNA, 17 bp, Homo sapiens
tctcctgtttttctggg

SEQ ID NO: 2584634 - DNA, 19 bp, Homo sapiens
tctcctgtttttctgggtg

SEQ ID NO: 2584635 - DNA, 14 bp, Homo sapiens
tctccttgtggcct

SEQ ID NO: 2584636 - DNA, 21 bp, Homo sapiens
tctccttgtgttactaagttt

SEQ ID NO: 2584637 - DNA, 20 bp, Homo sapiens
tctcctttctttttcttctt

SEQ ID NO: 2584638 - DNA, 23 bp, Homo sapiens
tctcctttgataaaataaatgag

SEQ ID NO: 2584639 - DNA, 14 bp, Homo sapiens
tctcctttgtatat

SEQ ID NO: 2584640 - DNA, 17 bp, Homo sapiens
tctccttttcctctctc

SEQ ID NO: 2584641 - DNA, 19 bp, Homo sapiens
tctccttttcctctctccc

SEQ ID NO: 2584642 - DNA, 23 bp, Homo sapiens
tctcgaacatggaactcattcct

SEQ ID NO: 2584643 - DNA, 15 bp, Homo sapiens
tctcgctctgtcacc

SEQ ID NO: 2584644 - DNA, 17 bp, Homo sapiens
tctcggaaggctggctg

SEQ ID NO: 2584645 - DNA, 21 bp, Homo sapiens
tctcggctccccatgtgtcct

SEQ ID NO: 2584646 - DNA, 14 bp, Homo sapiens
tctcgtttcaaaaa

SEQ ID NO: 2584647 - DNA, 18 bp, Homo sapiens
tctctaactcagaaacat

SEQ ID NO: 2584648 - DNA, 20 bp, Homo sapiens
tctctaactcagaaacatca

SEQ ID NO: 2584649 - DNA, 22 bp, Homo sapiens
tctctaactcagaaacatcagt

SEQ ID NO: 2584650 - DNA, 12 bp, Homo sapiens
tctctaacttca

SEQ ID NO: 2584651 - DNA, 22 bp, Homo sapiens
tctctaacttcaaggcccatat

SEQ ID NO: 2584652 - DNA, 21 bp, Homo sapiens
tctctaagttccactgagctc

SEQ ID NO: 2584653 - DNA, 11 bp, Homo sapiens
tctctaatatg

SEQ ID NO: 2584654 - DNA, 19 bp, Homo sapiens
tctctactcctacctcagc

SEQ ID NO: 2584655 - DNA, 13 bp, Homo sapiens
tctctagaatttt

SEQ ID NO: 2584656 - DNA, 14 bp, Homo sapiens
tctctaggctgggg

SEQ ID NO: 2584657 - DNA, 16 bp, Homo sapiens
tctctagtgctgtgaa

SEQ ID NO: 2584658 - DNA, 17 bp, Homo sapiens
tctctagtgctgtgaaa

SEQ ID NO: 2584659 - DNA, 19 bp, Homo sapiens
tctctagtttgattaaatt

SEQ ID NO: 2584660 - DNA, 16 bp, Homo sapiens
tctctatagcaccagg

SEQ ID NO: 2584661 - DNA, 15 bp, Homo sapiens
tctctatttaatatt

SEQ ID NO: 2584662 - DNA, 20 bp, Homo sapiens
tctctcaatatgcttacaaa

SEQ ID NO: 2584663 - DNA, 15 bp, Homo sapiens
tctctcaggagcaca

SEQ ID NO: 2584664 - DNA, 16 bp, Homo sapiens
tctctcattgtctgtg

SEQ ID NO: 2584665 - DNA, 18 bp, Homo sapiens
tctctccagcccctggat

SEQ ID NO: 2584666 - DNA, 14 bp, Homo sapiens
tctctccattcccg

SEQ ID NO: 2584667 - DNA, 23 bp, Homo sapiens
tctctcccagtctacccagagaa

SEQ ID NO: 2584668 - DNA, 13 bp, Homo sapiens
tctctcccctcaa

SEQ ID NO: 2584669 - DNA, 20 bp, Homo sapiens
tctctccctccctttgaaat

SEQ ID NO: 2584670 - DNA, 11 bp, Homo sapiens
tctctcctcct

SEQ ID NO: 2584671 - DNA, 16 bp, Homo sapiens
tctctcctgtacctct

SEQ ID NO: 2584672 - DNA, 17 bp, Homo sapiens
tctctcctgtacctctt

SEQ ID NO: 2584673 - DNA, 22 bp, Homo sapiens
tctctcctttctttttcttctt

SEQ ID NO: 2584674 - DNA, 14 bp, Homo sapiens
tctctcctttgctg

SEQ ID NO: 2584675 - DNA, 20 bp, Homo sapiens
tctctcgtaactggtttcat

SEQ ID NO: 2584676 - DNA, 19 bp, Homo sapiens
tctctctactcctacctca

SEQ ID NO: 2584677 - DNA, 22 bp, Homo sapiens
tctctctactcctacctcagcc

SEQ ID NO: 2584678 - DNA, 18 bp, Homo sapiens
tctctctcccatggagcc

SEQ ID NO: 2584679 - DNA, 13 bp, Homo sapiens
tctctctctacaa

SEQ ID NO: 2584680 - DNA, 12 bp, Homo sapiens
tctctctggccc

SEQ ID NO: 2584681 - DNA, 20 bp, Homo sapiens
tctctctggggccacacaga

SEQ ID NO: 2584682 - DNA, 17 bp, Homo sapiens
tctctctgtgctgtgga

SEQ ID NO: 2584683 - DNA, 11 bp, Homo sapiens
tctctctgtgg

SEQ ID NO: 2584684 - DNA, 20 bp, Homo sapiens
tctctcttctgctccaccct

SEQ ID NO: 2584685 - DNA, 13 bp, Homo sapiens
tctctgaagatga

SEQ ID NO: 2584686 - DNA, 11 bp, Homo sapiens
tctctgaaggg

SEQ ID NO: 2584687 - DNA, 16 bp, Homo sapiens
tctctgaagggaggtg

SEQ ID NO: 2584688 - DNA, 14 bp, Homo sapiens
tctctgagcagtga

SEQ ID NO: 2584689 - DNA, 14 bp, Homo sapiens
tctctgaggacact

SEQ ID NO: 2584690 - DNA, 17 bp, Homo sapiens
tctctgaggacactaac

SEQ ID NO: 2584691 - DNA, 13 bp, Homo sapiens
tctctgcatctga

SEQ ID NO: 2584692 - DNA, 16 bp, Homo sapiens
tctctgcatctgacca

SEQ ID NO: 2584693 - DNA, 11 bp, Homo sapiens
tctctgccctc

SEQ ID NO: 2584694 - DNA, 23 bp, Homo sapiens
tctctgcctccctcaccctgagc

SEQ ID NO: 2584695 - DNA, 12 bp, Homo sapiens
tctctgctccac

SEQ ID NO: 2584696 - DNA, 21 bp, Homo sapiens
tctctgctctgcgtgtcacct

SEQ ID NO: 2584697 - DNA, 22 bp, Homo sapiens
tctctgctctgcgtgtcacctg

SEQ ID NO: 2584698 - DNA, 22 bp, Homo sapiens
tctctggagccaagtccagatt

SEQ ID NO: 2584699 - DNA, 15 bp, Homo sapiens
tctctggccccaagg

SEQ ID NO: 2584700 - DNA, 17 bp, Homo sapiens
tctctggccttttccta

SEQ ID NO: 2584701 - DNA, 16 bp, Homo sapiens
tctctggcgacagttt

SEQ ID NO: 2584702 - DNA, 22 bp, Homo sapiens
tctctggcgacagttttccttc

SEQ ID NO: 2584703 - DNA, 18 bp, Homo sapiens
tctctgtagggaactctg

SEQ ID NO: 2584704 - DNA, 14 bp, Homo sapiens
tctctgtctcatcc

SEQ ID NO: 2584705 - DNA, 18 bp, Homo sapiens
tctcttaatttaatcttt

SEQ ID NO: 2584706 - DNA, 22 bp, Homo sapiens
tctcttacgcccaacccttccc

SEQ ID NO: 2584707 - DNA, 13 bp, Homo sapiens
tctcttactgcaa

SEQ ID NO: 2584708 - DNA, 15 bp, Homo sapiens
tctcttactgcaaat

SEQ ID NO: 2584709 - DNA, 15 bp, Homo sapiens
tctcttcaggttctt

SEQ ID NO: 2584710 - DNA, 23 bp, Homo sapiens
tctcttcaggttcttagtgtcac

SEQ ID NO: 2584711 - DNA, 11 bp, Homo sapiens
tctcttcctgt

SEQ ID NO: 2584712 - DNA, 19 bp, Homo sapiens
tctcttctgctccaccctt

SEQ ID NO: 2584713 - DNA, 13 bp, Homo sapiens
tctcttctttaaa

SEQ ID NO: 2584714 - DNA, 14 bp, Homo sapiens
tctcttgagcctgg

SEQ ID NO: 2584715 - DNA, 18 bp, Homo sapiens
tctcttgagcctgggagg

SEQ ID NO: 2584716 - DNA, 12 bp, Homo sapiens
tctcttgcaccc

SEQ ID NO: 2584717 - DNA, 22 bp, Homo sapiens
tctcttgcacccgcctctcccg

SEQ ID NO: 2584718 - DNA, 16 bp, Homo sapiens
tctctttaatcttcag

SEQ ID NO: 2584719 - DNA, 22 bp, Homo sapiens
tctctttaatgtcacaggcagg

SEQ ID NO: 2584720 - DNA, 17 bp, Homo sapiens
tctctttgttctaaaga

SEQ ID NO: 2584721 - DNA, 12 bp, Homo sapiens
tctcttttctct

SEQ ID NO: 2584722 - DNA, 18 bp, Homo sapiens
tctcttttctttagagca

SEQ ID NO: 2584723 - DNA, 20 bp, Homo sapiens
tctcttttctttagagcatt

SEQ ID NO: 2584724 - DNA, 14 bp, Homo sapiens
tctctttttgactc

SEQ ID NO: 2584725 - DNA, 13 bp, Homo sapiens
tctctttttggag

SEQ ID NO: 2584726 - DNA, 19 bp, Homo sapiens
tctctttttggaggtgctt

SEQ ID NO: 2584727 - DNA, 20 bp, Homo sapiens
tctctttttggaggtgctta

SEQ ID NO: 2584728 - DNA, 13 bp, Homo sapiens
tctgaaaatataa

SEQ ID NO: 2584729 - DNA, 15 bp, Homo sapiens
tctgaaaccagtgtt

SEQ ID NO: 2584730 - DNA, 12 bp, Homo sapiens
tctgaaatctga

SEQ ID NO: 2584731 - DNA, 12 bp, Homo sapiens
tctgaagggagg

SEQ ID NO: 2584732 - DNA, 20 bp, Homo sapiens
tctgaagtcacatcacagga

SEQ ID NO: 2584733 - DNA, 16 bp, Homo sapiens
tctgaataacatttgt

SEQ ID NO: 2584734 - DNA, 13 bp, Homo sapiens
tctgaatcctaag

SEQ ID NO: 2584735 - DNA, 16 bp, Homo sapiens
tctgaatgctgctact

SEQ ID NO: 2584736 - DNA, 22 bp, Homo sapiens
tctgaatgttctgacattaaca

SEQ ID NO: 2584737 - DNA, 17 bp, Homo sapiens
tctgacacacagctctg

SEQ ID NO: 2584738 - DNA, 19 bp, Homo sapiens
tctgacacacagctctgtc

SEQ ID NO: 2584739 - DNA, 16 bp, Homo sapiens
tctgacagaaagcaga

SEQ ID NO: 2584740 - DNA, 12 bp, Homo sapiens
tctgacaggcaa

SEQ ID NO: 2584741 - DNA, 16 bp, Homo sapiens
tctgacattaacagtt

SEQ ID NO: 2584742 - DNA, 13 bp, Homo sapiens
tctgacattctca

SEQ ID NO: 2584743 - DNA, 21 bp, Homo sapiens
tctgacattctcaggaagccc

SEQ ID NO: 2584744 - DNA, 13 bp, Homo sapiens
tctgaccacactt

SEQ ID NO: 2584745 - DNA, 15 bp, Homo sapiens
tctgacccactgctt

SEQ ID NO: 2584746 - DNA, 20 bp, Homo sapiens
tctgacccatgctgccctgt

SEQ ID NO: 2584747 - DNA, 21 bp, Homo sapiens
tctgaccgaaacagcgctggg

SEQ ID NO: 2584748 - DNA, 20 bp, Homo sapiens
tctgacgtgccttttgcacc

SEQ ID NO: 2584749 - DNA, 16 bp, Homo sapiens
tctgactcacaagaag

SEQ ID NO: 2584750 - DNA, 15 bp, Homo sapiens
tctgactcagggctc

SEQ ID NO: 2584751 - DNA, 22 bp, Homo sapiens
tcttggcacatttaagagacag

SEQ ID NO: 2584752 - DNA, 18 bp, Homo sapiens
tcttggcggcagcagcca

SEQ ID NO: 2584753 - DNA, 19 bp, Homo sapiens
tcttggcttactgcagcct

SEQ ID NO: 2584754 - DNA, 14 bp, Homo sapiens
tcttgggaaatatg

SEQ ID NO: 2584755 - DNA, 11 bp, Homo sapiens
tcttgggccct

SEQ ID NO: 2584756 - DNA, 17 bp, Homo sapiens
tcttggggacatctctt

SEQ ID NO: 2584757 - DNA, 21 bp, Homo sapiens
tcttggggacatctctttgaa

SEQ ID NO: 2584758 - DNA, 16 bp, Homo sapiens
tcttgggtctatgcct

SEQ ID NO: 2584759 - DNA, 17 bp, Homo sapiens
tcttggtcagatttgaa

SEQ ID NO: 2584760 - DNA, 14 bp, Homo sapiens
tcttggtcctgctg

SEQ ID NO: 2584761 - DNA, 17 bp, Homo sapiens
tcttggtcctgctgcag

SEQ ID NO: 2584762 - DNA, 19 bp, Homo sapiens
tcttggtcctgctgcagtt

SEQ ID NO: 2584763 - DNA, 15 bp, Homo sapiens
tcttggtcttcccag

SEQ ID NO: 2584764 - DNA, 21 bp, Homo sapiens
tcttggttcataaatgaattt

SEQ ID NO: 2584765 - DNA, 15 bp, Homo sapiens
tcttggttgaggaaa

SEQ ID NO: 2584766 - DNA, 14 bp, Homo sapiens
tcttggtttgtaaa

SEQ ID NO: 2584767 - DNA, 16 bp, Homo sapiens
tcttgtagtagtctca

SEQ ID NO: 2584768 - DNA, 15 bp, Homo sapiens
tcttgtgaaggcagg

SEQ ID NO: 2584769 - DNA, 21 bp, Homo sapiens
tcttgtgcttttcctatttgt

SEQ ID NO: 2584770 - DNA, 19 bp, Homo sapiens
tcttgtggatgttttaatt

SEQ ID NO: 2584771 - DNA, 22 bp, Homo sapiens
tcttgttgctcaaaaaatgagc

SEQ ID NO: 2584772 - DNA, 20 bp, Homo sapiens
tcttgtttttccactactgc

SEQ ID NO: 2584773 - DNA, 14 bp, Homo sapiens
tctttaatcttcag

SEQ ID NO: 2584774 - DNA, 15 bp, Homo sapiens
tctttaatgtcacag

SEQ ID NO: 2584775 - DNA, 20 bp, Homo sapiens
tctttaatgtcacaggcagg

SEQ ID NO: 2584776 - DNA, 22 bp, Homo sapiens
tctttaatgtcacaggcaggtc

SEQ ID NO: 2584777 - DNA, 13 bp, Homo sapiens
tctttagagcatt

SEQ ID NO: 2584778 - DNA, 14 bp, Homo sapiens
tctttagagcattg

SEQ ID NO: 2584779 - DNA, 17 bp, Homo sapiens
tctttatacaacagtgc

SEQ ID NO: 2584780 - DNA, 21 bp, Homo sapiens
tctttcaaaaccttttgaaat

SEQ ID NO: 2584781 - DNA, 20 bp, Homo sapiens
tctttcaaaggtagccatca

SEQ ID NO: 2584782 - DNA, 22 bp, Homo sapiens
tctttcaaaggtagccatcatg

SEQ ID NO: 2584783 - DNA, 22 bp, Homo sapiens
tctttcaaattgagagaatgga

SEQ ID NO: 2584784 - DNA, 15 bp, Homo sapiens
tctttcaacttgcat

SEQ ID NO: 2584785 - DNA, 20 bp, Homo sapiens
tctttcaagtgaatctaaaa

SEQ ID NO: 2584786 - DNA, 20 bp, Homo sapiens
tctttcacacttccaccagc

SEQ ID NO: 2584787 - DNA, 21 bp, Homo sapiens
tctttcacacttccaccagcc

SEQ ID NO: 2584788 - DNA, 15 bp, Homo sapiens
tctttcacagctcct

SEQ ID NO: 2584789 - DNA, 19 bp, Homo sapiens
tctttcacagctcctccca

SEQ ID NO: 2584790 - DNA, 20 bp, Homo sapiens
tctttcacagctcctcccac

SEQ ID NO: 2584791 - DNA, 19 bp, Homo sapiens
tctttccacggagccactc

SEQ ID NO: 2584792 - DNA, 10 bp, Homo sapiens
tctttccaga

SEQ ID NO: 2584793 - DNA, 19 bp, Homo sapiens
tctttccattatgattctt

SEQ ID NO: 2584794 - DNA, 20 bp, Homo sapiens
tctttccattggatctcatt

SEQ ID NO: 2584795 - DNA, 20 bp, Homo sapiens
tctttccctgcttaatgaaa

SEQ ID NO: 2584796 - DNA, 16 bp, Homo sapiens
tctttcctgaggctgg

SEQ ID NO: 2584797 - DNA, 17 bp, Homo sapiens
tctttcctgaggctggg

SEQ ID NO: 2584798 - DNA, 19 bp, Homo sapiens
tctttctactctgaactaa

SEQ ID NO: 2584799 - DNA, 16 bp, Homo sapiens
tctttctagtggtctt

SEQ ID NO: 2584800 - DNA, 20 bp, Homo sapiens
tctttctagtggtctttgta

SEQ ID NO: 2584801 - DNA, 12 bp, Homo sapiens
tctttctctcct

SEQ ID NO: 2584802 - DNA, 18 bp, Homo sapiens
tctttctgagcacacttt

SEQ ID NO: 2584803 - DNA, 22 bp, Homo sapiens
tctttctgcagaaacagaaagg

SEQ ID NO: 2584804 - DNA, 13 bp, Homo sapiens
tctttctggagtc

SEQ ID NO: 2584805 - DNA, 15 bp, Homo sapiens
tctttcttcctctgc

SEQ ID NO: 2584806 - DNA, 16 bp, Homo sapiens
tctttgaatgacaaag

SEQ ID NO: 2584807 - DNA, 18 bp, Homo sapiens
tctttgagatagaagaac

SEQ ID NO: 2584808 - DNA, 16 bp, Homo sapiens
tctttgataatgttaa

SEQ ID NO: 2584809 - DNA, 17 bp, Homo sapiens
tctttgataatgttaaa

SEQ ID NO: 2584810 - DNA, 21 bp, Homo sapiens
tctttgataatgttaaatttg

SEQ ID NO: 2584811 - DNA, 12 bp, Homo sapiens
tctttgatgtta

SEQ ID NO: 2584812 - DNA, 13 bp, Homo sapiens
tctttgcagacag

SEQ ID NO: 2584813 - DNA, 17 bp, Homo sapiens
tctttgccaccctcatg

SEQ ID NO: 2584814 - DNA, 16 bp, Homo sapiens
tctttgcctgttcagt

SEQ ID NO: 2584815 - DNA, 23 bp, Homo sapiens
tctttgcctgttcagttacagaa

SEQ ID NO: 2584816 - DNA, 17 bp, Homo sapiens
tctttggaaggagtgag

SEQ ID NO: 2584817 - DNA, 21 bp, Homo sapiens
tctttggacagaagcagctct

SEQ ID NO: 2584818 - DNA, 22 bp, Homo sapiens
tctttggacagaagcagctctt

SEQ ID NO: 2584819 - DNA, 17 bp, Homo sapiens
tctttggaccctgaggc

SEQ ID NO: 2584820 - DNA, 21 bp, Homo sapiens
tctttggaccctgaggcccag

SEQ ID NO: 2584821 - DNA, 14 bp, Homo sapiens
tctttggctcccct

SEQ ID NO: 2584822 - DNA, 18 bp, Homo sapiens
tctttggggtcagccagg

SEQ ID NO: 2584823 - DNA, 20 bp, Homo sapiens
tctttgggtacctattttca

SEQ ID NO: 2584824 - DNA, 22 bp, Homo sapiens
tctttggtctacactgtgctga

SEQ ID NO: 2584825 - DNA, 18 bp, Homo sapiens
tctttgtaagagtgtaga

SEQ ID NO: 2584826 - DNA, 15 bp, Homo sapiens
tctttgtctaaaaca

SEQ ID NO: 2584827 - DNA, 21 bp, Homo sapiens
tctttgttatcaaacttcagc

SEQ ID NO: 2584828 - DNA, 16 bp, Homo sapiens
tcttttagttttagtt

SEQ ID NO: 2584829 - DNA, 16 bp, Homo sapiens
tcttttcacaaataaa

SEQ ID NO: 2584830 - DNA, 20 bp, Homo sapiens
tcttttcagatcatggcatc

SEQ ID NO: 2584831 - DNA, 22 bp, Homo sapiens
tcttttcatctgggaaagacat

SEQ ID NO: 2584832 - DNA, 19 bp, Homo sapiens
tcttttcccactgtttaag

SEQ ID NO: 2584833 - DNA, 19 bp, Homo sapiens
tcttttctaccctagccat

SEQ ID NO: 2584834 - DNA, 23 bp, Homo sapiens
tcttttgaatattcccaagccca

SEQ ID NO: 2584835 - DNA, 19 bp, Homo sapiens
tcttttgaatccatgcttg

SEQ ID NO: 2584836 - DNA, 20 bp, Homo sapiens
tcttttgaatccatgcttgg

SEQ ID NO: 2584837 - DNA, 12 bp, Homo sapiens
tctttttcagtt

SEQ ID NO: 2584838 - DNA, 15 bp, Homo sapiens
tctttttcttcttcc

SEQ ID NO: 2584839 - DNA, 19 bp, Homo sapiens
tctttttgactcttgcaat

SEQ ID NO: 2584840 - DNA, 20 bp, Homo sapiens
tcttttttagcataaaattt

SEQ ID NO: 2584841 - DNA, 22 bp, Homo sapiens
tcttttttttaatgtgctgtgt

SEQ ID NO: 2584842 - DNA, 19 bp, Homo sapiens
tcttttttttattccacat

SEQ ID NO: 2584843 - DNA, 22 bp, Homo sapiens
tgaaaaaaaaaatgctgaacat

SEQ ID NO: 2584844 - DNA, 16 bp, Homo sapiens
tgaaaaaaagtttaca

SEQ ID NO: 2584845 - DNA, 22 bp, Homo sapiens
tgaaaaaatagagcctgaggga

SEQ ID NO: 2584846 - DNA, 12 bp, Homo sapiens
tgaaaaacttcc

SEQ ID NO: 2584847 - DNA, 22 bp, Homo sapiens
tgaaaaaggaggaagagaaaaa

SEQ ID NO: 2584848 - DNA, 18 bp, Homo sapiens
tgaaaaatcggcttacca

SEQ ID NO: 2584849 - DNA, 20 bp, Homo sapiens
tgaaaaatttaagcattgtt

SEQ ID NO: 2584850 - DNA, 13 bp, Homo sapiens
tgaaaacaagtgc

SEQ ID NO: 2584851 - DNA, 14 bp, Homo sapiens
tgaaaacaagtgct

SEQ ID NO: 2584852 - DNA, 21 bp, Homo sapiens
tgaaaacaagtgctggcacca

SEQ ID NO: 2584853 - DNA, 17 bp, Homo sapiens
tgaaaacactgttctct

SEQ ID NO: 2584854 - DNA, 23 bp, Homo sapiens
tgaaaacatggtagaattggaga

SEQ ID NO: 2584855 - DNA, 17 bp, Homo sapiens
tgaaaacttttctcaga

SEQ ID NO: 2584856 - DNA, 18 bp, Homo sapiens
tgaaaagacatcaagcac

SEQ ID NO: 2584857 - DNA, 15 bp, Homo sapiens
tgaaaagactccaaa

SEQ ID NO: 2584858 - DNA, 16 bp, Homo sapiens
tgaaaagactccaaag

SEQ ID NO: 2584859 - DNA, 19 bp, Homo sapiens
tgaaaagctattagccagg

SEQ ID NO: 2584860 - DNA, 16 bp, Homo sapiens
tgaaaaggtgaccttg

SEQ ID NO: 2584861 - DNA, 22 bp, Homo sapiens
tgaaaagttactacctgtcaag

SEQ ID NO: 2584862 - DNA, 21 bp, Homo sapiens
tgaaaataaaaagatcacttt

SEQ ID NO: 2584863 - DNA, 23 bp, Homo sapiens
tgaaaatacaacttaaataataa

SEQ ID NO: 2584864 - DNA, 21 bp, Homo sapiens
tgaaaatatttgtatcacaaa

SEQ ID NO: 2584865 - DNA, 16 bp, Homo sapiens
tgaaaatcgtgacaac

SEQ ID NO: 2584866 - DNA, 19 bp, Homo sapiens
tgaaaatcgtgacaacact

SEQ ID NO: 2584867 - DNA, 21 bp, Homo sapiens
tgaaaatgggttggtgcttct

SEQ ID NO: 2584868 - DNA, 16 bp, Homo sapiens
tgaaaatggtattttc

SEQ ID NO: 2584869 - DNA, 17 bp, Homo sapiens
tgaaaatgtatgtgtaa

SEQ ID NO: 2584870 - DNA, 17 bp, Homo sapiens
tgaaaatgtgctatact

SEQ ID NO: 2584871 - DNA, 21 bp, Homo sapiens
tgaaaatgtgctatactgcat

SEQ ID NO: 2584872 - DNA, 14 bp, Homo sapiens
tgaaaattcagtgg

SEQ ID NO: 2584873 - DNA, 19 bp, Homo sapiens
tgaaaattttgatgtttta

SEQ ID NO: 2584874 - DNA, 14 bp, Homo sapiens
tgaaacaaagaagg

SEQ ID NO: 2584875 - DNA, 21 bp, Homo sapiens
tgaaacaagataactgagaat

SEQ ID NO: 2584876 - DNA, 17 bp, Homo sapiens
tgaaacacaccaggctg

SEQ ID NO: 2584877 - DNA, 13 bp, Homo sapiens
tgaaacagaaaca

SEQ ID NO: 2584878 - DNA, 16 bp, Homo sapiens
tgaaacagaaacaaaa

SEQ ID NO: 2584879 - DNA, 14 bp, Homo sapiens
tgaaacattttgtc

SEQ ID NO: 2584880 - DNA, 18 bp, Homo sapiens
tgaaacccccacacacac

SEQ ID NO: 2584881 - DNA, 22 bp, Homo sapiens
tgaaacctttagggcagcttgc

SEQ ID NO: 2584882 - DNA, 20 bp, Homo sapiens
tgaaaccttttttaagattt

SEQ ID NO: 2584883 - DNA, 13 bp, Homo sapiens
tgaaactccacct

SEQ ID NO: 2584884 - DNA, 22 bp, Homo sapiens
tgaaactgagatgtgaacacat

SEQ ID NO: 2584885 - DNA, 18 bp, Homo sapiens
tgaaactgcttgtttcct

SEQ ID NO: 2584886 - DNA, 19 bp, Homo sapiens
tgaaactgcttgtttccta

SEQ ID NO: 2584887 - DNA, 17 bp, Homo sapiens
tgaaactggattaaact

SEQ ID NO: 2584888 - DNA, 18 bp, Homo sapiens
tgaaactggcactgaatt

SEQ ID NO: 2584889 - DNA, 16 bp, Homo sapiens
tgaaacttacacacaa

SEQ ID NO: 2584890 - DNA, 20 bp, Homo sapiens
tgaaagaaacagttaacttt

SEQ ID NO: 2584891 - DNA, 13 bp, Homo sapiens
tgaaagagaacca

SEQ ID NO: 2584892 - DNA, 18 bp, Homo sapiens
tgaaagagaaccagtttc

SEQ ID NO: 2584893 - DNA, 16 bp, Homo sapiens
tgaaagagtaaaggaa

SEQ ID NO: 2584894 - DNA, 20 bp, Homo sapiens
tgagaactgcatatgtttcg

SEQ ID NO: 2584895 - DNA, 21 bp, Homo sapiens
tgagaagagggcctgtgggag

SEQ ID NO: 2584896 - DNA, 23 bp, Homo sapiens
tgagaagagggcctgtgggagcc

SEQ ID NO: 2584897 - DNA, 20 bp, Homo sapiens
tgagaagcagaggaaggaga

SEQ ID NO: 2584898 - DNA, 16 bp, Homo sapiens
tgagaagccgtgggtg

SEQ ID NO: 2584899 - DNA, 17 bp, Homo sapiens
tgagaagccgtgggtgg

SEQ ID NO: 2584900 - DNA, 18 bp, Homo sapiens
tgagaagttttgtacaga

SEQ ID NO: 2584901 - DNA, 17 bp, Homo sapiens
tgagaataagagagtca

SEQ ID NO: 2584902 - DNA, 19 bp, Homo sapiens
tgagaataagagagtcata

SEQ ID NO: 2584903 - DNA, 23 bp, Homo sapiens
tgagaatctatatttaacaagat

SEQ ID NO: 2584904 - DNA, 16 bp, Homo sapiens
tgagaattccaaggag

SEQ ID NO: 2584905 - DNA, 17 bp, Homo sapiens
tgagacagcccgggctc

SEQ ID NO: 2584906 - DNA, 18 bp, Homo sapiens
tgagacagcccgggctct

SEQ ID NO: 2584907 - DNA, 16 bp, Homo sapiens
tgagacagtccagcct

SEQ ID NO: 2584908 - DNA, 19 bp, Homo sapiens
tgagacagtccagcctgga

SEQ ID NO: 2584909 - DNA, 13 bp, Homo sapiens
tgagacagtggga

SEQ ID NO: 2584910 - DNA, 15 bp, Homo sapiens
tgagacagtgggaaa

SEQ ID NO: 2584911 - DNA, 16 bp, Homo sapiens
tgagacagtttcttag

SEQ ID NO: 2584912 - DNA, 14 bp, Homo sapiens
tgagaccaacctgg

SEQ ID NO: 2584913 - DNA, 13 bp, Homo sapiens
tgagaccacagag

SEQ ID NO: 2584914 - DNA, 14 bp, Homo sapiens
tgagaccactgtta

SEQ ID NO: 2584915 - DNA, 21 bp, Homo sapiens
tgagaccagttgggagcactg

SEQ ID NO: 2584916 - DNA, 23 bp, Homo sapiens
tgagaccagttgggagcactgga

SEQ ID NO: 2584917 - DNA, 21 bp, Homo sapiens
tgagacccattcctatttctt

SEQ ID NO: 2584918 - DNA, 19 bp, Homo sapiens
tgagactctcttaggagca

SEQ ID NO: 2584919 - DNA, 13 bp, Homo sapiens
tgagactctgtct

SEQ ID NO: 2584920 - DNA, 20 bp, Homo sapiens
tgagactctgtctcaaaaaa

SEQ ID NO: 2584921 - DNA, 23 bp, Homo sapiens
tgagactgcgggatggtcctggg

SEQ ID NO: 2584922 - DNA, 21 bp, Homo sapiens
tgagactggatactgcccggg

SEQ ID NO: 2584923 - DNA, 13 bp, Homo sapiens
tgagagaaaataa

SEQ ID NO: 2584924 - DNA, 14 bp, Homo sapiens
tgagagaccaggca

SEQ ID NO: 2584925 - DNA, 16 bp, Homo sapiens
tgagagagatgggagc

SEQ ID NO: 2584926 - DNA, 15 bp, Homo sapiens
tgagagccccagctg

SEQ ID NO: 2584927 - DNA, 19 bp, Homo sapiens
tgagagccccagctgacat

SEQ ID NO: 2584928 - DNA, 23 bp, Homo sapiens
tgagagcgtgctccagcctggct

SEQ ID NO: 2584929 - DNA, 16 bp, Homo sapiens
tgagagctgctctgga

SEQ ID NO: 2584930 - DNA, 22 bp, Homo sapiens
tgagaggatgaatgtatgtgca

SEQ ID NO: 2584931 - DNA, 18 bp, Homo sapiens
tgagaggcagacttccct

SEQ ID NO: 2584932 - DNA, 22 bp, Homo sapiens
tgagagggcatgcgcacaaggc

SEQ ID NO: 2584933 - DNA, 19 bp, Homo sapiens
tgagagtatattatgtatt

SEQ ID NO: 2584934 - DNA, 16 bp, Homo sapiens
tgagagtgaacaaatt

SEQ ID NO: 2584935 - DNA, 16 bp, Homo sapiens
tgagagtttagttgta

SEQ ID NO: 2584936 - DNA, 21 bp, Homo sapiens
tgagagttttgtcttgaatgt

SEQ ID NO: 2584937 - DNA, 22 bp, Homo sapiens
tgagataatgtgatattataca

SEQ ID NO: 2584938 - DNA, 19 bp, Homo sapiens
tgagatagaagaactgcaa

SEQ ID NO: 2584939 - DNA, 21 bp, Homo sapiens
tgagatagaagaactgcaaag

SEQ ID NO: 2584940 - DNA, 18 bp, Homo sapiens
tgagatagcattgtgaac

SEQ ID NO: 2584941 - DNA, 15 bp, Homo sapiens
tgagatatttattgt

SEQ ID NO: 2584942 - DNA, 20 bp, Homo sapiens
tgagatatttattgtttatt

SEQ ID NO: 2584943 - DNA, 22 bp, Homo sapiens
tgagatctaagcctttccataa

SEQ ID NO: 2584944 - DNA, 14 bp, Homo sapiens
tgagatgcagctgg

SEQ ID NO: 2584945 - DNA, 15 bp, Homo sapiens
tgagatgcagctgga

SEQ ID NO: 2584946 - DNA, 18 bp, Homo sapiens
tgagatgcagctggaaaa

SEQ ID NO: 2584947 - DNA, 21 bp, Homo sapiens
tgagatggaacccttttggcc

SEQ ID NO: 2584948 - DNA, 13 bp, Homo sapiens
tgagatggacaca

SEQ ID NO: 2584949 - DNA, 18 bp, Homo sapiens
tgagatgtgaacacatca

SEQ ID NO: 2584950 - DNA, 24 bp, Homo sapiens
tgagatgtgaacacatcagcttgc

SEQ ID NO: 2584951 - DNA, 15 bp, Homo sapiens
tgagattacagagga

SEQ ID NO: 2584952 - DNA, 19 bp, Homo sapiens
tgagattacagaggaagtt

SEQ ID NO: 2584953 - DNA, 17 bp, Homo sapiens
tgagattagagggaggt

SEQ ID NO: 2584954 - DNA, 13 bp, Homo sapiens
tgagcacattctg

SEQ ID NO: 2584955 - DNA, 14 bp, Homo sapiens
tgagcaccagggga

SEQ ID NO: 2584956 - DNA, 19 bp, Homo sapiens
tgagcaccgtcatggctta

SEQ ID NO: 2584957 - DNA, 21 bp, Homo sapiens
tgagcactaaggtgtgctctg

SEQ ID NO: 2584958 - DNA, 23 bp, Homo sapiens
tgagcactcccaagtctacagag

SEQ ID NO: 2584959 - DNA, 17 bp, Homo sapiens
tgagcagggatcctggt

SEQ ID NO: 2584960 - DNA, 14 bp, Homo sapiens
tgagcagggctcag

SEQ ID NO: 2584961 - DNA, 20 bp, Homo sapiens
tgagcagggctcagcgggga

SEQ ID NO: 2584962 - DNA, 23 bp, Homo sapiens
tgagccactgcaccgggccacag

SEQ ID NO: 2584963 - DNA, 14 bp, Homo sapiens
tgagccagacaaat

SEQ ID NO: 2584964 - DNA, 20 bp, Homo sapiens
tgagccagacaaatggagga

SEQ ID NO: 2584965 - DNA, 14 bp, Homo sapiens
tgagccaggcctgg

SEQ ID NO: 2584966 - DNA, 13 bp, Homo sapiens
tgagccagtccca

SEQ ID NO: 2584967 - DNA, 19 bp, Homo sapiens
tgagccagtcccaggggca

SEQ ID NO: 2584968 - DNA, 23 bp, Homo sapiens
tgagccagttcagtacctggagg

SEQ ID NO: 2584969 - DNA, 15 bp, Homo sapiens
tgagcccacaaagcc

SEQ ID NO: 2584970 - DNA, 16 bp, Homo sapiens
tgagcccacaaagcct

SEQ ID NO: 2584971 - DNA, 13 bp, Homo sapiens
tgagccccaaaag

SEQ ID NO: 2584972 - DNA, 23 bp, Homo sapiens
tgagccccaagtcctgaagaggc

SEQ ID NO: 2584973 - DNA, 19 bp, Homo sapiens
tgagcccctaccccacacc

SEQ ID NO: 2584974 - DNA, 22 bp, Homo sapiens
tgagcccctaccccacaccagg

SEQ ID NO: 2584975 - DNA, 19 bp, Homo sapiens
tgagcccgggctgcctggg

SEQ ID NO: 2584976 - DNA, 21 bp, Homo sapiens
tgagcccgggctgcctgggct

SEQ ID NO: 2584977 - DNA, 23 bp, Homo sapiens
tgagccgagatcacgccactgca

SEQ ID NO: 2584978 - DNA, 15 bp, Homo sapiens
tgagcctcagcatcc

SEQ ID NO: 2584979 - DNA, 17 bp, Homo sapiens
tgagcctcagcatcctg

SEQ ID NO: 2584980 - DNA, 18 bp, Homo sapiens
tgagcctcagcatcctgg

SEQ ID NO: 2584981 - DNA, 13 bp, Homo sapiens
tgagcctctcacc

SEQ ID NO: 2584982 - DNA, 14 bp, Homo sapiens
tgagcctgagcaga

SEQ ID NO: 2584983 - DNA, 22 bp, Homo sapiens
tgagcctgggaggtcaaggctg

SEQ ID NO: 2584984 - DNA, 13 bp, Homo sapiens
tgagccttcagtc

SEQ ID NO: 2584985 - DNA, 18 bp, Homo sapiens
tgagccttgaactttgac

SEQ ID NO: 2584986 - DNA, 16 bp, Homo sapiens
tgagccttttccctct

SEQ ID NO: 2584987 - DNA, 16 bp, Homo sapiens
tgagcgacaaagatga

SEQ ID NO: 2584988 - DNA, 17 bp, Homo sapiens
tgagcgacaaagatgat

SEQ ID NO: 2584989 - DNA, 16 bp, Homo sapiens
tgagcgacagtgagac

SEQ ID NO: 2584990 - DNA, 20 bp, Homo sapiens
tgagcgacagtgagactctg

SEQ ID NO: 2584991 - DNA, 17 bp, Homo sapiens
tgagcgaggacattctc

SEQ ID NO: 2584992 - DNA, 22 bp, Homo sapiens
tgagctagaagctggaggacta

SEQ ID NO: 2584993 - DNA, 19 bp, Homo sapiens
tgagctcaggagtttgaga

SEQ ID NO: 2584994 - DNA, 16 bp, Homo sapiens
tgagctccagaccccc

SEQ ID NO: 2584995 - DNA, 14 bp, Homo sapiens
tgagctcctctggg

SEQ ID NO: 2584996 - DNA, 18 bp, Homo sapiens
tgagctcctctgggcagg

SEQ ID NO: 2584997 - DNA, 19 bp, Homo sapiens
tgagctcctctgggcagga

SEQ ID NO: 2584998 - DNA, 20 bp, Homo sapiens
tgagctcggtggacccaggg

SEQ ID NO: 2584999 - DNA, 21 bp, Homo sapiens
tgagctctgcagcccagggac

SEQ ID NO: 2585000 - DNA, 14 bp, Homo sapiens
tgagctgaggcagc

SEQ ID NO: 2585001 - DNA, 12 bp, Homo sapiens
tgagctggaagg

SEQ ID NO: 2585002 - DNA, 14 bp, Homo sapiens
tgagctgttgcctc

SEQ ID NO: 2585003 - DNA, 11 bp, Homo sapiens
tgagctgtttt

SEQ ID NO: 2585004 - DNA, 16 bp, Homo sapiens
tgagcttctctgtgaa

SEQ ID NO: 2585005 - DNA, 20 bp, Homo sapiens
tgagcttggcagctgaacta

SEQ ID NO: 2585006 - DNA, 22 bp, Homo sapiens
tgagctttatgtaataatgtga

SEQ ID NO: 2585007 - DNA, 16 bp, Homo sapiens
tgaggaaacaacagct

SEQ ID NO: 2585008 - DNA, 17 bp, Homo sapiens
tgaggaagagggactgt

SEQ ID NO: 2585009 - DNA, 23 bp, Homo sapiens
tgaggaagccaggtccacggtct

SEQ ID NO: 2585010 - DNA, 14 bp, Homo sapiens
tgaggaagccgctg

SEQ ID NO: 2585011 - DNA, 17 bp, Homo sapiens
tgaggaagccgctgggg

SEQ ID NO: 2585012 - DNA, 17 bp, Homo sapiens
tgaggaagcgtgaaggc

SEQ ID NO: 2585013 - DNA, 22 bp, Homo sapiens
tgaggaagcgtgaaggccgaga

SEQ ID NO: 2585014 - DNA, 19 bp, Homo sapiens
tgaggaaggcaggaagaga

SEQ ID NO: 2585015 - DNA, 19 bp, Homo sapiens
tgaggaataattatttatt

SEQ ID NO: 2585016 - DNA, 15 bp, Homo sapiens
tgaggaatttcacct

SEQ ID NO: 2585017 - DNA, 21 bp, Homo sapiens
tgaggacactaaccacgctgg

SEQ ID NO: 2585018 - DNA, 16 bp, Homo sapiens
tgaggacagctgtcct

SEQ ID NO: 2585019 - DNA, 18 bp, Homo sapiens
tgaggacagctgtcctct

SEQ ID NO: 2585020 - DNA, 18 bp, Homo sapiens
tgaggatgcagagtcagc

SEQ ID NO: 2585021 - DNA, 17 bp, Homo sapiens
tgaggcaatgtcaggaa

SEQ ID NO: 2585022 - DNA, 16 bp, Homo sapiens
tgaggcagacagcagc

SEQ ID NO: 2585023 - DNA, 13 bp, Homo sapiens
tgaggcagggaag

SEQ ID NO: 2585024 - DNA, 22 bp, Homo sapiens
tgaggcagggaagtccccaggc

SEQ ID NO: 2585025 - DNA, 17 bp, Homo sapiens
tgaggcattgcacaggg

SEQ ID NO: 2585026 - DNA, 21 bp, Homo sapiens
tgaggcatttgtttgaactga

SEQ ID NO: 2585027 - DNA, 22 bp, Homo sapiens
tgaggccaaacgttttgaacta

SEQ ID NO: 2585028 - DNA, 13 bp, Homo sapiens
tgaggccaggagt

SEQ ID NO: 2585029 - DNA, 13 bp, Homo sapiens
tgaggccagggca

SEQ ID NO: 2585030 - DNA, 12 bp, Homo sapiens
tgaggcccagag

SEQ ID NO: 2585031 - DNA, 13 bp, Homo sapiens
tgaggcccagagg

SEQ ID NO: 2585032 - DNA, 20 bp, Homo sapiens
tgaggcccagggagaggcca

SEQ ID NO: 2585033 - DNA, 21 bp, Homo sapiens
tgaggccccttctaggtggca

SEQ ID NO: 2585034 - DNA, 18 bp, Homo sapiens
tgaggcccttctctccag

SEQ ID NO: 2585035 - DNA, 20 bp, Homo sapiens
tgaggcccttctctccagcc

SEQ ID NO: 2585036 - DNA, 22 bp, Homo sapiens
tgaggcccttctctccagcccc

SEQ ID NO: 2585037 - DNA, 21 bp, Homo sapiens
tgcaaaatttgatgccaggac

SEQ ID NO: 2585038 - DNA, 22 bp, Homo sapiens
tgcaaaatttgatgccaggaca

SEQ ID NO: 2585039 - DNA, 20 bp, Homo sapiens
tgcaaagcactgacttctaa

SEQ ID NO: 2585040 - DNA, 21 bp, Homo sapiens
tgcaaatcctatgtgatttta

SEQ ID NO: 2585041 - DNA, 21 bp, Homo sapiens
tgcaaatgctatgagatgcat

SEQ ID NO: 2585042 - DNA, 15 bp, Homo sapiens
tgcaaatgctgtatt

SEQ ID NO: 2585043 - DNA, 14 bp, Homo sapiens
tgcaaattaacagt

SEQ ID NO: 2585044 - DNA, 15 bp, Homo sapiens
tgcaacaacatgtat

SEQ ID NO: 2585045 - DNA, 12 bp, Homo sapiens
tgcaacacacag

SEQ ID NO: 2585046 - DNA, 15 bp, Homo sapiens
tgcaacacacagaca

SEQ ID NO: 2585047 - DNA, 13 bp, Homo sapiens
tgcaaccactgca

SEQ ID NO: 2585048 - DNA, 16 bp, Homo sapiens
tgcaacccaaggactg

SEQ ID NO: 2585049 - DNA, 16 bp, Homo sapiens
tgcaaccgtctgttat

SEQ ID NO: 2585050 - DNA, 18 bp, Homo sapiens
tgcaacctccgcctcttg

SEQ ID NO: 2585051 - DNA, 21 bp, Homo sapiens
tgcaacctccgcctcttgggt

SEQ ID NO: 2585052 - DNA, 15 bp, Homo sapiens
tgcaacttcatgtca

SEQ ID NO: 2585053 - DNA, 21 bp, Homo sapiens
tgcaacttctttttattttct

SEQ ID NO: 2585054 - DNA, 18 bp, Homo sapiens
tgcaacttgtaaatgtgg

SEQ ID NO: 2585055 - DNA, 23 bp, Homo sapiens
tgcaagcccctgctccagaagat

SEQ ID NO: 2585056 - DNA, 15 bp, Homo sapiens
tgcaaggaccaggac

SEQ ID NO: 2585057 - DNA, 14 bp, Homo sapiens
tgcaaggcctttct

SEQ ID NO: 2585058 - DNA, 15 bp, Homo sapiens
tgcaaggtcattttt

SEQ ID NO: 2585059 - DNA, 18 bp, Homo sapiens
tgcaagtatgtgagtgtg

SEQ ID NO: 2585060 - DNA, 19 bp, Homo sapiens
tgcaagtatgttttagcat

SEQ ID NO: 2585061 - DNA, 14 bp, Homo sapiens
tgcaagtcagagga

SEQ ID NO: 2585062 - DNA, 15 bp, Homo sapiens
tgcaagtcagaggat

SEQ ID NO: 2585063 - DNA, 14 bp, Homo sapiens
tgcaagtcatggct

SEQ ID NO: 2585064 - DNA, 16 bp, Homo sapiens
tgcaagtgacatctct

SEQ ID NO: 2585065 - DNA, 16 bp, Homo sapiens
tgcaagtgtctgtgtg

SEQ ID NO: 2585066 - DNA, 17 bp, Homo sapiens
tgcaagtgtctgtgtgc

SEQ ID NO: 2585067 - DNA, 23 bp, Homo sapiens
tgcaagtgtgtgcatgtgtgcga

SEQ ID NO: 2585068 - DNA, 19 bp, Homo sapiens
tgcaatatatctaaattga

SEQ ID NO: 2585069 - DNA, 20 bp, Homo sapiens
tgcaatatatctaaattgaa

SEQ ID NO: 2585070 - DNA, 22 bp, Homo sapiens
tgcaatatatctaaattgaata

SEQ ID NO: 2585071 - DNA, 19 bp, Homo sapiens
tgcaatcctgtctttctga

SEQ ID NO: 2585072 - DNA, 11 bp, Homo sapiens
tgcaatgaaca

SEQ ID NO: 2585073 - DNA, 18 bp, Homo sapiens
tgcaatgaagtctctgaa

SEQ ID NO: 2585074 - DNA, 16 bp, Homo sapiens
tgcaatgactcaggac

SEQ ID NO: 2585075 - DNA, 18 bp, Homo sapiens
tgcaatggctatatggca

SEQ ID NO: 2585076 - DNA, 22 bp, Homo sapiens
tgcaattgtaggggtgtgtgtg

SEQ ID NO: 2585077 - DNA, 20 bp, Homo sapiens
tgcaattttaattgattatt

SEQ ID NO: 2585078 - DNA, 15 bp, Homo sapiens
tgcacaaactcacca

SEQ ID NO: 2585079 - DNA, 15 bp, Homo sapiens
tgcacaaagcccttc

SEQ ID NO: 2585080 - DNA, 21 bp, Homo sapiens
tgcacaaatatttattttctt

SEQ ID NO: 2585081 - DNA, 16 bp, Homo sapiens
tgcacaagctccaagc

SEQ ID NO: 2585082 - DNA, 20 bp, Homo sapiens
tgcacaagctccaagctccc

SEQ ID NO: 2585083 - DNA, 22 bp, Homo sapiens
tgcacaagctccaagctcccag

SEQ ID NO: 2585084 - DNA, 14 bp, Homo sapiens
tgcacaagctgcac

SEQ ID NO: 2585085 - DNA, 21 bp, Homo sapiens
tgcacaagctgcaccctcagg

SEQ ID NO: 2585086 - DNA, 17 bp, Homo sapiens
tgcacaatattgaactt

SEQ ID NO: 2585087 - DNA, 18 bp, Homo sapiens
tgcacacaccagagccca

SEQ ID NO: 2585088 - DNA, 22 bp, Homo sapiens
tgcacacaccagagcccacctt

SEQ ID NO: 2585089 - DNA, 14 bp, Homo sapiens
tgcacacagtgctt

SEQ ID NO: 2585090 - DNA, 11 bp, Homo sapiens
tgcacacattt

SEQ ID NO: 2585091 - DNA, 19 bp, Homo sapiens
tgcacactagcctctccag

SEQ ID NO: 2585092 - DNA, 21 bp, Homo sapiens
tgcacactcccctgcactgga

SEQ ID NO: 2585093 - DNA, 13 bp, Homo sapiens
tgcacagagctct

SEQ ID NO: 2585094 - DNA, 14 bp, Homo sapiens
tgcacagagctctc

SEQ ID NO: 2585095 - DNA, 19 bp, Homo sapiens
tgcacagagctctccagct

SEQ ID NO: 2585096 - DNA, 20 bp, Homo sapiens
tgcacagagctctccagctc

SEQ ID NO: 2585097 - DNA, 22 bp, Homo sapiens
tgcacagagttgttacattttt

SEQ ID NO: 2585098 - DNA, 17 bp, Homo sapiens
tgcacagcgtcctgtcc

SEQ ID NO: 2585099 - DNA, 15 bp, Homo sapiens
tgcacagggcagctg

SEQ ID NO: 2585100 - DNA, 20 bp, Homo sapiens
tgcacagggcagctgggccc

SEQ ID NO: 2585101 - DNA, 24 bp, Homo sapiens
tgcacagttttctggctggagcct

SEQ ID NO: 2585102 - DNA, 15 bp, Homo sapiens
tgcacatatggactc

SEQ ID NO: 2585103 - DNA, 17 bp, Homo sapiens
tgcacatatggactctg

SEQ ID NO: 2585104 - DNA, 18 bp, Homo sapiens
tgcacatctgtgtcttgt

SEQ ID NO: 2585105 - DNA, 13 bp, Homo sapiens
tgcacatgtgtgc

SEQ ID NO: 2585106 - DNA, 13 bp, Homo sapiens
tgcaccagccctt

SEQ ID NO: 2585107 - DNA, 23 bp, Homo sapiens
tgcaccagggttgaccccagagg

SEQ ID NO: 2585108 - DNA, 13 bp, Homo sapiens
tgcacccagccct

SEQ ID NO: 2585109 - DNA, 16 bp, Homo sapiens
tgcacccagccctggt

SEQ ID NO: 2585110 - DNA, 15 bp, Homo sapiens
tgcacccatgggctc

SEQ ID NO: 2585111 - DNA, 21 bp, Homo sapiens
tgcacccatgggctctgacag

SEQ ID NO: 2585112 - DNA, 17 bp, Homo sapiens
tgcaccctcaggcaggt

SEQ ID NO: 2585113 - DNA, 15 bp, Homo sapiens
tgcaccctccaccct

SEQ ID NO: 2585114 - DNA, 16 bp, Homo sapiens
tgcaccctccaccctg

SEQ ID NO: 2585115 - DNA, 14 bp, Homo sapiens
tgcaccggctggcc

SEQ ID NO: 2585116 - DNA, 15 bp, Homo sapiens
tgcaccggctggcct

SEQ ID NO: 2585117 - DNA, 21 bp, Homo sapiens
tgcaccggctggcctggcccc

SEQ ID NO: 2585118 - DNA, 23 bp, Homo sapiens
tgcaccggctggcctggcccctc

SEQ ID NO: 2585119 - DNA, 15 bp, Homo sapiens
tgcacctgccagcct

SEQ ID NO: 2585120 - DNA, 17 bp, Homo sapiens
tgcacctgccagcctgg

SEQ ID NO: 2585121 - DNA, 12 bp, Homo sapiens
tgcacctgtgca

SEQ ID NO: 2585122 - DNA, 19 bp, Homo sapiens
tgcaccttaccaactttct

SEQ ID NO: 2585123 - DNA, 15 bp, Homo sapiens
tgcacgaccttggga

SEQ ID NO: 2585124 - DNA, 22 bp, Homo sapiens
tgcacgcccatgtgtgagtgtg

SEQ ID NO: 2585125 - DNA, 16 bp, Homo sapiens
tgcacgtacacacaca

SEQ ID NO: 2585126 - DNA, 21 bp, Homo sapiens
tgcacgtggagagctggtgcc

SEQ ID NO: 2585127 - DNA, 23 bp, Homo sapiens
tgcacgtggcatgtggcctgtgg

SEQ ID NO: 2585128 - DNA, 12 bp, Homo sapiens
tgcacgtgtgca

SEQ ID NO: 2585129 - DNA, 14 bp, Homo sapiens
tgcacgtgtgtgca

SEQ ID NO: 2585130 - DNA, 20 bp, Homo sapiens
tgcacgttatggtgtttctc

SEQ ID NO: 2585131 - DNA, 18 bp, Homo sapiens
tgcactaaagtatgtaaa

SEQ ID NO: 2585132 - DNA, 16 bp, Homo sapiens
tgcactactcctctgc

SEQ ID NO: 2585133 - DNA, 22 bp, Homo sapiens
tgcactatagcctaggtgacag

SEQ ID NO: 2585134 - DNA, 23 bp, Homo sapiens
tgcactatagcctaggtgacaga

SEQ ID NO: 2585135 - DNA, 15 bp, Homo sapiens
tgcactatgaggaat

SEQ ID NO: 2585136 - DNA, 14 bp, Homo sapiens
tgcactccagcctg

SEQ ID NO: 2585137 - DNA, 15 bp, Homo sapiens
tgcactccagcctgg

SEQ ID NO: 2585138 - DNA, 19 bp, Homo sapiens
tgcactccagcctgggcga

SEQ ID NO: 2585139 - DNA, 13 bp, Homo sapiens
tgcactcccctgc

SEQ ID NO: 2585140 - DNA, 17 bp, Homo sapiens
tgcactcccctgctggg

SEQ ID NO: 2585141 - DNA, 22 bp, Homo sapiens
tgcactctaaccctaggcatca

SEQ ID NO: 2585142 - DNA, 16 bp, Homo sapiens
tgcactgagggccaca

SEQ ID NO: 2585143 - DNA, 20 bp, Homo sapiens
tgcactggagtccagtctct

SEQ ID NO: 2585144 - DNA, 21 bp, Homo sapiens
tgcactgtcactttgctctgg

SEQ ID NO: 2585145 - DNA, 19 bp, Homo sapiens
tgcactgtcgataatcaga

SEQ ID NO: 2585146 - DNA, 21 bp, Homo sapiens
tgcacttgcagactctacaga

SEQ ID NO: 2585147 - DNA, 14 bp, Homo sapiens
tgcactttgttctg

SEQ ID NO: 2585148 - DNA, 12 bp, Homo sapiens
tgcagacaggca

SEQ ID NO: 2585149 - DNA, 15 bp, Homo sapiens
tgcagacatgagtgc

SEQ ID NO: 2585150 - DNA, 15 bp, Homo sapiens
tgcagacctgtcctc

SEQ ID NO: 2585151 - DNA, 18 bp, Homo sapiens
tgcagacctgtcctcctg

SEQ ID NO: 2585152 - DNA, 23 bp, Homo sapiens
tgcagacctgtcctcctggtggg

SEQ ID NO: 2585153 - DNA, 22 bp, Homo sapiens
tgcagactctacagaggccatg

SEQ ID NO: 2585154 - DNA, 22 bp, Homo sapiens
tgcagactgctgctagagccag

SEQ ID NO: 2585155 - DNA, 17 bp, Homo sapiens
tgcagagacaggacctg

SEQ ID NO: 2585156 - DNA, 14 bp, Homo sapiens
tgcagagagaagcc

SEQ ID NO: 2585157 - DNA, 15 bp, Homo sapiens
tgcagagagccattt

SEQ ID NO: 2585158 - DNA, 18 bp, Homo sapiens
tgcagagagccattttgt

SEQ ID NO: 2585159 - DNA, 13 bp, Homo sapiens
tgcagaggggaaa

SEQ ID NO: 2585160 - DNA, 20 bp, Homo sapiens
tgcagaggggctttctggag

SEQ ID NO: 2585161 - DNA, 21 bp, Homo sapiens
tgcagaggggctttctggaga

SEQ ID NO: 2585162 - DNA, 22 bp, Homo sapiens
tgcagaggggctttctggagag

SEQ ID NO: 2585163 - DNA, 20 bp, Homo sapiens
tgcagaggtaaaagtgtgag

SEQ ID NO: 2585164 - DNA, 13 bp, Homo sapiens
tgcagagtcagca

SEQ ID NO: 2585165 - DNA, 17 bp, Homo sapiens
tgcagagtcagcagaac

SEQ ID NO: 2585166 - DNA, 22 bp, Homo sapiens
tgcagatggggctcccgcccgt

SEQ ID NO: 2585167 - DNA, 15 bp, Homo sapiens
tgcagcaataaagca

SEQ ID NO: 2585168 - DNA, 13 bp, Homo sapiens
tgcagcagaggca

SEQ ID NO: 2585169 - DNA, 16 bp, Homo sapiens
tgcagcagaggcactg

SEQ ID NO: 2585170 - DNA, 18 bp, Homo sapiens
tgcagcagcggtggcctc

SEQ ID NO: 2585171 - DNA, 20 bp, Homo sapiens
tgcagcagcggtggcctctt

SEQ ID NO: 2585172 - DNA, 18 bp, Homo sapiens
tgcagcagtgagtctctt

SEQ ID NO: 2585173 - DNA, 15 bp, Homo sapiens
tgcagcatatgagga

SEQ ID NO: 2585174 - DNA, 20 bp, Homo sapiens
tgcagcatatgaggatgcag

SEQ ID NO: 2585175 - DNA, 20 bp, Homo sapiens
tgcagcatgttgctgaggag

SEQ ID NO: 2585176 - DNA, 21 bp, Homo sapiens
tgcagcatgttgctgaggagt

SEQ ID NO: 2585177 - DNA, 13 bp, Homo sapiens
tgcagccagacct

SEQ ID NO: 2585178 - DNA, 14 bp, Homo sapiens
tgcagccagaccta

SEQ ID NO: 2585179 - DNA, 23 bp, Homo sapiens
tgcagcccatgcccacctgccca

SEQ ID NO: 2585180 - DNA, 17 bp, Homo sapiens
tgcagcccccactgcct

SEQ ID NO: 2585181 - DNA, 19 bp, Homo sapiens
tgccttggggaatttcctc

SEQ ID NO: 2585182 - DNA, 18 bp, Homo sapiens
tgcctttaaatctgtgat

SEQ ID NO: 2585183 - DNA, 20 bp, Homo sapiens
tgcctttctcgattttatct

SEQ ID NO: 2585184 - DNA, 17 bp, Homo sapiens
tgcctttgacctgcctc

SEQ ID NO: 2585185 - DNA, 20 bp, Homo sapiens
tgcctttgagacagtttctt

SEQ ID NO: 2585186 - DNA, 21 bp, Homo sapiens
tgcctttgagacagtttctta

SEQ ID NO: 2585187 - DNA, 17 bp, Homo sapiens
tgcctttggcagagttc

SEQ ID NO: 2585188 - DNA, 15 bp, Homo sapiens
tgcctttgttttgat

SEQ ID NO: 2585189 - DNA, 15 bp, Homo sapiens
tgccttttctagccc

SEQ ID NO: 2585190 - DNA, 17 bp, Homo sapiens
tgccttttgcacccctc

SEQ ID NO: 2585191 - DNA, 22 bp, Homo sapiens
tgccttttgcacccctcccatt

SEQ ID NO: 2585192 - DNA, 15 bp, Homo sapiens
tgcgagtatgtgttt

SEQ ID NO: 2585193 - DNA, 22 bp, Homo sapiens
tgcgagtatgtgtttgtgtgtg

SEQ ID NO: 2585194 - DNA, 17 bp, Homo sapiens
tgcgagtgtgtgcatgt

SEQ ID NO: 2585195 - DNA, 21 bp, Homo sapiens
tgcgagtgtgtgcatgtgtgt

SEQ ID NO: 2585196 - DNA, 20 bp, Homo sapiens
tgcgatctgggttcactgca

SEQ ID NO: 2585197 - DNA, 18 bp, Homo sapiens
tgcgatcttcagagcagg

SEQ ID NO: 2585198 - DNA, 21 bp, Homo sapiens
tgcgattctggataaagccac

SEQ ID NO: 2585199 - DNA, 18 bp, Homo sapiens
tgcgccattgcactccag

SEQ ID NO: 2585200 - DNA, 21 bp, Homo sapiens
tgcgccattgcactccagcct

SEQ ID NO: 2585201 - DNA, 15 bp, Homo sapiens
tgcgcccttaccttc

SEQ ID NO: 2585202 - DNA, 17 bp, Homo sapiens
tgcgccgagtctgtctc

SEQ ID NO: 2585203 - DNA, 24 bp, Homo sapiens
tgcgccgagtctgtctctgtcatg

SEQ ID NO: 2585204 - DNA, 17 bp, Homo sapiens
tgcgcgcacaatagtaa

SEQ ID NO: 2585205 - DNA, 23 bp, Homo sapiens
tgcgcgtgcacgtggagagctgg

SEQ ID NO: 2585206 - DNA, 20 bp, Homo sapiens
tgcgctctagcctgggcaac

SEQ ID NO: 2585207 - DNA, 20 bp, Homo sapiens
tgcggacagccacggccagg

SEQ ID NO: 2585208 - DNA, 15 bp, Homo sapiens
tgcggatctctggag

SEQ ID NO: 2585209 - DNA, 17 bp, Homo sapiens
tgcggcattaaagccat

SEQ ID NO: 2585210 - DNA, 14 bp, Homo sapiens
tgcggcccagcccg

SEQ ID NO: 2585211 - DNA, 20 bp, Homo sapiens
tgcggctgtgcagcctgtcc

SEQ ID NO: 2585212 - DNA, 17 bp, Homo sapiens
tgcgggatggtcctggg

SEQ ID NO: 2585213 - DNA, 18 bp, Homo sapiens
tgcgggatggtcctgggg

SEQ ID NO: 2585214 - DNA, 17 bp, Homo sapiens
tgcgggtttgaggatag

SEQ ID NO: 2585215 - DNA, 15 bp, Homo sapiens
tgcggtccacccagg

SEQ ID NO: 2585216 - DNA, 20 bp, Homo sapiens
tgcgtacgtttcctgagaag

SEQ ID NO: 2585217 - DNA, 14 bp, Homo sapiens
tgcgtatgtctgtt

SEQ ID NO: 2585218 - DNA, 14 bp, Homo sapiens
tgcgtgaaacacac

SEQ ID NO: 2585219 - DNA, 19 bp, Homo sapiens
tgcgtggcatagcccagac

SEQ ID NO: 2585220 - DNA, 13 bp, Homo sapiens
tgcgtgtcgtggg

SEQ ID NO: 2585221 - DNA, 12 bp, Homo sapiens
tgctaaaaatgg

SEQ ID NO: 2585222 - DNA, 17 bp, Homo sapiens
tgctaaaaatgggactt

SEQ ID NO: 2585223 - DNA, 13 bp, Homo sapiens
tgctaaaccttag

SEQ ID NO: 2585224 - DNA, 14 bp, Homo sapiens
tgctaaaccttagt

SEQ ID NO: 2585225 - DNA, 21 bp, Homo sapiens
tgctaaagaaaaagtcatcca

SEQ ID NO: 2585226 - DNA, 22 bp, Homo sapiens
tgctaaagaaaaagtcatccaa

SEQ ID NO: 2585227 - DNA, 23 bp, Homo sapiens
tgctaaataaaatttgttgcata

SEQ ID NO: 2585228 - DNA, 21 bp, Homo sapiens
tgctaaatggtcgcccaggag

SEQ ID NO: 2585229 - DNA, 16 bp, Homo sapiens
tgctaaatgtaacagt

SEQ ID NO: 2585230 - DNA, 18 bp, Homo sapiens
tgctaaatgtaacagtct

SEQ ID NO: 2585231 - DNA, 13 bp, Homo sapiens
tgctaatcagtgt

SEQ ID NO: 2585232 - DNA, 14 bp, Homo sapiens
tgctaatcagtgtc

SEQ ID NO: 2585233 - DNA, 20 bp, Homo sapiens
tgctaatcttcttatgcaat

SEQ ID NO: 2585234 - DNA, 14 bp, Homo sapiens
tgctacaaaaacac

SEQ ID NO: 2585235 - DNA, 21 bp, Homo sapiens
tgctacaaagaagacatgttt

SEQ ID NO: 2585236 - DNA, 13 bp, Homo sapiens
tgctacaacttca

SEQ ID NO: 2585237 - DNA, 15 bp, Homo sapiens
tgctacctcactggg

SEQ ID NO: 2585238 - DNA, 16 bp, Homo sapiens
tgctacctcactgggg

SEQ ID NO: 2585239 - DNA, 22 bp, Homo sapiens
tgctacctcactggggtcctgg

SEQ ID NO: 2585240 - DNA, 16 bp, Homo sapiens
tgctacgtgtgatttt

SEQ ID NO: 2585241 - DNA, 14 bp, Homo sapiens
tgctactgccaacc

SEQ ID NO: 2585242 - DNA, 15 bp, Homo sapiens
tgctactgccaacct

SEQ ID NO: 2585243 - DNA, 19 bp, Homo sapiens
tgctagatgtgcaaatgca

SEQ ID NO: 2585244 - DNA, 18 bp, Homo sapiens
tgctagcacttggagcca

SEQ ID NO: 2585245 - DNA, 18 bp, Homo sapiens
tgctagctctgagccagt

SEQ ID NO: 2585246 - DNA, 19 bp, Homo sapiens
tgctaggcgagtgccagga

SEQ ID NO: 2585247 - DNA, 20 bp, Homo sapiens
tgctaggggttttaggtctc

SEQ ID NO: 2585248 - DNA, 22 bp, Homo sapiens
tgctaggtctcggactaagcct

SEQ ID NO: 2585249 - DNA, 20 bp, Homo sapiens
tgctaggtgggccagcccct

SEQ ID NO: 2585250 - DNA, 16 bp, Homo sapiens
tgctagtcttaagaac

SEQ ID NO: 2585251 - DNA, 20 bp, Homo sapiens
tgctataggctggagaagct

SEQ ID NO: 2585252 - DNA, 14 bp, Homo sapiens
tgctatctccccca

SEQ ID NO: 2585253 - DNA, 17 bp, Homo sapiens
tgctatctcccccagcc

SEQ ID NO: 2585254 - DNA, 20 bp, Homo sapiens
tgctatctcccccagcccca

SEQ ID NO: 2585255 - DNA, 21 bp, Homo sapiens
tgctatctctgtgtgcacaaa

SEQ ID NO: 2585256 - DNA, 17 bp, Homo sapiens
tgctatcttaattttgg

SEQ ID NO: 2585257 - DNA, 19 bp, Homo sapiens
tgctatgagctggggatgt

SEQ ID NO: 2585258 - DNA, 20 bp, Homo sapiens
tgctatgagctggggatgtc

SEQ ID NO: 2585259 - DNA, 22 bp, Homo sapiens
tgctatgagctggggatgtctc

SEQ ID NO: 2585260 - DNA, 19 bp, Homo sapiens
tgctatggggagaaaagac

SEQ ID NO: 2585261 - DNA, 13 bp, Homo sapiens
tgctattgtaaat

SEQ ID NO: 2585262 - DNA, 15 bp, Homo sapiens
tgctcaaaaatctgt

SEQ ID NO: 2585263 - DNA, 14 bp, Homo sapiens
tgctcaaaatttga

SEQ ID NO: 2585264 - DNA, 21 bp, Homo sapiens
tgctcaaaatttgaagaatga

SEQ ID NO: 2585265 - DNA, 18 bp, Homo sapiens
tgctcaaatctattcaga

SEQ ID NO: 2585266 - DNA, 21 bp, Homo sapiens
tgctcaataaatgattcttag

SEQ ID NO: 2585267 - DNA, 13 bp, Homo sapiens
tgctcacagtctc

SEQ ID NO: 2585268 - DNA, 15 bp, Homo sapiens
tgctcacatatctgt

SEQ ID NO: 2585269 - DNA, 16 bp, Homo sapiens
tgctcacatatctgtc

SEQ ID NO: 2585270 - DNA, 13 bp, Homo sapiens
tgctcacctgggg

SEQ ID NO: 2585271 - DNA, 14 bp, Homo sapiens
tgctcacctggggt

SEQ ID NO: 2585272 - DNA, 22 bp, Homo sapiens
tgctcacctggggtgtgggagg

SEQ ID NO: 2585273 - DNA, 12 bp, Homo sapiens
tgctcagcagct

SEQ ID NO: 2585274 - DNA, 19 bp, Homo sapiens
tgctcagggaaaagcagct

SEQ ID NO: 2585275 - DNA, 16 bp, Homo sapiens
tgctcagggtcaattt

SEQ ID NO: 2585276 - DNA, 17 bp, Homo sapiens
tgctcagtaatttgagg

SEQ ID NO: 2585277 - DNA, 15 bp, Homo sapiens
tgctcagttgtagaa

SEQ ID NO: 2585278 - DNA, 20 bp, Homo sapiens
tgctcagttgtagaatgtat

SEQ ID NO: 2585279 - DNA, 22 bp, Homo sapiens
tgctcagttgtagaatgtattg

SEQ ID NO: 2585280 - DNA, 21 bp, Homo sapiens
tgctcatattgtgattctgcc

SEQ ID NO: 2585281 - DNA, 19 bp, Homo sapiens
tgctcatcattctctgtct

SEQ ID NO: 2585282 - DNA, 17 bp, Homo sapiens
tgctccacccttggcct

SEQ ID NO: 2585283 - DNA, 23 bp, Homo sapiens
tgctccacccttggcctgtctca

SEQ ID NO: 2585284 - DNA, 17 bp, Homo sapiens
tgctccagccaacccct

SEQ ID NO: 2585285 - DNA, 20 bp, Homo sapiens
tgctccagccaacccctgtg

SEQ ID NO: 2585286 - DNA, 23 bp, Homo sapiens
tgctccagccaacccctgtggag

SEQ ID NO: 2585287 - DNA, 12 bp, Homo sapiens
tgctccaggcag

SEQ ID NO: 2585288 - DNA, 20 bp, Homo sapiens
tgctcccagcagccctaagg

SEQ ID NO: 2585289 - DNA, 23 bp, Homo sapiens
tgctccccagccctggctctgca

SEQ ID NO: 2585290 - DNA, 20 bp, Homo sapiens
tgctccctaccacctcccca

SEQ ID NO: 2585291 - DNA, 20 bp, Homo sapiens
tgctccctcccctgccctgg

SEQ ID NO: 2585292 - DNA, 13 bp, Homo sapiens
tgctccgtgcctc

SEQ ID NO: 2585293 - DNA, 14 bp, Homo sapiens
tgctccgtgcctcc

SEQ ID NO: 2585294 - DNA, 17 bp, Homo sapiens
tgctccgtgcctccacc

SEQ ID NO: 2585295 - DNA, 18 bp, Homo sapiens
tgctccgtgcctccacca

SEQ ID NO: 2585296 - DNA, 14 bp, Homo sapiens
tgctcctccctggc

SEQ ID NO: 2585297 - DNA, 19 bp, Homo sapiens
tgctcctccctggctgccc

SEQ ID NO: 2585298 - DNA, 19 bp, Homo sapiens
tgctcctccttggtgcctg

SEQ ID NO: 2585299 - DNA, 13 bp, Homo sapiens
tgctcctctccag

SEQ ID NO: 2585300 - DNA, 16 bp, Homo sapiens
tgctcctctccaggca

SEQ ID NO: 2585301 - DNA, 18 bp, Homo sapiens
tgctcctctccccagcaa

SEQ ID NO: 2585302 - DNA, 20 bp, Homo sapiens
tgctcctgggctacaaggac

SEQ ID NO: 2585303 - DNA, 21 bp, Homo sapiens
tgctccttccaacaggagctg

SEQ ID NO: 2585304 - DNA, 19 bp, Homo sapiens
tgctccttgggccctttga

SEQ ID NO: 2585305 - DNA, 21 bp, Homo sapiens
tgctccttgggccctttgagt

SEQ ID NO: 2585306 - DNA, 15 bp, Homo sapiens
tgctcggccgtcttc

SEQ ID NO: 2585307 - DNA, 20 bp, Homo sapiens
tgctctatcttgctctgtaa

SEQ ID NO: 2585308 - DNA, 21 bp, Homo sapiens
tgctctatcttgctctgtaat

SEQ ID NO: 2585309 - DNA, 18 bp, Homo sapiens
tgctctccaagtctcagt

SEQ ID NO: 2585310 - DNA, 17 bp, Homo sapiens
tgctctcccctgccctg

SEQ ID NO: 2585311 - DNA, 22 bp, Homo sapiens
tgctctccctcttctcaagtgc

SEQ ID NO: 2585312 - DNA, 22 bp, Homo sapiens
tgctctgaattagtccttgctt

SEQ ID NO: 2585313 - DNA, 18 bp, Homo sapiens
tgctctgaggcttccaga

SEQ ID NO: 2585314 - DNA, 20 bp, Homo sapiens
tgctctgaggcttccagaga

SEQ ID NO: 2585315 - DNA, 18 bp, Homo sapiens
tgctctgcatgttacata

SEQ ID NO: 2585316 - DNA, 19 bp, Homo sapiens
tgctctggaaaatgtgacc

SEQ ID NO: 2585317 - DNA, 22 bp, Homo sapiens
tgctctgtaatctcgtttcaaa

SEQ ID NO: 2585318 - DNA, 18 bp, Homo sapiens
tgctctttcatctctgct

SEQ ID NO: 2585319 - DNA, 16 bp, Homo sapiens
tgctctttctactctg

SEQ ID NO: 2585320 - DNA, 19 bp, Homo sapiens
tgctgaaaactagctcgtg

SEQ ID NO: 2585321 - DNA, 17 bp, Homo sapiens
tgctgaaacaacaaata

SEQ ID NO: 2585322 - DNA, 23 bp, Homo sapiens
tgctgaaggaataaattgctcct

SEQ ID NO: 2585323 - DNA, 13 bp, Homo sapiens
tgctgaagggacc

SEQ ID NO: 2585324 - DNA, 15 bp, Homo sapiens
tggcatcacagggca

SEQ ID NO: 2585325 - DNA, 20 bp, Homo sapiens
tggcatcacagggcagagcc

SEQ ID NO: 2585326 - DNA, 14 bp, Homo sapiens
tggcatcagctggc

SEQ ID NO: 2585327 - DNA, 15 bp, Homo sapiens
tggcatcccagtggc

SEQ ID NO: 2585328 - DNA, 15 bp, Homo sapiens
tggcatcctgtgaag

SEQ ID NO: 2585329 - DNA, 16 bp, Homo sapiens
tggcatcctgtgaagt

SEQ ID NO: 2585330 - DNA, 14 bp, Homo sapiens
tggcatggccacca

SEQ ID NO: 2585331 - DNA, 16 bp, Homo sapiens
tggcatggctccagtc

SEQ ID NO: 2585332 - DNA, 17 bp, Homo sapiens
tggcatgtggcctgtgg

SEQ ID NO: 2585333 - DNA, 18 bp, Homo sapiens
tggcatgtggcctgtggc

SEQ ID NO: 2585334 - DNA, 19 bp, Homo sapiens
tggcattacagctggagaa

SEQ ID NO: 2585335 - DNA, 13 bp, Homo sapiens
tggcattatgtcc

SEQ ID NO: 2585336 - DNA, 23 bp, Homo sapiens
tggcattatgtccactgtgtata

SEQ ID NO: 2585337 - DNA, 20 bp, Homo sapiens
tggcattgtccctgtgccta

SEQ ID NO: 2585338 - DNA, 21 bp, Homo sapiens
tggccaaagccaaagctaggc

SEQ ID NO: 2585339 - DNA, 16 bp, Homo sapiens
tggccaaattatttgt

SEQ ID NO: 2585340 - DNA, 16 bp, Homo sapiens
tggccaagttcttagt

SEQ ID NO: 2585341 - DNA, 13 bp, Homo sapiens
tggccaccacccc

SEQ ID NO: 2585342 - DNA, 15 bp, Homo sapiens
tggccaccacccccc

SEQ ID NO: 2585343 - DNA, 23 bp, Homo sapiens
tggccaccaccccccactctgtg

SEQ ID NO: 2585344 - DNA, 21 bp, Homo sapiens
tggccaccaggctggcgcagc

SEQ ID NO: 2585345 - DNA, 22 bp, Homo sapiens
tggccaccaggctggcgcagcc

SEQ ID NO: 2585346 - DNA, 17 bp, Homo sapiens
tggccacctgaggtggg

SEQ ID NO: 2585347 - DNA, 20 bp, Homo sapiens
tggccacctgaggtgggccc

SEQ ID NO: 2585348 - DNA, 15 bp, Homo sapiens
tggccactcagcttc

SEQ ID NO: 2585349 - DNA, 17 bp, Homo sapiens
tggccactgcacagagc

SEQ ID NO: 2585350 - DNA, 18 bp, Homo sapiens
tggccactgcacagagct

SEQ ID NO: 2585351 - DNA, 20 bp, Homo sapiens
tggccagaagggggccatga

SEQ ID NO: 2585352 - DNA, 17 bp, Homo sapiens
tggccagagctgggagg

SEQ ID NO: 2585353 - DNA, 20 bp, Homo sapiens
tggccagagctgggaggcat

SEQ ID NO: 2585354 - DNA, 23 bp, Homo sapiens
tggccagagctgggaggcatggc

SEQ ID NO: 2585355 - DNA, 17 bp, Homo sapiens
tggccagatgcaccagc

SEQ ID NO: 2585356 - DNA, 17 bp, Homo sapiens
tggccagcccggctggt

SEQ ID NO: 2585357 - DNA, 15 bp, Homo sapiens
tggccaggagctctt

SEQ ID NO: 2585358 - DNA, 16 bp, Homo sapiens
tggccaggagctcttc

SEQ ID NO: 2585359 - DNA, 20 bp, Homo sapiens
tggccaggagctcttcaggc

SEQ ID NO: 2585360 - DNA, 22 bp, Homo sapiens
tggccaggagctcttcaggcct

SEQ ID NO: 2585361 - DNA, 23 bp, Homo sapiens
tggccaggagctcttcaggcctc

SEQ ID NO: 2585362 - DNA, 20 bp, Homo sapiens
tggccaggcaccccctggag

SEQ ID NO: 2585363 - DNA, 17 bp, Homo sapiens
tggccagggtgagagct

SEQ ID NO: 2585364 - DNA, 18 bp, Homo sapiens
tggccagggtgagagctg

SEQ ID NO: 2585365 - DNA, 15 bp, Homo sapiens
tggccagtggctgga

SEQ ID NO: 2585366 - DNA, 16 bp, Homo sapiens
tggccagttatccctt

SEQ ID NO: 2585367 - DNA, 13 bp, Homo sapiens
tggccatctccac

SEQ ID NO: 2585368 - DNA, 16 bp, Homo sapiens
tggccatctctggatg

SEQ ID NO: 2585369 - DNA, 21 bp, Homo sapiens
tggcccaagtggcagagcttg

SEQ ID NO: 2585370 - DNA, 14 bp, Homo sapiens
tggcccactgcatc

SEQ ID NO: 2585371 - DNA, 14 bp, Homo sapiens
tggcccagccctgc

SEQ ID NO: 2585372 - DNA, 15 bp, Homo sapiens
tggcccagccctgct

SEQ ID NO: 2585373 - DNA, 15 bp, Homo sapiens
tggcccagccggcct

SEQ ID NO: 2585374 - DNA, 18 bp, Homo sapiens
tggcccagccggcctctc

SEQ ID NO: 2585375 - DNA, 22 bp, Homo sapiens
tggcccagccggcctctctggc

SEQ ID NO: 2585376 - DNA, 20 bp, Homo sapiens
tggcccagcggcccctccca

SEQ ID NO: 2585377 - DNA, 15 bp, Homo sapiens
tggcccccgagctgg

SEQ ID NO: 2585378 - DNA, 13 bp, Homo sapiens
tggccccctgtcc

SEQ ID NO: 2585379 - DNA, 14 bp, Homo sapiens
tggccccctgtcct

SEQ ID NO: 2585380 - DNA, 21 bp, Homo sapiens
tggcccctcaaatcgtccagc

SEQ ID NO: 2585381 - DNA, 21 bp, Homo sapiens
tggcccctcacctgggcacct

SEQ ID NO: 2585382 - DNA, 19 bp, Homo sapiens
tggcccctccccctgccag

SEQ ID NO: 2585383 - DNA, 12 bp, Homo sapiens
tggcccctctga

SEQ ID NO: 2585384 - DNA, 21 bp, Homo sapiens
tggcccctgcccggctgcgga

SEQ ID NO: 2585385 - DNA, 21 bp, Homo sapiens
tggccccttcacttctgacca

SEQ ID NO: 2585386 - DNA, 14 bp, Homo sapiens
tggccctcagtttc

SEQ ID NO: 2585387 - DNA, 16 bp, Homo sapiens
tggccctgaggtgtgg

SEQ ID NO: 2585388 - DNA, 18 bp, Homo sapiens
tggccgagggtcctggct

SEQ ID NO: 2585389 - DNA, 19 bp, Homo sapiens
tggccgagggtcctggctc

SEQ ID NO: 2585390 - DNA, 23 bp, Homo sapiens
tggccgccccctgccccccagcc

SEQ ID NO: 2585391 - DNA, 18 bp, Homo sapiens
tggccgggtgcggtggct

SEQ ID NO: 2585392 - DNA, 14 bp, Homo sapiens
tggccgtgggcctg

SEQ ID NO: 2585393 - DNA, 21 bp, Homo sapiens
tggccgttgatgttggctggg

SEQ ID NO: 2585394 - DNA, 22 bp, Homo sapiens
tggccgttgatgttggctggga

SEQ ID NO: 2585395 - DNA, 16 bp, Homo sapiens
tggcctaaaaatgcaa

SEQ ID NO: 2585396 - DNA, 21 bp, Homo sapiens
tggcctaggagatatctgagg

SEQ ID NO: 2585397 - DNA, 22 bp, Homo sapiens
tggcctaggagatatctgaggg

SEQ ID NO: 2585398 - DNA, 15 bp, Homo sapiens
tggcctatgcacata

SEQ ID NO: 2585399 - DNA, 20 bp, Homo sapiens
tggcctatgcacatatggac

SEQ ID NO: 2585400 - DNA, 22 bp, Homo sapiens
tggcctcaaccctccctcagcc

SEQ ID NO: 2585401 - DNA, 23 bp, Homo sapiens
tggcctcaaccctccctcagccc

SEQ ID NO: 2585402 - DNA, 23 bp, Homo sapiens
tggcctcaagtgattctcctgcc

SEQ ID NO: 2585403 - DNA, 17 bp, Homo sapiens
tggcctcagctgcctca

SEQ ID NO: 2585404 - DNA, 18 bp, Homo sapiens
tggcctcagctgcctcac

SEQ ID NO: 2585405 - DNA, 19 bp, Homo sapiens
tggcctcagctgcctcact

SEQ ID NO: 2585406 - DNA, 22 bp, Homo sapiens
tggcctcattactttaccaccc

SEQ ID NO: 2585407 - DNA, 21 bp, Homo sapiens
tggcctccacagttcgacctg

SEQ ID NO: 2585408 - DNA, 19 bp, Homo sapiens
tggcctcccaactcacccc

SEQ ID NO: 2585409 - DNA, 18 bp, Homo sapiens
tggcctcccacagactca

SEQ ID NO: 2585410 - DNA, 14 bp, Homo sapiens
tggcctcccacccg

SEQ ID NO: 2585411 - DNA, 20 bp, Homo sapiens
tggcctccggcgtcagcctc

SEQ ID NO: 2585412 - DNA, 21 bp, Homo sapiens
tggcctccggcgtcagcctcc

SEQ ID NO: 2585413 - DNA, 18 bp, Homo sapiens
tggcctcctcccttagct

SEQ ID NO: 2585414 - DNA, 19 bp, Homo sapiens
tggcctcgggacacctgcc

SEQ ID NO: 2585415 - DNA, 23 bp, Homo sapiens
tggcctcgggacacctgccctgc

SEQ ID NO: 2585416 - DNA, 18 bp, Homo sapiens
tggcctctgcaaaggaaa

SEQ ID NO: 2585417 - DNA, 17 bp, Homo sapiens
tggcctctgcactcccc

SEQ ID NO: 2585418 - DNA, 19 bp, Homo sapiens
tggcctctgcactcccctg

SEQ ID NO: 2585419 - DNA, 14 bp, Homo sapiens
tggcctctttgtct

SEQ ID NO: 2585420 - DNA, 14 bp, Homo sapiens
tggcctcttttcag

SEQ ID NO: 2585421 - DNA, 23 bp, Homo sapiens
tggcctcttttcagatcatggca

SEQ ID NO: 2585422 - DNA, 12 bp, Homo sapiens
tggcctggatct

SEQ ID NO: 2585423 - DNA, 14 bp, Homo sapiens
tggcctggatctcc

SEQ ID NO: 2585424 - DNA, 13 bp, Homo sapiens
tggcctggccagg

SEQ ID NO: 2585425 - DNA, 21 bp, Homo sapiens
tggcctggccaggagctcttc

SEQ ID NO: 2585426 - DNA, 21 bp, Homo sapiens
tggcctggcccctcagggtcc

SEQ ID NO: 2585427 - DNA, 16 bp, Homo sapiens
tggcctggcttctcct

SEQ ID NO: 2585428 - DNA, 14 bp, Homo sapiens
tggcctgggcctcc

SEQ ID NO: 2585429 - DNA, 17 bp, Homo sapiens
tggcctgggcctcctca

SEQ ID NO: 2585430 - DNA, 24 bp, Homo sapiens
tggcctgtctcatccccaggggtc

SEQ ID NO: 2585431 - DNA, 14 bp, Homo sapiens
tggcctgtgtccca

SEQ ID NO: 2585432 - DNA, 21 bp, Homo sapiens
tggcctgtgtcccatgaccca

SEQ ID NO: 2585433 - DNA, 18 bp, Homo sapiens
tggcctgtttcaacacag

SEQ ID NO: 2585434 - DNA, 23 bp, Homo sapiens
tggcctgttttagaaggttctct

SEQ ID NO: 2585435 - DNA, 16 bp, Homo sapiens
tggccttccccagcct

SEQ ID NO: 2585436 - DNA, 17 bp, Homo sapiens
tggccttccccagcctc

SEQ ID NO: 2585437 - DNA, 13 bp, Homo sapiens
tggcgcagccaag

SEQ ID NO: 2585438 - DNA, 15 bp, Homo sapiens
tggcgcagtgcctct

SEQ ID NO: 2585439 - DNA, 18 bp, Homo sapiens
tggcgcagtgcctctggt

SEQ ID NO: 2585440 - DNA, 15 bp, Homo sapiens
tggcggcagcagcca

SEQ ID NO: 2585441 - DNA, 14 bp, Homo sapiens
tggcgggcgcctgt

SEQ ID NO: 2585442 - DNA, 15 bp, Homo sapiens
tggcgggtgggggtg

SEQ ID NO: 2585443 - DNA, 13 bp, Homo sapiens
tggcgtctgtctt

SEQ ID NO: 2585444 - DNA, 17 bp, Homo sapiens
tggcgtctgtcttcaag

SEQ ID NO: 2585445 - DNA, 18 bp, Homo sapiens
tggcgtgtccctctcgga

SEQ ID NO: 2585446 - DNA, 17 bp, Homo sapiens
tggctaatgtactgcat

SEQ ID NO: 2585447 - DNA, 19 bp, Homo sapiens
tggctaatgtactgcatat

SEQ ID NO: 2585448 - DNA, 22 bp, Homo sapiens
tggctagaggccagccccaccc

SEQ ID NO: 2585449 - DNA, 23 bp, Homo sapiens
tggctagaggccagccccaccca

SEQ ID NO: 2585450 - DNA, 13 bp, Homo sapiens
tggctataaatat

SEQ ID NO: 2585451 - DNA, 19 bp, Homo sapiens
tggctataaatatataaaa

SEQ ID NO: 2585452 - DNA, 19 bp, Homo sapiens
tggctataggtgctacaaa

SEQ ID NO: 2585453 - DNA, 15 bp, Homo sapiens
tggctatgcatttga

SEQ ID NO: 2585454 - DNA, 19 bp, Homo sapiens
tggctatgcatttgaaaat

SEQ ID NO: 2585455 - DNA, 16 bp, Homo sapiens
tggctatttaaagaca

SEQ ID NO: 2585456 - DNA, 16 bp, Homo sapiens
tggctcacgcctgtaa

SEQ ID NO: 2585457 - DNA, 19 bp, Homo sapiens
tggctcacgcctgtaatcc

SEQ ID NO: 2585458 - DNA, 16 bp, Homo sapiens
tggctccaaaccctcg

SEQ ID NO: 2585459 - DNA, 20 bp, Homo sapiens
tggctccattggtgttgaca

SEQ ID NO: 2585460 - DNA, 20 bp, Homo sapiens
tggctcccatgaccatactg

SEQ ID NO: 2585461 - DNA, 14 bp, Homo sapiens
tggctcctgagggg

SEQ ID NO: 2585462 - DNA, 19 bp, Homo sapiens
tggctccttcccatcgctg

SEQ ID NO: 2585463 - DNA, 19 bp, Homo sapiens
tggctctccaagtgccaga

SEQ ID NO: 2585464 - DNA, 23 bp, Homo sapiens
tggctctccaagtgccagaggtg

SEQ ID NO: 2585465 - DNA, 17 bp, Homo sapiens
tggctctcccatttcct

SEQ ID NO: 2585466 - DNA, 13 bp, Homo sapiens
tggctctctccag

SEQ ID NO: 2585467 - DNA, 15 bp, Homo sapiens
tgtaaactcaaaata

SEQ ID NO: 2585468 - DNA, 17 bp, Homo sapiens
tgtaaagaaagagagaa

SEQ ID NO: 2585469 - DNA, 19 bp, Homo sapiens
tgtaaagaaagagagaaaa

SEQ ID NO: 2585470 - DNA, 18 bp, Homo sapiens
tgtaaagatatttttatc

SEQ ID NO: 2585471 - DNA, 17 bp, Homo sapiens
tgtaaagcattccaaca

SEQ ID NO: 2585472 - DNA, 19 bp, Homo sapiens
tgtaaagtaggaaaaataa

SEQ ID NO: 2585473 - DNA, 22 bp, Homo sapiens
tgtaaagtgtggtcccaacagg

SEQ ID NO: 2585474 - DNA, 14 bp, Homo sapiens
tgtaaagttagtct

SEQ ID NO: 2585475 - DNA, 12 bp, Homo sapiens
tgtaaatacata

SEQ ID NO: 2585476 - DNA, 14 bp, Homo sapiens
tgtaaatattctat

SEQ ID NO: 2585477 - DNA, 13 bp, Homo sapiens
tgtaaatatttat

SEQ ID NO: 2585478 - DNA, 12 bp, Homo sapiens
tgtaaatccttt

SEQ ID NO: 2585479 - DNA, 18 bp, Homo sapiens
tgtaaatggtgtacataa

SEQ ID NO: 2585480 - DNA, 14 bp, Homo sapiens
tgtaaattaacttt

SEQ ID NO: 2585481 - DNA, 15 bp, Homo sapiens
tgtaaattaactttt

SEQ ID NO: 2585482 - DNA, 20 bp, Homo sapiens
tgtaacacagctgagagact

SEQ ID NO: 2585483 - DNA, 23 bp, Homo sapiens
tgtaacagaaagggcaacaataa

SEQ ID NO: 2585484 - DNA, 14 bp, Homo sapiens
tgtaacagctgagg

SEQ ID NO: 2585485 - DNA, 20 bp, Homo sapiens
tgtaaccgattcatctctca

SEQ ID NO: 2585486 - DNA, 22 bp, Homo sapiens
tgtaaccgattcatctctcaga

SEQ ID NO: 2585487 - DNA, 14 bp, Homo sapiens
tgtaacctcagctc

SEQ ID NO: 2585488 - DNA, 15 bp, Homo sapiens
tgtaacctcagctct

SEQ ID NO: 2585489 - DNA, 16 bp, Homo sapiens
tgtaacgttgctgtgg

SEQ ID NO: 2585490 - DNA, 20 bp, Homo sapiens
tgtaacgttgctgtgggaac

SEQ ID NO: 2585491 - DNA, 23 bp, Homo sapiens
tgtaactgcattgagaactgcat

SEQ ID NO: 2585492 - DNA, 18 bp, Homo sapiens
tgtaactttctctatgaa

SEQ ID NO: 2585493 - DNA, 15 bp, Homo sapiens
tgtaacttttgtaag

SEQ ID NO: 2585494 - DNA, 20 bp, Homo sapiens
tgtaacttttgtaagacaaa

SEQ ID NO: 2585495 - DNA, 17 bp, Homo sapiens
tgtaagaaacacactga

SEQ ID NO: 2585496 - DNA, 22 bp, Homo sapiens
tgtaagaaacacactgaggcag

SEQ ID NO: 2585497 - DNA, 18 bp, Homo sapiens
tgtaagaaatactgtaca

SEQ ID NO: 2585498 - DNA, 20 bp, Homo sapiens
tgtaagacaaaggttttcct

SEQ ID NO: 2585499 - DNA, 19 bp, Homo sapiens
tgtaagagtgtagaagcat

SEQ ID NO: 2585500 - DNA, 19 bp, Homo sapiens
tgtaagatcgttctctgcc

SEQ ID NO: 2585501 - DNA, 17 bp, Homo sapiens
tgtaagatgctgggttg

SEQ ID NO: 2585502 - DNA, 22 bp, Homo sapiens
tgtaagctctactgaggtgcta

SEQ ID NO: 2585503 - DNA, 13 bp, Homo sapiens
tgtaagctgaagt

SEQ ID NO: 2585504 - DNA, 22 bp, Homo sapiens
tgtaagctgtttattttatatt

SEQ ID NO: 2585505 - DNA, 15 bp, Homo sapiens
tgtaaggcatgaagg

SEQ ID NO: 2585506 - DNA, 19 bp, Homo sapiens
tgtaagggaaactgccagc

SEQ ID NO: 2585507 - DNA, 15 bp, Homo sapiens
tgtaagtgtgtgtgt

SEQ ID NO: 2585508 - DNA, 14 bp, Homo sapiens
tgtaagtttcaggt

SEQ ID NO: 2585509 - DNA, 19 bp, Homo sapiens
tgtaagtttcaggtgacat

SEQ ID NO: 2585510 - DNA, 21 bp, Homo sapiens
tgtaagtttcaggtgacatgt

SEQ ID NO: 2585511 - DNA, 15 bp, Homo sapiens
tgtaataagacataa

SEQ ID NO: 2585512 - DNA, 13 bp, Homo sapiens
tgtaataatgtga

SEQ ID NO: 2585513 - DNA, 16 bp, Homo sapiens
tgtaatagaaaactga

SEQ ID NO: 2585514 - DNA, 14 bp, Homo sapiens
tgtaatcacagcta

SEQ ID NO: 2585515 - DNA, 22 bp, Homo sapiens
tgtaatcccagcactttgggag

SEQ ID NO: 2585516 - DNA, 22 bp, Homo sapiens
tgtaatcccagctacttgggag

SEQ ID NO: 2585517 - DNA, 16 bp, Homo sapiens
tgtaatcgttatgtgt

SEQ ID NO: 2585518 - DNA, 19 bp, Homo sapiens
tgtaatcgttatgtgtgta

SEQ ID NO: 2585519 - DNA, 16 bp, Homo sapiens
tgtaatctatgtatat

SEQ ID NO: 2585520 - DNA, 15 bp, Homo sapiens
tgtaatcttgaattg

SEQ ID NO: 2585521 - DNA, 16 bp, Homo sapiens
tgtaatgaaacacctt

SEQ ID NO: 2585522 - DNA, 13 bp, Homo sapiens
tgtaatgatcata

SEQ ID NO: 2585523 - DNA, 18 bp, Homo sapiens
tgtaattaagtactatgt

SEQ ID NO: 2585524 - DNA, 19 bp, Homo sapiens
tgtaattaagtactatgta

SEQ ID NO: 2585525 - DNA, 20 bp, Homo sapiens
tgtaattgttgtttgtatgt

SEQ ID NO: 2585526 - DNA, 16 bp, Homo sapiens
tgtaatttaaacaggc

SEQ ID NO: 2585527 - DNA, 20 bp, Homo sapiens
tgtaatttaaacaggcccag

SEQ ID NO: 2585528 - DNA, 17 bp, Homo sapiens
tgtaatttgtgatacaa

SEQ ID NO: 2585529 - DNA, 17 bp, Homo sapiens
tgtacaaaataaacaaa

SEQ ID NO: 2585530 - DNA, 19 bp, Homo sapiens
tgtacaaataaagtcccag

SEQ ID NO: 2585531 - DNA, 17 bp, Homo sapiens
tgtacaatatttaaaat

SEQ ID NO: 2585532 - DNA, 23 bp, Homo sapiens
tgtacaattgaacttaaataaat

SEQ ID NO: 2585533 - DNA, 20 bp, Homo sapiens
tgtacacgggactgacgcaa

SEQ ID NO: 2585534 - DNA, 16 bp, Homo sapiens
tgtacactgaatattt

SEQ ID NO: 2585535 - DNA, 21 bp, Homo sapiens
tgtacagaattctgctacctc

SEQ ID NO: 2585536 - DNA, 13 bp, Homo sapiens
tgtacagagccca

SEQ ID NO: 2585537 - DNA, 18 bp, Homo sapiens
tgtacagagcccacgccc

SEQ ID NO: 2585538 - DNA, 14 bp, Homo sapiens
tgtacagtctgtca

SEQ ID NO: 2585539 - DNA, 12 bp, Homo sapiens
tgtacagtcttg

SEQ ID NO: 2585540 - DNA, 15 bp, Homo sapiens
tgtacagtcttgtat

SEQ ID NO: 2585541 - DNA, 19 bp, Homo sapiens
tgtacagtgtgtaaagtgt

SEQ ID NO: 2585542 - DNA, 19 bp, Homo sapiens
tgtacataatgcgtgcata

SEQ ID NO: 2585543 - DNA, 13 bp, Homo sapiens
tgtacatatgtaa

SEQ ID NO: 2585544 - DNA, 19 bp, Homo sapiens
tgtacatatgtaaaataaa

SEQ ID NO: 2585545 - DNA, 21 bp, Homo sapiens
tgtacatatgtaaaataaaat

SEQ ID NO: 2585546 - DNA, 20 bp, Homo sapiens
tgtacatatttgagactagt

SEQ ID NO: 2585547 - DNA, 18 bp, Homo sapiens
tgtacatatttgtggaat

SEQ ID NO: 2585548 - DNA, 19 bp, Homo sapiens
tgtacatatttgtggaata

SEQ ID NO: 2585549 - DNA, 17 bp, Homo sapiens
tgtacatgaaaacacat

SEQ ID NO: 2585550 - DNA, 18 bp, Homo sapiens
tgtacatgaaaacacatt

SEQ ID NO: 2585551 - DNA, 14 bp, Homo sapiens
tgtacatgcattca

SEQ ID NO: 2585552 - DNA, 17 bp, Homo sapiens
tgtacatgtgtagcctg

SEQ ID NO: 2585553 - DNA, 17 bp, Homo sapiens
tgtaccagcccagatgt

SEQ ID NO: 2585554 - DNA, 14 bp, Homo sapiens
tgtacctcttgagc

SEQ ID NO: 2585555 - DNA, 15 bp, Homo sapiens
tgtacgtctgacagg

SEQ ID NO: 2585556 - DNA, 19 bp, Homo sapiens
tgtacgtttgtatgtgtgt

SEQ ID NO: 2585557 - DNA, 20 bp, Homo sapiens
tgtactgaaaaatggtaatt

SEQ ID NO: 2585558 - DNA, 23 bp, Homo sapiens
tgtactgttctcttcttgaacac

SEQ ID NO: 2585559 - DNA, 16 bp, Homo sapiens
tgtactgttctgtgtc

SEQ ID NO: 2585560 - DNA, 20 bp, Homo sapiens
tgtacttaataaattcagat

SEQ ID NO: 2585561 - DNA, 21 bp, Homo sapiens
tgtagaaatgatgatgtggaa

SEQ ID NO: 2585562 - DNA, 17 bp, Homo sapiens
tgtagaagcattccttc

SEQ ID NO: 2585563 - DNA, 22 bp, Homo sapiens
tgtagaagcattccttctttga

SEQ ID NO: 2585564 - DNA, 17 bp, Homo sapiens
tgtagaatgatttcatg

SEQ ID NO: 2585565 - DNA, 18 bp, Homo sapiens
tgtagaatgatttcatgc

SEQ ID NO: 2585566 - DNA, 17 bp, Homo sapiens
tgtagaatgtattgtac

SEQ ID NO: 2585567 - DNA, 12 bp, Homo sapiens
tgtagagccagg

SEQ ID NO: 2585568 - DNA, 15 bp, Homo sapiens
tgtagagccagggtc

SEQ ID NO: 2585569 - DNA, 18 bp, Homo sapiens
tgtagagccagggtctca

SEQ ID NO: 2585570 - DNA, 14 bp, Homo sapiens
tgtagagggccctg

SEQ ID NO: 2585571 - DNA, 21 bp, Homo sapiens
tgtagagttaagaagctgttg

SEQ ID NO: 2585572 - DNA, 15 bp, Homo sapiens
tgtagattctgtgga

SEQ ID NO: 2585573 - DNA, 15 bp, Homo sapiens
tgtagatttatttca

SEQ ID NO: 2585574 - DNA, 10 bp, Homo sapiens
tgtagccaag

SEQ ID NO: 2585575 - DNA, 15 bp, Homo sapiens
tgtagcctgtgcatg

SEQ ID NO: 2585576 - DNA, 16 bp, Homo sapiens
tgtagcctgtgcatgt

SEQ ID NO: 2585577 - DNA, 20 bp, Homo sapiens
tgtaggaaggttaatgttca

SEQ ID NO: 2585578 - DNA, 21 bp, Homo sapiens
tgtaggaattcttttggggaa

SEQ ID NO: 2585579 - DNA, 15 bp, Homo sapiens
tgtagggctggacct

SEQ ID NO: 2585580 - DNA, 19 bp, Homo sapiens
tgtagtaaactatttatct

SEQ ID NO: 2585581 - DNA, 22 bp, Homo sapiens
tgtagtaaagccgttgtttact

SEQ ID NO: 2585582 - DNA, 13 bp, Homo sapiens
tgtagtagtctca

SEQ ID NO: 2585583 - DNA, 18 bp, Homo sapiens
tgtagtatcaaatattag

SEQ ID NO: 2585584 - DNA, 19 bp, Homo sapiens
tgtagtatcaaatattaga

SEQ ID NO: 2585585 - DNA, 23 bp, Homo sapiens
tgtagtatcaaatattagatgtg

SEQ ID NO: 2585586 - DNA, 17 bp, Homo sapiens
tgtagtcccagctactc

SEQ ID NO: 2585587 - DNA, 12 bp, Homo sapiens
tgtagttaggaa

SEQ ID NO: 2585588 - DNA, 20 bp, Homo sapiens
tgtagttgaactgatagtta

SEQ ID NO: 2585589 - DNA, 22 bp, Homo sapiens
tgtagttgcaatagaacagaga

SEQ ID NO: 2585590 - DNA, 20 bp, Homo sapiens
tgtagttgcgtggactctgc

SEQ ID NO: 2585591 - DNA, 22 bp, Homo sapiens
tgtagttttatcacatgtatgt

SEQ ID NO: 2585592 - DNA, 14 bp, Homo sapiens
tgtataaatttatt

SEQ ID NO: 2585593 - DNA, 15 bp, Homo sapiens
tgtataacaggttat

SEQ ID NO: 2585594 - DNA, 17 bp, Homo sapiens
tgtataacaggttattt

SEQ ID NO: 2585595 - DNA, 21 bp, Homo sapiens
tgtataacaggttattttagt

SEQ ID NO: 2585596 - DNA, 21 bp, Homo sapiens
tgtataacttcttaaaagttg

SEQ ID NO: 2585597 - DNA, 19 bp, Homo sapiens
tgtataagtccttgcaaga

SEQ ID NO: 2585598 - DNA, 19 bp, Homo sapiens
tgtatagatgcaagatatt

SEQ ID NO: 2585599 - DNA, 21 bp, Homo sapiens
tgtatagtactggcatggtac

SEQ ID NO: 2585600 - DNA, 24 bp, Homo sapiens
tgtatagtgtaaaataagaatgat

SEQ ID NO: 2585601 - DNA, 21 bp, Homo sapiens
tgtatagttgtggacatttaa

SEQ ID NO: 2585602 - DNA, 13 bp, Homo sapiens
tgtatatatgtgt

SEQ ID NO: 2585603 - DNA, 18 bp, Homo sapiens
tgtatatatgtgtgttta

SEQ ID NO: 2585604 - DNA, 20 bp, Homo sapiens
tgtatatatgtgtgtttaaa

SEQ ID NO: 2585605 - DNA, 18 bp, Homo sapiens
tgtatatcagaaaaggga

SEQ ID NO: 2585606 - DNA, 15 bp, Homo sapiens
tgtatatttgtacaa

SEQ ID NO: 2585607 - DNA, 21 bp, Homo sapiens
tgtatcaggaaatatatatgt

SEQ ID NO: 2585608 - DNA, 17 bp, Homo sapiens
tgtatcatagaaatgta

SEQ ID NO: 2585609 - DNA, 19 bp, Homo sapiens
tgtatccattatcatgtgt

SEQ ID NO: 2585610 - DNA, 23 bp, Homo sapiens
tgtatcccatgagcctcagcatc

SEQ ID NO: 2585611 - DNA, 10 bp, Homo sapiens
tgtgtacagg

SEQ ID NO: 2585612 - DNA, 19 bp, Homo sapiens
tgtgtacagtgtgtaaagt

SEQ ID NO: 2585613 - DNA, 23 bp, Homo sapiens
tgtgtacatcccatgtaacagaa

SEQ ID NO: 2585614 - DNA, 16 bp, Homo sapiens
tgtgtagacaaatatt

SEQ ID NO: 2585615 - DNA, 13 bp, Homo sapiens
tgtgtagagttaa

SEQ ID NO: 2585616 - DNA, 18 bp, Homo sapiens
tgtgtagagttaagaagc

SEQ ID NO: 2585617 - DNA, 15 bp, Homo sapiens
tgtgtatacatgcca

SEQ ID NO: 2585618 - DNA, 23 bp, Homo sapiens
tgtgtatgtgggggtctgtgtgt

SEQ ID NO: 2585619 - DNA, 14 bp, Homo sapiens
tgtgtattccaaga

SEQ ID NO: 2585620 - DNA, 12 bp, Homo sapiens
tgtgtattgttc

SEQ ID NO: 2585621 - DNA, 19 bp, Homo sapiens
tgtgtcagcatagaagtaa

SEQ ID NO: 2585622 - DNA, 17 bp, Homo sapiens
tgtgtcaggtggggcag

SEQ ID NO: 2585623 - DNA, 14 bp, Homo sapiens
tgtgtcccatgacc

SEQ ID NO: 2585624 - DNA, 19 bp, Homo sapiens
tgtgtcccatgacccaccc

SEQ ID NO: 2585625 - DNA, 22 bp, Homo sapiens
tgtgtcccatgacccacccctg

SEQ ID NO: 2585626 - DNA, 14 bp, Homo sapiens
tgtgtccttccctg

SEQ ID NO: 2585627 - DNA, 19 bp, Homo sapiens
tgtgtctaggcaggacctg

SEQ ID NO: 2585628 - DNA, 17 bp, Homo sapiens
tgtgtctcttggtcctg

SEQ ID NO: 2585629 - DNA, 20 bp, Homo sapiens
tgtgtctcttggtcctgctg

SEQ ID NO: 2585630 - DNA, 14 bp, Homo sapiens
tgtgtctcttttct

SEQ ID NO: 2585631 - DNA, 16 bp, Homo sapiens
tgtgtctcttttctct

SEQ ID NO: 2585632 - DNA, 21 bp, Homo sapiens
tgtgtctgtacacgtgtcctg

SEQ ID NO: 2585633 - DNA, 20 bp, Homo sapiens
tgtgtcttgcaatggcagcc

SEQ ID NO: 2585634 - DNA, 17 bp, Homo sapiens
tgtgtgagcaagcattt

SEQ ID NO: 2585635 - DNA, 20 bp, Homo sapiens
tgtgtgaggagctgctggct

SEQ ID NO: 2585636 - DNA, 23 bp, Homo sapiens
tgtgtgcaccttaccaactttct

SEQ ID NO: 2585637 - DNA, 20 bp, Homo sapiens
tgtgtgcatgtgtgtgctca

SEQ ID NO: 2585638 - DNA, 23 bp, Homo sapiens
tgtgtgccatagagtttaacaca

SEQ ID NO: 2585639 - DNA, 18 bp, Homo sapiens
tgtgtgctcttcttcttt

SEQ ID NO: 2585640 - DNA, 16 bp, Homo sapiens
tgtgtggactgtgatg

SEQ ID NO: 2585641 - DNA, 15 bp, Homo sapiens
tgtgtgggagtgtgt

SEQ ID NO: 2585642 - DNA, 13 bp, Homo sapiens
tgtgtgtatgcta

SEQ ID NO: 2585643 - DNA, 11 bp, Homo sapiens
tgtgtgtatgt

SEQ ID NO: 2585644 - DNA, 19 bp, Homo sapiens
tgtgtgtatgtttgcacac

SEQ ID NO: 2585645 - DNA, 13 bp, Homo sapiens
tgtgtgtgtatgt

SEQ ID NO: 2585646 - DNA, 14 bp, Homo sapiens
tgtgtgtgtatgtg

SEQ ID NO: 2585647 - DNA, 11 bp, Homo sapiens
tgtgtgtgtgt

SEQ ID NO: 2585648 - DNA, 16 bp, Homo sapiens
tgtgtgtgtgtatgtg

SEQ ID NO: 2585649 - DNA, 16 bp, Homo sapiens
tgtgtgtttaaataaa

SEQ ID NO: 2585650 - DNA, 23 bp, Homo sapiens
tgtgttatcacccagaagaaaat

SEQ ID NO: 2585651 - DNA, 13 bp, Homo sapiens
tgtgttatttaaa

SEQ ID NO: 2585652 - DNA, 14 bp, Homo sapiens
tgtgttatttaaat

SEQ ID NO: 2585653 - DNA, 17 bp, Homo sapiens
tgtgttcccatttcagc

SEQ ID NO: 2585654 - DNA, 10 bp, Homo sapiens
tgtgttcctg

SEQ ID NO: 2585655 - DNA, 23 bp, Homo sapiens
tgtgttgtgtgtgggagtgtgta

SEQ ID NO: 2585656 - DNA, 13 bp, Homo sapiens
tgtgttgttgctt

SEQ ID NO: 2585657 - DNA, 14 bp, Homo sapiens
tgtgttgttgcttt

SEQ ID NO: 2585658 - DNA, 12 bp, Homo sapiens
tgtgtttaaata

SEQ ID NO: 2585659 - DNA, 13 bp, Homo sapiens
tgtgtttatgtgt

SEQ ID NO: 2585660 - DNA, 11 bp, Homo sapiens
tgtgtttcctt

SEQ ID NO: 2585661 - DNA, 15 bp, Homo sapiens
tgtgtttttaataaa

SEQ ID NO: 2585662 - DNA, 14 bp, Homo sapiens
tgtgtttttattgt

SEQ ID NO: 2585663 - DNA, 24 bp, Homo sapiens
tgttaaatcccattcataactttc

SEQ ID NO: 2585664 - DNA, 19 bp, Homo sapiens
tgttaaatgaaattgtaaa

SEQ ID NO: 2585665 - DNA, 14 bp, Homo sapiens
tgttaaatttgtaa

SEQ ID NO: 2585666 - DNA, 18 bp, Homo sapiens
tgttaaatttgtaagttt

SEQ ID NO: 2585667 - DNA, 21 bp, Homo sapiens
tgttaaatttgtaagtttcag

SEQ ID NO: 2585668 - DNA, 13 bp, Homo sapiens
tgttaacacattt

SEQ ID NO: 2585669 - DNA, 14 bp, Homo sapiens
tgttaacttagctt

SEQ ID NO: 2585670 - DNA, 14 bp, Homo sapiens
tgttaaggaaactc

SEQ ID NO: 2585671 - DNA, 15 bp, Homo sapiens
tgttaaggaaactct

SEQ ID NO: 2585672 - DNA, 20 bp, Homo sapiens
tgttaagggaagaattccag

SEQ ID NO: 2585673 - DNA, 22 bp, Homo sapiens
tgttaagttgatggtgatgaaa

SEQ ID NO: 2585674 - DNA, 19 bp, Homo sapiens
tgttaataaaagtacatgt

SEQ ID NO: 2585675 - DNA, 18 bp, Homo sapiens
tgttaatactagttgtga

SEQ ID NO: 2585676 - DNA, 20 bp, Homo sapiens
tgttaatcaatttaaaccca

SEQ ID NO: 2585677 - DNA, 22 bp, Homo sapiens
tgttaatcaatttaaacccatt

SEQ ID NO: 2585678 - DNA, 23 bp, Homo sapiens
tgttaatcttaggggagagcttt

SEQ ID NO: 2585679 - DNA, 14 bp, Homo sapiens
tgttaatgaaaatg

SEQ ID NO: 2585680 - DNA, 22 bp, Homo sapiens
tgttacatttttaagtgctgca

SEQ ID NO: 2585681 - DNA, 18 bp, Homo sapiens
tgttaccctcctgtaaat

SEQ ID NO: 2585682 - DNA, 15 bp, Homo sapiens
tgttacctgaaaaca

SEQ ID NO: 2585683 - DNA, 16 bp, Homo sapiens
tgttacctgaaaacac

SEQ ID NO: 2585684 - DNA, 14 bp, Homo sapiens
tgttactaagtttt

SEQ ID NO: 2585685 - DNA, 13 bp, Homo sapiens
tgttactgatcat

SEQ ID NO: 2585686 - DNA, 14 bp, Homo sapiens
tgttactgatcatg

SEQ ID NO: 2585687 - DNA, 22 bp, Homo sapiens
tgttagaggatccctctctgga

SEQ ID NO: 2585688 - DNA, 22 bp, Homo sapiens
tgttagaggttttaaagtgatt

SEQ ID NO: 2585689 - DNA, 17 bp, Homo sapiens
tgttagccccataattt

SEQ ID NO: 2585690 - DNA, 13 bp, Homo sapiens
tgttatgaaataa

SEQ ID NO: 2585691 - DNA, 20 bp, Homo sapiens
tgttattaaacgtatgcatg

SEQ ID NO: 2585692 - DNA, 18 bp, Homo sapiens
tgttatttcttacaggca

SEQ ID NO: 2585693 - DNA, 14 bp, Homo sapiens
tgttattttcagta

SEQ ID NO: 2585694 - DNA, 18 bp, Homo sapiens
tgttattttctgttgaag

SEQ ID NO: 2585695 - DNA, 22 bp, Homo sapiens
tgttatttttatatcagcctga

SEQ ID NO: 2585696 - DNA, 18 bp, Homo sapiens
tgttattttttaattatt

SEQ ID NO: 2585697 - DNA, 23 bp, Homo sapiens
tgttcaagaccagcctgaccaac

SEQ ID NO: 2585698 - DNA, 16 bp, Homo sapiens
tgttcaatgtttaatg

SEQ ID NO: 2585699 - DNA, 22 bp, Homo sapiens
tgttcacacctagcgtcagtat

SEQ ID NO: 2585700 - DNA, 16 bp, Homo sapiens
tgttcacactctcaca

SEQ ID NO: 2585701 - DNA, 13 bp, Homo sapiens
tgttcactgtccc

SEQ ID NO: 2585702 - DNA, 18 bp, Homo sapiens
tgttcagaaggttgctct

SEQ ID NO: 2585703 - DNA, 22 bp, Homo sapiens
tgttcagaaggttgctctagat

SEQ ID NO: 2585704 - DNA, 14 bp, Homo sapiens
tgttcagctccagc

SEQ ID NO: 2585705 - DNA, 18 bp, Homo sapiens
tgttcagctccagctcac

SEQ ID NO: 2585706 - DNA, 15 bp, Homo sapiens
tgttcagtgtaaata

SEQ ID NO: 2585707 - DNA, 17 bp, Homo sapiens
tgttcagtgtcccgggc

SEQ ID NO: 2585708 - DNA, 15 bp, Homo sapiens
tgttcagttacagaa

SEQ ID NO: 2585709 - DNA, 17 bp, Homo sapiens
tgttcagttacagaaag

SEQ ID NO: 2585710 - DNA, 12 bp, Homo sapiens
tgttcatacatt

SEQ ID NO: 2585711 - DNA, 16 bp, Homo sapiens
tgttcattgtaatgtt

SEQ ID NO: 2585712 - DNA, 19 bp, Homo sapiens
tgttcattgtaatgttact

SEQ ID NO: 2585713 - DNA, 11 bp, Homo sapiens
tgttccaagac

SEQ ID NO: 2585714 - DNA, 14 bp, Homo sapiens
tgttccaagacatt

SEQ ID NO: 2585715 - DNA, 14 bp, Homo sapiens
tgttccagctcttt

SEQ ID NO: 2585716 - DNA, 17 bp, Homo sapiens
tgttcccacctgctgga

SEQ ID NO: 2585717 - DNA, 16 bp, Homo sapiens
tgttcccatttcagct

SEQ ID NO: 2585718 - DNA, 17 bp, Homo sapiens
tgttcccatttcagctg

SEQ ID NO: 2585719 - DNA, 13 bp, Homo sapiens
tgttccccatctg

SEQ ID NO: 2585720 - DNA, 16 bp, Homo sapiens
tgttccccctgtgcag

SEQ ID NO: 2585721 - DNA, 14 bp, Homo sapiens
tgttcccctcactg

SEQ ID NO: 2585722 - DNA, 17 bp, Homo sapiens
tgttccccttccactga

SEQ ID NO: 2585723 - DNA, 23 bp, Homo sapiens
tgttccccttccactgagggcag

SEQ ID NO: 2585724 - DNA, 18 bp, Homo sapiens
tgttccctctccctgttg

SEQ ID NO: 2585725 - DNA, 18 bp, Homo sapiens
tgttccctctgctcctgg

SEQ ID NO: 2585726 - DNA, 19 bp, Homo sapiens
tgttcctacagcccctttt

SEQ ID NO: 2585727 - DNA, 21 bp, Homo sapiens
tgttcctggcaatagtgtgtt

SEQ ID NO: 2585728 - DNA, 18 bp, Homo sapiens
tgttctactcatatatat

SEQ ID NO: 2585729 - DNA, 16 bp, Homo sapiens
tgttctattcatctca

SEQ ID NO: 2585730 - DNA, 16 bp, Homo sapiens
tgttctccgtccctgc

SEQ ID NO: 2585731 - DNA, 18 bp, Homo sapiens
tgttctctgaggacacta

SEQ ID NO: 2585732 - DNA, 12 bp, Homo sapiens
tgttctctgccc

SEQ ID NO: 2585733 - DNA, 19 bp, Homo sapiens
tgttctgacattaacagtt

SEQ ID NO: 2585734 - DNA, 20 bp, Homo sapiens
tgttctgacattaacagttt

SEQ ID NO: 2585735 - DNA, 15 bp, Homo sapiens
tgttctgaccctgct

SEQ ID NO: 2585736 - DNA, 14 bp, Homo sapiens
tgttctgattagaa

SEQ ID NO: 2585737 - DNA, 13 bp, Homo sapiens
tgttctggccctc

SEQ ID NO: 2585738 - DNA, 20 bp, Homo sapiens
tgttctggctcttccaggct

SEQ ID NO: 2585739 - DNA, 14 bp, Homo sapiens
tgttctgggacaca

SEQ ID NO: 2585740 - DNA, 15 bp, Homo sapiens
tgttctgggacacag

SEQ ID NO: 2585741 - DNA, 21 bp, Homo sapiens
tgttctgtggaaagtgtaaag

SEQ ID NO: 2585742 - DNA, 22 bp, Homo sapiens
tgttctgtggaaagtgtaaagc

SEQ ID NO: 2585743 - DNA, 16 bp, Homo sapiens
tgttcttaagacgtga

SEQ ID NO: 2585744 - DNA, 16 bp, Homo sapiens
tgttcttaattgcact

SEQ ID NO: 2585745 - DNA, 17 bp, Homo sapiens
tgttcttaattgcactc

SEQ ID NO: 2585746 - DNA, 18 bp, Homo sapiens
tgttcttaattgcactct

SEQ ID NO: 2585747 - DNA, 17 bp, Homo sapiens
tgttcttggtttgtaaa

SEQ ID NO: 2585748 - DNA, 15 bp, Homo sapiens
tgttctttaggagat

SEQ ID NO: 2585749 - DNA, 14 bp, Homo sapiens
tgttctttctggct

SEQ ID NO: 2585750 - DNA, 14 bp, Homo sapiens
tgttctttttattg

SEQ ID NO: 2585751 - DNA, 14 bp, Homo sapiens
tgttgaaaatgttc

SEQ ID NO: 2585752 - DNA, 21 bp, Homo sapiens
tgttgaaattatgtatgttta

SEQ ID NO: 2585753 - DNA, 22 bp, Homo sapiens
tgttgaatgcccacaggcaaat

SEQ ID NO: 2585754 - DNA, 17 bp, Homo sapiens
tgttgacagttcatatg

SEQ ID NO: 2585755 - DNA, 16 bp, Homo sapiens
tgttgacagttctgaa

SEQ ID NO: 2585756 - DNA, 14 bp, Homo sapiens
tgttgacatgtgct

SEQ ID NO: 2585757 - DNA, 13 bp, Homo sapiens
ttagcaaagagtt

SEQ ID NO: 2585758 - DNA, 19 bp, Homo sapiens
ttagcaaagagttaatata

SEQ ID NO: 2585759 - DNA, 20 bp, Homo sapiens
ttagcaggagaggagagcca

SEQ ID NO: 2585760 - DNA, 22 bp, Homo sapiens
ttagcaggagaggagagccaga

SEQ ID NO: 2585761 - DNA, 21 bp, Homo sapiens
ttagcatgacaagccccaggc

SEQ ID NO: 2585762 - DNA, 22 bp, Homo sapiens
ttagcatttagtccaatgtctt

SEQ ID NO: 2585763 - DNA, 23 bp, Homo sapiens
ttagccaggatcatggtgtaata

SEQ ID NO: 2585764 - DNA, 12 bp, Homo sapiens
ttagcccccacc

SEQ ID NO: 2585765 - DNA, 15 bp, Homo sapiens
ttagcctccctgaaa

SEQ ID NO: 2585766 - DNA, 19 bp, Homo sapiens
ttagctctggaccagcctg

SEQ ID NO: 2585767 - DNA, 15 bp, Homo sapiens
ttagctgtctgctca

SEQ ID NO: 2585768 - DNA, 17 bp, Homo sapiens
ttagctgtctgctcaga

SEQ ID NO: 2585769 - DNA, 17 bp, Homo sapiens
ttagctgttatttctat

SEQ ID NO: 2585770 - DNA, 21 bp, Homo sapiens
ttagctgttatttctattttt

SEQ ID NO: 2585771 - DNA, 16 bp, Homo sapiens
ttagcttagacctcag

SEQ ID NO: 2585772 - DNA, 15 bp, Homo sapiens
ttagctttactgttt

SEQ ID NO: 2585773 - DNA, 17 bp, Homo sapiens
ttagctttttaattgtt

SEQ ID NO: 2585774 - DNA, 11 bp, Homo sapiens
ttaggaaataa

SEQ ID NO: 2585775 - DNA, 20 bp, Homo sapiens
ttaggaaataaaacctttca

SEQ ID NO: 2585776 - DNA, 13 bp, Homo sapiens
ttaggaagtgtaa

SEQ ID NO: 2585777 - DNA, 19 bp, Homo sapiens
ttaggaagtgtaacagctg

SEQ ID NO: 2585778 - DNA, 21 bp, Homo sapiens
ttaggaagtgtaacagctgag

SEQ ID NO: 2585779 - DNA, 19 bp, Homo sapiens
ttaggaattaagttatctt

SEQ ID NO: 2585780 - DNA, 22 bp, Homo sapiens
ttaggatttaacagtcatttaa

SEQ ID NO: 2585781 - DNA, 22 bp, Homo sapiens
ttaggccaaaaaaatgtaagat

SEQ ID NO: 2585782 - DNA, 16 bp, Homo sapiens
ttaggctattcacaac

SEQ ID NO: 2585783 - DNA, 14 bp, Homo sapiens
ttagggagagaaga

SEQ ID NO: 2585784 - DNA, 15 bp, Homo sapiens
ttagggagagaagat

SEQ ID NO: 2585785 - DNA, 23 bp, Homo sapiens
ttagggagagtcatattttgatt

SEQ ID NO: 2585786 - DNA, 12 bp, Homo sapiens
ttagggaggggt

SEQ ID NO: 2585787 - DNA, 19 bp, Homo sapiens
ttaggtgtgggggaagcac

SEQ ID NO: 2585788 - DNA, 19 bp, Homo sapiens
ttaggtgttgattttctgt

SEQ ID NO: 2585789 - DNA, 14 bp, Homo sapiens
ttaggttttgtaca

SEQ ID NO: 2585790 - DNA, 16 bp, Homo sapiens
ttaggttttgtacaat

SEQ ID NO: 2585791 - DNA, 22 bp, Homo sapiens
ttaggttttgtacaattgaact

SEQ ID NO: 2585792 - DNA, 14 bp, Homo sapiens
ttagtagagacagg

SEQ ID NO: 2585793 - DNA, 17 bp, Homo sapiens
ttagtagagacagggtt

SEQ ID NO: 2585794 - DNA, 13 bp, Homo sapiens
ttagtagcatgtt

SEQ ID NO: 2585795 - DNA, 17 bp, Homo sapiens
ttagtatctaacatgta

SEQ ID NO: 2585796 - DNA, 23 bp, Homo sapiens
ttagtatctaacatgtatcccaa

SEQ ID NO: 2585797 - DNA, 18 bp, Homo sapiens
ttagtatgaggcatttgt

SEQ ID NO: 2585798 - DNA, 13 bp, Homo sapiens
ttagtcacttttt

SEQ ID NO: 2585799 - DNA, 22 bp, Homo sapiens
ttagtcactttttttttccaaa

SEQ ID NO: 2585800 - DNA, 17 bp, Homo sapiens
ttagtccctcatgcaaa

SEQ ID NO: 2585801 - DNA, 22 bp, Homo sapiens
ttagtctactcttaagccatct

SEQ ID NO: 2585802 - DNA, 23 bp, Homo sapiens
ttagtctcagtttgtgtgtctta

SEQ ID NO: 2585803 - DNA, 18 bp, Homo sapiens
ttagtctctaaagagttt

SEQ ID NO: 2585804 - DNA, 14 bp, Homo sapiens
ttagtcttctcata

SEQ ID NO: 2585805 - DNA, 18 bp, Homo sapiens
ttagtcttctcatagcat

SEQ ID NO: 2585806 - DNA, 14 bp, Homo sapiens
ttagtgcctgtgtg

SEQ ID NO: 2585807 - DNA, 17 bp, Homo sapiens
ttagtgcggacaagttt

SEQ ID NO: 2585808 - DNA, 20 bp, Homo sapiens
ttagtggctcaacattgtgt

SEQ ID NO: 2585809 - DNA, 12 bp, Homo sapiens
ttagtggcttca

SEQ ID NO: 2585810 - DNA, 16 bp, Homo sapiens
ttagtgtatgctttga

SEQ ID NO: 2585811 - DNA, 23 bp, Homo sapiens
ttagtgtcacttacctagattta

SEQ ID NO: 2585812 - DNA, 17 bp, Homo sapiens
ttagtgtttctgtgcat

SEQ ID NO: 2585813 - DNA, 21 bp, Homo sapiens
ttagtgtttgggtatattcat

SEQ ID NO: 2585814 - DNA, 13 bp, Homo sapiens
ttagttaatatat

SEQ ID NO: 2585815 - DNA, 22 bp, Homo sapiens
ttagttatagtttcagatatat

SEQ ID NO: 2585816 - DNA, 14 bp, Homo sapiens
ttagttccttgagt

SEQ ID NO: 2585817 - DNA, 17 bp, Homo sapiens
ttagtttacaatcagcc

SEQ ID NO: 2585818 - DNA, 15 bp, Homo sapiens
ttagtttctgttctg

SEQ ID NO: 2585819 - DNA, 14 bp, Homo sapiens
ttagtttctttggg

SEQ ID NO: 2585820 - DNA, 14 bp, Homo sapiens
ttagtttggattct

SEQ ID NO: 2585821 - DNA, 17 bp, Homo sapiens
ttagttttagttgcaga

SEQ ID NO: 2585822 - DNA, 12 bp, Homo sapiens
ttagttttgatt

SEQ ID NO: 2585823 - DNA, 18 bp, Homo sapiens
ttagtttttgtgaagttt

SEQ ID NO: 2585824 - DNA, 21 bp, Homo sapiens
ttagtttttgtgaagtttaat

SEQ ID NO: 2585825 - DNA, 13 bp, Homo sapiens
ttataaaagtgat

SEQ ID NO: 2585826 - DNA, 16 bp, Homo sapiens
ttataaaattaagcaa

SEQ ID NO: 2585827 - DNA, 17 bp, Homo sapiens
ttataaactttaccttt

SEQ ID NO: 2585828 - DNA, 18 bp, Homo sapiens
ttataaactttacctttt

SEQ ID NO: 2585829 - DNA, 18 bp, Homo sapiens
ttataaatcgcttttgat

SEQ ID NO: 2585830 - DNA, 14 bp, Homo sapiens
ttataaatgctatt

SEQ ID NO: 2585831 - DNA, 15 bp, Homo sapiens
ttataaattatgttt

SEQ ID NO: 2585832 - DNA, 21 bp, Homo sapiens
ttataaattatgtttatataa

SEQ ID NO: 2585833 - DNA, 19 bp, Homo sapiens
ttataactcatcataaaat

SEQ ID NO: 2585834 - DNA, 16 bp, Homo sapiens
ttataactctgcacta

SEQ ID NO: 2585835 - DNA, 14 bp, Homo sapiens
ttataagcagattt

SEQ ID NO: 2585836 - DNA, 15 bp, Homo sapiens
ttataataatgttaa

SEQ ID NO: 2585837 - DNA, 13 bp, Homo sapiens
ttataatatacta

SEQ ID NO: 2585838 - DNA, 15 bp, Homo sapiens
ttatacaaatgtctt

SEQ ID NO: 2585839 - DNA, 17 bp, Homo sapiens
ttatacaacagtgctaa

SEQ ID NO: 2585840 - DNA, 18 bp, Homo sapiens
ttatacgtgtagctatat

SEQ ID NO: 2585841 - DNA, 21 bp, Homo sapiens
ttatacgtgtagctatatcta

SEQ ID NO: 2585842 - DNA, 14 bp, Homo sapiens
ttatactgtattaa

SEQ ID NO: 2585843 - DNA, 18 bp, Homo sapiens
ttatactttgtaaagaca

SEQ ID NO: 2585844 - DNA, 16 bp, Homo sapiens
ttatagccgaaatgat

SEQ ID NO: 2585845 - DNA, 16 bp, Homo sapiens
ttatagctcagtttat

SEQ ID NO: 2585846 - DNA, 19 bp, Homo sapiens
ttataggtggcctctcctt

SEQ ID NO: 2585847 - DNA, 21 bp, Homo sapiens
ttatagtgatgtaatcttgaa

SEQ ID NO: 2585848 - DNA, 15 bp, Homo sapiens
ttatagttgtaacta

SEQ ID NO: 2585849 - DNA, 14 bp, Homo sapiens
ttatataaatgctt

SEQ ID NO: 2585850 - DNA, 19 bp, Homo sapiens
ttatatagattataacttg

SEQ ID NO: 2585851 - DNA, 22 bp, Homo sapiens
ttatatagattataacttgtct

SEQ ID NO: 2585852 - DNA, 21 bp, Homo sapiens
ttatataggttttgtttgcta

SEQ ID NO: 2585853 - DNA, 15 bp, Homo sapiens
ttatatatacagtaa

SEQ ID NO: 2585854 - DNA, 13 bp, Homo sapiens
ttatatatttata

SEQ ID NO: 2585855 - DNA, 14 bp, Homo sapiens
ttatatatttataa

SEQ ID NO: 2585856 - DNA, 23 bp, Homo sapiens
ttatatatttataactcatcata

SEQ ID NO: 2585857 - DNA, 13 bp, Homo sapiens
ttatatgcttact

SEQ ID NO: 2585858 - DNA, 14 bp, Homo sapiens
ttatattccatata

SEQ ID NO: 2585859 - DNA, 21 bp, Homo sapiens
ttatattccatatattagcat

SEQ ID NO: 2585860 - DNA, 15 bp, Homo sapiens
ttatcaagtgtcttc

SEQ ID NO: 2585861 - DNA, 17 bp, Homo sapiens
ttatcaagtgtcttcca

SEQ ID NO: 2585862 - DNA, 15 bp, Homo sapiens
ttatcacatgtatgt

SEQ ID NO: 2585863 - DNA, 19 bp, Homo sapiens
ttatcaccagctgcctctt

SEQ ID NO: 2585864 - DNA, 18 bp, Homo sapiens
ttatcacccagaagaaaa

SEQ ID NO: 2585865 - DNA, 21 bp, Homo sapiens
ttatcacccagaagaaaatag

SEQ ID NO: 2585866 - DNA, 18 bp, Homo sapiens
ttatcactgacacaaaaa

SEQ ID NO: 2585867 - DNA, 16 bp, Homo sapiens
ttatcagtgacagagt

SEQ ID NO: 2585868 - DNA, 17 bp, Homo sapiens
ttatcagtgacagagtt

SEQ ID NO: 2585869 - DNA, 16 bp, Homo sapiens
ttatcatgctgtcttt

SEQ ID NO: 2585870 - DNA, 13 bp, Homo sapiens
ttatcatgtgtaa

SEQ ID NO: 2585871 - DNA, 12 bp, Homo sapiens
ttatccaggact

SEQ ID NO: 2585872 - DNA, 15 bp, Homo sapiens
ttatcctctgatctc

SEQ ID NO: 2585873 - DNA, 20 bp, Homo sapiens
ttatcctctgatctccatgg

SEQ ID NO: 2585874 - DNA, 13 bp, Homo sapiens
ttatcgaaataac

SEQ ID NO: 2585875 - DNA, 14 bp, Homo sapiens
ttatcggaagcagt

SEQ ID NO: 2585876 - DNA, 14 bp, Homo sapiens
ttatcgggaacagt

SEQ ID NO: 2585877 - DNA, 16 bp, Homo sapiens
ttatcgggaacagtgt

SEQ ID NO: 2585878 - DNA, 19 bp, Homo sapiens
ttatctaatacctctgtgt

SEQ ID NO: 2585879 - DNA, 16 bp, Homo sapiens
ttatctagatactgta

SEQ ID NO: 2585880 - DNA, 16 bp, Homo sapiens
ttatctcacttgtgcc

SEQ ID NO: 2585881 - DNA, 23 bp, Homo sapiens
ttatctgggattatggttttgtg

SEQ ID NO: 2585882 - DNA, 12 bp, Homo sapiens
ttatctgtccca

SEQ ID NO: 2585883 - DNA, 14 bp, Homo sapiens
ttatcttgggactg

SEQ ID NO: 2585884 - DNA, 17 bp, Homo sapiens
ttatcttggttgaaaat

SEQ ID NO: 2585885 - DNA, 16 bp, Homo sapiens
ttatctttacttttaa

SEQ ID NO: 2585886 - DNA, 14 bp, Homo sapiens
ttatgaaataaaga

SEQ ID NO: 2585887 - DNA, 18 bp, Homo sapiens
ttatgagggccacgggtc

SEQ ID NO: 2585888 - DNA, 15 bp, Homo sapiens
ttatgagtttttgat

SEQ ID NO: 2585889 - DNA, 16 bp, Homo sapiens
ttatgatgtatattta

SEQ ID NO: 2585890 - DNA, 13 bp, Homo sapiens
ttatgatttaata

SEQ ID NO: 2585891 - DNA, 18 bp, Homo sapiens
ttatgatttttttttcat

SEQ ID NO: 2585892 - DNA, 17 bp, Homo sapiens
ttatgcaaggaaggaaa

SEQ ID NO: 2585893 - DNA, 15 bp, Homo sapiens
ttatgccttttattt

SEQ ID NO: 2585894 - DNA, 17 bp, Homo sapiens
ttatgccttttttgatc

SEQ ID NO: 2585895 - DNA, 16 bp, Homo sapiens
ttatgcggtctaggga

SEQ ID NO: 2585896 - DNA, 14 bp, Homo sapiens
ttatgctttaaaca

SEQ ID NO: 2585897 - DNA, 19 bp, Homo sapiens
ttatggaagattttaaatt

SEQ ID NO: 2585898 - DNA, 11 bp, Homo sapiens
ttatggcctca

SEQ ID NO: 2585899 - DNA, 16 bp, Homo sapiens
ttatggcttttgtgca

SEQ ID NO: 2585900 - DNA, 18 bp, Homo sapiens
ttatggcttttgtgcatt

SEQ ID NO: 2585901 - DNA, 19 bp, Homo sapiens
ttatggcttttgtgcatta

SEQ ID NO: 2585902 - DNA, 16 bp, Homo sapiens
ttatgtaaaatgtttt

SEQ ID NO: 2585903 - DNA, 21 bp, Homo sapiens
ttcctgtaacacaagccacag

SEQ ID NO: 2585904 - DNA, 22 bp, Homo sapiens
ttcctgtagccttctgtaggaa

SEQ ID NO: 2585905 - DNA, 21 bp, Homo sapiens
ttcctgtggatgtaaagtgat

SEQ ID NO: 2585906 - DNA, 19 bp, Homo sapiens
ttcctgtttttcacatttt

SEQ ID NO: 2585907 - DNA, 22 bp, Homo sapiens
ttccttaggtttttttccttct

SEQ ID NO: 2585908 - DNA, 23 bp, Homo sapiens
ttccttatgtatatttaaaagaa

SEQ ID NO: 2585909 - DNA, 15 bp, Homo sapiens
ttccttcagggtgat

SEQ ID NO: 2585910 - DNA, 22 bp, Homo sapiens
ttccttcagggtgatgccaggt

SEQ ID NO: 2585911 - DNA, 22 bp, Homo sapiens
ttccttcagtgcatctgggaag

SEQ ID NO: 2585912 - DNA, 17 bp, Homo sapiens
ttccttgagaaaaacaa

SEQ ID NO: 2585913 - DNA, 21 bp, Homo sapiens
ttccttgagttgattcagctc

SEQ ID NO: 2585914 - DNA, 19 bp, Homo sapiens
ttccttgcctgcacaaact

SEQ ID NO: 2585915 - DNA, 13 bp, Homo sapiens
ttccttgctcaac

SEQ ID NO: 2585916 - DNA, 11 bp, Homo sapiens
ttccttgctct

SEQ ID NO: 2585917 - DNA, 14 bp, Homo sapiens
ttccttgctctccc

SEQ ID NO: 2585918 - DNA, 18 bp, Homo sapiens
ttccttgctgtcctaggc

SEQ ID NO: 2585919 - DNA, 20 bp, Homo sapiens
ttccttgctgtcctaggcca

SEQ ID NO: 2585920 - DNA, 23 bp, Homo sapiens
ttccttggataggctttttagta

SEQ ID NO: 2585921 - DNA, 13 bp, Homo sapiens
ttccttggctggt

SEQ ID NO: 2585922 - DNA, 13 bp, Homo sapiens
ttcctttctcacc

SEQ ID NO: 2585923 - DNA, 22 bp, Homo sapiens
ttccttttaaaacacttccata

SEQ ID NO: 2585924 - DNA, 18 bp, Homo sapiens
ttccttttctaactctcc

SEQ ID NO: 2585925 - DNA, 14 bp, Homo sapiens
ttcgaagctcagcc

SEQ ID NO: 2585926 - DNA, 17 bp, Homo sapiens
ttcgactcagcctcagg

SEQ ID NO: 2585927 - DNA, 14 bp, Homo sapiens
ttcgcacagcagtt

SEQ ID NO: 2585928 - DNA, 23 bp, Homo sapiens
ttcgcacctaccatcagggacag

SEQ ID NO: 2585929 - DNA, 18 bp, Homo sapiens
ttcgcatcaaaagacaat

SEQ ID NO: 2585930 - DNA, 19 bp, Homo sapiens
ttcgcccaaagccagacag

SEQ ID NO: 2585931 - DNA, 12 bp, Homo sapiens
ttcgctgcaacc

SEQ ID NO: 2585932 - DNA, 13 bp, Homo sapiens
ttcggtgtgcacc

SEQ ID NO: 2585933 - DNA, 14 bp, Homo sapiens
ttcgtacagttctt

SEQ ID NO: 2585934 - DNA, 22 bp, Homo sapiens
ttcgtacagttcttcgggaaga

SEQ ID NO: 2585935 - DNA, 17 bp, Homo sapiens
ttcgtgaagtatactgt

SEQ ID NO: 2585936 - DNA, 21 bp, Homo sapiens
ttcgtgaagtatactgtattt

SEQ ID NO: 2585937 - DNA, 22 bp, Homo sapiens
ttcgtggtgatcaattaaatgt

SEQ ID NO: 2585938 - DNA, 15 bp, Homo sapiens
ttcgtttattttcaa

SEQ ID NO: 2585939 - DNA, 14 bp, Homo sapiens
ttcgtttctgtata

SEQ ID NO: 2585940 - DNA, 16 bp, Homo sapiens
ttcgtttctgtataca

SEQ ID NO: 2585941 - DNA, 17 bp, Homo sapiens
ttcgtttgtttgtttca

SEQ ID NO: 2585942 - DNA, 13 bp, Homo sapiens
ttctaaaaaacag

SEQ ID NO: 2585943 - DNA, 19 bp, Homo sapiens
ttctaaaatataatcaacc

SEQ ID NO: 2585944 - DNA, 13 bp, Homo sapiens
ttctaaagatgga

SEQ ID NO: 2585945 - DNA, 16 bp, Homo sapiens
ttctaaaggctacctt

SEQ ID NO: 2585946 - DNA, 19 bp, Homo sapiens
ttctaaaggctacctttgt

SEQ ID NO: 2585947 - DNA, 21 bp, Homo sapiens
ttctaaaggctacctttgtat

SEQ ID NO: 2585948 - DNA, 13 bp, Homo sapiens
ttctaaatagcaa

SEQ ID NO: 2585949 - DNA, 19 bp, Homo sapiens
ttctaaatctccaaaataa

SEQ ID NO: 2585950 - DNA, 21 bp, Homo sapiens
ttctaaatctccaaaataaaa

SEQ ID NO: 2585951 - DNA, 21 bp, Homo sapiens
ttctaaatgaatgtttacact

SEQ ID NO: 2585952 - DNA, 13 bp, Homo sapiens
ttctaaatgcata

SEQ ID NO: 2585953 - DNA, 15 bp, Homo sapiens
ttctaactccagtga

SEQ ID NO: 2585954 - DNA, 14 bp, Homo sapiens
ttctaaggaatatg

SEQ ID NO: 2585955 - DNA, 21 bp, Homo sapiens
ttctaagtaaaaccacagcag

SEQ ID NO: 2585956 - DNA, 12 bp, Homo sapiens
ttctaagtcttt

SEQ ID NO: 2585957 - DNA, 15 bp, Homo sapiens
ttctaataaaacaaa

SEQ ID NO: 2585958 - DNA, 12 bp, Homo sapiens
ttctaatagaac

SEQ ID NO: 2585959 - DNA, 13 bp, Homo sapiens
ttctaatgtcttc

SEQ ID NO: 2585960 - DNA, 14 bp, Homo sapiens
ttctaatgtcttca

SEQ ID NO: 2585961 - DNA, 16 bp, Homo sapiens
ttctaatgtcttcatt

SEQ ID NO: 2585962 - DNA, 23 bp, Homo sapiens
ttctaatgtgtgaatcagagcac

SEQ ID NO: 2585963 - DNA, 15 bp, Homo sapiens
ttctacacagagcag

SEQ ID NO: 2585964 - DNA, 17 bp, Homo sapiens
ttctacagtattatgta

SEQ ID NO: 2585965 - DNA, 17 bp, Homo sapiens
ttctacatttcttagac

SEQ ID NO: 2585966 - DNA, 21 bp, Homo sapiens
ttctaccacacagcagcagtt

SEQ ID NO: 2585967 - DNA, 18 bp, Homo sapiens
ttctaccatttcagagag

SEQ ID NO: 2585968 - DNA, 12 bp, Homo sapiens
ttctacctgcca

SEQ ID NO: 2585969 - DNA, 13 bp, Homo sapiens
ttctactgtgact

SEQ ID NO: 2585970 - DNA, 18 bp, Homo sapiens
ttctactttaagcactac

SEQ ID NO: 2585971 - DNA, 21 bp, Homo sapiens
ttctagaatttatcacacttc

SEQ ID NO: 2585972 - DNA, 12 bp, Homo sapiens
ttctagagaaga

SEQ ID NO: 2585973 - DNA, 16 bp, Homo sapiens
ttctagcactggcctg

SEQ ID NO: 2585974 - DNA, 17 bp, Homo sapiens
ttctagcactggcctgc

SEQ ID NO: 2585975 - DNA, 18 bp, Homo sapiens
ttctagcccgaatacaaa

SEQ ID NO: 2585976 - DNA, 17 bp, Homo sapiens
ttctagctagaaatatg

SEQ ID NO: 2585977 - DNA, 12 bp, Homo sapiens
ttctagctgttg

SEQ ID NO: 2585978 - DNA, 14 bp, Homo sapiens
ttctaggaagaatt

SEQ ID NO: 2585979 - DNA, 23 bp, Homo sapiens
ttctaggctacaattttctccca

SEQ ID NO: 2585980 - DNA, 15 bp, Homo sapiens
ttctagggaaatgaa

SEQ ID NO: 2585981 - DNA, 23 bp, Homo sapiens
ttctaggtggcaaggctgtgctc

SEQ ID NO: 2585982 - DNA, 21 bp, Homo sapiens
ttctagtggtctttgtaagag

SEQ ID NO: 2585983 - DNA, 15 bp, Homo sapiens
ttctagtttgcattc

SEQ ID NO: 2585984 - DNA, 13 bp, Homo sapiens
ttctagttttgtc

SEQ ID NO: 2585985 - DNA, 13 bp, Homo sapiens
ttctatcattttt

SEQ ID NO: 2585986 - DNA, 19 bp, Homo sapiens
ttctatcatttttgtacag

SEQ ID NO: 2585987 - DNA, 14 bp, Homo sapiens
ttctatcctctgta

SEQ ID NO: 2585988 - DNA, 15 bp, Homo sapiens
ttctatcctctgtaa

SEQ ID NO: 2585989 - DNA, 22 bp, Homo sapiens
ttctattcaaggtggccaaatt

SEQ ID NO: 2585990 - DNA, 13 bp, Homo sapiens
ttctattgaaaaa

SEQ ID NO: 2585991 - DNA, 14 bp, Homo sapiens
ttctattgttactc

SEQ ID NO: 2585992 - DNA, 13 bp, Homo sapiens
ttctatttaatgg

SEQ ID NO: 2585993 - DNA, 15 bp, Homo sapiens
ttctatttatttact

SEQ ID NO: 2585994 - DNA, 19 bp, Homo sapiens
ttctatttctcctccatgg

SEQ ID NO: 2585995 - DNA, 17 bp, Homo sapiens
ttctatttgctgggctt

SEQ ID NO: 2585996 - DNA, 18 bp, Homo sapiens
ttctatttgctgggcttt

SEQ ID NO: 2585997 - DNA, 18 bp, Homo sapiens
ttctcaaagttttgaaaa

SEQ ID NO: 2585998 - DNA, 21 bp, Homo sapiens
ttctcaaagttttgaaaagct

SEQ ID NO: 2585999 - DNA, 14 bp, Homo sapiens
ttctcacacccacc

SEQ ID NO: 2586000 - DNA, 18 bp, Homo sapiens
ttctcacacccaccgtcc

SEQ ID NO: 2586001 - DNA, 22 bp, Homo sapiens
ttctcacacccaccgtccgccc

SEQ ID NO: 2586002 - DNA, 21 bp, Homo sapiens
ttctcacagtgggagccaggg

SEQ ID NO: 2586003 - DNA, 22 bp, Homo sapiens
ttctcacagtgggagccagggc

SEQ ID NO: 2586004 - DNA, 18 bp, Homo sapiens
ttctcagaaggcaaatga

SEQ ID NO: 2586005 - DNA, 22 bp, Homo sapiens
ttctcagactttggaaaatgca

SEQ ID NO: 2586006 - DNA, 15 bp, Homo sapiens
ttctcagatccttgt

SEQ ID NO: 2586007 - DNA, 19 bp, Homo sapiens
ttctcagatccttgtttca

SEQ ID NO: 2586008 - DNA, 21 bp, Homo sapiens
ttctcagatggattgataatt

SEQ ID NO: 2586009 - DNA, 14 bp, Homo sapiens
ttctcagctcccat

SEQ ID NO: 2586010 - DNA, 17 bp, Homo sapiens
ttctcaggcatgaacat

SEQ ID NO: 2586011 - DNA, 20 bp, Homo sapiens
ttctcaggctctgccctgcc

SEQ ID NO: 2586012 - DNA, 16 bp, Homo sapiens
ttctcagggctcctgc

SEQ ID NO: 2586013 - DNA, 13 bp, Homo sapiens
ttctcagggtctc

SEQ ID NO: 2586014 - DNA, 16 bp, Homo sapiens
ttctcagggtctctgc

SEQ ID NO: 2586015 - DNA, 21 bp, Homo sapiens
ttctcatagcattaactaatc

SEQ ID NO: 2586016 - DNA, 22 bp, Homo sapiens
ttctcataggaaaagtacattt

SEQ ID NO: 2586017 - DNA, 17 bp, Homo sapiens
ttctcatcactcccctc

SEQ ID NO: 2586018 - DNA, 17 bp, Homo sapiens
ttctcatgtgatccttt

SEQ ID NO: 2586019 - DNA, 18 bp, Homo sapiens
ttctcatgtgatcctttt

SEQ ID NO: 2586020 - DNA, 16 bp, Homo sapiens
ttctccaccctgctct

SEQ ID NO: 2586021 - DNA, 20 bp, Homo sapiens
ttctccacctgccagggaca

SEQ ID NO: 2586022 - DNA, 13 bp, Homo sapiens
ttctccagccagc

SEQ ID NO: 2586023 - DNA, 12 bp, Homo sapiens
ttctccagctgg

SEQ ID NO: 2586024 - DNA, 20 bp, Homo sapiens
ttctccagctgggctctgca

SEQ ID NO: 2586025 - DNA, 18 bp, Homo sapiens
ttctccaggctctttggg

SEQ ID NO: 2586026 - DNA, 20 bp, Homo sapiens
ttctccaggtctcacgggca

SEQ ID NO: 2586027 - DNA, 20 bp, Homo sapiens
ttctccatccacatgggagc

SEQ ID NO: 2586028 - DNA, 15 bp, Homo sapiens
ttctccatctctctg

SEQ ID NO: 2586029 - DNA, 19 bp, Homo sapiens
ttctccatctctctggccc

SEQ ID NO: 2586030 - DNA, 22 bp, Homo sapiens
ttctccatggccaccttttcag

SEQ ID NO: 2586031 - DNA, 12 bp, Homo sapiens
ttctcccaggaa

SEQ ID NO: 2586032 - DNA, 13 bp, Homo sapiens
ttctcccaggaag

SEQ ID NO: 2586033 - DNA, 23 bp, Homo sapiens
ttctcccaggccaggctccttcc

SEQ ID NO: 2586034 - DNA, 14 bp, Homo sapiens
ttctccccctgggc

SEQ ID NO: 2586035 - DNA, 12 bp, Homo sapiens
ttctcctgtgct

SEQ ID NO: 2586036 - DNA, 20 bp, Homo sapiens
ttctcctttgataaaataaa

SEQ ID NO: 2586037 - DNA, 13 bp, Homo sapiens
ttctccttttcct

SEQ ID NO: 2586038 - DNA, 18 bp, Homo sapiens
ttctccttttcctctctc

SEQ ID NO: 2586039 - DNA, 17 bp, Homo sapiens
ttctcgattttatcttt

SEQ ID NO: 2586040 - DNA, 12 bp, Homo sapiens
ttctcgggctga

SEQ ID NO: 2586041 - DNA, 24 bp, Homo sapiens
ttctctaagagaacaatgtgctat

SEQ ID NO: 2586042 - DNA, 21 bp, Homo sapiens
ttctctaagttccactgagct

SEQ ID NO: 2586043 - DNA, 19 bp, Homo sapiens
ttctctactttgaggaaac

SEQ ID NO: 2586044 - DNA, 18 bp, Homo sapiens
ttctctccagcccctgga

SEQ ID NO: 2586045 - DNA, 22 bp, Homo sapiens
ttctctcctgtacctcttgagc

SEQ ID NO: 2586046 - DNA, 17 bp, Homo sapiens
ttctctgagctgtgcag

SEQ ID NO: 2586047 - DNA, 11 bp, Homo sapiens
ttctctgccct

SEQ ID NO: 2586048 - DNA, 12 bp, Homo sapiens
ttgcaaatagtc

SEQ ID NO: 2586049 - DNA, 19 bp, Homo sapiens
ttgcaagggaaaagtctct

SEQ ID NO: 2586050 - DNA, 22 bp, Homo sapiens
ttgcaagggaaaagtctcttgt

SEQ ID NO: 2586051 - DNA, 13 bp, Homo sapiens
ttgcaataatact

SEQ ID NO: 2586052 - DNA, 13 bp, Homo sapiens
ttgcacacttgtg

SEQ ID NO: 2586053 - DNA, 16 bp, Homo sapiens
ttgcaccactgcactc

SEQ ID NO: 2586054 - DNA, 18 bp, Homo sapiens
ttgcaccactgcactcca

SEQ ID NO: 2586055 - DNA, 15 bp, Homo sapiens
ttgcacccagccctg

SEQ ID NO: 2586056 - DNA, 19 bp, Homo sapiens
ttgcacccagccctggtct

SEQ ID NO: 2586057 - DNA, 13 bp, Homo sapiens
ttgcacccctccc

SEQ ID NO: 2586058 - DNA, 14 bp, Homo sapiens
ttgcacccctccca

SEQ ID NO: 2586059 - DNA, 16 bp, Homo sapiens
ttgcacccctcccatt

SEQ ID NO: 2586060 - DNA, 17 bp, Homo sapiens
ttgcacctacctcacag

SEQ ID NO: 2586061 - DNA, 14 bp, Homo sapiens
ttgcacggctgctg

SEQ ID NO: 2586062 - DNA, 19 bp, Homo sapiens
ttgcactaaagtatgtaaa

SEQ ID NO: 2586063 - DNA, 17 bp, Homo sapiens
ttgcactctagcctggg

SEQ ID NO: 2586064 - DNA, 13 bp, Homo sapiens
ttgcactgagggc

SEQ ID NO: 2586065 - DNA, 16 bp, Homo sapiens
ttgcactgagggccac

SEQ ID NO: 2586066 - DNA, 21 bp, Homo sapiens
ttgcactgagggccacactat

SEQ ID NO: 2586067 - DNA, 19 bp, Homo sapiens
ttgcagactcagtttgtca

SEQ ID NO: 2586068 - DNA, 12 bp, Homo sapiens
ttgcagcagtga

SEQ ID NO: 2586069 - DNA, 23 bp, Homo sapiens
ttgcagcagtgagtctcttcaga

SEQ ID NO: 2586070 - DNA, 21 bp, Homo sapiens
ttgcaggcatgcatgtgcttg

SEQ ID NO: 2586071 - DNA, 19 bp, Homo sapiens
ttgcaggtggaactcagtc

SEQ ID NO: 2586072 - DNA, 15 bp, Homo sapiens
ttgcaggttgctttg

SEQ ID NO: 2586073 - DNA, 22 bp, Homo sapiens
ttgcagtaaacttttaattaaa

SEQ ID NO: 2586074 - DNA, 13 bp, Homo sapiens
ttgcagtgagcca

SEQ ID NO: 2586075 - DNA, 13 bp, Homo sapiens
ttgcagtttatca

SEQ ID NO: 2586076 - DNA, 22 bp, Homo sapiens
ttgcatataacttatattgtaa

SEQ ID NO: 2586077 - DNA, 23 bp, Homo sapiens
ttgcatataacttatattgtaag

SEQ ID NO: 2586078 - DNA, 18 bp, Homo sapiens
ttgcatccaactccagga

SEQ ID NO: 2586079 - DNA, 21 bp, Homo sapiens
ttgcatctgggtagctgtaag

SEQ ID NO: 2586080 - DNA, 12 bp, Homo sapiens
ttgcatgaggct

SEQ ID NO: 2586081 - DNA, 20 bp, Homo sapiens
ttgcatggctccagaaatgt

SEQ ID NO: 2586082 - DNA, 22 bp, Homo sapiens
ttgcatgggctaatgaagatca

SEQ ID NO: 2586083 - DNA, 17 bp, Homo sapiens
ttgcattgaatatatta

SEQ ID NO: 2586084 - DNA, 22 bp, Homo sapiens
ttgcatttaaaacagacactgg

SEQ ID NO: 2586085 - DNA, 12 bp, Homo sapiens
ttgcatttttgc

SEQ ID NO: 2586086 - DNA, 15 bp, Homo sapiens
ttgccaagctcagga

SEQ ID NO: 2586087 - DNA, 13 bp, Homo sapiens
ttgccaccaggag

SEQ ID NO: 2586088 - DNA, 18 bp, Homo sapiens
ttgccactgcctcttcct

SEQ ID NO: 2586089 - DNA, 19 bp, Homo sapiens
ttgccagctgctgctggat

SEQ ID NO: 2586090 - DNA, 12 bp, Homo sapiens
ttgccagctttt

SEQ ID NO: 2586091 - DNA, 18 bp, Homo sapiens
ttgccagcttttcctccc

SEQ ID NO: 2586092 - DNA, 19 bp, Homo sapiens
ttgccagcttttcctccct

SEQ ID NO: 2586093 - DNA, 18 bp, Homo sapiens
ttgccatgttggccaggc

SEQ ID NO: 2586094 - DNA, 11 bp, Homo sapiens
ttgcccaggca

SEQ ID NO: 2586095 - DNA, 16 bp, Homo sapiens
ttgcccaggcaggtct

SEQ ID NO: 2586096 - DNA, 14 bp, Homo sapiens
ttgcccaggctggc

SEQ ID NO: 2586097 - DNA, 23 bp, Homo sapiens
ttgcccaggctggcgtgcagtgg

SEQ ID NO: 2586098 - DNA, 18 bp, Homo sapiens
ttgcccagggctcagcct

SEQ ID NO: 2586099 - DNA, 19 bp, Homo sapiens
ttgcccagggctcagcctg

SEQ ID NO: 2586100 - DNA, 15 bp, Homo sapiens
ttgcccccagggcac

SEQ ID NO: 2586101 - DNA, 13 bp, Homo sapiens
ttgccccccaccc

SEQ ID NO: 2586102 - DNA, 16 bp, Homo sapiens
ttgccccccaccccag

SEQ ID NO: 2586103 - DNA, 17 bp, Homo sapiens
ttgcccggattctggga

SEQ ID NO: 2586104 - DNA, 18 bp, Homo sapiens
ttgccctgacctcccagc

SEQ ID NO: 2586105 - DNA, 18 bp, Homo sapiens
ttgcccttcacagtgttt

SEQ ID NO: 2586106 - DNA, 17 bp, Homo sapiens
ttgcccttgccctgacc

SEQ ID NO: 2586107 - DNA, 18 bp, Homo sapiens
ttgccgcgtcgccctccc

SEQ ID NO: 2586108 - DNA, 14 bp, Homo sapiens
ttgccgttattaaa

SEQ ID NO: 2586109 - DNA, 17 bp, Homo sapiens
ttgcctactatgccaga

SEQ ID NO: 2586110 - DNA, 18 bp, Homo sapiens
ttgcctctgcctctgaca

SEQ ID NO: 2586111 - DNA, 17 bp, Homo sapiens
ttgcctcttccagtctt

SEQ ID NO: 2586112 - DNA, 13 bp, Homo sapiens
ttgcctgcagaga

SEQ ID NO: 2586113 - DNA, 15 bp, Homo sapiens
ttgcctgcagagaga

SEQ ID NO: 2586114 - DNA, 13 bp, Homo sapiens
ttgcctgttcagt

SEQ ID NO: 2586115 - DNA, 20 bp, Homo sapiens
ttgcctgttcagttacagaa

SEQ ID NO: 2586116 - DNA, 22 bp, Homo sapiens
ttgcctgttcagttacagaaag

SEQ ID NO: 2586117 - DNA, 23 bp, Homo sapiens
ttgcctgttcagttacagaaagt

SEQ ID NO: 2586118 - DNA, 16 bp, Homo sapiens
ttgccttaaagaaagt

SEQ ID NO: 2586119 - DNA, 17 bp, Homo sapiens
ttgccttctacttttaa

SEQ ID NO: 2586120 - DNA, 19 bp, Homo sapiens
ttgccttcttcacccagct

SEQ ID NO: 2586121 - DNA, 18 bp, Homo sapiens
ttgccttgaaccacttcc

SEQ ID NO: 2586122 - DNA, 20 bp, Homo sapiens
ttgccttgggctgctcctca

SEQ ID NO: 2586123 - DNA, 13 bp, Homo sapiens
ttgcctttctcga

SEQ ID NO: 2586124 - DNA, 18 bp, Homo sapiens
ttgccttttctagcccga

SEQ ID NO: 2586125 - DNA, 13 bp, Homo sapiens
ttgcgctgttgcg

SEQ ID NO: 2586126 - DNA, 14 bp, Homo sapiens
ttgcggggggaggg

SEQ ID NO: 2586127 - DNA, 18 bp, Homo sapiens
ttgcgtatgtctgttacc

SEQ ID NO: 2586128 - DNA, 21 bp, Homo sapiens
ttgcgtggaattgtgctgagt

SEQ ID NO: 2586129 - DNA, 15 bp, Homo sapiens
ttgctaaatgtaaca

SEQ ID NO: 2586130 - DNA, 13 bp, Homo sapiens
ttgctaagatgct

SEQ ID NO: 2586131 - DNA, 16 bp, Homo sapiens
ttgctaagatgctcta

SEQ ID NO: 2586132 - DNA, 18 bp, Homo sapiens
ttgctaatcagtgtctca

SEQ ID NO: 2586133 - DNA, 13 bp, Homo sapiens
ttgctatcttaat

SEQ ID NO: 2586134 - DNA, 16 bp, Homo sapiens
ttgctatcttaatttt

SEQ ID NO: 2586135 - DNA, 20 bp, Homo sapiens
ttgctatgagctggggatgt

SEQ ID NO: 2586136 - DNA, 12 bp, Homo sapiens
ttgctattgtaa

SEQ ID NO: 2586137 - DNA, 15 bp, Homo sapiens
ttgctattgtaaata

SEQ ID NO: 2586138 - DNA, 18 bp, Homo sapiens
ttgctcaaaaaatgagct

SEQ ID NO: 2586139 - DNA, 13 bp, Homo sapiens
ttgctcagtctcc

SEQ ID NO: 2586140 - DNA, 18 bp, Homo sapiens
ttgctctccctcttctca

SEQ ID NO: 2586141 - DNA, 12 bp, Homo sapiens
ttgctctgcacc

SEQ ID NO: 2586142 - DNA, 20 bp, Homo sapiens
ttgctctgccaacttcttca

SEQ ID NO: 2586143 - DNA, 11 bp, Homo sapiens
ttgctgaaatt

SEQ ID NO: 2586144 - DNA, 13 bp, Homo sapiens
ttgctgcaaacct

SEQ ID NO: 2586145 - DNA, 18 bp, Homo sapiens
ttgctgcagtatgaaaat

SEQ ID NO: 2586146 - DNA, 19 bp, Homo sapiens
ttgctgccccatcagtgct

SEQ ID NO: 2586147 - DNA, 20 bp, Homo sapiens
ttgctgccccatcagtgctc

SEQ ID NO: 2586148 - DNA, 18 bp, Homo sapiens
ttgctgcttttccttggg

SEQ ID NO: 2586149 - DNA, 23 bp, Homo sapiens
ttgctggacggggactggggatg

SEQ ID NO: 2586150 - DNA, 21 bp, Homo sapiens
ttgctgtaccagcccagatgt

SEQ ID NO: 2586151 - DNA, 20 bp, Homo sapiens
ttgctgtgagcaagaagtca

SEQ ID NO: 2586152 - DNA, 23 bp, Homo sapiens
ttgctgtgggaacgagaggggaa

SEQ ID NO: 2586153 - DNA, 20 bp, Homo sapiens
ttgctgttgatttctttcca

SEQ ID NO: 2586154 - DNA, 19 bp, Homo sapiens
ttgctgttgtttctaaaca

SEQ ID NO: 2586155 - DNA, 15 bp, Homo sapiens
ttgctgtttcctttt

SEQ ID NO: 2586156 - DNA, 13 bp, Homo sapiens
ttgcttacaattt

SEQ ID NO: 2586157 - DNA, 14 bp, Homo sapiens
ttgcttacaatttt

SEQ ID NO: 2586158 - DNA, 23 bp, Homo sapiens
ttgcttacaatttttttaatttt

SEQ ID NO: 2586159 - DNA, 13 bp, Homo sapiens
ttgcttatgacat

SEQ ID NO: 2586160 - DNA, 15 bp, Homo sapiens
ttgcttattgttcca

SEQ ID NO: 2586161 - DNA, 13 bp, Homo sapiens
ttgcttgaaacca

SEQ ID NO: 2586162 - DNA, 14 bp, Homo sapiens
ttgcttgagcccag

SEQ ID NO: 2586163 - DNA, 18 bp, Homo sapiens
ttgcttgagcccaggagt

SEQ ID NO: 2586164 - DNA, 20 bp, Homo sapiens
ttgcttgcagtagattttct

SEQ ID NO: 2586165 - DNA, 11 bp, Homo sapiens
ttgcttgcctc

SEQ ID NO: 2586166 - DNA, 15 bp, Homo sapiens
ttgcttgcctctctg

SEQ ID NO: 2586167 - DNA, 15 bp, Homo sapiens
ttgcttggctgcttg

SEQ ID NO: 2586168 - DNA, 14 bp, Homo sapiens
ttgcttgggaaggg

SEQ ID NO: 2586169 - DNA, 15 bp, Homo sapiens
ttgctttactgtcaa

SEQ ID NO: 2586170 - DNA, 20 bp, Homo sapiens
ttgctttatgccttcttatt

SEQ ID NO: 2586171 - DNA, 14 bp, Homo sapiens
ttgctttgaagcag

SEQ ID NO: 2586172 - DNA, 16 bp, Homo sapiens
ttgctttgaagcagtt

SEQ ID NO: 2586173 - DNA, 14 bp, Homo sapiens
ttgctttgcccagc

SEQ ID NO: 2586174 - DNA, 15 bp, Homo sapiens
ttgctttgtgatttt

SEQ ID NO: 2586175 - DNA, 13 bp, Homo sapiens
ttgcttttgtgaa

SEQ ID NO: 2586176 - DNA, 19 bp, Homo sapiens
ttggaaaagaatacagaaa

SEQ ID NO: 2586177 - DNA, 12 bp, Homo sapiens
ttggaaaataaa

SEQ ID NO: 2586178 - DNA, 15 bp, Homo sapiens
ttggaaaatgcattg

SEQ ID NO: 2586179 - DNA, 21 bp, Homo sapiens
ttggaaacctgccctgcctga

SEQ ID NO: 2586180 - DNA, 23 bp, Homo sapiens
ttggaaagagtaggaagactttg

SEQ ID NO: 2586181 - DNA, 21 bp, Homo sapiens
ttggaaagcaggtggcatctc

SEQ ID NO: 2586182 - DNA, 13 bp, Homo sapiens
ttggaaatattca

SEQ ID NO: 2586183 - DNA, 20 bp, Homo sapiens
ttggaagaccccacccaagc

SEQ ID NO: 2586184 - DNA, 22 bp, Homo sapiens
ttggaagctagctcccctcctc

SEQ ID NO: 2586185 - DNA, 23 bp, Homo sapiens
ttggaagctagctcccctcctct

SEQ ID NO: 2586186 - DNA, 16 bp, Homo sapiens
ttggaagttgcatggc

SEQ ID NO: 2586187 - DNA, 13 bp, Homo sapiens
ttggaagtttcat

SEQ ID NO: 2586188 - DNA, 17 bp, Homo sapiens
ttggaatgggcagctca

SEQ ID NO: 2586189 - DNA, 17 bp, Homo sapiens
ttggaattaacctggtg

SEQ ID NO: 2586190 - DNA, 21 bp, Homo sapiens
ttggaatttgtaacctcagct

SEQ ID NO: 2586191 - DNA, 23 bp, Homo sapiens
ttggacaatcatgaaatatgcat

SEQ ID NO: 2586192 - DNA, 16 bp, Homo sapiens
ttggacccttccatgg

SEQ ID NO: 2586193 - DNA, 16 bp, Homo sapiens
ttggacctctgctctg

SEQ ID NO: 2586194 - DNA, 14 bp, Homo sapiens
tttcaattctcaaa

SEQ ID NO: 2586195 - DNA, 15 bp, Homo sapiens
tttcaattctcaaaa

SEQ ID NO: 2586196 - DNA, 20 bp, Homo sapiens
tttcaattgcatctcccaga

SEQ ID NO: 2586197 - DNA, 14 bp, Homo sapiens
tttcacaaatttgt

SEQ ID NO: 2586198 - DNA, 18 bp, Homo sapiens
tttcacatagctgtctag

SEQ ID NO: 2586199 - DNA, 16 bp, Homo sapiens
tttcacattcttataa

SEQ ID NO: 2586200 - DNA, 21 bp, Homo sapiens
tttcacattcttataaatatg

SEQ ID NO: 2586201 - DNA, 22 bp, Homo sapiens
tttcaccatttgattatgtagc

SEQ ID NO: 2586202 - DNA, 21 bp, Homo sapiens
tttcactttcacatagatgtc

SEQ ID NO: 2586203 - DNA, 21 bp, Homo sapiens
tttcagaaagaagtggggaca

SEQ ID NO: 2586204 - DNA, 16 bp, Homo sapiens
tttcagaaatatgtgg

SEQ ID NO: 2586205 - DNA, 11 bp, Homo sapiens
tttcagaaatg

SEQ ID NO: 2586206 - DNA, 18 bp, Homo sapiens
tttcagaacctcttcccc

SEQ ID NO: 2586207 - DNA, 20 bp, Homo sapiens
tttcagaacctcttccccag

SEQ ID NO: 2586208 - DNA, 23 bp, Homo sapiens
tttcagaacctcttccccagaaa

SEQ ID NO: 2586209 - DNA, 16 bp, Homo sapiens
tttcagatataaaaga

SEQ ID NO: 2586210 - DNA, 14 bp, Homo sapiens
tttcagatgcttct

SEQ ID NO: 2586211 - DNA, 17 bp, Homo sapiens
tttcagatgtcttctgc

SEQ ID NO: 2586212 - DNA, 19 bp, Homo sapiens
tttcagatgtcttctgcct

SEQ ID NO: 2586213 - DNA, 22 bp, Homo sapiens
tttcagatgtcttctgcctgtt

SEQ ID NO: 2586214 - DNA, 20 bp, Homo sapiens
tttcagattcccagagcaaa

SEQ ID NO: 2586215 - DNA, 14 bp, Homo sapiens
tttcagcagactat

SEQ ID NO: 2586216 - DNA, 21 bp, Homo sapiens
tttcagcgatgtatgcagcta

SEQ ID NO: 2586217 - DNA, 17 bp, Homo sapiens
tttcaggagcagcctca

SEQ ID NO: 2586218 - DNA, 19 bp, Homo sapiens
tttcagggaggtggctggg

SEQ ID NO: 2586219 - DNA, 22 bp, Homo sapiens
tttcagggctaacgaccacagg

SEQ ID NO: 2586220 - DNA, 21 bp, Homo sapiens
tttcaggggtcgtcaccacct

SEQ ID NO: 2586221 - DNA, 13 bp, Homo sapiens
tttcaggtgacat

SEQ ID NO: 2586222 - DNA, 19 bp, Homo sapiens
tttcaggtgacatgtgaaa

SEQ ID NO: 2586223 - DNA, 20 bp, Homo sapiens
tttcaggtgacatgtgaaac

SEQ ID NO: 2586224 - DNA, 18 bp, Homo sapiens
tttcaggttttgtaaaga

SEQ ID NO: 2586225 - DNA, 19 bp, Homo sapiens
tttcaggttttgtaaagat

SEQ ID NO: 2586226 - DNA, 18 bp, Homo sapiens
tttcataagtatttcaaa

SEQ ID NO: 2586227 - DNA, 20 bp, Homo sapiens
tttcatagctaagaaataaa

SEQ ID NO: 2586228 - DNA, 21 bp, Homo sapiens
tttcatattttagctactata

SEQ ID NO: 2586229 - DNA, 17 bp, Homo sapiens
tttcatcatattataca

SEQ ID NO: 2586230 - DNA, 13 bp, Homo sapiens
tttcatctatttc

SEQ ID NO: 2586231 - DNA, 14 bp, Homo sapiens
tttcatctgggaaa

SEQ ID NO: 2586232 - DNA, 18 bp, Homo sapiens
tttcatctgggaaagaca

SEQ ID NO: 2586233 - DNA, 19 bp, Homo sapiens
tttcatctgggaaagacat

SEQ ID NO: 2586234 - DNA, 21 bp, Homo sapiens
tttcatgattagcaagttaca

SEQ ID NO: 2586235 - DNA, 16 bp, Homo sapiens
tttcatgattttgaaa

SEQ ID NO: 2586236 - DNA, 16 bp, Homo sapiens
tttcatgttttaacaa

SEQ ID NO: 2586237 - DNA, 14 bp, Homo sapiens
tttcattaaagcat

SEQ ID NO: 2586238 - DNA, 16 bp, Homo sapiens
tttcattaaagcattt

SEQ ID NO: 2586239 - DNA, 18 bp, Homo sapiens
tttcattatgtaaaatgt

SEQ ID NO: 2586240 - DNA, 15 bp, Homo sapiens
tttcattgtatgatg

SEQ ID NO: 2586241 - DNA, 13 bp, Homo sapiens
tttcatttgccta

SEQ ID NO: 2586242 - DNA, 14 bp, Homo sapiens
tttcatttgcctat

SEQ ID NO: 2586243 - DNA, 22 bp, Homo sapiens
tttcatttgcctattcccacac

SEQ ID NO: 2586244 - DNA, 14 bp, Homo sapiens
tttccaaaggcatt

SEQ ID NO: 2586245 - DNA, 15 bp, Homo sapiens
tttccaaattcacaa

SEQ ID NO: 2586246 - DNA, 23 bp, Homo sapiens
tttccaaattcacaagttgtgtt

SEQ ID NO: 2586247 - DNA, 18 bp, Homo sapiens
tttccaacaccacagaca

SEQ ID NO: 2586248 - DNA, 16 bp, Homo sapiens
tttccaagagctgagg

SEQ ID NO: 2586249 - DNA, 16 bp, Homo sapiens
tttccaagtgtgcata

SEQ ID NO: 2586250 - DNA, 19 bp, Homo sapiens
tttccacaaaatctgtcca

SEQ ID NO: 2586251 - DNA, 15 bp, Homo sapiens
tttccacaaatcagt

SEQ ID NO: 2586252 - DNA, 14 bp, Homo sapiens
tttccactactgct

SEQ ID NO: 2586253 - DNA, 15 bp, Homo sapiens
tttccactactgcta

SEQ ID NO: 2586254 - DNA, 12 bp, Homo sapiens
tttccactttgt

SEQ ID NO: 2586255 - DNA, 23 bp, Homo sapiens
tttccactttgttctttaggaga

SEQ ID NO: 2586256 - DNA, 19 bp, Homo sapiens
tttccagaggctattattt

SEQ ID NO: 2586257 - DNA, 15 bp, Homo sapiens
tttccagtacctttg

SEQ ID NO: 2586258 - DNA, 22 bp, Homo sapiens
tttccatatggattttctattg

SEQ ID NO: 2586259 - DNA, 17 bp, Homo sapiens
tttccatgaaaatgcaa

SEQ ID NO: 2586260 - DNA, 13 bp, Homo sapiens
tttccattattta

SEQ ID NO: 2586261 - DNA, 21 bp, Homo sapiens
tttccattggtttacctgtga

SEQ ID NO: 2586262 - DNA, 15 bp, Homo sapiens
tttcccaattcacat

SEQ ID NO: 2586263 - DNA, 19 bp, Homo sapiens
tttccccaacagtgtgaag

SEQ ID NO: 2586264 - DNA, 21 bp, Homo sapiens
tttccccaggggaaaatgaag

SEQ ID NO: 2586265 - DNA, 12 bp, Homo sapiens
tttccccccact

SEQ ID NO: 2586266 - DNA, 17 bp, Homo sapiens
tttccccccactctccc

SEQ ID NO: 2586267 - DNA, 23 bp, Homo sapiens
tttccccctgcattctttctgta

SEQ ID NO: 2586268 - DNA, 14 bp, Homo sapiens
tttccctgactcct

SEQ ID NO: 2586269 - DNA, 19 bp, Homo sapiens
tttcccttcagtaccctct

SEQ ID NO: 2586270 - DNA, 15 bp, Homo sapiens
tttcccttgaggaaa

SEQ ID NO: 2586271 - DNA, 16 bp, Homo sapiens
tttccgtggcactgca

SEQ ID NO: 2586272 - DNA, 17 bp, Homo sapiens
tttccgttaaaatacca

SEQ ID NO: 2586273 - DNA, 19 bp, Homo sapiens
tttcctaagtgattgtatg

SEQ ID NO: 2586274 - DNA, 16 bp, Homo sapiens
tttcctcatctgtcca

SEQ ID NO: 2586275 - DNA, 20 bp, Homo sapiens
tttcctctattgatgtacag

SEQ ID NO: 2586276 - DNA, 22 bp, Homo sapiens
tttcctgagcttggccagaagg

SEQ ID NO: 2586277 - DNA, 16 bp, Homo sapiens
tttcctgaggctgggc

SEQ ID NO: 2586278 - DNA, 16 bp, Homo sapiens
tttcctgccttcttct

SEQ ID NO: 2586279 - DNA, 17 bp, Homo sapiens
tttcctgccttcttctt

SEQ ID NO: 2586280 - DNA, 23 bp, Homo sapiens
tttcctgtaaaaaaaaaaaagtt

SEQ ID NO: 2586281 - DNA, 12 bp, Homo sapiens
tttcctgtgtct

SEQ ID NO: 2586282 - DNA, 19 bp, Homo sapiens
tttccttaaattatctaaa

SEQ ID NO: 2586283 - DNA, 13 bp, Homo sapiens
tttccttcagtgc

SEQ ID NO: 2586284 - DNA, 19 bp, Homo sapiens
tttccttccatccctaccc

SEQ ID NO: 2586285 - DNA, 19 bp, Homo sapiens
tttccttgtccccacactc

SEQ ID NO: 2586286 - DNA, 21 bp, Homo sapiens
tttccttgtccccacactcct

SEQ ID NO: 2586287 - DNA, 21 bp, Homo sapiens
tttcctttaaaaaaatttaag

SEQ ID NO: 2586288 - DNA, 22 bp, Homo sapiens
tttcgattcgttaagagagcaa

SEQ ID NO: 2586289 - DNA, 19 bp, Homo sapiens
tttcgccgttgaagaggaa

SEQ ID NO: 2586290 - DNA, 21 bp, Homo sapiens
tttcgtctgtttataaacatt

SEQ ID NO: 2586291 - DNA, 14 bp, Homo sapiens
tttcgtttctgtat

SEQ ID NO: 2586292 - DNA, 14 bp, Homo sapiens
tttcgtttgtttgt

SEQ ID NO: 2586293 - DNA, 14 bp, Homo sapiens
tttctaaaaaacag

SEQ ID NO: 2586294 - DNA, 13 bp, Homo sapiens
tttctaatgtggt

SEQ ID NO: 2586295 - DNA, 16 bp, Homo sapiens
tttctaccatttcaga

SEQ ID NO: 2586296 - DNA, 22 bp, Homo sapiens
tttctacccagcgagccctggt

SEQ ID NO: 2586297 - DNA, 15 bp, Homo sapiens
tttctagactttctg

SEQ ID NO: 2586298 - DNA, 16 bp, Homo sapiens
tttctagactttctgt

SEQ ID NO: 2586299 - DNA, 16 bp, Homo sapiens
tttctagattaagata

SEQ ID NO: 2586300 - DNA, 19 bp, Homo sapiens
tttctagcccgaatacaaa

SEQ ID NO: 2586301 - DNA, 20 bp, Homo sapiens
tttctagcccgaatacaaac

SEQ ID NO: 2586302 - DNA, 19 bp, Homo sapiens
tttctagctagaaatatga

SEQ ID NO: 2586303 - DNA, 14 bp, Homo sapiens
tttctaggaagaat

SEQ ID NO: 2586304 - DNA, 17 bp, Homo sapiens
tttctagtggtctttgt

SEQ ID NO: 2586305 - DNA, 18 bp, Homo sapiens
tttctagtggtctttgta

SEQ ID NO: 2586306 - DNA, 19 bp, Homo sapiens
tttctagtggtctttgtaa

SEQ ID NO: 2586307 - DNA, 21 bp, Homo sapiens
tttctagtggtctttgtaaga

SEQ ID NO: 2586308 - DNA, 20 bp, Homo sapiens
tttctatcatttttgtacag

SEQ ID NO: 2586309 - DNA, 15 bp, Homo sapiens
tttctcaaagttttg

SEQ ID NO: 2586310 - DNA, 18 bp, Homo sapiens
tttctcaaagttttgaaa

SEQ ID NO: 2586311 - DNA, 22 bp, Homo sapiens
tttctcaaagttttgaaaagct

SEQ ID NO: 2586312 - DNA, 14 bp, Homo sapiens
tttctcagctccca

SEQ ID NO: 2586313 - DNA, 12 bp, Homo sapiens
tttctcccagct

SEQ ID NO: 2586314 - DNA, 17 bp, Homo sapiens
tttctcccagtcattta

SEQ ID NO: 2586315 - DNA, 13 bp, Homo sapiens
tttctccccctgg

SEQ ID NO: 2586316 - DNA, 17 bp, Homo sapiens
tttctccctaaactgta

SEQ ID NO: 2586317 - DNA, 13 bp, Homo sapiens
tttctccctctca

SEQ ID NO: 2586318 - DNA, 22 bp, Homo sapiens
tttctccctctcactgtctgag

SEQ ID NO: 2586319 - DNA, 17 bp, Homo sapiens
tttctcgattttatctt

SEQ ID NO: 2586320 - DNA, 16 bp, Homo sapiens
tttctcttcatacttt

SEQ ID NO: 2586321 - DNA, 22 bp, Homo sapiens
tttctgagaaagactattcaaa

SEQ ID NO: 2586322 - DNA, 15 bp, Homo sapiens
tttctgagcccgggc

SEQ ID NO: 2586323 - DNA, 16 bp, Homo sapiens
tttctgaggagaaaca

SEQ ID NO: 2586324 - DNA, 18 bp, Homo sapiens
tttctgaggagaaacaaa

SEQ ID NO: 2586325 - DNA, 23 bp, Homo sapiens
tttctgatctgatgcaagcaaga

SEQ ID NO: 2586326 - DNA, 22 bp, Homo sapiens
tttctgattgtaacgttgctgt

SEQ ID NO: 2586327 - DNA, 14 bp, Homo sapiens
tttctgcagaaaca

SEQ ID NO: 2586328 - DNA, 21 bp, Homo sapiens
tttctggactgaagcctgcag

SEQ ID NO: 2586329 - DNA, 21 bp, Homo sapiens
tttctggaggttgataacttt

SEQ ID NO: 2586330 - DNA, 22 bp, Homo sapiens
tttctggaggttgataactttg

SEQ ID NO: 2586331 - DNA, 11 bp, Homo sapiens
tttctggagtc

SEQ ID NO: 2586332 - DNA, 15 bp, Homo sapiens
tttctggtagataga

SEQ ID NO: 2586333 - DNA, 17 bp, Homo sapiens
tttctggtagatagaaa

SEQ ID NO: 2586334 - DNA, 15 bp, Homo sapiens
tttctgtctctgcct

SEQ ID NO: 2586335 - DNA, 18 bp, Homo sapiens
tttctgttgtcattgctg

SEQ ID NO: 2586336 - DNA, 23 bp, Homo sapiens
tttctgttgtcattgctgttgtc

SEQ ID NO: 2586337 - DNA, 12 bp, Homo sapiens
tttcttaaataa

SEQ ID NO: 2586338 - DNA, 16 bp, Homo sapiens
aagcaatgcattttgg

SEQ ID NO: 2586339 - DNA, 15 bp, Homo sapiens
aagcaattagacaag

SEQ ID NO: 2586340 - DNA, 13 bp, Homo sapiens
aagcacagtggtg

SEQ ID NO: 2586341 - DNA, 14 bp, Homo sapiens
aagcacagtggtgg

SEQ ID NO: 2586342 - DNA, 18 bp, Homo sapiens
aagcacagtggtggcagg

SEQ ID NO: 2586343 - DNA, 23 bp, Homo sapiens
aagcacagtggtggcagggccta

SEQ ID NO: 2586344 - DNA, 20 bp, Homo sapiens
aagcaccagcttctccaggc

SEQ ID NO: 2586345 - DNA, 14 bp, Homo sapiens
aagcaccccatgcc

SEQ ID NO: 2586346 - DNA, 19 bp, Homo sapiens
aagcaccgcctccaaatgc

SEQ ID NO: 2586347 - DNA, 19 bp, Homo sapiens
aagcactgctaggcgagtg

SEQ ID NO: 2586348 - DNA, 15 bp, Homo sapiens
aagcactgtgctcag

SEQ ID NO: 2586349 - DNA, 16 bp, Homo sapiens
aagcactgtgctcagg

SEQ ID NO: 2586350 - DNA, 21 bp, Homo sapiens
aagcagaccactgataaaacc

SEQ ID NO: 2586351 - DNA, 16 bp, Homo sapiens
aagcagatgcaaagag

SEQ ID NO: 2586352 - DNA, 14 bp, Homo sapiens
aagcagccaagctc

SEQ ID NO: 2586353 - DNA, 17 bp, Homo sapiens
aagcagctttaaacaaa

SEQ ID NO: 2586354 - DNA, 21 bp, Homo sapiens
aagcagtagaaataatatgca

SEQ ID NO: 2586355 - DNA, 23 bp, Homo sapiens
aagcatattgttattatataatt

SEQ ID NO: 2586356 - DNA, 14 bp, Homo sapiens
aagcatcaaactct

SEQ ID NO: 2586357 - DNA, 15 bp, Homo sapiens
aagcatcaaactctt

SEQ ID NO: 2586358 - DNA, 18 bp, Homo sapiens
aagcatcacctcaggcca

SEQ ID NO: 2586359 - DNA, 19 bp, Homo sapiens
aagcatcacctcaggccag

SEQ ID NO: 2586360 - DNA, 14 bp, Homo sapiens
aagcatccatgtgt

SEQ ID NO: 2586361 - DNA, 19 bp, Homo sapiens
aagcatccatgtgtggact

SEQ ID NO: 2586362 - DNA, 14 bp, Homo sapiens
aagcatgtttcatg

SEQ ID NO: 2586363 - DNA, 15 bp, Homo sapiens
aagcatgtttcatgt

SEQ ID NO: 2586364 - DNA, 17 bp, Homo sapiens
aagcattaacttctctg

SEQ ID NO: 2586365 - DNA, 18 bp, Homo sapiens
aagcattaagaacacttt

SEQ ID NO: 2586366 - DNA, 18 bp, Homo sapiens
aagcattacatttccaaa

SEQ ID NO: 2586367 - DNA, 21 bp, Homo sapiens
aagcattcaatttattcaaga

SEQ ID NO: 2586368 - DNA, 23 bp, Homo sapiens
aagcattcaatttattcaagaaa

SEQ ID NO: 2586369 - DNA, 13 bp, Homo sapiens
aagcattcacaac

SEQ ID NO: 2586370 - DNA, 17 bp, Homo sapiens
aagcattccttctttga

SEQ ID NO: 2586371 - DNA, 13 bp, Homo sapiens
aagcattgtaaat

SEQ ID NO: 2586372 - DNA, 11 bp, Homo sapiens
aagcattgttt

SEQ ID NO: 2586373 - DNA, 20 bp, Homo sapiens
aagccaaactctgccagcca

SEQ ID NO: 2586374 - DNA, 13 bp, Homo sapiens
aagccaaagccaa

SEQ ID NO: 2586375 - DNA, 20 bp, Homo sapiens
aagccaaagctaggcctggc

SEQ ID NO: 2586376 - DNA, 16 bp, Homo sapiens
aagccaacgacaaagc

SEQ ID NO: 2586377 - DNA, 16 bp, Homo sapiens
aagccaacttgtaaat

SEQ ID NO: 2586378 - DNA, 13 bp, Homo sapiens
aagccaagcagcc

SEQ ID NO: 2586379 - DNA, 17 bp, Homo sapiens
aagccacctctccctca

SEQ ID NO: 2586380 - DNA, 13 bp, Homo sapiens
aagccagaagctg

SEQ ID NO: 2586381 - DNA, 14 bp, Homo sapiens
aagccagcgtcctc

SEQ ID NO: 2586382 - DNA, 21 bp, Homo sapiens
aagccagctgccgaccagagc

SEQ ID NO: 2586383 - DNA, 23 bp, Homo sapiens
aagccagctgccgaccagagccc

SEQ ID NO: 2586384 - DNA, 17 bp, Homo sapiens
aagccagtgcggcaggt

SEQ ID NO: 2586385 - DNA, 18 bp, Homo sapiens
aagccataattgttctta

SEQ ID NO: 2586386 - DNA, 15 bp, Homo sapiens
aagccatcttggtaa

SEQ ID NO: 2586387 - DNA, 16 bp, Homo sapiens
aagcccaacctcctga

SEQ ID NO: 2586388 - DNA, 17 bp, Homo sapiens
aagcccaacctcctgac

SEQ ID NO: 2586389 - DNA, 20 bp, Homo sapiens
aagcccagcactgcttgagg

SEQ ID NO: 2586390 - DNA, 22 bp, Homo sapiens
aagcccatcaattatagaaagc

SEQ ID NO: 2586391 - DNA, 23 bp, Homo sapiens
aagcccattcattccattctgga

SEQ ID NO: 2586392 - DNA, 21 bp, Homo sapiens
aagccccaggcaggctgtgcg

SEQ ID NO: 2586393 - DNA, 16 bp, Homo sapiens
aagcccccccttccac

SEQ ID NO: 2586394 - DNA, 18 bp, Homo sapiens
aagccctcttccatcatg

SEQ ID NO: 2586395 - DNA, 23 bp, Homo sapiens
aagccctgattgtgtatattcat

SEQ ID NO: 2586396 - DNA, 23 bp, Homo sapiens
aagccctggagccaactgctgct

SEQ ID NO: 2586397 - DNA, 19 bp, Homo sapiens
aagccctgtcgagacactt

SEQ ID NO: 2586398 - DNA, 20 bp, Homo sapiens
aagccctgtcgagacacttg

SEQ ID NO: 2586399 - DNA, 15 bp, Homo sapiens
aagcccttccatgtc

SEQ ID NO: 2586400 - DNA, 20 bp, Homo sapiens
aagcccttccatgtcgcctc

SEQ ID NO: 2586401 - DNA, 21 bp, Homo sapiens
aagccgtgattttcattgctg

SEQ ID NO: 2586402 - DNA, 22 bp, Homo sapiens
aagcctcaactagtcatttttt

SEQ ID NO: 2586403 - DNA, 14 bp, Homo sapiens
aagcctcatattta

SEQ ID NO: 2586404 - DNA, 20 bp, Homo sapiens
aagcctccatttagttcttt

SEQ ID NO: 2586405 - DNA, 22 bp, Homo sapiens
aagcctccatttagttctttgt

SEQ ID NO: 2586406 - DNA, 23 bp, Homo sapiens
aagcctctggctagaggccagcc

SEQ ID NO: 2586407 - DNA, 20 bp, Homo sapiens
aagcctgagtttgctttcaa

SEQ ID NO: 2586408 - DNA, 22 bp, Homo sapiens
aagccttatcaagtgtcttcca

SEQ ID NO: 2586409 - DNA, 16 bp, Homo sapiens
aagccttccacactca

SEQ ID NO: 2586410 - DNA, 18 bp, Homo sapiens
aagcgatcacttcctata

SEQ ID NO: 2586411 - DNA, 21 bp, Homo sapiens
aagcgatgaatttggagactc

SEQ ID NO: 2586412 - DNA, 14 bp, Homo sapiens
aagcgattcttctg

SEQ ID NO: 2586413 - DNA, 21 bp, Homo sapiens
aagcggaggttgcagggagcc

SEQ ID NO: 2586414 - DNA, 16 bp, Homo sapiens
aagcgtgagccactgc

SEQ ID NO: 2586415 - DNA, 17 bp, Homo sapiens
aagcgtgagccactgca

SEQ ID NO: 2586416 - DNA, 21 bp, Homo sapiens
aagcgtgagccactgcaccgg

SEQ ID NO: 2586417 - DNA, 23 bp, Homo sapiens
aagctaaaacctgagctagaagc

SEQ ID NO: 2586418 - DNA, 13 bp, Homo sapiens
aagctacaggtta

SEQ ID NO: 2586419 - DNA, 14 bp, Homo sapiens
aagctacaggttac

SEQ ID NO: 2586420 - DNA, 15 bp, Homo sapiens
aagctacaggttaca

SEQ ID NO: 2586421 - DNA, 21 bp, Homo sapiens
aagctacaggttacaacagat

SEQ ID NO: 2586422 - DNA, 22 bp, Homo sapiens
aagctacaggttacaacagatt

SEQ ID NO: 2586423 - DNA, 19 bp, Homo sapiens
aagctacctcaaacttcca

SEQ ID NO: 2586424 - DNA, 17 bp, Homo sapiens
aagctagaacctggagg

SEQ ID NO: 2586425 - DNA, 13 bp, Homo sapiens
aagctagctcccc

SEQ ID NO: 2586426 - DNA, 16 bp, Homo sapiens
aagctaggcctggcca

SEQ ID NO: 2586427 - DNA, 22 bp, Homo sapiens
aagctagggtggcccttgcagt

SEQ ID NO: 2586428 - DNA, 15 bp, Homo sapiens
aagctatggtgagat

SEQ ID NO: 2586429 - DNA, 18 bp, Homo sapiens
aagctatggtgagatgca

SEQ ID NO: 2586430 - DNA, 22 bp, Homo sapiens
aagctattcagtaataactcta

SEQ ID NO: 2586431 - DNA, 17 bp, Homo sapiens
aagctatttatctgtag

SEQ ID NO: 2586432 - DNA, 16 bp, Homo sapiens
aagctcacctgttgct

SEQ ID NO: 2586433 - DNA, 14 bp, Homo sapiens
aagctcagaaggct

SEQ ID NO: 2586434 - DNA, 17 bp, Homo sapiens
aagctcaggaccaggca

SEQ ID NO: 2586435 - DNA, 16 bp, Homo sapiens
aagctcagggcctggc

SEQ ID NO: 2586436 - DNA, 17 bp, Homo sapiens
aagctcagggcctggct

SEQ ID NO: 2586437 - DNA, 21 bp, Homo sapiens
aagctcccaagggatggtgcc

SEQ ID NO: 2586438 - DNA, 18 bp, Homo sapiens
aagctcctagcagagaga

SEQ ID NO: 2586439 - DNA, 15 bp, Homo sapiens
aagctcctgtcctcc

SEQ ID NO: 2586440 - DNA, 20 bp, Homo sapiens
aagctcctgtcctcccatcc

SEQ ID NO: 2586441 - DNA, 17 bp, Homo sapiens
aactcttagaaatgaag

SEQ ID NO: 2586442 - DNA, 14 bp, Homo sapiens
aactcttatctcag

SEQ ID NO: 2586443 - DNA, 17 bp, Homo sapiens
aactcttggtttcttca

SEQ ID NO: 2586444 - DNA, 23 bp, Homo sapiens
aactgaatgaaacccccacacac

SEQ ID NO: 2586445 - DNA, 20 bp, Homo sapiens
aactgaatgtttattccttg

SEQ ID NO: 2586446 - DNA, 13 bp, Homo sapiens
aactgactttatc

SEQ ID NO: 2586447 - DNA, 20 bp, Homo sapiens
aactgagatgtgaacacatc

SEQ ID NO: 2586448 - DNA, 13 bp, Homo sapiens
aactgaggaattt

SEQ ID NO: 2586449 - DNA, 16 bp, Homo sapiens
aactgaggaattttct

SEQ ID NO: 2586450 - DNA, 12 bp, Homo sapiens
aactgaggcaga

SEQ ID NO: 2586451 - DNA, 14 bp, Homo sapiens
aactgataaagatg

SEQ ID NO: 2586452 - DNA, 17 bp, Homo sapiens
aactgatagttactgtt

SEQ ID NO: 2586453 - DNA, 19 bp, Homo sapiens
aactgatagttactgttgt

SEQ ID NO: 2586454 - DNA, 19 bp, Homo sapiens
aactgcactgtcaagatga

SEQ ID NO: 2586455 - DNA, 16 bp, Homo sapiens
aactgcattggctttg

SEQ ID NO: 2586456 - DNA, 16 bp, Homo sapiens
aactgcctactccaaa

SEQ ID NO: 2586457 - DNA, 23 bp, Homo sapiens
aactgctgaaaactagctcgtga

SEQ ID NO: 2586458 - DNA, 20 bp, Homo sapiens
aactgctgactgttttctct

SEQ ID NO: 2586459 - DNA, 21 bp, Homo sapiens
aactgctgactgttttctctt

SEQ ID NO: 2586460 - DNA, 16 bp, Homo sapiens
aactggattaaactta

SEQ ID NO: 2586461 - DNA, 13 bp, Homo sapiens
aactgggaccttt

SEQ ID NO: 2586462 - DNA, 14 bp, Homo sapiens
aactgggctgaaca

SEQ ID NO: 2586463 - DNA, 22 bp, Homo sapiens
aactgggggagggtgaagtgaa

SEQ ID NO: 2586464 - DNA, 21 bp, Homo sapiens
aactggtttgttgcagccaaa

SEQ ID NO: 2586465 - DNA, 18 bp, Homo sapiens
aactgtacttttaaggca

SEQ ID NO: 2586466 - DNA, 14 bp, Homo sapiens
aactgtagaaatga

SEQ ID NO: 2586467 - DNA, 16 bp, Homo sapiens
aactgtagaaatgatg

SEQ ID NO: 2586468 - DNA, 17 bp, Homo sapiens
aactgtagaaatgatga

SEQ ID NO: 2586469 - DNA, 16 bp, Homo sapiens
aactgtccagagagca

SEQ ID NO: 2586470 - DNA, 21 bp, Homo sapiens
aactgtgtacataactgaaaa

SEQ ID NO: 2586471 - DNA, 19 bp, Homo sapiens
aactgttaaattgctgtgt

SEQ ID NO: 2586472 - DNA, 17 bp, Homo sapiens
aactgttatttataatc

SEQ ID NO: 2586473 - DNA, 14 bp, Homo sapiens
aactgttgattgca

SEQ ID NO: 2586474 - DNA, 13 bp, Homo sapiens
aactgttgtataa

SEQ ID NO: 2586475 - DNA, 14 bp, Homo sapiens
aactgttgtataaa

SEQ ID NO: 2586476 - DNA, 15 bp, Homo sapiens
aactgttgtataaat

SEQ ID NO: 2586477 - DNA, 17 bp, Homo sapiens
aacttaaaaatgtaaat

SEQ ID NO: 2586478 - DNA, 13 bp, Homo sapiens
aacttaaaatatt

SEQ ID NO: 2586479 - DNA, 13 bp, Homo sapiens
aacttaaataata

SEQ ID NO: 2586480 - DNA, 14 bp, Homo sapiens
aacttaaataataa

SEQ ID NO: 2586481 - DNA, 19 bp, Homo sapiens
aacttaaataatgtgaaac

SEQ ID NO: 2586482 - DNA, 16 bp, Homo sapiens
aacttaacattctgta

SEQ ID NO: 2586483 - DNA, 16 bp, Homo sapiens
aacttaatctaaatgg

SEQ ID NO: 2586484 - DNA, 18 bp, Homo sapiens
aacttaatctaaatggaa

SEQ ID NO: 2586485 - DNA, 23 bp, Homo sapiens
aacttaccgtgagcgacaaagat

SEQ ID NO: 2586486 - DNA, 14 bp, Homo sapiens
aacttacttagtgt

SEQ ID NO: 2586487 - DNA, 22 bp, Homo sapiens
aacttagtgcggacaagtttta

SEQ ID NO: 2586488 - DNA, 23 bp, Homo sapiens
aacttatatcatcagcatacctt

SEQ ID NO: 2586489 - DNA, 20 bp, Homo sapiens
aacttatattgtaagaaata

SEQ ID NO: 2586490 - DNA, 16 bp, Homo sapiens
aacttatttttttctg

SEQ ID NO: 2586491 - DNA, 21 bp, Homo sapiens
aacttatttttttctgattgt

SEQ ID NO: 2586492 - DNA, 22 bp, Homo sapiens
aacttatttttttctgattgta

SEQ ID NO: 2586493 - DNA, 14 bp, Homo sapiens
aacttcaacattta

SEQ ID NO: 2586494 - DNA, 13 bp, Homo sapiens
aacttccaattta

SEQ ID NO: 2586495 - DNA, 23 bp, Homo sapiens
aacttcgcatcaaaagacaattc

SEQ ID NO: 2586496 - DNA, 11 bp, Homo sapiens
aacttcttcag

SEQ ID NO: 2586497 - DNA, 19 bp, Homo sapiens
aacttcttcagagctgaca

SEQ ID NO: 2586498 - DNA, 24 bp, Homo sapiens
aacttctttgtaatcgttatgtgt

SEQ ID NO: 2586499 - DNA, 21 bp, Homo sapiens
aacttgcatccaactccagga

SEQ ID NO: 2586500 - DNA, 15 bp, Homo sapiens
aacttgcatggagca

SEQ ID NO: 2586501 - DNA, 23 bp, Homo sapiens
aacttggaaaaatccagaaagaa

SEQ ID NO: 2586502 - DNA, 15 bp, Homo sapiens
aacttggagccccag

SEQ ID NO: 2586503 - DNA, 19 bp, Homo sapiens
aacttggggaacaagggtg

SEQ ID NO: 2586504 - DNA, 18 bp, Homo sapiens
aacttgtaaatgctgtca

SEQ ID NO: 2586505 - DNA, 20 bp, Homo sapiens
aacttgtaatttttttaatt

SEQ ID NO: 2586506 - DNA, 21 bp, Homo sapiens
aactttaagtttcaggataca

SEQ ID NO: 2586507 - DNA, 21 bp, Homo sapiens
aactttaattctctttcaaag

SEQ ID NO: 2586508 - DNA, 13 bp, Homo sapiens
aactttacctttt

SEQ ID NO: 2586509 - DNA, 20 bp, Homo sapiens
aactttactaagatgacatt

SEQ ID NO: 2586510 - DNA, 15 bp, Homo sapiens
aactttctgtaaact

SEQ ID NO: 2586511 - DNA, 13 bp, Homo sapiens
aactttgacctct

SEQ ID NO: 2586512 - DNA, 14 bp, Homo sapiens
aactttgacctctg

SEQ ID NO: 2586513 - DNA, 17 bp, Homo sapiens
aactttgacctctgcag

SEQ ID NO: 2586514 - DNA, 12 bp, Homo sapiens
aactttgcttgc

SEQ ID NO: 2586515 - DNA, 18 bp, Homo sapiens
aactttggagtcccctca

SEQ ID NO: 2586516 - DNA, 19 bp, Homo sapiens
aactttgtggatgtcttcc

SEQ ID NO: 2586517 - DNA, 15 bp, Homo sapiens
aacttttataaactt

SEQ ID NO: 2586518 - DNA, 19 bp, Homo sapiens
aacttttataaactttacc

SEQ ID NO: 2586519 - DNA, 12 bp, Homo sapiens
aacttttctcag

SEQ ID NO: 2586520 - DNA, 14 bp, Homo sapiens
aacttttttttaag

SEQ ID NO: 2586521 - DNA, 20 bp, Homo sapiens
aacttttttttaagttacac

SEQ ID NO: 2586522 - DNA, 17 bp, Homo sapiens
aacttttttttgagaat

SEQ ID NO: 2586523 - DNA, 18 bp, Homo sapiens
aagaaaaaaaaagaaaaa

SEQ ID NO: 2586524 - DNA, 11 bp, Homo sapiens
aagaaaaaagt

SEQ ID NO: 2586525 - DNA, 14 bp, Homo sapiens
aagaaaaaatacat

SEQ ID NO: 2586526 - DNA, 19 bp, Homo sapiens
aagaaaaaatattttccct

SEQ ID NO: 2586527 - DNA, 17 bp, Homo sapiens
aagaaaaaggatgcaca

SEQ ID NO: 2586528 - DNA, 11 bp, Homo sapiens
aagaaaagata

SEQ ID NO: 2586529 - DNA, 19 bp, Homo sapiens
aagaaaagtgaatgctcaa

SEQ ID NO: 2586530 - DNA, 21 bp, Homo sapiens
aagaaaataaaaaaaagaaaa

SEQ ID NO: 2586531 - DNA, 19 bp, Homo sapiens
aagaaaatacataagacca

SEQ ID NO: 2586532 - DNA, 16 bp, Homo sapiens
aagaaaataccaagga

SEQ ID NO: 2586533 - DNA, 19 bp, Homo sapiens
aagaaacagatctcctggc

SEQ ID NO: 2586534 - DNA, 18 bp, Homo sapiens
aagaaacccgacagaggg

SEQ ID NO: 2586535 - DNA, 16 bp, Homo sapiens
aagaaactgaggaatt

SEQ ID NO: 2586536 - DNA, 19 bp, Homo sapiens
aagaaactgaggaattttc

SEQ ID NO: 2586537 - DNA, 20 bp, Homo sapiens
aagaaagactatctaaatgt

SEQ ID NO: 2586538 - DNA, 17 bp, Homo sapiens
aagaaagagaaggagcc

SEQ ID NO: 2586539 - DNA, 12 bp, Homo sapiens
aagaaagagaga

SEQ ID NO: 2586540 - DNA, 14 bp, Homo sapiens
aagaaagagagaaa

SEQ ID NO: 2586541 - DNA, 20 bp, Homo sapiens
aagaaagagagaaaataaaa

SEQ ID NO: 2586542 - DNA, 23 bp, Homo sapiens
aagaaagagcaacaatccatctc

SEQ ID NO: 2586543 - DNA, 20 bp, Homo sapiens
aagaaagttgcacggctgct

SEQ ID NO: 2586544 - DNA, 22 bp, Homo sapiens
aagaaagttgcacggctgctga

SEQ ID NO: 2586545 - DNA, 14 bp, Homo sapiens
aagaaattcctgta

SEQ ID NO: 2586546 - DNA, 16 bp, Homo sapiens
aagaaattgcaataac

SEQ ID NO: 2586547 - DNA, 17 bp, Homo sapiens
aagaaatttaaaagaca

SEQ ID NO: 2586548 - DNA, 21 bp, Homo sapiens
aagaacaaagagaaaaaatac

SEQ ID NO: 2586549 - DNA, 14 bp, Homo sapiens
aagaacaagaattt

SEQ ID NO: 2586550 - DNA, 18 bp, Homo sapiens
aagaacatccaaggagaa

SEQ ID NO: 2586551 - DNA, 23 bp, Homo sapiens
aagaactatatgtgaatcctctt

SEQ ID NO: 2586552 - DNA, 15 bp, Homo sapiens
aagaagaacttgcat

SEQ ID NO: 2586553 - DNA, 17 bp, Homo sapiens
aagaagacatggagact

SEQ ID NO: 2586554 - DNA, 13 bp, Homo sapiens
aagaagacatgtt

SEQ ID NO: 2586555 - DNA, 15 bp, Homo sapiens
aagaagacatgtttt

SEQ ID NO: 2586556 - DNA, 17 bp, Homo sapiens
aagaagacatgttttag

SEQ ID NO: 2586557 - DNA, 21 bp, Homo sapiens
aagaagaccagactgtggaga

SEQ ID NO: 2586558 - DNA, 14 bp, Homo sapiens
aagaagctctctcc

SEQ ID NO: 2586559 - DNA, 14 bp, Homo sapiens
aagaagctgttgta

SEQ ID NO: 2586560 - DNA, 18 bp, Homo sapiens
aagaagctgttgtacatt

SEQ ID NO: 2586561 - DNA, 22 bp, Homo sapiens
aagaagctgttgtacatttatg

SEQ ID NO: 2586562 - DNA, 17 bp, Homo sapiens
aagaaggaaaaggcagg

SEQ ID NO: 2586563 - DNA, 22 bp, Homo sapiens
aagaagggctagaacctggagg

SEQ ID NO: 2586564 - DNA, 21 bp, Homo sapiens
aagaaggttaccaagaagcct

SEQ ID NO: 2586565 - DNA, 23 bp, Homo sapiens
aagaaggtttcagaaagaagtgg

SEQ ID NO: 2586566 - DNA, 16 bp, Homo sapiens
aagaagtgaaaatcta

SEQ ID NO: 2586567 - DNA, 14 bp, Homo sapiens
aagaatacagaaag

SEQ ID NO: 2586568 - DNA, 14 bp, Homo sapiens
aagaatgaaagagt

SEQ ID NO: 2586569 - DNA, 22 bp, Homo sapiens
aagaatgagcctacgctgaaga

SEQ ID NO: 2586570 - DNA, 15 bp, Homo sapiens
aagaatgctggtttt

SEQ ID NO: 2586571 - DNA, 18 bp, Homo sapiens
aagaatgctggttttcct

SEQ ID NO: 2586572 - DNA, 17 bp, Homo sapiens
aagaatgggcagttaca

SEQ ID NO: 2586573 - DNA, 20 bp, Homo sapiens
aagaatggggatcacagaga

SEQ ID NO: 2586574 - DNA, 14 bp, Homo sapiens
aagaattttaaaaa

SEQ ID NO: 2586575 - DNA, 15 bp, Homo sapiens
aagaattttaaaaat

SEQ ID NO: 2586576 - DNA, 16 bp, Homo sapiens
aagaattttaaaaatg

SEQ ID NO: 2586577 - DNA, 19 bp, Homo sapiens
aagaattttaaaaatgaat

SEQ ID NO: 2586578 - DNA, 20 bp, Homo sapiens
aagaattttaaaaatgaatc

SEQ ID NO: 2586579 - DNA, 21 bp, Homo sapiens
aagacaacattaaaacaatat

SEQ ID NO: 2586580 - DNA, 22 bp, Homo sapiens
aagacaatgacttactgtacat

SEQ ID NO: 2586581 - DNA, 12 bp, Homo sapiens
aagacaattctt

SEQ ID NO: 2586582 - DNA, 16 bp, Homo sapiens
aagacaccagagcaga

SEQ ID NO: 2586583 - DNA, 22 bp, Homo sapiens
aagacaccagagcagatgcaga

SEQ ID NO: 2586584 - DNA, 22 bp, Homo sapiens
aagacactgaaatatacacaca

SEQ ID NO: 2586585 - DNA, 12 bp, Homo sapiens
aagacagaagcc

SEQ ID NO: 2586586 - DNA, 13 bp, Homo sapiens
aagacagaagcct

SEQ ID NO: 2586587 - DNA, 15 bp, Homo sapiens
aagacagagctggga

SEQ ID NO: 2586588 - DNA, 23 bp, Homo sapiens
aagacagatactcctccaaggtt

SEQ ID NO: 2586589 - DNA, 21 bp, Homo sapiens
aagacagggctgataagctaa

SEQ ID NO: 2586590 - DNA, 17 bp, Homo sapiens
aagacatccataaagaa

SEQ ID NO: 2586591 - DNA, 21 bp, Homo sapiens
aagacatccataaagaagcaa

SEQ ID NO: 2586592 - DNA, 21 bp, Homo sapiens
aaagtgataatttctggaatt

SEQ ID NO: 2586593 - DNA, 15 bp, Homo sapiens
aaagtgattaaacgt

SEQ ID NO: 2586594 - DNA, 23 bp, Homo sapiens
aaagtgcagctccgtttggcagt

SEQ ID NO: 2586595 - DNA, 13 bp, Homo sapiens
aaagtggaaaaat

SEQ ID NO: 2586596 - DNA, 20 bp, Homo sapiens
aaagtggaaaacaaggaagt

SEQ ID NO: 2586597 - DNA, 16 bp, Homo sapiens
aaagtggtatagaaat

SEQ ID NO: 2586598 - DNA, 21 bp, Homo sapiens
aaagtggtgctcagttgtaga

SEQ ID NO: 2586599 - DNA, 12 bp, Homo sapiens
aaagtgtaaagc

SEQ ID NO: 2586600 - DNA, 15 bp, Homo sapiens
aaagtgtaaagcatt

SEQ ID NO: 2586601 - DNA, 16 bp, Homo sapiens
aaagtgtaaagcattc

SEQ ID NO: 2586602 - DNA, 18 bp, Homo sapiens
aaagtgtaaagcattcca

SEQ ID NO: 2586603 - DNA, 14 bp, Homo sapiens
aaagtgtatttttt

SEQ ID NO: 2586604 - DNA, 22 bp, Homo sapiens
aaagtgtgagcagtgagttaca

SEQ ID NO: 2586605 - DNA, 19 bp, Homo sapiens
aaagtgtggtcccaacagg

SEQ ID NO: 2586606 - DNA, 17 bp, Homo sapiens
aaagtgtgttgttgctt

SEQ ID NO: 2586607 - DNA, 20 bp, Homo sapiens
aaagtgtgttgttgctttag

SEQ ID NO: 2586608 - DNA, 18 bp, Homo sapiens
aaagtgtttatttttcat

SEQ ID NO: 2586609 - DNA, 16 bp, Homo sapiens
aaagttaaacattgaa

SEQ ID NO: 2586610 - DNA, 17 bp, Homo sapiens
aaagttacaaattgctt

SEQ ID NO: 2586611 - DNA, 20 bp, Homo sapiens
aaagttactttgtcagaggc

SEQ ID NO: 2586612 - DNA, 14 bp, Homo sapiens
aaagttagctgagc

SEQ ID NO: 2586613 - DNA, 21 bp, Homo sapiens
aaagttccctacttcctgtga

SEQ ID NO: 2586614 - DNA, 12 bp, Homo sapiens
aaagttgaaatt

SEQ ID NO: 2586615 - DNA, 19 bp, Homo sapiens
aaagtttacaagtgtatat

SEQ ID NO: 2586616 - DNA, 13 bp, Homo sapiens
aaagtttccatat

SEQ ID NO: 2586617 - DNA, 14 bp, Homo sapiens
aaagtttccatatg

SEQ ID NO: 2586618 - DNA, 13 bp, Homo sapiens
aaagtttctcaga

SEQ ID NO: 2586619 - DNA, 23 bp, Homo sapiens
aaagtttctcttttcaaaacatt

SEQ ID NO: 2586620 - DNA, 13 bp, Homo sapiens
aaagttttgaaaa

SEQ ID NO: 2586621 - DNA, 19 bp, Homo sapiens
aaagttttgaaaagctatt

SEQ ID NO: 2586622 - DNA, 15 bp, Homo sapiens
aaataaaaaaaagaa

SEQ ID NO: 2586623 - DNA, 17 bp, Homo sapiens
aaataaaaaaaagaaaa

SEQ ID NO: 2586624 - DNA, 20 bp, Homo sapiens
aaataaaaaaaagaaaaaag

SEQ ID NO: 2586625 - DNA, 13 bp, Homo sapiens
aaataaaaacaaa

SEQ ID NO: 2586626 - DNA, 19 bp, Homo sapiens
aaataaaaagtgacacagc

SEQ ID NO: 2586627 - DNA, 14 bp, Homo sapiens
aaataaaaagttaa

SEQ ID NO: 2586628 - DNA, 19 bp, Homo sapiens
aaataaaaagttaaaaagt

SEQ ID NO: 2586629 - DNA, 16 bp, Homo sapiens
aaataaaaattctgaa

SEQ ID NO: 2586630 - DNA, 17 bp, Homo sapiens
aaataaaacctttcaaa

SEQ ID NO: 2586631 - DNA, 19 bp, Homo sapiens
aaataaaagcagcatctgc

SEQ ID NO: 2586632 - DNA, 22 bp, Homo sapiens
aaataaaattaaagctgaaaac

SEQ ID NO: 2586633 - DNA, 15 bp, Homo sapiens
aaataaagtatatat

SEQ ID NO: 2586634 - DNA, 15 bp, Homo sapiens
aaataaagtatcatg

SEQ ID NO: 2586635 - DNA, 18 bp, Homo sapiens
aaataaagtatcatgcat

SEQ ID NO: 2586636 - DNA, 16 bp, Homo sapiens
aaataaatagctatat

SEQ ID NO: 2586637 - DNA, 22 bp, Homo sapiens
aaataaatgagctatgtattaa

SEQ ID NO: 2586638 - DNA, 23 bp, Homo sapiens
aaataacaaatctcaagcaaaca

SEQ ID NO: 2586639 - DNA, 17 bp, Homo sapiens
aaataacaatgttaagg

SEQ ID NO: 2586640 - DNA, 19 bp, Homo sapiens
aaataacaatgttaaggaa

SEQ ID NO: 2586641 - DNA, 22 bp, Homo sapiens
aaataagaaaagatgtagattt

SEQ ID NO: 2586642 - DNA, 18 bp, Homo sapiens
aaataagggcagagtcac

SEQ ID NO: 2586643 - DNA, 14 bp, Homo sapiens
aaataatatgcatt

SEQ ID NO: 2586644 - DNA, 14 bp, Homo sapiens
aaataatcattctt

SEQ ID NO: 2586645 - DNA, 13 bp, Homo sapiens
aaataatctattt

SEQ ID NO: 2586646 - DNA, 22 bp, Homo sapiens
aaataatctatttctatgagaa

SEQ ID NO: 2586647 - DNA, 13 bp, Homo sapiens
aaataattctaaa

SEQ ID NO: 2586648 - DNA, 20 bp, Homo sapiens
aaataattttaaacaaaggt

SEQ ID NO: 2586649 - DNA, 19 bp, Homo sapiens
aaatacacactcaaatcaa

SEQ ID NO: 2586650 - DNA, 22 bp, Homo sapiens
aaatacaccacctcactcctgt

SEQ ID NO: 2586651 - DNA, 22 bp, Homo sapiens
aaatacagacactaagttatag

SEQ ID NO: 2586652 - DNA, 22 bp, Homo sapiens
aaatacagtcttccatttgcaa

SEQ ID NO: 2586653 - DNA, 23 bp, Homo sapiens
aaatacagtcttccatttgcaag

SEQ ID NO: 2586654 - DNA, 21 bp, Homo sapiens
aaataccaaaattatttcaga

SEQ ID NO: 2586655 - DNA, 20 bp, Homo sapiens
aaataccagccagtaaatgg

SEQ ID NO: 2586656 - DNA, 18 bp, Homo sapiens
aaataccccatcattcat

SEQ ID NO: 2586657 - DNA, 19 bp, Homo sapiens
aaataccccatcattcatg

SEQ ID NO: 2586658 - DNA, 17 bp, Homo sapiens
aaatactcatgtgtatg

SEQ ID NO: 2586659 - DNA, 15 bp, Homo sapiens
aaatactgtacaatg

SEQ ID NO: 2586660 - DNA, 14 bp, Homo sapiens
aaatactgtttgag

SEQ ID NO: 2586661 - DNA, 15 bp, Homo sapiens
aaatactttaaagga

SEQ ID NO: 2586662 - DNA, 14 bp, Homo sapiens
aaatagaaataagt

SEQ ID NO: 2586663 - DNA, 16 bp, Homo sapiens
aaatagaaccactatg

SEQ ID NO: 2586664 - DNA, 15 bp, Homo sapiens
aaatagacagtatat

SEQ ID NO: 2586665 - DNA, 16 bp, Homo sapiens
aaatagacagtatatt

SEQ ID NO: 2586666 - DNA, 19 bp, Homo sapiens
aaatagacagtatatttat

SEQ ID NO: 2586667 - DNA, 21 bp, Homo sapiens
aaatagataagagtagaaact

SEQ ID NO: 2586668 - DNA, 16 bp, Homo sapiens
aaatagcaatcctaaa

SEQ ID NO: 2586669 - DNA, 13 bp, Homo sapiens
aaatagcatttgt

SEQ ID NO: 2586670 - DNA, 16 bp, Homo sapiens
aaatagcttgtatagt

SEQ ID NO: 2586671 - DNA, 23 bp, Homo sapiens
aaataggagaggatgagagccca

SEQ ID NO: 2586672 - DNA, 16 bp, Homo sapiens
aaatagggtctaactc

SEQ ID NO: 2586673 - DNA, 20 bp, Homo sapiens
aaatagtgcagaatctcata

SEQ ID NO: 2586674 - DNA, 13 bp, Homo sapiens
aaatataattctg

SEQ ID NO: 2586675 - DNA, 16 bp, Homo sapiens
aaatataattctgtaa

SEQ ID NO: 2586676 - DNA, 18 bp, Homo sapiens
aaatataattctgtaaat

SEQ ID NO: 2586677 - DNA, 13 bp, Homo sapiens
aaatatactgtaa

SEQ ID NO: 2586678 - DNA, 14 bp, Homo sapiens
aaatatactgtaaa

SEQ ID NO: 2586679 - DNA, 18 bp, Homo sapiens
aaatatacttaaatggaa

SEQ ID NO: 2586680 - DNA, 15 bp, Homo sapiens
aaatataggaactta

SEQ ID NO: 2586681 - DNA, 21 bp, Homo sapiens
aaatatataaaaagaaaagat

SEQ ID NO: 2586682 - DNA, 23 bp, Homo sapiens
aaatatatgattaactaatttta

SEQ ID NO: 2586683 - DNA, 21 bp, Homo sapiens
aaatatatttaagataattat

SEQ ID NO: 2586684 - DNA, 22 bp, Homo sapiens
aaatatatttaagataattata

SEQ ID NO: 2586685 - DNA, 15 bp, Homo sapiens
aaatatcagactagt

SEQ ID NO: 2586686 - DNA, 19 bp, Homo sapiens
aaatatgatattgcatatg

SEQ ID NO: 2586687 - DNA, 16 bp, Homo sapiens
aaatatgcaaagcact

SEQ ID NO: 2586688 - DNA, 18 bp, Homo sapiens
aaatatgcagtgatatgg

SEQ ID NO: 2586689 - DNA, 12 bp, Homo sapiens
aaatatgcatct

SEQ ID NO: 2586690 - DNA, 17 bp, Homo sapiens
aaatatggaacttctaa

SEQ ID NO: 2586691 - DNA, 18 bp, Homo sapiens
aaatatggaacttctaat

SEQ ID NO: 2586692 - DNA, 19 bp, Homo sapiens
aaatatggaacttctaata

SEQ ID NO: 2586693 - DNA, 19 bp, Homo sapiens
aaatatgttttttagatca

SEQ ID NO: 2586694 - DNA, 14 bp, Homo sapiens
aaatattagaaaca

SEQ ID NO: 2586695 - DNA, 22 bp, Homo sapiens
aaatattagatgtgatttaata

SEQ ID NO: 2586696 - DNA, 20 bp, Homo sapiens
aaatattataacttaaaaaa

SEQ ID NO: 2586697 - DNA, 16 bp, Homo sapiens
aaatattcatgcttct

SEQ ID NO: 2586698 - DNA, 18 bp, Homo sapiens
aaatattctatatgaatt

SEQ ID NO: 2586699 - DNA, 13 bp, Homo sapiens
aaatattgctggg

SEQ ID NO: 2586700 - DNA, 15 bp, Homo sapiens
aaatatttatttatt

SEQ ID NO: 2586701 - DNA, 13 bp, Homo sapiens
aaatatttatttt

SEQ ID NO: 2586702 - DNA, 14 bp, Homo sapiens
aaatatttgtacat

SEQ ID NO: 2586703 - DNA, 16 bp, Homo sapiens
aaatattttgctagtt

SEQ ID NO: 2586704 - DNA, 12 bp, Homo sapiens
aaatcaaatatg

SEQ ID NO: 2586705 - DNA, 14 bp, Homo sapiens
aaatcaaatatgca

SEQ ID NO: 2586706 - DNA, 18 bp, Homo sapiens
aaatcaaatatgcaaagc

SEQ ID NO: 2586707 - DNA, 19 bp, Homo sapiens
aaatcaattactggtccaa

SEQ ID NO: 2586708 - DNA, 23 bp, Homo sapiens
aaatcaattactggtccaaaaga

SEQ ID NO: 2586709 - DNA, 22 bp, Homo sapiens
aaatcaccacaccaaacctctc

SEQ ID NO: 2586710 - DNA, 18 bp, Homo sapiens
aaatcagcctgctccagc

SEQ ID NO: 2586711 - DNA, 14 bp, Homo sapiens
aaatcataaactgt

SEQ ID NO: 2586712 - DNA, 21 bp, Homo sapiens
aaatcatgaagatatttttcc

SEQ ID NO: 2586713 - DNA, 21 bp, Homo sapiens
aaatcattgctttgaagcagt

SEQ ID NO: 2586714 - DNA, 21 bp, Homo sapiens
aaatcccattcataactttca

SEQ ID NO: 2586715 - DNA, 17 bp, Homo sapiens
aaatccctgtttaatat

SEQ ID NO: 2586716 - DNA, 21 bp, Homo sapiens
aaatcctatgtgattttaact

SEQ ID NO: 2586717 - DNA, 23 bp, Homo sapiens
aaatcctatgtgattttaactct

SEQ ID NO: 2586718 - DNA, 13 bp, Homo sapiens
aaatcctcttcct

SEQ ID NO: 2586719 - DNA, 17 bp, Homo sapiens
aaatcctcttcctctga

SEQ ID NO: 2586720 - DNA, 21 bp, Homo sapiens
aaatcctcttcctctgaggct

SEQ ID NO: 2586721 - DNA, 17 bp, Homo sapiens
aaatcctttttctttat

SEQ ID NO: 2586722 - DNA, 19 bp, Homo sapiens
aaatcctttttctttataa

SEQ ID NO: 2586723 - DNA, 13 bp, Homo sapiens
aaatcgatgcagt

SEQ ID NO: 2586724 - DNA, 13 bp, Homo sapiens
aaatcgcttttga

SEQ ID NO: 2586725 - DNA, 14 bp, Homo sapiens
aaatcgcttttgat

SEQ ID NO: 2586726 - DNA, 17 bp, Homo sapiens
aaatctaatattaaaaa

SEQ ID NO: 2586727 - DNA, 18 bp, Homo sapiens
aaatctaatattaaaaat

SEQ ID NO: 2586728 - DNA, 19 bp, Homo sapiens
aaatctacactccagtgag

SEQ ID NO: 2586729 - DNA, 16 bp, Homo sapiens
aaatctaccttctgta

SEQ ID NO: 2586730 - DNA, 22 bp, Homo sapiens
aaatctagtatttcatgctggg

SEQ ID NO: 2586731 - DNA, 17 bp, Homo sapiens
aacaataactactgtgt

SEQ ID NO: 2586732 - DNA, 19 bp, Homo sapiens
aacaataactactgtgttc

SEQ ID NO: 2586733 - DNA, 20 bp, Homo sapiens
aacaatactcataatgtgaa

SEQ ID NO: 2586734 - DNA, 15 bp, Homo sapiens
aacaatgacatttat

SEQ ID NO: 2586735 - DNA, 14 bp, Homo sapiens
aacaatgatatatg

SEQ ID NO: 2586736 - DNA, 21 bp, Homo sapiens
aacaatttcctttatatttag

SEQ ID NO: 2586737 - DNA, 13 bp, Homo sapiens
aacaatttctgtc

SEQ ID NO: 2586738 - DNA, 16 bp, Homo sapiens
aacacaagtcctgtga

SEQ ID NO: 2586739 - DNA, 14 bp, Homo sapiens
aacacacaaaggta

SEQ ID NO: 2586740 - DNA, 16 bp, Homo sapiens
aacacaccaggctgtg

SEQ ID NO: 2586741 - DNA, 19 bp, Homo sapiens
aacacactgaggcagggaa

SEQ ID NO: 2586742 - DNA, 20 bp, Homo sapiens
aacacactgaggcagggaag

SEQ ID NO: 2586743 - DNA, 15 bp, Homo sapiens
aacacaggcaaaatc

SEQ ID NO: 2586744 - DNA, 18 bp, Homo sapiens
aacacagtgtttttgtaa

SEQ ID NO: 2586745 - DNA, 16 bp, Homo sapiens
aacacatcagcttgcc

SEQ ID NO: 2586746 - DNA, 21 bp, Homo sapiens
aacacattatcgggagcagtg

SEQ ID NO: 2586747 - DNA, 18 bp, Homo sapiens
aacacatttgattctgtg

SEQ ID NO: 2586748 - DNA, 19 bp, Homo sapiens
aacacattttgtataattg

SEQ ID NO: 2586749 - DNA, 21 bp, Homo sapiens
aacacattttgtataattgta

SEQ ID NO: 2586750 - DNA, 13 bp, Homo sapiens
aacaccacagaca

SEQ ID NO: 2586751 - DNA, 20 bp, Homo sapiens
aacacccagtctgttcccca

SEQ ID NO: 2586752 - DNA, 21 bp, Homo sapiens
aacacccatgaatcaaagaca

SEQ ID NO: 2586753 - DNA, 23 bp, Homo sapiens
aacacctcccaggagacagttca

SEQ ID NO: 2586754 - DNA, 19 bp, Homo sapiens
aacacctctgcacaagctg

SEQ ID NO: 2586755 - DNA, 13 bp, Homo sapiens
aacacctgatgtg

SEQ ID NO: 2586756 - DNA, 11 bp, Homo sapiens
aacactaacct

SEQ ID NO: 2586757 - DNA, 14 bp, Homo sapiens
aacactatatggca

SEQ ID NO: 2586758 - DNA, 17 bp, Homo sapiens
aacactcaagaagcagg

SEQ ID NO: 2586759 - DNA, 14 bp, Homo sapiens
aacactcatgctga

SEQ ID NO: 2586760 - DNA, 14 bp, Homo sapiens
aacactgcttgtgt

SEQ ID NO: 2586761 - DNA, 14 bp, Homo sapiens
aacactggggctgg

SEQ ID NO: 2586762 - DNA, 16 bp, Homo sapiens
aacactgggggagggg

SEQ ID NO: 2586763 - DNA, 20 bp, Homo sapiens
aacactgtgcacatctgtgt

SEQ ID NO: 2586764 - DNA, 15 bp, Homo sapiens
aacactgtgccctgg

SEQ ID NO: 2586765 - DNA, 15 bp, Homo sapiens
aacactgttctctgc

SEQ ID NO: 2586766 - DNA, 19 bp, Homo sapiens
aacagaaaacattctgatt

SEQ ID NO: 2586767 - DNA, 12 bp, Homo sapiens
aacagaaatgta

SEQ ID NO: 2586768 - DNA, 14 bp, Homo sapiens
aacagaaatgtaca

SEQ ID NO: 2586769 - DNA, 16 bp, Homo sapiens
aacagaagcttccatt

SEQ ID NO: 2586770 - DNA, 16 bp, Homo sapiens
aacagacaacagaagt

SEQ ID NO: 2586771 - DNA, 18 bp, Homo sapiens
aacagacaacagaagtca

SEQ ID NO: 2586772 - DNA, 13 bp, Homo sapiens
aacagactcaggt

SEQ ID NO: 2586773 - DNA, 19 bp, Homo sapiens
aacagagacaggcccaaga

SEQ ID NO: 2586774 - DNA, 17 bp, Homo sapiens
aacagaggccatggcag

SEQ ID NO: 2586775 - DNA, 16 bp, Homo sapiens
aacagataaatagttt

SEQ ID NO: 2586776 - DNA, 20 bp, Homo sapiens
aacagatataaatggctggt

SEQ ID NO: 2586777 - DNA, 22 bp, Homo sapiens
aacagatgcaatgtgctactga

SEQ ID NO: 2586778 - DNA, 16 bp, Homo sapiens
aacagattcacactgt

SEQ ID NO: 2586779 - DNA, 16 bp, Homo sapiens
aacagatttgtgaact

SEQ ID NO: 2586780 - DNA, 16 bp, Homo sapiens
aacagattttggggtt

SEQ ID NO: 2586781 - DNA, 14 bp, Homo sapiens
aacagcactggctc

SEQ ID NO: 2586782 - DNA, 23 bp, Homo sapiens
aacagcactggctctctccagga

SEQ ID NO: 2586783 - DNA, 16 bp, Homo sapiens
aacagcagaggttctt

SEQ ID NO: 2586784 - DNA, 21 bp, Homo sapiens
aacagcagaggttcttttaaa

SEQ ID NO: 2586785 - DNA, 13 bp, Homo sapiens
aacagcagtgttc

SEQ ID NO: 2586786 - DNA, 15 bp, Homo sapiens
aacagcagtgttccc

SEQ ID NO: 2586787 - DNA, 12 bp, Homo sapiens
aacagcattgct

SEQ ID NO: 2586788 - DNA, 14 bp, Homo sapiens
aacagcattgcttt

SEQ ID NO: 2586789 - DNA, 20 bp, Homo sapiens
aacagcattgctttctgaaa

SEQ ID NO: 2586790 - DNA, 15 bp, Homo sapiens
aacagccaacaggtg

SEQ ID NO: 2586791 - DNA, 20 bp, Homo sapiens
aacagccgctcctgtctgcc

SEQ ID NO: 2586792 - DNA, 13 bp, Homo sapiens
aacagcgctgggt

SEQ ID NO: 2586793 - DNA, 19 bp, Homo sapiens
aacagctatgggagcccca

SEQ ID NO: 2586794 - DNA, 13 bp, Homo sapiens
aacagctgtggct

SEQ ID NO: 2586795 - DNA, 15 bp, Homo sapiens
aacagcttcaggtta

SEQ ID NO: 2586796 - DNA, 16 bp, Homo sapiens
aacagcttctcaattt

SEQ ID NO: 2586797 - DNA, 22 bp, Homo sapiens
aacaggaagatcttaaattttg

SEQ ID NO: 2586798 - DNA, 10 bp, Homo sapiens
aacaggaagc

SEQ ID NO: 2586799 - DNA, 12 bp, Homo sapiens
aacaggagaatt

SEQ ID NO: 2586800 - DNA, 14 bp, Homo sapiens
aacaggaggacaat

SEQ ID NO: 2586801 - DNA, 16 bp, Homo sapiens
aacaggaggacaattc

SEQ ID NO: 2586802 - DNA, 18 bp, Homo sapiens
aacaggaggacaattcat

SEQ ID NO: 2586803 - DNA, 22 bp, Homo sapiens
aacaggaggacaattcatgaac

SEQ ID NO: 2586804 - DNA, 11 bp, Homo sapiens
aacaggcccag

SEQ ID NO: 2586805 - DNA, 12 bp, Homo sapiens
aacaggcccagc

SEQ ID NO: 2586806 - DNA, 13 bp, Homo sapiens
aacaggcccagca

SEQ ID NO: 2586807 - DNA, 23 bp, Homo sapiens
aacaggcccagcattgctggttc

SEQ ID NO: 2586808 - DNA, 21 bp, Homo sapiens
aacaggctcaatattcctgaa

SEQ ID NO: 2586809 - DNA, 13 bp, Homo sapiens
aacaggctgggct

SEQ ID NO: 2586810 - DNA, 23 bp, Homo sapiens
aacaggctgggcttcagtggcag

SEQ ID NO: 2586811 - DNA, 18 bp, Homo sapiens
aacagggcatctccagga

SEQ ID NO: 2586812 - DNA, 13 bp, Homo sapiens
aacagggtctcta

SEQ ID NO: 2586813 - DNA, 20 bp, Homo sapiens
aacagggtctctagtgctgt

SEQ ID NO: 2586814 - DNA, 23 bp, Homo sapiens
aacagggtctctagtgctgtgaa

SEQ ID NO: 2586815 - DNA, 17 bp, Homo sapiens
aacaggtctcctcttaa

SEQ ID NO: 2586816 - DNA, 19 bp, Homo sapiens
aacaggtggcaggaccagg

SEQ ID NO: 2586817 - DNA, 22 bp, Homo sapiens
aacaggtggcaggaccaggact

SEQ ID NO: 2586818 - DNA, 23 bp, Homo sapiens
aacaggtggcaggaccaggacta

SEQ ID NO: 2586819 - DNA, 16 bp, Homo sapiens
aacaggttattttagt

SEQ ID NO: 2586820 - DNA, 14 bp, Homo sapiens
aacagtaaatgtgc

SEQ ID NO: 2586821 - DNA, 12 bp, Homo sapiens
aacagtagcata

SEQ ID NO: 2586822 - DNA, 13 bp, Homo sapiens
aacagtcatttaa

SEQ ID NO: 2586823 - DNA, 17 bp, Homo sapiens
aacagtcttcaggcaaa

SEQ ID NO: 2586824 - DNA, 15 bp, Homo sapiens
aacagtgattaccag

SEQ ID NO: 2586825 - DNA, 15 bp, Homo sapiens
aacagtgcatattcc

SEQ ID NO: 2586826 - DNA, 16 bp, Homo sapiens
aacagtgctaaaaatg

SEQ ID NO: 2586827 - DNA, 23 bp, Homo sapiens
aacagtgtttcccataattttct

SEQ ID NO: 2586828 - DNA, 20 bp, Homo sapiens
aacagttaactttcagaaga

SEQ ID NO: 2586829 - DNA, 23 bp, Homo sapiens
aacagttcatgtttgcttcataa

SEQ ID NO: 2586830 - DNA, 14 bp, Homo sapiens
aacagttccttcag

SEQ ID NO: 2586831 - DNA, 13 bp, Homo sapiens
aacagtttgtaca

SEQ ID NO: 2586832 - DNA, 11 bp, Homo sapiens
aacagttttcc

SEQ ID NO: 2586833 - DNA, 16 bp, Homo sapiens
aacagttttccatgaa

SEQ ID NO: 2586834 - DNA, 18 bp, Homo sapiens
aacagttttccatgaaaa

SEQ ID NO: 2586835 - DNA, 14 bp, Homo sapiens
aacataaaatacaa

SEQ ID NO: 2586836 - DNA, 20 bp, Homo sapiens
aacataatcttctgccttct

SEQ ID NO: 2586837 - DNA, 15 bp, Homo sapiens
aacatataaagcact

SEQ ID NO: 2586838 - DNA, 22 bp, Homo sapiens
aacatataatgttgttatttaa

SEQ ID NO: 2586839 - DNA, 22 bp, Homo sapiens
aacatatttgttaaatatttac

SEQ ID NO: 2586840 - DNA, 12 bp, Homo sapiens
aacatcaatgtt

SEQ ID NO: 2586841 - DNA, 13 bp, Homo sapiens
aacatcaatgttc

SEQ ID NO: 2586842 - DNA, 18 bp, Homo sapiens
aacatcaatgttcattgt

SEQ ID NO: 2586843 - DNA, 13 bp, Homo sapiens
aacatcacacaca

SEQ ID NO: 2586844 - DNA, 17 bp, Homo sapiens
aacatcactgaaatgct

SEQ ID NO: 2586845 - DNA, 17 bp, Homo sapiens
aacatctagcaaatgtt

SEQ ID NO: 2586846 - DNA, 22 bp, Homo sapiens
aacatgcctgccccaaacaaat

SEQ ID NO: 2586847 - DNA, 16 bp, Homo sapiens
aacatggacttgtata

SEQ ID NO: 2586848 - DNA, 18 bp, Homo sapiens
aacatggacttgtatatt

SEQ ID NO: 2586849 - DNA, 23 bp, Homo sapiens
aacatggggttggctgggcccag

SEQ ID NO: 2586850 - DNA, 12 bp, Homo sapiens
aacatgtaatat

SEQ ID NO: 2586851 - DNA, 15 bp, Homo sapiens
aacatgtactgttct

SEQ ID NO: 2586852 - DNA, 15 bp, Homo sapiens
aacatgtaggaagta

SEQ ID NO: 2586853 - DNA, 17 bp, Homo sapiens
aacatgtataatatttt

SEQ ID NO: 2586854 - DNA, 17 bp, Homo sapiens
aacatgttactgaccag

SEQ ID NO: 2586855 - DNA, 13 bp, Homo sapiens
aacatgttcctga

SEQ ID NO: 2586856 - DNA, 22 bp, Homo sapiens
aacattacagggaatgcctgag

SEQ ID NO: 2586857 - DNA, 10 bp, Homo sapiens
aacattccat

SEQ ID NO: 2586858 - DNA, 19 bp, Homo sapiens
aacattgaagtaatgaatt

SEQ ID NO: 2586859 - DNA, 21 bp, Homo sapiens
aacattgcatataacttatat

SEQ ID NO: 2586860 - DNA, 18 bp, Homo sapiens
aacattgggaaatcttat

SEQ ID NO: 2586861 - DNA, 20 bp, Homo sapiens
aacattttaaataaaagaaa

SEQ ID NO: 2586862 - DNA, 17 bp, Homo sapiens
aacattttacccacaca

SEQ ID NO: 2586863 - DNA, 21 bp, Homo sapiens
aaccaaaagaacaagaatttc

SEQ ID NO: 2586864 - DNA, 23 bp, Homo sapiens
aaccaaagagactggagcatctg

SEQ ID NO: 2586865 - DNA, 23 bp, Homo sapiens
aaccaaagtaaccttttgcacct

SEQ ID NO: 2586866 - DNA, 16 bp, Homo sapiens
aaccaaatattccaga

SEQ ID NO: 2586867 - DNA, 15 bp, Homo sapiens
aaccaagtcaagtga

SEQ ID NO: 2586868 - DNA, 15 bp, Homo sapiens
aaccaatatttgtag

SEQ ID NO: 2586869 - DNA, 13 bp, Homo sapiens
aaccaatcctgga

SEQ ID NO: 2586870 - DNA, 12 bp, Homo sapiens
aaccacagccct

SEQ ID NO: 2586871 - DNA, 13 bp, Homo sapiens
aaccacagctgct

SEQ ID NO: 2586872 - DNA, 18 bp, Homo sapiens
aaccacagctgctggaga

SEQ ID NO: 2586873 - DNA, 20 bp, Homo sapiens
aaccacatcttgctctgctg

SEQ ID NO: 2586874 - DNA, 22 bp, Homo sapiens
aaccacatcttgctctgctgac

SEQ ID NO: 2586875 - DNA, 19 bp, Homo sapiens
aaccaccacacccagccca

SEQ ID NO: 2586876 - DNA, 16 bp, Homo sapiens
aaccaccgctccccag

SEQ ID NO: 2586877 - DNA, 23 bp, Homo sapiens
aactcagtcattagactcctcct

SEQ ID NO: 2586878 - DNA, 16 bp, Homo sapiens
aactcatactgtgctg

SEQ ID NO: 2586879 - DNA, 14 bp, Homo sapiens
aactcatcataaaa

SEQ ID NO: 2586880 - DNA, 16 bp, Homo sapiens
aactcatcataaaata

SEQ ID NO: 2586881 - DNA, 17 bp, Homo sapiens
aactcatcataaaataa

SEQ ID NO: 2586882 - DNA, 22 bp, Homo sapiens
aactcatccctaatgctgcaga

SEQ ID NO: 2586883 - DNA, 19 bp, Homo sapiens
aactcattcctgcctgtct

SEQ ID NO: 2586884 - DNA, 22 bp, Homo sapiens
aactcccagcaacacaagctgg

SEQ ID NO: 2586885 - DNA, 18 bp, Homo sapiens
aactcctgcccctgttct

SEQ ID NO: 2586886 - DNA, 12 bp, Homo sapiens
aactcctggcct

SEQ ID NO: 2586887 - DNA, 21 bp, Homo sapiens
aactcctttagcaggtggtcc

SEQ ID NO: 2586888 - DNA, 16 bp, Homo sapiens
aactctcctctgctgc

SEQ ID NO: 2586889 - DNA, 19 bp, Homo sapiens
aactctcctctgctgctgg

SEQ ID NO: 2586890 - DNA, 14 bp, Homo sapiens
aactctgccagcca

SEQ ID NO: 2586891 - DNA, 18 bp, Homo sapiens
aactctggcttccaggta

SEQ ID NO: 2586892 - DNA, 19 bp, Homo sapiens
acacacacgcacgcacaca

SEQ ID NO: 2586893 - DNA, 17 bp, Homo sapiens
acacacagaaaatatac

SEQ ID NO: 2586894 - DNA, 11 bp, Homo sapiens
acacacagcca

SEQ ID NO: 2586895 - DNA, 13 bp, Homo sapiens
acacacagccaca

SEQ ID NO: 2586896 - DNA, 17 bp, Homo sapiens
acacacagccacacaca

SEQ ID NO: 2586897 - DNA, 21 bp, Homo sapiens
acacacagccacacacacaga

SEQ ID NO: 2586898 - DNA, 12 bp, Homo sapiens
acacacagctcc

SEQ ID NO: 2586899 - DNA, 17 bp, Homo sapiens
acacacagctctgtcct

SEQ ID NO: 2586900 - DNA, 19 bp, Homo sapiens
acacacagctctgtcctgg

SEQ ID NO: 2586901 - DNA, 13 bp, Homo sapiens
acacacaggagga

SEQ ID NO: 2586902 - DNA, 17 bp, Homo sapiens
acacacaggcaactgag

SEQ ID NO: 2586903 - DNA, 15 bp, Homo sapiens
acacacatgcataca

SEQ ID NO: 2586904 - DNA, 19 bp, Homo sapiens
acacacatgcatacacaca

SEQ ID NO: 2586905 - DNA, 14 bp, Homo sapiens
acacaccagagccc

SEQ ID NO: 2586906 - DNA, 17 bp, Homo sapiens
acacacctaagggacat

SEQ ID NO: 2586907 - DNA, 23 bp, Homo sapiens
acacacgcacacacacacacagg

SEQ ID NO: 2586908 - DNA, 15 bp, Homo sapiens
acacacgcacgcaca

SEQ ID NO: 2586909 - DNA, 16 bp, Homo sapiens
acacacgcacgcacac

SEQ ID NO: 2586910 - DNA, 14 bp, Homo sapiens
acacacgcaggaac

SEQ ID NO: 2586911 - DNA, 21 bp, Homo sapiens
acacacgcaggaactcccagc

SEQ ID NO: 2586912 - DNA, 20 bp, Homo sapiens
acacactcaaatcaagaaac

SEQ ID NO: 2586913 - DNA, 18 bp, Homo sapiens
acacactgaggcagggaa

SEQ ID NO: 2586914 - DNA, 23 bp, Homo sapiens
acacacttttggttaagtctgtt

SEQ ID NO: 2586915 - DNA, 11 bp, Homo sapiens
acacagaaaat

SEQ ID NO: 2586916 - DNA, 15 bp, Homo sapiens
acacagaaaatatac

SEQ ID NO: 2586917 - DNA, 23 bp, Homo sapiens
acacagaaaatatactgtaaaga

SEQ ID NO: 2586918 - DNA, 23 bp, Homo sapiens
acacagactgcgatttgtcccag

SEQ ID NO: 2586919 - DNA, 21 bp, Homo sapiens
acacagaggaagagcaggcac

SEQ ID NO: 2586920 - DNA, 19 bp, Homo sapiens
acacagaggctgcctctcc

SEQ ID NO: 2586921 - DNA, 14 bp, Homo sapiens
acacagatgaaaca

SEQ ID NO: 2586922 - DNA, 22 bp, Homo sapiens
acacagcagcttcaccagagca

SEQ ID NO: 2586923 - DNA, 14 bp, Homo sapiens
acacagcatgtgta

SEQ ID NO: 2586924 - DNA, 15 bp, Homo sapiens
acacagcatgtgtat

SEQ ID NO: 2586925 - DNA, 12 bp, Homo sapiens
acacagccacac

SEQ ID NO: 2586926 - DNA, 14 bp, Homo sapiens
acacagccacacac

SEQ ID NO: 2586927 - DNA, 18 bp, Homo sapiens
acacagccacacacacag

SEQ ID NO: 2586928 - DNA, 23 bp, Homo sapiens
acacagccacacacacagaaaat

SEQ ID NO: 2586929 - DNA, 20 bp, Homo sapiens
acacagccaggtgccttgga

SEQ ID NO: 2586930 - DNA, 20 bp, Homo sapiens
acacagctaacacacagctc

SEQ ID NO: 2586931 - DNA, 23 bp, Homo sapiens
acacagctaacacacagctccca

SEQ ID NO: 2586932 - DNA, 20 bp, Homo sapiens
acacagctctgtcctgggag

SEQ ID NO: 2586933 - DNA, 19 bp, Homo sapiens
acacagctcttctccaggc

SEQ ID NO: 2586934 - DNA, 20 bp, Homo sapiens
acacagctcttctccaggct

SEQ ID NO: 2586935 - DNA, 19 bp, Homo sapiens
acacaggcaactgaggcag

SEQ ID NO: 2586936 - DNA, 18 bp, Homo sapiens
acacaggcccggctccag

SEQ ID NO: 2586937 - DNA, 19 bp, Homo sapiens
acacaggcccggctccagg

SEQ ID NO: 2586938 - DNA, 21 bp, Homo sapiens
acacaggcccggctccaggct

SEQ ID NO: 2586939 - DNA, 15 bp, Homo sapiens
acacagtctgcaaga

SEQ ID NO: 2586940 - DNA, 16 bp, Homo sapiens
acacagtctgcaagat

SEQ ID NO: 2586941 - DNA, 19 bp, Homo sapiens
acacagtcttggctcactg

SEQ ID NO: 2586942 - DNA, 16 bp, Homo sapiens
acacagtgccttcaat

SEQ ID NO: 2586943 - DNA, 19 bp, Homo sapiens
acacagtgccttcaataaa

SEQ ID NO: 2586944 - DNA, 15 bp, Homo sapiens
acacagttgctgtca

SEQ ID NO: 2586945 - DNA, 14 bp, Homo sapiens
acacatataaacat

SEQ ID NO: 2586946 - DNA, 22 bp, Homo sapiens
acacatataaacatcacacaca

SEQ ID NO: 2586947 - DNA, 17 bp, Homo sapiens
acacatccctaatgtgt

SEQ ID NO: 2586948 - DNA, 12 bp, Homo sapiens
acacatctcctc

SEQ ID NO: 2586949 - DNA, 14 bp, Homo sapiens
acacatctcctcca

SEQ ID NO: 2586950 - DNA, 14 bp, Homo sapiens
acacatcttcccta

SEQ ID NO: 2586951 - DNA, 19 bp, Homo sapiens
acacatgcaaggtcatttt

SEQ ID NO: 2586952 - DNA, 21 bp, Homo sapiens
acacatgcaaggtcatttttt

SEQ ID NO: 2586953 - DNA, 15 bp, Homo sapiens
acacatgcatacaca

SEQ ID NO: 2586954 - DNA, 21 bp, Homo sapiens
acacatgtccaagaagcccag

SEQ ID NO: 2586955 - DNA, 18 bp, Homo sapiens
acacattcggctccctgg

SEQ ID NO: 2586956 - DNA, 13 bp, Homo sapiens
acacattttattt

SEQ ID NO: 2586957 - DNA, 19 bp, Homo sapiens
acacattttattttattat

SEQ ID NO: 2586958 - DNA, 20 bp, Homo sapiens
acacattttattttattatg

SEQ ID NO: 2586959 - DNA, 21 bp, Homo sapiens
acacattttattttattatgc

SEQ ID NO: 2586960 - DNA, 22 bp, Homo sapiens
acacattttattttattatgca

SEQ ID NO: 2586961 - DNA, 14 bp, Homo sapiens
acacattttgtata

SEQ ID NO: 2586962 - DNA, 15 bp, Homo sapiens
acacattttgtataa

SEQ ID NO: 2586963 - DNA, 14 bp, Homo sapiens
acacatttttcaga

SEQ ID NO: 2586964 - DNA, 12 bp, Homo sapiens
acacatttttct

SEQ ID NO: 2586965 - DNA, 19 bp, Homo sapiens
acacattttttaaatgcac

SEQ ID NO: 2586966 - DNA, 13 bp, Homo sapiens
acaccaagcagca

SEQ ID NO: 2586967 - DNA, 15 bp, Homo sapiens
acaccacagacacac

SEQ ID NO: 2586968 - DNA, 22 bp, Homo sapiens
acaccacagacacacacacgca

SEQ ID NO: 2586969 - DNA, 15 bp, Homo sapiens
acaccactacattct

SEQ ID NO: 2586970 - DNA, 13 bp, Homo sapiens
acaccagagcaga

SEQ ID NO: 2586971 - DNA, 18 bp, Homo sapiens
acaccagagcagatgcag

SEQ ID NO: 2586972 - DNA, 23 bp, Homo sapiens
acaccagagcccaccttggctca

SEQ ID NO: 2586973 - DNA, 22 bp, Homo sapiens
acaccagccaggctctgtgctg

SEQ ID NO: 2586974 - DNA, 20 bp, Homo sapiens
acaccagcctttctcccagg

SEQ ID NO: 2586975 - DNA, 15 bp, Homo sapiens
acaccagctgttctg

SEQ ID NO: 2586976 - DNA, 23 bp, Homo sapiens
acaccagctgttctgtcccttgg

SEQ ID NO: 2586977 - DNA, 17 bp, Homo sapiens
acacccaccgtccgccc

SEQ ID NO: 2586978 - DNA, 23 bp, Homo sapiens
acacccaccgtccgccctgctcc

SEQ ID NO: 2586979 - DNA, 21 bp, Homo sapiens
acaccccagacgatgtcttca

SEQ ID NO: 2586980 - DNA, 17 bp, Homo sapiens
acaccccttatccagga

SEQ ID NO: 2586981 - DNA, 20 bp, Homo sapiens
acaccccttatccaggactc

SEQ ID NO: 2586982 - DNA, 14 bp, Homo sapiens
acaccctcccccgc

SEQ ID NO: 2586983 - DNA, 12 bp, Homo sapiens
acaccctgtgat

SEQ ID NO: 2586984 - DNA, 19 bp, Homo sapiens
acaccctgtgatggggccc

SEQ ID NO: 2586985 - DNA, 16 bp, Homo sapiens
acaccgggcactcaga

SEQ ID NO: 2586986 - DNA, 19 bp, Homo sapiens
acaccgtgtaaaccaaagc

SEQ ID NO: 2586987 - DNA, 14 bp, Homo sapiens
acacctaagggaca

SEQ ID NO: 2586988 - DNA, 21 bp, Homo sapiens
acacctcagttcccttggcct

SEQ ID NO: 2586989 - DNA, 23 bp, Homo sapiens
acacctcagttcccttggcctca

SEQ ID NO: 2586990 - DNA, 12 bp, Homo sapiens
acacctcccagg

SEQ ID NO: 2586991 - DNA, 19 bp, Homo sapiens
acacctcccaggagacagt

SEQ ID NO: 2586992 - DNA, 13 bp, Homo sapiens
acacctccctgaa

SEQ ID NO: 2586993 - DNA, 18 bp, Homo sapiens
acacctctgcacaagctg

SEQ ID NO: 2586994 - DNA, 13 bp, Homo sapiens
acacctctgccag

SEQ ID NO: 2586995 - DNA, 12 bp, Homo sapiens
acacctgatgtg

SEQ ID NO: 2586996 - DNA, 14 bp, Homo sapiens
acacctgccctgcc

SEQ ID NO: 2586997 - DNA, 13 bp, Homo sapiens
acaccttctctgg

SEQ ID NO: 2586998 - DNA, 14 bp, Homo sapiens
acaccttgacaggg

SEQ ID NO: 2586999 - DNA, 17 bp, Homo sapiens
acaccttttaactcacc

SEQ ID NO: 2587000 - DNA, 18 bp, Homo sapiens
acacgaactttagctgca

SEQ ID NO: 2587001 - DNA, 21 bp, Homo sapiens
acacgagcaggctactgtcag

SEQ ID NO: 2587002 - DNA, 14 bp, Homo sapiens
acacgcacgcacac

SEQ ID NO: 2587003 - DNA, 16 bp, Homo sapiens
acacgcacgcacacac

SEQ ID NO: 2587004 - DNA, 17 bp, Homo sapiens
acacgcgtgcacacacc

SEQ ID NO: 2587005 - DNA, 23 bp, Homo sapiens
acacgtacttaaatgaaagcatg

SEQ ID NO: 2587006 - DNA, 21 bp, Homo sapiens
acacgtgagaatccctggcaa

SEQ ID NO: 2587007 - DNA, 22 bp, Homo sapiens
acacgtggaggaatgctccccc

SEQ ID NO: 2587008 - DNA, 24 bp, Homo sapiens
acacgtggaggaatgctcccccat

SEQ ID NO: 2587009 - DNA, 19 bp, Homo sapiens
acactaagttatagtatat

SEQ ID NO: 2587010 - DNA, 22 bp, Homo sapiens
acactagctaatatcaatagaa

SEQ ID NO: 2587011 - DNA, 23 bp, Homo sapiens
acactagttttgtgccagccgtg

SEQ ID NO: 2587012 - DNA, 13 bp, Homo sapiens
acactatatctgt

SEQ ID NO: 2587013 - DNA, 18 bp, Homo sapiens
acactatatctgtatata

SEQ ID NO: 2587014 - DNA, 19 bp, Homo sapiens
acactatggtatttgagtg

SEQ ID NO: 2587015 - DNA, 22 bp, Homo sapiens
acactatggtatttgagtgttt

SEQ ID NO: 2587016 - DNA, 15 bp, Homo sapiens
acactcaaaagctgg

SEQ ID NO: 2587017 - DNA, 16 bp, Homo sapiens
acactcactcctgaga

SEQ ID NO: 2587018 - DNA, 21 bp, Homo sapiens
acactcactcctgagacccct

SEQ ID NO: 2587019 - DNA, 12 bp, Homo sapiens
acactcatgctg

SEQ ID NO: 2587020 - DNA, 19 bp, Homo sapiens
acactcattgacctgaggc

SEQ ID NO: 2587021 - DNA, 16 bp, Homo sapiens
acactccaagatatgg

SEQ ID NO: 2587022 - DNA, 17 bp, Homo sapiens
acactccaattaaggat

SEQ ID NO: 2587023 - DNA, 21 bp, Homo sapiens
acactccagtgccagcaatga

SEQ ID NO: 2587024 - DNA, 16 bp, Homo sapiens
acactccatcagctta

SEQ ID NO: 2587025 - DNA, 20 bp, Homo sapiens
acactcctagagaacgcagc

SEQ ID NO: 2587026 - DNA, 16 bp, Homo sapiens
aaggaccacattttat

SEQ ID NO: 2587027 - DNA, 19 bp, Homo sapiens
aaggaccacattttatatt

SEQ ID NO: 2587028 - DNA, 13 bp, Homo sapiens
aaggactccaccc

SEQ ID NO: 2587029 - DNA, 17 bp, Homo sapiens
aaggactgagggactct

SEQ ID NO: 2587030 - DNA, 23 bp, Homo sapiens
aaggactgcgggacttgggtctc

SEQ ID NO: 2587031 - DNA, 22 bp, Homo sapiens
aaggacttgaaagcatccatgt

SEQ ID NO: 2587032 - DNA, 12 bp, Homo sapiens
aaggagacacaa

SEQ ID NO: 2587033 - DNA, 13 bp, Homo sapiens
aaggagagcctgc

SEQ ID NO: 2587034 - DNA, 14 bp, Homo sapiens
aaggagagcctgct

SEQ ID NO: 2587035 - DNA, 11 bp, Homo sapiens
aaggagagcta

SEQ ID NO: 2587036 - DNA, 14 bp, Homo sapiens
aaggagatttacaa

SEQ ID NO: 2587037 - DNA, 17 bp, Homo sapiens
aaggagatttacaactg

SEQ ID NO: 2587038 - DNA, 14 bp, Homo sapiens
aaggaggctggcag

SEQ ID NO: 2587039 - DNA, 15 bp, Homo sapiens
aaggagggagatgga

SEQ ID NO: 2587040 - DNA, 17 bp, Homo sapiens
aaggagggtcaggaagg

SEQ ID NO: 2587041 - DNA, 18 bp, Homo sapiens
aaggagggttagggaggg

SEQ ID NO: 2587042 - DNA, 19 bp, Homo sapiens
aaggaggtgagggatgtga

SEQ ID NO: 2587043 - DNA, 13 bp, Homo sapiens
aaggagtagaaaa

SEQ ID NO: 2587044 - DNA, 13 bp, Homo sapiens
aaggagttaagag

SEQ ID NO: 2587045 - DNA, 20 bp, Homo sapiens
aaggagttccatgaagacca

SEQ ID NO: 2587046 - DNA, 18 bp, Homo sapiens
aaggatgatctaggaaga

SEQ ID NO: 2587047 - DNA, 22 bp, Homo sapiens
aaggatgcacagagttgttaca

SEQ ID NO: 2587048 - DNA, 15 bp, Homo sapiens
aaggatgcttgtaca

SEQ ID NO: 2587049 - DNA, 20 bp, Homo sapiens
aaggcaaagcacgaaatgtt

SEQ ID NO: 2587050 - DNA, 17 bp, Homo sapiens
aaggcaaatgcccaagg

SEQ ID NO: 2587051 - DNA, 16 bp, Homo sapiens
aaggcagaaagcaaaa

SEQ ID NO: 2587052 - DNA, 13 bp, Homo sapiens
aaggcaggaagag

SEQ ID NO: 2587053 - DNA, 18 bp, Homo sapiens
aaggcagggaaaggctct

SEQ ID NO: 2587054 - DNA, 20 bp, Homo sapiens
aaggcagggagcgagggaga

SEQ ID NO: 2587055 - DNA, 17 bp, Homo sapiens
aaggcaggtgcctccag

SEQ ID NO: 2587056 - DNA, 22 bp, Homo sapiens
aaggcaggtgcctccaggtgtg

SEQ ID NO: 2587057 - DNA, 20 bp, Homo sapiens
aaggcatcagtccctatgta

SEQ ID NO: 2587058 - DNA, 21 bp, Homo sapiens
aaggcatgatgttaaccagaa

SEQ ID NO: 2587059 - DNA, 14 bp, Homo sapiens
aaggcattctctga

SEQ ID NO: 2587060 - DNA, 15 bp, Homo sapiens
aaggcattgtttgag

SEQ ID NO: 2587061 - DNA, 16 bp, Homo sapiens
aaggccaaacctctgt

SEQ ID NO: 2587062 - DNA, 19 bp, Homo sapiens
aaggccaagaggctgttcc

SEQ ID NO: 2587063 - DNA, 21 bp, Homo sapiens
aaggccagagtggcctggcca

SEQ ID NO: 2587064 - DNA, 21 bp, Homo sapiens
aaggcccacgagcttgttctt

SEQ ID NO: 2587065 - DNA, 14 bp, Homo sapiens
aaggccccgcccag

SEQ ID NO: 2587066 - DNA, 16 bp, Homo sapiens
aaggccgaagctctgg

SEQ ID NO: 2587067 - DNA, 17 bp, Homo sapiens
aaggccgagaagcaaga

SEQ ID NO: 2587068 - DNA, 19 bp, Homo sapiens
aaggcctccctagccagca

SEQ ID NO: 2587069 - DNA, 14 bp, Homo sapiens
aaggcctttctgtg

SEQ ID NO: 2587070 - DNA, 14 bp, Homo sapiens
aaggcgtggagctg

SEQ ID NO: 2587071 - DNA, 15 bp, Homo sapiens
aaggctacctttgta

SEQ ID NO: 2587072 - DNA, 15 bp, Homo sapiens
aaggctatacttgtc

SEQ ID NO: 2587073 - DNA, 17 bp, Homo sapiens
aaggctcagtctcagga

SEQ ID NO: 2587074 - DNA, 19 bp, Homo sapiens
aaggctccaggagcagcca

SEQ ID NO: 2587075 - DNA, 22 bp, Homo sapiens
aaggctccaggagcagccacat

SEQ ID NO: 2587076 - DNA, 16 bp, Homo sapiens
aaggctcgagcatgcc

SEQ ID NO: 2587077 - DNA, 17 bp, Homo sapiens
aaggctctgaaagccag

SEQ ID NO: 2587078 - DNA, 16 bp, Homo sapiens
aaggctcttctgacta

SEQ ID NO: 2587079 - DNA, 20 bp, Homo sapiens
aaggctgaggaaaggccagc

SEQ ID NO: 2587080 - DNA, 16 bp, Homo sapiens
aaggctgggggaagaa

SEQ ID NO: 2587081 - DNA, 22 bp, Homo sapiens
aaggctgtgctccctggttctg

SEQ ID NO: 2587082 - DNA, 17 bp, Homo sapiens
aagggaaactgccagca

SEQ ID NO: 2587083 - DNA, 17 bp, Homo sapiens
aagggaagttgtgcctt

SEQ ID NO: 2587084 - DNA, 19 bp, Homo sapiens
aagggacatgttttgataa

SEQ ID NO: 2587085 - DNA, 17 bp, Homo sapiens
aagggagagacctcatc

SEQ ID NO: 2587086 - DNA, 17 bp, Homo sapiens
aagggatggcaagatgt

SEQ ID NO: 2587087 - DNA, 19 bp, Homo sapiens
aagggattacccaagcaaa

SEQ ID NO: 2587088 - DNA, 20 bp, Homo sapiens
aagggcaacaataaaatagc

SEQ ID NO: 2587089 - DNA, 22 bp, Homo sapiens
aagggcaggaaggagagcctgc

SEQ ID NO: 2587090 - DNA, 22 bp, Homo sapiens
aagggcagggcatctcctgtgc

SEQ ID NO: 2587091 - DNA, 9 bp, Homo sapiens
aagggccag

SEQ ID NO: 2587092 - DNA, 14 bp, Homo sapiens
aagggccagtctgg

SEQ ID NO: 2587093 - DNA, 17 bp, Homo sapiens
aagggccatgctgaagg

SEQ ID NO: 2587094 - DNA, 13 bp, Homo sapiens
aagggcctggcct

SEQ ID NO: 2587095 - DNA, 19 bp, Homo sapiens
aagggctagaacctggaga

SEQ ID NO: 2587096 - DNA, 19 bp, Homo sapiens
aagggcttctgcaccctcc

SEQ ID NO: 2587097 - DNA, 23 bp, Homo sapiens
aagggcttctgcaccctccaccc

SEQ ID NO: 2587098 - DNA, 18 bp, Homo sapiens
aagggctttgttttgcac

SEQ ID NO: 2587099 - DNA, 20 bp, Homo sapiens
aaggggacccccgccccctg

SEQ ID NO: 2587100 - DNA, 23 bp, Homo sapiens
aaggggcctcaccgagtgggggc

SEQ ID NO: 2587101 - DNA, 16 bp, Homo sapiens
aaggggctgaaagaac

SEQ ID NO: 2587102 - DNA, 21 bp, Homo sapiens
aagggggatatgaatggagat

SEQ ID NO: 2587103 - DNA, 16 bp, Homo sapiens
aagggggtccacccag

SEQ ID NO: 2587104 - DNA, 12 bp, Homo sapiens
aagggggtccca

SEQ ID NO: 2587105 - DNA, 16 bp, Homo sapiens
aagggtatcaggtgct

SEQ ID NO: 2587106 - DNA, 19 bp, Homo sapiens
aagggtcttgggaaatatg

SEQ ID NO: 2587107 - DNA, 16 bp, Homo sapiens
aagggtgctgcttccc

SEQ ID NO: 2587108 - DNA, 23 bp, Homo sapiens
aagggtgctgcttccctctgcct

SEQ ID NO: 2587109 - DNA, 14 bp, Homo sapiens
aagggttatatttt

SEQ ID NO: 2587110 - DNA, 20 bp, Homo sapiens
aagggtttgtggctgggggc

SEQ ID NO: 2587111 - DNA, 21 bp, Homo sapiens
aagggttttccaccctggaat

SEQ ID NO: 2587112 - DNA, 12 bp, Homo sapiens
aaggtagttttt

SEQ ID NO: 2587113 - DNA, 22 bp, Homo sapiens
aaggtagtttttacctaccaca

SEQ ID NO: 2587114 - DNA, 20 bp, Homo sapiens
aaggtatcagttgcaataat

SEQ ID NO: 2587115 - DNA, 19 bp, Homo sapiens
aaggtcaccagcaccaaca

SEQ ID NO: 2587116 - DNA, 12 bp, Homo sapiens
aaggtcattttt

SEQ ID NO: 2587117 - DNA, 23 bp, Homo sapiens
aaggtctggagaagctcccagga

SEQ ID NO: 2587118 - DNA, 20 bp, Homo sapiens
aatttttttccttacctttt

SEQ ID NO: 2587119 - DNA, 17 bp, Homo sapiens
aatttttttgagacaga

SEQ ID NO: 2587120 - DNA, 14 bp, Homo sapiens
aattttttttcatg

SEQ ID NO: 2587121 - DNA, 15 bp, Homo sapiens
aattttttttcatgt

SEQ ID NO: 2587122 - DNA, 22 bp, Homo sapiens
acaaaaaaaaagttttattttt

SEQ ID NO: 2587123 - DNA, 16 bp, Homo sapiens
acaaaaacacagcaag

SEQ ID NO: 2587124 - DNA, 16 bp, Homo sapiens
acaaaaagcataaaaa

SEQ ID NO: 2587125 - DNA, 23 bp, Homo sapiens
acaaaacactcggcatttcaaat

SEQ ID NO: 2587126 - DNA, 11 bp, Homo sapiens
acaaaagcatg

SEQ ID NO: 2587127 - DNA, 21 bp, Homo sapiens
acaaaagggtttaaactgatt

SEQ ID NO: 2587128 - DNA, 14 bp, Homo sapiens
acaaaataaacaaa

SEQ ID NO: 2587129 - DNA, 20 bp, Homo sapiens
acaaaatccagctatgaata

SEQ ID NO: 2587130 - DNA, 21 bp, Homo sapiens
acaaaatgacattttgccaaa

SEQ ID NO: 2587131 - DNA, 20 bp, Homo sapiens
acaaacaatggaaactgaat

SEQ ID NO: 2587132 - DNA, 13 bp, Homo sapiens
acaaacagctcag

SEQ ID NO: 2587133 - DNA, 14 bp, Homo sapiens
acaaaccatgcaaa

SEQ ID NO: 2587134 - DNA, 18 bp, Homo sapiens
acaaacctgcctgggttt

SEQ ID NO: 2587135 - DNA, 13 bp, Homo sapiens
acaaagaagacat

SEQ ID NO: 2587136 - DNA, 16 bp, Homo sapiens
acaaagaagacatgtt

SEQ ID NO: 2587137 - DNA, 22 bp, Homo sapiens
acaaagacaaattctgtttctt

SEQ ID NO: 2587138 - DNA, 22 bp, Homo sapiens
acaaagatgtttgtcagatatg

SEQ ID NO: 2587139 - DNA, 24 bp, Homo sapiens
acaaagatgtttgtcagatatgat

SEQ ID NO: 2587140 - DNA, 15 bp, Homo sapiens
acaaagcacagtgtt

SEQ ID NO: 2587141 - DNA, 18 bp, Homo sapiens
acaaagcacagtttgaac

SEQ ID NO: 2587142 - DNA, 17 bp, Homo sapiens
acaaagccaacagtcaa

SEQ ID NO: 2587143 - DNA, 20 bp, Homo sapiens
acaaagccagaagctgagca

SEQ ID NO: 2587144 - DNA, 23 bp, Homo sapiens
acaaagccttatcaagtgtcttc

SEQ ID NO: 2587145 - DNA, 21 bp, Homo sapiens
acaaagcttagcaggagagga

SEQ ID NO: 2587146 - DNA, 21 bp, Homo sapiens
acaaagcttctatcccaggag

SEQ ID NO: 2587147 - DNA, 11 bp, Homo sapiens
acaaaggcaag

SEQ ID NO: 2587148 - DNA, 18 bp, Homo sapiens
acaaagggttttaatgta

SEQ ID NO: 2587149 - DNA, 14 bp, Homo sapiens
acaaagtaattcct

SEQ ID NO: 2587150 - DNA, 16 bp, Homo sapiens
acaaataataagcaaa

SEQ ID NO: 2587151 - DNA, 13 bp, Homo sapiens
acaaatactcatg

SEQ ID NO: 2587152 - DNA, 11 bp, Homo sapiens
acaaatatgca

SEQ ID NO: 2587153 - DNA, 12 bp, Homo sapiens
acaaatatgcaa

SEQ ID NO: 2587154 - DNA, 22 bp, Homo sapiens
acaaatatttattttctttctg

SEQ ID NO: 2587155 - DNA, 23 bp, Homo sapiens
acaaatatttattttctttctgt

SEQ ID NO: 2587156 - DNA, 16 bp, Homo sapiens
acaaatgccacacatc

SEQ ID NO: 2587157 - DNA, 17 bp, Homo sapiens
acaaattattaatgaaa

SEQ ID NO: 2587158 - DNA, 18 bp, Homo sapiens
acaaattgcttgaaagaa

SEQ ID NO: 2587159 - DNA, 17 bp, Homo sapiens
acaaatttacagagaca

SEQ ID NO: 2587160 - DNA, 15 bp, Homo sapiens
acaacaacctggtca

SEQ ID NO: 2587161 - DNA, 23 bp, Homo sapiens
acaacactcattgacctgaggcc

SEQ ID NO: 2587162 - DNA, 15 bp, Homo sapiens
acaacagatttgtga

SEQ ID NO: 2587163 - DNA, 16 bp, Homo sapiens
acaacagatttgtgaa

SEQ ID NO: 2587164 - DNA, 17 bp, Homo sapiens
acaacagatttgtgaac

SEQ ID NO: 2587165 - DNA, 22 bp, Homo sapiens
acaacatgtataatatttttaa

SEQ ID NO: 2587166 - DNA, 14 bp, Homo sapiens
acaaccctgcaaag

SEQ ID NO: 2587167 - DNA, 18 bp, Homo sapiens
acaaccctgttttatact

SEQ ID NO: 2587168 - DNA, 13 bp, Homo sapiens
acaaccgttggaa

SEQ ID NO: 2587169 - DNA, 16 bp, Homo sapiens
acaacctcaactgcct

SEQ ID NO: 2587170 - DNA, 22 bp, Homo sapiens
acaacctgcttgggtggagaag

SEQ ID NO: 2587171 - DNA, 19 bp, Homo sapiens
acaactaggcttcagcata

SEQ ID NO: 2587172 - DNA, 20 bp, Homo sapiens
acaactcctagggccactga

SEQ ID NO: 2587173 - DNA, 14 bp, Homo sapiens
acaactgagtcctt

SEQ ID NO: 2587174 - DNA, 19 bp, Homo sapiens
acaactgagtccttaaaca

SEQ ID NO: 2587175 - DNA, 13 bp, Homo sapiens
acaagaaatgaaa

SEQ ID NO: 2587176 - DNA, 15 bp, Homo sapiens
acaagaaatgaaagc

SEQ ID NO: 2587177 - DNA, 14 bp, Homo sapiens
acaagaagaagggc

SEQ ID NO: 2587178 - DNA, 20 bp, Homo sapiens
acaagaagccacagacctag

SEQ ID NO: 2587179 - DNA, 19 bp, Homo sapiens
acaagaccccgtctcaaaa

SEQ ID NO: 2587180 - DNA, 19 bp, Homo sapiens
acaagacccttgtggtccc

SEQ ID NO: 2587181 - DNA, 13 bp, Homo sapiens
acaagagcccagc

SEQ ID NO: 2587182 - DNA, 16 bp, Homo sapiens
acaagatctttcagga

SEQ ID NO: 2587183 - DNA, 14 bp, Homo sapiens
acaagccaacttgt

SEQ ID NO: 2587184 - DNA, 15 bp, Homo sapiens
acaagctccaagctc

SEQ ID NO: 2587185 - DNA, 17 bp, Homo sapiens
acaagctccaagctccc

SEQ ID NO: 2587186 - DNA, 13 bp, Homo sapiens
acaagctgcaccc

SEQ ID NO: 2587187 - DNA, 19 bp, Homo sapiens
acaagctgcaccctcaggc

SEQ ID NO: 2587188 - DNA, 23 bp, Homo sapiens
acaagctgcaccctcaggcaggt

SEQ ID NO: 2587189 - DNA, 20 bp, Homo sapiens
acaagcttttttacacaaat

SEQ ID NO: 2587190 - DNA, 21 bp, Homo sapiens
acaaggaagtcaaagcaagga

SEQ ID NO: 2587191 - DNA, 16 bp, Homo sapiens
acaaggattgctactg

SEQ ID NO: 2587192 - DNA, 17 bp, Homo sapiens
acaaggcattcaagtgt

SEQ ID NO: 2587193 - DNA, 13 bp, Homo sapiens
acaaggccccaga

SEQ ID NO: 2587194 - DNA, 15 bp, Homo sapiens
acaaggccccagaga

SEQ ID NO: 2587195 - DNA, 18 bp, Homo sapiens
acaaggccccagagactc

SEQ ID NO: 2587196 - DNA, 18 bp, Homo sapiens
acaagggagagacctcat

SEQ ID NO: 2587197 - DNA, 17 bp, Homo sapiens
acaaggtccaagatacc

SEQ ID NO: 2587198 - DNA, 22 bp, Homo sapiens
acaaggttcttcccttttacat

SEQ ID NO: 2587199 - DNA, 23 bp, Homo sapiens
acaagtcattttaactttatcac

SEQ ID NO: 2587200 - DNA, 16 bp, Homo sapiens
acaagtccctgtaatt

SEQ ID NO: 2587201 - DNA, 12 bp, Homo sapiens
acaagtgccact

SEQ ID NO: 2587202 - DNA, 13 bp, Homo sapiens
acaagtgctggca

SEQ ID NO: 2587203 - DNA, 15 bp, Homo sapiens
acaagttgtgtttga

SEQ ID NO: 2587204 - DNA, 20 bp, Homo sapiens
acaataaaaatggctcagat

SEQ ID NO: 2587205 - DNA, 16 bp, Homo sapiens
acaataaaaatgttta

SEQ ID NO: 2587206 - DNA, 16 bp, Homo sapiens
acaatacatgctgcta

SEQ ID NO: 2587207 - DNA, 19 bp, Homo sapiens
acaatagctttaccctcag

SEQ ID NO: 2587208 - DNA, 21 bp, Homo sapiens
acaatatgaatacagggcatg

SEQ ID NO: 2587209 - DNA, 14 bp, Homo sapiens
acaatatgcaatgt

SEQ ID NO: 2587210 - DNA, 19 bp, Homo sapiens
acaatcagtcccctcccat

SEQ ID NO: 2587211 - DNA, 13 bp, Homo sapiens
acaatcattgctg

SEQ ID NO: 2587212 - DNA, 14 bp, Homo sapiens
acaatcattgctga

SEQ ID NO: 2587213 - DNA, 16 bp, Homo sapiens
acaatcgatggccttg

SEQ ID NO: 2587214 - DNA, 21 bp, Homo sapiens
acaatgctgtgccctaaagtg

SEQ ID NO: 2587215 - DNA, 19 bp, Homo sapiens
acaatggaaactgaatgct

SEQ ID NO: 2587216 - DNA, 14 bp, Homo sapiens
acaatgtatttatt

SEQ ID NO: 2587217 - DNA, 17 bp, Homo sapiens
acaatgtatttatttaa

SEQ ID NO: 2587218 - DNA, 11 bp, Homo sapiens
acaatgttaag

SEQ ID NO: 2587219 - DNA, 14 bp, Homo sapiens
acaatgttaaggaa

SEQ ID NO: 2587220 - DNA, 18 bp, Homo sapiens
acaattatatcagtcctc

SEQ ID NO: 2587221 - DNA, 15 bp, Homo sapiens
acaattccctgctgt

SEQ ID NO: 2587222 - DNA, 16 bp, Homo sapiens
acaattctttatacaa

SEQ ID NO: 2587223 - DNA, 17 bp, Homo sapiens
acaattgaacttaaata

SEQ ID NO: 2587224 - DNA, 12 bp, Homo sapiens
acaattgtaata

SEQ ID NO: 2587225 - DNA, 18 bp, Homo sapiens
acaatttatgaattgaat

SEQ ID NO: 2587226 - DNA, 14 bp, Homo sapiens
acaatttattatgg

SEQ ID NO: 2587227 - DNA, 16 bp, Homo sapiens
acaatttattatggca

SEQ ID NO: 2587228 - DNA, 17 bp, Homo sapiens
acaatttcctttatatt

SEQ ID NO: 2587229 - DNA, 21 bp, Homo sapiens
acaatttgagatgtatttcaa

SEQ ID NO: 2587230 - DNA, 12 bp, Homo sapiens
acaattttgtac

SEQ ID NO: 2587231 - DNA, 16 bp, Homo sapiens
acaattttttatcatg

SEQ ID NO: 2587232 - DNA, 22 bp, Homo sapiens
acaattttttatcatgcatgtc

SEQ ID NO: 2587233 - DNA, 17 bp, Homo sapiens
acaatttttttaatttt

SEQ ID NO: 2587234 - DNA, 21 bp, Homo sapiens
acaatttttttaattttgtat

SEQ ID NO: 2587235 - DNA, 15 bp, Homo sapiens
acacaaacctgcctg

SEQ ID NO: 2587236 - DNA, 13 bp, Homo sapiens
acacaacacacac

SEQ ID NO: 2587237 - DNA, 15 bp, Homo sapiens
acacaagccacagaa

SEQ ID NO: 2587238 - DNA, 19 bp, Homo sapiens
acacaagccacagaagcca

SEQ ID NO: 2587239 - DNA, 16 bp, Homo sapiens
acacaagtcctgtgaa

SEQ ID NO: 2587240 - DNA, 12 bp, Homo sapiens
acacaatacaat

SEQ ID NO: 2587241 - DNA, 14 bp, Homo sapiens
acacaatatgaata

SEQ ID NO: 2587242 - DNA, 18 bp, Homo sapiens
acatcagcacgatttctg

SEQ ID NO: 2587243 - DNA, 19 bp, Homo sapiens
acatcagcacgatttctgt

SEQ ID NO: 2587244 - DNA, 22 bp, Homo sapiens
acatcagtggcatggctccagt

SEQ ID NO: 2587245 - DNA, 23 bp, Homo sapiens
acatcagtggcatggctccagtc

SEQ ID NO: 2587246 - DNA, 20 bp, Homo sapiens
acatcagttactctgaaggg

SEQ ID NO: 2587247 - DNA, 20 bp, Homo sapiens
acatcatcaaggcactgcct

SEQ ID NO: 2587248 - DNA, 17 bp, Homo sapiens
acatccataaagaagca

SEQ ID NO: 2587249 - DNA, 19 bp, Homo sapiens
acatccataaagaagcaat

SEQ ID NO: 2587250 - DNA, 18 bp, Homo sapiens
acatccatgtttgtaaaa

SEQ ID NO: 2587251 - DNA, 18 bp, Homo sapiens
acatcccatgtaacagaa

SEQ ID NO: 2587252 - DNA, 20 bp, Homo sapiens
acatcccatgtaacagaaag

SEQ ID NO: 2587253 - DNA, 17 bp, Homo sapiens
acatcctccgtccagcc

SEQ ID NO: 2587254 - DNA, 13 bp, Homo sapiens
acatcctcttctg

SEQ ID NO: 2587255 - DNA, 16 bp, Homo sapiens
acatcctgtgtttcta

SEQ ID NO: 2587256 - DNA, 23 bp, Homo sapiens
acatcctgtgtttctagggaaat

SEQ ID NO: 2587257 - DNA, 21 bp, Homo sapiens
acatcctttctattgaaaaat

SEQ ID NO: 2587258 - DNA, 22 bp, Homo sapiens
acatctctgcaccctggggcct

SEQ ID NO: 2587259 - DNA, 15 bp, Homo sapiens
acatctgtcctgtga

SEQ ID NO: 2587260 - DNA, 16 bp, Homo sapiens
acatctgtgtcttgtt

SEQ ID NO: 2587261 - DNA, 13 bp, Homo sapiens
acatcttgctctg

SEQ ID NO: 2587262 - DNA, 14 bp, Homo sapiens
acatcttgctctgc

SEQ ID NO: 2587263 - DNA, 17 bp, Homo sapiens
acatcttgctctgctga

SEQ ID NO: 2587264 - DNA, 21 bp, Homo sapiens
acatcttgctctgctgacaga

SEQ ID NO: 2587265 - DNA, 24 bp, Homo sapiens
acatcttggcacatttaagagaca

SEQ ID NO: 2587266 - DNA, 13 bp, Homo sapiens
acatctttatccg

SEQ ID NO: 2587267 - DNA, 12 bp, Homo sapiens
acatctttcaca

SEQ ID NO: 2587268 - DNA, 15 bp, Homo sapiens
acatctttcacactt

SEQ ID NO: 2587269 - DNA, 14 bp, Homo sapiens
acatctttcctgtc

SEQ ID NO: 2587270 - DNA, 22 bp, Homo sapiens
acatgaaaacacatttttctta

SEQ ID NO: 2587271 - DNA, 13 bp, Homo sapiens
acatgaagaagct

SEQ ID NO: 2587272 - DNA, 17 bp, Homo sapiens
acatgaagattctttcc

SEQ ID NO: 2587273 - DNA, 13 bp, Homo sapiens
acatgaatatgat

SEQ ID NO: 2587274 - DNA, 20 bp, Homo sapiens
acatgaatcccacccacatg

SEQ ID NO: 2587275 - DNA, 18 bp, Homo sapiens
acatgagcatcaggccag

SEQ ID NO: 2587276 - DNA, 20 bp, Homo sapiens
acatgagcatcaggccaggc

SEQ ID NO: 2587277 - DNA, 23 bp, Homo sapiens
acatgagcatcaggccaggccct

SEQ ID NO: 2587278 - DNA, 21 bp, Homo sapiens
acatgaggacatgatggagcg

SEQ ID NO: 2587279 - DNA, 13 bp, Homo sapiens
acatgagtcaaga

SEQ ID NO: 2587280 - DNA, 17 bp, Homo sapiens
acatgcaaggtcatttt

SEQ ID NO: 2587281 - DNA, 19 bp, Homo sapiens
acatgcaaggtcatttttt

SEQ ID NO: 2587282 - DNA, 16 bp, Homo sapiens
acatgcactatgagga

SEQ ID NO: 2587283 - DNA, 17 bp, Homo sapiens
acatgcactatgaggaa

SEQ ID NO: 2587284 - DNA, 15 bp, Homo sapiens
acatgcagcccatgc

SEQ ID NO: 2587285 - DNA, 22 bp, Homo sapiens
acatgcagcccatgcccacctg

SEQ ID NO: 2587286 - DNA, 14 bp, Homo sapiens
acatgcatacacac

SEQ ID NO: 2587287 - DNA, 15 bp, Homo sapiens
acatgcatacacaca

SEQ ID NO: 2587288 - DNA, 17 bp, Homo sapiens
acatgcatttgaggtca

SEQ ID NO: 2587289 - DNA, 21 bp, Homo sapiens
acatgcatttgaggtcaagta

SEQ ID NO: 2587290 - DNA, 18 bp, Homo sapiens
acatgccaagcactgtgc

SEQ ID NO: 2587291 - DNA, 17 bp, Homo sapiens
acatgcggagaacaaat

SEQ ID NO: 2587292 - DNA, 21 bp, Homo sapiens
acatgctacacactgcatgtt

SEQ ID NO: 2587293 - DNA, 22 bp, Homo sapiens
acatgctacacactgcatgttt

SEQ ID NO: 2587294 - DNA, 14 bp, Homo sapiens
acatgctgaagcca

SEQ ID NO: 2587295 - DNA, 13 bp, Homo sapiens
acatggacccgga

SEQ ID NO: 2587296 - DNA, 17 bp, Homo sapiens
acatggacttgtatatt

SEQ ID NO: 2587297 - DNA, 16 bp, Homo sapiens
acatggagactcctgc

SEQ ID NO: 2587298 - DNA, 15 bp, Homo sapiens
acatggagtatatgt

SEQ ID NO: 2587299 - DNA, 20 bp, Homo sapiens
acatggctctaaaaagtttt

SEQ ID NO: 2587300 - DNA, 13 bp, Homo sapiens
acatggcttcctc

SEQ ID NO: 2587301 - DNA, 21 bp, Homo sapiens
acatggtgaaacctcatctct

SEQ ID NO: 2587302 - DNA, 20 bp, Homo sapiens
acatggttgtgacctgagga

SEQ ID NO: 2587303 - DNA, 17 bp, Homo sapiens
acatggtttgactcccg

SEQ ID NO: 2587304 - DNA, 17 bp, Homo sapiens
acatgtaataaaaagta

SEQ ID NO: 2587305 - DNA, 15 bp, Homo sapiens
acatgtaattaagta

SEQ ID NO: 2587306 - DNA, 19 bp, Homo sapiens
acatgtaattaagtactat

SEQ ID NO: 2587307 - DNA, 20 bp, Homo sapiens
acatgtataatatttttaat

SEQ ID NO: 2587308 - DNA, 22 bp, Homo sapiens
acatgtatgttttggtatctgt

SEQ ID NO: 2587309 - DNA, 12 bp, Homo sapiens
acatgtatttgt

SEQ ID NO: 2587310 - DNA, 16 bp, Homo sapiens
acatgtatttgtttgc

SEQ ID NO: 2587311 - DNA, 18 bp, Homo sapiens
acatgtatttgtttgcat

SEQ ID NO: 2587312 - DNA, 16 bp, Homo sapiens
acatgtccttgtgtgt

SEQ ID NO: 2587313 - DNA, 14 bp, Homo sapiens
acatgtcttgtaca

SEQ ID NO: 2587314 - DNA, 22 bp, Homo sapiens
acatgtcttgtacatgtgtagc

SEQ ID NO: 2587315 - DNA, 23 bp, Homo sapiens
acatgtgaaaccttttttaagat

SEQ ID NO: 2587316 - DNA, 21 bp, Homo sapiens
acatgtgacacatatgcacct

SEQ ID NO: 2587317 - DNA, 16 bp, Homo sapiens
acatgtgcacatgcac

SEQ ID NO: 2587318 - DNA, 20 bp, Homo sapiens
acatgtgccgaatgtgcagg

SEQ ID NO: 2587319 - DNA, 18 bp, Homo sapiens
acatgtggaaagtgaatt

SEQ ID NO: 2587320 - DNA, 19 bp, Homo sapiens
acatgtggaaagtgaattt

SEQ ID NO: 2587321 - DNA, 20 bp, Homo sapiens
acatgtgttaagtattttca

SEQ ID NO: 2587322 - DNA, 21 bp, Homo sapiens
acatgtgttttaattccaata

SEQ ID NO: 2587323 - DNA, 19 bp, Homo sapiens
acatgttactgaccagcaa

SEQ ID NO: 2587324 - DNA, 23 bp, Homo sapiens
acatgtttatttattctgcattt

SEQ ID NO: 2587325 - DNA, 23 bp, Homo sapiens
acatgtttttgttttctttgaat

SEQ ID NO: 2587326 - DNA, 16 bp, Homo sapiens
acattaacagttttcc

SEQ ID NO: 2587327 - DNA, 21 bp, Homo sapiens
acattaatcaatcatctgtgt

SEQ ID NO: 2587328 - DNA, 15 bp, Homo sapiens
acattaatgttaatt

SEQ ID NO: 2587329 - DNA, 22 bp, Homo sapiens
acattaatgttaattcagcact

SEQ ID NO: 2587330 - DNA, 16 bp, Homo sapiens
acattaccttactgtg

SEQ ID NO: 2587331 - DNA, 18 bp, Homo sapiens
acattatcgggagcagtg

SEQ ID NO: 2587332 - DNA, 16 bp, Homo sapiens
acattatttattcagc

SEQ ID NO: 2587333 - DNA, 23 bp, Homo sapiens
acattccgacaaccgatgctcca

SEQ ID NO: 2587334 - DNA, 17 bp, Homo sapiens
acattcggctccctgga

SEQ ID NO: 2587335 - DNA, 20 bp, Homo sapiens
acattcggctccctggagcc

SEQ ID NO: 2587336 - DNA, 18 bp, Homo sapiens
acattctgctttcatctt

SEQ ID NO: 2587337 - DNA, 12 bp, Homo sapiens
acattctgttaa

SEQ ID NO: 2587338 - DNA, 18 bp, Homo sapiens
acattcttataaatatga

SEQ ID NO: 2587339 - DNA, 18 bp, Homo sapiens
acattgaagtaatgaatt

SEQ ID NO: 2587340 - DNA, 20 bp, Homo sapiens
acattgaagtaatgaatttt

SEQ ID NO: 2587341 - DNA, 22 bp, Homo sapiens
acattgccttttctagcccgaa

SEQ ID NO: 2587342 - DNA, 22 bp, Homo sapiens
acattgcggacagccacggcca

SEQ ID NO: 2587343 - DNA, 17 bp, Homo sapiens
acattgctaagatgctc

SEQ ID NO: 2587344 - DNA, 21 bp, Homo sapiens
acattgctttactgtcaaaat

SEQ ID NO: 2587345 - DNA, 19 bp, Homo sapiens
acattgggaaggggacccc

SEQ ID NO: 2587346 - DNA, 14 bp, Homo sapiens
acattggttcttgt

SEQ ID NO: 2587347 - DNA, 16 bp, Homo sapiens
acattggttcttgtat

SEQ ID NO: 2587348 - DNA, 21 bp, Homo sapiens
acattggttcttgtattaaga

SEQ ID NO: 2587349 - DNA, 23 bp, Homo sapiens
acattggttcttgtattaagaat

SEQ ID NO: 2587350 - DNA, 17 bp, Homo sapiens
acattgtggcacattct

SEQ ID NO: 2587351 - DNA, 15 bp, Homo sapiens
acattgttttaaaaa

SEQ ID NO: 2587352 - DNA, 17 bp, Homo sapiens
acattgttttaaaaaga

SEQ ID NO: 2587353 - DNA, 16 bp, Homo sapiens
acatttaatacagcag

SEQ ID NO: 2587354 - DNA, 15 bp, Homo sapiens
acatttataatgttt

SEQ ID NO: 2587355 - DNA, 14 bp, Homo sapiens
acatttattctgct

SEQ ID NO: 2587356 - DNA, 15 bp, Homo sapiens
acatttccctgtgct

SEQ ID NO: 2587357 - DNA, 20 bp, Homo sapiens
acatttggagtgttcccctt

SEQ ID NO: 2587358 - DNA, 14 bp, Homo sapiens
acattttaaataaa

SEQ ID NO: 2587359 - DNA, 15 bp, Homo sapiens
acattttaaataaaa

SEQ ID NO: 2587360 - DNA, 20 bp, Homo sapiens
acattttcacacaatacaat

SEQ ID NO: 2587361 - DNA, 22 bp, Homo sapiens
acatttttaagtgctgcattta

SEQ ID NO: 2587362 - DNA, 14 bp, Homo sapiens
acattttttaaatg

SEQ ID NO: 2587363 - DNA, 17 bp, Homo sapiens
acattttttaaatgcac

SEQ ID NO: 2587364 - DNA, 15 bp, Homo sapiens
accaaaaaagttaca

SEQ ID NO: 2587365 - DNA, 19 bp, Homo sapiens
accaaaaactgaaagtgaa

SEQ ID NO: 2587366 - DNA, 14 bp, Homo sapiens
accaaaatcccctt

SEQ ID NO: 2587367 - DNA, 22 bp, Homo sapiens
accaaagatatatacacaggat

SEQ ID NO: 2587368 - DNA, 23 bp, Homo sapiens
accaaagatatatacacaggatc

SEQ ID NO: 2587369 - DNA, 16 bp, Homo sapiens
accaacatactcccat

SEQ ID NO: 2587370 - DNA, 22 bp, Homo sapiens
accaacatactcccatctgtga

SEQ ID NO: 2587371 - DNA, 16 bp, Homo sapiens
accaaccctgtttcct

SEQ ID NO: 2587372 - DNA, 21 bp, Homo sapiens
accaacgtctgtgccattttg

SEQ ID NO: 2587373 - DNA, 15 bp, Homo sapiens
accaactagacattc

SEQ ID NO: 2587374 - DNA, 17 bp, Homo sapiens
accaactagacattctg

SEQ ID NO: 2587375 - DNA, 20 bp, Homo sapiens
accaactagacattctgtcg

SEQ ID NO: 2587376 - DNA, 18 bp, Homo sapiens
accaactttctgtaaact

SEQ ID NO: 2587377 - DNA, 11 bp, Homo sapiens
accaagaagat

SEQ ID NO: 2587378 - DNA, 20 bp, Homo sapiens
accaagaagcctttcctgta

SEQ ID NO: 2587379 - DNA, 24 bp, Homo sapiens
accaagcaggaagctcagactggt

SEQ ID NO: 2587380 - DNA, 12 bp, Homo sapiens
accaagcccagt

SEQ ID NO: 2587381 - DNA, 17 bp, Homo sapiens
accaagctatcctggct

SEQ ID NO: 2587382 - DNA, 13 bp, Homo sapiens
accaaggacccct

SEQ ID NO: 2587383 - DNA, 19 bp, Homo sapiens
accaaggctgattaaacca

SEQ ID NO: 2587384 - DNA, 17 bp, Homo sapiens
accaatattgtacagtt

SEQ ID NO: 2587385 - DNA, 18 bp, Homo sapiens
accaatattgtacagttt

SEQ ID NO: 2587386 - DNA, 13 bp, Homo sapiens
accaatatttgta

SEQ ID NO: 2587387 - DNA, 20 bp, Homo sapiens
accaatcattttaattatta

SEQ ID NO: 2587388 - DNA, 13 bp, Homo sapiens
accaatcctggac

SEQ ID NO: 2587389 - DNA, 14 bp, Homo sapiens
accaatgaaaaaat

SEQ ID NO: 2587390 - DNA, 21 bp, Homo sapiens
accaatgccaaaaaaagacag

SEQ ID NO: 2587391 - DNA, 13 bp, Homo sapiens
accaatgtcttga

SEQ ID NO: 2587392 - DNA, 14 bp, Homo sapiens
accacaaaaatgaa

SEQ ID NO: 2587393 - DNA, 15 bp, Homo sapiens
accacacccagccca

SEQ ID NO: 2587394 - DNA, 17 bp, Homo sapiens
accacaccctgtactgt

SEQ ID NO: 2587395 - DNA, 17 bp, Homo sapiens
accacacttcctgtcca

SEQ ID NO: 2587396 - DNA, 22 bp, Homo sapiens
accacacttcctgtccagagag

SEQ ID NO: 2587397 - DNA, 12 bp, Homo sapiens
accacagacaca

SEQ ID NO: 2587398 - DNA, 13 bp, Homo sapiens
accacagacacac

SEQ ID NO: 2587399 - DNA, 18 bp, Homo sapiens
accacagacacacacacg

SEQ ID NO: 2587400 - DNA, 22 bp, Homo sapiens
accacagacatactaaccagca

SEQ ID NO: 2587401 - DNA, 13 bp, Homo sapiens
accacagccctgt

SEQ ID NO: 2587402 - DNA, 15 bp, Homo sapiens
accacagccctgtca

SEQ ID NO: 2587403 - DNA, 14 bp, Homo sapiens
accacagctgctgg

SEQ ID NO: 2587404 - DNA, 16 bp, Homo sapiens
accacagctgctggag

SEQ ID NO: 2587405 - DNA, 23 bp, Homo sapiens
accacagggttcaaaatgtctgt

SEQ ID NO: 2587406 - DNA, 19 bp, Homo sapiens
accacatagcatgaggcca

SEQ ID NO: 2587407 - DNA, 14 bp, Homo sapiens
accacatcctccgt

SEQ ID NO: 2587408 - DNA, 22 bp, Homo sapiens
accacatcctccgtccagccgc

SEQ ID NO: 2587409 - DNA, 18 bp, Homo sapiens
accacatcttgctctgct

SEQ ID NO: 2587410 - DNA, 20 bp, Homo sapiens
accacatgccaagcactgtg

SEQ ID NO: 2587411 - DNA, 18 bp, Homo sapiens
accacatgcggagaacaa

SEQ ID NO: 2587412 - DNA, 22 bp, Homo sapiens
accaccccgcctgccctcatgg

SEQ ID NO: 2587413 - DNA, 22 bp, Homo sapiens
accacccctgcctccaccctct

SEQ ID NO: 2587414 - DNA, 14 bp, Homo sapiens
accaccccttcctg

SEQ ID NO: 2587415 - DNA, 20 bp, Homo sapiens
accaccctagtcccttcccc

SEQ ID NO: 2587416 - DNA, 14 bp, Homo sapiens
accaccctcccctc

SEQ ID NO: 2587417 - DNA, 13 bp, Homo sapiens
accaccctgaggc

SEQ ID NO: 2587418 - DNA, 14 bp, Homo sapiens
accaccgctcccca

SEQ ID NO: 2587419 - DNA, 21 bp, Homo sapiens
accaccgctccccagcccagg

SEQ ID NO: 2587420 - DNA, 14 bp, Homo sapiens
accacgctggacct

SEQ ID NO: 2587421 - DNA, 14 bp, Homo sapiens
accacgtccagctg

SEQ ID NO: 2587422 - DNA, 14 bp, Homo sapiens
accactacattctg

SEQ ID NO: 2587423 - DNA, 17 bp, Homo sapiens
accactacattctgtta

SEQ ID NO: 2587424 - DNA, 13 bp, Homo sapiens
accactagaactc

SEQ ID NO: 2587425 - DNA, 20 bp, Homo sapiens
accactagaactctccatct

SEQ ID NO: 2587426 - DNA, 20 bp, Homo sapiens
accactcaaattaatctttc

SEQ ID NO: 2587427 - DNA, 20 bp, Homo sapiens
accactctatcaagtattat

SEQ ID NO: 2587428 - DNA, 20 bp, Homo sapiens
accactgcactccagcctgg

SEQ ID NO: 2587429 - DNA, 14 bp, Homo sapiens
accactgcagaaga

SEQ ID NO: 2587430 - DNA, 12 bp, Homo sapiens
accactggccac

SEQ ID NO: 2587431 - DNA, 21 bp, Homo sapiens
accactggccaccaggctggc

SEQ ID NO: 2587432 - DNA, 19 bp, Homo sapiens
accactgtaaaatgaaatt

SEQ ID NO: 2587433 - DNA, 15 bp, Homo sapiens
accacttcagctgac

SEQ ID NO: 2587434 - DNA, 15 bp, Homo sapiens
accacttcttttata

SEQ ID NO: 2587435 - DNA, 12 bp, Homo sapiens
accacttttgtt

SEQ ID NO: 2587436 - DNA, 20 bp, Homo sapiens
accagacggttcaccagcct

SEQ ID NO: 2587437 - DNA, 20 bp, Homo sapiens
accagagataatatgagaat

SEQ ID NO: 2587438 - DNA, 22 bp, Homo sapiens
accagagcagatgcagagagcc

SEQ ID NO: 2587439 - DNA, 20 bp, Homo sapiens
accagagcatttccaacacc

SEQ ID NO: 2587440 - DNA, 19 bp, Homo sapiens
accagaggctgcagaaggc

SEQ ID NO: 2587441 - DNA, 22 bp, Homo sapiens
accagaggctgcagaaggccaa

SEQ ID NO: 2587442 - DNA, 21 bp, Homo sapiens
accagataagaatgctggttt

SEQ ID NO: 2587443 - DNA, 23 bp, Homo sapiens
accagcaacttgtctttttctgg

SEQ ID NO: 2587444 - DNA, 17 bp, Homo sapiens
accagcaatatgtaaat

SEQ ID NO: 2587445 - DNA, 16 bp, Homo sapiens
accagcactgtctcag

SEQ ID NO: 2587446 - DNA, 21 bp, Homo sapiens
accagcagatcccagctcacg

SEQ ID NO: 2587447 - DNA, 14 bp, Homo sapiens
accagcagcctgga

SEQ ID NO: 2587448 - DNA, 22 bp, Homo sapiens
accagcatcccttgaccaggcc

SEQ ID NO: 2587449 - DNA, 19 bp, Homo sapiens
accagccaggctctgtgct

SEQ ID NO: 2587450 - DNA, 22 bp, Homo sapiens
accagccatacttatctctctg

SEQ ID NO: 2587451 - DNA, 15 bp, Homo sapiens
accagcccagatgtt

SEQ ID NO: 2587452 - DNA, 15 bp, Homo sapiens
accagcccggcctgc

SEQ ID NO: 2587453 - DNA, 20 bp, Homo sapiens
accagcctccgtatttcaga

SEQ ID NO: 2587454 - DNA, 19 bp, Homo sapiens
accagcctcgtcttcatta

SEQ ID NO: 2587455 - DNA, 11 bp, Homo sapiens
accagcctggc

SEQ ID NO: 2587456 - DNA, 23 bp, Homo sapiens
accagcctgttggacccgctctg

SEQ ID NO: 2587457 - DNA, 16 bp, Homo sapiens
accagcctttctccca

SEQ ID NO: 2587458 - DNA, 17 bp, Homo sapiens
accagcctttctcccag

SEQ ID NO: 2587459 - DNA, 14 bp, Homo sapiens
accagcgaagggag

SEQ ID NO: 2587460 - DNA, 23 bp, Homo sapiens
accagcgaggaggctccagaggg

SEQ ID NO: 2587461 - DNA, 13 bp, Homo sapiens
accagctcctccc

SEQ ID NO: 2587462 - DNA, 14 bp, Homo sapiens
accagctgcctctt

SEQ ID NO: 2587463 - DNA, 16 bp, Homo sapiens
accagctgcctcttct

SEQ ID NO: 2587464 - DNA, 21 bp, Homo sapiens
accagctggggcgtggggagg

SEQ ID NO: 2587465 - DNA, 23 bp, Homo sapiens
accagctggggcgtggggagggc

SEQ ID NO: 2587466 - DNA, 15 bp, Homo sapiens
accagcttctccagg

SEQ ID NO: 2587467 - DNA, 20 bp, Homo sapiens
accagcttctccaggctctt

SEQ ID NO: 2587468 - DNA, 20 bp, Homo sapiens
accaggactatagcccaggt

SEQ ID NO: 2587469 - DNA, 14 bp, Homo sapiens
accaggagaaccac

SEQ ID NO: 2587470 - DNA, 19 bp, Homo sapiens
accaggagaaccactacat

SEQ ID NO: 2587471 - DNA, 20 bp, Homo sapiens
accaggagaaccactacatg

SEQ ID NO: 2587472 - DNA, 18 bp, Homo sapiens
accaggagggcactggag

SEQ ID NO: 2587473 - DNA, 18 bp, Homo sapiens
accaggccgtcctcccgg

SEQ ID NO: 2587474 - DNA, 20 bp, Homo sapiens
accaggccgtcctcccgggc

SEQ ID NO: 2587475 - DNA, 19 bp, Homo sapiens
accaggctggcgcagccaa

SEQ ID NO: 2587476 - DNA, 19 bp, Homo sapiens
accaggcttgcctgcaggc

SEQ ID NO: 2587477 - DNA, 16 bp, Homo sapiens
accaggtcttggagct

SEQ ID NO: 2587478 - DNA, 22 bp, Homo sapiens
accagtgcccaaagtctgtgtg

SEQ ID NO: 2587479 - DNA, 17 bp, Homo sapiens
accagtgttgtggattt

SEQ ID NO: 2587480 - DNA, 15 bp, Homo sapiens
accagttgggagcac

SEQ ID NO: 2587481 - DNA, 19 bp, Homo sapiens
accagttgggagcactgga

SEQ ID NO: 2587482 - DNA, 19 bp, Homo sapiens
accagtttaacctgatgca

SEQ ID NO: 2587483 - DNA, 21 bp, Homo sapiens
accagtttaacctgatgcagt

SEQ ID NO: 2587484 - DNA, 19 bp, Homo sapiens
accataaccccggaagcca

SEQ ID NO: 2587485 - DNA, 22 bp, Homo sapiens
accataaggtttcgtttctgta

SEQ ID NO: 2587486 - DNA, 15 bp, Homo sapiens
accataatgttacat

SEQ ID NO: 2587487 - DNA, 14 bp, Homo sapiens
accatattaccaca

SEQ ID NO: 2587488 - DNA, 14 bp, Homo sapiens
accatcagggacag

SEQ ID NO: 2587489 - DNA, 23 bp, Homo sapiens
accatccactctaccctcccacc

SEQ ID NO: 2587490 - DNA, 16 bp, Homo sapiens
accatccctgaaggcc

SEQ ID NO: 2587491 - DNA, 18 bp, Homo sapiens
accatccctgaaggcccc

SEQ ID NO: 2587492 - DNA, 16 bp, Homo sapiens
accatctcaggccacc

SEQ ID NO: 2587493 - DNA, 18 bp, Homo sapiens
accatgaacagaaaacat

SEQ ID NO: 2587494 - DNA, 18 bp, Homo sapiens
accatgagaagagggcct

SEQ ID NO: 2587495 - DNA, 22 bp, Homo sapiens
accatgagtggcatggccacca

SEQ ID NO: 2587496 - DNA, 16 bp, Homo sapiens
accatggagacaagaa

SEQ ID NO: 2587497 - DNA, 15 bp, Homo sapiens
accatggccagccaa

SEQ ID NO: 2587498 - DNA, 21 bp, Homo sapiens
accatgtaaagaacataaata

SEQ ID NO: 2587499 - DNA, 11 bp, Homo sapiens
accatgtacat

SEQ ID NO: 2587500 - DNA, 14 bp, Homo sapiens
accatgtacatagc

SEQ ID NO: 2587501 - DNA, 13 bp, Homo sapiens
accattaaaactg

SEQ ID NO: 2587502 - DNA, 18 bp, Homo sapiens
accattctccacctgcca

SEQ ID NO: 2587503 - DNA, 11 bp, Homo sapiens
accatttcaga

SEQ ID NO: 2587504 - DNA, 22 bp, Homo sapiens
accatttgcatggctccagaaa

SEQ ID NO: 2587505 - DNA, 21 bp, Homo sapiens
accattttggggtacccactg

SEQ ID NO: 2587506 - DNA, 21 bp, Homo sapiens
acccaaaagctcagccagccc

SEQ ID NO: 2587507 - DNA, 14 bp, Homo sapiens
acccaaatcctctc

SEQ ID NO: 2587508 - DNA, 21 bp, Homo sapiens
acccaaatgttcatcaatgaa

SEQ ID NO: 2587509 - DNA, 13 bp, Homo sapiens
acccaagcttggc

SEQ ID NO: 2587510 - DNA, 18 bp, Homo sapiens
acccaagggcctggcctg

SEQ ID NO: 2587511 - DNA, 19 bp, Homo sapiens
acccaagggcctggcctga

SEQ ID NO: 2587512 - DNA, 13 bp, Homo sapiens
acccaatgattca

SEQ ID NO: 2587513 - DNA, 17 bp, Homo sapiens
acccacaagaaatgaaa

SEQ ID NO: 2587514 - DNA, 16 bp, Homo sapiens
acccacacctctgcca

SEQ ID NO: 2587515 - DNA, 15 bp, Homo sapiens
acccacatgtgacac

SEQ ID NO: 2587516 - DNA, 14 bp, Homo sapiens
acccacccctgtgc

SEQ ID NO: 2587517 - DNA, 15 bp, Homo sapiens
acccaccctcctttc

SEQ ID NO: 2587518 - DNA, 17 bp, Homo sapiens
acccaccgtccgccctg

SEQ ID NO: 2587519 - DNA, 20 bp, Homo sapiens
acccaccgtccgccctgctc

SEQ ID NO: 2587520 - DNA, 20 bp, Homo sapiens
acccacgtgtaactgtcagc

SEQ ID NO: 2587521 - DNA, 21 bp, Homo sapiens
acccacgttctcacacccacc

SEQ ID NO: 2587522 - DNA, 18 bp, Homo sapiens
acccactctcctctgcct

SEQ ID NO: 2587523 - DNA, 20 bp, Homo sapiens
acccactctcctctgcctca

SEQ ID NO: 2587524 - DNA, 13 bp, Homo sapiens
acccactgctctg

SEQ ID NO: 2587525 - DNA, 15 bp, Homo sapiens
acccactgctctggt

SEQ ID NO: 2587526 - DNA, 21 bp, Homo sapiens
acccagacagctccctctgcc

SEQ ID NO: 2587527 - DNA, 10 bp, Homo sapiens
acccagaccc

SEQ ID NO: 2587528 - DNA, 14 bp, Homo sapiens
acccagacccagtg

SEQ ID NO: 2587529 - DNA, 15 bp, Homo sapiens
acccagacccagtgg

SEQ ID NO: 2587530 - DNA, 14 bp, Homo sapiens
acccagagaatata

SEQ ID NO: 2587531 - DNA, 23 bp, Homo sapiens
acccagagcattacgtgagccag

SEQ ID NO: 2587532 - DNA, 13 bp, Homo sapiens
acccagccatctg

SEQ ID NO: 2587533 - DNA, 15 bp, Homo sapiens
acccagccatctgcc

SEQ ID NO: 2587534 - DNA, 20 bp, Homo sapiens
acccagccatctgcccaggg

SEQ ID NO: 2587535 - DNA, 21 bp, Homo sapiens
acccagccatctgcccagggg

SEQ ID NO: 2587536 - DNA, 20 bp, Homo sapiens
acccagccccttgagaaacc

SEQ ID NO: 2587537 - DNA, 16 bp, Homo sapiens
acccagccctcatccc

SEQ ID NO: 2587538 - DNA, 16 bp, Homo sapiens
acccagccctggtctc

SEQ ID NO: 2587539 - DNA, 16 bp, Homo sapiens
acccagcgagccctgg

SEQ ID NO: 2587540 - DNA, 19 bp, Homo sapiens
acccagcgagccctggtgg

SEQ ID NO: 2587541 - DNA, 24 bp, Homo sapiens
acccagcgagccctggtggcagtg

SEQ ID NO: 2587542 - DNA, 22 bp, Homo sapiens
acccagctatggttctctcgca

SEQ ID NO: 2587543 - DNA, 23 bp, Homo sapiens
acccaggagatggaagttgcagt

SEQ ID NO: 2587544 - DNA, 23 bp, Homo sapiens
acccaggagcatccacctccttc

SEQ ID NO: 2587545 - DNA, 13 bp, Homo sapiens
acccaggagcccc

SEQ ID NO: 2587546 - DNA, 23 bp, Homo sapiens
acccaggagccccgaggccttct

SEQ ID NO: 2587547 - DNA, 17 bp, Homo sapiens
acccaggagtgtggcca

SEQ ID NO: 2587548 - DNA, 20 bp, Homo sapiens
acccaggctggagtacagtg

SEQ ID NO: 2587549 - DNA, 12 bp, Homo sapiens
acccaggctggg

SEQ ID NO: 2587550 - DNA, 15 bp, Homo sapiens
acccatagcttccat

SEQ ID NO: 2587551 - DNA, 16 bp, Homo sapiens
acccatagcttccatg

SEQ ID NO: 2587552 - DNA, 14 bp, Homo sapiens
acccatatcccctc

SEQ ID NO: 2587553 - DNA, 19 bp, Homo sapiens
acccatatcccctctcccc

SEQ ID NO: 2587554 - DNA, 20 bp, Homo sapiens
acccatcctaccaatgcatg

SEQ ID NO: 2587555 - DNA, 22 bp, Homo sapiens
acccatctgcacccccctgggc

SEQ ID NO: 2587556 - DNA, 14 bp, Homo sapiens
acccatgaatcaaa

SEQ ID NO: 2587557 - DNA, 23 bp, Homo sapiens
acccatgactttatatggatgat

SEQ ID NO: 2587558 - DNA, 13 bp, Homo sapiens
acccatgaggcaa

SEQ ID NO: 2587559 - DNA, 14 bp, Homo sapiens
acccatgctgccct

SEQ ID NO: 2587560 - DNA, 15 bp, Homo sapiens
acccatgctgccctg

SEQ ID NO: 2587561 - DNA, 13 bp, Homo sapiens
acccattcctatt

SEQ ID NO: 2587562 - DNA, 20 bp, Homo sapiens
acccatttaaatttttttcc

SEQ ID NO: 2587563 - DNA, 23 bp, Homo sapiens
acccatttaaatttttttcctta

SEQ ID NO: 2587564 - DNA, 14 bp, Homo sapiens
acccattttcacat

SEQ ID NO: 2587565 - DNA, 19 bp, Homo sapiens
accccaaagagcctggaga

SEQ ID NO: 2587566 - DNA, 21 bp, Homo sapiens
accccaaagagcctggagaag

SEQ ID NO: 2587567 - DNA, 17 bp, Homo sapiens
accccacacacgccaga

SEQ ID NO: 2587568 - DNA, 18 bp, Homo sapiens
accccacacgctcctccc

SEQ ID NO: 2587569 - DNA, 11 bp, Homo sapiens
accccacactt

SEQ ID NO: 2587570 - DNA, 13 bp, Homo sapiens
accccacccttcc

SEQ ID NO: 2587571 - DNA, 18 bp, Homo sapiens
accccagacgatgtcttc

SEQ ID NO: 2587572 - DNA, 13 bp, Homo sapiens
accccagcatcct

SEQ ID NO: 2587573 - DNA, 10 bp, Homo sapiens
accccagctg

SEQ ID NO: 2587574 - DNA, 13 bp, Homo sapiens
accccaggccccg

SEQ ID NO: 2587575 - DNA, 17 bp, Homo sapiens
accccagttctgctcct

SEQ ID NO: 2587576 - DNA, 20 bp, Homo sapiens
accccagttctgctcctctc

SEQ ID NO: 2587577 - DNA, 21 bp, Homo sapiens
accccagttctgctcctctcc

SEQ ID NO: 2587578 - DNA, 23 bp, Homo sapiens
accccagttctgctcctctccag

SEQ ID NO: 2587579 - DNA, 17 bp, Homo sapiens
accccatccagttcatg

SEQ ID NO: 2587580 - DNA, 15 bp, Homo sapiens
accccatctgtgaat

SEQ ID NO: 2587581 - DNA, 22 bp, Homo sapiens
accccatgctgttgattgctaa

SEQ ID NO: 2587582 - DNA, 23 bp, Homo sapiens
accccatgctgttgattgctaaa

SEQ ID NO: 2587583 - DNA, 12 bp, Homo sapiens
acccccacacac

SEQ ID NO: 2587584 - DNA, 12 bp, Homo sapiens
acccccacccca

SEQ ID NO: 2587585 - DNA, 15 bp, Homo sapiens
acccccaccccacac

SEQ ID NO: 2587586 - DNA, 14 bp, Homo sapiens
acccccacccccag

SEQ ID NO: 2587587 - DNA, 15 bp, Homo sapiens
acccccacccccagc

SEQ ID NO: 2587588 - DNA, 18 bp, Homo sapiens
acccccacccccagctca

SEQ ID NO: 2587589 - DNA, 13 bp, Homo sapiens
acccccacccctt

SEQ ID NO: 2587590 - DNA, 13 bp, Homo sapiens
acccccagcaacc

SEQ ID NO: 2587591 - DNA, 12 bp, Homo sapiens
acccccagcctg

SEQ ID NO: 2587592 - DNA, 13 bp, Homo sapiens
acccccagctcaa

SEQ ID NO: 2587593 - DNA, 20 bp, Homo sapiens
acccccagctcaatggactg

SEQ ID NO: 2587594 - DNA, 22 bp, Homo sapiens
accccccacactcactcctgag

SEQ ID NO: 2587595 - DNA, 16 bp, Homo sapiens
accccccactctgtgc

SEQ ID NO: 2587596 - DNA, 22 bp, Homo sapiens
acccccgagtttggtccctggg

SEQ ID NO: 2587597 - DNA, 22 bp, Homo sapiens
accccctccctggcctgttctg

SEQ ID NO: 2587598 - DNA, 13 bp, Homo sapiens
accccctcctctc

SEQ ID NO: 2587599 - DNA, 14 bp, Homo sapiens
accccctctagaaa

SEQ ID NO: 2587600 - DNA, 11 bp, Homo sapiens
acccccttccc

SEQ ID NO: 2587601 - DNA, 18 bp, Homo sapiens
acccccttctccatccac

SEQ ID NO: 2587602 - DNA, 13 bp, Homo sapiens
acccccttctctg

SEQ ID NO: 2587603 - DNA, 18 bp, Homo sapiens
acccccttctctgctcca

SEQ ID NO: 2587604 - DNA, 20 bp, Homo sapiens
acccccttctctgctccacc

SEQ ID NO: 2587605 - DNA, 16 bp, Homo sapiens
accccgctctgcatgc

SEQ ID NO: 2587606 - DNA, 23 bp, Homo sapiens
accccgctctgcatgcggcccag

SEQ ID NO: 2587607 - DNA, 16 bp, Homo sapiens
accccgggctctctgc

SEQ ID NO: 2587608 - DNA, 17 bp, Homo sapiens
accccgggctctctgct

SEQ ID NO: 2587609 - DNA, 21 bp, Homo sapiens
accccgggctctctgctgtac

SEQ ID NO: 2587610 - DNA, 15 bp, Homo sapiens
acccctcactctggc

SEQ ID NO: 2587611 - DNA, 23 bp, Homo sapiens
acccctcctccctttttccttgt

SEQ ID NO: 2587612 - DNA, 12 bp, Homo sapiens
acccctccttcc

SEQ ID NO: 2587613 - DNA, 14 bp, Homo sapiens
acccctctggccag

SEQ ID NO: 2587614 - DNA, 18 bp, Homo sapiens
acccctctggccaggatg

SEQ ID NO: 2587615 - DNA, 15 bp, Homo sapiens
acccctgccctggga

SEQ ID NO: 2587616 - DNA, 12 bp, Homo sapiens
acccctgcctcc

SEQ ID NO: 2587617 - DNA, 15 bp, Homo sapiens
acccctgcctccacc

SEQ ID NO: 2587618 - DNA, 19 bp, Homo sapiens
acccctgcctccaccctct

SEQ ID NO: 2587619 - DNA, 23 bp, Homo sapiens
acccctgcctccaccctctgagc

SEQ ID NO: 2587620 - DNA, 17 bp, Homo sapiens
acccctgtctctagcca

SEQ ID NO: 2587621 - DNA, 14 bp, Homo sapiens
acccctgtgctccg

SEQ ID NO: 2587622 - DNA, 22 bp, Homo sapiens
acccctgtgctccgtgcctcca

SEQ ID NO: 2587623 - DNA, 18 bp, Homo sapiens
accccttagcctccctga

SEQ ID NO: 2587624 - DNA, 15 bp, Homo sapiens
accccttccatgtgg

SEQ ID NO: 2587625 - DNA, 18 bp, Homo sapiens
accccttccatgtggaga

SEQ ID NO: 2587626 - DNA, 19 bp, Homo sapiens
accccttccatgtggagaa

SEQ ID NO: 2587627 - DNA, 18 bp, Homo sapiens
accccttccccactgcct

SEQ ID NO: 2587628 - DNA, 14 bp, Homo sapiens
accccttcctgtcc

SEQ ID NO: 2587629 - DNA, 19 bp, Homo sapiens
accccttcgctcctgtgtc

SEQ ID NO: 2587630 - DNA, 17 bp, Homo sapiens
acccctttctggctctc

SEQ ID NO: 2587631 - DNA, 15 bp, Homo sapiens
acccgaggctgccca

SEQ ID NO: 2587632 - DNA, 22 bp, Homo sapiens
acccgatgctgctttcccctgt

SEQ ID NO: 2587633 - DNA, 23 bp, Homo sapiens
acccgcctctcccgtcagggccc

SEQ ID NO: 2587634 - DNA, 19 bp, Homo sapiens
acccgctaagagggaggga

SEQ ID NO: 2587635 - DNA, 18 bp, Homo sapiens
acccgctcatcactggat

SEQ ID NO: 2587636 - DNA, 12 bp, Homo sapiens
acccgctctgga

SEQ ID NO: 2587637 - DNA, 13 bp, Homo sapiens
acccgctctggac

SEQ ID NO: 2587638 - DNA, 17 bp, Homo sapiens
acccggcccctgctggt

SEQ ID NO: 2587639 - DNA, 12 bp, Homo sapiens
acccgggaaggg

SEQ ID NO: 2587640 - DNA, 17 bp, Homo sapiens
acccgggaggcagaggt

SEQ ID NO: 2587641 - DNA, 16 bp, Homo sapiens
accctacctgtgcctg

SEQ ID NO: 2587642 - DNA, 19 bp, Homo sapiens
accctagccattcctggta

SEQ ID NO: 2587643 - DNA, 23 bp, Homo sapiens
accctagccattcctggtaccca

SEQ ID NO: 2587644 - DNA, 15 bp, Homo sapiens
accctagttctacct

SEQ ID NO: 2587645 - DNA, 16 bp, Homo sapiens
accctagtttccctga

SEQ ID NO: 2587646 - DNA, 23 bp, Homo sapiens
accctatattttgcatagtacca

SEQ ID NO: 2587647 - DNA, 15 bp, Homo sapiens
accctcacactggga

SEQ ID NO: 2587648 - DNA, 14 bp, Homo sapiens
accctcaggcaggt

SEQ ID NO: 2587649 - DNA, 19 bp, Homo sapiens
accctcaggcataggcctg

SEQ ID NO: 2587650 - DNA, 12 bp, Homo sapiens
accctcatgctg

SEQ ID NO: 2587651 - DNA, 17 bp, Homo sapiens
accctcatgttcttaat

SEQ ID NO: 2587652 - DNA, 15 bp, Homo sapiens
accctccaccctgtc

SEQ ID NO: 2587653 - DNA, 17 bp, Homo sapiens
accctccaccctgtccc

SEQ ID NO: 2587654 - DNA, 23 bp, Homo sapiens
accctccaccctgtcccccagct

SEQ ID NO: 2587655 - DNA, 23 bp, Homo sapiens
accctcccccaggaggtcgaccc

SEQ ID NO: 2587656 - DNA, 23 bp, Homo sapiens
accctccccgcaccccccaagct

SEQ ID NO: 2587657 - DNA, 12 bp, Homo sapiens
accctcccctct

SEQ ID NO: 2587658 - DNA, 13 bp, Homo sapiens
accctcccctctc

SEQ ID NO: 2587659 - DNA, 18 bp, Homo sapiens
accctcccctctcttgca

SEQ ID NO: 2587660 - DNA, 17 bp, Homo sapiens
accctccctcagcccct

SEQ ID NO: 2587661 - DNA, 18 bp, Homo sapiens
accctccctcagcccctc

SEQ ID NO: 2587662 - DNA, 21 bp, Homo sapiens
accctcctatcacctcccctc

SEQ ID NO: 2587663 - DNA, 19 bp, Homo sapiens
accctcctccagaccattc

SEQ ID NO: 2587664 - DNA, 17 bp, Homo sapiens
accctcctgtaaatggt

SEQ ID NO: 2587665 - DNA, 21 bp, Homo sapiens
accctcctgtaaatggtgtac

SEQ ID NO: 2587666 - DNA, 13 bp, Homo sapiens
accctcctgtctt

SEQ ID NO: 2587667 - DNA, 18 bp, Homo sapiens
accctcctgtcttcccag

SEQ ID NO: 2587668 - DNA, 23 bp, Homo sapiens
accctcctgttgcacccagccct

SEQ ID NO: 2587669 - DNA, 14 bp, Homo sapiens
accctcgaggcgga

SEQ ID NO: 2587670 - DNA, 15 bp, Homo sapiens
accctcgggcccacc

SEQ ID NO: 2587671 - DNA, 14 bp, Homo sapiens
accctcgtggcctt

SEQ ID NO: 2587672 - DNA, 15 bp, Homo sapiens
accctctcagctcca

SEQ ID NO: 2587673 - DNA, 22 bp, Homo sapiens
accctctgaatggtccagggtt

SEQ ID NO: 2587674 - DNA, 22 bp, Homo sapiens
accctgagctgaggcagcagtg

SEQ ID NO: 2587675 - DNA, 13 bp, Homo sapiens
accctgaggccca

SEQ ID NO: 2587676 - DNA, 23 bp, Homo sapiens
accctgaggcccagagggcctgc

SEQ ID NO: 2587677 - DNA, 12 bp, Homo sapiens
accctgcccctg

SEQ ID NO: 2587678 - DNA, 14 bp, Homo sapiens
accctgcccctgcc

SEQ ID NO: 2587679 - DNA, 13 bp, Homo sapiens
accctgccctgtg

SEQ ID NO: 2587680 - DNA, 17 bp, Homo sapiens
accctgccctgtgggcc

SEQ ID NO: 2587681 - DNA, 20 bp, Homo sapiens
accctgcgaaggggccctgg

SEQ ID NO: 2587682 - DNA, 22 bp, Homo sapiens
accctgcgaaggggccctggtc

SEQ ID NO: 2587683 - DNA, 22 bp, Homo sapiens
accctgcgcccagtccttccac

SEQ ID NO: 2587684 - DNA, 16 bp, Homo sapiens
accctgcgtggggaca

SEQ ID NO: 2587685 - DNA, 17 bp, Homo sapiens
accctgcgtggggacag

SEQ ID NO: 2587686 - DNA, 12 bp, Homo sapiens
accctgggacct

SEQ ID NO: 2587687 - DNA, 16 bp, Homo sapiens
accctggggagaaagt

SEQ ID NO: 2587688 - DNA, 13 bp, Homo sapiens
accctggggcctg

SEQ ID NO: 2587689 - DNA, 22 bp, Homo sapiens
accctggggcctggacctgcct

SEQ ID NO: 2587690 - DNA, 22 bp, Homo sapiens
accctgtcccccagctctggtg

SEQ ID NO: 2587691 - DNA, 21 bp, Homo sapiens
accctgtctcttaaagaaaaa

SEQ ID NO: 2587692 - DNA, 23 bp, Homo sapiens
accctgtctgtagagggccctgg

SEQ ID NO: 2587693 - DNA, 16 bp, Homo sapiens
accctgtgatggggcc

SEQ ID NO: 2587694 - DNA, 17 bp, Homo sapiens
accctgttaccattttg

SEQ ID NO: 2587695 - DNA, 15 bp, Homo sapiens
accctgtttcctgag

SEQ ID NO: 2587696 - DNA, 16 bp, Homo sapiens
accctgttttatactg

SEQ ID NO: 2587697 - DNA, 22 bp, Homo sapiens
acccttaccccttagcctccct

SEQ ID NO: 2587698 - DNA, 20 bp, Homo sapiens
acccttcccttgagccctct

SEQ ID NO: 2587699 - DNA, 19 bp, Homo sapiens
acccttcctcaccacttcc

SEQ ID NO: 2587700 - DNA, 14 bp, Homo sapiens
acccttctttcctc

SEQ ID NO: 2587701 - DNA, 16 bp, Homo sapiens
acccttctttcctctt

SEQ ID NO: 2587702 - DNA, 20 bp, Homo sapiens
acccttctttcctcttcccc

SEQ ID NO: 2587703 - DNA, 11 bp, Homo sapiens
acctcctgcct

SEQ ID NO: 2587704 - DNA, 12 bp, Homo sapiens
acctcctgcctc

SEQ ID NO: 2587705 - DNA, 13 bp, Homo sapiens
acctcctgcctcg

SEQ ID NO: 2587706 - DNA, 23 bp, Homo sapiens
acctcctgcctcgaactggctgc

SEQ ID NO: 2587707 - DNA, 21 bp, Homo sapiens
acctccttgtaacatcaggga

SEQ ID NO: 2587708 - DNA, 18 bp, Homo sapiens
acctcgctggactctcag

SEQ ID NO: 2587709 - DNA, 11 bp, Homo sapiens
acctctccaag

SEQ ID NO: 2587710 - DNA, 15 bp, Homo sapiens
acctctccatcttca

SEQ ID NO: 2587711 - DNA, 19 bp, Homo sapiens
acctctccatcttcagctt

SEQ ID NO: 2587712 - DNA, 15 bp, Homo sapiens
acctctcccttggat

SEQ ID NO: 2587713 - DNA, 14 bp, Homo sapiens
acctctctttttca

SEQ ID NO: 2587714 - DNA, 21 bp, Homo sapiens
acctctgcacaagctgcaccc

SEQ ID NO: 2587715 - DNA, 15 bp, Homo sapiens
acctctgcagcaata

SEQ ID NO: 2587716 - DNA, 12 bp, Homo sapiens
acctctgccaga

SEQ ID NO: 2587717 - DNA, 12 bp, Homo sapiens
acctctgctctg

SEQ ID NO: 2587718 - DNA, 14 bp, Homo sapiens
acctctgctctgag

SEQ ID NO: 2587719 - DNA, 22 bp, Homo sapiens
acctctgctctgaggcttccag

SEQ ID NO: 2587720 - DNA, 14 bp, Homo sapiens
acctctggactggc

SEQ ID NO: 2587721 - DNA, 19 bp, Homo sapiens
acctctggactggctagag

SEQ ID NO: 2587722 - DNA, 22 bp, Homo sapiens
acctctgtcttggctttcatgt

SEQ ID NO: 2587723 - DNA, 12 bp, Homo sapiens
acctctgtgtgc

SEQ ID NO: 2587724 - DNA, 15 bp, Homo sapiens
acctctgttcagtgt

SEQ ID NO: 2587725 - DNA, 14 bp, Homo sapiens
acctctgttgtcct

SEQ ID NO: 2587726 - DNA, 17 bp, Homo sapiens
acctctgttgtcctccc

SEQ ID NO: 2587727 - DNA, 15 bp, Homo sapiens
acctcttcacccccc

SEQ ID NO: 2587728 - DNA, 17 bp, Homo sapiens
acctcttcagaggccct

SEQ ID NO: 2587729 - DNA, 13 bp, Homo sapiens
acctcttccccag

SEQ ID NO: 2587730 - DNA, 22 bp, Homo sapiens
acctcttccccagaaaggagac

SEQ ID NO: 2587731 - DNA, 19 bp, Homo sapiens
acctctttattttttgatt

SEQ ID NO: 2587732 - DNA, 20 bp, Homo sapiens
acctgaaaacactgtgcaca

SEQ ID NO: 2587733 - DNA, 21 bp, Homo sapiens
acctgaaaacactgtgcacat

SEQ ID NO: 2587734 - DNA, 12 bp, Homo sapiens
acctgaaaagta

SEQ ID NO: 2587735 - DNA, 18 bp, Homo sapiens
acctgaagactcattctt

SEQ ID NO: 2587736 - DNA, 15 bp, Homo sapiens
acctgaagttcacca

SEQ ID NO: 2587737 - DNA, 19 bp, Homo sapiens
acctgacactcccttgggc

SEQ ID NO: 2587738 - DNA, 16 bp, Homo sapiens
acctgactctgaaatc

SEQ ID NO: 2587739 - DNA, 22 bp, Homo sapiens
acctgactctgaaatctgaaga

SEQ ID NO: 2587740 - DNA, 17 bp, Homo sapiens
acctgagccccaaaagg

SEQ ID NO: 2587741 - DNA, 21 bp, Homo sapiens
acctgagcccggatgcttctc

SEQ ID NO: 2587742 - DNA, 19 bp, Homo sapiens
acctgagctagaagctgga

SEQ ID NO: 2587743 - DNA, 13 bp, Homo sapiens
acctgaggaagcg

SEQ ID NO: 2587744 - DNA, 20 bp, Homo sapiens
acctgaggcccttctctcca

SEQ ID NO: 2587745 - DNA, 22 bp, Homo sapiens
acctgaggcccttctctccagc

SEQ ID NO: 2587746 - DNA, 23 bp, Homo sapiens
acctgagggcagaaaggttctgc

SEQ ID NO: 2587747 - DNA, 14 bp, Homo sapiens
acctgaggggcctc

SEQ ID NO: 2587748 - DNA, 22 bp, Homo sapiens
acctgaggtgggcccaggacca

SEQ ID NO: 2587749 - DNA, 23 bp, Homo sapiens
acctgaggtgggcccaggaccag

SEQ ID NO: 2587750 - DNA, 19 bp, Homo sapiens
acctgattcaactaaaaaa

SEQ ID NO: 2587751 - DNA, 16 bp, Homo sapiens
acctgattttttttcc

SEQ ID NO: 2587752 - DNA, 20 bp, Homo sapiens
acctgattttttttcctttt

SEQ ID NO: 2587753 - DNA, 23 bp, Homo sapiens
acctgcactggggagcccgtctc

SEQ ID NO: 2587754 - DNA, 21 bp, Homo sapiens
acctgccactcacacagccag

SEQ ID NO: 2587755 - DNA, 14 bp, Homo sapiens
acctgccagcctgg

SEQ ID NO: 2587756 - DNA, 18 bp, Homo sapiens
acctgccagcctggcttc

SEQ ID NO: 2587757 - DNA, 11 bp, Homo sapiens
acctgccaggg

SEQ ID NO: 2587758 - DNA, 14 bp, Homo sapiens
accttgtgcctggc

SEQ ID NO: 2587759 - DNA, 20 bp, Homo sapiens
accttgtggcaagcccctgc

SEQ ID NO: 2587760 - DNA, 16 bp, Homo sapiens
accttgttggagcctg

SEQ ID NO: 2587761 - DNA, 17 bp, Homo sapiens
accttgttggagcctgc

SEQ ID NO: 2587762 - DNA, 14 bp, Homo sapiens
acctttagggcagc

SEQ ID NO: 2587763 - DNA, 15 bp, Homo sapiens
acctttagggcagct

SEQ ID NO: 2587764 - DNA, 15 bp, Homo sapiens
acctttattaaaatc

SEQ ID NO: 2587765 - DNA, 17 bp, Homo sapiens
acctttattaaaatctt

SEQ ID NO: 2587766 - DNA, 16 bp, Homo sapiens
acctttattgtgatct

SEQ ID NO: 2587767 - DNA, 18 bp, Homo sapiens
acctttattgtgatctat

SEQ ID NO: 2587768 - DNA, 18 bp, Homo sapiens
acctttcccatcttccaa

SEQ ID NO: 2587769 - DNA, 23 bp, Homo sapiens
acctttgtattctctcctgtacc

SEQ ID NO: 2587770 - DNA, 13 bp, Homo sapiens
acctttgtcccca

SEQ ID NO: 2587771 - DNA, 12 bp, Homo sapiens
accttttaacac

SEQ ID NO: 2587772 - DNA, 21 bp, Homo sapiens
accttttaattaatgaaatat

SEQ ID NO: 2587773 - DNA, 15 bp, Homo sapiens
accttttatccactt

SEQ ID NO: 2587774 - DNA, 19 bp, Homo sapiens
accttttgaagtagtttgt

SEQ ID NO: 2587775 - DNA, 16 bp, Homo sapiens
accttttttatacata

SEQ ID NO: 2587776 - DNA, 22 bp, Homo sapiens
acgaatacttttgccctttgat

SEQ ID NO: 2587777 - DNA, 19 bp, Homo sapiens
acgacaaggaaaggcaaat

SEQ ID NO: 2587778 - DNA, 20 bp, Homo sapiens
acgagaccctacaggagagg

SEQ ID NO: 2587779 - DNA, 20 bp, Homo sapiens
acgagaggggaagagtgtac

SEQ ID NO: 2587780 - DNA, 19 bp, Homo sapiens
acgagcaggctactgtcag

SEQ ID NO: 2587781 - DNA, 13 bp, Homo sapiens
acgaggccctcgg

SEQ ID NO: 2587782 - DNA, 20 bp, Homo sapiens
acgaggccctcgggcccagc

SEQ ID NO: 2587783 - DNA, 14 bp, Homo sapiens
acgaggtatgaggt

SEQ ID NO: 2587784 - DNA, 15 bp, Homo sapiens
acgatggcacccagt

SEQ ID NO: 2587785 - DNA, 14 bp, Homo sapiens
acgatttaattctc

SEQ ID NO: 2587786 - DNA, 18 bp, Homo sapiens
acgatttagaaagaagcc

SEQ ID NO: 2587787 - DNA, 20 bp, Homo sapiens
acgatttctgtttagataat

SEQ ID NO: 2587788 - DNA, 13 bp, Homo sapiens
acgcacacacaca

SEQ ID NO: 2587789 - DNA, 20 bp, Homo sapiens
acgcacacacacacacagga

SEQ ID NO: 2587790 - DNA, 22 bp, Homo sapiens
acgcacacgtacttaaatgaaa

SEQ ID NO: 2587791 - DNA, 15 bp, Homo sapiens
acgcacagccaagga

SEQ ID NO: 2587792 - DNA, 15 bp, Homo sapiens
acgcacctcccatcc

SEQ ID NO: 2587793 - DNA, 15 bp, Homo sapiens
acgcacgcacacaca

SEQ ID NO: 2587794 - DNA, 16 bp, Homo sapiens
acgcacgcacacacac

SEQ ID NO: 2587795 - DNA, 21 bp, Homo sapiens
acgcactccatgagcacccca

SEQ ID NO: 2587796 - DNA, 14 bp, Homo sapiens
acgcagccctagag

SEQ ID NO: 2587797 - DNA, 19 bp, Homo sapiens
acgcagccctagagcctgc

SEQ ID NO: 2587798 - DNA, 23 bp, Homo sapiens
acgcagccctagagcctgcctgg

SEQ ID NO: 2587799 - DNA, 16 bp, Homo sapiens
acgcaggaactcccag

SEQ ID NO: 2587800 - DNA, 18 bp, Homo sapiens
acgccactgcactatagc

SEQ ID NO: 2587801 - DNA, 17 bp, Homo sapiens
acgccagattctttcct

SEQ ID NO: 2587802 - DNA, 14 bp, Homo sapiens
acgccatcccagcc

SEQ ID NO: 2587803 - DNA, 16 bp, Homo sapiens
acgccatcccagcccc

SEQ ID NO: 2587804 - DNA, 18 bp, Homo sapiens
acgccatcccagccccaa

SEQ ID NO: 2587805 - DNA, 16 bp, Homo sapiens
acgcccatgtgtgagt

SEQ ID NO: 2587806 - DNA, 20 bp, Homo sapiens
acgccgccctaaaagcacac

SEQ ID NO: 2587807 - DNA, 21 bp, Homo sapiens
acgccggggacagaggcctgc

SEQ ID NO: 2587808 - DNA, 13 bp, Homo sapiens
acgcctgaggaac

SEQ ID NO: 2587809 - DNA, 21 bp, Homo sapiens
acgcctgaggaacccttacag

SEQ ID NO: 2587810 - DNA, 16 bp, Homo sapiens
acgcctgtaatcccag

SEQ ID NO: 2587811 - DNA, 18 bp, Homo sapiens
acgcctgtaatcccagca

SEQ ID NO: 2587812 - DNA, 20 bp, Homo sapiens
acgcctgtaatcccagcact

SEQ ID NO: 2587813 - DNA, 14 bp, Homo sapiens
acgccttgttcttg

SEQ ID NO: 2587814 - DNA, 18 bp, Homo sapiens
acgccttgttcttggcca

SEQ ID NO: 2587815 - DNA, 20 bp, Homo sapiens
acgcgtgcacacaccagagc

SEQ ID NO: 2587816 - DNA, 21 bp, Homo sapiens
acgcgtgtgtacacgggactg

SEQ ID NO: 2587817 - DNA, 17 bp, Homo sapiens
acgctacccgggaaggg

SEQ ID NO: 2587818 - DNA, 18 bp, Homo sapiens
acgctacccgggaagggg

SEQ ID NO: 2587819 - DNA, 22 bp, Homo sapiens
acgctcctccctctgaggctgt

SEQ ID NO: 2587820 - DNA, 15 bp, Homo sapiens
acgctgaataaatgt

SEQ ID NO: 2587821 - DNA, 16 bp, Homo sapiens
acgctgaataaatgtc

SEQ ID NO: 2587822 - DNA, 23 bp, Homo sapiens
acgctggaccttgaactgggtac

SEQ ID NO: 2587823 - DNA, 18 bp, Homo sapiens
acgctggagtgcagtgag

SEQ ID NO: 2587824 - DNA, 19 bp, Homo sapiens
actaatcgaactatgaact

SEQ ID NO: 2587825 - DNA, 18 bp, Homo sapiens
actaatggggcggtgaga

SEQ ID NO: 2587826 - DNA, 22 bp, Homo sapiens
actaattgtataacaggttatt

SEQ ID NO: 2587827 - DNA, 21 bp, Homo sapiens
actacaaaaaagttgttaact

SEQ ID NO: 2587828 - DNA, 13 bp, Homo sapiens
actacaaaatttg

SEQ ID NO: 2587829 - DNA, 17 bp, Homo sapiens
actacaatttaaagcaa

SEQ ID NO: 2587830 - DNA, 15 bp, Homo sapiens
actacacattcaata

SEQ ID NO: 2587831 - DNA, 17 bp, Homo sapiens
actacactccagcctga

SEQ ID NO: 2587832 - DNA, 19 bp, Homo sapiens
actacactccagcctgagc

SEQ ID NO: 2587833 - DNA, 20 bp, Homo sapiens
actacactccagcctgagca

SEQ ID NO: 2587834 - DNA, 15 bp, Homo sapiens
actacaggcacccac

SEQ ID NO: 2587835 - DNA, 16 bp, Homo sapiens
actacagtcctcccat

SEQ ID NO: 2587836 - DNA, 17 bp, Homo sapiens
actacagtcctcccatc

SEQ ID NO: 2587837 - DNA, 23 bp, Homo sapiens
actacataaactgactttatcct

SEQ ID NO: 2587838 - DNA, 19 bp, Homo sapiens
actacatgtggtttataga

SEQ ID NO: 2587839 - DNA, 11 bp, Homo sapiens
actacattctg

SEQ ID NO: 2587840 - DNA, 14 bp, Homo sapiens
actacattctgtta

SEQ ID NO: 2587841 - DNA, 15 bp, Homo sapiens
actacattctgttaa

SEQ ID NO: 2587842 - DNA, 13 bp, Homo sapiens
actacctgtcaag

SEQ ID NO: 2587843 - DNA, 18 bp, Homo sapiens
actaccttggttccccca

SEQ ID NO: 2587844 - DNA, 15 bp, Homo sapiens
actactcagggaatg

SEQ ID NO: 2587845 - DNA, 19 bp, Homo sapiens
actactcctctgcagtgcc

SEQ ID NO: 2587846 - DNA, 19 bp, Homo sapiens
actactgtggaaaaatatt

SEQ ID NO: 2587847 - DNA, 21 bp, Homo sapiens
actactgtggaaaaatattta

SEQ ID NO: 2587848 - DNA, 15 bp, Homo sapiens
actactgtgttcctg

SEQ ID NO: 2587849 - DNA, 21 bp, Homo sapiens
actactgtgttcctggcaata

SEQ ID NO: 2587850 - DNA, 14 bp, Homo sapiens
actagaacctggag

SEQ ID NO: 2587851 - DNA, 13 bp, Homo sapiens
actagaactctcc

SEQ ID NO: 2587852 - DNA, 14 bp, Homo sapiens
actagaagggccag

SEQ ID NO: 2587853 - DNA, 23 bp, Homo sapiens
actagaagggccagtcctgcctg

SEQ ID NO: 2587854 - DNA, 20 bp, Homo sapiens
actagacattctgtcgcctt

SEQ ID NO: 2587855 - DNA, 17 bp, Homo sapiens
actagagatctggtttt

SEQ ID NO: 2587856 - DNA, 23 bp, Homo sapiens
actagagatctggttttgctatt

SEQ ID NO: 2587857 - DNA, 16 bp, Homo sapiens
actagagcagccctgg

SEQ ID NO: 2587858 - DNA, 14 bp, Homo sapiens
actagaggcaggga

SEQ ID NO: 2587859 - DNA, 15 bp, Homo sapiens
actagaggcagggag

SEQ ID NO: 2587860 - DNA, 19 bp, Homo sapiens
actagagggacctctccca

SEQ ID NO: 2587861 - DNA, 21 bp, Homo sapiens
actagagggacctctcccagg

SEQ ID NO: 2587862 - DNA, 22 bp, Homo sapiens
actagagggacctctcccaggg

SEQ ID NO: 2587863 - DNA, 15 bp, Homo sapiens
actagatggcgagca

SEQ ID NO: 2587864 - DNA, 18 bp, Homo sapiens
actagattacattcagtt

SEQ ID NO: 2587865 - DNA, 15 bp, Homo sapiens
actagccaccaactc

SEQ ID NO: 2587866 - DNA, 15 bp, Homo sapiens
actagcccaatgaaa

SEQ ID NO: 2587867 - DNA, 16 bp, Homo sapiens
actaggactctgaggc

SEQ ID NO: 2587868 - DNA, 17 bp, Homo sapiens
actagggagaaggtttc

SEQ ID NO: 2587869 - DNA, 19 bp, Homo sapiens
actagggattcaggctgct

SEQ ID NO: 2587870 - DNA, 20 bp, Homo sapiens
actagttgtgaccttagtgt

SEQ ID NO: 2587871 - DNA, 21 bp, Homo sapiens
actagttgtgaccttagtgtt

SEQ ID NO: 2587872 - DNA, 17 bp, Homo sapiens
actagttttgtgccagc

SEQ ID NO: 2587873 - DNA, 12 bp, Homo sapiens
actataatgtaa

SEQ ID NO: 2587874 - DNA, 18 bp, Homo sapiens
actatatctgtatataaa

SEQ ID NO: 2587875 - DNA, 13 bp, Homo sapiens
actatatgtgaat

SEQ ID NO: 2587876 - DNA, 16 bp, Homo sapiens
actatcttggtgaatt

SEQ ID NO: 2587877 - DNA, 22 bp, Homo sapiens
actatctttttgcttacagttt

SEQ ID NO: 2587878 - DNA, 19 bp, Homo sapiens
actatgaacttctctcaga

SEQ ID NO: 2587879 - DNA, 21 bp, Homo sapiens
actatgaacttctctcagact

SEQ ID NO: 2587880 - DNA, 22 bp, Homo sapiens
actatgaatctattatactgta

SEQ ID NO: 2587881 - DNA, 23 bp, Homo sapiens
actatgaatgggcaaaactgaat

SEQ ID NO: 2587882 - DNA, 14 bp, Homo sapiens
actatgttgcccag

SEQ ID NO: 2587883 - DNA, 16 bp, Homo sapiens
actatgttgcccaggc

SEQ ID NO: 2587884 - DNA, 19 bp, Homo sapiens
actatgttgcccaggcagg

SEQ ID NO: 2587885 - DNA, 14 bp, Homo sapiens
actattaagaggca

SEQ ID NO: 2587886 - DNA, 17 bp, Homo sapiens
actattataatttaatg

SEQ ID NO: 2587887 - DNA, 11 bp, Homo sapiens
actatttaaag

SEQ ID NO: 2587888 - DNA, 15 bp, Homo sapiens
actatttatctgtgt

SEQ ID NO: 2587889 - DNA, 16 bp, Homo sapiens
actatttgtctttcag

SEQ ID NO: 2587890 - DNA, 18 bp, Homo sapiens
actatttgtctttcagga

SEQ ID NO: 2587891 - DNA, 17 bp, Homo sapiens
actattttattttctaa

SEQ ID NO: 2587892 - DNA, 18 bp, Homo sapiens
actatttttactgccact

SEQ ID NO: 2587893 - DNA, 15 bp, Homo sapiens
actcaaaacttaaca

SEQ ID NO: 2587894 - DNA, 19 bp, Homo sapiens
actcaaaatatttgtacat

SEQ ID NO: 2587895 - DNA, 16 bp, Homo sapiens
actcaaactcttaaaa

SEQ ID NO: 2587896 - DNA, 23 bp, Homo sapiens
actcaaactgaggaatttcacct

SEQ ID NO: 2587897 - DNA, 18 bp, Homo sapiens
actcaaatgctcagacca

SEQ ID NO: 2587898 - DNA, 12 bp, Homo sapiens
actcaaatgctt

SEQ ID NO: 2587899 - DNA, 19 bp, Homo sapiens
actcaaatgcttggcttct

SEQ ID NO: 2587900 - DNA, 16 bp, Homo sapiens
actcaacatgagtcaa

SEQ ID NO: 2587901 - DNA, 21 bp, Homo sapiens
actccaattaaggattttatg

SEQ ID NO: 2587902 - DNA, 17 bp, Homo sapiens
actccagactctctgtg

SEQ ID NO: 2587903 - DNA, 19 bp, Homo sapiens
actccagcctggcgacaga

SEQ ID NO: 2587904 - DNA, 18 bp, Homo sapiens
actccagcctgggcaaca

SEQ ID NO: 2587905 - DNA, 18 bp, Homo sapiens
actccagcctgggcgaca

SEQ ID NO: 2587906 - DNA, 14 bp, Homo sapiens
actccaggagagga

SEQ ID NO: 2587907 - DNA, 19 bp, Homo sapiens
actccagtgagacagctct

SEQ ID NO: 2587908 - DNA, 14 bp, Homo sapiens
actccagtgccagc

SEQ ID NO: 2587909 - DNA, 16 bp, Homo sapiens
actccagtggtgaaga

SEQ ID NO: 2587910 - DNA, 20 bp, Homo sapiens
actccagttaaaaaaaattt

SEQ ID NO: 2587911 - DNA, 19 bp, Homo sapiens
actcccaagtctacagagt

SEQ ID NO: 2587912 - DNA, 13 bp, Homo sapiens
actcccaggcagc

SEQ ID NO: 2587913 - DNA, 22 bp, Homo sapiens
actcccctgcactggagtccag

SEQ ID NO: 2587914 - DNA, 13 bp, Homo sapiens
actcccctgctgg

SEQ ID NO: 2587915 - DNA, 17 bp, Homo sapiens
actcccctgctgggtgt

SEQ ID NO: 2587916 - DNA, 15 bp, Homo sapiens
actccccttgagctg

SEQ ID NO: 2587917 - DNA, 17 bp, Homo sapiens
actccccttgagctgag

SEQ ID NO: 2587918 - DNA, 18 bp, Homo sapiens
actccctggctctcagaa

SEQ ID NO: 2587919 - DNA, 15 bp, Homo sapiens
actcccttcccataa

SEQ ID NO: 2587920 - DNA, 23 bp, Homo sapiens
actcccttcccatgacccaggct

SEQ ID NO: 2587921 - DNA, 22 bp, Homo sapiens
actcccttctacctgccactca

SEQ ID NO: 2587922 - DNA, 14 bp, Homo sapiens
actcccttgggctc

SEQ ID NO: 2587923 - DNA, 14 bp, Homo sapiens
actccggccctcct

SEQ ID NO: 2587924 - DNA, 15 bp, Homo sapiens
actccggccctccta

SEQ ID NO: 2587925 - DNA, 15 bp, Homo sapiens
actccggtgtgcctg

SEQ ID NO: 2587926 - DNA, 15 bp, Homo sapiens
actccgtctcaagga

SEQ ID NO: 2587927 - DNA, 17 bp, Homo sapiens
actcctacacctaactc

SEQ ID NO: 2587928 - DNA, 14 bp, Homo sapiens
actcctacctcagc

SEQ ID NO: 2587929 - DNA, 17 bp, Homo sapiens
actcctacctcagccta

SEQ ID NO: 2587930 - DNA, 20 bp, Homo sapiens
actcctagagaacgcagccc

SEQ ID NO: 2587931 - DNA, 22 bp, Homo sapiens
actcctagagaacgcagcccta

SEQ ID NO: 2587932 - DNA, 23 bp, Homo sapiens
actcctagagaacgcagccctag

SEQ ID NO: 2587933 - DNA, 18 bp, Homo sapiens
actcctaggcaggacatg

SEQ ID NO: 2587934 - DNA, 18 bp, Homo sapiens
actcctatgatctcaggt

SEQ ID NO: 2587935 - DNA, 12 bp, Homo sapiens
actcctctgcag

SEQ ID NO: 2587936 - DNA, 14 bp, Homo sapiens
actcctctgtccag

SEQ ID NO: 2587937 - DNA, 19 bp, Homo sapiens
actcctgacagtcttgtgc

SEQ ID NO: 2587938 - DNA, 21 bp, Homo sapiens
actcctgacagtcttgtgctt

SEQ ID NO: 2587939 - DNA, 19 bp, Homo sapiens
actcctgaggacagctgtc

SEQ ID NO: 2587940 - DNA, 21 bp, Homo sapiens
actcctgaggacagctgtcct

SEQ ID NO: 2587941 - DNA, 13 bp, Homo sapiens
actcctgcaaaat

SEQ ID NO: 2587942 - DNA, 21 bp, Homo sapiens
actcctgcaggcagccaggcc

SEQ ID NO: 2587943 - DNA, 21 bp, Homo sapiens
actcctgcccctgttctcttc

SEQ ID NO: 2587944 - DNA, 11 bp, Homo sapiens
actcctggcct

SEQ ID NO: 2587945 - DNA, 16 bp, Homo sapiens
actcctgggttgagct

SEQ ID NO: 2587946 - DNA, 17 bp, Homo sapiens
actccttgagagaccag

SEQ ID NO: 2587947 - DNA, 18 bp, Homo sapiens
actccttgagagaccagg

SEQ ID NO: 2587948 - DNA, 21 bp, Homo sapiens
actccttgagagaccaggcaa

SEQ ID NO: 2587949 - DNA, 23 bp, Homo sapiens
actccttgagagaccaggcaaag

SEQ ID NO: 2587950 - DNA, 19 bp, Homo sapiens
actccttgtggtttatgtc

SEQ ID NO: 2587951 - DNA, 14 bp, Homo sapiens
actcgcccgcccac

SEQ ID NO: 2587952 - DNA, 17 bp, Homo sapiens
actcgcccgcccactgt

SEQ ID NO: 2587953 - DNA, 20 bp, Homo sapiens
actcgcccgcccactgtcct

SEQ ID NO: 2587954 - DNA, 21 bp, Homo sapiens
actcgcccgcccactgtcctg

SEQ ID NO: 2587955 - DNA, 16 bp, Homo sapiens
actctaaaaggttcag

SEQ ID NO: 2587956 - DNA, 18 bp, Homo sapiens
actctaaaaggttcaggg

SEQ ID NO: 2587957 - DNA, 13 bp, Homo sapiens
actctacataatt

SEQ ID NO: 2587958 - DNA, 18 bp, Homo sapiens
actctaccctcccacccc

SEQ ID NO: 2587959 - DNA, 19 bp, Homo sapiens
actctaccctcccaccccc

SEQ ID NO: 2587960 - DNA, 15 bp, Homo sapiens
actctagggaaaaac

SEQ ID NO: 2587961 - DNA, 18 bp, Homo sapiens
actctatagactctagga

SEQ ID NO: 2587962 - DNA, 14 bp, Homo sapiens
actctcacatgttt

SEQ ID NO: 2587963 - DNA, 19 bp, Homo sapiens
actctcaggatcaagaaag

SEQ ID NO: 2587964 - DNA, 14 bp, Homo sapiens
actctcagtctctg

SEQ ID NO: 2587965 - DNA, 12 bp, Homo sapiens
actctcctagag

SEQ ID NO: 2587966 - DNA, 21 bp, Homo sapiens
actctcctagagacagaagca

SEQ ID NO: 2587967 - DNA, 13 bp, Homo sapiens
actctcctctgct

SEQ ID NO: 2587968 - DNA, 17 bp, Homo sapiens
actctgaagcctctggg

SEQ ID NO: 2587969 - DNA, 18 bp, Homo sapiens
actctgaagcctctggga

SEQ ID NO: 2587970 - DNA, 19 bp, Homo sapiens
actctgaagcctctgggaa

SEQ ID NO: 2587971 - DNA, 20 bp, Homo sapiens
actctgaagggcatcatgca

SEQ ID NO: 2587972 - DNA, 19 bp, Homo sapiens
actctgcactactcctctg

SEQ ID NO: 2587973 - DNA, 12 bp, Homo sapiens
actctgccccct

SEQ ID NO: 2587974 - DNA, 16 bp, Homo sapiens
actctgcctcctcttc

SEQ ID NO: 2587975 - DNA, 16 bp, Homo sapiens
actctgcctctgcctg

SEQ ID NO: 2587976 - DNA, 14 bp, Homo sapiens
actctggcttccag

SEQ ID NO: 2587977 - DNA, 14 bp, Homo sapiens
actctgggctccag

SEQ ID NO: 2587978 - DNA, 17 bp, Homo sapiens
actctgggctgctaccc

SEQ ID NO: 2587979 - DNA, 17 bp, Homo sapiens
actctggggtttttact

SEQ ID NO: 2587980 - DNA, 18 bp, Homo sapiens
actctggtcttctttggg

SEQ ID NO: 2587981 - DNA, 14 bp, Homo sapiens
actctgtcagatgg

SEQ ID NO: 2587982 - DNA, 16 bp, Homo sapiens
actctgtcagatggga

SEQ ID NO: 2587983 - DNA, 19 bp, Homo sapiens
actctgtctcaaaaaaaca

SEQ ID NO: 2587984 - DNA, 18 bp, Homo sapiens
actctgtctcagtccatg

SEQ ID NO: 2587985 - DNA, 20 bp, Homo sapiens
actctgtctcagtccatgaa

SEQ ID NO: 2587986 - DNA, 20 bp, Homo sapiens
actctgtgcctgaccttgag

SEQ ID NO: 2587987 - DNA, 17 bp, Homo sapiens
actctgtggggccttgg

SEQ ID NO: 2587988 - DNA, 22 bp, Homo sapiens
actgagatgtgaacacatcagc

SEQ ID NO: 2587989 - DNA, 22 bp, Homo sapiens
actgagcccccccaacactgtg

SEQ ID NO: 2587990 - DNA, 16 bp, Homo sapiens
actgagctccatgtgc

SEQ ID NO: 2587991 - DNA, 23 bp, Homo sapiens
actgagctccatgtgccccctct

SEQ ID NO: 2587992 - DNA, 16 bp, Homo sapiens
actgagctcctctggg

SEQ ID NO: 2587993 - DNA, 18 bp, Homo sapiens
actgagcttctctgtgaa

SEQ ID NO: 2587994 - DNA, 16 bp, Homo sapiens
actgaggaattttctt

SEQ ID NO: 2587995 - DNA, 22 bp, Homo sapiens
actgaggcagacagcagctcag

SEQ ID NO: 2587996 - DNA, 15 bp, Homo sapiens
actgaggcagggaag

SEQ ID NO: 2587997 - DNA, 22 bp, Homo sapiens
actgaggccaaaagaggcctga

SEQ ID NO: 2587998 - DNA, 20 bp, Homo sapiens
actgagggaccaactgggcc

SEQ ID NO: 2587999 - DNA, 22 bp, Homo sapiens
actgagggaccaactgggccca

SEQ ID NO: 2588000 - DNA, 22 bp, Homo sapiens
actgagggactctgaagcctct

SEQ ID NO: 2588001 - DNA, 20 bp, Homo sapiens
actgagtaagaaatgctgcc

SEQ ID NO: 2588002 - DNA, 16 bp, Homo sapiens
actgagtccttaaaca

SEQ ID NO: 2588003 - DNA, 15 bp, Homo sapiens
actgataaagaaaga

SEQ ID NO: 2588004 - DNA, 16 bp, Homo sapiens
actgatagtgtccaaa

SEQ ID NO: 2588005 - DNA, 15 bp, Homo sapiens
actgatagttactgt

SEQ ID NO: 2588006 - DNA, 18 bp, Homo sapiens
actgatagttactgttgt

SEQ ID NO: 2588007 - DNA, 14 bp, Homo sapiens
actgatttttgtaa

SEQ ID NO: 2588008 - DNA, 14 bp, Homo sapiens
actgatttttgtga

SEQ ID NO: 2588009 - DNA, 21 bp, Homo sapiens
actgcaaatgtcatcagaact

SEQ ID NO: 2588010 - DNA, 22 bp, Homo sapiens
actgcaaatgtcatcagaactt

SEQ ID NO: 2588011 - DNA, 13 bp, Homo sapiens
actgcaacctccg

SEQ ID NO: 2588012 - DNA, 14 bp, Homo sapiens
actgcaacctccgc

SEQ ID NO: 2588013 - DNA, 17 bp, Homo sapiens
actgcacagagctctcc

SEQ ID NO: 2588014 - DNA, 23 bp, Homo sapiens
actgcacagagctctccagctcc

SEQ ID NO: 2588015 - DNA, 16 bp, Homo sapiens
actgcaccgggccaca

SEQ ID NO: 2588016 - DNA, 21 bp, Homo sapiens
actgcactatagcctaggtga

SEQ ID NO: 2588017 - DNA, 21 bp, Homo sapiens
actgcagacctgtcctcctgg

SEQ ID NO: 2588018 - DNA, 19 bp, Homo sapiens
actgcaggcatcacagcta

SEQ ID NO: 2588019 - DNA, 23 bp, Homo sapiens
actgcagggaaaattatttgcat

SEQ ID NO: 2588020 - DNA, 17 bp, Homo sapiens
actgcagggactgccag

SEQ ID NO: 2588021 - DNA, 18 bp, Homo sapiens
actgcatactttttaaat

SEQ ID NO: 2588022 - DNA, 21 bp, Homo sapiens
actgcatgtaccatttgcatg

SEQ ID NO: 2588023 - DNA, 21 bp, Homo sapiens
actgccaaagggaaatatcat

SEQ ID NO: 2588024 - DNA, 19 bp, Homo sapiens
actgccagatgctgatgtt

SEQ ID NO: 2588025 - DNA, 14 bp, Homo sapiens
actgcccaaagtgc

SEQ ID NO: 2588026 - DNA, 19 bp, Homo sapiens
actgcccaaagtgcttcca

SEQ ID NO: 2588027 - DNA, 15 bp, Homo sapiens
actgcccgagctggt

SEQ ID NO: 2588028 - DNA, 16 bp, Homo sapiens
actgcccgagctggtg

SEQ ID NO: 2588029 - DNA, 18 bp, Homo sapiens
actgcccgagctggtgca

SEQ ID NO: 2588030 - DNA, 19 bp, Homo sapiens
actgcccgagctggtgcat

SEQ ID NO: 2588031 - DNA, 15 bp, Homo sapiens
actgcccggcagggt

SEQ ID NO: 2588032 - DNA, 20 bp, Homo sapiens
actgcccggggcagctgcca

SEQ ID NO: 2588033 - DNA, 21 bp, Homo sapiens
actgcccggggcagctgccag

SEQ ID NO: 2588034 - DNA, 23 bp, Homo sapiens
actgccgaccgaggctggagctg

SEQ ID NO: 2588035 - DNA, 14 bp, Homo sapiens
actgcctaagccct

SEQ ID NO: 2588036 - DNA, 16 bp, Homo sapiens
actgcctcaggttcct

SEQ ID NO: 2588037 - DNA, 16 bp, Homo sapiens
actgcctctccctggc

SEQ ID NO: 2588038 - DNA, 14 bp, Homo sapiens
actgcctcttcctc

SEQ ID NO: 2588039 - DNA, 17 bp, Homo sapiens
actgcctgatggacctg

SEQ ID NO: 2588040 - DNA, 9 bp, Homo sapiens
actgcctgc

SEQ ID NO: 2588041 - DNA, 12 bp, Homo sapiens
actgcctgccca

SEQ ID NO: 2588042 - DNA, 16 bp, Homo sapiens
actgcctgcccacccg

SEQ ID NO: 2588043 - DNA, 18 bp, Homo sapiens
actgcgatcttcagagca

SEQ ID NO: 2588044 - DNA, 19 bp, Homo sapiens
actgcgatcttcagagcag

SEQ ID NO: 2588045 - DNA, 19 bp, Homo sapiens
actgcgggatggtcctggg

SEQ ID NO: 2588046 - DNA, 20 bp, Homo sapiens
actgcgggatggtcctgggg

SEQ ID NO: 2588047 - DNA, 21 bp, Homo sapiens
actgcgggatggtcctggggc

SEQ ID NO: 2588048 - DNA, 15 bp, Homo sapiens
actgctaaataaaat

SEQ ID NO: 2588049 - DNA, 19 bp, Homo sapiens
actgctaaataaaatttgt

SEQ ID NO: 2588050 - DNA, 20 bp, Homo sapiens
actgctaggcgagtgccagg

SEQ ID NO: 2588051 - DNA, 22 bp, Homo sapiens
actgctaggcgagtgccaggac

SEQ ID NO: 2588052 - DNA, 16 bp, Homo sapiens
actgctcaagaagaca

SEQ ID NO: 2588053 - DNA, 20 bp, Homo sapiens
actgctccccagccctggct

SEQ ID NO: 2588054 - DNA, 15 bp, Homo sapiens
actgctcttgtttct

SEQ ID NO: 2588055 - DNA, 18 bp, Homo sapiens
actgctcttgtttctttt

SEQ ID NO: 2588056 - DNA, 21 bp, Homo sapiens
actgctgctttttgaggtggc

SEQ ID NO: 2588057 - DNA, 18 bp, Homo sapiens
actgctgggactggccag

SEQ ID NO: 2588058 - DNA, 19 bp, Homo sapiens
actgcttcatgacattcct

SEQ ID NO: 2588059 - DNA, 17 bp, Homo sapiens
actgcttccagtgaggc

SEQ ID NO: 2588060 - DNA, 22 bp, Homo sapiens
actgcttccagtgaggctctgc

SEQ ID NO: 2588061 - DNA, 20 bp, Homo sapiens
actgcttcccatcctaccct

SEQ ID NO: 2588062 - DNA, 16 bp, Homo sapiens
actgcttgtttcctag

SEQ ID NO: 2588063 - DNA, 23 bp, Homo sapiens
actgctttctttcgtttgtttgt

SEQ ID NO: 2588064 - DNA, 14 bp, Homo sapiens
actgcttttggtct

SEQ ID NO: 2588065 - DNA, 15 bp, Homo sapiens
actgcttttggtctg

SEQ ID NO: 2588066 - DNA, 15 bp, Homo sapiens
actggaaccagggag

SEQ ID NO: 2588067 - DNA, 14 bp, Homo sapiens
actggaagcacagc

SEQ ID NO: 2588068 - DNA, 16 bp, Homo sapiens
actggaagttttgcat

SEQ ID NO: 2588069 - DNA, 21 bp, Homo sapiens
actggaccactgggcaatgat

SEQ ID NO: 2588070 - DNA, 16 bp, Homo sapiens
actggactccggccct

SEQ ID NO: 2588071 - DNA, 17 bp, Homo sapiens
actggagcatctgactc

SEQ ID NO: 2588072 - DNA, 14 bp, Homo sapiens
actggaggtcacat

SEQ ID NO: 2588073 - DNA, 12 bp, Homo sapiens
actggagtccag

SEQ ID NO: 2588074 - DNA, 17 bp, Homo sapiens
actggagtccagtctct

SEQ ID NO: 2588075 - DNA, 13 bp, Homo sapiens
actggagtgcagg

SEQ ID NO: 2588076 - DNA, 16 bp, Homo sapiens
actggagttacattaa

SEQ ID NO: 2588077 - DNA, 13 bp, Homo sapiens
actggatgaagat

SEQ ID NO: 2588078 - DNA, 18 bp, Homo sapiens
actggatgcagaaacagt

SEQ ID NO: 2588079 - DNA, 13 bp, Homo sapiens
actggcaaacttc

SEQ ID NO: 2588080 - DNA, 21 bp, Homo sapiens
actggcacagttttctgagaa

SEQ ID NO: 2588081 - DNA, 14 bp, Homo sapiens
actggcagcatctt

SEQ ID NO: 2588082 - DNA, 21 bp, Homo sapiens
actggcatggatatagtttta

SEQ ID NO: 2588083 - DNA, 16 bp, Homo sapiens
actggccacagttgtt

SEQ ID NO: 2588084 - DNA, 14 bp, Homo sapiens
actggccaccaggc

SEQ ID NO: 2588085 - DNA, 17 bp, Homo sapiens
actgtataaataggaga

SEQ ID NO: 2588086 - DNA, 15 bp, Homo sapiens
actgtatttgtgact

SEQ ID NO: 2588087 - DNA, 23 bp, Homo sapiens
actgtatttgtgactaattgtat

SEQ ID NO: 2588088 - DNA, 19 bp, Homo sapiens
actgtcaaaataattttat

SEQ ID NO: 2588089 - DNA, 15 bp, Homo sapiens
actgtcaccctccac

SEQ ID NO: 2588090 - DNA, 16 bp, Homo sapiens
actgtcactgtttctc

SEQ ID NO: 2588091 - DNA, 18 bp, Homo sapiens
actgtcactttgctctgg

SEQ ID NO: 2588092 - DNA, 21 bp, Homo sapiens
actgtcagctcccctcggaga

SEQ ID NO: 2588093 - DNA, 13 bp, Homo sapiens
actgtccagagag

SEQ ID NO: 2588094 - DNA, 13 bp, Homo sapiens
actgtccctcaaa

SEQ ID NO: 2588095 - DNA, 12 bp, Homo sapiens
actgtcctgggc

SEQ ID NO: 2588096 - DNA, 13 bp, Homo sapiens
actgtcctgggcg

SEQ ID NO: 2588097 - DNA, 18 bp, Homo sapiens
actgtctcagtttcactt

SEQ ID NO: 2588098 - DNA, 13 bp, Homo sapiens
actgtctggtttt

SEQ ID NO: 2588099 - DNA, 18 bp, Homo sapiens
actgtctggttttaacaa

SEQ ID NO: 2588100 - DNA, 19 bp, Homo sapiens
actgtctggttttaacaat

SEQ ID NO: 2588101 - DNA, 12 bp, Homo sapiens
actgtcttcagt

SEQ ID NO: 2588102 - DNA, 13 bp, Homo sapiens
actgtgacaggca

SEQ ID NO: 2588103 - DNA, 19 bp, Homo sapiens
actgtgacaggcagcagag

SEQ ID NO: 2588104 - DNA, 23 bp, Homo sapiens
actgtgactctttttagggccag

SEQ ID NO: 2588105 - DNA, 11 bp, Homo sapiens
actgtgactga

SEQ ID NO: 2588106 - DNA, 13 bp, Homo sapiens
actgtgatgccac

SEQ ID NO: 2588107 - DNA, 20 bp, Homo sapiens
actgtgcacatctgtgtctt

SEQ ID NO: 2588108 - DNA, 17 bp, Homo sapiens
actgtgccatgtgccag

SEQ ID NO: 2588109 - DNA, 13 bp, Homo sapiens
actgtgccctggt

SEQ ID NO: 2588110 - DNA, 14 bp, Homo sapiens
actgtgccctggtg

SEQ ID NO: 2588111 - DNA, 18 bp, Homo sapiens
actgtgccctggtggaga

SEQ ID NO: 2588112 - DNA, 21 bp, Homo sapiens
actgtgctaataacagtgcat

SEQ ID NO: 2588113 - DNA, 20 bp, Homo sapiens
actgtgctgagtctgaaggc

SEQ ID NO: 2588114 - DNA, 15 bp, Homo sapiens
actgtgctggagcca

SEQ ID NO: 2588115 - DNA, 15 bp, Homo sapiens
actgtggaggaagga

SEQ ID NO: 2588116 - DNA, 22 bp, Homo sapiens
actgtggaggaaggattgtaaa

SEQ ID NO: 2588117 - DNA, 23 bp, Homo sapiens
actgtggaggaaggattgtaaaa

SEQ ID NO: 2588118 - DNA, 17 bp, Homo sapiens
actgtggccgttatctg

SEQ ID NO: 2588119 - DNA, 12 bp, Homo sapiens
actgtggctgct

SEQ ID NO: 2588120 - DNA, 20 bp, Homo sapiens
actgtgggaaggccagctgc

SEQ ID NO: 2588121 - DNA, 23 bp, Homo sapiens
actgtgtacagtaaatggcttat

SEQ ID NO: 2588122 - DNA, 17 bp, Homo sapiens
actgtgtacataactga

SEQ ID NO: 2588123 - DNA, 21 bp, Homo sapiens
actgtgtattccaagacatgt

SEQ ID NO: 2588124 - DNA, 12 bp, Homo sapiens
actgtgttcctg

SEQ ID NO: 2588125 - DNA, 13 bp, Homo sapiens
actgttatttata

SEQ ID NO: 2588126 - DNA, 14 bp, Homo sapiens
actgttatttataa

SEQ ID NO: 2588127 - DNA, 16 bp, Homo sapiens
actgttcaagagcaca

SEQ ID NO: 2588128 - DNA, 20 bp, Homo sapiens
actgttccctctgctcctgg

SEQ ID NO: 2588129 - DNA, 19 bp, Homo sapiens
actgttctctgccctccaa

SEQ ID NO: 2588130 - DNA, 21 bp, Homo sapiens
actgttctctgccctccaaga

SEQ ID NO: 2588131 - DNA, 21 bp, Homo sapiens
actgttctcttcttgaacact

SEQ ID NO: 2588132 - DNA, 13 bp, Homo sapiens
actgttctgtgtc

SEQ ID NO: 2588133 - DNA, 17 bp, Homo sapiens
actgttctgtgtctttc

SEQ ID NO: 2588134 - DNA, 14 bp, Homo sapiens
actgttgaaaatta

SEQ ID NO: 2588135 - DNA, 20 bp, Homo sapiens
actgttgtaactaggctcag

SEQ ID NO: 2588136 - DNA, 19 bp, Homo sapiens
actgttgtgacctgaagtt

SEQ ID NO: 2588137 - DNA, 14 bp, Homo sapiens
actgtttctctgct

SEQ ID NO: 2588138 - DNA, 16 bp, Homo sapiens
actgtttctgtcagga

SEQ ID NO: 2588139 - DNA, 21 bp, Homo sapiens
actgtttgccttctactttta

SEQ ID NO: 2588140 - DNA, 17 bp, Homo sapiens
actgtttttacccatat

SEQ ID NO: 2588141 - DNA, 21 bp, Homo sapiens
actgtttttacccatatcccc

SEQ ID NO: 2588142 - DNA, 17 bp, Homo sapiens
actgttttttcctgagc

SEQ ID NO: 2588143 - DNA, 22 bp, Homo sapiens
acttaaaaaaatgacagatgtt

SEQ ID NO: 2588144 - DNA, 13 bp, Homo sapiens
acttaaaaaactt

SEQ ID NO: 2588145 - DNA, 15 bp, Homo sapiens
acttaaaaaatgtcc

SEQ ID NO: 2588146 - DNA, 14 bp, Homo sapiens
acttaaaaatggtt

SEQ ID NO: 2588147 - DNA, 21 bp, Homo sapiens
acttaaaaatggtttaaatgg

SEQ ID NO: 2588148 - DNA, 19 bp, Homo sapiens
acttaaaaatgtaaatatt

SEQ ID NO: 2588149 - DNA, 19 bp, Homo sapiens
acttaaatggaaaaaatga

SEQ ID NO: 2588150 - DNA, 14 bp, Homo sapiens
acttaacatattta

SEQ ID NO: 2588151 - DNA, 13 bp, Homo sapiens
acttaatctaaat

SEQ ID NO: 2588152 - DNA, 22 bp, Homo sapiens
acttaatttctttatgtaatct

SEQ ID NO: 2588153 - DNA, 17 bp, Homo sapiens
acttacactttatgcac

SEQ ID NO: 2588154 - DNA, 21 bp, Homo sapiens
acttaccgtgagcgacaaaga

SEQ ID NO: 2588155 - DNA, 19 bp, Homo sapiens
acttacctaaacagatata

SEQ ID NO: 2588156 - DNA, 20 bp, Homo sapiens
acttaccttcaataaagtat

SEQ ID NO: 2588157 - DNA, 16 bp, Homo sapiens
acttactgtacatgaa

SEQ ID NO: 2588158 - DNA, 22 bp, Homo sapiens
acttacttaccctcacctgtca

SEQ ID NO: 2588159 - DNA, 17 bp, Homo sapiens
acttataattttcctaa

SEQ ID NO: 2588160 - DNA, 15 bp, Homo sapiens
acttatattgtaaga

SEQ ID NO: 2588161 - DNA, 20 bp, Homo sapiens
acttattggaactctgcttg

SEQ ID NO: 2588162 - DNA, 16 bp, Homo sapiens
acttatttttgacagt

SEQ ID NO: 2588163 - DNA, 17 bp, Homo sapiens
acttatttttttctgat

SEQ ID NO: 2588164 - DNA, 19 bp, Homo sapiens
acttcaaaagtattttcct

SEQ ID NO: 2588165 - DNA, 21 bp, Homo sapiens
acttcaaaagtattttcctgt

SEQ ID NO: 2588166 - DNA, 13 bp, Homo sapiens
acttcaaggccca

SEQ ID NO: 2588167 - DNA, 12 bp, Homo sapiens
acttcacagagt

SEQ ID NO: 2588168 - DNA, 19 bp, Homo sapiens
acttcagactgaacatgta

SEQ ID NO: 2588169 - DNA, 15 bp, Homo sapiens
acttcagagagctgg

SEQ ID NO: 2588170 - DNA, 17 bp, Homo sapiens
acttcagagagctggta

SEQ ID NO: 2588171 - DNA, 13 bp, Homo sapiens
acttcagctctgt

SEQ ID NO: 2588172 - DNA, 23 bp, Homo sapiens
acttcagggcagggctctgatat

SEQ ID NO: 2588173 - DNA, 16 bp, Homo sapiens
acttcatcttctcagc

SEQ ID NO: 2588174 - DNA, 14 bp, Homo sapiens
acttcatgtcaact

SEQ ID NO: 2588175 - DNA, 19 bp, Homo sapiens
acttcattcttgaaagctg

SEQ ID NO: 2588176 - DNA, 21 bp, Homo sapiens
acttcattcttgaaagctgtg

SEQ ID NO: 2588177 - DNA, 18 bp, Homo sapiens
acttccaccagcctgcac

SEQ ID NO: 2588178 - DNA, 17 bp, Homo sapiens
acttccatgaggccaaa

SEQ ID NO: 2588179 - DNA, 23 bp, Homo sapiens
acttcccagttcaggagtcccaa

SEQ ID NO: 2588180 - DNA, 13 bp, Homo sapiens
acttccctgggca

SEQ ID NO: 2588181 - DNA, 12 bp, Homo sapiens
acttcctgtcca

SEQ ID NO: 2588182 - DNA, 17 bp, Homo sapiens
acttcctgtccagagag

SEQ ID NO: 2588183 - DNA, 19 bp, Homo sapiens
acttccttgctctccctct

SEQ ID NO: 2588184 - DNA, 20 bp, Homo sapiens
acttcgcatcaaaagacaat

SEQ ID NO: 2588185 - DNA, 20 bp, Homo sapiens
acttcgtcttctaatttcaa

SEQ ID NO: 2588186 - DNA, 16 bp, Homo sapiens
acttctaaatgaagtg

SEQ ID NO: 2588187 - DNA, 19 bp, Homo sapiens
acttctaagtaaaaccaca

SEQ ID NO: 2588188 - DNA, 16 bp, Homo sapiens
acttctccaccctgct

SEQ ID NO: 2588189 - DNA, 22 bp, Homo sapiens
acttctccagacccaccacacc

SEQ ID NO: 2588190 - DNA, 15 bp, Homo sapiens
acttctccagcctag

SEQ ID NO: 2588191 - DNA, 16 bp, Homo sapiens
acttctccaggtctca

SEQ ID NO: 2588192 - DNA, 16 bp, Homo sapiens
acttctgaccacactt

SEQ ID NO: 2588193 - DNA, 22 bp, Homo sapiens
acttgctttatgccttcttatt

SEQ ID NO: 2588194 - DNA, 21 bp, Homo sapiens
acttggaaaaatccagaaaga

SEQ ID NO: 2588195 - DNA, 15 bp, Homo sapiens
acttggactcttgct

SEQ ID NO: 2588196 - DNA, 19 bp, Homo sapiens
acttggactcttgctcttt

SEQ ID NO: 2588197 - DNA, 11 bp, Homo sapiens
acttggagcca

SEQ ID NO: 2588198 - DNA, 19 bp, Homo sapiens
acttggagccaagggttca

SEQ ID NO: 2588199 - DNA, 20 bp, Homo sapiens
acttggagggttggtcctct

SEQ ID NO: 2588200 - DNA, 14 bp, Homo sapiens
acttgggccactgt

SEQ ID NO: 2588201 - DNA, 20 bp, Homo sapiens
acttggggagatggagttct

SEQ ID NO: 2588202 - DNA, 14 bp, Homo sapiens
acttggtcaccagc

SEQ ID NO: 2588203 - DNA, 13 bp, Homo sapiens
acttgtaaataca

SEQ ID NO: 2588204 - DNA, 14 bp, Homo sapiens
acttgtaaatacac

SEQ ID NO: 2588205 - DNA, 20 bp, Homo sapiens
acttgtacaaaataaacaaa

SEQ ID NO: 2588206 - DNA, 15 bp, Homo sapiens
acttgtcaaagaagg

SEQ ID NO: 2588207 - DNA, 16 bp, Homo sapiens
acttgtcaaagaaggt

SEQ ID NO: 2588208 - DNA, 17 bp, Homo sapiens
acttgtcaatatttaaa

SEQ ID NO: 2588209 - DNA, 19 bp, Homo sapiens
acttgtctaaataagtttg

SEQ ID NO: 2588210 - DNA, 14 bp, Homo sapiens
acttgtctttggac

SEQ ID NO: 2588211 - DNA, 20 bp, Homo sapiens
acttgtctttggaccctgag

SEQ ID NO: 2588212 - DNA, 15 bp, Homo sapiens
acttgtctttttctg

SEQ ID NO: 2588213 - DNA, 17 bp, Homo sapiens
acttgtctttttctgga

SEQ ID NO: 2588214 - DNA, 16 bp, Homo sapiens
acttgtggacacagct

SEQ ID NO: 2588215 - DNA, 19 bp, Homo sapiens
acttgtggacacagctctt

SEQ ID NO: 2588216 - DNA, 20 bp, Homo sapiens
acttgtgtgtgggctgtgag

SEQ ID NO: 2588217 - DNA, 17 bp, Homo sapiens
acttgttccagctcttt

SEQ ID NO: 2588218 - DNA, 14 bp, Homo sapiens
actttaagcactac

SEQ ID NO: 2588219 - DNA, 15 bp, Homo sapiens
actttaccaccccca

SEQ ID NO: 2588220 - DNA, 18 bp, Homo sapiens
actttaccttttttatac

SEQ ID NO: 2588221 - DNA, 19 bp, Homo sapiens
actttaccttttttataca

SEQ ID NO: 2588222 - DNA, 13 bp, Homo sapiens
actttagatgctg

SEQ ID NO: 2588223 - DNA, 22 bp, Homo sapiens
actttagctgcatcctccaaga

SEQ ID NO: 2588224 - DNA, 13 bp, Homo sapiens
actttatcacatt

SEQ ID NO: 2588225 - DNA, 14 bp, Homo sapiens
actttatcacatta

SEQ ID NO: 2588226 - DNA, 17 bp, Homo sapiens
actttatgctaagtgaa

SEQ ID NO: 2588227 - DNA, 13 bp, Homo sapiens
actttattgcatc

SEQ ID NO: 2588228 - DNA, 22 bp, Homo sapiens
actttcaggccacatggctaaa

SEQ ID NO: 2588229 - DNA, 19 bp, Homo sapiens
actttccaccccctccctg

SEQ ID NO: 2588230 - DNA, 15 bp, Homo sapiens
actttcgtacattgg

SEQ ID NO: 2588231 - DNA, 22 bp, Homo sapiens
actttctatagcagattgtgta

SEQ ID NO: 2588232 - DNA, 17 bp, Homo sapiens
actttctatcctctgta

SEQ ID NO: 2588233 - DNA, 14 bp, Homo sapiens
actttctgaaataa

SEQ ID NO: 2588234 - DNA, 20 bp, Homo sapiens
actttctgaaataacatggc

SEQ ID NO: 2588235 - DNA, 14 bp, Homo sapiens
actttctgtaaact

SEQ ID NO: 2588236 - DNA, 19 bp, Homo sapiens
actttctgtaaactcaaaa

SEQ ID NO: 2588237 - DNA, 19 bp, Homo sapiens
actttcttttctggaatgt

SEQ ID NO: 2588238 - DNA, 19 bp, Homo sapiens
actttgacctctgcagcaa

SEQ ID NO: 2588239 - DNA, 19 bp, Homo sapiens
actttgccagcttttcctc

SEQ ID NO: 2588240 - DNA, 20 bp, Homo sapiens
actttgcctttccataatca

SEQ ID NO: 2588241 - DNA, 14 bp, Homo sapiens
actttgctctgggt

SEQ ID NO: 2588242 - DNA, 17 bp, Homo sapiens
actttggaaagactttt

SEQ ID NO: 2588243 - DNA, 23 bp, Homo sapiens
actttggaaagacttttccaacc

SEQ ID NO: 2588244 - DNA, 14 bp, Homo sapiens
actttggaaagagt

SEQ ID NO: 2588245 - DNA, 18 bp, Homo sapiens
actttggaatacatttct

SEQ ID NO: 2588246 - DNA, 18 bp, Homo sapiens
actttggagtcccctcac

SEQ ID NO: 2588247 - DNA, 12 bp, Homo sapiens
actttgggaggc

SEQ ID NO: 2588248 - DNA, 16 bp, Homo sapiens
actttgggaggccaag

SEQ ID NO: 2588249 - DNA, 19 bp, Homo sapiens
actttgggaggccaaggtg

SEQ ID NO: 2588250 - DNA, 19 bp, Homo sapiens
actttgggattctttccat

SEQ ID NO: 2588251 - DNA, 15 bp, Homo sapiens
actttgtcagaggca

SEQ ID NO: 2588252 - DNA, 17 bp, Homo sapiens
actttgtctgaaaaatt

SEQ ID NO: 2588253 - DNA, 17 bp, Homo sapiens
actttgtggatgtcttc

SEQ ID NO: 2588254 - DNA, 16 bp, Homo sapiens
actttgtgttcacctt

SEQ ID NO: 2588255 - DNA, 19 bp, Homo sapiens
actttgttctggctcttcc

SEQ ID NO: 2588256 - DNA, 20 bp, Homo sapiens
actttgttctggctcttcca

SEQ ID NO: 2588257 - DNA, 15 bp, Homo sapiens
actttgttctttagg

SEQ ID NO: 2588258 - DNA, 13 bp, Homo sapiens
acttttaaactgt

SEQ ID NO: 2588259 - DNA, 14 bp, Homo sapiens
acttttaaggcagt

SEQ ID NO: 2588260 - DNA, 17 bp, Homo sapiens
acttttaataaactttt

SEQ ID NO: 2588261 - DNA, 19 bp, Homo sapiens
acttttataaactttacct

SEQ ID NO: 2588262 - DNA, 17 bp, Homo sapiens
acttttcccctgtcctg

SEQ ID NO: 2588263 - DNA, 24 bp, Homo sapiens
acttttcttaaaccttcagttatg

SEQ ID NO: 2588264 - DNA, 14 bp, Homo sapiens
acttttctttgtgg

SEQ ID NO: 2588265 - DNA, 15 bp, Homo sapiens
acttttgccctttga

SEQ ID NO: 2588266 - DNA, 20 bp, Homo sapiens
acttttggttaagtctgttt

SEQ ID NO: 2588267 - DNA, 22 bp, Homo sapiens
acttttggttaagtctgtttta

SEQ ID NO: 2588268 - DNA, 17 bp, Homo sapiens
acttttgtaagacaaag

SEQ ID NO: 2588269 - DNA, 12 bp, Homo sapiens
acttttgttctt

SEQ ID NO: 2588270 - DNA, 15 bp, Homo sapiens
acttttgttcttggt

SEQ ID NO: 2588271 - DNA, 23 bp, Homo sapiens
acttttgttcttggtttgtaaat

SEQ ID NO: 2588272 - DNA, 18 bp, Homo sapiens
actttttaattcaccaaa

SEQ ID NO: 2588273 - DNA, 11 bp, Homo sapiens
actttttccag

SEQ ID NO: 2588274 - DNA, 13 bp, Homo sapiens
acttttttccaca

SEQ ID NO: 2588275 - DNA, 21 bp, Homo sapiens
acttttttgaaataataaatc

SEQ ID NO: 2588276 - DNA, 22 bp, Homo sapiens
acttttttgagtggatgatgtt

SEQ ID NO: 2588277 - DNA, 23 bp, Homo sapiens
acttttttgctatccagctattt

SEQ ID NO: 2588278 - DNA, 15 bp, Homo sapiens
acttttttttaagtt

SEQ ID NO: 2588279 - DNA, 15 bp, Homo sapiens
acttttttttgagaa

SEQ ID NO: 2588280 - DNA, 14 bp, Homo sapiens
agaaaaaaaaagaa

SEQ ID NO: 2588281 - DNA, 17 bp, Homo sapiens
agaaaaaaagatttatt

SEQ ID NO: 2588282 - DNA, 12 bp, Homo sapiens
agaaaaaagttg

SEQ ID NO: 2588283 - DNA, 14 bp, Homo sapiens
agaaaaaagttgta

SEQ ID NO: 2588284 - DNA, 19 bp, Homo sapiens
agaaaaaatattttcccta

SEQ ID NO: 2588285 - DNA, 18 bp, Homo sapiens
agaaaaaggatgcacaga

SEQ ID NO: 2588286 - DNA, 10 bp, Homo sapiens
agaaaagaaa

SEQ ID NO: 2588287 - DNA, 12 bp, Homo sapiens
agaaaagaaaaa

SEQ ID NO: 2588288 - DNA, 18 bp, Homo sapiens
agaaaagaaaaaaaaaga

SEQ ID NO: 2588289 - DNA, 19 bp, Homo sapiens
agaaaagatgtagatttat

SEQ ID NO: 2588290 - DNA, 23 bp, Homo sapiens
agaaaagggaagttgtgcctttt

SEQ ID NO: 2588291 - DNA, 15 bp, Homo sapiens
agaaaagtaagccct

SEQ ID NO: 2588292 - DNA, 21 bp, Homo sapiens
agaaaataaaaaaaagaaaaa

SEQ ID NO: 2588293 - DNA, 17 bp, Homo sapiens
agaaaataaaaagttaa

SEQ ID NO: 2588294 - DNA, 17 bp, Homo sapiens
agaaaataatcattctt

SEQ ID NO: 2588295 - DNA, 11 bp, Homo sapiens
agaaaatatac

SEQ ID NO: 2588296 - DNA, 15 bp, Homo sapiens
agaaaatatactgta

SEQ ID NO: 2588297 - DNA, 17 bp, Homo sapiens
agaaaatatactgtaaa

SEQ ID NO: 2588298 - DNA, 19 bp, Homo sapiens
agaaaatatactgtaaaga

SEQ ID NO: 2588299 - DNA, 20 bp, Homo sapiens
agaaaatatactgtaaagaa

SEQ ID NO: 2588300 - DNA, 23 bp, Homo sapiens
agaaaatatactgtaaagaaaga

SEQ ID NO: 2588301 - DNA, 13 bp, Homo sapiens
agaaaatcactta

SEQ ID NO: 2588302 - DNA, 20 bp, Homo sapiens
agaaacacactgaggcaggg

SEQ ID NO: 2588303 - DNA, 17 bp, Homo sapiens
agaaacaccctcacact

SEQ ID NO: 2588304 - DNA, 19 bp, Homo sapiens
agaaacagagacaggccca

SEQ ID NO: 2588305 - DNA, 21 bp, Homo sapiens
agaaacatcagttactctgaa

SEQ ID NO: 2588306 - DNA, 23 bp, Homo sapiens
agaaacatcagttactctgaagg

SEQ ID NO: 2588307 - DNA, 15 bp, Homo sapiens
agaaacattgaagat

SEQ ID NO: 2588308 - DNA, 21 bp, Homo sapiens
agaaaccagttatgtgaatga

SEQ ID NO: 2588309 - DNA, 21 bp, Homo sapiens
agaaacccgacagagggaaga

SEQ ID NO: 2588310 - DNA, 20 bp, Homo sapiens
agaaaccttattgtacctct

SEQ ID NO: 2588311 - DNA, 14 bp, Homo sapiens
agaaagaaaatcag

SEQ ID NO: 2588312 - DNA, 20 bp, Homo sapiens
caaaaggttaataaagtaat

SEQ ID NO: 2588313 - DNA, 19 bp, Homo sapiens
caaaaggttcactaaagca

SEQ ID NO: 2588314 - DNA, 15 bp, Homo sapiens
caaaagtattttcct

SEQ ID NO: 2588315 - DNA, 17 bp, Homo sapiens
caaaagttagctgagcg

SEQ ID NO: 2588316 - DNA, 18 bp, Homo sapiens
caaaagtttcatcctttt

SEQ ID NO: 2588317 - DNA, 15 bp, Homo sapiens
caaaataaaaaccaa

SEQ ID NO: 2588318 - DNA, 21 bp, Homo sapiens
caaaataaaaagtgacacagc

SEQ ID NO: 2588319 - DNA, 20 bp, Homo sapiens
caaaataaaactttttaaaa

SEQ ID NO: 2588320 - DNA, 16 bp, Homo sapiens
caaaataagaaaagat

SEQ ID NO: 2588321 - DNA, 15 bp, Homo sapiens
caaaatagcatttgt

SEQ ID NO: 2588322 - DNA, 23 bp, Homo sapiens
caaaatattatgcaaactactgt

SEQ ID NO: 2588323 - DNA, 12 bp, Homo sapiens
caaaatattttc

SEQ ID NO: 2588324 - DNA, 20 bp, Homo sapiens
caaaatgatggacccaatgc

SEQ ID NO: 2588325 - DNA, 13 bp, Homo sapiens
caaaattgacatt

SEQ ID NO: 2588326 - DNA, 17 bp, Homo sapiens
caaaattgacattgctt

SEQ ID NO: 2588327 - DNA, 19 bp, Homo sapiens
caaaatttccagtaccttt

SEQ ID NO: 2588328 - DNA, 12 bp, Homo sapiens
caaaatttgaaa

SEQ ID NO: 2588329 - DNA, 18 bp, Homo sapiens
caaaattttattcctata

SEQ ID NO: 2588330 - DNA, 20 bp, Homo sapiens
caaacaaagccagaagctga

SEQ ID NO: 2588331 - DNA, 15 bp, Homo sapiens
caaacaaatatgcaa

SEQ ID NO: 2588332 - DNA, 17 bp, Homo sapiens
caaacaaatatgcaaaa

SEQ ID NO: 2588333 - DNA, 24 bp, Homo sapiens
caaacaatagtaattctcaggcca

SEQ ID NO: 2588334 - DNA, 13 bp, Homo sapiens
caaacacattaag

SEQ ID NO: 2588335 - DNA, 14 bp, Homo sapiens
caaacacctcccag

SEQ ID NO: 2588336 - DNA, 15 bp, Homo sapiens
caaacacctggactt

SEQ ID NO: 2588337 - DNA, 14 bp, Homo sapiens
caaacaccttccag

SEQ ID NO: 2588338 - DNA, 14 bp, Homo sapiens
caaacagtaggttg

SEQ ID NO: 2588339 - DNA, 12 bp, Homo sapiens
caaacatgaagt

SEQ ID NO: 2588340 - DNA, 14 bp, Homo sapiens
caaacatgaagtgt

SEQ ID NO: 2588341 - DNA, 21 bp, Homo sapiens
caaacatgaccctaaatcttg

SEQ ID NO: 2588342 - DNA, 20 bp, Homo sapiens
caaacatggggttggctggg

SEQ ID NO: 2588343 - DNA, 17 bp, Homo sapiens
caaaccccctttgtgct

SEQ ID NO: 2588344 - DNA, 14 bp, Homo sapiens
caaacctctgttca

SEQ ID NO: 2588345 - DNA, 23 bp, Homo sapiens
caaacctctgttcagtgtaaata

SEQ ID NO: 2588346 - DNA, 20 bp, Homo sapiens
caaacctgacccctgctcag

SEQ ID NO: 2588347 - DNA, 21 bp, Homo sapiens
caaacctgcaagggctcccca

SEQ ID NO: 2588348 - DNA, 20 bp, Homo sapiens
caaactaagcccccgctgta

SEQ ID NO: 2588349 - DNA, 16 bp, Homo sapiens
caaactacatgtaatc

SEQ ID NO: 2588350 - DNA, 19 bp, Homo sapiens
caaactagggccaagccca

SEQ ID NO: 2588351 - DNA, 19 bp, Homo sapiens
caaactcactgctcaagaa

SEQ ID NO: 2588352 - DNA, 17 bp, Homo sapiens
caaactcttgacctcag

SEQ ID NO: 2588353 - DNA, 22 bp, Homo sapiens
caaactgaatgaaacccccaca

SEQ ID NO: 2588354 - DNA, 17 bp, Homo sapiens
caaactgaggaatttca

SEQ ID NO: 2588355 - DNA, 23 bp, Homo sapiens
caaactgcctaagccctccgcca

SEQ ID NO: 2588356 - DNA, 17 bp, Homo sapiens
caaactggcaaacttca

SEQ ID NO: 2588357 - DNA, 13 bp, Homo sapiens
caaactgttgatt

SEQ ID NO: 2588358 - DNA, 15 bp, Homo sapiens
caaacttcagactga

SEQ ID NO: 2588359 - DNA, 13 bp, Homo sapiens
caaacttgcttta

SEQ ID NO: 2588360 - DNA, 14 bp, Homo sapiens
caaagaagacaaca

SEQ ID NO: 2588361 - DNA, 14 bp, Homo sapiens
caaagaagacatgt

SEQ ID NO: 2588362 - DNA, 15 bp, Homo sapiens
caaagaatgtttata

SEQ ID NO: 2588363 - DNA, 19 bp, Homo sapiens
caaagacttagtatatttt

SEQ ID NO: 2588364 - DNA, 16 bp, Homo sapiens
caaagagactggagca

SEQ ID NO: 2588365 - DNA, 13 bp, Homo sapiens
caaagaggcaaga

SEQ ID NO: 2588366 - DNA, 17 bp, Homo sapiens
cagacacacacacgcac

SEQ ID NO: 2588367 - DNA, 18 bp, Homo sapiens
cagacacacacacgcacg

SEQ ID NO: 2588368 - DNA, 13 bp, Homo sapiens
cagacacaggccc

SEQ ID NO: 2588369 - DNA, 21 bp, Homo sapiens
cagacacatgtccaagaagcc

SEQ ID NO: 2588370 - DNA, 15 bp, Homo sapiens
cagacaccgccacat

SEQ ID NO: 2588371 - DNA, 13 bp, Homo sapiens
cagacactctggc

SEQ ID NO: 2588372 - DNA, 14 bp, Homo sapiens
cagacactctggct

SEQ ID NO: 2588373 - DNA, 15 bp, Homo sapiens
cagacagacacacac

SEQ ID NO: 2588374 - DNA, 16 bp, Homo sapiens
cagacagcagctcagg

SEQ ID NO: 2588375 - DNA, 17 bp, Homo sapiens
cagacagcagctcaggc

SEQ ID NO: 2588376 - DNA, 16 bp, Homo sapiens
cagacagctgcctggg

SEQ ID NO: 2588377 - DNA, 15 bp, Homo sapiens
cagacaggaccaggg

SEQ ID NO: 2588378 - DNA, 20 bp, Homo sapiens
cagacaggcaagcacctcct

SEQ ID NO: 2588379 - DNA, 23 bp, Homo sapiens
cagacaggcaagcacctcctgcc

SEQ ID NO: 2588380 - DNA, 19 bp, Homo sapiens
cagacatactaaccagcag

SEQ ID NO: 2588381 - DNA, 19 bp, Homo sapiens
cagacatagaattaacaca

SEQ ID NO: 2588382 - DNA, 19 bp, Homo sapiens
cagacatccatgtttgtaa

SEQ ID NO: 2588383 - DNA, 23 bp, Homo sapiens
cagacatccatgtttgtaaaact

SEQ ID NO: 2588384 - DNA, 16 bp, Homo sapiens
cagacattctgccagg

SEQ ID NO: 2588385 - DNA, 20 bp, Homo sapiens
cagaccacaaaacttttcta

SEQ ID NO: 2588386 - DNA, 20 bp, Homo sapiens
cagaccacatctttatctgt

SEQ ID NO: 2588387 - DNA, 16 bp, Homo sapiens
cagaccataatgttac

SEQ ID NO: 2588388 - DNA, 12 bp, Homo sapiens
cagacccagtgg

SEQ ID NO: 2588389 - DNA, 13 bp, Homo sapiens
cagacccccaccc

SEQ ID NO: 2588390 - DNA, 18 bp, Homo sapiens
cagacccccaccccttcc

SEQ ID NO: 2588391 - DNA, 19 bp, Homo sapiens
cagacccccaccccttccc

SEQ ID NO: 2588392 - DNA, 20 bp, Homo sapiens
cagacccccaccccttcccc

SEQ ID NO: 2588393 - DNA, 17 bp, Homo sapiens
cagacccccagcaaccc

SEQ ID NO: 2588394 - DNA, 18 bp, Homo sapiens
cagacccccagcaaccct

SEQ ID NO: 2588395 - DNA, 17 bp, Homo sapiens
cagacccctctggccag

SEQ ID NO: 2588396 - DNA, 22 bp, Homo sapiens
cagacccctctggccaggatgg

SEQ ID NO: 2588397 - DNA, 12 bp, Homo sapiens
cagaccctgccc

SEQ ID NO: 2588398 - DNA, 14 bp, Homo sapiens
cagaccctgccctg

SEQ ID NO: 2588399 - DNA, 22 bp, Homo sapiens
cagacctaggatttcatgattt

SEQ ID NO: 2588400 - DNA, 14 bp, Homo sapiens
cagacctggagccc

SEQ ID NO: 2588401 - DNA, 16 bp, Homo sapiens
cagacctggagcccct

SEQ ID NO: 2588402 - DNA, 23 bp, Homo sapiens
cagacctggagcccctgggtggg

SEQ ID NO: 2588403 - DNA, 13 bp, Homo sapiens
cagaccttttatc

SEQ ID NO: 2588404 - DNA, 17 bp, Homo sapiens
cagacggttcaccagcc

SEQ ID NO: 2588405 - DNA, 19 bp, Homo sapiens
cagacggttcaccagcctc

SEQ ID NO: 2588406 - DNA, 14 bp, Homo sapiens
cagactcaataaaa

SEQ ID NO: 2588407 - DNA, 20 bp, Homo sapiens
cagactcctgaggacagctg

SEQ ID NO: 2588408 - DNA, 21 bp, Homo sapiens
cagactcctgaggacagctgt

SEQ ID NO: 2588409 - DNA, 21 bp, Homo sapiens
cagactctacagaggccatgg

SEQ ID NO: 2588410 - DNA, 23 bp, Homo sapiens
cagactctacagaggccatgggc

SEQ ID NO: 2588411 - DNA, 20 bp, Homo sapiens
cagactgacaaatgtgtatc

SEQ ID NO: 2588412 - DNA, 16 bp, Homo sapiens
cagactgctgggactg

SEQ ID NO: 2588413 - DNA, 23 bp, Homo sapiens
cagactgctgggactggccaggt

SEQ ID NO: 2588414 - DNA, 14 bp, Homo sapiens
cagactgcttccaa

SEQ ID NO: 2588415 - DNA, 13 bp, Homo sapiens
cagactggaagca

SEQ ID NO: 2588416 - DNA, 16 bp, Homo sapiens
cagactggaagcacag

SEQ ID NO: 2588417 - DNA, 17 bp, Homo sapiens
cagactggaagcacagc

SEQ ID NO: 2588418 - DNA, 16 bp, Homo sapiens
cagactggctggctgc

SEQ ID NO: 2588419 - DNA, 24 bp, Homo sapiens
cagactgttagaaaatggacactg

SEQ ID NO: 2588420 - DNA, 15 bp, Homo sapiens
cagacttctccagac

SEQ ID NO: 2588421 - DNA, 20 bp, Homo sapiens
cagactttttttaaatagta

SEQ ID NO: 2588422 - DNA, 15 bp, Homo sapiens
cagagaaagaagaga

SEQ ID NO: 2588423 - DNA, 18 bp, Homo sapiens
cagagaaagaagagacag

SEQ ID NO: 2588424 - DNA, 23 bp, Homo sapiens
cagagaaagtacttctccaccct

SEQ ID NO: 2588425 - DNA, 23 bp, Homo sapiens
cagagaagtgacagggaagctac

SEQ ID NO: 2588426 - DNA, 22 bp, Homo sapiens
cagagacaggaagtcttcaggg

SEQ ID NO: 2588427 - DNA, 14 bp, Homo sapiens
cagagacaggccca

SEQ ID NO: 2588428 - DNA, 13 bp, Homo sapiens
cagagacattcct

SEQ ID NO: 2588429 - DNA, 14 bp, Homo sapiens
cagagaccatccct

SEQ ID NO: 2588430 - DNA, 17 bp, Homo sapiens
cagagaccatccctgaa

SEQ ID NO: 2588431 - DNA, 21 bp, Homo sapiens
cagagaccatccctgaaggcc

SEQ ID NO: 2588432 - DNA, 16 bp, Homo sapiens
cagagacctcctgcct

SEQ ID NO: 2588433 - DNA, 20 bp, Homo sapiens
cagagactcagggccccagc

SEQ ID NO: 2588434 - DNA, 13 bp, Homo sapiens
cagagactcctgc

SEQ ID NO: 2588435 - DNA, 15 bp, Homo sapiens
cagagactcctgcag

SEQ ID NO: 2588436 - DNA, 14 bp, Homo sapiens
cagagagaagcctg

SEQ ID NO: 2588437 - DNA, 22 bp, Homo sapiens
cagagagaggggagaagcctgg

SEQ ID NO: 2588438 - DNA, 20 bp, Homo sapiens
cagagagccattttgtgaat

SEQ ID NO: 2588439 - DNA, 21 bp, Homo sapiens
cagagagccattttgtgaatg

SEQ ID NO: 2588440 - DNA, 23 bp, Homo sapiens
cagagagccattttgtgaatgga

SEQ ID NO: 2588441 - DNA, 13 bp, Homo sapiens
cagagagctggta

SEQ ID NO: 2588442 - DNA, 13 bp, Homo sapiens
cagagaggagaaa

SEQ ID NO: 2588443 - DNA, 16 bp, Homo sapiens
cagagaggccaggtgc

SEQ ID NO: 2588444 - DNA, 21 bp, Homo sapiens
cagagagggcaggcatgaagt

SEQ ID NO: 2588445 - DNA, 17 bp, Homo sapiens
cagagagggtgacaaga

SEQ ID NO: 2588446 - DNA, 18 bp, Homo sapiens
cagagagggtgacaagat

SEQ ID NO: 2588447 - DNA, 22 bp, Homo sapiens
cagagagggtgggagtgggccc

SEQ ID NO: 2588448 - DNA, 15 bp, Homo sapiens
cagagagtcctctgg

SEQ ID NO: 2588449 - DNA, 16 bp, Homo sapiens
cagagatgtgcaccca

SEQ ID NO: 2588450 - DNA, 16 bp, Homo sapiens
cagagcaaaataattt

SEQ ID NO: 2588451 - DNA, 18 bp, Homo sapiens
cagagcaagatcctgtct

SEQ ID NO: 2588452 - DNA, 20 bp, Homo sapiens
cagagcaagtgagaccctgt

SEQ ID NO: 2588453 - DNA, 21 bp, Homo sapiens
cagagcaccttagacagtccc

SEQ ID NO: 2588454 - DNA, 13 bp, Homo sapiens
cagagcagagacc

SEQ ID NO: 2588455 - DNA, 17 bp, Homo sapiens
cagagcagagaccatcc

SEQ ID NO: 2588456 - DNA, 19 bp, Homo sapiens
cagagcagagaccatccct

SEQ ID NO: 2588457 - DNA, 13 bp, Homo sapiens
cagatttacactg

SEQ ID NO: 2588458 - DNA, 18 bp, Homo sapiens
cagatttgggctggaaca

SEQ ID NO: 2588459 - DNA, 14 bp, Homo sapiens
cagatttgtgaact

SEQ ID NO: 2588460 - DNA, 24 bp, Homo sapiens
cagatttgtgaactcagccaagca

SEQ ID NO: 2588461 - DNA, 15 bp, Homo sapiens
cagattttcagcaaa

SEQ ID NO: 2588462 - DNA, 17 bp, Homo sapiens
cagcaacacaagctgga

SEQ ID NO: 2588463 - DNA, 13 bp, Homo sapiens
cagcaactgaata

SEQ ID NO: 2588464 - DNA, 19 bp, Homo sapiens
cagcaacttgtctttttct

SEQ ID NO: 2588465 - DNA, 20 bp, Homo sapiens
cagcaacttgtctttttctg

SEQ ID NO: 2588466 - DNA, 22 bp, Homo sapiens
cagcaacttgtctttttctgga

SEQ ID NO: 2588467 - DNA, 18 bp, Homo sapiens
cagcaaggagatttacaa

SEQ ID NO: 2588468 - DNA, 14 bp, Homo sapiens
cagcaagtctcttt

SEQ ID NO: 2588469 - DNA, 19 bp, Homo sapiens
cagcaagtgagagctgggt

SEQ ID NO: 2588470 - DNA, 21 bp, Homo sapiens
cagcaagtgagagctgggtgt

SEQ ID NO: 2588471 - DNA, 21 bp, Homo sapiens
cagcaataaagcagcgtttct

SEQ ID NO: 2588472 - DNA, 18 bp, Homo sapiens
cagcaatgatgtccagaa

SEQ ID NO: 2588473 - DNA, 14 bp, Homo sapiens
cagcacagagaaga

SEQ ID NO: 2588474 - DNA, 16 bp, Homo sapiens
cagcacagagaagaca

SEQ ID NO: 2588475 - DNA, 16 bp, Homo sapiens
cagcacagagaccccc

SEQ ID NO: 2588476 - DNA, 13 bp, Homo sapiens
cagcaccacccta

SEQ ID NO: 2588477 - DNA, 21 bp, Homo sapiens
cagcaccaccctagtcccttc

SEQ ID NO: 2588478 - DNA, 20 bp, Homo sapiens
cagcaccatccgccagggcc

SEQ ID NO: 2588479 - DNA, 15 bp, Homo sapiens
cagcaccccttccat

SEQ ID NO: 2588480 - DNA, 23 bp, Homo sapiens
cagcaccccttccatgtggagaa

SEQ ID NO: 2588481 - DNA, 15 bp, Homo sapiens
cagcacgatttctgt

SEQ ID NO: 2588482 - DNA, 18 bp, Homo sapiens
cagcacgatttctgttta

SEQ ID NO: 2588483 - DNA, 20 bp, Homo sapiens
cagcacgatttctgtttaga

SEQ ID NO: 2588484 - DNA, 17 bp, Homo sapiens
cagcacgtgtggcctgt

SEQ ID NO: 2588485 - DNA, 14 bp, Homo sapiens
cagcactaaagcag

SEQ ID NO: 2588486 - DNA, 11 bp, Homo sapiens
cagcactactc

SEQ ID NO: 2588487 - DNA, 22 bp, Homo sapiens
cagcactcacacaggaccccct

SEQ ID NO: 2588488 - DNA, 14 bp, Homo sapiens
cagcactgatttca

SEQ ID NO: 2588489 - DNA, 16 bp, Homo sapiens
cagcactggctctctc

SEQ ID NO: 2588490 - DNA, 23 bp, Homo sapiens
cagcactggctctctccaggatc

SEQ ID NO: 2588491 - DNA, 14 bp, Homo sapiens
cagcactgtctcag

SEQ ID NO: 2588492 - DNA, 15 bp, Homo sapiens
cagcactgtctcagt

SEQ ID NO: 2588493 - DNA, 15 bp, Homo sapiens
cagcactttgggagg

SEQ ID NO: 2588494 - DNA, 18 bp, Homo sapiens
cagcactttgggaggcca

SEQ ID NO: 2588495 - DNA, 22 bp, Homo sapiens
cagcactttgggaggccaagga

SEQ ID NO: 2588496 - DNA, 23 bp, Homo sapiens
cagcactttgggaggctgaggcg

SEQ ID NO: 2588497 - DNA, 11 bp, Homo sapiens
cagcagagcac

SEQ ID NO: 2588498 - DNA, 15 bp, Homo sapiens
cagcagaggcactgg

SEQ ID NO: 2588499 - DNA, 13 bp, Homo sapiens
cagcagagtgtgg

SEQ ID NO: 2588500 - DNA, 16 bp, Homo sapiens
cagcagatcccagctc

SEQ ID NO: 2588501 - DNA, 18 bp, Homo sapiens
cagcagatcccagctcac

SEQ ID NO: 2588502 - DNA, 20 bp, Homo sapiens
cagcagccagctctcagcca

SEQ ID NO: 2588503 - DNA, 22 bp, Homo sapiens
cagcagccatcataggaaggga

SEQ ID NO: 2588504 - DNA, 23 bp, Homo sapiens
cagcagcccctgcacaaagccct

SEQ ID NO: 2588505 - DNA, 20 bp, Homo sapiens
cagcagccctaaggatctct

SEQ ID NO: 2588506 - DNA, 24 bp, Homo sapiens
cagcagccctaaggatctctcagg

SEQ ID NO: 2588507 - DNA, 21 bp, Homo sapiens
cagcagcgaccacccctgcct

SEQ ID NO: 2588508 - DNA, 18 bp, Homo sapiens
cagcagcttcaccagagc

SEQ ID NO: 2588509 - DNA, 20 bp, Homo sapiens
cagcagggtagtctggtttc

SEQ ID NO: 2588510 - DNA, 16 bp, Homo sapiens
cagcagtgcagccggg

SEQ ID NO: 2588511 - DNA, 16 bp, Homo sapiens
cagcagtgtcatcaga

SEQ ID NO: 2588512 - DNA, 12 bp, Homo sapiens
cagcagtgttcc

SEQ ID NO: 2588513 - DNA, 14 bp, Homo sapiens
cagcagtgttcccc

SEQ ID NO: 2588514 - DNA, 17 bp, Homo sapiens
cagcagttgaaaagact

SEQ ID NO: 2588515 - DNA, 23 bp, Homo sapiens
cagcagttgaatgacaacagaag

SEQ ID NO: 2588516 - DNA, 19 bp, Homo sapiens
cagcatacctttattgtga

SEQ ID NO: 2588517 - DNA, 19 bp, Homo sapiens
cagcatagcaagacacatc

SEQ ID NO: 2588518 - DNA, 16 bp, Homo sapiens
cagcatattcaggaag

SEQ ID NO: 2588519 - DNA, 18 bp, Homo sapiens
cagcatattcaggaagct

SEQ ID NO: 2588520 - DNA, 23 bp, Homo sapiens
cagcatattcaggaagctcaggg

SEQ ID NO: 2588521 - DNA, 12 bp, Homo sapiens
cagcatatttat

SEQ ID NO: 2588522 - DNA, 18 bp, Homo sapiens
cagcatcccttgaccagg

SEQ ID NO: 2588523 - DNA, 23 bp, Homo sapiens
cagcatcccttgaccaggcctgg

SEQ ID NO: 2588524 - DNA, 14 bp, Homo sapiens
cagcatcctggcac

SEQ ID NO: 2588525 - DNA, 23 bp, Homo sapiens
cagcatccttttctgcagagggg

SEQ ID NO: 2588526 - DNA, 17 bp, Homo sapiens
cagcatgaggaactagc

SEQ ID NO: 2588527 - DNA, 18 bp, Homo sapiens
cagcccgggctctgcctc

SEQ ID NO: 2588528 - DNA, 21 bp, Homo sapiens
cagcccgtgtggccccttcac

SEQ ID NO: 2588529 - DNA, 15 bp, Homo sapiens
cagccctagagcctg

SEQ ID NO: 2588530 - DNA, 20 bp, Homo sapiens
cagccctagagcctgcctgg

SEQ ID NO: 2588531 - DNA, 22 bp, Homo sapiens
cagccctagagcctgcctggag

SEQ ID NO: 2588532 - DNA, 12 bp, Homo sapiens
cagccctgaggt

SEQ ID NO: 2588533 - DNA, 20 bp, Homo sapiens
cagccctgctggccgcctca

SEQ ID NO: 2588534 - DNA, 15 bp, Homo sapiens
cagccctggctctgc

SEQ ID NO: 2588535 - DNA, 20 bp, Homo sapiens
cagccctggctgaaggactg

SEQ ID NO: 2588536 - DNA, 15 bp, Homo sapiens
cagccctggtctcag

SEQ ID NO: 2588537 - DNA, 16 bp, Homo sapiens
cagccctggtctcagc

SEQ ID NO: 2588538 - DNA, 19 bp, Homo sapiens
cagccctggtctcagcagc

SEQ ID NO: 2588539 - DNA, 18 bp, Homo sapiens
cagccctgtcagtgcagc

SEQ ID NO: 2588540 - DNA, 20 bp, Homo sapiens
cagccctgtcagtgcagccc

SEQ ID NO: 2588541 - DNA, 21 bp, Homo sapiens
cagcccttagcagggaaacag

SEQ ID NO: 2588542 - DNA, 20 bp, Homo sapiens
cagcccttgagctccccaaa

SEQ ID NO: 2588543 - DNA, 12 bp, Homo sapiens
cagcccttgctt

SEQ ID NO: 2588544 - DNA, 13 bp, Homo sapiens
cagcccttgcttg

SEQ ID NO: 2588545 - DNA, 14 bp, Homo sapiens
cagcccttgcttgt

SEQ ID NO: 2588546 - DNA, 15 bp, Homo sapiens
cagcccttgcttgtt

SEQ ID NO: 2588547 - DNA, 20 bp, Homo sapiens
cagccctttgggaggctgag

SEQ ID NO: 2588548 - DNA, 18 bp, Homo sapiens
cagccgagccgggcctgg

SEQ ID NO: 2588549 - DNA, 14 bp, Homo sapiens
cagccgagctcgtg

SEQ ID NO: 2588550 - DNA, 16 bp, Homo sapiens
cagccgcagcctccct

SEQ ID NO: 2588551 - DNA, 18 bp, Homo sapiens
cagccgccattgccacca

SEQ ID NO: 2588552 - DNA, 14 bp, Homo sapiens
cagccgctcctgtc

SEQ ID NO: 2588553 - DNA, 16 bp, Homo sapiens
cagccgctcctgtctg

SEQ ID NO: 2588554 - DNA, 17 bp, Homo sapiens
cagccgctcctgtctgc

SEQ ID NO: 2588555 - DNA, 20 bp, Homo sapiens
cagccgctcctgtctgccag

SEQ ID NO: 2588556 - DNA, 22 bp, Homo sapiens
cagccgctcctgtctgccagcc

SEQ ID NO: 2588557 - DNA, 23 bp, Homo sapiens
cagccgctcctgtctgccagcca

SEQ ID NO: 2588558 - DNA, 19 bp, Homo sapiens
cagccgctgagcgaggaga

SEQ ID NO: 2588559 - DNA, 14 bp, Homo sapiens
cagccgcttctgac

SEQ ID NO: 2588560 - DNA, 18 bp, Homo sapiens
cagccgcttctgactgct

SEQ ID NO: 2588561 - DNA, 14 bp, Homo sapiens
cagccggcacccac

SEQ ID NO: 2588562 - DNA, 15 bp, Homo sapiens
cagccggcctctctg

SEQ ID NO: 2588563 - DNA, 15 bp, Homo sapiens
cagccgggccctgag

SEQ ID NO: 2588564 - DNA, 16 bp, Homo sapiens
cagccgtgatgctcag

SEQ ID NO: 2588565 - DNA, 17 bp, Homo sapiens
cagccgtgatgctcagg

SEQ ID NO: 2588566 - DNA, 16 bp, Homo sapiens
cagcctaagatgaaga

SEQ ID NO: 2588567 - DNA, 17 bp, Homo sapiens
cagcctagccgacctca

SEQ ID NO: 2588568 - DNA, 20 bp, Homo sapiens
cagcctagccgacctcagcc

SEQ ID NO: 2588569 - DNA, 17 bp, Homo sapiens
cagcctcaacctcctgg

SEQ ID NO: 2588570 - DNA, 20 bp, Homo sapiens
cagcctcaacctcctgggct

SEQ ID NO: 2588571 - DNA, 14 bp, Homo sapiens
cagcctcacagtcc

SEQ ID NO: 2588572 - DNA, 22 bp, Homo sapiens
cagcctcagggacgactctgac

SEQ ID NO: 2588573 - DNA, 15 bp, Homo sapiens
cagcctccagcctct

SEQ ID NO: 2588574 - DNA, 15 bp, Homo sapiens
cagcctccatgctgc

SEQ ID NO: 2588575 - DNA, 19 bp, Homo sapiens
cagcctcccaaagtgctgg

SEQ ID NO: 2588576 - DNA, 23 bp, Homo sapiens
cagcctcccaaagtgctgggatt

SEQ ID NO: 2588577 - DNA, 18 bp, Homo sapiens
cagcctcccctgccaggg

SEQ ID NO: 2588578 - DNA, 23 bp, Homo sapiens
cagcctcccgaatagctgggact

SEQ ID NO: 2588579 - DNA, 20 bp, Homo sapiens
cagcctcccgagtagctggg

SEQ ID NO: 2588580 - DNA, 22 bp, Homo sapiens
cagcctccctctgacctgcagg

SEQ ID NO: 2588581 - DNA, 19 bp, Homo sapiens
cagcctctagggacccctc

SEQ ID NO: 2588582 - DNA, 20 bp, Homo sapiens
cagcctctagggacccctcc

SEQ ID NO: 2588583 - DNA, 19 bp, Homo sapiens
cagcctctcccctgattac

SEQ ID NO: 2588584 - DNA, 18 bp, Homo sapiens
cagcctctctcccagtct

SEQ ID NO: 2588585 - DNA, 22 bp, Homo sapiens
cagcctctctcccagtctaccc

SEQ ID NO: 2588586 - DNA, 14 bp, Homo sapiens
cagcctctgttccc

SEQ ID NO: 2588587 - DNA, 15 bp, Homo sapiens
cagcctcttaaagct

SEQ ID NO: 2588588 - DNA, 22 bp, Homo sapiens
cagcctgagcgacagtgagact

SEQ ID NO: 2588589 - DNA, 23 bp, Homo sapiens
cagcctgagcgacagtgagactc

SEQ ID NO: 2588590 - DNA, 12 bp, Homo sapiens
cagcctgaggct

SEQ ID NO: 2588591 - DNA, 18 bp, Homo sapiens
cagcctgaggctgagact

SEQ ID NO: 2588592 - DNA, 19 bp, Homo sapiens
cagcctgaggctgagactg

SEQ ID NO: 2588593 - DNA, 10 bp, Homo sapiens
cagcctgagt

SEQ ID NO: 2588594 - DNA, 14 bp, Homo sapiens
cagcctgagtctcc

SEQ ID NO: 2588595 - DNA, 19 bp, Homo sapiens
cagcctgcctggcaggctg

SEQ ID NO: 2588596 - DNA, 19 bp, Homo sapiens
cagcctgctaattccccag

SEQ ID NO: 2588597 - DNA, 15 bp, Homo sapiens
cagcctgctccagct

SEQ ID NO: 2588598 - DNA, 17 bp, Homo sapiens
cagcctgctccagctgt

SEQ ID NO: 2588599 - DNA, 16 bp, Homo sapiens
cagcctggagatgaaa

SEQ ID NO: 2588600 - DNA, 14 bp, Homo sapiens
cagcctggcttctg

SEQ ID NO: 2588601 - DNA, 20 bp, Homo sapiens
cagcctggtcaacatggtga

SEQ ID NO: 2588602 - DNA, 17 bp, Homo sapiens
cagcctggtgggcctcc

SEQ ID NO: 2588603 - DNA, 23 bp, Homo sapiens
cagcctggtgggcctcctctgtc

SEQ ID NO: 2588604 - DNA, 17 bp, Homo sapiens
cagcctgtatcttgggg

SEQ ID NO: 2588605 - DNA, 21 bp, Homo sapiens
cagcctgtcccatggacactc

SEQ ID NO: 2588606 - DNA, 12 bp, Homo sapiens
cagcctgtcctg

SEQ ID NO: 2588607 - DNA, 16 bp, Homo sapiens
cagcctgtctcttcca

SEQ ID NO: 2588608 - DNA, 16 bp, Homo sapiens
cagcctgtgctgcccg

SEQ ID NO: 2588609 - DNA, 16 bp, Homo sapiens
cagccttccccttgcc

SEQ ID NO: 2588610 - DNA, 23 bp, Homo sapiens
cagccttccccttgcccagggct

SEQ ID NO: 2588611 - DNA, 19 bp, Homo sapiens
cagccttcctctgcagctg

SEQ ID NO: 2588612 - DNA, 21 bp, Homo sapiens
cagccttcctctgcagctgac

SEQ ID NO: 2588613 - DNA, 17 bp, Homo sapiens
cagccttctttgcttgc

SEQ ID NO: 2588614 - DNA, 17 bp, Homo sapiens
cagccttggcatctaga

SEQ ID NO: 2588615 - DNA, 17 bp, Homo sapiens
cagcctttctcccaggc

SEQ ID NO: 2588616 - DNA, 23 bp, Homo sapiens
cagcctttctcccaggccaggct

SEQ ID NO: 2588617 - DNA, 19 bp, Homo sapiens
cagcctttgatcaggtggg

SEQ ID NO: 2588618 - DNA, 22 bp, Homo sapiens
cagcctttgatcaggtggggag

SEQ ID NO: 2588619 - DNA, 16 bp, Homo sapiens
cagcgaccgccccctc

SEQ ID NO: 2588620 - DNA, 20 bp, Homo sapiens
cagcgagccctggtggcagt

SEQ ID NO: 2588621 - DNA, 14 bp, Homo sapiens
cagcgccaagcaac

SEQ ID NO: 2588622 - DNA, 16 bp, Homo sapiens
cagcgccaagcaacct

SEQ ID NO: 2588623 - DNA, 19 bp, Homo sapiens
cagcgccaagcaacctggg

SEQ ID NO: 2588624 - DNA, 19 bp, Homo sapiens
cagcgctgggtccacccca

SEQ ID NO: 2588625 - DNA, 15 bp, Homo sapiens
cagcggcccctgcat

SEQ ID NO: 2588626 - DNA, 20 bp, Homo sapiens
cagcggcccctgcatcccct

SEQ ID NO: 2588627 - DNA, 22 bp, Homo sapiens
cagcgggaatggcagctgccac

SEQ ID NO: 2588628 - DNA, 18 bp, Homo sapiens
cagcggggacagctcctt

SEQ ID NO: 2588629 - DNA, 19 bp, Homo sapiens
cagcggggacagctccttc

SEQ ID NO: 2588630 - DNA, 14 bp, Homo sapiens
cagcggggcgaagc

SEQ ID NO: 2588631 - DNA, 19 bp, Homo sapiens
cagcggggcgaagcccagg

SEQ ID NO: 2588632 - DNA, 17 bp, Homo sapiens
cagcgtagcctctccgg

SEQ ID NO: 2588633 - DNA, 15 bp, Homo sapiens
cagcgtcctgtccac

SEQ ID NO: 2588634 - DNA, 17 bp, Homo sapiens
cagcgttgcatgtcgtg

SEQ ID NO: 2588635 - DNA, 17 bp, Homo sapiens
cagctaacaattgtgaa

SEQ ID NO: 2588636 - DNA, 16 bp, Homo sapiens
cagctaacacacagct

SEQ ID NO: 2588637 - DNA, 18 bp, Homo sapiens
cagctaacacacagctcc

SEQ ID NO: 2588638 - DNA, 20 bp, Homo sapiens
cagctaacacacagctccca

SEQ ID NO: 2588639 - DNA, 18 bp, Homo sapiens
cagctaagctaggaatga

SEQ ID NO: 2588640 - DNA, 19 bp, Homo sapiens
cagctaatctgtagggctg

SEQ ID NO: 2588641 - DNA, 18 bp, Homo sapiens
cagctaccaggtgttcta

SEQ ID NO: 2588642 - DNA, 21 bp, Homo sapiens
cagctaccctttttctccagc

SEQ ID NO: 2588643 - DNA, 17 bp, Homo sapiens
cagctactaatgatgtt

SEQ ID NO: 2588644 - DNA, 19 bp, Homo sapiens
cagctactaatgatgtttt

SEQ ID NO: 2588645 - DNA, 15 bp, Homo sapiens
cagctactcagaagc

SEQ ID NO: 2588646 - DNA, 13 bp, Homo sapiens
cagctactcagga

SEQ ID NO: 2588647 - DNA, 16 bp, Homo sapiens
cagctactgatttttg

SEQ ID NO: 2588648 - DNA, 15 bp, Homo sapiens
cagctacttgggaag

SEQ ID NO: 2588649 - DNA, 23 bp, Homo sapiens
cagctagaaataagcccaacaga

SEQ ID NO: 2588650 - DNA, 23 bp, Homo sapiens
cagctatctggtcaacctcctgg

SEQ ID NO: 2588651 - DNA, 13 bp, Homo sapiens
cagctatgctggt

SEQ ID NO: 2588652 - DNA, 15 bp, Homo sapiens
cagctatgggagccc

SEQ ID NO: 2588653 - DNA, 23 bp, Homo sapiens
cagctatgggagccccagggtct

SEQ ID NO: 2588654 - DNA, 20 bp, Homo sapiens
cagctatgttatattgaaaa

SEQ ID NO: 2588655 - DNA, 21 bp, Homo sapiens
cagctatgttatattgaaaaa

SEQ ID NO: 2588656 - DNA, 18 bp, Homo sapiens
cagctattgatataaata

SEQ ID NO: 2588657 - DNA, 16 bp, Homo sapiens
cagctcaatggactgg

SEQ ID NO: 2588658 - DNA, 16 bp, Homo sapiens
cagctcaccagcccca

SEQ ID NO: 2588659 - DNA, 19 bp, Homo sapiens
cagctcaccagccccagtg

SEQ ID NO: 2588660 - DNA, 19 bp, Homo sapiens
cagctcaccccccacactc

SEQ ID NO: 2588661 - DNA, 15 bp, Homo sapiens
cagctcacctctccc

SEQ ID NO: 2588662 - DNA, 17 bp, Homo sapiens
cagctcacgtcacactt

SEQ ID NO: 2588663 - DNA, 17 bp, Homo sapiens
cagctcagagagggtgg

SEQ ID NO: 2588664 - DNA, 11 bp, Homo sapiens
cagctcagcgc

SEQ ID NO: 2588665 - DNA, 18 bp, Homo sapiens
cagctcagcgccagcctg

SEQ ID NO: 2588666 - DNA, 12 bp, Homo sapiens
cagctcaggcac

SEQ ID NO: 2588667 - DNA, 14 bp, Homo sapiens
cagctccagctcac

SEQ ID NO: 2588668 - DNA, 23 bp, Homo sapiens
cagctcccataaccgctgattct

SEQ ID NO: 2588669 - DNA, 14 bp, Homo sapiens
cagctcccatttct

SEQ ID NO: 2588670 - DNA, 19 bp, Homo sapiens
cagctcccatttctactct

SEQ ID NO: 2588671 - DNA, 20 bp, Homo sapiens
cagctcccatttctactctt

SEQ ID NO: 2588672 - DNA, 13 bp, Homo sapiens
cagctccccagag

SEQ ID NO: 2588673 - DNA, 22 bp, Homo sapiens
cagctcccccgacggtgggcat

SEQ ID NO: 2588674 - DNA, 16 bp, Homo sapiens
cagctcccctcggaga

SEQ ID NO: 2588675 - DNA, 17 bp, Homo sapiens
cagctcccctcggagaa

SEQ ID NO: 2588676 - DNA, 22 bp, Homo sapiens
cagctcccctcggagaagagct

SEQ ID NO: 2588677 - DNA, 19 bp, Homo sapiens
cagctccctaggagaccaa

SEQ ID NO: 2588678 - DNA, 15 bp, Homo sapiens
cagctccctctgcct

SEQ ID NO: 2588679 - DNA, 15 bp, Homo sapiens
cagctcctcatccag

SEQ ID NO: 2588680 - DNA, 21 bp, Homo sapiens
cagctcctcccttgttctcta

SEQ ID NO: 2588681 - DNA, 22 bp, Homo sapiens
cagctcctcccttgttctctaa

SEQ ID NO: 2588682 - DNA, 14 bp, Homo sapiens
cagctccttcctgg

SEQ ID NO: 2588683 - DNA, 16 bp, Homo sapiens
cagctccttctgtcct

SEQ ID NO: 2588684 - DNA, 17 bp, Homo sapiens
cagctccttctgtccta

SEQ ID NO: 2588685 - DNA, 21 bp, Homo sapiens
cagctctagacaaccctgcaa

SEQ ID NO: 2588686 - DNA, 12 bp, Homo sapiens
cagctctcagcc

SEQ ID NO: 2588687 - DNA, 14 bp, Homo sapiens
cagctctccagtca

SEQ ID NO: 2588688 - DNA, 16 bp, Homo sapiens
cagctctgcaagaatt

SEQ ID NO: 2588689 - DNA, 20 bp, Homo sapiens
cagctctgcatactcattag

SEQ ID NO: 2588690 - DNA, 14 bp, Homo sapiens
cagctctgggagag

SEQ ID NO: 2588691 - DNA, 23 bp, Homo sapiens
cagctctggtccatagagagcaa

SEQ ID NO: 2588692 - DNA, 18 bp, Homo sapiens
cagctctgtcctgggagt

SEQ ID NO: 2588693 - DNA, 15 bp, Homo sapiens
cagctcttctccagg

SEQ ID NO: 2588694 - DNA, 16 bp, Homo sapiens
cagctcttctccaggc

SEQ ID NO: 2588695 - DNA, 17 bp, Homo sapiens
cagctcttgcccttccc

SEQ ID NO: 2588696 - DNA, 18 bp, Homo sapiens
cagctcttgcccttccct

SEQ ID NO: 2588697 - DNA, 19 bp, Homo sapiens
cagctcttgcccttccctg

SEQ ID NO: 2588698 - DNA, 21 bp, Homo sapiens
cagctcttgcccttccctgtc

SEQ ID NO: 2588699 - DNA, 22 bp, Homo sapiens
cagctcttgctaatcagtgtct

SEQ ID NO: 2588700 - DNA, 16 bp, Homo sapiens
cagctcttggctccac

SEQ ID NO: 2588701 - DNA, 13 bp, Homo sapiens
cagctgacctctg

SEQ ID NO: 2588702 - DNA, 19 bp, Homo sapiens
cagctgagggtgagtgggt

SEQ ID NO: 2588703 - DNA, 15 bp, Homo sapiens
cagctgatacaaatt

SEQ ID NO: 2588704 - DNA, 20 bp, Homo sapiens
cagctgatgttggaagagaa

SEQ ID NO: 2588705 - DNA, 18 bp, Homo sapiens
cagctgcacctgccagcc

SEQ ID NO: 2588706 - DNA, 20 bp, Homo sapiens
cagctgcacctgccagcctg

SEQ ID NO: 2588707 - DNA, 14 bp, Homo sapiens
cagctgccagagaa

SEQ ID NO: 2588708 - DNA, 15 bp, Homo sapiens
cagctgccagagaag

SEQ ID NO: 2588709 - DNA, 12 bp, Homo sapiens
cagctgcctggg

SEQ ID NO: 2588710 - DNA, 18 bp, Homo sapiens
cagctgcggtccacccag

SEQ ID NO: 2588711 - DNA, 20 bp, Homo sapiens
cagctgcggtccacccagga

SEQ ID NO: 2588712 - DNA, 17 bp, Homo sapiens
cagctgctactactcct

SEQ ID NO: 2588713 - DNA, 23 bp, Homo sapiens
cagctgctggagactcctaggca

SEQ ID NO: 2588714 - DNA, 16 bp, Homo sapiens
cagctgcttgtgtccc

SEQ ID NO: 2588715 - DNA, 22 bp, Homo sapiens
cagctgcttgtgtccctcctgg

SEQ ID NO: 2588716 - DNA, 16 bp, Homo sapiens
cagctggagaagaccc

SEQ ID NO: 2588717 - DNA, 12 bp, Homo sapiens
cagctgggaggc

SEQ ID NO: 2588718 - DNA, 13 bp, Homo sapiens
cagctgggaggca

SEQ ID NO: 2588719 - DNA, 15 bp, Homo sapiens
cagctgggctctgca

SEQ ID NO: 2588720 - DNA, 17 bp, Homo sapiens
cagctgggctctgcaat

SEQ ID NO: 2588721 - DNA, 16 bp, Homo sapiens
cagctgggctctgcca

SEQ ID NO: 2588722 - DNA, 14 bp, Homo sapiens
cagctgggctgtgg

SEQ ID NO: 2588723 - DNA, 18 bp, Homo sapiens
cagctggggcgtggggag

SEQ ID NO: 2588724 - DNA, 19 bp, Homo sapiens
cagctggggcgtggggagg

SEQ ID NO: 2588725 - DNA, 18 bp, Homo sapiens
cagctgggtggcactgcc

SEQ ID NO: 2588726 - DNA, 17 bp, Homo sapiens
cagctgggttggaaaac

SEQ ID NO: 2588727 - DNA, 19 bp, Homo sapiens
cagctggtggtatctgagt

SEQ ID NO: 2588728 - DNA, 20 bp, Homo sapiens
cagctgtaacacagctgaga

SEQ ID NO: 2588729 - DNA, 16 bp, Homo sapiens
cagctgtcctcttctg

SEQ ID NO: 2588730 - DNA, 20 bp, Homo sapiens
cagctgtgctctggacaggc

SEQ ID NO: 2588731 - DNA, 19 bp, Homo sapiens
cagctgttcagctggttga

SEQ ID NO: 2588732 - DNA, 14 bp, Homo sapiens
cagctgtttaagat

SEQ ID NO: 2588733 - DNA, 21 bp, Homo sapiens
cagctgtttatgcatagataa

SEQ ID NO: 2588734 - DNA, 14 bp, Homo sapiens
cagctgtttgtcat

SEQ ID NO: 2588735 - DNA, 21 bp, Homo sapiens
cagcttcatttcctgtgtctt

SEQ ID NO: 2588736 - DNA, 22 bp, Homo sapiens
cagcttcctacccacacctctg

SEQ ID NO: 2588737 - DNA, 22 bp, Homo sapiens
cagcttcgtttattttcaagaa

SEQ ID NO: 2588738 - DNA, 21 bp, Homo sapiens
cagcttctggtactctcctag

SEQ ID NO: 2588739 - DNA, 22 bp, Homo sapiens
cagcttctggtactctcctaga

SEQ ID NO: 2588740 - DNA, 23 bp, Homo sapiens
cagcttctggtactctcctagag

SEQ ID NO: 2588741 - DNA, 15 bp, Homo sapiens
cagcttcttcatctt

SEQ ID NO: 2588742 - DNA, 14 bp, Homo sapiens
cagcttgagggttg

SEQ ID NO: 2588743 - DNA, 13 bp, Homo sapiens
cagcttgccccgg

SEQ ID NO: 2588744 - DNA, 16 bp, Homo sapiens
cagcttgccccggccc

SEQ ID NO: 2588745 - DNA, 21 bp, Homo sapiens
cagcttgggcccagctgggct

SEQ ID NO: 2588746 - DNA, 23 bp, Homo sapiens
cagcttgggcccagctgggctct

SEQ ID NO: 2588747 - DNA, 20 bp, Homo sapiens
cagcttgtaaatagctcagg

SEQ ID NO: 2588748 - DNA, 15 bp, Homo sapiens
cagcttgtggagccc

SEQ ID NO: 2588749 - DNA, 21 bp, Homo sapiens
cagcttgtggagccccacact

SEQ ID NO: 2588750 - DNA, 20 bp, Homo sapiens
cagctttaaactcagggaca

SEQ ID NO: 2588751 - DNA, 21 bp, Homo sapiens
cagctttacatgcaatttatt

SEQ ID NO: 2588752 - DNA, 16 bp, Homo sapiens
cagctttcatgattag

SEQ ID NO: 2588753 - DNA, 15 bp, Homo sapiens
cagctttgccttcca

SEQ ID NO: 2588754 - DNA, 21 bp, Homo sapiens
cagctttgtttgttgtcagct

SEQ ID NO: 2588755 - DNA, 15 bp, Homo sapiens
cagcttttgcttcat

SEQ ID NO: 2588756 - DNA, 17 bp, Homo sapiens
cagctttttaccaagtt

SEQ ID NO: 2588757 - DNA, 21 bp, Homo sapiens
caggagaaggccaattcctat

SEQ ID NO: 2588758 - DNA, 14 bp, Homo sapiens
caggagacaggaag

SEQ ID NO: 2588759 - DNA, 12 bp, Homo sapiens
caggagacatcc

SEQ ID NO: 2588760 - DNA, 12 bp, Homo sapiens
caggagagcagc

SEQ ID NO: 2588761 - DNA, 20 bp, Homo sapiens
caggagaggagcgggacctg

SEQ ID NO: 2588762 - DNA, 12 bp, Homo sapiens
caggagagggaa

SEQ ID NO: 2588763 - DNA, 15 bp, Homo sapiens
caggagaggggcaga

SEQ ID NO: 2588764 - DNA, 17 bp, Homo sapiens
caggagaggggcagaac

SEQ ID NO: 2588765 - DNA, 18 bp, Homo sapiens
caggagcaaatgtttctg

SEQ ID NO: 2588766 - DNA, 13 bp, Homo sapiens
caggagcagccac

SEQ ID NO: 2588767 - DNA, 20 bp, Homo sapiens
caggagcagcctcagaacaa

SEQ ID NO: 2588768 - DNA, 11 bp, Homo sapiens
caggagcctgg

SEQ ID NO: 2588769 - DNA, 12 bp, Homo sapiens
caggagctgggc

SEQ ID NO: 2588770 - DNA, 15 bp, Homo sapiens
caggagctgggcaga

SEQ ID NO: 2588771 - DNA, 23 bp, Homo sapiens
caggaggaatcatgtcaggcctg

SEQ ID NO: 2588772 - DNA, 15 bp, Homo sapiens
caggaggacaattca

SEQ ID NO: 2588773 - DNA, 16 bp, Homo sapiens
caggaggacaattcat

SEQ ID NO: 2588774 - DNA, 22 bp, Homo sapiens
caggaggacaattcatgaactt

SEQ ID NO: 2588775 - DNA, 23 bp, Homo sapiens
caggaggattgcttgagcccagg

SEQ ID NO: 2588776 - DNA, 17 bp, Homo sapiens
caggaggccagccttga

SEQ ID NO: 2588777 - DNA, 19 bp, Homo sapiens
caggaggccagccttgacc

SEQ ID NO: 2588778 - DNA, 22 bp, Homo sapiens
caggaggccagccttgaccatt

SEQ ID NO: 2588779 - DNA, 19 bp, Homo sapiens
caggaggcccctggcccag

SEQ ID NO: 2588780 - DNA, 19 bp, Homo sapiens
caggaggccggggccgggt

SEQ ID NO: 2588781 - DNA, 13 bp, Homo sapiens
caggaggctgagg

SEQ ID NO: 2588782 - DNA, 15 bp, Homo sapiens
caggaggctgaggca

SEQ ID NO: 2588783 - DNA, 16 bp, Homo sapiens
caggaggctgaggcag

SEQ ID NO: 2588784 - DNA, 19 bp, Homo sapiens
caggaggctgaggcaggag

SEQ ID NO: 2588785 - DNA, 16 bp, Homo sapiens
caggagggccctacct

SEQ ID NO: 2588786 - DNA, 20 bp, Homo sapiens
caggaggtggaggctgcagt

SEQ ID NO: 2588787 - DNA, 16 bp, Homo sapiens
caggagtcccaaggaa

SEQ ID NO: 2588788 - DNA, 18 bp, Homo sapiens
caggagtcccaaggaaag

SEQ ID NO: 2588789 - DNA, 14 bp, Homo sapiens
caggagtccctggt

SEQ ID NO: 2588790 - DNA, 19 bp, Homo sapiens
caggagttagaggccagcc

SEQ ID NO: 2588791 - DNA, 21 bp, Homo sapiens
caggagttagaggccagcctg

SEQ ID NO: 2588792 - DNA, 18 bp, Homo sapiens
caggagtttgaggctgca

SEQ ID NO: 2588793 - DNA, 20 bp, Homo sapiens
caggagtttgaggctgcagc

SEQ ID NO: 2588794 - DNA, 14 bp, Homo sapiens
caggatacatgtgc

SEQ ID NO: 2588795 - DNA, 20 bp, Homo sapiens
caggatactctgtcagatgg

SEQ ID NO: 2588796 - DNA, 23 bp, Homo sapiens
caggatactctgtcagatgggaa

SEQ ID NO: 2588797 - DNA, 23 bp, Homo sapiens
caggatcagattgcatgtgactc

SEQ ID NO: 2588798 - DNA, 15 bp, Homo sapiens
caggatcatggtgta

SEQ ID NO: 2588799 - DNA, 19 bp, Homo sapiens
caggatcatggtgtaataa

SEQ ID NO: 2588800 - DNA, 22 bp, Homo sapiens
caggatcatggtgtaataagac

SEQ ID NO: 2588801 - DNA, 23 bp, Homo sapiens
caggatcatggtgtaataagaca

SEQ ID NO: 2588802 - DNA, 19 bp, Homo sapiens
caggatcctattctcacca

SEQ ID NO: 2588803 - DNA, 21 bp, Homo sapiens
caggatcctattctcaccagg

SEQ ID NO: 2588804 - DNA, 23 bp, Homo sapiens
caggatcgcaagagccatgtaga

SEQ ID NO: 2588805 - DNA, 16 bp, Homo sapiens
caggatgacctggata

SEQ ID NO: 2588806 - DNA, 13 bp, Homo sapiens
caggatgcccagg

SEQ ID NO: 2588807 - DNA, 19 bp, Homo sapiens
caggatgcccagggccact

SEQ ID NO: 2588808 - DNA, 22 bp, Homo sapiens
caggatgcccagggccactctg

SEQ ID NO: 2588809 - DNA, 21 bp, Homo sapiens
caggatggaggggtggtcctg

SEQ ID NO: 2588810 - DNA, 22 bp, Homo sapiens
caggatggaggggtggtcctga

SEQ ID NO: 2588811 - DNA, 23 bp, Homo sapiens
caggatggcccttcccactggag

SEQ ID NO: 2588812 - DNA, 22 bp, Homo sapiens
caggattttaacaaaagcaaga

SEQ ID NO: 2588813 - DNA, 16 bp, Homo sapiens
caggcaactgaggcag

SEQ ID NO: 2588814 - DNA, 15 bp, Homo sapiens
caggcaatgctggct

SEQ ID NO: 2588815 - DNA, 17 bp, Homo sapiens
caggcaatgctggctgt

SEQ ID NO: 2588816 - DNA, 18 bp, Homo sapiens
caggcacccaccatcatg

SEQ ID NO: 2588817 - DNA, 22 bp, Homo sapiens
caggcacccaccatcatgtctg

SEQ ID NO: 2588818 - DNA, 23 bp, Homo sapiens
caggcacccaccatcatgtctgg

SEQ ID NO: 2588819 - DNA, 16 bp, Homo sapiens
caggcaccccctggag

SEQ ID NO: 2588820 - DNA, 18 bp, Homo sapiens
caggcaccccctggagag

SEQ ID NO: 2588821 - DNA, 13 bp, Homo sapiens
caggcaccgagaa

SEQ ID NO: 2588822 - DNA, 20 bp, Homo sapiens
caggcacctcacagaaatga

SEQ ID NO: 2588823 - DNA, 16 bp, Homo sapiens
caggcactgctgccca

SEQ ID NO: 2588824 - DNA, 15 bp, Homo sapiens
caggcagagaatcat

SEQ ID NO: 2588825 - DNA, 18 bp, Homo sapiens
caggcagatacaggaaaa

SEQ ID NO: 2588826 - DNA, 13 bp, Homo sapiens
caggcagatctgt

SEQ ID NO: 2588827 - DNA, 11 bp, Homo sapiens
caggcagcaga

SEQ ID NO: 2588828 - DNA, 16 bp, Homo sapiens
caggcagccaggccac

SEQ ID NO: 2588829 - DNA, 12 bp, Homo sapiens
caggcagcccta

SEQ ID NO: 2588830 - DNA, 15 bp, Homo sapiens
caggcagcgccaagc

SEQ ID NO: 2588831 - DNA, 19 bp, Homo sapiens
caggcagctttttctctcc

SEQ ID NO: 2588832 - DNA, 21 bp, Homo sapiens
caggcaggccaaggccttctc

SEQ ID NO: 2588833 - DNA, 13 bp, Homo sapiens
caggcaggctgtg

SEQ ID NO: 2588834 - DNA, 19 bp, Homo sapiens
caggcaggctgtgcgctga

SEQ ID NO: 2588835 - DNA, 23 bp, Homo sapiens
caggcagggctgactctaggtgc

SEQ ID NO: 2588836 - DNA, 13 bp, Homo sapiens
caggcaggtccag

SEQ ID NO: 2588837 - DNA, 12 bp, Homo sapiens
caggcaggtctt

SEQ ID NO: 2588838 - DNA, 13 bp, Homo sapiens
caggcaggtcttg

SEQ ID NO: 2588839 - DNA, 15 bp, Homo sapiens
caggcaggtgggatg

SEQ ID NO: 2588840 - DNA, 16 bp, Homo sapiens
caggcagtcgggggct

SEQ ID NO: 2588841 - DNA, 22 bp, Homo sapiens
caggcagtcgggggctggccta

SEQ ID NO: 2588842 - DNA, 23 bp, Homo sapiens
caggcagtcgggggctggcctag

SEQ ID NO: 2588843 - DNA, 24 bp, Homo sapiens
caggcagtcgggggctggcctagg

SEQ ID NO: 2588844 - DNA, 20 bp, Homo sapiens
caggcagtgatgctggatgc

SEQ ID NO: 2588845 - DNA, 17 bp, Homo sapiens
caggcataggcctgggt

SEQ ID NO: 2588846 - DNA, 12 bp, Homo sapiens
caggcatcctcc

SEQ ID NO: 2588847 - DNA, 20 bp, Homo sapiens
caggcatgaacatgtactgt

SEQ ID NO: 2588848 - DNA, 15 bp, Homo sapiens
caggcatgttctctg

SEQ ID NO: 2588849 - DNA, 19 bp, Homo sapiens
caggcatgttctctgagga

SEQ ID NO: 2588850 - DNA, 15 bp, Homo sapiens
caggcattccccagg

SEQ ID NO: 2588851 - DNA, 19 bp, Homo sapiens
caggcattccccaggaggc

SEQ ID NO: 2588852 - DNA, 21 bp, Homo sapiens
caggcattccccaggaggcca

SEQ ID NO: 2588853 - DNA, 21 bp, Homo sapiens
caggccaagagcagaggcagc

SEQ ID NO: 2588854 - DNA, 23 bp, Homo sapiens
caggccaagagcagaggcagcga

SEQ ID NO: 2588855 - DNA, 13 bp, Homo sapiens
caggccacaagac

SEQ ID NO: 2588856 - DNA, 17 bp, Homo sapiens
caggccacaagaccctt

SEQ ID NO: 2588857 - DNA, 20 bp, Homo sapiens
caggccacaagacccttgtg

SEQ ID NO: 2588858 - DNA, 16 bp, Homo sapiens
caggccaccaggatgg

SEQ ID NO: 2588859 - DNA, 16 bp, Homo sapiens
caggccacctgccccc

SEQ ID NO: 2588860 - DNA, 18 bp, Homo sapiens
caggccacctgccccctt

SEQ ID NO: 2588861 - DNA, 15 bp, Homo sapiens
caggccacttgatga

SEQ ID NO: 2588862 - DNA, 16 bp, Homo sapiens
caggccagagggagtg

SEQ ID NO: 2588863 - DNA, 14 bp, Homo sapiens
caggccaggccctc

SEQ ID NO: 2588864 - DNA, 16 bp, Homo sapiens
caggccaggccctctg

SEQ ID NO: 2588865 - DNA, 22 bp, Homo sapiens
caggccaggccctctgcccact

SEQ ID NO: 2588866 - DNA, 15 bp, Homo sapiens
caggccaggtgcagt

SEQ ID NO: 2588867 - DNA, 16 bp, Homo sapiens
caggccagtaagggaa

SEQ ID NO: 2588868 - DNA, 19 bp, Homo sapiens
caggcccaagagatgaaga

SEQ ID NO: 2588869 - DNA, 13 bp, Homo sapiens
caggcccacagta

SEQ ID NO: 2588870 - DNA, 13 bp, Homo sapiens
caggccccaggaa

SEQ ID NO: 2588871 - DNA, 14 bp, Homo sapiens
caggccccaggaag

SEQ ID NO: 2588872 - DNA, 15 bp, Homo sapiens
caggccccaggaagc

SEQ ID NO: 2588873 - DNA, 16 bp, Homo sapiens
caggccccaggaagcc

SEQ ID NO: 2588874 - DNA, 15 bp, Homo sapiens
caggcccccaagcct

SEQ ID NO: 2588875 - DNA, 14 bp, Homo sapiens
caggcccccaggtg

SEQ ID NO: 2588876 - DNA, 20 bp, Homo sapiens
caggcccccaggtgccagtt

SEQ ID NO: 2588877 - DNA, 22 bp, Homo sapiens
caggccccgaggacccagaccc

SEQ ID NO: 2588878 - DNA, 15 bp, Homo sapiens
caggcccctgccacc

SEQ ID NO: 2588879 - DNA, 20 bp, Homo sapiens
caggcccctgccaccctggg

SEQ ID NO: 2588880 - DNA, 17 bp, Homo sapiens
caggcccggctccaggc

SEQ ID NO: 2588881 - DNA, 21 bp, Homo sapiens
caggcccggctccaggctcct

SEQ ID NO: 2588882 - DNA, 17 bp, Homo sapiens
caggccctctgcccact

SEQ ID NO: 2588883 - DNA, 21 bp, Homo sapiens
caggccctctgcccactccct

SEQ ID NO: 2588884 - DNA, 22 bp, Homo sapiens
caggccctctgcccactccctg

SEQ ID NO: 2588885 - DNA, 14 bp, Homo sapiens
caggccgcagctct

SEQ ID NO: 2588886 - DNA, 15 bp, Homo sapiens
caggccgcagctctt

SEQ ID NO: 2588887 - DNA, 19 bp, Homo sapiens
caggccggtgtgggctgtg

SEQ ID NO: 2588888 - DNA, 18 bp, Homo sapiens
caggcctccctctctctt

SEQ ID NO: 2588889 - DNA, 19 bp, Homo sapiens
caggcctccctctctcttc

SEQ ID NO: 2588890 - DNA, 12 bp, Homo sapiens
caggcctctgtg

SEQ ID NO: 2588891 - DNA, 13 bp, Homo sapiens
caggcctctgtgt

SEQ ID NO: 2588892 - DNA, 14 bp, Homo sapiens
caggcctctgtgtc

SEQ ID NO: 2588893 - DNA, 15 bp, Homo sapiens
caggcctctgtgtcc

SEQ ID NO: 2588894 - DNA, 22 bp, Homo sapiens
caggcctctgtgtccttccctg

SEQ ID NO: 2588895 - DNA, 17 bp, Homo sapiens
caggcctggcaagtggg

SEQ ID NO: 2588896 - DNA, 17 bp, Homo sapiens
caggcctgggccagagt

SEQ ID NO: 2588897 - DNA, 14 bp, Homo sapiens
caggcctgggtctg

SEQ ID NO: 2588898 - DNA, 18 bp, Homo sapiens
caggcctgggtctgtgtc

SEQ ID NO: 2588899 - DNA, 20 bp, Homo sapiens
caggcctgggtctgtgtctc

SEQ ID NO: 2588900 - DNA, 15 bp, Homo sapiens
caggcgaggcctgga

SEQ ID NO: 2588901 - DNA, 16 bp, Homo sapiens
cattgctttgaagcag

SEQ ID NO: 2588902 - DNA, 22 bp, Homo sapiens
cattgctttgaagcagttgtgt

SEQ ID NO: 2588903 - DNA, 23 bp, Homo sapiens
cattgctttgaagcagttgtgtc

SEQ ID NO: 2588904 - DNA, 16 bp, Homo sapiens
cattggaagaccccac

SEQ ID NO: 2588905 - DNA, 18 bp, Homo sapiens
cattggaagaccccaccc

SEQ ID NO: 2588906 - DNA, 20 bp, Homo sapiens
cattggaagaccccacccaa

SEQ ID NO: 2588907 - DNA, 18 bp, Homo sapiens
cattggacccacatgagg

SEQ ID NO: 2588908 - DNA, 16 bp, Homo sapiens
cattggacccttccat

SEQ ID NO: 2588909 - DNA, 14 bp, Homo sapiens
cattggctatttaa

SEQ ID NO: 2588910 - DNA, 20 bp, Homo sapiens
cattgggtcctgggtctttc

SEQ ID NO: 2588911 - DNA, 21 bp, Homo sapiens
cattgggtcctgggtctttca

SEQ ID NO: 2588912 - DNA, 19 bp, Homo sapiens
cattgggtgggtaaattca

SEQ ID NO: 2588913 - DNA, 14 bp, Homo sapiens
cattggtggactac

SEQ ID NO: 2588914 - DNA, 13 bp, Homo sapiens
cattgtaaaccac

SEQ ID NO: 2588915 - DNA, 16 bp, Homo sapiens
cattgtagagcttctg

SEQ ID NO: 2588916 - DNA, 19 bp, Homo sapiens
cattgtagagcttctggca

SEQ ID NO: 2588917 - DNA, 20 bp, Homo sapiens
cattgtatgatgtgttgtga

SEQ ID NO: 2588918 - DNA, 19 bp, Homo sapiens
cattgtccaatcctatgtt

SEQ ID NO: 2588919 - DNA, 18 bp, Homo sapiens
cattgtgaactgacaggc

SEQ ID NO: 2588920 - DNA, 17 bp, Homo sapiens
cattgtggcacattctt

SEQ ID NO: 2588921 - DNA, 21 bp, Homo sapiens
cattgtttgaaacaaagaagg

SEQ ID NO: 2588922 - DNA, 18 bp, Homo sapiens
cattgtttgcttattgtt

SEQ ID NO: 2588923 - DNA, 21 bp, Homo sapiens
cattgtttgcttattgttcca

SEQ ID NO: 2588924 - DNA, 22 bp, Homo sapiens
cattgtttgcttattgttccaa

SEQ ID NO: 2588925 - DNA, 23 bp, Homo sapiens
cattgttttaaaaagaaacaaga

SEQ ID NO: 2588926 - DNA, 17 bp, Homo sapiens
catttaaaacagacact

SEQ ID NO: 2588927 - DNA, 15 bp, Homo sapiens
catttaaaagataca

SEQ ID NO: 2588928 - DNA, 17 bp, Homo sapiens
catttaaaatgattaga

SEQ ID NO: 2588929 - DNA, 19 bp, Homo sapiens
catttaaagcttattaaaa

SEQ ID NO: 2588930 - DNA, 23 bp, Homo sapiens
catttaaattttaccctttagac

SEQ ID NO: 2588931 - DNA, 24 bp, Homo sapiens
catttaatgtagccatgggaccaa

SEQ ID NO: 2588932 - DNA, 22 bp, Homo sapiens
catttacccttcttttctgact

SEQ ID NO: 2588933 - DNA, 15 bp, Homo sapiens
catttactgtggctt

SEQ ID NO: 2588934 - DNA, 19 bp, Homo sapiens
catttagattgaaaacttt

SEQ ID NO: 2588935 - DNA, 20 bp, Homo sapiens
catttagtccaatgtctttt

SEQ ID NO: 2588936 - DNA, 14 bp, Homo sapiens
catttagttctttg

SEQ ID NO: 2588937 - DNA, 20 bp, Homo sapiens
catttagttctttgttattt

SEQ ID NO: 2588938 - DNA, 21 bp, Homo sapiens
ccacaagaaatttgatttcta

SEQ ID NO: 2588939 - DNA, 16 bp, Homo sapiens
ccacaagacccttgtg

SEQ ID NO: 2588940 - DNA, 14 bp, Homo sapiens
ccacacacacacac

SEQ ID NO: 2588941 - DNA, 21 bp, Homo sapiens
ccacacacacacacatgcata

SEQ ID NO: 2588942 - DNA, 16 bp, Homo sapiens
ccacacacacagaaaa

SEQ ID NO: 2588943 - DNA, 17 bp, Homo sapiens
ccacacacacagaaaat

SEQ ID NO: 2588944 - DNA, 18 bp, Homo sapiens
ccacacacacagaaaata

SEQ ID NO: 2588945 - DNA, 19 bp, Homo sapiens
ccacacacacagaaaatat

SEQ ID NO: 2588946 - DNA, 21 bp, Homo sapiens
ccacacacacagaaaatatac

SEQ ID NO: 2588947 - DNA, 22 bp, Homo sapiens
ccacacacacagaaaatatact

SEQ ID NO: 2588948 - DNA, 23 bp, Homo sapiens
ccacacacacagaaaatatactg

SEQ ID NO: 2588949 - DNA, 17 bp, Homo sapiens
ccacacacagaggaaga

SEQ ID NO: 2588950 - DNA, 18 bp, Homo sapiens
ccacacacagaggaagag

SEQ ID NO: 2588951 - DNA, 19 bp, Homo sapiens
ccacacacagctgggctgt

SEQ ID NO: 2588952 - DNA, 20 bp, Homo sapiens
ccacacacagctgggctgtg

SEQ ID NO: 2588953 - DNA, 20 bp, Homo sapiens
ccacacagacttgggcaggg

SEQ ID NO: 2588954 - DNA, 15 bp, Homo sapiens
ccacacccagcccac

SEQ ID NO: 2588955 - DNA, 21 bp, Homo sapiens
ccacacccagcccacttctgc

SEQ ID NO: 2588956 - DNA, 22 bp, Homo sapiens
ccacacccagcccacttctgcc

SEQ ID NO: 2588957 - DNA, 13 bp, Homo sapiens
ccacacccccacc

SEQ ID NO: 2588958 - DNA, 18 bp, Homo sapiens
ccacaccctctcccagga

SEQ ID NO: 2588959 - DNA, 19 bp, Homo sapiens
ccacaccctgtactgttct

SEQ ID NO: 2588960 - DNA, 16 bp, Homo sapiens
ccacaccgtgtaaacc

SEQ ID NO: 2588961 - DNA, 14 bp, Homo sapiens
ccacacctccacag

SEQ ID NO: 2588962 - DNA, 23 bp, Homo sapiens
ccacacctccacagttcagtggc

SEQ ID NO: 2588963 - DNA, 14 bp, Homo sapiens
ccacacctctgcca

SEQ ID NO: 2588964 - DNA, 23 bp, Homo sapiens
ccacactgctaggtgggccagcc

SEQ ID NO: 2588965 - DNA, 14 bp, Homo sapiens
ccacactggactcc

SEQ ID NO: 2588966 - DNA, 19 bp, Homo sapiens
ccacactggggtgccgcct

SEQ ID NO: 2588967 - DNA, 20 bp, Homo sapiens
ccacactggggtgccgcctg

SEQ ID NO: 2588968 - DNA, 14 bp, Homo sapiens
ccacactggtgact

SEQ ID NO: 2588969 - DNA, 12 bp, Homo sapiens
ccacacttcctg

SEQ ID NO: 2588970 - DNA, 21 bp, Homo sapiens
ccacacttgttccagctcttt

SEQ ID NO: 2588971 - DNA, 18 bp, Homo sapiens
ccacagaagccaggagca

SEQ ID NO: 2588972 - DNA, 20 bp, Homo sapiens
ccacagaagccaggagcaaa

SEQ ID NO: 2588973 - DNA, 22 bp, Homo sapiens
ccacagagaaagtacttctcca

SEQ ID NO: 2588974 - DNA, 14 bp, Homo sapiens
ccacagagcgggga

SEQ ID NO: 2588975 - DNA, 18 bp, Homo sapiens
ccacagatgcctccaccc

SEQ ID NO: 2588976 - DNA, 23 bp, Homo sapiens
ccacagccctgtcagtgcagccc

SEQ ID NO: 2588977 - DNA, 18 bp, Homo sapiens
ccacagccgcagcctccc

SEQ ID NO: 2588978 - DNA, 20 bp, Homo sapiens
ccacagcctcccctgccagg

SEQ ID NO: 2588979 - DNA, 12 bp, Homo sapiens
ccacagctgctg

SEQ ID NO: 2588980 - DNA, 16 bp, Homo sapiens
ccacagctgctggaga

SEQ ID NO: 2588981 - DNA, 23 bp, Homo sapiens
ccacaggaagcctgcagtcctgg

SEQ ID NO: 2588982 - DNA, 16 bp, Homo sapiens
ccacaggacatttctc

SEQ ID NO: 2588983 - DNA, 14 bp, Homo sapiens
ccacaggcagcttt

SEQ ID NO: 2588984 - DNA, 22 bp, Homo sapiens
ccacaggttcatgccaccatgg

SEQ ID NO: 2588985 - DNA, 12 bp, Homo sapiens
ccacagtgtctg

SEQ ID NO: 2588986 - DNA, 15 bp, Homo sapiens
ccacagttcagtggc

SEQ ID NO: 2588987 - DNA, 22 bp, Homo sapiens
ccacagttcagtggcagggctc

SEQ ID NO: 2588988 - DNA, 22 bp, Homo sapiens
ccacatcaatattgtcattcct

SEQ ID NO: 2588989 - DNA, 17 bp, Homo sapiens
ccacatccctttgaaac

SEQ ID NO: 2588990 - DNA, 19 bp, Homo sapiens
ccacatcctccgtccagcc

SEQ ID NO: 2588991 - DNA, 17 bp, Homo sapiens
ccacatcttgctctgct

SEQ ID NO: 2588992 - DNA, 20 bp, Homo sapiens
ccacatcttgctctgctgac

SEQ ID NO: 2588993 - DNA, 17 bp, Homo sapiens
ccacatggcttcctcct

SEQ ID NO: 2588994 - DNA, 20 bp, Homo sapiens
ccacatggggctgggcagct

SEQ ID NO: 2588995 - DNA, 14 bp, Homo sapiens
ccacattgttttaa

SEQ ID NO: 2588996 - DNA, 17 bp, Homo sapiens
ccaccaagagggacgcc

SEQ ID NO: 2588997 - DNA, 16 bp, Homo sapiens
ccaccacacccagccc

SEQ ID NO: 2588998 - DNA, 20 bp, Homo sapiens
ccagtgttagggaagggcct

SEQ ID NO: 2588999 - DNA, 19 bp, Homo sapiens
cccaggggtgccccctcct

SEQ ID NO: 2589000 - DNA, 22 bp, Homo sapiens
cccaggggtgccccctcctctc

SEQ ID NO: 2589001 - DNA, 23 bp, Homo sapiens
cccaggggtgccccctcctctcc

SEQ ID NO: 2589002 - DNA, 15 bp, Homo sapiens
cccagggtagcccgc

SEQ ID NO: 2589003 - DNA, 16 bp, Homo sapiens
cccagggtagcccgcc

SEQ ID NO: 2589004 - DNA, 16 bp, Homo sapiens
cccagggtcttcccta

SEQ ID NO: 2589005 - DNA, 18 bp, Homo sapiens
cccagggtcttccctacc

SEQ ID NO: 2589006 - DNA, 20 bp, Homo sapiens
cccaggtcctctgataccca

SEQ ID NO: 2589007 - DNA, 22 bp, Homo sapiens
cccaggtgctaggaacactcct

SEQ ID NO: 2589008 - DNA, 13 bp, Homo sapiens
cccaggtttctgg

SEQ ID NO: 2589009 - DNA, 17 bp, Homo sapiens
cccagtcagcctctctc

SEQ ID NO: 2589010 - DNA, 22 bp, Homo sapiens
cccagtcagcctctctcccagt

SEQ ID NO: 2589011 - DNA, 23 bp, Homo sapiens
cccagtccaaatgtcctccagaa

SEQ ID NO: 2589012 - DNA, 13 bp, Homo sapiens
cccagtcctggcc

SEQ ID NO: 2589013 - DNA, 17 bp, Homo sapiens
cccagtctacccagaga

SEQ ID NO: 2589014 - DNA, 20 bp, Homo sapiens
cccagtctggaatgcagtgg

SEQ ID NO: 2589015 - DNA, 12 bp, Homo sapiens
cccagtgacact

SEQ ID NO: 2589016 - DNA, 13 bp, Homo sapiens
cccagtgacactt

SEQ ID NO: 2589017 - DNA, 19 bp, Homo sapiens
cccagtgagattacagagg

SEQ ID NO: 2589018 - DNA, 19 bp, Homo sapiens
cccagtgagcactcccaag

SEQ ID NO: 2589019 - DNA, 15 bp, Homo sapiens
cccagtgcccacagg

SEQ ID NO: 2589020 - DNA, 13 bp, Homo sapiens
cccagtggcctca

SEQ ID NO: 2589021 - DNA, 15 bp, Homo sapiens
ccccagtgcccacag

SEQ ID NO: 2589022 - DNA, 16 bp, Homo sapiens
ccccagttctgctcct

SEQ ID NO: 2589023 - DNA, 17 bp, Homo sapiens
ccccagttctgctcctc

SEQ ID NO: 2589024 - DNA, 16 bp, Homo sapiens
ccccatcctccagctt

SEQ ID NO: 2589025 - DNA, 17 bp, Homo sapiens
ccccatcctccagcttc

SEQ ID NO: 2589026 - DNA, 19 bp, Homo sapiens
ccccatcctccccttccct

SEQ ID NO: 2589027 - DNA, 17 bp, Homo sapiens
ccccatcctctgtacag

SEQ ID NO: 2589028 - DNA, 22 bp, Homo sapiens
ccccatcctctgtacagagccc

SEQ ID NO: 2589029 - DNA, 12 bp, Homo sapiens
ccccatctctcc

SEQ ID NO: 2589030 - DNA, 12 bp, Homo sapiens
ccccatctgtga

SEQ ID NO: 2589031 - DNA, 13 bp, Homo sapiens
ccccatgcctgtc

SEQ ID NO: 2589032 - DNA, 20 bp, Homo sapiens
ccccatgcctgtccagcctg

SEQ ID NO: 2589033 - DNA, 16 bp, Homo sapiens
ccccatgtgtcctggt

SEQ ID NO: 2589034 - DNA, 23 bp, Homo sapiens
ccccattcctgggaaatattccc

SEQ ID NO: 2589035 - DNA, 16 bp, Homo sapiens
ccccattcttcctagt

SEQ ID NO: 2589036 - DNA, 17 bp, Homo sapiens
ccccattgcctcctcct

SEQ ID NO: 2589037 - DNA, 15 bp, Homo sapiens
ccccattgtggtcac

SEQ ID NO: 2589038 - DNA, 13 bp, Homo sapiens
ccccatttctatt

SEQ ID NO: 2589039 - DNA, 19 bp, Homo sapiens
cccccaagctgttttcttc

SEQ ID NO: 2589040 - DNA, 12 bp, Homo sapiens
cccccacacaca

SEQ ID NO: 2589041 - DNA, 19 bp, Homo sapiens
cccccacacacacacacat

SEQ ID NO: 2589042 - DNA, 24 bp, Homo sapiens
cccccacccaagggcctggcctga

SEQ ID NO: 2589043 - DNA, 13 bp, Homo sapiens
cccccacccactt

SEQ ID NO: 2589044 - DNA, 17 bp, Homo sapiens
cccccaccccttcccca

SEQ ID NO: 2589045 - DNA, 13 bp, Homo sapiens
cccccactggtga

SEQ ID NO: 2589046 - DNA, 15 bp, Homo sapiens
cccccactggtgaca

SEQ ID NO: 2589047 - DNA, 12 bp, Homo sapiens
cccccagccctg

SEQ ID NO: 2589048 - DNA, 14 bp, Homo sapiens
cccccagccctgtg

SEQ ID NO: 2589049 - DNA, 12 bp, Homo sapiens
cccccagctctg

SEQ ID NO: 2589050 - DNA, 14 bp, Homo sapiens
cccccagctctggt

SEQ ID NO: 2589051 - DNA, 11 bp, Homo sapiens
cccccagctgg

SEQ ID NO: 2589052 - DNA, 11 bp, Homo sapiens
ccccccactct

SEQ ID NO: 2589053 - DNA, 12 bp, Homo sapiens
ccccccactctc

SEQ ID NO: 2589054 - DNA, 18 bp, Homo sapiens
ccccccagaacctgtcct

SEQ ID NO: 2589055 - DNA, 13 bp, Homo sapiens
ccacttcagctga

SEQ ID NO: 2589056 - DNA, 23 bp, Homo sapiens
ccacttcattcttgaaagctgtg

SEQ ID NO: 2589057 - DNA, 14 bp, Homo sapiens
ccacttccctgggc

SEQ ID NO: 2589058 - DNA, 17 bp, Homo sapiens
ccacttgggtcttccct

SEQ ID NO: 2589059 - DNA, 16 bp, Homo sapiens
ccacttttattcattt

SEQ ID NO: 2589060 - DNA, 14 bp, Homo sapiens
ccacttttgttctt

SEQ ID NO: 2589061 - DNA, 19 bp, Homo sapiens
ccagaaaaaaaaaaactta

SEQ ID NO: 2589062 - DNA, 15 bp, Homo sapiens
ccagaaaaggacaga

SEQ ID NO: 2589063 - DNA, 23 bp, Homo sapiens
ccagaaataaagttggtgacaga

SEQ ID NO: 2589064 - DNA, 22 bp, Homo sapiens
ccagaaatccatctaaatacct

SEQ ID NO: 2589065 - DNA, 22 bp, Homo sapiens
ccagaacacactccatcagctt

SEQ ID NO: 2589066 - DNA, 22 bp, Homo sapiens
ccagaagaaaatagtggtgtga

SEQ ID NO: 2589067 - DNA, 18 bp, Homo sapiens
ccagaagaatattcagga

SEQ ID NO: 2589068 - DNA, 22 bp, Homo sapiens
ccagaagatagcttcaccccaa

SEQ ID NO: 2589069 - DNA, 24 bp, Homo sapiens
ccagaagatcccctcaggactgca

SEQ ID NO: 2589070 - DNA, 16 bp, Homo sapiens
ccagaagccaaagact

SEQ ID NO: 2589071 - DNA, 19 bp, Homo sapiens
ccagaagcctctggctaga

SEQ ID NO: 2589072 - DNA, 20 bp, Homo sapiens
ccagaagctgagcaccaggg

SEQ ID NO: 2589073 - DNA, 22 bp, Homo sapiens
ccagaagtttgagatcagcctg

SEQ ID NO: 2589074 - DNA, 16 bp, Homo sapiens
ccagaataaacccagc

SEQ ID NO: 2589075 - DNA, 15 bp, Homo sapiens
ccagaataagttatt

SEQ ID NO: 2589076 - DNA, 20 bp, Homo sapiens
ccagacacatgtccaagaag

SEQ ID NO: 2589077 - DNA, 20 bp, Homo sapiens
ccagacaccttgacagggca

SEQ ID NO: 2589078 - DNA, 18 bp, Homo sapiens
ccagacagacatctctgc

SEQ ID NO: 2589079 - DNA, 13 bp, Homo sapiens
ccagacagcctgt

SEQ ID NO: 2589080 - DNA, 14 bp, Homo sapiens
ccagacagcctgta

SEQ ID NO: 2589081 - DNA, 17 bp, Homo sapiens
ccagacagcctgtatct

SEQ ID NO: 2589082 - DNA, 14 bp, Homo sapiens
ccagacatcaacag

SEQ ID NO: 2589083 - DNA, 19 bp, Homo sapiens
ccagacatgtggtgggaca

SEQ ID NO: 2589084 - DNA, 14 bp, Homo sapiens
ccagacccagtggg

SEQ ID NO: 2589085 - DNA, 12 bp, Homo sapiens
ccagacccccac

SEQ ID NO: 2589086 - DNA, 19 bp, Homo sapiens
ccagacccccaccccttcc

SEQ ID NO: 2589087 - DNA, 21 bp, Homo sapiens
ccagcctggctcccacaggca

SEQ ID NO: 2589088 - DNA, 19 bp, Homo sapiens
ccagcctggcttctggagc

SEQ ID NO: 2589089 - DNA, 16 bp, Homo sapiens
ccagcctgggcagcca

SEQ ID NO: 2589090 - DNA, 18 bp, Homo sapiens
ccagcctgggcagccagg

SEQ ID NO: 2589091 - DNA, 23 bp, Homo sapiens
ccagcctgggcagccaggctgcc

SEQ ID NO: 2589092 - DNA, 19 bp, Homo sapiens
ccagcctgggcgacagagc

SEQ ID NO: 2589093 - DNA, 14 bp, Homo sapiens
ccagcctgttggac

SEQ ID NO: 2589094 - DNA, 15 bp, Homo sapiens
ccagccttcctctgc

SEQ ID NO: 2589095 - DNA, 18 bp, Homo sapiens
ccagccttggcatctaga

SEQ ID NO: 2589096 - DNA, 19 bp, Homo sapiens
ccagcctttctcccaggcc

SEQ ID NO: 2589097 - DNA, 14 bp, Homo sapiens
ccagcgagccctgg

SEQ ID NO: 2589098 - DNA, 15 bp, Homo sapiens
ccagcgagccctggt

SEQ ID NO: 2589099 - DNA, 16 bp, Homo sapiens
ccagcgagccctggtg

SEQ ID NO: 2589100 - DNA, 16 bp, Homo sapiens
ccagcgaggaggctcc

SEQ ID NO: 2589101 - DNA, 19 bp, Homo sapiens
ccagcgcccgctgggctga

SEQ ID NO: 2589102 - DNA, 17 bp, Homo sapiens
ccagcgggaatggcagc

SEQ ID NO: 2589103 - DNA, 17 bp, Homo sapiens
ccagcgtcctcctctgt

SEQ ID NO: 2589104 - DNA, 21 bp, Homo sapiens
ccagctaccctttttctccag

SEQ ID NO: 2589105 - DNA, 22 bp, Homo sapiens
ccagctaccctttttctccagc

SEQ ID NO: 2589106 - DNA, 20 bp, Homo sapiens
ccagctactcaagaggctga

SEQ ID NO: 2589107 - DNA, 17 bp, Homo sapiens
ccagctactcagaagcc

SEQ ID NO: 2589108 - DNA, 20 bp, Homo sapiens
ccagctactcagaagcctga

SEQ ID NO: 2589109 - DNA, 16 bp, Homo sapiens
ccagctacttgggaag

SEQ ID NO: 2589110 - DNA, 17 bp, Homo sapiens
ccagctacttgggaagc

SEQ ID NO: 2589111 - DNA, 22 bp, Homo sapiens
ccagctattgatataaataaaa

SEQ ID NO: 2589112 - DNA, 22 bp, Homo sapiens
ccagctcaccagccccagtgcc

SEQ ID NO: 2589113 - DNA, 19 bp, Homo sapiens
ccagctcaccccccacact

SEQ ID NO: 2589114 - DNA, 21 bp, Homo sapiens
ccagctccaagacctgttggt

SEQ ID NO: 2589115 - DNA, 14 bp, Homo sapiens
ccagctccccaaga

SEQ ID NO: 2589116 - DNA, 12 bp, Homo sapiens
ccagctcctcat

SEQ ID NO: 2589117 - DNA, 13 bp, Homo sapiens
ccagctctcagcc

SEQ ID NO: 2589118 - DNA, 14 bp, Homo sapiens
ccagctctcagcca

SEQ ID NO: 2589119 - DNA, 15 bp, Homo sapiens
ccagctctgaaacca

SEQ ID NO: 2589120 - DNA, 12 bp, Homo sapiens
ccagctctggtc

SEQ ID NO: 2589121 - DNA, 13 bp, Homo sapiens
ccagctctggtcc

SEQ ID NO: 2589122 - DNA, 17 bp, Homo sapiens
ccagctctggtccatag

SEQ ID NO: 2589123 - DNA, 21 bp, Homo sapiens
ccagctctggtccatagagag

SEQ ID NO: 2589124 - DNA, 18 bp, Homo sapiens
ccagctctgtatcaggac

SEQ ID NO: 2589125 - DNA, 21 bp, Homo sapiens
ccagctgaaatactgaggggt

SEQ ID NO: 2589126 - DNA, 23 bp, Homo sapiens
ccagctgcacctgccagcctggc

SEQ ID NO: 2589127 - DNA, 10 bp, Homo sapiens
ccagctgcct

SEQ ID NO: 2589128 - DNA, 14 bp, Homo sapiens
ccagctgctcccca

SEQ ID NO: 2589129 - DNA, 13 bp, Homo sapiens
ccagctggcagca

SEQ ID NO: 2589130 - DNA, 12 bp, Homo sapiens
ccagctgggagg

SEQ ID NO: 2589131 - DNA, 12 bp, Homo sapiens
ccagctgggctc

SEQ ID NO: 2589132 - DNA, 16 bp, Homo sapiens
ccagctgggctctgca

SEQ ID NO: 2589133 - DNA, 18 bp, Homo sapiens
ccagctgggctctgcaat

SEQ ID NO: 2589134 - DNA, 16 bp, Homo sapiens
ccagctgggctctgcc

SEQ ID NO: 2589135 - DNA, 22 bp, Homo sapiens
ccagctgggctctgccacccta

SEQ ID NO: 2589136 - DNA, 23 bp, Homo sapiens
ccagctgggctctgccaccctac

SEQ ID NO: 2589137 - DNA, 17 bp, Homo sapiens
ccagctgggttggaaaa

SEQ ID NO: 2589138 - DNA, 22 bp, Homo sapiens
ccagctgtgctctggacaggca

SEQ ID NO: 2589139 - DNA, 17 bp, Homo sapiens
ccagctgttcagctggt

SEQ ID NO: 2589140 - DNA, 22 bp, Homo sapiens
ccagctgttctgtcccttggag

SEQ ID NO: 2589141 - DNA, 15 bp, Homo sapiens
ccagcttctccaggc

SEQ ID NO: 2589142 - DNA, 23 bp, Homo sapiens
ccagcttctggtactctcctaga

SEQ ID NO: 2589143 - DNA, 18 bp, Homo sapiens
ccagcttgggcccagctg

SEQ ID NO: 2589144 - DNA, 22 bp, Homo sapiens
ccagcttgggcccagctgggct

SEQ ID NO: 2589145 - DNA, 24 bp, Homo sapiens
ccagcttgggcccagctgggctct

SEQ ID NO: 2589146 - DNA, 18 bp, Homo sapiens
ccagcttgtggagcccca

SEQ ID NO: 2589147 - DNA, 22 bp, Homo sapiens
ccagcttgtggagccccacact

SEQ ID NO: 2589148 - DNA, 23 bp, Homo sapiens
ccagcttgtggagccccacactg

SEQ ID NO: 2589149 - DNA, 15 bp, Homo sapiens
ccagcttgttattta

SEQ ID NO: 2589150 - DNA, 17 bp, Homo sapiens
ccagcttgttatttata

SEQ ID NO: 2589151 - DNA, 20 bp, Homo sapiens
ccagctttgctaccaaagca

SEQ ID NO: 2589152 - DNA, 23 bp, Homo sapiens
ccagcttttcccaaaagcccatt

SEQ ID NO: 2589153 - DNA, 23 bp, Homo sapiens
ccaggaaactctgcattctagta

SEQ ID NO: 2589154 - DNA, 14 bp, Homo sapiens
ccaggaaaggctcc

SEQ ID NO: 2589155 - DNA, 15 bp, Homo sapiens
ccaggaaaggctcca

SEQ ID NO: 2589156 - DNA, 19 bp, Homo sapiens
ccaggaaaggctccaggag

SEQ ID NO: 2589157 - DNA, 21 bp, Homo sapiens
ccaggaaaggctccaggagca

SEQ ID NO: 2589158 - DNA, 22 bp, Homo sapiens
ccaggaaaggctccaggagcag

SEQ ID NO: 2589159 - DNA, 14 bp, Homo sapiens
ccaggaactgggcc

SEQ ID NO: 2589160 - DNA, 15 bp, Homo sapiens
ccaggaagccgtgcc

SEQ ID NO: 2589161 - DNA, 15 bp, Homo sapiens
ccaggaaggcggggc

SEQ ID NO: 2589162 - DNA, 21 bp, Homo sapiens
ccaggaagggggtccacccag

SEQ ID NO: 2589163 - DNA, 14 bp, Homo sapiens
ccaggaccagctgg

SEQ ID NO: 2589164 - DNA, 16 bp, Homo sapiens
ccaggaccagctgggg

SEQ ID NO: 2589165 - DNA, 18 bp, Homo sapiens
ccaggacgcttctgaatg

SEQ ID NO: 2589166 - DNA, 22 bp, Homo sapiens
ccaggacgcttctgaatgctgc

SEQ ID NO: 2589167 - DNA, 23 bp, Homo sapiens
ccaggacgcttctgaatgctgct

SEQ ID NO: 2589168 - DNA, 17 bp, Homo sapiens
ccaggactccccaggcc

SEQ ID NO: 2589169 - DNA, 22 bp, Homo sapiens
ccaggactccccaggccaggcc

SEQ ID NO: 2589170 - DNA, 17 bp, Homo sapiens
ccaggactccctcctca

SEQ ID NO: 2589171 - DNA, 22 bp, Homo sapiens
ccaggactccctcctcacctct

SEQ ID NO: 2589172 - DNA, 12 bp, Homo sapiens
ccaggagcagcc

SEQ ID NO: 2589173 - DNA, 15 bp, Homo sapiens
ccaggagcagccaca

SEQ ID NO: 2589174 - DNA, 16 bp, Homo sapiens
ccaggagcagccacat

SEQ ID NO: 2589175 - DNA, 23 bp, Homo sapiens
ccaggagcatccacctccttctc

SEQ ID NO: 2589176 - DNA, 20 bp, Homo sapiens
ccaggagccccgaggccttc

SEQ ID NO: 2589177 - DNA, 14 bp, Homo sapiens
ccaggaggccagcc

SEQ ID NO: 2589178 - DNA, 15 bp, Homo sapiens
ccaggaggccagcct

SEQ ID NO: 2589179 - DNA, 20 bp, Homo sapiens
ccaggagggcactggagctg

SEQ ID NO: 2589180 - DNA, 18 bp, Homo sapiens
ccaggaggtcgaccccaa

SEQ ID NO: 2589181 - DNA, 22 bp, Homo sapiens
ccaggaggtggctatggccacc

SEQ ID NO: 2589182 - DNA, 17 bp, Homo sapiens
ccaggagtttgagacca

SEQ ID NO: 2589183 - DNA, 21 bp, Homo sapiens
ccaggagtttgaggctgcagc

SEQ ID NO: 2589184 - DNA, 18 bp, Homo sapiens
ccaggatcagattgcatg

SEQ ID NO: 2589185 - DNA, 17 bp, Homo sapiens
ccaggatccagaagggg

SEQ ID NO: 2589186 - DNA, 20 bp, Homo sapiens
ccaggatgagcatcccagga

SEQ ID NO: 2589187 - DNA, 20 bp, Homo sapiens
ccaggcagatctgtgcccca

SEQ ID NO: 2589188 - DNA, 21 bp, Homo sapiens
ccaggcagatctgtgccccat

SEQ ID NO: 2589189 - DNA, 18 bp, Homo sapiens
ccaggcaggctaaggcgt

SEQ ID NO: 2589190 - DNA, 20 bp, Homo sapiens
ccaggcaggctaaggcgtgg

SEQ ID NO: 2589191 - DNA, 21 bp, Homo sapiens
ccaggcaggctaaggcgtgga

SEQ ID NO: 2589192 - DNA, 20 bp, Homo sapiens
ccaggcagtcgggggctggc

SEQ ID NO: 2589193 - DNA, 22 bp, Homo sapiens
ccaggcagtcgggggctggcct

SEQ ID NO: 2589194 - DNA, 24 bp, Homo sapiens
ccaggcagtcgggggctggcctag

SEQ ID NO: 2589195 - DNA, 17 bp, Homo sapiens
ccaggcattccccagga

SEQ ID NO: 2589196 - DNA, 19 bp, Homo sapiens
ccaggcattccccaggagg

SEQ ID NO: 2589197 - DNA, 22 bp, Homo sapiens
ccaggcattccccaggaggcca

SEQ ID NO: 2589198 - DNA, 23 bp, Homo sapiens
ccaggcattccccaggaggccag

SEQ ID NO: 2589199 - DNA, 19 bp, Homo sapiens
ccaggccacatggggctgg

SEQ ID NO: 2589200 - DNA, 22 bp, Homo sapiens
ccaggccatccggcccccagag

SEQ ID NO: 2589201 - DNA, 21 bp, Homo sapiens
ccaggccccaaaaccacagcc

SEQ ID NO: 2589202 - DNA, 19 bp, Homo sapiens
ccaggcccccaagcctgca

SEQ ID NO: 2589203 - DNA, 21 bp, Homo sapiens
ccaggccccgaggacccagac

SEQ ID NO: 2589204 - DNA, 22 bp, Homo sapiens
ccaggccccgaggacccagacc

SEQ ID NO: 2589205 - DNA, 13 bp, Homo sapiens
ccaggcccctgcc

SEQ ID NO: 2589206 - DNA, 15 bp, Homo sapiens
ccaggcccctgccac

SEQ ID NO: 2589207 - DNA, 16 bp, Homo sapiens
ccaggcccctgccacc

SEQ ID NO: 2589208 - DNA, 15 bp, Homo sapiens
ccaggccctctgccc

SEQ ID NO: 2589209 - DNA, 20 bp, Homo sapiens
ccaggccctctgcccactcc

SEQ ID NO: 2589210 - DNA, 21 bp, Homo sapiens
ccaggccctctgcccactccc

SEQ ID NO: 2589211 - DNA, 23 bp, Homo sapiens
ccaggccctctgcccactccctg

SEQ ID NO: 2589212 - DNA, 14 bp, Homo sapiens
ccaggccgcagctc

SEQ ID NO: 2589213 - DNA, 13 bp, Homo sapiens
ccaggcctctgtg

SEQ ID NO: 2589214 - DNA, 16 bp, Homo sapiens
ccccttctcccacact

SEQ ID NO: 2589215 - DNA, 14 bp, Homo sapiens
ccccttctgaccca

SEQ ID NO: 2589216 - DNA, 20 bp, Homo sapiens
ccccttgcccagggctcagc

SEQ ID NO: 2589217 - DNA, 21 bp, Homo sapiens
ccccttgcccagggctcagcc

SEQ ID NO: 2589218 - DNA, 22 bp, Homo sapiens
ccccttgctctcccctgccctg

SEQ ID NO: 2589219 - DNA, 15 bp, Homo sapiens
ccccttgtcctttcc

SEQ ID NO: 2589220 - DNA, 13 bp, Homo sapiens
cccctttgggccc

SEQ ID NO: 2589221 - DNA, 15 bp, Homo sapiens
cccctttgtgctgtg

SEQ ID NO: 2589222 - DNA, 17 bp, Homo sapiens
ccccttttcttttctac

SEQ ID NO: 2589223 - DNA, 19 bp, Homo sapiens
ccccttttcttttctaccc

SEQ ID NO: 2589224 - DNA, 15 bp, Homo sapiens
cccgacagagggaag

SEQ ID NO: 2589225 - DNA, 14 bp, Homo sapiens
cccgactcctcaaa

SEQ ID NO: 2589226 - DNA, 13 bp, Homo sapiens
cccgacttgctgt

SEQ ID NO: 2589227 - DNA, 11 bp, Homo sapiens
cccgagctggg

SEQ ID NO: 2589228 - DNA, 14 bp, Homo sapiens
cccgagctggtgca

SEQ ID NO: 2589229 - DNA, 15 bp, Homo sapiens
cccgaggacccagac

SEQ ID NO: 2589230 - DNA, 18 bp, Homo sapiens
cccgaggacccagaccca

SEQ ID NO: 2589231 - DNA, 18 bp, Homo sapiens
cccgagtagctgggacta

SEQ ID NO: 2589232 - DNA, 16 bp, Homo sapiens
cccgatgctgctttcc

SEQ ID NO: 2589233 - DNA, 13 bp, Homo sapiens
cccgcacccccac

SEQ ID NO: 2589234 - DNA, 18 bp, Homo sapiens
cccgcccactgtcctggg

SEQ ID NO: 2589235 - DNA, 19 bp, Homo sapiens
cccgcccactgtcctgggc

SEQ ID NO: 2589236 - DNA, 13 bp, Homo sapiens
cccgcccagctgc

SEQ ID NO: 2589237 - DNA, 11 bp, Homo sapiens
cccgcctgcca

SEQ ID NO: 2589238 - DNA, 12 bp, Homo sapiens
cccgcctgccct

SEQ ID NO: 2589239 - DNA, 17 bp, Homo sapiens
cccgcctgccctcatgg

SEQ ID NO: 2589240 - DNA, 22 bp, Homo sapiens
cccgcctggcagaactgagctc

SEQ ID NO: 2589241 - DNA, 23 bp, Homo sapiens
cccgctaagagggagggagggct

SEQ ID NO: 2589242 - DNA, 14 bp, Homo sapiens
cccgctctgcatgc

SEQ ID NO: 2589243 - DNA, 14 bp, Homo sapiens
cccgctctggacca

SEQ ID NO: 2589244 - DNA, 22 bp, Homo sapiens
cccgctgcccaggggagccctc

SEQ ID NO: 2589245 - DNA, 23 bp, Homo sapiens
cccggaagccaaacctctgtgag

SEQ ID NO: 2589246 - DNA, 20 bp, Homo sapiens
cccggagctaacactggccc

SEQ ID NO: 2589247 - DNA, 21 bp, Homo sapiens
cccggagctaacactggcccc

SEQ ID NO: 2589248 - DNA, 17 bp, Homo sapiens
cccggccacctgcggtg

SEQ ID NO: 2589249 - DNA, 14 bp, Homo sapiens
cccggccccagcca

SEQ ID NO: 2589250 - DNA, 18 bp, Homo sapiens
cccggccccggccccagc

SEQ ID NO: 2589251 - DNA, 15 bp, Homo sapiens
cccggcccctgctgg

SEQ ID NO: 2589252 - DNA, 16 bp, Homo sapiens
cccggcccctgctggt

SEQ ID NO: 2589253 - DNA, 22 bp, Homo sapiens
cccggccctgggctcggaggct

SEQ ID NO: 2589254 - DNA, 18 bp, Homo sapiens
cccggcctgctcccagca

SEQ ID NO: 2589255 - DNA, 21 bp, Homo sapiens
cccggcctgctcccagcagcc

SEQ ID NO: 2589256 - DNA, 12 bp, Homo sapiens
cccggctccagg

SEQ ID NO: 2589257 - DNA, 13 bp, Homo sapiens
cccggctccaggc

SEQ ID NO: 2589258 - DNA, 17 bp, Homo sapiens
cccggctcccaccgagg

SEQ ID NO: 2589259 - DNA, 22 bp, Homo sapiens
cccggctcgagcagtcctgcct

SEQ ID NO: 2589260 - DNA, 17 bp, Homo sapiens
cccggctggttttgtaa

SEQ ID NO: 2589261 - DNA, 12 bp, Homo sapiens
cccgggaagggg

SEQ ID NO: 2589262 - DNA, 23 bp, Homo sapiens
cccgggaggcagaggttgcagtg

SEQ ID NO: 2589263 - DNA, 18 bp, Homo sapiens
cccgggccctcccttgga

SEQ ID NO: 2589264 - DNA, 21 bp, Homo sapiens
cccgggcgcggccagccccgg

SEQ ID NO: 2589265 - DNA, 16 bp, Homo sapiens
cccgggctctctgctg

SEQ ID NO: 2589266 - DNA, 14 bp, Homo sapiens
cccgtaatgcttag

SEQ ID NO: 2589267 - DNA, 17 bp, Homo sapiens
cccgtcaccatctcagg

SEQ ID NO: 2589268 - DNA, 20 bp, Homo sapiens
cccgtcgaggggctctcagc

SEQ ID NO: 2589269 - DNA, 15 bp, Homo sapiens
cccgtctctctccca

SEQ ID NO: 2589270 - DNA, 16 bp, Homo sapiens
cccgtctctctcccat

SEQ ID NO: 2589271 - DNA, 14 bp, Homo sapiens
cccgtcttcagcct

SEQ ID NO: 2589272 - DNA, 15 bp, Homo sapiens
cccgtcttcagccta

SEQ ID NO: 2589273 - DNA, 17 bp, Homo sapiens
cccgtcttcagcctagc

SEQ ID NO: 2589274 - DNA, 18 bp, Homo sapiens
cccgtgacagactcctga

SEQ ID NO: 2589275 - DNA, 22 bp, Homo sapiens
cccgtgacagactcctgaggac

SEQ ID NO: 2589276 - DNA, 15 bp, Homo sapiens
cccgtggggttcctc

SEQ ID NO: 2589277 - DNA, 15 bp, Homo sapiens
cccgtgtcctgcctg

SEQ ID NO: 2589278 - DNA, 18 bp, Homo sapiens
cccgtgtggccccttcac

SEQ ID NO: 2589279 - DNA, 13 bp, Homo sapiens
ccctacaccttga

SEQ ID NO: 2589280 - DNA, 21 bp, Homo sapiens
ccctaccagcgcccgctgggc

SEQ ID NO: 2589281 - DNA, 21 bp, Homo sapiens
ccctaccccacaccaggccgt

SEQ ID NO: 2589282 - DNA, 23 bp, Homo sapiens
ccctacctgattggtgcaaccct

SEQ ID NO: 2589283 - DNA, 18 bp, Homo sapiens
ccctagagcctgcctgga

SEQ ID NO: 2589284 - DNA, 19 bp, Homo sapiens
ccctagagggttcctgtag

SEQ ID NO: 2589285 - DNA, 22 bp, Homo sapiens
ccctagcttagagcctccctca

SEQ ID NO: 2589286 - DNA, 21 bp, Homo sapiens
ccctagtgacccggaggccac

SEQ ID NO: 2589287 - DNA, 14 bp, Homo sapiens
ccctatctttgcca

SEQ ID NO: 2589288 - DNA, 16 bp, Homo sapiens
ccctatctttgccacc

SEQ ID NO: 2589289 - DNA, 16 bp, Homo sapiens
ccctatggatgtgggg

SEQ ID NO: 2589290 - DNA, 17 bp, Homo sapiens
ccctattggtaaagaat

SEQ ID NO: 2589291 - DNA, 21 bp, Homo sapiens
ccctattttttttctgttata

SEQ ID NO: 2589292 - DNA, 15 bp, Homo sapiens
ccctcaaacctcctc

SEQ ID NO: 2589293 - DNA, 20 bp, Homo sapiens
ccctcaaacctcctcttctg

SEQ ID NO: 2589294 - DNA, 19 bp, Homo sapiens
ccctcaaatgacccaaaga

SEQ ID NO: 2589295 - DNA, 15 bp, Homo sapiens
ccctcaccctgagcc

SEQ ID NO: 2589296 - DNA, 22 bp, Homo sapiens
ccctcaccctgagccccttcct

SEQ ID NO: 2589297 - DNA, 14 bp, Homo sapiens
ccctcacctcctct

SEQ ID NO: 2589298 - DNA, 17 bp, Homo sapiens
ccctcacctgggcacct

SEQ ID NO: 2589299 - DNA, 16 bp, Homo sapiens
ccctcactctggcctc

SEQ ID NO: 2589300 - DNA, 17 bp, Homo sapiens
ccctcagaaacactggg

SEQ ID NO: 2589301 - DNA, 15 bp, Homo sapiens
ccctcagagtgcaag

SEQ ID NO: 2589302 - DNA, 17 bp, Homo sapiens
ccctcagcaccccttcc

SEQ ID NO: 2589303 - DNA, 19 bp, Homo sapiens
ccctcagccccaccccagg

SEQ ID NO: 2589304 - DNA, 12 bp, Homo sapiens
ccctcagcccct

SEQ ID NO: 2589305 - DNA, 14 bp, Homo sapiens
ccctcagcccctct

SEQ ID NO: 2589306 - DNA, 23 bp, Homo sapiens
ccctcagcccctcttgcccccca

SEQ ID NO: 2589307 - DNA, 20 bp, Homo sapiens
ccctcaggcataggcctggg

SEQ ID NO: 2589308 - DNA, 15 bp, Homo sapiens
ccctcagggtccctg

SEQ ID NO: 2589309 - DNA, 19 bp, Homo sapiens
ccctcagggtccctggtgg

SEQ ID NO: 2589310 - DNA, 22 bp, Homo sapiens
ccctcatcctcatacccacccc

SEQ ID NO: 2589311 - DNA, 15 bp, Homo sapiens
ccctccaaaagcact

SEQ ID NO: 2589312 - DNA, 15 bp, Homo sapiens
ccctccaatcctgcc

SEQ ID NO: 2589313 - DNA, 22 bp, Homo sapiens
ccctccaccctgtcccccagct

SEQ ID NO: 2589314 - DNA, 15 bp, Homo sapiens
ccctccagcttgtgg

SEQ ID NO: 2589315 - DNA, 15 bp, Homo sapiens
ccctccatcccgaca

SEQ ID NO: 2589316 - DNA, 12 bp, Homo sapiens
ccctcccaccca

SEQ ID NO: 2589317 - DNA, 15 bp, Homo sapiens
ccctcccacccaccg

SEQ ID NO: 2589318 - DNA, 13 bp, Homo sapiens
ccctcccaccccc

SEQ ID NO: 2589319 - DNA, 14 bp, Homo sapiens
ccctccccctgcca

SEQ ID NO: 2589320 - DNA, 17 bp, Homo sapiens
ccctcccccttctccca

SEQ ID NO: 2589321 - DNA, 13 bp, Homo sapiens
ccctcccccttgt

SEQ ID NO: 2589322 - DNA, 17 bp, Homo sapiens
ccctccccgcacccccc

SEQ ID NO: 2589323 - DNA, 22 bp, Homo sapiens
ccctccccggccctaccagcgc

SEQ ID NO: 2589324 - DNA, 16 bp, Homo sapiens
ccctccctcagcccct

SEQ ID NO: 2589325 - DNA, 14 bp, Homo sapiens
ccctccctgcttca

SEQ ID NO: 2589326 - DNA, 12 bp, Homo sapiens
ccctccctggag

SEQ ID NO: 2589327 - DNA, 14 bp, Homo sapiens
ccctccctggctcc

SEQ ID NO: 2589328 - DNA, 16 bp, Homo sapiens
ccctccctggctccca

SEQ ID NO: 2589329 - DNA, 13 bp, Homo sapiens
ccctccctgggtt

SEQ ID NO: 2589330 - DNA, 19 bp, Homo sapiens
ccctcccttggaaacctgc

SEQ ID NO: 2589331 - DNA, 23 bp, Homo sapiens
ccctcccttggaaacctgccctg

SEQ ID NO: 2589332 - DNA, 16 bp, Homo sapiens
ccctccgccaggcgag

SEQ ID NO: 2589333 - DNA, 17 bp, Homo sapiens
ccctcctaccctgcgcc

SEQ ID NO: 2589334 - DNA, 21 bp, Homo sapiens
ccctcctatcacctcccctcc

SEQ ID NO: 2589335 - DNA, 12 bp, Homo sapiens
ccctcctcacct

SEQ ID NO: 2589336 - DNA, 18 bp, Homo sapiens
ccctcctcacctctggac

SEQ ID NO: 2589337 - DNA, 20 bp, Homo sapiens
ccctcctgccgactcctggg

SEQ ID NO: 2589338 - DNA, 13 bp, Homo sapiens
ccctcctgtaaat

SEQ ID NO: 2589339 - DNA, 13 bp, Homo sapiens
ccctcctgttgca

SEQ ID NO: 2589340 - DNA, 22 bp, Homo sapiens
ccctcctgttgcacccagccct

SEQ ID NO: 2589341 - DNA, 23 bp, Homo sapiens
ccctccttgctctgcaggcacct

SEQ ID NO: 2589342 - DNA, 14 bp, Homo sapiens
ccctccttgggcac

SEQ ID NO: 2589343 - DNA, 14 bp, Homo sapiens
ccctcgctgccagc

SEQ ID NO: 2589344 - DNA, 21 bp, Homo sapiens
ccctcgcttggacggctgggc

SEQ ID NO: 2589345 - DNA, 15 bp, Homo sapiens
ccctcgggcccacct

SEQ ID NO: 2589346 - DNA, 18 bp, Homo sapiens
ccctcgggcccacctggc

SEQ ID NO: 2589347 - DNA, 20 bp, Homo sapiens
ccctcgggcccacctggcca

SEQ ID NO: 2589348 - DNA, 22 bp, Homo sapiens
ccctcgggcccagcccccacag

SEQ ID NO: 2589349 - DNA, 17 bp, Homo sapiens
ccctcgggcgagtcact

SEQ ID NO: 2589350 - DNA, 16 bp, Homo sapiens
ccctcgtggccagccc

SEQ ID NO: 2589351 - DNA, 15 bp, Homo sapiens
ccctcgtggccttcc

SEQ ID NO: 2589352 - DNA, 16 bp, Homo sapiens
ccctctaaagcaataa

SEQ ID NO: 2589353 - DNA, 13 bp, Homo sapiens
ccctctcagctcc

SEQ ID NO: 2589354 - DNA, 17 bp, Homo sapiens
ccctctcagctccaggt

SEQ ID NO: 2589355 - DNA, 22 bp, Homo sapiens
ccctgcactggagtccagtctc

SEQ ID NO: 2589356 - DNA, 23 bp, Homo sapiens
ccctgcactggagtccagtctct

SEQ ID NO: 2589357 - DNA, 13 bp, Homo sapiens
ccctgcatcccct

SEQ ID NO: 2589358 - DNA, 14 bp, Homo sapiens
ccctgccacctccc

SEQ ID NO: 2589359 - DNA, 17 bp, Homo sapiens
ccctgccacctccctga

SEQ ID NO: 2589360 - DNA, 12 bp, Homo sapiens
ccctgccagctc

SEQ ID NO: 2589361 - DNA, 13 bp, Homo sapiens
ccctgccagctct

SEQ ID NO: 2589362 - DNA, 22 bp, Homo sapiens
ccctgccaggagctttggacct

SEQ ID NO: 2589363 - DNA, 13 bp, Homo sapiens
ccctgcccacctg

SEQ ID NO: 2589364 - DNA, 18 bp, Homo sapiens
ccctgcccccacttcctg

SEQ ID NO: 2589365 - DNA, 12 bp, Homo sapiens
ccctgcccccca

SEQ ID NO: 2589366 - DNA, 15 bp, Homo sapiens
ccctgccccccagcc

SEQ ID NO: 2589367 - DNA, 16 bp, Homo sapiens
ccctgccccccagcct

SEQ ID NO: 2589368 - DNA, 21 bp, Homo sapiens
ccctgccccccagcctctggc

SEQ ID NO: 2589369 - DNA, 12 bp, Homo sapiens
ccctgcccctgc

SEQ ID NO: 2589370 - DNA, 19 bp, Homo sapiens
ccctgcccctgccccgtca

SEQ ID NO: 2589371 - DNA, 16 bp, Homo sapiens
ccctgccctagctcca

SEQ ID NO: 2589372 - DNA, 15 bp, Homo sapiens
ccctgccctcccctc

SEQ ID NO: 2589373 - DNA, 13 bp, Homo sapiens
ccctgccctcgtg

SEQ ID NO: 2589374 - DNA, 16 bp, Homo sapiens
ccctgccctcgtggcc

SEQ ID NO: 2589375 - DNA, 18 bp, Homo sapiens
ccctgccctcgtggccag

SEQ ID NO: 2589376 - DNA, 21 bp, Homo sapiens
ccctgccctcgtggccagccc

SEQ ID NO: 2589377 - DNA, 18 bp, Homo sapiens
ccctgccctggtccaggg

SEQ ID NO: 2589378 - DNA, 11 bp, Homo sapiens
ccctgccctgt

SEQ ID NO: 2589379 - DNA, 14 bp, Homo sapiens
ccctgccctgtggg

SEQ ID NO: 2589380 - DNA, 15 bp, Homo sapiens
ccctgcctccaccct

SEQ ID NO: 2589381 - DNA, 20 bp, Homo sapiens
ccctgcctccaccctctgag

SEQ ID NO: 2589382 - DNA, 12 bp, Homo sapiens
ccctgcctctca

SEQ ID NO: 2589383 - DNA, 20 bp, Homo sapiens
ccctgcctgagggcccctct

SEQ ID NO: 2589384 - DNA, 23 bp, Homo sapiens
ccctgcctgagggcccctctgcc

SEQ ID NO: 2589385 - DNA, 20 bp, Homo sapiens
ccctgcgaaggggccctggt

SEQ ID NO: 2589386 - DNA, 17 bp, Homo sapiens
ccctgctccctcccatc

SEQ ID NO: 2589387 - DNA, 15 bp, Homo sapiens
ccctgctcctccctg

SEQ ID NO: 2589388 - DNA, 19 bp, Homo sapiens
ccctgctcctccctggctg

SEQ ID NO: 2589389 - DNA, 21 bp, Homo sapiens
ccctgctcctccctggctgcc

SEQ ID NO: 2589390 - DNA, 22 bp, Homo sapiens
ccctgctctccgaccagacacc

SEQ ID NO: 2589391 - DNA, 22 bp, Homo sapiens
ccctgctgccgcctcccagcct

SEQ ID NO: 2589392 - DNA, 23 bp, Homo sapiens
ccctgctgccgcctcccagcctg

SEQ ID NO: 2589393 - DNA, 12 bp, Homo sapiens
ccctgctgcctc

SEQ ID NO: 2589394 - DNA, 15 bp, Homo sapiens
ccctgctggccgcct

SEQ ID NO: 2589395 - DNA, 17 bp, Homo sapiens
ccctggacaagcagagg

SEQ ID NO: 2589396 - DNA, 16 bp, Homo sapiens
ccctggagccaactgc

SEQ ID NO: 2589397 - DNA, 22 bp, Homo sapiens
ccctggagccaactgctgcttt

SEQ ID NO: 2589398 - DNA, 14 bp, Homo sapiens
ccctggagccagac

SEQ ID NO: 2589399 - DNA, 20 bp, Homo sapiens
ccctggagccagactctggt

SEQ ID NO: 2589400 - DNA, 23 bp, Homo sapiens
ccctggagtgtggctgaggaggc

SEQ ID NO: 2589401 - DNA, 19 bp, Homo sapiens
ccctggatccatcaggcca

SEQ ID NO: 2589402 - DNA, 17 bp, Homo sapiens
ccctggatgcagcctca

SEQ ID NO: 2589403 - DNA, 22 bp, Homo sapiens
ccctggcaggatgaccctgcga

SEQ ID NO: 2589404 - DNA, 16 bp, Homo sapiens
ccctggccctgaggtg

SEQ ID NO: 2589405 - DNA, 17 bp, Homo sapiens
ccctggccctgaggtgt

SEQ ID NO: 2589406 - DNA, 20 bp, Homo sapiens
ccctggcctccggcgtcagc

SEQ ID NO: 2589407 - DNA, 19 bp, Homo sapiens
ccctggcctgttctgtttt

SEQ ID NO: 2589408 - DNA, 13 bp, Homo sapiens
ccctggctcccat

SEQ ID NO: 2589409 - DNA, 15 bp, Homo sapiens
ccctggctcccatga

SEQ ID NO: 2589410 - DNA, 23 bp, Homo sapiens
ccctggctcccatgaccatactg

SEQ ID NO: 2589411 - DNA, 18 bp, Homo sapiens
ccctggctgaaggactgt

SEQ ID NO: 2589412 - DNA, 19 bp, Homo sapiens
ccctggctgaaggactgtg

SEQ ID NO: 2589413 - DNA, 19 bp, Homo sapiens
ccctggctgaccccaaaga

SEQ ID NO: 2589414 - DNA, 17 bp, Homo sapiens
ccctggctgccctggcc

SEQ ID NO: 2589415 - DNA, 15 bp, Homo sapiens
ccctgggatgtccac

SEQ ID NO: 2589416 - DNA, 16 bp, Homo sapiens
ccctgggctctgcccc

SEQ ID NO: 2589417 - DNA, 13 bp, Homo sapiens
ccctgggctgaga

SEQ ID NO: 2589418 - DNA, 20 bp, Homo sapiens
ccctggggacagcaagggct

SEQ ID NO: 2589419 - DNA, 23 bp, Homo sapiens
ccctggggcctggacctgcctcc

SEQ ID NO: 2589420 - DNA, 21 bp, Homo sapiens
ccctgggtgggtggtggggag

SEQ ID NO: 2589421 - DNA, 17 bp, Homo sapiens
ccctggtccttccaggc

SEQ ID NO: 2589422 - DNA, 18 bp, Homo sapiens
ccctggtggacagtcctg

SEQ ID NO: 2589423 - DNA, 19 bp, Homo sapiens
ccctggtggacagtcctgg

SEQ ID NO: 2589424 - DNA, 20 bp, Homo sapiens
ccctggtggacagtcctggg

SEQ ID NO: 2589425 - DNA, 21 bp, Homo sapiens
ccctggtggacagtcctggga

SEQ ID NO: 2589426 - DNA, 23 bp, Homo sapiens
ccctggtggacagtcctgggaga

SEQ ID NO: 2589427 - DNA, 20 bp, Homo sapiens
ccctggtggagaaagcactg

SEQ ID NO: 2589428 - DNA, 16 bp, Homo sapiens
ccctggtggcagctca

SEQ ID NO: 2589429 - DNA, 20 bp, Homo sapiens
ccctggtggcagctcacctc

SEQ ID NO: 2589430 - DNA, 21 bp, Homo sapiens
ccctggtggcagtgggagctg

SEQ ID NO: 2589431 - DNA, 22 bp, Homo sapiens
ccctggtggcagtgggagctgc

SEQ ID NO: 2589432 - DNA, 20 bp, Homo sapiens
ccctggtgtttctagcactg

SEQ ID NO: 2589433 - DNA, 17 bp, Homo sapiens
ccctgtacaatatttaa

SEQ ID NO: 2589434 - DNA, 19 bp, Homo sapiens
ccctgtaccttttgaggag

SEQ ID NO: 2589435 - DNA, 20 bp, Homo sapiens
ccctgtattttctttctcta

SEQ ID NO: 2589436 - DNA, 14 bp, Homo sapiens
ccctgtcagtgcag

SEQ ID NO: 2589437 - DNA, 21 bp, Homo sapiens
ccctgtcagtgcagcccgtgt

SEQ ID NO: 2589438 - DNA, 14 bp, Homo sapiens
ccctgtccaaactg

SEQ ID NO: 2589439 - DNA, 13 bp, Homo sapiens
ccctgtcccccag

SEQ ID NO: 2589440 - DNA, 23 bp, Homo sapiens
ccctgtcctgatggtcagctccc

SEQ ID NO: 2589441 - DNA, 18 bp, Homo sapiens
ccgcgcgcgtccccctgc

SEQ ID NO: 2589442 - DNA, 20 bp, Homo sapiens
ccgcggggacattgggaagg

SEQ ID NO: 2589443 - DNA, 17 bp, Homo sapiens
ccgcgtcgccctcccag

SEQ ID NO: 2589444 - DNA, 17 bp, Homo sapiens
ccgctagaggcctgagg

SEQ ID NO: 2589445 - DNA, 19 bp, Homo sapiens
ccgctagaggcctgaggat

SEQ ID NO: 2589446 - DNA, 12 bp, Homo sapiens
ccgctccccagc

SEQ ID NO: 2589447 - DNA, 13 bp, Homo sapiens
ccgctccccagcc

SEQ ID NO: 2589448 - DNA, 15 bp, Homo sapiens
ccgctcctgtctgcc

SEQ ID NO: 2589449 - DNA, 18 bp, Homo sapiens
ccgctctacatcttctgc

SEQ ID NO: 2589450 - DNA, 14 bp, Homo sapiens
ccgctctggaccaa

SEQ ID NO: 2589451 - DNA, 19 bp, Homo sapiens
ccgctgagtggactggagt

SEQ ID NO: 2589452 - DNA, 22 bp, Homo sapiens
ccgctgattctcagggtctctg

SEQ ID NO: 2589453 - DNA, 11 bp, Homo sapiens
ccgctgctgct

SEQ ID NO: 2589454 - DNA, 11 bp, Homo sapiens
ccgctggggcc

SEQ ID NO: 2589455 - DNA, 19 bp, Homo sapiens
ccgctgtgagcccctggtc

SEQ ID NO: 2589456 - DNA, 15 bp, Homo sapiens
ccgcttctgcctgca

SEQ ID NO: 2589457 - DNA, 11 bp, Homo sapiens
ccggaagccaa

SEQ ID NO: 2589458 - DNA, 23 bp, Homo sapiens
ccggactttcggagttgggggtc

SEQ ID NO: 2589459 - DNA, 20 bp, Homo sapiens
ccggagctaacactggcccc

SEQ ID NO: 2589460 - DNA, 21 bp, Homo sapiens
ccggagctttcaaagaaggaa

SEQ ID NO: 2589461 - DNA, 17 bp, Homo sapiens
ccggagtccactcccag

SEQ ID NO: 2589462 - DNA, 20 bp, Homo sapiens
ccggatggcggacacctggc

SEQ ID NO: 2589463 - DNA, 22 bp, Homo sapiens
ccggcagttctgggtgctccct

SEQ ID NO: 2589464 - DNA, 14 bp, Homo sapiens
ccggcatgggaaag

SEQ ID NO: 2589465 - DNA, 17 bp, Homo sapiens
ccggccacctgcggtgc

SEQ ID NO: 2589466 - DNA, 12 bp, Homo sapiens
ccggccccagcc

SEQ ID NO: 2589467 - DNA, 18 bp, Homo sapiens
ccggccccagccagagtt

SEQ ID NO: 2589468 - DNA, 13 bp, Homo sapiens
ccggccccctggt

SEQ ID NO: 2589469 - DNA, 16 bp, Homo sapiens
ccggccccggccccag

SEQ ID NO: 2589470 - DNA, 15 bp, Homo sapiens
ccggcccctgctggt

SEQ ID NO: 2589471 - DNA, 21 bp, Homo sapiens
ccggccctcctaccctgcgcc

SEQ ID NO: 2589472 - DNA, 24 bp, Homo sapiens
ccggccctgggctcggaggctgcc

SEQ ID NO: 2589473 - DNA, 12 bp, Homo sapiens
ccggcctctctg

SEQ ID NO: 2589474 - DNA, 13 bp, Homo sapiens
ccggcctctctgg

SEQ ID NO: 2589475 - DNA, 20 bp, Homo sapiens
ccggcctgctcccagcagcc

SEQ ID NO: 2589476 - DNA, 15 bp, Homo sapiens
ccggcgtcagcctcc

SEQ ID NO: 2589477 - DNA, 16 bp, Homo sapiens
ccggcgtcagcctcca

SEQ ID NO: 2589478 - DNA, 20 bp, Homo sapiens
ccggcgtcagcctccagcct

SEQ ID NO: 2589479 - DNA, 16 bp, Homo sapiens
ccggcgtggtggaaga

SEQ ID NO: 2589480 - DNA, 22 bp, Homo sapiens
ccggcgtggtggaagaggggac

SEQ ID NO: 2589481 - DNA, 21 bp, Homo sapiens
ccggctccaggctcctttagc

SEQ ID NO: 2589482 - DNA, 16 bp, Homo sapiens
ccggctcctgtgcttt

SEQ ID NO: 2589483 - DNA, 15 bp, Homo sapiens
ccggctggcctggcc

SEQ ID NO: 2589484 - DNA, 18 bp, Homo sapiens
ccggctggcctggcccct

SEQ ID NO: 2589485 - DNA, 17 bp, Homo sapiens
ccgggaccccgagcctg

SEQ ID NO: 2589486 - DNA, 22 bp, Homo sapiens
ccgggagggtgcggctgtgcag

SEQ ID NO: 2589487 - DNA, 13 bp, Homo sapiens
ccgggccacagag

SEQ ID NO: 2589488 - DNA, 13 bp, Homo sapiens
ccgggcctggggc

SEQ ID NO: 2589489 - DNA, 19 bp, Homo sapiens
ccgggcgcggccagccccg

SEQ ID NO: 2589490 - DNA, 16 bp, Homo sapiens
ccgggcgtggtggtga

SEQ ID NO: 2589491 - DNA, 13 bp, Homo sapiens
ccgggctctctgc

SEQ ID NO: 2589492 - DNA, 16 bp, Homo sapiens
ccgggctctctgctgt

SEQ ID NO: 2589493 - DNA, 14 bp, Homo sapiens
ccgggctctgcctc

SEQ ID NO: 2589494 - DNA, 18 bp, Homo sapiens
ccgggctctgcctcccat

SEQ ID NO: 2589495 - DNA, 18 bp, Homo sapiens
ccgggctgcctgggctgt

SEQ ID NO: 2589496 - DNA, 19 bp, Homo sapiens
ccgggctgggagctctgca

SEQ ID NO: 2589497 - DNA, 15 bp, Homo sapiens
ccggggacagaggcc

SEQ ID NO: 2589498 - DNA, 18 bp, Homo sapiens
ccggggcagctgccagag

SEQ ID NO: 2589499 - DNA, 20 bp, Homo sapiens
ccggggcagctgccagagaa

SEQ ID NO: 2589500 - DNA, 22 bp, Homo sapiens
ccgggggcagctctggaggggg

SEQ ID NO: 2589501 - DNA, 14 bp, Homo sapiens
ccgggtctgcctct

SEQ ID NO: 2589502 - DNA, 14 bp, Homo sapiens
ccgggtgggcggca

SEQ ID NO: 2589503 - DNA, 17 bp, Homo sapiens
ccgggttctagtctcct

SEQ ID NO: 2589504 - DNA, 19 bp, Homo sapiens
ccgggtttggcgggccaag

SEQ ID NO: 2589505 - DNA, 22 bp, Homo sapiens
ccgggtttggcgggccaaggac

SEQ ID NO: 2589506 - DNA, 12 bp, Homo sapiens
ccgtaccccacc

SEQ ID NO: 2589507 - DNA, 13 bp, Homo sapiens
ccgtaccccaccc

SEQ ID NO: 2589508 - DNA, 15 bp, Homo sapiens
ccgtaccccaccctc

SEQ ID NO: 2589509 - DNA, 16 bp, Homo sapiens
ccgtaccccaccctca

SEQ ID NO: 2589510 - DNA, 12 bp, Homo sapiens
ccgtcacagcct

SEQ ID NO: 2589511 - DNA, 17 bp, Homo sapiens
ccgtcatgttcctcaaa

SEQ ID NO: 2589512 - DNA, 22 bp, Homo sapiens
ccgtccagccgccattgccacc

SEQ ID NO: 2589513 - DNA, 16 bp, Homo sapiens
ccgtccaggagcctgg

SEQ ID NO: 2589514 - DNA, 18 bp, Homo sapiens
ccgtccaggagcctgtgc

SEQ ID NO: 2589515 - DNA, 14 bp, Homo sapiens
ccgtccgccctgct

SEQ ID NO: 2589516 - DNA, 17 bp, Homo sapiens
ccgtctacctgaggggc

SEQ ID NO: 2589517 - DNA, 19 bp, Homo sapiens
ccgtgagttctcagggctc

SEQ ID NO: 2589518 - DNA, 13 bp, Homo sapiens
cctactgaatgct

SEQ ID NO: 2589519 - DNA, 12 bp, Homo sapiens
cctacttctcca

SEQ ID NO: 2589520 - DNA, 14 bp, Homo sapiens
cctacttctccagc

SEQ ID NO: 2589521 - DNA, 19 bp, Homo sapiens
cctacttctccagcctaga

SEQ ID NO: 2589522 - DNA, 22 bp, Homo sapiens
cctacttcttttgctcttagct

SEQ ID NO: 2589523 - DNA, 14 bp, Homo sapiens
cctactttgacttt

SEQ ID NO: 2589524 - DNA, 21 bp, Homo sapiens
cctactttgactttttgcatt

SEQ ID NO: 2589525 - DNA, 16 bp, Homo sapiens
cctagaccctcctcct

SEQ ID NO: 2589526 - DNA, 19 bp, Homo sapiens
cctagagaacgcagcccta

SEQ ID NO: 2589527 - DNA, 16 bp, Homo sapiens
cctagagacagaagca

SEQ ID NO: 2589528 - DNA, 18 bp, Homo sapiens
cctagagcctgcctggag

SEQ ID NO: 2589529 - DNA, 17 bp, Homo sapiens
cctagcactttgggagg

SEQ ID NO: 2589530 - DNA, 21 bp, Homo sapiens
cctagcatacgtacacatttt

SEQ ID NO: 2589531 - DNA, 21 bp, Homo sapiens
cctagccccttagcccccacc

SEQ ID NO: 2589532 - DNA, 20 bp, Homo sapiens
cctagccgacctcagccttc

SEQ ID NO: 2589533 - DNA, 20 bp, Homo sapiens
cctagcctgtgcctctggga

SEQ ID NO: 2589534 - DNA, 22 bp, Homo sapiens
cctagccttagaagtcacacag

SEQ ID NO: 2589535 - DNA, 19 bp, Homo sapiens
cctagccttatcctctgat

SEQ ID NO: 2589536 - DNA, 22 bp, Homo sapiens
cctagccttatcctctgatctc

SEQ ID NO: 2589537 - DNA, 19 bp, Homo sapiens
cctagctgcacagggcagc

SEQ ID NO: 2589538 - DNA, 17 bp, Homo sapiens
cctagctgctacaaaga

SEQ ID NO: 2589539 - DNA, 18 bp, Homo sapiens
cctagctgctacaaagaa

SEQ ID NO: 2589540 - DNA, 17 bp, Homo sapiens
cctaggaattcccagcc

SEQ ID NO: 2589541 - DNA, 19 bp, Homo sapiens
cctaggagatatctgaggg

SEQ ID NO: 2589542 - DNA, 20 bp, Homo sapiens
cctaggagatatctgaggga

SEQ ID NO: 2589543 - DNA, 22 bp, Homo sapiens
cctaggagatatctgagggagg

SEQ ID NO: 2589544 - DNA, 16 bp, Homo sapiens
cctaggattgtgcctg

SEQ ID NO: 2589545 - DNA, 13 bp, Homo sapiens
cctaggcaggaca

SEQ ID NO: 2589546 - DNA, 18 bp, Homo sapiens
cctaggcaggacatgctg

SEQ ID NO: 2589547 - DNA, 22 bp, Homo sapiens
cctaggcaggacatgctgaagc

SEQ ID NO: 2589548 - DNA, 14 bp, Homo sapiens
cctaggcgggcggt

SEQ ID NO: 2589549 - DNA, 15 bp, Homo sapiens
cctaggggtcaggga

SEQ ID NO: 2589550 - DNA, 15 bp, Homo sapiens
cctaggtgacagagt

SEQ ID NO: 2589551 - DNA, 18 bp, Homo sapiens
cctagtaagtgccttcca

SEQ ID NO: 2589552 - DNA, 19 bp, Homo sapiens
cctagtaagtgccttccat

SEQ ID NO: 2589553 - DNA, 13 bp, Homo sapiens
cctagtcccttcc

SEQ ID NO: 2589554 - DNA, 14 bp, Homo sapiens
cctagtcccttccc

SEQ ID NO: 2589555 - DNA, 16 bp, Homo sapiens
cctagtcccttcccct

SEQ ID NO: 2589556 - DNA, 18 bp, Homo sapiens
cctagtgaaggcttctct

SEQ ID NO: 2589557 - DNA, 21 bp, Homo sapiens
cctagtgaaggcttctctctg

SEQ ID NO: 2589558 - DNA, 20 bp, Homo sapiens
cctagtgacccggaggccac

SEQ ID NO: 2589559 - DNA, 16 bp, Homo sapiens
cctagttttctcctcc

SEQ ID NO: 2589560 - DNA, 19 bp, Homo sapiens
cctagttttctcctcccag

SEQ ID NO: 2589561 - DNA, 20 bp, Homo sapiens
cctagttttctcctcccagg

SEQ ID NO: 2589562 - DNA, 12 bp, Homo sapiens
cctataaaacag

SEQ ID NO: 2589563 - DNA, 20 bp, Homo sapiens
cctataaaacaggtcaatac

SEQ ID NO: 2589564 - DNA, 13 bp, Homo sapiens
cctatagtcccag

SEQ ID NO: 2589565 - DNA, 15 bp, Homo sapiens
cctatattggctaaa

SEQ ID NO: 2589566 - DNA, 17 bp, Homo sapiens
cctatctcgtgggagag

SEQ ID NO: 2589567 - DNA, 20 bp, Homo sapiens
cctatctcgtgggagagcca

SEQ ID NO: 2589568 - DNA, 15 bp, Homo sapiens
cctatctttgccacc

SEQ ID NO: 2589569 - DNA, 19 bp, Homo sapiens
cctatctttgccaccctca

SEQ ID NO: 2589570 - DNA, 17 bp, Homo sapiens
cctatgatattttctgt

SEQ ID NO: 2589571 - DNA, 14 bp, Homo sapiens
cctatgatcccagc

SEQ ID NO: 2589572 - DNA, 15 bp, Homo sapiens
cctatgatcccagca

SEQ ID NO: 2589573 - DNA, 20 bp, Homo sapiens
cctatgcacatatggactct

SEQ ID NO: 2589574 - DNA, 17 bp, Homo sapiens
cctatggggatggtcca

SEQ ID NO: 2589575 - DNA, 14 bp, Homo sapiens
cctatgtatttgca

SEQ ID NO: 2589576 - DNA, 15 bp, Homo sapiens
cctatgtcctaagga

SEQ ID NO: 2589577 - DNA, 22 bp, Homo sapiens
cctatgtcctaaggacacacta

SEQ ID NO: 2589578 - DNA, 23 bp, Homo sapiens
cctatgtcctaaggacacactaa

SEQ ID NO: 2589579 - DNA, 17 bp, Homo sapiens
cctatgtgattttaact

SEQ ID NO: 2589580 - DNA, 22 bp, Homo sapiens
cctattcccacacctccacagt

SEQ ID NO: 2589581 - DNA, 15 bp, Homo sapiens
cctattctcgggctg

SEQ ID NO: 2589582 - DNA, 22 bp, Homo sapiens
cctattgcaaaggttccaactg

SEQ ID NO: 2589583 - DNA, 15 bp, Homo sapiens
cctattgtcattaaa

SEQ ID NO: 2589584 - DNA, 14 bp, Homo sapiens
cctattgtgatttg

SEQ ID NO: 2589585 - DNA, 21 bp, Homo sapiens
cctattgtgatttgactgttt

SEQ ID NO: 2589586 - DNA, 22 bp, Homo sapiens
cctattgtgatttgactgtttt

SEQ ID NO: 2589587 - DNA, 22 bp, Homo sapiens
cctattttgaaaaattcctatt

SEQ ID NO: 2589588 - DNA, 20 bp, Homo sapiens
cctattttttttctgttata

SEQ ID NO: 2589589 - DNA, 15 bp, Homo sapiens
cctcaaacactgcag

SEQ ID NO: 2589590 - DNA, 18 bp, Homo sapiens
cctcaaacactgcaggca

SEQ ID NO: 2589591 - DNA, 17 bp, Homo sapiens
cctcaacaagggagaga

SEQ ID NO: 2589592 - DNA, 22 bp, Homo sapiens
cctcaacaagggagagacctca

SEQ ID NO: 2589593 - DNA, 18 bp, Homo sapiens
cctcaaccctccctcagc

SEQ ID NO: 2589594 - DNA, 21 bp, Homo sapiens
cctcaactcacctaatgttta

SEQ ID NO: 2589595 - DNA, 20 bp, Homo sapiens
cctcaagccaatcccctcct

SEQ ID NO: 2589596 - DNA, 12 bp, Homo sapiens
cctcaaggactt

SEQ ID NO: 2589597 - DNA, 13 bp, Homo sapiens
cctcaaggacttg

SEQ ID NO: 2589598 - DNA, 20 bp, Homo sapiens
cctcaagtcactcccaagcc

SEQ ID NO: 2589599 - DNA, 18 bp, Homo sapiens
cctcaataagccttgtcg

SEQ ID NO: 2589600 - DNA, 16 bp, Homo sapiens
cctcaatgtgaccagg

SEQ ID NO: 2589601 - DNA, 22 bp, Homo sapiens
cctcacagtccttaccagcaga

SEQ ID NO: 2589602 - DNA, 23 bp, Homo sapiens
cctcacagtccttaccagcagag

SEQ ID NO: 2589603 - DNA, 15 bp, Homo sapiens
cctcaccccctcggg

SEQ ID NO: 2589604 - DNA, 21 bp, Homo sapiens
agaaagttgcacggctgctga

SEQ ID NO: 2589605 - DNA, 18 bp, Homo sapiens
agaaataaatagctatat

SEQ ID NO: 2589606 - DNA, 22 bp, Homo sapiens
agaaataagtggttatttctca

SEQ ID NO: 2589607 - DNA, 19 bp, Homo sapiens
agaaatacaattctacatt

SEQ ID NO: 2589608 - DNA, 20 bp, Homo sapiens
agaaatagcctgcgctgttt

SEQ ID NO: 2589609 - DNA, 21 bp, Homo sapiens
agaaatatgcacaatagcagt

SEQ ID NO: 2589610 - DNA, 12 bp, Homo sapiens
agaaatgaataa

SEQ ID NO: 2589611 - DNA, 19 bp, Homo sapiens
agaaatgagatcaggctct

SEQ ID NO: 2589612 - DNA, 23 bp, Homo sapiens
agaaatgctgcctgcctgtctgt

SEQ ID NO: 2589613 - DNA, 13 bp, Homo sapiens
agaaattaagtat

SEQ ID NO: 2589614 - DNA, 17 bp, Homo sapiens
agaaattagaaacctta

SEQ ID NO: 2589615 - DNA, 15 bp, Homo sapiens
agaaattagctgtgt

SEQ ID NO: 2589616 - DNA, 17 bp, Homo sapiens
agaaattagctgtgtga

SEQ ID NO: 2589617 - DNA, 14 bp, Homo sapiens
agaaattatttaat

SEQ ID NO: 2589618 - DNA, 19 bp, Homo sapiens
agaaattcctgtagcatct

SEQ ID NO: 2589619 - DNA, 19 bp, Homo sapiens
agaaattggaacagaatgt

SEQ ID NO: 2589620 - DNA, 22 bp, Homo sapiens
agaaattggaacagaatgtttt

SEQ ID NO: 2589621 - DNA, 15 bp, Homo sapiens
agaaattggctggat

SEQ ID NO: 2589622 - DNA, 21 bp, Homo sapiens
agaaatttaattcatgtttct

SEQ ID NO: 2589623 - DNA, 22 bp, Homo sapiens
agaaatttttatttttctaagg

SEQ ID NO: 2589624 - DNA, 17 bp, Homo sapiens
agaaatttttcagatgc

SEQ ID NO: 2589625 - DNA, 21 bp, Homo sapiens
agaaatttttcagatgcttct

SEQ ID NO: 2589626 - DNA, 23 bp, Homo sapiens
agaaatttttcagatgcttctgg

SEQ ID NO: 2589627 - DNA, 16 bp, Homo sapiens
agaacaaagtgagaca

SEQ ID NO: 2589628 - DNA, 17 bp, Homo sapiens
agaacaaggtagttttt

SEQ ID NO: 2589629 - DNA, 18 bp, Homo sapiens
agaacagcagaggttctt

SEQ ID NO: 2589630 - DNA, 23 bp, Homo sapiens
agaacagccgctcctgtctgcca

SEQ ID NO: 2589631 - DNA, 13 bp, Homo sapiens
agaacagcttcag

SEQ ID NO: 2589632 - DNA, 18 bp, Homo sapiens
agaacagcttcaggttat

SEQ ID NO: 2589633 - DNA, 15 bp, Homo sapiens
agaacatcattagaa

SEQ ID NO: 2589634 - DNA, 18 bp, Homo sapiens
agaacatctgtcctgtga

SEQ ID NO: 2589635 - DNA, 16 bp, Homo sapiens
agaacatggacttgta

SEQ ID NO: 2589636 - DNA, 19 bp, Homo sapiens
agaacatggacttgtatat

SEQ ID NO: 2589637 - DNA, 16 bp, Homo sapiens
agaaccaagaagggct

SEQ ID NO: 2589638 - DNA, 17 bp, Homo sapiens
agaacccctacatgaaa

SEQ ID NO: 2589639 - DNA, 20 bp, Homo sapiens
agaaccctgcgtggggacag

SEQ ID NO: 2589640 - DNA, 15 bp, Homo sapiens
agaaccgagcaaaga

SEQ ID NO: 2589641 - DNA, 16 bp, Homo sapiens
agaaccgagcaaagat

SEQ ID NO: 2589642 - DNA, 20 bp, Homo sapiens
agaaccgagcaaagatcaaa

SEQ ID NO: 2589643 - DNA, 16 bp, Homo sapiens
agaacctagaagggct

SEQ ID NO: 2589644 - DNA, 21 bp, Homo sapiens
agaacctcacgcacctcccat

SEQ ID NO: 2589645 - DNA, 12 bp, Homo sapiens
agaacctcaggc

SEQ ID NO: 2589646 - DNA, 15 bp, Homo sapiens
agaacctcttcccca

SEQ ID NO: 2589647 - DNA, 17 bp, Homo sapiens
agaacctggagggctgg

SEQ ID NO: 2589648 - DNA, 13 bp, Homo sapiens
agaacctgtcctt

SEQ ID NO: 2589649 - DNA, 22 bp, Homo sapiens
agaacgcagccctagagcctgc

SEQ ID NO: 2589650 - DNA, 21 bp, Homo sapiens
agaacggagccccaggcctct

SEQ ID NO: 2589651 - DNA, 22 bp, Homo sapiens
agaactactcagggaatgaagg

SEQ ID NO: 2589652 - DNA, 17 bp, Homo sapiens
agaactagaatttgatt

SEQ ID NO: 2589653 - DNA, 11 bp, Homo sapiens
agaactcctag

SEQ ID NO: 2589654 - DNA, 14 bp, Homo sapiens
agaactctgggctg

SEQ ID NO: 2589655 - DNA, 15 bp, Homo sapiens
agaactgcatatgtt

SEQ ID NO: 2589656 - DNA, 19 bp, Homo sapiens
agaactgtatgtcagacat

SEQ ID NO: 2589657 - DNA, 15 bp, Homo sapiens
agaagaatattcagg

SEQ ID NO: 2589658 - DNA, 16 bp, Homo sapiens
agaagaatattcagga

SEQ ID NO: 2589659 - DNA, 14 bp, Homo sapiens
agaagacaccagag

SEQ ID NO: 2589660 - DNA, 17 bp, Homo sapiens
agaagacaccagagcag

SEQ ID NO: 2589661 - DNA, 18 bp, Homo sapiens
agaagacaccagagcaga

SEQ ID NO: 2589662 - DNA, 19 bp, Homo sapiens
agaagacaccagagcagat

SEQ ID NO: 2589663 - DNA, 22 bp, Homo sapiens
agaagacaccagagcagatgca

SEQ ID NO: 2589664 - DNA, 17 bp, Homo sapiens
agaagacatgttttaga

SEQ ID NO: 2589665 - DNA, 19 bp, Homo sapiens
agaagacatgttttagaca

SEQ ID NO: 2589666 - DNA, 21 bp, Homo sapiens
agaagaccacaaaaattgact

SEQ ID NO: 2589667 - DNA, 15 bp, Homo sapiens
agaagagagaaatag

SEQ ID NO: 2589668 - DNA, 13 bp, Homo sapiens
agaagagctgttc

SEQ ID NO: 2589669 - DNA, 12 bp, Homo sapiens
agaagagggaga

SEQ ID NO: 2589670 - DNA, 18 bp, Homo sapiens
agaagagggcctgtggga

SEQ ID NO: 2589671 - DNA, 13 bp, Homo sapiens
agaagatagcagg

SEQ ID NO: 2589672 - DNA, 17 bp, Homo sapiens
agaagatcctaaaacaa

SEQ ID NO: 2589673 - DNA, 18 bp, Homo sapiens
agaagatgaatgagcaaa

SEQ ID NO: 2589674 - DNA, 19 bp, Homo sapiens
agaagatttgatgctggag

SEQ ID NO: 2589675 - DNA, 15 bp, Homo sapiens
agaagcatgaaaaag

SEQ ID NO: 2589676 - DNA, 13 bp, Homo sapiens
agaagcattcctt

SEQ ID NO: 2589677 - DNA, 17 bp, Homo sapiens
agaagcattccttcttt

SEQ ID NO: 2589678 - DNA, 19 bp, Homo sapiens
agaagcattccttctttga

SEQ ID NO: 2589679 - DNA, 10 bp, Homo sapiens
agaagccatt

SEQ ID NO: 2589680 - DNA, 20 bp, Homo sapiens
agaagccattgtcttcggaa

SEQ ID NO: 2589681 - DNA, 18 bp, Homo sapiens
agaagcccaggaaaggct

SEQ ID NO: 2589682 - DNA, 22 bp, Homo sapiens
agaagccgggaacagacaacag

SEQ ID NO: 2589683 - DNA, 12 bp, Homo sapiens
agaagcctctgg

SEQ ID NO: 2589684 - DNA, 13 bp, Homo sapiens
agaagcctctggc

SEQ ID NO: 2589685 - DNA, 14 bp, Homo sapiens
agaagcctctggct

SEQ ID NO: 2589686 - DNA, 23 bp, Homo sapiens
agaagcctctggctagaggccag

SEQ ID NO: 2589687 - DNA, 17 bp, Homo sapiens
agaagcctgaggctggg

SEQ ID NO: 2589688 - DNA, 23 bp, Homo sapiens
agaagcgggacgagaccctacag

SEQ ID NO: 2589689 - DNA, 15 bp, Homo sapiens
agaagctcccaggaa

SEQ ID NO: 2589690 - DNA, 16 bp, Homo sapiens
agaagctcccaggaac

SEQ ID NO: 2589691 - DNA, 17 bp, Homo sapiens
agaagctcccaggaaca

SEQ ID NO: 2589692 - DNA, 23 bp, Homo sapiens
agaagctccctgaagtaagcaaa

SEQ ID NO: 2589693 - DNA, 15 bp, Homo sapiens
agaagctgagcacca

SEQ ID NO: 2589694 - DNA, 16 bp, Homo sapiens
agaagctgttgtacat

SEQ ID NO: 2589695 - DNA, 22 bp, Homo sapiens
agaagctgttgtacatttatga

SEQ ID NO: 2589696 - DNA, 14 bp, Homo sapiens
agaaggagacagag

SEQ ID NO: 2589697 - DNA, 16 bp, Homo sapiens
agaaggatgtacattt

SEQ ID NO: 2589698 - DNA, 14 bp, Homo sapiens
agaaggcaaatgac

SEQ ID NO: 2589699 - DNA, 15 bp, Homo sapiens
agaaggcaaatgact

SEQ ID NO: 2589700 - DNA, 20 bp, Homo sapiens
agaaggcaaatgactttgga

SEQ ID NO: 2589701 - DNA, 22 bp, Homo sapiens
agaaggcaagtttctagctaga

SEQ ID NO: 2589702 - DNA, 11 bp, Homo sapiens
agaaggctctt

SEQ ID NO: 2589703 - DNA, 13 bp, Homo sapiens
agaagggagaagg

SEQ ID NO: 2589704 - DNA, 21 bp, Homo sapiens
agaagggatggattccaaccc

SEQ ID NO: 2589705 - DNA, 20 bp, Homo sapiens
agaagggccagtcctgcctg

SEQ ID NO: 2589706 - DNA, 14 bp, Homo sapiens
agaagggctagaac

SEQ ID NO: 2589707 - DNA, 17 bp, Homo sapiens
agaagggggccatgagg

SEQ ID NO: 2589708 - DNA, 20 bp, Homo sapiens
agaaggtccttaatgatccg

SEQ ID NO: 2589709 - DNA, 20 bp, Homo sapiens
agaaggttgctctagattga

SEQ ID NO: 2589710 - DNA, 20 bp, Homo sapiens
agaaggtttgtgtttttctg

SEQ ID NO: 2589711 - DNA, 19 bp, Homo sapiens
agaagtagattaagagcca

SEQ ID NO: 2589712 - DNA, 21 bp, Homo sapiens
agaagtaggcatgagggatca

SEQ ID NO: 2589713 - DNA, 15 bp, Homo sapiens
agaagtcttagactt

SEQ ID NO: 2589714 - DNA, 13 bp, Homo sapiens
agaagtgacaggg

SEQ ID NO: 2589715 - DNA, 17 bp, Homo sapiens
agaagtgacagggaagc

SEQ ID NO: 2589716 - DNA, 22 bp, Homo sapiens
agaagtgtgattgggaataaat

SEQ ID NO: 2589717 - DNA, 14 bp, Homo sapiens
agaagttactgaat

SEQ ID NO: 2589718 - DNA, 15 bp, Homo sapiens
agaagttactgaatg

SEQ ID NO: 2589719 - DNA, 19 bp, Homo sapiens
agaagttgaatgggcacag

SEQ ID NO: 2589720 - DNA, 16 bp, Homo sapiens
agaagtttaaggaata

SEQ ID NO: 2589721 - DNA, 16 bp, Homo sapiens
agaagtttctggccct

SEQ ID NO: 2589722 - DNA, 20 bp, Homo sapiens
agaagtttgatattaaagga

SEQ ID NO: 2589723 - DNA, 16 bp, Homo sapiens
agaagtttttgtactg

SEQ ID NO: 2589724 - DNA, 17 bp, Homo sapiens
agaataaagttctgagt

SEQ ID NO: 2589725 - DNA, 16 bp, Homo sapiens
agaataagttattgca

SEQ ID NO: 2589726 - DNA, 14 bp, Homo sapiens
agaataataagagg

SEQ ID NO: 2589727 - DNA, 16 bp, Homo sapiens
agaataatctttgggt

SEQ ID NO: 2589728 - DNA, 21 bp, Homo sapiens
agaatacagaaagatggatgt

SEQ ID NO: 2589729 - DNA, 14 bp, Homo sapiens
agaatataattatc

SEQ ID NO: 2589730 - DNA, 19 bp, Homo sapiens
agaatattagctttactgt

SEQ ID NO: 2589731 - DNA, 23 bp, Homo sapiens
agaatattagctttactgtttgt

SEQ ID NO: 2589732 - DNA, 12 bp, Homo sapiens
agaatattcagg

SEQ ID NO: 2589733 - DNA, 14 bp, Homo sapiens
agaatcacttgaac

SEQ ID NO: 2589734 - DNA, 16 bp, Homo sapiens
aggactgtatttgtga

SEQ ID NO: 2589735 - DNA, 18 bp, Homo sapiens
aggacttaacggctccag

SEQ ID NO: 2589736 - DNA, 21 bp, Homo sapiens
aggacttgaaagcatccatgt

SEQ ID NO: 2589737 - DNA, 20 bp, Homo sapiens
aggacttggtctgatttcag

SEQ ID NO: 2589738 - DNA, 17 bp, Homo sapiens
aggactttctgaagcct

SEQ ID NO: 2589739 - DNA, 23 bp, Homo sapiens
aggacttttctttgtggcttcct

SEQ ID NO: 2589740 - DNA, 17 bp, Homo sapiens
aggagaccaaggcggga

SEQ ID NO: 2589741 - DNA, 12 bp, Homo sapiens
aggagagaagaa

SEQ ID NO: 2589742 - DNA, 16 bp, Homo sapiens
aggagagcccttcatt

SEQ ID NO: 2589743 - DNA, 14 bp, Homo sapiens
aggagagcctgctg

SEQ ID NO: 2589744 - DNA, 15 bp, Homo sapiens
aggagaggaaaagta

SEQ ID NO: 2589745 - DNA, 20 bp, Homo sapiens
aggagaggaaaagtaaggtg

SEQ ID NO: 2589746 - DNA, 13 bp, Homo sapiens
aggagaggagagc

SEQ ID NO: 2589747 - DNA, 16 bp, Homo sapiens
aggagaggagagccag

SEQ ID NO: 2589748 - DNA, 18 bp, Homo sapiens
aggagaggatgagagccc

SEQ ID NO: 2589749 - DNA, 20 bp, Homo sapiens
aggagaggatgagagcccag

SEQ ID NO: 2589750 - DNA, 16 bp, Homo sapiens
aggagaggggcacagg

SEQ ID NO: 2589751 - DNA, 13 bp, Homo sapiens
aggagaggggcag

SEQ ID NO: 2589752 - DNA, 18 bp, Homo sapiens
aggagaggggcagaacag

SEQ ID NO: 2589753 - DNA, 20 bp, Homo sapiens
aggagagtcccagagcagga

SEQ ID NO: 2589754 - DNA, 21 bp, Homo sapiens
aggagagtcccagagcaggag

SEQ ID NO: 2589755 - DNA, 20 bp, Homo sapiens
aggagatatctgagggagga

SEQ ID NO: 2589756 - DNA, 23 bp, Homo sapiens
aggagatatctgagggaggaggc

SEQ ID NO: 2589757 - DNA, 16 bp, Homo sapiens
aggagcaaaggctgag

SEQ ID NO: 2589758 - DNA, 22 bp, Homo sapiens
aggagcaaaggctgagaacact

SEQ ID NO: 2589759 - DNA, 17 bp, Homo sapiens
aggagcaaatgtttctg

SEQ ID NO: 2589760 - DNA, 22 bp, Homo sapiens
aggagcaaatgtttctgcagta

SEQ ID NO: 2589761 - DNA, 12 bp, Homo sapiens
aggagcagccac

SEQ ID NO: 2589762 - DNA, 19 bp, Homo sapiens
aggagcaggagcctgagcc

SEQ ID NO: 2589763 - DNA, 16 bp, Homo sapiens
aggagcagtgcaggca

SEQ ID NO: 2589764 - DNA, 16 bp, Homo sapiens
aggagccccattcctg

SEQ ID NO: 2589765 - DNA, 19 bp, Homo sapiens
aggagccccattcctggga

SEQ ID NO: 2589766 - DNA, 21 bp, Homo sapiens
aggagccccattcctgggaaa

SEQ ID NO: 2589767 - DNA, 22 bp, Homo sapiens
aggagcctgctggtcacagcct

SEQ ID NO: 2589768 - DNA, 11 bp, Homo sapiens
aggagcctggc

SEQ ID NO: 2589769 - DNA, 18 bp, Homo sapiens
aggagcgggacctgtggc

SEQ ID NO: 2589770 - DNA, 17 bp, Homo sapiens
aggagctcttcaggcct

SEQ ID NO: 2589771 - DNA, 21 bp, Homo sapiens
aggagctcttcaggcctccct

SEQ ID NO: 2589772 - DNA, 12 bp, Homo sapiens
aggagctgctgg

SEQ ID NO: 2589773 - DNA, 21 bp, Homo sapiens
aggagctgctggcttgcagtg

SEQ ID NO: 2589774 - DNA, 18 bp, Homo sapiens
aggagctgggatcctaag

SEQ ID NO: 2589775 - DNA, 15 bp, Homo sapiens
aggaggagcaggggc

SEQ ID NO: 2589776 - DNA, 20 bp, Homo sapiens
aggaggattgcttgagccca

SEQ ID NO: 2589777 - DNA, 12 bp, Homo sapiens
aggaggccacct

SEQ ID NO: 2589778 - DNA, 13 bp, Homo sapiens
aggaggccacctc

SEQ ID NO: 2589779 - DNA, 15 bp, Homo sapiens
aggaggccacctctc

SEQ ID NO: 2589780 - DNA, 16 bp, Homo sapiens
aggaggccacctctcc

SEQ ID NO: 2589781 - DNA, 22 bp, Homo sapiens
aggaggccacctctccaagggc

SEQ ID NO: 2589782 - DNA, 14 bp, Homo sapiens
aggaggccacgtga

SEQ ID NO: 2589783 - DNA, 17 bp, Homo sapiens
aggaggctccagagggc

SEQ ID NO: 2589784 - DNA, 18 bp, Homo sapiens
aggaggctccagagggca

SEQ ID NO: 2589785 - DNA, 23 bp, Homo sapiens
aggagggaggtattcgtgcagca

SEQ ID NO: 2589786 - DNA, 20 bp, Homo sapiens
aggagggcaagggccatgct

SEQ ID NO: 2589787 - DNA, 20 bp, Homo sapiens
aggagggccctacctgattg

SEQ ID NO: 2589788 - DNA, 17 bp, Homo sapiens
aggaggggatagagaga

SEQ ID NO: 2589789 - DNA, 16 bp, Homo sapiens
aggaggggctgtaaaa

SEQ ID NO: 2589790 - DNA, 17 bp, Homo sapiens
aggagggtcaggaagga

SEQ ID NO: 2589791 - DNA, 20 bp, Homo sapiens
aggaggtggaggctgcagtg

SEQ ID NO: 2589792 - DNA, 14 bp, Homo sapiens
aggaggtggcagcc

SEQ ID NO: 2589793 - DNA, 17 bp, Homo sapiens
aggaggtggcagccctg

SEQ ID NO: 2589794 - DNA, 21 bp, Homo sapiens
aggaggtggcagccctgtagg

SEQ ID NO: 2589795 - DNA, 14 bp, Homo sapiens
aggaggtttggatg

SEQ ID NO: 2589796 - DNA, 23 bp, Homo sapiens
aggaggtttggggtctgccacca

SEQ ID NO: 2589797 - DNA, 20 bp, Homo sapiens
aggagtaatctgtgtacaaa

SEQ ID NO: 2589798 - DNA, 14 bp, Homo sapiens
aggagtcagagaga

SEQ ID NO: 2589799 - DNA, 14 bp, Homo sapiens
aggagtcccaagga

SEQ ID NO: 2589800 - DNA, 17 bp, Homo sapiens
aggagtgagaggggaca

SEQ ID NO: 2589801 - DNA, 12 bp, Homo sapiens
aggagtgagcac

SEQ ID NO: 2589802 - DNA, 14 bp, Homo sapiens
aggagtgagcacta

SEQ ID NO: 2589803 - DNA, 16 bp, Homo sapiens
aggagtgtgagaatca

SEQ ID NO: 2589804 - DNA, 16 bp, Homo sapiens
aggagtgtggccacgt

SEQ ID NO: 2589805 - DNA, 20 bp, Homo sapiens
aggagttagaggccagcctg

SEQ ID NO: 2589806 - DNA, 14 bp, Homo sapiens
aggagttcaatgat

SEQ ID NO: 2589807 - DNA, 18 bp, Homo sapiens
aggagttcaatgatctag

SEQ ID NO: 2589808 - DNA, 17 bp, Homo sapiens
aggagttcgaggctgca

SEQ ID NO: 2589809 - DNA, 21 bp, Homo sapiens
aggagtttgagaccaacctgg

SEQ ID NO: 2589810 - DNA, 20 bp, Homo sapiens
aggagtttgaggctgcagcg

SEQ ID NO: 2589811 - DNA, 24 bp, Homo sapiens
aggagtttgaggctgcagcgagct

SEQ ID NO: 2589812 - DNA, 16 bp, Homo sapiens
aggatactctgtcaga

SEQ ID NO: 2589813 - DNA, 23 bp, Homo sapiens
aggatagaagtatacctgatttt

SEQ ID NO: 2589814 - DNA, 21 bp, Homo sapiens
aggataggagttcacttcatc

SEQ ID NO: 2589815 - DNA, 21 bp, Homo sapiens
aggatatattttcactttgtg

SEQ ID NO: 2589816 - DNA, 20 bp, Homo sapiens
aggatcatttgttggaatga

SEQ ID NO: 2589817 - DNA, 21 bp, Homo sapiens
aggatcatttgttggaatgaa

SEQ ID NO: 2589818 - DNA, 19 bp, Homo sapiens
aggatccctctctggattg

SEQ ID NO: 2589819 - DNA, 21 bp, Homo sapiens
aggatcctattctcaccagga

SEQ ID NO: 2589820 - DNA, 19 bp, Homo sapiens
aggatctctcaggagcaca

SEQ ID NO: 2589821 - DNA, 21 bp, Homo sapiens
aggatctctcaggagcacagg

SEQ ID NO: 2589822 - DNA, 12 bp, Homo sapiens
aggatctcttga

SEQ ID NO: 2589823 - DNA, 18 bp, Homo sapiens
aggatctcttgagcctgg

SEQ ID NO: 2589824 - DNA, 19 bp, Homo sapiens
aggatctcttgagcctggg

SEQ ID NO: 2589825 - DNA, 19 bp, Homo sapiens
aggatgaatgaggtcccag

SEQ ID NO: 2589826 - DNA, 21 bp, Homo sapiens
aggatgaatgaggtcccaggc

SEQ ID NO: 2589827 - DNA, 14 bp, Homo sapiens
aggatgagagccca

SEQ ID NO: 2589828 - DNA, 17 bp, Homo sapiens
aggatgagagcccagag

SEQ ID NO: 2589829 - DNA, 19 bp, Homo sapiens
aggatgagagcccagaggt

SEQ ID NO: 2589830 - DNA, 20 bp, Homo sapiens
aggatgagagcccagaggta

SEQ ID NO: 2589831 - DNA, 13 bp, Homo sapiens
aggatgagctgga

SEQ ID NO: 2589832 - DNA, 22 bp, Homo sapiens
aggatgcacagagttgttacat

SEQ ID NO: 2589833 - DNA, 19 bp, Homo sapiens
aggatgcagagtcagcaga

SEQ ID NO: 2589834 - DNA, 14 bp, Homo sapiens
aggatgcccagggc

SEQ ID NO: 2589835 - DNA, 22 bp, Homo sapiens
aggatgcccagggccactctgc

SEQ ID NO: 2589836 - DNA, 15 bp, Homo sapiens
aggatgcttgtacat

SEQ ID NO: 2589837 - DNA, 21 bp, Homo sapiens
aggatgcttgtacataatgcg

SEQ ID NO: 2589838 - DNA, 13 bp, Homo sapiens
aggatggagagag

SEQ ID NO: 2589839 - DNA, 15 bp, Homo sapiens
aggcaatgctggctg

SEQ ID NO: 2589840 - DNA, 12 bp, Homo sapiens
aggcacacttct

SEQ ID NO: 2589841 - DNA, 16 bp, Homo sapiens
aggcacacttcttctt

SEQ ID NO: 2589842 - DNA, 17 bp, Homo sapiens
aggcacatggaggagct

SEQ ID NO: 2589843 - DNA, 22 bp, Homo sapiens
aggcacccaccatcatgtctgg

SEQ ID NO: 2589844 - DNA, 16 bp, Homo sapiens
aggcaccccctggaga

SEQ ID NO: 2589845 - DNA, 17 bp, Homo sapiens
aggcaccccctggagag

SEQ ID NO: 2589846 - DNA, 23 bp, Homo sapiens
aggcactgagataccagcgagga

SEQ ID NO: 2589847 - DNA, 22 bp, Homo sapiens
aggcactgctgcccagcctcca

SEQ ID NO: 2589848 - DNA, 23 bp, Homo sapiens
aggcactgggggcagcgggggcc

SEQ ID NO: 2589849 - DNA, 13 bp, Homo sapiens
aggcagacagcag

SEQ ID NO: 2589850 - DNA, 19 bp, Homo sapiens
aggcagacagcagctcagg

SEQ ID NO: 2589851 - DNA, 20 bp, Homo sapiens
aggcagacagcagctcaggc

SEQ ID NO: 2589852 - DNA, 21 bp, Homo sapiens
aggcagacagcagctcaggca

SEQ ID NO: 2589853 - DNA, 21 bp, Homo sapiens
aggcagagaaagaagagacag

SEQ ID NO: 2589854 - DNA, 22 bp, Homo sapiens
aggcagagaatcatacttagca

SEQ ID NO: 2589855 - DNA, 16 bp, Homo sapiens
aggcagatctgtgccc

SEQ ID NO: 2589856 - DNA, 21 bp, Homo sapiens
aggcagatctgtgccccatgc

SEQ ID NO: 2589857 - DNA, 16 bp, Homo sapiens
aggcagattgaaaagg

SEQ ID NO: 2589858 - DNA, 17 bp, Homo sapiens
aggcagattgaaaagga

SEQ ID NO: 2589859 - DNA, 19 bp, Homo sapiens
aggcagcagtgtgaggcca

SEQ ID NO: 2589860 - DNA, 19 bp, Homo sapiens
aggcagccccattctgcct

SEQ ID NO: 2589861 - DNA, 20 bp, Homo sapiens
aggcagcctggacatagaga

SEQ ID NO: 2589862 - DNA, 17 bp, Homo sapiens
aggcagctgcctgctct

SEQ ID NO: 2589863 - DNA, 22 bp, Homo sapiens
aggcagctttaaccattaaaac

SEQ ID NO: 2589864 - DNA, 23 bp, Homo sapiens
aggcaggctaaggcgtggagctg

SEQ ID NO: 2589865 - DNA, 23 bp, Homo sapiens
aggcagggaagtccccaggcccc

SEQ ID NO: 2589866 - DNA, 13 bp, Homo sapiens
aggcagggagggg

SEQ ID NO: 2589867 - DNA, 14 bp, Homo sapiens
aggcagggtcagga

SEQ ID NO: 2589868 - DNA, 17 bp, Homo sapiens
aggcagggtcaggagag

SEQ ID NO: 2589869 - DNA, 20 bp, Homo sapiens
aggcagggtcaggagagggg

SEQ ID NO: 2589870 - DNA, 18 bp, Homo sapiens
aggcagggtctcactctg

SEQ ID NO: 2589871 - DNA, 22 bp, Homo sapiens
aggcagggtctcactctgtcgc

SEQ ID NO: 2589872 - DNA, 15 bp, Homo sapiens
aggcaggtgcctgga

SEQ ID NO: 2589873 - DNA, 17 bp, Homo sapiens
aggcaggtgggatggat

SEQ ID NO: 2589874 - DNA, 20 bp, Homo sapiens
aggcagtcgggggctggcct

SEQ ID NO: 2589875 - DNA, 18 bp, Homo sapiens
aggcataggcctgggtgc

SEQ ID NO: 2589876 - DNA, 20 bp, Homo sapiens
aggcatcagtccctatgtat

SEQ ID NO: 2589877 - DNA, 18 bp, Homo sapiens
aggcatccttcctcacac

SEQ ID NO: 2589878 - DNA, 13 bp, Homo sapiens
aggcatggccctg

SEQ ID NO: 2589879 - DNA, 15 bp, Homo sapiens
aggcatggccctggg

SEQ ID NO: 2589880 - DNA, 22 bp, Homo sapiens
aggcatgtgccacccacccaac

SEQ ID NO: 2589881 - DNA, 17 bp, Homo sapiens
aggcatgttctctgagg

SEQ ID NO: 2589882 - DNA, 12 bp, Homo sapiens
aggcattcaagt

SEQ ID NO: 2589883 - DNA, 13 bp, Homo sapiens
aggcattgccaag

SEQ ID NO: 2589884 - DNA, 16 bp, Homo sapiens
aggcattgccaagggc

SEQ ID NO: 2589885 - DNA, 23 bp, Homo sapiens
aggccaaaattaccaaaaatctt

SEQ ID NO: 2589886 - DNA, 22 bp, Homo sapiens
aggccaaacctctgttcagtgt

SEQ ID NO: 2589887 - DNA, 17 bp, Homo sapiens
aggccaagagcagaggc

SEQ ID NO: 2589888 - DNA, 18 bp, Homo sapiens
aggccaagagcagaggca

SEQ ID NO: 2589889 - DNA, 20 bp, Homo sapiens
aggccaagagcagaggcagc

SEQ ID NO: 2589890 - DNA, 23 bp, Homo sapiens
aggccaagtttgtatcaggtgcc

SEQ ID NO: 2589891 - DNA, 20 bp, Homo sapiens
aggccacaagacccttgtgg

SEQ ID NO: 2589892 - DNA, 22 bp, Homo sapiens
aggccacatggggctgggcagc

SEQ ID NO: 2589893 - DNA, 23 bp, Homo sapiens
aggccacatggggctgggcagct

SEQ ID NO: 2589894 - DNA, 15 bp, Homo sapiens
aggccacatgtcacc

SEQ ID NO: 2589895 - DNA, 12 bp, Homo sapiens
aggccaccagga

SEQ ID NO: 2589896 - DNA, 13 bp, Homo sapiens
aggccacctctcc

SEQ ID NO: 2589897 - DNA, 15 bp, Homo sapiens
aggccacctgccccc

SEQ ID NO: 2589898 - DNA, 16 bp, Homo sapiens
aggccacctgccccct

SEQ ID NO: 2589899 - DNA, 17 bp, Homo sapiens
aggccacctgccccctt

SEQ ID NO: 2589900 - DNA, 19 bp, Homo sapiens
aggccacctgcccccttct

SEQ ID NO: 2589901 - DNA, 21 bp, Homo sapiens
aggccacctgcccccttctcc

SEQ ID NO: 2589902 - DNA, 22 bp, Homo sapiens
aggccacctgcccccttctccc

SEQ ID NO: 2589903 - DNA, 14 bp, Homo sapiens
aggccagagggagt

SEQ ID NO: 2589904 - DNA, 17 bp, Homo sapiens
aggccagagtggcctgg

SEQ ID NO: 2589905 - DNA, 19 bp, Homo sapiens
aggccagagtggcctggcc

SEQ ID NO: 2589906 - DNA, 20 bp, Homo sapiens
aggccagagtggcctggcca

SEQ ID NO: 2589907 - DNA, 22 bp, Homo sapiens
aggccagccagtgacctgagga

SEQ ID NO: 2589908 - DNA, 13 bp, Homo sapiens
aggccagccccac

SEQ ID NO: 2589909 - DNA, 16 bp, Homo sapiens
aggccagccccaccca

SEQ ID NO: 2589910 - DNA, 17 bp, Homo sapiens
aggccagccccacccag

SEQ ID NO: 2589911 - DNA, 13 bp, Homo sapiens
aggccagccttga

SEQ ID NO: 2589912 - DNA, 15 bp, Homo sapiens
aggccagccttgacc

SEQ ID NO: 2589913 - DNA, 17 bp, Homo sapiens
aggccagctggcagcag

SEQ ID NO: 2589914 - DNA, 21 bp, Homo sapiens
aggccaggagtttgagaccag

SEQ ID NO: 2589915 - DNA, 17 bp, Homo sapiens
aggccaggccaccagga

SEQ ID NO: 2589916 - DNA, 19 bp, Homo sapiens
aggccaggccaccaggatg

SEQ ID NO: 2589917 - DNA, 15 bp, Homo sapiens
aggccaggccctctg

SEQ ID NO: 2589918 - DNA, 18 bp, Homo sapiens
aggccaggccctctgccc

SEQ ID NO: 2589919 - DNA, 19 bp, Homo sapiens
aggccaggccctctgccca

SEQ ID NO: 2589920 - DNA, 17 bp, Homo sapiens
aggccaggctccttcct

SEQ ID NO: 2589921 - DNA, 23 bp, Homo sapiens
aggccagggctatagctcaggac

SEQ ID NO: 2589922 - DNA, 23 bp, Homo sapiens
aggccagggtcactgaaggcctg

SEQ ID NO: 2589923 - DNA, 21 bp, Homo sapiens
aggccatcatcagtggagcca

SEQ ID NO: 2589924 - DNA, 19 bp, Homo sapiens
aggccatgattcgcccaaa

SEQ ID NO: 2589925 - DNA, 17 bp, Homo sapiens
aggccatggagagctgg

SEQ ID NO: 2589926 - DNA, 21 bp, Homo sapiens
aggccatggagagctggagcc

SEQ ID NO: 2589927 - DNA, 16 bp, Homo sapiens
aggccatgggcctcct

SEQ ID NO: 2589928 - DNA, 18 bp, Homo sapiens
aggccatgggcctcctgt

SEQ ID NO: 2589929 - DNA, 13 bp, Homo sapiens
aggccattattgt

SEQ ID NO: 2589930 - DNA, 20 bp, Homo sapiens
aggcccagcattgctggttc

SEQ ID NO: 2589931 - DNA, 17 bp, Homo sapiens
aggcccagtgagatgca

SEQ ID NO: 2589932 - DNA, 21 bp, Homo sapiens
aggccccaaaaccacagccct

SEQ ID NO: 2589933 - DNA, 13 bp, Homo sapiens
aggccccactggg

SEQ ID NO: 2589934 - DNA, 14 bp, Homo sapiens
aggccccagagact

SEQ ID NO: 2589935 - DNA, 22 bp, Homo sapiens
aggccccagagactcagaggga

SEQ ID NO: 2589936 - DNA, 12 bp, Homo sapiens
aggccccaggaa

SEQ ID NO: 2589937 - DNA, 13 bp, Homo sapiens
aggccccaggaag

SEQ ID NO: 2589938 - DNA, 15 bp, Homo sapiens
aggccccaggaagcc

SEQ ID NO: 2589939 - DNA, 16 bp, Homo sapiens
aggccccaggaagccg

SEQ ID NO: 2589940 - DNA, 19 bp, Homo sapiens
aggccccgaggacccagac

SEQ ID NO: 2589941 - DNA, 21 bp, Homo sapiens
aggccccgaggacccagaccc

SEQ ID NO: 2589942 - DNA, 14 bp, Homo sapiens
aggcccctggccca

SEQ ID NO: 2589943 - DNA, 16 bp, Homo sapiens
aggcccctggcccagc

SEQ ID NO: 2589944 - DNA, 20 bp, Homo sapiens
aggcccgctctacatcttct

SEQ ID NO: 2589945 - DNA, 13 bp, Homo sapiens
aggcccggctcca

SEQ ID NO: 2589946 - DNA, 19 bp, Homo sapiens
aggccctctgcccactccc

SEQ ID NO: 2589947 - DNA, 22 bp, Homo sapiens
aggcccttctctccagcccctg

SEQ ID NO: 2589948 - DNA, 23 bp, Homo sapiens
aggcccttctctccagcccctgg

SEQ ID NO: 2589949 - DNA, 16 bp, Homo sapiens
aggccgaagctctggc

SEQ ID NO: 2589950 - DNA, 23 bp, Homo sapiens
aggccgaagctctggctgaaccc

SEQ ID NO: 2589951 - DNA, 16 bp, Homo sapiens
aggccgcagctcttgc

SEQ ID NO: 2589952 - DNA, 22 bp, Homo sapiens
aggccgcagctcttgcccttcc

SEQ ID NO: 2589953 - DNA, 21 bp, Homo sapiens
aggccgggccgaatcccctcc

SEQ ID NO: 2589954 - DNA, 20 bp, Homo sapiens
agggatcttgcattcccagt

SEQ ID NO: 2589955 - DNA, 15 bp, Homo sapiens
agggatgactaaaat

SEQ ID NO: 2589956 - DNA, 22 bp, Homo sapiens
agggatgactaaaatatttatt

SEQ ID NO: 2589957 - DNA, 19 bp, Homo sapiens
agggatgagcatggagctg

SEQ ID NO: 2589958 - DNA, 20 bp, Homo sapiens
agggatgagcatggagctgg

SEQ ID NO: 2589959 - DNA, 21 bp, Homo sapiens
agggatgagcatggagctggc

SEQ ID NO: 2589960 - DNA, 17 bp, Homo sapiens
agggatggattccaacc

SEQ ID NO: 2589961 - DNA, 23 bp, Homo sapiens
agggatgtgaattgcctgcagag

SEQ ID NO: 2589962 - DNA, 17 bp, Homo sapiens
agggattacccaagcaa

SEQ ID NO: 2589963 - DNA, 20 bp, Homo sapiens
agggattagggagagaagat

SEQ ID NO: 2589964 - DNA, 14 bp, Homo sapiens
agggattcaggctg

SEQ ID NO: 2589965 - DNA, 15 bp, Homo sapiens
agggattcaggctgc

SEQ ID NO: 2589966 - DNA, 20 bp, Homo sapiens
agggcaacaataaaatagca

SEQ ID NO: 2589967 - DNA, 13 bp, Homo sapiens
agggcaagggcca

SEQ ID NO: 2589968 - DNA, 22 bp, Homo sapiens
agggcaagggccatgctgaagg

SEQ ID NO: 2589969 - DNA, 20 bp, Homo sapiens
agggcacattccttgcctgc

SEQ ID NO: 2589970 - DNA, 21 bp, Homo sapiens
agggcacattccttgcctgca

SEQ ID NO: 2589971 - DNA, 17 bp, Homo sapiens
agggcacttcacagagt

SEQ ID NO: 2589972 - DNA, 19 bp, Homo sapiens
agggcagaaaggttctgcc

SEQ ID NO: 2589973 - DNA, 20 bp, Homo sapiens
agggcagaaaggttctgccc

SEQ ID NO: 2589974 - DNA, 14 bp, Homo sapiens
agggcagcagggct

SEQ ID NO: 2589975 - DNA, 15 bp, Homo sapiens
agggcagcagggcta

SEQ ID NO: 2589976 - DNA, 13 bp, Homo sapiens
agggcagcttgcc

SEQ ID NO: 2589977 - DNA, 17 bp, Homo sapiens
agggcagcttgccccgg

SEQ ID NO: 2589978 - DNA, 23 bp, Homo sapiens
agggcagcttgccccggccccgg

SEQ ID NO: 2589979 - DNA, 22 bp, Homo sapiens
agggcagggaccacaccctgta

SEQ ID NO: 2589980 - DNA, 16 bp, Homo sapiens
agggcagggctctgat

SEQ ID NO: 2589981 - DNA, 20 bp, Homo sapiens
agggcagtcgatagagctgt

SEQ ID NO: 2589982 - DNA, 15 bp, Homo sapiens
agggcataatgatga

SEQ ID NO: 2589983 - DNA, 13 bp, Homo sapiens
agggcattggcca

SEQ ID NO: 2589984 - DNA, 16 bp, Homo sapiens
agggccaagacttggc

SEQ ID NO: 2589985 - DNA, 24 bp, Homo sapiens
agggccacactattaccatgagaa

SEQ ID NO: 2589986 - DNA, 18 bp, Homo sapiens
agggccactctgcctctg

SEQ ID NO: 2589987 - DNA, 14 bp, Homo sapiens
agggccactgaaga

SEQ ID NO: 2589988 - DNA, 21 bp, Homo sapiens
agggccaggcaggtgcctgga

SEQ ID NO: 2589989 - DNA, 12 bp, Homo sapiens
agggccagggcc

SEQ ID NO: 2589990 - DNA, 14 bp, Homo sapiens
agggccagggccct

SEQ ID NO: 2589991 - DNA, 20 bp, Homo sapiens
agggccaggggtctccctgg

SEQ ID NO: 2589992 - DNA, 13 bp, Homo sapiens
agggccagtcctg

SEQ ID NO: 2589993 - DNA, 18 bp, Homo sapiens
agggccagtcctgcctgg

SEQ ID NO: 2589994 - DNA, 21 bp, Homo sapiens
agggccagtcctgcctggcca

SEQ ID NO: 2589995 - DNA, 23 bp, Homo sapiens
agggccagtcctgcctggccagg

SEQ ID NO: 2589996 - DNA, 16 bp, Homo sapiens
agggcccaagtccctg

SEQ ID NO: 2589997 - DNA, 23 bp, Homo sapiens
agggcccagagagggtggtgacc

SEQ ID NO: 2589998 - DNA, 12 bp, Homo sapiens
agggcccagagc

SEQ ID NO: 2589999 - DNA, 18 bp, Homo sapiens
agggcccagagcaggaag

SEQ ID NO: 2590000 - DNA, 17 bp, Homo sapiens
agggcccaggcaggcca

SEQ ID NO: 2590001 - DNA, 13 bp, Homo sapiens
agggcccctctgc

SEQ ID NO: 2590002 - DNA, 16 bp, Homo sapiens
agggcccctctgccca

SEQ ID NO: 2590003 - DNA, 17 bp, Homo sapiens
agggcccctctgcccag

SEQ ID NO: 2590004 - DNA, 18 bp, Homo sapiens
agggcccctctgcccagc

SEQ ID NO: 2590005 - DNA, 19 bp, Homo sapiens
agggccgtaccccaccctc

SEQ ID NO: 2590006 - DNA, 15 bp, Homo sapiens
agggcctagctgcta

SEQ ID NO: 2590007 - DNA, 16 bp, Homo sapiens
agggcctagctgctac

SEQ ID NO: 2590008 - DNA, 21 bp, Homo sapiens
agggcctagctgctacaaaga

SEQ ID NO: 2590009 - DNA, 13 bp, Homo sapiens
agggcctggcctg

SEQ ID NO: 2590010 - DNA, 14 bp, Homo sapiens
agggcctggctcag

SEQ ID NO: 2590011 - DNA, 12 bp, Homo sapiens
agggcctgtggg

SEQ ID NO: 2590012 - DNA, 18 bp, Homo sapiens
agggcctgtgggagcctg

SEQ ID NO: 2590013 - DNA, 20 bp, Homo sapiens
agggcgaacgacaatagctt

SEQ ID NO: 2590014 - DNA, 13 bp, Homo sapiens
agggcggcactca

SEQ ID NO: 2590015 - DNA, 19 bp, Homo sapiens
agggcgtggaaaggggcag

SEQ ID NO: 2590016 - DNA, 21 bp, Homo sapiens
agggctaccctgagctgaggc

SEQ ID NO: 2590017 - DNA, 22 bp, Homo sapiens
agggctaccctgagctgaggca

SEQ ID NO: 2590018 - DNA, 23 bp, Homo sapiens
agggctaccctgagctgaggcag

SEQ ID NO: 2590019 - DNA, 22 bp, Homo sapiens
agggctagaacctggaagggct

SEQ ID NO: 2590020 - DNA, 17 bp, Homo sapiens
agggctagaacctggag

SEQ ID NO: 2590021 - DNA, 19 bp, Homo sapiens
agggctagaacctggagaa

SEQ ID NO: 2590022 - DNA, 20 bp, Homo sapiens
agggctagaacctggagagc

SEQ ID NO: 2590023 - DNA, 22 bp, Homo sapiens
agggctagaacctggagggcta

SEQ ID NO: 2590024 - DNA, 18 bp, Homo sapiens
agggctagaacctggcag

SEQ ID NO: 2590025 - DNA, 18 bp, Homo sapiens
agggctagaatctggaga

SEQ ID NO: 2590026 - DNA, 12 bp, Homo sapiens
agggctcagcct

SEQ ID NO: 2590027 - DNA, 13 bp, Homo sapiens
agggctcaggatt

SEQ ID NO: 2590028 - DNA, 12 bp, Homo sapiens
agggctccagac

SEQ ID NO: 2590029 - DNA, 15 bp, Homo sapiens
agggctccagacaca

SEQ ID NO: 2590030 - DNA, 20 bp, Homo sapiens
agggctccagacacatgtcc

SEQ ID NO: 2590031 - DNA, 15 bp, Homo sapiens
agggctcctgccttc

SEQ ID NO: 2590032 - DNA, 22 bp, Homo sapiens
agggctctgatattccatgaat

SEQ ID NO: 2590033 - DNA, 12 bp, Homo sapiens
agggctggacct

SEQ ID NO: 2590034 - DNA, 13 bp, Homo sapiens
agggctggaccta

SEQ ID NO: 2590035 - DNA, 14 bp, Homo sapiens
agggctggcccagc

SEQ ID NO: 2590036 - DNA, 22 bp, Homo sapiens
agggctggcccagccctgctgg

SEQ ID NO: 2590037 - DNA, 16 bp, Homo sapiens
agggctggtctctgct

SEQ ID NO: 2590038 - DNA, 16 bp, Homo sapiens
agggcttctgcaccct

SEQ ID NO: 2590039 - DNA, 18 bp, Homo sapiens
agggctttgttttgcaca

SEQ ID NO: 2590040 - DNA, 22 bp, Homo sapiens
aggggaaaatcagcctgctcca

SEQ ID NO: 2590041 - DNA, 13 bp, Homo sapiens
aggggaaaatgaa

SEQ ID NO: 2590042 - DNA, 23 bp, Homo sapiens
aggggaagggccagtctgggctg

SEQ ID NO: 2590043 - DNA, 17 bp, Homo sapiens
aggggaataatagaaga

SEQ ID NO: 2590044 - DNA, 18 bp, Homo sapiens
aggggaataatagaagaa

SEQ ID NO: 2590045 - DNA, 19 bp, Homo sapiens
aggggaatgtttgcctctg

SEQ ID NO: 2590046 - DNA, 19 bp, Homo sapiens
aggggactatttatgaagg

SEQ ID NO: 2590047 - DNA, 14 bp, Homo sapiens
aggggactcagccc

SEQ ID NO: 2590048 - DNA, 18 bp, Homo sapiens
aggggagcatgggaagtg

SEQ ID NO: 2590049 - DNA, 11 bp, Homo sapiens
aggggagccct

SEQ ID NO: 2590050 - DNA, 13 bp, Homo sapiens
aggggaggcagcc

SEQ ID NO: 2590051 - DNA, 16 bp, Homo sapiens
aggggagggtggcagg

SEQ ID NO: 2590052 - DNA, 16 bp, Homo sapiens
aggggatagagagaga

SEQ ID NO: 2590053 - DNA, 18 bp, Homo sapiens
aggggatataggagagga

SEQ ID NO: 2590054 - DNA, 13 bp, Homo sapiens
aggggcagccctt

SEQ ID NO: 2590055 - DNA, 14 bp, Homo sapiens
aggggcagcttcta

SEQ ID NO: 2590056 - DNA, 15 bp, Homo sapiens
aggggcagcttctat

SEQ ID NO: 2590057 - DNA, 14 bp, Homo sapiens
aggggcatctgccc

SEQ ID NO: 2590058 - DNA, 17 bp, Homo sapiens
aggggcatctgcccctc

SEQ ID NO: 2590059 - DNA, 19 bp, Homo sapiens
aggggcatctgcccctccc

SEQ ID NO: 2590060 - DNA, 19 bp, Homo sapiens
aggggcatgtattggcctg

SEQ ID NO: 2590061 - DNA, 12 bp, Homo sapiens
aggggccagagg

SEQ ID NO: 2590062 - DNA, 17 bp, Homo sapiens
aggggcccaaggcggcc

SEQ ID NO: 2590063 - DNA, 20 bp, Homo sapiens
aggggcccaaggcggcccct

SEQ ID NO: 2590064 - DNA, 20 bp, Homo sapiens
aggggccccgtgtcctgcct

SEQ ID NO: 2590065 - DNA, 16 bp, Homo sapiens
aggggcccctccagct

SEQ ID NO: 2590066 - DNA, 12 bp, Homo sapiens
aggggccctggt

SEQ ID NO: 2590067 - DNA, 13 bp, Homo sapiens
aggggcgctggcc

SEQ ID NO: 2590068 - DNA, 15 bp, Homo sapiens
aggggcgctggccca

SEQ ID NO: 2590069 - DNA, 20 bp, Homo sapiens
aggggcgctggcccagccgg

SEQ ID NO: 2590070 - DNA, 22 bp, Homo sapiens
aggggcgtggagggcgtggagg

SEQ ID NO: 2590071 - DNA, 20 bp, Homo sapiens
aggggctgaaagaacatgga

SEQ ID NO: 2590072 - DNA, 16 bp, Homo sapiens
aggggctttctggaga

SEQ ID NO: 2590073 - DNA, 13 bp, Homo sapiens
aggggggagctgg

SEQ ID NO: 2590074 - DNA, 14 bp, Homo sapiens
aggggggagctggg

SEQ ID NO: 2590075 - DNA, 16 bp, Homo sapiens
agggggtcccagtggg

SEQ ID NO: 2590076 - DNA, 22 bp, Homo sapiens
agggggtttgggggcttgcaag

SEQ ID NO: 2590077 - DNA, 14 bp, Homo sapiens
aggggtcaaagaaa

SEQ ID NO: 2590078 - DNA, 16 bp, Homo sapiens
aggggtcaggctccat

SEQ ID NO: 2590079 - DNA, 18 bp, Homo sapiens
aggggtctccaggaggag

SEQ ID NO: 2590080 - DNA, 19 bp, Homo sapiens
aggggtctccaggaggaga

SEQ ID NO: 2590081 - DNA, 13 bp, Homo sapiens
aggggtctccctg

SEQ ID NO: 2590082 - DNA, 17 bp, Homo sapiens
aggggtctccctggagt

SEQ ID NO: 2590083 - DNA, 21 bp, Homo sapiens
aggggtgccccctcctctccc

SEQ ID NO: 2590084 - DNA, 15 bp, Homo sapiens
aggggtggagactgc

SEQ ID NO: 2590085 - DNA, 20 bp, Homo sapiens
aggggtggagactgcttccc

SEQ ID NO: 2590086 - DNA, 20 bp, Homo sapiens
aggggtgggacaccctgtga

SEQ ID NO: 2590087 - DNA, 20 bp, Homo sapiens
aggggtgggttcctcttccc

SEQ ID NO: 2590088 - DNA, 13 bp, Homo sapiens
aggggtggtcctg

SEQ ID NO: 2590089 - DNA, 24 bp, Homo sapiens
aggggttcccttttttggctgctg

SEQ ID NO: 2590090 - DNA, 20 bp, Homo sapiens
aggggttcgagaccagtctg

SEQ ID NO: 2590091 - DNA, 23 bp, Homo sapiens
aggggttgagcagggatcctggt

SEQ ID NO: 2590092 - DNA, 21 bp, Homo sapiens
aggggttttcgaagctcagcc

SEQ ID NO: 2590093 - DNA, 23 bp, Homo sapiens
agggtaccttgaacactggggga

SEQ ID NO: 2590094 - DNA, 23 bp, Homo sapiens
agggtagcccgcctgccagtcct

SEQ ID NO: 2590095 - DNA, 18 bp, Homo sapiens
agggtatcaaataaaatt

SEQ ID NO: 2590096 - DNA, 21 bp, Homo sapiens
agggtcagacgcctgaggaac

SEQ ID NO: 2590097 - DNA, 18 bp, Homo sapiens
agggtcccaagctgggcc

SEQ ID NO: 2590098 - DNA, 18 bp, Homo sapiens
agggtccccacctgggac

SEQ ID NO: 2590099 - DNA, 16 bp, Homo sapiens
agggtccctggtggca

SEQ ID NO: 2590100 - DNA, 17 bp, Homo sapiens
agggtccctggtggcag

SEQ ID NO: 2590101 - DNA, 15 bp, Homo sapiens
agggtcctccacaat

SEQ ID NO: 2590102 - DNA, 16 bp, Homo sapiens
agggtcctggctcctg

SEQ ID NO: 2590103 - DNA, 21 bp, Homo sapiens
agggtcctggctcctgagggg

SEQ ID NO: 2590104 - DNA, 22 bp, Homo sapiens
agggtctcactatgttgcccag

SEQ ID NO: 2590105 - DNA, 15 bp, Homo sapiens
agggtctcactctgt

SEQ ID NO: 2590106 - DNA, 16 bp, Homo sapiens
agggtctctagtgctg

SEQ ID NO: 2590107 - DNA, 21 bp, Homo sapiens
agggtctctagtgctgtgaaa

SEQ ID NO: 2590108 - DNA, 14 bp, Homo sapiens
agggtctctgctgc

SEQ ID NO: 2590109 - DNA, 17 bp, Homo sapiens
agggtcttccctacctc

SEQ ID NO: 2590110 - DNA, 14 bp, Homo sapiens
agggtcttgggaaa

SEQ ID NO: 2590111 - DNA, 15 bp, Homo sapiens
agggtcttgggaaat

SEQ ID NO: 2590112 - DNA, 16 bp, Homo sapiens
agggtcttgggaaata

SEQ ID NO: 2590113 - DNA, 18 bp, Homo sapiens
agggtcttttcatctggg

SEQ ID NO: 2590114 - DNA, 14 bp, Homo sapiens
agggtgagagctgc

SEQ ID NO: 2590115 - DNA, 13 bp, Homo sapiens
agggtgaggatgg

SEQ ID NO: 2590116 - DNA, 15 bp, Homo sapiens
agggtgatgccaggt

SEQ ID NO: 2590117 - DNA, 19 bp, Homo sapiens
agggtgatgccaggttcta

SEQ ID NO: 2590118 - DNA, 21 bp, Homo sapiens
agggtgatgggaaagcattgt

SEQ ID NO: 2590119 - DNA, 23 bp, Homo sapiens
agggtgctacgtacatgtgaggc

SEQ ID NO: 2590120 - DNA, 21 bp, Homo sapiens
agggtgctgcttccctctgcc

SEQ ID NO: 2590121 - DNA, 12 bp, Homo sapiens
agggtggagact

SEQ ID NO: 2590122 - DNA, 21 bp, Homo sapiens
agggtggagactaagccctgt

SEQ ID NO: 2590123 - DNA, 14 bp, Homo sapiens
agggtggcaggtga

SEQ ID NO: 2590124 - DNA, 21 bp, Homo sapiens
agggtggctgggtccagggga

SEQ ID NO: 2590125 - DNA, 19 bp, Homo sapiens
agggtgggagagcccagcc

SEQ ID NO: 2590126 - DNA, 18 bp, Homo sapiens
agggtggtgacctctgcc

SEQ ID NO: 2590127 - DNA, 19 bp, Homo sapiens
agggtggtgacctctgcct

SEQ ID NO: 2590128 - DNA, 14 bp, Homo sapiens
agggtgtttatgta

SEQ ID NO: 2590129 - DNA, 15 bp, Homo sapiens
agggttatattttac

SEQ ID NO: 2590130 - DNA, 22 bp, Homo sapiens
agggttcaaaatgtctgtagct

SEQ ID NO: 2590131 - DNA, 17 bp, Homo sapiens
agggttcccccagccct

SEQ ID NO: 2590132 - DNA, 18 bp, Homo sapiens
agggttcccccagccctg

SEQ ID NO: 2590133 - DNA, 19 bp, Homo sapiens
agggttcccccagccctgt

SEQ ID NO: 2590134 - DNA, 18 bp, Homo sapiens
agggttggcccctgcccg

SEQ ID NO: 2590135 - DNA, 15 bp, Homo sapiens
agggttgggcccaga

SEQ ID NO: 2590136 - DNA, 20 bp, Homo sapiens
agggttggtcctcttgcctc

SEQ ID NO: 2590137 - DNA, 18 bp, Homo sapiens
agggtttctgagctgctc

SEQ ID NO: 2590138 - DNA, 19 bp, Homo sapiens
aggtaaaattgaaaggcat

SEQ ID NO: 2590139 - DNA, 14 bp, Homo sapiens
aggtaaactcctgt

SEQ ID NO: 2590140 - DNA, 15 bp, Homo sapiens
aggtaacagaacagc

SEQ ID NO: 2590141 - DNA, 21 bp, Homo sapiens
aggtaacagaacagcttcagg

SEQ ID NO: 2590142 - DNA, 17 bp, Homo sapiens
aggtaatgagggactgg

SEQ ID NO: 2590143 - DNA, 17 bp, Homo sapiens
aggtagaaatatctgaa

SEQ ID NO: 2590144 - DNA, 23 bp, Homo sapiens
aggtagaaatatctgaaaatgta

SEQ ID NO: 2590145 - DNA, 17 bp, Homo sapiens
aggtagagtttgaagga

SEQ ID NO: 2590146 - DNA, 21 bp, Homo sapiens
aggtagagtttgaaggaggtg

SEQ ID NO: 2590147 - DNA, 17 bp, Homo sapiens
aggtatcagttgcaata

SEQ ID NO: 2590148 - DNA, 14 bp, Homo sapiens
aggtatctccagga

SEQ ID NO: 2590149 - DNA, 15 bp, Homo sapiens
aggtatctccaggat

SEQ ID NO: 2590150 - DNA, 13 bp, Homo sapiens
aggtatgaataag

SEQ ID NO: 2590151 - DNA, 16 bp, Homo sapiens
aggtatgaggtctagg

SEQ ID NO: 2590152 - DNA, 17 bp, Homo sapiens
aggtatgcaatcaaatc

SEQ ID NO: 2590153 - DNA, 17 bp, Homo sapiens
aggtattcgtgcagcat

SEQ ID NO: 2590154 - DNA, 14 bp, Homo sapiens
aggtatttcaaaac

SEQ ID NO: 2590155 - DNA, 17 bp, Homo sapiens
aggtcaagtaagaagac

SEQ ID NO: 2590156 - DNA, 18 bp, Homo sapiens
aggtcaagtaagaagaca

SEQ ID NO: 2590157 - DNA, 22 bp, Homo sapiens
aggtcaagtaagaagacatgaa

SEQ ID NO: 2590158 - DNA, 18 bp, Homo sapiens
aggtcaatacagtacagg

SEQ ID NO: 2590159 - DNA, 22 bp, Homo sapiens
aggtcaatacagtacaggcagc

SEQ ID NO: 2590160 - DNA, 21 bp, Homo sapiens
aggtcaatgccagagacggaa

SEQ ID NO: 2590161 - DNA, 23 bp, Homo sapiens
aggtcacacgaggggccccgtgt

SEQ ID NO: 2590162 - DNA, 15 bp, Homo sapiens
aggtcacattcagga

SEQ ID NO: 2590163 - DNA, 18 bp, Homo sapiens
aggtcacattcaggaaga

SEQ ID NO: 2590164 - DNA, 19 bp, Homo sapiens
aggtcacattcaggaagat

SEQ ID NO: 2590165 - DNA, 18 bp, Homo sapiens
aggtcactcctggggcct

SEQ ID NO: 2590166 - DNA, 17 bp, Homo sapiens
aggtcactggctctcca

SEQ ID NO: 2590167 - DNA, 19 bp, Homo sapiens
aggtcactggctctccaag

SEQ ID NO: 2590168 - DNA, 12 bp, Homo sapiens
aggtcagagcct

SEQ ID NO: 2590169 - DNA, 15 bp, Homo sapiens
aggtcagagcctgca

SEQ ID NO: 2590170 - DNA, 19 bp, Homo sapiens
aggtcagcgtgcttagcct

SEQ ID NO: 2590171 - DNA, 19 bp, Homo sapiens
aggtcaggagttagaggcc

SEQ ID NO: 2590172 - DNA, 21 bp, Homo sapiens
aggtcatacaatccattctta

SEQ ID NO: 2590173 - DNA, 14 bp, Homo sapiens
aggtccaagatacc

SEQ ID NO: 2590174 - DNA, 21 bp, Homo sapiens
aggtccacggtctgttcttga

SEQ ID NO: 2590175 - DNA, 20 bp, Homo sapiens
aggtccagccctggctgaag

SEQ ID NO: 2590176 - DNA, 12 bp, Homo sapiens
aggtcccaggca

SEQ ID NO: 2590177 - DNA, 13 bp, Homo sapiens
aggtcccaggcag

SEQ ID NO: 2590178 - DNA, 14 bp, Homo sapiens
aggtcccttgtttc

SEQ ID NO: 2590179 - DNA, 15 bp, Homo sapiens
aggtcctcagagaat

SEQ ID NO: 2590180 - DNA, 16 bp, Homo sapiens
aggtccttctgctgga

SEQ ID NO: 2590181 - DNA, 12 bp, Homo sapiens
aggtccttgccc

SEQ ID NO: 2590182 - DNA, 17 bp, Homo sapiens
aggtccttgccctttgt

SEQ ID NO: 2590183 - DNA, 17 bp, Homo sapiens
aggtcggaggcttggga

SEQ ID NO: 2590184 - DNA, 22 bp, Homo sapiens
aggtctcaacccttttgtctgc

SEQ ID NO: 2590185 - DNA, 11 bp, Homo sapiens
aggtctcctct

SEQ ID NO: 2590186 - DNA, 17 bp, Homo sapiens
aggtctcctcttaaaaa

SEQ ID NO: 2590187 - DNA, 21 bp, Homo sapiens
aggtctcggactaagcctacc

SEQ ID NO: 2590188 - DNA, 19 bp, Homo sapiens
aggtctctgccggctcttt

SEQ ID NO: 2590189 - DNA, 15 bp, Homo sapiens
aggtctcttcccctc

SEQ ID NO: 2590190 - DNA, 16 bp, Homo sapiens
aggtctcttcccctct

SEQ ID NO: 2590191 - DNA, 18 bp, Homo sapiens
aggtctgttctttccaaa

SEQ ID NO: 2590192 - DNA, 16 bp, Homo sapiens
aggtcttcagccatca

SEQ ID NO: 2590193 - DNA, 21 bp, Homo sapiens
aggtcttgaactcctggcctc

SEQ ID NO: 2590194 - DNA, 22 bp, Homo sapiens
aggtcttggagctgagcctctc

SEQ ID NO: 2590195 - DNA, 16 bp, Homo sapiens
aggtcttttgacatgt

SEQ ID NO: 2590196 - DNA, 21 bp, Homo sapiens
aggtgaaagggagctatcagg

SEQ ID NO: 2590197 - DNA, 13 bp, Homo sapiens
aggtgacagagtg

SEQ ID NO: 2590198 - DNA, 15 bp, Homo sapiens
aggtgacagagtgag

SEQ ID NO: 2590199 - DNA, 22 bp, Homo sapiens
aggtgacagagtgagactctgt

SEQ ID NO: 2590200 - DNA, 15 bp, Homo sapiens
aggtgacatgtgaaa

SEQ ID NO: 2590201 - DNA, 13 bp, Homo sapiens
aggtgaccccagg

SEQ ID NO: 2590202 - DNA, 16 bp, Homo sapiens
aggtgaccttctggga

SEQ ID NO: 2590203 - DNA, 13 bp, Homo sapiens
aggtgagggaagc

SEQ ID NO: 2590204 - DNA, 13 bp, Homo sapiens
aggtgagggatgt

SEQ ID NO: 2590205 - DNA, 17 bp, Homo sapiens
aggtgcacaagctccaa

SEQ ID NO: 2590206 - DNA, 23 bp, Homo sapiens
aggtgcagttcccccaacctcag

SEQ ID NO: 2590207 - DNA, 23 bp, Homo sapiens
aggtgcatctggggaactagagg

SEQ ID NO: 2590208 - DNA, 19 bp, Homo sapiens
aggtgccagcaactgaata

SEQ ID NO: 2590209 - DNA, 21 bp, Homo sapiens
aggtgccagcaactgaataaa

SEQ ID NO: 2590210 - DNA, 21 bp, Homo sapiens
aggtgcccttggaggccagcc

SEQ ID NO: 2590211 - DNA, 22 bp, Homo sapiens
aggtgcccttggaggccagcca

SEQ ID NO: 2590212 - DNA, 12 bp, Homo sapiens
aggtgcctccag

SEQ ID NO: 2590213 - DNA, 21 bp, Homo sapiens
aggtgccttggagggtcccaa

SEQ ID NO: 2590214 - DNA, 21 bp, Homo sapiens
aggtgctacacccttttccag

SEQ ID NO: 2590215 - DNA, 18 bp, Homo sapiens
aggtgctcacaccccatt

SEQ ID NO: 2590216 - DNA, 15 bp, Homo sapiens
aggtgctcattggct

SEQ ID NO: 2590217 - DNA, 21 bp, Homo sapiens
aggtgctgagcaaagggaaca

SEQ ID NO: 2590218 - DNA, 23 bp, Homo sapiens
aggtgctgttatccatggggaag

SEQ ID NO: 2590219 - DNA, 11 bp, Homo sapiens
aggtggagcaa

SEQ ID NO: 2590220 - DNA, 14 bp, Homo sapiens
aggtggcaaggctg

SEQ ID NO: 2590221 - DNA, 15 bp, Homo sapiens
aggtggcaaggctgt

SEQ ID NO: 2590222 - DNA, 19 bp, Homo sapiens
aggtggcactttttcattt

SEQ ID NO: 2590223 - DNA, 13 bp, Homo sapiens
aggtggcagccct

SEQ ID NO: 2590224 - DNA, 23 bp, Homo sapiens
aggtggcctctccttgtggcctg

SEQ ID NO: 2590225 - DNA, 14 bp, Homo sapiens
aggtggctctccag

SEQ ID NO: 2590226 - DNA, 19 bp, Homo sapiens
aggtggctctccagttagt

SEQ ID NO: 2590227 - DNA, 17 bp, Homo sapiens
aggtgggatcctccagg

SEQ ID NO: 2590228 - DNA, 22 bp, Homo sapiens
aggtgggcaggtggtggcactg

SEQ ID NO: 2590229 - DNA, 14 bp, Homo sapiens
aggtgggccagccc

SEQ ID NO: 2590230 - DNA, 18 bp, Homo sapiens
aggtgggccagcccctcc

SEQ ID NO: 2590231 - DNA, 12 bp, Homo sapiens
aggtgggcccag

SEQ ID NO: 2590232 - DNA, 16 bp, Homo sapiens
aggtgggcccaggacc

SEQ ID NO: 2590233 - DNA, 15 bp, Homo sapiens
aggtgggccttgcta

SEQ ID NO: 2590234 - DNA, 21 bp, Homo sapiens
aggtgggccttgctacctcaa

SEQ ID NO: 2590235 - DNA, 20 bp, Homo sapiens
aggtgggctgagccctggca

SEQ ID NO: 2590236 - DNA, 21 bp, Homo sapiens
agtatcctccaggtttttcaa

SEQ ID NO: 2590237 - DNA, 23 bp, Homo sapiens
agtatcctccaggtttttcaatt

SEQ ID NO: 2590238 - DNA, 16 bp, Homo sapiens
agtatctaacatgtat

SEQ ID NO: 2590239 - DNA, 18 bp, Homo sapiens
agtatctatatatgtgta

SEQ ID NO: 2590240 - DNA, 15 bp, Homo sapiens
agtatctcagggcct

SEQ ID NO: 2590241 - DNA, 17 bp, Homo sapiens
agtatcttttttcaaaa

SEQ ID NO: 2590242 - DNA, 13 bp, Homo sapiens
agtatgaaaataa

SEQ ID NO: 2590243 - DNA, 17 bp, Homo sapiens
agtatgaggcatttgtt

SEQ ID NO: 2590244 - DNA, 20 bp, Homo sapiens
agtatgaggcatttgtttga

SEQ ID NO: 2590245 - DNA, 23 bp, Homo sapiens
agtatgcttgaaaagataaatta

SEQ ID NO: 2590246 - DNA, 14 bp, Homo sapiens
agtatggagctcag

SEQ ID NO: 2590247 - DNA, 15 bp, Homo sapiens
agtatgtaaagtatg

SEQ ID NO: 2590248 - DNA, 21 bp, Homo sapiens
agtatgtaaagtatgtaaaca

SEQ ID NO: 2590249 - DNA, 17 bp, Homo sapiens
agtatgtggaagtgtgg

SEQ ID NO: 2590250 - DNA, 19 bp, Homo sapiens
agtatgttttagcatgtgt

SEQ ID NO: 2590251 - DNA, 13 bp, Homo sapiens
agtattataaatt

SEQ ID NO: 2590252 - DNA, 19 bp, Homo sapiens
agtattataaattatgttt

SEQ ID NO: 2590253 - DNA, 15 bp, Homo sapiens
agtattatacctttt

SEQ ID NO: 2590254 - DNA, 13 bp, Homo sapiens
agtattattttcc

SEQ ID NO: 2590255 - DNA, 15 bp, Homo sapiens
agtattattttccaa

SEQ ID NO: 2590256 - DNA, 12 bp, Homo sapiens
agtattcttctc

SEQ ID NO: 2590257 - DNA, 12 bp, Homo sapiens
agtatttatata

SEQ ID NO: 2590258 - DNA, 13 bp, Homo sapiens
agtatttatatat

SEQ ID NO: 2590259 - DNA, 17 bp, Homo sapiens
agtatttatatatttat

SEQ ID NO: 2590260 - DNA, 20 bp, Homo sapiens
agtatttcaaattggagctt

SEQ ID NO: 2590261 - DNA, 14 bp, Homo sapiens
agtatttgtgggga

SEQ ID NO: 2590262 - DNA, 19 bp, Homo sapiens
agtattttccctgctaggg

SEQ ID NO: 2590263 - DNA, 20 bp, Homo sapiens
agtatttttttatcttggga

SEQ ID NO: 2590264 - DNA, 16 bp, Homo sapiens
agtcaaaactcaaatg

SEQ ID NO: 2590265 - DNA, 13 bp, Homo sapiens
agtcaaaccataa

SEQ ID NO: 2590266 - DNA, 18 bp, Homo sapiens
agtcaaaccataaacttc

SEQ ID NO: 2590267 - DNA, 20 bp, Homo sapiens
agtcaaaccataaacttcat

SEQ ID NO: 2590268 - DNA, 16 bp, Homo sapiens
agtcaacaaactattt

SEQ ID NO: 2590269 - DNA, 19 bp, Homo sapiens
agtcacacgggggcagctg

SEQ ID NO: 2590270 - DNA, 14 bp, Homo sapiens
agtcacatctcttc

SEQ ID NO: 2590271 - DNA, 17 bp, Homo sapiens
agtcactgagacagccc

SEQ ID NO: 2590272 - DNA, 18 bp, Homo sapiens
agtcactgagacagcccg

SEQ ID NO: 2590273 - DNA, 20 bp, Homo sapiens
agtcactgcctctccctggc

SEQ ID NO: 2590274 - DNA, 10 bp, Homo sapiens
agtcactgtc

SEQ ID NO: 2590275 - DNA, 24 bp, Homo sapiens
agtcacttcgtgggatctgcccct

SEQ ID NO: 2590276 - DNA, 20 bp, Homo sapiens
agtcacttgatgtgccattt

SEQ ID NO: 2590277 - DNA, 21 bp, Homo sapiens
agtcacttgatgtgccatttt

SEQ ID NO: 2590278 - DNA, 23 bp, Homo sapiens
agtcagatgcccagagggcccag

SEQ ID NO: 2590279 - DNA, 16 bp, Homo sapiens
agtcagcctctctccc

SEQ ID NO: 2590280 - DNA, 17 bp, Homo sapiens
agtcagcctctctccca

SEQ ID NO: 2590281 - DNA, 22 bp, Homo sapiens
agtcagccttccccctcccagg

SEQ ID NO: 2590282 - DNA, 23 bp, Homo sapiens
agtcagccttccccctcccaggg

SEQ ID NO: 2590283 - DNA, 16 bp, Homo sapiens
agtcagggacccctgc

SEQ ID NO: 2590284 - DNA, 16 bp, Homo sapiens
agtcagtgcaaatgtc

SEQ ID NO: 2590285 - DNA, 16 bp, Homo sapiens
agtcagtgccaggtcc

SEQ ID NO: 2590286 - DNA, 14 bp, Homo sapiens
agtcagtttgcagt

SEQ ID NO: 2590287 - DNA, 15 bp, Homo sapiens
agtcataaaccttaa

SEQ ID NO: 2590288 - DNA, 18 bp, Homo sapiens
agtcataaaccttaagta

SEQ ID NO: 2590289 - DNA, 14 bp, Homo sapiens
agtcatgagctgag

SEQ ID NO: 2590290 - DNA, 16 bp, Homo sapiens
agtcatgagctgagca

SEQ ID NO: 2590291 - DNA, 17 bp, Homo sapiens
agtcatgcaaaggctgg

SEQ ID NO: 2590292 - DNA, 19 bp, Homo sapiens
agtcatgcaaaggctggga

SEQ ID NO: 2590293 - DNA, 13 bp, Homo sapiens
agtcatgcataaa

SEQ ID NO: 2590294 - DNA, 17 bp, Homo sapiens
agtcatgcataaatatg

SEQ ID NO: 2590295 - DNA, 19 bp, Homo sapiens
agtcatgcataaatatgca

SEQ ID NO: 2590296 - DNA, 20 bp, Homo sapiens
agtcatgcataaatatgcag

SEQ ID NO: 2590297 - DNA, 12 bp, Homo sapiens
agtcatggctgt

SEQ ID NO: 2590298 - DNA, 13 bp, Homo sapiens
agtcatgttcctt

SEQ ID NO: 2590299 - DNA, 15 bp, Homo sapiens
agtcattagactcct

SEQ ID NO: 2590300 - DNA, 22 bp, Homo sapiens
agtcattatgagaggcaatgat

SEQ ID NO: 2590301 - DNA, 19 bp, Homo sapiens
agtccaaatgtcctccaga

SEQ ID NO: 2590302 - DNA, 23 bp, Homo sapiens
agtccaaatgtcctccagaagcc

SEQ ID NO: 2590303 - DNA, 21 bp, Homo sapiens
agtccaaggaaaccacagctg

SEQ ID NO: 2590304 - DNA, 17 bp, Homo sapiens
agtccaatgtcttttta

SEQ ID NO: 2590305 - DNA, 16 bp, Homo sapiens
agtccactcccagtgc

SEQ ID NO: 2590306 - DNA, 13 bp, Homo sapiens
agtccagcctgga

SEQ ID NO: 2590307 - DNA, 15 bp, Homo sapiens
agtccagcctggaga

SEQ ID NO: 2590308 - DNA, 19 bp, Homo sapiens
agtccaggccatggaggca

SEQ ID NO: 2590309 - DNA, 13 bp, Homo sapiens
agtccaggcccca

SEQ ID NO: 2590310 - DNA, 23 bp, Homo sapiens
agtccaggccccaaaaccacagc

SEQ ID NO: 2590311 - DNA, 21 bp, Homo sapiens
agtccatatttcaatttccaa

SEQ ID NO: 2590312 - DNA, 20 bp, Homo sapiens
agtcccaaggaaagccccag

SEQ ID NO: 2590313 - DNA, 21 bp, Homo sapiens
agtcccaaggaaagccccagc

SEQ ID NO: 2590314 - DNA, 16 bp, Homo sapiens
agtcccaccttggctg

SEQ ID NO: 2590315 - DNA, 18 bp, Homo sapiens
agtcccaccttggctgca

SEQ ID NO: 2590316 - DNA, 19 bp, Homo sapiens
agtcccaccttggctgcag

SEQ ID NO: 2590317 - DNA, 18 bp, Homo sapiens
agtcccagctactcagga

SEQ ID NO: 2590318 - DNA, 17 bp, Homo sapiens
agtccccaggccccagg

SEQ ID NO: 2590319 - DNA, 16 bp, Homo sapiens
agtcccctcacctcct

SEQ ID NO: 2590320 - DNA, 16 bp, Homo sapiens
agtcccctcccatctg

SEQ ID NO: 2590321 - DNA, 19 bp, Homo sapiens
agtcccctccccggcccta

SEQ ID NO: 2590322 - DNA, 23 bp, Homo sapiens
agtcccctgtttgtttctgaaag

SEQ ID NO: 2590323 - DNA, 12 bp, Homo sapiens
agtccctgccaa

SEQ ID NO: 2590324 - DNA, 20 bp, Homo sapiens
agtcccttcccctccctggc

SEQ ID NO: 2590325 - DNA, 22 bp, Homo sapiens
agtcccttcccctccctggctc

SEQ ID NO: 2590326 - DNA, 23 bp, Homo sapiens
agtccgaaagggacttggaagct

SEQ ID NO: 2590327 - DNA, 16 bp, Homo sapiens
agtcctcactcccagt

SEQ ID NO: 2590328 - DNA, 18 bp, Homo sapiens
agtcctcactcccagtcc

SEQ ID NO: 2590329 - DNA, 22 bp, Homo sapiens
agtcctctggatggcaccagag

SEQ ID NO: 2590330 - DNA, 20 bp, Homo sapiens
agtcctctgggtaggaatca

SEQ ID NO: 2590331 - DNA, 19 bp, Homo sapiens
agtcctcttttctgagagg

SEQ ID NO: 2590332 - DNA, 16 bp, Homo sapiens
agtcctgcctcagcct

SEQ ID NO: 2590333 - DNA, 16 bp, Homo sapiens
agtcctgcctggccag

SEQ ID NO: 2590334 - DNA, 14 bp, Homo sapiens
agtcctggaagcca

SEQ ID NO: 2590335 - DNA, 13 bp, Homo sapiens
agtcctggcctgg

SEQ ID NO: 2590336 - DNA, 17 bp, Homo sapiens
agtccttaaacagggca

SEQ ID NO: 2590337 - DNA, 20 bp, Homo sapiens
agtccttaccagcagagcac

SEQ ID NO: 2590338 - DNA, 16 bp, Homo sapiens
agtccttcacctcact

SEQ ID NO: 2590339 - DNA, 18 bp, Homo sapiens
agtccttgcttggctgct

SEQ ID NO: 2590340 - DNA, 15 bp, Homo sapiens
agtcgatgaactatt

SEQ ID NO: 2590341 - DNA, 19 bp, Homo sapiens
agtcgcatctcagtgcagg

SEQ ID NO: 2590342 - DNA, 20 bp, Homo sapiens
agtcggaacggagaaaggtg

SEQ ID NO: 2590343 - DNA, 18 bp, Homo sapiens
agtcgtcgcacagtctct

SEQ ID NO: 2590344 - DNA, 19 bp, Homo sapiens
agtcgtggagatgtcttcg

SEQ ID NO: 2590345 - DNA, 21 bp, Homo sapiens
agtcgtggagatgtcttcgta

SEQ ID NO: 2590346 - DNA, 14 bp, Homo sapiens
agtcgttgtgaggg

SEQ ID NO: 2590347 - DNA, 17 bp, Homo sapiens
agtctaaatatttcctt

SEQ ID NO: 2590348 - DNA, 18 bp, Homo sapiens
agtctactcttaagccat

SEQ ID NO: 2590349 - DNA, 19 bp, Homo sapiens
agtctactcttaagccatc

SEQ ID NO: 2590350 - DNA, 18 bp, Homo sapiens
agtctatatgaaaaacaa

SEQ ID NO: 2590351 - DNA, 14 bp, Homo sapiens
agtctatccacaga

SEQ ID NO: 2590352 - DNA, 14 bp, Homo sapiens
agtctattagccac

SEQ ID NO: 2590353 - DNA, 20 bp, Homo sapiens
agtctcactgttgcccaggc

SEQ ID NO: 2590354 - DNA, 21 bp, Homo sapiens
agtctcactgttgcccaggct

SEQ ID NO: 2590355 - DNA, 23 bp, Homo sapiens
agtctcactgttgcccaggctgg

SEQ ID NO: 2590356 - DNA, 16 bp, Homo sapiens
agtctcaggaaatcaa

SEQ ID NO: 2590357 - DNA, 20 bp, Homo sapiens
agtctcagtttgtgtgtctt

SEQ ID NO: 2590358 - DNA, 19 bp, Homo sapiens
agtctccagtggttgctgt

SEQ ID NO: 2590359 - DNA, 14 bp, Homo sapiens
agtctcccttctcc

SEQ ID NO: 2590360 - DNA, 17 bp, Homo sapiens
agtctcctttgcactga

SEQ ID NO: 2590361 - DNA, 15 bp, Homo sapiens
agttctagagaagag

SEQ ID NO: 2590362 - DNA, 20 bp, Homo sapiens
agttctagagaagaggctgg

SEQ ID NO: 2590363 - DNA, 17 bp, Homo sapiens
agttctagtctctctgg

SEQ ID NO: 2590364 - DNA, 19 bp, Homo sapiens
agttctagtctctctgggg

SEQ ID NO: 2590365 - DNA, 15 bp, Homo sapiens
agttctagttgcttg

SEQ ID NO: 2590366 - DNA, 17 bp, Homo sapiens
agttctagtttgcattc

SEQ ID NO: 2590367 - DNA, 12 bp, Homo sapiens
agttctcactgt

SEQ ID NO: 2590368 - DNA, 20 bp, Homo sapiens
agttctcactgttccctctg

SEQ ID NO: 2590369 - DNA, 12 bp, Homo sapiens
agttctcagggc

SEQ ID NO: 2590370 - DNA, 17 bp, Homo sapiens
agttctcagggctcctg

SEQ ID NO: 2590371 - DNA, 18 bp, Homo sapiens
agttctcagggctcctgc

SEQ ID NO: 2590372 - DNA, 17 bp, Homo sapiens
agttctctcgtaactgg

SEQ ID NO: 2590373 - DNA, 12 bp, Homo sapiens
agttctgctcct

SEQ ID NO: 2590374 - DNA, 16 bp, Homo sapiens
agttctgctcctctcc

SEQ ID NO: 2590375 - DNA, 17 bp, Homo sapiens
agttctgctcctctcca

SEQ ID NO: 2590376 - DNA, 19 bp, Homo sapiens
agttctgctcctctccagg

SEQ ID NO: 2590377 - DNA, 20 bp, Homo sapiens
agttctgctcctctccaggc

SEQ ID NO: 2590378 - DNA, 21 bp, Homo sapiens
agttctgctcctctccaggca

SEQ ID NO: 2590379 - DNA, 12 bp, Homo sapiens
agttctgggtgc

SEQ ID NO: 2590380 - DNA, 14 bp, Homo sapiens
agttctgtaaaata

SEQ ID NO: 2590381 - DNA, 15 bp, Homo sapiens
agttcttcgggaaga

SEQ ID NO: 2590382 - DNA, 22 bp, Homo sapiens
agttcttcgggaagagaggagt

SEQ ID NO: 2590383 - DNA, 13 bp, Homo sapiens
agttcttctccaa

SEQ ID NO: 2590384 - DNA, 14 bp, Homo sapiens
agttcttgtgccat

SEQ ID NO: 2590385 - DNA, 18 bp, Homo sapiens
agttgaaaaacagctgag

SEQ ID NO: 2590386 - DNA, 14 bp, Homo sapiens
agttgaaaagactc

SEQ ID NO: 2590387 - DNA, 21 bp, Homo sapiens
agttgaaaagactccaaagaa

SEQ ID NO: 2590388 - DNA, 22 bp, Homo sapiens
agttgaaaagactccaaagaaa

SEQ ID NO: 2590389 - DNA, 16 bp, Homo sapiens
agttgaagctaagatt

SEQ ID NO: 2590390 - DNA, 22 bp, Homo sapiens
agttgacaaaaagctcttacac

SEQ ID NO: 2590391 - DNA, 13 bp, Homo sapiens
agttgacagcagg

SEQ ID NO: 2590392 - DNA, 12 bp, Homo sapiens
agttgagcccca

SEQ ID NO: 2590393 - DNA, 21 bp, Homo sapiens
agttgagccccaagtcctgaa

SEQ ID NO: 2590394 - DNA, 17 bp, Homo sapiens
agttgagtgatagagct

SEQ ID NO: 2590395 - DNA, 14 bp, Homo sapiens
agttgatagcacag

SEQ ID NO: 2590396 - DNA, 15 bp, Homo sapiens
agttgatgttgcatt

SEQ ID NO: 2590397 - DNA, 14 bp, Homo sapiens
agttgcaataatac

SEQ ID NO: 2590398 - DNA, 17 bp, Homo sapiens
agttgcaataatacttc

SEQ ID NO: 2590399 - DNA, 22 bp, Homo sapiens
agttgcaataatacttctcaaa

SEQ ID NO: 2590400 - DNA, 17 bp, Homo sapiens
agttgcaatagaacaga

SEQ ID NO: 2590401 - DNA, 19 bp, Homo sapiens
agttgcaatcgtaatgtac

SEQ ID NO: 2590402 - DNA, 17 bp, Homo sapiens
agttgcagactcagttt

SEQ ID NO: 2590403 - DNA, 18 bp, Homo sapiens
agttgcagactcagtttg

SEQ ID NO: 2590404 - DNA, 22 bp, Homo sapiens
agttgcagactcagtttgtcag

SEQ ID NO: 2590405 - DNA, 20 bp, Homo sapiens
agttgcatggcatcacctcc

SEQ ID NO: 2590406 - DNA, 16 bp, Homo sapiens
agttggccagagagcc

SEQ ID NO: 2590407 - DNA, 13 bp, Homo sapiens
agttggcttctaa

SEQ ID NO: 2590408 - DNA, 23 bp, Homo sapiens
agttgggaacttcagatggacct

SEQ ID NO: 2590409 - DNA, 13 bp, Homo sapiens
agttgggagcact

SEQ ID NO: 2590410 - DNA, 21 bp, Homo sapiens
agttgggtggatgcctggtgg

SEQ ID NO: 2590411 - DNA, 18 bp, Homo sapiens
agttggtcccccttccat

SEQ ID NO: 2590412 - DNA, 13 bp, Homo sapiens
agttggtgacaga

SEQ ID NO: 2590413 - DNA, 18 bp, Homo sapiens
agttgtaccgcaatgtga

SEQ ID NO: 2590414 - DNA, 17 bp, Homo sapiens
agttgtagaatgtattg

SEQ ID NO: 2590415 - DNA, 21 bp, Homo sapiens
agttgtaggcgaatcatttgt

SEQ ID NO: 2590416 - DNA, 20 bp, Homo sapiens
agttgtatcagcacgtgtgg

SEQ ID NO: 2590417 - DNA, 18 bp, Homo sapiens
agttgtgaccttagtgtt

SEQ ID NO: 2590418 - DNA, 15 bp, Homo sapiens
agttgtgccttttat

SEQ ID NO: 2590419 - DNA, 21 bp, Homo sapiens
agttgtgccttttatagctat

SEQ ID NO: 2590420 - DNA, 22 bp, Homo sapiens
agttgtgccttttatagctatt

SEQ ID NO: 2590421 - DNA, 14 bp, Homo sapiens
agttgtgcttgttt

SEQ ID NO: 2590422 - DNA, 20 bp, Homo sapiens
agttgtggagagtgcaacag

SEQ ID NO: 2590423 - DNA, 19 bp, Homo sapiens
agttgtggtgctgacaaag

SEQ ID NO: 2590424 - DNA, 20 bp, Homo sapiens
agttgtggtgctgacaaagc

SEQ ID NO: 2590425 - DNA, 16 bp, Homo sapiens
agttgttaataaaagt

SEQ ID NO: 2590426 - DNA, 23 bp, Homo sapiens
agttgttaataaaagtacatgtt

SEQ ID NO: 2590427 - DNA, 20 bp, Homo sapiens
agttgttacatttttaagtg

SEQ ID NO: 2590428 - DNA, 22 bp, Homo sapiens
agttgttacatttttaagtgct

SEQ ID NO: 2590429 - DNA, 15 bp, Homo sapiens
agttgttgccctggg

SEQ ID NO: 2590430 - DNA, 19 bp, Homo sapiens
agttgtttcattgactatc

SEQ ID NO: 2590431 - DNA, 11 bp, Homo sapiens
agttgtttgat

SEQ ID NO: 2590432 - DNA, 13 bp, Homo sapiens
agttgtttgatgc

SEQ ID NO: 2590433 - DNA, 21 bp, Homo sapiens
agtttaaagctcgaaaacaat

SEQ ID NO: 2590434 - DNA, 23 bp, Homo sapiens
agtttaaccaaaaagaccagact

SEQ ID NO: 2590435 - DNA, 14 bp, Homo sapiens
agtttaattgactt

SEQ ID NO: 2590436 - DNA, 15 bp, Homo sapiens
agtttacaagtgtat

SEQ ID NO: 2590437 - DNA, 16 bp, Homo sapiens
agtttacaagtgtata

SEQ ID NO: 2590438 - DNA, 17 bp, Homo sapiens
agtttatcattcaagtg

SEQ ID NO: 2590439 - DNA, 15 bp, Homo sapiens
agtttattttaagac

SEQ ID NO: 2590440 - DNA, 15 bp, Homo sapiens
agtttcaatgtgatt

SEQ ID NO: 2590441 - DNA, 22 bp, Homo sapiens
agtttcaatgtgattctaatgt

SEQ ID NO: 2590442 - DNA, 17 bp, Homo sapiens
agtttcaattcagtgct

SEQ ID NO: 2590443 - DNA, 14 bp, Homo sapiens
agtttcaggtgaca

SEQ ID NO: 2590444 - DNA, 18 bp, Homo sapiens
agtttcatagctaagaaa

SEQ ID NO: 2590445 - DNA, 15 bp, Homo sapiens
agtttccttggctgg

SEQ ID NO: 2590446 - DNA, 17 bp, Homo sapiens
agtttccttggctggtg

SEQ ID NO: 2590447 - DNA, 16 bp, Homo sapiens
agtttctagctagaaa

SEQ ID NO: 2590448 - DNA, 21 bp, Homo sapiens
agtttctagctagaaatatga

SEQ ID NO: 2590449 - DNA, 15 bp, Homo sapiens
agtttctcagatcct

SEQ ID NO: 2590450 - DNA, 18 bp, Homo sapiens
agtttctcagatccttgt

SEQ ID NO: 2590451 - DNA, 11 bp, Homo sapiens
agtttctcagc

SEQ ID NO: 2590452 - DNA, 13 bp, Homo sapiens
agtttctccaagc

SEQ ID NO: 2590453 - DNA, 17 bp, Homo sapiens
agtttctgtcctgctgg

SEQ ID NO: 2590454 - DNA, 20 bp, Homo sapiens
ataactccttcttgtagtag

SEQ ID NO: 2590455 - DNA, 22 bp, Homo sapiens
ataactctgtggcattattgca

SEQ ID NO: 2590456 - DNA, 12 bp, Homo sapiens
ataactgagaat

SEQ ID NO: 2590457 - DNA, 22 bp, Homo sapiens
ataactgttatttataatcact

SEQ ID NO: 2590458 - DNA, 19 bp, Homo sapiens
ataacttaaaaatgtaaat

SEQ ID NO: 2590459 - DNA, 20 bp, Homo sapiens
ataacttaaaaatgtaaata

SEQ ID NO: 2590460 - DNA, 12 bp, Homo sapiens
ataacttaaaat

SEQ ID NO: 2590461 - DNA, 15 bp, Homo sapiens
ataacttatattgta

SEQ ID NO: 2590462 - DNA, 22 bp, Homo sapiens
ataagaaagtgcgagtcctcca

SEQ ID NO: 2590463 - DNA, 20 bp, Homo sapiens
ataagaagggatggattcca

SEQ ID NO: 2590464 - DNA, 21 bp, Homo sapiens
ataagaagggatggattccaa

SEQ ID NO: 2590465 - DNA, 16 bp, Homo sapiens
ataagaatgctggttt

SEQ ID NO: 2590466 - DNA, 14 bp, Homo sapiens
ataagacataacgt

SEQ ID NO: 2590467 - DNA, 17 bp, Homo sapiens
ataagacataacgtttt

SEQ ID NO: 2590468 - DNA, 22 bp, Homo sapiens
ataagaccaccacctcagagta

SEQ ID NO: 2590469 - DNA, 14 bp, Homo sapiens
ataagagaaagaaa

SEQ ID NO: 2590470 - DNA, 15 bp, Homo sapiens
ataagagaatcaaca

SEQ ID NO: 2590471 - DNA, 19 bp, Homo sapiens
ataagagagtcataaacct

SEQ ID NO: 2590472 - DNA, 20 bp, Homo sapiens
ataagagagtcataaacctt

SEQ ID NO: 2590473 - DNA, 21 bp, Homo sapiens
ataagaggctgataattccag

SEQ ID NO: 2590474 - DNA, 21 bp, Homo sapiens
ataagattcatatttacttct

SEQ ID NO: 2590475 - DNA, 14 bp, Homo sapiens
ataagcaagagaga

SEQ ID NO: 2590476 - DNA, 16 bp, Homo sapiens
ataagcaagagagatg

SEQ ID NO: 2590477 - DNA, 14 bp, Homo sapiens
ataagcactgtgct

SEQ ID NO: 2590478 - DNA, 17 bp, Homo sapiens
ataagcactgtgctaat

SEQ ID NO: 2590479 - DNA, 16 bp, Homo sapiens
ataagcatcaaactct

SEQ ID NO: 2590480 - DNA, 21 bp, Homo sapiens
ataagccagacatcaacagat

SEQ ID NO: 2590481 - DNA, 22 bp, Homo sapiens
ataagccagacatcaacagata

SEQ ID NO: 2590482 - DNA, 13 bp, Homo sapiens
ataagctaaagag

SEQ ID NO: 2590483 - DNA, 21 bp, Homo sapiens
ataagctaacaccagacagac

SEQ ID NO: 2590484 - DNA, 22 bp, Homo sapiens
ataaggatcagaacagcagagg

SEQ ID NO: 2590485 - DNA, 16 bp, Homo sapiens
ataaggccttaatatg

SEQ ID NO: 2590486 - DNA, 23 bp, Homo sapiens
ataaggtttcgtttctgtataca

SEQ ID NO: 2590487 - DNA, 13 bp, Homo sapiens
ataagtaagtttg

SEQ ID NO: 2590488 - DNA, 16 bp, Homo sapiens
ataagtactgtgtaca

SEQ ID NO: 2590489 - DNA, 19 bp, Homo sapiens
ataagtactgtgtacagaa

SEQ ID NO: 2590490 - DNA, 18 bp, Homo sapiens
ataagtatttcaaattgg

SEQ ID NO: 2590491 - DNA, 19 bp, Homo sapiens
ataagtatttcaaattgga

SEQ ID NO: 2590492 - DNA, 16 bp, Homo sapiens
ataagtcatgttcctt

SEQ ID NO: 2590493 - DNA, 21 bp, Homo sapiens
ataagtccttgcaagaatcag

SEQ ID NO: 2590494 - DNA, 24 bp, Homo sapiens
ataagttcaaattcttctgaactc

SEQ ID NO: 2590495 - DNA, 23 bp, Homo sapiens
ataagttctagttgcttgtaaaa

SEQ ID NO: 2590496 - DNA, 20 bp, Homo sapiens
ataagttcttatgccatgtt

SEQ ID NO: 2590497 - DNA, 15 bp, Homo sapiens
ataataaaaggaaaa

SEQ ID NO: 2590498 - DNA, 23 bp, Homo sapiens
ataataaattccctggcctttca

SEQ ID NO: 2590499 - DNA, 13 bp, Homo sapiens
ataataagctaaa

SEQ ID NO: 2590500 - DNA, 15 bp, Homo sapiens
ataataagctaaaga

SEQ ID NO: 2590501 - DNA, 12 bp, Homo sapiens
ataatacaccac

SEQ ID NO: 2590502 - DNA, 21 bp, Homo sapiens
ataatacactaattcctttct

SEQ ID NO: 2590503 - DNA, 22 bp, Homo sapiens
ataatacactaattcctttcta

SEQ ID NO: 2590504 - DNA, 22 bp, Homo sapiens
ataatactatatttatactgta

SEQ ID NO: 2590505 - DNA, 13 bp, Homo sapiens
ataatagaagaac

SEQ ID NO: 2590506 - DNA, 13 bp, Homo sapiens
ataatatattttc

SEQ ID NO: 2590507 - DNA, 20 bp, Homo sapiens
ataatatttttaattaaata

SEQ ID NO: 2590508 - DNA, 16 bp, Homo sapiens
ataatcacgctttcct

SEQ ID NO: 2590509 - DNA, 21 bp, Homo sapiens
ataatcagcaagaatttgatc

SEQ ID NO: 2590510 - DNA, 13 bp, Homo sapiens
ataatcagcctct

SEQ ID NO: 2590511 - DNA, 15 bp, Homo sapiens
ataatcagcctctta

SEQ ID NO: 2590512 - DNA, 17 bp, Homo sapiens
ataatcccagcactttg

SEQ ID NO: 2590513 - DNA, 20 bp, Homo sapiens
ataatctggactcctctgtc

SEQ ID NO: 2590514 - DNA, 17 bp, Homo sapiens
ataatctgtacaatgaa

SEQ ID NO: 2590515 - DNA, 14 bp, Homo sapiens
ataatgaagcttta

SEQ ID NO: 2590516 - DNA, 17 bp, Homo sapiens
ataatgccggtgagaat

SEQ ID NO: 2590517 - DNA, 21 bp, Homo sapiens
ataatgcgtgcataccacttt

SEQ ID NO: 2590518 - DNA, 17 bp, Homo sapiens
ataatggtaccagataa

SEQ ID NO: 2590519 - DNA, 14 bp, Homo sapiens
ataatggttgactg

SEQ ID NO: 2590520 - DNA, 19 bp, Homo sapiens
ataatgtaaacaatatcag

SEQ ID NO: 2590521 - DNA, 18 bp, Homo sapiens
ataatgtgaaactggatt

SEQ ID NO: 2590522 - DNA, 12 bp, Homo sapiens
ataatgtgaagt

SEQ ID NO: 2590523 - DNA, 16 bp, Homo sapiens
ataatgtgaagtgtta

SEQ ID NO: 2590524 - DNA, 12 bp, Homo sapiens
ataatgttaaat

SEQ ID NO: 2590525 - DNA, 22 bp, Homo sapiens
ataatgttaaatttgtaagttt

SEQ ID NO: 2590526 - DNA, 23 bp, Homo sapiens
ataatgttaaatttgtaagtttc

SEQ ID NO: 2590527 - DNA, 12 bp, Homo sapiens
ataatgttaaca

SEQ ID NO: 2590528 - DNA, 19 bp, Homo sapiens
ataatgtttaatattgaga

SEQ ID NO: 2590529 - DNA, 17 bp, Homo sapiens
ataattatccagagttt

SEQ ID NO: 2590530 - DNA, 16 bp, Homo sapiens
ataattatcggaagca

SEQ ID NO: 2590531 - DNA, 20 bp, Homo sapiens
ataattatcggaagcagtgc

SEQ ID NO: 2590532 - DNA, 22 bp, Homo sapiens
ataattatcggaagcagtgcct

SEQ ID NO: 2590533 - DNA, 12 bp, Homo sapiens
ataattccctat

SEQ ID NO: 2590534 - DNA, 19 bp, Homo sapiens
ataattccctatcttttag

SEQ ID NO: 2590535 - DNA, 12 bp, Homo sapiens
ataattctaaag

SEQ ID NO: 2590536 - DNA, 12 bp, Homo sapiens
ataattctgtaa

SEQ ID NO: 2590537 - DNA, 14 bp, Homo sapiens
ataattctgtaaat

SEQ ID NO: 2590538 - DNA, 22 bp, Homo sapiens
ataattctgtacatagcctata

SEQ ID NO: 2590539 - DNA, 23 bp, Homo sapiens
ataattctgtacatagcctatat

SEQ ID NO: 2590540 - DNA, 22 bp, Homo sapiens
ataattgacaggattattggaa

SEQ ID NO: 2590541 - DNA, 13 bp, Homo sapiens
ataattgcattca

SEQ ID NO: 2590542 - DNA, 14 bp, Homo sapiens
ataattgcattcat

SEQ ID NO: 2590543 - DNA, 17 bp, Homo sapiens
ataattgtatcagaggc

SEQ ID NO: 2590544 - DNA, 23 bp, Homo sapiens
ataattgtatcagaggcctataa

SEQ ID NO: 2590545 - DNA, 13 bp, Homo sapiens
ataattgtatcgt

SEQ ID NO: 2590546 - DNA, 15 bp, Homo sapiens
ataatttaatgcatg

SEQ ID NO: 2590547 - DNA, 22 bp, Homo sapiens
ataatttgtacatatgtaaaat

SEQ ID NO: 2590548 - DNA, 15 bp, Homo sapiens
ataattttaaacaaa

SEQ ID NO: 2590549 - DNA, 17 bp, Homo sapiens
ataattttttattcaag

SEQ ID NO: 2590550 - DNA, 22 bp, Homo sapiens
ataatttttttcaatatttatt

SEQ ID NO: 2590551 - DNA, 12 bp, Homo sapiens
atacaacagtgc

SEQ ID NO: 2590552 - DNA, 15 bp, Homo sapiens
atacaacagtgctaa

SEQ ID NO: 2590553 - DNA, 16 bp, Homo sapiens
atacaacagtgctaaa

SEQ ID NO: 2590554 - DNA, 18 bp, Homo sapiens
atacaacagtgctaaaaa

SEQ ID NO: 2590555 - DNA, 20 bp, Homo sapiens
atacaacagtgctaaaaatg

SEQ ID NO: 2590556 - DNA, 14 bp, Homo sapiens
atacaacctgcttg

SEQ ID NO: 2590557 - DNA, 22 bp, Homo sapiens
atacaagccattctaaggaaat

SEQ ID NO: 2590558 - DNA, 21 bp, Homo sapiens
atacaatgtatttatttaaaa

SEQ ID NO: 2590559 - DNA, 13 bp, Homo sapiens
atacacacacaca

SEQ ID NO: 2590560 - DNA, 18 bp, Homo sapiens
atacacacacacacacag

SEQ ID NO: 2590561 - DNA, 22 bp, Homo sapiens
atacacacacacacacagccac

SEQ ID NO: 2590562 - DNA, 17 bp, Homo sapiens
atacacactcaaatcaa

SEQ ID NO: 2590563 - DNA, 20 bp, Homo sapiens
atacaccacctcactcctgt

SEQ ID NO: 2590564 - DNA, 21 bp, Homo sapiens
atacaccacctcactcctgtt

SEQ ID NO: 2590565 - DNA, 21 bp, Homo sapiens
atacaccactacattctgtta

SEQ ID NO: 2590566 - DNA, 19 bp, Homo sapiens
atacaccagagataatatg

SEQ ID NO: 2590567 - DNA, 22 bp, Homo sapiens
atacactatttgtgagcaaagg

SEQ ID NO: 2590568 - DNA, 23 bp, Homo sapiens
atacagaaagatggatgtgcttt

SEQ ID NO: 2590569 - DNA, 14 bp, Homo sapiens
atacagacactaag

SEQ ID NO: 2590570 - DNA, 18 bp, Homo sapiens
atacagacactaagttat

SEQ ID NO: 2590571 - DNA, 16 bp, Homo sapiens
atacagcaacaattta

SEQ ID NO: 2590572 - DNA, 21 bp, Homo sapiens
atacaggatttgaactcagat

SEQ ID NO: 2590573 - DNA, 21 bp, Homo sapiens
atacagggcatgcattttgca

SEQ ID NO: 2590574 - DNA, 17 bp, Homo sapiens
atacagtaactttatgt

SEQ ID NO: 2590575 - DNA, 19 bp, Homo sapiens
atacagtaactttatgtgt

SEQ ID NO: 2590576 - DNA, 20 bp, Homo sapiens
atacagtaactttatgtgta

SEQ ID NO: 2590577 - DNA, 15 bp, Homo sapiens
atacagtacaggcag

SEQ ID NO: 2590578 - DNA, 19 bp, Homo sapiens
atacagtacaggcagcaca

SEQ ID NO: 2590579 - DNA, 17 bp, Homo sapiens
atacagtccctaaagaa

SEQ ID NO: 2590580 - DNA, 18 bp, Homo sapiens
atacagtccctaaagaaa

SEQ ID NO: 2590581 - DNA, 22 bp, Homo sapiens
atacagtttgtcacatgaaaca

SEQ ID NO: 2590582 - DNA, 14 bp, Homo sapiens
atacatggataaca

SEQ ID NO: 2590583 - DNA, 14 bp, Homo sapiens
atacatggttgtga

SEQ ID NO: 2590584 - DNA, 21 bp, Homo sapiens
atacatttataatgtttgcta

SEQ ID NO: 2590585 - DNA, 17 bp, Homo sapiens
atacatttatgaattaa

SEQ ID NO: 2590586 - DNA, 22 bp, Homo sapiens
atacatttctcctttgataaaa

SEQ ID NO: 2590587 - DNA, 16 bp, Homo sapiens
ataccacccaatgctg

SEQ ID NO: 2590588 - DNA, 19 bp, Homo sapiens
ataccagccagtaaatggg

SEQ ID NO: 2590589 - DNA, 22 bp, Homo sapiens
ataccattttttaaggaaacaa

SEQ ID NO: 2590590 - DNA, 18 bp, Homo sapiens
atacccatagcttccatg

SEQ ID NO: 2590591 - DNA, 19 bp, Homo sapiens
ataccctggccgccccctg

SEQ ID NO: 2590592 - DNA, 15 bp, Homo sapiens
atacctacatgtatt

SEQ ID NO: 2590593 - DNA, 18 bp, Homo sapiens
atacctcaacctatggta

SEQ ID NO: 2590594 - DNA, 15 bp, Homo sapiens
atacctcaccctgct

SEQ ID NO: 2590595 - DNA, 12 bp, Homo sapiens
atacctctgtgt

SEQ ID NO: 2590596 - DNA, 13 bp, Homo sapiens
atacctctgtgtg

SEQ ID NO: 2590597 - DNA, 15 bp, Homo sapiens
atacctcttagctga

SEQ ID NO: 2590598 - DNA, 12 bp, Homo sapiens
agtcttcctgac

SEQ ID NO: 2590599 - DNA, 19 bp, Homo sapiens
agtcttcctgacactttaa

SEQ ID NO: 2590600 - DNA, 13 bp, Homo sapiens
agtcttctcatag

SEQ ID NO: 2590601 - DNA, 20 bp, Homo sapiens
agtcttgtgcttttcctatt

SEQ ID NO: 2590602 - DNA, 17 bp, Homo sapiens
agtgaaaaaggaggaag

SEQ ID NO: 2590603 - DNA, 12 bp, Homo sapiens
agtgaaaacaag

SEQ ID NO: 2590604 - DNA, 13 bp, Homo sapiens
agtgaaactgctt

SEQ ID NO: 2590605 - DNA, 21 bp, Homo sapiens
agtgaaactgcttgtttccta

SEQ ID NO: 2590606 - DNA, 22 bp, Homo sapiens
agtgaaagaggcagcttgaaac

SEQ ID NO: 2590607 - DNA, 15 bp, Homo sapiens
agtgaaccaaagaga

SEQ ID NO: 2590608 - DNA, 22 bp, Homo sapiens
agtgaaccaaagagactggagc

SEQ ID NO: 2590609 - DNA, 22 bp, Homo sapiens
agtgaagaaaagtgaatgctca

SEQ ID NO: 2590610 - DNA, 13 bp, Homo sapiens
agtgaagaggggc

SEQ ID NO: 2590611 - DNA, 19 bp, Homo sapiens
agtgaagaggggcagccct

SEQ ID NO: 2590612 - DNA, 21 bp, Homo sapiens
agtgaaggcttctctctgtgg

SEQ ID NO: 2590613 - DNA, 23 bp, Homo sapiens
agtgaatctaaaagcttttgctt

SEQ ID NO: 2590614 - DNA, 16 bp, Homo sapiens
agtgaatgattcagtg

SEQ ID NO: 2590615 - DNA, 14 bp, Homo sapiens
agtgaatttgaatg

SEQ ID NO: 2590616 - DNA, 20 bp, Homo sapiens
agtgaatttgaatgaaaaat

SEQ ID NO: 2590617 - DNA, 15 bp, Homo sapiens
agtgacaaggcccca

SEQ ID NO: 2590618 - DNA, 21 bp, Homo sapiens
agtgacaaggccccagagact

SEQ ID NO: 2590619 - DNA, 20 bp, Homo sapiens
agtgacacttcagagagctg

SEQ ID NO: 2590620 - DNA, 22 bp, Homo sapiens
agtgacacttcagagagctggt

SEQ ID NO: 2590621 - DNA, 23 bp, Homo sapiens
agtgacacttcagagagctggta

SEQ ID NO: 2590622 - DNA, 20 bp, Homo sapiens
agtgacagggaagctacagg

SEQ ID NO: 2590623 - DNA, 22 bp, Homo sapiens
agtgacagggaagctacaggtt

SEQ ID NO: 2590624 - DNA, 23 bp, Homo sapiens
agtgacccggaggccacatgagt

SEQ ID NO: 2590625 - DNA, 18 bp, Homo sapiens
agtgacctgaggaagcgt

SEQ ID NO: 2590626 - DNA, 13 bp, Homo sapiens
agtgactccagga

SEQ ID NO: 2590627 - DNA, 14 bp, Homo sapiens
agtgactcgagggt

SEQ ID NO: 2590628 - DNA, 20 bp, Homo sapiens
agtgactgttcaagagcaca

SEQ ID NO: 2590629 - DNA, 15 bp, Homo sapiens
agtgacttgcccagt

SEQ ID NO: 2590630 - DNA, 20 bp, Homo sapiens
agtgagaaaaagctcctgtc

SEQ ID NO: 2590631 - DNA, 22 bp, Homo sapiens
agtgagaaaaagctcctgtcct

SEQ ID NO: 2590632 - DNA, 14 bp, Homo sapiens
agtgagacagctct

SEQ ID NO: 2590633 - DNA, 21 bp, Homo sapiens
agtgagacagtccagcctgga

SEQ ID NO: 2590634 - DNA, 21 bp, Homo sapiens
agtgagacccagccctcatcc

SEQ ID NO: 2590635 - DNA, 16 bp, Homo sapiens
agtgagactctgtctc

SEQ ID NO: 2590636 - DNA, 22 bp, Homo sapiens
agtgagagagatgggagctcct

SEQ ID NO: 2590637 - DNA, 23 bp, Homo sapiens
agtgagagcgtgctccagcctgg

SEQ ID NO: 2590638 - DNA, 14 bp, Homo sapiens
agtgagagctgggt

SEQ ID NO: 2590639 - DNA, 12 bp, Homo sapiens
agtgagatgcat

SEQ ID NO: 2590640 - DNA, 11 bp, Homo sapiens
agtgagcctga

SEQ ID NO: 2590641 - DNA, 16 bp, Homo sapiens
agtgagctctatgggc

SEQ ID NO: 2590642 - DNA, 12 bp, Homo sapiens
agtgagctggtt

SEQ ID NO: 2590643 - DNA, 22 bp, Homo sapiens
agtgaggcattgcacagggaga

SEQ ID NO: 2590644 - DNA, 16 bp, Homo sapiens
agtgaggctctgccct

SEQ ID NO: 2590645 - DNA, 20 bp, Homo sapiens
agtgaggctctgcccttggt

SEQ ID NO: 2590646 - DNA, 20 bp, Homo sapiens
agtgagggcttgtcattacc

SEQ ID NO: 2590647 - DNA, 13 bp, Homo sapiens
agtgagggtcaga

SEQ ID NO: 2590648 - DNA, 16 bp, Homo sapiens
agtgagggtcagagag

SEQ ID NO: 2590649 - DNA, 22 bp, Homo sapiens
agtgagggtttctgagctgctc

SEQ ID NO: 2590650 - DNA, 15 bp, Homo sapiens
agtgaggtgcccagc

SEQ ID NO: 2590651 - DNA, 16 bp, Homo sapiens
agtgagtgtggctccc

SEQ ID NO: 2590652 - DNA, 19 bp, Homo sapiens
agtgagtgtggctcccctc

SEQ ID NO: 2590653 - DNA, 21 bp, Homo sapiens
agtgagtgtggctcccctcta

SEQ ID NO: 2590654 - DNA, 21 bp, Homo sapiens
agtgagttgatagcacagacc

SEQ ID NO: 2590655 - DNA, 19 bp, Homo sapiens
agtgatatggcagaagaca

SEQ ID NO: 2590656 - DNA, 13 bp, Homo sapiens
agtgatcctccca

SEQ ID NO: 2590657 - DNA, 15 bp, Homo sapiens
agtgattctcctgcc

SEQ ID NO: 2590658 - DNA, 17 bp, Homo sapiens
agtgattctcctgcctc

SEQ ID NO: 2590659 - DNA, 24 bp, Homo sapiens
agtgattctcctgcctcagcctcc

SEQ ID NO: 2590660 - DNA, 17 bp, Homo sapiens
agtgattgggacagagg

SEQ ID NO: 2590661 - DNA, 15 bp, Homo sapiens
agtgattgttggcac

SEQ ID NO: 2590662 - DNA, 15 bp, Homo sapiens
agtgatttctagaaa

SEQ ID NO: 2590663 - DNA, 21 bp, Homo sapiens
agtgcaaagatttgctttaat

SEQ ID NO: 2590664 - DNA, 17 bp, Homo sapiens
agtgcaacactgaagct

SEQ ID NO: 2590665 - DNA, 15 bp, Homo sapiens
agtgcaacagtagca

SEQ ID NO: 2590666 - DNA, 16 bp, Homo sapiens
agtgcaatgacacagt

SEQ ID NO: 2590667 - DNA, 22 bp, Homo sapiens
agtgcaatggtataaatttcaa

SEQ ID NO: 2590668 - DNA, 21 bp, Homo sapiens
agtgcagcccgtgtggcccct

SEQ ID NO: 2590669 - DNA, 11 bp, Homo sapiens
agtgcaggctg

SEQ ID NO: 2590670 - DNA, 22 bp, Homo sapiens
agtgcagtcctgatcagagccg

SEQ ID NO: 2590671 - DNA, 23 bp, Homo sapiens
agtgcagtcctgatcagagccgt

SEQ ID NO: 2590672 - DNA, 16 bp, Homo sapiens
agtgccaacaatccta

SEQ ID NO: 2590673 - DNA, 19 bp, Homo sapiens
agtgccactcattcctgta

SEQ ID NO: 2590674 - DNA, 15 bp, Homo sapiens
agtgccagaggtggg

SEQ ID NO: 2590675 - DNA, 19 bp, Homo sapiens
agtgccagaggtgggcagg

SEQ ID NO: 2590676 - DNA, 13 bp, Homo sapiens
agtgccaggactc

SEQ ID NO: 2590677 - DNA, 14 bp, Homo sapiens
agtgcccaactgtt

SEQ ID NO: 2590678 - DNA, 23 bp, Homo sapiens
agtgcccagaactggactcagga

SEQ ID NO: 2590679 - DNA, 11 bp, Homo sapiens
agtgcccctgc

SEQ ID NO: 2590680 - DNA, 12 bp, Homo sapiens
agtgcccctgct

SEQ ID NO: 2590681 - DNA, 14 bp, Homo sapiens
agtgcccctgctgc

SEQ ID NO: 2590682 - DNA, 19 bp, Homo sapiens
agtgcccctgctgcctccc

SEQ ID NO: 2590683 - DNA, 21 bp, Homo sapiens
agtgcccctgctgcctcccca

SEQ ID NO: 2590684 - DNA, 16 bp, Homo sapiens
agtgccctccacagcc

SEQ ID NO: 2590685 - DNA, 17 bp, Homo sapiens
agtgccctccacagccg

SEQ ID NO: 2590686 - DNA, 18 bp, Homo sapiens
agtgccttcaataaatgg

SEQ ID NO: 2590687 - DNA, 21 bp, Homo sapiens
agtgccttggggaatttcctc

SEQ ID NO: 2590688 - DNA, 17 bp, Homo sapiens
agtgcgattctggataa

SEQ ID NO: 2590689 - DNA, 16 bp, Homo sapiens
agtgctaaaaatggga

SEQ ID NO: 2590690 - DNA, 18 bp, Homo sapiens
agtgctcgctttctatgt

SEQ ID NO: 2590691 - DNA, 19 bp, Homo sapiens
agtgctgcatttaaaagat

SEQ ID NO: 2590692 - DNA, 20 bp, Homo sapiens
agtgctgggattacaagcgt

SEQ ID NO: 2590693 - DNA, 13 bp, Homo sapiens
agtgctgtgaaaa

SEQ ID NO: 2590694 - DNA, 16 bp, Homo sapiens
agtgcttaaaaatcat

SEQ ID NO: 2590695 - DNA, 17 bp, Homo sapiens
agtgcttaaaaatcatt

SEQ ID NO: 2590696 - DNA, 19 bp, Homo sapiens
agtgcttaaaaatcattga

SEQ ID NO: 2590697 - DNA, 19 bp, Homo sapiens
agtgcttcagcctgaggct

SEQ ID NO: 2590698 - DNA, 14 bp, Homo sapiens
agtgcttctctaca

SEQ ID NO: 2590699 - DNA, 22 bp, Homo sapiens
agtgctttccttttttaaaaat

SEQ ID NO: 2590700 - DNA, 11 bp, Homo sapiens
agtggaaaaat

SEQ ID NO: 2590701 - DNA, 17 bp, Homo sapiens
agtggaagaagcagatg

SEQ ID NO: 2590702 - DNA, 19 bp, Homo sapiens
agtggaatagtatcctcca

SEQ ID NO: 2590703 - DNA, 22 bp, Homo sapiens
agtggaatagtatcctccaggt

SEQ ID NO: 2590704 - DNA, 22 bp, Homo sapiens
agtggaatgcttcctagaagtt

SEQ ID NO: 2590705 - DNA, 13 bp, Homo sapiens
agtggacaggagt

SEQ ID NO: 2590706 - DNA, 15 bp, Homo sapiens
agtggactggcccct

SEQ ID NO: 2590707 - DNA, 16 bp, Homo sapiens
agtggactggcccctg

SEQ ID NO: 2590708 - DNA, 17 bp, Homo sapiens
agtggactggcccctgg

SEQ ID NO: 2590709 - DNA, 19 bp, Homo sapiens
agtggactttccaccccct

SEQ ID NO: 2590710 - DNA, 14 bp, Homo sapiens
agtggatctccaag

SEQ ID NO: 2590711 - DNA, 16 bp, Homo sapiens
atatggcctcaagatc

SEQ ID NO: 2590712 - DNA, 15 bp, Homo sapiens
atatgggagaaatag

SEQ ID NO: 2590713 - DNA, 20 bp, Homo sapiens
atatggggatgcagcattat

SEQ ID NO: 2590714 - DNA, 12 bp, Homo sapiens
atatgtaaaata

SEQ ID NO: 2590715 - DNA, 13 bp, Homo sapiens
atatgtaaaataa

SEQ ID NO: 2590716 - DNA, 17 bp, Homo sapiens
atatgtaacaagccacc

SEQ ID NO: 2590717 - DNA, 19 bp, Homo sapiens
atatgtaccatgtacatga

SEQ ID NO: 2590718 - DNA, 21 bp, Homo sapiens
atatgtacttgtcaaagaagg

SEQ ID NO: 2590719 - DNA, 15 bp, Homo sapiens
atatgtatgtgtgta

SEQ ID NO: 2590720 - DNA, 21 bp, Homo sapiens
atatgtattgtaaacatgtgt

SEQ ID NO: 2590721 - DNA, 14 bp, Homo sapiens
atatgtcaagccat

SEQ ID NO: 2590722 - DNA, 11 bp, Homo sapiens
atatgtgaatc

SEQ ID NO: 2590723 - DNA, 18 bp, Homo sapiens
atatgtgcttgcctcagt

SEQ ID NO: 2590724 - DNA, 12 bp, Homo sapiens
atatgtgtatgt

SEQ ID NO: 2590725 - DNA, 14 bp, Homo sapiens
atatgtgtatgtac

SEQ ID NO: 2590726 - DNA, 22 bp, Homo sapiens
atatgtgtatgtacgtttgtat

SEQ ID NO: 2590727 - DNA, 20 bp, Homo sapiens
atatgtgtgtgtatgtttgc

SEQ ID NO: 2590728 - DNA, 19 bp, Homo sapiens
atatgtgtttttcacattt

SEQ ID NO: 2590729 - DNA, 20 bp, Homo sapiens
atatgttaacctcagtgtca

SEQ ID NO: 2590730 - DNA, 17 bp, Homo sapiens
atatgtttaccttttaa

SEQ ID NO: 2590731 - DNA, 24 bp, Homo sapiens
atattaagaaagactatctaaatg

SEQ ID NO: 2590732 - DNA, 19 bp, Homo sapiens
atattaatatatatctgct

SEQ ID NO: 2590733 - DNA, 18 bp, Homo sapiens
atattagaagtgttaact

SEQ ID NO: 2590734 - DNA, 15 bp, Homo sapiens
atattagatgtgatt

SEQ ID NO: 2590735 - DNA, 20 bp, Homo sapiens
atattagatgtgatttaata

SEQ ID NO: 2590736 - DNA, 22 bp, Homo sapiens
atattagcatttagtccaatgt

SEQ ID NO: 2590737 - DNA, 20 bp, Homo sapiens
atattagctttactgtttgt

SEQ ID NO: 2590738 - DNA, 19 bp, Homo sapiens
atattatcatgcaaatgct

SEQ ID NO: 2590739 - DNA, 14 bp, Homo sapiens
atattatttctagg

SEQ ID NO: 2590740 - DNA, 14 bp, Homo sapiens
atattcaggaagct

SEQ ID NO: 2590741 - DNA, 17 bp, Homo sapiens
atattcaggaagctcag

SEQ ID NO: 2590742 - DNA, 18 bp, Homo sapiens
atattcatgcttcttcct

SEQ ID NO: 2590743 - DNA, 20 bp, Homo sapiens
atattcatgcttcttcctta

SEQ ID NO: 2590744 - DNA, 14 bp, Homo sapiens
atattcattgtata

SEQ ID NO: 2590745 - DNA, 13 bp, Homo sapiens
atattcatttcaa

SEQ ID NO: 2590746 - DNA, 15 bp, Homo sapiens
atattccatgaatgt

SEQ ID NO: 2590747 - DNA, 23 bp, Homo sapiens
atattcctgaatgaaatatcaga

SEQ ID NO: 2590748 - DNA, 18 bp, Homo sapiens
atattctatatgaattta

SEQ ID NO: 2590749 - DNA, 20 bp, Homo sapiens
atattctatatgaatttaaa

SEQ ID NO: 2590750 - DNA, 21 bp, Homo sapiens
atattgaatataatatatttg

SEQ ID NO: 2590751 - DNA, 22 bp, Homo sapiens
atattgatttctgccttccttg

SEQ ID NO: 2590752 - DNA, 16 bp, Homo sapiens
atattgctttttctaa

SEQ ID NO: 2590753 - DNA, 21 bp, Homo sapiens
atattgctttttctaatgtgg

SEQ ID NO: 2590754 - DNA, 13 bp, Homo sapiens
atattgtacagtt

SEQ ID NO: 2590755 - DNA, 16 bp, Homo sapiens
atattgtattactaga

SEQ ID NO: 2590756 - DNA, 19 bp, Homo sapiens
atattgtgattctgccttt

SEQ ID NO: 2590757 - DNA, 19 bp, Homo sapiens
atattgtgccaatatgtat

SEQ ID NO: 2590758 - DNA, 20 bp, Homo sapiens
atattgtgccaatatgtatt

SEQ ID NO: 2590759 - DNA, 23 bp, Homo sapiens
atatttaaacatggttacaatca

SEQ ID NO: 2590760 - DNA, 16 bp, Homo sapiens
atatttacatatgaaa

SEQ ID NO: 2590761 - DNA, 19 bp, Homo sapiens
atatttacatatgaaattt

SEQ ID NO: 2590762 - DNA, 23 bp, Homo sapiens
atatttactaagccacaagaaat

SEQ ID NO: 2590763 - DNA, 21 bp, Homo sapiens
atcctcaaacactgcaggcat

SEQ ID NO: 2590764 - DNA, 12 bp, Homo sapiens
atcctcaatcca

SEQ ID NO: 2590765 - DNA, 15 bp, Homo sapiens
atcctcactgggtgg

SEQ ID NO: 2590766 - DNA, 13 bp, Homo sapiens
atcctccagcttc

SEQ ID NO: 2590767 - DNA, 19 bp, Homo sapiens
atcctccaggtgcacaagc

SEQ ID NO: 2590768 - DNA, 22 bp, Homo sapiens
atcctccaggtgcacaagctcc

SEQ ID NO: 2590769 - DNA, 23 bp, Homo sapiens
atcctccaggtgcacaagctcca

SEQ ID NO: 2590770 - DNA, 12 bp, Homo sapiens
atcctccaggtt

SEQ ID NO: 2590771 - DNA, 14 bp, Homo sapiens
atcctccaggtttt

SEQ ID NO: 2590772 - DNA, 16 bp, Homo sapiens
atcctccaggtttttc

SEQ ID NO: 2590773 - DNA, 17 bp, Homo sapiens
atcctccaggtttttca

SEQ ID NO: 2590774 - DNA, 20 bp, Homo sapiens
atcctccaggtttttcaatt

SEQ ID NO: 2590775 - DNA, 20 bp, Homo sapiens
atcctcccacctcagcctcc

SEQ ID NO: 2590776 - DNA, 18 bp, Homo sapiens
atcctccccttccctgca

SEQ ID NO: 2590777 - DNA, 15 bp, Homo sapiens
atcctccgtccagcc

SEQ ID NO: 2590778 - DNA, 20 bp, Homo sapiens
atcctctcaaccacctttca

SEQ ID NO: 2590779 - DNA, 15 bp, Homo sapiens
atcctcttcctctga

SEQ ID NO: 2590780 - DNA, 19 bp, Homo sapiens
atcctcttcctctgaggct

SEQ ID NO: 2590781 - DNA, 17 bp, Homo sapiens
atcctgaaatttcagat

SEQ ID NO: 2590782 - DNA, 15 bp, Homo sapiens
atcctgactctgccc

SEQ ID NO: 2590783 - DNA, 17 bp, Homo sapiens
atcctgactctgccccc

SEQ ID NO: 2590784 - DNA, 16 bp, Homo sapiens
atcctgcaattccact

SEQ ID NO: 2590785 - DNA, 20 bp, Homo sapiens
atcctgccccctgaaactta

SEQ ID NO: 2590786 - DNA, 23 bp, Homo sapiens
atcctgccccctgaaacttattt

SEQ ID NO: 2590787 - DNA, 19 bp, Homo sapiens
atcctgcttctgatatgca

SEQ ID NO: 2590788 - DNA, 19 bp, Homo sapiens
atcctggcacccggcccct

SEQ ID NO: 2590789 - DNA, 21 bp, Homo sapiens
atcctggcacccggcccctgc

SEQ ID NO: 2590790 - DNA, 22 bp, Homo sapiens
atcctggttggtgttgcagaag

SEQ ID NO: 2590791 - DNA, 23 bp, Homo sapiens
atcctgtctttaaggaaaaaaag

SEQ ID NO: 2590792 - DNA, 12 bp, Homo sapiens
atcctgtgaagt

SEQ ID NO: 2590793 - DNA, 14 bp, Homo sapiens
atcctgtgtttcta

SEQ ID NO: 2590794 - DNA, 13 bp, Homo sapiens
atccttcctccca

SEQ ID NO: 2590795 - DNA, 22 bp, Homo sapiens
atgtgtgtatatgtatgtgtgt

SEQ ID NO: 2590796 - DNA, 20 bp, Homo sapiens
atgtgtgtatgggtgtgtgt

SEQ ID NO: 2590797 - DNA, 21 bp, Homo sapiens
atgtgtgtgtatgtttgcaca

SEQ ID NO: 2590798 - DNA, 19 bp, Homo sapiens
atgtgtgtttaaataaagt

SEQ ID NO: 2590799 - DNA, 14 bp, Homo sapiens
atgtgttgaaaaaa

SEQ ID NO: 2590800 - DNA, 12 bp, Homo sapiens
atgtgtttgtgt

SEQ ID NO: 2590801 - DNA, 14 bp, Homo sapiens
atgtgttttctgaa

SEQ ID NO: 2590802 - DNA, 12 bp, Homo sapiens
atgttaaatttg

SEQ ID NO: 2590803 - DNA, 22 bp, Homo sapiens
atgttaacacattttgtataat

SEQ ID NO: 2590804 - DNA, 23 bp, Homo sapiens
atgttaacacattttgtataatt

SEQ ID NO: 2590805 - DNA, 18 bp, Homo sapiens
atgttaacctcagtgtca

SEQ ID NO: 2590806 - DNA, 21 bp, Homo sapiens
atgttaacctcagtgtcattt

SEQ ID NO: 2590807 - DNA, 13 bp, Homo sapiens
atgttaaggaaac

SEQ ID NO: 2590808 - DNA, 15 bp, Homo sapiens
atgttaagttacttc

SEQ ID NO: 2590809 - DNA, 17 bp, Homo sapiens
atgttaagttacttcac

SEQ ID NO: 2590810 - DNA, 23 bp, Homo sapiens
atgttaagttacttcactttaat

SEQ ID NO: 2590811 - DNA, 22 bp, Homo sapiens
atgttaattcagcactgatttc

SEQ ID NO: 2590812 - DNA, 13 bp, Homo sapiens
atgttaatttcat

SEQ ID NO: 2590813 - DNA, 19 bp, Homo sapiens
atgttacataagataaatg

SEQ ID NO: 2590814 - DNA, 20 bp, Homo sapiens
atgttactgatcatgcattg

SEQ ID NO: 2590815 - DNA, 21 bp, Homo sapiens
atgttactgatcatgcattgt

SEQ ID NO: 2590816 - DNA, 15 bp, Homo sapiens
attacagaggaagtt

SEQ ID NO: 2590817 - DNA, 18 bp, Homo sapiens
attacatttccaaatgaa

SEQ ID NO: 2590818 - DNA, 12 bp, Homo sapiens
attaccagggac

SEQ ID NO: 2590819 - DNA, 20 bp, Homo sapiens
attaccatgagaagagggcc

SEQ ID NO: 2590820 - DNA, 17 bp, Homo sapiens
attacctcctgagaaaa

SEQ ID NO: 2590821 - DNA, 20 bp, Homo sapiens
attaccttttttgataaagt

SEQ ID NO: 2590822 - DNA, 13 bp, Homo sapiens
attactgtttgtc

SEQ ID NO: 2590823 - DNA, 23 bp, Homo sapiens
attacttatcatccacattgttt

SEQ ID NO: 2590824 - DNA, 18 bp, Homo sapiens
attacttatttttgacag

SEQ ID NO: 2590825 - DNA, 21 bp, Homo sapiens
attacttttccacaaatcagt

SEQ ID NO: 2590826 - DNA, 19 bp, Homo sapiens
attagaacaggcaagtgaa

SEQ ID NO: 2590827 - DNA, 14 bp, Homo sapiens
attagaatgaaaat

SEQ ID NO: 2590828 - DNA, 13 bp, Homo sapiens
attagaattattt

SEQ ID NO: 2590829 - DNA, 15 bp, Homo sapiens
attagactcctcctc

SEQ ID NO: 2590830 - DNA, 22 bp, Homo sapiens
attagactgtaggaagagtagc

SEQ ID NO: 2590831 - DNA, 15 bp, Homo sapiens
attagatgtgattta

SEQ ID NO: 2590832 - DNA, 22 bp, Homo sapiens
attagatgtgatttaatagtgt

SEQ ID NO: 2590833 - DNA, 14 bp, Homo sapiens
attagccaggatca

SEQ ID NO: 2590834 - DNA, 12 bp, Homo sapiens
attagctctgga

SEQ ID NO: 2590835 - DNA, 20 bp, Homo sapiens
attagctttactgtttgtta

SEQ ID NO: 2590836 - DNA, 13 bp, Homo sapiens
attaggaataaat

SEQ ID NO: 2590837 - DNA, 22 bp, Homo sapiens
attaggacaatcagtcccctcc

SEQ ID NO: 2590838 - DNA, 16 bp, Homo sapiens
attaggatttcatgat

SEQ ID NO: 2590839 - DNA, 19 bp, Homo sapiens
attagggcatttgagaaat

SEQ ID NO: 2590840 - DNA, 16 bp, Homo sapiens
attaggtgtgactgaa

SEQ ID NO: 2590841 - DNA, 13 bp, Homo sapiens
attagtccttgct

SEQ ID NO: 2590842 - DNA, 15 bp, Homo sapiens
attataacttaaaaa

SEQ ID NO: 2590843 - DNA, 15 bp, Homo sapiens
attataacttaaaat

SEQ ID NO: 2590844 - DNA, 20 bp, Homo sapiens
attataacttaaaatatttt

SEQ ID NO: 2590845 - DNA, 20 bp, Homo sapiens
attatataggttgtgcaaat

SEQ ID NO: 2590846 - DNA, 14 bp, Homo sapiens
attatattaaaata

SEQ ID NO: 2590847 - DNA, 20 bp, Homo sapiens
attatattattagttttgat

SEQ ID NO: 2590848 - DNA, 17 bp, Homo sapiens
attccctagatctttct

SEQ ID NO: 2590849 - DNA, 21 bp, Homo sapiens
attccctatcttttagtttta

SEQ ID NO: 2590850 - DNA, 14 bp, Homo sapiens
attccctcctgcta

SEQ ID NO: 2590851 - DNA, 21 bp, Homo sapiens
attccctcctgctactctgtt

SEQ ID NO: 2590852 - DNA, 20 bp, Homo sapiens
attccctctctctgactctc

SEQ ID NO: 2590853 - DNA, 22 bp, Homo sapiens
attccctctctctgactctcaa

SEQ ID NO: 2590854 - DNA, 13 bp, Homo sapiens
attccctgcctgg

SEQ ID NO: 2590855 - DNA, 21 bp, Homo sapiens
attccctgtacaatatttaaa

SEQ ID NO: 2590856 - DNA, 16 bp, Homo sapiens
attcccttcatctgga

SEQ ID NO: 2590857 - DNA, 19 bp, Homo sapiens
attcccttcatctggaacc

SEQ ID NO: 2590858 - DNA, 17 bp, Homo sapiens
attcctaaactatcttt

SEQ ID NO: 2590859 - DNA, 19 bp, Homo sapiens
attcctaaactatcttttt

SEQ ID NO: 2590860 - DNA, 21 bp, Homo sapiens
attcctatacgcagcgtgctt

SEQ ID NO: 2590861 - DNA, 20 bp, Homo sapiens
attcctattgtgatttgact

SEQ ID NO: 2590862 - DNA, 23 bp, Homo sapiens
attcctattgtgatttgactgtt

SEQ ID NO: 2590863 - DNA, 15 bp, Homo sapiens
attcctccacctgcc

SEQ ID NO: 2590864 - DNA, 13 bp, Homo sapiens
attcctcctgctc

SEQ ID NO: 2590865 - DNA, 14 bp, Homo sapiens
attcctcctgctca

SEQ ID NO: 2590866 - DNA, 15 bp, Homo sapiens
attcctcctgctcat

SEQ ID NO: 2590867 - DNA, 20 bp, Homo sapiens
attcctcctgctcatattgt

SEQ ID NO: 2590868 - DNA, 14 bp, Homo sapiens
attcctgacccagg

SEQ ID NO: 2590869 - DNA, 17 bp, Homo sapiens
attcctgcctgtctcct

SEQ ID NO: 2590870 - DNA, 10 bp, Homo sapiens
attcctgggc

SEQ ID NO: 2590871 - DNA, 17 bp, Homo sapiens
attcctgtagcatcttc

SEQ ID NO: 2590872 - DNA, 17 bp, Homo sapiens
attcctgtatgttgtcc

SEQ ID NO: 2590873 - DNA, 18 bp, Homo sapiens
attcctgtatgttgtcca

SEQ ID NO: 2590874 - DNA, 20 bp, Homo sapiens
attccttagcttagacctca

SEQ ID NO: 2590875 - DNA, 21 bp, Homo sapiens
attccttagcttagacctcag

SEQ ID NO: 2590876 - DNA, 22 bp, Homo sapiens
attccttagcttagacctcagc

SEQ ID NO: 2590877 - DNA, 16 bp, Homo sapiens
attccttctttgataa

SEQ ID NO: 2590878 - DNA, 23 bp, Homo sapiens
attccttctttgataatgttaaa

SEQ ID NO: 2590879 - DNA, 15 bp, Homo sapiens
attcgaaccaggaaa

SEQ ID NO: 2590880 - DNA, 16 bp, Homo sapiens
attcgagacagaacct

SEQ ID NO: 2590881 - DNA, 21 bp, Homo sapiens
attcgtgcagcatatgaggat

SEQ ID NO: 2590882 - DNA, 23 bp, Homo sapiens
attcgtggtgatcaattaaatgt

SEQ ID NO: 2590883 - DNA, 14 bp, Homo sapiens
attctaatgtcttc

SEQ ID NO: 2590884 - DNA, 17 bp, Homo sapiens
attctactttaagcact

SEQ ID NO: 2590885 - DNA, 16 bp, Homo sapiens
attctactttgagtgc

SEQ ID NO: 2590886 - DNA, 13 bp, Homo sapiens
attctaggcatcc

SEQ ID NO: 2590887 - DNA, 13 bp, Homo sapiens
attctatatgaat

SEQ ID NO: 2590888 - DNA, 14 bp, Homo sapiens
attctatatgaatt

SEQ ID NO: 2590889 - DNA, 16 bp, Homo sapiens
attctatatgaattta

SEQ ID NO: 2590890 - DNA, 17 bp, Homo sapiens
attctatatgaatttaa

SEQ ID NO: 2590891 - DNA, 16 bp, Homo sapiens
attgcctgcagagaga

SEQ ID NO: 2590892 - DNA, 23 bp, Homo sapiens
attgcctttagtgatcacagcag

SEQ ID NO: 2590893 - DNA, 16 bp, Homo sapiens
attgcggacagccacg

SEQ ID NO: 2590894 - DNA, 14 bp, Homo sapiens
attgctaaatgtaa

SEQ ID NO: 2590895 - DNA, 21 bp, Homo sapiens
attgctactacttacctacca

SEQ ID NO: 2590896 - DNA, 20 bp, Homo sapiens
attgctactgtcctacccac

SEQ ID NO: 2590897 - DNA, 22 bp, Homo sapiens
attgctactgtcctacccaccc

SEQ ID NO: 2590898 - DNA, 22 bp, Homo sapiens
attgctatgttttgacattttt

SEQ ID NO: 2590899 - DNA, 12 bp, Homo sapiens
attgctgaaatt

SEQ ID NO: 2590900 - DNA, 13 bp, Homo sapiens
attgctgaaattt

SEQ ID NO: 2590901 - DNA, 16 bp, Homo sapiens
attgctgaaattttat

SEQ ID NO: 2590902 - DNA, 14 bp, Homo sapiens
attgctgccacttt

SEQ ID NO: 2590903 - DNA, 21 bp, Homo sapiens
attgctgccactttttaacta

SEQ ID NO: 2590904 - DNA, 18 bp, Homo sapiens
attgctggctggaaggga

SEQ ID NO: 2590905 - DNA, 21 bp, Homo sapiens
attgctgttgtccctctgcta

SEQ ID NO: 2590906 - DNA, 17 bp, Homo sapiens
attgcttaaaatagcaa

SEQ ID NO: 2590907 - DNA, 16 bp, Homo sapiens
attgctttactgtcaa

SEQ ID NO: 2590908 - DNA, 15 bp, Homo sapiens
attgctttctgaaat

SEQ ID NO: 2590909 - DNA, 21 bp, Homo sapiens
attgctttgattaatccagaa

SEQ ID NO: 2590910 - DNA, 15 bp, Homo sapiens
attgctttttctaat

SEQ ID NO: 2590911 - DNA, 14 bp, Homo sapiens
attggaagaaattc

SEQ ID NO: 2590912 - DNA, 20 bp, Homo sapiens
attggaattaacctggtgct

SEQ ID NO: 2590913 - DNA, 14 bp, Homo sapiens
attggacccttcca

SEQ ID NO: 2590914 - DNA, 15 bp, Homo sapiens
attggacccttccat

SEQ ID NO: 2590915 - DNA, 15 bp, Homo sapiens
attggaggaaagcaa

SEQ ID NO: 2590916 - DNA, 16 bp, Homo sapiens
attggattatttaata

SEQ ID NO: 2590917 - DNA, 14 bp, Homo sapiens
attggcatgtgtat

SEQ ID NO: 2590918 - DNA, 17 bp, Homo sapiens
attggcatgtgtatgtt

SEQ ID NO: 2590919 - DNA, 11 bp, Homo sapiens
attggcctgga

SEQ ID NO: 2590920 - DNA, 17 bp, Homo sapiens
attggctatttaaaact

SEQ ID NO: 2590921 - DNA, 22 bp, Homo sapiens
attggctgaactcatgagaagt

SEQ ID NO: 2590922 - DNA, 14 bp, Homo sapiens
attggctgagagac

SEQ ID NO: 2590923 - DNA, 23 bp, Homo sapiens
attggctttgggttgcaggacct

SEQ ID NO: 2590924 - DNA, 16 bp, Homo sapiens
attgggaataaatatg

SEQ ID NO: 2590925 - DNA, 17 bp, Homo sapiens
attgggactggggctga

SEQ ID NO: 2590926 - DNA, 13 bp, Homo sapiens
attgggttcatta

SEQ ID NO: 2590927 - DNA, 15 bp, Homo sapiens
attggtaacatcctt

SEQ ID NO: 2590928 - DNA, 17 bp, Homo sapiens
attggtatcaagaaagt

SEQ ID NO: 2590929 - DNA, 18 bp, Homo sapiens
attggtatcaagaaagtc

SEQ ID NO: 2590930 - DNA, 14 bp, Homo sapiens
attggtctcctctc

SEQ ID NO: 2590931 - DNA, 16 bp, Homo sapiens
attggttcttgtatta

SEQ ID NO: 2590932 - DNA, 21 bp, Homo sapiens
attgtaaaaaaaaatgccttt

SEQ ID NO: 2590933 - DNA, 20 bp, Homo sapiens
attgtaaaacctgtcaatga

SEQ ID NO: 2590934 - DNA, 15 bp, Homo sapiens
attgtaaaatagctt

SEQ ID NO: 2590935 - DNA, 14 bp, Homo sapiens
attgtaaatgtgct

SEQ ID NO: 2590936 - DNA, 16 bp, Homo sapiens
attgtaacgttgctgt

SEQ ID NO: 2590937 - DNA, 20 bp, Homo sapiens
attgtaagaaatactgtaca

SEQ ID NO: 2590938 - DNA, 12 bp, Homo sapiens
attgtaatcact

SEQ ID NO: 2590939 - DNA, 13 bp, Homo sapiens
attgtaatgttac

SEQ ID NO: 2590940 - DNA, 19 bp, Homo sapiens
attgtacacaccttatatt

SEQ ID NO: 2590941 - DNA, 17 bp, Homo sapiens
attgtacagctgtttaa

SEQ ID NO: 2590942 - DNA, 14 bp, Homo sapiens
attgtacagttttt

SEQ ID NO: 2590943 - DNA, 16 bp, Homo sapiens
attgtaccttttaaca

SEQ ID NO: 2590944 - DNA, 22 bp, Homo sapiens
attgtaccttttaacacctgat

SEQ ID NO: 2590945 - DNA, 18 bp, Homo sapiens
attgtagagccagaggtc

SEQ ID NO: 2590946 - DNA, 21 bp, Homo sapiens
attgtataaactatcagtttg

SEQ ID NO: 2590947 - DNA, 22 bp, Homo sapiens
attgtataaactatcagtttgt

SEQ ID NO: 2590948 - DNA, 13 bp, Homo sapiens
attgtataacagg

SEQ ID NO: 2590949 - DNA, 14 bp, Homo sapiens
attgtataacaggt

SEQ ID NO: 2590950 - DNA, 22 bp, Homo sapiens
attgtataagattagaatgaaa

SEQ ID NO: 2590951 - DNA, 11 bp, Homo sapiens
attgtatatat

SEQ ID NO: 2590952 - DNA, 15 bp, Homo sapiens
attgtatcagaggcc

SEQ ID NO: 2590953 - DNA, 21 bp, Homo sapiens
attgtatcagaggcctataat

SEQ ID NO: 2590954 - DNA, 17 bp, Homo sapiens
attgtatcgtatagctg

SEQ ID NO: 2590955 - DNA, 15 bp, Homo sapiens
attgtatctagtgca

SEQ ID NO: 2590956 - DNA, 14 bp, Homo sapiens
attgtatgatgtgt

SEQ ID NO: 2590957 - DNA, 15 bp, Homo sapiens
attgtatgatgtgtt

SEQ ID NO: 2590958 - DNA, 23 bp, Homo sapiens
attgtcagatattttttcagaaa

SEQ ID NO: 2590959 - DNA, 13 bp, Homo sapiens
attgtcattaaag

SEQ ID NO: 2590960 - DNA, 15 bp, Homo sapiens
attgtcattcctgta

SEQ ID NO: 2590961 - DNA, 23 bp, Homo sapiens
attgtcattcctgtattcacccg

SEQ ID NO: 2590962 - DNA, 13 bp, Homo sapiens
attgtcatttata

SEQ ID NO: 2590963 - DNA, 17 bp, Homo sapiens
attgtccccgacccttg

SEQ ID NO: 2590964 - DNA, 15 bp, Homo sapiens
attgtctccttgagt

SEQ ID NO: 2590965 - DNA, 23 bp, Homo sapiens
attgtcttcggaaaccttggtgt

SEQ ID NO: 2590966 - DNA, 14 bp, Homo sapiens
attgtgaagtacat

SEQ ID NO: 2590967 - DNA, 15 bp, Homo sapiens
attgtgaagtacata

SEQ ID NO: 2590968 - DNA, 17 bp, Homo sapiens
attgtgaccaagttata

SEQ ID NO: 2590969 - DNA, 16 bp, Homo sapiens
attgtgagccaccacg

SEQ ID NO: 2590970 - DNA, 14 bp, Homo sapiens
attgtgatgtgtcc

SEQ ID NO: 2590971 - DNA, 15 bp, Homo sapiens
attgtgatgtgtcct

SEQ ID NO: 2590972 - DNA, 18 bp, Homo sapiens
attgtgattctgcctttg

SEQ ID NO: 2590973 - DNA, 19 bp, Homo sapiens
attgtgatttgactgtttt

SEQ ID NO: 2590974 - DNA, 23 bp, Homo sapiens
attgtgatttgactgtttttacc

SEQ ID NO: 2590975 - DNA, 17 bp, Homo sapiens
attgtgccaatatgtat

SEQ ID NO: 2590976 - DNA, 19 bp, Homo sapiens
attgtgccaatatgtattg

SEQ ID NO: 2590977 - DNA, 13 bp, Homo sapiens
attgtgcccctgc

SEQ ID NO: 2590978 - DNA, 17 bp, Homo sapiens
attgtggctgtcagcag

SEQ ID NO: 2590979 - DNA, 21 bp, Homo sapiens
attgtggggatgatgaaataa

SEQ ID NO: 2590980 - DNA, 18 bp, Homo sapiens
attgtggtacaatctcaa

SEQ ID NO: 2590981 - DNA, 14 bp, Homo sapiens
attgtggtgccaca

SEQ ID NO: 2590982 - DNA, 18 bp, Homo sapiens
attgtgtctcttggtcct

SEQ ID NO: 2590983 - DNA, 12 bp, Homo sapiens
attgtgtgatgt

SEQ ID NO: 2590984 - DNA, 17 bp, Homo sapiens
attgttaactcttgtct

SEQ ID NO: 2590985 - DNA, 21 bp, Homo sapiens
attgttaagtctaaatatttc

SEQ ID NO: 2590986 - DNA, 22 bp, Homo sapiens
attgttccaagacattgtcaat

SEQ ID NO: 2590987 - DNA, 19 bp, Homo sapiens
attgttgtttctttctagt

SEQ ID NO: 2590988 - DNA, 15 bp, Homo sapiens
attgtttatttatca

SEQ ID NO: 2590989 - DNA, 17 bp, Homo sapiens
attgtttatttatcagt

SEQ ID NO: 2590990 - DNA, 17 bp, Homo sapiens
attgtttgaaacaaaga

SEQ ID NO: 2590991 - DNA, 18 bp, Homo sapiens
attgtttgaaacaaagaa

SEQ ID NO: 2590992 - DNA, 19 bp, Homo sapiens
attgtttgaaacaaagaag

SEQ ID NO: 2590993 - DNA, 14 bp, Homo sapiens
attgtttgcttatt

SEQ ID NO: 2590994 - DNA, 16 bp, Homo sapiens
attgtttgcttattgt

SEQ ID NO: 2590995 - DNA, 18 bp, Homo sapiens
attgtttgcttattgttc

SEQ ID NO: 2590996 - DNA, 22 bp, Homo sapiens
attgtttgcttattgttccaag

SEQ ID NO: 2590997 - DNA, 22 bp, Homo sapiens
attgttttaaaaagaaacaaga

SEQ ID NO: 2590998 - DNA, 16 bp, Homo sapiens
atttaaaaataagaaa

SEQ ID NO: 2590999 - DNA, 14 bp, Homo sapiens
atttaaaacatgta

SEQ ID NO: 2591000 - DNA, 17 bp, Homo sapiens
atttaaaagatacagtt

SEQ ID NO: 2591001 - DNA, 19 bp, Homo sapiens
atttaaaagggaagtctag

SEQ ID NO: 2591002 - DNA, 20 bp, Homo sapiens
atttaaacagcagtgttccc

SEQ ID NO: 2591003 - DNA, 14 bp, Homo sapiens
atttaaacccattt

SEQ ID NO: 2591004 - DNA, 18 bp, Homo sapiens
atttaaacccattttagt

SEQ ID NO: 2591005 - DNA, 21 bp, Homo sapiens
atttaaagacagggaagagca

SEQ ID NO: 2591006 - DNA, 15 bp, Homo sapiens
atttaaagcctcctc

SEQ ID NO: 2591007 - DNA, 19 bp, Homo sapiens
atttaaagcttattaaaac

SEQ ID NO: 2591008 - DNA, 20 bp, Homo sapiens
atttaacagaaatgtacagc

SEQ ID NO: 2591009 - DNA, 16 bp, Homo sapiens
atttaacagtcattta

SEQ ID NO: 2591010 - DNA, 13 bp, Homo sapiens
atttaactggctt

SEQ ID NO: 2591011 - DNA, 20 bp, Homo sapiens
atttaacttaacattctgta

SEQ ID NO: 2591012 - DNA, 21 bp, Homo sapiens
atttaacttaacattctgtaa

SEQ ID NO: 2591013 - DNA, 15 bp, Homo sapiens
atttaagataattat

SEQ ID NO: 2591014 - DNA, 15 bp, Homo sapiens
atttaagatagtttt

SEQ ID NO: 2591015 - DNA, 11 bp, Homo sapiens
atttaagcatt

SEQ ID NO: 2591016 - DNA, 15 bp, Homo sapiens
atttaagcattgttt

SEQ ID NO: 2591017 - DNA, 14 bp, Homo sapiens
atttaagtgcgtgt

SEQ ID NO: 2591018 - DNA, 21 bp, Homo sapiens
atttaagtgcgtgtgtagagt

SEQ ID NO: 2591019 - DNA, 19 bp, Homo sapiens
atttaagttcatattccat

SEQ ID NO: 2591020 - DNA, 19 bp, Homo sapiens
atttaataaaataattcta

SEQ ID NO: 2591021 - DNA, 21 bp, Homo sapiens
atttaataaaataattctaaa

SEQ ID NO: 2591022 - DNA, 16 bp, Homo sapiens
atttaataaatgtgcc

SEQ ID NO: 2591023 - DNA, 15 bp, Homo sapiens
atttaataacattac

SEQ ID NO: 2591024 - DNA, 15 bp, Homo sapiens
atttaataatctgta

SEQ ID NO: 2591025 - DNA, 19 bp, Homo sapiens
atttaatagtgttaatcaa

SEQ ID NO: 2591026 - DNA, 14 bp, Homo sapiens
atttaatatagcta

SEQ ID NO: 2591027 - DNA, 15 bp, Homo sapiens
atttaatattttgca

SEQ ID NO: 2591028 - DNA, 20 bp, Homo sapiens
atttaatgaaagactgtaca

SEQ ID NO: 2591029 - DNA, 14 bp, Homo sapiens
atttaatgttttca

SEQ ID NO: 2591030 - DNA, 13 bp, Homo sapiens
atttaattaaaaa

SEQ ID NO: 2591031 - DNA, 16 bp, Homo sapiens
atttaattctcttgaa

SEQ ID NO: 2591032 - DNA, 14 bp, Homo sapiens
atttatttattaag

SEQ ID NO: 2591033 - DNA, 14 bp, Homo sapiens
atttatttatttat

SEQ ID NO: 2591034 - DNA, 20 bp, Homo sapiens
atttattttcctccccagca

SEQ ID NO: 2591035 - DNA, 17 bp, Homo sapiens
atttatttttgcatggc

SEQ ID NO: 2591036 - DNA, 19 bp, Homo sapiens
atttattttttacattatt

SEQ ID NO: 2591037 - DNA, 17 bp, Homo sapiens
atttcaaaaatataact

SEQ ID NO: 2591038 - DNA, 15 bp, Homo sapiens
atttcaagaccttct

SEQ ID NO: 2591039 - DNA, 15 bp, Homo sapiens
atttcaattctcaaa

SEQ ID NO: 2591040 - DNA, 21 bp, Homo sapiens
atttcaatttccaagagctga

SEQ ID NO: 2591041 - DNA, 15 bp, Homo sapiens
atttcacaacagatc

SEQ ID NO: 2591042 - DNA, 23 bp, Homo sapiens
atttcacagtgtgtttgtgattg

SEQ ID NO: 2591043 - DNA, 21 bp, Homo sapiens
atttcacattaatatttgctg

SEQ ID NO: 2591044 - DNA, 15 bp, Homo sapiens
atttcacctgtaaac

SEQ ID NO: 2591045 - DNA, 16 bp, Homo sapiens
atttcacctgtaaacc

SEQ ID NO: 2591046 - DNA, 19 bp, Homo sapiens
atttcacctgtaaacctga

SEQ ID NO: 2591047 - DNA, 12 bp, Homo sapiens
atttcacttaat

SEQ ID NO: 2591048 - DNA, 17 bp, Homo sapiens
atttcacttaataatgt

SEQ ID NO: 2591049 - DNA, 15 bp, Homo sapiens
atttcactttagatg

SEQ ID NO: 2591050 - DNA, 22 bp, Homo sapiens
atttcagagaggccttttggaa

SEQ ID NO: 2591051 - DNA, 15 bp, Homo sapiens
atttcaggagcagcc

SEQ ID NO: 2591052 - DNA, 19 bp, Homo sapiens
atttcaggatactctgtca

SEQ ID NO: 2591053 - DNA, 19 bp, Homo sapiens
atttcaggggtcgtcacca

SEQ ID NO: 2591054 - DNA, 22 bp, Homo sapiens
atttcaggggtcgtcaccacct

SEQ ID NO: 2591055 - DNA, 13 bp, Homo sapiens
atttcatctattt

SEQ ID NO: 2591056 - DNA, 20 bp, Homo sapiens
atttcatctatttctgagaa

SEQ ID NO: 2591057 - DNA, 22 bp, Homo sapiens
atttcatgtgtcaacttcaaca

SEQ ID NO: 2591058 - DNA, 14 bp, Homo sapiens
atttcattgtatga

SEQ ID NO: 2591059 - DNA, 21 bp, Homo sapiens
atttcattgtatgatgtgttg

SEQ ID NO: 2591060 - DNA, 18 bp, Homo sapiens
atttcatttcaactgttt

SEQ ID NO: 2591061 - DNA, 15 bp, Homo sapiens
atttccaaataaaat

SEQ ID NO: 2591062 - DNA, 17 bp, Homo sapiens
atttccaaataaaatga

SEQ ID NO: 2591063 - DNA, 17 bp, Homo sapiens
atttccagccagggctg

SEQ ID NO: 2591064 - DNA, 17 bp, Homo sapiens
atttccattatttatat

SEQ ID NO: 2591065 - DNA, 16 bp, Homo sapiens
atttccattccagaat

SEQ ID NO: 2591066 - DNA, 21 bp, Homo sapiens
atttcccaggctgaattggga

SEQ ID NO: 2591067 - DNA, 17 bp, Homo sapiens
atttccccaacagtgtg

SEQ ID NO: 2591068 - DNA, 18 bp, Homo sapiens
atttccccaacagtgtga

SEQ ID NO: 2591069 - DNA, 19 bp, Homo sapiens
atttccccaacagtgtgaa

SEQ ID NO: 2591070 - DNA, 17 bp, Homo sapiens
atttccccaccccagct

SEQ ID NO: 2591071 - DNA, 20 bp, Homo sapiens
atttccccaggggaaaatga

SEQ ID NO: 2591072 - DNA, 23 bp, Homo sapiens
atttcccttgaaattttaaacta

SEQ ID NO: 2591073 - DNA, 15 bp, Homo sapiens
atttccgttaaaata

SEQ ID NO: 2591074 - DNA, 17 bp, Homo sapiens
atttccgttaaaatacc

SEQ ID NO: 2591075 - DNA, 24 bp, Homo sapiens
atttcctcaacgttgctccccatc

SEQ ID NO: 2591076 - DNA, 16 bp, Homo sapiens
atttcctccacaaatt

SEQ ID NO: 2591077 - DNA, 22 bp, Homo sapiens
atttcctctattgatgtacagt

SEQ ID NO: 2591078 - DNA, 14 bp, Homo sapiens
atttcctgtgtctt

SEQ ID NO: 2591079 - DNA, 18 bp, Homo sapiens
atttccttaaactgtgtg

SEQ ID NO: 2591080 - DNA, 21 bp, Homo sapiens
atttcgccgttgaagaggaag

SEQ ID NO: 2591081 - DNA, 20 bp, Homo sapiens
atttcgtgggtctgttttcc

SEQ ID NO: 2591082 - DNA, 14 bp, Homo sapiens
atttctaaaaaaca

SEQ ID NO: 2591083 - DNA, 21 bp, Homo sapiens
atttctaaatctccaaaataa

SEQ ID NO: 2591084 - DNA, 17 bp, Homo sapiens
atttctaccatttcaga

SEQ ID NO: 2591085 - DNA, 16 bp, Homo sapiens
atttctaggaagaatt

SEQ ID NO: 2591086 - DNA, 22 bp, Homo sapiens
atttctaggaagaattttaaaa

SEQ ID NO: 2591087 - DNA, 14 bp, Homo sapiens
atttctatgagaaa

SEQ ID NO: 2591088 - DNA, 23 bp, Homo sapiens
atttctattcaaggtggccaaat

SEQ ID NO: 2591089 - DNA, 18 bp, Homo sapiens
atttctatttctcctcca

SEQ ID NO: 2591090 - DNA, 20 bp, Homo sapiens
atttctcaacaaagcacagt

SEQ ID NO: 2591091 - DNA, 22 bp, Homo sapiens
atttctcaacaaagcacagtgt

SEQ ID NO: 2591092 - DNA, 18 bp, Homo sapiens
atttctcagactttggaa

SEQ ID NO: 2591093 - DNA, 14 bp, Homo sapiens
atttctcatgtttt

SEQ ID NO: 2591094 - DNA, 20 bp, Homo sapiens
atttctcctccatgggagaa

SEQ ID NO: 2591095 - DNA, 20 bp, Homo sapiens
atttctgaaatgacctcaag

SEQ ID NO: 2591096 - DNA, 11 bp, Homo sapiens
atttctgagaa

SEQ ID NO: 2591097 - DNA, 17 bp, Homo sapiens
atttctgagaaggtcct

SEQ ID NO: 2591098 - DNA, 23 bp, Homo sapiens
atttctgagtttcattctcctgc

SEQ ID NO: 2591099 - DNA, 16 bp, Homo sapiens
atttctgcaggttctt

SEQ ID NO: 2591100 - DNA, 17 bp, Homo sapiens
atttctgccttccttgc

SEQ ID NO: 2591101 - DNA, 16 bp, Homo sapiens
atttctgtttagataa

SEQ ID NO: 2591102 - DNA, 19 bp, Homo sapiens
atttctgtttagataatac

SEQ ID NO: 2591103 - DNA, 20 bp, Homo sapiens
atttctgtttagataataca

SEQ ID NO: 2591104 - DNA, 14 bp, Homo sapiens
atttcttgggccct

SEQ ID NO: 2591105 - DNA, 15 bp, Homo sapiens
atttctttgcctgtt

SEQ ID NO: 2591106 - DNA, 14 bp, Homo sapiens
gggctggcccagcc

SEQ ID NO: 2591107 - DNA, 18 bp, Homo sapiens
gggctgggagctctgcag

SEQ ID NO: 2591108 - DNA, 22 bp, Homo sapiens
gggctgggttctacccaggtgc

SEQ ID NO: 2591109 - DNA, 17 bp, Homo sapiens
gggctggtagctcaggt

SEQ ID NO: 2591110 - DNA, 15 bp, Homo sapiens
gggctggtgccagcc

SEQ ID NO: 2591111 - DNA, 20 bp, Homo sapiens
gggctggtgccagccttcct

SEQ ID NO: 2591112 - DNA, 12 bp, Homo sapiens
gggctgtgatcg

SEQ ID NO: 2591113 - DNA, 16 bp, Homo sapiens
gggctgttggcactca

SEQ ID NO: 2591114 - DNA, 24 bp, Homo sapiens
gggcttagagcagtttctgtcctg

SEQ ID NO: 2591115 - DNA, 14 bp, Homo sapiens
gggcttcagtggca

SEQ ID NO: 2591116 - DNA, 16 bp, Homo sapiens
gggcttcagtggcagc

SEQ ID NO: 2591117 - DNA, 19 bp, Homo sapiens
gggcttcagtggcagctgc

SEQ ID NO: 2591118 - DNA, 21 bp, Homo sapiens
gggcttctgcaccctccaccc

SEQ ID NO: 2591119 - DNA, 23 bp, Homo sapiens
gggcttctgcaccctccaccctg

SEQ ID NO: 2591120 - DNA, 23 bp, Homo sapiens
gggcttgttgctgttgatgtttt

SEQ ID NO: 2591121 - DNA, 14 bp, Homo sapiens
gggctttctggaga

SEQ ID NO: 2591122 - DNA, 17 bp, Homo sapiens
ggggaaaatcagcctgc

SEQ ID NO: 2591123 - DNA, 13 bp, Homo sapiens
ggggaagggccag

SEQ ID NO: 2591124 - DNA, 23 bp, Homo sapiens
ggggaagggccagtctgggctgc

SEQ ID NO: 2591125 - DNA, 18 bp, Homo sapiens
ggggaatgtttgcctctg

SEQ ID NO: 2591126 - DNA, 15 bp, Homo sapiens
ggggaattcatctct

SEQ ID NO: 2591127 - DNA, 13 bp, Homo sapiens
ggggacagggatg

SEQ ID NO: 2591128 - DNA, 15 bp, Homo sapiens
ggggacagggctggc

SEQ ID NO: 2591129 - DNA, 19 bp, Homo sapiens
ttgtgaagaaaaataaagt

SEQ ID NO: 2591130 - DNA, 13 bp, Homo sapiens
ttgtgaaggcagg

SEQ ID NO: 2591131 - DNA, 13 bp, Homo sapiens
ttgtgaatggatt

SEQ ID NO: 2591132 - DNA, 14 bp, Homo sapiens
ttgtgaatggattg

SEQ ID NO: 2591133 - DNA, 19 bp, Homo sapiens
ttgtgaccttagtgtttct

SEQ ID NO: 2591134 - DNA, 14 bp, Homo sapiens
ttgtgactaattgt

SEQ ID NO: 2591135 - DNA, 20 bp, Homo sapiens
ttgtgactaattgtataaca

SEQ ID NO: 2591136 - DNA, 20 bp, Homo sapiens
acattctggctcagggaggt

SEQ ID NO: 2591137 - DNA, 23 bp, Homo sapiens
acattctgtcgccttagcatgtt

SEQ ID NO: 2591138 - DNA, 22 bp, Homo sapiens
acattcttataaatatgaagct

SEQ ID NO: 2591139 - DNA, 23 bp, Homo sapiens
acattcttataaatatgaagctc

SEQ ID NO: 2591140 - DNA, 17 bp, Homo sapiens
acattgggaaatcttat

SEQ ID NO: 2591141 - DNA, 23 bp, Homo sapiens
acattgggaaggggacccccgcc

SEQ ID NO: 2591142 - DNA, 16 bp, Homo sapiens
acattggtaagaatga

SEQ ID NO: 2591143 - DNA, 22 bp, Homo sapiens
acattggttcttgtattaagaa

SEQ ID NO: 2591144 - DNA, 13 bp, Homo sapiens
acattgtcaataa

SEQ ID NO: 2591145 - DNA, 14 bp, Homo sapiens
acattgtcaataaa

SEQ ID NO: 2591146 - DNA, 15 bp, Homo sapiens
acattgtcatttata

SEQ ID NO: 2591147 - DNA, 13 bp, Homo sapiens
acattgttttaaa

SEQ ID NO: 2591148 - DNA, 17 bp, Homo sapiens
acatttaaacttgtcag

SEQ ID NO: 2591149 - DNA, 22 bp, Homo sapiens
acatttaacttgtttccaatgt

SEQ ID NO: 2591150 - DNA, 20 bp, Homo sapiens
acatttaagagacagtcacc

SEQ ID NO: 2591151 - DNA, 21 bp, Homo sapiens
acatttacatgtattatttca

SEQ ID NO: 2591152 - DNA, 18 bp, Homo sapiens
acatttataatgtttgct

SEQ ID NO: 2591153 - DNA, 19 bp, Homo sapiens
acatttatgatttaataaa

SEQ ID NO: 2591154 - DNA, 22 bp, Homo sapiens
acatttatgatttaataaaata

SEQ ID NO: 2591155 - DNA, 12 bp, Homo sapiens
acatttctcaat

SEQ ID NO: 2591156 - DNA, 15 bp, Homo sapiens
acatttggagtgttc

SEQ ID NO: 2591157 - DNA, 20 bp, Homo sapiens
acattttaaataaaagaaaa

SEQ ID NO: 2591158 - DNA, 15 bp, Homo sapiens
acattttcacacaat

SEQ ID NO: 2591159 - DNA, 20 bp, Homo sapiens
acattttgtaacaaagaact

SEQ ID NO: 2591160 - DNA, 21 bp, Homo sapiens
acattttgtataattgtatcg

SEQ ID NO: 2591161 - DNA, 18 bp, Homo sapiens
acatttttaagtgctgca

SEQ ID NO: 2591162 - DNA, 15 bp, Homo sapiens
acatttttacaataa

SEQ ID NO: 2591163 - DNA, 13 bp, Homo sapiens
acatttttcttag

SEQ ID NO: 2591164 - DNA, 23 bp, Homo sapiens
acatttttcttagggaaggatac

SEQ ID NO: 2591165 - DNA, 12 bp, Homo sapiens
accaaaactgtg

SEQ ID NO: 2591166 - DNA, 15 bp, Homo sapiens
accaaaagaacaaga

SEQ ID NO: 2591167 - DNA, 13 bp, Homo sapiens
accaaaataagaa

SEQ ID NO: 2591168 - DNA, 16 bp, Homo sapiens
accaaaataagaaaag

SEQ ID NO: 2591169 - DNA, 16 bp, Homo sapiens
accaaaatccccttct

SEQ ID NO: 2591170 - DNA, 17 bp, Homo sapiens
accaaaatccccttctc

SEQ ID NO: 2591171 - DNA, 17 bp, Homo sapiens
accaaaattatttcaga

SEQ ID NO: 2591172 - DNA, 23 bp, Homo sapiens
accaaaccgccagcgaacttgac

SEQ ID NO: 2591173 - DNA, 18 bp, Homo sapiens
accaaagagactggagca

SEQ ID NO: 2591174 - DNA, 21 bp, Homo sapiens
accaaagagactggagcatct

SEQ ID NO: 2591175 - DNA, 20 bp, Homo sapiens
accaaagcaccttagctggc

SEQ ID NO: 2591176 - DNA, 14 bp, Homo sapiens
accaaagccaccag

SEQ ID NO: 2591177 - DNA, 13 bp, Homo sapiens
accaaaggccagg

SEQ ID NO: 2591178 - DNA, 16 bp, Homo sapiens
accaaatcagctgcta

SEQ ID NO: 2591179 - DNA, 19 bp, Homo sapiens
accaaatcagctgctacta

SEQ ID NO: 2591180 - DNA, 14 bp, Homo sapiens
accaacacgagcag

SEQ ID NO: 2591181 - DNA, 17 bp, Homo sapiens
accaaccctgtttcctg

SEQ ID NO: 2591182 - DNA, 19 bp, Homo sapiens
accaaccctgtttcctgag

SEQ ID NO: 2591183 - DNA, 17 bp, Homo sapiens
accaacgtctgtgccat

SEQ ID NO: 2591184 - DNA, 14 bp, Homo sapiens
accaactgggccca

SEQ ID NO: 2591185 - DNA, 14 bp, Homo sapiens
accaagaaagcagg

SEQ ID NO: 2591186 - DNA, 13 bp, Homo sapiens
accaagagagaaa

SEQ ID NO: 2591187 - DNA, 15 bp, Homo sapiens
accaagagagaaaga

SEQ ID NO: 2591188 - DNA, 13 bp, Homo sapiens
accaagcaggaag

SEQ ID NO: 2591189 - DNA, 15 bp, Homo sapiens
accaagcaggaagct

SEQ ID NO: 2591190 - DNA, 16 bp, Homo sapiens
accaagcaggaagctc

SEQ ID NO: 2591191 - DNA, 15 bp, Homo sapiens
accaagctatcctgg

SEQ ID NO: 2591192 - DNA, 15 bp, Homo sapiens
accaaggtcttcagc

SEQ ID NO: 2591193 - DNA, 23 bp, Homo sapiens
accaagtttcaggtattaagaaa

SEQ ID NO: 2591194 - DNA, 14 bp, Homo sapiens
accaatattgtaca

SEQ ID NO: 2591195 - DNA, 12 bp, Homo sapiens
accaatgtcttg

SEQ ID NO: 2591196 - DNA, 15 bp, Homo sapiens
accaatgttctctct

SEQ ID NO: 2591197 - DNA, 16 bp, Homo sapiens
accaattcaacccttt

SEQ ID NO: 2591198 - DNA, 14 bp, Homo sapiens
accaattgccaaag

SEQ ID NO: 2591199 - DNA, 20 bp, Homo sapiens
accacaaagcacagtttgaa

SEQ ID NO: 2591200 - DNA, 21 bp, Homo sapiens
accacaaggctgttgcatggg

SEQ ID NO: 2591201 - DNA, 16 bp, Homo sapiens
accacacccagcccac

SEQ ID NO: 2591202 - DNA, 16 bp, Homo sapiens
accacaccgcagaagc

SEQ ID NO: 2591203 - DNA, 16 bp, Homo sapiens
accacacctccctgaa

SEQ ID NO: 2591204 - DNA, 13 bp, Homo sapiens
accacactggact

SEQ ID NO: 2591205 - DNA, 16 bp, Homo sapiens
accacactggactccg

SEQ ID NO: 2591206 - DNA, 21 bp, Homo sapiens
accacactggactccggccct

SEQ ID NO: 2591207 - DNA, 13 bp, Homo sapiens
accacacttcctg

SEQ ID NO: 2591208 - DNA, 21 bp, Homo sapiens
accacacttcctgtccagaga

SEQ ID NO: 2591209 - DNA, 21 bp, Homo sapiens
accacagacatactaaccagc

SEQ ID NO: 2591210 - DNA, 21 bp, Homo sapiens
accacagcagctgaacagcca

SEQ ID NO: 2591211 - DNA, 14 bp, Homo sapiens
accacagccctgtc

SEQ ID NO: 2591212 - DNA, 12 bp, Homo sapiens
accacagctgct

SEQ ID NO: 2591213 - DNA, 13 bp, Homo sapiens
accacagctgctg

SEQ ID NO: 2591214 - DNA, 11 bp, Homo sapiens
accacagtgtc

SEQ ID NO: 2591215 - DNA, 20 bp, Homo sapiens
accacatcctccgtccagcc

SEQ ID NO: 2591216 - DNA, 16 bp, Homo sapiens
accacatcttgctctg

SEQ ID NO: 2591217 - DNA, 19 bp, Homo sapiens
accacatcttgctctgctg

SEQ ID NO: 2591218 - DNA, 19 bp, Homo sapiens
accacattttatatttatt

SEQ ID NO: 2591219 - DNA, 16 bp, Homo sapiens
accaccactggccacc

SEQ ID NO: 2591220 - DNA, 21 bp, Homo sapiens
accaccactggccaccaggct

SEQ ID NO: 2591221 - DNA, 13 bp, Homo sapiens
accacccctgcct

SEQ ID NO: 2591222 - DNA, 11 bp, Homo sapiens
accaccctccc

SEQ ID NO: 2591223 - DNA, 15 bp, Homo sapiens
accaccctcccctct

SEQ ID NO: 2591224 - DNA, 19 bp, Homo sapiens
accaggcaacttgggaact

SEQ ID NO: 2591225 - DNA, 16 bp, Homo sapiens
accaggccgtcctccc

SEQ ID NO: 2591226 - DNA, 12 bp, Homo sapiens
accaggcctggg

SEQ ID NO: 2591227 - DNA, 19 bp, Homo sapiens
accaggctgctcagggctg

SEQ ID NO: 2591228 - DNA, 16 bp, Homo sapiens
accaggctggcgcagc

SEQ ID NO: 2591229 - DNA, 17 bp, Homo sapiens
accaggctggcgcagcc

SEQ ID NO: 2591230 - DNA, 15 bp, Homo sapiens
accagggcagggcca

SEQ ID NO: 2591231 - DNA, 23 bp, Homo sapiens
accagggcgaacgacaatagctt

SEQ ID NO: 2591232 - DNA, 22 bp, Homo sapiens
accaggtcttggagctgagcct

SEQ ID NO: 2591233 - DNA, 14 bp, Homo sapiens
accagtgaaccaaa

SEQ ID NO: 2591234 - DNA, 17 bp, Homo sapiens
accagtgaaccaaagag

SEQ ID NO: 2591235 - DNA, 17 bp, Homo sapiens
accagtgcaacagcact

SEQ ID NO: 2591236 - DNA, 18 bp, Homo sapiens
accagtgcaacagcactg

SEQ ID NO: 2591237 - DNA, 23 bp, Homo sapiens
accagtgcccaaagtctgtgtga

SEQ ID NO: 2591238 - DNA, 21 bp, Homo sapiens
accagtgtagccttgcccgga

SEQ ID NO: 2591239 - DNA, 20 bp, Homo sapiens
accagtgtcccctccactgt

SEQ ID NO: 2591240 - DNA, 21 bp, Homo sapiens
accagtgtggtttgtgtttga

SEQ ID NO: 2591241 - DNA, 21 bp, Homo sapiens
accagttgggagcactggagt

SEQ ID NO: 2591242 - DNA, 16 bp, Homo sapiens
accatattaccacaga

SEQ ID NO: 2591243 - DNA, 20 bp, Homo sapiens
accatcagaaacaccctcac

SEQ ID NO: 2591244 - DNA, 22 bp, Homo sapiens
accatccctgaaggccccgccc

SEQ ID NO: 2591245 - DNA, 13 bp, Homo sapiens
accatctcaggcc

SEQ ID NO: 2591246 - DNA, 17 bp, Homo sapiens
accatctcaggccacct

SEQ ID NO: 2591247 - DNA, 14 bp, Homo sapiens
accatctctttacc

SEQ ID NO: 2591248 - DNA, 14 bp, Homo sapiens
accatgaaacaaag

SEQ ID NO: 2591249 - DNA, 23 bp, Homo sapiens
accatgaacagaaaacattctga

SEQ ID NO: 2591250 - DNA, 19 bp, Homo sapiens
accatgaagagatttttca

SEQ ID NO: 2591251 - DNA, 20 bp, Homo sapiens
accatgagaagagggcctgt

SEQ ID NO: 2591252 - DNA, 21 bp, Homo sapiens
accatgagaagagggcctgtg

SEQ ID NO: 2591253 - DNA, 23 bp, Homo sapiens
accatgagaataagagaaagaaa

SEQ ID NO: 2591254 - DNA, 23 bp, Homo sapiens
accatgattaaccacttcagctg

SEQ ID NO: 2591255 - DNA, 22 bp, Homo sapiens
accatggtcggaaaacatgcta

SEQ ID NO: 2591256 - DNA, 17 bp, Homo sapiens
accatgtagaaaatttg

SEQ ID NO: 2591257 - DNA, 15 bp, Homo sapiens
accatgtcactgtgg

SEQ ID NO: 2591258 - DNA, 12 bp, Homo sapiens
accattaaaact

SEQ ID NO: 2591259 - DNA, 21 bp, Homo sapiens
accattaaaactgaagtctga

SEQ ID NO: 2591260 - DNA, 18 bp, Homo sapiens
accattatgaagaagaga

SEQ ID NO: 2591261 - DNA, 13 bp, Homo sapiens
accattctccacc

SEQ ID NO: 2591262 - DNA, 16 bp, Homo sapiens
accattctccacctgc

SEQ ID NO: 2591263 - DNA, 14 bp, Homo sapiens
accatttcagagag

SEQ ID NO: 2591264 - DNA, 20 bp, Homo sapiens
accattttttaaggaaacaa

SEQ ID NO: 2591265 - DNA, 13 bp, Homo sapiens
acccaaaaggcag

SEQ ID NO: 2591266 - DNA, 18 bp, Homo sapiens
acccaaaaggcagaagca

SEQ ID NO: 2591267 - DNA, 18 bp, Homo sapiens
acccaaagaccaatattc

SEQ ID NO: 2591268 - DNA, 18 bp, Homo sapiens
acccaaagaggtatttat

SEQ ID NO: 2591269 - DNA, 15 bp, Homo sapiens
acccaaatcctctcc

SEQ ID NO: 2591270 - DNA, 17 bp, Homo sapiens
acccaaatcctctccag

SEQ ID NO: 2591271 - DNA, 20 bp, Homo sapiens
acccaaatgttcatcaatga

SEQ ID NO: 2591272 - DNA, 12 bp, Homo sapiens
acccaaccactc

SEQ ID NO: 2591273 - DNA, 22 bp, Homo sapiens
acccaagcttggcagccgagct

SEQ ID NO: 2591274 - DNA, 22 bp, Homo sapiens
acccaagggcctggcctgagct

SEQ ID NO: 2591275 - DNA, 23 bp, Homo sapiens
acccaagggcctggcctgagctg

SEQ ID NO: 2591276 - DNA, 20 bp, Homo sapiens
acccaatgcacacaaaacaa

SEQ ID NO: 2591277 - DNA, 15 bp, Homo sapiens
acccacaagaaatga

SEQ ID NO: 2591278 - DNA, 17 bp, Homo sapiens
acccacaagtgccactg

SEQ ID NO: 2591279 - DNA, 13 bp, Homo sapiens
acccacctcagcc

SEQ ID NO: 2591280 - DNA, 21 bp, Homo sapiens
acccaccttgttggagcctgc

SEQ ID NO: 2591281 - DNA, 22 bp, Homo sapiens
acccaccttgttggagcctgca

SEQ ID NO: 2591282 - DNA, 10 bp, Homo sapiens
acccactgct

SEQ ID NO: 2591283 - DNA, 15 bp, Homo sapiens
acccagacagctccc

SEQ ID NO: 2591284 - DNA, 19 bp, Homo sapiens
acccagagaagccccttcc

SEQ ID NO: 2591285 - DNA, 18 bp, Homo sapiens
acccagagaatatataca

SEQ ID NO: 2591286 - DNA, 16 bp, Homo sapiens
acccagccccttgaga

SEQ ID NO: 2591287 - DNA, 15 bp, Homo sapiens
acccagccctcatcc

SEQ ID NO: 2591288 - DNA, 15 bp, Homo sapiens
acccagccctggtct

SEQ ID NO: 2591289 - DNA, 19 bp, Homo sapiens
acccagccctggtctcagc

SEQ ID NO: 2591290 - DNA, 17 bp, Homo sapiens
acccagcgagccctggt

SEQ ID NO: 2591291 - DNA, 15 bp, Homo sapiens
acccaggagccccga

SEQ ID NO: 2591292 - DNA, 19 bp, Homo sapiens
acccaggagccccgaggcc

SEQ ID NO: 2591293 - DNA, 15 bp, Homo sapiens
acccaggccgcagct

SEQ ID NO: 2591294 - DNA, 22 bp, Homo sapiens
acccaggccgcagctcttgccc

SEQ ID NO: 2591295 - DNA, 20 bp, Homo sapiens
acccaggctggagtgcaatg

SEQ ID NO: 2591296 - DNA, 13 bp, Homo sapiens
acccaggctgggc

SEQ ID NO: 2591297 - DNA, 20 bp, Homo sapiens
acccaggctgggcaaggagg

SEQ ID NO: 2591298 - DNA, 23 bp, Homo sapiens
acccaggtgctaggaacactcct

SEQ ID NO: 2591299 - DNA, 16 bp, Homo sapiens
acccagtccacaaaat

SEQ ID NO: 2591300 - DNA, 16 bp, Homo sapiens
acccagtctgttcccc

SEQ ID NO: 2591301 - DNA, 11 bp, Homo sapiens
acccatatccc

SEQ ID NO: 2591302 - DNA, 15 bp, Homo sapiens
acccatatcccctct

SEQ ID NO: 2591303 - DNA, 18 bp, Homo sapiens
acccatcacgcctgtgca

SEQ ID NO: 2591304 - DNA, 21 bp, Homo sapiens
acccatcctaccaatgcatgc

SEQ ID NO: 2591305 - DNA, 18 bp, Homo sapiens
acccatctgttttttgta

SEQ ID NO: 2591306 - DNA, 19 bp, Homo sapiens
acccatgaagacaggacag

SEQ ID NO: 2591307 - DNA, 17 bp, Homo sapiens
acccatgaatcaaagac

SEQ ID NO: 2591308 - DNA, 18 bp, Homo sapiens
acccatgatgagctcctc

SEQ ID NO: 2591309 - DNA, 18 bp, Homo sapiens
acccatgctgccctgtga

SEQ ID NO: 2591310 - DNA, 19 bp, Homo sapiens
acccatgctgccctgtgag

SEQ ID NO: 2591311 - DNA, 16 bp, Homo sapiens
acccatgggctctgac

SEQ ID NO: 2591312 - DNA, 17 bp, Homo sapiens
acccatgggctctgaca

SEQ ID NO: 2591313 - DNA, 17 bp, Homo sapiens
acccatgtgccaaggtg

SEQ ID NO: 2591314 - DNA, 19 bp, Homo sapiens
acccattctacacagagca

SEQ ID NO: 2591315 - DNA, 23 bp, Homo sapiens
accccaaacaccttccagctcct

SEQ ID NO: 2591316 - DNA, 14 bp, Homo sapiens
accccaaagagcct

SEQ ID NO: 2591317 - DNA, 18 bp, Homo sapiens
accccaaagccccttgct

SEQ ID NO: 2591318 - DNA, 16 bp, Homo sapiens
accctgtcccccagct

SEQ ID NO: 2591319 - DNA, 21 bp, Homo sapiens
accctgtctctactaaaaata

SEQ ID NO: 2591320 - DNA, 17 bp, Homo sapiens
accctgtgatggggccc

SEQ ID NO: 2591321 - DNA, 19 bp, Homo sapiens
accctgtgatggggccctg

SEQ ID NO: 2591322 - DNA, 21 bp, Homo sapiens
accctgtgatggggccctgcc

SEQ ID NO: 2591323 - DNA, 14 bp, Homo sapiens
accctgtgctggtg

SEQ ID NO: 2591324 - DNA, 14 bp, Homo sapiens
accctgtttcctga

SEQ ID NO: 2591325 - DNA, 13 bp, Homo sapiens
acccttacagtag

SEQ ID NO: 2591326 - DNA, 19 bp, Homo sapiens
acccttacagtaggagccc

SEQ ID NO: 2591327 - DNA, 18 bp, Homo sapiens
acccttaccatgtgcctg

SEQ ID NO: 2591328 - DNA, 23 bp, Homo sapiens
acccttatcaccagctgcctctt

SEQ ID NO: 2591329 - DNA, 18 bp, Homo sapiens
acccttctttcctcttcc

SEQ ID NO: 2591330 - DNA, 17 bp, Homo sapiens
acccttgtggtcccacc

SEQ ID NO: 2591331 - DNA, 23 bp, Homo sapiens
acccttttggcccccgagctggg

SEQ ID NO: 2591332 - DNA, 14 bp, Homo sapiens
acccttttgtctgc

SEQ ID NO: 2591333 - DNA, 17 bp, Homo sapiens
accgaaacagcgctggg

SEQ ID NO: 2591334 - DNA, 20 bp, Homo sapiens
accgaagtggactggcccct

SEQ ID NO: 2591335 - DNA, 16 bp, Homo sapiens
accgacgcgtctcctg

SEQ ID NO: 2591336 - DNA, 17 bp, Homo sapiens
accgacgcgtctcctgt

SEQ ID NO: 2591337 - DNA, 17 bp, Homo sapiens
accgagcaaagatcaaa

SEQ ID NO: 2591338 - DNA, 18 bp, Homo sapiens
accgagcgctttctggaa

SEQ ID NO: 2591339 - DNA, 20 bp, Homo sapiens
accgagcgctttctggaaaa

SEQ ID NO: 2591340 - DNA, 17 bp, Homo sapiens
accgaggggctcaggaa

SEQ ID NO: 2591341 - DNA, 19 bp, Homo sapiens
accgaggggctcaggaaaa

SEQ ID NO: 2591342 - DNA, 16 bp, Homo sapiens
accgcaggaagctgct

SEQ ID NO: 2591343 - DNA, 17 bp, Homo sapiens
accgccaaggctggggg

SEQ ID NO: 2591344 - DNA, 17 bp, Homo sapiens
accgccacatggcttcc

SEQ ID NO: 2591345 - DNA, 20 bp, Homo sapiens
accgccagatggggcctctg

SEQ ID NO: 2591346 - DNA, 11 bp, Homo sapiens
accgccccctc

SEQ ID NO: 2591347 - DNA, 13 bp, Homo sapiens
accgctccccagc

SEQ ID NO: 2591348 - DNA, 17 bp, Homo sapiens
accgctgattctcaggg

SEQ ID NO: 2591349 - DNA, 18 bp, Homo sapiens
accggctggcctggcccc

SEQ ID NO: 2591350 - DNA, 19 bp, Homo sapiens
accggctttaccaaaccgc

SEQ ID NO: 2591351 - DNA, 16 bp, Homo sapiens
accgggcactcagaag

SEQ ID NO: 2591352 - DNA, 15 bp, Homo sapiens
accgggccacagaga

SEQ ID NO: 2591353 - DNA, 22 bp, Homo sapiens
accgggccagtatctatatatg

SEQ ID NO: 2591354 - DNA, 16 bp, Homo sapiens
accgggccgctagatg

SEQ ID NO: 2591355 - DNA, 23 bp, Homo sapiens
accgggctgggagctctgcagag

SEQ ID NO: 2591356 - DNA, 23 bp, Homo sapiens
accgtcatggcttaatgtttatt

SEQ ID NO: 2591357 - DNA, 14 bp, Homo sapiens
accgtccgccctgc

SEQ ID NO: 2591358 - DNA, 17 bp, Homo sapiens
accgtgggcggggcctt

SEQ ID NO: 2591359 - DNA, 14 bp, Homo sapiens
accgtgtaaaccaa

SEQ ID NO: 2591360 - DNA, 21 bp, Homo sapiens
accgtgttggttttgactgga

SEQ ID NO: 2591361 - DNA, 13 bp, Homo sapiens
acctaaaagagat

SEQ ID NO: 2591362 - DNA, 21 bp, Homo sapiens
acctaaaagagatttcaagag

SEQ ID NO: 2591363 - DNA, 21 bp, Homo sapiens
acctaaaaggaaatctcaccc

SEQ ID NO: 2591364 - DNA, 18 bp, Homo sapiens
acctaacattatttattc

SEQ ID NO: 2591365 - DNA, 19 bp, Homo sapiens
acctaacgccctatttttg

SEQ ID NO: 2591366 - DNA, 12 bp, Homo sapiens
acctaatgttta

SEQ ID NO: 2591367 - DNA, 15 bp, Homo sapiens
acctacagtgtacag

SEQ ID NO: 2591368 - DNA, 17 bp, Homo sapiens
acctacagtgtacagtc

SEQ ID NO: 2591369 - DNA, 14 bp, Homo sapiens
acctaccaaaaaat

SEQ ID NO: 2591370 - DNA, 19 bp, Homo sapiens
acctaccacagtgtctgta

SEQ ID NO: 2591371 - DNA, 18 bp, Homo sapiens
acctaccaccccttcctg

SEQ ID NO: 2591372 - DNA, 14 bp, Homo sapiens
acctaccatcaggg

SEQ ID NO: 2591373 - DNA, 13 bp, Homo sapiens
acctacctcaggt

SEQ ID NO: 2591374 - DNA, 14 bp, Homo sapiens
acctacctcaggtt

SEQ ID NO: 2591375 - DNA, 20 bp, Homo sapiens
acctacctcaggttgctggt

SEQ ID NO: 2591376 - DNA, 20 bp, Homo sapiens
acctactttgactttttgca

SEQ ID NO: 2591377 - DNA, 21 bp, Homo sapiens
acctactttgactttttgcat

SEQ ID NO: 2591378 - DNA, 14 bp, Homo sapiens
acctagttttccat

SEQ ID NO: 2591379 - DNA, 19 bp, Homo sapiens
acctataaagtaaagctaa

SEQ ID NO: 2591380 - DNA, 15 bp, Homo sapiens
acctatagtcccagc

SEQ ID NO: 2591381 - DNA, 13 bp, Homo sapiens
acctatatgattt

SEQ ID NO: 2591382 - DNA, 17 bp, Homo sapiens
acctatatgatttatag

SEQ ID NO: 2591383 - DNA, 15 bp, Homo sapiens
acctatctcgtggga

SEQ ID NO: 2591384 - DNA, 17 bp, Homo sapiens
acctatctcgtgggaga

SEQ ID NO: 2591385 - DNA, 18 bp, Homo sapiens
acctatctcgtgggagag

SEQ ID NO: 2591386 - DNA, 16 bp, Homo sapiens
acctattcctcctggg

SEQ ID NO: 2591387 - DNA, 21 bp, Homo sapiens
acctattttgaaaaattccta

SEQ ID NO: 2591388 - DNA, 21 bp, Homo sapiens
acctcaacccccatttctatt

SEQ ID NO: 2591389 - DNA, 20 bp, Homo sapiens
acctcaagggggactgtctt

SEQ ID NO: 2591390 - DNA, 12 bp, Homo sapiens
acctcaccctgc

SEQ ID NO: 2591391 - DNA, 15 bp, Homo sapiens
acctcacgcacctcc

SEQ ID NO: 2591392 - DNA, 17 bp, Homo sapiens
acctcacgcacctccca

SEQ ID NO: 2591393 - DNA, 18 bp, Homo sapiens
acctcacgcacctcccat

SEQ ID NO: 2591394 - DNA, 19 bp, Homo sapiens
acctcacgcacctcccatc

SEQ ID NO: 2591395 - DNA, 14 bp, Homo sapiens
acctcactcctgtt

SEQ ID NO: 2591396 - DNA, 21 bp, Homo sapiens
acctcactggggtcctggggc

SEQ ID NO: 2591397 - DNA, 20 bp, Homo sapiens
acctcagagtccaggcccca

SEQ ID NO: 2591398 - DNA, 11 bp, Homo sapiens
acctcagcctc

SEQ ID NO: 2591399 - DNA, 17 bp, Homo sapiens
acctcagcctgtgctgc

SEQ ID NO: 2591400 - DNA, 15 bp, Homo sapiens
acctcagctctggga

SEQ ID NO: 2591401 - DNA, 18 bp, Homo sapiens
acctcagctctgggagag

SEQ ID NO: 2591402 - DNA, 22 bp, Homo sapiens
acctcagctctgggagaggatt

SEQ ID NO: 2591403 - DNA, 15 bp, Homo sapiens
acctcaggcagctca

SEQ ID NO: 2591404 - DNA, 16 bp, Homo sapiens
acctcaggcagctcaa

SEQ ID NO: 2591405 - DNA, 12 bp, Homo sapiens
acctcaggcagg

SEQ ID NO: 2591406 - DNA, 20 bp, Homo sapiens
acctcaggccaggtgcagtg

SEQ ID NO: 2591407 - DNA, 18 bp, Homo sapiens
acctcaggtgagaagcag

SEQ ID NO: 2591408 - DNA, 16 bp, Homo sapiens
acctcaggttgctggt

SEQ ID NO: 2591409 - DNA, 19 bp, Homo sapiens
acctcagtgtcatttatga

SEQ ID NO: 2591410 - DNA, 18 bp, Homo sapiens
acctcagttttatcattt

SEQ ID NO: 2591411 - DNA, 14 bp, Homo sapiens
acctcatcaggatg

SEQ ID NO: 2591412 - DNA, 18 bp, Homo sapiens
acctcatcaggatgaacc

SEQ ID NO: 2591413 - DNA, 16 bp, Homo sapiens
acctcatgcatctcca

SEQ ID NO: 2591414 - DNA, 18 bp, Homo sapiens
acctcatgcatctccacc

SEQ ID NO: 2591415 - DNA, 17 bp, Homo sapiens
acctcattgacaagaac

SEQ ID NO: 2591416 - DNA, 21 bp, Homo sapiens
acctccaaaactcctgcccct

SEQ ID NO: 2591417 - DNA, 12 bp, Homo sapiens
acctccacagct

SEQ ID NO: 2591418 - DNA, 14 bp, Homo sapiens
acctccacagcttc

SEQ ID NO: 2591419 - DNA, 18 bp, Homo sapiens
acctccacagttcagtgg

SEQ ID NO: 2591420 - DNA, 14 bp, Homo sapiens
acctccacatcctc

SEQ ID NO: 2591421 - DNA, 20 bp, Homo sapiens
acctcccacaaaggagagct

SEQ ID NO: 2591422 - DNA, 13 bp, Homo sapiens
acctccccagcct

SEQ ID NO: 2591423 - DNA, 19 bp, Homo sapiens
acctccccctcccccttct

SEQ ID NO: 2591424 - DNA, 19 bp, Homo sapiens
acctcccctccttgcctcc

SEQ ID NO: 2591425 - DNA, 21 bp, Homo sapiens
acctcccctccttgcctcctg

SEQ ID NO: 2591426 - DNA, 15 bp, Homo sapiens
acctccctcccggca

SEQ ID NO: 2591427 - DNA, 13 bp, Homo sapiens
acctccctgaccc

SEQ ID NO: 2591428 - DNA, 23 bp, Homo sapiens
acctcctacgtcaaacatgaagt

SEQ ID NO: 2591429 - DNA, 13 bp, Homo sapiens
acctcctctgtga

SEQ ID NO: 2591430 - DNA, 18 bp, Homo sapiens
acctcctctgtgaagcat

SEQ ID NO: 2591431 - DNA, 16 bp, Homo sapiens
acctcctcttctgacg

SEQ ID NO: 2591432 - DNA, 15 bp, Homo sapiens
acctcctgtctctgg

SEQ ID NO: 2591433 - DNA, 16 bp, Homo sapiens
acctcctttctcttct

SEQ ID NO: 2591434 - DNA, 18 bp, Homo sapiens
acctcctttctcttctct

SEQ ID NO: 2591435 - DNA, 20 bp, Homo sapiens
acctcctttctcttctctgt

SEQ ID NO: 2591436 - DNA, 16 bp, Homo sapiens
acctcgctggactctc

SEQ ID NO: 2591437 - DNA, 17 bp, Homo sapiens
acctcggtgccttcctc

SEQ ID NO: 2591438 - DNA, 13 bp, Homo sapiens
acctctccaaggg

SEQ ID NO: 2591439 - DNA, 20 bp, Homo sapiens
acctctccaagggcttctgc

SEQ ID NO: 2591440 - DNA, 23 bp, Homo sapiens
acctctccatcttcagcttcttc

SEQ ID NO: 2591441 - DNA, 14 bp, Homo sapiens
acctctcccttgga

SEQ ID NO: 2591442 - DNA, 14 bp, Homo sapiens
acctctcctcatgt

SEQ ID NO: 2591443 - DNA, 23 bp, Homo sapiens
acctctctcctttgctgaggcct

SEQ ID NO: 2591444 - DNA, 23 bp, Homo sapiens
acctctcttatagaatatttatt

SEQ ID NO: 2591445 - DNA, 20 bp, Homo sapiens
acctctgaaaacggccctct

SEQ ID NO: 2591446 - DNA, 15 bp, Homo sapiens
acctctgatacctca

SEQ ID NO: 2591447 - DNA, 21 bp, Homo sapiens
acctctgcagcaataaagcag

SEQ ID NO: 2591448 - DNA, 12 bp, Homo sapiens
acctctgcctga

SEQ ID NO: 2591449 - DNA, 16 bp, Homo sapiens
acctctggactggcta

SEQ ID NO: 2591450 - DNA, 19 bp, Homo sapiens
acctctgtcttggctttca

SEQ ID NO: 2591451 - DNA, 17 bp, Homo sapiens
acctctgttcagtgtaa

SEQ ID NO: 2591452 - DNA, 22 bp, Homo sapiens
acctctgttcagtgtaaatagt

SEQ ID NO: 2591453 - DNA, 16 bp, Homo sapiens
acctctgttgtcctcc

SEQ ID NO: 2591454 - DNA, 15 bp, Homo sapiens
acctcttagctgagt

SEQ ID NO: 2591455 - DNA, 16 bp, Homo sapiens
acctcttctcttcctg

SEQ ID NO: 2591456 - DNA, 21 bp, Homo sapiens
acctgaaaaaaagtttacaag

SEQ ID NO: 2591457 - DNA, 19 bp, Homo sapiens
acctgaaaacactgtgcac

SEQ ID NO: 2591458 - DNA, 23 bp, Homo sapiens
acctgaagagtggtcagaacaga

SEQ ID NO: 2591459 - DNA, 16 bp, Homo sapiens
acctgacaagcactgc

SEQ ID NO: 2591460 - DNA, 15 bp, Homo sapiens
acctgacccctgctc

SEQ ID NO: 2591461 - DNA, 17 bp, Homo sapiens
acctgacccctgctcag

SEQ ID NO: 2591462 - DNA, 14 bp, Homo sapiens
acctgaccgtgggc

SEQ ID NO: 2591463 - DNA, 20 bp, Homo sapiens
acctgactattgaagttgca

SEQ ID NO: 2591464 - DNA, 20 bp, Homo sapiens
acctgagctagaagctggag

SEQ ID NO: 2591465 - DNA, 23 bp, Homo sapiens
acctgaggcccttctctccagcc

SEQ ID NO: 2591466 - DNA, 16 bp, Homo sapiens
acctgaggggcctctt

SEQ ID NO: 2591467 - DNA, 14 bp, Homo sapiens
acctgaggtgggcc

SEQ ID NO: 2591468 - DNA, 18 bp, Homo sapiens
acctgaggtgggcccagg

SEQ ID NO: 2591469 - DNA, 19 bp, Homo sapiens
acctgaggtgggcccagga

SEQ ID NO: 2591470 - DNA, 21 bp, Homo sapiens
acctgaggtgggcccaggacc

SEQ ID NO: 2591471 - DNA, 21 bp, Homo sapiens
acctgagtcgtacagaaagct

SEQ ID NO: 2591472 - DNA, 16 bp, Homo sapiens
acctgatcaatgacag

SEQ ID NO: 2591473 - DNA, 17 bp, Homo sapiens
acctgatcaatgacaga

SEQ ID NO: 2591474 - DNA, 13 bp, Homo sapiens
acctgatgtgtac

SEQ ID NO: 2591475 - DNA, 11 bp, Homo sapiens
acctgattcaa

SEQ ID NO: 2591476 - DNA, 15 bp, Homo sapiens
acctgattgtgtctc

SEQ ID NO: 2591477 - DNA, 13 bp, Homo sapiens
acctgcaaaaaat

SEQ ID NO: 2591478 - DNA, 18 bp, Homo sapiens
acctgcaagggctcccca

SEQ ID NO: 2591479 - DNA, 14 bp, Homo sapiens
acctgccactcaca

SEQ ID NO: 2591480 - DNA, 16 bp, Homo sapiens
acctgccactcacaca

SEQ ID NO: 2591481 - DNA, 15 bp, Homo sapiens
acctgccagcctggc

SEQ ID NO: 2591482 - DNA, 18 bp, Homo sapiens
acctgccagggagacaga

SEQ ID NO: 2591483 - DNA, 19 bp, Homo sapiens
acctgccatttgcaccctc

SEQ ID NO: 2591484 - DNA, 13 bp, Homo sapiens
acctgcccaacct

SEQ ID NO: 2591485 - DNA, 21 bp, Homo sapiens
acctgcccaacctgctctcct

SEQ ID NO: 2591486 - DNA, 16 bp, Homo sapiens
acctgcccccaatcca

SEQ ID NO: 2591487 - DNA, 13 bp, Homo sapiens
acctgccccctgg

SEQ ID NO: 2591488 - DNA, 23 bp, Homo sapiens
acctgcccccttctcccacactg

SEQ ID NO: 2591489 - DNA, 18 bp, Homo sapiens
acctgccctgcctgaggg

SEQ ID NO: 2591490 - DNA, 19 bp, Homo sapiens
acctgccctgcctgagggc

SEQ ID NO: 2591491 - DNA, 13 bp, Homo sapiens
acctgcctgggtt

SEQ ID NO: 2591492 - DNA, 18 bp, Homo sapiens
acctgcggtgctatctcc

SEQ ID NO: 2591493 - DNA, 21 bp, Homo sapiens
acctgctagacacatttttaa

SEQ ID NO: 2591494 - DNA, 17 bp, Homo sapiens
acctgctctcctcttgc

SEQ ID NO: 2591495 - DNA, 18 bp, Homo sapiens
acctgctctcctcttgcc

SEQ ID NO: 2591496 - DNA, 19 bp, Homo sapiens
acctgctgagggaccagcc

SEQ ID NO: 2591497 - DNA, 23 bp, Homo sapiens
acctgctgagggaccagccaaga

SEQ ID NO: 2591498 - DNA, 13 bp, Homo sapiens
acctgctggcccc

SEQ ID NO: 2591499 - DNA, 19 bp, Homo sapiens
acctgcttcatgctcagcc

SEQ ID NO: 2591500 - DNA, 12 bp, Homo sapiens
accccctggaga

SEQ ID NO: 2591501 - DNA, 16 bp, Homo sapiens
acccccttctctgctc

SEQ ID NO: 2591502 - DNA, 23 bp, Homo sapiens
acccccttctctgctccaccaca

SEQ ID NO: 2591503 - DNA, 18 bp, Homo sapiens
accccctttgtgctgtgg

SEQ ID NO: 2591504 - DNA, 21 bp, Homo sapiens
accccgctctgcatgcggccc

SEQ ID NO: 2591505 - DNA, 15 bp, Homo sapiens
accccgggctctctg

SEQ ID NO: 2591506 - DNA, 16 bp, Homo sapiens
acccctacatgaaaca

SEQ ID NO: 2591507 - DNA, 20 bp, Homo sapiens
acccctcacaggagcttact

SEQ ID NO: 2591508 - DNA, 16 bp, Homo sapiens
acccctcaccttgcaa

SEQ ID NO: 2591509 - DNA, 23 bp, Homo sapiens
acccctcaccttgcaacacacag

SEQ ID NO: 2591510 - DNA, 18 bp, Homo sapiens
acccctcactctggcctc

SEQ ID NO: 2591511 - DNA, 12 bp, Homo sapiens
acccctccagga

SEQ ID NO: 2591512 - DNA, 16 bp, Homo sapiens
acccctccatgtgggc

SEQ ID NO: 2591513 - DNA, 19 bp, Homo sapiens
acccctccatgtgggctag

SEQ ID NO: 2591514 - DNA, 19 bp, Homo sapiens
acccctcccattaggacaa

SEQ ID NO: 2591515 - DNA, 17 bp, Homo sapiens
acccctccttccttgac

SEQ ID NO: 2591516 - DNA, 20 bp, Homo sapiens
acccctccttccttgaccag

SEQ ID NO: 2591517 - DNA, 15 bp, Homo sapiens
acccctctggccagg

SEQ ID NO: 2591518 - DNA, 15 bp, Homo sapiens
acccctgatctgaca

SEQ ID NO: 2591519 - DNA, 13 bp, Homo sapiens
acccctgcctcca

SEQ ID NO: 2591520 - DNA, 17 bp, Homo sapiens
acccctgcctccaccct

SEQ ID NO: 2591521 - DNA, 20 bp, Homo sapiens
acccctgcctccaccctctg

SEQ ID NO: 2591522 - DNA, 21 bp, Homo sapiens
acccctgcctccaccctctga

SEQ ID NO: 2591523 - DNA, 22 bp, Homo sapiens
acccctgcctccaccctctgag

SEQ ID NO: 2591524 - DNA, 14 bp, Homo sapiens
acccctggcctccg

SEQ ID NO: 2591525 - DNA, 21 bp, Homo sapiens
acccctgtgctccgtgcctcc

SEQ ID NO: 2591526 - DNA, 19 bp, Homo sapiens
acccctgtggagcccgcac

SEQ ID NO: 2591527 - DNA, 14 bp, Homo sapiens
accccttagcctcc

SEQ ID NO: 2591528 - DNA, 16 bp, Homo sapiens
accccttatccaggac

SEQ ID NO: 2591529 - DNA, 16 bp, Homo sapiens
accccttccccactgc

SEQ ID NO: 2591530 - DNA, 20 bp, Homo sapiens
accccttccccactgcctgc

SEQ ID NO: 2591531 - DNA, 13 bp, Homo sapiens
acccgaggaaact

SEQ ID NO: 2591532 - DNA, 14 bp, Homo sapiens
acccgaggctgccc

SEQ ID NO: 2591533 - DNA, 14 bp, Homo sapiens
acccgatgctgctt

SEQ ID NO: 2591534 - DNA, 23 bp, Homo sapiens
acccgatgctgctttcccctgtg

SEQ ID NO: 2591535 - DNA, 13 bp, Homo sapiens
acccgcctctccc

SEQ ID NO: 2591536 - DNA, 15 bp, Homo sapiens
acccggaggccacat

SEQ ID NO: 2591537 - DNA, 19 bp, Homo sapiens
acccggaggccacatgagt

SEQ ID NO: 2591538 - DNA, 15 bp, Homo sapiens
acccggcccctgctg

SEQ ID NO: 2591539 - DNA, 16 bp, Homo sapiens
acccggcccctgctgg

SEQ ID NO: 2591540 - DNA, 21 bp, Homo sapiens
acccggcggtcccctccgcca

SEQ ID NO: 2591541 - DNA, 13 bp, Homo sapiens
acccgggaagggg

SEQ ID NO: 2591542 - DNA, 21 bp, Homo sapiens
acccgggaggcggagcttgca

SEQ ID NO: 2591543 - DNA, 14 bp, Homo sapiens
acccgtccagacct

SEQ ID NO: 2591544 - DNA, 20 bp, Homo sapiens
acccgttctgctggcctgga

SEQ ID NO: 2591545 - DNA, 23 bp, Homo sapiens
acccgttctgctggcctggatct

SEQ ID NO: 2591546 - DNA, 16 bp, Homo sapiens
accctaaatcttgact

SEQ ID NO: 2591547 - DNA, 16 bp, Homo sapiens
accctaagcctccttt

SEQ ID NO: 2591548 - DNA, 22 bp, Homo sapiens
accctaaggtcattaccacagg

SEQ ID NO: 2591549 - DNA, 13 bp, Homo sapiens
accctacctgtgc

SEQ ID NO: 2591550 - DNA, 13 bp, Homo sapiens
accctacctgttc

SEQ ID NO: 2591551 - DNA, 14 bp, Homo sapiens
accctacttctttt

SEQ ID NO: 2591552 - DNA, 16 bp, Homo sapiens
accctagccattcctg

SEQ ID NO: 2591553 - DNA, 17 bp, Homo sapiens
accctagccattcctgg

SEQ ID NO: 2591554 - DNA, 22 bp, Homo sapiens
accctagtcccttcccctccct

SEQ ID NO: 2591555 - DNA, 19 bp, Homo sapiens
accctattgctgcttgagg

SEQ ID NO: 2591556 - DNA, 16 bp, Homo sapiens
accctcagcacccctt

SEQ ID NO: 2591557 - DNA, 18 bp, Homo sapiens
accctcagcaccccttcc

SEQ ID NO: 2591558 - DNA, 22 bp, Homo sapiens
accctcagcaccccttccatgt

SEQ ID NO: 2591559 - DNA, 13 bp, Homo sapiens
accctcaggcagg

SEQ ID NO: 2591560 - DNA, 16 bp, Homo sapiens
accctcaggcaggtgg

SEQ ID NO: 2591561 - DNA, 23 bp, Homo sapiens
accctcatcaccaacgtctgtgc

SEQ ID NO: 2591562 - DNA, 15 bp, Homo sapiens
accctcatgttctta

SEQ ID NO: 2591563 - DNA, 13 bp, Homo sapiens
accctccaccctg

SEQ ID NO: 2591564 - DNA, 16 bp, Homo sapiens
accctccaccctgtcc

SEQ ID NO: 2591565 - DNA, 12 bp, Homo sapiens
accctcccaccc

SEQ ID NO: 2591566 - DNA, 14 bp, Homo sapiens
accctcccaccccc

SEQ ID NO: 2591567 - DNA, 19 bp, Homo sapiens
accctccctcagcccctct

SEQ ID NO: 2591568 - DNA, 22 bp, Homo sapiens
accctccctccgatccttcctc

SEQ ID NO: 2591569 - DNA, 13 bp, Homo sapiens
accctccctggag

SEQ ID NO: 2591570 - DNA, 13 bp, Homo sapiens
accctcctggctc

SEQ ID NO: 2591571 - DNA, 11 bp, Homo sapiens
accctcctgtt

SEQ ID NO: 2591572 - DNA, 19 bp, Homo sapiens
accctcctgttgcacccag

SEQ ID NO: 2591573 - DNA, 20 bp, Homo sapiens
accctcctgttgcacccagc

SEQ ID NO: 2591574 - DNA, 21 bp, Homo sapiens
accctcctgttgcacccagcc

SEQ ID NO: 2591575 - DNA, 22 bp, Homo sapiens
accctcctgttgcacccagccc

SEQ ID NO: 2591576 - DNA, 13 bp, Homo sapiens
accctcgggccca

SEQ ID NO: 2591577 - DNA, 14 bp, Homo sapiens
accctcgggcccac

SEQ ID NO: 2591578 - DNA, 19 bp, Homo sapiens
accctcgggcccacctggc

SEQ ID NO: 2591579 - DNA, 20 bp, Homo sapiens
accctcgtggccttccccag

SEQ ID NO: 2591580 - DNA, 16 bp, Homo sapiens
accctctcagctccag

SEQ ID NO: 2591581 - DNA, 15 bp, Homo sapiens
accctctcccaggac

SEQ ID NO: 2591582 - DNA, 13 bp, Homo sapiens
accctctgagctt

SEQ ID NO: 2591583 - DNA, 18 bp, Homo sapiens
accctctgagctttgcat

SEQ ID NO: 2591584 - DNA, 21 bp, Homo sapiens
accctctgagctttgcatgtt

SEQ ID NO: 2591585 - DNA, 14 bp, Homo sapiens
accctcttagaaaa

SEQ ID NO: 2591586 - DNA, 16 bp, Homo sapiens
accctgaaagccctga

SEQ ID NO: 2591587 - DNA, 18 bp, Homo sapiens
accctgaaagccctgagc

SEQ ID NO: 2591588 - DNA, 22 bp, Homo sapiens
accctgaatggttccatgcctg

SEQ ID NO: 2591589 - DNA, 16 bp, Homo sapiens
accctgagccccttcc

SEQ ID NO: 2591590 - DNA, 11 bp, Homo sapiens
accctgaggcc

SEQ ID NO: 2591591 - DNA, 15 bp, Homo sapiens
accctgaggcccaga

SEQ ID NO: 2591592 - DNA, 19 bp, Homo sapiens
accctgaggcccagagggc

SEQ ID NO: 2591593 - DNA, 18 bp, Homo sapiens
accctgcaaaggactgtt

SEQ ID NO: 2591594 - DNA, 13 bp, Homo sapiens
accctgcccctgc

SEQ ID NO: 2591595 - DNA, 11 bp, Homo sapiens
accctgccctg

SEQ ID NO: 2591596 - DNA, 22 bp, Homo sapiens
accctgccctgtgggcccccaa

SEQ ID NO: 2591597 - DNA, 17 bp, Homo sapiens
accctggaaaatgaatc

SEQ ID NO: 2591598 - DNA, 15 bp, Homo sapiens
accctggcattatgt

SEQ ID NO: 2591599 - DNA, 17 bp, Homo sapiens
accctggccgccccctg

SEQ ID NO: 2591600 - DNA, 19 bp, Homo sapiens
accctggccgccccctgcc

SEQ ID NO: 2591601 - DNA, 22 bp, Homo sapiens
accctggccgccccctgccccc

SEQ ID NO: 2591602 - DNA, 19 bp, Homo sapiens
accctgggctctgggagca

SEQ ID NO: 2591603 - DNA, 18 bp, Homo sapiens
accctggggcctggacct

SEQ ID NO: 2591604 - DNA, 22 bp, Homo sapiens
acgcaggcccccaggtgccagt

SEQ ID NO: 2591605 - DNA, 14 bp, Homo sapiens
acgcagtggccttc

SEQ ID NO: 2591606 - DNA, 22 bp, Homo sapiens
acgcatggagtgtgtattgttc

SEQ ID NO: 2591607 - DNA, 23 bp, Homo sapiens
acgccactgcactccagcctggg

SEQ ID NO: 2591608 - DNA, 19 bp, Homo sapiens
acgccagattctttcctga

SEQ ID NO: 2591609 - DNA, 18 bp, Homo sapiens
acgccaggggaaaatcag

SEQ ID NO: 2591610 - DNA, 11 bp, Homo sapiens
acgccatccca

SEQ ID NO: 2591611 - DNA, 15 bp, Homo sapiens
acgccatcccagccc

SEQ ID NO: 2591612 - DNA, 14 bp, Homo sapiens
acgcccatgtgtga

SEQ ID NO: 2591613 - DNA, 22 bp, Homo sapiens
acgccggggacagaggcctgcc

SEQ ID NO: 2591614 - DNA, 23 bp, Homo sapiens
acgccggggacagaggcctgccc

SEQ ID NO: 2591615 - DNA, 17 bp, Homo sapiens
acgcctatgatcccagc

SEQ ID NO: 2591616 - DNA, 14 bp, Homo sapiens
acgcctcccactgg

SEQ ID NO: 2591617 - DNA, 21 bp, Homo sapiens
acgcctgccctccccagagca

SEQ ID NO: 2591618 - DNA, 21 bp, Homo sapiens
acgcctgtaatcccagcactt

SEQ ID NO: 2591619 - DNA, 16 bp, Homo sapiens
acgcctgtagtcctag

SEQ ID NO: 2591620 - DNA, 12 bp, Homo sapiens
acgcgtctcctg

SEQ ID NO: 2591621 - DNA, 23 bp, Homo sapiens
acgcgtgcacacaccagagccca

SEQ ID NO: 2591622 - DNA, 22 bp, Homo sapiens
acgctctcctttctttctaact

SEQ ID NO: 2591623 - DNA, 18 bp, Homo sapiens
acgctgaataaatgtctt

SEQ ID NO: 2591624 - DNA, 13 bp, Homo sapiens
acgctggaccttg

SEQ ID NO: 2591625 - DNA, 15 bp, Homo sapiens
actatggtatttgag

SEQ ID NO: 2591626 - DNA, 14 bp, Homo sapiens
actatggtgccaat

SEQ ID NO: 2591627 - DNA, 20 bp, Homo sapiens
actatggtgccaatggaacc

SEQ ID NO: 2591628 - DNA, 14 bp, Homo sapiens
actatgtaacatgt

SEQ ID NO: 2591629 - DNA, 12 bp, Homo sapiens
actatgtatcaa

SEQ ID NO: 2591630 - DNA, 13 bp, Homo sapiens
actatgttgataa

SEQ ID NO: 2591631 - DNA, 15 bp, Homo sapiens
actatgttgcccagg

SEQ ID NO: 2591632 - DNA, 21 bp, Homo sapiens
actattaagaggcagaaaatt

SEQ ID NO: 2591633 - DNA, 16 bp, Homo sapiens
actattcaaacagtct

SEQ ID NO: 2591634 - DNA, 13 bp, Homo sapiens
actattgcccagg

SEQ ID NO: 2591635 - DNA, 17 bp, Homo sapiens
actattgcttgcacaaa

SEQ ID NO: 2591636 - DNA, 13 bp, Homo sapiens
actattggagggt

SEQ ID NO: 2591637 - DNA, 23 bp, Homo sapiens
actatttagtttttgtaatttat

SEQ ID NO: 2591638 - DNA, 12 bp, Homo sapiens
actatttatctg

SEQ ID NO: 2591639 - DNA, 22 bp, Homo sapiens
actatttcccttgaaattttaa

SEQ ID NO: 2591640 - DNA, 13 bp, Homo sapiens
actattttacttc

SEQ ID NO: 2591641 - DNA, 11 bp, Homo sapiens
actattttatt

SEQ ID NO: 2591642 - DNA, 18 bp, Homo sapiens
actatttttatttatatt

SEQ ID NO: 2591643 - DNA, 14 bp, Homo sapiens
actatttttcagaa

SEQ ID NO: 2591644 - DNA, 13 bp, Homo sapiens
actcaaaagctgg

SEQ ID NO: 2591645 - DNA, 21 bp, Homo sapiens
actcaaactgaggaatttcac

SEQ ID NO: 2591646 - DNA, 23 bp, Homo sapiens
actcaaacttttcccctgtcctg

SEQ ID NO: 2591647 - DNA, 15 bp, Homo sapiens
actcaacatgagtca

SEQ ID NO: 2591648 - DNA, 21 bp, Homo sapiens
actcaacatgttactgaccag

SEQ ID NO: 2591649 - DNA, 14 bp, Homo sapiens
actcaagaagcagg

SEQ ID NO: 2591650 - DNA, 17 bp, Homo sapiens
actcaagaggctgaggc

SEQ ID NO: 2591651 - DNA, 20 bp, Homo sapiens
actcaaggttcccagagatg

SEQ ID NO: 2591652 - DNA, 18 bp, Homo sapiens
actcaataaaatcatgta

SEQ ID NO: 2591653 - DNA, 21 bp, Homo sapiens
actcaatattttccatgaaaa

SEQ ID NO: 2591654 - DNA, 23 bp, Homo sapiens
actcaatattttccatgaaaatg

SEQ ID NO: 2591655 - DNA, 16 bp, Homo sapiens
actcaatggatttgat

SEQ ID NO: 2591656 - DNA, 15 bp, Homo sapiens
actcaattgataaac

SEQ ID NO: 2591657 - DNA, 14 bp, Homo sapiens
actcacacaggacc

SEQ ID NO: 2591658 - DNA, 19 bp, Homo sapiens
actcacagacctggagccc

SEQ ID NO: 2591659 - DNA, 19 bp, Homo sapiens
actcacatggctatgtttt

SEQ ID NO: 2591660 - DNA, 17 bp, Homo sapiens
actcaccagtgtcccct

SEQ ID NO: 2591661 - DNA, 19 bp, Homo sapiens
actcaccagtgtcccctcc

SEQ ID NO: 2591662 - DNA, 14 bp, Homo sapiens
actcaccatctgtg

SEQ ID NO: 2591663 - DNA, 15 bp, Homo sapiens
actcaccatgtaaaa

SEQ ID NO: 2591664 - DNA, 17 bp, Homo sapiens
actcaccccagccccaa

SEQ ID NO: 2591665 - DNA, 18 bp, Homo sapiens
actcacctgctggcccct

SEQ ID NO: 2591666 - DNA, 19 bp, Homo sapiens
actcacctgctggcccctc

SEQ ID NO: 2591667 - DNA, 12 bp, Homo sapiens
actcacctgggg

SEQ ID NO: 2591668 - DNA, 23 bp, Homo sapiens
actcacctggggctgctggcctg

SEQ ID NO: 2591669 - DNA, 15 bp, Homo sapiens
actcacctgttactt

SEQ ID NO: 2591670 - DNA, 13 bp, Homo sapiens
actcactcctgag

SEQ ID NO: 2591671 - DNA, 20 bp, Homo sapiens
actcactcctgagacccctg

SEQ ID NO: 2591672 - DNA, 14 bp, Homo sapiens
actcagaaacatca

SEQ ID NO: 2591673 - DNA, 17 bp, Homo sapiens
actcagaagacactgat

SEQ ID NO: 2591674 - DNA, 15 bp, Homo sapiens
actcagaagcctgag

SEQ ID NO: 2591675 - DNA, 14 bp, Homo sapiens
actcagagggagga

SEQ ID NO: 2591676 - DNA, 16 bp, Homo sapiens
actcagatcactactg

SEQ ID NO: 2591677 - DNA, 20 bp, Homo sapiens
actcagatcactactgcagt

SEQ ID NO: 2591678 - DNA, 15 bp, Homo sapiens
actcagccctgaggt

SEQ ID NO: 2591679 - DNA, 19 bp, Homo sapiens
actcagctccccagagtcc

SEQ ID NO: 2591680 - DNA, 17 bp, Homo sapiens
actcagcttcctaccca

SEQ ID NO: 2591681 - DNA, 17 bp, Homo sapiens
actcaggaggctgaggg

SEQ ID NO: 2591682 - DNA, 13 bp, Homo sapiens
actcagggacaga

SEQ ID NO: 2591683 - DNA, 17 bp, Homo sapiens
actcagggacagagcca

SEQ ID NO: 2591684 - DNA, 18 bp, Homo sapiens
actcagggacagagccat

SEQ ID NO: 2591685 - DNA, 15 bp, Homo sapiens
actcagggccccagc

SEQ ID NO: 2591686 - DNA, 16 bp, Homo sapiens
actcagggctcctggg

SEQ ID NO: 2591687 - DNA, 21 bp, Homo sapiens
actcaggttgtagtaaagaaa

SEQ ID NO: 2591688 - DNA, 13 bp, Homo sapiens
actcagtctttaa

SEQ ID NO: 2591689 - DNA, 14 bp, Homo sapiens
actcagtttgtcag

SEQ ID NO: 2591690 - DNA, 15 bp, Homo sapiens
actcagtttgtcaga

SEQ ID NO: 2591691 - DNA, 16 bp, Homo sapiens
actcataatgtgaagt

SEQ ID NO: 2591692 - DNA, 17 bp, Homo sapiens
actcatactgtgctgga

SEQ ID NO: 2591693 - DNA, 14 bp, Homo sapiens
actcatcataaaat

SEQ ID NO: 2591694 - DNA, 19 bp, Homo sapiens
actcatcttactgtacctg

SEQ ID NO: 2591695 - DNA, 18 bp, Homo sapiens
actcatcttagtgcctga

SEQ ID NO: 2591696 - DNA, 22 bp, Homo sapiens
actcatcttagtgcctgagagt

SEQ ID NO: 2591697 - DNA, 14 bp, Homo sapiens
actcatgctgaaag

SEQ ID NO: 2591698 - DNA, 12 bp, Homo sapiens
actcatgtgtat

SEQ ID NO: 2591699 - DNA, 19 bp, Homo sapiens
actcattctgaaggagccc

SEQ ID NO: 2591700 - DNA, 18 bp, Homo sapiens
actcattgacctgaggcc

SEQ ID NO: 2591701 - DNA, 13 bp, Homo sapiens
actccaaaatgtt

SEQ ID NO: 2591702 - DNA, 14 bp, Homo sapiens
actccaaagaaatg

SEQ ID NO: 2591703 - DNA, 18 bp, Homo sapiens
actccaaagaaatgtaag

SEQ ID NO: 2591704 - DNA, 13 bp, Homo sapiens
actccagcctgag

SEQ ID NO: 2591705 - DNA, 14 bp, Homo sapiens
actccagcctgagc

SEQ ID NO: 2591706 - DNA, 15 bp, Homo sapiens
actccagcctgagca

SEQ ID NO: 2591707 - DNA, 19 bp, Homo sapiens
actccagcctgagcaacag

SEQ ID NO: 2591708 - DNA, 12 bp, Homo sapiens
actccagcctgg

SEQ ID NO: 2591709 - DNA, 13 bp, Homo sapiens
actccagcctggg

SEQ ID NO: 2591710 - DNA, 21 bp, Homo sapiens
actccagcctgggcaacacag

SEQ ID NO: 2591711 - DNA, 20 bp, Homo sapiens
actccagcctgggcgacaga

SEQ ID NO: 2591712 - DNA, 13 bp, Homo sapiens
actccaggagagg

SEQ ID NO: 2591713 - DNA, 20 bp, Homo sapiens
actccagtgatgttcttcaa

SEQ ID NO: 2591714 - DNA, 15 bp, Homo sapiens
actccagtgccagca

SEQ ID NO: 2591715 - DNA, 19 bp, Homo sapiens
actccatcagttagagctg

SEQ ID NO: 2591716 - DNA, 13 bp, Homo sapiens
actccatgagcac

SEQ ID NO: 2591717 - DNA, 17 bp, Homo sapiens
actcccagacacccacc

SEQ ID NO: 2591718 - DNA, 19 bp, Homo sapiens
actccccaggccaggccac

SEQ ID NO: 2591719 - DNA, 14 bp, Homo sapiens
actcccccaggtgg

SEQ ID NO: 2591720 - DNA, 13 bp, Homo sapiens
actccctcctcac

SEQ ID NO: 2591721 - DNA, 17 bp, Homo sapiens
actccctggctctcaga

SEQ ID NO: 2591722 - DNA, 13 bp, Homo sapiens
actcccttcccat

SEQ ID NO: 2591723 - DNA, 21 bp, Homo sapiens
actcccttcccatgacccagg

SEQ ID NO: 2591724 - DNA, 15 bp, Homo sapiens
actcccttctacctg

SEQ ID NO: 2591725 - DNA, 17 bp, Homo sapiens
actcccttctacctgcc

SEQ ID NO: 2591726 - DNA, 19 bp, Homo sapiens
actcccttggtggcaagag

SEQ ID NO: 2591727 - DNA, 23 bp, Homo sapiens
actccggagtgagaagctttgcc

SEQ ID NO: 2591728 - DNA, 23 bp, Homo sapiens
actccggcctgatgacagagcga

SEQ ID NO: 2591729 - DNA, 17 bp, Homo sapiens
actccggggagcgcccg

SEQ ID NO: 2591730 - DNA, 22 bp, Homo sapiens
actccgggtttgagatggacac

SEQ ID NO: 2591731 - DNA, 16 bp, Homo sapiens
actccggtgtgcctgc

SEQ ID NO: 2591732 - DNA, 18 bp, Homo sapiens
actcctacacctaactca

SEQ ID NO: 2591733 - DNA, 15 bp, Homo sapiens
actcctacctcagcc

SEQ ID NO: 2591734 - DNA, 21 bp, Homo sapiens
actcctagagaacgcagccct

SEQ ID NO: 2591735 - DNA, 21 bp, Homo sapiens
actcctcctccaaaggccccc

SEQ ID NO: 2591736 - DNA, 22 bp, Homo sapiens
actcctcctccaaaggccccct

SEQ ID NO: 2591737 - DNA, 21 bp, Homo sapiens
actcctctaagccactcttcc

SEQ ID NO: 2591738 - DNA, 23 bp, Homo sapiens
actcctctaagccactcttccaa

SEQ ID NO: 2591739 - DNA, 17 bp, Homo sapiens
actcctctgcagtgcct

SEQ ID NO: 2591740 - DNA, 13 bp, Homo sapiens
actcctctgtcca

SEQ ID NO: 2591741 - DNA, 18 bp, Homo sapiens
actcctgagacccctggc

SEQ ID NO: 2591742 - DNA, 20 bp, Homo sapiens
actcctgagacccctggcct

SEQ ID NO: 2591743 - DNA, 16 bp, Homo sapiens
actcctgaggacagct

SEQ ID NO: 2591744 - DNA, 17 bp, Homo sapiens
actcctgaggacagctg

SEQ ID NO: 2591745 - DNA, 20 bp, Homo sapiens
actcctgaggacagctgtcc

SEQ ID NO: 2591746 - DNA, 18 bp, Homo sapiens
actcctgcaggcagccag

SEQ ID NO: 2591747 - DNA, 22 bp, Homo sapiens
actcctgcaggcagccaggcca

SEQ ID NO: 2591748 - DNA, 14 bp, Homo sapiens
actcctgccctgtt

SEQ ID NO: 2591749 - DNA, 13 bp, Homo sapiens
actcctggcctca

SEQ ID NO: 2591750 - DNA, 16 bp, Homo sapiens
actcctggggcctctt

SEQ ID NO: 2591751 - DNA, 21 bp, Homo sapiens
actcctggggcctcttgggtc

SEQ ID NO: 2591752 - DNA, 17 bp, Homo sapiens
actcctgggttgagctg

SEQ ID NO: 2591753 - DNA, 23 bp, Homo sapiens
actcctgggttgagctgttgcct

SEQ ID NO: 2591754 - DNA, 15 bp, Homo sapiens
actcctgtacactga

SEQ ID NO: 2591755 - DNA, 16 bp, Homo sapiens
actcctgtacactgaa

SEQ ID NO: 2591756 - DNA, 17 bp, Homo sapiens
actcctgttacttacct

SEQ ID NO: 2591757 - DNA, 23 bp, Homo sapiens
actccttgaaaacactgttctct

SEQ ID NO: 2591758 - DNA, 20 bp, Homo sapiens
actccttgtggtttatgtca

SEQ ID NO: 2591759 - DNA, 17 bp, Homo sapiens
actcgagaccttttcaa

SEQ ID NO: 2591760 - DNA, 22 bp, Homo sapiens
actcgcccgcccactgtcctgg

SEQ ID NO: 2591761 - DNA, 20 bp, Homo sapiens
actcgggaggctgagacagg

SEQ ID NO: 2591762 - DNA, 22 bp, Homo sapiens
actcgggaggctgagacaggag

SEQ ID NO: 2591763 - DNA, 15 bp, Homo sapiens
actctaaaaggttca

SEQ ID NO: 2591764 - DNA, 14 bp, Homo sapiens
agaaatttccagag

SEQ ID NO: 2591765 - DNA, 15 bp, Homo sapiens
agaaatttgatttct

SEQ ID NO: 2591766 - DNA, 16 bp, Homo sapiens
agaaatttgatttcta

SEQ ID NO: 2591767 - DNA, 20 bp, Homo sapiens
agaaatttgatttctattca

SEQ ID NO: 2591768 - DNA, 13 bp, Homo sapiens
agaaatttttatt

SEQ ID NO: 2591769 - DNA, 18 bp, Homo sapiens
agaaatttttcagatgct

SEQ ID NO: 2591770 - DNA, 21 bp, Homo sapiens
agaacaaaggacagagtatga

SEQ ID NO: 2591771 - DNA, 16 bp, Homo sapiens
agaacacaaggtcatt

SEQ ID NO: 2591772 - DNA, 13 bp, Homo sapiens
agaacactaacct

SEQ ID NO: 2591773 - DNA, 14 bp, Homo sapiens
agaacactaacctg

SEQ ID NO: 2591774 - DNA, 17 bp, Homo sapiens
agaacactgtgaaaaca

SEQ ID NO: 2591775 - DNA, 23 bp, Homo sapiens
agaacagcagggtagtctggttt

SEQ ID NO: 2591776 - DNA, 18 bp, Homo sapiens
agaacagccgctcctgtc

SEQ ID NO: 2591777 - DNA, 20 bp, Homo sapiens
agaacagccgctcctgtctg

SEQ ID NO: 2591778 - DNA, 22 bp, Homo sapiens
agaacagccgctcctgtctgcc

SEQ ID NO: 2591779 - DNA, 16 bp, Homo sapiens
agaacagcttcaggtt

SEQ ID NO: 2591780 - DNA, 13 bp, Homo sapiens
agaacagtaaaca

SEQ ID NO: 2591781 - DNA, 17 bp, Homo sapiens
agaacatccctgccagc

SEQ ID NO: 2591782 - DNA, 14 bp, Homo sapiens
agaacatggacttg

SEQ ID NO: 2591783 - DNA, 18 bp, Homo sapiens
agaaccaaaagttttcct

SEQ ID NO: 2591784 - DNA, 20 bp, Homo sapiens
agaaccaaaagttttcctga

SEQ ID NO: 2591785 - DNA, 13 bp, Homo sapiens
agaaccactatga

SEQ ID NO: 2591786 - DNA, 17 bp, Homo sapiens
agaaccaggcaacttgg

SEQ ID NO: 2591787 - DNA, 18 bp, Homo sapiens
agaaccagtttcaggtgt

SEQ ID NO: 2591788 - DNA, 22 bp, Homo sapiens
agaaccatccctattttgtatt

SEQ ID NO: 2591789 - DNA, 18 bp, Homo sapiens
agaaccgagcaaagatca

SEQ ID NO: 2591790 - DNA, 21 bp, Homo sapiens
agaaccgagcaaagatcaaaa

SEQ ID NO: 2591791 - DNA, 18 bp, Homo sapiens
agaacctcacgcacctcc

SEQ ID NO: 2591792 - DNA, 13 bp, Homo sapiens
agaacctcttccc

SEQ ID NO: 2591793 - DNA, 14 bp, Homo sapiens
actctaatagtgct

SEQ ID NO: 2591794 - DNA, 22 bp, Homo sapiens
actctaattcccattttgcaaa

SEQ ID NO: 2591795 - DNA, 19 bp, Homo sapiens
actctacataatttagagt

SEQ ID NO: 2591796 - DNA, 13 bp, Homo sapiens
actgcctttgacc

SEQ ID NO: 2591797 - DNA, 19 bp, Homo sapiens
actgcctttggcagagttc

SEQ ID NO: 2591798 - DNA, 20 bp, Homo sapiens
actgcggaaaaggaaggaaa

SEQ ID NO: 2591799 - DNA, 23 bp, Homo sapiens
actgcggagaaccttgtgcctgg

SEQ ID NO: 2591800 - DNA, 13 bp, Homo sapiens
actgctaaataaa

SEQ ID NO: 2591801 - DNA, 16 bp, Homo sapiens
actgctaaataaaatt

SEQ ID NO: 2591802 - DNA, 20 bp, Homo sapiens
actgctaaataaaatttgtt

SEQ ID NO: 2591803 - DNA, 23 bp, Homo sapiens
actgctacaaatactcttaggaa

SEQ ID NO: 2591804 - DNA, 19 bp, Homo sapiens
actgctaggcgagtgccag

SEQ ID NO: 2591805 - DNA, 16 bp, Homo sapiens
actgctaggtgggcca

SEQ ID NO: 2591806 - DNA, 17 bp, Homo sapiens
actgctaggtgggccag

SEQ ID NO: 2591807 - DNA, 23 bp, Homo sapiens
actgctaggtgggccagcccctc

SEQ ID NO: 2591808 - DNA, 19 bp, Homo sapiens
actgctagtcttaagaact

SEQ ID NO: 2591809 - DNA, 19 bp, Homo sapiens
actgctcatcattccttga

SEQ ID NO: 2591810 - DNA, 18 bp, Homo sapiens
actgctccccagccctgg

SEQ ID NO: 2591811 - DNA, 15 bp, Homo sapiens
actgctgcaaggcct

SEQ ID NO: 2591812 - DNA, 16 bp, Homo sapiens
actgctgcccagcctc

SEQ ID NO: 2591813 - DNA, 18 bp, Homo sapiens
actgctgcccagcctcca

SEQ ID NO: 2591814 - DNA, 21 bp, Homo sapiens
actgctgcccagcctccaagc

SEQ ID NO: 2591815 - DNA, 12 bp, Homo sapiens
actgctgctttt

SEQ ID NO: 2591816 - DNA, 21 bp, Homo sapiens
actgctgtgctgtgcccaagt

SEQ ID NO: 2591817 - DNA, 18 bp, Homo sapiens
actgcttaacttcacata

SEQ ID NO: 2591818 - DNA, 20 bp, Homo sapiens
actgcttaacttcacatatt

SEQ ID NO: 2591819 - DNA, 21 bp, Homo sapiens
actgcttccagtgaggctctg

SEQ ID NO: 2591820 - DNA, 23 bp, Homo sapiens
actgcttccagtgaggctctgcc

SEQ ID NO: 2591821 - DNA, 19 bp, Homo sapiens
actgcttcccatcctaccc

SEQ ID NO: 2591822 - DNA, 14 bp, Homo sapiens
actgcttgaggaaa

SEQ ID NO: 2591823 - DNA, 18 bp, Homo sapiens
actgcttgaggaaaacaa

SEQ ID NO: 2591824 - DNA, 16 bp, Homo sapiens
actggaaccagggaga

SEQ ID NO: 2591825 - DNA, 12 bp, Homo sapiens
actggaactctc

SEQ ID NO: 2591826 - DNA, 16 bp, Homo sapiens
actggaagcacagctt

SEQ ID NO: 2591827 - DNA, 17 bp, Homo sapiens
actggaagttttgcatt

SEQ ID NO: 2591828 - DNA, 16 bp, Homo sapiens
actggaccactgggca

SEQ ID NO: 2591829 - DNA, 14 bp, Homo sapiens
actggactccggcc

SEQ ID NO: 2591830 - DNA, 17 bp, Homo sapiens
actggagaagtcttaga

SEQ ID NO: 2591831 - DNA, 14 bp, Homo sapiens
actggagcccagga

SEQ ID NO: 2591832 - DNA, 20 bp, Homo sapiens
actggaggtcacattcagga

SEQ ID NO: 2591833 - DNA, 17 bp, Homo sapiens
actggagtgcagggagg

SEQ ID NO: 2591834 - DNA, 21 bp, Homo sapiens
actggcaaacttcagactgaa

SEQ ID NO: 2591835 - DNA, 13 bp, Homo sapiens
actggcacagttt

SEQ ID NO: 2591836 - DNA, 16 bp, Homo sapiens
actggcactgaattaa

SEQ ID NO: 2591837 - DNA, 20 bp, Homo sapiens
actggcactgaattaatcat

SEQ ID NO: 2591838 - DNA, 16 bp, Homo sapiens
actggcagttttccat

SEQ ID NO: 2591839 - DNA, 23 bp, Homo sapiens
actggcatggatatagttttact

SEQ ID NO: 2591840 - DNA, 17 bp, Homo sapiens
actggcattgtccctgt

SEQ ID NO: 2591841 - DNA, 18 bp, Homo sapiens
actggccaccaggctggc

SEQ ID NO: 2591842 - DNA, 21 bp, Homo sapiens
actggcccctagaatcagcct

SEQ ID NO: 2591843 - DNA, 13 bp, Homo sapiens
actggcccctggg

SEQ ID NO: 2591844 - DNA, 14 bp, Homo sapiens
actggcccctgggt

SEQ ID NO: 2591845 - DNA, 22 bp, Homo sapiens
actggccggtctgcaagtcaga

SEQ ID NO: 2591846 - DNA, 23 bp, Homo sapiens
actggccggtctgcaagtcagag

SEQ ID NO: 2591847 - DNA, 23 bp, Homo sapiens
actggcgtagaagtttttgtact

SEQ ID NO: 2591848 - DNA, 18 bp, Homo sapiens
actggctagagtcctcac

SEQ ID NO: 2591849 - DNA, 13 bp, Homo sapiens
actggctctccaa

SEQ ID NO: 2591850 - DNA, 14 bp, Homo sapiens
actggctctccaag

SEQ ID NO: 2591851 - DNA, 15 bp, Homo sapiens
actggctctccaagt

SEQ ID NO: 2591852 - DNA, 15 bp, Homo sapiens
actggctctctccag

SEQ ID NO: 2591853 - DNA, 16 bp, Homo sapiens
actggctctctccagg

SEQ ID NO: 2591854 - DNA, 23 bp, Homo sapiens
actggctctctccaggatccaga

SEQ ID NO: 2591855 - DNA, 21 bp, Homo sapiens
actggcttttattaatgcact

SEQ ID NO: 2591856 - DNA, 19 bp, Homo sapiens
actgggaagataggctctg

SEQ ID NO: 2591857 - DNA, 21 bp, Homo sapiens
actgggacctttagtggtggc

SEQ ID NO: 2591858 - DNA, 22 bp, Homo sapiens
actgggagaggtgccagcaact

SEQ ID NO: 2591859 - DNA, 16 bp, Homo sapiens
actgggccctgcctct

SEQ ID NO: 2591860 - DNA, 16 bp, Homo sapiens
actgggctgaacactc

SEQ ID NO: 2591861 - DNA, 13 bp, Homo sapiens
actgggctgaggg

SEQ ID NO: 2591862 - DNA, 14 bp, Homo sapiens
actgggctgaggga

SEQ ID NO: 2591863 - DNA, 21 bp, Homo sapiens
actggggagcccgtctcagtg

SEQ ID NO: 2591864 - DNA, 12 bp, Homo sapiens
actggggcactt

SEQ ID NO: 2591865 - DNA, 13 bp, Homo sapiens
actgggggagggg

SEQ ID NO: 2591866 - DNA, 19 bp, Homo sapiens
actgggggttgcgggggga

SEQ ID NO: 2591867 - DNA, 15 bp, Homo sapiens
actgggtacttgtgg

SEQ ID NO: 2591868 - DNA, 19 bp, Homo sapiens
actgggtacttgtggacac

SEQ ID NO: 2591869 - DNA, 13 bp, Homo sapiens
actgggttgactt

SEQ ID NO: 2591870 - DNA, 20 bp, Homo sapiens
actgggtttctctgtatagt

SEQ ID NO: 2591871 - DNA, 18 bp, Homo sapiens
actggtattcctgcctcc

SEQ ID NO: 2591872 - DNA, 21 bp, Homo sapiens
actggtccaaaagattgctga

SEQ ID NO: 2591873 - DNA, 15 bp, Homo sapiens
actggtcctgtgtgc

SEQ ID NO: 2591874 - DNA, 20 bp, Homo sapiens
actggtcctgtgtgcagtga

SEQ ID NO: 2591875 - DNA, 21 bp, Homo sapiens
actggtgtgacctgagggcag

SEQ ID NO: 2591876 - DNA, 22 bp, Homo sapiens
actggtttgttgcagccaaaga

SEQ ID NO: 2591877 - DNA, 14 bp, Homo sapiens
actgtaaagaaaga

SEQ ID NO: 2591878 - DNA, 16 bp, Homo sapiens
actgtaaagaaagaga

SEQ ID NO: 2591879 - DNA, 20 bp, Homo sapiens
actgtaaagaaagagagaaa

SEQ ID NO: 2591880 - DNA, 22 bp, Homo sapiens
actgtaaagaaagagagaaaat

SEQ ID NO: 2591881 - DNA, 23 bp, Homo sapiens
actgtaaagaaagagagaaaata

SEQ ID NO: 2591882 - DNA, 14 bp, Homo sapiens
actgtacatgaaaa

SEQ ID NO: 2591883 - DNA, 17 bp, Homo sapiens
actgtacttaataaatt

SEQ ID NO: 2591884 - DNA, 23 bp, Homo sapiens
actgtagaaaagggaactgaaca

SEQ ID NO: 2591885 - DNA, 18 bp, Homo sapiens
actgtagaatgatttcat

SEQ ID NO: 2591886 - DNA, 22 bp, Homo sapiens
actgtagcctcgccgtctgtga

SEQ ID NO: 2591887 - DNA, 19 bp, Homo sapiens
actgtaggaagagtagcat

SEQ ID NO: 2591888 - DNA, 20 bp, Homo sapiens
actgtaggaagagtagcatt

SEQ ID NO: 2591889 - DNA, 20 bp, Homo sapiens
actgtagtttttcttcaaca

SEQ ID NO: 2591890 - DNA, 21 bp, Homo sapiens
actgtagtttttcttcaacat

SEQ ID NO: 2591891 - DNA, 12 bp, Homo sapiens
actgtataaata

SEQ ID NO: 2591892 - DNA, 18 bp, Homo sapiens
actgtatataaaggaaaa

SEQ ID NO: 2591893 - DNA, 16 bp, Homo sapiens
actgtatcatgacaaa

SEQ ID NO: 2591894 - DNA, 13 bp, Homo sapiens
actgtatgctgga

SEQ ID NO: 2591895 - DNA, 14 bp, Homo sapiens
actgtatttgtatc

SEQ ID NO: 2591896 - DNA, 14 bp, Homo sapiens
actgtatttgtgac

SEQ ID NO: 2591897 - DNA, 20 bp, Homo sapiens
actgtatttgtgactaattg

SEQ ID NO: 2591898 - DNA, 21 bp, Homo sapiens
actgtattttgtattgtttca

SEQ ID NO: 2591899 - DNA, 20 bp, Homo sapiens
actgtatttttacctttttc

SEQ ID NO: 2591900 - DNA, 14 bp, Homo sapiens
actgtcaccctcca

SEQ ID NO: 2591901 - DNA, 15 bp, Homo sapiens
actgtcactgttcct

SEQ ID NO: 2591902 - DNA, 20 bp, Homo sapiens
actgtcactgtttctctgct

SEQ ID NO: 2591903 - DNA, 21 bp, Homo sapiens
actgtcactgtttctctgctg

SEQ ID NO: 2591904 - DNA, 19 bp, Homo sapiens
actgtcactttgctctggg

SEQ ID NO: 2591905 - DNA, 22 bp, Homo sapiens
actgtcagctcccctcggagaa

SEQ ID NO: 2591906 - DNA, 13 bp, Homo sapiens
actgtcatagaaa

SEQ ID NO: 2591907 - DNA, 20 bp, Homo sapiens
actgtccctcaaatgaccca

SEQ ID NO: 2591908 - DNA, 23 bp, Homo sapiens
actgtccctcaaatgacccaaag

SEQ ID NO: 2591909 - DNA, 18 bp, Homo sapiens
actgtcctgggcgccctg

SEQ ID NO: 2591910 - DNA, 19 bp, Homo sapiens
actgtcctgggcgccctgg

SEQ ID NO: 2591911 - DNA, 20 bp, Homo sapiens
actgtctgagagtttagttg

SEQ ID NO: 2591912 - DNA, 16 bp, Homo sapiens
actgtcttcttcaggg

SEQ ID NO: 2591913 - DNA, 15 bp, Homo sapiens
actgtgacaggcagc

SEQ ID NO: 2591914 - DNA, 18 bp, Homo sapiens
actgtgacaggcagcaga

SEQ ID NO: 2591915 - DNA, 21 bp, Homo sapiens
actgtgcacatctgtgtcttg

SEQ ID NO: 2591916 - DNA, 18 bp, Homo sapiens
actgtgcaccaagcagga

SEQ ID NO: 2591917 - DNA, 12 bp, Homo sapiens
actgtgcagagt

SEQ ID NO: 2591918 - DNA, 16 bp, Homo sapiens
actgtgccatgtgcca

SEQ ID NO: 2591919 - DNA, 12 bp, Homo sapiens
actgtgccctgg

SEQ ID NO: 2591920 - DNA, 15 bp, Homo sapiens
actgtgccctggtgg

SEQ ID NO: 2591921 - DNA, 17 bp, Homo sapiens
actgtgccctggtggag

SEQ ID NO: 2591922 - DNA, 18 bp, Homo sapiens
actgtgctaataacagtg

SEQ ID NO: 2591923 - DNA, 22 bp, Homo sapiens
actgtgctggagccactaacta

SEQ ID NO: 2591924 - DNA, 17 bp, Homo sapiens
actgtggaaaaatattt

SEQ ID NO: 2591925 - DNA, 20 bp, Homo sapiens
actgtggccgttatctggaa

SEQ ID NO: 2591926 - DNA, 23 bp, Homo sapiens
actgtggccgttatctggaagta

SEQ ID NO: 2591927 - DNA, 19 bp, Homo sapiens
actgtggctgctagcactt

SEQ ID NO: 2591928 - DNA, 14 bp, Homo sapiens
actgtggtcctatg

SEQ ID NO: 2591929 - DNA, 19 bp, Homo sapiens
actgtgtgcagactcaata

SEQ ID NO: 2591930 - DNA, 17 bp, Homo sapiens
actgtgtggactgtgat

SEQ ID NO: 2591931 - DNA, 18 bp, Homo sapiens
actgtgtggactgtgatg

SEQ ID NO: 2591932 - DNA, 19 bp, Homo sapiens
actgtgtggactgtgatgc

SEQ ID NO: 2591933 - DNA, 20 bp, Homo sapiens
actgtgtgtggaggagtcca

SEQ ID NO: 2591934 - DNA, 15 bp, Homo sapiens
actgtgttcctggca

SEQ ID NO: 2591935 - DNA, 20 bp, Homo sapiens
actgttaaattgctgtgtat

SEQ ID NO: 2591936 - DNA, 17 bp, Homo sapiens
actgttaatagttcagg

SEQ ID NO: 2591937 - DNA, 23 bp, Homo sapiens
actgttacctgatcaatgacaga

SEQ ID NO: 2591938 - DNA, 15 bp, Homo sapiens
actgttatttataat

SEQ ID NO: 2591939 - DNA, 20 bp, Homo sapiens
actgttatttataatcactt

SEQ ID NO: 2591940 - DNA, 13 bp, Homo sapiens
actgttcaagagc

SEQ ID NO: 2591941 - DNA, 15 bp, Homo sapiens
actgttcaagagcac

SEQ ID NO: 2591942 - DNA, 18 bp, Homo sapiens
actgttccccctgtgcag

SEQ ID NO: 2591943 - DNA, 16 bp, Homo sapiens
actgttccctctgctc

SEQ ID NO: 2591944 - DNA, 17 bp, Homo sapiens
actgttctctgccctcc

SEQ ID NO: 2591945 - DNA, 20 bp, Homo sapiens
actgttctctgccctccaag

SEQ ID NO: 2591946 - DNA, 16 bp, Homo sapiens
actgttctgtgtcttt

SEQ ID NO: 2591947 - DNA, 13 bp, Homo sapiens
actgttcttgaat

SEQ ID NO: 2591948 - DNA, 13 bp, Homo sapiens
actgttgaaaatt

SEQ ID NO: 2591949 - DNA, 12 bp, Homo sapiens
actgttgcccag

SEQ ID NO: 2591950 - DNA, 13 bp, Homo sapiens
actgttgcccagg

SEQ ID NO: 2591951 - DNA, 14 bp, Homo sapiens
actgttgcccaggc

SEQ ID NO: 2591952 - DNA, 18 bp, Homo sapiens
actgttgcccaggctggc

SEQ ID NO: 2591953 - DNA, 12 bp, Homo sapiens
actgttgctcaa

SEQ ID NO: 2591954 - DNA, 20 bp, Homo sapiens
actgtttacaagaaaaaatg

SEQ ID NO: 2591955 - DNA, 15 bp, Homo sapiens
actgtttcaaacttt

SEQ ID NO: 2591956 - DNA, 18 bp, Homo sapiens
actgtttcaaactttact

SEQ ID NO: 2591957 - DNA, 22 bp, Homo sapiens
actgtttgccttctacttttaa

SEQ ID NO: 2591958 - DNA, 15 bp, Homo sapiens
actgtttgtcttctc

SEQ ID NO: 2591959 - DNA, 18 bp, Homo sapiens
actgtttgtcttctcccc

SEQ ID NO: 2591960 - DNA, 20 bp, Homo sapiens
actgtttgtcttctccccag

SEQ ID NO: 2591961 - DNA, 21 bp, Homo sapiens
actgtttgtcttctccccagg

SEQ ID NO: 2591962 - DNA, 12 bp, Homo sapiens
actgtttttacc

SEQ ID NO: 2591963 - DNA, 16 bp, Homo sapiens
actgtttttacccata

SEQ ID NO: 2591964 - DNA, 23 bp, Homo sapiens
actgtttttacccatatcccctc

SEQ ID NO: 2591965 - DNA, 23 bp, Homo sapiens
actgtttttcagggaggtggctg

SEQ ID NO: 2591966 - DNA, 18 bp, Homo sapiens
actgttttttcctgagct

SEQ ID NO: 2591967 - DNA, 13 bp, Homo sapiens
acttaaaaaaatg

SEQ ID NO: 2591968 - DNA, 14 bp, Homo sapiens
acttaaaaaaatga

SEQ ID NO: 2591969 - DNA, 16 bp, Homo sapiens
acttaaaaaatgtcca

SEQ ID NO: 2591970 - DNA, 18 bp, Homo sapiens
acttaaaaatgtaaatat

SEQ ID NO: 2591971 - DNA, 13 bp, Homo sapiens
acttaaatgaaag

SEQ ID NO: 2591972 - DNA, 15 bp, Homo sapiens
acttaacaagctccc

SEQ ID NO: 2591973 - DNA, 20 bp, Homo sapiens
acttaacaagctcccaggcc

SEQ ID NO: 2591974 - DNA, 14 bp, Homo sapiens
acttaacagatgca

SEQ ID NO: 2591975 - DNA, 21 bp, Homo sapiens
acttaacagatgcaatgtgct

SEQ ID NO: 2591976 - DNA, 15 bp, Homo sapiens
acttaacggctccag

SEQ ID NO: 2591977 - DNA, 17 bp, Homo sapiens
acttaacggctccagga

SEQ ID NO: 2591978 - DNA, 22 bp, Homo sapiens
acttaatctaaatggaaccact

SEQ ID NO: 2591979 - DNA, 16 bp, Homo sapiens
acttaccatatgtgct

SEQ ID NO: 2591980 - DNA, 17 bp, Homo sapiens
acttacctagatttaca

SEQ ID NO: 2591981 - DNA, 16 bp, Homo sapiens
acttaccttcaataaa

SEQ ID NO: 2591982 - DNA, 13 bp, Homo sapiens
acttactgtacat

SEQ ID NO: 2591983 - DNA, 21 bp, Homo sapiens
acttactgtacatgaaaacac

SEQ ID NO: 2591984 - DNA, 13 bp, Homo sapiens
acttactgtttct

SEQ ID NO: 2591985 - DNA, 21 bp, Homo sapiens
acttactgtttctgtcaggag

SEQ ID NO: 2591986 - DNA, 20 bp, Homo sapiens
acttagaggtggggagcaga

SEQ ID NO: 2591987 - DNA, 21 bp, Homo sapiens
acttagcttgaaggatctgtt

SEQ ID NO: 2591988 - DNA, 17 bp, Homo sapiens
acttatatcatcagcat

SEQ ID NO: 2591989 - DNA, 22 bp, Homo sapiens
acttatatcatcagcatacctt

SEQ ID NO: 2591990 - DNA, 20 bp, Homo sapiens
acttatattgtaagaaatac

SEQ ID NO: 2591991 - DNA, 19 bp, Homo sapiens
acttatcatccacattgtt

SEQ ID NO: 2591992 - DNA, 18 bp, Homo sapiens
acttatcctaaaacaaat

SEQ ID NO: 2591993 - DNA, 17 bp, Homo sapiens
acttatctctctgtgct

SEQ ID NO: 2591994 - DNA, 22 bp, Homo sapiens
acttatttttgacagtgttgaa

SEQ ID NO: 2591995 - DNA, 16 bp, Homo sapiens
acttatttttttctga

SEQ ID NO: 2591996 - DNA, 18 bp, Homo sapiens
acttatttttttctgatt

SEQ ID NO: 2591997 - DNA, 21 bp, Homo sapiens
acttatttttttctgattgta

SEQ ID NO: 2591998 - DNA, 15 bp, Homo sapiens
acttcaaaagtattt

SEQ ID NO: 2591999 - DNA, 16 bp, Homo sapiens
acttcaaaagtatttt

SEQ ID NO: 2592000 - DNA, 16 bp, Homo sapiens
acttcaaactgagatc

SEQ ID NO: 2592001 - DNA, 19 bp, Homo sapiens
acttcacacacaggcaact

SEQ ID NO: 2592002 - DNA, 16 bp, Homo sapiens
acttcacagagtgtgc

SEQ ID NO: 2592003 - DNA, 19 bp, Homo sapiens
acttcacatattgatttcc

SEQ ID NO: 2592004 - DNA, 23 bp, Homo sapiens
acttcacatattgatttccgtta

SEQ ID NO: 2592005 - DNA, 12 bp, Homo sapiens
acttcagacata

SEQ ID NO: 2592006 - DNA, 13 bp, Homo sapiens
acttcagactgaa

SEQ ID NO: 2592007 - DNA, 18 bp, Homo sapiens
acttcagagagctggtag

SEQ ID NO: 2592008 - DNA, 14 bp, Homo sapiens
acttcagctctgtt

SEQ ID NO: 2592009 - DNA, 21 bp, Homo sapiens
acttcagggcagggctctgat

SEQ ID NO: 2592010 - DNA, 17 bp, Homo sapiens
acttcatagatttcctt

SEQ ID NO: 2592011 - DNA, 18 bp, Homo sapiens
acttcatatatgaggact

SEQ ID NO: 2592012 - DNA, 19 bp, Homo sapiens
acttcatcttctcagctcc

SEQ ID NO: 2592013 - DNA, 14 bp, Homo sapiens
acttcattcttgaa

SEQ ID NO: 2592014 - DNA, 20 bp, Homo sapiens
acttccagtgcaacactgaa

SEQ ID NO: 2592015 - DNA, 20 bp, Homo sapiens
acttcccactctagggcagt

SEQ ID NO: 2592016 - DNA, 19 bp, Homo sapiens
acttcccattttggaagtt

SEQ ID NO: 2592017 - DNA, 15 bp, Homo sapiens
acttcctcctcccca

SEQ ID NO: 2592018 - DNA, 17 bp, Homo sapiens
acttcctcctccccact

SEQ ID NO: 2592019 - DNA, 18 bp, Homo sapiens
acttcctcctccccactt

SEQ ID NO: 2592020 - DNA, 22 bp, Homo sapiens
acttccttactaagcatagcaa

SEQ ID NO: 2592021 - DNA, 16 bp, Homo sapiens
acttcgcatcaaaaga

SEQ ID NO: 2592022 - DNA, 22 bp, Homo sapiens
acttcgcatcaaaagacaattc

SEQ ID NO: 2592023 - DNA, 17 bp, Homo sapiens
acttcgggaggtcgagg

SEQ ID NO: 2592024 - DNA, 15 bp, Homo sapiens
acttcgtcttctaat

SEQ ID NO: 2592025 - DNA, 19 bp, Homo sapiens
acttcgtcttctaatttca

SEQ ID NO: 2592026 - DNA, 23 bp, Homo sapiens
acttcgtgggatctgcccctccc

SEQ ID NO: 2592027 - DNA, 23 bp, Homo sapiens
acttctaagtaaaaccacagcag

SEQ ID NO: 2592028 - DNA, 22 bp, Homo sapiens
acttctcaaacctgtttaaata

SEQ ID NO: 2592029 - DNA, 15 bp, Homo sapiens
acttctccaccctgc

SEQ ID NO: 2592030 - DNA, 14 bp, Homo sapiens
acttctctgaaggg

SEQ ID NO: 2592031 - DNA, 20 bp, Homo sapiens
acttctctggaaagggggga

SEQ ID NO: 2592032 - DNA, 14 bp, Homo sapiens
acttctgctttcca

SEQ ID NO: 2592033 - DNA, 15 bp, Homo sapiens
acttctggctcctca

SEQ ID NO: 2592034 - DNA, 16 bp, Homo sapiens
acttctggctcctcaa

SEQ ID NO: 2592035 - DNA, 20 bp, Homo sapiens
acttctgtgagacccccaca

SEQ ID NO: 2592036 - DNA, 17 bp, Homo sapiens
acttcttatacatttga

SEQ ID NO: 2592037 - DNA, 16 bp, Homo sapiens
acttctttgctttgcc

SEQ ID NO: 2592038 - DNA, 11 bp, Homo sapiens
acttcttttca

SEQ ID NO: 2592039 - DNA, 13 bp, Homo sapiens
acttgaaagcatc

SEQ ID NO: 2592040 - DNA, 20 bp, Homo sapiens
acttgaaagcatccatgtgt

SEQ ID NO: 2592041 - DNA, 18 bp, Homo sapiens
acttgaaatctaggatta

SEQ ID NO: 2592042 - DNA, 21 bp, Homo sapiens
acttgaacccatatttgtaca

SEQ ID NO: 2592043 - DNA, 16 bp, Homo sapiens
acttgaatgtgtcact

SEQ ID NO: 2592044 - DNA, 19 bp, Homo sapiens
acttgacccccttgagggt

SEQ ID NO: 2592045 - DNA, 19 bp, Homo sapiens
acttgagaggatgaatgta

SEQ ID NO: 2592046 - DNA, 15 bp, Homo sapiens
acttgagggcccaga

SEQ ID NO: 2592047 - DNA, 16 bp, Homo sapiens
acttgatgtgccattt

SEQ ID NO: 2592048 - DNA, 18 bp, Homo sapiens
acttgatgtgccatttta

SEQ ID NO: 2592049 - DNA, 23 bp, Homo sapiens
acttgcaaaaagggtcagtatgg

SEQ ID NO: 2592050 - DNA, 13 bp, Homo sapiens
acttgcacctctg

SEQ ID NO: 2592051 - DNA, 23 bp, Homo sapiens
acttgcagactctacagaggcca

SEQ ID NO: 2592052 - DNA, 14 bp, Homo sapiens
acttgcatttttgc

SEQ ID NO: 2592053 - DNA, 17 bp, Homo sapiens
acttgcatttttgcagg

SEQ ID NO: 2592054 - DNA, 21 bp, Homo sapiens
acttgcccacaccgagggcga

SEQ ID NO: 2592055 - DNA, 16 bp, Homo sapiens
acttggaatttgtaac

SEQ ID NO: 2592056 - DNA, 18 bp, Homo sapiens
acttggaatttgtaacct

SEQ ID NO: 2592057 - DNA, 16 bp, Homo sapiens
acttggactcttgctc

SEQ ID NO: 2592058 - DNA, 18 bp, Homo sapiens
acttggactcttgctctt

SEQ ID NO: 2592059 - DNA, 23 bp, Homo sapiens
acttggggggctgaggtgggagg

SEQ ID NO: 2592060 - DNA, 16 bp, Homo sapiens
acttggtttttaaaaa

SEQ ID NO: 2592061 - DNA, 16 bp, Homo sapiens
acttgtaaatacacca

SEQ ID NO: 2592062 - DNA, 18 bp, Homo sapiens
acttgtaatttttttaat

SEQ ID NO: 2592063 - DNA, 18 bp, Homo sapiens
acttgtacaaaataaaca

SEQ ID NO: 2592064 - DNA, 16 bp, Homo sapiens
acttgtatatttgtac

SEQ ID NO: 2592065 - DNA, 17 bp, Homo sapiens
acttgtatatttgtaca

SEQ ID NO: 2592066 - DNA, 18 bp, Homo sapiens
acttgtatatttgtacaa

SEQ ID NO: 2592067 - DNA, 18 bp, Homo sapiens
acttgtattaaagacaga

SEQ ID NO: 2592068 - DNA, 18 bp, Homo sapiens
acttgtcaaagaaggttt

SEQ ID NO: 2592069 - DNA, 13 bp, Homo sapiens
acttgtcaatatt

SEQ ID NO: 2592070 - DNA, 16 bp, Homo sapiens
acttgtcaatatttaa

SEQ ID NO: 2592071 - DNA, 13 bp, Homo sapiens
acttgtcatgtga

SEQ ID NO: 2592072 - DNA, 18 bp, Homo sapiens
acttgtcccactatctgg

SEQ ID NO: 2592073 - DNA, 21 bp, Homo sapiens
acttgtctttggaccctgagg

SEQ ID NO: 2592074 - DNA, 15 bp, Homo sapiens
acttgtggacacagc

SEQ ID NO: 2592075 - DNA, 22 bp, Homo sapiens
acttgtggacacagctcttctc

SEQ ID NO: 2592076 - DNA, 22 bp, Homo sapiens
acttgtgtctctgtgcttttaa

SEQ ID NO: 2592077 - DNA, 16 bp, Homo sapiens
actttaaaaggagcca

SEQ ID NO: 2592078 - DNA, 20 bp, Homo sapiens
actttaaaggaaaaaatgtt

SEQ ID NO: 2592079 - DNA, 17 bp, Homo sapiens
actttaagactgagcac

SEQ ID NO: 2592080 - DNA, 15 bp, Homo sapiens
actttaagcactaca

SEQ ID NO: 2592081 - DNA, 16 bp, Homo sapiens
actttaagcactacat

SEQ ID NO: 2592082 - DNA, 19 bp, Homo sapiens
actttaagcagctcttgct

SEQ ID NO: 2592083 - DNA, 15 bp, Homo sapiens
actttaagtttcagg

SEQ ID NO: 2592084 - DNA, 22 bp, Homo sapiens
actttaattaccaacctgttac

SEQ ID NO: 2592085 - DNA, 19 bp, Homo sapiens
actttaattctcatgtgat

SEQ ID NO: 2592086 - DNA, 17 bp, Homo sapiens
actttacatgacacagc

SEQ ID NO: 2592087 - DNA, 16 bp, Homo sapiens
actttaccacccccac

SEQ ID NO: 2592088 - DNA, 12 bp, Homo sapiens
actttacctttt

SEQ ID NO: 2592089 - DNA, 18 bp, Homo sapiens
actttactaagatgacat

SEQ ID NO: 2592090 - DNA, 12 bp, Homo sapiens
actttatgctaa

SEQ ID NO: 2592091 - DNA, 13 bp, Homo sapiens
actttatgtgtaa

SEQ ID NO: 2592092 - DNA, 16 bp, Homo sapiens
actttatgtgtaaata

SEQ ID NO: 2592093 - DNA, 21 bp, Homo sapiens
actttatgtgtaaatacataa

SEQ ID NO: 2592094 - DNA, 13 bp, Homo sapiens
actttattttctg

SEQ ID NO: 2592095 - DNA, 24 bp, Homo sapiens
actttattttctggtagatagaaa

SEQ ID NO: 2592096 - DNA, 15 bp, Homo sapiens
agaggccagcctggc

SEQ ID NO: 2592097 - DNA, 15 bp, Homo sapiens
agaggccatggcaga

SEQ ID NO: 2592098 - DNA, 13 bp, Homo sapiens
agaggcctgagga

SEQ ID NO: 2592099 - DNA, 13 bp, Homo sapiens
agaggcctgcccg

SEQ ID NO: 2592100 - DNA, 19 bp, Homo sapiens
agaggccttttggaatgtg

SEQ ID NO: 2592101 - DNA, 13 bp, Homo sapiens
agaggcgggccag

SEQ ID NO: 2592102 - DNA, 15 bp, Homo sapiens
agaggcgggccagcc

SEQ ID NO: 2592103 - DNA, 19 bp, Homo sapiens
agaggcgggccagccaggc

SEQ ID NO: 2592104 - DNA, 13 bp, Homo sapiens
agaggctgaaaga

SEQ ID NO: 2592105 - DNA, 13 bp, Homo sapiens
agaggctgcagaa

SEQ ID NO: 2592106 - DNA, 21 bp, Homo sapiens
agaggctgcagaaggccaaga

SEQ ID NO: 2592107 - DNA, 14 bp, Homo sapiens
agaggctggtgctg

SEQ ID NO: 2592108 - DNA, 17 bp, Homo sapiens
agagggaagagtgcatt

SEQ ID NO: 2592109 - DNA, 16 bp, Homo sapiens
agagggacctctccca

SEQ ID NO: 2592110 - DNA, 15 bp, Homo sapiens
agagggacgcctggg

SEQ ID NO: 2592111 - DNA, 14 bp, Homo sapiens
agagggagaagaag

SEQ ID NO: 2592112 - DNA, 15 bp, Homo sapiens
agagggaggtaagga

SEQ ID NO: 2592113 - DNA, 23 bp, Homo sapiens
agagggataaggtacctttcaca

SEQ ID NO: 2592114 - DNA, 16 bp, Homo sapiens
agagggcactctgctt

SEQ ID NO: 2592115 - DNA, 16 bp, Homo sapiens
agagggcctgtgggag

SEQ ID NO: 2592116 - DNA, 19 bp, Homo sapiens
agagggcctgtgggagcct

SEQ ID NO: 2592117 - DNA, 22 bp, Homo sapiens
agaggggaacagactggaagca

SEQ ID NO: 2592118 - DNA, 16 bp, Homo sapiens
agaggggaagggccag

SEQ ID NO: 2592119 - DNA, 19 bp, Homo sapiens
agaggggaataatagaaga

SEQ ID NO: 2592120 - DNA, 15 bp, Homo sapiens
agaggggcagaacag

SEQ ID NO: 2592121 - DNA, 12 bp, Homo sapiens
agaggggcagcc

SEQ ID NO: 2592122 - DNA, 18 bp, Homo sapiens
agaggggcagcccttgct

SEQ ID NO: 2592123 - DNA, 19 bp, Homo sapiens
agaggggcagcccttgctt

SEQ ID NO: 2592124 - DNA, 20 bp, Homo sapiens
agaggggtacatttccctgt

SEQ ID NO: 2592125 - DNA, 22 bp, Homo sapiens
agagggtgacaagatagagagc

SEQ ID NO: 2592126 - DNA, 17 bp, Homo sapiens
agaggtatttatcttta

SEQ ID NO: 2592127 - DNA, 12 bp, Homo sapiens
agaggtcttttt

SEQ ID NO: 2592128 - DNA, 14 bp, Homo sapiens
agaggtgagggaag

SEQ ID NO: 2592129 - DNA, 18 bp, Homo sapiens
agaggtgccagcaactga

SEQ ID NO: 2592130 - DNA, 20 bp, Homo sapiens
agaggtgccagcaactgaat

SEQ ID NO: 2592131 - DNA, 21 bp, Homo sapiens
agaggtgccagcaactgaata

SEQ ID NO: 2592132 - DNA, 13 bp, Homo sapiens
agaggtggccaga

SEQ ID NO: 2592133 - DNA, 13 bp, Homo sapiens
agaggtgggcagg

SEQ ID NO: 2592134 - DNA, 17 bp, Homo sapiens
agaggtgggcaggtggt

SEQ ID NO: 2592135 - DNA, 19 bp, Homo sapiens
agaggtgggcaggtggtgg

SEQ ID NO: 2592136 - DNA, 17 bp, Homo sapiens
agaggttcatttcaaat

SEQ ID NO: 2592137 - DNA, 15 bp, Homo sapiens
agaggttgcagtgag

SEQ ID NO: 2592138 - DNA, 16 bp, Homo sapiens
agagtacagtgagcca

SEQ ID NO: 2592139 - DNA, 18 bp, Homo sapiens
agagtatattatgtattt

SEQ ID NO: 2592140 - DNA, 14 bp, Homo sapiens
agagtatgaacacc

SEQ ID NO: 2592141 - DNA, 13 bp, Homo sapiens
agagtatggagct

SEQ ID NO: 2592142 - DNA, 16 bp, Homo sapiens
agagtcagcagaactg

SEQ ID NO: 2592143 - DNA, 14 bp, Homo sapiens
agagtcatctccat

SEQ ID NO: 2592144 - DNA, 14 bp, Homo sapiens
agagtccaggcccc

SEQ ID NO: 2592145 - DNA, 16 bp, Homo sapiens
agagtccaggccccaa

SEQ ID NO: 2592146 - DNA, 14 bp, Homo sapiens
agagtcccactgcc

SEQ ID NO: 2592147 - DNA, 20 bp, Homo sapiens
agagtcccactgcctcaggt

SEQ ID NO: 2592148 - DNA, 21 bp, Homo sapiens
agagtcccactgcctcaggtt

SEQ ID NO: 2592149 - DNA, 12 bp, Homo sapiens
agagtcctattt

SEQ ID NO: 2592150 - DNA, 14 bp, Homo sapiens
agagtcctcactcc

SEQ ID NO: 2592151 - DNA, 23 bp, Homo sapiens
agagtctggtgaagctcacttct

SEQ ID NO: 2592152 - DNA, 16 bp, Homo sapiens
agagtgaaaattgtct

SEQ ID NO: 2592153 - DNA, 15 bp, Homo sapiens
agagtgagaccctgt

SEQ ID NO: 2592154 - DNA, 18 bp, Homo sapiens
agagtgagactcagtctt

SEQ ID NO: 2592155 - DNA, 17 bp, Homo sapiens
agagtgataatacaagt

SEQ ID NO: 2592156 - DNA, 13 bp, Homo sapiens
agagtgcaacagt

SEQ ID NO: 2592157 - DNA, 21 bp, Homo sapiens
agagtgcgccgagtctgtctc

SEQ ID NO: 2592158 - DNA, 16 bp, Homo sapiens
agagtggcctggccag

SEQ ID NO: 2592159 - DNA, 19 bp, Homo sapiens
agagtggcctggccaggag

SEQ ID NO: 2592160 - DNA, 22 bp, Homo sapiens
agagtggcctggccaggagctc

SEQ ID NO: 2592161 - DNA, 16 bp, Homo sapiens
agagtgggtttcacaa

SEQ ID NO: 2592162 - DNA, 15 bp, Homo sapiens
agagtgtagaagcat

SEQ ID NO: 2592163 - DNA, 16 bp, Homo sapiens
agagtgtagaagcatt

SEQ ID NO: 2592164 - DNA, 17 bp, Homo sapiens
agagtgtggccttcgga

SEQ ID NO: 2592165 - DNA, 17 bp, Homo sapiens
agagttaagaagctgtt

SEQ ID NO: 2592166 - DNA, 20 bp, Homo sapiens
agagttaagaagctgttgta

SEQ ID NO: 2592167 - DNA, 17 bp, Homo sapiens
agagttgttacattttt

SEQ ID NO: 2592168 - DNA, 19 bp, Homo sapiens
agagttgttacatttttaa

SEQ ID NO: 2592169 - DNA, 20 bp, Homo sapiens
agagttgttacatttttaag

SEQ ID NO: 2592170 - DNA, 16 bp, Homo sapiens
agagtttagttgtagc

SEQ ID NO: 2592171 - DNA, 13 bp, Homo sapiens
agagtttgaagga

SEQ ID NO: 2592172 - DNA, 19 bp, Homo sapiens
agagtttgaaggaggtgag

SEQ ID NO: 2592173 - DNA, 19 bp, Homo sapiens
agagtttgtgtgttgtctt

SEQ ID NO: 2592174 - DNA, 22 bp, Homo sapiens
agagtttgtgtgttgtcttgaa

SEQ ID NO: 2592175 - DNA, 14 bp, Homo sapiens
agagttttgtcttg

SEQ ID NO: 2592176 - DNA, 19 bp, Homo sapiens
agagttttgtcttgaatgt

SEQ ID NO: 2592177 - DNA, 21 bp, Homo sapiens
agataaaattatagatgggaa

SEQ ID NO: 2592178 - DNA, 16 bp, Homo sapiens
agataaagatgatcta

SEQ ID NO: 2592179 - DNA, 14 bp, Homo sapiens
agataaagatttct

SEQ ID NO: 2592180 - DNA, 17 bp, Homo sapiens
agataaagatttcttga

SEQ ID NO: 2592181 - DNA, 21 bp, Homo sapiens
agataacaagatctttcagga

SEQ ID NO: 2592182 - DNA, 16 bp, Homo sapiens
agataagcaagagaga

SEQ ID NO: 2592183 - DNA, 17 bp, Homo sapiens
agataagcaagagagat

SEQ ID NO: 2592184 - DNA, 13 bp, Homo sapiens
agataatagttta

SEQ ID NO: 2592185 - DNA, 16 bp, Homo sapiens
agataatctagaacac

SEQ ID NO: 2592186 - DNA, 22 bp, Homo sapiens
agattgcatgtgactctgaagc

SEQ ID NO: 2592187 - DNA, 21 bp, Homo sapiens
agattgcgccattgcactcca

SEQ ID NO: 2592188 - DNA, 13 bp, Homo sapiens
agattgctgaaat

SEQ ID NO: 2592189 - DNA, 22 bp, Homo sapiens
agattgctgaaattttatatgc

SEQ ID NO: 2592190 - DNA, 23 bp, Homo sapiens
agattgttgtttgccatactttg

SEQ ID NO: 2592191 - DNA, 23 bp, Homo sapiens
agattgttttatcatgacatgtt

SEQ ID NO: 2592192 - DNA, 22 bp, Homo sapiens
agatttaattaatcatgaatgt

SEQ ID NO: 2592193 - DNA, 16 bp, Homo sapiens
agatttacactgggag

SEQ ID NO: 2592194 - DNA, 15 bp, Homo sapiens
agatttatcaaatca

SEQ ID NO: 2592195 - DNA, 16 bp, Homo sapiens
agatttatcaaatcag

SEQ ID NO: 2592196 - DNA, 19 bp, Homo sapiens
agatttcttgagttttgtt

SEQ ID NO: 2592197 - DNA, 17 bp, Homo sapiens
agatttgggctggaaca

SEQ ID NO: 2592198 - DNA, 11 bp, Homo sapiens
agatttgtgaa

SEQ ID NO: 2592199 - DNA, 13 bp, Homo sapiens
agatttgtgaact

SEQ ID NO: 2592200 - DNA, 21 bp, Homo sapiens
agatttgtgaactcagccaag

SEQ ID NO: 2592201 - DNA, 13 bp, Homo sapiens
agatttgtgttat

SEQ ID NO: 2592202 - DNA, 19 bp, Homo sapiens
agattttaaattcacaata

SEQ ID NO: 2592203 - DNA, 14 bp, Homo sapiens
agattttaattttg

SEQ ID NO: 2592204 - DNA, 15 bp, Homo sapiens
agattttaggtgttg

SEQ ID NO: 2592205 - DNA, 13 bp, Homo sapiens
agattttctttaa

SEQ ID NO: 2592206 - DNA, 16 bp, Homo sapiens
agattttgcttttcca

SEQ ID NO: 2592207 - DNA, 17 bp, Homo sapiens
agatttttcatgatttt

SEQ ID NO: 2592208 - DNA, 22 bp, Homo sapiens
agatttttctcaaagttttgaa

SEQ ID NO: 2592209 - DNA, 21 bp, Homo sapiens
agcaaaagggtgtctgagccc

SEQ ID NO: 2592210 - DNA, 13 bp, Homo sapiens
agcaaacagagga

SEQ ID NO: 2592211 - DNA, 13 bp, Homo sapiens
agcaaactctttt

SEQ ID NO: 2592212 - DNA, 12 bp, Homo sapiens
agcaaagagtgg

SEQ ID NO: 2592213 - DNA, 22 bp, Homo sapiens
agcaaagagtgggctgcatctg

SEQ ID NO: 2592214 - DNA, 15 bp, Homo sapiens
agcaaagatcaaaat

SEQ ID NO: 2592215 - DNA, 17 bp, Homo sapiens
agcaaagatcaaaataa

SEQ ID NO: 2592216 - DNA, 23 bp, Homo sapiens
agcaaaggagtagaaagacagag

SEQ ID NO: 2592217 - DNA, 19 bp, Homo sapiens
agcaaataaactaggaaat

SEQ ID NO: 2592218 - DNA, 20 bp, Homo sapiens
agcaaatcagaaacttgtga

SEQ ID NO: 2592219 - DNA, 16 bp, Homo sapiens
agcaaatgtggctcct

SEQ ID NO: 2592220 - DNA, 17 bp, Homo sapiens
agcaaatgtttctgcag

SEQ ID NO: 2592221 - DNA, 11 bp, Homo sapiens
agcaaattgat

SEQ ID NO: 2592222 - DNA, 23 bp, Homo sapiens
agcaacagagtgagaccctgtct

SEQ ID NO: 2592223 - DNA, 19 bp, Homo sapiens
agcaacaggttttataatt

SEQ ID NO: 2592224 - DNA, 22 bp, Homo sapiens
agcaaccctcctatcacctccc

SEQ ID NO: 2592225 - DNA, 14 bp, Homo sapiens
agcaacgcaggccc

SEQ ID NO: 2592226 - DNA, 23 bp, Homo sapiens
agcaacgcaggcccccaggtgcc

SEQ ID NO: 2592227 - DNA, 20 bp, Homo sapiens
agcaacgtagcttctaccat

SEQ ID NO: 2592228 - DNA, 13 bp, Homo sapiens
agcaactgttatg

SEQ ID NO: 2592229 - DNA, 21 bp, Homo sapiens
agcaacttgtctttttctgga

SEQ ID NO: 2592230 - DNA, 13 bp, Homo sapiens
agcaactttctta

SEQ ID NO: 2592231 - DNA, 12 bp, Homo sapiens
agcaagaaagaa

SEQ ID NO: 2592232 - DNA, 21 bp, Homo sapiens
agcaagaagatcctaaaacaa

SEQ ID NO: 2592233 - DNA, 13 bp, Homo sapiens
agcaagacgctgt

SEQ ID NO: 2592234 - DNA, 16 bp, Homo sapiens
agcaagacgctgtgct

SEQ ID NO: 2592235 - DNA, 20 bp, Homo sapiens
agcaagacgctgtgctgccc

SEQ ID NO: 2592236 - DNA, 22 bp, Homo sapiens
agcaagacgctgtgctgccctg

SEQ ID NO: 2592237 - DNA, 12 bp, Homo sapiens
agcaagagagat

SEQ ID NO: 2592238 - DNA, 15 bp, Homo sapiens
agcaagagagatgtt

SEQ ID NO: 2592239 - DNA, 21 bp, Homo sapiens
agcaagatcctgtctttaagg

SEQ ID NO: 2592240 - DNA, 19 bp, Homo sapiens
agcaaggagatttacaact

SEQ ID NO: 2592241 - DNA, 13 bp, Homo sapiens
agcaagtctcttt

SEQ ID NO: 2592242 - DNA, 20 bp, Homo sapiens
agcaagtgagaccctgtctc

SEQ ID NO: 2592243 - DNA, 20 bp, Homo sapiens
agcaagttctagagaagagg

SEQ ID NO: 2592244 - DNA, 21 bp, Homo sapiens
agcaagttctagagaagaggc

SEQ ID NO: 2592245 - DNA, 16 bp, Homo sapiens
agcaataaagaagagt

SEQ ID NO: 2592246 - DNA, 12 bp, Homo sapiens
agcaatatgcat

SEQ ID NO: 2592247 - DNA, 22 bp, Homo sapiens
agcaatccatgttagtttttac

SEQ ID NO: 2592248 - DNA, 19 bp, Homo sapiens
agcaatgacatctcagggg

SEQ ID NO: 2592249 - DNA, 19 bp, Homo sapiens
agcaatgatgtccagaaga

SEQ ID NO: 2592250 - DNA, 13 bp, Homo sapiens
agcaatgcatttt

SEQ ID NO: 2592251 - DNA, 21 bp, Homo sapiens
agcaatgcccgtaatgcttag

SEQ ID NO: 2592252 - DNA, 21 bp, Homo sapiens
agcaatggacggtccgcagaa

SEQ ID NO: 2592253 - DNA, 14 bp, Homo sapiens
agcaattccaacct

SEQ ID NO: 2592254 - DNA, 15 bp, Homo sapiens
agcaattccaacctt

SEQ ID NO: 2592255 - DNA, 21 bp, Homo sapiens
agagcgcctgcccctcccaga

SEQ ID NO: 2592256 - DNA, 16 bp, Homo sapiens
agagctacttgggcca

SEQ ID NO: 2592257 - DNA, 20 bp, Homo sapiens
agagctcccggcgtggtgga

SEQ ID NO: 2592258 - DNA, 18 bp, Homo sapiens
agagctgacacaaacctg

SEQ ID NO: 2592259 - DNA, 23 bp, Homo sapiens
agagctgacacaggatgaaggca

SEQ ID NO: 2592260 - DNA, 13 bp, Homo sapiens
agagctgatccag

SEQ ID NO: 2592261 - DNA, 18 bp, Homo sapiens
agagctgatccagagcac

SEQ ID NO: 2592262 - DNA, 19 bp, Homo sapiens
agagctgatccagagcaca

SEQ ID NO: 2592263 - DNA, 21 bp, Homo sapiens
agagctgccctccttgtccac

SEQ ID NO: 2592264 - DNA, 22 bp, Homo sapiens
agagctgctctggaaaatgtga

SEQ ID NO: 2592265 - DNA, 17 bp, Homo sapiens
agagctggagcctggtg

SEQ ID NO: 2592266 - DNA, 12 bp, Homo sapiens
agagctgggagg

SEQ ID NO: 2592267 - DNA, 15 bp, Homo sapiens
agagctggtgcccgg

SEQ ID NO: 2592268 - DNA, 16 bp, Homo sapiens
agagctggttgggaag

SEQ ID NO: 2592269 - DNA, 20 bp, Homo sapiens
agagctgttcccaaattttc

SEQ ID NO: 2592270 - DNA, 19 bp, Homo sapiens
agagctgtttatggcctca

SEQ ID NO: 2592271 - DNA, 20 bp, Homo sapiens
agagctgtttatggcctcag

SEQ ID NO: 2592272 - DNA, 21 bp, Homo sapiens
agagctgtttatggcctcagc

SEQ ID NO: 2592273 - DNA, 21 bp, Homo sapiens
agagcttaatgataatattgt

SEQ ID NO: 2592274 - DNA, 13 bp, Homo sapiens
agagcttccctga

SEQ ID NO: 2592275 - DNA, 17 bp, Homo sapiens
agagcttccctgactca

SEQ ID NO: 2592276 - DNA, 17 bp, Homo sapiens
agagcttgatgccagta

SEQ ID NO: 2592277 - DNA, 13 bp, Homo sapiens
agagcttggactg

SEQ ID NO: 2592278 - DNA, 23 bp, Homo sapiens
agagcttggactggatgcatgtt

SEQ ID NO: 2592279 - DNA, 23 bp, Homo sapiens
agagctttctgtccttttggcac

SEQ ID NO: 2592280 - DNA, 22 bp, Homo sapiens
agaggaaaagtaaggtgcagtt

SEQ ID NO: 2592281 - DNA, 12 bp, Homo sapiens
agaggaactgtc

SEQ ID NO: 2592282 - DNA, 21 bp, Homo sapiens
agaggaactgtccagagagca

SEQ ID NO: 2592283 - DNA, 22 bp, Homo sapiens
agaggaagaatttgttatcagt

SEQ ID NO: 2592284 - DNA, 20 bp, Homo sapiens
agaggaaggggccagaggct

SEQ ID NO: 2592285 - DNA, 20 bp, Homo sapiens
agaggacagtatttgtgggg

SEQ ID NO: 2592286 - DNA, 19 bp, Homo sapiens
agaggactcacttgcccac

SEQ ID NO: 2592287 - DNA, 23 bp, Homo sapiens
agaggacttttctttgtggcttc

SEQ ID NO: 2592288 - DNA, 14 bp, Homo sapiens
agaggagaaacaca

SEQ ID NO: 2592289 - DNA, 15 bp, Homo sapiens
agaggagaaacacat

SEQ ID NO: 2592290 - DNA, 14 bp, Homo sapiens
agaggagagccaga

SEQ ID NO: 2592291 - DNA, 19 bp, Homo sapiens
agaggagcgggacctgtgg

SEQ ID NO: 2592292 - DNA, 17 bp, Homo sapiens
agaggagggatgctgcc

SEQ ID NO: 2592293 - DNA, 16 bp, Homo sapiens
agaggagtgactgagc

SEQ ID NO: 2592294 - DNA, 13 bp, Homo sapiens
agaggagttcaat

SEQ ID NO: 2592295 - DNA, 16 bp, Homo sapiens
agaggagttcaatgat

SEQ ID NO: 2592296 - DNA, 17 bp, Homo sapiens
agaggagttcaatgatc

SEQ ID NO: 2592297 - DNA, 18 bp, Homo sapiens
agaggagttcaatgatct

SEQ ID NO: 2592298 - DNA, 22 bp, Homo sapiens
agaggatgaatgtatgtgcact

SEQ ID NO: 2592299 - DNA, 17 bp, Homo sapiens
agaggatgagagcccag

SEQ ID NO: 2592300 - DNA, 18 bp, Homo sapiens
agaggatttttttctgag

SEQ ID NO: 2592301 - DNA, 21 bp, Homo sapiens
agaggatttttttctgagcga

SEQ ID NO: 2592302 - DNA, 18 bp, Homo sapiens
agaggcaactgcattggc

SEQ ID NO: 2592303 - DNA, 17 bp, Homo sapiens
agaggcagagaaagaag

SEQ ID NO: 2592304 - DNA, 13 bp, Homo sapiens
agaggcagcccca

SEQ ID NO: 2592305 - DNA, 23 bp, Homo sapiens
agaggcagccccattctgcctgc

SEQ ID NO: 2592306 - DNA, 10 bp, Homo sapiens
agaggcaggg

SEQ ID NO: 2592307 - DNA, 16 bp, Homo sapiens
agaggccagccccacc

SEQ ID NO: 2592308 - DNA, 14 bp, Homo sapiens
agaggccagcctgg

SEQ ID NO: 2592309 - DNA, 22 bp, Homo sapiens
agcagccaagctccttgggagg

SEQ ID NO: 2592310 - DNA, 15 bp, Homo sapiens
agcagccacattcct

SEQ ID NO: 2592311 - DNA, 15 bp, Homo sapiens
agcagccagctctca

SEQ ID NO: 2592312 - DNA, 17 bp, Homo sapiens
agcagccagctctcagc

SEQ ID NO: 2592313 - DNA, 20 bp, Homo sapiens
agcagccatcataggaaggg

SEQ ID NO: 2592314 - DNA, 16 bp, Homo sapiens
agcagccctggagtca

SEQ ID NO: 2592315 - DNA, 14 bp, Homo sapiens
agcagcctgtggca

SEQ ID NO: 2592316 - DNA, 20 bp, Homo sapiens
agcagcgaccacccctgcct

SEQ ID NO: 2592317 - DNA, 13 bp, Homo sapiens
agcagcgtttcta

SEQ ID NO: 2592318 - DNA, 19 bp, Homo sapiens
agcagcgtttctatgacac

SEQ ID NO: 2592319 - DNA, 12 bp, Homo sapiens
agcagctcaggc

SEQ ID NO: 2592320 - DNA, 13 bp, Homo sapiens
agcagctcaggca

SEQ ID NO: 2592321 - DNA, 21 bp, Homo sapiens
agcagctcaggcacacttctt

SEQ ID NO: 2592322 - DNA, 16 bp, Homo sapiens
agcagctcttgctaat

SEQ ID NO: 2592323 - DNA, 17 bp, Homo sapiens
agcagctcttgctaatc

SEQ ID NO: 2592324 - DNA, 10 bp, Homo sapiens
agcagctgga

SEQ ID NO: 2592325 - DNA, 13 bp, Homo sapiens
agcagctggacta

SEQ ID NO: 2592326 - DNA, 18 bp, Homo sapiens
agcagctggactacccac

SEQ ID NO: 2592327 - DNA, 17 bp, Homo sapiens
agcagctttaaacaaat

SEQ ID NO: 2592328 - DNA, 21 bp, Homo sapiens
agcagcttttttttcccccct

SEQ ID NO: 2592329 - DNA, 21 bp, Homo sapiens
agcaggaagcattcagagagc

SEQ ID NO: 2592330 - DNA, 22 bp, Homo sapiens
agcaggaagcattcagagagca

SEQ ID NO: 2592331 - DNA, 17 bp, Homo sapiens
agcaggagaggagagcc

SEQ ID NO: 2592332 - DNA, 21 bp, Homo sapiens
agcaggccttgcgctgttgcg

SEQ ID NO: 2592333 - DNA, 21 bp, Homo sapiens
agcaggcgttcagctcactgt

SEQ ID NO: 2592334 - DNA, 16 bp, Homo sapiens
agcaggctacactgac

SEQ ID NO: 2592335 - DNA, 14 bp, Homo sapiens
agcaggctactgtc

SEQ ID NO: 2592336 - DNA, 16 bp, Homo sapiens
agcaggctactgtcag

SEQ ID NO: 2592337 - DNA, 19 bp, Homo sapiens
agcaggctactgtcagctc

SEQ ID NO: 2592338 - DNA, 13 bp, Homo sapiens
agcaggctggcag

SEQ ID NO: 2592339 - DNA, 16 bp, Homo sapiens
agcaggctggcagctc

SEQ ID NO: 2592340 - DNA, 24 bp, Homo sapiens
agcaggctggcagctctccagtca

SEQ ID NO: 2592341 - DNA, 15 bp, Homo sapiens
agcagggaaacagct

SEQ ID NO: 2592342 - DNA, 19 bp, Homo sapiens
agcagggcatggctgggaa

SEQ ID NO: 2592343 - DNA, 13 bp, Homo sapiens
agcagggctcagc

SEQ ID NO: 2592344 - DNA, 23 bp, Homo sapiens
agcagggctctgccccagaggcc

SEQ ID NO: 2592345 - DNA, 21 bp, Homo sapiens
agcagggtagtctggtttcta

SEQ ID NO: 2592346 - DNA, 16 bp, Homo sapiens
agcagggtcttttcat

SEQ ID NO: 2592347 - DNA, 18 bp, Homo sapiens
agcagggtcttttcatct

SEQ ID NO: 2592348 - DNA, 22 bp, Homo sapiens
agcagggtcttttcatctggga

SEQ ID NO: 2592349 - DNA, 23 bp, Homo sapiens
agcagggtcttttcatctgggaa

SEQ ID NO: 2592350 - DNA, 15 bp, Homo sapiens
agcagggtgctgtgg

SEQ ID NO: 2592351 - DNA, 17 bp, Homo sapiens
agcaggtgggaaatggt

SEQ ID NO: 2592352 - DNA, 13 bp, Homo sapiens
agcaggtggtcct

SEQ ID NO: 2592353 - DNA, 21 bp, Homo sapiens
agcagtgaatgattcagtgtt

SEQ ID NO: 2592354 - DNA, 16 bp, Homo sapiens
agcagtgagtctcttc

SEQ ID NO: 2592355 - DNA, 13 bp, Homo sapiens
agcagtgcaggca

SEQ ID NO: 2592356 - DNA, 20 bp, Homo sapiens
agcagtgccttccataatta

SEQ ID NO: 2592357 - DNA, 15 bp, Homo sapiens
agcagtggacaccag

SEQ ID NO: 2592358 - DNA, 20 bp, Homo sapiens
agcagtgtcttccataatgt

SEQ ID NO: 2592359 - DNA, 22 bp, Homo sapiens
agcagttaactttaagactgag

SEQ ID NO: 2592360 - DNA, 13 bp, Homo sapiens
agcagttgaaaag

SEQ ID NO: 2592361 - DNA, 16 bp, Homo sapiens
agcagttgaaaagact

SEQ ID NO: 2592362 - DNA, 23 bp, Homo sapiens
agcagttgagtcgtcatcacttt

SEQ ID NO: 2592363 - DNA, 18 bp, Homo sapiens
agcagtttctgtcctgct

SEQ ID NO: 2592364 - DNA, 19 bp, Homo sapiens
agcataaaaattagccaag

SEQ ID NO: 2592365 - DNA, 23 bp, Homo sapiens
agcataagtttctgggacctcag

SEQ ID NO: 2592366 - DNA, 12 bp, Homo sapiens
agcatacaactt

SEQ ID NO: 2592367 - DNA, 13 bp, Homo sapiens
agcatacatttat

SEQ ID NO: 2592368 - DNA, 16 bp, Homo sapiens
agcatacctttattgt

SEQ ID NO: 2592369 - DNA, 17 bp, Homo sapiens
agcatacgtacacattt

SEQ ID NO: 2592370 - DNA, 12 bp, Homo sapiens
agcatatgagga

SEQ ID NO: 2592371 - DNA, 16 bp, Homo sapiens
agcatatgaggatgca

SEQ ID NO: 2592372 - DNA, 23 bp, Homo sapiens
agcatatgaggatgcagagtcag

SEQ ID NO: 2592373 - DNA, 16 bp, Homo sapiens
agcatattcaggaagc

SEQ ID NO: 2592374 - DNA, 17 bp, Homo sapiens
agcatattcaggaagct

SEQ ID NO: 2592375 - DNA, 21 bp, Homo sapiens
agcatattcaggaagctcagg

SEQ ID NO: 2592376 - DNA, 15 bp, Homo sapiens
agcatcacctcaggc

SEQ ID NO: 2592377 - DNA, 16 bp, Homo sapiens
agcatcacctcaggcc

SEQ ID NO: 2592378 - DNA, 17 bp, Homo sapiens
agcatcaggccaggccc

SEQ ID NO: 2592379 - DNA, 18 bp, Homo sapiens
agcatcaggccaggccct

SEQ ID NO: 2592380 - DNA, 22 bp, Homo sapiens
agcatcattttgcattcaaatt

SEQ ID NO: 2592381 - DNA, 15 bp, Homo sapiens
agcatccacctcctt

SEQ ID NO: 2592382 - DNA, 16 bp, Homo sapiens
agcatccacctccttc

SEQ ID NO: 2592383 - DNA, 22 bp, Homo sapiens
agcatcccaggatcgcaagagc

SEQ ID NO: 2592384 - DNA, 20 bp, Homo sapiens
agcatccctgaggagccagg

SEQ ID NO: 2592385 - DNA, 14 bp, Homo sapiens
agcatcctggcacc

SEQ ID NO: 2592386 - DNA, 18 bp, Homo sapiens
agcatcctggcacccggc

SEQ ID NO: 2592387 - DNA, 23 bp, Homo sapiens
agcatcctggcacccggcccctg

SEQ ID NO: 2592388 - DNA, 14 bp, Homo sapiens
ataccttttttaga

SEQ ID NO: 2592389 - DNA, 14 bp, Homo sapiens
atacgtacacattt

SEQ ID NO: 2592390 - DNA, 14 bp, Homo sapiens
atacgtccaccatg

SEQ ID NO: 2592391 - DNA, 13 bp, Homo sapiens
atacgtgtagcta

SEQ ID NO: 2592392 - DNA, 13 bp, Homo sapiens
atactaaccagca

SEQ ID NO: 2592393 - DNA, 20 bp, Homo sapiens
atactaaccagcagaaatgc

SEQ ID NO: 2592394 - DNA, 15 bp, Homo sapiens
atactacagtttgtt

SEQ ID NO: 2592395 - DNA, 16 bp, Homo sapiens
atactacagtttgtta

SEQ ID NO: 2592396 - DNA, 13 bp, Homo sapiens
atactagttgtga

SEQ ID NO: 2592397 - DNA, 22 bp, Homo sapiens
atactatttaaagcctcctcat

SEQ ID NO: 2592398 - DNA, 23 bp, Homo sapiens
atactatttagtttttgtaattt

SEQ ID NO: 2592399 - DNA, 17 bp, Homo sapiens
atactcataatgtgaag

SEQ ID NO: 2592400 - DNA, 19 bp, Homo sapiens
atactcataatgtgaagtg

SEQ ID NO: 2592401 - DNA, 20 bp, Homo sapiens
atactcataatgtgaagtgt

SEQ ID NO: 2592402 - DNA, 19 bp, Homo sapiens
atactgactgagaatataa

SEQ ID NO: 2592403 - DNA, 15 bp, Homo sapiens
atactgccagatgct

SEQ ID NO: 2592404 - DNA, 18 bp, Homo sapiens
atactggaagttttgcat

SEQ ID NO: 2592405 - DNA, 12 bp, Homo sapiens
atactgtaaaga

SEQ ID NO: 2592406 - DNA, 13 bp, Homo sapiens
atactgtaaagaa

SEQ ID NO: 2592407 - DNA, 16 bp, Homo sapiens
atactgtaaagaaaga

SEQ ID NO: 2592408 - DNA, 20 bp, Homo sapiens
atactgtaaagaaagagaga

SEQ ID NO: 2592409 - DNA, 21 bp, Homo sapiens
atactgtaaagaaagagagaa

SEQ ID NO: 2592410 - DNA, 20 bp, Homo sapiens
atactgtacaatgactttat

SEQ ID NO: 2592411 - DNA, 15 bp, Homo sapiens
atactgtattaagag

SEQ ID NO: 2592412 - DNA, 19 bp, Homo sapiens
atactgtattttgtattgt

SEQ ID NO: 2592413 - DNA, 21 bp, Homo sapiens
atactgtcggttttttttaaa

SEQ ID NO: 2592414 - DNA, 12 bp, Homo sapiens
atactgtttgag

SEQ ID NO: 2592415 - DNA, 16 bp, Homo sapiens
atacttatctctctgt

SEQ ID NO: 2592416 - DNA, 12 bp, Homo sapiens
atacttcaaaag

SEQ ID NO: 2592417 - DNA, 21 bp, Homo sapiens
atacttctcaaacctgtttaa

SEQ ID NO: 2592418 - DNA, 17 bp, Homo sapiens
atacttgtcttgttcac

SEQ ID NO: 2592419 - DNA, 14 bp, Homo sapiens
atactttaaaggaa

SEQ ID NO: 2592420 - DNA, 15 bp, Homo sapiens
atactttagtgaacg

SEQ ID NO: 2592421 - DNA, 23 bp, Homo sapiens
atactttagtgaacgtggactcc

SEQ ID NO: 2592422 - DNA, 21 bp, Homo sapiens
atactttcatcctgactctgc

SEQ ID NO: 2592423 - DNA, 19 bp, Homo sapiens
atactttttaaatgtaaag

SEQ ID NO: 2592424 - DNA, 19 bp, Homo sapiens
atagaaataagtggttatt

SEQ ID NO: 2592425 - DNA, 13 bp, Homo sapiens
atagaaatgctgg

SEQ ID NO: 2592426 - DNA, 19 bp, Homo sapiens
atagaaatgctggtttttc

SEQ ID NO: 2592427 - DNA, 15 bp, Homo sapiens
atagaaatttccaga

SEQ ID NO: 2592428 - DNA, 17 bp, Homo sapiens
atagaacagagaaagag

SEQ ID NO: 2592429 - DNA, 20 bp, Homo sapiens
atagaagaatacaaacatat

SEQ ID NO: 2592430 - DNA, 13 bp, Homo sapiens
atagaagctgtag

SEQ ID NO: 2592431 - DNA, 12 bp, Homo sapiens
atagaatattta

SEQ ID NO: 2592432 - DNA, 19 bp, Homo sapiens
atagaatatttattacctc

SEQ ID NO: 2592433 - DNA, 23 bp, Homo sapiens
atagacaatttattatggcacat

SEQ ID NO: 2592434 - DNA, 21 bp, Homo sapiens
atagagagggagaagaagtca

SEQ ID NO: 2592435 - DNA, 14 bp, Homo sapiens
atagagtgttatca

SEQ ID NO: 2592436 - DNA, 20 bp, Homo sapiens
atagataagagtagaaactg

SEQ ID NO: 2592437 - DNA, 19 bp, Homo sapiens
atagatgcaagatatttat

SEQ ID NO: 2592438 - DNA, 21 bp, Homo sapiens
atagatgcaagatatttatat

SEQ ID NO: 2592439 - DNA, 22 bp, Homo sapiens
atagatgtccctttcttggcca

SEQ ID NO: 2592440 - DNA, 23 bp, Homo sapiens
atagatgtccctttcttggccag

SEQ ID NO: 2592441 - DNA, 18 bp, Homo sapiens
atagatgtctaggtactt

SEQ ID NO: 2592442 - DNA, 14 bp, Homo sapiens
atagattataactt

SEQ ID NO: 2592443 - DNA, 21 bp, Homo sapiens
atagattataacttgtctaaa

SEQ ID NO: 2592444 - DNA, 16 bp, Homo sapiens
atagcaacactctata

SEQ ID NO: 2592445 - DNA, 13 bp, Homo sapiens
atagcaagtgaat

SEQ ID NO: 2592446 - DNA, 18 bp, Homo sapiens
atagcacagaccctgccc

SEQ ID NO: 2592447 - DNA, 14 bp, Homo sapiens
atagcaccagggct

SEQ ID NO: 2592448 - DNA, 15 bp, Homo sapiens
atagcactgagcaaa

SEQ ID NO: 2592449 - DNA, 15 bp, Homo sapiens
atagcattgtgaact

SEQ ID NO: 2592450 - DNA, 22 bp, Homo sapiens
atagccacatccctttgaaaca

SEQ ID NO: 2592451 - DNA, 19 bp, Homo sapiens
atagccacttaccttcaat

SEQ ID NO: 2592452 - DNA, 14 bp, Homo sapiens
atagcccaggtcct

SEQ ID NO: 2592453 - DNA, 17 bp, Homo sapiens
atagcctaggtgacaga

SEQ ID NO: 2592454 - DNA, 16 bp, Homo sapiens
atagcctatatttaca

SEQ ID NO: 2592455 - DNA, 18 bp, Homo sapiens
atagcctgcctcttctct

SEQ ID NO: 2592456 - DNA, 20 bp, Homo sapiens
atagcgggttactttcacat

SEQ ID NO: 2592457 - DNA, 22 bp, Homo sapiens
atagctaacattttaaataaaa

SEQ ID NO: 2592458 - DNA, 16 bp, Homo sapiens
atagctacaggaagca

SEQ ID NO: 2592459 - DNA, 16 bp, Homo sapiens
atagctatatccatgt

SEQ ID NO: 2592460 - DNA, 14 bp, Homo sapiens
atagctattactgt

SEQ ID NO: 2592461 - DNA, 18 bp, Homo sapiens
atagctatttttatggaa

SEQ ID NO: 2592462 - DNA, 20 bp, Homo sapiens
atagctcaggtgtccctgca

SEQ ID NO: 2592463 - DNA, 13 bp, Homo sapiens
atagctcagttta

SEQ ID NO: 2592464 - DNA, 20 bp, Homo sapiens
atagctccccgcttctgcct

SEQ ID NO: 2592465 - DNA, 15 bp, Homo sapiens
atagctctttcaggg

SEQ ID NO: 2592466 - DNA, 22 bp, Homo sapiens
atagctggtcttatttgtaaag

SEQ ID NO: 2592467 - DNA, 23 bp, Homo sapiens
atagctggtcttatttgtaaagc

SEQ ID NO: 2592468 - DNA, 21 bp, Homo sapiens
atagcttcaccccaatcccag

SEQ ID NO: 2592469 - DNA, 23 bp, Homo sapiens
atagcttgcgcattctcatggag

SEQ ID NO: 2592470 - DNA, 18 bp, Homo sapiens
atagctttattttttaag

SEQ ID NO: 2592471 - DNA, 23 bp, Homo sapiens
atagctttattttttaagtattt

SEQ ID NO: 2592472 - DNA, 17 bp, Homo sapiens
atagcttttattgtata

SEQ ID NO: 2592473 - DNA, 21 bp, Homo sapiens
ataggaacatatgaaaataca

SEQ ID NO: 2592474 - DNA, 21 bp, Homo sapiens
ataggagaggatgagagccca

SEQ ID NO: 2592475 - DNA, 23 bp, Homo sapiens
ataggagaggatgagagcccaga

SEQ ID NO: 2592476 - DNA, 24 bp, Homo sapiens
ataggagaggatgagagcccagag

SEQ ID NO: 2592477 - DNA, 13 bp, Homo sapiens
ataggagcctgct

SEQ ID NO: 2592478 - DNA, 13 bp, Homo sapiens
ataggctctgcac

SEQ ID NO: 2592479 - DNA, 19 bp, Homo sapiens
ataggctctgcacagatgg

SEQ ID NO: 2592480 - DNA, 16 bp, Homo sapiens
ataggctggagaagct

SEQ ID NO: 2592481 - DNA, 21 bp, Homo sapiens
atagggtctcttcaggttctt

SEQ ID NO: 2592482 - DNA, 17 bp, Homo sapiens
ataggtcactggctctc

SEQ ID NO: 2592483 - DNA, 19 bp, Homo sapiens
ataggtcactggctctcca

SEQ ID NO: 2592484 - DNA, 22 bp, Homo sapiens
ataggtcactggctctccaagt

SEQ ID NO: 2592485 - DNA, 20 bp, Homo sapiens
ataggttgccaataatacac

SEQ ID NO: 2592486 - DNA, 22 bp, Homo sapiens
ataggttttgtttgctatctta

SEQ ID NO: 2592487 - DNA, 18 bp, Homo sapiens
atagtactctttgtagca

SEQ ID NO: 2592488 - DNA, 17 bp, Homo sapiens
atagtatcctccaggtt

SEQ ID NO: 2592489 - DNA, 22 bp, Homo sapiens
atagtatcctccaggtttttca

SEQ ID NO: 2592490 - DNA, 21 bp, Homo sapiens
atagtcaagaaaaattattgt

SEQ ID NO: 2592491 - DNA, 19 bp, Homo sapiens
atagtcaatgtttctttta

SEQ ID NO: 2592492 - DNA, 17 bp, Homo sapiens
atagtccagctttgttc

SEQ ID NO: 2592493 - DNA, 17 bp, Homo sapiens
atagtgcttaaaaatca

SEQ ID NO: 2592494 - DNA, 22 bp, Homo sapiens
atagtgggccctccgacagccc

SEQ ID NO: 2592495 - DNA, 13 bp, Homo sapiens
atagtgtaaaata

SEQ ID NO: 2592496 - DNA, 14 bp, Homo sapiens
atagtgtaaaataa

SEQ ID NO: 2592497 - DNA, 18 bp, Homo sapiens
atagtgttaatcaattta

SEQ ID NO: 2592498 - DNA, 20 bp, Homo sapiens
atagtgttaatcaatttaaa

SEQ ID NO: 2592499 - DNA, 12 bp, Homo sapiens
atagttactgtt

SEQ ID NO: 2592500 - DNA, 15 bp, Homo sapiens
atagttcaaagccaa

SEQ ID NO: 2592501 - DNA, 22 bp, Homo sapiens
atagtttactattttacttcta

SEQ ID NO: 2592502 - DNA, 14 bp, Homo sapiens
atagtttattgaca

SEQ ID NO: 2592503 - DNA, 21 bp, Homo sapiens
atagtttcagatatatatcat

SEQ ID NO: 2592504 - DNA, 13 bp, Homo sapiens
atagtttgtacat

SEQ ID NO: 2592505 - DNA, 22 bp, Homo sapiens
atagttttacttttaaactgtg

SEQ ID NO: 2592506 - DNA, 23 bp, Homo sapiens
atagttttacttttaaactgtgt

SEQ ID NO: 2592507 - DNA, 14 bp, Homo sapiens
atataaaaaacttt

SEQ ID NO: 2592508 - DNA, 18 bp, Homo sapiens
atataaaaagaaaagata

SEQ ID NO: 2592509 - DNA, 16 bp, Homo sapiens
atataaaagactgacc

SEQ ID NO: 2592510 - DNA, 22 bp, Homo sapiens
atataaatgcttttaaaaatct

SEQ ID NO: 2592511 - DNA, 15 bp, Homo sapiens
atataaatggctggt

SEQ ID NO: 2592512 - DNA, 21 bp, Homo sapiens
atataacttaaaaatgtaaat

SEQ ID NO: 2592513 - DNA, 20 bp, Homo sapiens
atataacttatattgtaaga

SEQ ID NO: 2592514 - DNA, 21 bp, Homo sapiens
atataacttatattgtaagaa

SEQ ID NO: 2592515 - DNA, 21 bp, Homo sapiens
atataataaagctactgattt

SEQ ID NO: 2592516 - DNA, 21 bp, Homo sapiens
atataataaatgtacattaat

SEQ ID NO: 2592517 - DNA, 21 bp, Homo sapiens
atataatggtttcaaagattc

SEQ ID NO: 2592518 - DNA, 21 bp, Homo sapiens
atataattatcggaagcagtg

SEQ ID NO: 2592519 - DNA, 19 bp, Homo sapiens
atataattctgtacatagc

SEQ ID NO: 2592520 - DNA, 18 bp, Homo sapiens
atatacaataacataatt

SEQ ID NO: 2592521 - DNA, 13 bp, Homo sapiens
atatacacacagc

SEQ ID NO: 2592522 - DNA, 19 bp, Homo sapiens
atatacacaggatcctatt

SEQ ID NO: 2592523 - DNA, 22 bp, Homo sapiens
atatacagtaactttatgtgta

SEQ ID NO: 2592524 - DNA, 18 bp, Homo sapiens
atatacattctttatctt

SEQ ID NO: 2592525 - DNA, 19 bp, Homo sapiens
atatactcactttctagat

SEQ ID NO: 2592526 - DNA, 11 bp, Homo sapiens
atatactgtaa

SEQ ID NO: 2592527 - DNA, 12 bp, Homo sapiens
atatactgtaaa

SEQ ID NO: 2592528 - DNA, 20 bp, Homo sapiens
atatactgtaaagaaagaga

SEQ ID NO: 2592529 - DNA, 15 bp, Homo sapiens
atatagaacagtgct

SEQ ID NO: 2592530 - DNA, 15 bp, Homo sapiens
atatagagatgtttt

SEQ ID NO: 2592531 - DNA, 16 bp, Homo sapiens
atatagagatgttttt

SEQ ID NO: 2592532 - DNA, 16 bp, Homo sapiens
atataggaacttaaat

SEQ ID NO: 2592533 - DNA, 22 bp, Homo sapiens
atataggttgtgcaaattaaca

SEQ ID NO: 2592534 - DNA, 14 bp, Homo sapiens
atataggttttgtt

SEQ ID NO: 2592535 - DNA, 20 bp, Homo sapiens
atataggttttgtttgctat

SEQ ID NO: 2592536 - DNA, 16 bp, Homo sapiens
atatagtttactattt

SEQ ID NO: 2592537 - DNA, 22 bp, Homo sapiens
agttgtaggcgaatcatttgtt

SEQ ID NO: 2592538 - DNA, 19 bp, Homo sapiens
agttgtgccttttatagct

SEQ ID NO: 2592539 - DNA, 23 bp, Homo sapiens
agttgtgccttttatagctatta

SEQ ID NO: 2592540 - DNA, 19 bp, Homo sapiens
agttgtggaaagcctctgc

SEQ ID NO: 2592541 - DNA, 17 bp, Homo sapiens
agttgtgggtgggagag

SEQ ID NO: 2592542 - DNA, 15 bp, Homo sapiens
agttgttacattttt

SEQ ID NO: 2592543 - DNA, 19 bp, Homo sapiens
agttgttacatttttaagt

SEQ ID NO: 2592544 - DNA, 15 bp, Homo sapiens
agttgttggcctccg

SEQ ID NO: 2592545 - DNA, 13 bp, Homo sapiens
agttgtttcattg

SEQ ID NO: 2592546 - DNA, 23 bp, Homo sapiens
agttgtttgattcagacagctgc

SEQ ID NO: 2592547 - DNA, 22 bp, Homo sapiens
agtttaacacaagtcctgtgaa

SEQ ID NO: 2592548 - DNA, 14 bp, Homo sapiens
agtttaaggaatat

SEQ ID NO: 2592549 - DNA, 19 bp, Homo sapiens
agtttacaagtgtatatca

SEQ ID NO: 2592550 - DNA, 16 bp, Homo sapiens
agtttacctctttaaa

SEQ ID NO: 2592551 - DNA, 19 bp, Homo sapiens
agtttagaggaaaaaaatg

SEQ ID NO: 2592552 - DNA, 16 bp, Homo sapiens
agtttatactcacctt

SEQ ID NO: 2592553 - DNA, 14 bp, Homo sapiens
agtttatcattcaa

SEQ ID NO: 2592554 - DNA, 15 bp, Homo sapiens
agtttatcattcaag

SEQ ID NO: 2592555 - DNA, 22 bp, Homo sapiens
agtttatttccaaataaaatga

SEQ ID NO: 2592556 - DNA, 12 bp, Homo sapiens
agtttcagagaa

SEQ ID NO: 2592557 - DNA, 15 bp, Homo sapiens
agtttcagatatata

SEQ ID NO: 2592558 - DNA, 20 bp, Homo sapiens
agtttcaggatacatgtgcc

SEQ ID NO: 2592559 - DNA, 11 bp, Homo sapiens
agtttcaggtg

SEQ ID NO: 2592560 - DNA, 15 bp, Homo sapiens
agtttcaggtgacat

SEQ ID NO: 2592561 - DNA, 21 bp, Homo sapiens
agtttcaggtgacatgtgaaa

SEQ ID NO: 2592562 - DNA, 17 bp, Homo sapiens
agtttcattctcctgcc

SEQ ID NO: 2592563 - DNA, 15 bp, Homo sapiens
agtttccaaaaccag

SEQ ID NO: 2592564 - DNA, 16 bp, Homo sapiens
agtttccaaaaccaga

SEQ ID NO: 2592565 - DNA, 19 bp, Homo sapiens
agtttccttggctggtgca

SEQ ID NO: 2592566 - DNA, 14 bp, Homo sapiens
agtttctcagctcc

SEQ ID NO: 2592567 - DNA, 15 bp, Homo sapiens
agtttctcagctccc

SEQ ID NO: 2592568 - DNA, 16 bp, Homo sapiens
agtttctcagctccca

SEQ ID NO: 2592569 - DNA, 21 bp, Homo sapiens
agtttctcagctcccatttct

SEQ ID NO: 2592570 - DNA, 16 bp, Homo sapiens
agtttctggccctggc

SEQ ID NO: 2592571 - DNA, 15 bp, Homo sapiens
agtttctgttctgtg

SEQ ID NO: 2592572 - DNA, 19 bp, Homo sapiens
agtttctgttctgtggaaa

SEQ ID NO: 2592573 - DNA, 17 bp, Homo sapiens
agtttcttagcttttta

SEQ ID NO: 2592574 - DNA, 21 bp, Homo sapiens
agtttctttcctgccttcttc

SEQ ID NO: 2592575 - DNA, 15 bp, Homo sapiens
agtttgaacttcata

SEQ ID NO: 2592576 - DNA, 15 bp, Homo sapiens
agtttgaaggaaaca

SEQ ID NO: 2592577 - DNA, 21 bp, Homo sapiens
agtttgaaggaggtgagggat

SEQ ID NO: 2592578 - DNA, 18 bp, Homo sapiens
agtttgagatcagcctgg

SEQ ID NO: 2592579 - DNA, 19 bp, Homo sapiens
agtttgagatcagcctggg

SEQ ID NO: 2592580 - DNA, 17 bp, Homo sapiens
agtttgaggctgcagcg

SEQ ID NO: 2592581 - DNA, 17 bp, Homo sapiens
agtttgattaaattctt

SEQ ID NO: 2592582 - DNA, 23 bp, Homo sapiens
agtttgctagcagaaatctagaa

SEQ ID NO: 2592583 - DNA, 18 bp, Homo sapiens
agtttgctgtactagaga

SEQ ID NO: 2592584 - DNA, 16 bp, Homo sapiens
agtttggcaatagttt

SEQ ID NO: 2592585 - DNA, 22 bp, Homo sapiens
agtttgtatgccaagtgagaag

SEQ ID NO: 2592586 - DNA, 14 bp, Homo sapiens
agtttgtcagactt

SEQ ID NO: 2592587 - DNA, 16 bp, Homo sapiens
agtttgtcctgtagag

SEQ ID NO: 2592588 - DNA, 21 bp, Homo sapiens
agttttatcacatgtatgttt

SEQ ID NO: 2592589 - DNA, 14 bp, Homo sapiens
agttttatcatttt

SEQ ID NO: 2592590 - DNA, 18 bp, Homo sapiens
agttttcagaacctcttc

SEQ ID NO: 2592591 - DNA, 18 bp, Homo sapiens
agttttcccttgaggaaa

SEQ ID NO: 2592592 - DNA, 12 bp, Homo sapiens
agttttccttct

SEQ ID NO: 2592593 - DNA, 14 bp, Homo sapiens
agttttccttctca

SEQ ID NO: 2592594 - DNA, 23 bp, Homo sapiens
agttttccttctcatctgtgatt

SEQ ID NO: 2592595 - DNA, 14 bp, Homo sapiens
agttttctgagaaa

SEQ ID NO: 2592596 - DNA, 17 bp, Homo sapiens
agttttctgagaaagac

SEQ ID NO: 2592597 - DNA, 19 bp, Homo sapiens
agttttctggctggagcct

SEQ ID NO: 2592598 - DNA, 12 bp, Homo sapiens
agttttgaaaag

SEQ ID NO: 2592599 - DNA, 17 bp, Homo sapiens
agttttgaaaagctatt

SEQ ID NO: 2592600 - DNA, 16 bp, Homo sapiens
agttttgcatttatgg

SEQ ID NO: 2592601 - DNA, 14 bp, Homo sapiens
agttttgtattcat

SEQ ID NO: 2592602 - DNA, 22 bp, Homo sapiens
agtttttacctaccacagtgtc

SEQ ID NO: 2592603 - DNA, 23 bp, Homo sapiens
agtttttacctaccacagtgtct

SEQ ID NO: 2592604 - DNA, 16 bp, Homo sapiens
agtttttactttctgt

SEQ ID NO: 2592605 - DNA, 18 bp, Homo sapiens
agtttttattccttgtga

SEQ ID NO: 2592606 - DNA, 17 bp, Homo sapiens
agtttttcagaaagcat

SEQ ID NO: 2592607 - DNA, 18 bp, Homo sapiens
agttttttctcttgggct

SEQ ID NO: 2592608 - DNA, 21 bp, Homo sapiens
ataaaaaataatctatttcta

SEQ ID NO: 2592609 - DNA, 12 bp, Homo sapiens
ataaaaactaaa

SEQ ID NO: 2592610 - DNA, 18 bp, Homo sapiens
ataaaaactaaattgtaa

SEQ ID NO: 2592611 - DNA, 22 bp, Homo sapiens
ataaaaagatcactttctcagt

SEQ ID NO: 2592612 - DNA, 11 bp, Homo sapiens
ataaaaaggca

SEQ ID NO: 2592613 - DNA, 21 bp, Homo sapiens
ataaaaaggcacctataaaac

SEQ ID NO: 2592614 - DNA, 19 bp, Homo sapiens
ataaaaagtgacacagcag

SEQ ID NO: 2592615 - DNA, 18 bp, Homo sapiens
ataaaaagttaaaaagtt

SEQ ID NO: 2592616 - DNA, 23 bp, Homo sapiens
agtgacaaggccccagagactca

SEQ ID NO: 2592617 - DNA, 13 bp, Homo sapiens
agtgacacagcag

SEQ ID NO: 2592618 - DNA, 17 bp, Homo sapiens
agtgacacagcagcttc

SEQ ID NO: 2592619 - DNA, 18 bp, Homo sapiens
agtgacacagcagcttca

SEQ ID NO: 2592620 - DNA, 23 bp, Homo sapiens
agtgacacagcagcttcaccaga

SEQ ID NO: 2592621 - DNA, 21 bp, Homo sapiens
agtgacagaccacatctttat

SEQ ID NO: 2592622 - DNA, 14 bp, Homo sapiens
agtgacagaggcag

SEQ ID NO: 2592623 - DNA, 16 bp, Homo sapiens
agtgacagggaagcta

SEQ ID NO: 2592624 - DNA, 19 bp, Homo sapiens
agtgacagggaagctacag

SEQ ID NO: 2592625 - DNA, 19 bp, Homo sapiens
agtgacagtggattgcatt

SEQ ID NO: 2592626 - DNA, 18 bp, Homo sapiens
agtgacccggaggccaca

SEQ ID NO: 2592627 - DNA, 14 bp, Homo sapiens
agtgacgtgcacct

SEQ ID NO: 2592628 - DNA, 22 bp, Homo sapiens
agtgactatgaacttctctcag

SEQ ID NO: 2592629 - DNA, 19 bp, Homo sapiens
agtgactgttcaagagcac

SEQ ID NO: 2592630 - DNA, 18 bp, Homo sapiens
agtgactttggctgcatg

SEQ ID NO: 2592631 - DNA, 13 bp, Homo sapiens
agtgagacagaag

SEQ ID NO: 2592632 - DNA, 16 bp, Homo sapiens
agtgagaccctgtctc

SEQ ID NO: 2592633 - DNA, 17 bp, Homo sapiens
agtgagaccctgtctct

SEQ ID NO: 2592634 - DNA, 16 bp, Homo sapiens
agtgagatagcattgt

SEQ ID NO: 2592635 - DNA, 19 bp, Homo sapiens
agtgagatagcattgtgaa

SEQ ID NO: 2592636 - DNA, 22 bp, Homo sapiens
agtgagatagcattgtgaactg

SEQ ID NO: 2592637 - DNA, 16 bp, Homo sapiens
agtgagatgcattctt

SEQ ID NO: 2592638 - DNA, 21 bp, Homo sapiens
agtgagcctgaattttgttgc

SEQ ID NO: 2592639 - DNA, 21 bp, Homo sapiens
agtgagcttggaaaggaccag

SEQ ID NO: 2592640 - DNA, 20 bp, Homo sapiens
agtgaggaaggcaggaagag

SEQ ID NO: 2592641 - DNA, 18 bp, Homo sapiens
agtgaggcattgcacagg

SEQ ID NO: 2592642 - DNA, 13 bp, Homo sapiens
agtgaggctctgc

SEQ ID NO: 2592643 - DNA, 17 bp, Homo sapiens
agtgaggctctgccctt

SEQ ID NO: 2592644 - DNA, 19 bp, Homo sapiens
agtgaggctctgcccttgg

SEQ ID NO: 2592645 - DNA, 22 bp, Homo sapiens
agtgaggggtaaaagctgatct

SEQ ID NO: 2592646 - DNA, 15 bp, Homo sapiens
agtgagggtcagaga

SEQ ID NO: 2592647 - DNA, 23 bp, Homo sapiens
agtgagggtcagagaggagtcag

SEQ ID NO: 2592648 - DNA, 17 bp, Homo sapiens
agtgagggtttctgagc

SEQ ID NO: 2592649 - DNA, 20 bp, Homo sapiens
agtgagggtttctgagctgc

SEQ ID NO: 2592650 - DNA, 15 bp, Homo sapiens
agtgagtcgaggaca

SEQ ID NO: 2592651 - DNA, 16 bp, Homo sapiens
agtgagtctcttcaga

SEQ ID NO: 2592652 - DNA, 23 bp, Homo sapiens
agtgagtgcaaaaagctgagtat

SEQ ID NO: 2592653 - DNA, 18 bp, Homo sapiens
agtgagtgtggctcccct

SEQ ID NO: 2592654 - DNA, 20 bp, Homo sapiens
agtgagttgttgccctgggt

SEQ ID NO: 2592655 - DNA, 14 bp, Homo sapiens
agtgatatggcaga

SEQ ID NO: 2592656 - DNA, 17 bp, Homo sapiens
agtgatatggcagaaga

SEQ ID NO: 2592657 - DNA, 17 bp, Homo sapiens
agtgatcaataaaatgt

SEQ ID NO: 2592658 - DNA, 20 bp, Homo sapiens
agtgatcaataaaatgtgat

SEQ ID NO: 2592659 - DNA, 15 bp, Homo sapiens
agtgatcacagcagc

SEQ ID NO: 2592660 - DNA, 16 bp, Homo sapiens
agtgatcacagcagct

SEQ ID NO: 2592661 - DNA, 14 bp, Homo sapiens
agtgatcctcccac

SEQ ID NO: 2592662 - DNA, 19 bp, Homo sapiens
agtgatcctcccacctcag

SEQ ID NO: 2592663 - DNA, 16 bp, Homo sapiens
agtgatccttacaagt

SEQ ID NO: 2592664 - DNA, 19 bp, Homo sapiens
agtgatgtcactagggcag

SEQ ID NO: 2592665 - DNA, 13 bp, Homo sapiens
agtgattaccagg

SEQ ID NO: 2592666 - DNA, 15 bp, Homo sapiens
agtgattaccaggga

SEQ ID NO: 2592667 - DNA, 18 bp, Homo sapiens
agtgattctcctgcctca

SEQ ID NO: 2592668 - DNA, 22 bp, Homo sapiens
agtgattctcctgcctcagcct

SEQ ID NO: 2592669 - DNA, 20 bp, Homo sapiens
agtgcaacagcactggctct

SEQ ID NO: 2592670 - DNA, 23 bp, Homo sapiens
agtgcagcccgtgtggccccttc

SEQ ID NO: 2592671 - DNA, 15 bp, Homo sapiens
agtgcagctgatttt

SEQ ID NO: 2592672 - DNA, 17 bp, Homo sapiens
agtgcagctgattttaa

SEQ ID NO: 2592673 - DNA, 18 bp, Homo sapiens
agtgcagctgattttaac

SEQ ID NO: 2592674 - DNA, 17 bp, Homo sapiens
agtgcagtgagccgaga

SEQ ID NO: 2592675 - DNA, 19 bp, Homo sapiens
agtgcatattcctttctat

SEQ ID NO: 2592676 - DNA, 20 bp, Homo sapiens
agtgcatattcctttctatc

SEQ ID NO: 2592677 - DNA, 19 bp, Homo sapiens
agtgccaagcacagtgcct

SEQ ID NO: 2592678 - DNA, 22 bp, Homo sapiens
agtgccactgcccgagctggtg

SEQ ID NO: 2592679 - DNA, 16 bp, Homo sapiens
agtgccagaggtgggc

SEQ ID NO: 2592680 - DNA, 18 bp, Homo sapiens
agtgccagaggtgggcag

SEQ ID NO: 2592681 - DNA, 20 bp, Homo sapiens
agtgccagaggtgggcaggt

SEQ ID NO: 2592682 - DNA, 19 bp, Homo sapiens
agtgccaggactccccagg

SEQ ID NO: 2592683 - DNA, 24 bp, Homo sapiens
agtgccaggactccccaggccagg

SEQ ID NO: 2592684 - DNA, 15 bp, Homo sapiens
agtgcccaactgtta

SEQ ID NO: 2592685 - DNA, 22 bp, Homo sapiens
agtgcccctgctgcctccccaa

SEQ ID NO: 2592686 - DNA, 12 bp, Homo sapiens
agtgcctctggt

SEQ ID NO: 2592687 - DNA, 13 bp, Homo sapiens
agtgcctgggaat

SEQ ID NO: 2592688 - DNA, 18 bp, Homo sapiens
agtgcctgggaatgtatt

SEQ ID NO: 2592689 - DNA, 21 bp, Homo sapiens
agtgcctgtaatcacagctac

SEQ ID NO: 2592690 - DNA, 13 bp, Homo sapiens
agtgccttccata

SEQ ID NO: 2592691 - DNA, 16 bp, Homo sapiens
agtgccttccataatt

SEQ ID NO: 2592692 - DNA, 22 bp, Homo sapiens
agtgccttggggaatttcctct

SEQ ID NO: 2592693 - DNA, 14 bp, Homo sapiens
agtgcgagtatgtg

SEQ ID NO: 2592694 - DNA, 14 bp, Homo sapiens
agtgcgtgctcagt

SEQ ID NO: 2592695 - DNA, 18 bp, Homo sapiens
agtgcgtgtgtagagtta

SEQ ID NO: 2592696 - DNA, 22 bp, Homo sapiens
agtgcgtgtgtagagttaagaa

SEQ ID NO: 2592697 - DNA, 14 bp, Homo sapiens
agtgctaaaaatgg

SEQ ID NO: 2592698 - DNA, 17 bp, Homo sapiens
agtgctcatttcaggat

SEQ ID NO: 2592699 - DNA, 20 bp, Homo sapiens
agtgctcgctttctatgtag

SEQ ID NO: 2592700 - DNA, 12 bp, Homo sapiens
agtgctgagacc

SEQ ID NO: 2592701 - DNA, 20 bp, Homo sapiens
agtgctgcatttaaaagata

SEQ ID NO: 2592702 - DNA, 21 bp, Homo sapiens
agtgctgggattacaggtgtg

SEQ ID NO: 2592703 - DNA, 19 bp, Homo sapiens
agtgctgtctgatctgtgc

SEQ ID NO: 2592704 - DNA, 22 bp, Homo sapiens
agtgctgtctgatctgtgcttt

SEQ ID NO: 2592705 - DNA, 14 bp, Homo sapiens
agtgctgtgaaaaa

SEQ ID NO: 2592706 - DNA, 17 bp, Homo sapiens
agtgctgtggcctgggc

SEQ ID NO: 2592707 - DNA, 20 bp, Homo sapiens
agtgctgtggcctgggcaag

SEQ ID NO: 2592708 - DNA, 14 bp, Homo sapiens
agtgcttcagcctg

SEQ ID NO: 2592709 - DNA, 21 bp, Homo sapiens
agtgcttcttaaagagttctt

SEQ ID NO: 2592710 - DNA, 16 bp, Homo sapiens
agtcagttgaaattct

SEQ ID NO: 2592711 - DNA, 20 bp, Homo sapiens
agtcataaaccttaagtaag

SEQ ID NO: 2592712 - DNA, 23 bp, Homo sapiens
agtcataccaatgaaaaaatgta

SEQ ID NO: 2592713 - DNA, 18 bp, Homo sapiens
agtcatataaaagctatg

SEQ ID NO: 2592714 - DNA, 20 bp, Homo sapiens
agtcatattttgattattgt

SEQ ID NO: 2592715 - DNA, 21 bp, Homo sapiens
agtcatattttgattattgta

SEQ ID NO: 2592716 - DNA, 18 bp, Homo sapiens
agtcatctccatcagctg

SEQ ID NO: 2592717 - DNA, 20 bp, Homo sapiens
agtcatctccatcagctgta

SEQ ID NO: 2592718 - DNA, 20 bp, Homo sapiens
agtcatcttgaccaagcagg

SEQ ID NO: 2592719 - DNA, 13 bp, Homo sapiens
agtcatgaagccc

SEQ ID NO: 2592720 - DNA, 18 bp, Homo sapiens
agtcatgcaaaggctggg

SEQ ID NO: 2592721 - DNA, 14 bp, Homo sapiens
agtcatgcataaat

SEQ ID NO: 2592722 - DNA, 14 bp, Homo sapiens
agtcattagactcc

SEQ ID NO: 2592723 - DNA, 18 bp, Homo sapiens
agtcattagactcctcct

SEQ ID NO: 2592724 - DNA, 20 bp, Homo sapiens
agtcattagactcctcctcc

SEQ ID NO: 2592725 - DNA, 19 bp, Homo sapiens
agtcattatagatccccca

SEQ ID NO: 2592726 - DNA, 19 bp, Homo sapiens
agtcattttaactttatca

SEQ ID NO: 2592727 - DNA, 21 bp, Homo sapiens
agtcattttaactttatcaca

SEQ ID NO: 2592728 - DNA, 18 bp, Homo sapiens
agtccaaggaaaccacag

SEQ ID NO: 2592729 - DNA, 20 bp, Homo sapiens
agtccaatctcatggagaag

SEQ ID NO: 2592730 - DNA, 14 bp, Homo sapiens
agtccactcccagt

SEQ ID NO: 2592731 - DNA, 20 bp, Homo sapiens
agtccactcccagtgcttgc

SEQ ID NO: 2592732 - DNA, 22 bp, Homo sapiens
agtccagatttacactgggaga

SEQ ID NO: 2592733 - DNA, 18 bp, Homo sapiens
agtccaggccccaaaacc

SEQ ID NO: 2592734 - DNA, 15 bp, Homo sapiens
agtccagtctcttct

SEQ ID NO: 2592735 - DNA, 14 bp, Homo sapiens
agtcccaaggaaag

SEQ ID NO: 2592736 - DNA, 15 bp, Homo sapiens
agtcccaccttggct

SEQ ID NO: 2592737 - DNA, 21 bp, Homo sapiens
agtcccaccttggctgcaggg

SEQ ID NO: 2592738 - DNA, 23 bp, Homo sapiens
agtcccactgcctcaggttccta

SEQ ID NO: 2592739 - DNA, 22 bp, Homo sapiens
agtcccagctactcagaagcct

SEQ ID NO: 2592740 - DNA, 19 bp, Homo sapiens
agtcccagctactcaggag

SEQ ID NO: 2592741 - DNA, 15 bp, Homo sapiens
agtcccagtgggagg

SEQ ID NO: 2592742 - DNA, 22 bp, Homo sapiens
agtcccccaacagatgcttttc

SEQ ID NO: 2592743 - DNA, 18 bp, Homo sapiens
agtcccctcccatctggg

SEQ ID NO: 2592744 - DNA, 21 bp, Homo sapiens
agtcccctccccggccctacc

SEQ ID NO: 2592745 - DNA, 13 bp, Homo sapiens
agtcccgtcagga

SEQ ID NO: 2592746 - DNA, 20 bp, Homo sapiens
agtccctatgtatttgcagt

SEQ ID NO: 2592747 - DNA, 19 bp, Homo sapiens
agtccctgactctctgtga

SEQ ID NO: 2592748 - DNA, 21 bp, Homo sapiens
agtccctgactctctgtgacc

SEQ ID NO: 2592749 - DNA, 16 bp, Homo sapiens
agtccctgtaattgtt

SEQ ID NO: 2592750 - DNA, 20 bp, Homo sapiens
agtccctgtaattgttgttt

SEQ ID NO: 2592751 - DNA, 17 bp, Homo sapiens
agtccctgttttctgag

SEQ ID NO: 2592752 - DNA, 18 bp, Homo sapiens
agtccctgttttctgagc

SEQ ID NO: 2592753 - DNA, 22 bp, Homo sapiens
agtccctgttttctgagcccgg

SEQ ID NO: 2592754 - DNA, 15 bp, Homo sapiens
agtcccttccacacc

SEQ ID NO: 2592755 - DNA, 14 bp, Homo sapiens
agtcccttcccctc

SEQ ID NO: 2592756 - DNA, 21 bp, Homo sapiens
agtcccttcccctccctggct

SEQ ID NO: 2592757 - DNA, 14 bp, Homo sapiens
agtcctagctgcac

SEQ ID NO: 2592758 - DNA, 22 bp, Homo sapiens
agtcctagctgcacagggcagc

SEQ ID NO: 2592759 - DNA, 20 bp, Homo sapiens
agtcctcaaggggccatcct

SEQ ID NO: 2592760 - DNA, 17 bp, Homo sapiens
agtcctcactcccagtc

SEQ ID NO: 2592761 - DNA, 16 bp, Homo sapiens
agtcctcccatctcac

SEQ ID NO: 2592762 - DNA, 21 bp, Homo sapiens
agtcctcgtagccatctctct

SEQ ID NO: 2592763 - DNA, 12 bp, Homo sapiens
agtcctctgaat

SEQ ID NO: 2592764 - DNA, 14 bp, Homo sapiens
agtcctgaagaggc

SEQ ID NO: 2592765 - DNA, 20 bp, Homo sapiens
agtcctgcacagttttctgg

SEQ ID NO: 2592766 - DNA, 13 bp, Homo sapiens
agtcctgcctggc

SEQ ID NO: 2592767 - DNA, 15 bp, Homo sapiens
agtcctgcctggcca

SEQ ID NO: 2592768 - DNA, 22 bp, Homo sapiens
agtcctggaagccagctttccc

SEQ ID NO: 2592769 - DNA, 14 bp, Homo sapiens
agtcctggcctggc

SEQ ID NO: 2592770 - DNA, 13 bp, Homo sapiens
agtcctgtgaatt

SEQ ID NO: 2592771 - DNA, 16 bp, Homo sapiens
agtcctgtgaatttct

SEQ ID NO: 2592772 - DNA, 23 bp, Homo sapiens
agtcctgtgaatttcttcactgt

SEQ ID NO: 2592773 - DNA, 17 bp, Homo sapiens
agtccttacctcttccg

SEQ ID NO: 2592774 - DNA, 11 bp, Homo sapiens
agtccttccac

SEQ ID NO: 2592775 - DNA, 17 bp, Homo sapiens
agtccttgaaaatattt

SEQ ID NO: 2592776 - DNA, 15 bp, Homo sapiens
agtccttgcaagaat

SEQ ID NO: 2592777 - DNA, 18 bp, Homo sapiens
agtccttgcaagaatcag

SEQ ID NO: 2592778 - DNA, 12 bp, Homo sapiens
agtccttgcttg

SEQ ID NO: 2592779 - DNA, 21 bp, Homo sapiens
agtcgaattaatagcttttat

SEQ ID NO: 2592780 - DNA, 19 bp, Homo sapiens
agtcgatagagctgtatta

SEQ ID NO: 2592781 - DNA, 15 bp, Homo sapiens
agtcgggggctggcc

SEQ ID NO: 2592782 - DNA, 16 bp, Homo sapiens
agtcgggggctggcct

SEQ ID NO: 2592783 - DNA, 17 bp, Homo sapiens
agtcgggggctggccta

SEQ ID NO: 2592784 - DNA, 21 bp, Homo sapiens
agtcgggggctggcctaggag

SEQ ID NO: 2592785 - DNA, 18 bp, Homo sapiens
agtcgtggagatgtcttc

SEQ ID NO: 2592786 - DNA, 14 bp, Homo sapiens
agtctacagagtga

SEQ ID NO: 2592787 - DNA, 14 bp, Homo sapiens
agtctacgctctcc

SEQ ID NO: 2592788 - DNA, 15 bp, Homo sapiens
agtctacgctctcct

SEQ ID NO: 2592789 - DNA, 13 bp, Homo sapiens
agtctactcttaa

SEQ ID NO: 2592790 - DNA, 14 bp, Homo sapiens
agtctagaagttgt

SEQ ID NO: 2592791 - DNA, 16 bp, Homo sapiens
agtctatccacagaga

SEQ ID NO: 2592792 - DNA, 18 bp, Homo sapiens
agtctcactgttgcccag

SEQ ID NO: 2592793 - DNA, 22 bp, Homo sapiens
agtctcaggaaatcaaatatgc

SEQ ID NO: 2592794 - DNA, 13 bp, Homo sapiens
agtctcaggagca

SEQ ID NO: 2592795 - DNA, 17 bp, Homo sapiens
agtctcaggagcatggg

SEQ ID NO: 2592796 - DNA, 17 bp, Homo sapiens
agtctcattacttttga

SEQ ID NO: 2592797 - DNA, 18 bp, Homo sapiens
agtctcattacttttgaa

SEQ ID NO: 2592798 - DNA, 22 bp, Homo sapiens
agtctccagtggttgctgttga

SEQ ID NO: 2592799 - DNA, 15 bp, Homo sapiens
agtctccctcacagc

SEQ ID NO: 2592800 - DNA, 20 bp, Homo sapiens
agtctccctcacagcacaga

SEQ ID NO: 2592801 - DNA, 17 bp, Homo sapiens
agtctccctttcccttc

SEQ ID NO: 2592802 - DNA, 19 bp, Homo sapiens
agtctcctttgcactgagg

SEQ ID NO: 2592803 - DNA, 20 bp, Homo sapiens
agtctcgctctgtcacccag

SEQ ID NO: 2592804 - DNA, 22 bp, Homo sapiens
agtctctctggggccacacaga

SEQ ID NO: 2592805 - DNA, 11 bp, Homo sapiens
agtctctgagc

SEQ ID NO: 2592806 - DNA, 16 bp, Homo sapiens
agtctctgagcagtga

SEQ ID NO: 2592807 - DNA, 19 bp, Homo sapiens
agtctctgagggcttcctt

SEQ ID NO: 2592808 - DNA, 16 bp, Homo sapiens
agtctctgctggccca

SEQ ID NO: 2592809 - DNA, 15 bp, Homo sapiens
agtctcttttcttta

SEQ ID NO: 2592810 - DNA, 22 bp, Homo sapiens
agtctcttttctttagagcatt

SEQ ID NO: 2592811 - DNA, 21 bp, Homo sapiens
agtctgaagcagatgcaaaga

SEQ ID NO: 2592812 - DNA, 13 bp, Homo sapiens
agtctgaaggctg

SEQ ID NO: 2592813 - DNA, 18 bp, Homo sapiens
agtctgatcgtgacgctg

SEQ ID NO: 2592814 - DNA, 19 bp, Homo sapiens
agtctgatgatttcttgaa

SEQ ID NO: 2592815 - DNA, 18 bp, Homo sapiens
agtctgattcccaagctc

SEQ ID NO: 2592816 - DNA, 20 bp, Homo sapiens
agtctgattcccaagctctg

SEQ ID NO: 2592817 - DNA, 18 bp, Homo sapiens
agtctggaatgcagtggt

SEQ ID NO: 2592818 - DNA, 14 bp, Homo sapiens
agtctgggctgccg

SEQ ID NO: 2592819 - DNA, 20 bp, Homo sapiens
agtctggtttctagacttgt

SEQ ID NO: 2592820 - DNA, 13 bp, Homo sapiens
agtctgtcatgaa

SEQ ID NO: 2592821 - DNA, 20 bp, Homo sapiens
agtctgtgccacgtgtttgt

SEQ ID NO: 2592822 - DNA, 18 bp, Homo sapiens
agtctgtgtgatgaactt

SEQ ID NO: 2592823 - DNA, 21 bp, Homo sapiens
agtctgtgtgatgaactttct

SEQ ID NO: 2592824 - DNA, 14 bp, Homo sapiens
agtctgttttatga

SEQ ID NO: 2592825 - DNA, 17 bp, Homo sapiens
agtctgttttatgactt

SEQ ID NO: 2592826 - DNA, 23 bp, Homo sapiens
agtcttcaagcagattggagaaa

SEQ ID NO: 2592827 - DNA, 19 bp, Homo sapiens
agtcttcactctctgaaga

SEQ ID NO: 2592828 - DNA, 16 bp, Homo sapiens
agtcttccatttgcaa

SEQ ID NO: 2592829 - DNA, 17 bp, Homo sapiens
agtcttccatttgcaag

SEQ ID NO: 2592830 - DNA, 16 bp, Homo sapiens
agtcttcctgacactt

SEQ ID NO: 2592831 - DNA, 17 bp, Homo sapiens
agtcttcctgacacttt

SEQ ID NO: 2592832 - DNA, 12 bp, Homo sapiens
agtcttctcata

SEQ ID NO: 2592833 - DNA, 15 bp, Homo sapiens
agtcttggcggcagc

SEQ ID NO: 2592834 - DNA, 21 bp, Homo sapiens
agtcttggcggcagcagccat

SEQ ID NO: 2592835 - DNA, 22 bp, Homo sapiens
agtcttgtattaagttgttaat

SEQ ID NO: 2592836 - DNA, 12 bp, Homo sapiens
agtcttgtgctt

SEQ ID NO: 2592837 - DNA, 20 bp, Homo sapiens
agtctttacagctgagcaca

SEQ ID NO: 2592838 - DNA, 20 bp, Homo sapiens
agtctttcttagtgcctgtg

SEQ ID NO: 2592839 - DNA, 13 bp, Homo sapiens
agtcttttccatg

SEQ ID NO: 2592840 - DNA, 23 bp, Homo sapiens
agtgaaaaaggaggaagagaaaa

SEQ ID NO: 2592841 - DNA, 19 bp, Homo sapiens
agtgaaaacaagtgctggc

SEQ ID NO: 2592842 - DNA, 14 bp, Homo sapiens
agtgaaaataggta

SEQ ID NO: 2592843 - DNA, 20 bp, Homo sapiens
agtgaaacctttagggcagc

SEQ ID NO: 2592844 - DNA, 22 bp, Homo sapiens
agtgaaacctttagggcagctt

SEQ ID NO: 2592845 - DNA, 24 bp, Homo sapiens
agtgaaactgcttgtttcctagca

SEQ ID NO: 2592846 - DNA, 16 bp, Homo sapiens
agtgaacaaatttaca

SEQ ID NO: 2592847 - DNA, 21 bp, Homo sapiens
agtgaacaaatttacagagac

SEQ ID NO: 2592848 - DNA, 23 bp, Homo sapiens
agtgaacaaatttacagagacag

SEQ ID NO: 2592849 - DNA, 13 bp, Homo sapiens
agtgaaccaaaga

SEQ ID NO: 2592850 - DNA, 20 bp, Homo sapiens
agtgaactacgcttgctcat

SEQ ID NO: 2592851 - DNA, 16 bp, Homo sapiens
agtgaagaaaagtgaa

SEQ ID NO: 2592852 - DNA, 19 bp, Homo sapiens
agtgaagagggagaaggga

SEQ ID NO: 2592853 - DNA, 15 bp, Homo sapiens
agtgaagaggggcag

SEQ ID NO: 2592854 - DNA, 17 bp, Homo sapiens
agtgaatgattcagtgt

SEQ ID NO: 2592855 - DNA, 16 bp, Homo sapiens
agtgaatttttctcta

SEQ ID NO: 2592856 - DNA, 17 bp, Homo sapiens
agtgaatttttctctaa

SEQ ID NO: 2592857 - DNA, 20 bp, Homo sapiens
agtgaatttttctctaactc

SEQ ID NO: 2592858 - DNA, 14 bp, Homo sapiens
agtgacaaggcccc

SEQ ID NO: 2592859 - DNA, 18 bp, Homo sapiens
agtgacaaggccccagag

SEQ ID NO: 2592860 - DNA, 11 bp, Homo sapiens
aggttgataac

SEQ ID NO: 2592861 - DNA, 17 bp, Homo sapiens
aggttgataactttgct

SEQ ID NO: 2592862 - DNA, 20 bp, Homo sapiens
aggttgataactttgcttgc

SEQ ID NO: 2592863 - DNA, 18 bp, Homo sapiens
aggttgcagtgagccaag

SEQ ID NO: 2592864 - DNA, 19 bp, Homo sapiens
aggttgcagtgagccaaga

SEQ ID NO: 2592865 - DNA, 15 bp, Homo sapiens
aggtttaactcagat

SEQ ID NO: 2592866 - DNA, 21 bp, Homo sapiens
aggtttggatgggagtgagac

SEQ ID NO: 2592867 - DNA, 13 bp, Homo sapiens
aggtttgtatatt

SEQ ID NO: 2592868 - DNA, 20 bp, Homo sapiens
aggtttgtatattgtcagat

SEQ ID NO: 2592869 - DNA, 15 bp, Homo sapiens
aggttttaaagtgat

SEQ ID NO: 2592870 - DNA, 21 bp, Homo sapiens
aggttttaaagtgattaaacg

SEQ ID NO: 2592871 - DNA, 13 bp, Homo sapiens
aggttttctccac

SEQ ID NO: 2592872 - DNA, 14 bp, Homo sapiens
aggttttctccact

SEQ ID NO: 2592873 - DNA, 12 bp, Homo sapiens
aggttttgttgt

SEQ ID NO: 2592874 - DNA, 16 bp, Homo sapiens
aggttttgtttgctat

SEQ ID NO: 2592875 - DNA, 19 bp, Homo sapiens
aggttttgtttgctatctt

SEQ ID NO: 2592876 - DNA, 23 bp, Homo sapiens
aggttttgtttgctatcttaatt

SEQ ID NO: 2592877 - DNA, 13 bp, Homo sapiens
aggtttttcaatt

SEQ ID NO: 2592878 - DNA, 14 bp, Homo sapiens
aggtttttcaatta

SEQ ID NO: 2592879 - DNA, 20 bp, Homo sapiens
aggtttttcaattaaacgga

SEQ ID NO: 2592880 - DNA, 23 bp, Homo sapiens
aggtttttcaattaaacggatta

SEQ ID NO: 2592881 - DNA, 18 bp, Homo sapiens
aggtttttttccttctga

SEQ ID NO: 2592882 - DNA, 22 bp, Homo sapiens
aggtttttttgtatagtaaagt

SEQ ID NO: 2592883 - DNA, 16 bp, Homo sapiens
agtaaaaccacagcag

SEQ ID NO: 2592884 - DNA, 17 bp, Homo sapiens
agtaaaaccacagcagt

SEQ ID NO: 2592885 - DNA, 19 bp, Homo sapiens
agtaaaaccacagcagttg

SEQ ID NO: 2592886 - DNA, 19 bp, Homo sapiens
agtaaatgggggtgcattt

SEQ ID NO: 2592887 - DNA, 14 bp, Homo sapiens
agtaactgacaact

SEQ ID NO: 2592888 - DNA, 15 bp, Homo sapiens
agtaacttggctttc

SEQ ID NO: 2592889 - DNA, 21 bp, Homo sapiens
agtaagaaagtgaagcaaatc

SEQ ID NO: 2592890 - DNA, 14 bp, Homo sapiens
agtaagaagacatg

SEQ ID NO: 2592891 - DNA, 15 bp, Homo sapiens
agtaagaagacatga

SEQ ID NO: 2592892 - DNA, 12 bp, Homo sapiens
agtaaggctgtg

SEQ ID NO: 2592893 - DNA, 16 bp, Homo sapiens
agtaagggaaatagaa

SEQ ID NO: 2592894 - DNA, 20 bp, Homo sapiens
agtaagtaccactcaggcca

SEQ ID NO: 2592895 - DNA, 17 bp, Homo sapiens
agtaatatgcacacatt

SEQ ID NO: 2592896 - DNA, 18 bp, Homo sapiens
agtaatatgcacacattt

SEQ ID NO: 2592897 - DNA, 14 bp, Homo sapiens
agtaatccacctgc

SEQ ID NO: 2592898 - DNA, 22 bp, Homo sapiens
agtaatcccgccacctatctcg

SEQ ID NO: 2592899 - DNA, 21 bp, Homo sapiens
agtaatctgtgtacaaagaaa

SEQ ID NO: 2592900 - DNA, 19 bp, Homo sapiens
agtaatgctacgtgtgatt

SEQ ID NO: 2592901 - DNA, 17 bp, Homo sapiens
agtaattctgctgtctc

SEQ ID NO: 2592902 - DNA, 15 bp, Homo sapiens
agtaattgtgaaaaa

SEQ ID NO: 2592903 - DNA, 16 bp, Homo sapiens
agtaattgtgaaaaag

SEQ ID NO: 2592904 - DNA, 19 bp, Homo sapiens
agtaattgttggttatctt

SEQ ID NO: 2592905 - DNA, 15 bp, Homo sapiens
agtaatttgaggaca

SEQ ID NO: 2592906 - DNA, 20 bp, Homo sapiens
agtacactgtttcaaacttt

SEQ ID NO: 2592907 - DNA, 19 bp, Homo sapiens
agtacaggcagcacagaga

SEQ ID NO: 2592908 - DNA, 13 bp, Homo sapiens
agtacatttaata

SEQ ID NO: 2592909 - DNA, 21 bp, Homo sapiens
agtacatttaatacagcagtg

SEQ ID NO: 2592910 - DNA, 16 bp, Homo sapiens
agtaccaatcatttta

SEQ ID NO: 2592911 - DNA, 15 bp, Homo sapiens
agtaccactcaggcc

SEQ ID NO: 2592912 - DNA, 21 bp, Homo sapiens
agtacccaaaagctcagccag

SEQ ID NO: 2592913 - DNA, 19 bp, Homo sapiens
agtacccgttcacattttt

SEQ ID NO: 2592914 - DNA, 16 bp, Homo sapiens
agtaccctctcagctc

SEQ ID NO: 2592915 - DNA, 22 bp, Homo sapiens
agtacctcctgtctctggcctg

SEQ ID NO: 2592916 - DNA, 13 bp, Homo sapiens
agtacctggagga

SEQ ID NO: 2592917 - DNA, 14 bp, Homo sapiens
agtacctggaggag

SEQ ID NO: 2592918 - DNA, 14 bp, Homo sapiens
agtacctttgtcac

SEQ ID NO: 2592919 - DNA, 19 bp, Homo sapiens
agtactacagtcctcccat

SEQ ID NO: 2592920 - DNA, 12 bp, Homo sapiens
agtactatgtat

SEQ ID NO: 2592921 - DNA, 13 bp, Homo sapiens
agtactcatacat

SEQ ID NO: 2592922 - DNA, 18 bp, Homo sapiens
agtactcctgcaaaattt

SEQ ID NO: 2592923 - DNA, 19 bp, Homo sapiens
agtactcctgcaaaatttt

SEQ ID NO: 2592924 - DNA, 17 bp, Homo sapiens
agtactgctcttgtttc

SEQ ID NO: 2592925 - DNA, 19 bp, Homo sapiens
agtacttctccaccctgct

SEQ ID NO: 2592926 - DNA, 21 bp, Homo sapiens
agtagaaagacagagctggga

SEQ ID NO: 2592927 - DNA, 20 bp, Homo sapiens
agtagaagatttgatgctgg

SEQ ID NO: 2592928 - DNA, 20 bp, Homo sapiens
agtagaagtcttagatgtat

SEQ ID NO: 2592929 - DNA, 11 bp, Homo sapiens
agtagagacag

SEQ ID NO: 2592930 - DNA, 12 bp, Homo sapiens
agtagagacagg

SEQ ID NO: 2592931 - DNA, 17 bp, Homo sapiens
agtagagtcatctccat

SEQ ID NO: 2592932 - DNA, 23 bp, Homo sapiens
agtagagtcatctccatcagctg

SEQ ID NO: 2592933 - DNA, 21 bp, Homo sapiens
agtagattttctttaaaagaa

SEQ ID NO: 2592934 - DNA, 14 bp, Homo sapiens
agtagcatgagaga

SEQ ID NO: 2592935 - DNA, 20 bp, Homo sapiens
agtagcatgttgagccaggc

SEQ ID NO: 2592936 - DNA, 21 bp, Homo sapiens
agtagccctttctgtgtgcac

SEQ ID NO: 2592937 - DNA, 22 bp, Homo sapiens
agtagcctaacacactccaaga

SEQ ID NO: 2592938 - DNA, 17 bp, Homo sapiens
agtagctggattacagg

SEQ ID NO: 2592939 - DNA, 12 bp, Homo sapiens
agtagtttgtat

SEQ ID NO: 2592940 - DNA, 13 bp, Homo sapiens
agtataaaaacaa

SEQ ID NO: 2592941 - DNA, 18 bp, Homo sapiens
agtataaatggttgtctg

SEQ ID NO: 2592942 - DNA, 15 bp, Homo sapiens
agtatacctgatttt

SEQ ID NO: 2592943 - DNA, 18 bp, Homo sapiens
agtatatctggacaagcc

SEQ ID NO: 2592944 - DNA, 14 bp, Homo sapiens
agtatatttatagt

SEQ ID NO: 2592945 - DNA, 18 bp, Homo sapiens
agtatatttatagtcaca

SEQ ID NO: 2592946 - DNA, 15 bp, Homo sapiens
agtatcaggtctccc

SEQ ID NO: 2592947 - DNA, 13 bp, Homo sapiens
agtatcatgaagc

SEQ ID NO: 2592948 - DNA, 11 bp, Homo sapiens
agtatcatgca

SEQ ID NO: 2592949 - DNA, 14 bp, Homo sapiens
agtatccactttgc

SEQ ID NO: 2592950 - DNA, 22 bp, Homo sapiens
agtatcctccaggtttttcaat

SEQ ID NO: 2592951 - DNA, 22 bp, Homo sapiens
agtatctatatatgtgtatgta

SEQ ID NO: 2592952 - DNA, 19 bp, Homo sapiens
agtatctcctcgcaagctg

SEQ ID NO: 2592953 - DNA, 18 bp, Homo sapiens
agtatctgtatctctctc

SEQ ID NO: 2592954 - DNA, 12 bp, Homo sapiens
agtatgaaaata

SEQ ID NO: 2592955 - DNA, 15 bp, Homo sapiens
agtatgaggcatttg

SEQ ID NO: 2592956 - DNA, 23 bp, Homo sapiens
agtatgaggcatttgtttgaact

SEQ ID NO: 2592957 - DNA, 19 bp, Homo sapiens
agtatggagctcagagagg

SEQ ID NO: 2592958 - DNA, 22 bp, Homo sapiens
agtatggtgagagaagcctgtg

SEQ ID NO: 2592959 - DNA, 14 bp, Homo sapiens
agtatggtggctgg

SEQ ID NO: 2592960 - DNA, 15 bp, Homo sapiens
agtatggtggctggg

SEQ ID NO: 2592961 - DNA, 15 bp, Homo sapiens
agtatgtggaagtgt

SEQ ID NO: 2592962 - DNA, 18 bp, Homo sapiens
agtattacttctgctaca

SEQ ID NO: 2592963 - DNA, 18 bp, Homo sapiens
agtattataaattatgtt

SEQ ID NO: 2592964 - DNA, 20 bp, Homo sapiens
agtattataaattatgttta

SEQ ID NO: 2592965 - DNA, 19 bp, Homo sapiens
agtattccattgtgtgagt

SEQ ID NO: 2592966 - DNA, 20 bp, Homo sapiens
agtattccattgtgtgagtg

SEQ ID NO: 2592967 - DNA, 14 bp, Homo sapiens
agtattcttctctt

SEQ ID NO: 2592968 - DNA, 15 bp, Homo sapiens
agtattgaagcattt

SEQ ID NO: 2592969 - DNA, 20 bp, Homo sapiens
agtattgaagcattttataa

SEQ ID NO: 2592970 - DNA, 23 bp, Homo sapiens
agggaggaggccacctctccaag

SEQ ID NO: 2592971 - DNA, 13 bp, Homo sapiens
agggagggctcca

SEQ ID NO: 2592972 - DNA, 16 bp, Homo sapiens
agggagggctccagac

SEQ ID NO: 2592973 - DNA, 19 bp, Homo sapiens
agggagggctccagacaca

SEQ ID NO: 2592974 - DNA, 22 bp, Homo sapiens
agggaggtgtttaaagagaggt

SEQ ID NO: 2592975 - DNA, 23 bp, Homo sapiens
agggaggtgtttaaagagaggtt

SEQ ID NO: 2592976 - DNA, 22 bp, Homo sapiens
agggagtcccctccccggccct

SEQ ID NO: 2592977 - DNA, 20 bp, Homo sapiens
agggagtccgaaagggactt

SEQ ID NO: 2592978 - DNA, 18 bp, Homo sapiens
agggagtgacagaggcag

SEQ ID NO: 2592979 - DNA, 14 bp, Homo sapiens
agggatacactgaa

SEQ ID NO: 2592980 - DNA, 22 bp, Homo sapiens
agggatagcactgagcaaagca

SEQ ID NO: 2592981 - DNA, 22 bp, Homo sapiens
agggatcacagggccccagaag

SEQ ID NO: 2592982 - DNA, 22 bp, Homo sapiens
agggatcttgcattcccagtgg

SEQ ID NO: 2592983 - DNA, 18 bp, Homo sapiens
agggatgaaggcctccct

SEQ ID NO: 2592984 - DNA, 16 bp, Homo sapiens
agggatgctgcctgag

SEQ ID NO: 2592985 - DNA, 22 bp, Homo sapiens
agggatgtgaattgcctgcaga

SEQ ID NO: 2592986 - DNA, 18 bp, Homo sapiens
agggattcacatctgcat

SEQ ID NO: 2592987 - DNA, 19 bp, Homo sapiens
agggattcaggctgcttgg

SEQ ID NO: 2592988 - DNA, 22 bp, Homo sapiens
agggatttggggctcagagtgg

SEQ ID NO: 2592989 - DNA, 14 bp, Homo sapiens
agggcacacactgt

SEQ ID NO: 2592990 - DNA, 17 bp, Homo sapiens
agggcacaccgggcact

SEQ ID NO: 2592991 - DNA, 20 bp, Homo sapiens
agggcacaccgggcactcag

SEQ ID NO: 2592992 - DNA, 21 bp, Homo sapiens
agggcacaccgggcactcaga

SEQ ID NO: 2592993 - DNA, 19 bp, Homo sapiens
agggcacattccttgcctg

SEQ ID NO: 2592994 - DNA, 15 bp, Homo sapiens
agggcactggagctg

SEQ ID NO: 2592995 - DNA, 16 bp, Homo sapiens
agggcacttcacagag

SEQ ID NO: 2592996 - DNA, 17 bp, Homo sapiens
agggcagagtcacacgg

SEQ ID NO: 2592997 - DNA, 15 bp, Homo sapiens
agggcagctgggccc

SEQ ID NO: 2592998 - DNA, 16 bp, Homo sapiens
agggcagctgggccca

SEQ ID NO: 2592999 - DNA, 20 bp, Homo sapiens
agggcagctgggcccaaccc

SEQ ID NO: 2593000 - DNA, 11 bp, Homo sapiens
agggcagcttg

SEQ ID NO: 2593001 - DNA, 16 bp, Homo sapiens
agggcaggaaggagag

SEQ ID NO: 2593002 - DNA, 18 bp, Homo sapiens
agggcaggaaggagagcc

SEQ ID NO: 2593003 - DNA, 21 bp, Homo sapiens
agggcaggaaggagagcctgc

SEQ ID NO: 2593004 - DNA, 17 bp, Homo sapiens
agggcagggacaggata

SEQ ID NO: 2593005 - DNA, 12 bp, Homo sapiens
agggcagggact

SEQ ID NO: 2593006 - DNA, 13 bp, Homo sapiens
agggcagggcatc

SEQ ID NO: 2593007 - DNA, 17 bp, Homo sapiens
agggcagggccccaggc

SEQ ID NO: 2593008 - DNA, 22 bp, Homo sapiens
agggcataatgatgatgggaat

SEQ ID NO: 2593009 - DNA, 17 bp, Homo sapiens
agggcatcatgcatctt

SEQ ID NO: 2593010 - DNA, 15 bp, Homo sapiens
agggcatctccagga

SEQ ID NO: 2593011 - DNA, 16 bp, Homo sapiens
agggcatctccaggaa

SEQ ID NO: 2593012 - DNA, 12 bp, Homo sapiens
agggcatctcct

SEQ ID NO: 2593013 - DNA, 13 bp, Homo sapiens
agggcatctcctg

SEQ ID NO: 2593014 - DNA, 21 bp, Homo sapiens
agggcatctcctgtgcatggg

SEQ ID NO: 2593015 - DNA, 23 bp, Homo sapiens
agggcatctcctgtgcatgggtg

SEQ ID NO: 2593016 - DNA, 17 bp, Homo sapiens
agggcatcttagcttct

SEQ ID NO: 2593017 - DNA, 22 bp, Homo sapiens
agggcatgccacgtgggctcat

SEQ ID NO: 2593018 - DNA, 19 bp, Homo sapiens
agggcatttgagaaatgca

SEQ ID NO: 2593019 - DNA, 23 bp, Homo sapiens
agggccaacttgagggcccagag

SEQ ID NO: 2593020 - DNA, 21 bp, Homo sapiens
agggccaagcccagcactgct

SEQ ID NO: 2593021 - DNA, 20 bp, Homo sapiens
agggccacatgggaggctca

SEQ ID NO: 2593022 - DNA, 21 bp, Homo sapiens
agggccacatgggaggctcac

SEQ ID NO: 2593023 - DNA, 12 bp, Homo sapiens
agggccaggcag

SEQ ID NO: 2593024 - DNA, 15 bp, Homo sapiens
agggccagggccctg

SEQ ID NO: 2593025 - DNA, 17 bp, Homo sapiens
agggccagtcctgcctg

SEQ ID NO: 2593026 - DNA, 22 bp, Homo sapiens
agggccagtcctgcctggccag

SEQ ID NO: 2593027 - DNA, 17 bp, Homo sapiens
agggccatgcctgcccc

SEQ ID NO: 2593028 - DNA, 17 bp, Homo sapiens
agggcccaagtccctgt

SEQ ID NO: 2593029 - DNA, 19 bp, Homo sapiens
agggcccaagtccctgttt

SEQ ID NO: 2593030 - DNA, 13 bp, Homo sapiens
agggcccagagag

SEQ ID NO: 2593031 - DNA, 13 bp, Homo sapiens
agggcccagagca

SEQ ID NO: 2593032 - DNA, 15 bp, Homo sapiens
agggcccagagcagg

SEQ ID NO: 2593033 - DNA, 17 bp, Homo sapiens
agggcccagagcaggaa

SEQ ID NO: 2593034 - DNA, 14 bp, Homo sapiens
agggcccaggcagg

SEQ ID NO: 2593035 - DNA, 15 bp, Homo sapiens
agggcccaggcaggc

SEQ ID NO: 2593036 - DNA, 16 bp, Homo sapiens
agggccctgagctcgg

SEQ ID NO: 2593037 - DNA, 19 bp, Homo sapiens
agggccctgagctgagggc

SEQ ID NO: 2593038 - DNA, 12 bp, Homo sapiens
agggccctgcag

SEQ ID NO: 2593039 - DNA, 13 bp, Homo sapiens
agggccctggtgt

SEQ ID NO: 2593040 - DNA, 24 bp, Homo sapiens
agggccctggtgtttctagcactg

SEQ ID NO: 2593041 - DNA, 15 bp, Homo sapiens
agggcccttcactgc

SEQ ID NO: 2593042 - DNA, 20 bp, Homo sapiens
agggccgtaccccaccctca

SEQ ID NO: 2593043 - DNA, 19 bp, Homo sapiens
agggcctagctgctacaaa

SEQ ID NO: 2593044 - DNA, 20 bp, Homo sapiens
agggcctcaaaggcccgctc

SEQ ID NO: 2593045 - DNA, 14 bp, Homo sapiens
agggcctgcaaggg

SEQ ID NO: 2593046 - DNA, 19 bp, Homo sapiens
agggcctggaagacagaga

SEQ ID NO: 2593047 - DNA, 14 bp, Homo sapiens
agggcctggcctga

SEQ ID NO: 2593048 - DNA, 15 bp, Homo sapiens
agggcctggcctgag

SEQ ID NO: 2593049 - DNA, 13 bp, Homo sapiens
agggcctggctca

SEQ ID NO: 2593050 - DNA, 13 bp, Homo sapiens
agggcgtggaggg

SEQ ID NO: 2593051 - DNA, 14 bp, Homo sapiens
agggcgtgggagcg

SEQ ID NO: 2593052 - DNA, 19 bp, Homo sapiens
agggctaccctcccccagg

SEQ ID NO: 2593053 - DNA, 15 bp, Homo sapiens
agggctaccctgagc

SEQ ID NO: 2593054 - DNA, 17 bp, Homo sapiens
agggctaccctgagctg

SEQ ID NO: 2593055 - DNA, 20 bp, Homo sapiens
agggctaccctgagctgagg

SEQ ID NO: 2593056 - DNA, 16 bp, Homo sapiens
agggctagaacctgga

SEQ ID NO: 2593057 - DNA, 19 bp, Homo sapiens
agggctagaacctggaagg

SEQ ID NO: 2593058 - DNA, 18 bp, Homo sapiens
agggctagaacctggagg

SEQ ID NO: 2593059 - DNA, 17 bp, Homo sapiens
agggctagaactggaga

SEQ ID NO: 2593060 - DNA, 19 bp, Homo sapiens
agggctatagctcaggacc

SEQ ID NO: 2593061 - DNA, 13 bp, Homo sapiens
agggctcagcctg

SEQ ID NO: 2593062 - DNA, 15 bp, Homo sapiens
agggctcagcctggt

SEQ ID NO: 2593063 - DNA, 19 bp, Homo sapiens
agggctcagcggggacagc

SEQ ID NO: 2593064 - DNA, 24 bp, Homo sapiens
agggctcaggatttcgtgggtctg

SEQ ID NO: 2593065 - DNA, 11 bp, Homo sapiens
agggctcccca

SEQ ID NO: 2593066 - DNA, 20 bp, Homo sapiens
agggctccccactgcctact

SEQ ID NO: 2593067 - DNA, 12 bp, Homo sapiens
agggctcctggg

SEQ ID NO: 2593068 - DNA, 17 bp, Homo sapiens
agggctctgatattcca

SEQ ID NO: 2593069 - DNA, 15 bp, Homo sapiens
agggctctttagcca

SEQ ID NO: 2593070 - DNA, 14 bp, Homo sapiens
agggctgaaagcca

SEQ ID NO: 2593071 - DNA, 13 bp, Homo sapiens
agggctgctgtga

SEQ ID NO: 2593072 - DNA, 22 bp, Homo sapiens
agggctggacctatgtcctaag

SEQ ID NO: 2593073 - DNA, 13 bp, Homo sapiens
agggctggcccag

SEQ ID NO: 2593074 - DNA, 14 bp, Homo sapiens
agggcttctgcacc

SEQ ID NO: 2593075 - DNA, 17 bp, Homo sapiens
agggcttctgcaccctc

SEQ ID NO: 2593076 - DNA, 18 bp, Homo sapiens
agggcttctgcaccctcc

SEQ ID NO: 2593077 - DNA, 23 bp, Homo sapiens
agggcttctgccatttctgagat

SEQ ID NO: 2593078 - DNA, 18 bp, Homo sapiens
aggggaaaatcagcctgc

SEQ ID NO: 2593079 - DNA, 22 bp, Homo sapiens
aggggaagagtgtactgggggt

SEQ ID NO: 2593080 - DNA, 20 bp, Homo sapiens
aggggaatgtttgcctctgc

SEQ ID NO: 2593081 - DNA, 14 bp, Homo sapiens
aggggacccccgcc

SEQ ID NO: 2593082 - DNA, 22 bp, Homo sapiens
aggggacccccgccccctgccc

SEQ ID NO: 2593083 - DNA, 21 bp, Homo sapiens
aggggaggcagccggcaccca

SEQ ID NO: 2593084 - DNA, 14 bp, Homo sapiens
aggggcagaacagc

SEQ ID NO: 2593085 - DNA, 16 bp, Homo sapiens
aggggcagcccttgct

SEQ ID NO: 2593086 - DNA, 14 bp, Homo sapiens
aggggcagctgacc

SEQ ID NO: 2593087 - DNA, 15 bp, Homo sapiens
aggggcagctgacca

SEQ ID NO: 2593088 - DNA, 11 bp, Homo sapiens
aggggcagctt

SEQ ID NO: 2593089 - DNA, 20 bp, Homo sapiens
aggggcatctgcccctcccc

SEQ ID NO: 2593090 - DNA, 22 bp, Homo sapiens
aggggcatctgcccctccccca

SEQ ID NO: 2593091 - DNA, 20 bp, Homo sapiens
aggggcatgtattggcctgg

SEQ ID NO: 2593092 - DNA, 19 bp, Homo sapiens
aggggcccacagggaaccc

SEQ ID NO: 2593093 - DNA, 15 bp, Homo sapiens
aggatttttatcttt

SEQ ID NO: 2593094 - DNA, 16 bp, Homo sapiens
aggatttttttctgag

SEQ ID NO: 2593095 - DNA, 19 bp, Homo sapiens
aggcaaaatccttgcttat

SEQ ID NO: 2593096 - DNA, 14 bp, Homo sapiens
aggcaaatgacttt

SEQ ID NO: 2593097 - DNA, 19 bp, Homo sapiens
aggcaactgaggcagacag

SEQ ID NO: 2593098 - DNA, 13 bp, Homo sapiens
aggcaaggcaggt

SEQ ID NO: 2593099 - DNA, 20 bp, Homo sapiens
aggcaaggcaggtgcctcca

SEQ ID NO: 2593100 - DNA, 23 bp, Homo sapiens
aggcaatgtcaggaacagaagga

SEQ ID NO: 2593101 - DNA, 20 bp, Homo sapiens
aggcacacttcttcttggtc

SEQ ID NO: 2593102 - DNA, 17 bp, Homo sapiens
aggcacagtgaaggctg

SEQ ID NO: 2593103 - DNA, 15 bp, Homo sapiens
aggcaccccctggag

SEQ ID NO: 2593104 - DNA, 19 bp, Homo sapiens
aggcaccccctggagagaa

SEQ ID NO: 2593105 - DNA, 14 bp, Homo sapiens
aggcacctgcattt

SEQ ID NO: 2593106 - DNA, 19 bp, Homo sapiens
aggcactctgttatttaga

SEQ ID NO: 2593107 - DNA, 20 bp, Homo sapiens
aggcactctgttatttagac

SEQ ID NO: 2593108 - DNA, 17 bp, Homo sapiens
aggcactgaagtgctta

SEQ ID NO: 2593109 - DNA, 13 bp, Homo sapiens
aggcactgcctga

SEQ ID NO: 2593110 - DNA, 14 bp, Homo sapiens
aggcactgcctgat

SEQ ID NO: 2593111 - DNA, 16 bp, Homo sapiens
aggcagaaagcaaaat

SEQ ID NO: 2593112 - DNA, 18 bp, Homo sapiens
aggcagacagcagctcag

SEQ ID NO: 2593113 - DNA, 22 bp, Homo sapiens
aggcagacttccctgaatgtat

SEQ ID NO: 2593114 - DNA, 13 bp, Homo sapiens
aggcagagaaaga

SEQ ID NO: 2593115 - DNA, 15 bp, Homo sapiens
aggcagagaaagaag

SEQ ID NO: 2593116 - DNA, 17 bp, Homo sapiens
aggcagagaaagaagag

SEQ ID NO: 2593117 - DNA, 18 bp, Homo sapiens
aggcagagaaagaagaga

SEQ ID NO: 2593118 - DNA, 20 bp, Homo sapiens
aggcagaggttgcagtgagc

SEQ ID NO: 2593119 - DNA, 23 bp, Homo sapiens
aggcagatctgtgccccatgcct

SEQ ID NO: 2593120 - DNA, 15 bp, Homo sapiens
aggcagattgaaaag

SEQ ID NO: 2593121 - DNA, 12 bp, Homo sapiens
aggcagcattta

SEQ ID NO: 2593122 - DNA, 14 bp, Homo sapiens
aggcagccaggcca

SEQ ID NO: 2593123 - DNA, 15 bp, Homo sapiens
aggcagccaggccac

SEQ ID NO: 2593124 - DNA, 16 bp, Homo sapiens
aggcagccccattctg

SEQ ID NO: 2593125 - DNA, 17 bp, Homo sapiens
aggcagccccattctgc

SEQ ID NO: 2593126 - DNA, 22 bp, Homo sapiens
aggcagctggatgagacttcca

SEQ ID NO: 2593127 - DNA, 20 bp, Homo sapiens
aggcagctttttctctccca

SEQ ID NO: 2593128 - DNA, 19 bp, Homo sapiens
aggcaggacatgctgaagc

SEQ ID NO: 2593129 - DNA, 17 bp, Homo sapiens
aggcaggagaatcactt

SEQ ID NO: 2593130 - DNA, 22 bp, Homo sapiens
aggcaggccaaggccttctcct

SEQ ID NO: 2593131 - DNA, 22 bp, Homo sapiens
aggcaggctaaggcgtggagct

SEQ ID NO: 2593132 - DNA, 13 bp, Homo sapiens
aggcagggaagtc

SEQ ID NO: 2593133 - DNA, 12 bp, Homo sapiens
aggcagggaggg

SEQ ID NO: 2593134 - DNA, 14 bp, Homo sapiens
aggcagggagggga

SEQ ID NO: 2593135 - DNA, 16 bp, Homo sapiens
aggcagggaggggact

SEQ ID NO: 2593136 - DNA, 19 bp, Homo sapiens
aggcagggtcaggagaggg

SEQ ID NO: 2593137 - DNA, 12 bp, Homo sapiens
aggcagggtctc

SEQ ID NO: 2593138 - DNA, 21 bp, Homo sapiens
aggcaggtcttgaactcctgg

SEQ ID NO: 2593139 - DNA, 14 bp, Homo sapiens
aggcaggtgcctcc

SEQ ID NO: 2593140 - DNA, 18 bp, Homo sapiens
aggcaggtgcctccaggt

SEQ ID NO: 2593141 - DNA, 20 bp, Homo sapiens
aggcaggtgcctccaggtgt

SEQ ID NO: 2593142 - DNA, 19 bp, Homo sapiens
aggcagtaataaaaagatt

SEQ ID NO: 2593143 - DNA, 18 bp, Homo sapiens
aggcagtcgggggctggc

SEQ ID NO: 2593144 - DNA, 21 bp, Homo sapiens
aggcagtcgggggctggccta

SEQ ID NO: 2593145 - DNA, 23 bp, Homo sapiens
aggcagtcgggggctggcctagg

SEQ ID NO: 2593146 - DNA, 15 bp, Homo sapiens
aggcataaagtcagg

SEQ ID NO: 2593147 - DNA, 22 bp, Homo sapiens
aggcataaagtcaggggttccc

SEQ ID NO: 2593148 - DNA, 16 bp, Homo sapiens
aggcataggcctgggt

SEQ ID NO: 2593149 - DNA, 19 bp, Homo sapiens
aggcataggcctgggtgct

SEQ ID NO: 2593150 - DNA, 20 bp, Homo sapiens
aggcataggcctgggtgctg

SEQ ID NO: 2593151 - DNA, 20 bp, Homo sapiens
aggcatattgctttttctaa

SEQ ID NO: 2593152 - DNA, 19 bp, Homo sapiens
aggcatcagtccctatgta

SEQ ID NO: 2593153 - DNA, 16 bp, Homo sapiens
aggcatcatgcagagt

SEQ ID NO: 2593154 - DNA, 13 bp, Homo sapiens
aggcatcccaggg

SEQ ID NO: 2593155 - DNA, 23 bp, Homo sapiens
aggcatcccaggggaccacacct

SEQ ID NO: 2593156 - DNA, 11 bp, Homo sapiens
aggcatgaagg

SEQ ID NO: 2593157 - DNA, 23 bp, Homo sapiens
aggcatgagggatcacagggccc

SEQ ID NO: 2593158 - DNA, 13 bp, Homo sapiens
aggcatgcctgtg

SEQ ID NO: 2593159 - DNA, 16 bp, Homo sapiens
aggcatggccctgggg

SEQ ID NO: 2593160 - DNA, 21 bp, Homo sapiens
aggcatggccctggggtccca

SEQ ID NO: 2593161 - DNA, 12 bp, Homo sapiens
aggcatggtgga

SEQ ID NO: 2593162 - DNA, 15 bp, Homo sapiens
aggcatggtggccca

SEQ ID NO: 2593163 - DNA, 14 bp, Homo sapiens
aggcatgtcctgga

SEQ ID NO: 2593164 - DNA, 20 bp, Homo sapiens
aggcatgttctctgaggaca

SEQ ID NO: 2593165 - DNA, 22 bp, Homo sapiens
aggcatgttctctgaggacact

SEQ ID NO: 2593166 - DNA, 18 bp, Homo sapiens
aggcattccccaggaggc

SEQ ID NO: 2593167 - DNA, 19 bp, Homo sapiens
aggcattccccaggaggcc

SEQ ID NO: 2593168 - DNA, 18 bp, Homo sapiens
aggcattgccaagggctt

SEQ ID NO: 2593169 - DNA, 20 bp, Homo sapiens
aggcattgccaagggctttg

SEQ ID NO: 2593170 - DNA, 21 bp, Homo sapiens
aggcattgccaagggctttgt

SEQ ID NO: 2593171 - DNA, 14 bp, Homo sapiens
aggcattgtttgag

SEQ ID NO: 2593172 - DNA, 18 bp, Homo sapiens
aggcatttgtttgaactg

SEQ ID NO: 2593173 - DNA, 13 bp, Homo sapiens
aggccaaaaaaat

SEQ ID NO: 2593174 - DNA, 15 bp, Homo sapiens
aggccaaacctctgt

SEQ ID NO: 2593175 - DNA, 16 bp, Homo sapiens
aggccaaacctctgtt

SEQ ID NO: 2593176 - DNA, 18 bp, Homo sapiens
aggccaaacctctgttca

SEQ ID NO: 2593177 - DNA, 14 bp, Homo sapiens
aggccaagagcaga

SEQ ID NO: 2593178 - DNA, 14 bp, Homo sapiens
aggccaagaggctg

SEQ ID NO: 2593179 - DNA, 14 bp, Homo sapiens
aggccaagtgcagg

SEQ ID NO: 2593180 - DNA, 16 bp, Homo sapiens
aggccacaagaccctt

SEQ ID NO: 2593181 - DNA, 19 bp, Homo sapiens
aggccacaagacccttgtg

SEQ ID NO: 2593182 - DNA, 22 bp, Homo sapiens
aggccacaccatctcctttcag

SEQ ID NO: 2593183 - DNA, 18 bp, Homo sapiens
aggccacatgagtcccag

SEQ ID NO: 2593184 - DNA, 19 bp, Homo sapiens
aggccacatggggctgggc

SEQ ID NO: 2593185 - DNA, 21 bp, Homo sapiens
aggccacatgtcaccgtggac

SEQ ID NO: 2593186 - DNA, 22 bp, Homo sapiens
aggccaccatattcagtgctgt

SEQ ID NO: 2593187 - DNA, 12 bp, Homo sapiens
aggccacctctc

SEQ ID NO: 2593188 - DNA, 16 bp, Homo sapiens
aggccacctctccaag

SEQ ID NO: 2593189 - DNA, 17 bp, Homo sapiens
aggccacctctccaagg

SEQ ID NO: 2593190 - DNA, 13 bp, Homo sapiens
aggccacctgccc

SEQ ID NO: 2593191 - DNA, 18 bp, Homo sapiens
aggccacctgcccccttc

SEQ ID NO: 2593192 - DNA, 23 bp, Homo sapiens
aggccacgtgatgtggagggcac

SEQ ID NO: 2593193 - DNA, 20 bp, Homo sapiens
aggccagagggagtgacaga

SEQ ID NO: 2593194 - DNA, 21 bp, Homo sapiens
aggccagagtggcctggccag

SEQ ID NO: 2593195 - DNA, 13 bp, Homo sapiens
aggccagccagtg

SEQ ID NO: 2593196 - DNA, 15 bp, Homo sapiens
aggccagccccaccc

SEQ ID NO: 2593197 - DNA, 21 bp, Homo sapiens
aggccagccccacccaggagg

SEQ ID NO: 2593198 - DNA, 13 bp, Homo sapiens
aggccagcctggc

SEQ ID NO: 2593199 - DNA, 13 bp, Homo sapiens
aggccagctgcct

SEQ ID NO: 2593200 - DNA, 14 bp, Homo sapiens
aggccagctggcag

SEQ ID NO: 2593201 - DNA, 11 bp, Homo sapiens
aggccaggagt

SEQ ID NO: 2593202 - DNA, 14 bp, Homo sapiens
aggccaggccacca

SEQ ID NO: 2593203 - DNA, 13 bp, Homo sapiens
aggccaggccagc

SEQ ID NO: 2593204 - DNA, 15 bp, Homo sapiens
aggccaggccagctg

SEQ ID NO: 2593205 - DNA, 13 bp, Homo sapiens
aggccagggcaga

SEQ ID NO: 2593206 - DNA, 12 bp, Homo sapiens
aggccagggtca

SEQ ID NO: 2593207 - DNA, 20 bp, Homo sapiens
aggccagggtcactgaaggc

SEQ ID NO: 2593208 - DNA, 14 bp, Homo sapiens
aggccaggtgcagt

SEQ ID NO: 2593209 - DNA, 21 bp, Homo sapiens
aggccatgattcgcccaaagc

SEQ ID NO: 2593210 - DNA, 22 bp, Homo sapiens
aggccatggagagctggagcct

SEQ ID NO: 2593211 - DNA, 12 bp, Homo sapiens
aggcccaagaga

SEQ ID NO: 2593212 - DNA, 13 bp, Homo sapiens
aggcccagagggc

SEQ ID NO: 2593213 - DNA, 15 bp, Homo sapiens
aggcccagagggcct

SEQ ID NO: 2593214 - DNA, 16 bp, Homo sapiens
aggcccagagggcctg

SEQ ID NO: 2593215 - DNA, 19 bp, Homo sapiens
aggcccagagggcctgcaa

SEQ ID NO: 2593216 - DNA, 19 bp, Homo sapiens
aggcccagcattgctggtt

SEQ ID NO: 2593217 - DNA, 22 bp, Homo sapiens
aggcccagcattgctggttcta

SEQ ID NO: 2593218 - DNA, 13 bp, Homo sapiens
aggccccagagac

SEQ ID NO: 2593219 - DNA, 20 bp, Homo sapiens
aggccccagagactcagagg

SEQ ID NO: 2593220 - DNA, 14 bp, Homo sapiens
aggccccaggaagc

SEQ ID NO: 2593221 - DNA, 20 bp, Homo sapiens
aggccccgaggacccagacc

SEQ ID NO: 2593222 - DNA, 16 bp, Homo sapiens
aggccccgcccaggct

SEQ ID NO: 2593223 - DNA, 17 bp, Homo sapiens
aggccccgcccaggctt

SEQ ID NO: 2593224 - DNA, 12 bp, Homo sapiens
aggcccctgcca

SEQ ID NO: 2593225 - DNA, 15 bp, Homo sapiens
aggcccctgccaccc

SEQ ID NO: 2593226 - DNA, 17 bp, Homo sapiens
aggcccctgccaccctg

SEQ ID NO: 2593227 - DNA, 18 bp, Homo sapiens
aggcccctgccaccctgg

SEQ ID NO: 2593228 - DNA, 16 bp, Homo sapiens
aggcccggctccaggc

SEQ ID NO: 2593229 - DNA, 21 bp, Homo sapiens
aggcccggctccaggctcctt

SEQ ID NO: 2593230 - DNA, 18 bp, Homo sapiens
aggccctcgggcccagcc

SEQ ID NO: 2593231 - DNA, 20 bp, Homo sapiens
aggccctcgggcccagcccc

SEQ ID NO: 2593232 - DNA, 13 bp, Homo sapiens
aggccctctgccc

SEQ ID NO: 2593233 - DNA, 14 bp, Homo sapiens
aggccctctgccca

SEQ ID NO: 2593234 - DNA, 17 bp, Homo sapiens
aggccctctgcccactc

SEQ ID NO: 2593235 - DNA, 19 bp, Homo sapiens
aggcccttctctccagccc

SEQ ID NO: 2593236 - DNA, 17 bp, Homo sapiens
aggccgaagctctggct

SEQ ID NO: 2593237 - DNA, 15 bp, Homo sapiens
aggcctctgtgtcct

SEQ ID NO: 2593238 - DNA, 20 bp, Homo sapiens
aggcctctgtgtccttccct

SEQ ID NO: 2593239 - DNA, 14 bp, Homo sapiens
aggcctgaggatga

SEQ ID NO: 2593240 - DNA, 15 bp, Homo sapiens
aggcctgctcaggga

SEQ ID NO: 2593241 - DNA, 18 bp, Homo sapiens
aggcctgctcagggactg

SEQ ID NO: 2593242 - DNA, 17 bp, Homo sapiens
aggcctggccagatgca

SEQ ID NO: 2593243 - DNA, 14 bp, Homo sapiens
aggcctggccaggc

SEQ ID NO: 2593244 - DNA, 15 bp, Homo sapiens
aggcctggccaggca

SEQ ID NO: 2593245 - DNA, 16 bp, Homo sapiens
aggcctggccaggcac

SEQ ID NO: 2593246 - DNA, 12 bp, Homo sapiens
aggcctggggac

SEQ ID NO: 2593247 - DNA, 16 bp, Homo sapiens
aggcctgggtctgtgt

SEQ ID NO: 2593248 - DNA, 17 bp, Homo sapiens
aggcctgggtctgtgtc

SEQ ID NO: 2593249 - DNA, 23 bp, Homo sapiens
aggcctgggtgctggctgcccag

SEQ ID NO: 2593250 - DNA, 23 bp, Homo sapiens
aggcctgtgtgtgaaaggaagct

SEQ ID NO: 2593251 - DNA, 13 bp, Homo sapiens
aggccttctcctc

SEQ ID NO: 2593252 - DNA, 22 bp, Homo sapiens
aggccttctcctccccacccgc

SEQ ID NO: 2593253 - DNA, 14 bp, Homo sapiens
aggccttgtcccag

SEQ ID NO: 2593254 - DNA, 16 bp, Homo sapiens
aggccttttggaatgt

SEQ ID NO: 2593255 - DNA, 23 bp, Homo sapiens
aggcgatccacctgtctcagcct

SEQ ID NO: 2593256 - DNA, 21 bp, Homo sapiens
aggcgcactttcctcctggca

SEQ ID NO: 2593257 - DNA, 24 bp, Homo sapiens
aggcggagagtacagtgagccaag

SEQ ID NO: 2593258 - DNA, 14 bp, Homo sapiens
aggcgggccagcca

SEQ ID NO: 2593259 - DNA, 21 bp, Homo sapiens
aggcgggccagccaggcgggc

SEQ ID NO: 2593260 - DNA, 15 bp, Homo sapiens
aggcgggcggtcagg

SEQ ID NO: 2593261 - DNA, 14 bp, Homo sapiens
aggcgggctcaagg

SEQ ID NO: 2593262 - DNA, 13 bp, Homo sapiens
aggctacactgac

SEQ ID NO: 2593263 - DNA, 18 bp, Homo sapiens
aggctacactgacactgg

SEQ ID NO: 2593264 - DNA, 15 bp, Homo sapiens
aggctacctttgtat

SEQ ID NO: 2593265 - DNA, 21 bp, Homo sapiens
aggctagaaccacctgcctat

SEQ ID NO: 2593266 - DNA, 19 bp, Homo sapiens
aggctattattttcactgt

SEQ ID NO: 2593267 - DNA, 19 bp, Homo sapiens
aggctcacccccttctcca

SEQ ID NO: 2593268 - DNA, 21 bp, Homo sapiens
aggctcacccccttctccatc

SEQ ID NO: 2593269 - DNA, 23 bp, Homo sapiens
aggctcacccccttctccatcca

SEQ ID NO: 2593270 - DNA, 14 bp, Homo sapiens
aggctcagagatgt

SEQ ID NO: 2593271 - DNA, 20 bp, Homo sapiens
aggctcatagggaagacctg

SEQ ID NO: 2593272 - DNA, 22 bp, Homo sapiens
aggctccaccccatccagttca

SEQ ID NO: 2593273 - DNA, 14 bp, Homo sapiens
aggctccagagggc

SEQ ID NO: 2593274 - DNA, 18 bp, Homo sapiens
aggctccaggagcagcca

SEQ ID NO: 2593275 - DNA, 14 bp, Homo sapiens
aggctccattagga

SEQ ID NO: 2593276 - DNA, 16 bp, Homo sapiens
aggctccttcctgtct

SEQ ID NO: 2593277 - DNA, 12 bp, Homo sapiens
aggctcgagcat

SEQ ID NO: 2593278 - DNA, 18 bp, Homo sapiens
aggctcgagcatgcctgg

SEQ ID NO: 2593279 - DNA, 20 bp, Homo sapiens
aggctctcaacaggggagag

SEQ ID NO: 2593280 - DNA, 13 bp, Homo sapiens
aggctctgcacag

SEQ ID NO: 2593281 - DNA, 16 bp, Homo sapiens
aggctctgtgctgacc

SEQ ID NO: 2593282 - DNA, 17 bp, Homo sapiens
aggctctgtgctgaccc

SEQ ID NO: 2593283 - DNA, 17 bp, Homo sapiens
aggctcttctccccaga

SEQ ID NO: 2593284 - DNA, 19 bp, Homo sapiens
aggctcttctccccagagt

SEQ ID NO: 2593285 - DNA, 15 bp, Homo sapiens
aggctctttctgggc

SEQ ID NO: 2593286 - DNA, 15 bp, Homo sapiens
aggctgaggaaaggc

SEQ ID NO: 2593287 - DNA, 19 bp, Homo sapiens
aggctgaggaaaggccagc

SEQ ID NO: 2593288 - DNA, 22 bp, Homo sapiens
aggctgaggaaaggccagctgg

SEQ ID NO: 2593289 - DNA, 14 bp, Homo sapiens
aggctgaggcagga

SEQ ID NO: 2593290 - DNA, 15 bp, Homo sapiens
aggctgaggcaggag

SEQ ID NO: 2593291 - DNA, 19 bp, Homo sapiens
aggctgaggcaggagaatg

SEQ ID NO: 2593292 - DNA, 17 bp, Homo sapiens
aggctgaggcaggagga

SEQ ID NO: 2593293 - DNA, 11 bp, Homo sapiens
aggctgaggcg

SEQ ID NO: 2593294 - DNA, 14 bp, Homo sapiens
aggctgaggtgtct

SEQ ID NO: 2593295 - DNA, 17 bp, Homo sapiens
aggctgcagaaggccaa

SEQ ID NO: 2593296 - DNA, 21 bp, Homo sapiens
aggctgcagtcagtcatgatg

SEQ ID NO: 2593297 - DNA, 17 bp, Homo sapiens
aggctgcagtgagccga

SEQ ID NO: 2593298 - DNA, 19 bp, Homo sapiens
aggctgcagtgagccgaga

SEQ ID NO: 2593299 - DNA, 17 bp, Homo sapiens
aggctgccaaggccaga

SEQ ID NO: 2593300 - DNA, 16 bp, Homo sapiens
aggctgctcagggctg

SEQ ID NO: 2593301 - DNA, 17 bp, Homo sapiens
aggctgctcagggctgg

SEQ ID NO: 2593302 - DNA, 15 bp, Homo sapiens
aggctgctggcgcct

SEQ ID NO: 2593303 - DNA, 18 bp, Homo sapiens
aggctgctggcgcctctg

SEQ ID NO: 2593304 - DNA, 20 bp, Homo sapiens
aggctgctggcgcctctgca

SEQ ID NO: 2593305 - DNA, 21 bp, Homo sapiens
aggctgctggcgcctctgcaa

SEQ ID NO: 2593306 - DNA, 14 bp, Homo sapiens
aggctggagaagct

SEQ ID NO: 2593307 - DNA, 12 bp, Homo sapiens
aggctggagctg

SEQ ID NO: 2593308 - DNA, 22 bp, Homo sapiens
aggctggattttgaattttctt

SEQ ID NO: 2593309 - DNA, 17 bp, Homo sapiens
aggctggcgcagccaag

SEQ ID NO: 2593310 - DNA, 19 bp, Homo sapiens
aggctggcgcagccaaggc

SEQ ID NO: 2593311 - DNA, 18 bp, Homo sapiens
aggctggcgtgcagtggt

SEQ ID NO: 2593312 - DNA, 13 bp, Homo sapiens
aggctggctggcc

SEQ ID NO: 2593313 - DNA, 14 bp, Homo sapiens
aggctgggagagcc

SEQ ID NO: 2593314 - DNA, 20 bp, Homo sapiens
aggctgggagagccttccag

SEQ ID NO: 2593315 - DNA, 21 bp, Homo sapiens
aggctgggagagccttccagg

SEQ ID NO: 2593316 - DNA, 14 bp, Homo sapiens
aggctgggctccct

SEQ ID NO: 2593317 - DNA, 14 bp, Homo sapiens
aggctgggcttcag

SEQ ID NO: 2593318 - DNA, 18 bp, Homo sapiens
aggctgggcttcagtggc

SEQ ID NO: 2593319 - DNA, 20 bp, Homo sapiens
aggctgggcttcagtggcag

SEQ ID NO: 2593320 - DNA, 22 bp, Homo sapiens
aggctggggaagtcctctgggt

SEQ ID NO: 2593321 - DNA, 17 bp, Homo sapiens
aggctgggggaagaagc

SEQ ID NO: 2593322 - DNA, 22 bp, Homo sapiens
aggctgggggaagaagctctct

SEQ ID NO: 2593323 - DNA, 18 bp, Homo sapiens
aggctgtatcccatgagc

SEQ ID NO: 2593324 - DNA, 23 bp, Homo sapiens
aggctgtatcccatgagcctcag

SEQ ID NO: 2593325 - DNA, 24 bp, Homo sapiens
aggctgtatcccatgagcctcagc

SEQ ID NO: 2593326 - DNA, 19 bp, Homo sapiens
aggctgtccttacccatct

SEQ ID NO: 2593327 - DNA, 17 bp, Homo sapiens
aggctgtctggccaggc

SEQ ID NO: 2593328 - DNA, 21 bp, Homo sapiens
aggctgtcttctcaggctctg

SEQ ID NO: 2593329 - DNA, 13 bp, Homo sapiens
aggctgtgctccc

SEQ ID NO: 2593330 - DNA, 20 bp, Homo sapiens
aggctgtgctccctggttct

SEQ ID NO: 2593331 - DNA, 15 bp, Homo sapiens
aggctgtgggcctca

SEQ ID NO: 2593332 - DNA, 15 bp, Homo sapiens
aggcttagctttgct

SEQ ID NO: 2593333 - DNA, 19 bp, Homo sapiens
aggcttagctttgctctgc

SEQ ID NO: 2593334 - DNA, 20 bp, Homo sapiens
aggcttagctttgctctgcc

SEQ ID NO: 2593335 - DNA, 17 bp, Homo sapiens
aggcttagtcactgaga

SEQ ID NO: 2593336 - DNA, 22 bp, Homo sapiens
aggcttagtcactgagacagcc

SEQ ID NO: 2593337 - DNA, 14 bp, Homo sapiens
aggcttccagagag

SEQ ID NO: 2593338 - DNA, 13 bp, Homo sapiens
aggcttccttggc

SEQ ID NO: 2593339 - DNA, 22 bp, Homo sapiens
aggcttctccaattctgcccaa

SEQ ID NO: 2593340 - DNA, 14 bp, Homo sapiens
aggcttgctgagag

SEQ ID NO: 2593341 - DNA, 15 bp, Homo sapiens
aggcttgtcagagct

SEQ ID NO: 2593342 - DNA, 16 bp, Homo sapiens
aggcttgtcagagctg

SEQ ID NO: 2593343 - DNA, 16 bp, Homo sapiens
agggaaactattgtcc

SEQ ID NO: 2593344 - DNA, 15 bp, Homo sapiens
agggaaactgccagc

SEQ ID NO: 2593345 - DNA, 16 bp, Homo sapiens
agggaaactgccagca

SEQ ID NO: 2593346 - DNA, 23 bp, Homo sapiens
agggaaactgccagcaacgcagg

SEQ ID NO: 2593347 - DNA, 12 bp, Homo sapiens
agggaaagaaaa

SEQ ID NO: 2593348 - DNA, 19 bp, Homo sapiens
agggaaagaaaaggaaggc

SEQ ID NO: 2593349 - DNA, 14 bp, Homo sapiens
agggaaatgaaaga

SEQ ID NO: 2593350 - DNA, 15 bp, Homo sapiens
agggaactctggggt

SEQ ID NO: 2593351 - DNA, 12 bp, Homo sapiens
agggaagagcag

SEQ ID NO: 2593352 - DNA, 18 bp, Homo sapiens
agggaaggaactctggct

SEQ ID NO: 2593353 - DNA, 22 bp, Homo sapiens
agggaaggatacaaaagcatgt

SEQ ID NO: 2593354 - DNA, 20 bp, Homo sapiens
agggaaggggaggcagccgg

SEQ ID NO: 2593355 - DNA, 15 bp, Homo sapiens
agggaagtccccagg

SEQ ID NO: 2593356 - DNA, 21 bp, Homo sapiens
agggaatgaaggtgtcagaat

SEQ ID NO: 2593357 - DNA, 23 bp, Homo sapiens
agggaatgagacaggacctagga

SEQ ID NO: 2593358 - DNA, 13 bp, Homo sapiens
agggaatgcctga

SEQ ID NO: 2593359 - DNA, 18 bp, Homo sapiens
agggaatgcctgagtgcc

SEQ ID NO: 2593360 - DNA, 21 bp, Homo sapiens
agggaatgcctgagtgcctgg

SEQ ID NO: 2593361 - DNA, 15 bp, Homo sapiens
agggaatttcaggaa

SEQ ID NO: 2593362 - DNA, 18 bp, Homo sapiens
agggacaccagccaggct

SEQ ID NO: 2593363 - DNA, 21 bp, Homo sapiens
agggacaccagccaggctctg

SEQ ID NO: 2593364 - DNA, 19 bp, Homo sapiens
agggacatgttttgataaa

SEQ ID NO: 2593365 - DNA, 12 bp, Homo sapiens
agggaccaaggc

SEQ ID NO: 2593366 - DNA, 17 bp, Homo sapiens
agggaccaaggcaaggc

SEQ ID NO: 2593367 - DNA, 18 bp, Homo sapiens
agggaccacaccctgtac

SEQ ID NO: 2593368 - DNA, 15 bp, Homo sapiens
agggacctctcccag

SEQ ID NO: 2593369 - DNA, 15 bp, Homo sapiens
agggaccttgaaggg

SEQ ID NO: 2593370 - DNA, 20 bp, Homo sapiens
agggactatgaatgggcaaa

SEQ ID NO: 2593371 - DNA, 20 bp, Homo sapiens
agggactcaatttctcccca

SEQ ID NO: 2593372 - DNA, 20 bp, Homo sapiens
agggactctgaagcctctgg

SEQ ID NO: 2593373 - DNA, 21 bp, Homo sapiens
agggactctgaagcctctggg

SEQ ID NO: 2593374 - DNA, 15 bp, Homo sapiens
agggactgaggggag

SEQ ID NO: 2593375 - DNA, 18 bp, Homo sapiens
agggactggaaccaggga

SEQ ID NO: 2593376 - DNA, 15 bp, Homo sapiens
agggagaagaagtca

SEQ ID NO: 2593377 - DNA, 20 bp, Homo sapiens
agggagacactggcccctca

SEQ ID NO: 2593378 - DNA, 16 bp, Homo sapiens
agggagagacctcatc

SEQ ID NO: 2593379 - DNA, 13 bp, Homo sapiens
agggagagagaga

SEQ ID NO: 2593380 - DNA, 17 bp, Homo sapiens
agggagaggagtgactg

SEQ ID NO: 2593381 - DNA, 16 bp, Homo sapiens
agggagaggtggagca

SEQ ID NO: 2593382 - DNA, 19 bp, Homo sapiens
agggagcaagtccttccct

SEQ ID NO: 2593383 - DNA, 14 bp, Homo sapiens
agggagcagacagg

SEQ ID NO: 2593384 - DNA, 19 bp, Homo sapiens
agggagcaggcggtgggca

SEQ ID NO: 2593385 - DNA, 22 bp, Homo sapiens
agggaggaccagggcagggcca

SEQ ID NO: 2593386 - DNA, 15 bp, Homo sapiens
agggaggaggccacc

SEQ ID NO: 2593387 - DNA, 16 bp, Homo sapiens
agggaggaggccacct

SEQ ID NO: 2593388 - DNA, 13 bp, Homo sapiens
agctccttcctgg

SEQ ID NO: 2593389 - DNA, 19 bp, Homo sapiens
agctccttcctggagactg

SEQ ID NO: 2593390 - DNA, 13 bp, Homo sapiens
agctccttctgtc

SEQ ID NO: 2593391 - DNA, 15 bp, Homo sapiens
agctccttctgtcct

SEQ ID NO: 2593392 - DNA, 23 bp, Homo sapiens
agctccttctgtcctactctgtg

SEQ ID NO: 2593393 - DNA, 14 bp, Homo sapiens
agctcggtggaccc

SEQ ID NO: 2593394 - DNA, 18 bp, Homo sapiens
agctcggtggacccaggg

SEQ ID NO: 2593395 - DNA, 19 bp, Homo sapiens
agctcggtggacccaggga

SEQ ID NO: 2593396 - DNA, 16 bp, Homo sapiens
agctctagacaaccct

SEQ ID NO: 2593397 - DNA, 22 bp, Homo sapiens
agctctattaagatttccaagt

SEQ ID NO: 2593398 - DNA, 12 bp, Homo sapiens
agctctcagcca

SEQ ID NO: 2593399 - DNA, 14 bp, Homo sapiens
agctctccagctcc

SEQ ID NO: 2593400 - DNA, 17 bp, Homo sapiens
agctctccagctccaag

SEQ ID NO: 2593401 - DNA, 15 bp, Homo sapiens
agctctcccctcaga

SEQ ID NO: 2593402 - DNA, 16 bp, Homo sapiens
agctctctcctccctt

SEQ ID NO: 2593403 - DNA, 23 bp, Homo sapiens
agctctgaagtcacatcacagga

SEQ ID NO: 2593404 - DNA, 21 bp, Homo sapiens
agctctgcagagcaggaaaca

SEQ ID NO: 2593405 - DNA, 12 bp, Homo sapiens
agctctgcatta

SEQ ID NO: 2593406 - DNA, 13 bp, Homo sapiens
agctctgcattat

SEQ ID NO: 2593407 - DNA, 23 bp, Homo sapiens
agctctgcccatcctgcccctga

SEQ ID NO: 2593408 - DNA, 12 bp, Homo sapiens
agctctggacca

SEQ ID NO: 2593409 - DNA, 15 bp, Homo sapiens
agctctggaccagcc

SEQ ID NO: 2593410 - DNA, 17 bp, Homo sapiens
agctctggctgaaccct

SEQ ID NO: 2593411 - DNA, 20 bp, Homo sapiens
agctctggtccatagagagc

SEQ ID NO: 2593412 - DNA, 19 bp, Homo sapiens
agctctggtgacaccagcc

SEQ ID NO: 2593413 - DNA, 12 bp, Homo sapiens
agctctgtcctg

SEQ ID NO: 2593414 - DNA, 16 bp, Homo sapiens
agctcttctccaggct

SEQ ID NO: 2593415 - DNA, 16 bp, Homo sapiens
agctcttctccccagg

SEQ ID NO: 2593416 - DNA, 23 bp, Homo sapiens
agctcttctgccggccctggggc

SEQ ID NO: 2593417 - DNA, 14 bp, Homo sapiens
agctcttgcccttc

SEQ ID NO: 2593418 - DNA, 22 bp, Homo sapiens
agctcttgcccttccctgtccc

SEQ ID NO: 2593419 - DNA, 19 bp, Homo sapiens
agctcttgctaatcagtgt

SEQ ID NO: 2593420 - DNA, 21 bp, Homo sapiens
agctcttgctaatcagtgtct

SEQ ID NO: 2593421 - DNA, 17 bp, Homo sapiens
agctgaagtgcatccaa

SEQ ID NO: 2593422 - DNA, 18 bp, Homo sapiens
agctgaatacattctgct

SEQ ID NO: 2593423 - DNA, 22 bp, Homo sapiens
agctgacacaaacctgcctggg

SEQ ID NO: 2593424 - DNA, 23 bp, Homo sapiens
agctgacacaaacctgcctgggt

SEQ ID NO: 2593425 - DNA, 16 bp, Homo sapiens
agctgagagaaaataa

SEQ ID NO: 2593426 - DNA, 14 bp, Homo sapiens
agctgagagacttt

SEQ ID NO: 2593427 - DNA, 15 bp, Homo sapiens
agctgagagactttt

SEQ ID NO: 2593428 - DNA, 13 bp, Homo sapiens
agctgagcctctc

SEQ ID NO: 2593429 - DNA, 13 bp, Homo sapiens
agctgaggggggc

SEQ ID NO: 2593430 - DNA, 23 bp, Homo sapiens
agctgaggtctcttgagggagct

SEQ ID NO: 2593431 - DNA, 15 bp, Homo sapiens
agctgatccagagca

SEQ ID NO: 2593432 - DNA, 21 bp, Homo sapiens
agctgatgttggaagagaaag

SEQ ID NO: 2593433 - DNA, 15 bp, Homo sapiens
agctgattttaacaa

SEQ ID NO: 2593434 - DNA, 16 bp, Homo sapiens
agctgattttaacaat

SEQ ID NO: 2593435 - DNA, 18 bp, Homo sapiens
agctgcaagtgacatctc

SEQ ID NO: 2593436 - DNA, 21 bp, Homo sapiens
agctgcaagtgacatctcttt

SEQ ID NO: 2593437 - DNA, 19 bp, Homo sapiens
agctgcacagggcagctgg

SEQ ID NO: 2593438 - DNA, 21 bp, Homo sapiens
agctgcacagggcagctgggc

SEQ ID NO: 2593439 - DNA, 17 bp, Homo sapiens
agctgcaccctcaggca

SEQ ID NO: 2593440 - DNA, 18 bp, Homo sapiens
agctgcacctgccagcct

SEQ ID NO: 2593441 - DNA, 18 bp, Homo sapiens
agctgcatacagtttgca

SEQ ID NO: 2593442 - DNA, 22 bp, Homo sapiens
agctgcatcctccaagaatcta

SEQ ID NO: 2593443 - DNA, 12 bp, Homo sapiens
agctgccagaga

SEQ ID NO: 2593444 - DNA, 14 bp, Homo sapiens
agctgccagagaag

SEQ ID NO: 2593445 - DNA, 20 bp, Homo sapiens
agctgcctctcggtggccag

SEQ ID NO: 2593446 - DNA, 14 bp, Homo sapiens
agctgcctcttctg

SEQ ID NO: 2593447 - DNA, 13 bp, Homo sapiens
agctgcctgggat

SEQ ID NO: 2593448 - DNA, 15 bp, Homo sapiens
agctgcctggtatat

SEQ ID NO: 2593449 - DNA, 18 bp, Homo sapiens
agctgcctgtagttagga

SEQ ID NO: 2593450 - DNA, 23 bp, Homo sapiens
agctgcctgtagttaggaaataa

SEQ ID NO: 2593451 - DNA, 13 bp, Homo sapiens
agctgcctgttca

SEQ ID NO: 2593452 - DNA, 14 bp, Homo sapiens
agctgcctgttcag

SEQ ID NO: 2593453 - DNA, 22 bp, Homo sapiens
agctgcctgttcagctccagct

SEQ ID NO: 2593454 - DNA, 13 bp, Homo sapiens
agctgcggtccac

SEQ ID NO: 2593455 - DNA, 19 bp, Homo sapiens
agctgcggtccacccagga

SEQ ID NO: 2593456 - DNA, 23 bp, Homo sapiens
agctgcggtccacccaggagccc

SEQ ID NO: 2593457 - DNA, 11 bp, Homo sapiens
agctgctacaa

SEQ ID NO: 2593458 - DNA, 16 bp, Homo sapiens
agctgctacaaagaag

SEQ ID NO: 2593459 - DNA, 19 bp, Homo sapiens
agctgctacaaagaagaca

SEQ ID NO: 2593460 - DNA, 21 bp, Homo sapiens
agctgctcagggaaaagcagc

SEQ ID NO: 2593461 - DNA, 13 bp, Homo sapiens
agctgctccccag

SEQ ID NO: 2593462 - DNA, 13 bp, Homo sapiens
agctgctgacagt

SEQ ID NO: 2593463 - DNA, 17 bp, Homo sapiens
agctgctggcttgcagt

SEQ ID NO: 2593464 - DNA, 19 bp, Homo sapiens
agctgctttctgttgtcat

SEQ ID NO: 2593465 - DNA, 21 bp, Homo sapiens
agctgcttttgtctatgggac

SEQ ID NO: 2593466 - DNA, 15 bp, Homo sapiens
agctggactacccac

SEQ ID NO: 2593467 - DNA, 14 bp, Homo sapiens
agctggagcctggt

SEQ ID NO: 2593468 - DNA, 17 bp, Homo sapiens
agctggagcctggtgcc

SEQ ID NO: 2593469 - DNA, 20 bp, Homo sapiens
agctggaggactagaacctg

SEQ ID NO: 2593470 - DNA, 16 bp, Homo sapiens
agctggcagcagagtg

SEQ ID NO: 2593471 - DNA, 21 bp, Homo sapiens
agctggcattacagctggaga

SEQ ID NO: 2593472 - DNA, 18 bp, Homo sapiens
agctggcccgtgacagac

SEQ ID NO: 2593473 - DNA, 21 bp, Homo sapiens
agctggccgagggtcctggct

SEQ ID NO: 2593474 - DNA, 16 bp, Homo sapiens
agctgggaggcatggc

SEQ ID NO: 2593475 - DNA, 23 bp, Homo sapiens
agctgggatgattggagggggga

SEQ ID NO: 2593476 - DNA, 17 bp, Homo sapiens
agctgggatgtttctgt

SEQ ID NO: 2593477 - DNA, 15 bp, Homo sapiens
agctgggcccaaccc

SEQ ID NO: 2593478 - DNA, 21 bp, Homo sapiens
agctgggcccaaccctgtctg

SEQ ID NO: 2593479 - DNA, 13 bp, Homo sapiens
agctgggccccag

SEQ ID NO: 2593480 - DNA, 20 bp, Homo sapiens
agctgggccccagcccaccc

SEQ ID NO: 2593481 - DNA, 11 bp, Homo sapiens
agctgggctgt

SEQ ID NO: 2593482 - DNA, 14 bp, Homo sapiens
agctggggacctgg

SEQ ID NO: 2593483 - DNA, 16 bp, Homo sapiens
agctggggcgtgggga

SEQ ID NO: 2593484 - DNA, 18 bp, Homo sapiens
agctggggcgtggggagg

SEQ ID NO: 2593485 - DNA, 14 bp, Homo sapiens
agctgggttggaaa

SEQ ID NO: 2593486 - DNA, 19 bp, Homo sapiens
agctggtagttagtagcat

SEQ ID NO: 2593487 - DNA, 17 bp, Homo sapiens
agctggtcccactcagt

SEQ ID NO: 2593488 - DNA, 18 bp, Homo sapiens
agctggtgagtgatgcgg

SEQ ID NO: 2593489 - DNA, 12 bp, Homo sapiens
agctggtgcatt

SEQ ID NO: 2593490 - DNA, 14 bp, Homo sapiens
agctggtgcattac

SEQ ID NO: 2593491 - DNA, 14 bp, Homo sapiens
agctggtgcccgga

SEQ ID NO: 2593492 - DNA, 12 bp, Homo sapiens
agctggtggttt

SEQ ID NO: 2593493 - DNA, 14 bp, Homo sapiens
agctggtggtttca

SEQ ID NO: 2593494 - DNA, 16 bp, Homo sapiens
agctggttgaggtttc

SEQ ID NO: 2593495 - DNA, 22 bp, Homo sapiens
agctggtttttagcggagacgg

SEQ ID NO: 2593496 - DNA, 16 bp, Homo sapiens
agctgtaaaccagaga

SEQ ID NO: 2593497 - DNA, 13 bp, Homo sapiens
agctgtaaggcat

SEQ ID NO: 2593498 - DNA, 18 bp, Homo sapiens
agctgtaaggcatgaagg

SEQ ID NO: 2593499 - DNA, 19 bp, Homo sapiens
agctgtacttcgtcttcta

SEQ ID NO: 2593500 - DNA, 22 bp, Homo sapiens
agctgtagtagccctttctgtg

SEQ ID NO: 2593501 - DNA, 19 bp, Homo sapiens
agctgtgctctggacaggc

SEQ ID NO: 2593502 - DNA, 20 bp, Homo sapiens
agctgtgctctggacaggca

SEQ ID NO: 2593503 - DNA, 18 bp, Homo sapiens
agctgttactgtcttcag

SEQ ID NO: 2593504 - DNA, 19 bp, Homo sapiens
agctgttactgtcttcagt

SEQ ID NO: 2593505 - DNA, 19 bp, Homo sapiens
agctgttcacagccagact

SEQ ID NO: 2593506 - DNA, 13 bp, Homo sapiens
agctgttcagctg

SEQ ID NO: 2593507 - DNA, 15 bp, Homo sapiens
agctgttgagctgtt

SEQ ID NO: 2593508 - DNA, 20 bp, Homo sapiens
agctgttgtacatttatgat

SEQ ID NO: 2593509 - DNA, 23 bp, Homo sapiens
agctgttgtacatttatgattta

SEQ ID NO: 2593510 - DNA, 12 bp, Homo sapiens
agctgtttaaga

SEQ ID NO: 2593511 - DNA, 19 bp, Homo sapiens
agctgtttatggcctcagc

SEQ ID NO: 2593512 - DNA, 21 bp, Homo sapiens
agctgtttatggcctcagctg

SEQ ID NO: 2593513 - DNA, 14 bp, Homo sapiens
agctgtttccatag

SEQ ID NO: 2593514 - DNA, 18 bp, Homo sapiens
agctgttttccctgacct

SEQ ID NO: 2593515 - DNA, 18 bp, Homo sapiens
agcttagacctcagcctg

SEQ ID NO: 2593516 - DNA, 19 bp, Homo sapiens
agcttagacctcagcctgt

SEQ ID NO: 2593517 - DNA, 14 bp, Homo sapiens
agcttagcaggaga

SEQ ID NO: 2593518 - DNA, 17 bp, Homo sapiens
agcttagccaatgtggg

SEQ ID NO: 2593519 - DNA, 15 bp, Homo sapiens
agcttattaaaactc

SEQ ID NO: 2593520 - DNA, 20 bp, Homo sapiens
agcttattaaaactcatttt

SEQ ID NO: 2593521 - DNA, 21 bp, Homo sapiens
agcttcaccccaatcccagct

SEQ ID NO: 2593522 - DNA, 16 bp, Homo sapiens
agcttcagaagtttgg

SEQ ID NO: 2593523 - DNA, 20 bp, Homo sapiens
agcttcagccaggagctggg

SEQ ID NO: 2593524 - DNA, 15 bp, Homo sapiens
agcttcagtttcctg

SEQ ID NO: 2593525 - DNA, 18 bp, Homo sapiens
agcttcatttcctgtgtc

SEQ ID NO: 2593526 - DNA, 20 bp, Homo sapiens
agcttcatttgtgtcaatgg

SEQ ID NO: 2593527 - DNA, 17 bp, Homo sapiens
agcttctaccatgaaca

SEQ ID NO: 2593528 - DNA, 18 bp, Homo sapiens
agcttctatcccaggagg

SEQ ID NO: 2593529 - DNA, 14 bp, Homo sapiens
agcttctccaggct

SEQ ID NO: 2593530 - DNA, 15 bp, Homo sapiens
agcttctggtactct

SEQ ID NO: 2593531 - DNA, 19 bp, Homo sapiens
agcttctggtactctccta

SEQ ID NO: 2593532 - DNA, 20 bp, Homo sapiens
agcttctggtactctcctag

SEQ ID NO: 2593533 - DNA, 21 bp, Homo sapiens
aggacctgtggccaagttctt

SEQ ID NO: 2593534 - DNA, 15 bp, Homo sapiens
aggaccttatctgtg

SEQ ID NO: 2593535 - DNA, 16 bp, Homo sapiens
aggaccttatctgtgc

SEQ ID NO: 2593536 - DNA, 14 bp, Homo sapiens
aggacgcttctgaa

SEQ ID NO: 2593537 - DNA, 15 bp, Homo sapiens
aggacgcttctgaat

SEQ ID NO: 2593538 - DNA, 19 bp, Homo sapiens
aggactacgttaagggaag

SEQ ID NO: 2593539 - DNA, 20 bp, Homo sapiens
aggactacgttaagggaagg

SEQ ID NO: 2593540 - DNA, 16 bp, Homo sapiens
aggactatagcccagg

SEQ ID NO: 2593541 - DNA, 18 bp, Homo sapiens
aggactatagcccaggtc

SEQ ID NO: 2593542 - DNA, 13 bp, Homo sapiens
aggactcagctcc

SEQ ID NO: 2593543 - DNA, 14 bp, Homo sapiens
aggactcagctccc

SEQ ID NO: 2593544 - DNA, 19 bp, Homo sapiens
aggactccccaggccaggc

SEQ ID NO: 2593545 - DNA, 15 bp, Homo sapiens
aggactccctcctca

SEQ ID NO: 2593546 - DNA, 18 bp, Homo sapiens
aggactccctcctcacct

SEQ ID NO: 2593547 - DNA, 18 bp, Homo sapiens
aggactctgcccagacca

SEQ ID NO: 2593548 - DNA, 13 bp, Homo sapiens
aggactctgcctc

SEQ ID NO: 2593549 - DNA, 17 bp, Homo sapiens
aggactctgcctcctct

SEQ ID NO: 2593550 - DNA, 17 bp, Homo sapiens
aggactgccgaccgagg

SEQ ID NO: 2593551 - DNA, 18 bp, Homo sapiens
aggactgtatttgtgact

SEQ ID NO: 2593552 - DNA, 16 bp, Homo sapiens
aggactgtgacaggca

SEQ ID NO: 2593553 - DNA, 22 bp, Homo sapiens
aggactgtgacaggcagcagag

SEQ ID NO: 2593554 - DNA, 21 bp, Homo sapiens
aggactgttttttcctgagct

SEQ ID NO: 2593555 - DNA, 17 bp, Homo sapiens
aggacttaacggctcca

SEQ ID NO: 2593556 - DNA, 21 bp, Homo sapiens
aggactttcctaaatgtttaa

SEQ ID NO: 2593557 - DNA, 22 bp, Homo sapiens
aggacttttctttgtggcttcc

SEQ ID NO: 2593558 - DNA, 16 bp, Homo sapiens
aggagaaacagagaca

SEQ ID NO: 2593559 - DNA, 17 bp, Homo sapiens
aggagaaactggaactc

SEQ ID NO: 2593560 - DNA, 18 bp, Homo sapiens
aggagaaactggaactct

SEQ ID NO: 2593561 - DNA, 14 bp, Homo sapiens
aggagaaccactac

SEQ ID NO: 2593562 - DNA, 20 bp, Homo sapiens
aggagaatcacttgaacctg

SEQ ID NO: 2593563 - DNA, 20 bp, Homo sapiens
aggagaattgcttgaacctg

SEQ ID NO: 2593564 - DNA, 14 bp, Homo sapiens
aggagacccacagg

SEQ ID NO: 2593565 - DNA, 13 bp, Homo sapiens
aggagagaagaat

SEQ ID NO: 2593566 - DNA, 14 bp, Homo sapiens
aggagagaagaatg

SEQ ID NO: 2593567 - DNA, 15 bp, Homo sapiens
aggagagccagagaa

SEQ ID NO: 2593568 - DNA, 23 bp, Homo sapiens
aggagagccagagaagtgacagg

SEQ ID NO: 2593569 - DNA, 12 bp, Homo sapiens
aggagagcctgc

SEQ ID NO: 2593570 - DNA, 15 bp, Homo sapiens
aggagagctagcagc

SEQ ID NO: 2593571 - DNA, 14 bp, Homo sapiens
aggagaggagagcc

SEQ ID NO: 2593572 - DNA, 19 bp, Homo sapiens
aggagaggatgagagccca

SEQ ID NO: 2593573 - DNA, 18 bp, Homo sapiens
aggagaggggaagggcca

SEQ ID NO: 2593574 - DNA, 19 bp, Homo sapiens
aggagaggggaagggccag

SEQ ID NO: 2593575 - DNA, 22 bp, Homo sapiens
aggagaggggaagggccagtct

SEQ ID NO: 2593576 - DNA, 17 bp, Homo sapiens
aggagagtcccagagca

SEQ ID NO: 2593577 - DNA, 24 bp, Homo sapiens
aggagagtcccagagcaggaggcc

SEQ ID NO: 2593578 - DNA, 14 bp, Homo sapiens
aggagatatctgag

SEQ ID NO: 2593579 - DNA, 19 bp, Homo sapiens
aggagatatctgagggagg

SEQ ID NO: 2593580 - DNA, 17 bp, Homo sapiens
aggagatgctccttggg

SEQ ID NO: 2593581 - DNA, 22 bp, Homo sapiens
aggagatgctccttgggccctt

SEQ ID NO: 2593582 - DNA, 18 bp, Homo sapiens
aggagcaaatgtttctgc

SEQ ID NO: 2593583 - DNA, 19 bp, Homo sapiens
aggagcaaatgtttctgca

SEQ ID NO: 2593584 - DNA, 22 bp, Homo sapiens
aggagcacaggcagctggatga

SEQ ID NO: 2593585 - DNA, 14 bp, Homo sapiens
aggagcagtgcagg

SEQ ID NO: 2593586 - DNA, 16 bp, Homo sapiens
aggagcatccacctcc

SEQ ID NO: 2593587 - DNA, 20 bp, Homo sapiens
aggagcatccacctccttct

SEQ ID NO: 2593588 - DNA, 23 bp, Homo sapiens
aggagctcactgtggtgtctgtg

SEQ ID NO: 2593589 - DNA, 13 bp, Homo sapiens
aggagctgctggc

SEQ ID NO: 2593590 - DNA, 16 bp, Homo sapiens
aggagctgctggcttg

SEQ ID NO: 2593591 - DNA, 13 bp, Homo sapiens
aggagcttctctg

SEQ ID NO: 2593592 - DNA, 23 bp, Homo sapiens
aggaggattgcttgagcccagga

SEQ ID NO: 2593593 - DNA, 19 bp, Homo sapiens
aggaggccacgtgatgtgg

SEQ ID NO: 2593594 - DNA, 15 bp, Homo sapiens
aggaggccagccttg

SEQ ID NO: 2593595 - DNA, 18 bp, Homo sapiens
aggaggcccctggcccag

SEQ ID NO: 2593596 - DNA, 17 bp, Homo sapiens
aggaggcctccatctca

SEQ ID NO: 2593597 - DNA, 19 bp, Homo sapiens
aggaggctccagagggcac

SEQ ID NO: 2593598 - DNA, 19 bp, Homo sapiens
aggaggctgaggcaggagg

SEQ ID NO: 2593599 - DNA, 20 bp, Homo sapiens
aggaggcttggaaagcatca

SEQ ID NO: 2593600 - DNA, 15 bp, Homo sapiens
aggagggagggggct

SEQ ID NO: 2593601 - DNA, 14 bp, Homo sapiens
aggagggtcaggaa

SEQ ID NO: 2593602 - DNA, 14 bp, Homo sapiens
aggaggtgagggat

SEQ ID NO: 2593603 - DNA, 20 bp, Homo sapiens
aggaggtggaggttgcagtg

SEQ ID NO: 2593604 - DNA, 18 bp, Homo sapiens
aggagtacaggtgaagca

SEQ ID NO: 2593605 - DNA, 16 bp, Homo sapiens
aggagtcccaaggaaa

SEQ ID NO: 2593606 - DNA, 17 bp, Homo sapiens
aggagtcccaaggaaag

SEQ ID NO: 2593607 - DNA, 21 bp, Homo sapiens
aggagtccctgccatcatgtt

SEQ ID NO: 2593608 - DNA, 12 bp, Homo sapiens
aggagtccctgg

SEQ ID NO: 2593609 - DNA, 12 bp, Homo sapiens
aggagtgaggaa

SEQ ID NO: 2593610 - DNA, 22 bp, Homo sapiens
aggagtgaggaaggcaggaaga

SEQ ID NO: 2593611 - DNA, 18 bp, Homo sapiens
aggagtgggttgatttca

SEQ ID NO: 2593612 - DNA, 16 bp, Homo sapiens
aggagttaagagtagc

SEQ ID NO: 2593613 - DNA, 17 bp, Homo sapiens
aggagttagaggccagc

SEQ ID NO: 2593614 - DNA, 13 bp, Homo sapiens
aggagttcaatga

SEQ ID NO: 2593615 - DNA, 16 bp, Homo sapiens
aggagttcaatgatct

SEQ ID NO: 2593616 - DNA, 19 bp, Homo sapiens
aggagttcaatgatctagg

SEQ ID NO: 2593617 - DNA, 16 bp, Homo sapiens
aggagttcgagaccag

SEQ ID NO: 2593618 - DNA, 22 bp, Homo sapiens
aggagttcgagaccagcctggc

SEQ ID NO: 2593619 - DNA, 21 bp, Homo sapiens
aggatacatgtgccgaatgtg

SEQ ID NO: 2593620 - DNA, 18 bp, Homo sapiens
aggatactatattttagg

SEQ ID NO: 2593621 - DNA, 14 bp, Homo sapiens
aggatagcattttt

SEQ ID NO: 2593622 - DNA, 16 bp, Homo sapiens
aggataggagttcact

SEQ ID NO: 2593623 - DNA, 14 bp, Homo sapiens
aggatatattttca

SEQ ID NO: 2593624 - DNA, 15 bp, Homo sapiens
aggatatcttctcca

SEQ ID NO: 2593625 - DNA, 21 bp, Homo sapiens
aggatatgttcacacctagcg

SEQ ID NO: 2593626 - DNA, 23 bp, Homo sapiens
aggatatgttcacacctagcgtc

SEQ ID NO: 2593627 - DNA, 18 bp, Homo sapiens
aggatcactggagcccag

SEQ ID NO: 2593628 - DNA, 12 bp, Homo sapiens
aggatcagtctg

SEQ ID NO: 2593629 - DNA, 13 bp, Homo sapiens
aggatcagtctga

SEQ ID NO: 2593630 - DNA, 15 bp, Homo sapiens
aggatcatggtgtaa

SEQ ID NO: 2593631 - DNA, 18 bp, Homo sapiens
aggatcatggtgtaataa

SEQ ID NO: 2593632 - DNA, 16 bp, Homo sapiens
aggatccctctctgga

SEQ ID NO: 2593633 - DNA, 20 bp, Homo sapiens
aggatcctattctcaccagg

SEQ ID NO: 2593634 - DNA, 16 bp, Homo sapiens
aggatctagaatgtgt

SEQ ID NO: 2593635 - DNA, 22 bp, Homo sapiens
aggatctagaatgtgttttctg

SEQ ID NO: 2593636 - DNA, 14 bp, Homo sapiens
aggatctagagggg

SEQ ID NO: 2593637 - DNA, 14 bp, Homo sapiens
aggatctctcagga

SEQ ID NO: 2593638 - DNA, 20 bp, Homo sapiens
aggatctctcaggagcacag

SEQ ID NO: 2593639 - DNA, 22 bp, Homo sapiens
aggatctcttgagcctgggagg

SEQ ID NO: 2593640 - DNA, 14 bp, Homo sapiens
aggatctggagaac

SEQ ID NO: 2593641 - DNA, 23 bp, Homo sapiens
aggatctgtttttaaaaatcata

SEQ ID NO: 2593642 - DNA, 20 bp, Homo sapiens
aggatgaatgaggtcccagg

SEQ ID NO: 2593643 - DNA, 12 bp, Homo sapiens
aggatgaatgta

SEQ ID NO: 2593644 - DNA, 18 bp, Homo sapiens
aggatgaatgtatgtgca

SEQ ID NO: 2593645 - DNA, 15 bp, Homo sapiens
aggatgagagcccag

SEQ ID NO: 2593646 - DNA, 16 bp, Homo sapiens
aggatgagagcccaga

SEQ ID NO: 2593647 - DNA, 16 bp, Homo sapiens
aggatgagctggaagg

SEQ ID NO: 2593648 - DNA, 23 bp, Homo sapiens
aggatgaggccgctagaggcctg

SEQ ID NO: 2593649 - DNA, 22 bp, Homo sapiens
aggatgatctaggaagactttg

SEQ ID NO: 2593650 - DNA, 18 bp, Homo sapiens
aggatgcttgtacataat

SEQ ID NO: 2593651 - DNA, 17 bp, Homo sapiens
aggatggagagagggga

SEQ ID NO: 2593652 - DNA, 23 bp, Homo sapiens
aggatggcctggccagggcctgg

SEQ ID NO: 2593653 - DNA, 12 bp, Homo sapiens
aggatgggaagg

SEQ ID NO: 2593654 - DNA, 15 bp, Homo sapiens
aggatgtcacagggc

SEQ ID NO: 2593655 - DNA, 16 bp, Homo sapiens
aggatgtcacagggcc

SEQ ID NO: 2593656 - DNA, 13 bp, Homo sapiens
aggatgtctgggc

SEQ ID NO: 2593657 - DNA, 21 bp, Homo sapiens
aggatgtgggggaagacctgg

SEQ ID NO: 2593658 - DNA, 15 bp, Homo sapiens
aggatgttctgggac

SEQ ID NO: 2593659 - DNA, 18 bp, Homo sapiens
aggatgttctgggacaca

SEQ ID NO: 2593660 - DNA, 22 bp, Homo sapiens
aggattgaagagcattgcatgg

SEQ ID NO: 2593661 - DNA, 17 bp, Homo sapiens
aggattgcttgagccca

SEQ ID NO: 2593662 - DNA, 18 bp, Homo sapiens
aggattgcttgagcccag

SEQ ID NO: 2593663 - DNA, 20 bp, Homo sapiens
aggattgcttgagcccagga

SEQ ID NO: 2593664 - DNA, 22 bp, Homo sapiens
aggattgcttgagcccaggagt

SEQ ID NO: 2593665 - DNA, 13 bp, Homo sapiens
aggattgtaaaaa

SEQ ID NO: 2593666 - DNA, 19 bp, Homo sapiens
aggattgtaaaaaaaaatg

SEQ ID NO: 2593667 - DNA, 21 bp, Homo sapiens
aggatttaacagtcatttaaa

SEQ ID NO: 2593668 - DNA, 15 bp, Homo sapiens
aggatttcaagcctg

SEQ ID NO: 2593669 - DNA, 14 bp, Homo sapiens
aggattttatgctt

SEQ ID NO: 2593670 - DNA, 19 bp, Homo sapiens
aggattttgatccaagctg

SEQ ID NO: 2593671 - DNA, 21 bp, Homo sapiens
agaatcctaggctccacccca

SEQ ID NO: 2593672 - DNA, 18 bp, Homo sapiens
agaatctatatttaacaa

SEQ ID NO: 2593673 - DNA, 21 bp, Homo sapiens
agaatgaaagagtaaaggaaa

SEQ ID NO: 2593674 - DNA, 16 bp, Homo sapiens
agaatgaaagggccca

SEQ ID NO: 2593675 - DNA, 20 bp, Homo sapiens
agaatgaaattgctgaaaga

SEQ ID NO: 2593676 - DNA, 21 bp, Homo sapiens
agaatgagcctacgctgaaga

SEQ ID NO: 2593677 - DNA, 14 bp, Homo sapiens
agaatgatttcatg

SEQ ID NO: 2593678 - DNA, 12 bp, Homo sapiens
agaatgctgaaa

SEQ ID NO: 2593679 - DNA, 13 bp, Homo sapiens
agaatgctggttt

SEQ ID NO: 2593680 - DNA, 16 bp, Homo sapiens
agaatgggcagttaca

SEQ ID NO: 2593681 - DNA, 21 bp, Homo sapiens
agaatggttgccttaaagaaa

SEQ ID NO: 2593682 - DNA, 13 bp, Homo sapiens
agaatgtattgta

SEQ ID NO: 2593683 - DNA, 19 bp, Homo sapiens
agaatgttgtattcagtga

SEQ ID NO: 2593684 - DNA, 19 bp, Homo sapiens
agaatgttttactgtgaaa

SEQ ID NO: 2593685 - DNA, 22 bp, Homo sapiens
agaattatataggttgtgcaaa

SEQ ID NO: 2593686 - DNA, 14 bp, Homo sapiens
agaattccaaggag

SEQ ID NO: 2593687 - DNA, 18 bp, Homo sapiens
agaattccttcagggtga

SEQ ID NO: 2593688 - DNA, 17 bp, Homo sapiens
agaattctcttatccaa

SEQ ID NO: 2593689 - DNA, 20 bp, Homo sapiens
agaattcttacatgttttct

SEQ ID NO: 2593690 - DNA, 13 bp, Homo sapiens
agaattctttcaa

SEQ ID NO: 2593691 - DNA, 21 bp, Homo sapiens
agaattgatcattttcccccc

SEQ ID NO: 2593692 - DNA, 22 bp, Homo sapiens
agaatttagggagaaatgttgt

SEQ ID NO: 2593693 - DNA, 16 bp, Homo sapiens
agaatttctaccattt

SEQ ID NO: 2593694 - DNA, 20 bp, Homo sapiens
agaatttctaccatttcaga

SEQ ID NO: 2593695 - DNA, 18 bp, Homo sapiens
agaatttgagtgctctga

SEQ ID NO: 2593696 - DNA, 19 bp, Homo sapiens
agaattttaaaaatgaatc

SEQ ID NO: 2593697 - DNA, 20 bp, Homo sapiens
agaattttaaaaatgaatcc

SEQ ID NO: 2593698 - DNA, 16 bp, Homo sapiens
agaattttaagtgctt

SEQ ID NO: 2593699 - DNA, 15 bp, Homo sapiens
agaattttgagcagg

SEQ ID NO: 2593700 - DNA, 14 bp, Homo sapiens
agacaaatactcat

SEQ ID NO: 2593701 - DNA, 17 bp, Homo sapiens
agacaaatactcatgtg

SEQ ID NO: 2593702 - DNA, 15 bp, Homo sapiens
agacaacagaagtca

SEQ ID NO: 2593703 - DNA, 20 bp, Homo sapiens
agacaaccctgcaaaggact

SEQ ID NO: 2593704 - DNA, 14 bp, Homo sapiens
agacaagcaacagg

SEQ ID NO: 2593705 - DNA, 17 bp, Homo sapiens
agacaagcctggcctac

SEQ ID NO: 2593706 - DNA, 22 bp, Homo sapiens
agacaatgacttactgtacatg

SEQ ID NO: 2593707 - DNA, 13 bp, Homo sapiens
agacaattcttta

SEQ ID NO: 2593708 - DNA, 17 bp, Homo sapiens
agacacacgcacacaca

SEQ ID NO: 2593709 - DNA, 11 bp, Homo sapiens
agccacatccc

SEQ ID NO: 2593710 - DNA, 19 bp, Homo sapiens
agccaccaacatactccca

SEQ ID NO: 2593711 - DNA, 20 bp, Homo sapiens
agccaccaacatactcccat

SEQ ID NO: 2593712 - DNA, 16 bp, Homo sapiens
agccaccaactcttgc

SEQ ID NO: 2593713 - DNA, 21 bp, Homo sapiens
agccaccccgggctctctgct

SEQ ID NO: 2593714 - DNA, 16 bp, Homo sapiens
agccacctctccctca

SEQ ID NO: 2593715 - DNA, 18 bp, Homo sapiens
agccacctctctttttca

SEQ ID NO: 2593716 - DNA, 16 bp, Homo sapiens
agccacggccaggcca

SEQ ID NO: 2593717 - DNA, 14 bp, Homo sapiens
agccactaactaga

SEQ ID NO: 2593718 - DNA, 22 bp, Homo sapiens
agccactcaggaggctgaggca

SEQ ID NO: 2593719 - DNA, 13 bp, Homo sapiens
agccactcctctg

SEQ ID NO: 2593720 - DNA, 13 bp, Homo sapiens
agccactgaagct

SEQ ID NO: 2593721 - DNA, 16 bp, Homo sapiens
agccactgaagctggg

SEQ ID NO: 2593722 - DNA, 19 bp, Homo sapiens
agccactgcaccgggccac

SEQ ID NO: 2593723 - DNA, 22 bp, Homo sapiens
agccacttaccttcaataaagt

SEQ ID NO: 2593724 - DNA, 23 bp, Homo sapiens
agccacttaccttcaataaagta

SEQ ID NO: 2593725 - DNA, 19 bp, Homo sapiens
agccagaaataaagttggt

SEQ ID NO: 2593726 - DNA, 12 bp, Homo sapiens
agccagaagctg

SEQ ID NO: 2593727 - DNA, 14 bp, Homo sapiens
agccagaagctgag

SEQ ID NO: 2593728 - DNA, 20 bp, Homo sapiens
agccagaagctgagcaccag

SEQ ID NO: 2593729 - DNA, 19 bp, Homo sapiens
agccagacctattcctcct

SEQ ID NO: 2593730 - DNA, 18 bp, Homo sapiens
agccagactctggtcttc

SEQ ID NO: 2593731 - DNA, 12 bp, Homo sapiens
agccagatcctc

SEQ ID NO: 2593732 - DNA, 14 bp, Homo sapiens
agccagatcctctt

SEQ ID NO: 2593733 - DNA, 23 bp, Homo sapiens
agccagcaatgatgtccagaaga

SEQ ID NO: 2593734 - DNA, 13 bp, Homo sapiens
agccagcagccag

SEQ ID NO: 2593735 - DNA, 20 bp, Homo sapiens
agccagcagccagctctcag

SEQ ID NO: 2593736 - DNA, 21 bp, Homo sapiens
agccagcgtcctcctctgtga

SEQ ID NO: 2593737 - DNA, 14 bp, Homo sapiens
agccagctctcagc

SEQ ID NO: 2593738 - DNA, 16 bp, Homo sapiens
agccagctgctcccca

SEQ ID NO: 2593739 - DNA, 13 bp, Homo sapiens
agccagctttccc

SEQ ID NO: 2593740 - DNA, 12 bp, Homo sapiens
agccaggccaca

SEQ ID NO: 2593741 - DNA, 21 bp, Homo sapiens
agccaggccacaagacccttg

SEQ ID NO: 2593742 - DNA, 22 bp, Homo sapiens
agccaggccacaagacccttgt

SEQ ID NO: 2593743 - DNA, 15 bp, Homo sapiens
agccaggcgggctca

SEQ ID NO: 2593744 - DNA, 17 bp, Homo sapiens
agccaggctctgtgctg

SEQ ID NO: 2593745 - DNA, 11 bp, Homo sapiens
agccagggcca

SEQ ID NO: 2593746 - DNA, 12 bp, Homo sapiens
agccagggctgc

SEQ ID NO: 2593747 - DNA, 12 bp, Homo sapiens
agccagggtctc

SEQ ID NO: 2593748 - DNA, 13 bp, Homo sapiens
agccaggtgcctt

SEQ ID NO: 2593749 - DNA, 17 bp, Homo sapiens
agccaggtgccttggag

SEQ ID NO: 2593750 - DNA, 13 bp, Homo sapiens
agccagtaaatgg

SEQ ID NO: 2593751 - DNA, 17 bp, Homo sapiens
agccagtgacctgagga

SEQ ID NO: 2593752 - DNA, 18 bp, Homo sapiens
agccagtgacctgaggaa

SEQ ID NO: 2593753 - DNA, 15 bp, Homo sapiens
agccagtgactccag

SEQ ID NO: 2593754 - DNA, 17 bp, Homo sapiens
agccagttcagtacctg

SEQ ID NO: 2593755 - DNA, 19 bp, Homo sapiens
agccagttcagtacctgga

SEQ ID NO: 2593756 - DNA, 22 bp, Homo sapiens
agccatcggtgaaactaacaga

SEQ ID NO: 2593757 - DNA, 14 bp, Homo sapiens
agccatctgcccag

SEQ ID NO: 2593758 - DNA, 16 bp, Homo sapiens
agccatctgcccaggg

SEQ ID NO: 2593759 - DNA, 18 bp, Homo sapiens
agccatctgcccaggggt

SEQ ID NO: 2593760 - DNA, 17 bp, Homo sapiens
agccatcttggtaaatt

SEQ ID NO: 2593761 - DNA, 19 bp, Homo sapiens
agccatgctgggaagacgc

SEQ ID NO: 2593762 - DNA, 18 bp, Homo sapiens
agccatggactctacact

SEQ ID NO: 2593763 - DNA, 15 bp, Homo sapiens
agccatgggaccaaa

SEQ ID NO: 2593764 - DNA, 22 bp, Homo sapiens
agccatgtagaagctgcatctt

SEQ ID NO: 2593765 - DNA, 18 bp, Homo sapiens
agccattaccatggagac

SEQ ID NO: 2593766 - DNA, 12 bp, Homo sapiens
agccattcctgg

SEQ ID NO: 2593767 - DNA, 21 bp, Homo sapiens
agccattggctatttaaaact

SEQ ID NO: 2593768 - DNA, 22 bp, Homo sapiens
agccattggctatttaaaactt

SEQ ID NO: 2593769 - DNA, 12 bp, Homo sapiens
agccattgtctt

SEQ ID NO: 2593770 - DNA, 17 bp, Homo sapiens
agccatttgttggggca

SEQ ID NO: 2593771 - DNA, 20 bp, Homo sapiens
agccattttggggggccccc

SEQ ID NO: 2593772 - DNA, 14 bp, Homo sapiens
agccattttgtgaa

SEQ ID NO: 2593773 - DNA, 23 bp, Homo sapiens
agcccaacagacaccatcttttg

SEQ ID NO: 2593774 - DNA, 16 bp, Homo sapiens
agcccaataaacctct

SEQ ID NO: 2593775 - DNA, 16 bp, Homo sapiens
agcccacaaagcctta

SEQ ID NO: 2593776 - DNA, 23 bp, Homo sapiens
agcccacacttgagaggatgaat

SEQ ID NO: 2593777 - DNA, 15 bp, Homo sapiens
agcccacccctcaac

SEQ ID NO: 2593778 - DNA, 16 bp, Homo sapiens
agcccaccctcctgtc

SEQ ID NO: 2593779 - DNA, 14 bp, Homo sapiens
agcccaccttggct

SEQ ID NO: 2593780 - DNA, 14 bp, Homo sapiens
agcccacgccccca

SEQ ID NO: 2593781 - DNA, 15 bp, Homo sapiens
agcccacttctgcca

SEQ ID NO: 2593782 - DNA, 12 bp, Homo sapiens
agcccagacaaa

SEQ ID NO: 2593783 - DNA, 15 bp, Homo sapiens
agcccagacacagaa

SEQ ID NO: 2593784 - DNA, 15 bp, Homo sapiens
agcccagaggtaaca

SEQ ID NO: 2593785 - DNA, 17 bp, Homo sapiens
agcccagaggtaacaga

SEQ ID NO: 2593786 - DNA, 21 bp, Homo sapiens
agcccagaggtaacagaacag

SEQ ID NO: 2593787 - DNA, 15 bp, Homo sapiens
agcccagcactgctt

SEQ ID NO: 2593788 - DNA, 21 bp, Homo sapiens
agcccagccattaccatggag

SEQ ID NO: 2593789 - DNA, 14 bp, Homo sapiens
agcccagctctgaa

SEQ ID NO: 2593790 - DNA, 14 bp, Homo sapiens
agcccaggaaaggc

SEQ ID NO: 2593791 - DNA, 19 bp, Homo sapiens
agcccaggaaaggctccag

SEQ ID NO: 2593792 - DNA, 22 bp, Homo sapiens
agcccaggaaaggctccaggag

SEQ ID NO: 2593793 - DNA, 24 bp, Homo sapiens
agcccaggaaaggctccaggagca

SEQ ID NO: 2593794 - DNA, 22 bp, Homo sapiens
agcccaggccggggtggagcat

SEQ ID NO: 2593795 - DNA, 18 bp, Homo sapiens
agcccagggagcggaaag

SEQ ID NO: 2593796 - DNA, 21 bp, Homo sapiens
agcccagggagcggaaagcag

SEQ ID NO: 2593797 - DNA, 17 bp, Homo sapiens
agcccagggttccccca

SEQ ID NO: 2593798 - DNA, 19 bp, Homo sapiens
agcctgagcgacagtgaga

SEQ ID NO: 2593799 - DNA, 11 bp, Homo sapiens
agcctgaggct

SEQ ID NO: 2593800 - DNA, 16 bp, Homo sapiens
agcctgagtctcctgt

SEQ ID NO: 2593801 - DNA, 18 bp, Homo sapiens
agcctgagtctcctgtgc

SEQ ID NO: 2593802 - DNA, 17 bp, Homo sapiens
agcctgcaaactcactg

SEQ ID NO: 2593803 - DNA, 18 bp, Homo sapiens
agcctgcagggtggtgct

SEQ ID NO: 2593804 - DNA, 15 bp, Homo sapiens
agcctgcaggtgctg

SEQ ID NO: 2593805 - DNA, 23 bp, Homo sapiens
agcctgcagttattaacactaac

SEQ ID NO: 2593806 - DNA, 14 bp, Homo sapiens
agcctgcctggcag

SEQ ID NO: 2593807 - DNA, 16 bp, Homo sapiens
agcctgctccagctgt

SEQ ID NO: 2593808 - DNA, 17 bp, Homo sapiens
agcctgctccagctgtt

SEQ ID NO: 2593809 - DNA, 19 bp, Homo sapiens
agcctgctccagctgttca

SEQ ID NO: 2593810 - DNA, 20 bp, Homo sapiens
agcctgctccttcccaggag

SEQ ID NO: 2593811 - DNA, 21 bp, Homo sapiens
agcctgctggtcacagcctcc

SEQ ID NO: 2593812 - DNA, 23 bp, Homo sapiens
agcctgctggtcacagcctcctc

SEQ ID NO: 2593813 - DNA, 19 bp, Homo sapiens
agcctggaacatcatcaag

SEQ ID NO: 2593814 - DNA, 14 bp, Homo sapiens
agcctggccaacat

SEQ ID NO: 2593815 - DNA, 13 bp, Homo sapiens
agcctggctccaa

SEQ ID NO: 2593816 - DNA, 15 bp, Homo sapiens
agcctgggcaacaga

SEQ ID NO: 2593817 - DNA, 14 bp, Homo sapiens
agcctgggcgacag

SEQ ID NO: 2593818 - DNA, 22 bp, Homo sapiens
agcctgggtgacagagcaagtg

SEQ ID NO: 2593819 - DNA, 14 bp, Homo sapiens
agcctggtgctgct

SEQ ID NO: 2593820 - DNA, 14 bp, Homo sapiens
agcctggtgggcct

SEQ ID NO: 2593821 - DNA, 18 bp, Homo sapiens
agcctggtgggcctcctc

SEQ ID NO: 2593822 - DNA, 11 bp, Homo sapiens
agcctgtcctg

SEQ ID NO: 2593823 - DNA, 15 bp, Homo sapiens
agcctgtctcttcca

SEQ ID NO: 2593824 - DNA, 16 bp, Homo sapiens
agcctgtctcttccat

SEQ ID NO: 2593825 - DNA, 21 bp, Homo sapiens
agcctgtgcctctgggactgg

SEQ ID NO: 2593826 - DNA, 17 bp, Homo sapiens
agcctgttcccctcact

SEQ ID NO: 2593827 - DNA, 22 bp, Homo sapiens
agcctgttggacccgctctgga

SEQ ID NO: 2593828 - DNA, 18 bp, Homo sapiens
agcctgttttgttggaag

SEQ ID NO: 2593829 - DNA, 18 bp, Homo sapiens
agccttaatcaggtcctc

SEQ ID NO: 2593830 - DNA, 14 bp, Homo sapiens
agccttatcaagtg

SEQ ID NO: 2593831 - DNA, 11 bp, Homo sapiens
agccttccagg

SEQ ID NO: 2593832 - DNA, 17 bp, Homo sapiens
agccttccaggggtggg

SEQ ID NO: 2593833 - DNA, 19 bp, Homo sapiens
agccttccccctcccaggg

SEQ ID NO: 2593834 - DNA, 23 bp, Homo sapiens
agccttctttgcttgcctctctg

SEQ ID NO: 2593835 - DNA, 22 bp, Homo sapiens
agccttgaccattctccacctg

SEQ ID NO: 2593836 - DNA, 16 bp, Homo sapiens
agccttggatgtatat

SEQ ID NO: 2593837 - DNA, 16 bp, Homo sapiens
agccttgtaattctaa

SEQ ID NO: 2593838 - DNA, 14 bp, Homo sapiens
agcctttccataag

SEQ ID NO: 2593839 - DNA, 23 bp, Homo sapiens
agcctttccataaggaatgtagc

SEQ ID NO: 2593840 - DNA, 21 bp, Homo sapiens
agcctttgaataaaaatgcac

SEQ ID NO: 2593841 - DNA, 15 bp, Homo sapiens
agcctttgcctcccc

SEQ ID NO: 2593842 - DNA, 20 bp, Homo sapiens
agcctttggatgaccagaac

SEQ ID NO: 2593843 - DNA, 16 bp, Homo sapiens
agcctttttctaggcc

SEQ ID NO: 2593844 - DNA, 16 bp, Homo sapiens
agcgaacttgacaatt

SEQ ID NO: 2593845 - DNA, 15 bp, Homo sapiens
agcgacaaagatgat

SEQ ID NO: 2593846 - DNA, 17 bp, Homo sapiens
agcgaccgccccctcct

SEQ ID NO: 2593847 - DNA, 16 bp, Homo sapiens
agcgagagtctgtctc

SEQ ID NO: 2593848 - DNA, 20 bp, Homo sapiens
agcgaggagatgctccttgg

SEQ ID NO: 2593849 - DNA, 23 bp, Homo sapiens
agcgattattatctaaagtgtgt

SEQ ID NO: 2593850 - DNA, 15 bp, Homo sapiens
agcgattcttctgct

SEQ ID NO: 2593851 - DNA, 14 bp, Homo sapiens
agcgcacctgcccc

SEQ ID NO: 2593852 - DNA, 21 bp, Homo sapiens
agcgccaagcaacctgggtcc

SEQ ID NO: 2593853 - DNA, 11 bp, Homo sapiens
agcgcccctcc

SEQ ID NO: 2593854 - DNA, 16 bp, Homo sapiens
agcgcccctccctagt

SEQ ID NO: 2593855 - DNA, 16 bp, Homo sapiens
agcgcccgctgggctg

SEQ ID NO: 2593856 - DNA, 21 bp, Homo sapiens
agcgccgtgagttctcagggc

SEQ ID NO: 2593857 - DNA, 22 bp, Homo sapiens
agcgccgtgagttctcagggct

SEQ ID NO: 2593858 - DNA, 22 bp, Homo sapiens
agcgctggccgggaccccgagc

SEQ ID NO: 2593859 - DNA, 14 bp, Homo sapiens
agcggaaagcagct

SEQ ID NO: 2593860 - DNA, 17 bp, Homo sapiens
agcggaaagcagctcaa

SEQ ID NO: 2593861 - DNA, 23 bp, Homo sapiens
agcggaaagcagctcaaaggcac

SEQ ID NO: 2593862 - DNA, 20 bp, Homo sapiens
agcggccccttgactctggg

SEQ ID NO: 2593863 - DNA, 23 bp, Homo sapiens
agcggccccttgactctggggac

SEQ ID NO: 2593864 - DNA, 13 bp, Homo sapiens
agcggctggcagc

SEQ ID NO: 2593865 - DNA, 14 bp, Homo sapiens
agcgggacctgtgg

SEQ ID NO: 2593866 - DNA, 16 bp, Homo sapiens
agcgggacctgtggct

SEQ ID NO: 2593867 - DNA, 13 bp, Homo sapiens
agcgggcgcctgt

SEQ ID NO: 2593868 - DNA, 17 bp, Homo sapiens
agcggggacagctcctt

SEQ ID NO: 2593869 - DNA, 21 bp, Homo sapiens
agcggggccccagggctaccc

SEQ ID NO: 2593870 - DNA, 16 bp, Homo sapiens
agcgggggccagggaa

SEQ ID NO: 2593871 - DNA, 14 bp, Homo sapiens
agcggtttggggag

SEQ ID NO: 2593872 - DNA, 18 bp, Homo sapiens
agcgtactcatcatcaac

SEQ ID NO: 2593873 - DNA, 16 bp, Homo sapiens
agcgtcccagtctctg

SEQ ID NO: 2593874 - DNA, 22 bp, Homo sapiens
agcgtgaaggccgagaagcaag

SEQ ID NO: 2593875 - DNA, 15 bp, Homo sapiens
agcgtgagccactgc

SEQ ID NO: 2593876 - DNA, 17 bp, Homo sapiens
agcgtgctttaaaaaat

SEQ ID NO: 2593877 - DNA, 21 bp, Homo sapiens
agcgtttgaggggctggcctt

SEQ ID NO: 2593878 - DNA, 20 bp, Homo sapiens
agctaaaatgattttatctg

SEQ ID NO: 2593879 - DNA, 21 bp, Homo sapiens
agctaaagaggctgaaagagg

SEQ ID NO: 2593880 - DNA, 18 bp, Homo sapiens
agctaacactggccccta

SEQ ID NO: 2593881 - DNA, 18 bp, Homo sapiens
agctaacattttaaataa

SEQ ID NO: 2593882 - DNA, 22 bp, Homo sapiens
agctaacattttaaataaaaga

SEQ ID NO: 2593883 - DNA, 23 bp, Homo sapiens
agctaacccccttctactgagcc

SEQ ID NO: 2593884 - DNA, 13 bp, Homo sapiens
agctaagaaataa

SEQ ID NO: 2593885 - DNA, 17 bp, Homo sapiens
agctaatctgtagggct

SEQ ID NO: 2593886 - DNA, 14 bp, Homo sapiens
agctacaggaagca

SEQ ID NO: 2593887 - DNA, 13 bp, Homo sapiens
agctacaggttac

SEQ ID NO: 2593888 - DNA, 20 bp, Homo sapiens
agctacaggttacaacagat

SEQ ID NO: 2593889 - DNA, 16 bp, Homo sapiens
agctactaatgatgtt

SEQ ID NO: 2593890 - DNA, 21 bp, Homo sapiens
agctactcaagaggctgaggc

SEQ ID NO: 2593891 - DNA, 22 bp, Homo sapiens
agctactcaagaggctgaggca

SEQ ID NO: 2593892 - DNA, 20 bp, Homo sapiens
agctactcagaagcctgagg

SEQ ID NO: 2593893 - DNA, 16 bp, Homo sapiens
agctactgatttttgt

SEQ ID NO: 2593894 - DNA, 15 bp, Homo sapiens
agctacttcctcctc

SEQ ID NO: 2593895 - DNA, 16 bp, Homo sapiens
agctacttcctcctcc

SEQ ID NO: 2593896 - DNA, 15 bp, Homo sapiens
agctacttgggccat

SEQ ID NO: 2593897 - DNA, 22 bp, Homo sapiens
agctacttgggccatagctcct

SEQ ID NO: 2593898 - DNA, 15 bp, Homo sapiens
agctagaaatatgat

SEQ ID NO: 2593899 - DNA, 12 bp, Homo sapiens
agctagaaatga

SEQ ID NO: 2593900 - DNA, 15 bp, Homo sapiens
agctagaaggccaca

SEQ ID NO: 2593901 - DNA, 22 bp, Homo sapiens
agctagaattccctctctctga

SEQ ID NO: 2593902 - DNA, 20 bp, Homo sapiens
agctagaggaaccaaccccc

SEQ ID NO: 2593903 - DNA, 14 bp, Homo sapiens
agctagctcccctc

SEQ ID NO: 2593904 - DNA, 15 bp, Homo sapiens
agctagctcccctcc

SEQ ID NO: 2593905 - DNA, 17 bp, Homo sapiens
agctagctcccctcctc

SEQ ID NO: 2593906 - DNA, 13 bp, Homo sapiens
agctaggaatgaa

SEQ ID NO: 2593907 - DNA, 14 bp, Homo sapiens
agctaggcctggcc

SEQ ID NO: 2593908 - DNA, 16 bp, Homo sapiens
agctaggcctggccag

SEQ ID NO: 2593909 - DNA, 19 bp, Homo sapiens
agctagtggcttcaaaata

SEQ ID NO: 2593910 - DNA, 12 bp, Homo sapiens
agctagttttct

SEQ ID NO: 2593911 - DNA, 19 bp, Homo sapiens
agctatagacccgaggaaa

SEQ ID NO: 2593912 - DNA, 15 bp, Homo sapiens
agctatatccatgta

SEQ ID NO: 2593913 - DNA, 17 bp, Homo sapiens
agctatatctatatata

SEQ ID NO: 2593914 - DNA, 17 bp, Homo sapiens
agctatcaagtgtgctt

SEQ ID NO: 2593915 - DNA, 23 bp, Homo sapiens
agctatcaagtgtgctttagctt

SEQ ID NO: 2593916 - DNA, 17 bp, Homo sapiens
agctatctctcagtgaa

SEQ ID NO: 2593917 - DNA, 20 bp, Homo sapiens
agctatgttatattgaaaaa

SEQ ID NO: 2593918 - DNA, 20 bp, Homo sapiens
agctattactgtctggtttt

SEQ ID NO: 2593919 - DNA, 20 bp, Homo sapiens
agctattagccaggatcatg

SEQ ID NO: 2593920 - DNA, 23 bp, Homo sapiens
agctattgatataaataaaacat

SEQ ID NO: 2593921 - DNA, 13 bp, Homo sapiens
agctatttcatct

SEQ ID NO: 2593922 - DNA, 22 bp, Homo sapiens
agctcaaagcgtggacaggtgt

SEQ ID NO: 2593923 - DNA, 20 bp, Homo sapiens
agctcaagcaggaagttcaa

SEQ ID NO: 2593924 - DNA, 23 bp, Homo sapiens
agctcaagtcttccctgatcaag

SEQ ID NO: 2593925 - DNA, 16 bp, Homo sapiens
agctcacacatgagat

SEQ ID NO: 2593926 - DNA, 13 bp, Homo sapiens
agctcaccagccc

SEQ ID NO: 2593927 - DNA, 14 bp, Homo sapiens
agctcaccagcccc

SEQ ID NO: 2593928 - DNA, 16 bp, Homo sapiens
agctcaccagccccag

SEQ ID NO: 2593929 - DNA, 20 bp, Homo sapiens
agctcaccagccccagtgcc

SEQ ID NO: 2593930 - DNA, 22 bp, Homo sapiens
agctcaccagccccagtgccca

SEQ ID NO: 2593931 - DNA, 14 bp, Homo sapiens
agctcaccccccac

SEQ ID NO: 2593932 - DNA, 13 bp, Homo sapiens
agctcacccctgg

SEQ ID NO: 2593933 - DNA, 16 bp, Homo sapiens
agctcacctgttgctt

SEQ ID NO: 2593934 - DNA, 19 bp, Homo sapiens
agctcacctgttgcttaca

SEQ ID NO: 2593935 - DNA, 22 bp, Homo sapiens
agctcacctgttgcttacaatt

SEQ ID NO: 2593936 - DNA, 23 bp, Homo sapiens
agctcacctgttgcttacaattt

SEQ ID NO: 2593937 - DNA, 16 bp, Homo sapiens
agctcacgtcacactt

SEQ ID NO: 2593938 - DNA, 13 bp, Homo sapiens
agctcacttctgg

SEQ ID NO: 2593939 - DNA, 16 bp, Homo sapiens
agctcagagagggcag

SEQ ID NO: 2593940 - DNA, 18 bp, Homo sapiens
agctcagagagggtggga

SEQ ID NO: 2593941 - DNA, 16 bp, Homo sapiens
agctcagcatttccac

SEQ ID NO: 2593942 - DNA, 14 bp, Homo sapiens
agctcagcccaccc

SEQ ID NO: 2593943 - DNA, 20 bp, Homo sapiens
agctcagctttttgtctttt

SEQ ID NO: 2593944 - DNA, 15 bp, Homo sapiens
agctcagggcctggc

SEQ ID NO: 2593945 - DNA, 16 bp, Homo sapiens
agctcaggtgggcgtg

SEQ ID NO: 2593946 - DNA, 23 bp, Homo sapiens
agctcagttctagtctctctggg

SEQ ID NO: 2593947 - DNA, 18 bp, Homo sapiens
agctcatattttgtatat

SEQ ID NO: 2593948 - DNA, 14 bp, Homo sapiens
agctcatctctgtc

SEQ ID NO: 2593949 - DNA, 19 bp, Homo sapiens
cctgtctgtctctccatct

SEQ ID NO: 2593950 - DNA, 14 bp, Homo sapiens
cctgtcttcccagg

SEQ ID NO: 2593951 - DNA, 15 bp, Homo sapiens
cctgtcttcctgcat

SEQ ID NO: 2593952 - DNA, 22 bp, Homo sapiens
cctgtctttgggagaaaacgtc

SEQ ID NO: 2593953 - DNA, 22 bp, Homo sapiens
cctgtgaaagactcaatgagct

SEQ ID NO: 2593954 - DNA, 17 bp, Homo sapiens
cctgtgaccagcactgt

SEQ ID NO: 2593955 - DNA, 18 bp, Homo sapiens
cctgtgacttcagctctg

SEQ ID NO: 2593956 - DNA, 20 bp, Homo sapiens
cctgtgcagccgctgagcga

SEQ ID NO: 2593957 - DNA, 20 bp, Homo sapiens
cctgtgcctctgggactgga

SEQ ID NO: 2593958 - DNA, 15 bp, Homo sapiens
cctgtgcctgaccct

SEQ ID NO: 2593959 - DNA, 17 bp, Homo sapiens
cctgtgctccgtgcctc

SEQ ID NO: 2593960 - DNA, 18 bp, Homo sapiens
cctgtgctccgtgcctcc

SEQ ID NO: 2593961 - DNA, 19 bp, Homo sapiens
cctgtgctccgtgcctcca

SEQ ID NO: 2593962 - DNA, 12 bp, Homo sapiens
cctgtgctggtg

SEQ ID NO: 2593963 - DNA, 15 bp, Homo sapiens
cctgtggagcccgca

SEQ ID NO: 2593964 - DNA, 17 bp, Homo sapiens
cctgtggagcccgcacc

SEQ ID NO: 2593965 - DNA, 18 bp, Homo sapiens
cctgtggcaggcagcgcc

SEQ ID NO: 2593966 - DNA, 20 bp, Homo sapiens
cctgtggccaagttcttagt

SEQ ID NO: 2593967 - DNA, 19 bp, Homo sapiens
cctgtggcctgtgtcccat

SEQ ID NO: 2593968 - DNA, 14 bp, Homo sapiens
cctgtgggagcctg

SEQ ID NO: 2593969 - DNA, 15 bp, Homo sapiens
cctgtgggagcctgc

SEQ ID NO: 2593970 - DNA, 22 bp, Homo sapiens
cctgtggggatctcaggggctg

SEQ ID NO: 2593971 - DNA, 11 bp, Homo sapiens
cctgtgtccca

SEQ ID NO: 2593972 - DNA, 13 bp, Homo sapiens
cctgtgtcccatg

SEQ ID NO: 2593973 - DNA, 21 bp, Homo sapiens
cctgtgtcttgcaatggcagc

SEQ ID NO: 2593974 - DNA, 21 bp, Homo sapiens
cctgtgtgtgaaaggaagctc

SEQ ID NO: 2593975 - DNA, 19 bp, Homo sapiens
cctgttacctactttgact

SEQ ID NO: 2593976 - DNA, 23 bp, Homo sapiens
cctgttacttgaaataccagtga

SEQ ID NO: 2593977 - DNA, 13 bp, Homo sapiens
cctgttcagctcc

SEQ ID NO: 2593978 - DNA, 19 bp, Homo sapiens
cctgttcagtgtcccgggc

SEQ ID NO: 2593979 - DNA, 11 bp, Homo sapiens
cctgttcagtt

SEQ ID NO: 2593980 - DNA, 19 bp, Homo sapiens
cctgttcagttacagaaag

SEQ ID NO: 2593981 - DNA, 20 bp, Homo sapiens
cctgttcagttacagaaagt

SEQ ID NO: 2593982 - DNA, 12 bp, Homo sapiens
cctgttcccatt

SEQ ID NO: 2593983 - DNA, 17 bp, Homo sapiens
cctgttcccctcactgg

SEQ ID NO: 2593984 - DNA, 23 bp, Homo sapiens
cctgttgacgaagtctcttttct

SEQ ID NO: 2593985 - DNA, 16 bp, Homo sapiens
cctgttgcttacaatt

SEQ ID NO: 2593986 - DNA, 14 bp, Homo sapiens
cctgtttaaatatt

SEQ ID NO: 2593987 - DNA, 19 bp, Homo sapiens
cctgttttatactgtactt

SEQ ID NO: 2593988 - DNA, 17 bp, Homo sapiens
cctgttttctgagcccg

SEQ ID NO: 2593989 - DNA, 16 bp, Homo sapiens
cctgtttttctgggtg

SEQ ID NO: 2593990 - DNA, 17 bp, Homo sapiens
cctgtttttctgggtgg

SEQ ID NO: 2593991 - DNA, 15 bp, Homo sapiens
ccttaaactgtgtgg

SEQ ID NO: 2593992 - DNA, 12 bp, Homo sapiens
ccttaaaggaag

SEQ ID NO: 2593993 - DNA, 23 bp, Homo sapiens
ccttaactggagccccatcagct

SEQ ID NO: 2593994 - DNA, 14 bp, Homo sapiens
ccttaagtaagcaa

SEQ ID NO: 2593995 - DNA, 22 bp, Homo sapiens
ccttacaagttagaaaacataa

SEQ ID NO: 2593996 - DNA, 17 bp, Homo sapiens
ccttaccaactttctgt

SEQ ID NO: 2593997 - DNA, 21 bp, Homo sapiens
ccttaccatgtgcctgatcca

SEQ ID NO: 2593998 - DNA, 16 bp, Homo sapiens
ccttaccccttagcct

SEQ ID NO: 2593999 - DNA, 19 bp, Homo sapiens
ccttaccctcatgttctta

SEQ ID NO: 2594000 - DNA, 14 bp, Homo sapiens
ccttacctttttat

SEQ ID NO: 2594001 - DNA, 17 bp, Homo sapiens
ccttagaagtcacacag

SEQ ID NO: 2594002 - DNA, 18 bp, Homo sapiens
ccttagaagtcacacagt

SEQ ID NO: 2594003 - DNA, 14 bp, Homo sapiens
ccttagacagtccc

SEQ ID NO: 2594004 - DNA, 16 bp, Homo sapiens
ccttagacagtccctg

SEQ ID NO: 2594005 - DNA, 16 bp, Homo sapiens
ccttagattagctctg

SEQ ID NO: 2594006 - DNA, 22 bp, Homo sapiens
ccttagcacaggggggccgccg

SEQ ID NO: 2594007 - DNA, 21 bp, Homo sapiens
ccttagcccccacccacttcc

SEQ ID NO: 2594008 - DNA, 22 bp, Homo sapiens
ccttagctggcattacagctgg

SEQ ID NO: 2594009 - DNA, 15 bp, Homo sapiens
ccttaggcagggaag

SEQ ID NO: 2594010 - DNA, 14 bp, Homo sapiens
ccttagtactgagt

SEQ ID NO: 2594011 - DNA, 14 bp, Homo sapiens
ccttagtctcagtt

SEQ ID NO: 2594012 - DNA, 16 bp, Homo sapiens
ccttagtggctttttt

SEQ ID NO: 2594013 - DNA, 20 bp, Homo sapiens
ccttagtgtttctgtgcatg

SEQ ID NO: 2594014 - DNA, 12 bp, Homo sapiens
ccttatcaagtg

SEQ ID NO: 2594015 - DNA, 13 bp, Homo sapiens
ccttatcaccagc

SEQ ID NO: 2594016 - DNA, 17 bp, Homo sapiens
ccttatccaggactctg

SEQ ID NO: 2594017 - DNA, 15 bp, Homo sapiens
ccttatcctctgatc

SEQ ID NO: 2594018 - DNA, 18 bp, Homo sapiens
ccttatcctctgatctcc

SEQ ID NO: 2594019 - DNA, 22 bp, Homo sapiens
ccttatctccaagaccagagat

SEQ ID NO: 2594020 - DNA, 20 bp, Homo sapiens
ccttatctgtgcgtgaaaca

SEQ ID NO: 2594021 - DNA, 21 bp, Homo sapiens
ccttatctgtgcgtgaaacac

SEQ ID NO: 2594022 - DNA, 13 bp, Homo sapiens
ccttcaagacctt

SEQ ID NO: 2594023 - DNA, 17 bp, Homo sapiens
ccttcaagttagctcag

SEQ ID NO: 2594024 - DNA, 16 bp, Homo sapiens
ccttcaataaagtatc

SEQ ID NO: 2594025 - DNA, 16 bp, Homo sapiens
ccttcaattcctgggc

SEQ ID NO: 2594026 - DNA, 12 bp, Homo sapiens
ccttcacagtgt

SEQ ID NO: 2594027 - DNA, 20 bp, Homo sapiens
ccttcacatcctgtgtttct

SEQ ID NO: 2594028 - DNA, 17 bp, Homo sapiens
ccttcaccccagtggcc

SEQ ID NO: 2594029 - DNA, 21 bp, Homo sapiens
ccttcacctttgtccccaccg

SEQ ID NO: 2594030 - DNA, 18 bp, Homo sapiens
ccttcagactttgcttcc

SEQ ID NO: 2594031 - DNA, 19 bp, Homo sapiens
cctctctcttctgctccac

SEQ ID NO: 2594032 - DNA, 16 bp, Homo sapiens
cctctctgctctgcgt

SEQ ID NO: 2594033 - DNA, 13 bp, Homo sapiens
cctctctggcctc

SEQ ID NO: 2594034 - DNA, 18 bp, Homo sapiens
cctctctggcctcccacc

SEQ ID NO: 2594035 - DNA, 10 bp, Homo sapiens
cctctctgtt

SEQ ID NO: 2594036 - DNA, 20 bp, Homo sapiens
cctctcttatagaatattta

SEQ ID NO: 2594037 - DNA, 11 bp, Homo sapiens
cctctcttgca

SEQ ID NO: 2594038 - DNA, 13 bp, Homo sapiens
cctctcttgcacc

SEQ ID NO: 2594039 - DNA, 18 bp, Homo sapiens
cctctcttggtttccttc

SEQ ID NO: 2594040 - DNA, 19 bp, Homo sapiens
cctctcttggtttccttcc

SEQ ID NO: 2594041 - DNA, 13 bp, Homo sapiens
cctctgacacaca

SEQ ID NO: 2594042 - DNA, 19 bp, Homo sapiens
cctctgacacacagctctg

SEQ ID NO: 2594043 - DNA, 12 bp, Homo sapiens
cctctgactcag

SEQ ID NO: 2594044 - DNA, 17 bp, Homo sapiens
cctctgactcagggctc

SEQ ID NO: 2594045 - DNA, 21 bp, Homo sapiens
cctctgactcagggctcctgg

SEQ ID NO: 2594046 - DNA, 15 bp, Homo sapiens
cctctgatacccaga

SEQ ID NO: 2594047 - DNA, 20 bp, Homo sapiens
cctctgatacccagagcatt

SEQ ID NO: 2594048 - DNA, 15 bp, Homo sapiens
cctctgcactcccct

SEQ ID NO: 2594049 - DNA, 18 bp, Homo sapiens
cctctgcactcccctgct

SEQ ID NO: 2594050 - DNA, 21 bp, Homo sapiens
cctctgcactcccctgctggg

SEQ ID NO: 2594051 - DNA, 23 bp, Homo sapiens
cctctgcactcccctgctgggtg

SEQ ID NO: 2594052 - DNA, 18 bp, Homo sapiens
cctctgcagcaataaagc

SEQ ID NO: 2594053 - DNA, 19 bp, Homo sapiens
cctctgcagcaataaagca

SEQ ID NO: 2594054 - DNA, 13 bp, Homo sapiens
cctctgcagctga

SEQ ID NO: 2594055 - DNA, 15 bp, Homo sapiens
cctctgcagctgacc

SEQ ID NO: 2594056 - DNA, 19 bp, Homo sapiens
cctctgcagctgacctctg

SEQ ID NO: 2594057 - DNA, 17 bp, Homo sapiens
cctctgcagtgccttgg

SEQ ID NO: 2594058 - DNA, 11 bp, Homo sapiens
cctctgccaga

SEQ ID NO: 2594059 - DNA, 17 bp, Homo sapiens
cctctgcccagcttggg

SEQ ID NO: 2594060 - DNA, 20 bp, Homo sapiens
cctctgcctctgacacacag

SEQ ID NO: 2594061 - DNA, 19 bp, Homo sapiens
cctctgcctgaaccttcca

SEQ ID NO: 2594062 - DNA, 21 bp, Homo sapiens
cctctgcctgaagtcacacag

SEQ ID NO: 2594063 - DNA, 22 bp, Homo sapiens
cctgcagccccgcgcctccttc

SEQ ID NO: 2594064 - DNA, 13 bp, Homo sapiens
cctgcaggcagcc

SEQ ID NO: 2594065 - DNA, 17 bp, Homo sapiens
cctgcaggcagccaggc

SEQ ID NO: 2594066 - DNA, 18 bp, Homo sapiens
cctgcaggccaggccagc

SEQ ID NO: 2594067 - DNA, 19 bp, Homo sapiens
cctgcagggtggtgctggg

SEQ ID NO: 2594068 - DNA, 17 bp, Homo sapiens
cctgcaggtgctgctgc

SEQ ID NO: 2594069 - DNA, 20 bp, Homo sapiens
cctgcaggtgctgctgcgtg

SEQ ID NO: 2594070 - DNA, 15 bp, Homo sapiens
cctgcagtcacagct

SEQ ID NO: 2594071 - DNA, 18 bp, Homo sapiens
cctgcatccccttggctg

SEQ ID NO: 2594072 - DNA, 21 bp, Homo sapiens
cctgcatccccttggctgtga

SEQ ID NO: 2594073 - DNA, 12 bp, Homo sapiens
cctgcattcttt

SEQ ID NO: 2594074 - DNA, 16 bp, Homo sapiens
cctgcattctttctgt

SEQ ID NO: 2594075 - DNA, 18 bp, Homo sapiens
cctgcattctttctgtat

SEQ ID NO: 2594076 - DNA, 19 bp, Homo sapiens
cctgccaatggactaactt

SEQ ID NO: 2594077 - DNA, 22 bp, Homo sapiens
cctgccaccctggggagaaagt

SEQ ID NO: 2594078 - DNA, 13 bp, Homo sapiens
cctgccacctccc

SEQ ID NO: 2594079 - DNA, 14 bp, Homo sapiens
cctgccacctccct

SEQ ID NO: 2594080 - DNA, 16 bp, Homo sapiens
cctgccacctccctga

SEQ ID NO: 2594081 - DNA, 17 bp, Homo sapiens
cctgccactcacacagc

SEQ ID NO: 2594082 - DNA, 21 bp, Homo sapiens
cctgccactcacacagccagg

SEQ ID NO: 2594083 - DNA, 13 bp, Homo sapiens
cctgccagcctgg

SEQ ID NO: 2594084 - DNA, 16 bp, Homo sapiens
cctgccagcctggctt

SEQ ID NO: 2594085 - DNA, 21 bp, Homo sapiens
cctgccaggagctttggacct

SEQ ID NO: 2594086 - DNA, 16 bp, Homo sapiens
cctgccaggcatggtg

SEQ ID NO: 2594087 - DNA, 14 bp, Homo sapiens
cctgccagggacag

SEQ ID NO: 2594088 - DNA, 15 bp, Homo sapiens
cctgccagggacaga

SEQ ID NO: 2594089 - DNA, 16 bp, Homo sapiens
cctgccagggacagag

SEQ ID NO: 2594090 - DNA, 17 bp, Homo sapiens
cctgccagggagacaga

SEQ ID NO: 2594091 - DNA, 17 bp, Homo sapiens
cctgccagggcagggcc

SEQ ID NO: 2594092 - DNA, 20 bp, Homo sapiens
cctgccagtcctagctgcac

SEQ ID NO: 2594093 - DNA, 21 bp, Homo sapiens
cctgccagtcctagctgcaca

SEQ ID NO: 2594094 - DNA, 18 bp, Homo sapiens
cctgccatcatgtttaca

SEQ ID NO: 2594095 - DNA, 12 bp, Homo sapiens
cctgcccacccg

SEQ ID NO: 2594096 - DNA, 22 bp, Homo sapiens
cctgcccaggcccctgccaccc

SEQ ID NO: 2594097 - DNA, 23 bp, Homo sapiens
cctgcccatgtcgcgctcagcat

SEQ ID NO: 2594098 - DNA, 17 bp, Homo sapiens
cctgcccccacttcctg

SEQ ID NO: 2594099 - DNA, 22 bp, Homo sapiens
cctgcccccagaccttttatcc

SEQ ID NO: 2594100 - DNA, 17 bp, Homo sapiens
cctgccccccagcctct

SEQ ID NO: 2594101 - DNA, 13 bp, Homo sapiens
cctgccccctggt

SEQ ID NO: 2594102 - DNA, 16 bp, Homo sapiens
cctgccccgcccagct

SEQ ID NO: 2594103 - DNA, 15 bp, Homo sapiens
cctgcccctctcccg

SEQ ID NO: 2594104 - DNA, 17 bp, Homo sapiens
cctgcccctgagcccat

SEQ ID NO: 2594105 - DNA, 11 bp, Homo sapiens
cctgcccctgc

SEQ ID NO: 2594106 - DNA, 14 bp, Homo sapiens
cctgcccggctgcg

SEQ ID NO: 2594107 - DNA, 20 bp, Homo sapiens
cctgccctacagaggtctct

SEQ ID NO: 2594108 - DNA, 18 bp, Homo sapiens
cctgccctagagcacact

SEQ ID NO: 2594109 - DNA, 20 bp, Homo sapiens
cctgccctccccagagcact

SEQ ID NO: 2594110 - DNA, 17 bp, Homo sapiens
cctgccctcgtggccag

SEQ ID NO: 2594111 - DNA, 15 bp, Homo sapiens
cctgccctgcctgag

SEQ ID NO: 2594112 - DNA, 20 bp, Homo sapiens
cctgccctgctgccgcctcc

SEQ ID NO: 2594113 - DNA, 19 bp, Homo sapiens
cctgcccttgtcccactca

SEQ ID NO: 2594114 - DNA, 17 bp, Homo sapiens
cctgcctcccctgtgca

SEQ ID NO: 2594115 - DNA, 20 bp, Homo sapiens
cctgcctcctgcctgcccct

SEQ ID NO: 2594116 - DNA, 21 bp, Homo sapiens
cctgcctcctttgtgaggaag

SEQ ID NO: 2594117 - DNA, 21 bp, Homo sapiens
cctgcctcgaactggctgcaa

SEQ ID NO: 2594118 - DNA, 20 bp, Homo sapiens
cctgcctctcatcaactgaa

SEQ ID NO: 2594119 - DNA, 19 bp, Homo sapiens
cctgcctgagggcccctct

SEQ ID NO: 2594120 - DNA, 20 bp, Homo sapiens
cctgcctgagggcccctctg

SEQ ID NO: 2594121 - DNA, 21 bp, Homo sapiens
cctgcctgagggcccctctgc

SEQ ID NO: 2594122 - DNA, 17 bp, Homo sapiens
cctgcctggccccctgt

SEQ ID NO: 2594123 - DNA, 14 bp, Homo sapiens
cctgcctgtctcct

SEQ ID NO: 2594124 - DNA, 15 bp, Homo sapiens
cctgcctgtctcctt

SEQ ID NO: 2594125 - DNA, 16 bp, Homo sapiens
cctgccttcctcctgg

SEQ ID NO: 2594126 - DNA, 13 bp, Homo sapiens
cctgccttgaagc

SEQ ID NO: 2594127 - DNA, 19 bp, Homo sapiens
cctgccttgaagccactga

SEQ ID NO: 2594128 - DNA, 15 bp, Homo sapiens
cctgcgaaggggccc

SEQ ID NO: 2594129 - DNA, 17 bp, Homo sapiens
cctgcgaaggggccctg

SEQ ID NO: 2594130 - DNA, 18 bp, Homo sapiens
cctgcgattttgcctgtg

SEQ ID NO: 2594131 - DNA, 19 bp, Homo sapiens
cctgcgcccaccccgctct

SEQ ID NO: 2594132 - DNA, 18 bp, Homo sapiens
cctgcgcccagtccttcc

SEQ ID NO: 2594133 - DNA, 22 bp, Homo sapiens
cctgcgcccagtccttccacct

SEQ ID NO: 2594134 - DNA, 16 bp, Homo sapiens
cctgcggagtgaagag

SEQ ID NO: 2594135 - DNA, 18 bp, Homo sapiens
cctgcggagtgaagaggg

SEQ ID NO: 2594136 - DNA, 22 bp, Homo sapiens
cctgcggagtgaagaggggcag

SEQ ID NO: 2594137 - DNA, 23 bp, Homo sapiens
cctgcggagtgaagaggggcagc

SEQ ID NO: 2594138 - DNA, 13 bp, Homo sapiens
cctgcgtggggac

SEQ ID NO: 2594139 - DNA, 16 bp, Homo sapiens
cctgcgtggggacagg

SEQ ID NO: 2594140 - DNA, 17 bp, Homo sapiens
cctgctaattccccaga

SEQ ID NO: 2594141 - DNA, 21 bp, Homo sapiens
cctgctaattccccagattgc

SEQ ID NO: 2594142 - DNA, 20 bp, Homo sapiens
cctgctacaacttcagcagt

SEQ ID NO: 2594143 - DNA, 18 bp, Homo sapiens
cctgctagacacattttt

SEQ ID NO: 2594144 - DNA, 19 bp, Homo sapiens
cctgctccacagccatccc

SEQ ID NO: 2594145 - DNA, 12 bp, Homo sapiens
cctgctcccagg

SEQ ID NO: 2594146 - DNA, 15 bp, Homo sapiens
cctgctccctcccat

SEQ ID NO: 2594147 - DNA, 16 bp, Homo sapiens
cctgctcctccctggc

SEQ ID NO: 2594148 - DNA, 18 bp, Homo sapiens
cctgctcctccctggctg

SEQ ID NO: 2594149 - DNA, 20 bp, Homo sapiens
cctgctcctccctggctgcc

SEQ ID NO: 2594150 - DNA, 23 bp, Homo sapiens
cctgctctccaagtctcagtggc

SEQ ID NO: 2594151 - DNA, 21 bp, Homo sapiens
cctgctctccgaccagacacc

SEQ ID NO: 2594152 - DNA, 16 bp, Homo sapiens
cctgctctcctcttgc

SEQ ID NO: 2594153 - DNA, 21 bp, Homo sapiens
cctgctgagggaccagccaag

SEQ ID NO: 2594154 - DNA, 20 bp, Homo sapiens
cctgctgcagttgccagtca

SEQ ID NO: 2594155 - DNA, 22 bp, Homo sapiens
cctgctgccgcctcccagcctg

SEQ ID NO: 2594156 - DNA, 15 bp, Homo sapiens
cctgctgcctcccca

SEQ ID NO: 2594157 - DNA, 16 bp, Homo sapiens
cctgctgcctccccaa

SEQ ID NO: 2594158 - DNA, 21 bp, Homo sapiens
cctgctgcctccccaaccctg

SEQ ID NO: 2594159 - DNA, 13 bp, Homo sapiens
cctgctggcccct

SEQ ID NO: 2594160 - DNA, 14 bp, Homo sapiens
cctgctggcccctc

SEQ ID NO: 2594161 - DNA, 21 bp, Homo sapiens
cctgctggcccctcacctggg

SEQ ID NO: 2594162 - DNA, 13 bp, Homo sapiens
cctgctggccgcc

SEQ ID NO: 2594163 - DNA, 15 bp, Homo sapiens
cctgctggccgcctc

SEQ ID NO: 2594164 - DNA, 16 bp, Homo sapiens
cctgctggccgcctca

SEQ ID NO: 2594165 - DNA, 15 bp, Homo sapiens
cctgctgggtaaact

SEQ ID NO: 2594166 - DNA, 12 bp, Homo sapiens
cctgctgggtgt

SEQ ID NO: 2594167 - DNA, 14 bp, Homo sapiens
cctgctgggtgtgg

SEQ ID NO: 2594168 - DNA, 14 bp, Homo sapiens
cctgcttcaaatat

SEQ ID NO: 2594169 - DNA, 21 bp, Homo sapiens
cctgcttttcactgctgcaag

SEQ ID NO: 2594170 - DNA, 22 bp, Homo sapiens
cctggaaaggctcagtctcagg

SEQ ID NO: 2594171 - DNA, 23 bp, Homo sapiens
cctggaaaggctcagtctcagga

SEQ ID NO: 2594172 - DNA, 12 bp, Homo sapiens
cctggaagacag

SEQ ID NO: 2594173 - DNA, 17 bp, Homo sapiens
cctggaagccagctttc

SEQ ID NO: 2594174 - DNA, 12 bp, Homo sapiens
cctggaagggct

SEQ ID NO: 2594175 - DNA, 20 bp, Homo sapiens
cctggacatcctcttctgct

SEQ ID NO: 2594176 - DNA, 13 bp, Homo sapiens
cctggaccctgtg

SEQ ID NO: 2594177 - DNA, 14 bp, Homo sapiens
cctggaccctgtgg

SEQ ID NO: 2594178 - DNA, 23 bp, Homo sapiens
cctggacctgccctgggccacac

SEQ ID NO: 2594179 - DNA, 13 bp, Homo sapiens
cctggacctgcct

SEQ ID NO: 2594180 - DNA, 14 bp, Homo sapiens
cctggacctgcctc

SEQ ID NO: 2594181 - DNA, 16 bp, Homo sapiens
cctggacctgcctcct

SEQ ID NO: 2594182 - DNA, 15 bp, Homo sapiens
cctggactagaggga

SEQ ID NO: 2594183 - DNA, 11 bp, Homo sapiens
cctggagaagc

SEQ ID NO: 2594184 - DNA, 23 bp, Homo sapiens
cctggagagccagaacctggagg

SEQ ID NO: 2594185 - DNA, 21 bp, Homo sapiens
cctggagagctagaacctgga

SEQ ID NO: 2594186 - DNA, 23 bp, Homo sapiens
cctggagagttcaatggctgctg

SEQ ID NO: 2594187 - DNA, 18 bp, Homo sapiens
cctggagcagaccacccc

SEQ ID NO: 2594188 - DNA, 14 bp, Homo sapiens
cctggagcaggcct

SEQ ID NO: 2594189 - DNA, 18 bp, Homo sapiens
cctggagccaactgctgc

SEQ ID NO: 2594190 - DNA, 22 bp, Homo sapiens
cctggagccagactctggtctt

SEQ ID NO: 2594191 - DNA, 14 bp, Homo sapiens
cctggagcccctgg

SEQ ID NO: 2594192 - DNA, 18 bp, Homo sapiens
cctggaggacggccggct

SEQ ID NO: 2594193 - DNA, 15 bp, Homo sapiens
cctggaggaggagca

SEQ ID NO: 2594194 - DNA, 20 bp, Homo sapiens
cctggaggaggagcaggggc

SEQ ID NO: 2594195 - DNA, 16 bp, Homo sapiens
cctggaggatttcatc

SEQ ID NO: 2594196 - DNA, 20 bp, Homo sapiens
cctggaggtggggttgggat

SEQ ID NO: 2594197 - DNA, 14 bp, Homo sapiens
cctggagtgcagtt

SEQ ID NO: 2594198 - DNA, 21 bp, Homo sapiens
cctggatccatcaggccactt

SEQ ID NO: 2594199 - DNA, 18 bp, Homo sapiens
cctggatggggctgcacc

SEQ ID NO: 2594200 - DNA, 21 bp, Homo sapiens
cctggcaatagtgtgttctga

SEQ ID NO: 2594201 - DNA, 22 bp, Homo sapiens
cctggcacggtggctcaggcct

SEQ ID NO: 2594202 - DNA, 15 bp, Homo sapiens
cctggcactgctgtg

SEQ ID NO: 2594203 - DNA, 13 bp, Homo sapiens
cctggcagaactg

SEQ ID NO: 2594204 - DNA, 14 bp, Homo sapiens
cctggcagaactga

SEQ ID NO: 2594205 - DNA, 17 bp, Homo sapiens
cctggcaggatgaccct

SEQ ID NO: 2594206 - DNA, 21 bp, Homo sapiens
cctggcaggctgtctggccag

SEQ ID NO: 2594207 - DNA, 20 bp, Homo sapiens
cctggcaggttagaacctag

SEQ ID NO: 2594208 - DNA, 17 bp, Homo sapiens
cctggccaccacccccc

SEQ ID NO: 2594209 - DNA, 15 bp, Homo sapiens
cctggccagatgcac

SEQ ID NO: 2594210 - DNA, 14 bp, Homo sapiens
cctggccaggagct

SEQ ID NO: 2594211 - DNA, 14 bp, Homo sapiens
cctggcccactgca

SEQ ID NO: 2594212 - DNA, 18 bp, Homo sapiens
cctggccccatggtcagc

SEQ ID NO: 2594213 - DNA, 16 bp, Homo sapiens
cctggcccctcagggt

SEQ ID NO: 2594214 - DNA, 16 bp, Homo sapiens
ccccttccatcccaga

SEQ ID NO: 2594215 - DNA, 14 bp, Homo sapiens
ccccttccatgtgg

SEQ ID NO: 2594216 - DNA, 19 bp, Homo sapiens
ccccttccccactgcctgc

SEQ ID NO: 2594217 - DNA, 14 bp, Homo sapiens
ccccttccctgcaa

SEQ ID NO: 2594218 - DNA, 12 bp, Homo sapiens
ccccttcctgtc

SEQ ID NO: 2594219 - DNA, 22 bp, Homo sapiens
ccccttcctgtcccacctcttc

SEQ ID NO: 2594220 - DNA, 13 bp, Homo sapiens
ccccttctcccac

SEQ ID NO: 2594221 - DNA, 13 bp, Homo sapiens
ccccttctctgct

SEQ ID NO: 2594222 - DNA, 16 bp, Homo sapiens
ccccttctgacccatg

SEQ ID NO: 2594223 - DNA, 17 bp, Homo sapiens
ccccttctgacccatgc

SEQ ID NO: 2594224 - DNA, 20 bp, Homo sapiens
ccccttgccaccccaccctc

SEQ ID NO: 2594225 - DNA, 17 bp, Homo sapiens
ccccttgcccagggctc

SEQ ID NO: 2594226 - DNA, 21 bp, Homo sapiens
ccccttgcccttgccctgacc

SEQ ID NO: 2594227 - DNA, 23 bp, Homo sapiens
ccccttgcccttgccctgacctc

SEQ ID NO: 2594228 - DNA, 18 bp, Homo sapiens
ccccttgtcctttccctt

SEQ ID NO: 2594229 - DNA, 10 bp, Homo sapiens
cccctttcct

SEQ ID NO: 2594230 - DNA, 18 bp, Homo sapiens
cccctttgggcccaggga

SEQ ID NO: 2594231 - DNA, 12 bp, Homo sapiens
cccctttgtgct

SEQ ID NO: 2594232 - DNA, 14 bp, Homo sapiens
ccccttttctgcat

SEQ ID NO: 2594233 - DNA, 20 bp, Homo sapiens
ccccttttcttttctaccct

SEQ ID NO: 2594234 - DNA, 20 bp, Homo sapiens
cccgaatacaaacacctgga

SEQ ID NO: 2594235 - DNA, 14 bp, Homo sapiens
cccgaatagctggg

SEQ ID NO: 2594236 - DNA, 23 bp, Homo sapiens
ccctggttctgatgatgtgcctg

SEQ ID NO: 2594237 - DNA, 14 bp, Homo sapiens
ccctgtatggcact

SEQ ID NO: 2594238 - DNA, 21 bp, Homo sapiens
ccctgtccaaactgcctaagc

SEQ ID NO: 2594239 - DNA, 16 bp, Homo sapiens
ccctgtcccccagctc

SEQ ID NO: 2594240 - DNA, 17 bp, Homo sapiens
ccctgtcccccagctct

SEQ ID NO: 2594241 - DNA, 16 bp, Homo sapiens
ccctgtcgagacactt

SEQ ID NO: 2594242 - DNA, 23 bp, Homo sapiens
ccctgtctcaaaaaaagaaaaag

SEQ ID NO: 2594243 - DNA, 23 bp, Homo sapiens
ccctgtctctactaaaaatgcaa

SEQ ID NO: 2594244 - DNA, 13 bp, Homo sapiens
ccctgtcttgtcc

SEQ ID NO: 2594245 - DNA, 23 bp, Homo sapiens
ccctgtgagattttgcttttcca

SEQ ID NO: 2594246 - DNA, 23 bp, Homo sapiens
ccctgtgagtttgtacagtcttg

SEQ ID NO: 2594247 - DNA, 19 bp, Homo sapiens
ccctgtgatggggccctgc

SEQ ID NO: 2594248 - DNA, 20 bp, Homo sapiens
ccctgtgatggggccctgcc

SEQ ID NO: 2594249 - DNA, 23 bp, Homo sapiens
ccctgtgatggggccctgcctcc

SEQ ID NO: 2594250 - DNA, 13 bp, Homo sapiens
ccctgtgctggtg

SEQ ID NO: 2594251 - DNA, 14 bp, Homo sapiens
ccctgtgctggtgt

SEQ ID NO: 2594252 - DNA, 16 bp, Homo sapiens
ccctgtgctggtgtcc

SEQ ID NO: 2594253 - DNA, 20 bp, Homo sapiens
ccctgtgctggtgtcctgac

SEQ ID NO: 2594254 - DNA, 21 bp, Homo sapiens
ccctgtgctggtgtcctgacc

SEQ ID NO: 2594255 - DNA, 17 bp, Homo sapiens
ccctgtggagcccgcac

SEQ ID NO: 2594256 - DNA, 18 bp, Homo sapiens
ccctgtgggcccccaaat

SEQ ID NO: 2594257 - DNA, 14 bp, Homo sapiens
ccctgtttaatatt

SEQ ID NO: 2594258 - DNA, 16 bp, Homo sapiens
ccctgtttaatattta

SEQ ID NO: 2594259 - DNA, 17 bp, Homo sapiens
ccctgtttaatatttaa

SEQ ID NO: 2594260 - DNA, 15 bp, Homo sapiens
ccctgtttgtttctg

SEQ ID NO: 2594261 - DNA, 15 bp, Homo sapiens
ccctgttttctgagc

SEQ ID NO: 2594262 - DNA, 23 bp, Homo sapiens
ccctgttttctgagcccgggctg

SEQ ID NO: 2594263 - DNA, 20 bp, Homo sapiens
cccttaccatgtgcctgatc

SEQ ID NO: 2594264 - DNA, 13 bp, Homo sapiens
cccttaccttccc

SEQ ID NO: 2594265 - DNA, 13 bp, Homo sapiens
cccttatccagga

SEQ ID NO: 2594266 - DNA, 14 bp, Homo sapiens
cccttatccaggac

SEQ ID NO: 2594267 - DNA, 20 bp, Homo sapiens
cccttattacacggaaaacg

SEQ ID NO: 2594268 - DNA, 20 bp, Homo sapiens
cccttcagtaccctctcagc

SEQ ID NO: 2594269 - DNA, 14 bp, Homo sapiens
cccttccccatggg

SEQ ID NO: 2594270 - DNA, 15 bp, Homo sapiens
cccttccccatggga

SEQ ID NO: 2594271 - DNA, 15 bp, Homo sapiens
cccttcccctccctg

SEQ ID NO: 2594272 - DNA, 17 bp, Homo sapiens
cccttcccctccctggc

SEQ ID NO: 2594273 - DNA, 22 bp, Homo sapiens
cccttcccctccctggctccca

SEQ ID NO: 2594274 - DNA, 16 bp, Homo sapiens
cccttccctgtccctc

SEQ ID NO: 2594275 - DNA, 19 bp, Homo sapiens
cccttcccttgagccctct

SEQ ID NO: 2594276 - DNA, 20 bp, Homo sapiens
cccttcctacagatagtcaa

SEQ ID NO: 2594277 - DNA, 14 bp, Homo sapiens
cccttccttgctct

SEQ ID NO: 2594278 - DNA, 15 bp, Homo sapiens
cccttcgctcctgtg

SEQ ID NO: 2594279 - DNA, 16 bp, Homo sapiens
cccttcgctcctgtgt

SEQ ID NO: 2594280 - DNA, 10 bp, Homo sapiens
cccttctcca

SEQ ID NO: 2594281 - DNA, 18 bp, Homo sapiens
cccttctccatctctctg

SEQ ID NO: 2594282 - DNA, 23 bp, Homo sapiens
cccttctccatctctctggccct

SEQ ID NO: 2594283 - DNA, 15 bp, Homo sapiens
cccttctctgctcca

SEQ ID NO: 2594284 - DNA, 17 bp, Homo sapiens
cccttctctgctccacc

SEQ ID NO: 2594285 - DNA, 20 bp, Homo sapiens
cccttctctgctccaccaca

SEQ ID NO: 2594286 - DNA, 23 bp, Homo sapiens
cccttctgacccatgctgccctg

SEQ ID NO: 2594287 - DNA, 21 bp, Homo sapiens
cccttcttggtgcttacacat

SEQ ID NO: 2594288 - DNA, 14 bp, Homo sapiens
cccttctttcctct

SEQ ID NO: 2594289 - DNA, 15 bp, Homo sapiens
cccttgacaccgggg

SEQ ID NO: 2594290 - DNA, 23 bp, Homo sapiens
cccttgacgtcaagtctccttcc

SEQ ID NO: 2594291 - DNA, 22 bp, Homo sapiens
cccttgcccagggctcagcctg

SEQ ID NO: 2594292 - DNA, 23 bp, Homo sapiens
cccttgcccagggctcagcctgg

SEQ ID NO: 2594293 - DNA, 16 bp, Homo sapiens
cccttgccctgacctc

SEQ ID NO: 2594294 - DNA, 18 bp, Homo sapiens
cccttgcccttgccctga

SEQ ID NO: 2594295 - DNA, 18 bp, Homo sapiens
cccttgccgtctacctga

SEQ ID NO: 2594296 - DNA, 17 bp, Homo sapiens
cccttggattgtccccg

SEQ ID NO: 2594297 - DNA, 12 bp, Homo sapiens
cccttggcctca

SEQ ID NO: 2594298 - DNA, 14 bp, Homo sapiens
cccttggcctcaga

SEQ ID NO: 2594299 - DNA, 14 bp, Homo sapiens
cccttgtggtccca

SEQ ID NO: 2594300 - DNA, 13 bp, Homo sapiens
cccttgttctcta

SEQ ID NO: 2594301 - DNA, 14 bp, Homo sapiens
ccctttctggctct

SEQ ID NO: 2594302 - DNA, 17 bp, Homo sapiens
ccctttcttggccagtt

SEQ ID NO: 2594303 - DNA, 17 bp, Homo sapiens
ccctttgcccagaaaga

SEQ ID NO: 2594304 - DNA, 16 bp, Homo sapiens
ccctttgggaggctga

SEQ ID NO: 2594305 - DNA, 20 bp, Homo sapiens
ccctttgggaggctgaggcg

SEQ ID NO: 2594306 - DNA, 18 bp, Homo sapiens
cccttttcttttctaccc

SEQ ID NO: 2594307 - DNA, 21 bp, Homo sapiens
cccttttgcggatgggagggg

SEQ ID NO: 2594308 - DNA, 20 bp, Homo sapiens
cccttttggcccccgagctg

SEQ ID NO: 2594309 - DNA, 18 bp, Homo sapiens
ccctttttactccccttg

SEQ ID NO: 2594310 - DNA, 15 bp, Homo sapiens
ccctttttctccagc

SEQ ID NO: 2594311 - DNA, 15 bp, Homo sapiens
ccgaaaaatcctctt

SEQ ID NO: 2594312 - DNA, 16 bp, Homo sapiens
ccgaacctcctctgtg

SEQ ID NO: 2594313 - DNA, 16 bp, Homo sapiens
ccgaatcccctccctg

SEQ ID NO: 2594314 - DNA, 20 bp, Homo sapiens
ccgaatgtgcaggtttgtta

SEQ ID NO: 2594315 - DNA, 15 bp, Homo sapiens
ccgaccacctgccca

SEQ ID NO: 2594316 - DNA, 13 bp, Homo sapiens
ccgaccagacacc

SEQ ID NO: 2594317 - DNA, 16 bp, Homo sapiens
ccgacccttgccgtct

SEQ ID NO: 2594318 - DNA, 23 bp, Homo sapiens
ccgacggtgggcatttgtgaggc

SEQ ID NO: 2594319 - DNA, 16 bp, Homo sapiens
ccgacttgctgttttg

SEQ ID NO: 2594320 - DNA, 18 bp, Homo sapiens
ccgagatcacgccactgc

SEQ ID NO: 2594321 - DNA, 19 bp, Homo sapiens
ccgagattgcaccactgca

SEQ ID NO: 2594322 - DNA, 15 bp, Homo sapiens
ccgagcaaagatcaa

SEQ ID NO: 2594323 - DNA, 19 bp, Homo sapiens
ccgagccgggcctggggct

SEQ ID NO: 2594324 - DNA, 16 bp, Homo sapiens
ccgagcctggctccaa

SEQ ID NO: 2594325 - DNA, 11 bp, Homo sapiens
ccgagctgggg

SEQ ID NO: 2594326 - DNA, 18 bp, Homo sapiens
ccgagctgggggccatga

SEQ ID NO: 2594327 - DNA, 16 bp, Homo sapiens
ccgagctggtgcatta

SEQ ID NO: 2594328 - DNA, 14 bp, Homo sapiens
ccgaggaaactcag

SEQ ID NO: 2594329 - DNA, 17 bp, Homo sapiens
ccgaggacccagaccca

SEQ ID NO: 2594330 - DNA, 17 bp, Homo sapiens
ccgaggccttctctgaa

SEQ ID NO: 2594331 - DNA, 15 bp, Homo sapiens
ccgagggcgaccccg

SEQ ID NO: 2594332 - DNA, 13 bp, Homo sapiens
ccgaggggcggga

SEQ ID NO: 2594333 - DNA, 14 bp, Homo sapiens
ccgagtagctggga

SEQ ID NO: 2594334 - DNA, 16 bp, Homo sapiens
ccgagtgaacctacct

SEQ ID NO: 2594335 - DNA, 19 bp, Homo sapiens
ccgatgctccagccaaccc

SEQ ID NO: 2594336 - DNA, 13 bp, Homo sapiens
ccgatgctgcttt

SEQ ID NO: 2594337 - DNA, 17 bp, Homo sapiens
ccgatgctgctttcccc

SEQ ID NO: 2594338 - DNA, 22 bp, Homo sapiens
ccgcagaagcctccccagctca

SEQ ID NO: 2594339 - DNA, 17 bp, Homo sapiens
ccgcagctcttgccctt

SEQ ID NO: 2594340 - DNA, 20 bp, Homo sapiens
ccgcagctcttgcccttccc

SEQ ID NO: 2594341 - DNA, 22 bp, Homo sapiens
ccgcagctcttgcccttccctg

SEQ ID NO: 2594342 - DNA, 19 bp, Homo sapiens
ccgcagtcgtcgcacagtc

SEQ ID NO: 2594343 - DNA, 21 bp, Homo sapiens
ccgcagtcgtcgcacagtctc

SEQ ID NO: 2594344 - DNA, 17 bp, Homo sapiens
ccgccaaggctggggga

SEQ ID NO: 2594345 - DNA, 16 bp, Homo sapiens
ccgccatgctcctggc

SEQ ID NO: 2594346 - DNA, 23 bp, Homo sapiens
ccgcccacaggaagcctgcagtc

SEQ ID NO: 2594347 - DNA, 22 bp, Homo sapiens
ccgcccagctgcacctgccagc

SEQ ID NO: 2594348 - DNA, 17 bp, Homo sapiens
ccgccccctgccctccc

SEQ ID NO: 2594349 - DNA, 15 bp, Homo sapiens
ccgccctgctcctcc

SEQ ID NO: 2594350 - DNA, 18 bp, Homo sapiens
ccgccctgctcctccctg

SEQ ID NO: 2594351 - DNA, 21 bp, Homo sapiens
ccgccctgctcctccctggct

SEQ ID NO: 2594352 - DNA, 22 bp, Homo sapiens
ccgccctgctcctccctggctg

SEQ ID NO: 2594353 - DNA, 13 bp, Homo sapiens
ccgcctctcccgt

SEQ ID NO: 2594354 - DNA, 20 bp, Homo sapiens
ccgcctctcccgtcagggcc

SEQ ID NO: 2594355 - DNA, 14 bp, Homo sapiens
ccgcctgccagtcc

SEQ ID NO: 2594356 - DNA, 21 bp, Homo sapiens
ccgcctgccagtcctagctgc

SEQ ID NO: 2594357 - DNA, 12 bp, Homo sapiens
ccgcctggcaga

SEQ ID NO: 2594358 - DNA, 14 bp, Homo sapiens
ccgcctggtactca

SEQ ID NO: 2594359 - DNA, 22 bp, Homo sapiens
ccgcctggtactcaagcccgcg

SEQ ID NO: 2594360 - DNA, 19 bp, Homo sapiens
ccgcgtcgccctcccaggc

SEQ ID NO: 2594361 - DNA, 22 bp, Homo sapiens
ccgcgtgatcaaagccacactc

SEQ ID NO: 2594362 - DNA, 23 bp, Homo sapiens
ccgctaagagggagggagggctc

SEQ ID NO: 2594363 - DNA, 18 bp, Homo sapiens
ccgctagaggcctgagga

SEQ ID NO: 2594364 - DNA, 15 bp, Homo sapiens
ccgctccccagccca

SEQ ID NO: 2594365 - DNA, 17 bp, Homo sapiens
ccgctcctgtctgccag

SEQ ID NO: 2594366 - DNA, 20 bp, Homo sapiens
ccgctctgcatgcggcccag

SEQ ID NO: 2594367 - DNA, 22 bp, Homo sapiens
ccgctctgcatgcggcccagcc

SEQ ID NO: 2594368 - DNA, 13 bp, Homo sapiens
ccgctgagtggac

SEQ ID NO: 2594369 - DNA, 13 bp, Homo sapiens
ccgctgattctca

SEQ ID NO: 2594370 - DNA, 15 bp, Homo sapiens
ccgctgattctcagg

SEQ ID NO: 2594371 - DNA, 14 bp, Homo sapiens
ccgctgctgctgct

SEQ ID NO: 2594372 - DNA, 16 bp, Homo sapiens
ccgctgctgctgctgc

SEQ ID NO: 2594373 - DNA, 14 bp, Homo sapiens
ccgctgggctgagc

SEQ ID NO: 2594374 - DNA, 21 bp, Homo sapiens
ccgctgggctgagcccctacc

SEQ ID NO: 2594375 - DNA, 14 bp, Homo sapiens
ccgctggggccagt

SEQ ID NO: 2594376 - DNA, 20 bp, Homo sapiens
ccgctgtgagcccctggtcc

SEQ ID NO: 2594377 - DNA, 15 bp, Homo sapiens
ccgcttggagcagag

SEQ ID NO: 2594378 - DNA, 17 bp, Homo sapiens
ccgcttggagcagaggg

SEQ ID NO: 2594379 - DNA, 12 bp, Homo sapiens
ccgctttctacc

SEQ ID NO: 2594380 - DNA, 16 bp, Homo sapiens
ccggacactcctagag

SEQ ID NO: 2594381 - DNA, 18 bp, Homo sapiens
cctatataataaagctac

SEQ ID NO: 2594382 - DNA, 18 bp, Homo sapiens
cctatatgatttatagtt

SEQ ID NO: 2594383 - DNA, 15 bp, Homo sapiens
cctatatttacagtg

SEQ ID NO: 2594384 - DNA, 24 bp, Homo sapiens
cctatatttacagtgaaaatgtaa

SEQ ID NO: 2594385 - DNA, 21 bp, Homo sapiens
cctatcagcctgtctcttcca

SEQ ID NO: 2594386 - DNA, 18 bp, Homo sapiens
cctatctcgtgggagagc

SEQ ID NO: 2594387 - DNA, 12 bp, Homo sapiens
cctatctttgcc

SEQ ID NO: 2594388 - DNA, 18 bp, Homo sapiens
cctatcttttagttttag

SEQ ID NO: 2594389 - DNA, 22 bp, Homo sapiens
cctatgcaatatatctaaattg

SEQ ID NO: 2594390 - DNA, 14 bp, Homo sapiens
cctatgcacatatg

SEQ ID NO: 2594391 - DNA, 11 bp, Homo sapiens
cctatggatgt

SEQ ID NO: 2594392 - DNA, 21 bp, Homo sapiens
cctatggctggccactgcaca

SEQ ID NO: 2594393 - DNA, 20 bp, Homo sapiens
cctatgtcctaaggacacac

SEQ ID NO: 2594394 - DNA, 15 bp, Homo sapiens
ccataacagccaaca

SEQ ID NO: 2594395 - DNA, 21 bp, Homo sapiens
ccataagcctccatttagttc

SEQ ID NO: 2594396 - DNA, 19 bp, Homo sapiens
ccataatgtataaagaaca

SEQ ID NO: 2594397 - DNA, 21 bp, Homo sapiens
ccataattttcttcatgcaat

SEQ ID NO: 2594398 - DNA, 23 bp, Homo sapiens
ccataattttcttcatgcaatga

SEQ ID NO: 2594399 - DNA, 17 bp, Homo sapiens
ccatacttatctctctg

SEQ ID NO: 2594400 - DNA, 19 bp, Homo sapiens
ccatactttgtctgaaaaa

SEQ ID NO: 2594401 - DNA, 21 bp, Homo sapiens
ccatagcaagattgcttaaaa

SEQ ID NO: 2594402 - DNA, 15 bp, Homo sapiens
ccatagcttccatga

SEQ ID NO: 2594403 - DNA, 15 bp, Homo sapiens
ccatataagtttgaa

SEQ ID NO: 2594404 - DNA, 22 bp, Homo sapiens
ccatataagtttgaaggaaaca

SEQ ID NO: 2594405 - DNA, 18 bp, Homo sapiens
ccatatcccctctccccc

SEQ ID NO: 2594406 - DNA, 15 bp, Homo sapiens
ccatattctgttggc

SEQ ID NO: 2594407 - DNA, 12 bp, Homo sapiens
ccatatttattc

SEQ ID NO: 2594408 - DNA, 14 bp, Homo sapiens
ccatcaagccacca

SEQ ID NO: 2594409 - DNA, 12 bp, Homo sapiens
ccatcacccgct

SEQ ID NO: 2594410 - DNA, 19 bp, Homo sapiens
ccatcacgcggccgagaca

SEQ ID NO: 2594411 - DNA, 20 bp, Homo sapiens
ccatcagaaacaccctcaca

SEQ ID NO: 2594412 - DNA, 22 bp, Homo sapiens
ccatcagaaacaccctcacact

SEQ ID NO: 2594413 - DNA, 19 bp, Homo sapiens
ccatcagctgtaagaagag

SEQ ID NO: 2594414 - DNA, 24 bp, Homo sapiens
ccatcagctgtaagaagagactgg

SEQ ID NO: 2594415 - DNA, 16 bp, Homo sapiens
ccatcatcatgtgtgt

SEQ ID NO: 2594416 - DNA, 14 bp, Homo sapiens
ccatcatcccagct

SEQ ID NO: 2594417 - DNA, 16 bp, Homo sapiens
ccatcatgtctggcta

SEQ ID NO: 2594418 - DNA, 17 bp, Homo sapiens
ccatcattataaacgtg

SEQ ID NO: 2594419 - DNA, 16 bp, Homo sapiens
ccatccactctaccct

SEQ ID NO: 2594420 - DNA, 18 bp, Homo sapiens
ccatccaggttcagcttg

SEQ ID NO: 2594421 - DNA, 14 bp, Homo sapiens
ccatcccacaccct

SEQ ID NO: 2594422 - DNA, 14 bp, Homo sapiens
ccatccccctgccc

SEQ ID NO: 2594423 - DNA, 15 bp, Homo sapiens
ccatccccctgccct

SEQ ID NO: 2594424 - DNA, 17 bp, Homo sapiens
ccatcccgacatggacc

SEQ ID NO: 2594425 - DNA, 14 bp, Homo sapiens
ccatcccgtttaga

SEQ ID NO: 2594426 - DNA, 16 bp, Homo sapiens
ccatccctccccagtt

SEQ ID NO: 2594427 - DNA, 20 bp, Homo sapiens
ccatccctgaaggccccgcc

SEQ ID NO: 2594428 - DNA, 15 bp, Homo sapiens
ccatccgccagggcc

SEQ ID NO: 2594429 - DNA, 19 bp, Homo sapiens
ccatcctaccaatgcatgc

SEQ ID NO: 2594430 - DNA, 16 bp, Homo sapiens
ccatcctaccctcggg

SEQ ID NO: 2594431 - DNA, 18 bp, Homo sapiens
ccatcctcaaacactgca

SEQ ID NO: 2594432 - DNA, 13 bp, Homo sapiens
ccatcctccagct

SEQ ID NO: 2594433 - DNA, 20 bp, Homo sapiens
ccatctcacacatgagcatc

SEQ ID NO: 2594434 - DNA, 21 bp, Homo sapiens
ccatctcacacatgagcatca

SEQ ID NO: 2594435 - DNA, 17 bp, Homo sapiens
ccatctcaggccacctg

SEQ ID NO: 2594436 - DNA, 18 bp, Homo sapiens
ccatctcaggccacctgc

SEQ ID NO: 2594437 - DNA, 22 bp, Homo sapiens
ccatctcaggccacctgccccc

SEQ ID NO: 2594438 - DNA, 23 bp, Homo sapiens
ccatctcaggccacctgccccct

SEQ ID NO: 2594439 - DNA, 18 bp, Homo sapiens
ccatctccaagaatgctg

SEQ ID NO: 2594440 - DNA, 21 bp, Homo sapiens
ccatctccaagaatgctgaaa

SEQ ID NO: 2594441 - DNA, 18 bp, Homo sapiens
ccatctcctttcagggaa

SEQ ID NO: 2594442 - DNA, 23 bp, Homo sapiens
ccatctctccctcccctgccatt

SEQ ID NO: 2594443 - DNA, 18 bp, Homo sapiens
ccatctctgattttcaaa

SEQ ID NO: 2594444 - DNA, 12 bp, Homo sapiens
ccatctctggat

SEQ ID NO: 2594445 - DNA, 15 bp, Homo sapiens
ccatctctggatgcc

SEQ ID NO: 2594446 - DNA, 19 bp, Homo sapiens
ccatctgcacccccctggg

SEQ ID NO: 2594447 - DNA, 16 bp, Homo sapiens
ccatctgggagtcccc

SEQ ID NO: 2594448 - DNA, 22 bp, Homo sapiens
ccatctgggagtccccttttct

SEQ ID NO: 2594449 - DNA, 17 bp, Homo sapiens
ccatctgggtccttgca

SEQ ID NO: 2594450 - DNA, 23 bp, Homo sapiens
ccatctgggtccttgcacccctc

SEQ ID NO: 2594451 - DNA, 14 bp, Homo sapiens
ccatctgtgaataa

SEQ ID NO: 2594452 - DNA, 13 bp, Homo sapiens
ccatcttggtaaa

SEQ ID NO: 2594453 - DNA, 22 bp, Homo sapiens
ccatgaaaatgcaacaacatgt

SEQ ID NO: 2594454 - DNA, 15 bp, Homo sapiens
ccatgaaccaagacc

SEQ ID NO: 2594455 - DNA, 12 bp, Homo sapiens
ccatgaagacag

SEQ ID NO: 2594456 - DNA, 13 bp, Homo sapiens
ccatgaagacagg

SEQ ID NO: 2594457 - DNA, 14 bp, Homo sapiens
ccatgaagacagga

SEQ ID NO: 2594458 - DNA, 16 bp, Homo sapiens
ccatgaagacaggaca

SEQ ID NO: 2594459 - DNA, 15 bp, Homo sapiens
ccatgaagacaggat

SEQ ID NO: 2594460 - DNA, 18 bp, Homo sapiens
ccatgaagagatttttca

SEQ ID NO: 2594461 - DNA, 19 bp, Homo sapiens
ccatgaatcgcttctcttt

SEQ ID NO: 2594462 - DNA, 16 bp, Homo sapiens
ccatgacccacccctg

SEQ ID NO: 2594463 - DNA, 18 bp, Homo sapiens
ccatgacccacccctgtg

SEQ ID NO: 2594464 - DNA, 19 bp, Homo sapiens
ccatgacccacccctgtgc

SEQ ID NO: 2594465 - DNA, 14 bp, Homo sapiens
ccatgacccaggct

SEQ ID NO: 2594466 - DNA, 15 bp, Homo sapiens
ccatgacccaggctg

SEQ ID NO: 2594467 - DNA, 16 bp, Homo sapiens
ccatgacccaggctgg

SEQ ID NO: 2594468 - DNA, 13 bp, Homo sapiens
ccatgagaagagg

SEQ ID NO: 2594469 - DNA, 13 bp, Homo sapiens
ccatgagcctcag

SEQ ID NO: 2594470 - DNA, 14 bp, Homo sapiens
ccatgagcctcagc

SEQ ID NO: 2594471 - DNA, 16 bp, Homo sapiens
ccatgagctccagacc

SEQ ID NO: 2594472 - DNA, 23 bp, Homo sapiens
ccatgagctccagacccccagca

SEQ ID NO: 2594473 - DNA, 19 bp, Homo sapiens
cattctctgtctcatccat

SEQ ID NO: 2594474 - DNA, 22 bp, Homo sapiens
cattctgccaggcccccaagcc

SEQ ID NO: 2594475 - DNA, 18 bp, Homo sapiens
cattctgcctgcccaggc

SEQ ID NO: 2594476 - DNA, 19 bp, Homo sapiens
cattctgcctgcccaggcc

SEQ ID NO: 2594477 - DNA, 20 bp, Homo sapiens
cattctgctttcatcttggt

SEQ ID NO: 2594478 - DNA, 16 bp, Homo sapiens
cattctggaagtgact

SEQ ID NO: 2594479 - DNA, 21 bp, Homo sapiens
cattgaattcttggttgagga

SEQ ID NO: 2594480 - DNA, 23 bp, Homo sapiens
cattgaattcttggttgaggaaa

SEQ ID NO: 2594481 - DNA, 15 bp, Homo sapiens
cattgacctgaggcc

SEQ ID NO: 2594482 - DNA, 18 bp, Homo sapiens
cattgagaactgcatatg

SEQ ID NO: 2594483 - DNA, 19 bp, Homo sapiens
cattgagaactgcatatgt

SEQ ID NO: 2594484 - DNA, 17 bp, Homo sapiens
cattgatatgaaaaata

SEQ ID NO: 2594485 - DNA, 18 bp, Homo sapiens
cattgatatgaaaaatat

SEQ ID NO: 2594486 - DNA, 22 bp, Homo sapiens
ccagagagcctggtgctgctgc

SEQ ID NO: 2594487 - DNA, 23 bp, Homo sapiens
ccagagagggactgacacccatg

SEQ ID NO: 2594488 - DNA, 14 bp, Homo sapiens
ccagagagggtggt

SEQ ID NO: 2594489 - DNA, 14 bp, Homo sapiens
ccagagagtcctct

SEQ ID NO: 2594490 - DNA, 18 bp, Homo sapiens
ccagagcagatgcagaga

SEQ ID NO: 2594491 - DNA, 12 bp, Homo sapiens
ccagagcaggag

SEQ ID NO: 2594492 - DNA, 15 bp, Homo sapiens
ccagagcaggaggcc

SEQ ID NO: 2594493 - DNA, 23 bp, Homo sapiens
ccagagcaggaggcccctggccc

SEQ ID NO: 2594494 - DNA, 21 bp, Homo sapiens
ccagagcattacgtgagccag

SEQ ID NO: 2594495 - DNA, 18 bp, Homo sapiens
ccagagcatttccaacac

SEQ ID NO: 2594496 - DNA, 21 bp, Homo sapiens
ccagagcatttccaacaccac

SEQ ID NO: 2594497 - DNA, 13 bp, Homo sapiens
ccagagccatgga

SEQ ID NO: 2594498 - DNA, 14 bp, Homo sapiens
ccagagcccacctt

SEQ ID NO: 2594499 - DNA, 16 bp, Homo sapiens
ccagagcccaccttgg

SEQ ID NO: 2594500 - DNA, 14 bp, Homo sapiens
ccagagccccacac

SEQ ID NO: 2594501 - DNA, 18 bp, Homo sapiens
ccagagccccacacggag

SEQ ID NO: 2594502 - DNA, 20 bp, Homo sapiens
ccagagctacccgcagagtt

SEQ ID NO: 2594503 - DNA, 21 bp, Homo sapiens
ccagagctacccgcagagttc

SEQ ID NO: 2594504 - DNA, 19 bp, Homo sapiens
ccagagctgtttatggcct

SEQ ID NO: 2594505 - DNA, 22 bp, Homo sapiens
ccagagctgtttatggcctcag

SEQ ID NO: 2594506 - DNA, 19 bp, Homo sapiens
ccagaggaactgtccagag

SEQ ID NO: 2594507 - DNA, 20 bp, Homo sapiens
ccagaggaactgtccagaga

SEQ ID NO: 2594508 - DNA, 23 bp, Homo sapiens
ccagaggaactgtccagagagca

SEQ ID NO: 2594509 - DNA, 11 bp, Homo sapiens
ccagaggctcg

SEQ ID NO: 2594510 - DNA, 14 bp, Homo sapiens
ccagaggctgcaga

SEQ ID NO: 2594511 - DNA, 21 bp, Homo sapiens
ccagagggagtgacagaggca

SEQ ID NO: 2594512 - DNA, 18 bp, Homo sapiens
ccagagggcccaggcagg

SEQ ID NO: 2594513 - DNA, 16 bp, Homo sapiens
ccagagggcctgcaag

SEQ ID NO: 2594514 - DNA, 17 bp, Homo sapiens
ccagaggtaacagaaca

SEQ ID NO: 2594515 - DNA, 14 bp, Homo sapiens
ccagaggtgggcag

SEQ ID NO: 2594516 - DNA, 16 bp, Homo sapiens
ccagaggtgggcaggt

SEQ ID NO: 2594517 - DNA, 19 bp, Homo sapiens
ccagaggtgggcaggtggt

SEQ ID NO: 2594518 - DNA, 22 bp, Homo sapiens
ccagaggtgggcaggtggtggc

SEQ ID NO: 2594519 - DNA, 16 bp, Homo sapiens
ccagagtggcctggcc

SEQ ID NO: 2594520 - DNA, 19 bp, Homo sapiens
ccagagtggcctggccagg

SEQ ID NO: 2594521 - DNA, 23 bp, Homo sapiens
ccagagtggcctggccaggagct

SEQ ID NO: 2594522 - DNA, 21 bp, Homo sapiens
ccagagtggggatgacatgca

SEQ ID NO: 2594523 - DNA, 18 bp, Homo sapiens
ccagagttccccatgcag

SEQ ID NO: 2594524 - DNA, 19 bp, Homo sapiens
ccagagttccccatgcaga

SEQ ID NO: 2594525 - DNA, 17 bp, Homo sapiens
ccagagttcctgcggag

SEQ ID NO: 2594526 - DNA, 19 bp, Homo sapiens
ccagataaaattatagatg

SEQ ID NO: 2594527 - DNA, 14 bp, Homo sapiens
ccagataagaatgc

SEQ ID NO: 2594528 - DNA, 21 bp, Homo sapiens
ccagatacacccaaagtatca

SEQ ID NO: 2594529 - DNA, 21 bp, Homo sapiens
ccagatcaccagcccggcctg

SEQ ID NO: 2594530 - DNA, 15 bp, Homo sapiens
ccagatgcaccagcc

SEQ ID NO: 2594531 - DNA, 17 bp, Homo sapiens
ccagatgcaccagccct

SEQ ID NO: 2594532 - DNA, 16 bp, Homo sapiens
ccagatgggggaaagc

SEQ ID NO: 2594533 - DNA, 19 bp, Homo sapiens
ccagattctttcctgaggc

SEQ ID NO: 2594534 - DNA, 21 bp, Homo sapiens
ccagattctttcctgaggctg

SEQ ID NO: 2594535 - DNA, 22 bp, Homo sapiens
ccagattctttcctgaggctgg

SEQ ID NO: 2594536 - DNA, 23 bp, Homo sapiens
ccagattctttcctgaggctggg

SEQ ID NO: 2594537 - DNA, 18 bp, Homo sapiens
ccagattgcaacaggctg

SEQ ID NO: 2594538 - DNA, 19 bp, Homo sapiens
ccagattgcaacaggctgg

SEQ ID NO: 2594539 - DNA, 13 bp, Homo sapiens
ccagatttacact

SEQ ID NO: 2594540 - DNA, 15 bp, Homo sapiens
ccagcaacacaagct

SEQ ID NO: 2594541 - DNA, 21 bp, Homo sapiens
ccagcaacacaagctggaagc

SEQ ID NO: 2594542 - DNA, 15 bp, Homo sapiens
ccagcaactgaataa

SEQ ID NO: 2594543 - DNA, 17 bp, Homo sapiens
ccagcaactgaataaat

SEQ ID NO: 2594544 - DNA, 17 bp, Homo sapiens
ccagcaagtgagagctg

SEQ ID NO: 2594545 - DNA, 20 bp, Homo sapiens
ccagcaagtgagagctgggt

SEQ ID NO: 2594546 - DNA, 12 bp, Homo sapiens
ccagcaatgaca

SEQ ID NO: 2594547 - DNA, 23 bp, Homo sapiens
ccagcaatgacatctcaggggcc

SEQ ID NO: 2594548 - DNA, 17 bp, Homo sapiens
ccagcactaaagcagtg

SEQ ID NO: 2594549 - DNA, 12 bp, Homo sapiens
ccagcactaacg

SEQ ID NO: 2594550 - DNA, 12 bp, Homo sapiens
ccagcactgctt

SEQ ID NO: 2594551 - DNA, 22 bp, Homo sapiens
ccagcactgcttgaggaaaaca

SEQ ID NO: 2594552 - DNA, 16 bp, Homo sapiens
ccagcactttgggagg

SEQ ID NO: 2594553 - DNA, 19 bp, Homo sapiens
ccagcactttgggaggcca

SEQ ID NO: 2594554 - DNA, 19 bp, Homo sapiens
ccagcactttgggaggcct

SEQ ID NO: 2594555 - DNA, 12 bp, Homo sapiens
ccagcagaaatg

SEQ ID NO: 2594556 - DNA, 17 bp, Homo sapiens
ccagcagaaatgcctta

SEQ ID NO: 2594557 - DNA, 12 bp, Homo sapiens
ccagcagagcac

SEQ ID NO: 2594558 - DNA, 15 bp, Homo sapiens
ccagcagatcccagc

SEQ ID NO: 2594559 - DNA, 16 bp, Homo sapiens
ccagcagatcccagct

SEQ ID NO: 2594560 - DNA, 11 bp, Homo sapiens
ccagcagcctg

SEQ ID NO: 2594561 - DNA, 15 bp, Homo sapiens
ccagcaggtggggag

SEQ ID NO: 2594562 - DNA, 18 bp, Homo sapiens
ccagccaacccctgtgga

SEQ ID NO: 2594563 - DNA, 22 bp, Homo sapiens
ccagccactcgggaggctgaga

SEQ ID NO: 2594564 - DNA, 19 bp, Homo sapiens
ccagccagagttcctgcgg

SEQ ID NO: 2594565 - DNA, 13 bp, Homo sapiens
ccagccagatcct

SEQ ID NO: 2594566 - DNA, 18 bp, Homo sapiens
ccagccagatcctcttgg

SEQ ID NO: 2594567 - DNA, 19 bp, Homo sapiens
ccagccagcagccagctct

SEQ ID NO: 2594568 - DNA, 23 bp, Homo sapiens
ccagccagcagccagctctcagc

SEQ ID NO: 2594569 - DNA, 10 bp, Homo sapiens
ccagccaggc

SEQ ID NO: 2594570 - DNA, 17 bp, Homo sapiens
ccagccaggcgggctca

SEQ ID NO: 2594571 - DNA, 21 bp, Homo sapiens
ccagccaggcgggctcaagga

SEQ ID NO: 2594572 - DNA, 17 bp, Homo sapiens
ccagccaggctctgtgc

SEQ ID NO: 2594573 - DNA, 14 bp, Homo sapiens
ccagccagggctgc

SEQ ID NO: 2594574 - DNA, 20 bp, Homo sapiens
ccagccagtgacctgaggaa

SEQ ID NO: 2594575 - DNA, 14 bp, Homo sapiens
ccaggcaggctgtg

SEQ ID NO: 2594576 - DNA, 14 bp, Homo sapiens
ccaggcaggtcttg

SEQ ID NO: 2594577 - DNA, 23 bp, Homo sapiens
ccaggcaggtcttgaactcctgg

SEQ ID NO: 2594578 - DNA, 17 bp, Homo sapiens
ccaggcagtcgggggct

SEQ ID NO: 2594579 - DNA, 23 bp, Homo sapiens
ccaggcagtcgggggctggccta

SEQ ID NO: 2594580 - DNA, 24 bp, Homo sapiens
ccaggcattccccaggaggccagc

SEQ ID NO: 2594581 - DNA, 14 bp, Homo sapiens
ccaggccaccagga

SEQ ID NO: 2594582 - DNA, 16 bp, Homo sapiens
ccaggccacctccaga

SEQ ID NO: 2594583 - DNA, 12 bp, Homo sapiens
ccaggccagagg

SEQ ID NO: 2594584 - DNA, 14 bp, Homo sapiens
ccaggccagaggga

SEQ ID NO: 2594585 - DNA, 20 bp, Homo sapiens
ccaggccccaaaaccacagc

SEQ ID NO: 2594586 - DNA, 15 bp, Homo sapiens
ccaggccccaggaag

SEQ ID NO: 2594587 - DNA, 16 bp, Homo sapiens
ccaggccccaggaagc

SEQ ID NO: 2594588 - DNA, 23 bp, Homo sapiens
ccaggccccgaggacccagaccc

SEQ ID NO: 2594589 - DNA, 19 bp, Homo sapiens
ccaggcccctgccaccctg

SEQ ID NO: 2594590 - DNA, 13 bp, Homo sapiens
ccaggccctctgc

SEQ ID NO: 2594591 - DNA, 16 bp, Homo sapiens
ccaggccctctgccca

SEQ ID NO: 2594592 - DNA, 18 bp, Homo sapiens
ccaggccgagaagccagt

SEQ ID NO: 2594593 - DNA, 16 bp, Homo sapiens
ccaggccgcagctctt

SEQ ID NO: 2594594 - DNA, 19 bp, Homo sapiens
ccaggccgcagctcttgcc

SEQ ID NO: 2594595 - DNA, 21 bp, Homo sapiens
ccaggccgcagctcttgccct

SEQ ID NO: 2594596 - DNA, 15 bp, Homo sapiens
ccaggcctctgtgtc

SEQ ID NO: 2594597 - DNA, 17 bp, Homo sapiens
ccaggcctctgtgtcct

SEQ ID NO: 2594598 - DNA, 12 bp, Homo sapiens
ccaggcctgcct

SEQ ID NO: 2594599 - DNA, 18 bp, Homo sapiens
ccaggcctgggtctgtgt

SEQ ID NO: 2594600 - DNA, 22 bp, Homo sapiens
ccaggcgagagacttgtggcct

SEQ ID NO: 2594601 - DNA, 18 bp, Homo sapiens
ccaggcgcaggggctcac

SEQ ID NO: 2594602 - DNA, 17 bp, Homo sapiens
ccaggcgggctcaagga

SEQ ID NO: 2594603 - DNA, 18 bp, Homo sapiens
ccaggcgggctcaaggaa

SEQ ID NO: 2594604 - DNA, 13 bp, Homo sapiens
ccaggctctgtgc

SEQ ID NO: 2594605 - DNA, 15 bp, Homo sapiens
ccaggctctgtgctg

SEQ ID NO: 2594606 - DNA, 19 bp, Homo sapiens
ccaggctctgtgctgaccc

SEQ ID NO: 2594607 - DNA, 23 bp, Homo sapiens
ccaggctctttggggtcagccag

SEQ ID NO: 2594608 - DNA, 17 bp, Homo sapiens
ccaggctgctcagggct

SEQ ID NO: 2594609 - DNA, 23 bp, Homo sapiens
ccaggctggcgcagccaaggccg

SEQ ID NO: 2594610 - DNA, 12 bp, Homo sapiens
ccaggctggcgt

SEQ ID NO: 2594611 - DNA, 16 bp, Homo sapiens
ccaggctggcgtgcag

SEQ ID NO: 2594612 - DNA, 13 bp, Homo sapiens
ccaggctgggaga

SEQ ID NO: 2594613 - DNA, 15 bp, Homo sapiens
ccaggctgggagagc

SEQ ID NO: 2594614 - DNA, 17 bp, Homo sapiens
ccaggctgggagagcct

SEQ ID NO: 2594615 - DNA, 18 bp, Homo sapiens
ccaggctgggagagcctt

SEQ ID NO: 2594616 - DNA, 21 bp, Homo sapiens
ccaggctgggagagccttcca

SEQ ID NO: 2594617 - DNA, 14 bp, Homo sapiens
ccaggctggtctca

SEQ ID NO: 2594618 - DNA, 20 bp, Homo sapiens
ccaggctgtatcccatgagc

SEQ ID NO: 2594619 - DNA, 21 bp, Homo sapiens
ccaggctgtgggcctcaagga

SEQ ID NO: 2594620 - DNA, 21 bp, Homo sapiens
ccaggcttagtcactgagaca

SEQ ID NO: 2594621 - DNA, 22 bp, Homo sapiens
ccaggcttagtcactgagacag

SEQ ID NO: 2594622 - DNA, 16 bp, Homo sapiens
ccaggcttcaccctga

SEQ ID NO: 2594623 - DNA, 18 bp, Homo sapiens
ccaggcttgcctgcaggc

SEQ ID NO: 2594624 - DNA, 17 bp, Homo sapiens
ccagggaagtgctctga

SEQ ID NO: 2594625 - DNA, 15 bp, Homo sapiens
ccagggacaccagcc

SEQ ID NO: 2594626 - DNA, 17 bp, Homo sapiens
ccagggacaccagccag

SEQ ID NO: 2594627 - DNA, 20 bp, Homo sapiens
ccagggacaccagccaggct

SEQ ID NO: 2594628 - DNA, 18 bp, Homo sapiens
ccagggagcggaaagcag

SEQ ID NO: 2594629 - DNA, 13 bp, Homo sapiens
ccagggagtcccc

SEQ ID NO: 2594630 - DNA, 14 bp, Homo sapiens
ccagggccagggcc

SEQ ID NO: 2594631 - DNA, 18 bp, Homo sapiens
ccagggcctgagccaagc

SEQ ID NO: 2594632 - DNA, 19 bp, Homo sapiens
ccagggcctggaagacaga

SEQ ID NO: 2594633 - DNA, 21 bp, Homo sapiens
ccagggcctggaagacagaga

SEQ ID NO: 2594634 - DNA, 19 bp, Homo sapiens
ccagggctatgggagcagc

SEQ ID NO: 2594635 - DNA, 13 bp, Homo sapiens
ccagggctcagcc

SEQ ID NO: 2594636 - DNA, 20 bp, Homo sapiens
ccagggctgctagacggagg

SEQ ID NO: 2594637 - DNA, 20 bp, Homo sapiens
ccaggggaaaatcagcctgc

SEQ ID NO: 2594638 - DNA, 18 bp, Homo sapiens
ccaggggaccacacctcc

SEQ ID NO: 2594639 - DNA, 12 bp, Homo sapiens
ccaggggcccct

SEQ ID NO: 2594640 - DNA, 18 bp, Homo sapiens
ccaggggcccctccagct

SEQ ID NO: 2594641 - DNA, 17 bp, Homo sapiens
ccaggggtcccagccac

SEQ ID NO: 2594642 - DNA, 18 bp, Homo sapiens
ccaggggtcccagccacc

SEQ ID NO: 2594643 - DNA, 19 bp, Homo sapiens
ccaggggtgatttcagaga

SEQ ID NO: 2594644 - DNA, 19 bp, Homo sapiens
ccaggggtgccccctcctc

SEQ ID NO: 2594645 - DNA, 19 bp, Homo sapiens
ccaaacctccaaaactcct

SEQ ID NO: 2594646 - DNA, 12 bp, Homo sapiens
ccaaacctctgt

SEQ ID NO: 2594647 - DNA, 13 bp, Homo sapiens
ccaaacctctgtt

SEQ ID NO: 2594648 - DNA, 17 bp, Homo sapiens
ccaaacctctgttcagt

SEQ ID NO: 2594649 - DNA, 14 bp, Homo sapiens
ccaaactgcctaag

SEQ ID NO: 2594650 - DNA, 17 bp, Homo sapiens
ccaaagagactggagca

SEQ ID NO: 2594651 - DNA, 20 bp, Homo sapiens
ccaaagagactggagcatct

SEQ ID NO: 2594652 - DNA, 12 bp, Homo sapiens
ccaaagagcctg

SEQ ID NO: 2594653 - DNA, 15 bp, Homo sapiens
ccaaagagcctggag

SEQ ID NO: 2594654 - DNA, 20 bp, Homo sapiens
ccaaagagcctggagaagct

SEQ ID NO: 2594655 - DNA, 22 bp, Homo sapiens
ccaaagagcctggagaagctga

SEQ ID NO: 2594656 - DNA, 21 bp, Homo sapiens
ccaaagatatatacacaggat

SEQ ID NO: 2594657 - DNA, 20 bp, Homo sapiens
ccaaagccaataacacacag

SEQ ID NO: 2594658 - DNA, 22 bp, Homo sapiens
ccaaagccaccagactgacaaa

SEQ ID NO: 2594659 - DNA, 22 bp, Homo sapiens
ccaaagcctcctccagccgcca

SEQ ID NO: 2594660 - DNA, 16 bp, Homo sapiens
ccaaagctttcatgta

SEQ ID NO: 2594661 - DNA, 17 bp, Homo sapiens
ccaaaggactccaccca

SEQ ID NO: 2594662 - DNA, 12 bp, Homo sapiens
ccaaaggaggct

SEQ ID NO: 2594663 - DNA, 18 bp, Homo sapiens
ccaaaggaggctggcagg

SEQ ID NO: 2594664 - DNA, 23 bp, Homo sapiens
ccaaagggtgaagctatttatct

SEQ ID NO: 2594665 - DNA, 20 bp, Homo sapiens
ccaaagtacactgtttcaaa

SEQ ID NO: 2594666 - DNA, 22 bp, Homo sapiens
ccaaagtacactgtttcaaact

SEQ ID NO: 2594667 - DNA, 13 bp, Homo sapiens
ccaaagtattttt

SEQ ID NO: 2594668 - DNA, 16 bp, Homo sapiens
ccaaagtcttaaaata

SEQ ID NO: 2594669 - DNA, 22 bp, Homo sapiens
ccaaagtgctgggattacaggg

SEQ ID NO: 2594670 - DNA, 16 bp, Homo sapiens
ccaaataaaaactaaa

SEQ ID NO: 2594671 - DNA, 15 bp, Homo sapiens
ccaaatcaaaatatg

SEQ ID NO: 2594672 - DNA, 15 bp, Homo sapiens
ccaaatcccctaagc

SEQ ID NO: 2594673 - DNA, 13 bp, Homo sapiens
ccaaatcctctcc

SEQ ID NO: 2594674 - DNA, 22 bp, Homo sapiens
ccaaatgcatggtgcagttgac

SEQ ID NO: 2594675 - DNA, 23 bp, Homo sapiens
ccaaatggaaatgggcagagcag

SEQ ID NO: 2594676 - DNA, 18 bp, Homo sapiens
ccaaatgtaattgaataa

SEQ ID NO: 2594677 - DNA, 22 bp, Homo sapiens
ccaaatgtaattgaataaagtt

SEQ ID NO: 2594678 - DNA, 17 bp, Homo sapiens
ccaaatgttcatcaatg

SEQ ID NO: 2594679 - DNA, 18 bp, Homo sapiens
ccaaatgttcatcaatga

SEQ ID NO: 2594680 - DNA, 17 bp, Homo sapiens
ccaaattatttgtgtaa

SEQ ID NO: 2594681 - DNA, 18 bp, Homo sapiens
ccaaattatttgtgtaat

SEQ ID NO: 2594682 - DNA, 12 bp, Homo sapiens
ccaacaaagctg

SEQ ID NO: 2594683 - DNA, 21 bp, Homo sapiens
ccaacaaagggttttaatgta

SEQ ID NO: 2594684 - DNA, 22 bp, Homo sapiens
ccaacaaagggttttaatgtag

SEQ ID NO: 2594685 - DNA, 17 bp, Homo sapiens
ccaacaccacagacaca

SEQ ID NO: 2594686 - DNA, 14 bp, Homo sapiens
ccaacactgtgccc

SEQ ID NO: 2594687 - DNA, 18 bp, Homo sapiens
ccaacactgtgccctggt

SEQ ID NO: 2594688 - DNA, 15 bp, Homo sapiens
ccaacaggaggacaa

SEQ ID NO: 2594689 - DNA, 17 bp, Homo sapiens
ccaacaggaggacaatt

SEQ ID NO: 2594690 - DNA, 18 bp, Homo sapiens
ccaacaggaggacaattc

SEQ ID NO: 2594691 - DNA, 19 bp, Homo sapiens
ccaacaggaggacaattca

SEQ ID NO: 2594692 - DNA, 18 bp, Homo sapiens
ccaacaggtggcaggacc

SEQ ID NO: 2594693 - DNA, 12 bp, Homo sapiens
ccaacagtgagt

SEQ ID NO: 2594694 - DNA, 15 bp, Homo sapiens
ccaacagtgtgaagt

SEQ ID NO: 2594695 - DNA, 19 bp, Homo sapiens
ccaacagtgtgaagttaga

SEQ ID NO: 2594696 - DNA, 14 bp, Homo sapiens
ccaacatactccca

SEQ ID NO: 2594697 - DNA, 22 bp, Homo sapiens
ccaacatactcccatctgtgaa

SEQ ID NO: 2594698 - DNA, 14 bp, Homo sapiens
ccaaccccaactcc

SEQ ID NO: 2594699 - DNA, 16 bp, Homo sapiens
ccaacccccaccccac

SEQ ID NO: 2594700 - DNA, 20 bp, Homo sapiens
ccaacccccaccccacactt

SEQ ID NO: 2594701 - DNA, 15 bp, Homo sapiens
ccaacccctgtggag

SEQ ID NO: 2594702 - DNA, 15 bp, Homo sapiens
ccaacccgaggcccg

SEQ ID NO: 2594703 - DNA, 17 bp, Homo sapiens
ccaacccgaggcccgca

SEQ ID NO: 2594704 - DNA, 13 bp, Homo sapiens
ccaaccctcatca

SEQ ID NO: 2594705 - DNA, 14 bp, Homo sapiens
ccaaccctgtctgt

SEQ ID NO: 2594706 - DNA, 14 bp, Homo sapiens
ccaacccttcccca

SEQ ID NO: 2594707 - DNA, 14 bp, Homo sapiens
ccaacctcctgacc

SEQ ID NO: 2594708 - DNA, 12 bp, Homo sapiens
ccaacctgctga

SEQ ID NO: 2594709 - DNA, 22 bp, Homo sapiens
ccaacggagagcgcctgcccct

SEQ ID NO: 2594710 - DNA, 15 bp, Homo sapiens
ccaacgtctgtgcca

SEQ ID NO: 2594711 - DNA, 16 bp, Homo sapiens
ccaactagacattctg

SEQ ID NO: 2594712 - DNA, 12 bp, Homo sapiens
ccaactccagga

SEQ ID NO: 2594713 - DNA, 14 bp, Homo sapiens
ccaactgctgcttt

SEQ ID NO: 2594714 - DNA, 16 bp, Homo sapiens
ccaactgggcccaaga

SEQ ID NO: 2594715 - DNA, 11 bp, Homo sapiens
ccaacttgtaa

SEQ ID NO: 2594716 - DNA, 22 bp, Homo sapiens
ccaactttgtggatgtcttcct

SEQ ID NO: 2594717 - DNA, 13 bp, Homo sapiens
ccaagaagcccag

SEQ ID NO: 2594718 - DNA, 15 bp, Homo sapiens
ccaagaagcccagga

SEQ ID NO: 2594719 - DNA, 17 bp, Homo sapiens
ccaagaagtttaaggaa

SEQ ID NO: 2594720 - DNA, 12 bp, Homo sapiens
ccaagaatgctg

SEQ ID NO: 2594721 - DNA, 15 bp, Homo sapiens
ccaagaatgctgaaa

SEQ ID NO: 2594722 - DNA, 22 bp, Homo sapiens
ccaagacagatgccccagagct

SEQ ID NO: 2594723 - DNA, 23 bp, Homo sapiens
ccaagacagatgccccagagctg

SEQ ID NO: 2594724 - DNA, 18 bp, Homo sapiens
ccaagacttggcaacaga

SEQ ID NO: 2594725 - DNA, 20 bp, Homo sapiens
ccaagacttggcaacagaag

SEQ ID NO: 2594726 - DNA, 24 bp, Homo sapiens
ccaagagactccttgagagaccag

SEQ ID NO: 2594727 - DNA, 15 bp, Homo sapiens
ccaagagagaaagaa

SEQ ID NO: 2594728 - DNA, 14 bp, Homo sapiens
ccaagagatgaaga

SEQ ID NO: 2594729 - DNA, 16 bp, Homo sapiens
ccaagatcgcgccact

SEQ ID NO: 2594730 - DNA, 21 bp, Homo sapiens
ccaagattgcgccattgcact

SEQ ID NO: 2594731 - DNA, 17 bp, Homo sapiens
ccaagcaaaatcatgga

SEQ ID NO: 2594732 - DNA, 17 bp, Homo sapiens
ccaagcaacctgggtcc

SEQ ID NO: 2594733 - DNA, 23 bp, Homo sapiens
ccaagcacagtggtggcagggcc

SEQ ID NO: 2594734 - DNA, 12 bp, Homo sapiens
ccaagcagccaa

SEQ ID NO: 2594735 - DNA, 18 bp, Homo sapiens
ccaagcaggaaatgaaaa

SEQ ID NO: 2594736 - DNA, 17 bp, Homo sapiens
ccaagcaggaagctcag

SEQ ID NO: 2594737 - DNA, 22 bp, Homo sapiens
ccaagcccgacttgctgttttg

SEQ ID NO: 2594738 - DNA, 22 bp, Homo sapiens
ccaagctagaattccctctctc

SEQ ID NO: 2594739 - DNA, 17 bp, Homo sapiens
ccaagctcaaagcgtgg

SEQ ID NO: 2594740 - DNA, 19 bp, Homo sapiens
ccaagctcaggaccaggca

SEQ ID NO: 2594741 - DNA, 13 bp, Homo sapiens
ccaagctctgctc

SEQ ID NO: 2594742 - DNA, 14 bp, Homo sapiens
ccaagctctgctcc

SEQ ID NO: 2594743 - DNA, 17 bp, Homo sapiens
ccaagctctgctcctct

SEQ ID NO: 2594744 - DNA, 16 bp, Homo sapiens
ccaagctgggccccag

SEQ ID NO: 2594745 - DNA, 18 bp, Homo sapiens
ccaagctgggccccagcc

SEQ ID NO: 2594746 - DNA, 22 bp, Homo sapiens
ccaagctgggccccagcccacc

SEQ ID NO: 2594747 - DNA, 20 bp, Homo sapiens
ccaagctggtcccactcagt

SEQ ID NO: 2594748 - DNA, 18 bp, Homo sapiens
ccaagctgttttcttcta

SEQ ID NO: 2594749 - DNA, 17 bp, Homo sapiens
ccaagcttggcagccga

SEQ ID NO: 2594750 - DNA, 20 bp, Homo sapiens
ccaaggaaaccacagctgct

SEQ ID NO: 2594751 - DNA, 15 bp, Homo sapiens
ccaaggactgaggga

SEQ ID NO: 2594752 - DNA, 23 bp, Homo sapiens
ccaaggactgagggactctgaag

SEQ ID NO: 2594753 - DNA, 11 bp, Homo sapiens
ccaaggactgc

SEQ ID NO: 2594754 - DNA, 13 bp, Homo sapiens
ccaaggactgccg

SEQ ID NO: 2594755 - DNA, 15 bp, Homo sapiens
ccaaggactgccgac

SEQ ID NO: 2594756 - DNA, 20 bp, Homo sapiens
ccaaggagggtgagtgcaag

SEQ ID NO: 2594757 - DNA, 15 bp, Homo sapiens
ccaaggcaaggcagg

SEQ ID NO: 2594758 - DNA, 14 bp, Homo sapiens
ccaaggcggcccct

SEQ ID NO: 2594759 - DNA, 16 bp, Homo sapiens
ccaaggcggcccctcc

SEQ ID NO: 2594760 - DNA, 22 bp, Homo sapiens
ccaaggcttctccaattctgcc

SEQ ID NO: 2594761 - DNA, 18 bp, Homo sapiens
ccaagggcaaaattccca

SEQ ID NO: 2594762 - DNA, 24 bp, Homo sapiens
ccaagggcaaaattcccagggaag

SEQ ID NO: 2594763 - DNA, 22 bp, Homo sapiens
ccaagggcttctgcaccctcca

SEQ ID NO: 2594764 - DNA, 20 bp, Homo sapiens
ccacccccttctctgctcca

SEQ ID NO: 2594765 - DNA, 23 bp, Homo sapiens
ccacccccttctctgctccacca

SEQ ID NO: 2594766 - DNA, 15 bp, Homo sapiens
ccaccccgctctgca

SEQ ID NO: 2594767 - DNA, 17 bp, Homo sapiens
ccaccccgggctctctg

SEQ ID NO: 2594768 - DNA, 20 bp, Homo sapiens
ccaccccgtagattcccatc

SEQ ID NO: 2594769 - DNA, 16 bp, Homo sapiens
ccacccctccttcctt

SEQ ID NO: 2594770 - DNA, 14 bp, Homo sapiens
ccacccctgcctcc

SEQ ID NO: 2594771 - DNA, 15 bp, Homo sapiens
ccacccctgtgctcc

SEQ ID NO: 2594772 - DNA, 15 bp, Homo sapiens
ccaccccttccccac

SEQ ID NO: 2594773 - DNA, 16 bp, Homo sapiens
ccaccccttccccact

SEQ ID NO: 2594774 - DNA, 14 bp, Homo sapiens
ccaccccttcctgt

SEQ ID NO: 2594775 - DNA, 16 bp, Homo sapiens
ccacccgatgctgctt

SEQ ID NO: 2594776 - DNA, 15 bp, Homo sapiens
ccacccgtggagatg

SEQ ID NO: 2594777 - DNA, 19 bp, Homo sapiens
ccacccgttctgctggcct

SEQ ID NO: 2594778 - DNA, 12 bp, Homo sapiens
ccaccctacctg

SEQ ID NO: 2594779 - DNA, 22 bp, Homo sapiens
ccaccctacctgttcagtgtcc

SEQ ID NO: 2594780 - DNA, 17 bp, Homo sapiens
ccaccctcagcacccct

SEQ ID NO: 2594781 - DNA, 13 bp, Homo sapiens
ccaccctccctgg

SEQ ID NO: 2594782 - DNA, 15 bp, Homo sapiens
ccaccctccctggag

SEQ ID NO: 2594783 - DNA, 13 bp, Homo sapiens
ccaccctcctgtc

SEQ ID NO: 2594784 - DNA, 14 bp, Homo sapiens
ccaccctcctgtct

SEQ ID NO: 2594785 - DNA, 15 bp, Homo sapiens
ccaccctcctgtctt

SEQ ID NO: 2594786 - DNA, 19 bp, Homo sapiens
ccaccctcctgtcttccca

SEQ ID NO: 2594787 - DNA, 20 bp, Homo sapiens
ccaccctcctgtcttcccag

SEQ ID NO: 2594788 - DNA, 21 bp, Homo sapiens
ccaccctcctgtcttcccagg

SEQ ID NO: 2594789 - DNA, 23 bp, Homo sapiens
ccaccctcctgtcttcccagggt

SEQ ID NO: 2594790 - DNA, 20 bp, Homo sapiens
ccaccctctgagctttgcat

SEQ ID NO: 2594791 - DNA, 11 bp, Homo sapiens
ccaccctggaa

SEQ ID NO: 2594792 - DNA, 14 bp, Homo sapiens
ccacccttcccctc

SEQ ID NO: 2594793 - DNA, 17 bp, Homo sapiens
ccacccttggcctgtct

SEQ ID NO: 2594794 - DNA, 13 bp, Homo sapiens
ccaccgcagacag

SEQ ID NO: 2594795 - DNA, 14 bp, Homo sapiens
ccaccgctccccag

SEQ ID NO: 2594796 - DNA, 14 bp, Homo sapiens
ccaccgtccgccct

SEQ ID NO: 2594797 - DNA, 19 bp, Homo sapiens
ccaccgtccgccctgctcc

SEQ ID NO: 2594798 - DNA, 17 bp, Homo sapiens
ccacctaatcaggctga

SEQ ID NO: 2594799 - DNA, 21 bp, Homo sapiens
ccacctagactgtaaacctct

SEQ ID NO: 2594800 - DNA, 20 bp, Homo sapiens
ccacctatctcgtgggagag

SEQ ID NO: 2594801 - DNA, 15 bp, Homo sapiens
ccacctcactcctgt

SEQ ID NO: 2594802 - DNA, 16 bp, Homo sapiens
ccacctcactcctgtt

SEQ ID NO: 2594803 - DNA, 18 bp, Homo sapiens
ccacctcactcctgttac

SEQ ID NO: 2594804 - DNA, 12 bp, Homo sapiens
ccacctcagcct

SEQ ID NO: 2594805 - DNA, 17 bp, Homo sapiens
ccacctcccacaaagga

SEQ ID NO: 2594806 - DNA, 22 bp, Homo sapiens
cattgatatgaaaaatatgata

SEQ ID NO: 2594807 - DNA, 17 bp, Homo sapiens
cattgattgtcagctac

SEQ ID NO: 2594808 - DNA, 16 bp, Homo sapiens
cattgcatataactta

SEQ ID NO: 2594809 - DNA, 15 bp, Homo sapiens
cattgccaccaggag

SEQ ID NO: 2594810 - DNA, 17 bp, Homo sapiens
cattgccaccaggagaa

SEQ ID NO: 2594811 - DNA, 20 bp, Homo sapiens
cattgccaccaggagaacca

SEQ ID NO: 2594812 - DNA, 20 bp, Homo sapiens
cattgccattccctgcctgg

SEQ ID NO: 2594813 - DNA, 17 bp, Homo sapiens
cattgcccccagggcac

SEQ ID NO: 2594814 - DNA, 21 bp, Homo sapiens
cattgcgctctagcctgggca

SEQ ID NO: 2594815 - DNA, 15 bp, Homo sapiens
cattgcggacagcca

SEQ ID NO: 2594816 - DNA, 16 bp, Homo sapiens
cattgctgaaaatggt

SEQ ID NO: 2594817 - DNA, 17 bp, Homo sapiens
cattgcttacacggatg

SEQ ID NO: 2594818 - DNA, 17 bp, Homo sapiens
cattgctttactgtcaa

SEQ ID NO: 2594819 - DNA, 17 bp, Homo sapiens
cattggaagaccccacc

SEQ ID NO: 2594820 - DNA, 17 bp, Homo sapiens
cattggacccttccatg

SEQ ID NO: 2594821 - DNA, 18 bp, Homo sapiens
cattgggtgggtaaattc

SEQ ID NO: 2594822 - DNA, 23 bp, Homo sapiens
cattgggttgtagccaaaggttc

SEQ ID NO: 2594823 - DNA, 14 bp, Homo sapiens
cattggttcttgta

SEQ ID NO: 2594824 - DNA, 15 bp, Homo sapiens
cattggttcttgtat

SEQ ID NO: 2594825 - DNA, 21 bp, Homo sapiens
cattgtaaatgtgcttttaaa

SEQ ID NO: 2594826 - DNA, 21 bp, Homo sapiens
cattgtaatgttactgatcat

SEQ ID NO: 2594827 - DNA, 15 bp, Homo sapiens
cattgtagagcttct

SEQ ID NO: 2594828 - DNA, 16 bp, Homo sapiens
cattgtataaaaatag

SEQ ID NO: 2594829 - DNA, 17 bp, Homo sapiens
cattgtatatatgtgtg

SEQ ID NO: 2594830 - DNA, 22 bp, Homo sapiens
cattgtatatatgtgtgtttaa

SEQ ID NO: 2594831 - DNA, 17 bp, Homo sapiens
cattgtatcgatgttat

SEQ ID NO: 2594832 - DNA, 16 bp, Homo sapiens
cattgtatgatgtgtt

SEQ ID NO: 2594833 - DNA, 19 bp, Homo sapiens
cattgtggctgtcagcagg

SEQ ID NO: 2594834 - DNA, 16 bp, Homo sapiens
cattgttgaggtggtc

SEQ ID NO: 2594835 - DNA, 17 bp, Homo sapiens
cattgttggccaaagcc

SEQ ID NO: 2594836 - DNA, 17 bp, Homo sapiens
cattgtttattaacaaa

SEQ ID NO: 2594837 - DNA, 18 bp, Homo sapiens
cattgtttgaaacaaaga

SEQ ID NO: 2594838 - DNA, 19 bp, Homo sapiens
cattgtttgaaacaaagaa

SEQ ID NO: 2594839 - DNA, 17 bp, Homo sapiens
cattgtttgcttattgt

SEQ ID NO: 2594840 - DNA, 19 bp, Homo sapiens
cattgtttgcttattgttc

SEQ ID NO: 2594841 - DNA, 20 bp, Homo sapiens
cattgtttgcttattgttcc

SEQ ID NO: 2594842 - DNA, 17 bp, Homo sapiens
cattgtttggagacatt

SEQ ID NO: 2594843 - DNA, 17 bp, Homo sapiens
cattgttttaaaaagaa

SEQ ID NO: 2594844 - DNA, 12 bp, Homo sapiens
catttaaaaaaa

SEQ ID NO: 2594845 - DNA, 18 bp, Homo sapiens
catttaaaacagacactg

SEQ ID NO: 2594846 - DNA, 23 bp, Homo sapiens
catttaaaacagacactggcatg

SEQ ID NO: 2594847 - DNA, 12 bp, Homo sapiens
catttaaaagat

SEQ ID NO: 2594848 - DNA, 12 bp, Homo sapiens
catttaaaatga

SEQ ID NO: 2594849 - DNA, 13 bp, Homo sapiens
catttaaaatgat

SEQ ID NO: 2594850 - DNA, 16 bp, Homo sapiens
catttaaaatgattag

SEQ ID NO: 2594851 - DNA, 18 bp, Homo sapiens
catttaaatacagtcttc

SEQ ID NO: 2594852 - DNA, 18 bp, Homo sapiens
catttaaatttttttcct

SEQ ID NO: 2594853 - DNA, 17 bp, Homo sapiens
catttaagagacagtca

SEQ ID NO: 2594854 - DNA, 20 bp, Homo sapiens
catttaatgtagccatggga

SEQ ID NO: 2594855 - DNA, 21 bp, Homo sapiens
catttaatgtagccatgggac

SEQ ID NO: 2594856 - DNA, 22 bp, Homo sapiens
catttaatgtagccatgggacc

SEQ ID NO: 2594857 - DNA, 12 bp, Homo sapiens
catttacatgta

SEQ ID NO: 2594858 - DNA, 13 bp, Homo sapiens
catttactgtggc

SEQ ID NO: 2594859 - DNA, 14 bp, Homo sapiens
catttactgtggct

SEQ ID NO: 2594860 - DNA, 17 bp, Homo sapiens
catttagtttgattatt

SEQ ID NO: 2594861 - DNA, 20 bp, Homo sapiens
catttatgatttaataaaat

SEQ ID NO: 2594862 - DNA, 21 bp, Homo sapiens
catttatgatttaataaaata

SEQ ID NO: 2594863 - DNA, 23 bp, Homo sapiens
catttatgatttaataaaataat

SEQ ID NO: 2594864 - DNA, 18 bp, Homo sapiens
catttatttttctcatga

SEQ ID NO: 2594865 - DNA, 17 bp, Homo sapiens
catttattttttacatt

SEQ ID NO: 2594866 - DNA, 15 bp, Homo sapiens
catttcaggagcagc

SEQ ID NO: 2594867 - DNA, 16 bp, Homo sapiens
catttcaggagcagcc

SEQ ID NO: 2594868 - DNA, 16 bp, Homo sapiens
catttcattgtatgat

SEQ ID NO: 2594869 - DNA, 20 bp, Homo sapiens
catttcattgtatgatgtgt

SEQ ID NO: 2594870 - DNA, 17 bp, Homo sapiens
catttccaaatgaatga

SEQ ID NO: 2594871 - DNA, 17 bp, Homo sapiens
catttccaaattcacaa

SEQ ID NO: 2594872 - DNA, 13 bp, Homo sapiens
catttccaacacc

SEQ ID NO: 2594873 - DNA, 20 bp, Homo sapiens
catttccaacaccacagaca

SEQ ID NO: 2594874 - DNA, 21 bp, Homo sapiens
catttccaacaccacagacac

SEQ ID NO: 2594875 - DNA, 13 bp, Homo sapiens
catttcctgtgtc

SEQ ID NO: 2594876 - DNA, 16 bp, Homo sapiens
catttccttcaaggca

SEQ ID NO: 2594877 - DNA, 20 bp, Homo sapiens
catttctactcttaagtttc

SEQ ID NO: 2594878 - DNA, 21 bp, Homo sapiens
catttctactcttaagtttct

SEQ ID NO: 2594879 - DNA, 23 bp, Homo sapiens
catttctactcttaagtttctca

SEQ ID NO: 2594880 - DNA, 16 bp, Homo sapiens
catttctctggggtat

SEQ ID NO: 2594881 - DNA, 18 bp, Homo sapiens
catttctcttactgcaaa

SEQ ID NO: 2594882 - DNA, 14 bp, Homo sapiens
catttcttgggccc

SEQ ID NO: 2594883 - DNA, 11 bp, Homo sapiens
catttgaaaga

SEQ ID NO: 2594884 - DNA, 22 bp, Homo sapiens
catttgagaaatgcatattgta

SEQ ID NO: 2594885 - DNA, 14 bp, Homo sapiens
catttgagcagggc

SEQ ID NO: 2594886 - DNA, 18 bp, Homo sapiens
catttgagcagggctcag

SEQ ID NO: 2594887 - DNA, 17 bp, Homo sapiens
catttgaggtctgttct

SEQ ID NO: 2594888 - DNA, 14 bp, Homo sapiens
catttgatgctaaa

SEQ ID NO: 2594889 - DNA, 15 bp, Homo sapiens
catttgcctattccc

SEQ ID NO: 2594890 - DNA, 17 bp, Homo sapiens
catttgcctattcccac

SEQ ID NO: 2594891 - DNA, 20 bp, Homo sapiens
catttgctaactagcttgga

SEQ ID NO: 2594892 - DNA, 15 bp, Homo sapiens
catttggattggatg

SEQ ID NO: 2594893 - DNA, 20 bp, Homo sapiens
catttggcaatgccatcatc

SEQ ID NO: 2594894 - DNA, 20 bp, Homo sapiens
catttggtcaagattttgaa

SEQ ID NO: 2594895 - DNA, 21 bp, Homo sapiens
catttggtggtttcagaaatg

SEQ ID NO: 2594896 - DNA, 22 bp, Homo sapiens
catttggtggtttcagaaatgt

SEQ ID NO: 2594897 - DNA, 17 bp, Homo sapiens
catttgtcacacacttt

SEQ ID NO: 2594898 - DNA, 14 bp, Homo sapiens
catttgtgaaatga

SEQ ID NO: 2594899 - DNA, 12 bp, Homo sapiens
catttgtgaggc

SEQ ID NO: 2594900 - DNA, 15 bp, Homo sapiens
catttgtgtcaatgg

SEQ ID NO: 2594901 - DNA, 13 bp, Homo sapiens
catttgtgtgtgt

SEQ ID NO: 2594902 - DNA, 16 bp, Homo sapiens
catttgttggaatgaa

SEQ ID NO: 2594903 - DNA, 17 bp, Homo sapiens
cattttaattattattc

SEQ ID NO: 2594904 - DNA, 20 bp, Homo sapiens
cattttacccacacacagat

SEQ ID NO: 2594905 - DNA, 15 bp, Homo sapiens
cattttatattagaa

SEQ ID NO: 2594906 - DNA, 13 bp, Homo sapiens
cattttattgctt

SEQ ID NO: 2594907 - DNA, 14 bp, Homo sapiens
cattttattgcttg

SEQ ID NO: 2594908 - DNA, 16 bp, Homo sapiens
cattttcaccccaccc

SEQ ID NO: 2594909 - DNA, 12 bp, Homo sapiens
cattttcccaga

SEQ ID NO: 2594910 - DNA, 15 bp, Homo sapiens
cattttccccccact

SEQ ID NO: 2594911 - DNA, 12 bp, Homo sapiens
cattttgcaaaa

SEQ ID NO: 2594912 - DNA, 14 bp, Homo sapiens
cattttgcaaaatt

SEQ ID NO: 2594913 - DNA, 15 bp, Homo sapiens
cattttgcaaaattt

SEQ ID NO: 2594914 - DNA, 17 bp, Homo sapiens
cattttgcaaaatttcc

SEQ ID NO: 2594915 - DNA, 20 bp, Homo sapiens
cattttgcagcagtgagtct

SEQ ID NO: 2594916 - DNA, 15 bp, Homo sapiens
cattttgcattcaaa

SEQ ID NO: 2594917 - DNA, 13 bp, Homo sapiens
cattttgccaaaa

SEQ ID NO: 2594918 - DNA, 15 bp, Homo sapiens
cattttgccaaaatt

SEQ ID NO: 2594919 - DNA, 15 bp, Homo sapiens
cattttgctattgta

SEQ ID NO: 2594920 - DNA, 20 bp, Homo sapiens
cattttggaagttttcagga

SEQ ID NO: 2594921 - DNA, 22 bp, Homo sapiens
cattttggaagttttcaggact

SEQ ID NO: 2594922 - DNA, 21 bp, Homo sapiens
cattttggggtacccactgct

SEQ ID NO: 2594923 - DNA, 15 bp, Homo sapiens
cattttgtataattg

SEQ ID NO: 2594924 - DNA, 17 bp, Homo sapiens
cattttgtataattgta

SEQ ID NO: 2594925 - DNA, 18 bp, Homo sapiens
cattttgtataattgtat

SEQ ID NO: 2594926 - DNA, 15 bp, Homo sapiens
cattttgtgaatgga

SEQ ID NO: 2594927 - DNA, 16 bp, Homo sapiens
cattttgtgaatggat

SEQ ID NO: 2594928 - DNA, 18 bp, Homo sapiens
catttttagtagagacag

SEQ ID NO: 2594929 - DNA, 20 bp, Homo sapiens
catttttagtagagacaggg

SEQ ID NO: 2594930 - DNA, 16 bp, Homo sapiens
catttttccttccctt

SEQ ID NO: 2594931 - DNA, 18 bp, Homo sapiens
catttttgaatacaggca

SEQ ID NO: 2594932 - DNA, 13 bp, Homo sapiens
catttttgtacag

SEQ ID NO: 2594933 - DNA, 14 bp, Homo sapiens
catttttgtacagt

SEQ ID NO: 2594934 - DNA, 19 bp, Homo sapiens
cattttttaaatgcacctg

SEQ ID NO: 2594935 - DNA, 13 bp, Homo sapiens
cattttttcagtc

SEQ ID NO: 2594936 - DNA, 17 bp, Homo sapiens
catttttttaatttatt

SEQ ID NO: 2594937 - DNA, 22 bp, Homo sapiens
cattttttttaagaaaaaggat

SEQ ID NO: 2594938 - DNA, 23 bp, Homo sapiens
cattttttttaagaaaaaggatg

SEQ ID NO: 2594939 - DNA, 21 bp, Homo sapiens
cattttttttcagcagactat

SEQ ID NO: 2594940 - DNA, 13 bp, Homo sapiens
ccaaaaaaatact

SEQ ID NO: 2594941 - DNA, 15 bp, Homo sapiens
ccaaaaagaccagac

SEQ ID NO: 2594942 - DNA, 12 bp, Homo sapiens
ccaaaacaaaca

SEQ ID NO: 2594943 - DNA, 14 bp, Homo sapiens
ccaaaactcctgcc

SEQ ID NO: 2594944 - DNA, 21 bp, Homo sapiens
ccaaaactctcctctgctgct

SEQ ID NO: 2594945 - DNA, 16 bp, Homo sapiens
ccaaaactgtgcagag

SEQ ID NO: 2594946 - DNA, 19 bp, Homo sapiens
ccaaaagattgctgaaatt

SEQ ID NO: 2594947 - DNA, 14 bp, Homo sapiens
ccaaaagctgctca

SEQ ID NO: 2594948 - DNA, 15 bp, Homo sapiens
ccaaaagctttttat

SEQ ID NO: 2594949 - DNA, 14 bp, Homo sapiens
ccaaaaggcagaag

SEQ ID NO: 2594950 - DNA, 21 bp, Homo sapiens
ccaaaagtggcctctttgtct

SEQ ID NO: 2594951 - DNA, 21 bp, Homo sapiens
ccaaaataaaactttttaaaa

SEQ ID NO: 2594952 - DNA, 14 bp, Homo sapiens
ccaaaataagaaaa

SEQ ID NO: 2594953 - DNA, 16 bp, Homo sapiens
ccaaaatccccttctc

SEQ ID NO: 2594954 - DNA, 16 bp, Homo sapiens
ccaaacagccacactg

SEQ ID NO: 2594955 - DNA, 14 bp, Homo sapiens
ccaaaccctgtctg

SEQ ID NO: 2594956 - DNA, 17 bp, Homo sapiens
ccaaaccgccagcgaac

SEQ ID NO: 2594957 - DNA, 14 bp, Homo sapiens
ccaaacctagcccc

SEQ ID NO: 2594958 - DNA, 16 bp, Homo sapiens
catgaacatgttcctg

SEQ ID NO: 2594959 - DNA, 21 bp, Homo sapiens
catgaacttcgcatcaaaaga

SEQ ID NO: 2594960 - DNA, 19 bp, Homo sapiens
catggggctgattgtattt

SEQ ID NO: 2594961 - DNA, 19 bp, Homo sapiens
catggggtgatgctgggct

SEQ ID NO: 2594962 - DNA, 13 bp, Homo sapiens
catggggtgggcc

SEQ ID NO: 2594963 - DNA, 16 bp, Homo sapiens
catggggtgggcctct

SEQ ID NO: 2594964 - DNA, 19 bp, Homo sapiens
caggcctgggtctgtgtct

SEQ ID NO: 2594965 - DNA, 16 bp, Homo sapiens
caggccttatctccaa

SEQ ID NO: 2594966 - DNA, 11 bp, Homo sapiens
caggccttgcg

SEQ ID NO: 2594967 - DNA, 19 bp, Homo sapiens
caggcgatccacctgtctc

SEQ ID NO: 2594968 - DNA, 15 bp, Homo sapiens
caggcgggctcaagg

SEQ ID NO: 2594969 - DNA, 15 bp, Homo sapiens
caggcggtgggcacc

SEQ ID NO: 2594970 - DNA, 17 bp, Homo sapiens
caggcggtgggcaccca

SEQ ID NO: 2594971 - DNA, 19 bp, Homo sapiens
caggcgttcagctcactgt

SEQ ID NO: 2594972 - DNA, 20 bp, Homo sapiens
caggctacactgacactggt

SEQ ID NO: 2594973 - DNA, 18 bp, Homo sapiens
caggctccttcctgtctt

SEQ ID NO: 2594974 - DNA, 20 bp, Homo sapiens
caggctccttcctgtcttcc

SEQ ID NO: 2594975 - DNA, 21 bp, Homo sapiens
caggctccttcctgtcttcct

SEQ ID NO: 2594976 - DNA, 22 bp, Homo sapiens
caggctctttggggtcagccag

SEQ ID NO: 2594977 - DNA, 23 bp, Homo sapiens
caggctctttggggtcagccagg

SEQ ID NO: 2594978 - DNA, 18 bp, Homo sapiens
caggctgctcagggctgg

SEQ ID NO: 2594979 - DNA, 19 bp, Homo sapiens
caggctggcagctctccag

SEQ ID NO: 2594980 - DNA, 13 bp, Homo sapiens
caggctggcgcag

SEQ ID NO: 2594981 - DNA, 15 bp, Homo sapiens
caggctggcgcagcc

SEQ ID NO: 2594982 - DNA, 16 bp, Homo sapiens
caggctggcgcagcca

SEQ ID NO: 2594983 - DNA, 21 bp, Homo sapiens
caggctggcgcagccaaggcc

SEQ ID NO: 2594984 - DNA, 14 bp, Homo sapiens
caggctgggagagc

SEQ ID NO: 2594985 - DNA, 15 bp, Homo sapiens
caggctgggagagcc

SEQ ID NO: 2594986 - DNA, 20 bp, Homo sapiens
caggctgggagagccttcca

SEQ ID NO: 2594987 - DNA, 15 bp, Homo sapiens
caggctgggcttcag

SEQ ID NO: 2594988 - DNA, 21 bp, Homo sapiens
caggctgggcttcagtggcag

SEQ ID NO: 2594989 - DNA, 22 bp, Homo sapiens
caggctgggcttcagtggcagc

SEQ ID NO: 2594990 - DNA, 23 bp, Homo sapiens
caggctgggcttcagtggcagct

SEQ ID NO: 2594991 - DNA, 13 bp, Homo sapiens
caggctggggctg

SEQ ID NO: 2594992 - DNA, 18 bp, Homo sapiens
caggctggggctgacctt

SEQ ID NO: 2594993 - DNA, 23 bp, Homo sapiens
caggctgtatcccatgagcctca

SEQ ID NO: 2594994 - DNA, 16 bp, Homo sapiens
caggctgtctggccag

SEQ ID NO: 2594995 - DNA, 17 bp, Homo sapiens
caggctgtctggccagg

SEQ ID NO: 2594996 - DNA, 19 bp, Homo sapiens
caggctgtgcgctgacaac

SEQ ID NO: 2594997 - DNA, 20 bp, Homo sapiens
caggcttagtcactgagaca

SEQ ID NO: 2594998 - DNA, 21 bp, Homo sapiens
caggcttagtcactgagacag

SEQ ID NO: 2594999 - DNA, 22 bp, Homo sapiens
caggcttagtcactgagacagc

SEQ ID NO: 2595000 - DNA, 17 bp, Homo sapiens
caggcttgcctgcaggc

SEQ ID NO: 2595001 - DNA, 17 bp, Homo sapiens
cagggaaaagcagctct

SEQ ID NO: 2595002 - DNA, 20 bp, Homo sapiens
cagggaaaagcagctctccc

SEQ ID NO: 2595003 - DNA, 20 bp, Homo sapiens
cagggaaaattatttgcata

SEQ ID NO: 2595004 - DNA, 15 bp, Homo sapiens
cagggaaaggccagt

SEQ ID NO: 2595005 - DNA, 23 bp, Homo sapiens
cagggaaccgttattataattgt

SEQ ID NO: 2595006 - DNA, 15 bp, Homo sapiens
cagggaagagcagaa

SEQ ID NO: 2595007 - DNA, 17 bp, Homo sapiens
cagggaagagcagaacg

SEQ ID NO: 2595008 - DNA, 20 bp, Homo sapiens
cagggaagctacaggttaca

SEQ ID NO: 2595009 - DNA, 22 bp, Homo sapiens
cagggaagctacaggttacaac

SEQ ID NO: 2595010 - DNA, 13 bp, Homo sapiens
cagggaagctggc

SEQ ID NO: 2595011 - DNA, 17 bp, Homo sapiens
cagggaagtccccaggc

SEQ ID NO: 2595012 - DNA, 23 bp, Homo sapiens
cagggaatgcctgagtgcctggc

SEQ ID NO: 2595013 - DNA, 18 bp, Homo sapiens
caggacatttctctaaga

SEQ ID NO: 2595014 - DNA, 16 bp, Homo sapiens
caggaccacaaaaatg

SEQ ID NO: 2595015 - DNA, 23 bp, Homo sapiens
caggaccagctggggcgtgggga

SEQ ID NO: 2595016 - DNA, 20 bp, Homo sapiens
caggacctgggacctcccct

SEQ ID NO: 2595017 - DNA, 17 bp, Homo sapiens
caggacctgtggccaag

SEQ ID NO: 2595018 - DNA, 13 bp, Homo sapiens
caggaccttttga

SEQ ID NO: 2595019 - DNA, 21 bp, Homo sapiens
caggacgcttctgaatgctgc

SEQ ID NO: 2595020 - DNA, 21 bp, Homo sapiens
caggactatagcccaggtcct

SEQ ID NO: 2595021 - DNA, 14 bp, Homo sapiens
caggactcagctcc

SEQ ID NO: 2595022 - DNA, 17 bp, Homo sapiens
caggactcagctcccca

SEQ ID NO: 2595023 - DNA, 18 bp, Homo sapiens
caggactcagctccccag

SEQ ID NO: 2595024 - DNA, 17 bp, Homo sapiens
caggactccccaggcca

SEQ ID NO: 2595025 - DNA, 19 bp, Homo sapiens
caggactccccaggccagg

SEQ ID NO: 2595026 - DNA, 13 bp, Homo sapiens
caggactccctcc

SEQ ID NO: 2595027 - DNA, 14 bp, Homo sapiens
caggactccctcct

SEQ ID NO: 2595028 - DNA, 17 bp, Homo sapiens
caggactccctcctcac

SEQ ID NO: 2595029 - DNA, 21 bp, Homo sapiens
caggactccctcctcacctct

SEQ ID NO: 2595030 - DNA, 19 bp, Homo sapiens
caggacttaacggctccag

SEQ ID NO: 2595031 - DNA, 20 bp, Homo sapiens
caggacttaacggctccagg

SEQ ID NO: 2595032 - DNA, 17 bp, Homo sapiens
caggagaaccactacat

SEQ ID NO: 2595033 - DNA, 19 bp, Homo sapiens
caggagaaggccaattcct

SEQ ID NO: 2595034 - DNA, 22 bp, Homo sapiens
caggagagcagcggggcgaagc

SEQ ID NO: 2595035 - DNA, 14 bp, Homo sapiens
caggagaggagagc

SEQ ID NO: 2595036 - DNA, 21 bp, Homo sapiens
caggagaggagagccagagaa

SEQ ID NO: 2595037 - DNA, 17 bp, Homo sapiens
caggagcacaggcagct

SEQ ID NO: 2595038 - DNA, 14 bp, Homo sapiens
caggagcagccaca

SEQ ID NO: 2595039 - DNA, 16 bp, Homo sapiens
caggagcagtatcatg

SEQ ID NO: 2595040 - DNA, 20 bp, Homo sapiens
caggagcagtatcatgaagc

SEQ ID NO: 2595041 - DNA, 22 bp, Homo sapiens
caggagcatccacctccttctc

SEQ ID NO: 2595042 - DNA, 15 bp, Homo sapiens
caggagccccgaggc

SEQ ID NO: 2595043 - DNA, 23 bp, Homo sapiens
caggagccccgaggccttctctg

SEQ ID NO: 2595044 - DNA, 12 bp, Homo sapiens
caggagcctggc

SEQ ID NO: 2595045 - DNA, 12 bp, Homo sapiens
caggagctcttc

SEQ ID NO: 2595046 - DNA, 22 bp, Homo sapiens
caggagctgggatcctaagggc

SEQ ID NO: 2595047 - DNA, 19 bp, Homo sapiens
caggaggacaattcatgaa

SEQ ID NO: 2595048 - DNA, 22 bp, Homo sapiens
caggaggattgcttgagcccag

SEQ ID NO: 2595049 - DNA, 14 bp, Homo sapiens
caggaggccagcct

SEQ ID NO: 2595050 - DNA, 15 bp, Homo sapiens
caggaggccagcctt

SEQ ID NO: 2595051 - DNA, 14 bp, Homo sapiens
caggaggcccctgg

SEQ ID NO: 2595052 - DNA, 17 bp, Homo sapiens
caggaggcccctggccc

SEQ ID NO: 2595053 - DNA, 18 bp, Homo sapiens
caggaggcccctggccca

SEQ ID NO: 2595054 - DNA, 20 bp, Homo sapiens
caggaggcccctggcccagc

SEQ ID NO: 2595055 - DNA, 12 bp, Homo sapiens
caggaggctgag

SEQ ID NO: 2595056 - DNA, 18 bp, Homo sapiens
caggaggctgaggcagga

SEQ ID NO: 2595057 - DNA, 21 bp, Homo sapiens
caggaggctgaggcaggagga

SEQ ID NO: 2595058 - DNA, 21 bp, Homo sapiens
caggaggcttggaaagcatca

SEQ ID NO: 2595059 - DNA, 12 bp, Homo sapiens
caggagggaggg

SEQ ID NO: 2595060 - DNA, 17 bp, Homo sapiens
caggagggcaagggcca

SEQ ID NO: 2595061 - DNA, 19 bp, Homo sapiens
caggagggcaagggccatg

SEQ ID NO: 2595062 - DNA, 18 bp, Homo sapiens
caggaggtggctatggcc

SEQ ID NO: 2595063 - DNA, 19 bp, Homo sapiens
caggagtcccaaggaaagc

SEQ ID NO: 2595064 - DNA, 21 bp, Homo sapiens
caggagtccctgccatcatgt

SEQ ID NO: 2595065 - DNA, 12 bp, Homo sapiens
caggagtgagca

SEQ ID NO: 2595066 - DNA, 16 bp, Homo sapiens
caggagttagaggcca

SEQ ID NO: 2595067 - DNA, 21 bp, Homo sapiens
caggagtttgagaccaacctg

SEQ ID NO: 2595068 - DNA, 23 bp, Homo sapiens
caggagtttgagaccaacctggg

SEQ ID NO: 2595069 - DNA, 21 bp, Homo sapiens
caggagtttgaggctgcagcg

SEQ ID NO: 2595070 - DNA, 17 bp, Homo sapiens
caggatactctgtcaga

SEQ ID NO: 2595071 - DNA, 18 bp, Homo sapiens
caggatactctgtcagat

SEQ ID NO: 2595072 - DNA, 19 bp, Homo sapiens
cagctaggtggggcctaga

SEQ ID NO: 2595073 - DNA, 20 bp, Homo sapiens
cagctataacagtagggatg

SEQ ID NO: 2595074 - DNA, 18 bp, Homo sapiens
cagctatgggagccccag

SEQ ID NO: 2595075 - DNA, 21 bp, Homo sapiens
cagctatgggagccccagggt

SEQ ID NO: 2595076 - DNA, 15 bp, Homo sapiens
cagctcaaaggcaca

SEQ ID NO: 2595077 - DNA, 20 bp, Homo sapiens
cagctcaatggactggaagg

SEQ ID NO: 2595078 - DNA, 20 bp, Homo sapiens
cagctcaccagccccagtgc

SEQ ID NO: 2595079 - DNA, 21 bp, Homo sapiens
cagctcaccagccccagtgcc

SEQ ID NO: 2595080 - DNA, 16 bp, Homo sapiens
cagctcacctctccct

SEQ ID NO: 2595081 - DNA, 12 bp, Homo sapiens
cagctcagagag

SEQ ID NO: 2595082 - DNA, 13 bp, Homo sapiens
cagctcagcgcca

SEQ ID NO: 2595083 - DNA, 17 bp, Homo sapiens
cagctcagcgccagcct

SEQ ID NO: 2595084 - DNA, 21 bp, Homo sapiens
cagctcaggcacacttcttct

SEQ ID NO: 2595085 - DNA, 23 bp, Homo sapiens
cagctcagttctagtctctctgg

SEQ ID NO: 2595086 - DNA, 18 bp, Homo sapiens
cagctccagctcaccagc

SEQ ID NO: 2595087 - DNA, 14 bp, Homo sapiens
cagctccagctgct

SEQ ID NO: 2595088 - DNA, 15 bp, Homo sapiens
cagctccccagagtc

SEQ ID NO: 2595089 - DNA, 24 bp, Homo sapiens
cagctccccagagtcctctatgaa

SEQ ID NO: 2595090 - DNA, 15 bp, Homo sapiens
cagctccctaggaga

SEQ ID NO: 2595091 - DNA, 18 bp, Homo sapiens
cagctccctaggagacca

SEQ ID NO: 2595092 - DNA, 14 bp, Homo sapiens
cagctcccttctct

SEQ ID NO: 2595093 - DNA, 15 bp, Homo sapiens
cagctcccttctctg

SEQ ID NO: 2595094 - DNA, 13 bp, Homo sapiens
cagctcctaaccc

SEQ ID NO: 2595095 - DNA, 14 bp, Homo sapiens
cagctcctcccaca

SEQ ID NO: 2595096 - DNA, 13 bp, Homo sapiens
cagctccttcctg

SEQ ID NO: 2595097 - DNA, 21 bp, Homo sapiens
cagctccttctgtcctactct

SEQ ID NO: 2595098 - DNA, 23 bp, Homo sapiens
cagctccttctgtcctactctgt

SEQ ID NO: 2595099 - DNA, 15 bp, Homo sapiens
cagctctactggtct

SEQ ID NO: 2595100 - DNA, 13 bp, Homo sapiens
cagctctcagcca

SEQ ID NO: 2595101 - DNA, 12 bp, Homo sapiens
cagctctccagt

SEQ ID NO: 2595102 - DNA, 13 bp, Homo sapiens
cagctctccagtc

SEQ ID NO: 2595103 - DNA, 12 bp, Homo sapiens
cagctctcccct

SEQ ID NO: 2595104 - DNA, 19 bp, Homo sapiens
cagctctgaaaccagtgtt

SEQ ID NO: 2595105 - DNA, 14 bp, Homo sapiens
cagctctggagggg

SEQ ID NO: 2595106 - DNA, 15 bp, Homo sapiens
cagctctgggagagg

SEQ ID NO: 2595107 - DNA, 10 bp, Homo sapiens
cagctctggt

SEQ ID NO: 2595108 - DNA, 16 bp, Homo sapiens
cagctctggtccatag

SEQ ID NO: 2595109 - DNA, 21 bp, Homo sapiens
cagctctggtccatagagagc

SEQ ID NO: 2595110 - DNA, 22 bp, Homo sapiens
cagctctggtccatagagagca

SEQ ID NO: 2595111 - DNA, 13 bp, Homo sapiens
cagctctgtcctg

SEQ ID NO: 2595112 - DNA, 14 bp, Homo sapiens
cagctctgtcctgg

SEQ ID NO: 2595113 - DNA, 16 bp, Homo sapiens
cagctctgtcctggga

SEQ ID NO: 2595114 - DNA, 23 bp, Homo sapiens
cagctctgtcctgggagtgagct

SEQ ID NO: 2595115 - DNA, 13 bp, Homo sapiens
cagctcttctcca

SEQ ID NO: 2595116 - DNA, 23 bp, Homo sapiens
cagctcttctccaggctgtatcc

SEQ ID NO: 2595117 - DNA, 23 bp, Homo sapiens
cagctcttctgccggccctgggg

SEQ ID NO: 2595118 - DNA, 20 bp, Homo sapiens
cagctcttgcccttccctgt

SEQ ID NO: 2595119 - DNA, 24 bp, Homo sapiens
cagctcttgctaatcagtgtctca

SEQ ID NO: 2595120 - DNA, 17 bp, Homo sapiens
cagctcttggctccact

SEQ ID NO: 2595121 - DNA, 22 bp, Homo sapiens
cagctctttgaaatagtctgtg

SEQ ID NO: 2595122 - DNA, 21 bp, Homo sapiens
cagctgagagacttttaatca

SEQ ID NO: 2595123 - DNA, 22 bp, Homo sapiens
cagctgagcacattctggctca

SEQ ID NO: 2595124 - DNA, 18 bp, Homo sapiens
cagctgatgttggaagag

SEQ ID NO: 2595125 - DNA, 21 bp, Homo sapiens
cagctgattttaacaataact

SEQ ID NO: 2595126 - DNA, 13 bp, Homo sapiens
cagctgccagaga

SEQ ID NO: 2595127 - DNA, 17 bp, Homo sapiens
cagctgccgaccagagc

SEQ ID NO: 2595128 - DNA, 17 bp, Homo sapiens
cagctgcctcacttcct

SEQ ID NO: 2595129 - DNA, 12 bp, Homo sapiens
cagctgcctctt

SEQ ID NO: 2595130 - DNA, 14 bp, Homo sapiens
cagctgcctgggat

SEQ ID NO: 2595131 - DNA, 19 bp, Homo sapiens
cagctgcggtccacccagg

SEQ ID NO: 2595132 - DNA, 23 bp, Homo sapiens
cagctgcggtccacccaggagcc

SEQ ID NO: 2595133 - DNA, 20 bp, Homo sapiens
cagctgctgaaacaacaaat

SEQ ID NO: 2595134 - DNA, 15 bp, Homo sapiens
cagctgctggagact

SEQ ID NO: 2595135 - DNA, 19 bp, Homo sapiens
cagctgctggagactccta

SEQ ID NO: 2595136 - DNA, 14 bp, Homo sapiens
cagctgcttgtgtc

SEQ ID NO: 2595137 - DNA, 15 bp, Homo sapiens
cagctgcttgtgtcc

SEQ ID NO: 2595138 - DNA, 23 bp, Homo sapiens
cagctgcttttgtctatgggact

SEQ ID NO: 2595139 - DNA, 15 bp, Homo sapiens
cagctggcagcagag

SEQ ID NO: 2595140 - DNA, 17 bp, Homo sapiens
cagctggcccgtgacag

SEQ ID NO: 2595141 - DNA, 21 bp, Homo sapiens
cagcccatgcccacctgccca

SEQ ID NO: 2595142 - DNA, 22 bp, Homo sapiens
cagccccaaaactctcctctgc

SEQ ID NO: 2595143 - DNA, 22 bp, Homo sapiens
cagccccacccaggagggaggg

SEQ ID NO: 2595144 - DNA, 14 bp, Homo sapiens
cagccccagtgccc

SEQ ID NO: 2595145 - DNA, 16 bp, Homo sapiens
cagccccagtgcccac

SEQ ID NO: 2595146 - DNA, 17 bp, Homo sapiens
cagccccagtgcccaca

SEQ ID NO: 2595147 - DNA, 13 bp, Homo sapiens
cagccccattctg

SEQ ID NO: 2595148 - DNA, 17 bp, Homo sapiens
cagccccattctgcctg

SEQ ID NO: 2595149 - DNA, 18 bp, Homo sapiens
cagccccattctgcctgc

SEQ ID NO: 2595150 - DNA, 24 bp, Homo sapiens
cagccccattctgcctgcccaggc

SEQ ID NO: 2595151 - DNA, 19 bp, Homo sapiens
cagcccccacagtgctgtc

SEQ ID NO: 2595152 - DNA, 20 bp, Homo sapiens
cagcccccacagtgctgtct

SEQ ID NO: 2595153 - DNA, 15 bp, Homo sapiens
cagccccctttgggc

SEQ ID NO: 2595154 - DNA, 22 bp, Homo sapiens
cagccccctttgggcccaggga

SEQ ID NO: 2595155 - DNA, 18 bp, Homo sapiens
cagccccgcctccaggcc

SEQ ID NO: 2595156 - DNA, 16 bp, Homo sapiens
cagccccggccctggg

SEQ ID NO: 2595157 - DNA, 17 bp, Homo sapiens
cagccccggccctgggc

SEQ ID NO: 2595158 - DNA, 21 bp, Homo sapiens
cagcccctcttgccccccacc

SEQ ID NO: 2595159 - DNA, 14 bp, Homo sapiens
cagcccctgatcct

SEQ ID NO: 2595160 - DNA, 19 bp, Homo sapiens
cagcccctgatcctgtgaa

SEQ ID NO: 2595161 - DNA, 21 bp, Homo sapiens
cagcccctgatcctgtgaagt

SEQ ID NO: 2595162 - DNA, 22 bp, Homo sapiens
cagcccctggatgcagcctcac

SEQ ID NO: 2595163 - DNA, 19 bp, Homo sapiens
cagccccttctgacccatg

SEQ ID NO: 2595164 - DNA, 21 bp, Homo sapiens
cagccccttctgacccatgct

SEQ ID NO: 2595165 - DNA, 22 bp, Homo sapiens
cagccccttctgacccatgctg

SEQ ID NO: 2595166 - DNA, 17 bp, Homo sapiens
cagccccttgagaaacc

SEQ ID NO: 2595167 - DNA, 16 bp, Homo sapiens
cagcccgctgagtgga

SEQ ID NO: 2595168 - DNA, 23 bp, Homo sapiens
cagcccggcctgctcccagcagc

SEQ ID NO: 2595169 - DNA, 13 bp, Homo sapiens
cagcccggctggt

SEQ ID NO: 2595170 - DNA, 14 bp, Homo sapiens
cagcccggctggtt

SEQ ID NO: 2595171 - DNA, 13 bp, Homo sapiens
cagcccgggctct

SEQ ID NO: 2595172 - DNA, 15 bp, Homo sapiens
cagcccgggctctgc

SEQ ID NO: 2595173 - DNA, 20 bp, Homo sapiens
cagcccgggctctgcctccc

SEQ ID NO: 2595174 - DNA, 21 bp, Homo sapiens
cagcccgggctctgcctccca

SEQ ID NO: 2595175 - DNA, 15 bp, Homo sapiens
cagcccgtgtggccc

SEQ ID NO: 2595176 - DNA, 17 bp, Homo sapiens
cagccctaaggatctct

SEQ ID NO: 2595177 - DNA, 22 bp, Homo sapiens
cagccctaaggatctctcagga

SEQ ID NO: 2595178 - DNA, 12 bp, Homo sapiens
cagccctagagc

SEQ ID NO: 2595179 - DNA, 16 bp, Homo sapiens
cagccctagagcctgc

SEQ ID NO: 2595180 - DNA, 18 bp, Homo sapiens
cagccctagagcctgcct

SEQ ID NO: 2595181 - DNA, 18 bp, Homo sapiens
cagccctagggtggagag

SEQ ID NO: 2595182 - DNA, 15 bp, Homo sapiens
cagccctatggatgt

SEQ ID NO: 2595183 - DNA, 20 bp, Homo sapiens
cagccctatggatgtggggt

SEQ ID NO: 2595184 - DNA, 14 bp, Homo sapiens
cagccctgctggcc

SEQ ID NO: 2595185 - DNA, 21 bp, Homo sapiens
cagccctgctggccgcctcac

SEQ ID NO: 2595186 - DNA, 16 bp, Homo sapiens
cagccctggctctgca

SEQ ID NO: 2595187 - DNA, 13 bp, Homo sapiens
cagccctggctga

SEQ ID NO: 2595188 - DNA, 17 bp, Homo sapiens
cagccctggctgaagga

SEQ ID NO: 2595189 - DNA, 18 bp, Homo sapiens
cagccctggtctcagcag

SEQ ID NO: 2595190 - DNA, 16 bp, Homo sapiens
cagccctgtcagtgca

SEQ ID NO: 2595191 - DNA, 21 bp, Homo sapiens
cagccctgtcagtgcagcccg

SEQ ID NO: 2595192 - DNA, 13 bp, Homo sapiens
cagcccttagcag

SEQ ID NO: 2595193 - DNA, 16 bp, Homo sapiens
cagcccttagcaggga

SEQ ID NO: 2595194 - DNA, 11 bp, Homo sapiens
cagcccttgct

SEQ ID NO: 2595195 - DNA, 12 bp, Homo sapiens
cagccgagccgg

SEQ ID NO: 2595196 - DNA, 17 bp, Homo sapiens
cagccgagccgggcctg

SEQ ID NO: 2595197 - DNA, 22 bp, Homo sapiens
cagccgagctcgtgtatcctgg

SEQ ID NO: 2595198 - DNA, 19 bp, Homo sapiens
cagccgcagcctccctctg

SEQ ID NO: 2595199 - DNA, 21 bp, Homo sapiens
cagccgccattgccaccagga

SEQ ID NO: 2595200 - DNA, 23 bp, Homo sapiens
cagccgccattgccaccaggaga

SEQ ID NO: 2595201 - DNA, 19 bp, Homo sapiens
cagccggcctctctggcct

SEQ ID NO: 2595202 - DNA, 20 bp, Homo sapiens
cagccggcctctctggcctc

SEQ ID NO: 2595203 - DNA, 23 bp, Homo sapiens
cagccggcctctctggcctccca

SEQ ID NO: 2595204 - DNA, 12 bp, Homo sapiens
cagccgggccct

SEQ ID NO: 2595205 - DNA, 17 bp, Homo sapiens
cagccggtacctgggaa

SEQ ID NO: 2595206 - DNA, 15 bp, Homo sapiens
cagcctaccatgaga

SEQ ID NO: 2595207 - DNA, 15 bp, Homo sapiens
cagcctagccgacct

SEQ ID NO: 2595208 - DNA, 21 bp, Homo sapiens
cagcctagccgacctcagcct

SEQ ID NO: 2595209 - DNA, 19 bp, Homo sapiens
cagcctaggggtcagggac

SEQ ID NO: 2595210 - DNA, 19 bp, Homo sapiens
cagcctcaacctcctgggc

SEQ ID NO: 2595211 - DNA, 19 bp, Homo sapiens
cagcctcaataagccttgt

SEQ ID NO: 2595212 - DNA, 20 bp, Homo sapiens
cagcctcaataagccttgtc

SEQ ID NO: 2595213 - DNA, 15 bp, Homo sapiens
cagcctcacagtcct

SEQ ID NO: 2595214 - DNA, 20 bp, Homo sapiens
cagcctccaagctccatctc

SEQ ID NO: 2595215 - DNA, 16 bp, Homo sapiens
cagcctccagcctctg

SEQ ID NO: 2595216 - DNA, 14 bp, Homo sapiens
cagcctccatgctg

SEQ ID NO: 2595217 - DNA, 20 bp, Homo sapiens
cagcctcccaaagtgctggg

SEQ ID NO: 2595218 - DNA, 16 bp, Homo sapiens
cagcctcccaccccca

SEQ ID NO: 2595219 - DNA, 19 bp, Homo sapiens
cagcctcccacccccatct

SEQ ID NO: 2595220 - DNA, 16 bp, Homo sapiens
cagcctcccctgccag

SEQ ID NO: 2595221 - DNA, 21 bp, Homo sapiens
cagcctcccgaatagctggga

SEQ ID NO: 2595222 - DNA, 23 bp, Homo sapiens
cagcctcccgagtagctgggact

SEQ ID NO: 2595223 - DNA, 15 bp, Homo sapiens
cagcctccctctgac

SEQ ID NO: 2595224 - DNA, 21 bp, Homo sapiens
cagcctccctctgacctgcag

SEQ ID NO: 2595225 - DNA, 19 bp, Homo sapiens
cagcctccgtatttcagac

SEQ ID NO: 2595226 - DNA, 17 bp, Homo sapiens
cagcctcctctgtctgc

SEQ ID NO: 2595227 - DNA, 23 bp, Homo sapiens
cagcctcctctgtctgcccttca

SEQ ID NO: 2595228 - DNA, 15 bp, Homo sapiens
cagcctctctcccag

SEQ ID NO: 2595229 - DNA, 23 bp, Homo sapiens
cagcctctctcccagtctaccca

SEQ ID NO: 2595230 - DNA, 22 bp, Homo sapiens
cagcctctcttggtttccttcc

SEQ ID NO: 2595231 - DNA, 13 bp, Homo sapiens
cagcctctggcat

SEQ ID NO: 2595232 - DNA, 15 bp, Homo sapiens
cagcctgcctggcag

SEQ ID NO: 2595233 - DNA, 16 bp, Homo sapiens
cagcctgctccagctg

SEQ ID NO: 2595234 - DNA, 19 bp, Homo sapiens
cagcctgctccagctgttc

SEQ ID NO: 2595235 - DNA, 22 bp, Homo sapiens
cagcctgctccttcccaggagt

SEQ ID NO: 2595236 - DNA, 15 bp, Homo sapiens
cagcctggaccctgt

SEQ ID NO: 2595237 - DNA, 12 bp, Homo sapiens
cagcctggctcc

SEQ ID NO: 2595238 - DNA, 23 bp, Homo sapiens
cagcctggctcccacaggcagct

SEQ ID NO: 2595239 - DNA, 15 bp, Homo sapiens
cagcctggcttctgg

SEQ ID NO: 2595240 - DNA, 16 bp, Homo sapiens
cagcctggcttctgga

SEQ ID NO: 2595241 - DNA, 19 bp, Homo sapiens
cagcctggcttctggagcc

SEQ ID NO: 2595242 - DNA, 20 bp, Homo sapiens
cagcctggcttctggagccc

SEQ ID NO: 2595243 - DNA, 20 bp, Homo sapiens
cagcctgggcaacacagcga

SEQ ID NO: 2595244 - DNA, 16 bp, Homo sapiens
cagcctgggcaatgtg

SEQ ID NO: 2595245 - DNA, 18 bp, Homo sapiens
cagcctgggcagccaggc

SEQ ID NO: 2595246 - DNA, 20 bp, Homo sapiens
cagcctgggcagccaggctg

SEQ ID NO: 2595247 - DNA, 11 bp, Homo sapiens
cagcctgggcg

SEQ ID NO: 2595248 - DNA, 15 bp, Homo sapiens
cagcctgtcctgggc

SEQ ID NO: 2595249 - DNA, 15 bp, Homo sapiens
cagcctgtctcttcc

SEQ ID NO: 2595250 - DNA, 19 bp, Homo sapiens
cagcctgtctcttccatat

SEQ ID NO: 2595251 - DNA, 14 bp, Homo sapiens
cagcctgtgctgcc

SEQ ID NO: 2595252 - DNA, 21 bp, Homo sapiens
cagccttccccctcccagggc

SEQ ID NO: 2595253 - DNA, 21 bp, Homo sapiens
cagccttccccttgcccaggg

SEQ ID NO: 2595254 - DNA, 14 bp, Homo sapiens
cagccttcctctgc

SEQ ID NO: 2595255 - DNA, 22 bp, Homo sapiens
cagccttcctctgcagctgacc

SEQ ID NO: 2595256 - DNA, 14 bp, Homo sapiens
cagccttctttgct

SEQ ID NO: 2595257 - DNA, 17 bp, Homo sapiens
cagccttgaccattctc

SEQ ID NO: 2595258 - DNA, 22 bp, Homo sapiens
cagccttgaccattctccacct

SEQ ID NO: 2595259 - DNA, 18 bp, Homo sapiens
cagcctttctcccaggcc

SEQ ID NO: 2595260 - DNA, 17 bp, Homo sapiens
cagcctttgcctccccg

SEQ ID NO: 2595261 - DNA, 14 bp, Homo sapiens
cagcgaccacccct

SEQ ID NO: 2595262 - DNA, 16 bp, Homo sapiens
cagcgaccacccctgc

SEQ ID NO: 2595263 - DNA, 17 bp, Homo sapiens
cagcgaccgccccctcc

SEQ ID NO: 2595264 - DNA, 18 bp, Homo sapiens
cagcgaccgccccctcct

SEQ ID NO: 2595265 - DNA, 13 bp, Homo sapiens
cagcgagaggcag

SEQ ID NO: 2595266 - DNA, 16 bp, Homo sapiens
cagcgagccctggtgg

SEQ ID NO: 2595267 - DNA, 16 bp, Homo sapiens
cagcgaggaggctcca

SEQ ID NO: 2595268 - DNA, 18 bp, Homo sapiens
cagcgatgtatgcagcta

SEQ ID NO: 2595269 - DNA, 22 bp, Homo sapiens
cagcgatgtatgcagctatctg

SEQ ID NO: 2595270 - DNA, 22 bp, Homo sapiens
cagcgccaagcaacctgggtcc

SEQ ID NO: 2595271 - DNA, 14 bp, Homo sapiens
cagcgcccgctggg

SEQ ID NO: 2595272 - DNA, 16 bp, Homo sapiens
cagcgcccgctgggct

SEQ ID NO: 2595273 - DNA, 13 bp, Homo sapiens
cagcggcccctcc

SEQ ID NO: 2595274 - DNA, 18 bp, Homo sapiens
cagcggcccctcccacac

SEQ ID NO: 2595275 - DNA, 21 bp, Homo sapiens
cagcggggacagctccttctg

SEQ ID NO: 2595276 - DNA, 15 bp, Homo sapiens
cagcggtggcctctt

SEQ ID NO: 2595277 - DNA, 15 bp, Homo sapiens
cagcggtttggggag

SEQ ID NO: 2595278 - DNA, 19 bp, Homo sapiens
cagcgtttctatgacacat

SEQ ID NO: 2595279 - DNA, 15 bp, Homo sapiens
cagctaacacacagc

SEQ ID NO: 2595280 - DNA, 15 bp, Homo sapiens
cagctaagctaggaa

SEQ ID NO: 2595281 - DNA, 19 bp, Homo sapiens
cagctactcaagaggctga

SEQ ID NO: 2595282 - DNA, 20 bp, Homo sapiens
cagctactcaagaggctgag

SEQ ID NO: 2595283 - DNA, 23 bp, Homo sapiens
cagctactcaagaggctgaggca

SEQ ID NO: 2595284 - DNA, 14 bp, Homo sapiens
cagctactcagaag

SEQ ID NO: 2595285 - DNA, 22 bp, Homo sapiens
cagctactcagaagcctgaggc

SEQ ID NO: 2595286 - DNA, 12 bp, Homo sapiens
cagctactcagg

SEQ ID NO: 2595287 - DNA, 19 bp, Homo sapiens
cagctactgatttttgtga

SEQ ID NO: 2595288 - DNA, 21 bp, Homo sapiens
cagctacttcctcctccccac

SEQ ID NO: 2595289 - DNA, 19 bp, Homo sapiens
cagctacttgggaggctga

SEQ ID NO: 2595290 - DNA, 17 bp, Homo sapiens
cagctactttaacacca

SEQ ID NO: 2595291 - DNA, 16 bp, Homo sapiens
cagatgcaaagaggca

SEQ ID NO: 2595292 - DNA, 17 bp, Homo sapiens
cagatgcaaagaggcaa

SEQ ID NO: 2595293 - DNA, 15 bp, Homo sapiens
cagatgcaatgtgct

SEQ ID NO: 2595294 - DNA, 18 bp, Homo sapiens
cagatgcagagagccatt

SEQ ID NO: 2595295 - DNA, 15 bp, Homo sapiens
cagatgccccagagc

SEQ ID NO: 2595296 - DNA, 16 bp, Homo sapiens
cagatgccccagagct

SEQ ID NO: 2595297 - DNA, 13 bp, Homo sapiens
cagatgctgatgt

SEQ ID NO: 2595298 - DNA, 18 bp, Homo sapiens
cagatggaaccgcaggaa

SEQ ID NO: 2595299 - DNA, 21 bp, Homo sapiens
cagatggaaccgcaggaagct

SEQ ID NO: 2595300 - DNA, 22 bp, Homo sapiens
cagatggaaccgcaggaagctg

SEQ ID NO: 2595301 - DNA, 19 bp, Homo sapiens
cagatggactccagcctgc

SEQ ID NO: 2595302 - DNA, 19 bp, Homo sapiens
cagatgggggaaagcacag

SEQ ID NO: 2595303 - DNA, 23 bp, Homo sapiens
cagatgggtgcttggaggaagga

SEQ ID NO: 2595304 - DNA, 17 bp, Homo sapiens
cagatgtcttctgcctg

SEQ ID NO: 2595305 - DNA, 23 bp, Homo sapiens
cagatgttgaatgcccacaggca

SEQ ID NO: 2595306 - DNA, 18 bp, Homo sapiens
cagatgttttacgtctgg

SEQ ID NO: 2595307 - DNA, 15 bp, Homo sapiens
cagattcatttttct

SEQ ID NO: 2595308 - DNA, 21 bp, Homo sapiens
cagattccaggcgatgtgcaa

SEQ ID NO: 2595309 - DNA, 14 bp, Homo sapiens
cagattcccagagc

SEQ ID NO: 2595310 - DNA, 17 bp, Homo sapiens
cagattcccagagcaaa

SEQ ID NO: 2595311 - DNA, 18 bp, Homo sapiens
cagattcccagagcaaaa

SEQ ID NO: 2595312 - DNA, 19 bp, Homo sapiens
cagattctttcctgaggct

SEQ ID NO: 2595313 - DNA, 22 bp, Homo sapiens
cagattctttcctgaggctggg

SEQ ID NO: 2595314 - DNA, 22 bp, Homo sapiens
cagattgagttttcttctgtga

SEQ ID NO: 2595315 - DNA, 17 bp, Homo sapiens
cagattgcaacaggctg

SEQ ID NO: 2595316 - DNA, 15 bp, Homo sapiens
cagattgcatgtgac

SEQ ID NO: 2595317 - DNA, 16 bp, Homo sapiens
cagattgcatgtgact

SEQ ID NO: 2595318 - DNA, 21 bp, Homo sapiens
cagattgcatgtgactctgaa

SEQ ID NO: 2595319 - DNA, 18 bp, Homo sapiens
cagattggagaaaccctt

SEQ ID NO: 2595320 - DNA, 14 bp, Homo sapiens
cagatttacactgg

SEQ ID NO: 2595321 - DNA, 18 bp, Homo sapiens
cagatttacactgggaga

SEQ ID NO: 2595322 - DNA, 15 bp, Homo sapiens
cagatttgggctgga

SEQ ID NO: 2595323 - DNA, 14 bp, Homo sapiens
cagatttgtgttat

SEQ ID NO: 2595324 - DNA, 20 bp, Homo sapiens
cagattttggggttgtgttg

SEQ ID NO: 2595325 - DNA, 15 bp, Homo sapiens
cagcaaaactccatc

SEQ ID NO: 2595326 - DNA, 21 bp, Homo sapiens
cagcaacacaagctggaagca

SEQ ID NO: 2595327 - DNA, 23 bp, Homo sapiens
cagcaacgcaggcccccaggtgc

SEQ ID NO: 2595328 - DNA, 15 bp, Homo sapiens
cagcaactgaataaa

SEQ ID NO: 2595329 - DNA, 18 bp, Homo sapiens
cagcaacttgtctttttc

SEQ ID NO: 2595330 - DNA, 23 bp, Homo sapiens
cagcaagggtgatgggaaagcat

SEQ ID NO: 2595331 - DNA, 15 bp, Homo sapiens
cagcaagtcagggtt

SEQ ID NO: 2595332 - DNA, 12 bp, Homo sapiens
cagcaagtgaga

SEQ ID NO: 2595333 - DNA, 15 bp, Homo sapiens
cagcaagtgagagct

SEQ ID NO: 2595334 - DNA, 15 bp, Homo sapiens
cagcaatatgtaaat

SEQ ID NO: 2595335 - DNA, 19 bp, Homo sapiens
cagcaatgacatctcaggg

SEQ ID NO: 2595336 - DNA, 21 bp, Homo sapiens
cagcaatgacatctcaggggc

SEQ ID NO: 2595337 - DNA, 22 bp, Homo sapiens
cagcaccaccctagtcccttcc

SEQ ID NO: 2595338 - DNA, 16 bp, Homo sapiens
cagcaccccttccatg

SEQ ID NO: 2595339 - DNA, 15 bp, Homo sapiens
cagcacctacagtgt

SEQ ID NO: 2595340 - DNA, 16 bp, Homo sapiens
cagcacgatttctgtt

SEQ ID NO: 2595341 - DNA, 19 bp, Homo sapiens
cagcacgatttctgtttag

SEQ ID NO: 2595342 - DNA, 17 bp, Homo sapiens
cagcactcacacaggac

SEQ ID NO: 2595343 - DNA, 16 bp, Homo sapiens
cagcactgcttgagga

SEQ ID NO: 2595344 - DNA, 12 bp, Homo sapiens
cagcactggctc

SEQ ID NO: 2595345 - DNA, 17 bp, Homo sapiens
cagcactggctctctcc

SEQ ID NO: 2595346 - DNA, 18 bp, Homo sapiens
cagcactggctctctcca

SEQ ID NO: 2595347 - DNA, 23 bp, Homo sapiens
cagcactgtctcagtttcacttt

SEQ ID NO: 2595348 - DNA, 13 bp, Homo sapiens
cagcacttgtata

SEQ ID NO: 2595349 - DNA, 20 bp, Homo sapiens
cagcactttgggaggccaag

SEQ ID NO: 2595350 - DNA, 17 bp, Homo sapiens
cagcagaaatgccttac

SEQ ID NO: 2595351 - DNA, 14 bp, Homo sapiens
cagcagactatgaa

SEQ ID NO: 2595352 - DNA, 18 bp, Homo sapiens
cagcagagacttgggaca

SEQ ID NO: 2595353 - DNA, 19 bp, Homo sapiens
cagcagagacttgggacat

SEQ ID NO: 2595354 - DNA, 21 bp, Homo sapiens
cagcagagacttgggacattg

SEQ ID NO: 2595355 - DNA, 16 bp, Homo sapiens
cagcagcccctgcaca

SEQ ID NO: 2595356 - DNA, 11 bp, Homo sapiens
cagcagcccta

SEQ ID NO: 2595357 - DNA, 23 bp, Homo sapiens
cagcagccctaaggatctctcag

SEQ ID NO: 2595358 - DNA, 22 bp, Homo sapiens
cagcagcctggaccctgtggat

SEQ ID NO: 2595359 - DNA, 20 bp, Homo sapiens
cagcagcgaccacccctgcc

SEQ ID NO: 2595360 - DNA, 13 bp, Homo sapiens
cagcagctcaggc

SEQ ID NO: 2595361 - DNA, 14 bp, Homo sapiens
cagcagctcaggca

SEQ ID NO: 2595362 - DNA, 12 bp, Homo sapiens
cagcagcttcac

SEQ ID NO: 2595363 - DNA, 17 bp, Homo sapiens
cagcagcttttaataca

SEQ ID NO: 2595364 - DNA, 18 bp, Homo sapiens
cagcagggagggcttctg

SEQ ID NO: 2595365 - DNA, 14 bp, Homo sapiens
cagcagggcctcaa

SEQ ID NO: 2595366 - DNA, 15 bp, Homo sapiens
cagcagggcctcaaa

SEQ ID NO: 2595367 - DNA, 11 bp, Homo sapiens
cagcagggcta

SEQ ID NO: 2595368 - DNA, 19 bp, Homo sapiens
cagcagggctaccctgagc

SEQ ID NO: 2595369 - DNA, 18 bp, Homo sapiens
cagcagggctgctgtgaa

SEQ ID NO: 2595370 - DNA, 18 bp, Homo sapiens
cagcagggtcttttcatc

SEQ ID NO: 2595371 - DNA, 19 bp, Homo sapiens
cagcagtacctataaagta

SEQ ID NO: 2595372 - DNA, 17 bp, Homo sapiens
cagcagtgttccccatc

SEQ ID NO: 2595373 - DNA, 22 bp, Homo sapiens
cagcagtgttccccatctgggt

SEQ ID NO: 2595374 - DNA, 23 bp, Homo sapiens
cagcagttccggattggcttgtg

SEQ ID NO: 2595375 - DNA, 20 bp, Homo sapiens
cagcagttgaaaagactcca

SEQ ID NO: 2595376 - DNA, 21 bp, Homo sapiens
cagcagttgaaaagactccaa

SEQ ID NO: 2595377 - DNA, 14 bp, Homo sapiens
cagcatatttatag

SEQ ID NO: 2595378 - DNA, 23 bp, Homo sapiens
cagcatcattttgcattcaaatt

SEQ ID NO: 2595379 - DNA, 14 bp, Homo sapiens
cactgagggccaca

SEQ ID NO: 2595380 - DNA, 14 bp, Homo sapiens
cactgatgggcaac

SEQ ID NO: 2595381 - DNA, 18 bp, Homo sapiens
cactgatgggcaaccccc

SEQ ID NO: 2595382 - DNA, 24 bp, Homo sapiens
cactgatgggcaacccccagcctg

SEQ ID NO: 2595383 - DNA, 18 bp, Homo sapiens
cactgatttcacaacaga

SEQ ID NO: 2595384 - DNA, 21 bp, Homo sapiens
cactgatttcacaacagatca

SEQ ID NO: 2595385 - DNA, 14 bp, Homo sapiens
cactgcaacctccg

SEQ ID NO: 2595386 - DNA, 16 bp, Homo sapiens
cactgcaacttctgcc

SEQ ID NO: 2595387 - DNA, 16 bp, Homo sapiens
cactgcaatcctgtct

SEQ ID NO: 2595388 - DNA, 19 bp, Homo sapiens
cactgcaatcctgtctttc

SEQ ID NO: 2595389 - DNA, 18 bp, Homo sapiens
cactgcacacacctcaga

SEQ ID NO: 2595390 - DNA, 15 bp, Homo sapiens
cactgcaccaccgag

SEQ ID NO: 2595391 - DNA, 14 bp, Homo sapiens
cactgcaccgggcc

SEQ ID NO: 2595392 - DNA, 12 bp, Homo sapiens
cactgcaggcac

SEQ ID NO: 2595393 - DNA, 19 bp, Homo sapiens
cactgcatggctcccacag

SEQ ID NO: 2595394 - DNA, 16 bp, Homo sapiens
cactgcatgtttgtga

SEQ ID NO: 2595395 - DNA, 19 bp, Homo sapiens
cactgccatgcagggcctc

SEQ ID NO: 2595396 - DNA, 17 bp, Homo sapiens
cactgccatgccagctt

SEQ ID NO: 2595397 - DNA, 21 bp, Homo sapiens
cactgcccccagctcttctcc

SEQ ID NO: 2595398 - DNA, 17 bp, Homo sapiens
cactgcccgagctggtg

SEQ ID NO: 2595399 - DNA, 18 bp, Homo sapiens
cactgcccgagctggtgc

SEQ ID NO: 2595400 - DNA, 21 bp, Homo sapiens
cactgcccgagctggtgcatt

SEQ ID NO: 2595401 - DNA, 16 bp, Homo sapiens
cactgcctactgcatc

SEQ ID NO: 2595402 - DNA, 12 bp, Homo sapiens
cactgcctcagg

SEQ ID NO: 2595403 - DNA, 14 bp, Homo sapiens
cactgcctcaggtt

SEQ ID NO: 2595404 - DNA, 15 bp, Homo sapiens
cactgcctcaggttc

SEQ ID NO: 2595405 - DNA, 19 bp, Homo sapiens
cactgcctctccctggccc

SEQ ID NO: 2595406 - DNA, 20 bp, Homo sapiens
cactgcctctccctggccct

SEQ ID NO: 2595407 - DNA, 10 bp, Homo sapiens
cactgcctgc

SEQ ID NO: 2595408 - DNA, 12 bp, Homo sapiens
cactgcctttga

SEQ ID NO: 2595409 - DNA, 22 bp, Homo sapiens
cactgcggagaaccttgtgcct

SEQ ID NO: 2595410 - DNA, 22 bp, Homo sapiens
cactgctaggtgggccagcccc

SEQ ID NO: 2595411 - DNA, 22 bp, Homo sapiens
cactgctcaagaagacatggag

SEQ ID NO: 2595412 - DNA, 18 bp, Homo sapiens
cactgctgcaaggccttt

SEQ ID NO: 2595413 - DNA, 14 bp, Homo sapiens
cactgcttccagtg

SEQ ID NO: 2595414 - DNA, 22 bp, Homo sapiens
cactgcttccagtgaggctctg

SEQ ID NO: 2595415 - DNA, 13 bp, Homo sapiens
cactgcttgagga

SEQ ID NO: 2595416 - DNA, 20 bp, Homo sapiens
cactgcttgaggaaaacaag

SEQ ID NO: 2595417 - DNA, 16 bp, Homo sapiens
cactggaccactgggc

SEQ ID NO: 2595418 - DNA, 19 bp, Homo sapiens
cactggactccggccctcc

SEQ ID NO: 2595419 - DNA, 22 bp, Homo sapiens
cactggaggagagaagaatgag

SEQ ID NO: 2595420 - DNA, 16 bp, Homo sapiens
cactggagtccagtct

SEQ ID NO: 2595421 - DNA, 23 bp, Homo sapiens
cactggagtgcagggaggagagg

SEQ ID NO: 2595422 - DNA, 22 bp, Homo sapiens
cactggagttacattaatgtta

SEQ ID NO: 2595423 - DNA, 14 bp, Homo sapiens
cactggcattgtcc

SEQ ID NO: 2595424 - DNA, 18 bp, Homo sapiens
cactggcattgtccctgt

SEQ ID NO: 2595425 - DNA, 12 bp, Homo sapiens
cactggccacca

SEQ ID NO: 2595426 - DNA, 14 bp, Homo sapiens
cactggccaccagg

SEQ ID NO: 2595427 - DNA, 19 bp, Homo sapiens
cactggccaccaggctggc

SEQ ID NO: 2595428 - DNA, 20 bp, Homo sapiens
cactggccaccaggctggcg

SEQ ID NO: 2595429 - DNA, 22 bp, Homo sapiens
cactggccaccaggctggcgca

SEQ ID NO: 2595430 - DNA, 24 bp, Homo sapiens
cactggccaccaggctggcgcagc

SEQ ID NO: 2595431 - DNA, 17 bp, Homo sapiens
cactggccatctccacc

SEQ ID NO: 2595432 - DNA, 22 bp, Homo sapiens
cactggcccctagaatcagcct

SEQ ID NO: 2595433 - DNA, 23 bp, Homo sapiens
cactggcgtagaagtttttgtac

SEQ ID NO: 2595434 - DNA, 17 bp, Homo sapiens
cactggctctccaagtg

SEQ ID NO: 2595435 - DNA, 19 bp, Homo sapiens
cactggctctccaagtgcc

SEQ ID NO: 2595436 - DNA, 21 bp, Homo sapiens
cactggctctccaagtgccag

SEQ ID NO: 2595437 - DNA, 22 bp, Homo sapiens
cactggctctccaagtgccaga

SEQ ID NO: 2595438 - DNA, 15 bp, Homo sapiens
cactggctctctcca

SEQ ID NO: 2595439 - DNA, 18 bp, Homo sapiens
cactggctctctccagga

SEQ ID NO: 2595440 - DNA, 18 bp, Homo sapiens
cactgggaaacagaggct

SEQ ID NO: 2595441 - DNA, 20 bp, Homo sapiens
cactgggatgagccgctgtg

SEQ ID NO: 2595442 - DNA, 19 bp, Homo sapiens
cactggggtccagggagca

SEQ ID NO: 2595443 - DNA, 18 bp, Homo sapiens
cactggggtgccgcctgc

SEQ ID NO: 2595444 - DNA, 20 bp, Homo sapiens
cactggggtgccgcctgccc

SEQ ID NO: 2595445 - DNA, 23 bp, Homo sapiens
cactgggtggggtgaggaccact

SEQ ID NO: 2595446 - DNA, 17 bp, Homo sapiens
cactgtaaaatgaaatt

SEQ ID NO: 2595447 - DNA, 14 bp, Homo sapiens
cactgtataaatag

SEQ ID NO: 2595448 - DNA, 15 bp, Homo sapiens
cactgtataaatagg

SEQ ID NO: 2595449 - DNA, 18 bp, Homo sapiens
cactgtataaataggaga

SEQ ID NO: 2595450 - DNA, 19 bp, Homo sapiens
cactgtataaataggagag

SEQ ID NO: 2595451 - DNA, 23 bp, Homo sapiens
cactgtataaataggagaggatg

SEQ ID NO: 2595452 - DNA, 16 bp, Homo sapiens
cactgtatgctggacg

SEQ ID NO: 2595453 - DNA, 18 bp, Homo sapiens
cactgtatgctggacggc

SEQ ID NO: 2595454 - DNA, 19 bp, Homo sapiens
cactgtcactgtttctctg

SEQ ID NO: 2595455 - DNA, 16 bp, Homo sapiens
cactgtcactttgctc

SEQ ID NO: 2595456 - DNA, 14 bp, Homo sapiens
cactgtcttcttca

SEQ ID NO: 2595457 - DNA, 14 bp, Homo sapiens
cactgtcttgaaga

SEQ ID NO: 2595458 - DNA, 17 bp, Homo sapiens
cactgtgcccagcccgg

SEQ ID NO: 2595459 - DNA, 15 bp, Homo sapiens
cactgtgccctggtg

SEQ ID NO: 2595460 - DNA, 17 bp, Homo sapiens
cactgtgccctggtgga

SEQ ID NO: 2595461 - DNA, 15 bp, Homo sapiens
cactgtgctcagggc

SEQ ID NO: 2595462 - DNA, 21 bp, Homo sapiens
cactgtgctgagtctgaaggc

SEQ ID NO: 2595463 - DNA, 22 bp, Homo sapiens
cactgtgctgagtctgaaggct

SEQ ID NO: 2595464 - DNA, 24 bp, Homo sapiens
cactgtggacttggtcaccagctc

SEQ ID NO: 2595465 - DNA, 14 bp, Homo sapiens
cactgtggtgtctg

SEQ ID NO: 2595466 - DNA, 13 bp, Homo sapiens
cactgttctctgc

SEQ ID NO: 2595467 - DNA, 19 bp, Homo sapiens
cactgttctgaaagtgact

SEQ ID NO: 2595468 - DNA, 14 bp, Homo sapiens
cactgttgaaaatt

SEQ ID NO: 2595469 - DNA, 15 bp, Homo sapiens
cactgttgcccaggc

SEQ ID NO: 2595470 - DNA, 16 bp, Homo sapiens
cactgttgcccaggct

SEQ ID NO: 2595471 - DNA, 17 bp, Homo sapiens
cactgtttacaagaaaa

SEQ ID NO: 2595472 - DNA, 18 bp, Homo sapiens
cactgtttacaagaaaaa

SEQ ID NO: 2595473 - DNA, 14 bp, Homo sapiens
cacttaaaaaatgt

SEQ ID NO: 2595474 - DNA, 22 bp, Homo sapiens
cacttaacaagctcccaggccg

SEQ ID NO: 2595475 - DNA, 13 bp, Homo sapiens
cacttaacagatg

SEQ ID NO: 2595476 - DNA, 17 bp, Homo sapiens
cacttaaggcactctgt

SEQ ID NO: 2595477 - DNA, 16 bp, Homo sapiens
cacttacactttatgc

SEQ ID NO: 2595478 - DNA, 18 bp, Homo sapiens
cacttacactttatgcac

SEQ ID NO: 2595479 - DNA, 14 bp, Homo sapiens
cacttaccttcaat

SEQ ID NO: 2595480 - DNA, 16 bp, Homo sapiens
cacttaccttcaataa

SEQ ID NO: 2595481 - DNA, 18 bp, Homo sapiens
cacttactgttgtcctat

SEQ ID NO: 2595482 - DNA, 15 bp, Homo sapiens
cacttactgtttctg

SEQ ID NO: 2595483 - DNA, 20 bp, Homo sapiens
cacttactgtttctgtcagg

SEQ ID NO: 2595484 - DNA, 14 bp, Homo sapiens
cacttcacagagtg

SEQ ID NO: 2595485 - DNA, 19 bp, Homo sapiens
cacttcacagagtgtgctg

SEQ ID NO: 2595486 - DNA, 14 bp, Homo sapiens
cacttcaccctgga

SEQ ID NO: 2595487 - DNA, 18 bp, Homo sapiens
cacttcagagagctggta

SEQ ID NO: 2595488 - DNA, 15 bp, Homo sapiens
cacttccaccagcct

SEQ ID NO: 2595489 - DNA, 16 bp, Homo sapiens
cacttccaccagcctg

SEQ ID NO: 2595490 - DNA, 18 bp, Homo sapiens
cacttccaccagcctgca

SEQ ID NO: 2595491 - DNA, 20 bp, Homo sapiens
cacttccaccagcctgcact

SEQ ID NO: 2595492 - DNA, 18 bp, Homo sapiens
cacttccatacagctcta

SEQ ID NO: 2595493 - DNA, 17 bp, Homo sapiens
cacttcctacaagagca

SEQ ID NO: 2595494 - DNA, 12 bp, Homo sapiens
cacttcctgtcc

SEQ ID NO: 2595495 - DNA, 18 bp, Homo sapiens
cacttcctgtccagagag

SEQ ID NO: 2595496 - DNA, 18 bp, Homo sapiens
cacttctaaatgaagtgc

SEQ ID NO: 2595497 - DNA, 16 bp, Homo sapiens
cacttctgaccacact

SEQ ID NO: 2595498 - DNA, 19 bp, Homo sapiens
cacttctgaccacacttcc

SEQ ID NO: 2595499 - DNA, 21 bp, Homo sapiens
cacttctgtgagacccccaca

SEQ ID NO: 2595500 - DNA, 23 bp, Homo sapiens
cacttcttcttggtcttatttat

SEQ ID NO: 2595501 - DNA, 15 bp, Homo sapiens
cacttcttttataac

SEQ ID NO: 2595502 - DNA, 19 bp, Homo sapiens
cacttgatgacccccaacc

SEQ ID NO: 2595503 - DNA, 14 bp, Homo sapiens
cacttgattccttg

SEQ ID NO: 2595504 - DNA, 13 bp, Homo sapiens
cacttgcagactc

SEQ ID NO: 2595505 - DNA, 14 bp, Homo sapiens
cacttgcagactct

SEQ ID NO: 2595506 - DNA, 22 bp, Homo sapiens
cacttgcagactctacagaggc

SEQ ID NO: 2595507 - DNA, 22 bp, Homo sapiens
cacttgccgcgtcgccctccca

SEQ ID NO: 2595508 - DNA, 12 bp, Homo sapiens
cacttggagcca

SEQ ID NO: 2595509 - DNA, 17 bp, Homo sapiens
cacttggcatcagctgg

SEQ ID NO: 2595510 - DNA, 16 bp, Homo sapiens
cacttggttgggtcct

SEQ ID NO: 2595511 - DNA, 19 bp, Homo sapiens
cacttggttgggtcctcac

SEQ ID NO: 2595512 - DNA, 21 bp, Homo sapiens
cacttggttgggtcctcacat

SEQ ID NO: 2595513 - DNA, 20 bp, Homo sapiens
cacttgtcccactatctggg

SEQ ID NO: 2595514 - DNA, 12 bp, Homo sapiens
cacttgtcccca

SEQ ID NO: 2595515 - DNA, 20 bp, Homo sapiens
cacttgtccccaaatccgaa

SEQ ID NO: 2595516 - DNA, 23 bp, Homo sapiens
cacttgtccccaaatccgaacct

SEQ ID NO: 2595517 - DNA, 15 bp, Homo sapiens
cacttgtgtgtgggc

SEQ ID NO: 2595518 - DNA, 22 bp, Homo sapiens
cacttgtgtgtgggctgtgagt

SEQ ID NO: 2595519 - DNA, 17 bp, Homo sapiens
cacttgttccagctctt

SEQ ID NO: 2595520 - DNA, 16 bp, Homo sapiens
cactttagatgctgat

SEQ ID NO: 2595521 - DNA, 19 bp, Homo sapiens
cactttcagtgaaagcatc

SEQ ID NO: 2595522 - DNA, 17 bp, Homo sapiens
cactttgcacagctctc

SEQ ID NO: 2595523 - DNA, 13 bp, Homo sapiens
cactttgctctgg

SEQ ID NO: 2595524 - DNA, 12 bp, Homo sapiens
cactttgggagg

SEQ ID NO: 2595525 - DNA, 13 bp, Homo sapiens
cactttgttctgg

SEQ ID NO: 2595526 - DNA, 16 bp, Homo sapiens
cactttgttctggctc

SEQ ID NO: 2595527 - DNA, 14 bp, Homo sapiens
cactttgttcttta

SEQ ID NO: 2595528 - DNA, 17 bp, Homo sapiens
cacttttaataaacttt

SEQ ID NO: 2595529 - DNA, 18 bp, Homo sapiens
cacttttgacaaaggcaa

SEQ ID NO: 2595530 - DNA, 15 bp, Homo sapiens
cagacatctctgcac

SEQ ID NO: 2595531 - DNA, 17 bp, Homo sapiens
cagacatctctgcaccc

SEQ ID NO: 2595532 - DNA, 14 bp, Homo sapiens
cagacccccacccc

SEQ ID NO: 2595533 - DNA, 17 bp, Homo sapiens
cagacccccaccccttc

SEQ ID NO: 2595534 - DNA, 21 bp, Homo sapiens
cagacccccaccccttcccca

SEQ ID NO: 2595535 - DNA, 22 bp, Homo sapiens
cagacccccaccccttccccac

SEQ ID NO: 2595536 - DNA, 13 bp, Homo sapiens
cagacccccagca

SEQ ID NO: 2595537 - DNA, 13 bp, Homo sapiens
cagacccctctgg

SEQ ID NO: 2595538 - DNA, 21 bp, Homo sapiens
cagacccctctggccaggatg

SEQ ID NO: 2595539 - DNA, 16 bp, Homo sapiens
cagaccctgccctgtg

SEQ ID NO: 2595540 - DNA, 21 bp, Homo sapiens
cagaccgaactgttgtataaa

SEQ ID NO: 2595541 - DNA, 13 bp, Homo sapiens
cagacctggagcc

SEQ ID NO: 2595542 - DNA, 17 bp, Homo sapiens
cagacctggagcccctg

SEQ ID NO: 2595543 - DNA, 17 bp, Homo sapiens
cagacctgtcctcctgg

SEQ ID NO: 2595544 - DNA, 21 bp, Homo sapiens
cagaccttctaggacgccacc

SEQ ID NO: 2595545 - DNA, 19 bp, Homo sapiens
cagaccttgttcacactct

SEQ ID NO: 2595546 - DNA, 15 bp, Homo sapiens
cagacctttgaggat

SEQ ID NO: 2595547 - DNA, 23 bp, Homo sapiens
cagacgccggggacagaggcctg

SEQ ID NO: 2595548 - DNA, 16 bp, Homo sapiens
cagacgcctgaggaac

SEQ ID NO: 2595549 - DNA, 22 bp, Homo sapiens
cagactcaaatgctcagaccag

SEQ ID NO: 2595550 - DNA, 16 bp, Homo sapiens
cagactcagtttgtca

SEQ ID NO: 2595551 - DNA, 17 bp, Homo sapiens
cagactcagtttgtcag

SEQ ID NO: 2595552 - DNA, 18 bp, Homo sapiens
cagactcagtttgtcaga

SEQ ID NO: 2595553 - DNA, 17 bp, Homo sapiens
cagactctacagaggcc

SEQ ID NO: 2595554 - DNA, 19 bp, Homo sapiens
cagactctacagaggccat

SEQ ID NO: 2595555 - DNA, 20 bp, Homo sapiens
cagactctacagaggccatg

SEQ ID NO: 2595556 - DNA, 12 bp, Homo sapiens
cagactctctgt

SEQ ID NO: 2595557 - DNA, 17 bp, Homo sapiens
cagactctctgtgaacc

SEQ ID NO: 2595558 - DNA, 14 bp, Homo sapiens
cagactctggtctt

SEQ ID NO: 2595559 - DNA, 18 bp, Homo sapiens
cagactgcatgtagttgg

SEQ ID NO: 2595560 - DNA, 21 bp, Homo sapiens
cagactggaagcacagcttca

SEQ ID NO: 2595561 - DNA, 17 bp, Homo sapiens
cagactggcacagtttt

SEQ ID NO: 2595562 - DNA, 23 bp, Homo sapiens
cagactggttgagttcaggtagc

SEQ ID NO: 2595563 - DNA, 12 bp, Homo sapiens
cagactgtgtat

SEQ ID NO: 2595564 - DNA, 14 bp, Homo sapiens
cagactgtgtattc

SEQ ID NO: 2595565 - DNA, 18 bp, Homo sapiens
cagacttaccaggaagca

SEQ ID NO: 2595566 - DNA, 21 bp, Homo sapiens
cagactttacatgacacagct

SEQ ID NO: 2595567 - DNA, 19 bp, Homo sapiens
cagactttggaaaatgcat

SEQ ID NO: 2595568 - DNA, 23 bp, Homo sapiens
cagactttggaaaatgcattgta

SEQ ID NO: 2595569 - DNA, 20 bp, Homo sapiens
cagagaaagaagagacagga

SEQ ID NO: 2595570 - DNA, 21 bp, Homo sapiens
cagagaaagaagagacaggag

SEQ ID NO: 2595571 - DNA, 13 bp, Homo sapiens
cagagaaagagga

SEQ ID NO: 2595572 - DNA, 23 bp, Homo sapiens
cagagaagagagtattgggtaga

SEQ ID NO: 2595573 - DNA, 14 bp, Homo sapiens
cacacccagcccac

SEQ ID NO: 2595574 - DNA, 14 bp, Homo sapiens
cacacccagctact

SEQ ID NO: 2595575 - DNA, 12 bp, Homo sapiens
cacacctccaca

SEQ ID NO: 2595576 - DNA, 14 bp, Homo sapiens
cacacctccctgaa

SEQ ID NO: 2595577 - DNA, 12 bp, Homo sapiens
cacacctctgcc

SEQ ID NO: 2595578 - DNA, 17 bp, Homo sapiens
cacacctgagccagcct

SEQ ID NO: 2595579 - DNA, 21 bp, Homo sapiens
cacacggaggcatctgcaccc

SEQ ID NO: 2595580 - DNA, 19 bp, Homo sapiens
cacacgtcatgtttcttca

SEQ ID NO: 2595581 - DNA, 19 bp, Homo sapiens
cacactagcctctccagga

SEQ ID NO: 2595582 - DNA, 17 bp, Homo sapiens
cacactattaccatgag

SEQ ID NO: 2595583 - DNA, 18 bp, Homo sapiens
cacactcactcctgagac

SEQ ID NO: 2595584 - DNA, 21 bp, Homo sapiens
cactcttattgcccacgctgg

SEQ ID NO: 2595585 - DNA, 14 bp, Homo sapiens
cactcttcctgagt

SEQ ID NO: 2595586 - DNA, 17 bp, Homo sapiens
cactcttcctgcaagga

SEQ ID NO: 2595587 - DNA, 22 bp, Homo sapiens
cactcttgtggatgttttaatt

SEQ ID NO: 2595588 - DNA, 15 bp, Homo sapiens
cactgaaaacatctg

SEQ ID NO: 2595589 - DNA, 20 bp, Homo sapiens
cactgaactttgctgagcct

SEQ ID NO: 2595590 - DNA, 17 bp, Homo sapiens
cactgaagctgggattc

SEQ ID NO: 2595591 - DNA, 19 bp, Homo sapiens
cactgaagttaacagagac

SEQ ID NO: 2595592 - DNA, 21 bp, Homo sapiens
cactgaatgcctcaatgtgac

SEQ ID NO: 2595593 - DNA, 14 bp, Homo sapiens
cactgacacctttg

SEQ ID NO: 2595594 - DNA, 17 bp, Homo sapiens
cactgacacctttgcag

SEQ ID NO: 2595595 - DNA, 15 bp, Homo sapiens
cactgacagcctccc

SEQ ID NO: 2595596 - DNA, 23 bp, Homo sapiens
cactgacattgttggccaaagcc

SEQ ID NO: 2595597 - DNA, 18 bp, Homo sapiens
cactgacctgtcatgccc

SEQ ID NO: 2595598 - DNA, 14 bp, Homo sapiens
cactgacttctaag

SEQ ID NO: 2595599 - DNA, 17 bp, Homo sapiens
cactgagaagattgtga

SEQ ID NO: 2595600 - DNA, 13 bp, Homo sapiens
cactgagacagcc

SEQ ID NO: 2595601 - DNA, 14 bp, Homo sapiens
cactgagacagccc

SEQ ID NO: 2595602 - DNA, 19 bp, Homo sapiens
cactgagacagcccgggct

SEQ ID NO: 2595603 - DNA, 18 bp, Homo sapiens
cactgagataccagcgag

SEQ ID NO: 2595604 - DNA, 12 bp, Homo sapiens
cactgagctcca

SEQ ID NO: 2595605 - DNA, 17 bp, Homo sapiens
cactgagctccatgtgc

SEQ ID NO: 2595606 - DNA, 15 bp, Homo sapiens
cactgagctgtcatg

SEQ ID NO: 2595607 - DNA, 16 bp, Homo sapiens
cactgaggcagggaag

SEQ ID NO: 2595608 - DNA, 13 bp, Homo sapiens
cactgagggccac

SEQ ID NO: 2595609 - DNA, 19 bp, Homo sapiens
attctgatttggaaaaaga

SEQ ID NO: 2595610 - DNA, 19 bp, Homo sapiens
attctgcaagcacatctgc

SEQ ID NO: 2595611 - DNA, 14 bp, Homo sapiens
attctgccaggccc

SEQ ID NO: 2595612 - DNA, 23 bp, Homo sapiens
attctgccaggcccccaagcctg

SEQ ID NO: 2595613 - DNA, 22 bp, Homo sapiens
attctgccgtgtgccctcgggc

SEQ ID NO: 2595614 - DNA, 11 bp, Homo sapiens
attctgcctgc

SEQ ID NO: 2595615 - DNA, 21 bp, Homo sapiens
attctgcctgcccaggcccct

SEQ ID NO: 2595616 - DNA, 15 bp, Homo sapiens
attctgctacctcac

SEQ ID NO: 2595617 - DNA, 19 bp, Homo sapiens
attctgctacctcactggg

SEQ ID NO: 2595618 - DNA, 18 bp, Homo sapiens
attctgctcacatatctg

SEQ ID NO: 2595619 - DNA, 19 bp, Homo sapiens
attctgctcacatatctgt

SEQ ID NO: 2595620 - DNA, 20 bp, Homo sapiens
attctgctcacatatctgtc

SEQ ID NO: 2595621 - DNA, 21 bp, Homo sapiens
attctggattttgtcaagcag

SEQ ID NO: 2595622 - DNA, 17 bp, Homo sapiens
attctggcctagtccct

SEQ ID NO: 2595623 - DNA, 14 bp, Homo sapiens
attctgtaaaatgt

SEQ ID NO: 2595624 - DNA, 12 bp, Homo sapiens
attctgtacata

SEQ ID NO: 2595625 - DNA, 18 bp, Homo sapiens
attctgtacatagcctat

SEQ ID NO: 2595626 - DNA, 15 bp, Homo sapiens
attctgtactgattt

SEQ ID NO: 2595627 - DNA, 21 bp, Homo sapiens
attctgtactgatttttgtaa

SEQ ID NO: 2595628 - DNA, 14 bp, Homo sapiens
attctgttggccag

SEQ ID NO: 2595629 - DNA, 16 bp, Homo sapiens
attcttacaaacatgt

SEQ ID NO: 2595630 - DNA, 15 bp, Homo sapiens
attcttacatgtttt

SEQ ID NO: 2595631 - DNA, 18 bp, Homo sapiens
attcttataaatatgaag

SEQ ID NO: 2595632 - DNA, 17 bp, Homo sapiens
attcttatttcatgaaa

SEQ ID NO: 2595633 - DNA, 21 bp, Homo sapiens
attcttccctatctttgccac

SEQ ID NO: 2595634 - DNA, 15 bp, Homo sapiens
attcttctctagctg

SEQ ID NO: 2595635 - DNA, 21 bp, Homo sapiens
attcttctcttccttttatca

SEQ ID NO: 2595636 - DNA, 13 bp, Homo sapiens
attcttctgaact

SEQ ID NO: 2595637 - DNA, 21 bp, Homo sapiens
attcttctgaactcaaactga

SEQ ID NO: 2595638 - DNA, 19 bp, Homo sapiens
attcttctgcttcagcctc

SEQ ID NO: 2595639 - DNA, 16 bp, Homo sapiens
attcttgcaaagtatc

SEQ ID NO: 2595640 - DNA, 17 bp, Homo sapiens
attctttaaatttcatc

SEQ ID NO: 2595641 - DNA, 13 bp, Homo sapiens
attctttatacaa

SEQ ID NO: 2595642 - DNA, 18 bp, Homo sapiens
attctttatacaacagtg

SEQ ID NO: 2595643 - DNA, 23 bp, Homo sapiens
attctttatacaacagtgctaaa

SEQ ID NO: 2595644 - DNA, 17 bp, Homo sapiens
attctttatcttgacat

SEQ ID NO: 2595645 - DNA, 19 bp, Homo sapiens
attctttcaagtgaatcta

SEQ ID NO: 2595646 - DNA, 17 bp, Homo sapiens
attctttccattatgat

SEQ ID NO: 2595647 - DNA, 13 bp, Homo sapiens
attctttcctgag

SEQ ID NO: 2595648 - DNA, 17 bp, Homo sapiens
attctttcctgaggctg

SEQ ID NO: 2595649 - DNA, 22 bp, Homo sapiens
attctttcctgaggctgggctc

SEQ ID NO: 2595650 - DNA, 15 bp, Homo sapiens
attctttctgtattg

SEQ ID NO: 2595651 - DNA, 13 bp, Homo sapiens
attctttgatgtt

SEQ ID NO: 2595652 - DNA, 14 bp, Homo sapiens
attctttgatgtta

SEQ ID NO: 2595653 - DNA, 22 bp, Homo sapiens
attgaaaaaatagagcctgagg

SEQ ID NO: 2595654 - DNA, 18 bp, Homo sapiens
attgaaagagaaccagtt

SEQ ID NO: 2595655 - DNA, 16 bp, Homo sapiens
attgaaatgactaaaa

SEQ ID NO: 2595656 - DNA, 17 bp, Homo sapiens
attgaaattgtacatat

SEQ ID NO: 2595657 - DNA, 22 bp, Homo sapiens
attgaacaagttgtttcattga

SEQ ID NO: 2595658 - DNA, 19 bp, Homo sapiens
attgaacttaaataaatgt

SEQ ID NO: 2595659 - DNA, 15 bp, Homo sapiens
attgaagccctccaa

SEQ ID NO: 2595660 - DNA, 19 bp, Homo sapiens
attgaagtattttgctgga

SEQ ID NO: 2595661 - DNA, 16 bp, Homo sapiens
attgaagtcagatgtg

SEQ ID NO: 2595662 - DNA, 18 bp, Homo sapiens
attgaagtcagatgtggt

SEQ ID NO: 2595663 - DNA, 23 bp, Homo sapiens
attgaatataatatatttgtgta

SEQ ID NO: 2595664 - DNA, 13 bp, Homo sapiens
attgaatcatgta

SEQ ID NO: 2595665 - DNA, 20 bp, Homo sapiens
attgaatcatgtagtatcaa

SEQ ID NO: 2595666 - DNA, 21 bp, Homo sapiens
attgaattatcttggttgaaa

SEQ ID NO: 2595667 - DNA, 20 bp, Homo sapiens
attgaattcttggttgagga

SEQ ID NO: 2595668 - DNA, 19 bp, Homo sapiens
attgacacttaaaaatggt

SEQ ID NO: 2595669 - DNA, 13 bp, Homo sapiens
attgacagaagct

SEQ ID NO: 2595670 - DNA, 18 bp, Homo sapiens
attgacccacaagaaatg

SEQ ID NO: 2595671 - DNA, 16 bp, Homo sapiens
attgacttcgactgtg

SEQ ID NO: 2595672 - DNA, 21 bp, Homo sapiens
attgagaattttaaattataa

SEQ ID NO: 2595673 - DNA, 22 bp, Homo sapiens
attgagagaatggaaaacagac

SEQ ID NO: 2595674 - DNA, 23 bp, Homo sapiens
attgataagagggcacacactgt

SEQ ID NO: 2595675 - DNA, 18 bp, Homo sapiens
attgatagagtgttatca

SEQ ID NO: 2595676 - DNA, 18 bp, Homo sapiens
attgatataaataaaaca

SEQ ID NO: 2595677 - DNA, 15 bp, Homo sapiens
attgatcaaattcat

SEQ ID NO: 2595678 - DNA, 17 bp, Homo sapiens
attgatcaaattcattt

SEQ ID NO: 2595679 - DNA, 16 bp, Homo sapiens
attgatggggaaggag

SEQ ID NO: 2595680 - DNA, 12 bp, Homo sapiens
attgattagaaa

SEQ ID NO: 2595681 - DNA, 13 bp, Homo sapiens
attgatttcaaga

SEQ ID NO: 2595682 - DNA, 16 bp, Homo sapiens
attgcaacaggctggg

SEQ ID NO: 2595683 - DNA, 18 bp, Homo sapiens
attgcaacaggctgggct

SEQ ID NO: 2595684 - DNA, 11 bp, Homo sapiens
attgcacaata

SEQ ID NO: 2595685 - DNA, 14 bp, Homo sapiens
attgcacagggaga

SEQ ID NO: 2595686 - DNA, 12 bp, Homo sapiens
attgcaccactg

SEQ ID NO: 2595687 - DNA, 23 bp, Homo sapiens
attgcaggagtccctgccatcat

SEQ ID NO: 2595688 - DNA, 16 bp, Homo sapiens
attgcaggtggaactc

SEQ ID NO: 2595689 - DNA, 18 bp, Homo sapiens
attgcagtttatcattca

SEQ ID NO: 2595690 - DNA, 16 bp, Homo sapiens
attgcatatatacata

SEQ ID NO: 2595691 - DNA, 15 bp, Homo sapiens
attgcatctcccaga

SEQ ID NO: 2595692 - DNA, 21 bp, Homo sapiens
attgcatctgggtagctgtaa

SEQ ID NO: 2595693 - DNA, 18 bp, Homo sapiens
attgccattccctgcctg

SEQ ID NO: 2595694 - DNA, 17 bp, Homo sapiens
attgcccacgctggagt

SEQ ID NO: 2595695 - DNA, 15 bp, Homo sapiens
attgcctgcagagag

SEQ ID NO: 2595696 - DNA, 18 bp, Homo sapiens
attgcggacagccacggc

SEQ ID NO: 2595697 - DNA, 19 bp, Homo sapiens
attgcggacagccacggcc

SEQ ID NO: 2595698 - DNA, 17 bp, Homo sapiens
attgctaaatgtaacag

SEQ ID NO: 2595699 - DNA, 15 bp, Homo sapiens
attgctaagatgctc

SEQ ID NO: 2595700 - DNA, 15 bp, Homo sapiens
attgctactgtccta

SEQ ID NO: 2595701 - DNA, 12 bp, Homo sapiens
attgctgcttga

SEQ ID NO: 2595702 - DNA, 22 bp, Homo sapiens
attgctggcaaagacagaagcc

SEQ ID NO: 2595703 - DNA, 12 bp, Homo sapiens
attgctgtgtat

SEQ ID NO: 2595704 - DNA, 15 bp, Homo sapiens
attgctgtgtatctg

SEQ ID NO: 2595705 - DNA, 16 bp, Homo sapiens
attgcttaaaatagca

SEQ ID NO: 2595706 - DNA, 16 bp, Homo sapiens
attgcttacattttta

SEQ ID NO: 2595707 - DNA, 21 bp, Homo sapiens
attgcttacatttttacaata

SEQ ID NO: 2595708 - DNA, 22 bp, Homo sapiens
attgcttacatttttacaataa

SEQ ID NO: 2595709 - DNA, 23 bp, Homo sapiens
attgcttgaaagaaaatatgcat

SEQ ID NO: 2595710 - DNA, 18 bp, Homo sapiens
attgcttgagcccaggag

SEQ ID NO: 2595711 - DNA, 14 bp, Homo sapiens
attgcttgagctca

SEQ ID NO: 2595712 - DNA, 16 bp, Homo sapiens
attgcttgttggattt

SEQ ID NO: 2595713 - DNA, 14 bp, Homo sapiens
attgctttccactg

SEQ ID NO: 2595714 - DNA, 11 bp, Homo sapiens
attgctttctg

SEQ ID NO: 2595715 - DNA, 13 bp, Homo sapiens
attgctttctgaa

SEQ ID NO: 2595716 - DNA, 16 bp, Homo sapiens
attgctttctgaaatt

SEQ ID NO: 2595717 - DNA, 21 bp, Homo sapiens
attgctttgaagcagttgtgt

SEQ ID NO: 2595718 - DNA, 18 bp, Homo sapiens
attggaagaaattcctgt

SEQ ID NO: 2595719 - DNA, 14 bp, Homo sapiens
attggaattaacct

SEQ ID NO: 2595720 - DNA, 16 bp, Homo sapiens
attggaattaacctgg

SEQ ID NO: 2595721 - DNA, 19 bp, Homo sapiens
attggaattaacctggtgc

SEQ ID NO: 2595722 - DNA, 22 bp, Homo sapiens
attggagaagtaatcctaggga

SEQ ID NO: 2595723 - DNA, 17 bp, Homo sapiens
attggagatagggaaag

SEQ ID NO: 2595724 - DNA, 22 bp, Homo sapiens
attggagggtaaatgatgtggt

SEQ ID NO: 2595725 - DNA, 22 bp, Homo sapiens
attggagggtgggagagcccag

SEQ ID NO: 2595726 - DNA, 18 bp, Homo sapiens
attggattattcatttaa

SEQ ID NO: 2595727 - DNA, 21 bp, Homo sapiens
attggattattcatttaaaat

SEQ ID NO: 2595728 - DNA, 22 bp, Homo sapiens
attggattattcatttaaaatg

SEQ ID NO: 2595729 - DNA, 14 bp, Homo sapiens
attggattatttaa

SEQ ID NO: 2595730 - DNA, 17 bp, Homo sapiens
attggattatttaataa

SEQ ID NO: 2595731 - DNA, 22 bp, Homo sapiens
attggctagaggttcaaagata

SEQ ID NO: 2595732 - DNA, 18 bp, Homo sapiens
attggctatttaaaactt

SEQ ID NO: 2595733 - DNA, 19 bp, Homo sapiens
attggctatttaaagacaa

SEQ ID NO: 2595734 - DNA, 17 bp, Homo sapiens
attggcttgtgtgtttc

SEQ ID NO: 2595735 - DNA, 20 bp, Homo sapiens
attgggaataaatatgcctc

SEQ ID NO: 2595736 - DNA, 18 bp, Homo sapiens
attgggagcttgggaatg

SEQ ID NO: 2595737 - DNA, 21 bp, Homo sapiens
attgggagcttgggaatggat

SEQ ID NO: 2595738 - DNA, 22 bp, Homo sapiens
attgggggctggtgccagcctt

SEQ ID NO: 2595739 - DNA, 16 bp, Homo sapiens
attggtaacatccttt

SEQ ID NO: 2595740 - DNA, 17 bp, Homo sapiens
attggtctcctctcagc

SEQ ID NO: 2595741 - DNA, 15 bp, Homo sapiens
attggttcttgtatt

SEQ ID NO: 2595742 - DNA, 21 bp, Homo sapiens
attgtaaaacctgtcaatgat

SEQ ID NO: 2595743 - DNA, 16 bp, Homo sapiens
attgtaaacatgtgtt

SEQ ID NO: 2595744 - DNA, 10 bp, Homo sapiens
attgtaaata

SEQ ID NO: 2595745 - DNA, 16 bp, Homo sapiens
attgtaaatatgtttt

SEQ ID NO: 2595746 - DNA, 13 bp, Homo sapiens
attgtaactgttc

SEQ ID NO: 2595747 - DNA, 21 bp, Homo sapiens
attgtaataatgctaaagaaa

SEQ ID NO: 2595748 - DNA, 13 bp, Homo sapiens
attgtaatcactg

SEQ ID NO: 2595749 - DNA, 17 bp, Homo sapiens
attgtaatgttactgat

SEQ ID NO: 2595750 - DNA, 14 bp, Homo sapiens
attgtacagctgtt

SEQ ID NO: 2595751 - DNA, 16 bp, Homo sapiens
attgtacagctgttta

SEQ ID NO: 2595752 - DNA, 13 bp, Homo sapiens
attgtacagtttt

SEQ ID NO: 2595753 - DNA, 15 bp, Homo sapiens
attgtacagttttta

SEQ ID NO: 2595754 - DNA, 21 bp, Homo sapiens
attgtacagtttttattgctt

SEQ ID NO: 2595755 - DNA, 19 bp, Homo sapiens
attgtacctctcttataga

SEQ ID NO: 2595756 - DNA, 14 bp, Homo sapiens
attgtaccttttaa

SEQ ID NO: 2595757 - DNA, 17 bp, Homo sapiens
attgtaccttttaacac

SEQ ID NO: 2595758 - DNA, 17 bp, Homo sapiens
attgtagagccagaggt

SEQ ID NO: 2595759 - DNA, 21 bp, Homo sapiens
attgtataaaaatagaagaat

SEQ ID NO: 2595760 - DNA, 18 bp, Homo sapiens
atttatgtagatgtgcat

SEQ ID NO: 2595761 - DNA, 20 bp, Homo sapiens
atttatgtagatgtgcattt

SEQ ID NO: 2595762 - DNA, 13 bp, Homo sapiens
atttatgtgtgag

SEQ ID NO: 2595763 - DNA, 23 bp, Homo sapiens
atttattaaaatgattgtaaaat

SEQ ID NO: 2595764 - DNA, 15 bp, Homo sapiens
atttattaagatgga

SEQ ID NO: 2595765 - DNA, 15 bp, Homo sapiens
atttattacctctga

SEQ ID NO: 2595766 - DNA, 16 bp, Homo sapiens
atttattagttaatat

SEQ ID NO: 2595767 - DNA, 16 bp, Homo sapiens
atttattattgaaatt

SEQ ID NO: 2595768 - DNA, 19 bp, Homo sapiens
atttattcaattcctctgg

SEQ ID NO: 2595769 - DNA, 18 bp, Homo sapiens
atttattcagcttcattt

SEQ ID NO: 2595770 - DNA, 12 bp, Homo sapiens
atttatttaata

SEQ ID NO: 2595771 - DNA, 21 bp, Homo sapiens
atttatttttctcatgaatct

SEQ ID NO: 2595772 - DNA, 14 bp, Homo sapiens
atttattttttaca

SEQ ID NO: 2595773 - DNA, 18 bp, Homo sapiens
atttattttttacattat

SEQ ID NO: 2595774 - DNA, 19 bp, Homo sapiens
atttcaaaaaaataaaata

SEQ ID NO: 2595775 - DNA, 23 bp, Homo sapiens
atttcaacaagtagctaaagtct

SEQ ID NO: 2595776 - DNA, 15 bp, Homo sapiens
atttcaagagattta

SEQ ID NO: 2595777 - DNA, 19 bp, Homo sapiens
atttcaagagatttaatta

SEQ ID NO: 2595778 - DNA, 16 bp, Homo sapiens
atttcaagttccaagt

SEQ ID NO: 2595779 - DNA, 13 bp, Homo sapiens
atttcacaacaga

SEQ ID NO: 2595780 - DNA, 22 bp, Homo sapiens
atttcacattaatatttgctga

SEQ ID NO: 2595781 - DNA, 20 bp, Homo sapiens
atttcacgtcgtcttctgta

SEQ ID NO: 2595782 - DNA, 18 bp, Homo sapiens
atttcactttagatgctg

SEQ ID NO: 2595783 - DNA, 18 bp, Homo sapiens
atttcatcatattataca

SEQ ID NO: 2595784 - DNA, 20 bp, Homo sapiens
atttcatcatattatacaga

SEQ ID NO: 2595785 - DNA, 15 bp, Homo sapiens
atttcatctatttct

SEQ ID NO: 2595786 - DNA, 18 bp, Homo sapiens
atttcatctatttctgag

SEQ ID NO: 2595787 - DNA, 14 bp, Homo sapiens
atttcatctatttt

SEQ ID NO: 2595788 - DNA, 14 bp, Homo sapiens
atttcatgaaaatt

SEQ ID NO: 2595789 - DNA, 15 bp, Homo sapiens
atttcatgatttcat

SEQ ID NO: 2595790 - DNA, 14 bp, Homo sapiens
atttcatgtgtcaa

SEQ ID NO: 2595791 - DNA, 14 bp, Homo sapiens
atttcattcctaac

SEQ ID NO: 2595792 - DNA, 12 bp, Homo sapiens
atttcatttctt

SEQ ID NO: 2595793 - DNA, 20 bp, Homo sapiens
atttccaacaccacagacac

SEQ ID NO: 2595794 - DNA, 21 bp, Homo sapiens
atttccaacaccacagacaca

SEQ ID NO: 2595795 - DNA, 15 bp, Homo sapiens
atttccaagagctga

SEQ ID NO: 2595796 - DNA, 16 bp, Homo sapiens
atttccaagagctgag

SEQ ID NO: 2595797 - DNA, 14 bp, Homo sapiens
atttccagccaggg

SEQ ID NO: 2595798 - DNA, 17 bp, Homo sapiens
atttccagtacctttgt

SEQ ID NO: 2595799 - DNA, 20 bp, Homo sapiens
atttccagtacctttgtcac

SEQ ID NO: 2595800 - DNA, 17 bp, Homo sapiens
atttccattccagaata

SEQ ID NO: 2595801 - DNA, 18 bp, Homo sapiens
atttcccaattaggaagt

SEQ ID NO: 2595802 - DNA, 15 bp, Homo sapiens
atttccccaacagtg

SEQ ID NO: 2595803 - DNA, 17 bp, Homo sapiens
atttcctggtgtgaagg

SEQ ID NO: 2595804 - DNA, 22 bp, Homo sapiens
atttcctgttggatttgtttaa

SEQ ID NO: 2595805 - DNA, 21 bp, Homo sapiens
atttctaaaaaacagaggcca

SEQ ID NO: 2595806 - DNA, 18 bp, Homo sapiens
atttctaccatttcagag

SEQ ID NO: 2595807 - DNA, 15 bp, Homo sapiens
atttctactctccca

SEQ ID NO: 2595808 - DNA, 18 bp, Homo sapiens
atttctactttgaagtca

SEQ ID NO: 2595809 - DNA, 23 bp, Homo sapiens
atttctagaacatccctgccagc

SEQ ID NO: 2595810 - DNA, 17 bp, Homo sapiens
atttctaggaagaattt

SEQ ID NO: 2595811 - DNA, 17 bp, Homo sapiens
atttctatgagaaaaga

SEQ ID NO: 2595812 - DNA, 12 bp, Homo sapiens
atttctatttat

SEQ ID NO: 2595813 - DNA, 15 bp, Homo sapiens
atttctatttctcct

SEQ ID NO: 2595814 - DNA, 20 bp, Homo sapiens
atttctatttctcctccatg

SEQ ID NO: 2595815 - DNA, 12 bp, Homo sapiens
atttctattttt

SEQ ID NO: 2595816 - DNA, 18 bp, Homo sapiens
atttctatttttgtagaa

SEQ ID NO: 2595817 - DNA, 16 bp, Homo sapiens
atttctcagactttgg

SEQ ID NO: 2595818 - DNA, 21 bp, Homo sapiens
atttctcagactttggaaaat

SEQ ID NO: 2595819 - DNA, 15 bp, Homo sapiens
atttctccatacgca

SEQ ID NO: 2595820 - DNA, 20 bp, Homo sapiens
atttctcctttgataaaata

SEQ ID NO: 2595821 - DNA, 21 bp, Homo sapiens
atttctcctttgataaaataa

SEQ ID NO: 2595822 - DNA, 19 bp, Homo sapiens
atttctctgatttgcaaaa

SEQ ID NO: 2595823 - DNA, 20 bp, Homo sapiens
atttctcttactgcaaatgt

SEQ ID NO: 2595824 - DNA, 15 bp, Homo sapiens
atttctgccttcctt

SEQ ID NO: 2595825 - DNA, 13 bp, Homo sapiens
atttcttaaacaa

SEQ ID NO: 2595826 - DNA, 13 bp, Homo sapiens
atttcttacaggc

SEQ ID NO: 2595827 - DNA, 11 bp, Homo sapiens
atttcttatag

SEQ ID NO: 2595828 - DNA, 13 bp, Homo sapiens
atttcttcactgt

SEQ ID NO: 2595829 - DNA, 21 bp, Homo sapiens
atttcttgagttttgttttaa

SEQ ID NO: 2595830 - DNA, 16 bp, Homo sapiens
atttcttgggccctcc

SEQ ID NO: 2595831 - DNA, 20 bp, Homo sapiens
atttcttgggccctcctgaa

SEQ ID NO: 2595832 - DNA, 18 bp, Homo sapiens
caatgatctaggtttaac

SEQ ID NO: 2595833 - DNA, 13 bp, Homo sapiens
caatgatggcaat

SEQ ID NO: 2595834 - DNA, 16 bp, Homo sapiens
caatgatggcaatttt

SEQ ID NO: 2595835 - DNA, 13 bp, Homo sapiens
caatgatggtcac

SEQ ID NO: 2595836 - DNA, 13 bp, Homo sapiens
caatgcactttgt

SEQ ID NO: 2595837 - DNA, 16 bp, Homo sapiens
caatgcatgcagccac

SEQ ID NO: 2595838 - DNA, 20 bp, Homo sapiens
caatgcatgcagccactgtg

SEQ ID NO: 2595839 - DNA, 22 bp, Homo sapiens
caatgccaaaaaaagacagggc

SEQ ID NO: 2595840 - DNA, 12 bp, Homo sapiens
caatgctggctg

SEQ ID NO: 2595841 - DNA, 13 bp, Homo sapiens
caatgctggctgt

SEQ ID NO: 2595842 - DNA, 17 bp, Homo sapiens
caatggaaactgaatgc

SEQ ID NO: 2595843 - DNA, 16 bp, Homo sapiens
caatggaacctccttt

SEQ ID NO: 2595844 - DNA, 13 bp, Homo sapiens
caatggatttgat

SEQ ID NO: 2595845 - DNA, 22 bp, Homo sapiens
caatggatttgatgctgtttga

SEQ ID NO: 2595846 - DNA, 11 bp, Homo sapiens
caatggcagcc

SEQ ID NO: 2595847 - DNA, 16 bp, Homo sapiens
caatggcagccttggc

SEQ ID NO: 2595848 - DNA, 16 bp, Homo sapiens
caatggcgcagtgcct

SEQ ID NO: 2595849 - DNA, 16 bp, Homo sapiens
caatggctaattccca

SEQ ID NO: 2595850 - DNA, 18 bp, Homo sapiens
caatggctaattcccaga

SEQ ID NO: 2595851 - DNA, 22 bp, Homo sapiens
caatggctgctgaagctgcctg

SEQ ID NO: 2595852 - DNA, 16 bp, Homo sapiens
attagagtgtctttcc

SEQ ID NO: 2595853 - DNA, 17 bp, Homo sapiens
attagagtgtctttcca

SEQ ID NO: 2595854 - DNA, 14 bp, Homo sapiens
attagatgtgattt

SEQ ID NO: 2595855 - DNA, 21 bp, Homo sapiens
attagatgtgatttaatagtg

SEQ ID NO: 2595856 - DNA, 22 bp, Homo sapiens
attagcaattgactgtcactgt

SEQ ID NO: 2595857 - DNA, 22 bp, Homo sapiens
attagccaggatcatggtgtaa

SEQ ID NO: 2595858 - DNA, 15 bp, Homo sapiens
attagccaggtaatg

SEQ ID NO: 2595859 - DNA, 16 bp, Homo sapiens
attagctgtgtgaaat

SEQ ID NO: 2595860 - DNA, 23 bp, Homo sapiens
attaggacaatcagtcccctccc

SEQ ID NO: 2595861 - DNA, 15 bp, Homo sapiens
attaggggttgctaa

SEQ ID NO: 2595862 - DNA, 21 bp, Homo sapiens
attaggttttgtacaattgaa

SEQ ID NO: 2595863 - DNA, 13 bp, Homo sapiens
attagtaacatgt

SEQ ID NO: 2595864 - DNA, 18 bp, Homo sapiens
attagtatttatttaatg

SEQ ID NO: 2595865 - DNA, 23 bp, Homo sapiens
attagtcattcaataaattgtaa

SEQ ID NO: 2595866 - DNA, 23 bp, Homo sapiens
attataattgtatcagaggccta

SEQ ID NO: 2595867 - DNA, 15 bp, Homo sapiens
attataatttaatgc

SEQ ID NO: 2595868 - DNA, 17 bp, Homo sapiens
attataatttaatgcat

SEQ ID NO: 2595869 - DNA, 15 bp, Homo sapiens
attatactaagaaaa

SEQ ID NO: 2595870 - DNA, 17 bp, Homo sapiens
attatactaagaaaaga

SEQ ID NO: 2595871 - DNA, 19 bp, Homo sapiens
attatactaagaaaagata

SEQ ID NO: 2595872 - DNA, 18 bp, Homo sapiens
attatactgtattaagag

SEQ ID NO: 2595873 - DNA, 21 bp, Homo sapiens
attatagatgggaatgaagct

SEQ ID NO: 2595874 - DNA, 16 bp, Homo sapiens
attataggccaaactg

SEQ ID NO: 2595875 - DNA, 13 bp, Homo sapiens
attatataggttg

SEQ ID NO: 2595876 - DNA, 23 bp, Homo sapiens
attatataggttgtgcaaattaa

SEQ ID NO: 2595877 - DNA, 16 bp, Homo sapiens
attatatctaattatt

SEQ ID NO: 2595878 - DNA, 13 bp, Homo sapiens
attatattaaaat

SEQ ID NO: 2595879 - DNA, 12 bp, Homo sapiens
attatcagatgc

SEQ ID NO: 2595880 - DNA, 19 bp, Homo sapiens
attatcatgtgtaatcaat

SEQ ID NO: 2595881 - DNA, 23 bp, Homo sapiens
attatcattttagaagactctac

SEQ ID NO: 2595882 - DNA, 16 bp, Homo sapiens
attatccttgctatga

SEQ ID NO: 2595883 - DNA, 22 bp, Homo sapiens
attatcgggaacagtgtttccc

SEQ ID NO: 2595884 - DNA, 16 bp, Homo sapiens
attatcgggagcagtg

SEQ ID NO: 2595885 - DNA, 19 bp, Homo sapiens
attatcgggagcagtgtct

SEQ ID NO: 2595886 - DNA, 17 bp, Homo sapiens
attatctaaagtgtgtt

SEQ ID NO: 2595887 - DNA, 15 bp, Homo sapiens
attatgacagttata

SEQ ID NO: 2595888 - DNA, 19 bp, Homo sapiens
attatgacagttatactgt

SEQ ID NO: 2595889 - DNA, 20 bp, Homo sapiens
attatgagaggcaatgattg

SEQ ID NO: 2595890 - DNA, 16 bp, Homo sapiens
attatggaagatttta

SEQ ID NO: 2595891 - DNA, 22 bp, Homo sapiens
attatgtaaaatgttttagcaa

SEQ ID NO: 2595892 - DNA, 16 bp, Homo sapiens
attatgtatgtttaca

SEQ ID NO: 2595893 - DNA, 17 bp, Homo sapiens
attatgtatgtttacat

SEQ ID NO: 2595894 - DNA, 17 bp, Homo sapiens
attatgtccactgtgta

SEQ ID NO: 2595895 - DNA, 14 bp, Homo sapiens
attattaatgaaaa

SEQ ID NO: 2595896 - DNA, 13 bp, Homo sapiens
atgtttatttata

SEQ ID NO: 2595897 - DNA, 13 bp, Homo sapiens
atgtttccaacct

SEQ ID NO: 2595898 - DNA, 20 bp, Homo sapiens
atgtttcgtgaagtatactg

SEQ ID NO: 2595899 - DNA, 17 bp, Homo sapiens
atgtttctctggcccca

SEQ ID NO: 2595900 - DNA, 19 bp, Homo sapiens
atgtttctctggccccaag

SEQ ID NO: 2595901 - DNA, 22 bp, Homo sapiens
atgtttcttctaggttctaaaa

SEQ ID NO: 2595902 - DNA, 14 bp, Homo sapiens
atgtttgcctctgc

SEQ ID NO: 2595903 - DNA, 15 bp, Homo sapiens
atgtttgcctctgcc

SEQ ID NO: 2595904 - DNA, 18 bp, Homo sapiens
atgtttgcctctgcctct

SEQ ID NO: 2595905 - DNA, 23 bp, Homo sapiens
atgtttgtcctgaacacttttgt

SEQ ID NO: 2595906 - DNA, 16 bp, Homo sapiens
atgtttgtggcctcag

SEQ ID NO: 2595907 - DNA, 17 bp, Homo sapiens
atgtttgtggcctcaga

SEQ ID NO: 2595908 - DNA, 21 bp, Homo sapiens
atgttttaaacatagaaagtt

SEQ ID NO: 2595909 - DNA, 15 bp, Homo sapiens
atgttttaacaaaaa

SEQ ID NO: 2595910 - DNA, 16 bp, Homo sapiens
atgttttaacaaaaac

SEQ ID NO: 2595911 - DNA, 14 bp, Homo sapiens
atgttttaattcca

SEQ ID NO: 2595912 - DNA, 19 bp, Homo sapiens
atgttttaattccatgaat

SEQ ID NO: 2595913 - DNA, 20 bp, Homo sapiens
atgttttaccgtaataatta

SEQ ID NO: 2595914 - DNA, 16 bp, Homo sapiens
atgttttactgtgaaa

SEQ ID NO: 2595915 - DNA, 19 bp, Homo sapiens
atgttttagacaaatactc

SEQ ID NO: 2595916 - DNA, 23 bp, Homo sapiens
atgttttagacaaatactcatgt

SEQ ID NO: 2595917 - DNA, 14 bp, Homo sapiens
atgttttagagtta

SEQ ID NO: 2595918 - DNA, 16 bp, Homo sapiens
atgttttccagctcct

SEQ ID NO: 2595919 - DNA, 20 bp, Homo sapiens
atgttttccattgtttgaaa

SEQ ID NO: 2595920 - DNA, 18 bp, Homo sapiens
atgttttctgaaaatata

SEQ ID NO: 2595921 - DNA, 12 bp, Homo sapiens
atgttttgataa

SEQ ID NO: 2595922 - DNA, 22 bp, Homo sapiens
atgttttgataaagtagtaaaa

SEQ ID NO: 2595923 - DNA, 19 bp, Homo sapiens
atgttttgtgactatatag

SEQ ID NO: 2595924 - DNA, 18 bp, Homo sapiens
atgtttttaaaagtttca

SEQ ID NO: 2595925 - DNA, 20 bp, Homo sapiens
atgtttttaaaagtttcaat

SEQ ID NO: 2595926 - DNA, 12 bp, Homo sapiens
atgtttttgaag

SEQ ID NO: 2595927 - DNA, 19 bp, Homo sapiens
atgtttttgaaggcagaaa

SEQ ID NO: 2595928 - DNA, 21 bp, Homo sapiens
atgtttttgaaggcagaaagc

SEQ ID NO: 2595929 - DNA, 12 bp, Homo sapiens
attaaaaaacaa

SEQ ID NO: 2595930 - DNA, 23 bp, Homo sapiens
atgaggaataattatttatttaa

SEQ ID NO: 2595931 - DNA, 13 bp, Homo sapiens
atgaggacatgtt

SEQ ID NO: 2595932 - DNA, 22 bp, Homo sapiens
atgaggcatttgtttgaactga

SEQ ID NO: 2595933 - DNA, 18 bp, Homo sapiens
atgaggcctcagtggact

SEQ ID NO: 2595934 - DNA, 23 bp, Homo sapiens
atgaggcctcttggacctctgct

SEQ ID NO: 2595935 - DNA, 11 bp, Homo sapiens
atgagggccac

SEQ ID NO: 2595936 - DNA, 17 bp, Homo sapiens
atgaggtactgagagtg

SEQ ID NO: 2595937 - DNA, 15 bp, Homo sapiens
atgaggtcagagcct

SEQ ID NO: 2595938 - DNA, 14 bp, Homo sapiens
atgaggtcccaggc

SEQ ID NO: 2595939 - DNA, 15 bp, Homo sapiens
atgaggtcccaggca

SEQ ID NO: 2595940 - DNA, 16 bp, Homo sapiens
atgaggtcccaggcag

SEQ ID NO: 2595941 - DNA, 17 bp, Homo sapiens
atgaggtcccaggcaga

SEQ ID NO: 2595942 - DNA, 17 bp, Homo sapiens
atgaggtctgaaatgga

SEQ ID NO: 2595943 - DNA, 22 bp, Homo sapiens
atgaggttcaactgttgattgc

SEQ ID NO: 2595944 - DNA, 20 bp, Homo sapiens
atgagtccttgaaaatattt

SEQ ID NO: 2595945 - DNA, 17 bp, Homo sapiens
atgagtggctttaatga

SEQ ID NO: 2595946 - DNA, 15 bp, Homo sapiens
atgagtttcatagct

SEQ ID NO: 2595947 - DNA, 14 bp, Homo sapiens
atgagtttgcttat

SEQ ID NO: 2595948 - DNA, 13 bp, Homo sapiens
atgagtttttgat

SEQ ID NO: 2595949 - DNA, 19 bp, Homo sapiens
atgagtttttgatagcttt

SEQ ID NO: 2595950 - DNA, 21 bp, Homo sapiens
atgagtttttgatagctttat

SEQ ID NO: 2595951 - DNA, 15 bp, Homo sapiens
atgataaaacacaaa

SEQ ID NO: 2595952 - DNA, 13 bp, Homo sapiens
atgatatgtaaac

SEQ ID NO: 2595953 - DNA, 15 bp, Homo sapiens
atgatcacggctcac

SEQ ID NO: 2595954 - DNA, 19 bp, Homo sapiens
atgatcacggctcactgca

SEQ ID NO: 2595955 - DNA, 22 bp, Homo sapiens
atgatcactaatactaattcat

SEQ ID NO: 2595956 - DNA, 15 bp, Homo sapiens
atgatcctaatgaat

SEQ ID NO: 2595957 - DNA, 16 bp, Homo sapiens
atgatctactcagaaa

SEQ ID NO: 2595958 - DNA, 20 bp, Homo sapiens
atgatctaggaagactttgg

SEQ ID NO: 2595959 - DNA, 17 bp, Homo sapiens
atgatctaggtttaact

SEQ ID NO: 2595960 - DNA, 14 bp, Homo sapiens
atgatcttctttat

SEQ ID NO: 2595961 - DNA, 18 bp, Homo sapiens
atgatcttctttataatt

SEQ ID NO: 2595962 - DNA, 16 bp, Homo sapiens
atgatctttaaaatac

SEQ ID NO: 2595963 - DNA, 20 bp, Homo sapiens
atgatctttctttcctttct

SEQ ID NO: 2595964 - DNA, 18 bp, Homo sapiens
atgatgccaacctctgga

SEQ ID NO: 2595965 - DNA, 13 bp, Homo sapiens
atgatgtatattt

SEQ ID NO: 2595966 - DNA, 16 bp, Homo sapiens
atgatgtatttttgta

SEQ ID NO: 2595967 - DNA, 14 bp, Homo sapiens
atgatgtccagaag

SEQ ID NO: 2595968 - DNA, 23 bp, Homo sapiens
atgatgtggagtggggcagtaga

SEQ ID NO: 2595969 - DNA, 24 bp, Homo sapiens
atgatgttttccatgagtcccctg

SEQ ID NO: 2595970 - DNA, 19 bp, Homo sapiens
atgattaaccacttcagct

SEQ ID NO: 2595971 - DNA, 20 bp, Homo sapiens
atgattaaccacttcagctg

SEQ ID NO: 2595972 - DNA, 23 bp, Homo sapiens
atgattagcaagttacagtgatg

SEQ ID NO: 2595973 - DNA, 23 bp, Homo sapiens
atgattcgcccaaagccagacag

SEQ ID NO: 2595974 - DNA, 14 bp, Homo sapiens
atgattgtaaaata

SEQ ID NO: 2595975 - DNA, 15 bp, Homo sapiens
atgattgtaaaatag

SEQ ID NO: 2595976 - DNA, 13 bp, Homo sapiens
atgatttaataaa

SEQ ID NO: 2595977 - DNA, 14 bp, Homo sapiens
atgatttaataaaa

SEQ ID NO: 2595978 - DNA, 22 bp, Homo sapiens
atgatttaataaaataattcta

SEQ ID NO: 2595979 - DNA, 15 bp, Homo sapiens
atgatttatagtttg

SEQ ID NO: 2595980 - DNA, 20 bp, Homo sapiens
atgatttatagtttgtacat

SEQ ID NO: 2595981 - DNA, 21 bp, Homo sapiens
atgatttcatgctatctctgt

SEQ ID NO: 2595982 - DNA, 13 bp, Homo sapiens
atgatttcattca

SEQ ID NO: 2595983 - DNA, 16 bp, Homo sapiens
atgattttatttgaca

SEQ ID NO: 2595984 - DNA, 13 bp, Homo sapiens
atgatttttagat

SEQ ID NO: 2595985 - DNA, 21 bp, Homo sapiens
atgcaaaataatacctgtcca

SEQ ID NO: 2595986 - DNA, 14 bp, Homo sapiens
atgcaaagaggcaa

SEQ ID NO: 2595987 - DNA, 15 bp, Homo sapiens
atgcaaagaggcaag

SEQ ID NO: 2595988 - DNA, 13 bp, Homo sapiens
atgcaaagcactg

SEQ ID NO: 2595989 - DNA, 14 bp, Homo sapiens
atgcaaagcactga

SEQ ID NO: 2595990 - DNA, 15 bp, Homo sapiens
atgcaaagcactgac

SEQ ID NO: 2595991 - DNA, 14 bp, Homo sapiens
atgcaaaggctggg

SEQ ID NO: 2595992 - DNA, 11 bp, Homo sapiens
atgcaaatcct

SEQ ID NO: 2595993 - DNA, 14 bp, Homo sapiens
atgcaacaacatgt

SEQ ID NO: 2595994 - DNA, 21 bp, Homo sapiens
atgcaacaacatgtataatat

SEQ ID NO: 2595995 - DNA, 18 bp, Homo sapiens
atgcaaggaaggaaagaa

SEQ ID NO: 2595996 - DNA, 22 bp, Homo sapiens
atgcaaggaccaggactccctc

SEQ ID NO: 2595997 - DNA, 14 bp, Homo sapiens
atgcaaggtcattt

SEQ ID NO: 2595998 - DNA, 22 bp, Homo sapiens
atgcaaggtcattttttttaag

SEQ ID NO: 2595999 - DNA, 22 bp, Homo sapiens
atgcaatatatctaaattgaat

SEQ ID NO: 2596000 - DNA, 19 bp, Homo sapiens
atgcaatgacatcttcaaa

SEQ ID NO: 2596001 - DNA, 17 bp, Homo sapiens
atgcaatgtgctactga

SEQ ID NO: 2596002 - DNA, 16 bp, Homo sapiens
atgcacaaaaagatgc

SEQ ID NO: 2596003 - DNA, 15 bp, Homo sapiens
atgcacacaaaacaa

SEQ ID NO: 2596004 - DNA, 16 bp, Homo sapiens
atgcacacctccccct

SEQ ID NO: 2596005 - DNA, 17 bp, Homo sapiens
atgcacagagttgttac

SEQ ID NO: 2596006 - DNA, 18 bp, Homo sapiens
atgcacagagttgttaca

SEQ ID NO: 2596007 - DNA, 21 bp, Homo sapiens
atgcacagagttgttacattt

SEQ ID NO: 2596008 - DNA, 18 bp, Homo sapiens
atgcacatatggactctg

SEQ ID NO: 2596009 - DNA, 14 bp, Homo sapiens
atgcaccagccctt

SEQ ID NO: 2596010 - DNA, 15 bp, Homo sapiens
atgcaccttgtgtct

SEQ ID NO: 2596011 - DNA, 21 bp, Homo sapiens
atgcaccttgtgtctgtacac

SEQ ID NO: 2596012 - DNA, 22 bp, Homo sapiens
atgcacgtgtgcacacacacca

SEQ ID NO: 2596013 - DNA, 16 bp, Homo sapiens
atgcactttgttctgg

SEQ ID NO: 2596014 - DNA, 21 bp, Homo sapiens
atgcactttgttctggctctt

SEQ ID NO: 2596015 - DNA, 22 bp, Homo sapiens
atgcagacatgagtgcgtgctc

SEQ ID NO: 2596016 - DNA, 20 bp, Homo sapiens
atgcagagagccattttgtg

SEQ ID NO: 2596017 - DNA, 23 bp, Homo sapiens
atgcagagagccattttgtgaat

SEQ ID NO: 2596018 - DNA, 21 bp, Homo sapiens
atgcagagcgccgtgagttct

SEQ ID NO: 2596019 - DNA, 23 bp, Homo sapiens
atgcagagcgccgtgagttctca

SEQ ID NO: 2596020 - DNA, 15 bp, Homo sapiens
atgcagagtcagcag

SEQ ID NO: 2596021 - DNA, 15 bp, Homo sapiens
atgcagcccatgccc

SEQ ID NO: 2596022 - DNA, 23 bp, Homo sapiens
atgcagcccatgcccacctgccc

SEQ ID NO: 2596023 - DNA, 22 bp, Homo sapiens
atgcagcgaaccaatatttgta

SEQ ID NO: 2596024 - DNA, 15 bp, Homo sapiens
atgcagctgcaccct

SEQ ID NO: 2596025 - DNA, 21 bp, Homo sapiens
atgcagctgcaccctccctcc

SEQ ID NO: 2596026 - DNA, 20 bp, Homo sapiens
atgcagggattgctgccact

SEQ ID NO: 2596027 - DNA, 22 bp, Homo sapiens
atgcagtgatatggcagaagac

SEQ ID NO: 2596028 - DNA, 21 bp, Homo sapiens
atgcataaatatgcagtgata

SEQ ID NO: 2596029 - DNA, 10 bp, Homo sapiens
atgcatacac

SEQ ID NO: 2596030 - DNA, 12 bp, Homo sapiens
atgcatacacac

SEQ ID NO: 2596031 - DNA, 15 bp, Homo sapiens
atgcatattgtatta

SEQ ID NO: 2596032 - DNA, 18 bp, Homo sapiens
atgcatcattcttgttaa

SEQ ID NO: 2596033 - DNA, 16 bp, Homo sapiens
atgcatcttactgaag

SEQ ID NO: 2596034 - DNA, 17 bp, Homo sapiens
atgcatgcactgttccc

SEQ ID NO: 2596035 - DNA, 12 bp, Homo sapiens
atgcatggaaac

SEQ ID NO: 2596036 - DNA, 23 bp, Homo sapiens
atgcatggaaacctgaaaaaaag

SEQ ID NO: 2596037 - DNA, 12 bp, Homo sapiens
atgcatggaaat

SEQ ID NO: 2596038 - DNA, 16 bp, Homo sapiens
atgcatggaaattccc

SEQ ID NO: 2596039 - DNA, 23 bp, Homo sapiens
atgcatggagggctgccctgtac

SEQ ID NO: 2596040 - DNA, 17 bp, Homo sapiens
atgcatgtcctgtaaag

SEQ ID NO: 2596041 - DNA, 21 bp, Homo sapiens
atgcattcttggttggctggc

SEQ ID NO: 2596042 - DNA, 15 bp, Homo sapiens
atgcattgttgaggt

SEQ ID NO: 2596043 - DNA, 12 bp, Homo sapiens
atgcatttgaaa

SEQ ID NO: 2596044 - DNA, 18 bp, Homo sapiens
atgcatttgaaaattttg

SEQ ID NO: 2596045 - DNA, 19 bp, Homo sapiens
atgcattttgcagcagtga

SEQ ID NO: 2596046 - DNA, 18 bp, Homo sapiens
atgccaaagctagggtgg

SEQ ID NO: 2596047 - DNA, 21 bp, Homo sapiens
atgccaagcactgtgctcagg

SEQ ID NO: 2596048 - DNA, 23 bp, Homo sapiens
atgccaagttgtttgagaaatta

SEQ ID NO: 2596049 - DNA, 22 bp, Homo sapiens
atgccaattagcaattgactgt

SEQ ID NO: 2596050 - DNA, 16 bp, Homo sapiens
atgccacacagagtgg

SEQ ID NO: 2596051 - DNA, 17 bp, Homo sapiens
atgccacgggaagttta

SEQ ID NO: 2596052 - DNA, 15 bp, Homo sapiens
atgccactaaattga

SEQ ID NO: 2596053 - DNA, 22 bp, Homo sapiens
atgccagagacggaagcctttt

SEQ ID NO: 2596054 - DNA, 12 bp, Homo sapiens
atgccaggacac

SEQ ID NO: 2596055 - DNA, 21 bp, Homo sapiens
atgccatcctcaaacactgca

SEQ ID NO: 2596056 - DNA, 17 bp, Homo sapiens
atgccatggacagaaga

SEQ ID NO: 2596057 - DNA, 19 bp, Homo sapiens
atgccatggacagaagaag

SEQ ID NO: 2596058 - DNA, 21 bp, Homo sapiens
atgccatttaaagcttattaa

SEQ ID NO: 2596059 - DNA, 21 bp, Homo sapiens
atgcccacctgcccatcacag

SEQ ID NO: 2596060 - DNA, 20 bp, Homo sapiens
atgcccagagggcccaggca

SEQ ID NO: 2596061 - DNA, 17 bp, Homo sapiens
atgcccagccccttctg

SEQ ID NO: 2596062 - DNA, 19 bp, Homo sapiens
atgcccagtttctgcctct

SEQ ID NO: 2596063 - DNA, 13 bp, Homo sapiens
atgcccccagctg

SEQ ID NO: 2596064 - DNA, 15 bp, Homo sapiens
atgcccccagctggc

SEQ ID NO: 2596065 - DNA, 22 bp, Homo sapiens
atgcccccctcaaacctcctct

SEQ ID NO: 2596066 - DNA, 18 bp, Homo sapiens
atgccccctttcagatgt

SEQ ID NO: 2596067 - DNA, 20 bp, Homo sapiens
atgcccctgtactccagcct

SEQ ID NO: 2596068 - DNA, 21 bp, Homo sapiens
atgccgaatgccctcagggga

SEQ ID NO: 2596069 - DNA, 20 bp, Homo sapiens
atgccggtgagaataagaga

SEQ ID NO: 2596070 - DNA, 16 bp, Homo sapiens
atgcctctcctttgta

SEQ ID NO: 2596071 - DNA, 11 bp, Homo sapiens
atgcctggtgg

SEQ ID NO: 2596072 - DNA, 12 bp, Homo sapiens
atgcctggtggc

SEQ ID NO: 2596073 - DNA, 21 bp, Homo sapiens
atgcctggtggcagctgcggt

SEQ ID NO: 2596074 - DNA, 15 bp, Homo sapiens
atggctggccactgc

SEQ ID NO: 2596075 - DNA, 21 bp, Homo sapiens
atggctggccactgcacagag

SEQ ID NO: 2596076 - DNA, 13 bp, Homo sapiens
atggctgtgagga

SEQ ID NO: 2596077 - DNA, 15 bp, Homo sapiens
atggctgtgaggatg

SEQ ID NO: 2596078 - DNA, 18 bp, Homo sapiens
atggcttatccagctggt

SEQ ID NO: 2596079 - DNA, 18 bp, Homo sapiens
atggcttttgtgcattat

SEQ ID NO: 2596080 - DNA, 20 bp, Homo sapiens
atgggaaagcattgtaaatg

SEQ ID NO: 2596081 - DNA, 17 bp, Homo sapiens
atgggaaagccacctct

SEQ ID NO: 2596082 - DNA, 23 bp, Homo sapiens
atgggaaagccacctctccctca

SEQ ID NO: 2596083 - DNA, 17 bp, Homo sapiens
atgggaaggagggaggt

SEQ ID NO: 2596084 - DNA, 13 bp, Homo sapiens
atgggaatgaagc

SEQ ID NO: 2596085 - DNA, 13 bp, Homo sapiens
atgggacattttt

SEQ ID NO: 2596086 - DNA, 23 bp, Homo sapiens
atgggacttcttttcacattctt

SEQ ID NO: 2596087 - DNA, 22 bp, Homo sapiens
atgggagaaatagtgtggaaat

SEQ ID NO: 2596088 - DNA, 15 bp, Homo sapiens
ataacaattcctcta

SEQ ID NO: 2596089 - DNA, 11 bp, Homo sapiens
ataacacacat

SEQ ID NO: 2596090 - DNA, 13 bp, Homo sapiens
ataacaggttatt

SEQ ID NO: 2596091 - DNA, 14 bp, Homo sapiens
ataacaggttattt

SEQ ID NO: 2596092 - DNA, 16 bp, Homo sapiens
ataacagtaaatgtgc

SEQ ID NO: 2596093 - DNA, 20 bp, Homo sapiens
ataacagtgcatattccttt

SEQ ID NO: 2596094 - DNA, 14 bp, Homo sapiens
ataacattacctta

SEQ ID NO: 2596095 - DNA, 23 bp, Homo sapiens
ataaccacaaagcacagtttgaa

SEQ ID NO: 2596096 - DNA, 13 bp, Homo sapiens
ataaccacttaaa

SEQ ID NO: 2596097 - DNA, 13 bp, Homo sapiens
ataacgccccaga

SEQ ID NO: 2596098 - DNA, 21 bp, Homo sapiens
ataacgccccagataccagcc

SEQ ID NO: 2596099 - DNA, 16 bp, Homo sapiens
ataactactgtgttcc

SEQ ID NO: 2596100 - DNA, 18 bp, Homo sapiens
ataactactgtgttcctg

SEQ ID NO: 2596101 - DNA, 19 bp, Homo sapiens
ataactactgtgttcctgg

SEQ ID NO: 2596102 - DNA, 15 bp, Homo sapiens
ataactcatcataaa

SEQ ID NO: 2596103 - DNA, 17 bp, Homo sapiens
ataactcatcataaaat

SEQ ID NO: 2596104 - DNA, 15 bp, Homo sapiens
ataactgaaaatgtg

SEQ ID NO: 2596105 - DNA, 18 bp, Homo sapiens
ataactgttatttataat

SEQ ID NO: 2596106 - DNA, 12 bp, Homo sapiens
ataacttaaaaa

SEQ ID NO: 2596107 - DNA, 16 bp, Homo sapiens
ataacttaaaaaaatg

SEQ ID NO: 2596108 - DNA, 21 bp, Homo sapiens
ataacttaaaaatgtaaatat

SEQ ID NO: 2596109 - DNA, 20 bp, Homo sapiens
ataacttatattgtaagaaa

SEQ ID NO: 2596110 - DNA, 22 bp, Homo sapiens
ataacttatattgtaagaaata

SEQ ID NO: 2596111 - DNA, 16 bp, Homo sapiens
ataacttcaagcaaac

SEQ ID NO: 2596112 - DNA, 17 bp, Homo sapiens
ataacttcttaaaagtt

SEQ ID NO: 2596113 - DNA, 19 bp, Homo sapiens
ataacttcttaaaagttgt

SEQ ID NO: 2596114 - DNA, 12 bp, Homo sapiens
ataactttgctt

SEQ ID NO: 2596115 - DNA, 18 bp, Homo sapiens
ataacttttttttaagtt

SEQ ID NO: 2596116 - DNA, 11 bp, Homo sapiens
ataagaaaaga

SEQ ID NO: 2596117 - DNA, 21 bp, Homo sapiens
ataagaaaagatgtagattta

SEQ ID NO: 2596118 - DNA, 21 bp, Homo sapiens
ataagaatgctggttttccta

SEQ ID NO: 2596119 - DNA, 22 bp, Homo sapiens
ataagaatgctggttttcctaa

SEQ ID NO: 2596120 - DNA, 17 bp, Homo sapiens
ataagaattattttgat

SEQ ID NO: 2596121 - DNA, 23 bp, Homo sapiens
ataagacataacgtttttccttt

SEQ ID NO: 2596122 - DNA, 20 bp, Homo sapiens
ataagagagaacaactactg

SEQ ID NO: 2596123 - DNA, 19 bp, Homo sapiens
ataagagggcacacactgt

SEQ ID NO: 2596124 - DNA, 16 bp, Homo sapiens
ataagatatttttcat

SEQ ID NO: 2596125 - DNA, 13 bp, Homo sapiens
ataagattagaat

SEQ ID NO: 2596126 - DNA, 14 bp, Homo sapiens
ataagccagacatc

SEQ ID NO: 2596127 - DNA, 17 bp, Homo sapiens
ataaggccttaatatgt

SEQ ID NO: 2596128 - DNA, 16 bp, Homo sapiens
ataagtatttcaaatt

SEQ ID NO: 2596129 - DNA, 14 bp, Homo sapiens
ataagtcatgttcc

SEQ ID NO: 2596130 - DNA, 17 bp, Homo sapiens
ataagttaacttccaat

SEQ ID NO: 2596131 - DNA, 13 bp, Homo sapiens
ataagttattgca

SEQ ID NO: 2596132 - DNA, 14 bp, Homo sapiens
ataagttattgcag

SEQ ID NO: 2596133 - DNA, 20 bp, Homo sapiens
ataagttattgcagtttatc

SEQ ID NO: 2596134 - DNA, 12 bp, Homo sapiens
ataagtttattt

SEQ ID NO: 2596135 - DNA, 20 bp, Homo sapiens
ataagtttcactgacttaga

SEQ ID NO: 2596136 - DNA, 15 bp, Homo sapiens
ataagtttgaaggaa

SEQ ID NO: 2596137 - DNA, 18 bp, Homo sapiens
ataagtttgcaatttggg

SEQ ID NO: 2596138 - DNA, 13 bp, Homo sapiens
ataagttttatgt

SEQ ID NO: 2596139 - DNA, 20 bp, Homo sapiens
ataataaaaggaaaagcaaa

SEQ ID NO: 2596140 - DNA, 12 bp, Homo sapiens
ataataaacttt

SEQ ID NO: 2596141 - DNA, 14 bp, Homo sapiens
ataataaagtgttt

SEQ ID NO: 2596142 - DNA, 18 bp, Homo sapiens
ataatacaccactacatt

SEQ ID NO: 2596143 - DNA, 23 bp, Homo sapiens
ataatacaccactacattctgtt

SEQ ID NO: 2596144 - DNA, 17 bp, Homo sapiens
ataatacagccaaagat

SEQ ID NO: 2596145 - DNA, 18 bp, Homo sapiens
ataatataccaatgcttt

SEQ ID NO: 2596146 - DNA, 14 bp, Homo sapiens
ataatatatttgtg

SEQ ID NO: 2596147 - DNA, 12 bp, Homo sapiens
ataatatgagaa

SEQ ID NO: 2596148 - DNA, 12 bp, Homo sapiens
ataatatgcaca

SEQ ID NO: 2596149 - DNA, 21 bp, Homo sapiens
ataatatgctgccaaattttg

SEQ ID NO: 2596150 - DNA, 14 bp, Homo sapiens
ataatatttttaat

SEQ ID NO: 2596151 - DNA, 17 bp, Homo sapiens
ataatcagcctcttaaa

SEQ ID NO: 2596152 - DNA, 15 bp, Homo sapiens
ataatctagaacaca

SEQ ID NO: 2596153 - DNA, 14 bp, Homo sapiens
ataatctatttcta

SEQ ID NO: 2596154 - DNA, 21 bp, Homo sapiens
ataatctatttctatgagaaa

SEQ ID NO: 2596155 - DNA, 14 bp, Homo sapiens
ataatctgtacaat

SEQ ID NO: 2596156 - DNA, 20 bp, Homo sapiens
ataatcttctgccttctcat

SEQ ID NO: 2596157 - DNA, 13 bp, Homo sapiens
ataatctttgggt

SEQ ID NO: 2596158 - DNA, 22 bp, Homo sapiens
ataatgatgatgggaattgtgt

SEQ ID NO: 2596159 - DNA, 15 bp, Homo sapiens
ataatggtaccagat

SEQ ID NO: 2596160 - DNA, 22 bp, Homo sapiens
ataatggtcccatccaggcagt

SEQ ID NO: 2596161 - DNA, 14 bp, Homo sapiens
ataatgtaagctct

SEQ ID NO: 2596162 - DNA, 15 bp, Homo sapiens
ataatgtaagctcta

SEQ ID NO: 2596163 - DNA, 22 bp, Homo sapiens
ataatgtataaagaacaaggta

SEQ ID NO: 2596164 - DNA, 19 bp, Homo sapiens
ataatgtgaaactggatta

SEQ ID NO: 2596165 - DNA, 16 bp, Homo sapiens
ataatgttaaatttgt

SEQ ID NO: 2596166 - DNA, 18 bp, Homo sapiens
ataatgttaaatttgtaa

SEQ ID NO: 2596167 - DNA, 19 bp, Homo sapiens
ataatgttgttatttaaag

SEQ ID NO: 2596168 - DNA, 13 bp, Homo sapiens
ataatgtttgcta

SEQ ID NO: 2596169 - DNA, 16 bp, Homo sapiens
ataattatgacagtta

SEQ ID NO: 2596170 - DNA, 19 bp, Homo sapiens
ataattatgacagttatac

SEQ ID NO: 2596171 - DNA, 20 bp, Homo sapiens
ataattatgacagttatact

SEQ ID NO: 2596172 - DNA, 16 bp, Homo sapiens
ataattatttatttaa

SEQ ID NO: 2596173 - DNA, 18 bp, Homo sapiens
ataattatttatttaata

SEQ ID NO: 2596174 - DNA, 15 bp, Homo sapiens
ataattctgtactga

SEQ ID NO: 2596175 - DNA, 14 bp, Homo sapiens
ataattgatcaaat

SEQ ID NO: 2596176 - DNA, 12 bp, Homo sapiens
ataattgtatca

SEQ ID NO: 2596177 - DNA, 21 bp, Homo sapiens
ataattgtatcgtatagctgt

SEQ ID NO: 2596178 - DNA, 22 bp, Homo sapiens
ataattgtatcgtatagctgta

SEQ ID NO: 2596179 - DNA, 21 bp, Homo sapiens
ataatttcccaattaggaagt

SEQ ID NO: 2596180 - DNA, 15 bp, Homo sapiens
ataattttatgaatg

SEQ ID NO: 2596181 - DNA, 15 bp, Homo sapiens
ataatttttaaagta

SEQ ID NO: 2596182 - DNA, 22 bp, Homo sapiens
atacaaaaaaaaaaaaaaatta

SEQ ID NO: 2596183 - DNA, 15 bp, Homo sapiens
atacaaaagcatgtg

SEQ ID NO: 2596184 - DNA, 16 bp, Homo sapiens
atacaaacaatggaaa

SEQ ID NO: 2596185 - DNA, 18 bp, Homo sapiens
atacaaacaatggaaact

SEQ ID NO: 2596186 - DNA, 19 bp, Homo sapiens
atacaaacatatttgttaa

SEQ ID NO: 2596187 - DNA, 14 bp, Homo sapiens
atacaacagtgcta

SEQ ID NO: 2596188 - DNA, 20 bp, Homo sapiens
atacaacatgtagctgagtt

SEQ ID NO: 2596189 - DNA, 22 bp, Homo sapiens
atacaaccctggcattatgtcc

SEQ ID NO: 2596190 - DNA, 17 bp, Homo sapiens
atacaatgctgtgccct

SEQ ID NO: 2596191 - DNA, 23 bp, Homo sapiens
atacaatgctgtgccctaaagtg

SEQ ID NO: 2596192 - DNA, 15 bp, Homo sapiens
atacaattctacatt

SEQ ID NO: 2596193 - DNA, 15 bp, Homo sapiens
atacacaacacacac

SEQ ID NO: 2596194 - DNA, 15 bp, Homo sapiens
atacacaagtaaaca

SEQ ID NO: 2596195 - DNA, 11 bp, Homo sapiens
atacacacaca

SEQ ID NO: 2596196 - DNA, 19 bp, Homo sapiens
atacacacacacacacagc

SEQ ID NO: 2596197 - DNA, 23 bp, Homo sapiens
atacacacacacacacagccaca

SEQ ID NO: 2596198 - DNA, 13 bp, Homo sapiens
atacacacagtta

SEQ ID NO: 2596199 - DNA, 19 bp, Homo sapiens
atacacacatatgtcatat

SEQ ID NO: 2596200 - DNA, 18 bp, Homo sapiens
atacaccactacattctg

SEQ ID NO: 2596201 - DNA, 17 bp, Homo sapiens
atacacgaggtatgagg

SEQ ID NO: 2596202 - DNA, 13 bp, Homo sapiens
atacacttacact

SEQ ID NO: 2596203 - DNA, 22 bp, Homo sapiens
atacacttattggaactctgct

SEQ ID NO: 2596204 - DNA, 15 bp, Homo sapiens
atacagacactaagt

SEQ ID NO: 2596205 - DNA, 23 bp, Homo sapiens
atacagacactaagttatagtat

SEQ ID NO: 2596206 - DNA, 20 bp, Homo sapiens
atacagaccgaactgttgta

SEQ ID NO: 2596207 - DNA, 20 bp, Homo sapiens
atacagcattacaaattgct

SEQ ID NO: 2596208 - DNA, 22 bp, Homo sapiens
atacaggaaaagctgctgacag

SEQ ID NO: 2596209 - DNA, 18 bp, Homo sapiens
atacagtaactttatgtg

SEQ ID NO: 2596210 - DNA, 20 bp, Homo sapiens
atacagtccctaaagaaaaa

SEQ ID NO: 2596211 - DNA, 22 bp, Homo sapiens
atacagtccctaaagaaaaaaa

SEQ ID NO: 2596212 - DNA, 18 bp, Homo sapiens
atacagttactcagaatt

SEQ ID NO: 2596213 - DNA, 16 bp, Homo sapiens
atacagttgttggcct

SEQ ID NO: 2596214 - DNA, 20 bp, Homo sapiens
atacagttgttggcctccgg

SEQ ID NO: 2596215 - DNA, 21 bp, Homo sapiens
atacatattttatagaacttc

SEQ ID NO: 2596216 - DNA, 16 bp, Homo sapiens
atacatgactcagcat

SEQ ID NO: 2596217 - DNA, 15 bp, Homo sapiens
atacatgctgctaat

SEQ ID NO: 2596218 - DNA, 20 bp, Homo sapiens
atacatggttgtgacctgag

SEQ ID NO: 2596219 - DNA, 21 bp, Homo sapiens
atacatgtgccgaatgtgcag

SEQ ID NO: 2596220 - DNA, 15 bp, Homo sapiens
atacatttataatgt

SEQ ID NO: 2596221 - DNA, 20 bp, Homo sapiens
atacatttataatgtttgct

SEQ ID NO: 2596222 - DNA, 23 bp, Homo sapiens
atacatttataatgtttgctatt

SEQ ID NO: 2596223 - DNA, 19 bp, Homo sapiens
atacatttgaggggaaaac

SEQ ID NO: 2596224 - DNA, 17 bp, Homo sapiens
ataccagccagtaaatg

SEQ ID NO: 2596225 - DNA, 22 bp, Homo sapiens
ataccagcccctgtatggcact

SEQ ID NO: 2596226 - DNA, 16 bp, Homo sapiens
ataccagcgaggaggc

SEQ ID NO: 2596227 - DNA, 19 bp, Homo sapiens
ataccatggtgaattaatc

SEQ ID NO: 2596228 - DNA, 14 bp, Homo sapiens
atacccaaatcctc

SEQ ID NO: 2596229 - DNA, 17 bp, Homo sapiens
atacccacccccaccca

SEQ ID NO: 2596230 - DNA, 15 bp, Homo sapiens
atacccatgaactta

SEQ ID NO: 2596231 - DNA, 21 bp, Homo sapiens
atacctacatgtatttgtttg

SEQ ID NO: 2596232 - DNA, 15 bp, Homo sapiens
atacctcaacctatg

SEQ ID NO: 2596233 - DNA, 16 bp, Homo sapiens
atacctcttagctgag

SEQ ID NO: 2596234 - DNA, 20 bp, Homo sapiens
atacctcttagctgagtgga

SEQ ID NO: 2596235 - DNA, 11 bp, Homo sapiens
atacctgccct

SEQ ID NO: 2596236 - DNA, 15 bp, Homo sapiens
atacctgtccccctg

SEQ ID NO: 2596237 - DNA, 17 bp, Homo sapiens
atacctgtccccctgac

SEQ ID NO: 2596238 - DNA, 18 bp, Homo sapiens
atacctgtccccctgaca

SEQ ID NO: 2596239 - DNA, 22 bp, Homo sapiens
tgggacttcttttcacattctt

SEQ ID NO: 2596240 - DNA, 22 bp, Homo sapiens
tgggagaatgtcagtatgtgga

SEQ ID NO: 2596241 - DNA, 19 bp, Homo sapiens
tgggagacacccaaagggt

SEQ ID NO: 2596242 - DNA, 18 bp, Homo sapiens
tgggagacctgtaatcat

SEQ ID NO: 2596243 - DNA, 21 bp, Homo sapiens
tgggagagagacgtgtacata

SEQ ID NO: 2596244 - DNA, 16 bp, Homo sapiens
tgggagagccttccag

SEQ ID NO: 2596245 - DNA, 14 bp, Homo sapiens
tgggagccccaggg

SEQ ID NO: 2596246 - DNA, 13 bp, Homo sapiens
tgggagctcctct

SEQ ID NO: 2596247 - DNA, 13 bp, Homo sapiens
tgggagctgcctg

SEQ ID NO: 2596248 - DNA, 23 bp, Homo sapiens
tgggagctgcctgttcagctcca

SEQ ID NO: 2596249 - DNA, 19 bp, Homo sapiens
tgggagctggttagaaatg

SEQ ID NO: 2596250 - DNA, 11 bp, Homo sapiens
tgggaggaagc

SEQ ID NO: 2596251 - DNA, 13 bp, Homo sapiens
tgggaggaagcag

SEQ ID NO: 2596252 - DNA, 18 bp, Homo sapiens
tgggaggatctcttgagc

SEQ ID NO: 2596253 - DNA, 16 bp, Homo sapiens
tgggaggccccactgg

SEQ ID NO: 2596254 - DNA, 18 bp, Homo sapiens
tgggaggcctaggcgggc

SEQ ID NO: 2596255 - DNA, 22 bp, Homo sapiens
tgggaggcggagagtacagtga

SEQ ID NO: 2596256 - DNA, 22 bp, Homo sapiens
tgggaggctcacccccttctcc

SEQ ID NO: 2596257 - DNA, 15 bp, Homo sapiens
tgggaggctgaggcg

SEQ ID NO: 2596258 - DNA, 18 bp, Homo sapiens
tgggaggtcaaggctgca

SEQ ID NO: 2596259 - DNA, 20 bp, Homo sapiens
tgggaggtggaggttgcagt

SEQ ID NO: 2596260 - DNA, 13 bp, Homo sapiens
tgggagtcccctt

SEQ ID NO: 2596261 - DNA, 11 bp, Homo sapiens
tgggagtgtgt

SEQ ID NO: 2596262 - DNA, 13 bp, Homo sapiens
tgggagtgtgtaa

SEQ ID NO: 2596263 - DNA, 21 bp, Homo sapiens
tgggataggaaaaatgagtaa

SEQ ID NO: 2596264 - DNA, 12 bp, Homo sapiens
tgggatcctcca

SEQ ID NO: 2596265 - DNA, 13 bp, Homo sapiens
tgggatcctccag

SEQ ID NO: 2596266 - DNA, 16 bp, Homo sapiens
tgggatgagccgctgt

SEQ ID NO: 2596267 - DNA, 18 bp, Homo sapiens
tgggatgattggaggggg

SEQ ID NO: 2596268 - DNA, 14 bp, Homo sapiens
tgggatgcttgcct

SEQ ID NO: 2596269 - DNA, 20 bp, Homo sapiens
tgggatgcttgcctagggcc

SEQ ID NO: 2596270 - DNA, 14 bp, Homo sapiens
tgggatgtttctgt

SEQ ID NO: 2596271 - DNA, 22 bp, Homo sapiens
tgggattacaagcgtgagccac

SEQ ID NO: 2596272 - DNA, 21 bp, Homo sapiens
tgggattacagggatgagcca

SEQ ID NO: 2596273 - DNA, 19 bp, Homo sapiens
tgggattgggggctggtgc

SEQ ID NO: 2596274 - DNA, 15 bp, Homo sapiens
tgggcaaacaggcag

SEQ ID NO: 2596275 - DNA, 15 bp, Homo sapiens
tgggcaaagagtgta

SEQ ID NO: 2596276 - DNA, 12 bp, Homo sapiens
tgggcaacagag

SEQ ID NO: 2596277 - DNA, 14 bp, Homo sapiens
tgggcaacagagca

SEQ ID NO: 2596278 - DNA, 16 bp, Homo sapiens
tgggcacacgcctccc

SEQ ID NO: 2596279 - DNA, 21 bp, Homo sapiens
tgggcacacgcctcccactgg

SEQ ID NO: 2596280 - DNA, 22 bp, Homo sapiens
tgggcacacgcctcccactggg

SEQ ID NO: 2596281 - DNA, 16 bp, Homo sapiens
tgggcacccaccctgg

SEQ ID NO: 2596282 - DNA, 16 bp, Homo sapiens
tgggcactgggatgag

SEQ ID NO: 2596283 - DNA, 22 bp, Homo sapiens
tgggcactgggatgagccgctg

SEQ ID NO: 2596284 - DNA, 16 bp, Homo sapiens
tgggcagaaggccaag

SEQ ID NO: 2596285 - DNA, 18 bp, Homo sapiens
tgggcagaaggccaagag

SEQ ID NO: 2596286 - DNA, 18 bp, Homo sapiens
tgggcagaagggagaagg

SEQ ID NO: 2596287 - DNA, 15 bp, Homo sapiens
tgggcagagcagaga

SEQ ID NO: 2596288 - DNA, 18 bp, Homo sapiens
tgggcagagcagagacca

SEQ ID NO: 2596289 - DNA, 15 bp, Homo sapiens
tgggcagatctaccc

SEQ ID NO: 2596290 - DNA, 13 bp, Homo sapiens
tgggcaggacctc

SEQ ID NO: 2596291 - DNA, 16 bp, Homo sapiens
tgggcaggacctcaga

SEQ ID NO: 2596292 - DNA, 17 bp, Homo sapiens
tgggcaggactcagctc

SEQ ID NO: 2596293 - DNA, 14 bp, Homo sapiens
tgggcaggtggtgg

SEQ ID NO: 2596294 - DNA, 15 bp, Homo sapiens
tgggcaggtggtggc

SEQ ID NO: 2596295 - DNA, 15 bp, Homo sapiens
tgggcagttacatgc

SEQ ID NO: 2596296 - DNA, 17 bp, Homo sapiens
tgggcagttacatgcat

SEQ ID NO: 2596297 - DNA, 22 bp, Homo sapiens
tgggcatagatgcaggtgagcc

SEQ ID NO: 2596298 - DNA, 15 bp, Homo sapiens
tgggcatggggtggg

SEQ ID NO: 2596299 - DNA, 20 bp, Homo sapiens
tgggcatggggtgggcctct

SEQ ID NO: 2596300 - DNA, 12 bp, Homo sapiens
tgggcattgctt

SEQ ID NO: 2596301 - DNA, 15 bp, Homo sapiens
tgggcattgctttcc

SEQ ID NO: 2596302 - DNA, 16 bp, Homo sapiens
tgggcatttgtgaggc

SEQ ID NO: 2596303 - DNA, 20 bp, Homo sapiens
tgggccaagtcaaagacatt

SEQ ID NO: 2596304 - DNA, 16 bp, Homo sapiens
tgggcccaaccctgtc

SEQ ID NO: 2596305 - DNA, 18 bp, Homo sapiens
tgggcccaaccctgtctg

SEQ ID NO: 2596306 - DNA, 23 bp, Homo sapiens
tgggcccaagacagatgccccag

SEQ ID NO: 2596307 - DNA, 12 bp, Homo sapiens
tgggcccagctg

SEQ ID NO: 2596308 - DNA, 13 bp, Homo sapiens
tgggcccagctgg

SEQ ID NO: 2596309 - DNA, 16 bp, Homo sapiens
tgggcccagctgggct

SEQ ID NO: 2596310 - DNA, 14 bp, Homo sapiens
tgggcccaggacca

SEQ ID NO: 2596311 - DNA, 15 bp, Homo sapiens
tgggcccaggaccag

SEQ ID NO: 2596312 - DNA, 17 bp, Homo sapiens
tgggccccagcccaccc

SEQ ID NO: 2596313 - DNA, 20 bp, Homo sapiens
tgggccccagcccaccctcc

SEQ ID NO: 2596314 - DNA, 18 bp, Homo sapiens
tgggccctctctgctctg

SEQ ID NO: 2596315 - DNA, 18 bp, Homo sapiens
tgggccctgcctctgttt

SEQ ID NO: 2596316 - DNA, 13 bp, Homo sapiens
tgggcctcctcac

SEQ ID NO: 2596317 - DNA, 20 bp, Homo sapiens
tgggcctcctcacaacatgg

SEQ ID NO: 2596318 - DNA, 21 bp, Homo sapiens
tgggcctctggtttggggcga

SEQ ID NO: 2596319 - DNA, 15 bp, Homo sapiens
tgggcgccctggaag

SEQ ID NO: 2596320 - DNA, 20 bp, Homo sapiens
tgggcgccctggaagccggc

SEQ ID NO: 2596321 - DNA, 18 bp, Homo sapiens
tgggcggctgagagcccc

SEQ ID NO: 2596322 - DNA, 19 bp, Homo sapiens
tgggcgtggtcactgctgt

SEQ ID NO: 2596323 - DNA, 13 bp, Homo sapiens
tgggctacaagga

SEQ ID NO: 2596324 - DNA, 16 bp, Homo sapiens
tgggctactttgtcct

SEQ ID NO: 2596325 - DNA, 14 bp, Homo sapiens
tgggctcgcccacc

SEQ ID NO: 2596326 - DNA, 19 bp, Homo sapiens
tgggctctgacagaaagca

SEQ ID NO: 2596327 - DNA, 20 bp, Homo sapiens
tgggctctgcaattcccctc

SEQ ID NO: 2596328 - DNA, 13 bp, Homo sapiens
tgggctctgccac

SEQ ID NO: 2596329 - DNA, 17 bp, Homo sapiens
tgggctctgccccagct

SEQ ID NO: 2596330 - DNA, 21 bp, Homo sapiens
tgggctctgccccagctctgg

SEQ ID NO: 2596331 - DNA, 23 bp, Homo sapiens
tgggctctgccccagctctggct

SEQ ID NO: 2596332 - DNA, 17 bp, Homo sapiens
tgggctgaacactccaa

SEQ ID NO: 2596333 - DNA, 18 bp, Homo sapiens
tgggctgacggtgcagtc

SEQ ID NO: 2596334 - DNA, 15 bp, Homo sapiens
tgggctgagactgga

SEQ ID NO: 2596335 - DNA, 17 bp, Homo sapiens
tgggctgagcccctacc

SEQ ID NO: 2596336 - DNA, 18 bp, Homo sapiens
tgggctgagcccctaccc

SEQ ID NO: 2596337 - DNA, 15 bp, Homo sapiens
tgggctgagccctgg

SEQ ID NO: 2596338 - DNA, 16 bp, Homo sapiens
tgggctgagggagcct

SEQ ID NO: 2596339 - DNA, 19 bp, Homo sapiens
tgggctgggttctacccag

SEQ ID NO: 2596340 - DNA, 14 bp, Homo sapiens
tgggcttagagcag

SEQ ID NO: 2596341 - DNA, 23 bp, Homo sapiens
tgggcttcactgtataaatagga

SEQ ID NO: 2596342 - DNA, 17 bp, Homo sapiens
tgggcttcagtggcagc

SEQ ID NO: 2596343 - DNA, 13 bp, Homo sapiens
tgggcttcatctg

SEQ ID NO: 2596344 - DNA, 21 bp, Homo sapiens
tgggcttcccagtggctgctg

SEQ ID NO: 2596345 - DNA, 17 bp, Homo sapiens
tggggaagactgtggct

SEQ ID NO: 2596346 - DNA, 13 bp, Homo sapiens
tggggaaggaggc

SEQ ID NO: 2596347 - DNA, 16 bp, Homo sapiens
tggggaagtgaggaag

SEQ ID NO: 2596348 - DNA, 16 bp, Homo sapiens
tggggaatttcctcta

SEQ ID NO: 2596349 - DNA, 17 bp, Homo sapiens
tggggacagagcagaac

SEQ ID NO: 2596350 - DNA, 12 bp, Homo sapiens
tggggagaaagt

SEQ ID NO: 2596351 - DNA, 15 bp, Homo sapiens
tggggagcagagaca

SEQ ID NO: 2596352 - DNA, 22 bp, Homo sapiens
tggggaggcggacgttccagcc

SEQ ID NO: 2596353 - DNA, 22 bp, Homo sapiens
tggggagggatttggggctcag

SEQ ID NO: 2596354 - DNA, 20 bp, Homo sapiens
tggggaggggcgctggccca

SEQ ID NO: 2596355 - DNA, 16 bp, Homo sapiens
tggggatagatgtgtg

SEQ ID NO: 2596356 - DNA, 18 bp, Homo sapiens
tggggatagatgtgtgga

SEQ ID NO: 2596357 - DNA, 20 bp, Homo sapiens
tggggatagatgtgtggaca

SEQ ID NO: 2596358 - DNA, 21 bp, Homo sapiens
tggggatcacagagacattcc

SEQ ID NO: 2596359 - DNA, 14 bp, Homo sapiens
tggggatctcaggg

SEQ ID NO: 2596360 - DNA, 15 bp, Homo sapiens
tggggatgtgggagg

SEQ ID NO: 2596361 - DNA, 16 bp, Homo sapiens
tggggatgtgggaggg

SEQ ID NO: 2596362 - DNA, 12 bp, Homo sapiens
tggggcaaggct

SEQ ID NO: 2596363 - DNA, 19 bp, Homo sapiens
tggggcaagtccctgactc

SEQ ID NO: 2596364 - DNA, 13 bp, Homo sapiens
tggggcagcttga

SEQ ID NO: 2596365 - DNA, 14 bp, Homo sapiens
tggggcaggcagtg

SEQ ID NO: 2596366 - DNA, 17 bp, Homo sapiens
tggggcaggctggctgg

SEQ ID NO: 2596367 - DNA, 20 bp, Homo sapiens
tggggccagttggtccccct

SEQ ID NO: 2596368 - DNA, 21 bp, Homo sapiens
tggggcccctttttactcccc

SEQ ID NO: 2596369 - DNA, 15 bp, Homo sapiens
tggggcctggacctg

SEQ ID NO: 2596370 - DNA, 20 bp, Homo sapiens
tggggcctggacctgcctcc

SEQ ID NO: 2596371 - DNA, 14 bp, Homo sapiens
tggggccttggcct

SEQ ID NO: 2596372 - DNA, 18 bp, Homo sapiens
tggaaatgggcagagcag

SEQ ID NO: 2596373 - DNA, 18 bp, Homo sapiens
tggaaattcccttcatct

SEQ ID NO: 2596374 - DNA, 16 bp, Homo sapiens
tggaacagaatgtttt

SEQ ID NO: 2596375 - DNA, 21 bp, Homo sapiens
tggaacagaatgttttactgt

SEQ ID NO: 2596376 - DNA, 20 bp, Homo sapiens
tggaacagattcacactgtc

SEQ ID NO: 2596377 - DNA, 20 bp, Homo sapiens
tggaacataaaatacaatgt

SEQ ID NO: 2596378 - DNA, 23 bp, Homo sapiens
tggaaccgcaggaagctgctccg

SEQ ID NO: 2596379 - DNA, 13 bp, Homo sapiens
tggaacctccttt

SEQ ID NO: 2596380 - DNA, 21 bp, Homo sapiens
tggaactcattcctgcctgtc

SEQ ID NO: 2596381 - DNA, 11 bp, Homo sapiens
tggaagacaca

SEQ ID NO: 2596382 - DNA, 13 bp, Homo sapiens
tggaagacagaga

SEQ ID NO: 2596383 - DNA, 20 bp, Homo sapiens
tggaagacagagacctcctg

SEQ ID NO: 2596384 - DNA, 13 bp, Homo sapiens
tggaagaccccac

SEQ ID NO: 2596385 - DNA, 15 bp, Homo sapiens
tggaagaccccaccc

SEQ ID NO: 2596386 - DNA, 23 bp, Homo sapiens
tggaagagcctgcaggtgctgct

SEQ ID NO: 2596387 - DNA, 16 bp, Homo sapiens
tggaagaggggacagg

SEQ ID NO: 2596388 - DNA, 16 bp, Homo sapiens
tggaagattttaaatt

SEQ ID NO: 2596389 - DNA, 18 bp, Homo sapiens
tggaagcaacaggaatca

SEQ ID NO: 2596390 - DNA, 15 bp, Homo sapiens
tggaagccagctttc

SEQ ID NO: 2596391 - DNA, 17 bp, Homo sapiens
tggaagccggagggtgt

SEQ ID NO: 2596392 - DNA, 20 bp, Homo sapiens
tggaagctagctcccctcct

SEQ ID NO: 2596393 - DNA, 17 bp, Homo sapiens
tggaagctgccctgccc

SEQ ID NO: 2596394 - DNA, 22 bp, Homo sapiens
tggaaggaccacattttatatt

SEQ ID NO: 2596395 - DNA, 18 bp, Homo sapiens
tggaagggttctggctgc

SEQ ID NO: 2596396 - DNA, 17 bp, Homo sapiens
tggaagtgactttggct

SEQ ID NO: 2596397 - DNA, 13 bp, Homo sapiens
tggaagttttcag

SEQ ID NO: 2596398 - DNA, 14 bp, Homo sapiens
tggaagttttgcat

SEQ ID NO: 2596399 - DNA, 13 bp, Homo sapiens
tggaataaaatac

SEQ ID NO: 2596400 - DNA, 20 bp, Homo sapiens
tggaatactaaaaatcatga

SEQ ID NO: 2596401 - DNA, 22 bp, Homo sapiens
tggaatactaaaaatcatgaga

SEQ ID NO: 2596402 - DNA, 17 bp, Homo sapiens
tggaatagtatcctcca

SEQ ID NO: 2596403 - DNA, 22 bp, Homo sapiens
tggaatagtatcctccaggttt

SEQ ID NO: 2596404 - DNA, 13 bp, Homo sapiens
tggaatataaaga

SEQ ID NO: 2596405 - DNA, 13 bp, Homo sapiens
tggaatctggaga

SEQ ID NO: 2596406 - DNA, 20 bp, Homo sapiens
tggaatgcttcttctcaggc

SEQ ID NO: 2596407 - DNA, 17 bp, Homo sapiens
tggaatggttataaaag

SEQ ID NO: 2596408 - DNA, 18 bp, Homo sapiens
tggaatggttataaaagt

SEQ ID NO: 2596409 - DNA, 14 bp, Homo sapiens
tggaatgtaatcaa

SEQ ID NO: 2596410 - DNA, 21 bp, Homo sapiens
tggaatgtggcccctgaacaa

SEQ ID NO: 2596411 - DNA, 17 bp, Homo sapiens
tggaattaacctggtgc

SEQ ID NO: 2596412 - DNA, 18 bp, Homo sapiens
tggaattaacctggtgct

SEQ ID NO: 2596413 - DNA, 18 bp, Homo sapiens
tggaatttgtaacctcag

SEQ ID NO: 2596414 - DNA, 14 bp, Homo sapiens
tggacacagctctt

SEQ ID NO: 2596415 - DNA, 16 bp, Homo sapiens
tggacacagctcttct

SEQ ID NO: 2596416 - DNA, 21 bp, Homo sapiens
tggacacagctcttctccagg

SEQ ID NO: 2596417 - DNA, 22 bp, Homo sapiens
tggacacagctcttctccaggc

SEQ ID NO: 2596418 - DNA, 23 bp, Homo sapiens
tggacacagctcttctccaggct

SEQ ID NO: 2596419 - DNA, 12 bp, Homo sapiens
tggacagaagaa

SEQ ID NO: 2596420 - DNA, 18 bp, Homo sapiens
tggacagaagcagctctt

SEQ ID NO: 2596421 - DNA, 17 bp, Homo sapiens
tggacaggcatgttctc

SEQ ID NO: 2596422 - DNA, 13 bp, Homo sapiens
tggacagtcctgg

SEQ ID NO: 2596423 - DNA, 14 bp, Homo sapiens
tggacatagagagg

SEQ ID NO: 2596424 - DNA, 12 bp, Homo sapiens
tggacatggccc

SEQ ID NO: 2596425 - DNA, 17 bp, Homo sapiens
tggacatttgccttgct

SEQ ID NO: 2596426 - DNA, 19 bp, Homo sapiens
tggacatttgccttgctgg

SEQ ID NO: 2596427 - DNA, 15 bp, Homo sapiens
tggaccccagctggg

SEQ ID NO: 2596428 - DNA, 16 bp, Homo sapiens
tggaccccagctggga

SEQ ID NO: 2596429 - DNA, 23 bp, Homo sapiens
tggaccccagctgggaggcaaga

SEQ ID NO: 2596430 - DNA, 20 bp, Homo sapiens
tggaccccatctgtgaataa

SEQ ID NO: 2596431 - DNA, 16 bp, Homo sapiens
tggacccgctctggac

SEQ ID NO: 2596432 - DNA, 19 bp, Homo sapiens
tggacccgctctggaccaa

SEQ ID NO: 2596433 - DNA, 18 bp, Homo sapiens
tggaccctgaggcccaga

SEQ ID NO: 2596434 - DNA, 19 bp, Homo sapiens
tggacctatgtcctaagga

SEQ ID NO: 2596435 - DNA, 22 bp, Homo sapiens
tggacctatgtcctaaggacac

SEQ ID NO: 2596436 - DNA, 13 bp, Homo sapiens
tggacctctgctc

SEQ ID NO: 2596437 - DNA, 15 bp, Homo sapiens
tggacctctgctctg

SEQ ID NO: 2596438 - DNA, 17 bp, Homo sapiens
tggacctgcctcctgcc

SEQ ID NO: 2596439 - DNA, 20 bp, Homo sapiens
tggacctgcctcctgcctgc

SEQ ID NO: 2596440 - DNA, 16 bp, Homo sapiens
tggactcaggatgccc

SEQ ID NO: 2596441 - DNA, 21 bp, Homo sapiens
tggactccagcctgcctggca

SEQ ID NO: 2596442 - DNA, 14 bp, Homo sapiens
tggactctgcacat

SEQ ID NO: 2596443 - DNA, 17 bp, Homo sapiens
tggactctgcacatgaa

SEQ ID NO: 2596444 - DNA, 17 bp, Homo sapiens
tggactgaagcctgcag

SEQ ID NO: 2596445 - DNA, 13 bp, Homo sapiens
tggactgacattt

SEQ ID NO: 2596446 - DNA, 14 bp, Homo sapiens
tggactggcccctg

SEQ ID NO: 2596447 - DNA, 19 bp, Homo sapiens
tggactggctagagtcctc

SEQ ID NO: 2596448 - DNA, 15 bp, Homo sapiens
tggactgtcatagaa

SEQ ID NO: 2596449 - DNA, 17 bp, Homo sapiens
tggactgttttctctcg

SEQ ID NO: 2596450 - DNA, 20 bp, Homo sapiens
tggactgttttctctcggct

SEQ ID NO: 2596451 - DNA, 13 bp, Homo sapiens
tggacttgtatat

SEQ ID NO: 2596452 - DNA, 14 bp, Homo sapiens
tggacttgtatatt

SEQ ID NO: 2596453 - DNA, 15 bp, Homo sapiens
tggacttgtatattt

SEQ ID NO: 2596454 - DNA, 18 bp, Homo sapiens
tggacttgtatatttgta

SEQ ID NO: 2596455 - DNA, 21 bp, Homo sapiens
tggacttgtatatttgtacaa

SEQ ID NO: 2596456 - DNA, 11 bp, Homo sapiens
tggactttgtt

SEQ ID NO: 2596457 - DNA, 22 bp, Homo sapiens
tggactttgttagtttctccaa

SEQ ID NO: 2596458 - DNA, 21 bp, Homo sapiens
tggagaaataaaaatacctct

SEQ ID NO: 2596459 - DNA, 17 bp, Homo sapiens
tggagaagaccctcccc

SEQ ID NO: 2596460 - DNA, 17 bp, Homo sapiens
tggagaagccattgtct

SEQ ID NO: 2596461 - DNA, 13 bp, Homo sapiens
tggagaagcggct

SEQ ID NO: 2596462 - DNA, 19 bp, Homo sapiens
tggagaagctcccaggaac

SEQ ID NO: 2596463 - DNA, 18 bp, Homo sapiens
tggagactcctaggcagg

SEQ ID NO: 2596464 - DNA, 19 bp, Homo sapiens
tggagactctgtggggcct

SEQ ID NO: 2596465 - DNA, 17 bp, Homo sapiens
tggagactgcttcccat

SEQ ID NO: 2596466 - DNA, 15 bp, Homo sapiens
tggagagaaggcctc

SEQ ID NO: 2596467 - DNA, 21 bp, Homo sapiens
tggagagaaggcctccctagc

SEQ ID NO: 2596468 - DNA, 13 bp, Homo sapiens
tggagagaagttt

SEQ ID NO: 2596469 - DNA, 21 bp, Homo sapiens
tggagagcccggcgcccctgc

SEQ ID NO: 2596470 - DNA, 11 bp, Homo sapiens
tggagagctgg

SEQ ID NO: 2596471 - DNA, 14 bp, Homo sapiens
tggagagctggtgc

SEQ ID NO: 2596472 - DNA, 22 bp, Homo sapiens
tggagaggagggatgctgcctg

SEQ ID NO: 2596473 - DNA, 22 bp, Homo sapiens
tggagaggttataggtcactcc

SEQ ID NO: 2596474 - DNA, 20 bp, Homo sapiens
tggagagtgcaacagtagca

SEQ ID NO: 2596475 - DNA, 19 bp, Homo sapiens
tggagagttcaatggctgc

SEQ ID NO: 2596476 - DNA, 20 bp, Homo sapiens
tggagataaagatttcttga

SEQ ID NO: 2596477 - DNA, 13 bp, Homo sapiens
tggagatgcagag

SEQ ID NO: 2596478 - DNA, 22 bp, Homo sapiens
tggagatgtcttcgtacagttc

SEQ ID NO: 2596479 - DNA, 19 bp, Homo sapiens
tggagatttgaaggtctgc

SEQ ID NO: 2596480 - DNA, 22 bp, Homo sapiens
tggagatttgaaggtctgcaag

SEQ ID NO: 2596481 - DNA, 12 bp, Homo sapiens
tggagcagaggg

SEQ ID NO: 2596482 - DNA, 18 bp, Homo sapiens
tggagcaggactctattt

SEQ ID NO: 2596483 - DNA, 11 bp, Homo sapiens
tggagcatctg

SEQ ID NO: 2596484 - DNA, 17 bp, Homo sapiens
tggagccaactgctgct

SEQ ID NO: 2596485 - DNA, 15 bp, Homo sapiens
tggagcccagggagc

SEQ ID NO: 2596486 - DNA, 20 bp, Homo sapiens
tggagcccagggagcggaaa

SEQ ID NO: 2596487 - DNA, 15 bp, Homo sapiens
tggagccccacactg

SEQ ID NO: 2596488 - DNA, 12 bp, Homo sapiens
tggagccccagc

SEQ ID NO: 2596489 - DNA, 16 bp, Homo sapiens
tggagccccagccccc

SEQ ID NO: 2596490 - DNA, 12 bp, Homo sapiens
tggagcccctgg

SEQ ID NO: 2596491 - DNA, 14 bp, Homo sapiens
tggagcccctgggt

SEQ ID NO: 2596492 - DNA, 23 bp, Homo sapiens
tggagcccctgggtgggtggtgg

SEQ ID NO: 2596493 - DNA, 16 bp, Homo sapiens
tggagcccgcaccccc

SEQ ID NO: 2596494 - DNA, 20 bp, Homo sapiens
tggagccggactttcggagt

SEQ ID NO: 2596495 - DNA, 22 bp, Homo sapiens
tggagccggactttcggagttg

SEQ ID NO: 2596496 - DNA, 13 bp, Homo sapiens
tggagcctgcagg

SEQ ID NO: 2596497 - DNA, 14 bp, Homo sapiens
tggagcgcacctgc

SEQ ID NO: 2596498 - DNA, 22 bp, Homo sapiens
tggagcgcacctgccccctggt

SEQ ID NO: 2596499 - DNA, 17 bp, Homo sapiens
tggagctgagcctctca

SEQ ID NO: 2596500 - DNA, 15 bp, Homo sapiens
tggagctgcctgata

SEQ ID NO: 2596501 - DNA, 16 bp, Homo sapiens
tggagcttttttcttt

SEQ ID NO: 2596502 - DNA, 21 bp, Homo sapiens
tggagcttttttctttaagat

SEQ ID NO: 2596503 - DNA, 18 bp, Homo sapiens
tggaggaaggaaacccag

SEQ ID NO: 2596504 - DNA, 19 bp, Homo sapiens
tggaggaaggattgtaaaa

SEQ ID NO: 2596505 - DNA, 22 bp, Homo sapiens
tggaggaatgctcccccatcct

SEQ ID NO: 2596506 - DNA, 19 bp, Homo sapiens
tggaggactagaacctgga

SEQ ID NO: 2596507 - DNA, 20 bp, Homo sapiens
tggaggactagaacctggag

SEQ ID NO: 2596508 - DNA, 14 bp, Homo sapiens
tggaggagaaggac

SEQ ID NO: 2596509 - DNA, 16 bp, Homo sapiens
tggaggagcaaaggct

SEQ ID NO: 2596510 - DNA, 13 bp, Homo sapiens
tggaggagcagtg

SEQ ID NO: 2596511 - DNA, 22 bp, Homo sapiens
tggaggagcagtgcaggcacag

SEQ ID NO: 2596512 - DNA, 22 bp, Homo sapiens
tggaggagcttgggggatgact

SEQ ID NO: 2596513 - DNA, 22 bp, Homo sapiens
tggaggccattgtgtgagccta

SEQ ID NO: 2596514 - DNA, 21 bp, Homo sapiens
tggagggctagaatctggaga

SEQ ID NO: 2596515 - DNA, 12 bp, Homo sapiens
tggagggctgga

SEQ ID NO: 2596516 - DNA, 23 bp, Homo sapiens
tggaggggtgtggctccttccca

SEQ ID NO: 2596517 - DNA, 15 bp, Homo sapiens
tggagggtcccaagc

SEQ ID NO: 2596518 - DNA, 17 bp, Homo sapiens
tggagggtcccaagctg

SEQ ID NO: 2596519 - DNA, 20 bp, Homo sapiens
tggaggtcacattcaggaag

SEQ ID NO: 2596520 - DNA, 14 bp, Homo sapiens
tggaggtggggcct

SEQ ID NO: 2596521 - DNA, 16 bp, Homo sapiens
tggaggtgtcaggctg

SEQ ID NO: 2596522 - DNA, 18 bp, Homo sapiens
tggaggtgtcaggctgct

SEQ ID NO: 2596523 - DNA, 21 bp, Homo sapiens
tgctgccgcctcccagcctgg

SEQ ID NO: 2596524 - DNA, 14 bp, Homo sapiens
tgctgcctccccaa

SEQ ID NO: 2596525 - DNA, 14 bp, Homo sapiens
tgctgcctgagtca

SEQ ID NO: 2596526 - DNA, 15 bp, Homo sapiens
tgctgcttccctctg

SEQ ID NO: 2596527 - DNA, 17 bp, Homo sapiens
tgctgcttccctctgcc

SEQ ID NO: 2596528 - DNA, 19 bp, Homo sapiens
tgctgcttgaggcaactca

SEQ ID NO: 2596529 - DNA, 15 bp, Homo sapiens
tgctgctttcccctg

SEQ ID NO: 2596530 - DNA, 17 bp, Homo sapiens
tgctgctttcccctgtg

SEQ ID NO: 2596531 - DNA, 23 bp, Homo sapiens
tgctgctttcccctgtggggatc

SEQ ID NO: 2596532 - DNA, 17 bp, Homo sapiens
tgctgcttttccttggg

SEQ ID NO: 2596533 - DNA, 23 bp, Homo sapiens
tgctgctttttgaggtggcactt

SEQ ID NO: 2596534 - DNA, 20 bp, Homo sapiens
tgctggacggcattcctgct

SEQ ID NO: 2596535 - DNA, 20 bp, Homo sapiens
tgctggacggggactgggga

SEQ ID NO: 2596536 - DNA, 21 bp, Homo sapiens
tgctggacggggactggggat

SEQ ID NO: 2596537 - DNA, 15 bp, Homo sapiens
tgctggactgtcata

SEQ ID NO: 2596538 - DNA, 12 bp, Homo sapiens
tgctggagaggt

SEQ ID NO: 2596539 - DNA, 13 bp, Homo sapiens
tgctggagaggtt

SEQ ID NO: 2596540 - DNA, 18 bp, Homo sapiens
tgctggagccactaacta

SEQ ID NO: 2596541 - DNA, 19 bp, Homo sapiens
tgctggagccactaactag

SEQ ID NO: 2596542 - DNA, 14 bp, Homo sapiens
tgctggagctctgc

SEQ ID NO: 2596543 - DNA, 22 bp, Homo sapiens
tgctggatgtctgccaattttt

SEQ ID NO: 2596544 - DNA, 12 bp, Homo sapiens
tgctggcccctc

SEQ ID NO: 2596545 - DNA, 24 bp, Homo sapiens
tgctggcccctcacctgggcacct

SEQ ID NO: 2596546 - DNA, 14 bp, Homo sapiens
tgctggcctggatc

SEQ ID NO: 2596547 - DNA, 15 bp, Homo sapiens
tgctggcctggatct

SEQ ID NO: 2596548 - DNA, 16 bp, Homo sapiens
tgctggcgcctctgca

SEQ ID NO: 2596549 - DNA, 13 bp, Homo sapiens
tgctggctgccca

SEQ ID NO: 2596550 - DNA, 14 bp, Homo sapiens
tgctggctgcccag

SEQ ID NO: 2596551 - DNA, 16 bp, Homo sapiens
tgctggctggaaggga

SEQ ID NO: 2596552 - DNA, 15 bp, Homo sapiens
tgctgggactgagcc

SEQ ID NO: 2596553 - DNA, 20 bp, Homo sapiens
tgctgggactgagccagtcc

SEQ ID NO: 2596554 - DNA, 17 bp, Homo sapiens
tgctgggattacaggtg

SEQ ID NO: 2596555 - DNA, 19 bp, Homo sapiens
tgctgggctgacggtgcag

SEQ ID NO: 2596556 - DNA, 21 bp, Homo sapiens
tgctgggctgacggtgcagtc

SEQ ID NO: 2596557 - DNA, 24 bp, Homo sapiens
tgctgggctgacggtgcagtctgg

SEQ ID NO: 2596558 - DNA, 19 bp, Homo sapiens
tgctgggttggtgcacagt

SEQ ID NO: 2596559 - DNA, 20 bp, Homo sapiens
tgctggtcacagcctcctct

SEQ ID NO: 2596560 - DNA, 13 bp, Homo sapiens
tgctggttgctgt

SEQ ID NO: 2596561 - DNA, 22 bp, Homo sapiens
tgctggttttcctaaatgcagt

SEQ ID NO: 2596562 - DNA, 18 bp, Homo sapiens
tgctggtttttcagtttt

SEQ ID NO: 2596563 - DNA, 21 bp, Homo sapiens
tgctgtactagagatctggtt

SEQ ID NO: 2596564 - DNA, 15 bp, Homo sapiens
tgctgtccagacagc

SEQ ID NO: 2596565 - DNA, 19 bp, Homo sapiens
tgctgtccagacagcctgt

SEQ ID NO: 2596566 - DNA, 12 bp, Homo sapiens
tgctgtccctcc

SEQ ID NO: 2596567 - DNA, 16 bp, Homo sapiens
tgctgtcctaggccac

SEQ ID NO: 2596568 - DNA, 22 bp, Homo sapiens
tgctgtgaaaaaaaaaatgctg

SEQ ID NO: 2596569 - DNA, 18 bp, Homo sapiens
tgctgtgaattagctcac

SEQ ID NO: 2596570 - DNA, 13 bp, Homo sapiens
tgctgtggaagca

SEQ ID NO: 2596571 - DNA, 14 bp, Homo sapiens
tgctgtggccaggg

SEQ ID NO: 2596572 - DNA, 15 bp, Homo sapiens
tgctgtggcctgggc

SEQ ID NO: 2596573 - DNA, 10 bp, Homo sapiens
tgctgtggga

SEQ ID NO: 2596574 - DNA, 17 bp, Homo sapiens
tgctgtgggaacgagag

SEQ ID NO: 2596575 - DNA, 16 bp, Homo sapiens
tgctgtggtgtgtccc

SEQ ID NO: 2596576 - DNA, 20 bp, Homo sapiens
tgattgtaacgttgctgtgg

SEQ ID NO: 2596577 - DNA, 23 bp, Homo sapiens
tgattgtaacgttgctgtgggaa

SEQ ID NO: 2596578 - DNA, 19 bp, Homo sapiens
tgattgttaatttacagct

SEQ ID NO: 2596579 - DNA, 16 bp, Homo sapiens
tgattgtttgctctga

SEQ ID NO: 2596580 - DNA, 14 bp, Homo sapiens
tgatttaataaaat

SEQ ID NO: 2596581 - DNA, 20 bp, Homo sapiens
tgatttaatagtgttaatca

SEQ ID NO: 2596582 - DNA, 13 bp, Homo sapiens
tgatttaatgttt

SEQ ID NO: 2596583 - DNA, 16 bp, Homo sapiens
tgatttaatgttttca

SEQ ID NO: 2596584 - DNA, 16 bp, Homo sapiens
tgatttatagtttgta

SEQ ID NO: 2596585 - DNA, 22 bp, Homo sapiens
tgatttatgcatggaaacctga

SEQ ID NO: 2596586 - DNA, 13 bp, Homo sapiens
tgatttcatttca

SEQ ID NO: 2596587 - DNA, 21 bp, Homo sapiens
tgatttcccctccaaggtatg

SEQ ID NO: 2596588 - DNA, 16 bp, Homo sapiens
tgatttctttccagag

SEQ ID NO: 2596589 - DNA, 18 bp, Homo sapiens
tgatttgactgtttttac

SEQ ID NO: 2596590 - DNA, 15 bp, Homo sapiens
tgatttgtactgaaa

SEQ ID NO: 2596591 - DNA, 18 bp, Homo sapiens
tgatttgtactgaaaaat

SEQ ID NO: 2596592 - DNA, 12 bp, Homo sapiens
tgattttaacaa

SEQ ID NO: 2596593 - DNA, 13 bp, Homo sapiens
tgattttaacaat

SEQ ID NO: 2596594 - DNA, 14 bp, Homo sapiens
tgattttaactctg

SEQ ID NO: 2596595 - DNA, 16 bp, Homo sapiens
tgattttatctgtgaa

SEQ ID NO: 2596596 - DNA, 12 bp, Homo sapiens
tgattttctgtt

SEQ ID NO: 2596597 - DNA, 15 bp, Homo sapiens
tgattttgaaaccat

SEQ ID NO: 2596598 - DNA, 19 bp, Homo sapiens
tgattttgctgtagaagat

SEQ ID NO: 2596599 - DNA, 21 bp, Homo sapiens
tgatttttaccgtttcttccc

SEQ ID NO: 2596600 - DNA, 19 bp, Homo sapiens
tgatttttctggaggttga

SEQ ID NO: 2596601 - DNA, 12 bp, Homo sapiens
tgcaaaaaatag

SEQ ID NO: 2596602 - DNA, 14 bp, Homo sapiens
tgcaaaaagggtca

SEQ ID NO: 2596603 - DNA, 23 bp, Homo sapiens
tgcaaaagactaatttaaaaaat

SEQ ID NO: 2596604 - DNA, 22 bp, Homo sapiens
tgcaaaaggactctcaggacca

SEQ ID NO: 2596605 - DNA, 22 bp, Homo sapiens
tgcaaacctgacccctgctcag

SEQ ID NO: 2596606 - DNA, 12 bp, Homo sapiens
tgcaaaggctgg

SEQ ID NO: 2596607 - DNA, 13 bp, Homo sapiens
tgcaaaggctggg

SEQ ID NO: 2596608 - DNA, 21 bp, Homo sapiens
tgcaaagggtatcaggtgctg

SEQ ID NO: 2596609 - DNA, 20 bp, Homo sapiens
tgcaaagtatccctactgta

SEQ ID NO: 2596610 - DNA, 21 bp, Homo sapiens
tgcaaagtcatgcaaaggctg

SEQ ID NO: 2596611 - DNA, 23 bp, Homo sapiens
tgcaaagtcatgcaaaggctggg

SEQ ID NO: 2596612 - DNA, 15 bp, Homo sapiens
tgcaaatcctatgtg

SEQ ID NO: 2596613 - DNA, 13 bp, Homo sapiens
tgcaacaacatgt

SEQ ID NO: 2596614 - DNA, 13 bp, Homo sapiens
tgcaacacacaga

SEQ ID NO: 2596615 - DNA, 14 bp, Homo sapiens
tgcaacacacagac

SEQ ID NO: 2596616 - DNA, 17 bp, Homo sapiens
tgcaacagcactggctc

SEQ ID NO: 2596617 - DNA, 17 bp, Homo sapiens
tgcaacaggctgggctt

SEQ ID NO: 2596618 - DNA, 19 bp, Homo sapiens
tgcaacaggctgggcttca

SEQ ID NO: 2596619 - DNA, 14 bp, Homo sapiens
tgcaacaggcttgt

SEQ ID NO: 2596620 - DNA, 15 bp, Homo sapiens
tgcaaccactgcaac

SEQ ID NO: 2596621 - DNA, 21 bp, Homo sapiens
tgcaacccaaggactgaggga

SEQ ID NO: 2596622 - DNA, 13 bp, Homo sapiens
tgcaacctccgcc

SEQ ID NO: 2596623 - DNA, 14 bp, Homo sapiens
tgcaacctccgcct

SEQ ID NO: 2596624 - DNA, 21 bp, Homo sapiens
tgcaacctccgcctcccgggt

SEQ ID NO: 2596625 - DNA, 14 bp, Homo sapiens
tgcaacctcgctgg

SEQ ID NO: 2596626 - DNA, 20 bp, Homo sapiens
tgcaacctcgctggactctc

SEQ ID NO: 2596627 - DNA, 19 bp, Homo sapiens
tgcaacctgattgtgtctc

SEQ ID NO: 2596628 - DNA, 17 bp, Homo sapiens
tgcaacttctttttatt

SEQ ID NO: 2596629 - DNA, 16 bp, Homo sapiens
tgcaacttgtaaatgt

SEQ ID NO: 2596630 - DNA, 17 bp, Homo sapiens
tgcaagcagggctctgc

SEQ ID NO: 2596631 - DNA, 20 bp, Homo sapiens
tgcaagcagggctctgcccc

SEQ ID NO: 2596632 - DNA, 19 bp, Homo sapiens
tgcaaggaagccacagctg

SEQ ID NO: 2596633 - DNA, 15 bp, Homo sapiens
tgcaaggaaggaaag

SEQ ID NO: 2596634 - DNA, 13 bp, Homo sapiens
tgcaaggaccagg

SEQ ID NO: 2596635 - DNA, 14 bp, Homo sapiens
tgcaaggaccagga

SEQ ID NO: 2596636 - DNA, 16 bp, Homo sapiens
tgcaaggtctttggtt

SEQ ID NO: 2596637 - DNA, 15 bp, Homo sapiens
tgcaaggtggctcca

SEQ ID NO: 2596638 - DNA, 15 bp, Homo sapiens
tgcaagtatgtgagt

SEQ ID NO: 2596639 - DNA, 21 bp, Homo sapiens
tgcaagtatgttttagcatgt

SEQ ID NO: 2596640 - DNA, 13 bp, Homo sapiens
tgcaagtcagagg

SEQ ID NO: 2596641 - DNA, 19 bp, Homo sapiens
tgcaagtgtgtatgtgcgt

SEQ ID NO: 2596642 - DNA, 22 bp, Homo sapiens
tgcaagtgtgtatgtgcgtgtg

SEQ ID NO: 2596643 - DNA, 13 bp, Homo sapiens
tgcaagtgtgtgc

SEQ ID NO: 2596644 - DNA, 14 bp, Homo sapiens
tgcaagtgtgtgca

SEQ ID NO: 2596645 - DNA, 21 bp, Homo sapiens
tgcaataagaatttagggaga

SEQ ID NO: 2596646 - DNA, 14 bp, Homo sapiens
tgcaataatacttc

SEQ ID NO: 2596647 - DNA, 18 bp, Homo sapiens
tgcaatatatctaaattg

SEQ ID NO: 2596648 - DNA, 21 bp, Homo sapiens
tgcaatatatctaaattgaat

SEQ ID NO: 2596649 - DNA, 16 bp, Homo sapiens
tgcaatatttcctcat

SEQ ID NO: 2596650 - DNA, 19 bp, Homo sapiens
tgcaatatttcctcatgtg

SEQ ID NO: 2596651 - DNA, 22 bp, Homo sapiens
tgcaatatttcctcatgtgatc

SEQ ID NO: 2596652 - DNA, 14 bp, Homo sapiens
tgcaatggcagcct

SEQ ID NO: 2596653 - DNA, 20 bp, Homo sapiens
tgcaatggcgtgatctcggc

SEQ ID NO: 2596654 - DNA, 15 bp, Homo sapiens
tgcaatgttttcctt

SEQ ID NO: 2596655 - DNA, 15 bp, Homo sapiens
tgcaattaaagtgat

SEQ ID NO: 2596656 - DNA, 16 bp, Homo sapiens
tgcaattaaagtgata

SEQ ID NO: 2596657 - DNA, 13 bp, Homo sapiens
tgcaattcccctc

SEQ ID NO: 2596658 - DNA, 14 bp, Homo sapiens
tgcaattcccctct

SEQ ID NO: 2596659 - DNA, 14 bp, Homo sapiens
tgcaatttattaaa

SEQ ID NO: 2596660 - DNA, 15 bp, Homo sapiens
tgcaatttattaaaa

SEQ ID NO: 2596661 - DNA, 18 bp, Homo sapiens
tgcaatttattaaaatga

SEQ ID NO: 2596662 - DNA, 14 bp, Homo sapiens
tgcacaacattaca

SEQ ID NO: 2596663 - DNA, 15 bp, Homo sapiens
tgcacaagctccaag

SEQ ID NO: 2596664 - DNA, 21 bp, Homo sapiens
tgcacaataaaaatgtttaac

SEQ ID NO: 2596665 - DNA, 17 bp, Homo sapiens
tgcacacaccagagccc

SEQ ID NO: 2596666 - DNA, 13 bp, Homo sapiens
tgcacacattttt

SEQ ID NO: 2596667 - DNA, 21 bp, Homo sapiens
tgcacacttgtgtgtgggctg

SEQ ID NO: 2596668 - DNA, 22 bp, Homo sapiens
tgcacactttgccatattttca

SEQ ID NO: 2596669 - DNA, 19 bp, Homo sapiens
tgcacagagttgttacatt

SEQ ID NO: 2596670 - DNA, 21 bp, Homo sapiens
tgcacagagttgttacatttt

SEQ ID NO: 2596671 - DNA, 23 bp, Homo sapiens
tgcacagagttgttacattttta

SEQ ID NO: 2596672 - DNA, 12 bp, Homo sapiens
tgcacagggcag

SEQ ID NO: 2596673 - DNA, 16 bp, Homo sapiens
tgcacagggcagctgg

SEQ ID NO: 2596674 - DNA, 17 bp, Homo sapiens
tgcacagggcagctggg

SEQ ID NO: 2596675 - DNA, 18 bp, Homo sapiens
tgcacagggcagctgggc

SEQ ID NO: 2596676 - DNA, 19 bp, Homo sapiens
tgcacagggcagctgggcc

SEQ ID NO: 2596677 - DNA, 13 bp, Homo sapiens
tgcacagtgattt

SEQ ID NO: 2596678 - DNA, 22 bp, Homo sapiens
tgcacatagctatcaagtgtgc

SEQ ID NO: 2596679 - DNA, 15 bp, Homo sapiens
tgcacatctgtgtct

SEQ ID NO: 2596680 - DNA, 13 bp, Homo sapiens
tcttatagaaagt

SEQ ID NO: 2596681 - DNA, 19 bp, Homo sapiens
tcttatagaatatttatta

SEQ ID NO: 2596682 - DNA, 18 bp, Homo sapiens
tcttatgtatgtgaaagt

SEQ ID NO: 2596683 - DNA, 18 bp, Homo sapiens
tcttattcagtaaaaaac

SEQ ID NO: 2596684 - DNA, 14 bp, Homo sapiens
tcttattgcccacg

SEQ ID NO: 2596685 - DNA, 18 bp, Homo sapiens
tcttattgcccacgctgg

SEQ ID NO: 2596686 - DNA, 17 bp, Homo sapiens
tcttatttaatgaaaga

SEQ ID NO: 2596687 - DNA, 20 bp, Homo sapiens
tcttcaacatcaatgttcat

SEQ ID NO: 2596688 - DNA, 21 bp, Homo sapiens
tcttcaacatcaatgttcatt

SEQ ID NO: 2596689 - DNA, 24 bp, Homo sapiens
tcttcaacatcaatgttcattgta

SEQ ID NO: 2596690 - DNA, 14 bp, Homo sapiens
tcttcaagaaatct

SEQ ID NO: 2596691 - DNA, 17 bp, Homo sapiens
tcttcaccatttggcaa

SEQ ID NO: 2596692 - DNA, 19 bp, Homo sapiens
tcttcacccagctaatctg

SEQ ID NO: 2596693 - DNA, 21 bp, Homo sapiens
tcttcacctgattcaactaaa

SEQ ID NO: 2596694 - DNA, 17 bp, Homo sapiens
tcttcagagactcctgc

SEQ ID NO: 2596695 - DNA, 18 bp, Homo sapiens
tcttcagagactcctgca

SEQ ID NO: 2596696 - DNA, 15 bp, Homo sapiens
tcttcagatctctaa

SEQ ID NO: 2596697 - DNA, 11 bp, Homo sapiens
tcttcagccta

SEQ ID NO: 2596698 - DNA, 16 bp, Homo sapiens
tcttcagcttcttcat

SEQ ID NO: 2596699 - DNA, 19 bp, Homo sapiens
tcttcagttttatctttaa

SEQ ID NO: 2596700 - DNA, 13 bp, Homo sapiens
tcttcatactttt

SEQ ID NO: 2596701 - DNA, 13 bp, Homo sapiens
tcttcatcttcac

SEQ ID NO: 2596702 - DNA, 17 bp, Homo sapiens
tcttcatgcaatgacat

SEQ ID NO: 2596703 - DNA, 21 bp, Homo sapiens
tcttcattaagccctcttcca

SEQ ID NO: 2596704 - DNA, 14 bp, Homo sapiens
tcttcatttcattg

SEQ ID NO: 2596705 - DNA, 15 bp, Homo sapiens
tcttcatttcattgt

SEQ ID NO: 2596706 - DNA, 17 bp, Homo sapiens
tcttcatttcattgtat

SEQ ID NO: 2596707 - DNA, 24 bp, Homo sapiens
tcttcatttcattgtatgatgtgt

SEQ ID NO: 2596708 - DNA, 14 bp, Homo sapiens
tcttccaaagcaca

SEQ ID NO: 2596709 - DNA, 19 bp, Homo sapiens
tcttccagaagtgtgattg

SEQ ID NO: 2596710 - DNA, 20 bp, Homo sapiens
tcttccaggctgggagagcc

SEQ ID NO: 2596711 - DNA, 12 bp, Homo sapiens
tcttccataatg

SEQ ID NO: 2596712 - DNA, 16 bp, Homo sapiens
tcttccatcatgtccc

SEQ ID NO: 2596713 - DNA, 14 bp, Homo sapiens
tcttccatttgcaa

SEQ ID NO: 2596714 - DNA, 18 bp, Homo sapiens
tcttcccaggctggggct

SEQ ID NO: 2596715 - DNA, 12 bp, Homo sapiens
tcttcccagggt

SEQ ID NO: 2596716 - DNA, 18 bp, Homo sapiens
tcttcccgaaccccaagg

SEQ ID NO: 2596717 - DNA, 22 bp, Homo sapiens
tcttccctacagttgaaaaaca

SEQ ID NO: 2596718 - DNA, 21 bp, Homo sapiens
tcttccctacctcaggcagga

SEQ ID NO: 2596719 - DNA, 21 bp, Homo sapiens
tcttccggagatgtagcaaaa

SEQ ID NO: 2596720 - DNA, 21 bp, Homo sapiens
tcttcctagttttctcctccc

SEQ ID NO: 2596721 - DNA, 21 bp, Homo sapiens
tcttcctatttgccatgggct

SEQ ID NO: 2596722 - DNA, 18 bp, Homo sapiens
tcttcctgcaaggactac

SEQ ID NO: 2596723 - DNA, 22 bp, Homo sapiens
tcttcctgtaacacaagccaca

SEQ ID NO: 2596724 - DNA, 14 bp, Homo sapiens
tcttcggaaacctt

SEQ ID NO: 2596725 - DNA, 14 bp, Homo sapiens
tcttcgggaagaga

SEQ ID NO: 2596726 - DNA, 23 bp, Homo sapiens
tcttctagagccgtgatgcctcc

SEQ ID NO: 2596727 - DNA, 17 bp, Homo sapiens
tcttctaggttctaaaa

SEQ ID NO: 2596728 - DNA, 21 bp, Homo sapiens
tcttctcaggctctgccctgc

SEQ ID NO: 2596729 - DNA, 12 bp, Homo sapiens
tcttctccccag

SEQ ID NO: 2596730 - DNA, 21 bp, Homo sapiens
tcttctctggcgacagttttc

SEQ ID NO: 2596731 - DNA, 13 bp, Homo sapiens
tcttctcttcctg

SEQ ID NO: 2596732 - DNA, 15 bp, Homo sapiens
tcttctcttcctgta

SEQ ID NO: 2596733 - DNA, 24 bp, Homo sapiens
tcttctgaactcaaactgaggaat

SEQ ID NO: 2596734 - DNA, 14 bp, Homo sapiens
tcttctgacgtgcc

SEQ ID NO: 2596735 - DNA, 19 bp, Homo sapiens
tcttctgagctatttcatc

SEQ ID NO: 2596736 - DNA, 18 bp, Homo sapiens
tcttctgccggccctggg

SEQ ID NO: 2596737 - DNA, 22 bp, Homo sapiens
tcttctgctatgtgacttgcat

SEQ ID NO: 2596738 - DNA, 11 bp, Homo sapiens
tcttctgctcc

SEQ ID NO: 2596739 - DNA, 22 bp, Homo sapiens
tcttctgggagggcagcagggc

SEQ ID NO: 2596740 - DNA, 15 bp, Homo sapiens
tcttctgtacgtctg

SEQ ID NO: 2596741 - DNA, 20 bp, Homo sapiens
tcttctgtacgtctgacagg

SEQ ID NO: 2596742 - DNA, 16 bp, Homo sapiens
tcttctgttttctgtt

SEQ ID NO: 2596743 - DNA, 12 bp, Homo sapiens
tcttcttatgca

SEQ ID NO: 2596744 - DNA, 22 bp, Homo sapiens
tcttcttgaacactcatgctga

SEQ ID NO: 2596745 - DNA, 15 bp, Homo sapiens
tcttctttttgctgt

SEQ ID NO: 2596746 - DNA, 18 bp, Homo sapiens
tcttctttttgctgttgt

SEQ ID NO: 2596747 - DNA, 19 bp, Homo sapiens
tcttctttttgcttcaaaa

SEQ ID NO: 2596748 - DNA, 16 bp, Homo sapiens
tcttctttttttgtga

SEQ ID NO: 2596749 - DNA, 18 bp, Homo sapiens
tcttctttttttgtgatg

SEQ ID NO: 2596750 - DNA, 23 bp, Homo sapiens
tcttgaaagattcaggtatgttg

SEQ ID NO: 2596751 - DNA, 12 bp, Homo sapiens
tcttgaaatgaa

SEQ ID NO: 2596752 - DNA, 12 bp, Homo sapiens
tcttgaactcct

SEQ ID NO: 2596753 - DNA, 21 bp, Homo sapiens
tcttgaatttaataatctgta

SEQ ID NO: 2596754 - DNA, 22 bp, Homo sapiens
tcttgacaccagctgttctgtc

SEQ ID NO: 2596755 - DNA, 16 bp, Homo sapiens
tcttgactacagtcag

SEQ ID NO: 2596756 - DNA, 16 bp, Homo sapiens
tcttgagatgtcttct

SEQ ID NO: 2596757 - DNA, 20 bp, Homo sapiens
tcttgaggtactctgcacat

SEQ ID NO: 2596758 - DNA, 21 bp, Homo sapiens
tcttgagttttgttttaaaat

SEQ ID NO: 2596759 - DNA, 14 bp, Homo sapiens
tcttgataagacca

SEQ ID NO: 2596760 - DNA, 17 bp, Homo sapiens
tcttgcaatggcagcct

SEQ ID NO: 2596761 - DNA, 19 bp, Homo sapiens
tcttgcaatggcagccttg

SEQ ID NO: 2596762 - DNA, 22 bp, Homo sapiens
tcttgcaatggcagccttggca

SEQ ID NO: 2596763 - DNA, 20 bp, Homo sapiens
tcttgcacccgcctctcccg

SEQ ID NO: 2596764 - DNA, 17 bp, Homo sapiens
tcttgccactgcctctt

SEQ ID NO: 2596765 - DNA, 17 bp, Homo sapiens
tcttgctaatcagtgtc

SEQ ID NO: 2596766 - DNA, 19 bp, Homo sapiens
tcttgctaatcagtgtctc

SEQ ID NO: 2596767 - DNA, 21 bp, Homo sapiens
tcttgctaatcagtgtctcac

SEQ ID NO: 2596768 - DNA, 23 bp, Homo sapiens
tcttgctaatcagtgtctcacac

SEQ ID NO: 2596769 - DNA, 18 bp, Homo sapiens
tcttgctcaaaaatctgt

SEQ ID NO: 2596770 - DNA, 12 bp, Homo sapiens
tcttgctctgct

SEQ ID NO: 2596771 - DNA, 13 bp, Homo sapiens
tcttgctctgctg

SEQ ID NO: 2596772 - DNA, 15 bp, Homo sapiens
tcttgctctgctgac

SEQ ID NO: 2596773 - DNA, 13 bp, Homo sapiens
tcttgctctgtaa

SEQ ID NO: 2596774 - DNA, 14 bp, Homo sapiens
tcttgctctgtaat

SEQ ID NO: 2596775 - DNA, 16 bp, Homo sapiens
tcttggacactgtaca

SEQ ID NO: 2596776 - DNA, 23 bp, Homo sapiens
tcttggacctctgctctgaggct

SEQ ID NO: 2596777 - DNA, 16 bp, Homo sapiens
tcttggagctgagcct

SEQ ID NO: 2596778 - DNA, 21 bp, Homo sapiens
tcttggcacatttaagagaca

SEQ ID NO: 2596779 - DNA, 19 bp, Homo sapiens
tcttggcggcagcagccat

SEQ ID NO: 2596780 - DNA, 17 bp, Homo sapiens
tcttggcttggtgagga

SEQ ID NO: 2596781 - DNA, 13 bp, Homo sapiens
tcttgggccctcc

SEQ ID NO: 2596782 - DNA, 20 bp, Homo sapiens
tcttgggggacagggctggc

SEQ ID NO: 2596783 - DNA, 23 bp, Homo sapiens
tcttgggggacagggctggccca

SEQ ID NO: 2596784 - DNA, 14 bp, Homo sapiens
tcttggtaagaagc

SEQ ID NO: 2596785 - DNA, 15 bp, Homo sapiens
tcttggtagagattc

SEQ ID NO: 2596786 - DNA, 14 bp, Homo sapiens
tcttggtattctta

SEQ ID NO: 2596787 - DNA, 24 bp, Homo sapiens
tcttgtacatgtgtagcctgtgca

SEQ ID NO: 2596788 - DNA, 22 bp, Homo sapiens
tcttgtccatgtggttcttcaa

SEQ ID NO: 2596789 - DNA, 23 bp, Homo sapiens
tcttgtcccctcttgacccatct

SEQ ID NO: 2596790 - DNA, 14 bp, Homo sapiens
tcttgtctctgggc

SEQ ID NO: 2596791 - DNA, 21 bp, Homo sapiens
tcttgtgacatattatgtctt

SEQ ID NO: 2596792 - DNA, 21 bp, Homo sapiens
tcttgttgctcaaaaaatgag

SEQ ID NO: 2596793 - DNA, 20 bp, Homo sapiens
tcttgtttatacctttgcct

SEQ ID NO: 2596794 - DNA, 17 bp, Homo sapiens
tctttaaaatacacact

SEQ ID NO: 2596795 - DNA, 21 bp, Homo sapiens
tctttaaagggatggcaagat

SEQ ID NO: 2596796 - DNA, 20 bp, Homo sapiens
tctttaacttaattgctatg

SEQ ID NO: 2596797 - DNA, 12 bp, Homo sapiens
tctttactttta

SEQ ID NO: 2596798 - DNA, 13 bp, Homo sapiens
tctttatacaaca

SEQ ID NO: 2596799 - DNA, 14 bp, Homo sapiens
tctttatacaacag

SEQ ID NO: 2596800 - DNA, 21 bp, Homo sapiens
tctttatacaacagtgctaaa

SEQ ID NO: 2596801 - DNA, 11 bp, Homo sapiens
tctttatatga

SEQ ID NO: 2596802 - DNA, 15 bp, Homo sapiens
tctttatatgaagaa

SEQ ID NO: 2596803 - DNA, 23 bp, Homo sapiens
tctttcaaaaccttttgaaatta

SEQ ID NO: 2596804 - DNA, 19 bp, Homo sapiens
tctttcaagtgaatctaaa

SEQ ID NO: 2596805 - DNA, 21 bp, Homo sapiens
tctttcaagtgaatctaaaag

SEQ ID NO: 2596806 - DNA, 14 bp, Homo sapiens
tctttccaaagtac

SEQ ID NO: 2596807 - DNA, 17 bp, Homo sapiens
tctttccaaagtacact

SEQ ID NO: 2596808 - DNA, 23 bp, Homo sapiens
tctttccaaagtacactgtttca

SEQ ID NO: 2596809 - DNA, 23 bp, Homo sapiens
tctttcctcttccccttgccctt

SEQ ID NO: 2596810 - DNA, 13 bp, Homo sapiens
tctttcctgaggc

SEQ ID NO: 2596811 - DNA, 15 bp, Homo sapiens
tctttcctgaggctg

SEQ ID NO: 2596812 - DNA, 17 bp, Homo sapiens
tctttcgcacagcagtt

SEQ ID NO: 2596813 - DNA, 15 bp, Homo sapiens
tctttctattccaaa

SEQ ID NO: 2596814 - DNA, 18 bp, Homo sapiens
tctttctccttagtcttc

SEQ ID NO: 2596815 - DNA, 24 bp, Homo sapiens
tctttctccttagtcttctcatag

SEQ ID NO: 2596816 - DNA, 19 bp, Homo sapiens
tctttctgagcacacttta

SEQ ID NO: 2596817 - DNA, 13 bp, Homo sapiens
tctttctgctttg

SEQ ID NO: 2596818 - DNA, 14 bp, Homo sapiens
tctttcttcctctg

SEQ ID NO: 2596819 - DNA, 16 bp, Homo sapiens
tctttgaattttctgt

SEQ ID NO: 2596820 - DNA, 22 bp, Homo sapiens
tgccaccccaccctccctggag

SEQ ID NO: 2596821 - DNA, 17 bp, Homo sapiens
tgccaccctcatgctgt

SEQ ID NO: 2596822 - DNA, 20 bp, Homo sapiens
tgccaccctggggagaaagt

SEQ ID NO: 2596823 - DNA, 14 bp, Homo sapiens
tgccacctccctga

SEQ ID NO: 2596824 - DNA, 15 bp, Homo sapiens
tgccactcacacagc

SEQ ID NO: 2596825 - DNA, 23 bp, Homo sapiens
tgccactcacacagccaggtgcc

SEQ ID NO: 2596826 - DNA, 18 bp, Homo sapiens
tgccactgcccgagctgg

SEQ ID NO: 2596827 - DNA, 22 bp, Homo sapiens
tgccactgcccgagctggtgca

SEQ ID NO: 2596828 - DNA, 13 bp, Homo sapiens
tgccactgcctct

SEQ ID NO: 2596829 - DNA, 17 bp, Homo sapiens
tgccactgcctcttcct

SEQ ID NO: 2596830 - DNA, 18 bp, Homo sapiens
tgccactgcctcttcctc

SEQ ID NO: 2596831 - DNA, 19 bp, Homo sapiens
tgccactgcctcttcctcc

SEQ ID NO: 2596832 - DNA, 20 bp, Homo sapiens
tgccactgcctcttcctccc

SEQ ID NO: 2596833 - DNA, 20 bp, Homo sapiens
tgccagaacagtttgtacag

SEQ ID NO: 2596834 - DNA, 15 bp, Homo sapiens
tgccagaggtgggca

SEQ ID NO: 2596835 - DNA, 21 bp, Homo sapiens
tgccagaggtgggcaggtggt

SEQ ID NO: 2596836 - DNA, 16 bp, Homo sapiens
tgccagatgctgatgt

SEQ ID NO: 2596837 - DNA, 17 bp, Homo sapiens
tgccagatgctgatgtt

SEQ ID NO: 2596838 - DNA, 21 bp, Homo sapiens
tgccagatgctgatgttcagt

SEQ ID NO: 2596839 - DNA, 11 bp, Homo sapiens
tgccagcaact

SEQ ID NO: 2596840 - DNA, 13 bp, Homo sapiens
tgccagcaactga

SEQ ID NO: 2596841 - DNA, 17 bp, Homo sapiens
tgccagcaactgaataa

SEQ ID NO: 2596842 - DNA, 11 bp, Homo sapiens
tgccagccagc

SEQ ID NO: 2596843 - DNA, 18 bp, Homo sapiens
tgccagcctggcttctgg

SEQ ID NO: 2596844 - DNA, 21 bp, Homo sapiens
tgccagcctggcttctggagc

SEQ ID NO: 2596845 - DNA, 21 bp, Homo sapiens
tgccagccttcctctgcagct

SEQ ID NO: 2596846 - DNA, 23 bp, Homo sapiens
tgccagccttcctctgcagctga

SEQ ID NO: 2596847 - DNA, 22 bp, Homo sapiens
tgccagctctgtatcaggaccc

SEQ ID NO: 2596848 - DNA, 20 bp, Homo sapiens
tgccagcttttcctcccttg

SEQ ID NO: 2596849 - DNA, 13 bp, Homo sapiens
tgccaggacacgc

SEQ ID NO: 2596850 - DNA, 21 bp, Homo sapiens
tgccaggactccccaggccag

SEQ ID NO: 2596851 - DNA, 22 bp, Homo sapiens
tgccagggacagagggggtggc

SEQ ID NO: 2596852 - DNA, 15 bp, Homo sapiens
tgccagggagacaga

SEQ ID NO: 2596853 - DNA, 18 bp, Homo sapiens
tgccagggagacagagct

SEQ ID NO: 2596854 - DNA, 12 bp, Homo sapiens
tgccagggagct

SEQ ID NO: 2596855 - DNA, 11 bp, Homo sapiens
tgccagggcag

SEQ ID NO: 2596856 - DNA, 15 bp, Homo sapiens
tgccagggcagggcc

SEQ ID NO: 2596857 - DNA, 20 bp, Homo sapiens
tgccagggtttcgagaagct

SEQ ID NO: 2596858 - DNA, 19 bp, Homo sapiens
tgccaggttctatttggaa

SEQ ID NO: 2596859 - DNA, 20 bp, Homo sapiens
tgccaggttctatttggaat

SEQ ID NO: 2596860 - DNA, 14 bp, Homo sapiens
tgccaggttttctg

SEQ ID NO: 2596861 - DNA, 19 bp, Homo sapiens
tgccaggttttctgggtgt

SEQ ID NO: 2596862 - DNA, 19 bp, Homo sapiens
tgccaggtttttggtctga

SEQ ID NO: 2596863 - DNA, 24 bp, Homo sapiens
tgccaggtttttggtctgacccac

SEQ ID NO: 2596864 - DNA, 18 bp, Homo sapiens
tgccagtcaccccggcca

SEQ ID NO: 2596865 - DNA, 20 bp, Homo sapiens
tgccagtcaccccggccacc

SEQ ID NO: 2596866 - DNA, 20 bp, Homo sapiens
tgccagtccccctgccccag

SEQ ID NO: 2596867 - DNA, 16 bp, Homo sapiens
tgccagtcctagctgc

SEQ ID NO: 2596868 - DNA, 17 bp, Homo sapiens
tgccagtcctagctgca

SEQ ID NO: 2596869 - DNA, 17 bp, Homo sapiens
tgccagttatggctata

SEQ ID NO: 2596870 - DNA, 13 bp, Homo sapiens
tgccatagagttt

SEQ ID NO: 2596871 - DNA, 17 bp, Homo sapiens
tgccatattctgttggc

SEQ ID NO: 2596872 - DNA, 21 bp, Homo sapiens
tgccatattctgttggccagt

SEQ ID NO: 2596873 - DNA, 13 bp, Homo sapiens
tgccatcatctcc

SEQ ID NO: 2596874 - DNA, 22 bp, Homo sapiens
tgccatcatgtttacagaggac

SEQ ID NO: 2596875 - DNA, 22 bp, Homo sapiens
tgccatctgcgtgacaataaaa

SEQ ID NO: 2596876 - DNA, 16 bp, Homo sapiens
tgccatgcagggcctc

SEQ ID NO: 2596877 - DNA, 18 bp, Homo sapiens
tgccatggacagaagaag

SEQ ID NO: 2596878 - DNA, 19 bp, Homo sapiens
tgccatgggcttcactgta

SEQ ID NO: 2596879 - DNA, 22 bp, Homo sapiens
tgccatgggcttcactgtataa

SEQ ID NO: 2596880 - DNA, 23 bp, Homo sapiens
tgccatgggcttcactgtataaa

SEQ ID NO: 2596881 - DNA, 15 bp, Homo sapiens
tgccatgtgaagagg

SEQ ID NO: 2596882 - DNA, 12 bp, Homo sapiens
tgccatgttggc

SEQ ID NO: 2596883 - DNA, 20 bp, Homo sapiens
tgccatgttggccaggctgg

SEQ ID NO: 2596884 - DNA, 21 bp, Homo sapiens
tgccatgttggccaggctggt

SEQ ID NO: 2596885 - DNA, 16 bp, Homo sapiens
tgccattatccctgaa

SEQ ID NO: 2596886 - DNA, 18 bp, Homo sapiens
tgccattccctgcctggg

SEQ ID NO: 2596887 - DNA, 16 bp, Homo sapiens
tgccatttgcaccctc

SEQ ID NO: 2596888 - DNA, 17 bp, Homo sapiens
tgccatttgcaccctcc

SEQ ID NO: 2596889 - DNA, 19 bp, Homo sapiens
tgccatttgcaccctccgc

SEQ ID NO: 2596890 - DNA, 19 bp, Homo sapiens
tgcccaaaaatatggttga

SEQ ID NO: 2596891 - DNA, 21 bp, Homo sapiens
tgcccaaagtgcttccaaggc

SEQ ID NO: 2596892 - DNA, 14 bp, Homo sapiens
tgcccacaggatca

SEQ ID NO: 2596893 - DNA, 14 bp, Homo sapiens
tgcccaccccctca

SEQ ID NO: 2596894 - DNA, 21 bp, Homo sapiens
tgcccacccgtggagatggga

SEQ ID NO: 2596895 - DNA, 14 bp, Homo sapiens
tgcccacctgccca

SEQ ID NO: 2596896 - DNA, 14 bp, Homo sapiens
tgcccacctggcct

SEQ ID NO: 2596897 - DNA, 16 bp, Homo sapiens
tgcctgcccaggcccc

SEQ ID NO: 2596898 - DNA, 18 bp, Homo sapiens
tgcctgcccaggcccctg

SEQ ID NO: 2596899 - DNA, 22 bp, Homo sapiens
tgcctgcccaggcccctgccac

SEQ ID NO: 2596900 - DNA, 14 bp, Homo sapiens
tgcctgcctgtctg

SEQ ID NO: 2596901 - DNA, 21 bp, Homo sapiens
tgcctgcctgtctgtctctcc

SEQ ID NO: 2596902 - DNA, 21 bp, Homo sapiens
tgcctgcttttcactgctgca

SEQ ID NO: 2596903 - DNA, 14 bp, Homo sapiens
tgcctggatggggc

SEQ ID NO: 2596904 - DNA, 16 bp, Homo sapiens
tgcctggatggggctg

SEQ ID NO: 2596905 - DNA, 21 bp, Homo sapiens
tgcctggatggggctgcaccg

SEQ ID NO: 2596906 - DNA, 23 bp, Homo sapiens
tgcctggcaggctgtctggccag

SEQ ID NO: 2596907 - DNA, 17 bp, Homo sapiens
tgcctggccccctgtcc

SEQ ID NO: 2596908 - DNA, 20 bp, Homo sapiens
tgcctggcctggcacacatc

SEQ ID NO: 2596909 - DNA, 13 bp, Homo sapiens
tgcctggctcaga

SEQ ID NO: 2596910 - DNA, 16 bp, Homo sapiens
tgcctggctcagagcc

SEQ ID NO: 2596911 - DNA, 16 bp, Homo sapiens
tgcctgggctgttggc

SEQ ID NO: 2596912 - DNA, 21 bp, Homo sapiens
tgcctgggtggacatggcccc

SEQ ID NO: 2596913 - DNA, 20 bp, Homo sapiens
tgcctggtatatccaaaagc

SEQ ID NO: 2596914 - DNA, 23 bp, Homo sapiens
tgcctggtatatccaaaagcttt

SEQ ID NO: 2596915 - DNA, 14 bp, Homo sapiens
tgcctggtggcagc

SEQ ID NO: 2596916 - DNA, 15 bp, Homo sapiens
tgcctggtggcagct

SEQ ID NO: 2596917 - DNA, 18 bp, Homo sapiens
tgcctggtggcagctgcg

SEQ ID NO: 2596918 - DNA, 13 bp, Homo sapiens
tgcctgtaaacat

SEQ ID NO: 2596919 - DNA, 15 bp, Homo sapiens
tgcctgtaaacatag

SEQ ID NO: 2596920 - DNA, 15 bp, Homo sapiens
tgcctgtaacttgag

SEQ ID NO: 2596921 - DNA, 13 bp, Homo sapiens
tgcctgtagttag

SEQ ID NO: 2596922 - DNA, 15 bp, Homo sapiens
tgcctgtagttagga

SEQ ID NO: 2596923 - DNA, 16 bp, Homo sapiens
tgcctgtagttaggaa

SEQ ID NO: 2596924 - DNA, 17 bp, Homo sapiens
tgcctgtagttaggaaa

SEQ ID NO: 2596925 - DNA, 18 bp, Homo sapiens
tgcctgtagttaggaaat

SEQ ID NO: 2596926 - DNA, 18 bp, Homo sapiens
tgcctgtccagcctgggc

SEQ ID NO: 2596927 - DNA, 20 bp, Homo sapiens
tgcctgtccagcctgggcag

SEQ ID NO: 2596928 - DNA, 14 bp, Homo sapiens
tgcctgtccctctc

SEQ ID NO: 2596929 - DNA, 23 bp, Homo sapiens
tgcctgtctcctttgcaggctca

SEQ ID NO: 2596930 - DNA, 14 bp, Homo sapiens
tgcctgtctgaagc

SEQ ID NO: 2596931 - DNA, 12 bp, Homo sapiens
tgcctgtgcctg

SEQ ID NO: 2596932 - DNA, 11 bp, Homo sapiens
tgcctgttcag

SEQ ID NO: 2596933 - DNA, 20 bp, Homo sapiens
tgcctgttcagctccagctc

SEQ ID NO: 2596934 - DNA, 21 bp, Homo sapiens
tgcctgttcagttacagaaag

SEQ ID NO: 2596935 - DNA, 18 bp, Homo sapiens
tgccttactcttcttgaa

SEQ ID NO: 2596936 - DNA, 19 bp, Homo sapiens
tgccttactcttcttgaaa

SEQ ID NO: 2596937 - DNA, 20 bp, Homo sapiens
tgccttagtctcagtttgtg

SEQ ID NO: 2596938 - DNA, 16 bp, Homo sapiens
tgccttattaaagttc

SEQ ID NO: 2596939 - DNA, 13 bp, Homo sapiens
tgccttccacgct

SEQ ID NO: 2596940 - DNA, 20 bp, Homo sapiens
tgccttcccctgggccctga

SEQ ID NO: 2596941 - DNA, 19 bp, Homo sapiens
tgccttcctgtttttcaca

SEQ ID NO: 2596942 - DNA, 20 bp, Homo sapiens
tgccttcgcggtggaaggcc

SEQ ID NO: 2596943 - DNA, 21 bp, Homo sapiens
tgccttcttctttttgctgtt

SEQ ID NO: 2596944 - DNA, 22 bp, Homo sapiens
tgccttcttctttttgctgttg

SEQ ID NO: 2596945 - DNA, 19 bp, Homo sapiens
tgccttgaaccacttccct

SEQ ID NO: 2596946 - DNA, 23 bp, Homo sapiens
tgccttgaatatcccctcccagt

SEQ ID NO: 2596947 - DNA, 17 bp, Homo sapiens
tgccttgggctgctcct

SEQ ID NO: 2596948 - DNA, 21 bp, Homo sapiens
tgccttggggaatttcctcta

SEQ ID NO: 2596949 - DNA, 16 bp, Homo sapiens
tgccttggtgtgctgt

SEQ ID NO: 2596950 - DNA, 14 bp, Homo sapiens
tgcctttaaatctg

SEQ ID NO: 2596951 - DNA, 13 bp, Homo sapiens
tgcctttgacctg

SEQ ID NO: 2596952 - DNA, 13 bp, Homo sapiens
tgcctttgagaca

SEQ ID NO: 2596953 - DNA, 15 bp, Homo sapiens
tgcctttgagacagt

SEQ ID NO: 2596954 - DNA, 13 bp, Homo sapiens
tgccttttatagc

SEQ ID NO: 2596955 - DNA, 14 bp, Homo sapiens
tgccttttttgatc

SEQ ID NO: 2596956 - DNA, 16 bp, Homo sapiens
tgcgaaggggccctgg

SEQ ID NO: 2596957 - DNA, 21 bp, Homo sapiens
tgcgaaggggccctggtcctt

SEQ ID NO: 2596958 - DNA, 13 bp, Homo sapiens
tgcgagtgtgtgc

SEQ ID NO: 2596959 - DNA, 15 bp, Homo sapiens
tgcgatctgggttca

SEQ ID NO: 2596960 - DNA, 19 bp, Homo sapiens
tgcgatctgggttcactgc

SEQ ID NO: 2596961 - DNA, 21 bp, Homo sapiens
tgcgatctgggttcactgcaa

SEQ ID NO: 2596962 - DNA, 17 bp, Homo sapiens
tgcgatcttcagagcag

SEQ ID NO: 2596963 - DNA, 22 bp, Homo sapiens
tgcgatggcgtgggctgcgtga

SEQ ID NO: 2596964 - DNA, 12 bp, Homo sapiens
tgcgattctgga

SEQ ID NO: 2596965 - DNA, 13 bp, Homo sapiens
tgcgattctggat

SEQ ID NO: 2596966 - DNA, 23 bp, Homo sapiens
tgcgattctggataaagccactg

SEQ ID NO: 2596967 - DNA, 19 bp, Homo sapiens
tgcgattttgcctgtgtct

SEQ ID NO: 2596968 - DNA, 17 bp, Homo sapiens
tgcgcattctcatggag

SEQ ID NO: 2596969 - DNA, 19 bp, Homo sapiens
tgcgcattctcatggagaa

SEQ ID NO: 2596970 - DNA, 17 bp, Homo sapiens
tgcgcccagtccttcca

SEQ ID NO: 2596971 - DNA, 15 bp, Homo sapiens
tgcgccgagtctgtc

SEQ ID NO: 2596972 - DNA, 14 bp, Homo sapiens
tgcgcctacaggag

SEQ ID NO: 2596973 - DNA, 17 bp, Homo sapiens
tgcgctgacaaccaccg

SEQ ID NO: 2596974 - DNA, 17 bp, Homo sapiens
tgcggacagccacggcc

SEQ ID NO: 2596975 - DNA, 21 bp, Homo sapiens
tgcggacagccacggccaggc

SEQ ID NO: 2596976 - DNA, 15 bp, Homo sapiens
tgcggagtgaagagg

SEQ ID NO: 2596977 - DNA, 20 bp, Homo sapiens
tgcggagtgaagaggggcag

SEQ ID NO: 2596978 - DNA, 15 bp, Homo sapiens
ttgcatttatggtca

SEQ ID NO: 2596979 - DNA, 15 bp, Homo sapiens
ttgccacaaccctgt

SEQ ID NO: 2596980 - DNA, 13 bp, Homo sapiens
ttgccacagctct

SEQ ID NO: 2596981 - DNA, 16 bp, Homo sapiens
ttgccaccaggagaac

SEQ ID NO: 2596982 - DNA, 14 bp, Homo sapiens
ttgccactgcctct

SEQ ID NO: 2596983 - DNA, 15 bp, Homo sapiens
ttgccactgcctctt

SEQ ID NO: 2596984 - DNA, 17 bp, Homo sapiens
ttgccagaaagcataaa

SEQ ID NO: 2596985 - DNA, 22 bp, Homo sapiens
ttgccagcttttcctcccttgg

SEQ ID NO: 2596986 - DNA, 18 bp, Homo sapiens
ttgccagtcaccccggcc

SEQ ID NO: 2596987 - DNA, 23 bp, Homo sapiens
ttgccatctgcgtgacaataaaa

SEQ ID NO: 2596988 - DNA, 21 bp, Homo sapiens
ttgccatgggcttcactgtat

SEQ ID NO: 2596989 - DNA, 18 bp, Homo sapiens
ttgcccacaccgagggcg

SEQ ID NO: 2596990 - DNA, 22 bp, Homo sapiens
ttgcccagcattttactgattc

SEQ ID NO: 2596991 - DNA, 13 bp, Homo sapiens
ttgcccaggcagg

SEQ ID NO: 2596992 - DNA, 18 bp, Homo sapiens
ttgcccaggcaggtcttg

SEQ ID NO: 2596993 - DNA, 20 bp, Homo sapiens
ttgcccagggctcagcctgg

SEQ ID NO: 2596994 - DNA, 15 bp, Homo sapiens
ttgcccatccatctg

SEQ ID NO: 2596995 - DNA, 22 bp, Homo sapiens
ttgcccccagggcacttcacag

SEQ ID NO: 2596996 - DNA, 22 bp, Homo sapiens
ttgccccggccccggccccagc

SEQ ID NO: 2596997 - DNA, 19 bp, Homo sapiens
ttgcccggattctgggagg

SEQ ID NO: 2596998 - DNA, 15 bp, Homo sapiens
ttgccctcccatccc

SEQ ID NO: 2596999 - DNA, 13 bp, Homo sapiens
ttgccctgttaaa

SEQ ID NO: 2597000 - DNA, 17 bp, Homo sapiens
ttgcccttcacagtgtt

SEQ ID NO: 2597001 - DNA, 13 bp, Homo sapiens
ttgcccttccctg

SEQ ID NO: 2597002 - DNA, 17 bp, Homo sapiens
ttgcccttccctgtccc

SEQ ID NO: 2597003 - DNA, 15 bp, Homo sapiens
ttgccgtctacctga

SEQ ID NO: 2597004 - DNA, 21 bp, Homo sapiens
ttgcctcagtcccccaacaga

SEQ ID NO: 2597005 - DNA, 15 bp, Homo sapiens
ttgcctcctgtgtaa

SEQ ID NO: 2597006 - DNA, 20 bp, Homo sapiens
ttgcctgaagttggagtgag

SEQ ID NO: 2597007 - DNA, 20 bp, Homo sapiens
ttgcctgcagagagaagcct

SEQ ID NO: 2597008 - DNA, 21 bp, Homo sapiens
ttgccttgaaccacttccctc

SEQ ID NO: 2597009 - DNA, 22 bp, Homo sapiens
ttgcctttagtgatcacagcag

SEQ ID NO: 2597010 - DNA, 14 bp, Homo sapiens
ttgcgtatgtctgt

SEQ ID NO: 2597011 - DNA, 14 bp, Homo sapiens
ttgctaagatgctc

SEQ ID NO: 2597012 - DNA, 16 bp, Homo sapiens
ttgctaatcagtgtct

SEQ ID NO: 2597013 - DNA, 15 bp, Homo sapiens
ttgctatcttaattt

SEQ ID NO: 2597014 - DNA, 19 bp, Homo sapiens
ttgctattgtaaatatgtt

SEQ ID NO: 2597015 - DNA, 19 bp, Homo sapiens
ttgctcaaatctattcaga

SEQ ID NO: 2597016 - DNA, 23 bp, Homo sapiens
ttgctctccctcttctcaagtgc

SEQ ID NO: 2597017 - DNA, 14 bp, Homo sapiens
ttgctctggctgag

SEQ ID NO: 2597018 - DNA, 23 bp, Homo sapiens
ttgctctgtaatctcgtttcaaa

SEQ ID NO: 2597019 - DNA, 16 bp, Homo sapiens
ttgctgaaattttata

SEQ ID NO: 2597020 - DNA, 19 bp, Homo sapiens
ttgctgaaattttatatgc

SEQ ID NO: 2597021 - DNA, 20 bp, Homo sapiens
ttgctgccactttttaacta

SEQ ID NO: 2597022 - DNA, 21 bp, Homo sapiens
ttgctggaataagttcaaatt

SEQ ID NO: 2597023 - DNA, 21 bp, Homo sapiens
ttgctggacggggactgggga

SEQ ID NO: 2597024 - DNA, 14 bp, Homo sapiens
ttgctggttgctgt

SEQ ID NO: 2597025 - DNA, 22 bp, Homo sapiens
ttgctggttgctgtgtggtttg

SEQ ID NO: 2597026 - DNA, 20 bp, Homo sapiens
ttgctgtagaagatggcact

SEQ ID NO: 2597027 - DNA, 21 bp, Homo sapiens
ttgctgtcataagaatgaata

SEQ ID NO: 2597028 - DNA, 11 bp, Homo sapiens
ttgctgtccta

SEQ ID NO: 2597029 - DNA, 15 bp, Homo sapiens
ttgctgtcctaggcc

SEQ ID NO: 2597030 - DNA, 20 bp, Homo sapiens
ttgctgtgaattagctcact

SEQ ID NO: 2597031 - DNA, 13 bp, Homo sapiens
ttgctgtgggaac

SEQ ID NO: 2597032 - DNA, 19 bp, Homo sapiens
ttgctgttgtccctctgct

SEQ ID NO: 2597033 - DNA, 13 bp, Homo sapiens
ttgctgtttcctt

SEQ ID NO: 2597034 - DNA, 16 bp, Homo sapiens
ttgctgttttgttctg

SEQ ID NO: 2597035 - DNA, 21 bp, Homo sapiens
ttgctgttttgttctgtggtt

SEQ ID NO: 2597036 - DNA, 20 bp, Homo sapiens
ttgcttattgttccaagaca

SEQ ID NO: 2597037 - DNA, 23 bp, Homo sapiens
ttgcttattgttccaagacattg

SEQ ID NO: 2597038 - DNA, 12 bp, Homo sapiens
ttgcttcactca

SEQ ID NO: 2597039 - DNA, 18 bp, Homo sapiens
ttgctttaattgttaaga

SEQ ID NO: 2597040 - DNA, 19 bp, Homo sapiens
ttgctttactgtcaaaata

SEQ ID NO: 2597041 - DNA, 14 bp, Homo sapiens
ttgctttctgaaat

SEQ ID NO: 2597042 - DNA, 15 bp, Homo sapiens
ttgctttttcaccag

SEQ ID NO: 2597043 - DNA, 15 bp, Homo sapiens
ttgctttttctaatg

SEQ ID NO: 2597044 - DNA, 22 bp, Homo sapiens
ttggaaaagaatacagaaagat

SEQ ID NO: 2597045 - DNA, 15 bp, Homo sapiens
ttggaaacctgccct

SEQ ID NO: 2597046 - DNA, 17 bp, Homo sapiens
ttggaaacctgccctgc

SEQ ID NO: 2597047 - DNA, 18 bp, Homo sapiens
ttggaaagagtaggaaga

SEQ ID NO: 2597048 - DNA, 22 bp, Homo sapiens
ttggaaagcatcacctcaggcc

SEQ ID NO: 2597049 - DNA, 22 bp, Homo sapiens
ttggaaagctcctagcagagag

SEQ ID NO: 2597050 - DNA, 16 bp, Homo sapiens
ttggaactctgcttga

SEQ ID NO: 2597051 - DNA, 16 bp, Homo sapiens
ttggaagttttcagga

SEQ ID NO: 2597052 - DNA, 16 bp, Homo sapiens
ttggaatgcttcttct

SEQ ID NO: 2597053 - DNA, 18 bp, Homo sapiens
ttggaatgggcagctcat

SEQ ID NO: 2597054 - DNA, 18 bp, Homo sapiens
ttggaattaacctggtgc

SEQ ID NO: 2597055 - DNA, 22 bp, Homo sapiens
ttggaatttgtaacctcagctc

SEQ ID NO: 2597056 - DNA, 15 bp, Homo sapiens
ttggacactgtacaa

SEQ ID NO: 2597057 - DNA, 19 bp, Homo sapiens
ttggacagaagcagctctt

SEQ ID NO: 2597058 - DNA, 14 bp, Homo sapiens
ttggaccccagctg

SEQ ID NO: 2597059 - DNA, 17 bp, Homo sapiens
ttggaccccagctggga

SEQ ID NO: 2597060 - DNA, 16 bp, Homo sapiens
ttggacccgctctgga

SEQ ID NO: 2597061 - DNA, 21 bp, Homo sapiens
ttggaccctgaggcccagagg

SEQ ID NO: 2597062 - DNA, 14 bp, Homo sapiens
ttggacccttccat

SEQ ID NO: 2597063 - DNA, 15 bp, Homo sapiens
ttggacctctgctct

SEQ ID NO: 2597064 - DNA, 17 bp, Homo sapiens
ttggactcttgctcttt

SEQ ID NO: 2597065 - DNA, 14 bp, Homo sapiens
ttggactgacattt

SEQ ID NO: 2597066 - DNA, 14 bp, Homo sapiens
ttggagaaattatt

SEQ ID NO: 2597067 - DNA, 15 bp, Homo sapiens
ttggagaaattattt

SEQ ID NO: 2597068 - DNA, 17 bp, Homo sapiens
ttggagacattcctggg

SEQ ID NO: 2597069 - DNA, 20 bp, Homo sapiens
ttggagagtaaaaactgaat

SEQ ID NO: 2597070 - DNA, 13 bp, Homo sapiens
ttggagcctgcag

SEQ ID NO: 2597071 - DNA, 14 bp, Homo sapiens
ttggagctgagcct

SEQ ID NO: 2597072 - DNA, 21 bp, Homo sapiens
ttggagcttttttctttaaga

SEQ ID NO: 2597073 - DNA, 15 bp, Homo sapiens
ttggaggccagccag

SEQ ID NO: 2597074 - DNA, 23 bp, Homo sapiens
ttggagggtgggagagcccagcc

SEQ ID NO: 2597075 - DNA, 18 bp, Homo sapiens
ttggaggtgcttaagcag

SEQ ID NO: 2597076 - DNA, 23 bp, Homo sapiens
ttggagtcccctcacctcctcta

SEQ ID NO: 2597077 - DNA, 22 bp, Homo sapiens
ttggagtgttccccttccactg

SEQ ID NO: 2597078 - DNA, 21 bp, Homo sapiens
ttggatgggagtgagacagaa

SEQ ID NO: 2597079 - DNA, 18 bp, Homo sapiens
ttggattattcatttaaa

SEQ ID NO: 2597080 - DNA, 15 bp, Homo sapiens
ttggattatttaata

SEQ ID NO: 2597081 - DNA, 17 bp, Homo sapiens
ttggattatttaataac

SEQ ID NO: 2597082 - DNA, 21 bp, Homo sapiens
ttggattatttaataacatta

SEQ ID NO: 2597083 - DNA, 15 bp, Homo sapiens
ttggattgtccccga

SEQ ID NO: 2597084 - DNA, 18 bp, Homo sapiens
ttggatttgtttaaaagg

SEQ ID NO: 2597085 - DNA, 15 bp, Homo sapiens
ttggcacagaaacac

SEQ ID NO: 2597086 - DNA, 14 bp, Homo sapiens
ttggcactcacaga

SEQ ID NO: 2597087 - DNA, 16 bp, Homo sapiens
ttggcagctctactct

SEQ ID NO: 2597088 - DNA, 15 bp, Homo sapiens
ttggcatcagctggc

SEQ ID NO: 2597089 - DNA, 16 bp, Homo sapiens
ttggccatctctggat

SEQ ID NO: 2597090 - DNA, 18 bp, Homo sapiens
ttggcccctgcccggctg

SEQ ID NO: 2597091 - DNA, 12 bp, Homo sapiens
ttggcctcagaa

SEQ ID NO: 2597092 - DNA, 22 bp, Homo sapiens
ttggcctgtctcatccccaggg

SEQ ID NO: 2597093 - DNA, 20 bp, Homo sapiens
ttggctaactatatttgctt

SEQ ID NO: 2597094 - DNA, 22 bp, Homo sapiens
ttggctagaggttcaaagatat

SEQ ID NO: 2597095 - DNA, 22 bp, Homo sapiens
ttggctaggacccctccatgtg

SEQ ID NO: 2597096 - DNA, 23 bp, Homo sapiens
ttggctattagagatcaacccct

SEQ ID NO: 2597097 - DNA, 14 bp, Homo sapiens
ttggctcaatcctc

SEQ ID NO: 2597098 - DNA, 13 bp, Homo sapiens
ttggctgcaggga

SEQ ID NO: 2597099 - DNA, 15 bp, Homo sapiens
ttggctgctgaaggc

SEQ ID NO: 2597100 - DNA, 13 bp, Homo sapiens
ttggctgggccca

SEQ ID NO: 2597101 - DNA, 16 bp, Homo sapiens
ttggctgggcccagaa

SEQ ID NO: 2597102 - DNA, 21 bp, Homo sapiens
ttggctgtagaaggagacaga

SEQ ID NO: 2597103 - DNA, 23 bp, Homo sapiens
ttggcttcacggaagagccttgc

SEQ ID NO: 2597104 - DNA, 20 bp, Homo sapiens
ttgaataaaaatatgtacaa

SEQ ID NO: 2597105 - DNA, 16 bp, Homo sapiens
ttgaatataaacacta

SEQ ID NO: 2597106 - DNA, 22 bp, Homo sapiens
ttgaatataatatatttgtgta

SEQ ID NO: 2597107 - DNA, 19 bp, Homo sapiens
ttgaatatattataatctt

SEQ ID NO: 2597108 - DNA, 20 bp, Homo sapiens
ttgaatctatttaagtaaaa

SEQ ID NO: 2597109 - DNA, 21 bp, Homo sapiens
ttgaatgaaaaatttaagcat

SEQ ID NO: 2597110 - DNA, 23 bp, Homo sapiens
ttgaatgaaaaatttaagcattg

SEQ ID NO: 2597111 - DNA, 18 bp, Homo sapiens
ttgaatgacaacagaagc

SEQ ID NO: 2597112 - DNA, 20 bp, Homo sapiens
ttgaatgagatgattcagaa

SEQ ID NO: 2597113 - DNA, 23 bp, Homo sapiens
ttgaatgctttttgaatgttatt

SEQ ID NO: 2597114 - DNA, 17 bp, Homo sapiens
ttgaattaaattaggaa

SEQ ID NO: 2597115 - DNA, 18 bp, Homo sapiens
ttgaattatcttggttga

SEQ ID NO: 2597116 - DNA, 20 bp, Homo sapiens
ttgaattatcttggttgaaa

SEQ ID NO: 2597117 - DNA, 18 bp, Homo sapiens
ttgaattttgatgaacaa

SEQ ID NO: 2597118 - DNA, 16 bp, Homo sapiens
ttgacaaaatttgttg

SEQ ID NO: 2597119 - DNA, 18 bp, Homo sapiens
ttgacaaaggcaagcact

SEQ ID NO: 2597120 - DNA, 18 bp, Homo sapiens
ttgacaataaatgtgctt

SEQ ID NO: 2597121 - DNA, 18 bp, Homo sapiens
ttgacactatatctgtat

SEQ ID NO: 2597122 - DNA, 19 bp, Homo sapiens
ttgacactatatctgtata

SEQ ID NO: 2597123 - DNA, 14 bp, Homo sapiens
ttgacagaacactg

SEQ ID NO: 2597124 - DNA, 19 bp, Homo sapiens
ttgacagggcacaccgggc

SEQ ID NO: 2597125 - DNA, 23 bp, Homo sapiens
ttgacatgagatttataaggttt

SEQ ID NO: 2597126 - DNA, 16 bp, Homo sapiens
ttgaccaagcaggaag

SEQ ID NO: 2597127 - DNA, 20 bp, Homo sapiens
ttgaccaagcaggaagctca

SEQ ID NO: 2597128 - DNA, 22 bp, Homo sapiens
ttgaccagcagatcccagctca

SEQ ID NO: 2597129 - DNA, 11 bp, Homo sapiens
ttgaccaggcc

SEQ ID NO: 2597130 - DNA, 17 bp, Homo sapiens
ttgaccattctccacct

SEQ ID NO: 2597131 - DNA, 18 bp, Homo sapiens
ttgaccattctccacctg

SEQ ID NO: 2597132 - DNA, 14 bp, Homo sapiens
ttgacctctgcagc

SEQ ID NO: 2597133 - DNA, 22 bp, Homo sapiens
ttgacctgaggcccttctctcc

SEQ ID NO: 2597134 - DNA, 16 bp, Homo sapiens
ttgacgaagtctcttt

SEQ ID NO: 2597135 - DNA, 19 bp, Homo sapiens
ttgacgccatcccagcccc

SEQ ID NO: 2597136 - DNA, 20 bp, Homo sapiens
ttgacggatgattggattat

SEQ ID NO: 2597137 - DNA, 17 bp, Homo sapiens
ttgactgggtttctctg

SEQ ID NO: 2597138 - DNA, 23 bp, Homo sapiens
ttgactgggtttctctgtatagt

SEQ ID NO: 2597139 - DNA, 19 bp, Homo sapiens
ttgactgtttttacccata

SEQ ID NO: 2597140 - DNA, 23 bp, Homo sapiens
ttgactgtttttacccatatccc

SEQ ID NO: 2597141 - DNA, 12 bp, Homo sapiens
ttgactttcagg

SEQ ID NO: 2597142 - DNA, 16 bp, Homo sapiens
ttgactttttgcattt

SEQ ID NO: 2597143 - DNA, 23 bp, Homo sapiens
ttgagaaaccttattgtacctct

SEQ ID NO: 2597144 - DNA, 16 bp, Homo sapiens
ttgagaaatgcatatt

SEQ ID NO: 2597145 - DNA, 22 bp, Homo sapiens
ttgagaattgtgctcaaaattt

SEQ ID NO: 2597146 - DNA, 13 bp, Homo sapiens
ttgagacagtttc

SEQ ID NO: 2597147 - DNA, 13 bp, Homo sapiens
ttgagaccagcct

SEQ ID NO: 2597148 - DNA, 14 bp, Homo sapiens
ttgagactagtttt

SEQ ID NO: 2597149 - DNA, 18 bp, Homo sapiens
ttgagagttttgtcttga

SEQ ID NO: 2597150 - DNA, 18 bp, Homo sapiens
ttgagatagaagaactgc

SEQ ID NO: 2597151 - DNA, 17 bp, Homo sapiens
ttgagattagagggagg

SEQ ID NO: 2597152 - DNA, 18 bp, Homo sapiens
ttgagcagggatcctggt

SEQ ID NO: 2597153 - DNA, 16 bp, Homo sapiens
ttgagcagggctcagc

SEQ ID NO: 2597154 - DNA, 17 bp, Homo sapiens
ttgagccaggcctgggt

SEQ ID NO: 2597155 - DNA, 22 bp, Homo sapiens
ttgagccaggcctgggtctgtg

SEQ ID NO: 2597156 - DNA, 14 bp, Homo sapiens
ttgagccccaagtc

SEQ ID NO: 2597157 - DNA, 18 bp, Homo sapiens
ttgaggaaacaacagctt

SEQ ID NO: 2597158 - DNA, 13 bp, Homo sapiens
ttgaggagtgtga

SEQ ID NO: 2597159 - DNA, 13 bp, Homo sapiens
ttgaggccaggag

SEQ ID NO: 2597160 - DNA, 14 bp, Homo sapiens
ttgaggctgcagcg

SEQ ID NO: 2597161 - DNA, 16 bp, Homo sapiens
ttgagggcccagagca

SEQ ID NO: 2597162 - DNA, 22 bp, Homo sapiens
ttgaggggctggccttcctgcc

SEQ ID NO: 2597163 - DNA, 16 bp, Homo sapiens
ttgaggtcaagtaaga

SEQ ID NO: 2597164 - DNA, 17 bp, Homo sapiens
ttgaggtctgctcggcc

SEQ ID NO: 2597165 - DNA, 21 bp, Homo sapiens
ttgaggtggtctgaatgttct

SEQ ID NO: 2597166 - DNA, 21 bp, Homo sapiens
ttgagtgctgtctccatgttt

SEQ ID NO: 2597167 - DNA, 17 bp, Homo sapiens
ttgagtggatgatgttt

SEQ ID NO: 2597168 - DNA, 23 bp, Homo sapiens
ttgagtggggttatctctgtgtt

SEQ ID NO: 2597169 - DNA, 20 bp, Homo sapiens
ttgagttttatttattttat

SEQ ID NO: 2597170 - DNA, 20 bp, Homo sapiens
ttgataaagtagtaaaaatt

SEQ ID NO: 2597171 - DNA, 22 bp, Homo sapiens
ttgataagagggcacacactgt

SEQ ID NO: 2597172 - DNA, 19 bp, Homo sapiens
ttgataatcaactgggctg

SEQ ID NO: 2597173 - DNA, 18 bp, Homo sapiens
ttgataatgttaaatttg

SEQ ID NO: 2597174 - DNA, 19 bp, Homo sapiens
ttgataatgttaaatttgt

SEQ ID NO: 2597175 - DNA, 21 bp, Homo sapiens
ttgatatacttttttcttatt

SEQ ID NO: 2597176 - DNA, 21 bp, Homo sapiens
ttgatatgaaaaatatgatat

SEQ ID NO: 2597177 - DNA, 14 bp, Homo sapiens
ttgatcagtataat

SEQ ID NO: 2597178 - DNA, 18 bp, Homo sapiens
ttgatcattttcccccca

SEQ ID NO: 2597179 - DNA, 22 bp, Homo sapiens
ttgatcattttccccccactct

SEQ ID NO: 2597180 - DNA, 17 bp, Homo sapiens
ttgatgacccccaacca

SEQ ID NO: 2597181 - DNA, 19 bp, Homo sapiens
ttgatgcattaaaagaaaa

SEQ ID NO: 2597182 - DNA, 15 bp, Homo sapiens
ttgatgccaggacac

SEQ ID NO: 2597183 - DNA, 21 bp, Homo sapiens
ttgatggtaaccataatggaa

SEQ ID NO: 2597184 - DNA, 14 bp, Homo sapiens
ttgatgttaacaca

SEQ ID NO: 2597185 - DNA, 16 bp, Homo sapiens
ttgatgttaacacatt

SEQ ID NO: 2597186 - DNA, 16 bp, Homo sapiens
ttgatgttggctggga

SEQ ID NO: 2597187 - DNA, 15 bp, Homo sapiens
ttgatgtttgtggcc

SEQ ID NO: 2597188 - DNA, 18 bp, Homo sapiens
ttgatgtttgtggcctca

SEQ ID NO: 2597189 - DNA, 19 bp, Homo sapiens
ttgatgtttgtggcctcag

SEQ ID NO: 2597190 - DNA, 15 bp, Homo sapiens
ttgattaaattcttg

SEQ ID NO: 2597191 - DNA, 16 bp, Homo sapiens
ttgattattagccagg

SEQ ID NO: 2597192 - DNA, 15 bp, Homo sapiens
ttgattattcagtgt

SEQ ID NO: 2597193 - DNA, 20 bp, Homo sapiens
ttgattattctgattccact

SEQ ID NO: 2597194 - DNA, 21 bp, Homo sapiens
ttgattcagacagctgcctgg

SEQ ID NO: 2597195 - DNA, 12 bp, Homo sapiens
ttgattcttcct

SEQ ID NO: 2597196 - DNA, 12 bp, Homo sapiens
ttgattgctaaa

SEQ ID NO: 2597197 - DNA, 18 bp, Homo sapiens
ttgatttccgttaaaata

SEQ ID NO: 2597198 - DNA, 13 bp, Homo sapiens
ttgattttacaat

SEQ ID NO: 2597199 - DNA, 16 bp, Homo sapiens
ttgattttctgttgta

SEQ ID NO: 2597200 - DNA, 15 bp, Homo sapiens
ttgcaacacacagac

SEQ ID NO: 2597201 - DNA, 14 bp, Homo sapiens
ttgcaacaggctgg

SEQ ID NO: 2597202 - DNA, 14 bp, Homo sapiens
ttgcaaccgtctgt

SEQ ID NO: 2597203 - DNA, 12 bp, Homo sapiens
ttgcaacttcat

SEQ ID NO: 2597204 - DNA, 21 bp, Homo sapiens
ttgcaagtatgttttagcatg

SEQ ID NO: 2597205 - DNA, 22 bp, Homo sapiens
ttgcaagtatgttttagcatgt

SEQ ID NO: 2597206 - DNA, 16 bp, Homo sapiens
ttgcaagtcatggctg

SEQ ID NO: 2597207 - DNA, 16 bp, Homo sapiens
ttgcaatggcagcctt

SEQ ID NO: 2597208 - DNA, 17 bp, Homo sapiens
ttgcaatggcagccttg

SEQ ID NO: 2597209 - DNA, 19 bp, Homo sapiens
ttgcaatggcagccttggc

SEQ ID NO: 2597210 - DNA, 19 bp, Homo sapiens
ttgcaatggctatatggca

SEQ ID NO: 2597211 - DNA, 20 bp, Homo sapiens
ttgcaatggtgttgccctga

SEQ ID NO: 2597212 - DNA, 22 bp, Homo sapiens
ttgcacactcccctgcactgga

SEQ ID NO: 2597213 - DNA, 16 bp, Homo sapiens
ttgcacagttagcaaa

SEQ ID NO: 2597214 - DNA, 21 bp, Homo sapiens
ttgcaccactgcactccagcc

SEQ ID NO: 2597215 - DNA, 12 bp, Homo sapiens
ttgcacccagcc

SEQ ID NO: 2597216 - DNA, 19 bp, Homo sapiens
ttgcaccccatgctgttga

SEQ ID NO: 2597217 - DNA, 20 bp, Homo sapiens
ttgcacgcccatgtgtgagt

SEQ ID NO: 2597218 - DNA, 14 bp, Homo sapiens
ttgcactccagcct

SEQ ID NO: 2597219 - DNA, 15 bp, Homo sapiens
ttgcactccagcctg

SEQ ID NO: 2597220 - DNA, 16 bp, Homo sapiens
ttgcactccagcctgg

SEQ ID NO: 2597221 - DNA, 22 bp, Homo sapiens
ttgcactctaaaaggttcaggg

SEQ ID NO: 2597222 - DNA, 16 bp, Homo sapiens
ttctgcaccctccacc

SEQ ID NO: 2597223 - DNA, 22 bp, Homo sapiens
ttctgcaccctccaccctgtcc

SEQ ID NO: 2597224 - DNA, 23 bp, Homo sapiens
ttctgcaccctccaccctgtccc

SEQ ID NO: 2597225 - DNA, 23 bp, Homo sapiens
ttctgcagagtttccaaaaccag

SEQ ID NO: 2597226 - DNA, 20 bp, Homo sapiens
ttctgcagtagtctctgtgc

SEQ ID NO: 2597227 - DNA, 17 bp, Homo sapiens
ttctgcattttgctatt

SEQ ID NO: 2597228 - DNA, 21 bp, Homo sapiens
ttctgcattttgctattgtaa

SEQ ID NO: 2597229 - DNA, 19 bp, Homo sapiens
ttctgcccacattggaccc

SEQ ID NO: 2597230 - DNA, 15 bp, Homo sapiens
ttctgcctgcccagg

SEQ ID NO: 2597231 - DNA, 16 bp, Homo sapiens
ttctgcctgcccaggc

SEQ ID NO: 2597232 - DNA, 18 bp, Homo sapiens
ttctgcctgcccaggccc

SEQ ID NO: 2597233 - DNA, 21 bp, Homo sapiens
ttctgcctgcccaggcccctg

SEQ ID NO: 2597234 - DNA, 13 bp, Homo sapiens
ttctgcctgttat

SEQ ID NO: 2597235 - DNA, 15 bp, Homo sapiens
ttctgcctgttataa

SEQ ID NO: 2597236 - DNA, 20 bp, Homo sapiens
ttctgcctgttataactctg

SEQ ID NO: 2597237 - DNA, 24 bp, Homo sapiens
ttctgcctgttataactctgcact

SEQ ID NO: 2597238 - DNA, 11 bp, Homo sapiens
ttctgccttcc

SEQ ID NO: 2597239 - DNA, 15 bp, Homo sapiens
ttctgctacctcact

SEQ ID NO: 2597240 - DNA, 21 bp, Homo sapiens
ttctgctacctcactggggtc

SEQ ID NO: 2597241 - DNA, 19 bp, Homo sapiens
ttctgctcacatatctgtc

SEQ ID NO: 2597242 - DNA, 9 bp, Homo sapiens
ttctgctcc

SEQ ID NO: 2597243 - DNA, 15 bp, Homo sapiens
ttctgctccaccctt

SEQ ID NO: 2597244 - DNA, 16 bp, Homo sapiens
ttctgctccacccttg

SEQ ID NO: 2597245 - DNA, 11 bp, Homo sapiens
ttctgctcctc

SEQ ID NO: 2597246 - DNA, 15 bp, Homo sapiens
ttctgctggcctgga

SEQ ID NO: 2597247 - DNA, 18 bp, Homo sapiens
ttctgctggcctggatct

SEQ ID NO: 2597248 - DNA, 19 bp, Homo sapiens
ttctgctggcctggatctc

SEQ ID NO: 2597249 - DNA, 14 bp, Homo sapiens
ttctgcttcagcct

SEQ ID NO: 2597250 - DNA, 19 bp, Homo sapiens
ttctgcttcagcctcccga

SEQ ID NO: 2597251 - DNA, 18 bp, Homo sapiens
ttctggaaaagaggagtt

SEQ ID NO: 2597252 - DNA, 19 bp, Homo sapiens
ttctggaatacatgaaata

SEQ ID NO: 2597253 - DNA, 20 bp, Homo sapiens
ttctggaatgtaatcaatgt

SEQ ID NO: 2597254 - DNA, 22 bp, Homo sapiens
ttctggaatgtaatcaatgttt

SEQ ID NO: 2597255 - DNA, 21 bp, Homo sapiens
ttctggaccttgttgttgtta

SEQ ID NO: 2597256 - DNA, 20 bp, Homo sapiens
ttctggaggttgataacttt

SEQ ID NO: 2597257 - DNA, 15 bp, Homo sapiens
ttctggatgcatttc

SEQ ID NO: 2597258 - DNA, 17 bp, Homo sapiens
ttctggctcagggaggt

SEQ ID NO: 2597259 - DNA, 22 bp, Homo sapiens
ttctggctctcccatttcctga

SEQ ID NO: 2597260 - DNA, 17 bp, Homo sapiens
ttctggctcttccaggc

SEQ ID NO: 2597261 - DNA, 19 bp, Homo sapiens
ttctggctgaacactggca

SEQ ID NO: 2597262 - DNA, 20 bp, Homo sapiens
ttctggcttccttctctcaa

SEQ ID NO: 2597263 - DNA, 17 bp, Homo sapiens
ttctgggaaatggcttg

SEQ ID NO: 2597264 - DNA, 23 bp, Homo sapiens
ttctgggaaatggcttgaagcca

SEQ ID NO: 2597265 - DNA, 22 bp, Homo sapiens
ttctgggagacacccaaagggt

SEQ ID NO: 2597266 - DNA, 14 bp, Homo sapiens
ttctggggcccctt

SEQ ID NO: 2597267 - DNA, 13 bp, Homo sapiens
ttctgggtgtcca

SEQ ID NO: 2597268 - DNA, 21 bp, Homo sapiens
ttctggtctctaggctgggga

SEQ ID NO: 2597269 - DNA, 12 bp, Homo sapiens
ttctggtgtgaa

SEQ ID NO: 2597270 - DNA, 16 bp, Homo sapiens
ttctgtacatagccta

SEQ ID NO: 2597271 - DNA, 19 bp, Homo sapiens
ttctgtacatagcctatat

SEQ ID NO: 2597272 - DNA, 13 bp, Homo sapiens
ttctgtatacaac

SEQ ID NO: 2597273 - DNA, 24 bp, Homo sapiens
ttctgtatacaaccctggcattat

SEQ ID NO: 2597274 - DNA, 17 bp, Homo sapiens
ttctgtcctactctgtg

SEQ ID NO: 2597275 - DNA, 14 bp, Homo sapiens
ttctgtccttcaga

SEQ ID NO: 2597276 - DNA, 22 bp, Homo sapiens
ttctgtccttttggcactgaga

SEQ ID NO: 2597277 - DNA, 23 bp, Homo sapiens
ttctgtccttttggcactgagat

SEQ ID NO: 2597278 - DNA, 18 bp, Homo sapiens
ttctgtcgccttagcatg

SEQ ID NO: 2597279 - DNA, 16 bp, Homo sapiens
ttctgtctcatatgat

SEQ ID NO: 2597280 - DNA, 17 bp, Homo sapiens
ttctgtcttcacaacag

SEQ ID NO: 2597281 - DNA, 14 bp, Homo sapiens
ttctgtctttagat

SEQ ID NO: 2597282 - DNA, 15 bp, Homo sapiens
ttctgtgcctgaata

SEQ ID NO: 2597283 - DNA, 17 bp, Homo sapiens
ttctgtgcctgaatatt

SEQ ID NO: 2597284 - DNA, 23 bp, Homo sapiens
ttctgtggaaagtgtaaagcatt

SEQ ID NO: 2597285 - DNA, 22 bp, Homo sapiens
ttctgtgggagaattcttacat

SEQ ID NO: 2597286 - DNA, 18 bp, Homo sapiens
ttctgtggttttcccctc

SEQ ID NO: 2597287 - DNA, 20 bp, Homo sapiens
ttctgtggttttcccctccc

SEQ ID NO: 2597288 - DNA, 12 bp, Homo sapiens
ttctgtgtcttt

SEQ ID NO: 2597289 - DNA, 22 bp, Homo sapiens
ttctgtgtctttcacagctcct

SEQ ID NO: 2597290 - DNA, 23 bp, Homo sapiens
ttctgtgtgcaccttaccaactt

SEQ ID NO: 2597291 - DNA, 18 bp, Homo sapiens
ttctgttctttctggcta

SEQ ID NO: 2597292 - DNA, 21 bp, Homo sapiens
ttctgttggccagtgtgacaa

SEQ ID NO: 2597293 - DNA, 20 bp, Homo sapiens
ttctgttgtcattgctgttg

SEQ ID NO: 2597294 - DNA, 15 bp, Homo sapiens
ttctgttttctgttt

SEQ ID NO: 2597295 - DNA, 17 bp, Homo sapiens
ttctgttttgcctgaag

SEQ ID NO: 2597296 - DNA, 20 bp, Homo sapiens
ttctgtttttctaggcctgg

SEQ ID NO: 2597297 - DNA, 19 bp, Homo sapiens
ttcttaaataataaagatc

SEQ ID NO: 2597298 - DNA, 18 bp, Homo sapiens
ttcttaagacatgtatca

SEQ ID NO: 2597299 - DNA, 22 bp, Homo sapiens
ttcttaaggattgtgatatttt

SEQ ID NO: 2597300 - DNA, 23 bp, Homo sapiens
ttcttaatcttttcacaaataaa

SEQ ID NO: 2597301 - DNA, 16 bp, Homo sapiens
ttcttacataattttt

SEQ ID NO: 2597302 - DNA, 16 bp, Homo sapiens
ttcttacatgcatttg

SEQ ID NO: 2597303 - DNA, 15 bp, Homo sapiens
ttcttagctttttaa

SEQ ID NO: 2597304 - DNA, 17 bp, Homo sapiens
ttcttagggaaggatac

SEQ ID NO: 2597305 - DNA, 15 bp, Homo sapiens
ttcttagtagatttt

SEQ ID NO: 2597306 - DNA, 13 bp, Homo sapiens
ttcttagtgtcac

SEQ ID NO: 2597307 - DNA, 15 bp, Homo sapiens
ttcttagttgctgta

SEQ ID NO: 2597308 - DNA, 16 bp, Homo sapiens
ttcttatcttctgcaa

SEQ ID NO: 2597309 - DNA, 23 bp, Homo sapiens
ttcttatttaatgaaagactgta

SEQ ID NO: 2597310 - DNA, 15 bp, Homo sapiens
ttcttatttcatttc

SEQ ID NO: 2597311 - DNA, 19 bp, Homo sapiens
ttcttcaacaggagaattt

SEQ ID NO: 2597312 - DNA, 22 bp, Homo sapiens
ttcttcaacatcaatgttcatt

SEQ ID NO: 2597313 - DNA, 21 bp, Homo sapiens
ttcttcacccagctaatctgt

SEQ ID NO: 2597314 - DNA, 22 bp, Homo sapiens
ttcttcactgtcctccaagcca

SEQ ID NO: 2597315 - DNA, 17 bp, Homo sapiens
ttcttcagaagacactg

SEQ ID NO: 2597316 - DNA, 14 bp, Homo sapiens
ttcttcagccacct

SEQ ID NO: 2597317 - DNA, 18 bp, Homo sapiens
ttcttcataacaatttta

SEQ ID NO: 2597318 - DNA, 18 bp, Homo sapiens
ttcttcatgcaatgacat

SEQ ID NO: 2597319 - DNA, 21 bp, Homo sapiens
ttcttcattcaatacaagtgt

SEQ ID NO: 2597320 - DNA, 21 bp, Homo sapiens
ttcttcccttttacatactgc

SEQ ID NO: 2597321 - DNA, 12 bp, Homo sapiens
ttcttcctctgc

SEQ ID NO: 2597322 - DNA, 21 bp, Homo sapiens
ttcttctaggttctaaaaatt

SEQ ID NO: 2597323 - DNA, 20 bp, Homo sapiens
ttcttctgcttcagcctccc

SEQ ID NO: 2597324 - DNA, 22 bp, Homo sapiens
ttcttcttccaacgtggcccag

SEQ ID NO: 2597325 - DNA, 13 bp, Homo sapiens
ttcttcttccctc

SEQ ID NO: 2597326 - DNA, 15 bp, Homo sapiens
ttcttctttttgctg

SEQ ID NO: 2597327 - DNA, 13 bp, Homo sapiens
ttcttgaaagctg

SEQ ID NO: 2597328 - DNA, 14 bp, Homo sapiens
ttcttgaaagctgt

SEQ ID NO: 2597329 - DNA, 21 bp, Homo sapiens
ttcttgaatttaataatctgt

SEQ ID NO: 2597330 - DNA, 16 bp, Homo sapiens
ttcttgccaatgaggt

SEQ ID NO: 2597331 - DNA, 21 bp, Homo sapiens
ttcttgcctactatgccagat

SEQ ID NO: 2597332 - DNA, 23 bp, Homo sapiens
ttcttgctggttgtcatttttgc

SEQ ID NO: 2597333 - DNA, 14 bp, Homo sapiens
ttcttgggccctcc

SEQ ID NO: 2597334 - DNA, 21 bp, Homo sapiens
ttcttggtgcttacacatctc

SEQ ID NO: 2597335 - DNA, 17 bp, Homo sapiens
ttcttggttcataaatg

SEQ ID NO: 2597336 - DNA, 19 bp, Homo sapiens
ttcttggttcataaatgaa

SEQ ID NO: 2597337 - DNA, 17 bp, Homo sapiens
ttcttggtttgtaaatt

SEQ ID NO: 2597338 - DNA, 18 bp, Homo sapiens
ttcttggtttgtaaatta

SEQ ID NO: 2597339 - DNA, 11 bp, Homo sapiens
ttcttgtaatt

SEQ ID NO: 2597340 - DNA, 13 bp, Homo sapiens
ttcttgtagtagt

SEQ ID NO: 2597341 - DNA, 19 bp, Homo sapiens
ttcttgtattaagaatgaa

SEQ ID NO: 2597342 - DNA, 19 bp, Homo sapiens
ttctttaaaagaatgggca

SEQ ID NO: 2597343 - DNA, 18 bp, Homo sapiens
ttctttagagcattgcca

SEQ ID NO: 2597344 - DNA, 14 bp, Homo sapiens
ttctttaggagatt

SEQ ID NO: 2597345 - DNA, 14 bp, Homo sapiens
ttctttataaactt

SEQ ID NO: 2597346 - DNA, 22 bp, Homo sapiens
ttctttatacaacagtgctaaa

SEQ ID NO: 2597347 - DNA, 15 bp, Homo sapiens
ttctttatactgtaa

SEQ ID NO: 2597348 - DNA, 16 bp, Homo sapiens
ttctttatactgtaat

SEQ ID NO: 2597349 - DNA, 10 bp, Homo sapiens
ttctttcaag

SEQ ID NO: 2597350 - DNA, 14 bp, Homo sapiens
ttctttccaaagta

SEQ ID NO: 2597351 - DNA, 12 bp, Homo sapiens
ttctttccagag

SEQ ID NO: 2597352 - DNA, 21 bp, Homo sapiens
ttctttcctgaggctgggctc

SEQ ID NO: 2597353 - DNA, 18 bp, Homo sapiens
ttctttctagtggtcttt

SEQ ID NO: 2597354 - DNA, 21 bp, Homo sapiens
ttctttctagtggtctttgta

SEQ ID NO: 2597355 - DNA, 12 bp, Homo sapiens
ttctttgtgtag

SEQ ID NO: 2597356 - DNA, 19 bp, Homo sapiens
ttcttttactcatgatctt

SEQ ID NO: 2597357 - DNA, 12 bp, Homo sapiens
ttcttttatcac

SEQ ID NO: 2597358 - DNA, 23 bp, Homo sapiens
ttcttttggtaaagactggcttt

SEQ ID NO: 2597359 - DNA, 14 bp, Homo sapiens
ttctttttgctgtt

SEQ ID NO: 2597360 - DNA, 22 bp, Homo sapiens
ttcttttttgtgtgatttaaga

SEQ ID NO: 2597361 - DNA, 14 bp, Homo sapiens
ttctttttttgtga

SEQ ID NO: 2597362 - DNA, 20 bp, Homo sapiens
ttgaaaaaatagagcctgag

SEQ ID NO: 2597363 - DNA, 16 bp, Homo sapiens
ttgaaaaattcctatt

SEQ ID NO: 2597364 - DNA, 23 bp, Homo sapiens
ttgaaaaattcctattgtgattt

SEQ ID NO: 2597365 - DNA, 21 bp, Homo sapiens
ttgaaaacactgttctctgcc

SEQ ID NO: 2597366 - DNA, 18 bp, Homo sapiens
ttgaaaacataatctgca

SEQ ID NO: 2597367 - DNA, 16 bp, Homo sapiens
ttgaaaacctgacaaa

SEQ ID NO: 2597368 - DNA, 14 bp, Homo sapiens
ttgaaaacttttct

SEQ ID NO: 2597369 - DNA, 16 bp, Homo sapiens
ttgaaaacttttctca

SEQ ID NO: 2597370 - DNA, 18 bp, Homo sapiens
ttgaaaagactccaaaga

SEQ ID NO: 2597371 - DNA, 22 bp, Homo sapiens
ttgaaaagactccaaagaaatg

SEQ ID NO: 2597372 - DNA, 15 bp, Homo sapiens
tgtggaaagcctctg

SEQ ID NO: 2597373 - DNA, 17 bp, Homo sapiens
tgtggaaagcctctgct

SEQ ID NO: 2597374 - DNA, 21 bp, Homo sapiens
tgtggaaagtcacaggtcaca

SEQ ID NO: 2597375 - DNA, 19 bp, Homo sapiens
tgtggaaagtgaatttgaa

SEQ ID NO: 2597376 - DNA, 19 bp, Homo sapiens
tgtggaaattaagaagaaa

SEQ ID NO: 2597377 - DNA, 14 bp, Homo sapiens
tgtggaagcaaaaa

SEQ ID NO: 2597378 - DNA, 15 bp, Homo sapiens
tgtggacacagctct

SEQ ID NO: 2597379 - DNA, 16 bp, Homo sapiens
tgtggacacagctctt

SEQ ID NO: 2597380 - DNA, 18 bp, Homo sapiens
tgtggacacagctcttct

SEQ ID NO: 2597381 - DNA, 17 bp, Homo sapiens
tgtggaccactgcatga

SEQ ID NO: 2597382 - DNA, 19 bp, Homo sapiens
tgtggaccactgcatgagc

SEQ ID NO: 2597383 - DNA, 23 bp, Homo sapiens
tgtggagaaactgtagtctcagg

SEQ ID NO: 2597384 - DNA, 21 bp, Homo sapiens
tgtggagaagcggctggcagc

SEQ ID NO: 2597385 - DNA, 14 bp, Homo sapiens
tgtggaggaaggat

SEQ ID NO: 2597386 - DNA, 20 bp, Homo sapiens
tgtggaggagtccaggccat

SEQ ID NO: 2597387 - DNA, 22 bp, Homo sapiens
tgtggatgttttaattccatga

SEQ ID NO: 2597388 - DNA, 18 bp, Homo sapiens
tgtggcaagcccctgccc

SEQ ID NO: 2597389 - DNA, 21 bp, Homo sapiens
tgtggcatctttgccttgggc

SEQ ID NO: 2597390 - DNA, 10 bp, Homo sapiens
tgtggcctca

SEQ ID NO: 2597391 - DNA, 11 bp, Homo sapiens
tgtggcctcag

SEQ ID NO: 2597392 - DNA, 16 bp, Homo sapiens
tgtggcctgggcctcc

SEQ ID NO: 2597393 - DNA, 16 bp, Homo sapiens
tgtggcctgtggcctg

SEQ ID NO: 2597394 - DNA, 23 bp, Homo sapiens
tgtggcgcagcatattcaggaag

SEQ ID NO: 2597395 - DNA, 14 bp, Homo sapiens
tgtggctcccctct

SEQ ID NO: 2597396 - DNA, 14 bp, Homo sapiens
tgtggctgctagca

SEQ ID NO: 2597397 - DNA, 15 bp, Homo sapiens
tgtggctgggggcag

SEQ ID NO: 2597398 - DNA, 21 bp, Homo sapiens
tgtggctgtcagcaggaagca

SEQ ID NO: 2597399 - DNA, 22 bp, Homo sapiens
tgtggcttcttaatcttttcac

SEQ ID NO: 2597400 - DNA, 19 bp, Homo sapiens
tgtggctttcagcctctgg

SEQ ID NO: 2597401 - DNA, 12 bp, Homo sapiens
tgtgggaagggg

SEQ ID NO: 2597402 - DNA, 19 bp, Homo sapiens
tgtgggaatgcggcaagaa

SEQ ID NO: 2597403 - DNA, 13 bp, Homo sapiens
tgtgggagcagcg

SEQ ID NO: 2597404 - DNA, 13 bp, Homo sapiens
tgtgggagggagc

SEQ ID NO: 2597405 - DNA, 15 bp, Homo sapiens
tgtgggagtgtgtaa

SEQ ID NO: 2597406 - DNA, 16 bp, Homo sapiens
tgtgggcaggaagtga

SEQ ID NO: 2597407 - DNA, 13 bp, Homo sapiens
tgtgggggctgca

SEQ ID NO: 2597408 - DNA, 16 bp, Homo sapiens
tgtgggggtctgtgtg

SEQ ID NO: 2597409 - DNA, 16 bp, Homo sapiens
tgtgggtctgtgtgtg

SEQ ID NO: 2597410 - DNA, 13 bp, Homo sapiens
tgtgggtgggaga

SEQ ID NO: 2597411 - DNA, 22 bp, Homo sapiens
tgtggtagggacttaaaaaact

SEQ ID NO: 2597412 - DNA, 16 bp, Homo sapiens
tgtggtcccaacagga

SEQ ID NO: 2597413 - DNA, 15 bp, Homo sapiens
tgtggtgcctgaggt

SEQ ID NO: 2597414 - DNA, 13 bp, Homo sapiens
tgtggtgctgaca

SEQ ID NO: 2597415 - DNA, 14 bp, Homo sapiens
tgtggtgtttcctg

SEQ ID NO: 2597416 - DNA, 21 bp, Homo sapiens
tgtggtgtttcctgcaggcca

SEQ ID NO: 2597417 - DNA, 15 bp, Homo sapiens
tgtggttaatgccat

SEQ ID NO: 2597418 - DNA, 14 bp, Homo sapiens
tgtggtttatgtca

SEQ ID NO: 2597419 - DNA, 18 bp, Homo sapiens
tgtggttttcccctccct

SEQ ID NO: 2597420 - DNA, 23 bp, Homo sapiens
tgtggttttcccctccctgggtt

SEQ ID NO: 2597421 - DNA, 15 bp, Homo sapiens
tgtgtaaaaagagag

SEQ ID NO: 2597422 - DNA, 12 bp, Homo sapiens
tgtgtaacacag

SEQ ID NO: 2597423 - DNA, 20 bp, Homo sapiens
tgtgtaatcaataaacgatt

SEQ ID NO: 2597424 - DNA, 22 bp, Homo sapiens
tgtgtaatcatttcttgggccc

SEQ ID NO: 2597425 - DNA, 18 bp, Homo sapiens
tgtgtaatttaaaattgt

SEQ ID NO: 2597426 - DNA, 22 bp, Homo sapiens
tgtgtacacgggactgacgcaa

SEQ ID NO: 2597427 - DNA, 21 bp, Homo sapiens
tgtgtacagaattctgctacc

SEQ ID NO: 2597428 - DNA, 18 bp, Homo sapiens
tgtgtacagatgaatgat

SEQ ID NO: 2597429 - DNA, 20 bp, Homo sapiens
tgtgtacatcccatgtaaca

SEQ ID NO: 2597430 - DNA, 24 bp, Homo sapiens
tgtgtacatcccatgtaacagaaa

SEQ ID NO: 2597431 - DNA, 21 bp, Homo sapiens
tgtgtagagttaagaagctgt

SEQ ID NO: 2597432 - DNA, 15 bp, Homo sapiens
tgtgtagcctgtgca

SEQ ID NO: 2597433 - DNA, 23 bp, Homo sapiens
tgtgtagcctgtgcatgtatgtc

SEQ ID NO: 2597434 - DNA, 14 bp, Homo sapiens
tgtgtagctttgct

SEQ ID NO: 2597435 - DNA, 16 bp, Homo sapiens
tgtgtatccattatca

SEQ ID NO: 2597436 - DNA, 18 bp, Homo sapiens
tgtgtatccattatcatg

SEQ ID NO: 2597437 - DNA, 23 bp, Homo sapiens
tgtgtatccattatcatgtgtaa

SEQ ID NO: 2597438 - DNA, 14 bp, Homo sapiens
tgtgtatgggcaaa

SEQ ID NO: 2597439 - DNA, 14 bp, Homo sapiens
tgtgtatgtgcgtg

SEQ ID NO: 2597440 - DNA, 12 bp, Homo sapiens
tgtgtatgtggg

SEQ ID NO: 2597441 - DNA, 13 bp, Homo sapiens
tgtgtatttaaca

SEQ ID NO: 2597442 - DNA, 19 bp, Homo sapiens
tgtgtatttccagtgcaat

SEQ ID NO: 2597443 - DNA, 19 bp, Homo sapiens
tgtgtcaggtggggcagct

SEQ ID NO: 2597444 - DNA, 20 bp, Homo sapiens
tgtgtcaggtggggcagctt

SEQ ID NO: 2597445 - DNA, 18 bp, Homo sapiens
tgtgtccacgactgtctc

SEQ ID NO: 2597446 - DNA, 18 bp, Homo sapiens
tgtgtccatgtgtgtgca

SEQ ID NO: 2597447 - DNA, 18 bp, Homo sapiens
tgtgtccccctctgtcca

SEQ ID NO: 2597448 - DNA, 21 bp, Homo sapiens
tgtgtccccctctgtccaggc

SEQ ID NO: 2597449 - DNA, 17 bp, Homo sapiens
tgtgtccttccctgcat

SEQ ID NO: 2597450 - DNA, 13 bp, Homo sapiens
tgtgtctacagag

SEQ ID NO: 2597451 - DNA, 13 bp, Homo sapiens
tgtgtctcttggt

SEQ ID NO: 2597452 - DNA, 16 bp, Homo sapiens
tgtgtctcttggtcct

SEQ ID NO: 2597453 - DNA, 22 bp, Homo sapiens
tgtgtctcttggtcctgctgca

SEQ ID NO: 2597454 - DNA, 19 bp, Homo sapiens
tgtgtctgcgtctgtgttg

SEQ ID NO: 2597455 - DNA, 14 bp, Homo sapiens
tgtgtctgtacacg

SEQ ID NO: 2597456 - DNA, 21 bp, Homo sapiens
tgtgtcttgcaatggcagcct

SEQ ID NO: 2597457 - DNA, 18 bp, Homo sapiens
tgtgtctttcacagctcc

SEQ ID NO: 2597458 - DNA, 17 bp, Homo sapiens
tgtgtgatgaactttct

SEQ ID NO: 2597459 - DNA, 13 bp, Homo sapiens
tgtgtgcagtgaa

SEQ ID NO: 2597460 - DNA, 17 bp, Homo sapiens
tgtgtggactcaagtcc

SEQ ID NO: 2597461 - DNA, 14 bp, Homo sapiens
tgtgtgggagtgtg

SEQ ID NO: 2597462 - DNA, 16 bp, Homo sapiens
tgtgtgggagtgtgta

SEQ ID NO: 2597463 - DNA, 22 bp, Homo sapiens
tgtgtgtctaggcaggacctgt

SEQ ID NO: 2597464 - DNA, 16 bp, Homo sapiens
tgtgtgtcttaattat

SEQ ID NO: 2597465 - DNA, 19 bp, Homo sapiens
tgtgtgtgggctgtgagtg

SEQ ID NO: 2597466 - DNA, 12 bp, Homo sapiens
tgtgtgtgtgtg

SEQ ID NO: 2597467 - DNA, 13 bp, Homo sapiens
tgtgtgtgtgtgt

SEQ ID NO: 2597468 - DNA, 15 bp, Homo sapiens
tgtgtgtgtgtgtcc

SEQ ID NO: 2597469 - DNA, 16 bp, Homo sapiens
tgtgttatttaaatga

SEQ ID NO: 2597470 - DNA, 15 bp, Homo sapiens
tgtgttccaaccact

SEQ ID NO: 2597471 - DNA, 16 bp, Homo sapiens
tgtgttccaaccactg

SEQ ID NO: 2597472 - DNA, 11 bp, Homo sapiens
tgtgttcctgg

SEQ ID NO: 2597473 - DNA, 24 bp, Homo sapiens
tgtgttcctggcaatagtgtgttc

SEQ ID NO: 2597474 - DNA, 17 bp, Homo sapiens
tgtgttctgattagaaa

SEQ ID NO: 2597475 - DNA, 14 bp, Homo sapiens
tgtgttgtgtgtgg

SEQ ID NO: 2597476 - DNA, 14 bp, Homo sapiens
tgtgtttaaataaa

SEQ ID NO: 2597477 - DNA, 15 bp, Homo sapiens
tgtgtttaaataaag

SEQ ID NO: 2597478 - DNA, 18 bp, Homo sapiens
tgtgtttaaataaagtat

SEQ ID NO: 2597479 - DNA, 15 bp, Homo sapiens
tgtgtttatgtgtgt

SEQ ID NO: 2597480 - DNA, 18 bp, Homo sapiens
tgtgtttggttctggggc

SEQ ID NO: 2597481 - DNA, 20 bp, Homo sapiens
tgtgtttgttctttttattg

SEQ ID NO: 2597482 - DNA, 17 bp, Homo sapiens
tgtgttttcataataaa

SEQ ID NO: 2597483 - DNA, 14 bp, Homo sapiens
tgtgttttctgaat

SEQ ID NO: 2597484 - DNA, 20 bp, Homo sapiens
tgtgtttttaataaagacag

SEQ ID NO: 2597485 - DNA, 19 bp, Homo sapiens
tgtgtttttattgttaact

SEQ ID NO: 2597486 - DNA, 13 bp, Homo sapiens
tgtgtttttgaaa

SEQ ID NO: 2597487 - DNA, 14 bp, Homo sapiens
tgttaaaataacta

SEQ ID NO: 2597488 - DNA, 15 bp, Homo sapiens
tgttaaaatgtattc

SEQ ID NO: 2597489 - DNA, 16 bp, Homo sapiens
tgttaaatatttacat

SEQ ID NO: 2597490 - DNA, 18 bp, Homo sapiens
tgttaaattgctgtgtat

SEQ ID NO: 2597491 - DNA, 19 bp, Homo sapiens
tgttaaatttgtaagtttc

SEQ ID NO: 2597492 - DNA, 16 bp, Homo sapiens
tgttaaccagaataaa

SEQ ID NO: 2597493 - DNA, 15 bp, Homo sapiens
tgttaacctcagtgt

SEQ ID NO: 2597494 - DNA, 19 bp, Homo sapiens
tgttaacctcagtgtcatt

SEQ ID NO: 2597495 - DNA, 17 bp, Homo sapiens
tgttaactcttgtctat

SEQ ID NO: 2597496 - DNA, 22 bp, Homo sapiens
tgttaacttaatagtatttatg

SEQ ID NO: 2597497 - DNA, 22 bp, Homo sapiens
tgttaaggaaactcttatctca

SEQ ID NO: 2597498 - DNA, 17 bp, Homo sapiens
tgttaagtattttcata

SEQ ID NO: 2597499 - DNA, 13 bp, Homo sapiens
tgttaataaaagt

SEQ ID NO: 2597500 - DNA, 13 bp, Homo sapiens
tgttaatcaattt

SEQ ID NO: 2597501 - DNA, 17 bp, Homo sapiens
tgttaatcaatttaaac

SEQ ID NO: 2597502 - DNA, 19 bp, Homo sapiens
tgttaatgaaaatgtcaga

SEQ ID NO: 2597503 - DNA, 22 bp, Homo sapiens
tgttaattcagcactgatttca

SEQ ID NO: 2597504 - DNA, 15 bp, Homo sapiens
tgttacattattatc

SEQ ID NO: 2597505 - DNA, 13 bp, Homo sapiens
tgttacattttta

SEQ ID NO: 2597506 - DNA, 22 bp, Homo sapiens
tgttacctgaaaacactgtgca

SEQ ID NO: 2597507 - DNA, 16 bp, Homo sapiens
tgttactatctgcttt

SEQ ID NO: 2597508 - DNA, 13 bp, Homo sapiens
tgttactctggtt

SEQ ID NO: 2597509 - DNA, 20 bp, Homo sapiens
tgttactctggttctttgtt

SEQ ID NO: 2597510 - DNA, 14 bp, Homo sapiens
tgttacttacctaa

SEQ ID NO: 2597511 - DNA, 19 bp, Homo sapiens
tgttagaaaatggacactg

SEQ ID NO: 2597512 - DNA, 21 bp, Homo sapiens
tgttagaggttttaaagtgat

SEQ ID NO: 2597513 - DNA, 17 bp, Homo sapiens
tgttagtatgaggcatt

SEQ ID NO: 2597514 - DNA, 15 bp, Homo sapiens
tgttagtcatttgct

SEQ ID NO: 2597515 - DNA, 17 bp, Homo sapiens
tgttagttatagatgtc

SEQ ID NO: 2597516 - DNA, 23 bp, Homo sapiens
tgttataactctgcactactcct

SEQ ID NO: 2597517 - DNA, 13 bp, Homo sapiens
tgttatataaatg

SEQ ID NO: 2597518 - DNA, 13 bp, Homo sapiens
tgttatcaaactt

SEQ ID NO: 2597519 - DNA, 18 bp, Homo sapiens
tgttatggcttaatgaca

SEQ ID NO: 2597520 - DNA, 22 bp, Homo sapiens
tgttatgtaaaaggccaaacct

SEQ ID NO: 2597521 - DNA, 22 bp, Homo sapiens
tgttattaaacgtatgcatgtg

SEQ ID NO: 2597522 - DNA, 14 bp, Homo sapiens
tgttatttaaagaa

SEQ ID NO: 2597523 - DNA, 18 bp, Homo sapiens
tgttatttataatcactt

SEQ ID NO: 2597524 - DNA, 15 bp, Homo sapiens
tggtgctgacctctg

SEQ ID NO: 2597525 - DNA, 13 bp, Homo sapiens
tggtgctgggact

SEQ ID NO: 2597526 - DNA, 13 bp, Homo sapiens
tggtgctgtggcc

SEQ ID NO: 2597527 - DNA, 22 bp, Homo sapiens
tggtgcttacacatctcagacc

SEQ ID NO: 2597528 - DNA, 19 bp, Homo sapiens
tggtggaagaggggacagg

SEQ ID NO: 2597529 - DNA, 16 bp, Homo sapiens
tggtggacagtcctgg

SEQ ID NO: 2597530 - DNA, 15 bp, Homo sapiens
tggtggcacaggccc

SEQ ID NO: 2597531 - DNA, 12 bp, Homo sapiens
tggtggcagtgg

SEQ ID NO: 2597532 - DNA, 13 bp, Homo sapiens
tggtggcagtggg

SEQ ID NO: 2597533 - DNA, 21 bp, Homo sapiens
tggtggctcccggagggccct

SEQ ID NO: 2597534 - DNA, 13 bp, Homo sapiens
tggtggctttgca

SEQ ID NO: 2597535 - DNA, 21 bp, Homo sapiens
tggtggggaggggcgctggcc

SEQ ID NO: 2597536 - DNA, 23 bp, Homo sapiens
tggtggggtgtgttccaactgcc

SEQ ID NO: 2597537 - DNA, 17 bp, Homo sapiens
tggtgggtccatgggca

SEQ ID NO: 2597538 - DNA, 13 bp, Homo sapiens
tggtgtaataaga

SEQ ID NO: 2597539 - DNA, 17 bp, Homo sapiens
tggtgtaataagacata

SEQ ID NO: 2597540 - DNA, 16 bp, Homo sapiens
tggtgtcacctgaaga

SEQ ID NO: 2597541 - DNA, 15 bp, Homo sapiens
tggtgtcctgaccac

SEQ ID NO: 2597542 - DNA, 19 bp, Homo sapiens
tggtgtctggattcccagg

SEQ ID NO: 2597543 - DNA, 14 bp, Homo sapiens
tggtgtgaactaaa

SEQ ID NO: 2597544 - DNA, 22 bp, Homo sapiens
tggtgtgaactaaactttcaca

SEQ ID NO: 2597545 - DNA, 23 bp, Homo sapiens
tggtgtgaccactgcagaagaca

SEQ ID NO: 2597546 - DNA, 16 bp, Homo sapiens
tggtgtgatcgtctga

SEQ ID NO: 2597547 - DNA, 19 bp, Homo sapiens
tggtgtgtccccctctgtc

SEQ ID NO: 2597548 - DNA, 13 bp, Homo sapiens
tggtgttgcagaa

SEQ ID NO: 2597549 - DNA, 18 bp, Homo sapiens
tggtgtttctagcactgg

SEQ ID NO: 2597550 - DNA, 21 bp, Homo sapiens
tggtgtttctagcactggcct

SEQ ID NO: 2597551 - DNA, 16 bp, Homo sapiens
tggtgtttctccctct

SEQ ID NO: 2597552 - DNA, 20 bp, Homo sapiens
tggtgttttcttatgcagga

SEQ ID NO: 2597553 - DNA, 17 bp, Homo sapiens
tggttaatctttcctga

SEQ ID NO: 2597554 - DNA, 20 bp, Homo sapiens
tggttaggcattgtgggaag

SEQ ID NO: 2597555 - DNA, 22 bp, Homo sapiens
tggttcagggttggcccctgcc

SEQ ID NO: 2597556 - DNA, 15 bp, Homo sapiens
tggttcataaatgaa

SEQ ID NO: 2597557 - DNA, 13 bp, Homo sapiens
tggttccatgcct

SEQ ID NO: 2597558 - DNA, 12 bp, Homo sapiens
tggttctggggc

SEQ ID NO: 2597559 - DNA, 13 bp, Homo sapiens
tggttctgtgcca

SEQ ID NO: 2597560 - DNA, 18 bp, Homo sapiens
tggttcttgtattaagaa

SEQ ID NO: 2597561 - DNA, 16 bp, Homo sapiens
tggttgaaaataaaaa

SEQ ID NO: 2597562 - DNA, 15 bp, Homo sapiens
tggttgactgggttt

SEQ ID NO: 2597563 - DNA, 17 bp, Homo sapiens
tggttgagaaatgaata

SEQ ID NO: 2597564 - DNA, 18 bp, Homo sapiens
tggttgatgatctttgca

SEQ ID NO: 2597565 - DNA, 18 bp, Homo sapiens
tggttgctttaatatcat

SEQ ID NO: 2597566 - DNA, 15 bp, Homo sapiens
tggttgtcaatatta

SEQ ID NO: 2597567 - DNA, 23 bp, Homo sapiens
tggttgtcatttttgcagtagag

SEQ ID NO: 2597568 - DNA, 22 bp, Homo sapiens
tggttgttagttatagatgtct

SEQ ID NO: 2597569 - DNA, 12 bp, Homo sapiens
tggtttatgtca

SEQ ID NO: 2597570 - DNA, 23 bp, Homo sapiens
tggtttgagcttagtgaaattac

SEQ ID NO: 2597571 - DNA, 23 bp, Homo sapiens
tggtttggggcgaggcagaggac

SEQ ID NO: 2597572 - DNA, 17 bp, Homo sapiens
tggttttcaaaataaaa

SEQ ID NO: 2597573 - DNA, 16 bp, Homo sapiens
tggttttcctaaatgc

SEQ ID NO: 2597574 - DNA, 12 bp, Homo sapiens
tggttttctgtt

SEQ ID NO: 2597575 - DNA, 16 bp, Homo sapiens
tggttttctgttcttt

SEQ ID NO: 2597576 - DNA, 18 bp, Homo sapiens
tggttttgtaagatgctg

SEQ ID NO: 2597577 - DNA, 13 bp, Homo sapiens
tgtaaaaaaaaaa

SEQ ID NO: 2597578 - DNA, 20 bp, Homo sapiens
tgtaaaaaaaaaaaagttat

SEQ ID NO: 2597579 - DNA, 20 bp, Homo sapiens
tgtaaaaacagcattgcttt

SEQ ID NO: 2597580 - DNA, 22 bp, Homo sapiens
tgtaaaaacagcattgctttct

SEQ ID NO: 2597581 - DNA, 23 bp, Homo sapiens
tgtaaaaacagcattgctttctg

SEQ ID NO: 2597582 - DNA, 14 bp, Homo sapiens
tgtaaaaactgtgg

SEQ ID NO: 2597583 - DNA, 22 bp, Homo sapiens
tgtaaaacgagaatccacccat

SEQ ID NO: 2597584 - DNA, 21 bp, Homo sapiens
tgtaaaaggccaaacctctgt

SEQ ID NO: 2597585 - DNA, 23 bp, Homo sapiens
tgtaaaaggccaaacctctgttc

SEQ ID NO: 2597586 - DNA, 20 bp, Homo sapiens
tgtaaaatagcttgtatagt

SEQ ID NO: 2597587 - DNA, 22 bp, Homo sapiens
tgtaaaatcttggcacagaaac

SEQ ID NO: 2597588 - DNA, 11 bp, Homo sapiens
tgtaaaatggt

SEQ ID NO: 2597589 - DNA, 17 bp, Homo sapiens
tgtaaaatttcacttaa

SEQ ID NO: 2597590 - DNA, 14 bp, Homo sapiens
tgtaaacatgtgtt

SEQ ID NO: 2597591 - DNA, 12 bp, Homo sapiens
tgtaaaccaaag

SEQ ID NO: 2597592 - DNA, 14 bp, Homo sapiens
tgtaaaccaaagcc

SEQ ID NO: 2597593 - DNA, 20 bp, Homo sapiens
tgtaaactcaaaatatttgt

SEQ ID NO: 2597594 - DNA, 15 bp, Homo sapiens
tgtaaactgtgcacc

SEQ ID NO: 2597595 - DNA, 19 bp, Homo sapiens
tgtaaactgtgtattccaa

SEQ ID NO: 2597596 - DNA, 22 bp, Homo sapiens
tgtaaactgtgtattccaagac

SEQ ID NO: 2597597 - DNA, 23 bp, Homo sapiens
tgtaaagagacctacctcaggtt

SEQ ID NO: 2597598 - DNA, 17 bp, Homo sapiens
tgtaaagtgtaaatcct

SEQ ID NO: 2597599 - DNA, 12 bp, Homo sapiens
tgtaaagtgtgg

SEQ ID NO: 2597600 - DNA, 17 bp, Homo sapiens
tgtaaagttagtctact

SEQ ID NO: 2597601 - DNA, 13 bp, Homo sapiens
tgtaaatacataa

SEQ ID NO: 2597602 - DNA, 20 bp, Homo sapiens
tgtaaatcctttttctttat

SEQ ID NO: 2597603 - DNA, 15 bp, Homo sapiens
tgtaaatgcatctgt

SEQ ID NO: 2597604 - DNA, 18 bp, Homo sapiens
tgtaaatgcatctgtcct

SEQ ID NO: 2597605 - DNA, 22 bp, Homo sapiens
tgtaaatgctgtcaactatgat

SEQ ID NO: 2597606 - DNA, 15 bp, Homo sapiens
tgtaaatggtgtaca

SEQ ID NO: 2597607 - DNA, 11 bp, Homo sapiens
tgtaaatgtat

SEQ ID NO: 2597608 - DNA, 16 bp, Homo sapiens
tgtaaattaactttta

SEQ ID NO: 2597609 - DNA, 15 bp, Homo sapiens
tgtaaatttatgtga

SEQ ID NO: 2597610 - DNA, 16 bp, Homo sapiens
tgtaaatttatgtgat

SEQ ID NO: 2597611 - DNA, 17 bp, Homo sapiens
tgtaaatttatgtgatg

SEQ ID NO: 2597612 - DNA, 21 bp, Homo sapiens
tgtaacacagctgagagactt

SEQ ID NO: 2597613 - DNA, 23 bp, Homo sapiens
tgtaacacagctgagagactttt

SEQ ID NO: 2597614 - DNA, 18 bp, Homo sapiens
tgtaacagccaggagtgt

SEQ ID NO: 2597615 - DNA, 11 bp, Homo sapiens
tgtaacagctg

SEQ ID NO: 2597616 - DNA, 20 bp, Homo sapiens
tgtaacaggtctcctcttaa

SEQ ID NO: 2597617 - DNA, 14 bp, Homo sapiens
tgtaacagtctgat

SEQ ID NO: 2597618 - DNA, 16 bp, Homo sapiens
tgtaacagtctgatcg

SEQ ID NO: 2597619 - DNA, 12 bp, Homo sapiens
tgtaacctcagc

SEQ ID NO: 2597620 - DNA, 16 bp, Homo sapiens
tgtaacctcagctctg

SEQ ID NO: 2597621 - DNA, 18 bp, Homo sapiens
tgtaacctcagctctggg

SEQ ID NO: 2597622 - DNA, 23 bp, Homo sapiens
tgtaacctcagctctgggagagg

SEQ ID NO: 2597623 - DNA, 18 bp, Homo sapiens
tgtaacgttgctgtggga

SEQ ID NO: 2597624 - DNA, 19 bp, Homo sapiens
tgtaactatagtccagctt

SEQ ID NO: 2597625 - DNA, 12 bp, Homo sapiens
tgtaactgctga

SEQ ID NO: 2597626 - DNA, 12 bp, Homo sapiens
tgtaagaaatac

SEQ ID NO: 2597627 - DNA, 17 bp, Homo sapiens
tgtaagaagagactggg

SEQ ID NO: 2597628 - DNA, 19 bp, Homo sapiens
tgtaagaagagactgggaa

SEQ ID NO: 2597629 - DNA, 21 bp, Homo sapiens
tgtaagacaaaggttttcctc

SEQ ID NO: 2597630 - DNA, 19 bp, Homo sapiens
tgtaagagcaccttcctca

SEQ ID NO: 2597631 - DNA, 22 bp, Homo sapiens
tgtaagagcaccttcctcactt

SEQ ID NO: 2597632 - DNA, 21 bp, Homo sapiens
tgtaagagtgtagaagcattc

SEQ ID NO: 2597633 - DNA, 20 bp, Homo sapiens
tgtaagatcgttctctgcct

SEQ ID NO: 2597634 - DNA, 15 bp, Homo sapiens
tgtaagatgctgggt

SEQ ID NO: 2597635 - DNA, 14 bp, Homo sapiens
tgtaagctgaaaat

SEQ ID NO: 2597636 - DNA, 16 bp, Homo sapiens
tgtaagctgtttattt

SEQ ID NO: 2597637 - DNA, 14 bp, Homo sapiens
tgtaaggcatgaag

SEQ ID NO: 2597638 - DNA, 17 bp, Homo sapiens
tgtaagtgtgagtaaga

SEQ ID NO: 2597639 - DNA, 21 bp, Homo sapiens
tgtaagtgtgagtaagagctg

SEQ ID NO: 2597640 - DNA, 20 bp, Homo sapiens
tgtaagtttacctatgtaac

SEQ ID NO: 2597641 - DNA, 18 bp, Homo sapiens
tgtaagtttcaggtgaca

SEQ ID NO: 2597642 - DNA, 18 bp, Homo sapiens
tgtaatagaaaactgaaa

SEQ ID NO: 2597643 - DNA, 15 bp, Homo sapiens
tgtaatcaataaacg

SEQ ID NO: 2597644 - DNA, 18 bp, Homo sapiens
tgtaatcaataaacgatt

SEQ ID NO: 2597645 - DNA, 20 bp, Homo sapiens
tgtaatcaatgtttcttcta

SEQ ID NO: 2597646 - DNA, 17 bp, Homo sapiens
tgtaatcatataataaa

SEQ ID NO: 2597647 - DNA, 21 bp, Homo sapiens
tgtaatcgttatgtgtgtata

SEQ ID NO: 2597648 - DNA, 21 bp, Homo sapiens
tgtaatcttgaattgtaactg

SEQ ID NO: 2597649 - DNA, 20 bp, Homo sapiens
tgtaatgaatctaagcagca

SEQ ID NO: 2597650 - DNA, 20 bp, Homo sapiens
tgtaatggtatcttaaagtg

SEQ ID NO: 2597651 - DNA, 13 bp, Homo sapiens
tgtaatgttactg

SEQ ID NO: 2597652 - DNA, 17 bp, Homo sapiens
tgtaattaagtactatg

SEQ ID NO: 2597653 - DNA, 15 bp, Homo sapiens
tgtaattctaaatga

SEQ ID NO: 2597654 - DNA, 14 bp, Homo sapiens
tgtaattgcttaca

SEQ ID NO: 2597655 - DNA, 18 bp, Homo sapiens
tgtaattgcttacatttt

SEQ ID NO: 2597656 - DNA, 17 bp, Homo sapiens
tgtaatttaaaattgtg

SEQ ID NO: 2597657 - DNA, 18 bp, Homo sapiens
tgtaatttaaaattgtga

SEQ ID NO: 2597658 - DNA, 21 bp, Homo sapiens
tgtaatttaaaattgtgatgt

SEQ ID NO: 2597659 - DNA, 15 bp, Homo sapiens
tgtaatttaaacagg

SEQ ID NO: 2597660 - DNA, 22 bp, Homo sapiens
tgtaatttaaacaggcccagca

SEQ ID NO: 2597661 - DNA, 18 bp, Homo sapiens
tgtaatttctttgcctgt

SEQ ID NO: 2597662 - DNA, 20 bp, Homo sapiens
tgtaatttttttatcgtcac

SEQ ID NO: 2597663 - DNA, 13 bp, Homo sapiens
tgtacaaaataaa

SEQ ID NO: 2597664 - DNA, 19 bp, Homo sapiens
tgtacaaagtagaagtctt

SEQ ID NO: 2597665 - DNA, 14 bp, Homo sapiens
tgtacaatatttaa

SEQ ID NO: 2597666 - DNA, 22 bp, Homo sapiens
tgtacaattgaacttaaataaa

SEQ ID NO: 2597667 - DNA, 15 bp, Homo sapiens
tgtacacgggactga

SEQ ID NO: 2597668 - DNA, 17 bp, Homo sapiens
tgtacacgtgtcctgta

SEQ ID NO: 2597669 - DNA, 16 bp, Homo sapiens
ttaactttaagactga

SEQ ID NO: 2597670 - DNA, 16 bp, Homo sapiens
ttaactttaagtttca

SEQ ID NO: 2597671 - DNA, 18 bp, Homo sapiens
ttaactttatcacattat

SEQ ID NO: 2597672 - DNA, 23 bp, Homo sapiens
ttaactttatcacattatttgca

SEQ ID NO: 2597673 - DNA, 12 bp, Homo sapiens
ttaacttttata

SEQ ID NO: 2597674 - DNA, 17 bp, Homo sapiens
ttaacttttataaactt

SEQ ID NO: 2597675 - DNA, 18 bp, Homo sapiens
ttaacttttataaacttt

SEQ ID NO: 2597676 - DNA, 20 bp, Homo sapiens
ttaagaaaaaggatgcacag

SEQ ID NO: 2597677 - DNA, 21 bp, Homo sapiens
ttaagaaaaaggatgcacaga

SEQ ID NO: 2597678 - DNA, 16 bp, Homo sapiens
ttaagaagctgttgta

SEQ ID NO: 2597679 - DNA, 22 bp, Homo sapiens
ttaagaagctgttgtacattta

SEQ ID NO: 2597680 - DNA, 23 bp, Homo sapiens
ttaagaagctgttgtacatttat

SEQ ID NO: 2597681 - DNA, 22 bp, Homo sapiens
ttaagaatgaaatactgtttga

SEQ ID NO: 2597682 - DNA, 23 bp, Homo sapiens
ttaagagccatataagtttgaag

SEQ ID NO: 2597683 - DNA, 13 bp, Homo sapiens
ttaagaggcaggg

SEQ ID NO: 2597684 - DNA, 21 bp, Homo sapiens
ttaagagtgggggagagcagg

SEQ ID NO: 2597685 - DNA, 21 bp, Homo sapiens
ttaagataatagtttacatgt

SEQ ID NO: 2597686 - DNA, 14 bp, Homo sapiens
ttaagatttttctc

SEQ ID NO: 2597687 - DNA, 22 bp, Homo sapiens
ttaagatttttctcaaagtttt

SEQ ID NO: 2597688 - DNA, 13 bp, Homo sapiens
ttaagcattacca

SEQ ID NO: 2597689 - DNA, 18 bp, Homo sapiens
ttaagcattaccactcag

SEQ ID NO: 2597690 - DNA, 16 bp, Homo sapiens
ttaagccatcttggta

SEQ ID NO: 2597691 - DNA, 18 bp, Homo sapiens
ttaagccatcttggtaaa

SEQ ID NO: 2597692 - DNA, 19 bp, Homo sapiens
ttaagcctcatatttaaag

SEQ ID NO: 2597693 - DNA, 21 bp, Homo sapiens
ttaagcctcatatttaaagac

SEQ ID NO: 2597694 - DNA, 14 bp, Homo sapiens
ttaaggaaacaata

SEQ ID NO: 2597695 - DNA, 16 bp, Homo sapiens
ttaaggaaactcttat

SEQ ID NO: 2597696 - DNA, 17 bp, Homo sapiens
ttaaggatgcttgtaca

SEQ ID NO: 2597697 - DNA, 20 bp, Homo sapiens
ttaaggatgcttgtacataa

SEQ ID NO: 2597698 - DNA, 20 bp, Homo sapiens
ttaaggattgtgatattttt

SEQ ID NO: 2597699 - DNA, 21 bp, Homo sapiens
ttaagggatggaaaaggaaga

SEQ ID NO: 2597700 - DNA, 17 bp, Homo sapiens
ttaagtatttatatatt

SEQ ID NO: 2597701 - DNA, 15 bp, Homo sapiens
ttaagtctgttttat

SEQ ID NO: 2597702 - DNA, 14 bp, Homo sapiens
ttaagtgctgcatt

SEQ ID NO: 2597703 - DNA, 15 bp, Homo sapiens
ttaagtgctgcattt

SEQ ID NO: 2597704 - DNA, 16 bp, Homo sapiens
ttaagtgctgcattta

SEQ ID NO: 2597705 - DNA, 22 bp, Homo sapiens
ttaagtgctgcatttaaaagat

SEQ ID NO: 2597706 - DNA, 16 bp, Homo sapiens
ttaagtgctttgtaat

SEQ ID NO: 2597707 - DNA, 22 bp, Homo sapiens
ttaagttacacatttttcagat

SEQ ID NO: 2597708 - DNA, 22 bp, Homo sapiens
ttaagttctggatgcatttctc

SEQ ID NO: 2597709 - DNA, 15 bp, Homo sapiens
ttaagtttctcagct

SEQ ID NO: 2597710 - DNA, 11 bp, Homo sapiens
ttaataaaaag

SEQ ID NO: 2597711 - DNA, 13 bp, Homo sapiens
ttaataacattac

SEQ ID NO: 2597712 - DNA, 17 bp, Homo sapiens
ttaataacattacctta

SEQ ID NO: 2597713 - DNA, 17 bp, Homo sapiens
ttaataagtttcactga

SEQ ID NO: 2597714 - DNA, 23 bp, Homo sapiens
ttaataataaattccctggcctt

SEQ ID NO: 2597715 - DNA, 20 bp, Homo sapiens
ttaatagcttttattgtata

SEQ ID NO: 2597716 - DNA, 22 bp, Homo sapiens
ttaatagcttttattgtataaa

SEQ ID NO: 2597717 - DNA, 22 bp, Homo sapiens
ttattttggaaaataaattatt

SEQ ID NO: 2597718 - DNA, 18 bp, Homo sapiens
ttattttggtacttttat

SEQ ID NO: 2597719 - DNA, 13 bp, Homo sapiens
ttatttttaaaat

SEQ ID NO: 2597720 - DNA, 17 bp, Homo sapiens
ttatttttagacagagt

SEQ ID NO: 2597721 - DNA, 20 bp, Homo sapiens
ttatttttatatcagcctga

SEQ ID NO: 2597722 - DNA, 23 bp, Homo sapiens
ttatttttgacagtgttgaaaat

SEQ ID NO: 2597723 - DNA, 19 bp, Homo sapiens
ttattttttcagaccgaaa

SEQ ID NO: 2597724 - DNA, 14 bp, Homo sapiens
ttatttttttctac

SEQ ID NO: 2597725 - DNA, 23 bp, Homo sapiens
ttcaaaaacacagtgtttttgta

SEQ ID NO: 2597726 - DNA, 21 bp, Homo sapiens
ttcaaaagtattttcctgtaa

SEQ ID NO: 2597727 - DNA, 17 bp, Homo sapiens
ttcaaaagttgaaatta

SEQ ID NO: 2597728 - DNA, 23 bp, Homo sapiens
ttcaaagccaagtttatatacaa

SEQ ID NO: 2597729 - DNA, 19 bp, Homo sapiens
ttcaaatagggtctaactc

SEQ ID NO: 2597730 - DNA, 22 bp, Homo sapiens
ttcaaatgatttttacaagttt

SEQ ID NO: 2597731 - DNA, 21 bp, Homo sapiens
ttcaacatcaatgttcattgt

SEQ ID NO: 2597732 - DNA, 22 bp, Homo sapiens
ttcaacatcaatgttcattgta

SEQ ID NO: 2597733 - DNA, 15 bp, Homo sapiens
ttcaaccctggagag

SEQ ID NO: 2597734 - DNA, 17 bp, Homo sapiens
ttcaactgaccagcctc

SEQ ID NO: 2597735 - DNA, 13 bp, Homo sapiens
ttcaagaaactga

SEQ ID NO: 2597736 - DNA, 23 bp, Homo sapiens
ttcaagaataatcacgctttcct

SEQ ID NO: 2597737 - DNA, 18 bp, Homo sapiens
ttcaagaccttctcccca

SEQ ID NO: 2597738 - DNA, 20 bp, Homo sapiens
ttcaaggcatcatgcagagt

SEQ ID NO: 2597739 - DNA, 17 bp, Homo sapiens
ttcaaggtggccaaatt

SEQ ID NO: 2597740 - DNA, 22 bp, Homo sapiens
ttcaaggtggccaaattatttg

SEQ ID NO: 2597741 - DNA, 15 bp, Homo sapiens
ttcaagtaattctgc

SEQ ID NO: 2597742 - DNA, 18 bp, Homo sapiens
ttcaagtaattctgctgt

SEQ ID NO: 2597743 - DNA, 16 bp, Homo sapiens
ttcaagtaattgtgaa

SEQ ID NO: 2597744 - DNA, 17 bp, Homo sapiens
ttcaagtgaatctaaaa

SEQ ID NO: 2597745 - DNA, 22 bp, Homo sapiens
ttcaagtggggctcgccatgcc

SEQ ID NO: 2597746 - DNA, 19 bp, Homo sapiens
ttcaagtgtaaaatatttt

SEQ ID NO: 2597747 - DNA, 17 bp, Homo sapiens
ttcaagttattgtacag

SEQ ID NO: 2597748 - DNA, 23 bp, Homo sapiens
ttcaagttccaagttgctaatac

SEQ ID NO: 2597749 - DNA, 18 bp, Homo sapiens
ttcaataaatgtctgttg

SEQ ID NO: 2597750 - DNA, 19 bp, Homo sapiens
ttcaataaatgtctgttga

SEQ ID NO: 2597751 - DNA, 20 bp, Homo sapiens
ttcaataagcatcaaactct

SEQ ID NO: 2597752 - DNA, 17 bp, Homo sapiens
ttcaatctgtaaactgt

SEQ ID NO: 2597753 - DNA, 15 bp, Homo sapiens
ttcaattaaacggat

SEQ ID NO: 2597754 - DNA, 12 bp, Homo sapiens
ttcaattcctct

SEQ ID NO: 2597755 - DNA, 14 bp, Homo sapiens
ttcaattcctgggc

SEQ ID NO: 2597756 - DNA, 13 bp, Homo sapiens
ttcaattctcaaa

SEQ ID NO: 2597757 - DNA, 18 bp, Homo sapiens
ttcaattctcatttgtca

SEQ ID NO: 2597758 - DNA, 17 bp, Homo sapiens
ttcaatttattcaagaa

SEQ ID NO: 2597759 - DNA, 17 bp, Homo sapiens
ttcaatttccaagagct

SEQ ID NO: 2597760 - DNA, 15 bp, Homo sapiens
ttcacaaaatttcca

SEQ ID NO: 2597761 - DNA, 21 bp, Homo sapiens
ttcacacacaggcaactgagg

SEQ ID NO: 2597762 - DNA, 13 bp, Homo sapiens
ttcacactgtctg

SEQ ID NO: 2597763 - DNA, 12 bp, Homo sapiens
ttcacagagtgt

SEQ ID NO: 2597764 - DNA, 17 bp, Homo sapiens
ttcacagctcctcccac

SEQ ID NO: 2597765 - DNA, 23 bp, Homo sapiens
ttcacagttggctggatgaaatt

SEQ ID NO: 2597766 - DNA, 19 bp, Homo sapiens
ttcacatagagatcatcct

SEQ ID NO: 2597767 - DNA, 17 bp, Homo sapiens
ttcacatagatgtccct

SEQ ID NO: 2597768 - DNA, 15 bp, Homo sapiens
ttcacatagctgtct

SEQ ID NO: 2597769 - DNA, 18 bp, Homo sapiens
ttcacatcctgtgtttct

SEQ ID NO: 2597770 - DNA, 19 bp, Homo sapiens
ttcacatcctgtgtttcta

SEQ ID NO: 2597771 - DNA, 18 bp, Homo sapiens
ttcacatctaacctcatc

SEQ ID NO: 2597772 - DNA, 19 bp, Homo sapiens
ttcacatctaacctcatct

SEQ ID NO: 2597773 - DNA, 20 bp, Homo sapiens
ttcacatctaacctcatctt

SEQ ID NO: 2597774 - DNA, 18 bp, Homo sapiens
ttcacatgcatcaagtta

SEQ ID NO: 2597775 - DNA, 22 bp, Homo sapiens
ttcacattaatatttgctgaca

SEQ ID NO: 2597776 - DNA, 16 bp, Homo sapiens
ttcacattcttataaa

SEQ ID NO: 2597777 - DNA, 19 bp, Homo sapiens
ttcacattttccttttcaa

SEQ ID NO: 2597778 - DNA, 22 bp, Homo sapiens
ttcaccacatgtgcacatgcac

SEQ ID NO: 2597779 - DNA, 24 bp, Homo sapiens
ttcaccatttggcaatgccatcat

SEQ ID NO: 2597780 - DNA, 15 bp, Homo sapiens
ttcacccagacagct

SEQ ID NO: 2597781 - DNA, 18 bp, Homo sapiens
ttcacccagctaatctgt

SEQ ID NO: 2597782 - DNA, 14 bp, Homo sapiens
ttcaccccaccctt

SEQ ID NO: 2597783 - DNA, 22 bp, Homo sapiens
ttcaccccagtggccactcagc

SEQ ID NO: 2597784 - DNA, 17 bp, Homo sapiens
ttcaccccccactcacc

SEQ ID NO: 2597785 - DNA, 22 bp, Homo sapiens
ttcaccccccactcaccagtgt

SEQ ID NO: 2597786 - DNA, 23 bp, Homo sapiens
ttcaccccccactcaccagtgtc

SEQ ID NO: 2597787 - DNA, 14 bp, Homo sapiens
ttcaccgaggacat

SEQ ID NO: 2597788 - DNA, 22 bp, Homo sapiens
ttcacctcactgaaaacatctg

SEQ ID NO: 2597789 - DNA, 19 bp, Homo sapiens
ttcacctgtttttaagctg

SEQ ID NO: 2597790 - DNA, 14 bp, Homo sapiens
ttcaccttgaagaa

SEQ ID NO: 2597791 - DNA, 16 bp, Homo sapiens
ttcaccttgggatgat

SEQ ID NO: 2597792 - DNA, 21 bp, Homo sapiens
ttcacgcctgtaatcccagca

SEQ ID NO: 2597793 - DNA, 14 bp, Homo sapiens
ttcactaaagcagt

SEQ ID NO: 2597794 - DNA, 23 bp, Homo sapiens
tctttgacctcaacctgtgatga

SEQ ID NO: 2597795 - DNA, 22 bp, Homo sapiens
tctttgagatagaagaactgca

SEQ ID NO: 2597796 - DNA, 15 bp, Homo sapiens
tctttgatgttaaca

SEQ ID NO: 2597797 - DNA, 14 bp, Homo sapiens
tctttgcagacagg

SEQ ID NO: 2597798 - DNA, 20 bp, Homo sapiens
tctttgccaccctcatgctg

SEQ ID NO: 2597799 - DNA, 21 bp, Homo sapiens
tctttgccaccctcatgctgt

SEQ ID NO: 2597800 - DNA, 12 bp, Homo sapiens
tctttgcctggt

SEQ ID NO: 2597801 - DNA, 12 bp, Homo sapiens
tctttgcctgtt

SEQ ID NO: 2597802 - DNA, 15 bp, Homo sapiens
tctttgcctgttcag

SEQ ID NO: 2597803 - DNA, 21 bp, Homo sapiens
tctttgccttgggctgctcct

SEQ ID NO: 2597804 - DNA, 13 bp, Homo sapiens
tctttgctttgcc

SEQ ID NO: 2597805 - DNA, 18 bp, Homo sapiens
tctttggaaggagtgaga

SEQ ID NO: 2597806 - DNA, 24 bp, Homo sapiens
tctttggaaggagtgagatcattt

SEQ ID NO: 2597807 - DNA, 17 bp, Homo sapiens
tctttggacactcacac

SEQ ID NO: 2597808 - DNA, 19 bp, Homo sapiens
tctttggacagaagcagct

SEQ ID NO: 2597809 - DNA, 14 bp, Homo sapiens
tctttggaccctga

SEQ ID NO: 2597810 - DNA, 22 bp, Homo sapiens
tctttggctcccctgtaccttt

SEQ ID NO: 2597811 - DNA, 19 bp, Homo sapiens
tctttgggtacctattttc

SEQ ID NO: 2597812 - DNA, 21 bp, Homo sapiens
tctttggtctacactgtgctg

SEQ ID NO: 2597813 - DNA, 13 bp, Homo sapiens
tctttgtaagagt

SEQ ID NO: 2597814 - DNA, 22 bp, Homo sapiens
tctttgtaagagtgtagaagca

SEQ ID NO: 2597815 - DNA, 24 bp, Homo sapiens
tctttgtaagagtgtagaagcatt

SEQ ID NO: 2597816 - DNA, 13 bp, Homo sapiens
tctttgtctaaaa

SEQ ID NO: 2597817 - DNA, 20 bp, Homo sapiens
tctttgtctaaaacaataaa

SEQ ID NO: 2597818 - DNA, 14 bp, Homo sapiens
tctttgtggcttcc

SEQ ID NO: 2597819 - DNA, 15 bp, Homo sapiens
tctttgttacaggca

SEQ ID NO: 2597820 - DNA, 18 bp, Homo sapiens
tcttttactcatgatctt

SEQ ID NO: 2597821 - DNA, 22 bp, Homo sapiens
tcttttataactagtcctttac

SEQ ID NO: 2597822 - DNA, 13 bp, Homo sapiens
tcttttcacaaat

SEQ ID NO: 2597823 - DNA, 14 bp, Homo sapiens
tcttttcacaaata

SEQ ID NO: 2597824 - DNA, 13 bp, Homo sapiens
tcttttcacattc

SEQ ID NO: 2597825 - DNA, 17 bp, Homo sapiens
tcttttcacattcttat

SEQ ID NO: 2597826 - DNA, 19 bp, Homo sapiens
tcttttcatctgggaaaga

SEQ ID NO: 2597827 - DNA, 12 bp, Homo sapiens
tcttttctaccc

SEQ ID NO: 2597828 - DNA, 19 bp, Homo sapiens
tcttttctggaatgtaatc

SEQ ID NO: 2597829 - DNA, 23 bp, Homo sapiens
tcttttctttagagcattgccat

SEQ ID NO: 2597830 - DNA, 14 bp, Homo sapiens
tcttttgaaacaat

SEQ ID NO: 2597831 - DNA, 14 bp, Homo sapiens
tcttttgacatgtg

SEQ ID NO: 2597832 - DNA, 17 bp, Homo sapiens
tcttttgccgttattaa

SEQ ID NO: 2597833 - DNA, 19 bp, Homo sapiens
tcttttgccgttattaaaa

SEQ ID NO: 2597834 - DNA, 20 bp, Homo sapiens
tcttttggggaagtgaggaa

SEQ ID NO: 2597835 - DNA, 22 bp, Homo sapiens
tcttttggtaaagactggcttt

SEQ ID NO: 2597836 - DNA, 14 bp, Homo sapiens
tctttttaagctta

SEQ ID NO: 2597837 - DNA, 14 bp, Homo sapiens
tctttttatgcatt

SEQ ID NO: 2597838 - DNA, 17 bp, Homo sapiens
tctttttcttcttccct

SEQ ID NO: 2597839 - DNA, 13 bp, Homo sapiens
tctttttgctgtt

SEQ ID NO: 2597840 - DNA, 13 bp, Homo sapiens
tcttttttatgtg

SEQ ID NO: 2597841 - DNA, 14 bp, Homo sapiens
tcttttttcacaaa

SEQ ID NO: 2597842 - DNA, 23 bp, Homo sapiens
tctttttttttttttaaagacag

SEQ ID NO: 2597843 - DNA, 22 bp, Homo sapiens
tgaaaaagtatcctgcttctga

SEQ ID NO: 2597844 - DNA, 16 bp, Homo sapiens
tgaaaaatgtgcaaaa

SEQ ID NO: 2597845 - DNA, 20 bp, Homo sapiens
tgaaaaatgtgcaaaacagc

SEQ ID NO: 2597846 - DNA, 22 bp, Homo sapiens
tgaaaaattcctattgtgattt

SEQ ID NO: 2597847 - DNA, 18 bp, Homo sapiens
tgaaaaatttaagcattg

SEQ ID NO: 2597848 - DNA, 15 bp, Homo sapiens
tgaaaacacattttt

SEQ ID NO: 2597849 - DNA, 19 bp, Homo sapiens
tgaaaacacatttttctta

SEQ ID NO: 2597850 - DNA, 20 bp, Homo sapiens
tgaaaacactgttctctgcc

SEQ ID NO: 2597851 - DNA, 21 bp, Homo sapiens
tgaaaacactgttctctgccc

SEQ ID NO: 2597852 - DNA, 22 bp, Homo sapiens
tgaaaacactgttctctgccct

SEQ ID NO: 2597853 - DNA, 17 bp, Homo sapiens
tgaaaacatctggaagg

SEQ ID NO: 2597854 - DNA, 17 bp, Homo sapiens
tgaaaacgttttattgt

SEQ ID NO: 2597855 - DNA, 19 bp, Homo sapiens
tgaaaacgttttattgtgt

SEQ ID NO: 2597856 - DNA, 19 bp, Homo sapiens
tgaaaactttatgctaagt

SEQ ID NO: 2597857 - DNA, 22 bp, Homo sapiens
tgaaaagaaaaatgagcctggc

SEQ ID NO: 2597858 - DNA, 17 bp, Homo sapiens
tgaaaagacatcaagca

SEQ ID NO: 2597859 - DNA, 17 bp, Homo sapiens
tgaaaagactccaaaga

SEQ ID NO: 2597860 - DNA, 22 bp, Homo sapiens
tgaaaagactccaaagaaatgt

SEQ ID NO: 2597861 - DNA, 23 bp, Homo sapiens
tgaaaagaggggaccagaagcca

SEQ ID NO: 2597862 - DNA, 13 bp, Homo sapiens
tgaaaagctatta

SEQ ID NO: 2597863 - DNA, 23 bp, Homo sapiens
tgaaaagctattagccaggatca

SEQ ID NO: 2597864 - DNA, 19 bp, Homo sapiens
tgaaaatacaacttaaata

SEQ ID NO: 2597865 - DNA, 20 bp, Homo sapiens
tgaaaatatgatgtttcaca

SEQ ID NO: 2597866 - DNA, 21 bp, Homo sapiens
tgaaaatattttttatatata

SEQ ID NO: 2597867 - DNA, 23 bp, Homo sapiens
tgaaaatattttttatatataca

SEQ ID NO: 2597868 - DNA, 15 bp, Homo sapiens
tgaaaatctaatatt

SEQ ID NO: 2597869 - DNA, 15 bp, Homo sapiens
tgaaaatggtatttt

SEQ ID NO: 2597870 - DNA, 21 bp, Homo sapiens
tgaaaatggtattttccccct

SEQ ID NO: 2597871 - DNA, 18 bp, Homo sapiens
tgaaaatgtaagctgttt

SEQ ID NO: 2597872 - DNA, 19 bp, Homo sapiens
tgaaaatgtaagctgttta

SEQ ID NO: 2597873 - DNA, 12 bp, Homo sapiens
tgaaaatgtact

SEQ ID NO: 2597874 - DNA, 15 bp, Homo sapiens
tgaaaatgtcagaaa

SEQ ID NO: 2597875 - DNA, 18 bp, Homo sapiens
tgaaaatgtcagaaacca

SEQ ID NO: 2597876 - DNA, 13 bp, Homo sapiens
tgaaaatgtcttg

SEQ ID NO: 2597877 - DNA, 15 bp, Homo sapiens
tgaaaatgtcttgtg

SEQ ID NO: 2597878 - DNA, 19 bp, Homo sapiens
tgaaaatgtgctatactgc

SEQ ID NO: 2597879 - DNA, 20 bp, Homo sapiens
tgaaaatgtgctatactgca

SEQ ID NO: 2597880 - DNA, 22 bp, Homo sapiens
tgaaaatgtgctatactgcata

SEQ ID NO: 2597881 - DNA, 14 bp, Homo sapiens
tgaaaattaacact

SEQ ID NO: 2597882 - DNA, 15 bp, Homo sapiens
tgaaaattaacactg

SEQ ID NO: 2597883 - DNA, 16 bp, Homo sapiens
tgaaaattaacactgc

SEQ ID NO: 2597884 - DNA, 18 bp, Homo sapiens
tgaaaattaacactgctt

SEQ ID NO: 2597885 - DNA, 17 bp, Homo sapiens
tgaaaattcaaaaagtg

SEQ ID NO: 2597886 - DNA, 19 bp, Homo sapiens
tgaaaattcaaaaagtgtt

SEQ ID NO: 2597887 - DNA, 17 bp, Homo sapiens
tgaaaattgtatgttaa

SEQ ID NO: 2597888 - DNA, 12 bp, Homo sapiens
tgaaaattttga

SEQ ID NO: 2597889 - DNA, 21 bp, Homo sapiens
tgaaaattttgatgttttaag

SEQ ID NO: 2597890 - DNA, 16 bp, Homo sapiens
tgaaacacaccaggct

SEQ ID NO: 2597891 - DNA, 18 bp, Homo sapiens
tgaaacacaccaggctgt

SEQ ID NO: 2597892 - DNA, 21 bp, Homo sapiens
tgaaactccaccttgcgggga

SEQ ID NO: 2597893 - DNA, 22 bp, Homo sapiens
tgaaactgcttgtttcctagca

SEQ ID NO: 2597894 - DNA, 18 bp, Homo sapiens
tgaaactggattaaactt

SEQ ID NO: 2597895 - DNA, 21 bp, Homo sapiens
tgaaacttatttttttctgat

SEQ ID NO: 2597896 - DNA, 22 bp, Homo sapiens
tgaaacttatttttttctgatt

SEQ ID NO: 2597897 - DNA, 23 bp, Homo sapiens
tgaaacttatttttttctgattg

SEQ ID NO: 2597898 - DNA, 14 bp, Homo sapiens
tgaaagaaacagtt

SEQ ID NO: 2597899 - DNA, 22 bp, Homo sapiens
tgaaagaaacagttaactttca

SEQ ID NO: 2597900 - DNA, 16 bp, Homo sapiens
tgaaagaaaggactct

SEQ ID NO: 2597901 - DNA, 12 bp, Homo sapiens
tgaaagaccttc

SEQ ID NO: 2597902 - DNA, 17 bp, Homo sapiens
tgaaagaccttctccaa

SEQ ID NO: 2597903 - DNA, 16 bp, Homo sapiens
tgaaagactgtacaaa

SEQ ID NO: 2597904 - DNA, 19 bp, Homo sapiens
tgaaagactgtacaaagta

SEQ ID NO: 2597905 - DNA, 18 bp, Homo sapiens
tgaaagaggaatgaagta

SEQ ID NO: 2597906 - DNA, 17 bp, Homo sapiens
tgaaagagtaaaggaaa

SEQ ID NO: 2597907 - DNA, 18 bp, Homo sapiens
tgaaagatggctgtgcct

SEQ ID NO: 2597908 - DNA, 21 bp, Homo sapiens
tgaaagatggctgtgcctctg

SEQ ID NO: 2597909 - DNA, 21 bp, Homo sapiens
tgaaagattcaggtatgttgc

SEQ ID NO: 2597910 - DNA, 14 bp, Homo sapiens
tgaaagccatttgt

SEQ ID NO: 2597911 - DNA, 18 bp, Homo sapiens
tgaaagccctgagctttc

SEQ ID NO: 2597912 - DNA, 22 bp, Homo sapiens
tgaaagctcctcgagggcaggg

SEQ ID NO: 2597913 - DNA, 18 bp, Homo sapiens
tgaaaggaagctccactg

SEQ ID NO: 2597914 - DNA, 13 bp, Homo sapiens
tgaaagggcccag

SEQ ID NO: 2597915 - DNA, 16 bp, Homo sapiens
tgaaagggcccagaga

SEQ ID NO: 2597916 - DNA, 17 bp, Homo sapiens
tgaaagggcccagagag

SEQ ID NO: 2597917 - DNA, 19 bp, Homo sapiens
tgaaaggttaccctgtaac

SEQ ID NO: 2597918 - DNA, 18 bp, Homo sapiens
tgaaagtcagatgcccag

SEQ ID NO: 2597919 - DNA, 15 bp, Homo sapiens
tgaaagttaatccac

SEQ ID NO: 2597920 - DNA, 17 bp, Homo sapiens
tgaaagtttgcactgta

SEQ ID NO: 2597921 - DNA, 18 bp, Homo sapiens
tgaaagttttcagaacct

SEQ ID NO: 2597922 - DNA, 20 bp, Homo sapiens
tgaaagttttcagaacctct

SEQ ID NO: 2597923 - DNA, 17 bp, Homo sapiens
tgaaataagccagacat

SEQ ID NO: 2597924 - DNA, 14 bp, Homo sapiens
tgaaataataaatc

SEQ ID NO: 2597925 - DNA, 14 bp, Homo sapiens
tgaaataccagtgt

SEQ ID NO: 2597926 - DNA, 14 bp, Homo sapiens
tgaaatactgtttg

SEQ ID NO: 2597927 - DNA, 13 bp, Homo sapiens
tgaaatagtctgt

SEQ ID NO: 2597928 - DNA, 16 bp, Homo sapiens
tgaaatagtctgtgtg

SEQ ID NO: 2597929 - DNA, 18 bp, Homo sapiens
tgaaatagtctgtgtgaa

SEQ ID NO: 2597930 - DNA, 15 bp, Homo sapiens
tgaaatatctgtatt

SEQ ID NO: 2597931 - DNA, 14 bp, Homo sapiens
tgaaatcctgcttc

SEQ ID NO: 2597932 - DNA, 13 bp, Homo sapiens
tgaaatgaaaaca

SEQ ID NO: 2597933 - DNA, 20 bp, Homo sapiens
tgaaatgaaaacatgtaata

SEQ ID NO: 2597934 - DNA, 16 bp, Homo sapiens
tgaaatgaatatttaa

SEQ ID NO: 2597935 - DNA, 20 bp, Homo sapiens
tgaaatgaggtcagagcctg

SEQ ID NO: 2597936 - DNA, 22 bp, Homo sapiens
tgaaatgaggtcagagcctgca

SEQ ID NO: 2597937 - DNA, 19 bp, Homo sapiens
tgaaattacttatcatcca

SEQ ID NO: 2597938 - DNA, 23 bp, Homo sapiens
tgaaattagggcccaattaataa

SEQ ID NO: 2597939 - DNA, 12 bp, Homo sapiens
tgaaattgtaaa

SEQ ID NO: 2597940 - DNA, 23 bp, Homo sapiens
tgaaattgtacatatttgtggaa

SEQ ID NO: 2597941 - DNA, 22 bp, Homo sapiens
tgaaattgtctagcagagcagg

SEQ ID NO: 2597942 - DNA, 23 bp, Homo sapiens
tgaaattgtttaagtgttgtaaa

SEQ ID NO: 2597943 - DNA, 20 bp, Homo sapiens
tgaaatttattagttaatat

SEQ ID NO: 2597944 - DNA, 19 bp, Homo sapiens
tctggctatgcatttgaaa

SEQ ID NO: 2597945 - DNA, 15 bp, Homo sapiens
tctggctcttccagg

SEQ ID NO: 2597946 - DNA, 18 bp, Homo sapiens
tctggctgaaccctgtgc

SEQ ID NO: 2597947 - DNA, 19 bp, Homo sapiens
tctggctgaaccctgtgct

SEQ ID NO: 2597948 - DNA, 13 bp, Homo sapiens
tctggcttccagg

SEQ ID NO: 2597949 - DNA, 22 bp, Homo sapiens
tctggcttccaggtatctccag

SEQ ID NO: 2597950 - DNA, 22 bp, Homo sapiens
tctgggaaatgagaaggcagcc

SEQ ID NO: 2597951 - DNA, 14 bp, Homo sapiens
tctgggaagggaag

SEQ ID NO: 2597952 - DNA, 13 bp, Homo sapiens
tctgggacacagt

SEQ ID NO: 2597953 - DNA, 14 bp, Homo sapiens
tctgggacacagtt

SEQ ID NO: 2597954 - DNA, 13 bp, Homo sapiens
tctgggacctcag

SEQ ID NO: 2597955 - DNA, 15 bp, Homo sapiens
tctgggagaggattt

SEQ ID NO: 2597956 - DNA, 13 bp, Homo sapiens
tctgggagggcag

SEQ ID NO: 2597957 - DNA, 19 bp, Homo sapiens
tctgggagggcagcagggc

SEQ ID NO: 2597958 - DNA, 18 bp, Homo sapiens
tctgggataagtaagttt

SEQ ID NO: 2597959 - DNA, 15 bp, Homo sapiens
tctgggattctactt

SEQ ID NO: 2597960 - DNA, 19 bp, Homo sapiens
tctgggattctactttaag

SEQ ID NO: 2597961 - DNA, 21 bp, Homo sapiens
tctgggcactggtaatcccaa

SEQ ID NO: 2597962 - DNA, 14 bp, Homo sapiens
tctgggcaggacct

SEQ ID NO: 2597963 - DNA, 19 bp, Homo sapiens
tctgggcaggacctcagag

SEQ ID NO: 2597964 - DNA, 14 bp, Homo sapiens
tctgggcaggactc

SEQ ID NO: 2597965 - DNA, 18 bp, Homo sapiens
tctgggccccctcctccc

SEQ ID NO: 2597966 - DNA, 22 bp, Homo sapiens
tctgggctgctacccagaaatc

SEQ ID NO: 2597967 - DNA, 16 bp, Homo sapiens
tctggggccacacaga

SEQ ID NO: 2597968 - DNA, 13 bp, Homo sapiens
tctggggcccctt

SEQ ID NO: 2597969 - DNA, 16 bp, Homo sapiens
tctggggctctgggat

SEQ ID NO: 2597970 - DNA, 18 bp, Homo sapiens
tctgggtagctgtaaggc

SEQ ID NO: 2597971 - DNA, 16 bp, Homo sapiens
tctgggttcactgcaa

SEQ ID NO: 2597972 - DNA, 15 bp, Homo sapiens
tctggtactctccta

SEQ ID NO: 2597973 - DNA, 17 bp, Homo sapiens
tctggtctcctcagcct

SEQ ID NO: 2597974 - DNA, 18 bp, Homo sapiens
tctggtctcctcagcctc

SEQ ID NO: 2597975 - DNA, 19 bp, Homo sapiens
tctggtctctaggctgggg

SEQ ID NO: 2597976 - DNA, 21 bp, Homo sapiens
tctggtctctaggctggggaa

SEQ ID NO: 2597977 - DNA, 23 bp, Homo sapiens
tctggtgactttcctctttggtc

SEQ ID NO: 2597978 - DNA, 22 bp, Homo sapiens
tctggtgagcgaggacattctc

SEQ ID NO: 2597979 - DNA, 18 bp, Homo sapiens
tctggtgaggccttgctc

SEQ ID NO: 2597980 - DNA, 23 bp, Homo sapiens
tctggtttggggcgaggcagagg

SEQ ID NO: 2597981 - DNA, 13 bp, Homo sapiens
tctggttttaaca

SEQ ID NO: 2597982 - DNA, 13 bp, Homo sapiens
tctgtaaactgtg

SEQ ID NO: 2597983 - DNA, 14 bp, Homo sapiens
tctgtaaactgtgt

SEQ ID NO: 2597984 - DNA, 15 bp, Homo sapiens
tctgtaaactgtgta

SEQ ID NO: 2597985 - DNA, 16 bp, Homo sapiens
tctgtaaactgtgtat

SEQ ID NO: 2597986 - DNA, 15 bp, Homo sapiens
tctgtaagctgaagt

SEQ ID NO: 2597987 - DNA, 13 bp, Homo sapiens
tctgtacaatgaa

SEQ ID NO: 2597988 - DNA, 23 bp, Homo sapiens
tctgtacagagcccacgccccca

SEQ ID NO: 2597989 - DNA, 14 bp, Homo sapiens
tctgtacatagcct

SEQ ID NO: 2597990 - DNA, 16 bp, Homo sapiens
tctgtagagggccctg

SEQ ID NO: 2597991 - DNA, 19 bp, Homo sapiens
tctgtagagggccctggtg

SEQ ID NO: 2597992 - DNA, 19 bp, Homo sapiens
tctgtagattctgtggaac

SEQ ID NO: 2597993 - DNA, 23 bp, Homo sapiens
tctgtagattctgtggaacaagc

SEQ ID NO: 2597994 - DNA, 13 bp, Homo sapiens
tctgtagctcctc

SEQ ID NO: 2597995 - DNA, 23 bp, Homo sapiens
tctgtagctcctcaactcaccta

SEQ ID NO: 2597996 - DNA, 14 bp, Homo sapiens
tctgtagggctgga

SEQ ID NO: 2597997 - DNA, 16 bp, Homo sapiens
tctgtagggctggacc

SEQ ID NO: 2597998 - DNA, 17 bp, Homo sapiens
tctgtagtgagatagca

SEQ ID NO: 2597999 - DNA, 22 bp, Homo sapiens
tctgtatataaaatattttcat

SEQ ID NO: 2598000 - DNA, 15 bp, Homo sapiens
tctgtatatacaata

SEQ ID NO: 2598001 - DNA, 15 bp, Homo sapiens
tctgtatattttggg

SEQ ID NO: 2598002 - DNA, 16 bp, Homo sapiens
tctgtatattttggga

SEQ ID NO: 2598003 - DNA, 19 bp, Homo sapiens
tctgtatcggagacagtga

SEQ ID NO: 2598004 - DNA, 21 bp, Homo sapiens
tctgtatcggagacagtgatc

SEQ ID NO: 2598005 - DNA, 23 bp, Homo sapiens
tctgtatttatgtgtgaggagct

SEQ ID NO: 2598006 - DNA, 13 bp, Homo sapiens
tctgtccaaggaa

SEQ ID NO: 2598007 - DNA, 15 bp, Homo sapiens
tctgtcctactctgt

SEQ ID NO: 2598008 - DNA, 16 bp, Homo sapiens
tctgtcgcccagtctg

SEQ ID NO: 2598009 - DNA, 23 bp, Homo sapiens
tctgtcgccttagcatgtttgct

SEQ ID NO: 2598010 - DNA, 14 bp, Homo sapiens
tctgtctcagtcca

SEQ ID NO: 2598011 - DNA, 22 bp, Homo sapiens
tctgtctccttaacactgagct

SEQ ID NO: 2598012 - DNA, 22 bp, Homo sapiens
tctgtctgcccttcaccccagt

SEQ ID NO: 2598013 - DNA, 15 bp, Homo sapiens
tctgtgaattcagat

SEQ ID NO: 2598014 - DNA, 18 bp, Homo sapiens
tctgtgaccaatgtcttg

SEQ ID NO: 2598015 - DNA, 21 bp, Homo sapiens
tctgtgcacgcagtggccttc

SEQ ID NO: 2598016 - DNA, 17 bp, Homo sapiens
tctgtgccccatgcctg

SEQ ID NO: 2598017 - DNA, 22 bp, Homo sapiens
tctgtgccccatgcctgtccag

SEQ ID NO: 2598018 - DNA, 19 bp, Homo sapiens
tctgtgctggagatgtttt

SEQ ID NO: 2598019 - DNA, 14 bp, Homo sapiens
tctgtgctttccag

SEQ ID NO: 2598020 - DNA, 17 bp, Homo sapiens
tctgtgctttccagctc

SEQ ID NO: 2598021 - DNA, 16 bp, Homo sapiens
tctgtggaaagtgtaa

SEQ ID NO: 2598022 - DNA, 23 bp, Homo sapiens
tctgtgggatgggatggtggagg

SEQ ID NO: 2598023 - DNA, 19 bp, Homo sapiens
tctgtggttttcccctccc

SEQ ID NO: 2598024 - DNA, 22 bp, Homo sapiens
tctgtggttttcccctccctgg

SEQ ID NO: 2598025 - DNA, 11 bp, Homo sapiens
tctgtgtcctt

SEQ ID NO: 2598026 - DNA, 21 bp, Homo sapiens
tctgtgtctttcacagctcct

SEQ ID NO: 2598027 - DNA, 11 bp, Homo sapiens
tctgtgtgtgt

SEQ ID NO: 2598028 - DNA, 15 bp, Homo sapiens
tctgtgtgtttatgt

SEQ ID NO: 2598029 - DNA, 16 bp, Homo sapiens
tctgtgtgtttatgtg

SEQ ID NO: 2598030 - DNA, 21 bp, Homo sapiens
tctgtgttggcccaagctctt

SEQ ID NO: 2598031 - DNA, 23 bp, Homo sapiens
tctgtgttggcccaagctcttgt

SEQ ID NO: 2598032 - DNA, 19 bp, Homo sapiens
tctgttaccatgtcactgt

SEQ ID NO: 2598033 - DNA, 19 bp, Homo sapiens
tctgttcacttttcctccc

SEQ ID NO: 2598034 - DNA, 21 bp, Homo sapiens
tctgttcacttttcctccctc

SEQ ID NO: 2598035 - DNA, 16 bp, Homo sapiens
tctgttcagtgtaaat

SEQ ID NO: 2598036 - DNA, 20 bp, Homo sapiens
tctgttccccatggccactt

SEQ ID NO: 2598037 - DNA, 14 bp, Homo sapiens
tctgttctgtggaa

SEQ ID NO: 2598038 - DNA, 19 bp, Homo sapiens
tctgttctgtggaaagtgt

SEQ ID NO: 2598039 - DNA, 23 bp, Homo sapiens
tctgttctgtggaaagtgtaaag

SEQ ID NO: 2598040 - DNA, 13 bp, Homo sapiens
tctgttcttgaag

SEQ ID NO: 2598041 - DNA, 18 bp, Homo sapiens
tctgttctttaatttatt

SEQ ID NO: 2598042 - DNA, 17 bp, Homo sapiens
tctgttggccagtgtga

SEQ ID NO: 2598043 - DNA, 19 bp, Homo sapiens
tctgttggccagtgtgaca

SEQ ID NO: 2598044 - DNA, 20 bp, Homo sapiens
tctgttggccagtgtgacaa

SEQ ID NO: 2598045 - DNA, 15 bp, Homo sapiens
tctgttgtcctcccc

SEQ ID NO: 2598046 - DNA, 17 bp, Homo sapiens
tctgttgtcctcccctt

SEQ ID NO: 2598047 - DNA, 19 bp, Homo sapiens
tctgttgtcctccccttgg

SEQ ID NO: 2598048 - DNA, 13 bp, Homo sapiens
tctgtttagataa

SEQ ID NO: 2598049 - DNA, 19 bp, Homo sapiens
tctgtttagataatacacc

SEQ ID NO: 2598050 - DNA, 13 bp, Homo sapiens
tctgtttcctttt

SEQ ID NO: 2598051 - DNA, 13 bp, Homo sapiens
tctgttttatgac

SEQ ID NO: 2598052 - DNA, 15 bp, Homo sapiens
tctgttttatgactt

SEQ ID NO: 2598053 - DNA, 17 bp, Homo sapiens
tctgttttatgacttca

SEQ ID NO: 2598054 - DNA, 14 bp, Homo sapiens
tctgtttttctttt

SEQ ID NO: 2598055 - DNA, 20 bp, Homo sapiens
tcttaaaatatatttcagat

SEQ ID NO: 2598056 - DNA, 17 bp, Homo sapiens
tcttaaacaaatgtatg

SEQ ID NO: 2598057 - DNA, 19 bp, Homo sapiens
tcttaaagctgcctgtagt

SEQ ID NO: 2598058 - DNA, 23 bp, Homo sapiens
tcttaaagctgcctgtagttagg

SEQ ID NO: 2598059 - DNA, 11 bp, Homo sapiens
tcttaaatttt

SEQ ID NO: 2598060 - DNA, 15 bp, Homo sapiens
tcttaacaatttctg

SEQ ID NO: 2598061 - DNA, 13 bp, Homo sapiens
tcttaagccatct

SEQ ID NO: 2598062 - DNA, 16 bp, Homo sapiens
tcttaagccatcttgg

SEQ ID NO: 2598063 - DNA, 17 bp, Homo sapiens
tcttaagccatcttggt

SEQ ID NO: 2598064 - DNA, 21 bp, Homo sapiens
tcttaagccttttgctcacaa

SEQ ID NO: 2598065 - DNA, 23 bp, Homo sapiens
tcttaaggattgtgatattttta

SEQ ID NO: 2598066 - DNA, 18 bp, Homo sapiens
tcttaagtttctcagctc

SEQ ID NO: 2598067 - DNA, 16 bp, Homo sapiens
tcttaatattaaatat

SEQ ID NO: 2598068 - DNA, 18 bp, Homo sapiens
tcttaatcttttcacaaa

SEQ ID NO: 2598069 - DNA, 20 bp, Homo sapiens
tcttaatcttttcacaaata

SEQ ID NO: 2598070 - DNA, 18 bp, Homo sapiens
tcttaattaaaagaatat

SEQ ID NO: 2598071 - DNA, 21 bp, Homo sapiens
tcttaattaaaagaatatttt

SEQ ID NO: 2598072 - DNA, 12 bp, Homo sapiens
tcttaattatta

SEQ ID NO: 2598073 - DNA, 14 bp, Homo sapiens
tcttacatgttttc

SEQ ID NO: 2598074 - DNA, 21 bp, Homo sapiens
tcttacctgtatgtctccagt

SEQ ID NO: 2598075 - DNA, 18 bp, Homo sapiens
tcttacgatggcacccag

SEQ ID NO: 2598076 - DNA, 13 bp, Homo sapiens
tcttactgaaggt

SEQ ID NO: 2598077 - DNA, 15 bp, Homo sapiens
tctccctttcccttc

SEQ ID NO: 2598078 - DNA, 17 bp, Homo sapiens
tctccgactgctaggga

SEQ ID NO: 2598079 - DNA, 19 bp, Homo sapiens
tctcctagagacagaagca

SEQ ID NO: 2598080 - DNA, 13 bp, Homo sapiens
tctcctcagcctc

SEQ ID NO: 2598081 - DNA, 20 bp, Homo sapiens
tctcctcagcctcctcatct

SEQ ID NO: 2598082 - DNA, 22 bp, Homo sapiens
tctcctcagcctcctcatctgg

SEQ ID NO: 2598083 - DNA, 19 bp, Homo sapiens
tctcctccaagacactgtg

SEQ ID NO: 2598084 - DNA, 16 bp, Homo sapiens
tctcctcctgcccacc

SEQ ID NO: 2598085 - DNA, 12 bp, Homo sapiens
tctcctctgctg

SEQ ID NO: 2598086 - DNA, 16 bp, Homo sapiens
tctcctctgctgctgg

SEQ ID NO: 2598087 - DNA, 14 bp, Homo sapiens
tctcctcttaaaaa

SEQ ID NO: 2598088 - DNA, 16 bp, Homo sapiens
tctcctcttttatctt

SEQ ID NO: 2598089 - DNA, 20 bp, Homo sapiens
tctcctgcctgtagcagtga

SEQ ID NO: 2598090 - DNA, 17 bp, Homo sapiens
tctcctgccttcctcct

SEQ ID NO: 2598091 - DNA, 18 bp, Homo sapiens
tctcctgccttcctcctg

SEQ ID NO: 2598092 - DNA, 16 bp, Homo sapiens
tctcctgtacctcttg

SEQ ID NO: 2598093 - DNA, 14 bp, Homo sapiens
tctccttagtcttc

SEQ ID NO: 2598094 - DNA, 18 bp, Homo sapiens
tctccttagtcttctcat

SEQ ID NO: 2598095 - DNA, 19 bp, Homo sapiens
tctccttagtcttctcata

SEQ ID NO: 2598096 - DNA, 16 bp, Homo sapiens
tctccttcacctttgt

SEQ ID NO: 2598097 - DNA, 19 bp, Homo sapiens
tctccttcccctttcccca

SEQ ID NO: 2598098 - DNA, 18 bp, Homo sapiens
tctccttgctacccagaa

SEQ ID NO: 2598099 - DNA, 19 bp, Homo sapiens
tctccttgtggcctgggcc

SEQ ID NO: 2598100 - DNA, 14 bp, Homo sapiens
tctcctttcaggga

SEQ ID NO: 2598101 - DNA, 15 bp, Homo sapiens
tctcctttctttcta

SEQ ID NO: 2598102 - DNA, 17 bp, Homo sapiens
tctcctttgataaaata

SEQ ID NO: 2598103 - DNA, 19 bp, Homo sapiens
tctcctttgcactgagggc

SEQ ID NO: 2598104 - DNA, 23 bp, Homo sapiens
tctcctttgcactgagggccaca

SEQ ID NO: 2598105 - DNA, 17 bp, Homo sapiens
tctcgatgcaatgaaca

SEQ ID NO: 2598106 - DNA, 17 bp, Homo sapiens
tctcgctctgttgccca

SEQ ID NO: 2598107 - DNA, 18 bp, Homo sapiens
tctcgtgggagagccatc

SEQ ID NO: 2598108 - DNA, 15 bp, Homo sapiens
tctcgtttcaaaaac

SEQ ID NO: 2598109 - DNA, 12 bp, Homo sapiens
tctcgtttttct

SEQ ID NO: 2598110 - DNA, 21 bp, Homo sapiens
tctctaaagagtttattttaa

SEQ ID NO: 2598111 - DNA, 22 bp, Homo sapiens
tctctaaagagtttattttaag

SEQ ID NO: 2598112 - DNA, 23 bp, Homo sapiens
tctctaaatgaggggcctcaggt

SEQ ID NO: 2598113 - DNA, 19 bp, Homo sapiens
tctctaacttcaccatatt

SEQ ID NO: 2598114 - DNA, 18 bp, Homo sapiens
tctctaagttccactgag

SEQ ID NO: 2598115 - DNA, 15 bp, Homo sapiens
tctctacaaaaagca

SEQ ID NO: 2598116 - DNA, 21 bp, Homo sapiens
tctctactcctacctcagcct

SEQ ID NO: 2598117 - DNA, 17 bp, Homo sapiens
tctctagaattttaagt

SEQ ID NO: 2598118 - DNA, 15 bp, Homo sapiens
tctctaggctgggga

SEQ ID NO: 2598119 - DNA, 13 bp, Homo sapiens
tctctcactcctt

SEQ ID NO: 2598120 - DNA, 15 bp, Homo sapiens
tctctcactccttga

SEQ ID NO: 2598121 - DNA, 13 bp, Homo sapiens
tctctcaggagca

SEQ ID NO: 2598122 - DNA, 21 bp, Homo sapiens
tctctcaggagcacaggcagc

SEQ ID NO: 2598123 - DNA, 22 bp, Homo sapiens
tctctcaggagcacaggcagct

SEQ ID NO: 2598124 - DNA, 19 bp, Homo sapiens
tctctccagcccctggatg

SEQ ID NO: 2598125 - DNA, 11 bp, Homo sapiens
tctctccagga

SEQ ID NO: 2598126 - DNA, 19 bp, Homo sapiens
tctctcccagtctacccag

SEQ ID NO: 2598127 - DNA, 15 bp, Homo sapiens
tctctcccatggagc

SEQ ID NO: 2598128 - DNA, 20 bp, Homo sapiens
tctctcccatggagccccag

SEQ ID NO: 2598129 - DNA, 21 bp, Homo sapiens
tctctcccatggagccccagc

SEQ ID NO: 2598130 - DNA, 23 bp, Homo sapiens
tctctcccatggagccccagccc

SEQ ID NO: 2598131 - DNA, 22 bp, Homo sapiens
tctctcccctcaaagtctgcaa

SEQ ID NO: 2598132 - DNA, 14 bp, Homo sapiens
tctctccctcccct

SEQ ID NO: 2598133 - DNA, 14 bp, Homo sapiens
tctctcctgtacct

SEQ ID NO: 2598134 - DNA, 20 bp, Homo sapiens
tctctcctgtacctcttgag

SEQ ID NO: 2598135 - DNA, 14 bp, Homo sapiens
tctctcctgtactt

SEQ ID NO: 2598136 - DNA, 14 bp, Homo sapiens
tctctctctctccc

SEQ ID NO: 2598137 - DNA, 14 bp, Homo sapiens
tctctctctctctc

SEQ ID NO: 2598138 - DNA, 14 bp, Homo sapiens
tctctctgactctc

SEQ ID NO: 2598139 - DNA, 20 bp, Homo sapiens
tctctctgactctcaaatct

SEQ ID NO: 2598140 - DNA, 21 bp, Homo sapiens
tctctctgactctcaaatctt

SEQ ID NO: 2598141 - DNA, 19 bp, Homo sapiens
tctctcttctgctccaccc

SEQ ID NO: 2598142 - DNA, 11 bp, Homo sapiens
tctctgaaccc

SEQ ID NO: 2598143 - DNA, 12 bp, Homo sapiens
tctctgaagcat

SEQ ID NO: 2598144 - DNA, 13 bp, Homo sapiens
tctctgaagggag

SEQ ID NO: 2598145 - DNA, 14 bp, Homo sapiens
tctctgaagggagg

SEQ ID NO: 2598146 - DNA, 14 bp, Homo sapiens
tctctgaatcctaa

SEQ ID NO: 2598147 - DNA, 15 bp, Homo sapiens
tctctgagctgtgca

SEQ ID NO: 2598148 - DNA, 16 bp, Homo sapiens
tctctgagctgtgcag

SEQ ID NO: 2598149 - DNA, 13 bp, Homo sapiens
tctctgaggacac

SEQ ID NO: 2598150 - DNA, 20 bp, Homo sapiens
tctctgagggcttcctttgg

SEQ ID NO: 2598151 - DNA, 20 bp, Homo sapiens
tctctgattttcaaagcttt

SEQ ID NO: 2598152 - DNA, 19 bp, Homo sapiens
tctctgcaatcttctcaga

SEQ ID NO: 2598153 - DNA, 11 bp, Homo sapiens
tctctgcaccc

SEQ ID NO: 2598154 - DNA, 15 bp, Homo sapiens
tctctgccctccaag

SEQ ID NO: 2598155 - DNA, 19 bp, Homo sapiens
tctctgccggctctttcct

SEQ ID NO: 2598156 - DNA, 11 bp, Homo sapiens
tctctgctcca

SEQ ID NO: 2598157 - DNA, 13 bp, Homo sapiens
tctctgctccacc

SEQ ID NO: 2598158 - DNA, 15 bp, Homo sapiens
tctctgctccaccac

SEQ ID NO: 2598159 - DNA, 17 bp, Homo sapiens
tctctgctccaccacat

SEQ ID NO: 2598160 - DNA, 19 bp, Homo sapiens
tctctgctccaccacatcc

SEQ ID NO: 2598161 - DNA, 23 bp, Homo sapiens
tctctgctctgcgtgtcacctgt

SEQ ID NO: 2598162 - DNA, 13 bp, Homo sapiens
tctctgctgaagg

SEQ ID NO: 2598163 - DNA, 11 bp, Homo sapiens
tctctgctgcc

SEQ ID NO: 2598164 - DNA, 13 bp, Homo sapiens
tctctgctgccgc

SEQ ID NO: 2598165 - DNA, 12 bp, Homo sapiens
tctctgctggcc

SEQ ID NO: 2598166 - DNA, 14 bp, Homo sapiens
tctctgctggccca

SEQ ID NO: 2598167 - DNA, 11 bp, Homo sapiens
tctctgctgta

SEQ ID NO: 2598168 - DNA, 22 bp, Homo sapiens
tctctggaaaggggggagctgg

SEQ ID NO: 2598169 - DNA, 20 bp, Homo sapiens
tctctggagccaagtccaga

SEQ ID NO: 2598170 - DNA, 22 bp, Homo sapiens
tctctggagtgagctctgtttc

SEQ ID NO: 2598171 - DNA, 15 bp, Homo sapiens
tctctggcctcccac

SEQ ID NO: 2598172 - DNA, 17 bp, Homo sapiens
tctctggcctcccaccc

SEQ ID NO: 2598173 - DNA, 12 bp, Homo sapiens
tctctggctggg

SEQ ID NO: 2598174 - DNA, 13 bp, Homo sapiens
tctctggctgggg

SEQ ID NO: 2598175 - DNA, 13 bp, Homo sapiens
tctctggtccgga

SEQ ID NO: 2598176 - DNA, 20 bp, Homo sapiens
tctctggtccggacactcct

SEQ ID NO: 2598177 - DNA, 15 bp, Homo sapiens
tctctgtctcatcca

SEQ ID NO: 2598178 - DNA, 21 bp, Homo sapiens
tctctgtctcatccatcatca

SEQ ID NO: 2598179 - DNA, 23 bp, Homo sapiens
tctctgtctcatccatcatcatg

SEQ ID NO: 2598180 - DNA, 18 bp, Homo sapiens
tctctgtgtgcacaaata

SEQ ID NO: 2598181 - DNA, 20 bp, Homo sapiens
tctcttatagaatatttatt

SEQ ID NO: 2598182 - DNA, 14 bp, Homo sapiens
tctcttcaggttct

SEQ ID NO: 2598183 - DNA, 14 bp, Homo sapiens
tctcttcatacttt

SEQ ID NO: 2598184 - DNA, 17 bp, Homo sapiens
tctcttccatatgacct

SEQ ID NO: 2598185 - DNA, 21 bp, Homo sapiens
tctcttccatatgacctcatg

SEQ ID NO: 2598186 - DNA, 14 bp, Homo sapiens
tctcttcccctctc

SEQ ID NO: 2598187 - DNA, 15 bp, Homo sapiens
tctcttcccctctca

SEQ ID NO: 2598188 - DNA, 19 bp, Homo sapiens
tctcttcctccgaggccag

SEQ ID NO: 2598189 - DNA, 21 bp, Homo sapiens
tctcttctgagctatttcatc

SEQ ID NO: 2598190 - DNA, 22 bp, Homo sapiens
tctcttctgagctatttcatct

SEQ ID NO: 2598191 - DNA, 17 bp, Homo sapiens
tctcttctgctccaccc

SEQ ID NO: 2598192 - DNA, 13 bp, Homo sapiens
tctcttcttgaac

SEQ ID NO: 2598193 - DNA, 12 bp, Homo sapiens
tctcttctttaa

SEQ ID NO: 2598194 - DNA, 16 bp, Homo sapiens
tctcttcttttggctt

SEQ ID NO: 2598195 - DNA, 18 bp, Homo sapiens
tctcttcttttggcttcc

SEQ ID NO: 2598196 - DNA, 14 bp, Homo sapiens
tctcttgagagggt

SEQ ID NO: 2598197 - DNA, 14 bp, Homo sapiens
tctcttgcacccgc

SEQ ID NO: 2598198 - DNA, 19 bp, Homo sapiens
tctcttggtttccttcctt

SEQ ID NO: 2598199 - DNA, 20 bp, Homo sapiens
tctctttaatcttcagtttt

SEQ ID NO: 2598200 - DNA, 20 bp, Homo sapiens
tctctttaatgtcacaggca

SEQ ID NO: 2598201 - DNA, 21 bp, Homo sapiens
tctctttaatgtcacaggcag

SEQ ID NO: 2598202 - DNA, 23 bp, Homo sapiens
tctctttctccttagtcttctca

SEQ ID NO: 2598203 - DNA, 14 bp, Homo sapiens
tctctttctctcct

SEQ ID NO: 2598204 - DNA, 15 bp, Homo sapiens
tctcttttcaaaaca

SEQ ID NO: 2598205 - DNA, 16 bp, Homo sapiens
tctcttttctctttct

SEQ ID NO: 2598206 - DNA, 22 bp, Homo sapiens
tctcttttgaatccatgcttgg

SEQ ID NO: 2598207 - DNA, 23 bp, Homo sapiens
tctcttttgaatccatgcttggg

SEQ ID NO: 2598208 - DNA, 21 bp, Homo sapiens
tctctttttgactcttgcaat

SEQ ID NO: 2598209 - DNA, 17 bp, Homo sapiens
tctctttttggaggtgc

SEQ ID NO: 2598210 - DNA, 15 bp, Homo sapiens
tctgaaaacggccct

SEQ ID NO: 2598211 - DNA, 14 bp, Homo sapiens
tctgaaaatataac

SEQ ID NO: 2598212 - DNA, 13 bp, Homo sapiens
tctgaaaatgtat

SEQ ID NO: 2598213 - DNA, 23 bp, Homo sapiens
tctgaaaatgtatgtgtaagtat

SEQ ID NO: 2598214 - DNA, 15 bp, Homo sapiens
tctgaacaattctct

SEQ ID NO: 2598215 - DNA, 16 bp, Homo sapiens
tctgaaccattaaagt

SEQ ID NO: 2598216 - DNA, 12 bp, Homo sapiens
tctgaactcaaa

SEQ ID NO: 2598217 - DNA, 12 bp, Homo sapiens
tctgaagcatgt

SEQ ID NO: 2598218 - DNA, 13 bp, Homo sapiens
tctgaagggaggt

SEQ ID NO: 2598219 - DNA, 23 bp, Homo sapiens
tctgaagtcacatcacaggacac

SEQ ID NO: 2598220 - DNA, 16 bp, Homo sapiens
tctgaagtgaaactgc

SEQ ID NO: 2598221 - DNA, 18 bp, Homo sapiens
tctgaagtgaaactgctt

SEQ ID NO: 2598222 - DNA, 13 bp, Homo sapiens
tctgaatgctgct

SEQ ID NO: 2598223 - DNA, 16 bp, Homo sapiens
tctgaatgttctgaca

SEQ ID NO: 2598224 - DNA, 17 bp, Homo sapiens
tctgaatgttctgacat

SEQ ID NO: 2598225 - DNA, 23 bp, Homo sapiens
tctgaatgttctgacattaacag

SEQ ID NO: 2598226 - DNA, 15 bp, Homo sapiens
tctgacacacagctc

SEQ ID NO: 2598227 - DNA, 18 bp, Homo sapiens
tctgacacacagctctgt

SEQ ID NO: 2598228 - DNA, 12 bp, Homo sapiens
tctgacatctct

SEQ ID NO: 2598229 - DNA, 22 bp, Homo sapiens
tctgacattctcaggaagcccc

SEQ ID NO: 2598230 - DNA, 21 bp, Homo sapiens
tctatatgaatttaaatataa

SEQ ID NO: 2598231 - DNA, 20 bp, Homo sapiens
tctatatgtacttgtcaaag

SEQ ID NO: 2598232 - DNA, 22 bp, Homo sapiens
tctatcaagtattatacctttt

SEQ ID NO: 2598233 - DNA, 15 bp, Homo sapiens
tctatcaatagtcaa

SEQ ID NO: 2598234 - DNA, 23 bp, Homo sapiens
tctatcatttttgtacagtttgc

SEQ ID NO: 2598235 - DNA, 14 bp, Homo sapiens
tctatccacagaga

SEQ ID NO: 2598236 - DNA, 16 bp, Homo sapiens
tctatcctacaacaag

SEQ ID NO: 2598237 - DNA, 16 bp, Homo sapiens
tctatcttatatagtt

SEQ ID NO: 2598238 - DNA, 14 bp, Homo sapiens
tctatgacacatgc

SEQ ID NO: 2598239 - DNA, 14 bp, Homo sapiens
tctatgccagctca

SEQ ID NO: 2598240 - DNA, 23 bp, Homo sapiens
tctatgggactcaatgcactgac

SEQ ID NO: 2598241 - DNA, 16 bp, Homo sapiens
tctatgtatatacatt

SEQ ID NO: 2598242 - DNA, 19 bp, Homo sapiens
tctatgtatatacatttat

SEQ ID NO: 2598243 - DNA, 17 bp, Homo sapiens
tctatgtgcttgtaaaa

SEQ ID NO: 2598244 - DNA, 19 bp, Homo sapiens
tctattatactgtattaag

SEQ ID NO: 2598245 - DNA, 16 bp, Homo sapiens
tctattcagacaagca

SEQ ID NO: 2598246 - DNA, 12 bp, Homo sapiens
tctattcagctt

SEQ ID NO: 2598247 - DNA, 22 bp, Homo sapiens
tctattgacttcaatgatagta

SEQ ID NO: 2598248 - DNA, 17 bp, Homo sapiens
tctattgctggcaaaga

SEQ ID NO: 2598249 - DNA, 22 bp, Homo sapiens
tctattgctggcaaagacagaa

SEQ ID NO: 2598250 - DNA, 16 bp, Homo sapiens
tctattgttactctgg

SEQ ID NO: 2598251 - DNA, 12 bp, Homo sapiens
tctatttaagcc

SEQ ID NO: 2598252 - DNA, 16 bp, Homo sapiens
tctatttctcctccat

SEQ ID NO: 2598253 - DNA, 13 bp, Homo sapiens
tctatttggaatt

SEQ ID NO: 2598254 - DNA, 16 bp, Homo sapiens
tctatttggaatttat

SEQ ID NO: 2598255 - DNA, 13 bp, Homo sapiens
tctatttttgtct

SEQ ID NO: 2598256 - DNA, 13 bp, Homo sapiens
tctcaaaaaataa

SEQ ID NO: 2598257 - DNA, 17 bp, Homo sapiens
tctcaaaactgcactgt

SEQ ID NO: 2598258 - DNA, 14 bp, Homo sapiens
tctcaaactcctga

SEQ ID NO: 2598259 - DNA, 13 bp, Homo sapiens
tctcaaactcttg

SEQ ID NO: 2598260 - DNA, 21 bp, Homo sapiens
tctcaaactcttgacctcagg

SEQ ID NO: 2598261 - DNA, 18 bp, Homo sapiens
tctcaaagttttgaaaag

SEQ ID NO: 2598262 - DNA, 20 bp, Homo sapiens
tctcaaagttttgaaaagct

SEQ ID NO: 2598263 - DNA, 17 bp, Homo sapiens
tctcaaattctcaacct

SEQ ID NO: 2598264 - DNA, 13 bp, Homo sapiens
tctcaaatttcta

SEQ ID NO: 2598265 - DNA, 14 bp, Homo sapiens
tctcaaatttctaa

SEQ ID NO: 2598266 - DNA, 16 bp, Homo sapiens
tctcaaatttctaaat

SEQ ID NO: 2598267 - DNA, 17 bp, Homo sapiens
tctcaacccaggagcat

SEQ ID NO: 2598268 - DNA, 13 bp, Homo sapiens
tctcaagccctgc

SEQ ID NO: 2598269 - DNA, 13 bp, Homo sapiens
tctcaatttttgg

SEQ ID NO: 2598270 - DNA, 16 bp, Homo sapiens
tctcacacatgagcat

SEQ ID NO: 2598271 - DNA, 14 bp, Homo sapiens
tctcacacccaccg

SEQ ID NO: 2598272 - DNA, 23 bp, Homo sapiens
tctcacacccaccgtccgccctg

SEQ ID NO: 2598273 - DNA, 14 bp, Homo sapiens
tctcacactggcgt

SEQ ID NO: 2598274 - DNA, 12 bp, Homo sapiens
tctcaccaggaa

SEQ ID NO: 2598275 - DNA, 19 bp, Homo sapiens
tctcaccccatcccacacc

SEQ ID NO: 2598276 - DNA, 20 bp, Homo sapiens
tcctaggctccaccccatcc

SEQ ID NO: 2598277 - DNA, 17 bp, Homo sapiens
tcctagttccaccatca

SEQ ID NO: 2598278 - DNA, 13 bp, Homo sapiens
tcctagttttctc

SEQ ID NO: 2598279 - DNA, 20 bp, Homo sapiens
tcctataatataataaatat

SEQ ID NO: 2598280 - DNA, 15 bp, Homo sapiens
tcctatatagtttat

SEQ ID NO: 2598281 - DNA, 18 bp, Homo sapiens
tcctatatagtttattga

SEQ ID NO: 2598282 - DNA, 18 bp, Homo sapiens
tcctatattgttttcagt

SEQ ID NO: 2598283 - DNA, 21 bp, Homo sapiens
tcctatattgttttcagtgta

SEQ ID NO: 2598284 - DNA, 20 bp, Homo sapiens
tcctatcaagccagtacgtg

SEQ ID NO: 2598285 - DNA, 14 bp, Homo sapiens
tcctatcacctccc

SEQ ID NO: 2598286 - DNA, 16 bp, Homo sapiens
tcctatcacctcccct

SEQ ID NO: 2598287 - DNA, 17 bp, Homo sapiens
tcctatcacctcccctc

SEQ ID NO: 2598288 - DNA, 19 bp, Homo sapiens
tcctatcacctcccctcct

SEQ ID NO: 2598289 - DNA, 13 bp, Homo sapiens
tcctatctgtgtt

SEQ ID NO: 2598290 - DNA, 14 bp, Homo sapiens
tcctatctgtgttt

SEQ ID NO: 2598291 - DNA, 17 bp, Homo sapiens
tcctatctgtgttttga

SEQ ID NO: 2598292 - DNA, 21 bp, Homo sapiens
tcctatgtgattttaactctg

SEQ ID NO: 2598293 - DNA, 23 bp, Homo sapiens
tcctatgtgattttaactctgtc

SEQ ID NO: 2598294 - DNA, 19 bp, Homo sapiens
tcctatgtttttgttcaaa

SEQ ID NO: 2598295 - DNA, 15 bp, Homo sapiens
tcctattctcaccag

SEQ ID NO: 2598296 - DNA, 20 bp, Homo sapiens
tcctattctcaccaggaagg

SEQ ID NO: 2598297 - DNA, 14 bp, Homo sapiens
tcctattgcaaagg

SEQ ID NO: 2598298 - DNA, 16 bp, Homo sapiens
tcctatttgcactgta

SEQ ID NO: 2598299 - DNA, 18 bp, Homo sapiens
tcctatttgccatgggct

SEQ ID NO: 2598300 - DNA, 14 bp, Homo sapiens
tcctcaaacaacac

SEQ ID NO: 2598301 - DNA, 16 bp, Homo sapiens
tcctcaaacactgcag

SEQ ID NO: 2598302 - DNA, 21 bp, Homo sapiens
tcctcaaggggccatcctgtc

SEQ ID NO: 2598303 - DNA, 13 bp, Homo sapiens
tcctcaatccagc

SEQ ID NO: 2598304 - DNA, 20 bp, Homo sapiens
tcctcacaacatggtgtctg

SEQ ID NO: 2598305 - DNA, 15 bp, Homo sapiens
tcctcacctctggac

SEQ ID NO: 2598306 - DNA, 20 bp, Homo sapiens
tcctcacctctggactggct

SEQ ID NO: 2598307 - DNA, 22 bp, Homo sapiens
tcctcacctctggactggctag

SEQ ID NO: 2598308 - DNA, 12 bp, Homo sapiens
tcctcactccca

SEQ ID NO: 2598309 - DNA, 17 bp, Homo sapiens
tcctcactcccagtcca

SEQ ID NO: 2598310 - DNA, 14 bp, Homo sapiens
tcctcactcccttc

SEQ ID NO: 2598311 - DNA, 13 bp, Homo sapiens
tcctcactgggtg

SEQ ID NO: 2598312 - DNA, 19 bp, Homo sapiens
tcctcagatcatccagaag

SEQ ID NO: 2598313 - DNA, 20 bp, Homo sapiens
tcctcagcctcctcatctgg

SEQ ID NO: 2598314 - DNA, 14 bp, Homo sapiens
tcctcatacccacc

SEQ ID NO: 2598315 - DNA, 17 bp, Homo sapiens
tcctcatccaccccatc

SEQ ID NO: 2598316 - DNA, 18 bp, Homo sapiens
tcctcatccagggctctg

SEQ ID NO: 2598317 - DNA, 20 bp, Homo sapiens
tcctcatctgggggagtgga

SEQ ID NO: 2598318 - DNA, 12 bp, Homo sapiens
tcctccaagcca

SEQ ID NO: 2598319 - DNA, 19 bp, Homo sapiens
tcctccacgttctgctcat

SEQ ID NO: 2598320 - DNA, 21 bp, Homo sapiens
tcctccagaagcctctggcta

SEQ ID NO: 2598321 - DNA, 22 bp, Homo sapiens
tcctccagaagcctctggctag

SEQ ID NO: 2598322 - DNA, 12 bp, Homo sapiens
tcctccaggtgc

SEQ ID NO: 2598323 - DNA, 18 bp, Homo sapiens
tcctccaggtgcacaagc

SEQ ID NO: 2598324 - DNA, 13 bp, Homo sapiens
tcctccaggtttt

SEQ ID NO: 2598325 - DNA, 14 bp, Homo sapiens
tcctccaggttttt

SEQ ID NO: 2598326 - DNA, 16 bp, Homo sapiens
tcctccaggtttttca

SEQ ID NO: 2598327 - DNA, 17 bp, Homo sapiens
tcctccaggtttttcaa

SEQ ID NO: 2598328 - DNA, 19 bp, Homo sapiens
tcctccaggtttttcaatt

SEQ ID NO: 2598329 - DNA, 19 bp, Homo sapiens
tcctcccaagtggtgccta

SEQ ID NO: 2598330 - DNA, 13 bp, Homo sapiens
tcctcccacctca

SEQ ID NO: 2598331 - DNA, 20 bp, Homo sapiens
tcctcccacctcagcctccc

SEQ ID NO: 2598332 - DNA, 21 bp, Homo sapiens
tcctcccacctcagcctcccg

SEQ ID NO: 2598333 - DNA, 23 bp, Homo sapiens
tcctcccatcccctggactggga

SEQ ID NO: 2598334 - DNA, 15 bp, Homo sapiens
tcctccccttccctg

SEQ ID NO: 2598335 - DNA, 17 bp, Homo sapiens
tcctccccttccctgca

SEQ ID NO: 2598336 - DNA, 22 bp, Homo sapiens
tcctcccgggccctcccttgga

SEQ ID NO: 2598337 - DNA, 18 bp, Homo sapiens
tcctccctggctgccctg

SEQ ID NO: 2598338 - DNA, 19 bp, Homo sapiens
tcctccctggctgccctgg

SEQ ID NO: 2598339 - DNA, 16 bp, Homo sapiens
tcctcccttgttctct

SEQ ID NO: 2598340 - DNA, 17 bp, Homo sapiens
tcctccctttttccttg

SEQ ID NO: 2598341 - DNA, 19 bp, Homo sapiens
tcctccctttttccttgtc

SEQ ID NO: 2598342 - DNA, 23 bp, Homo sapiens
tcctccgagccggggagtttctt

SEQ ID NO: 2598343 - DNA, 16 bp, Homo sapiens
tcctccgtccagccgc

SEQ ID NO: 2598344 - DNA, 22 bp, Homo sapiens
tcctcctaccgaaaccttgcct

SEQ ID NO: 2598345 - DNA, 12 bp, Homo sapiens
tcctcctctgtg

SEQ ID NO: 2598346 - DNA, 13 bp, Homo sapiens
tcctcctctgtga

SEQ ID NO: 2598347 - DNA, 16 bp, Homo sapiens
tcctcctgcccacctg

SEQ ID NO: 2598348 - DNA, 12 bp, Homo sapiens
tcctcctgctca

SEQ ID NO: 2598349 - DNA, 23 bp, Homo sapiens
tcctgttagctgttatttctatt

SEQ ID NO: 2598350 - DNA, 13 bp, Homo sapiens
tcctgttgcaccc

SEQ ID NO: 2598351 - DNA, 21 bp, Homo sapiens
tcctgttgcacccagccctgg

SEQ ID NO: 2598352 - DNA, 22 bp, Homo sapiens
tcctgttgcacccagccctggt

SEQ ID NO: 2598353 - DNA, 20 bp, Homo sapiens
tcctgtttttctgggtggcc

SEQ ID NO: 2598354 - DNA, 15 bp, Homo sapiens
tccttaaactgtgtg

SEQ ID NO: 2598355 - DNA, 16 bp, Homo sapiens
tccttaaactgtgtgg

SEQ ID NO: 2598356 - DNA, 18 bp, Homo sapiens
tccttagcttagacctca

SEQ ID NO: 2598357 - DNA, 19 bp, Homo sapiens
tccttagcttagacctcag

SEQ ID NO: 2598358 - DNA, 20 bp, Homo sapiens
tccttagcttagacctcagc

SEQ ID NO: 2598359 - DNA, 22 bp, Homo sapiens
tccttaggtttttttccttctg

SEQ ID NO: 2598360 - DNA, 20 bp, Homo sapiens
tccttcaagaactctgggct

SEQ ID NO: 2598361 - DNA, 21 bp, Homo sapiens
tccttcaagaactctgggctg

SEQ ID NO: 2598362 - DNA, 18 bp, Homo sapiens
tccttcacctttgtcccc

SEQ ID NO: 2598363 - DNA, 18 bp, Homo sapiens
tccttcagggtgatgcca

SEQ ID NO: 2598364 - DNA, 14 bp, Homo sapiens
tccttccaacagga

SEQ ID NO: 2598365 - DNA, 17 bp, Homo sapiens
tccttccatccctaccc

SEQ ID NO: 2598366 - DNA, 13 bp, Homo sapiens
tccttccatgaaa

SEQ ID NO: 2598367 - DNA, 17 bp, Homo sapiens
tccttcccctttcccca

SEQ ID NO: 2598368 - DNA, 15 bp, Homo sapiens
tccttctctgtctca

SEQ ID NO: 2598369 - DNA, 13 bp, Homo sapiens
tccttctttgata

SEQ ID NO: 2598370 - DNA, 19 bp, Homo sapiens
tccttctttgataatgtta

SEQ ID NO: 2598371 - DNA, 13 bp, Homo sapiens
tccttgaccagca

SEQ ID NO: 2598372 - DNA, 16 bp, Homo sapiens
tccttgagagaccagg

SEQ ID NO: 2598373 - DNA, 22 bp, Homo sapiens
tccttgcacactcccctgcact

SEQ ID NO: 2598374 - DNA, 21 bp, Homo sapiens
tccttgcacccctcactctgg

SEQ ID NO: 2598375 - DNA, 16 bp, Homo sapiens
tccttgcctcctgtgt

SEQ ID NO: 2598376 - DNA, 17 bp, Homo sapiens
tccttgcctcctgtgta

SEQ ID NO: 2598377 - DNA, 18 bp, Homo sapiens
tccttgcctcctgtgtaa

SEQ ID NO: 2598378 - DNA, 13 bp, Homo sapiens
tccttgctctccc

SEQ ID NO: 2598379 - DNA, 14 bp, Homo sapiens
tccttgctctccct

SEQ ID NO: 2598380 - DNA, 20 bp, Homo sapiens
tccttgctctccctcttctc

SEQ ID NO: 2598381 - DNA, 14 bp, Homo sapiens
tccttgctctgcac

SEQ ID NO: 2598382 - DNA, 16 bp, Homo sapiens
tccttgctctgcaggc

SEQ ID NO: 2598383 - DNA, 15 bp, Homo sapiens
tccttggcatgcctt

SEQ ID NO: 2598384 - DNA, 13 bp, Homo sapiens
tccttgggcactt

SEQ ID NO: 2598385 - DNA, 15 bp, Homo sapiens
tccttggggcaggca

SEQ ID NO: 2598386 - DNA, 21 bp, Homo sapiens
tccttggtgtgaccctctgaa

SEQ ID NO: 2598387 - DNA, 15 bp, Homo sapiens
tccttgtatttaaat

SEQ ID NO: 2598388 - DNA, 15 bp, Homo sapiens
tccttgtccacccac

SEQ ID NO: 2598389 - DNA, 18 bp, Homo sapiens
tccttgtccccacactcc

SEQ ID NO: 2598390 - DNA, 19 bp, Homo sapiens
tccttgtccccacactcct

SEQ ID NO: 2598391 - DNA, 20 bp, Homo sapiens
tccttgtccccacactccta

SEQ ID NO: 2598392 - DNA, 19 bp, Homo sapiens
tccttgtggcctgggcctc

SEQ ID NO: 2598393 - DNA, 14 bp, Homo sapiens
tccttgtttcaaac

SEQ ID NO: 2598394 - DNA, 21 bp, Homo sapiens
tcctttaaaaaaatttaagtg

SEQ ID NO: 2598395 - DNA, 23 bp, Homo sapiens
tcctttagcgcccagttgggtgg

SEQ ID NO: 2598396 - DNA, 19 bp, Homo sapiens
tcctttcaatggtttgcaa

SEQ ID NO: 2598397 - DNA, 15 bp, Homo sapiens
tcctttcaccacatg

SEQ ID NO: 2598398 - DNA, 22 bp, Homo sapiens
tcctttcagggaatttcaggaa

SEQ ID NO: 2598399 - DNA, 16 bp, Homo sapiens
tcctttcatttactgt

SEQ ID NO: 2598400 - DNA, 18 bp, Homo sapiens
tcctttccaaggcttctc

SEQ ID NO: 2598401 - DNA, 11 bp, Homo sapiens
tcctttctatc

SEQ ID NO: 2598402 - DNA, 15 bp, Homo sapiens
tcctttctattgaaa

SEQ ID NO: 2598403 - DNA, 14 bp, Homo sapiens
tcctttctcagccg

SEQ ID NO: 2598404 - DNA, 20 bp, Homo sapiens
tcctttcttggttcataaat

SEQ ID NO: 2598405 - DNA, 22 bp, Homo sapiens
tcctttcttggttcataaatga

SEQ ID NO: 2598406 - DNA, 14 bp, Homo sapiens
tcctttctttttct

SEQ ID NO: 2598407 - DNA, 17 bp, Homo sapiens
tcctttctttttcttct

SEQ ID NO: 2598408 - DNA, 20 bp, Homo sapiens
tcctttgataaaataaatga

SEQ ID NO: 2598409 - DNA, 23 bp, Homo sapiens
tcctttgtatattatttctagga

SEQ ID NO: 2598410 - DNA, 18 bp, Homo sapiens
tcctttgtgaggaagccg

SEQ ID NO: 2598411 - DNA, 22 bp, Homo sapiens
tcctttgtgaggaagccgctgg

SEQ ID NO: 2598412 - DNA, 20 bp, Homo sapiens
tcctttgtgtttctattgac

SEQ ID NO: 2598413 - DNA, 24 bp, Homo sapiens
tcctttgttcttacctgtatgtct

SEQ ID NO: 2598414 - DNA, 12 bp, Homo sapiens
tccttttatgtt

SEQ ID NO: 2598415 - DNA, 14 bp, Homo sapiens
tcctttttctttat

SEQ ID NO: 2598416 - DNA, 13 bp, Homo sapiens
tcctttttgttat

SEQ ID NO: 2598417 - DNA, 14 bp, Homo sapiens
tcctttttgttatt

SEQ ID NO: 2598418 - DNA, 12 bp, Homo sapiens
tcgaaataacaa

SEQ ID NO: 2598419 - DNA, 19 bp, Homo sapiens
tcgaaataacaatgttaag

SEQ ID NO: 2598420 - DNA, 14 bp, Homo sapiens
tcgaactggctgca

SEQ ID NO: 2598421 - DNA, 17 bp, Homo sapiens
tcgaccaattcaaccct

SEQ ID NO: 2598422 - DNA, 14 bp, Homo sapiens
tcgactcagcctca

SEQ ID NO: 2598423 - DNA, 14 bp, Homo sapiens
tcgactcaggatcc

SEQ ID NO: 2598424 - DNA, 17 bp, Homo sapiens
tcgactgtgacctgtgg

SEQ ID NO: 2598425 - DNA, 21 bp, Homo sapiens
tcgagaagctgctctggaatt

SEQ ID NO: 2598426 - DNA, 20 bp, Homo sapiens
tcgagcagggtgctgtgggt

SEQ ID NO: 2598427 - DNA, 15 bp, Homo sapiens
tcgagcatgcctgga

SEQ ID NO: 2598428 - DNA, 18 bp, Homo sapiens
tcgaggcccagcgacctc

SEQ ID NO: 2598429 - DNA, 14 bp, Homo sapiens
tcgaggggctctca

SEQ ID NO: 2598430 - DNA, 18 bp, Homo sapiens
tcgaggggctctcagctc

SEQ ID NO: 2598431 - DNA, 23 bp, Homo sapiens
tcgatgaagcccaataaacctct

SEQ ID NO: 2598432 - DNA, 23 bp, Homo sapiens
tcgatgggggagtctgaagcaga

SEQ ID NO: 2598433 - DNA, 16 bp, Homo sapiens
tcgatgttatgtaaaa

SEQ ID NO: 2598434 - DNA, 14 bp, Homo sapiens
tcgcacagtctctc

SEQ ID NO: 2598435 - DNA, 15 bp, Homo sapiens
tcagctactgatttt

SEQ ID NO: 2598436 - DNA, 19 bp, Homo sapiens
tcagctactgatttttgtg

SEQ ID NO: 2598437 - DNA, 22 bp, Homo sapiens
tcagctatttaaaaaaaaaaga

SEQ ID NO: 2598438 - DNA, 19 bp, Homo sapiens
tcagctatttactgccaaa

SEQ ID NO: 2598439 - DNA, 14 bp, Homo sapiens
tcagctcactgttc

SEQ ID NO: 2598440 - DNA, 18 bp, Homo sapiens
tcagctcagcgccagcct

SEQ ID NO: 2598441 - DNA, 14 bp, Homo sapiens
tcagctccagctca

SEQ ID NO: 2598442 - DNA, 15 bp, Homo sapiens
tcagctccagctcac

SEQ ID NO: 2598443 - DNA, 22 bp, Homo sapiens
tcagctccagctcaccagcccc

SEQ ID NO: 2598444 - DNA, 24 bp, Homo sapiens
tcagctccagctcaccagccccag

SEQ ID NO: 2598445 - DNA, 13 bp, Homo sapiens
tcagctccagctg

SEQ ID NO: 2598446 - DNA, 19 bp, Homo sapiens
tcagctccaggtggctctg

SEQ ID NO: 2598447 - DNA, 15 bp, Homo sapiens
tcagctccccagagt

SEQ ID NO: 2598448 - DNA, 23 bp, Homo sapiens
tcagctctgcaagaattgaagca

SEQ ID NO: 2598449 - DNA, 11 bp, Homo sapiens
tcagctctggg

SEQ ID NO: 2598450 - DNA, 16 bp, Homo sapiens
tcagctctgggagagg

SEQ ID NO: 2598451 - DNA, 16 bp, Homo sapiens
tcagctgtttgtcata

SEQ ID NO: 2598452 - DNA, 18 bp, Homo sapiens
tcagcttaggggctgctg

SEQ ID NO: 2598453 - DNA, 14 bp, Homo sapiens
tcagcttcttcatc

SEQ ID NO: 2598454 - DNA, 21 bp, Homo sapiens
tcagcttgtaaatagctcagg

SEQ ID NO: 2598455 - DNA, 15 bp, Homo sapiens
tcagctttgccttcc

SEQ ID NO: 2598456 - DNA, 15 bp, Homo sapiens
tcaggaaaggaatca

SEQ ID NO: 2598457 - DNA, 19 bp, Homo sapiens
tcaggaaatatatatgtgt

SEQ ID NO: 2598458 - DNA, 20 bp, Homo sapiens
tcaggaaatcaaatatgcaa

SEQ ID NO: 2598459 - DNA, 14 bp, Homo sapiens
tcaggaacagaagg

SEQ ID NO: 2598460 - DNA, 23 bp, Homo sapiens
tcaggaagaaaggagtctgcaca

SEQ ID NO: 2598461 - DNA, 13 bp, Homo sapiens
tcaggaagctcag

SEQ ID NO: 2598462 - DNA, 14 bp, Homo sapiens
tcaggaagctcagg

SEQ ID NO: 2598463 - DNA, 19 bp, Homo sapiens
tcaggaagctcagggcctg

SEQ ID NO: 2598464 - DNA, 23 bp, Homo sapiens
tcaggaagctcagggcctggctc

SEQ ID NO: 2598465 - DNA, 14 bp, Homo sapiens
tcaggaatgggctg

SEQ ID NO: 2598466 - DNA, 20 bp, Homo sapiens
tcaggaccaaagctttcatg

SEQ ID NO: 2598467 - DNA, 13 bp, Homo sapiens
tcaggaccaggca

SEQ ID NO: 2598468 - DNA, 19 bp, Homo sapiens
tcaggacgagaatgagggt

SEQ ID NO: 2598469 - DNA, 15 bp, Homo sapiens
tcaggacttggtctg

SEQ ID NO: 2598470 - DNA, 13 bp, Homo sapiens
tcaggagagcagc

SEQ ID NO: 2598471 - DNA, 15 bp, Homo sapiens
tcaggagaggggcag

SEQ ID NO: 2598472 - DNA, 11 bp, Homo sapiens
tcaggagcaca

SEQ ID NO: 2598473 - DNA, 18 bp, Homo sapiens
tcaggagcacaggcagct

SEQ ID NO: 2598474 - DNA, 18 bp, Homo sapiens
tcaggaggctgaggggag

SEQ ID NO: 2598475 - DNA, 19 bp, Homo sapiens
tcaggagtcccaaggaaag

SEQ ID NO: 2598476 - DNA, 20 bp, Homo sapiens
tcaggagtcccaaggaaagc

SEQ ID NO: 2598477 - DNA, 20 bp, Homo sapiens
tcaggagttagaggccagcc

SEQ ID NO: 2598478 - DNA, 12 bp, Homo sapiens
tcaggagttcct

SEQ ID NO: 2598479 - DNA, 14 bp, Homo sapiens
tcaggatacatgtg

SEQ ID NO: 2598480 - DNA, 16 bp, Homo sapiens
tcaggatacatgtgcc

SEQ ID NO: 2598481 - DNA, 17 bp, Homo sapiens
tcaggatcaagaaagtg

SEQ ID NO: 2598482 - DNA, 16 bp, Homo sapiens
tcaggatgaacccagg

SEQ ID NO: 2598483 - DNA, 17 bp, Homo sapiens
tcaggatgaacccagga

SEQ ID NO: 2598484 - DNA, 15 bp, Homo sapiens
tcaggatgcccaggg

SEQ ID NO: 2598485 - DNA, 12 bp, Homo sapiens
tcaggccaggcc

SEQ ID NO: 2598486 - DNA, 21 bp, Homo sapiens
tcaggccatcatcagtggagc

SEQ ID NO: 2598487 - DNA, 18 bp, Homo sapiens
tcaggcctccctctctct

SEQ ID NO: 2598488 - DNA, 20 bp, Homo sapiens
tcaggctccattaggatttg

SEQ ID NO: 2598489 - DNA, 15 bp, Homo sapiens
tcaggctctgcctca

SEQ ID NO: 2598490 - DNA, 13 bp, Homo sapiens
tcaggctgaggtg

SEQ ID NO: 2598491 - DNA, 17 bp, Homo sapiens
tcaggctgctggcgcct

SEQ ID NO: 2598492 - DNA, 22 bp, Homo sapiens
tcaggctgctggcgcctctgca

SEQ ID NO: 2598493 - DNA, 15 bp, Homo sapiens
tcaggctgcttggga

SEQ ID NO: 2598494 - DNA, 14 bp, Homo sapiens
tcaggcttccttgg

SEQ ID NO: 2598495 - DNA, 23 bp, Homo sapiens
tcaggcttccttggcatcacagg

SEQ ID NO: 2598496 - DNA, 16 bp, Homo sapiens
tcaggcttgaaatgca

SEQ ID NO: 2598497 - DNA, 22 bp, Homo sapiens
tcagggaaccgttattataatt

SEQ ID NO: 2598498 - DNA, 15 bp, Homo sapiens
tcagggacaggatga

SEQ ID NO: 2598499 - DNA, 14 bp, Homo sapiens
tcagggaccaagga

SEQ ID NO: 2598500 - DNA, 23 bp, Homo sapiens
tcagggaccaaggacccctcacc

SEQ ID NO: 2598501 - DNA, 12 bp, Homo sapiens
tcagggacccct

SEQ ID NO: 2598502 - DNA, 23 bp, Homo sapiens
tcagggatagcactgagcaaagc

SEQ ID NO: 2598503 - DNA, 18 bp, Homo sapiens
tcagggcccaagtccctg

SEQ ID NO: 2598504 - DNA, 16 bp, Homo sapiens
tcagggcctggctcag

SEQ ID NO: 2598505 - DNA, 20 bp, Homo sapiens
tcagggctcctgccttctgt

SEQ ID NO: 2598506 - DNA, 14 bp, Homo sapiens
tcagggctcctggg

SEQ ID NO: 2598507 - DNA, 23 bp, Homo sapiens
tcaggggtgtgcggcctttggct

SEQ ID NO: 2598508 - DNA, 19 bp, Homo sapiens
tcagggtccctggtggcag

SEQ ID NO: 2598509 - DNA, 16 bp, Homo sapiens
tcagggtctctgctgc

SEQ ID NO: 2598510 - DNA, 17 bp, Homo sapiens
tcagggtctctgctgcc

SEQ ID NO: 2598511 - DNA, 18 bp, Homo sapiens
tcagggtctctgctgccg

SEQ ID NO: 2598512 - DNA, 16 bp, Homo sapiens
tcagggtgatgccagg

SEQ ID NO: 2598513 - DNA, 18 bp, Homo sapiens
tcaggtcagggtgaggat

SEQ ID NO: 2598514 - DNA, 21 bp, Homo sapiens
tcaggtctcccacgtgggaga

SEQ ID NO: 2598515 - DNA, 23 bp, Homo sapiens
tcaggtgagaagcagaggaagga

SEQ ID NO: 2598516 - DNA, 21 bp, Homo sapiens
tcaggtgcccatccctggaag

SEQ ID NO: 2598517 - DNA, 17 bp, Homo sapiens
tcaggtgggcgtggtca

SEQ ID NO: 2598518 - DNA, 15 bp, Homo sapiens
tcaggtggggcagct

SEQ ID NO: 2598519 - DNA, 20 bp, Homo sapiens
tcaggtggggtcactctggc

SEQ ID NO: 2598520 - DNA, 21 bp, Homo sapiens
tcaggtggggtcactctggca

SEQ ID NO: 2598521 - DNA, 23 bp, Homo sapiens
tcaggtggggtcactctggcagc

SEQ ID NO: 2598522 - DNA, 17 bp, Homo sapiens
tcaggtgtccctgcact

SEQ ID NO: 2598523 - DNA, 19 bp, Homo sapiens
tcaggttgctggttgctgt

SEQ ID NO: 2598524 - DNA, 23 bp, Homo sapiens
tcaggttgctggttgctgtgtgg

SEQ ID NO: 2598525 - DNA, 19 bp, Homo sapiens
tcaggttgtagtaaagaaa

SEQ ID NO: 2598526 - DNA, 17 bp, Homo sapiens
tcaggtttgcctgaggg

SEQ ID NO: 2598527 - DNA, 18 bp, Homo sapiens
tcaggtttgcctgagggc

SEQ ID NO: 2598528 - DNA, 13 bp, Homo sapiens
tcagtaagacgac

SEQ ID NO: 2598529 - DNA, 22 bp, Homo sapiens
tcagtaagacgacaaggaaagg

SEQ ID NO: 2598530 - DNA, 13 bp, Homo sapiens
tcagtaagccgtg

SEQ ID NO: 2598531 - DNA, 13 bp, Homo sapiens
tcagtaataactc

SEQ ID NO: 2598532 - DNA, 17 bp, Homo sapiens
tcagtaatttgaggaca

SEQ ID NO: 2598533 - DNA, 16 bp, Homo sapiens
tcagtaccctctcagc

SEQ ID NO: 2598534 - DNA, 14 bp, Homo sapiens
tcagtattgaagca

SEQ ID NO: 2598535 - DNA, 15 bp, Homo sapiens
tcagtattgaagcat

SEQ ID NO: 2598536 - DNA, 19 bp, Homo sapiens
tcagtattgaagcatttta

SEQ ID NO: 2598537 - DNA, 22 bp, Homo sapiens
tcagtattgaagcattttataa

SEQ ID NO: 2598538 - DNA, 19 bp, Homo sapiens
tcagtattttggagaaatt

SEQ ID NO: 2598539 - DNA, 20 bp, Homo sapiens
tcagtattttggagaaatta

SEQ ID NO: 2598540 - DNA, 22 bp, Homo sapiens
tcagtattttggagaaattatt

SEQ ID NO: 2598541 - DNA, 23 bp, Homo sapiens
tcagtattttggagaaattattt

SEQ ID NO: 2598542 - DNA, 16 bp, Homo sapiens
tcagtcatgcataaat

SEQ ID NO: 2598543 - DNA, 17 bp, Homo sapiens
tcagtcatgcataaata

SEQ ID NO: 2598544 - DNA, 21 bp, Homo sapiens
tcagtcattagactcctcctc

SEQ ID NO: 2598545 - DNA, 18 bp, Homo sapiens
tcagtccatgaagatgta

SEQ ID NO: 2598546 - DNA, 12 bp, Homo sapiens
tcagtcccctcc

SEQ ID NO: 2598547 - DNA, 16 bp, Homo sapiens
tcagtctatccacaga

SEQ ID NO: 2598548 - DNA, 18 bp, Homo sapiens
tcagtctatccacagaga

SEQ ID NO: 2598549 - DNA, 14 bp, Homo sapiens
tcagtctcaggagc

SEQ ID NO: 2598550 - DNA, 17 bp, Homo sapiens
tcagtctccctttccct

SEQ ID NO: 2598551 - DNA, 17 bp, Homo sapiens
tcagtctgattcccaag

SEQ ID NO: 2598552 - DNA, 19 bp, Homo sapiens
tcagtctgattcccaagct

SEQ ID NO: 2598553 - DNA, 21 bp, Homo sapiens
tcagtctgattcccaagctct

SEQ ID NO: 2598554 - DNA, 22 bp, Homo sapiens
tcagtctttcttagtgcctgtg

SEQ ID NO: 2598555 - DNA, 19 bp, Homo sapiens
tcagtgacagagttcacta

SEQ ID NO: 2598556 - DNA, 12 bp, Homo sapiens
tcagtgctccct

SEQ ID NO: 2598557 - DNA, 12 bp, Homo sapiens
tcagtgctgtgg

SEQ ID NO: 2598558 - DNA, 15 bp, Homo sapiens
tcagtgcttcgcaga

SEQ ID NO: 2598559 - DNA, 13 bp, Homo sapiens
tcccacaccctgg

SEQ ID NO: 2598560 - DNA, 15 bp, Homo sapiens
tcccacacctccaca

SEQ ID NO: 2598561 - DNA, 18 bp, Homo sapiens
tcccacactggtgactgc

SEQ ID NO: 2598562 - DNA, 17 bp, Homo sapiens
tcccacaggacatttct

SEQ ID NO: 2598563 - DNA, 18 bp, Homo sapiens
tcccacaggacatttctc

SEQ ID NO: 2598564 - DNA, 14 bp, Homo sapiens
tcccacaggcagct

SEQ ID NO: 2598565 - DNA, 17 bp, Homo sapiens
tcccacaggcagcttta

SEQ ID NO: 2598566 - DNA, 15 bp, Homo sapiens
tcccacccacatgtg

SEQ ID NO: 2598567 - DNA, 16 bp, Homo sapiens
tcccacccacatgtga

SEQ ID NO: 2598568 - DNA, 15 bp, Homo sapiens
tcccaccccacacac

SEQ ID NO: 2598569 - DNA, 20 bp, Homo sapiens
tcccaccccacacacgccag

SEQ ID NO: 2598570 - DNA, 22 bp, Homo sapiens
tcccacccccacccccagctca

SEQ ID NO: 2598571 - DNA, 17 bp, Homo sapiens
tcccacccgatgctgct

SEQ ID NO: 2598572 - DNA, 14 bp, Homo sapiens
tcccacctcagcct

SEQ ID NO: 2598573 - DNA, 22 bp, Homo sapiens
tcccacctcttctcttcctgta

SEQ ID NO: 2598574 - DNA, 18 bp, Homo sapiens
tcccacgcttctctttgg

SEQ ID NO: 2598575 - DNA, 14 bp, Homo sapiens
tcccacgtgggaga

SEQ ID NO: 2598576 - DNA, 20 bp, Homo sapiens
tcccactatctgggtgcatg

SEQ ID NO: 2598577 - DNA, 15 bp, Homo sapiens
tcccactcaccccgg

SEQ ID NO: 2598578 - DNA, 23 bp, Homo sapiens
tcccactcaccccggcagacgcc

SEQ ID NO: 2598579 - DNA, 14 bp, Homo sapiens
tcccactcagtcca

SEQ ID NO: 2598580 - DNA, 17 bp, Homo sapiens
tcccactctagggcagt

SEQ ID NO: 2598581 - DNA, 22 bp, Homo sapiens
tcccactctagggcagtggagt

SEQ ID NO: 2598582 - DNA, 16 bp, Homo sapiens
tcccactgcctcaggt

SEQ ID NO: 2598583 - DNA, 17 bp, Homo sapiens
tcccacttggaggcctt

SEQ ID NO: 2598584 - DNA, 20 bp, Homo sapiens
tcccagaacacactccatca

SEQ ID NO: 2598585 - DNA, 23 bp, Homo sapiens
tcccagaatcaaagcaatgcatt

SEQ ID NO: 2598586 - DNA, 16 bp, Homo sapiens
tcccagagcaaaataa

SEQ ID NO: 2598587 - DNA, 17 bp, Homo sapiens
tcccagaggctgcccca

SEQ ID NO: 2598588 - DNA, 13 bp, Homo sapiens
tcccagcagccct

SEQ ID NO: 2598589 - DNA, 16 bp, Homo sapiens
tcccagccactcggga

SEQ ID NO: 2598590 - DNA, 15 bp, Homo sapiens
tcccagcccaaagct

SEQ ID NO: 2598591 - DNA, 12 bp, Homo sapiens
tcccagccccaa

SEQ ID NO: 2598592 - DNA, 16 bp, Homo sapiens
tcccagccctatggat

SEQ ID NO: 2598593 - DNA, 18 bp, Homo sapiens
tcccagccctatggatgt

SEQ ID NO: 2598594 - DNA, 22 bp, Homo sapiens
tcccagccctttgggaggctga

SEQ ID NO: 2598595 - DNA, 14 bp, Homo sapiens
tcccagccttggca

SEQ ID NO: 2598596 - DNA, 23 bp, Homo sapiens
tcccagctactcagaagcctgag

SEQ ID NO: 2598597 - DNA, 17 bp, Homo sapiens
tcccagctactcaggag

SEQ ID NO: 2598598 - DNA, 16 bp, Homo sapiens
tcccagctactcggga

SEQ ID NO: 2598599 - DNA, 17 bp, Homo sapiens
tcccagctacttgggag

SEQ ID NO: 2598600 - DNA, 19 bp, Homo sapiens
tcccagctacttgggaggc

SEQ ID NO: 2598601 - DNA, 20 bp, Homo sapiens
tcccagctctagacaaccct

SEQ ID NO: 2598602 - DNA, 23 bp, Homo sapiens
tcccaggaacaatcgatggcctt

SEQ ID NO: 2598603 - DNA, 16 bp, Homo sapiens
tcccaggagacagttc

SEQ ID NO: 2598604 - DNA, 22 bp, Homo sapiens
tcccaggagacagttcaagaaa

SEQ ID NO: 2598605 - DNA, 16 bp, Homo sapiens
tcccaggatgagcatc

SEQ ID NO: 2598606 - DNA, 24 bp, Homo sapiens
tcccaggatgagcatcccaggatc

SEQ ID NO: 2598607 - DNA, 21 bp, Homo sapiens
tcccaggctctcaacagggga

SEQ ID NO: 2598608 - DNA, 18 bp, Homo sapiens
tcccaggcttcaccctga

SEQ ID NO: 2598609 - DNA, 22 bp, Homo sapiens
tcccaggcttcaccctgaatgg

SEQ ID NO: 2598610 - DNA, 18 bp, Homo sapiens
tcccagggaagtgctctg

SEQ ID NO: 2598611 - DNA, 17 bp, Homo sapiens
tcccagggccagggccc

SEQ ID NO: 2598612 - DNA, 22 bp, Homo sapiens
tcccagggccagggccctgcag

SEQ ID NO: 2598613 - DNA, 12 bp, Homo sapiens
tcccaggggacc

SEQ ID NO: 2598614 - DNA, 21 bp, Homo sapiens
tcccagggtagcccgcctgcc

SEQ ID NO: 2598615 - DNA, 23 bp, Homo sapiens
tcccagtacctcctgtctctggc

SEQ ID NO: 2598616 - DNA, 15 bp, Homo sapiens
tcccagtgacacttc

SEQ ID NO: 2598617 - DNA, 19 bp, Homo sapiens
tcccagtgccgagaaggaa

SEQ ID NO: 2598618 - DNA, 14 bp, Homo sapiens
tcccagtggcctca

SEQ ID NO: 2598619 - DNA, 18 bp, Homo sapiens
tcccagtggcctcaaccc

SEQ ID NO: 2598620 - DNA, 19 bp, Homo sapiens
tcccagtggcctcaaccct

SEQ ID NO: 2598621 - DNA, 17 bp, Homo sapiens
tcccagtggctgctgcc

SEQ ID NO: 2598622 - DNA, 23 bp, Homo sapiens
tcccagtggctgctgcccaggcc

SEQ ID NO: 2598623 - DNA, 10 bp, Homo sapiens
tcccagtggg

SEQ ID NO: 2598624 - DNA, 14 bp, Homo sapiens
tcccagtgggaggg

SEQ ID NO: 2598625 - DNA, 17 bp, Homo sapiens
tcccagtgggaggggca

SEQ ID NO: 2598626 - DNA, 20 bp, Homo sapiens
tcccagttcaggagtcccaa

SEQ ID NO: 2598627 - DNA, 13 bp, Homo sapiens
tcccatccaggca

SEQ ID NO: 2598628 - DNA, 15 bp, Homo sapiens
tcccatccaggcagt

SEQ ID NO: 2598629 - DNA, 18 bp, Homo sapiens
tcccatccagtgtctcac

SEQ ID NO: 2598630 - DNA, 16 bp, Homo sapiens
tcccatccccctgccc

SEQ ID NO: 2598631 - DNA, 17 bp, Homo sapiens
tcccatccccctgccct

SEQ ID NO: 2598632 - DNA, 18 bp, Homo sapiens
tcccatcctaccctcggg

SEQ ID NO: 2598633 - DNA, 13 bp, Homo sapiens
tcccatcgctgtc

SEQ ID NO: 2598634 - DNA, 14 bp, Homo sapiens
tcccatctcacaca

SEQ ID NO: 2598635 - DNA, 16 bp, Homo sapiens
tcccatctccactgtt

SEQ ID NO: 2598636 - DNA, 14 bp, Homo sapiens
tcccatctcttcct

SEQ ID NO: 2598637 - DNA, 23 bp, Homo sapiens
tcccatctgggagtccccttttc

SEQ ID NO: 2598638 - DNA, 15 bp, Homo sapiens
tcccatcttccaagg

SEQ ID NO: 2598639 - DNA, 14 bp, Homo sapiens
tcccatgacccacc

SEQ ID NO: 2598640 - DNA, 20 bp, Homo sapiens
tcccatgacccacccctgtg

SEQ ID NO: 2598641 - DNA, 22 bp, Homo sapiens
tcccatgacccacccctgtgct

SEQ ID NO: 2598642 - DNA, 14 bp, Homo sapiens
tcccatgacccagg

SEQ ID NO: 2598643 - DNA, 20 bp, Homo sapiens
tcccatgacccaggctgggc

SEQ ID NO: 2598644 - DNA, 18 bp, Homo sapiens
tcccatgagcctcagcat

SEQ ID NO: 2598645 - DNA, 22 bp, Homo sapiens
tcccatgagcctcagcatcctg

SEQ ID NO: 2598646 - DNA, 15 bp, Homo sapiens
tcccatgtaacagaa

SEQ ID NO: 2598647 - DNA, 17 bp, Homo sapiens
tcccatgtaacagaaag

SEQ ID NO: 2598648 - DNA, 16 bp, Homo sapiens
tcccattagcaaaaat

SEQ ID NO: 2598649 - DNA, 21 bp, Homo sapiens
tcccattaggacaatcagtcc

SEQ ID NO: 2598650 - DNA, 15 bp, Homo sapiens
tcccatttctcactg

SEQ ID NO: 2598651 - DNA, 13 bp, Homo sapiens
tcccattttgcaa

SEQ ID NO: 2598652 - DNA, 14 bp, Homo sapiens
tccccaacagtgtg

SEQ ID NO: 2598653 - DNA, 15 bp, Homo sapiens
tccccaacagtgtga

SEQ ID NO: 2598654 - DNA, 16 bp, Homo sapiens
tccccaacagtgtgaa

SEQ ID NO: 2598655 - DNA, 21 bp, Homo sapiens
tccccaacagtgtgaagttag

SEQ ID NO: 2598656 - DNA, 16 bp, Homo sapiens
tccccaaccctgcccc

SEQ ID NO: 2598657 - DNA, 17 bp, Homo sapiens
tccccaaccctgcccct

SEQ ID NO: 2598658 - DNA, 18 bp, Homo sapiens
tccccacaggagccctgc

SEQ ID NO: 2598659 - DNA, 12 bp, Homo sapiens
tccccaccctga

SEQ ID NO: 2598660 - DNA, 16 bp, Homo sapiens
tccccaccgcagacag

SEQ ID NO: 2598661 - DNA, 22 bp, Homo sapiens
tccccaccgcagacaggaccag

SEQ ID NO: 2598662 - DNA, 13 bp, Homo sapiens
tccccacctggga

SEQ ID NO: 2598663 - DNA, 14 bp, Homo sapiens
tccccacctgggac

SEQ ID NO: 2598664 - DNA, 18 bp, Homo sapiens
tccccaccttcaattcct

SEQ ID NO: 2598665 - DNA, 20 bp, Homo sapiens
tccccaccttcaattcctgg

SEQ ID NO: 2598666 - DNA, 18 bp, Homo sapiens
tccccacggccgctccag

SEQ ID NO: 2598667 - DNA, 19 bp, Homo sapiens
tccccactgacagcctccc

SEQ ID NO: 2598668 - DNA, 20 bp, Homo sapiens
tccccactgcctgcccaccc

SEQ ID NO: 2598669 - DNA, 12 bp, Homo sapiens
tccccagagcac

SEQ ID NO: 2598670 - DNA, 20 bp, Homo sapiens
tccccagattgcaacaggct

SEQ ID NO: 2598671 - DNA, 20 bp, Homo sapiens
tccccagcaagtgagagctg

SEQ ID NO: 2598672 - DNA, 22 bp, Homo sapiens
tccccagcaagtgagagctggg

SEQ ID NO: 2598673 - DNA, 21 bp, Homo sapiens
tccccagcagggtcttttcat

SEQ ID NO: 2598674 - DNA, 15 bp, Homo sapiens
tccccagcccagggt

SEQ ID NO: 2598675 - DNA, 13 bp, Homo sapiens
tccccagccctgg

SEQ ID NO: 2598676 - DNA, 22 bp, Homo sapiens
tccccagcgtcccagtctctgg

SEQ ID NO: 2598677 - DNA, 13 bp, Homo sapiens
tccccaggaggcc

SEQ ID NO: 2598678 - DNA, 14 bp, Homo sapiens
tccccaggaggcca

SEQ ID NO: 2598679 - DNA, 18 bp, Homo sapiens
tccccaggaggccagcct

SEQ ID NO: 2598680 - DNA, 14 bp, Homo sapiens
tccccaggccaggc

SEQ ID NO: 2598681 - DNA, 23 bp, Homo sapiens
tccccaggccaggccaccaggat

SEQ ID NO: 2598682 - DNA, 11 bp, Homo sapiens
tccccaggccc

SEQ ID NO: 2598683 - DNA, 21 bp, Homo sapiens
tccccaggccccaggaagccg

SEQ ID NO: 2598684 - DNA, 17 bp, Homo sapiens
tccccaggggtcccagc

SEQ ID NO: 2598685 - DNA, 22 bp, Homo sapiens
tccccaggggtcccagccaccc

SEQ ID NO: 2598686 - DNA, 14 bp, Homo sapiens
tccccatcctccag

SEQ ID NO: 2598687 - DNA, 16 bp, Homo sapiens
tccccatcctccagct

SEQ ID NO: 2598688 - DNA, 17 bp, Homo sapiens
tccccatcctccagctt

SEQ ID NO: 2598689 - DNA, 18 bp, Homo sapiens
tccccatcctccagcttc

SEQ ID NO: 2598690 - DNA, 23 bp, Homo sapiens
tccccatgggaagacgaggccct

SEQ ID NO: 2598691 - DNA, 21 bp, Homo sapiens
tccccattagagtcagccttc

SEQ ID NO: 2598692 - DNA, 21 bp, Homo sapiens
tcccccagccccatcctctgt

SEQ ID NO: 2598693 - DNA, 12 bp, Homo sapiens
tcccccagccct

SEQ ID NO: 2598694 - DNA, 14 bp, Homo sapiens
tcccccagccctgt

SEQ ID NO: 2598695 - DNA, 17 bp, Homo sapiens
tcccccagccctgtgga

SEQ ID NO: 2598696 - DNA, 12 bp, Homo sapiens
tcccccagcctc

SEQ ID NO: 2598697 - DNA, 17 bp, Homo sapiens
tcccccatcctcccctt

SEQ ID NO: 2598698 - DNA, 19 bp, Homo sapiens
tcccccatcctccccttcc

SEQ ID NO: 2598699 - DNA, 17 bp, Homo sapiens
tccccctcccagggcca

SEQ ID NO: 2598700 - DNA, 15 bp, Homo sapiens
tccccctgccctcgt

SEQ ID NO: 2598701 - DNA, 22 bp, Homo sapiens
tccccctgccctcgtggccagc

SEQ ID NO: 2598702 - DNA, 23 bp, Homo sapiens
tccccctgccctcgtggccagcc

SEQ ID NO: 2598703 - DNA, 23 bp, Homo sapiens
tccccctggccaccaccccccac

SEQ ID NO: 2598704 - DNA, 15 bp, Homo sapiens
tcacagatgggtgct

SEQ ID NO: 2598705 - DNA, 20 bp, Homo sapiens
tcacagatgggtgcttggag

SEQ ID NO: 2598706 - DNA, 17 bp, Homo sapiens
tcacagcacagagaaga

SEQ ID NO: 2598707 - DNA, 18 bp, Homo sapiens
tcacagcacagagaagac

SEQ ID NO: 2598708 - DNA, 15 bp, Homo sapiens
tcacagcagcttcta

SEQ ID NO: 2598709 - DNA, 16 bp, Homo sapiens
tcacagccacttggga

SEQ ID NO: 2598710 - DNA, 23 bp, Homo sapiens
tcacagccagactggcacagttt

SEQ ID NO: 2598711 - DNA, 13 bp, Homo sapiens
tcacagcctcctc

SEQ ID NO: 2598712 - DNA, 11 bp, Homo sapiens
tcacagctcct

SEQ ID NO: 2598713 - DNA, 14 bp, Homo sapiens
tcacagctcctccc

SEQ ID NO: 2598714 - DNA, 17 bp, Homo sapiens
tcacagcttcagccagg

SEQ ID NO: 2598715 - DNA, 14 bp, Homo sapiens
tcacaggaagtaga

SEQ ID NO: 2598716 - DNA, 19 bp, Homo sapiens
tcacaggactctgcctcct

SEQ ID NO: 2598717 - DNA, 11 bp, Homo sapiens
tcacaggcagg

SEQ ID NO: 2598718 - DNA, 12 bp, Homo sapiens
tcacaggcaggt

SEQ ID NO: 2598719 - DNA, 18 bp, Homo sapiens
tcacaggcaggtccaggg

SEQ ID NO: 2598720 - DNA, 18 bp, Homo sapiens
tcacaggcgaggcctgga

SEQ ID NO: 2598721 - DNA, 20 bp, Homo sapiens
tcacaggcgaggcctggagt

SEQ ID NO: 2598722 - DNA, 15 bp, Homo sapiens
tcacagggcagagcc

SEQ ID NO: 2598723 - DNA, 22 bp, Homo sapiens
tcacagggccaacttgagggcc

SEQ ID NO: 2598724 - DNA, 17 bp, Homo sapiens
tcacagggccccagaag

SEQ ID NO: 2598725 - DNA, 23 bp, Homo sapiens
tcacagggccccagaaggcaggg

SEQ ID NO: 2598726 - DNA, 16 bp, Homo sapiens
tcacagtcacattcca

SEQ ID NO: 2598727 - DNA, 18 bp, Homo sapiens
tcacagtctctttaatct

SEQ ID NO: 2598728 - DNA, 19 bp, Homo sapiens
tcacagtctctttaatctt

SEQ ID NO: 2598729 - DNA, 17 bp, Homo sapiens
tcacagtgttgcccagg

SEQ ID NO: 2598730 - DNA, 22 bp, Homo sapiens
tcacagtgtttgcaatggtgtt

SEQ ID NO: 2598731 - DNA, 17 bp, Homo sapiens
tcacagttggccttcag

SEQ ID NO: 2598732 - DNA, 20 bp, Homo sapiens
tcacagttttggttgcttta

SEQ ID NO: 2598733 - DNA, 17 bp, Homo sapiens
tcacatcctgtgtttct

SEQ ID NO: 2598734 - DNA, 19 bp, Homo sapiens
tcacatcctgtgtttctag

SEQ ID NO: 2598735 - DNA, 15 bp, Homo sapiens
tcacatcttggcaca

SEQ ID NO: 2598736 - DNA, 22 bp, Homo sapiens
tcacatctttcacacttccacc

SEQ ID NO: 2598737 - DNA, 13 bp, Homo sapiens
tcacatgaccaca

SEQ ID NO: 2598738 - DNA, 18 bp, Homo sapiens
tcacatgaccacatagca

SEQ ID NO: 2598739 - DNA, 23 bp, Homo sapiens
tcacatgtatgttttggtatctg

SEQ ID NO: 2598740 - DNA, 21 bp, Homo sapiens
tcacatgtcagtaccttcaaa

SEQ ID NO: 2598741 - DNA, 20 bp, Homo sapiens
tcacattaatatttgctgac

SEQ ID NO: 2598742 - DNA, 15 bp, Homo sapiens
tcacattatttgcat

SEQ ID NO: 2598743 - DNA, 13 bp, Homo sapiens
tcacattcaggaa

SEQ ID NO: 2598744 - DNA, 13 bp, Homo sapiens
tcacattcttata

SEQ ID NO: 2598745 - DNA, 17 bp, Homo sapiens
tcacatttattctgctc

SEQ ID NO: 2598746 - DNA, 18 bp, Homo sapiens
tcacatttattctgctca

SEQ ID NO: 2598747 - DNA, 14 bp, Homo sapiens
tcacattttccttt

SEQ ID NO: 2598748 - DNA, 17 bp, Homo sapiens
tcacattttccttttca

SEQ ID NO: 2598749 - DNA, 17 bp, Homo sapiens
tcaccaacgtctgtgcc

SEQ ID NO: 2598750 - DNA, 18 bp, Homo sapiens
tcaccaacgtctgtgcca

SEQ ID NO: 2598751 - DNA, 14 bp, Homo sapiens
tcaccaaggctgat

SEQ ID NO: 2598752 - DNA, 16 bp, Homo sapiens
tcaccacatgtgcaca

SEQ ID NO: 2598753 - DNA, 15 bp, Homo sapiens
tcaccagatttgcta

SEQ ID NO: 2598754 - DNA, 17 bp, Homo sapiens
tcaccagccccagtgcc

SEQ ID NO: 2598755 - DNA, 22 bp, Homo sapiens
tcaccagccccagtgcccacag

SEQ ID NO: 2598756 - DNA, 20 bp, Homo sapiens
tcaccagctgcctcttctgt

SEQ ID NO: 2598757 - DNA, 19 bp, Homo sapiens
tcaccagtgcgattctgga

SEQ ID NO: 2598758 - DNA, 13 bp, Homo sapiens
tcaccagtgtccc

SEQ ID NO: 2598759 - DNA, 14 bp, Homo sapiens
tcaccatctgtgca

SEQ ID NO: 2598760 - DNA, 19 bp, Homo sapiens
tcacccaagcaaggccaaa

SEQ ID NO: 2598761 - DNA, 21 bp, Homo sapiens
tcacccagctaatctgtaggg

SEQ ID NO: 2598762 - DNA, 17 bp, Homo sapiens
tcacccatgaagacagg

SEQ ID NO: 2598763 - DNA, 13 bp, Homo sapiens
tcaccccaccctt

SEQ ID NO: 2598764 - DNA, 13 bp, Homo sapiens
tcaccccagcccc

SEQ ID NO: 2598765 - DNA, 12 bp, Homo sapiens
tcaccccatccc

SEQ ID NO: 2598766 - DNA, 14 bp, Homo sapiens
tcaccccccactca

SEQ ID NO: 2598767 - DNA, 13 bp, Homo sapiens
tcaccccctcggg

SEQ ID NO: 2598768 - DNA, 22 bp, Homo sapiens
tcacccccttctccatccacat

SEQ ID NO: 2598769 - DNA, 22 bp, Homo sapiens
tcaccccggccacctgcggtgc

SEQ ID NO: 2598770 - DNA, 13 bp, Homo sapiens
tcacccctccagg

SEQ ID NO: 2598771 - DNA, 14 bp, Homo sapiens
tcacccctccagga

SEQ ID NO: 2598772 - DNA, 17 bp, Homo sapiens
tcacccctgccctggga

SEQ ID NO: 2598773 - DNA, 18 bp, Homo sapiens
tcacccgctaagagggag

SEQ ID NO: 2598774 - DNA, 15 bp, Homo sapiens
tcacccgtccagacc

SEQ ID NO: 2598775 - DNA, 13 bp, Homo sapiens
tcaccctccacct

SEQ ID NO: 2598776 - DNA, 21 bp, Homo sapiens
tcaccctgagccccttccttg

SEQ ID NO: 2598777 - DNA, 15 bp, Homo sapiens
tcaccgaagccactt

SEQ ID NO: 2598778 - DNA, 17 bp, Homo sapiens
tcaccgacgcgtctcct

SEQ ID NO: 2598779 - DNA, 23 bp, Homo sapiens
tcaccgcagtcgtcgcacagtct

SEQ ID NO: 2598780 - DNA, 19 bp, Homo sapiens
tcaccgtggaccttcctgc

SEQ ID NO: 2598781 - DNA, 20 bp, Homo sapiens
tcaccgtggaccttcctgcc

SEQ ID NO: 2598782 - DNA, 13 bp, Homo sapiens
tcaccgtgggctc

SEQ ID NO: 2598783 - DNA, 19 bp, Homo sapiens
tcaccgtgggctccctgac

SEQ ID NO: 2598784 - DNA, 14 bp, Homo sapiens
tcacctaatgttta

SEQ ID NO: 2598785 - DNA, 13 bp, Homo sapiens
tcacctcccctcc

SEQ ID NO: 2598786 - DNA, 21 bp, Homo sapiens
tcacctccggtcgtgtctctg

SEQ ID NO: 2598787 - DNA, 15 bp, Homo sapiens
tcacctctcccttgg

SEQ ID NO: 2598788 - DNA, 19 bp, Homo sapiens
tcacctgaagactcattct

SEQ ID NO: 2598789 - DNA, 22 bp, Homo sapiens
tcacctgagcccggatgcttct

SEQ ID NO: 2598790 - DNA, 23 bp, Homo sapiens
tcacctgagcccggatgcttctc

SEQ ID NO: 2598791 - DNA, 18 bp, Homo sapiens
tcacctgattcaactaaa

SEQ ID NO: 2598792 - DNA, 21 bp, Homo sapiens
tcacctgattcaactaaaaaa

SEQ ID NO: 2598793 - DNA, 20 bp, Homo sapiens
tcacctgctggcccctcacc

SEQ ID NO: 2598794 - DNA, 14 bp, Homo sapiens
tcacctgggcacct

SEQ ID NO: 2598795 - DNA, 20 bp, Homo sapiens
tcacctgggcacctggggag

SEQ ID NO: 2598796 - DNA, 16 bp, Homo sapiens
tcacctgtactcttcc

SEQ ID NO: 2598797 - DNA, 21 bp, Homo sapiens
tcacctgtgcttcgggccctt

SEQ ID NO: 2598798 - DNA, 14 bp, Homo sapiens
tcacctgttgctta

SEQ ID NO: 2598799 - DNA, 20 bp, Homo sapiens
tcacctgttgcttacaattt

SEQ ID NO: 2598800 - DNA, 21 bp, Homo sapiens
tcacctgttgcttacaatttt

SEQ ID NO: 2598801 - DNA, 20 bp, Homo sapiens
tcacctgtttttaagctgtt

SEQ ID NO: 2598802 - DNA, 15 bp, Homo sapiens
tcaccttaggcaggg

SEQ ID NO: 2598803 - DNA, 18 bp, Homo sapiens
tcaccttgcaacacacag

SEQ ID NO: 2598804 - DNA, 21 bp, Homo sapiens
tcaccttgcaacacacagaca

SEQ ID NO: 2598805 - DNA, 16 bp, Homo sapiens
tcacgaagtgttgcat

SEQ ID NO: 2598806 - DNA, 22 bp, Homo sapiens
tcacgaagtgttgcatggatgt

SEQ ID NO: 2598807 - DNA, 18 bp, Homo sapiens
tcacgattgtcatcagga

SEQ ID NO: 2598808 - DNA, 16 bp, Homo sapiens
tcacgccactgcacta

SEQ ID NO: 2598809 - DNA, 19 bp, Homo sapiens
tcacgcctatgatcccagc

SEQ ID NO: 2598810 - DNA, 21 bp, Homo sapiens
tcacgcctatgatcccagcac

SEQ ID NO: 2598811 - DNA, 21 bp, Homo sapiens
tcacgcctgtaatcccagcac

SEQ ID NO: 2598812 - DNA, 13 bp, Homo sapiens
tcacgcctgtgca

SEQ ID NO: 2598813 - DNA, 14 bp, Homo sapiens
tcacgctttcctga

SEQ ID NO: 2598814 - DNA, 16 bp, Homo sapiens
tcacgtggaggagcag

SEQ ID NO: 2598815 - DNA, 19 bp, Homo sapiens
tcactaatactaattcatt

SEQ ID NO: 2598816 - DNA, 20 bp, Homo sapiens
tcactaccctattctctctt

SEQ ID NO: 2598817 - DNA, 14 bp, Homo sapiens
tcactagccatgat

SEQ ID NO: 2598818 - DNA, 17 bp, Homo sapiens
tcactataaatggtgtt

SEQ ID NO: 2598819 - DNA, 17 bp, Homo sapiens
tcactatgttgcccagg

SEQ ID NO: 2598820 - DNA, 19 bp, Homo sapiens
tcactatgttgcccaggca

SEQ ID NO: 2598821 - DNA, 18 bp, Homo sapiens
tcactatttttatttata

SEQ ID NO: 2598822 - DNA, 14 bp, Homo sapiens
tcactcagatggaa

SEQ ID NO: 2598823 - DNA, 17 bp, Homo sapiens
tcactcatacatctggc

SEQ ID NO: 2598824 - DNA, 15 bp, Homo sapiens
tcactcccttctacc

SEQ ID NO: 2598825 - DNA, 14 bp, Homo sapiens
tcactccggtgtgc

SEQ ID NO: 2598826 - DNA, 20 bp, Homo sapiens
tcactccggtgtgcctgcag

SEQ ID NO: 2598827 - DNA, 22 bp, Homo sapiens
tcactcctgagacccctggcct

SEQ ID NO: 2598828 - DNA, 11 bp, Homo sapiens
tcactcctggg

SEQ ID NO: 2598829 - DNA, 13 bp, Homo sapiens
tcactccttgaaa

SEQ ID NO: 2598830 - DNA, 13 bp, Homo sapiens
tcactctgctgct

SEQ ID NO: 2598831 - DNA, 15 bp, Homo sapiens
tcactctggcagctc

SEQ ID NO: 2598832 - DNA, 19 bp, Homo sapiens
tcactctggcagctcagag

SEQ ID NO: 2598833 - DNA, 22 bp, Homo sapiens
tcactctgtcgcccagtctgga

SEQ ID NO: 2598834 - DNA, 23 bp, Homo sapiens
tcactcttattgcccacgctgga

SEQ ID NO: 2598835 - DNA, 18 bp, Homo sapiens
tcactcttcctgcaagga

SEQ ID NO: 2598836 - DNA, 20 bp, Homo sapiens
tcactcttgtggatgtttta

SEQ ID NO: 2598837 - DNA, 21 bp, Homo sapiens
tcactcttgtggatgttttaa

SEQ ID NO: 2598838 - DNA, 21 bp, Homo sapiens
tcactgaactttgctgagcct

SEQ ID NO: 2598839 - DNA, 16 bp, Homo sapiens
tcactgaaggcctggc

SEQ ID NO: 2598840 - DNA, 21 bp, Homo sapiens
tcactgagacagcccgggctc

SEQ ID NO: 2598841 - DNA, 18 bp, Homo sapiens
tcactgcaacctctgcct

SEQ ID NO: 2598842 - DNA, 18 bp, Homo sapiens
tcactgcaacttctgcct

SEQ ID NO: 2598843 - DNA, 15 bp, Homo sapiens
tcactgcagcctcaa

SEQ ID NO: 2598844 - DNA, 18 bp, Homo sapiens
tcactgccatgccagctt

SEQ ID NO: 2598845 - DNA, 11 bp, Homo sapiens
tcactgcctct

SEQ ID NO: 2598846 - DNA, 17 bp, Homo sapiens
tcactgctgcaaggcct

SEQ ID NO: 2598847 - DNA, 22 bp, Homo sapiens
tcactgctgcaaggcctttctg

SEQ ID NO: 2598848 - DNA, 17 bp, Homo sapiens
tacccaaatcctctcca

SEQ ID NO: 2598849 - DNA, 12 bp, Homo sapiens
tacccaagcaaa

SEQ ID NO: 2598850 - DNA, 17 bp, Homo sapiens
tacccacacctctgcca

SEQ ID NO: 2598851 - DNA, 19 bp, Homo sapiens
tacccacacctctgccaga

SEQ ID NO: 2598852 - DNA, 17 bp, Homo sapiens
tacccacccccacccaa

SEQ ID NO: 2598853 - DNA, 13 bp, Homo sapiens
tacccactgctct

SEQ ID NO: 2598854 - DNA, 19 bp, Homo sapiens
tacccagagaagccccttc

SEQ ID NO: 2598855 - DNA, 20 bp, Homo sapiens
tacccagagaatatatacat

SEQ ID NO: 2598856 - DNA, 17 bp, Homo sapiens
tacccagccatctgccc

SEQ ID NO: 2598857 - DNA, 23 bp, Homo sapiens
tacccagccatctgcccaggggt

SEQ ID NO: 2598858 - DNA, 18 bp, Homo sapiens
tacccagcgagccctggt

SEQ ID NO: 2598859 - DNA, 12 bp, Homo sapiens
taccccaccctc

SEQ ID NO: 2598860 - DNA, 15 bp, Homo sapiens
taccccaccctcagc

SEQ ID NO: 2598861 - DNA, 16 bp, Homo sapiens
tacccccagggttgag

SEQ ID NO: 2598862 - DNA, 15 bp, Homo sapiens
tacccccctctgtct

SEQ ID NO: 2598863 - DNA, 17 bp, Homo sapiens
taccccctcctctctgc

SEQ ID NO: 2598864 - DNA, 13 bp, Homo sapiens
tacccctgatctg

SEQ ID NO: 2598865 - DNA, 14 bp, Homo sapiens
tacccgcagagttc

SEQ ID NO: 2598866 - DNA, 17 bp, Homo sapiens
tacccgttcacattttt

SEQ ID NO: 2598867 - DNA, 15 bp, Homo sapiens
taccctagccattcc

SEQ ID NO: 2598868 - DNA, 16 bp, Homo sapiens
taccctattctctctt

SEQ ID NO: 2598869 - DNA, 15 bp, Homo sapiens
taccctcatgttctt

SEQ ID NO: 2598870 - DNA, 14 bp, Homo sapiens
taccctcccacccc

SEQ ID NO: 2598871 - DNA, 15 bp, Homo sapiens
taccctcctgtaaat

SEQ ID NO: 2598872 - DNA, 15 bp, Homo sapiens
taccctcgggcccac

SEQ ID NO: 2598873 - DNA, 18 bp, Homo sapiens
taccctcgggcccacctg

SEQ ID NO: 2598874 - DNA, 21 bp, Homo sapiens
taccctcgggcccacctggcc

SEQ ID NO: 2598875 - DNA, 23 bp, Homo sapiens
taccctcgggcccacctggccac

SEQ ID NO: 2598876 - DNA, 16 bp, Homo sapiens
taccctctcagctcca

SEQ ID NO: 2598877 - DNA, 14 bp, Homo sapiens
taccctctggaggg

SEQ ID NO: 2598878 - DNA, 22 bp, Homo sapiens
taccctggcactataatgtaag

SEQ ID NO: 2598879 - DNA, 18 bp, Homo sapiens
taccctggccgccccctg

SEQ ID NO: 2598880 - DNA, 20 bp, Homo sapiens
tacccttggctcaatcctct

SEQ ID NO: 2598881 - DNA, 20 bp, Homo sapiens
taccctttagactgtagcct

SEQ ID NO: 2598882 - DNA, 14 bp, Homo sapiens
taccgtttcttccc

SEQ ID NO: 2598883 - DNA, 15 bp, Homo sapiens
taccgtttcttccct

SEQ ID NO: 2598884 - DNA, 21 bp, Homo sapiens
tacctaaaagagatttcaaga

SEQ ID NO: 2598885 - DNA, 19 bp, Homo sapiens
tacctaaacagatataaat

SEQ ID NO: 2598886 - DNA, 22 bp, Homo sapiens
tacctaaacagatataaatggc

SEQ ID NO: 2598887 - DNA, 15 bp, Homo sapiens
tacctacatacaatt

SEQ ID NO: 2598888 - DNA, 13 bp, Homo sapiens
tacctacatgtat

SEQ ID NO: 2598889 - DNA, 16 bp, Homo sapiens
tacctaccacagtgtc

SEQ ID NO: 2598890 - DNA, 17 bp, Homo sapiens
tacctaccacagtgtct

SEQ ID NO: 2598891 - DNA, 18 bp, Homo sapiens
tacctaccacagtgtctg

SEQ ID NO: 2598892 - DNA, 13 bp, Homo sapiens
tacctagatttac

SEQ ID NO: 2598893 - DNA, 16 bp, Homo sapiens
tacctagatttacagc

SEQ ID NO: 2598894 - DNA, 23 bp, Homo sapiens
tacctatataataaagctactga

SEQ ID NO: 2598895 - DNA, 22 bp, Homo sapiens
tacctcaacccccatttctatt

SEQ ID NO: 2598896 - DNA, 11 bp, Homo sapiens
tacctcagcct

SEQ ID NO: 2598897 - DNA, 12 bp, Homo sapiens
tacctcaggttg

SEQ ID NO: 2598898 - DNA, 21 bp, Homo sapiens
tacctcaggttgctggttgct

SEQ ID NO: 2598899 - DNA, 11 bp, Homo sapiens
tacctcctcct

SEQ ID NO: 2598900 - DNA, 18 bp, Homo sapiens
tacctcggtgccttcctc

SEQ ID NO: 2598901 - DNA, 17 bp, Homo sapiens
tacctctcttatagaat

SEQ ID NO: 2598902 - DNA, 21 bp, Homo sapiens
tacctctcttatagaatattt

SEQ ID NO: 2598903 - DNA, 17 bp, Homo sapiens
tacctctgatacctcaa

SEQ ID NO: 2598904 - DNA, 14 bp, Homo sapiens
tacctcttagctga

SEQ ID NO: 2598905 - DNA, 20 bp, Homo sapiens
tacctgacactcccttgggc

SEQ ID NO: 2598906 - DNA, 15 bp, Homo sapiens
tacctgaggggcctc

SEQ ID NO: 2598907 - DNA, 12 bp, Homo sapiens
tacctgattttt

SEQ ID NO: 2598908 - DNA, 21 bp, Homo sapiens
tacctgccactcacacagcca

SEQ ID NO: 2598909 - DNA, 14 bp, Homo sapiens
tacctgctctccaa

SEQ ID NO: 2598910 - DNA, 13 bp, Homo sapiens
tacctgtgaaata

SEQ ID NO: 2598911 - DNA, 12 bp, Homo sapiens
taccttactgtg

SEQ ID NO: 2598912 - DNA, 22 bp, Homo sapiens
taccttagattagctctggacc

SEQ ID NO: 2598913 - DNA, 20 bp, Homo sapiens
taccttcaataaagtatcta

SEQ ID NO: 2598914 - DNA, 13 bp, Homo sapiens
taccttcatttca

SEQ ID NO: 2598915 - DNA, 14 bp, Homo sapiens
taccttctccctca

SEQ ID NO: 2598916 - DNA, 22 bp, Homo sapiens
taccttctccctcatttcagga

SEQ ID NO: 2598917 - DNA, 13 bp, Homo sapiens
taccttggttccc

SEQ ID NO: 2598918 - DNA, 16 bp, Homo sapiens
tacctttatggtttct

SEQ ID NO: 2598919 - DNA, 12 bp, Homo sapiens
tacctttgtcac

SEQ ID NO: 2598920 - DNA, 23 bp, Homo sapiens
tacctttgttcccaaatttcata

SEQ ID NO: 2598921 - DNA, 22 bp, Homo sapiens
taccttttttagagttgatact

SEQ ID NO: 2598922 - DNA, 18 bp, Homo sapiens
taccttttttatacataa

SEQ ID NO: 2598923 - DNA, 20 bp, Homo sapiens
taccttttttatacataaac

SEQ ID NO: 2598924 - DNA, 17 bp, Homo sapiens
tacgactttattttctg

SEQ ID NO: 2598925 - DNA, 16 bp, Homo sapiens
tacgatggcacccagt

SEQ ID NO: 2598926 - DNA, 16 bp, Homo sapiens
tacgcctgcctcccct

SEQ ID NO: 2598927 - DNA, 24 bp, Homo sapiens
tacgctccatcgctgtcatctcag

SEQ ID NO: 2598928 - DNA, 15 bp, Homo sapiens
tacgctctcctttct

SEQ ID NO: 2598929 - DNA, 19 bp, Homo sapiens
tacgctctcctttctttct

SEQ ID NO: 2598930 - DNA, 13 bp, Homo sapiens
tacgctgaagatg

SEQ ID NO: 2598931 - DNA, 22 bp, Homo sapiens
tacgctgaagatggcatcctgt

SEQ ID NO: 2598932 - DNA, 14 bp, Homo sapiens
tatttaataacatt

SEQ ID NO: 2598933 - DNA, 15 bp, Homo sapiens
tatttaataacatta

SEQ ID NO: 2598934 - DNA, 21 bp, Homo sapiens
tatttaatgaaagactgtaca

SEQ ID NO: 2598935 - DNA, 21 bp, Homo sapiens
tatttacatgaattgcatttt

SEQ ID NO: 2598936 - DNA, 17 bp, Homo sapiens
tatttagggaactgctt

SEQ ID NO: 2598937 - DNA, 20 bp, Homo sapiens
tatttagttatagtttcaga

SEQ ID NO: 2598938 - DNA, 16 bp, Homo sapiens
tatttataaatatatt

SEQ ID NO: 2598939 - DNA, 19 bp, Homo sapiens
tatttataacaacctaaat

SEQ ID NO: 2598940 - DNA, 20 bp, Homo sapiens
tatttataacaacctaaatt

SEQ ID NO: 2598941 - DNA, 13 bp, Homo sapiens
tatttataactca

SEQ ID NO: 2598942 - DNA, 22 bp, Homo sapiens
tatttataactcatcataaaat

SEQ ID NO: 2598943 - DNA, 17 bp, Homo sapiens
tatttataatacatttc

SEQ ID NO: 2598944 - DNA, 18 bp, Homo sapiens
tatttatagcaatccatg

SEQ ID NO: 2598945 - DNA, 23 bp, Homo sapiens
tatttatatatgtatttataaat

SEQ ID NO: 2598946 - DNA, 18 bp, Homo sapiens
tatttatatatttataac

SEQ ID NO: 2598947 - DNA, 18 bp, Homo sapiens
tatttatcagtgacagag

SEQ ID NO: 2598948 - DNA, 18 bp, Homo sapiens
tcaaccctaaaaagcaga

SEQ ID NO: 2598949 - DNA, 23 bp, Homo sapiens
tcaaccctaaaaagcagagcttt

SEQ ID NO: 2598950 - DNA, 15 bp, Homo sapiens
tcaaccctccctcag

SEQ ID NO: 2598951 - DNA, 17 bp, Homo sapiens
tcaaccctccctcagcc

SEQ ID NO: 2598952 - DNA, 18 bp, Homo sapiens
tcaaccctccctcagccc

SEQ ID NO: 2598953 - DNA, 20 bp, Homo sapiens
tcaaccctccctcagcccct

SEQ ID NO: 2598954 - DNA, 21 bp, Homo sapiens
tcaaccctccctcagcccctc

SEQ ID NO: 2598955 - DNA, 23 bp, Homo sapiens
tcaaccctccctcagcccctctt

SEQ ID NO: 2598956 - DNA, 18 bp, Homo sapiens
tcaaccctctcaggtgac

SEQ ID NO: 2598957 - DNA, 18 bp, Homo sapiens
tcaacccttttgtctgcc

SEQ ID NO: 2598958 - DNA, 21 bp, Homo sapiens
tcaacctaccaccccttcctg

SEQ ID NO: 2598959 - DNA, 12 bp, Homo sapiens
tcaacctcctgg

SEQ ID NO: 2598960 - DNA, 14 bp, Homo sapiens
tcaacctcctgggc

SEQ ID NO: 2598961 - DNA, 15 bp, Homo sapiens
tcaacctgtgatgag

SEQ ID NO: 2598962 - DNA, 20 bp, Homo sapiens
tcaacctgtgatgaggggag

SEQ ID NO: 2598963 - DNA, 16 bp, Homo sapiens
tcaaccttgagacagc

SEQ ID NO: 2598964 - DNA, 16 bp, Homo sapiens
tcaactcacctaatgt

SEQ ID NO: 2598965 - DNA, 16 bp, Homo sapiens
tcaacttctggctcct

SEQ ID NO: 2598966 - DNA, 19 bp, Homo sapiens
tcaagaagacatggagact

SEQ ID NO: 2598967 - DNA, 20 bp, Homo sapiens
tcaagactggaaggtgggga

SEQ ID NO: 2598968 - DNA, 18 bp, Homo sapiens
tcaagagatttaattaat

SEQ ID NO: 2598969 - DNA, 15 bp, Homo sapiens
tcaagagcacacttg

SEQ ID NO: 2598970 - DNA, 17 bp, Homo sapiens
tcaagatttcaggatta

SEQ ID NO: 2598971 - DNA, 13 bp, Homo sapiens
tcaagattttgaa

SEQ ID NO: 2598972 - DNA, 16 bp, Homo sapiens
tcaagattttgaatgc

SEQ ID NO: 2598973 - DNA, 18 bp, Homo sapiens
tcaagcagcgaccgcccc

SEQ ID NO: 2598974 - DNA, 21 bp, Homo sapiens
tcaagcagcgaccgccccctc

SEQ ID NO: 2598975 - DNA, 23 bp, Homo sapiens
tcaagcagcgaccgccccctcct

SEQ ID NO: 2598976 - DNA, 15 bp, Homo sapiens
tcaagccaagcagcc

SEQ ID NO: 2598977 - DNA, 20 bp, Homo sapiens
tcaagccaagcagccaagct

SEQ ID NO: 2598978 - DNA, 12 bp, Homo sapiens
tcaagccaccaa

SEQ ID NO: 2598979 - DNA, 14 bp, Homo sapiens
tcaagcctctggtc

SEQ ID NO: 2598980 - DNA, 18 bp, Homo sapiens
tcaagcgattcttctgct

SEQ ID NO: 2598981 - DNA, 19 bp, Homo sapiens
tcaagctagaaggccacat

SEQ ID NO: 2598982 - DNA, 20 bp, Homo sapiens
tcaagctagaaggccacatg

SEQ ID NO: 2598983 - DNA, 20 bp, Homo sapiens
tcaaggaaagggggtcccag

SEQ ID NO: 2598984 - DNA, 21 bp, Homo sapiens
tcaaggaaagggggtcccagt

SEQ ID NO: 2598985 - DNA, 20 bp, Homo sapiens
tcaaggactttctgaagcct

SEQ ID NO: 2598986 - DNA, 14 bp, Homo sapiens
tcaaggcactgcct

SEQ ID NO: 2598987 - DNA, 15 bp, Homo sapiens
tcaaggcactgcctg

SEQ ID NO: 2598988 - DNA, 17 bp, Homo sapiens
tcaaggcatcatgcaga

SEQ ID NO: 2598989 - DNA, 18 bp, Homo sapiens
tcaaggcgtgaggatggg

SEQ ID NO: 2598990 - DNA, 19 bp, Homo sapiens
tcaagggaatgtaactgct

SEQ ID NO: 2598991 - DNA, 20 bp, Homo sapiens
tcaagggaatgtaactgctg

SEQ ID NO: 2598992 - DNA, 20 bp, Homo sapiens
tcaaggtggccaaattattt

SEQ ID NO: 2598993 - DNA, 19 bp, Homo sapiens
tcaagtaatccacctgcct

SEQ ID NO: 2598994 - DNA, 17 bp, Homo sapiens
tcaagtaattctgctgt

SEQ ID NO: 2598995 - DNA, 16 bp, Homo sapiens
tcaagtaattgtgaaa

SEQ ID NO: 2598996 - DNA, 22 bp, Homo sapiens
tcaagtccttacctcttccgga

SEQ ID NO: 2598997 - DNA, 14 bp, Homo sapiens
tcaagtctctgctg

SEQ ID NO: 2598998 - DNA, 16 bp, Homo sapiens
tcaagtctctgctggc

SEQ ID NO: 2598999 - DNA, 17 bp, Homo sapiens
tcaagtctctgctggcc

SEQ ID NO: 2599000 - DNA, 21 bp, Homo sapiens
tcaagtgattctcctgcctca

SEQ ID NO: 2599001 - DNA, 22 bp, Homo sapiens
tcaagtgattctcctgcctcag

SEQ ID NO: 2599002 - DNA, 12 bp, Homo sapiens
tcaagtgcctta

SEQ ID NO: 2599003 - DNA, 16 bp, Homo sapiens
tcaagtggggctcgcc

SEQ ID NO: 2599004 - DNA, 18 bp, Homo sapiens
tcaagtggggctcgccat

SEQ ID NO: 2599005 - DNA, 13 bp, Homo sapiens
tcaagttattgta

SEQ ID NO: 2599006 - DNA, 16 bp, Homo sapiens
tcaagttcctttgggt

SEQ ID NO: 2599007 - DNA, 21 bp, Homo sapiens
tcaataaaatcatgtacattt

SEQ ID NO: 2599008 - DNA, 13 bp, Homo sapiens
tcaataaaatgtg

SEQ ID NO: 2599009 - DNA, 18 bp, Homo sapiens
tcaataaaatgtgatttt

SEQ ID NO: 2599010 - DNA, 22 bp, Homo sapiens
tcaataaaatgtgatttttctg

SEQ ID NO: 2599011 - DNA, 23 bp, Homo sapiens
tcaataaaatgtgatttttctga

SEQ ID NO: 2599012 - DNA, 13 bp, Homo sapiens
tcaataaacgatt

SEQ ID NO: 2599013 - DNA, 22 bp, Homo sapiens
tcaataaacgatttaattctct

SEQ ID NO: 2599014 - DNA, 16 bp, Homo sapiens
tcaataaatgtctgtt

SEQ ID NO: 2599015 - DNA, 18 bp, Homo sapiens
tcaatacagtacaggcag

SEQ ID NO: 2599016 - DNA, 19 bp, Homo sapiens
tcaatagtaaaagataaca

SEQ ID NO: 2599017 - DNA, 17 bp, Homo sapiens
tcaatagtcaagaaaaa

SEQ ID NO: 2599018 - DNA, 22 bp, Homo sapiens
tcaatatcttttttttaataaa

SEQ ID NO: 2599019 - DNA, 22 bp, Homo sapiens
tcaatattaaatacagacacta

SEQ ID NO: 2599020 - DNA, 17 bp, Homo sapiens
tcaatattcctgaatga

SEQ ID NO: 2599021 - DNA, 17 bp, Homo sapiens
tcaatattgtcattcct

SEQ ID NO: 2599022 - DNA, 10 bp, Homo sapiens
tcaatattta

SEQ ID NO: 2599023 - DNA, 17 bp, Homo sapiens
tcaatatttaaacatgg

SEQ ID NO: 2599024 - DNA, 13 bp, Homo sapiens
tcaatatttatta

SEQ ID NO: 2599025 - DNA, 20 bp, Homo sapiens
tcaatatttattattttcac

SEQ ID NO: 2599026 - DNA, 15 bp, Homo sapiens
tcaatattttccatg

SEQ ID NO: 2599027 - DNA, 16 bp, Homo sapiens
tcaatcagtataattc

SEQ ID NO: 2599028 - DNA, 19 bp, Homo sapiens
tcaatcatctgtgtgaaaa

SEQ ID NO: 2599029 - DNA, 18 bp, Homo sapiens
tcaatctcccgctgctgc

SEQ ID NO: 2599030 - DNA, 13 bp, Homo sapiens
tcaatctgtaaac

SEQ ID NO: 2599031 - DNA, 17 bp, Homo sapiens
tcaatctgtaaactgtg

SEQ ID NO: 2599032 - DNA, 23 bp, Homo sapiens
tcaatgaatgaatgaatggctaa

SEQ ID NO: 2599033 - DNA, 17 bp, Homo sapiens
tcaatgacagagccttc

SEQ ID NO: 2599034 - DNA, 15 bp, Homo sapiens
tcaatgatctaggtt

SEQ ID NO: 2599035 - DNA, 22 bp, Homo sapiens
tcaatgatctaggtttaactca

SEQ ID NO: 2599036 - DNA, 19 bp, Homo sapiens
tcaatgcagccagacctat

SEQ ID NO: 2599037 - DNA, 13 bp, Homo sapiens
tcaatgcagcccc

SEQ ID NO: 2599038 - DNA, 18 bp, Homo sapiens
tcaatggtttgcaaggaa

SEQ ID NO: 2599039 - DNA, 19 bp, Homo sapiens
tcaatggtttgcaaggaag

SEQ ID NO: 2599040 - DNA, 11 bp, Homo sapiens
tcaatgttcat

SEQ ID NO: 2599041 - DNA, 11 bp, Homo sapiens
tcaattaaacg

SEQ ID NO: 2599042 - DNA, 14 bp, Homo sapiens
tcaattaaacggat

SEQ ID NO: 2599043 - DNA, 16 bp, Homo sapiens
tcaattaaacggatta

SEQ ID NO: 2599044 - DNA, 19 bp, Homo sapiens
tcaattaaacggattattt

SEQ ID NO: 2599045 - DNA, 20 bp, Homo sapiens
tcaattaaacggattatttt

SEQ ID NO: 2599046 - DNA, 21 bp, Homo sapiens
tcaattaaacggattattttt

SEQ ID NO: 2599047 - DNA, 20 bp, Homo sapiens
tcaattactggtccaaaaga

SEQ ID NO: 2599048 - DNA, 14 bp, Homo sapiens
tcaattccacctgc

SEQ ID NO: 2599049 - DNA, 22 bp, Homo sapiens
tcaattccccctggccaccacc

SEQ ID NO: 2599050 - DNA, 19 bp, Homo sapiens
tcaattccgtagccagctg

SEQ ID NO: 2599051 - DNA, 12 bp, Homo sapiens
tcaattctcaaa

SEQ ID NO: 2599052 - DNA, 17 bp, Homo sapiens
tcaattcttccctatct

SEQ ID NO: 2599053 - DNA, 23 bp, Homo sapiens
tcaattcttccctatctttgcca

SEQ ID NO: 2599054 - DNA, 15 bp, Homo sapiens
tcaattgaatggtca

SEQ ID NO: 2599055 - DNA, 17 bp, Homo sapiens
tcaattgcatctcccag

SEQ ID NO: 2599056 - DNA, 18 bp, Homo sapiens
tcaattgcatctcccaga

SEQ ID NO: 2599057 - DNA, 19 bp, Homo sapiens
tcaatttaaacccatttta

SEQ ID NO: 2599058 - DNA, 20 bp, Homo sapiens
tcaatttattcaagaaaagt

SEQ ID NO: 2599059 - DNA, 20 bp, Homo sapiens
tcaatttccaagagctgagg

SEQ ID NO: 2599060 - DNA, 21 bp, Homo sapiens
tcaatttccctgactcctcta

SEQ ID NO: 2599061 - DNA, 15 bp, Homo sapiens
tcaatttctccccag

SEQ ID NO: 2599062 - DNA, 20 bp, Homo sapiens
tcaatttgtaattgcttaca

SEQ ID NO: 2599063 - DNA, 14 bp, Homo sapiens
tcacaaaattttat

SEQ ID NO: 2599064 - DNA, 21 bp, Homo sapiens
tcacaacagattattacctta

SEQ ID NO: 2599065 - DNA, 22 bp, Homo sapiens
tcacaagacccaaaaggcagaa

SEQ ID NO: 2599066 - DNA, 16 bp, Homo sapiens
tcacaagtgaaaaaca

SEQ ID NO: 2599067 - DNA, 20 bp, Homo sapiens
tcacaagttgtgtttgatat

SEQ ID NO: 2599068 - DNA, 21 bp, Homo sapiens
tcacacacaggcaactgaggc

SEQ ID NO: 2599069 - DNA, 19 bp, Homo sapiens
tcacacaggacccccttcc

SEQ ID NO: 2599070 - DNA, 22 bp, Homo sapiens
tcacacagtattacttctgcta

SEQ ID NO: 2599071 - DNA, 13 bp, Homo sapiens
tcacacagtgagt

SEQ ID NO: 2599072 - DNA, 12 bp, Homo sapiens
tcacaccagcca

SEQ ID NO: 2599073 - DNA, 22 bp, Homo sapiens
tcacaccaggcttgcctgcagg

SEQ ID NO: 2599074 - DNA, 11 bp, Homo sapiens
tcacacccacc

SEQ ID NO: 2599075 - DNA, 15 bp, Homo sapiens
tcacacccaccgtcc

SEQ ID NO: 2599076 - DNA, 22 bp, Homo sapiens
tcacacccaccgtccgccctgc

SEQ ID NO: 2599077 - DNA, 17 bp, Homo sapiens
tcacacctgactctgaa

SEQ ID NO: 2599078 - DNA, 18 bp, Homo sapiens
tcacacctgactctgaaa

SEQ ID NO: 2599079 - DNA, 19 bp, Homo sapiens
tcacacctgtaatcccaac

SEQ ID NO: 2599080 - DNA, 18 bp, Homo sapiens
tcacacgggggcagctga

SEQ ID NO: 2599081 - DNA, 18 bp, Homo sapiens
tcacacttccaccagcct

SEQ ID NO: 2599082 - DNA, 16 bp, Homo sapiens
tcacacttctgtgaga

SEQ ID NO: 2599083 - DNA, 22 bp, Homo sapiens
tcacacttctgtgagaccccca

SEQ ID NO: 2599084 - DNA, 12 bp, Homo sapiens
tcacagaaatga

SEQ ID NO: 2599085 - DNA, 18 bp, Homo sapiens
tcacagacctggagcccc

SEQ ID NO: 2599086 - DNA, 20 bp, Homo sapiens
tcacagacctggagcccctg

SEQ ID NO: 2599087 - DNA, 15 bp, Homo sapiens
tcacagagtgtgctg

SEQ ID NO: 2599088 - DNA, 18 bp, Homo sapiens
tcacagagtgtgctggag

SEQ ID NO: 2599089 - DNA, 14 bp, Homo sapiens
tcacagatgggtgc

SEQ ID NO: 2599090 - DNA, 17 bp, Homo sapiens
tacacagtctgcaagat

SEQ ID NO: 2599091 - DNA, 23 bp, Homo sapiens
tacacatagcatgtaatggtatc

SEQ ID NO: 2599092 - DNA, 18 bp, Homo sapiens
tacacattcaataagcat

SEQ ID NO: 2599093 - DNA, 23 bp, Homo sapiens
tacacattttattttattatgca

SEQ ID NO: 2599094 - DNA, 15 bp, Homo sapiens
tacacatttttcaga

SEQ ID NO: 2599095 - DNA, 18 bp, Homo sapiens
tacaccacctcactcctg

SEQ ID NO: 2599096 - DNA, 16 bp, Homo sapiens
tacaccactacattct

SEQ ID NO: 2599097 - DNA, 18 bp, Homo sapiens
tacaccactacattctgt

SEQ ID NO: 2599098 - DNA, 20 bp, Homo sapiens
tacaccactacattctgtta

SEQ ID NO: 2599099 - DNA, 13 bp, Homo sapiens
tacacggaaaacg

SEQ ID NO: 2599100 - DNA, 16 bp, Homo sapiens
tacactccagcctgag

SEQ ID NO: 2599101 - DNA, 12 bp, Homo sapiens
tacactcttata

SEQ ID NO: 2599102 - DNA, 13 bp, Homo sapiens
tacactcttatag

SEQ ID NO: 2599103 - DNA, 19 bp, Homo sapiens
tacactggaggagagaaga

SEQ ID NO: 2599104 - DNA, 21 bp, Homo sapiens
tacactgtgctgagtctgaag

SEQ ID NO: 2599105 - DNA, 22 bp, Homo sapiens
tacactgtttcaaactttacta

SEQ ID NO: 2599106 - DNA, 13 bp, Homo sapiens
tacagaaagctgc

SEQ ID NO: 2599107 - DNA, 14 bp, Homo sapiens
tacagaaagctgcc

SEQ ID NO: 2599108 - DNA, 10 bp, Homo sapiens
tacagaaagt

SEQ ID NO: 2599109 - DNA, 19 bp, Homo sapiens
tacagaacacgctttcaca

SEQ ID NO: 2599110 - DNA, 23 bp, Homo sapiens
tacagaacccattccatttatct

SEQ ID NO: 2599111 - DNA, 21 bp, Homo sapiens
tacagaattctgctacctcac

SEQ ID NO: 2599112 - DNA, 19 bp, Homo sapiens
tacagacactaagttatag

SEQ ID NO: 2599113 - DNA, 19 bp, Homo sapiens
tacagaccgaactgttgta

SEQ ID NO: 2599114 - DNA, 23 bp, Homo sapiens
tacagaccgaactgttgtataaa

SEQ ID NO: 2599115 - DNA, 17 bp, Homo sapiens
tacagacgtatgcttat

SEQ ID NO: 2599116 - DNA, 18 bp, Homo sapiens
tacagacgtatgcttatt

SEQ ID NO: 2599117 - DNA, 16 bp, Homo sapiens
tacagagaggagaaac

SEQ ID NO: 2599118 - DNA, 17 bp, Homo sapiens
tacagagaggagaaaca

SEQ ID NO: 2599119 - DNA, 18 bp, Homo sapiens
tacagagaggagaaacac

SEQ ID NO: 2599120 - DNA, 21 bp, Homo sapiens
tacagagaggagaaacacatc

SEQ ID NO: 2599121 - DNA, 23 bp, Homo sapiens
tacagagcccacgcccccactgg

SEQ ID NO: 2599122 - DNA, 18 bp, Homo sapiens
tacagaggccatgggcct

SEQ ID NO: 2599123 - DNA, 20 bp, Homo sapiens
tacagcaacaatttatgaat

SEQ ID NO: 2599124 - DNA, 24 bp, Homo sapiens
tacagcaaggagatttacaactgg

SEQ ID NO: 2599125 - DNA, 19 bp, Homo sapiens
tacagcactactctgtgcc

SEQ ID NO: 2599126 - DNA, 19 bp, Homo sapiens
tacagcccctttttcatat

SEQ ID NO: 2599127 - DNA, 14 bp, Homo sapiens
tacagcgagaggca

SEQ ID NO: 2599128 - DNA, 20 bp, Homo sapiens
tacagcgagaggcagagaaa

SEQ ID NO: 2599129 - DNA, 14 bp, Homo sapiens
tacagctgtttaag

SEQ ID NO: 2599130 - DNA, 15 bp, Homo sapiens
tacaggagtgagcac

SEQ ID NO: 2599131 - DNA, 17 bp, Homo sapiens
tacaggttacaacagat

SEQ ID NO: 2599132 - DNA, 21 bp, Homo sapiens
tacaggttacaacagatttgt

SEQ ID NO: 2599133 - DNA, 16 bp, Homo sapiens
tacagtaactttatgt

SEQ ID NO: 2599134 - DNA, 18 bp, Homo sapiens
tacagtatctcagggcct

SEQ ID NO: 2599135 - DNA, 12 bp, Homo sapiens
tacagtcctccc

SEQ ID NO: 2599136 - DNA, 17 bp, Homo sapiens
tacagtcctcccatctc

SEQ ID NO: 2599137 - DNA, 18 bp, Homo sapiens
tacagtcctcccatctca

SEQ ID NO: 2599138 - DNA, 13 bp, Homo sapiens
tacagtctgtcat

SEQ ID NO: 2599139 - DNA, 15 bp, Homo sapiens
tacagtctgtcatga

SEQ ID NO: 2599140 - DNA, 16 bp, Homo sapiens
tacagtctgtcatgaa

SEQ ID NO: 2599141 - DNA, 20 bp, Homo sapiens
tacagtcttccatttgcaag

SEQ ID NO: 2599142 - DNA, 22 bp, Homo sapiens
tacagtgaaaatgtaagctgtt

SEQ ID NO: 2599143 - DNA, 15 bp, Homo sapiens
tacagtgtacagtct

SEQ ID NO: 2599144 - DNA, 22 bp, Homo sapiens
tacagtgtacagtcttgtatta

SEQ ID NO: 2599145 - DNA, 12 bp, Homo sapiens
tacagttcttcg

SEQ ID NO: 2599146 - DNA, 21 bp, Homo sapiens
tacagttcttcgggaagagag

SEQ ID NO: 2599147 - DNA, 22 bp, Homo sapiens
tacagttcttcgggaagagagg

SEQ ID NO: 2599148 - DNA, 17 bp, Homo sapiens
tacagttgaaaaacagc

SEQ ID NO: 2599149 - DNA, 16 bp, Homo sapiens
tacagttgttggcctc

SEQ ID NO: 2599150 - DNA, 20 bp, Homo sapiens
tacagttgttttttgaaaac

SEQ ID NO: 2599151 - DNA, 21 bp, Homo sapiens
tacagtttgctgtactagaga

SEQ ID NO: 2599152 - DNA, 18 bp, Homo sapiens
tacagtttgttagtatga

SEQ ID NO: 2599153 - DNA, 17 bp, Homo sapiens
tacataaactgacttta

SEQ ID NO: 2599154 - DNA, 21 bp, Homo sapiens
tacataaaggtggtatgtgtg

SEQ ID NO: 2599155 - DNA, 15 bp, Homo sapiens
tacataactgaaaat

SEQ ID NO: 2599156 - DNA, 18 bp, Homo sapiens
tacataagataaatgtgc

SEQ ID NO: 2599157 - DNA, 19 bp, Homo sapiens
tacataagataaatgtgct

SEQ ID NO: 2599158 - DNA, 22 bp, Homo sapiens
tacataagcggcgtaagtttaa

SEQ ID NO: 2599159 - DNA, 17 bp, Homo sapiens
tacataatgcgtgcata

SEQ ID NO: 2599160 - DNA, 20 bp, Homo sapiens
tacataatgcgtgcatacca

SEQ ID NO: 2599161 - DNA, 21 bp, Homo sapiens
tacataatgcgtgcataccac

SEQ ID NO: 2599162 - DNA, 22 bp, Homo sapiens
tacataattttttattcaagtt

SEQ ID NO: 2599163 - DNA, 13 bp, Homo sapiens
tacatactgctgt

SEQ ID NO: 2599164 - DNA, 13 bp, Homo sapiens
tacatagcctata

SEQ ID NO: 2599165 - DNA, 20 bp, Homo sapiens
tacatatgtaaaataaaatt

SEQ ID NO: 2599166 - DNA, 19 bp, Homo sapiens
tacatattaggaaaatatg

SEQ ID NO: 2599167 - DNA, 23 bp, Homo sapiens
tacatattaggaaaatatgggtt

SEQ ID NO: 2599168 - DNA, 14 bp, Homo sapiens
tacatattctttaa

SEQ ID NO: 2599169 - DNA, 17 bp, Homo sapiens
tacatatttgagactag

SEQ ID NO: 2599170 - DNA, 19 bp, Homo sapiens
tacatatttgcatatgtat

SEQ ID NO: 2599171 - DNA, 21 bp, Homo sapiens
tacatatttgcatatgtatga

SEQ ID NO: 2599172 - DNA, 17 bp, Homo sapiens
tacatatttgtggaata

SEQ ID NO: 2599173 - DNA, 17 bp, Homo sapiens
tacatcccatgtaacag

SEQ ID NO: 2599174 - DNA, 15 bp, Homo sapiens
tacatcctcatgcag

SEQ ID NO: 2599175 - DNA, 14 bp, Homo sapiens
tacatcttctgcct

SEQ ID NO: 2599176 - DNA, 14 bp, Homo sapiens
tacatctttcacat

SEQ ID NO: 2599177 - DNA, 20 bp, Homo sapiens
tacatctttcacattggcta

SEQ ID NO: 2599178 - DNA, 16 bp, Homo sapiens
tacatgaaaacacatt

SEQ ID NO: 2599179 - DNA, 14 bp, Homo sapiens
tacatgaaacagaa

SEQ ID NO: 2599180 - DNA, 15 bp, Homo sapiens
tacatgaaacagaaa

SEQ ID NO: 2599181 - DNA, 20 bp, Homo sapiens
tacatgcaatttattaaaat

SEQ ID NO: 2599182 - DNA, 18 bp, Homo sapiens
taatcgcttaaagatgtt

SEQ ID NO: 2599183 - DNA, 11 bp, Homo sapiens
taatctaaatg

SEQ ID NO: 2599184 - DNA, 12 bp, Homo sapiens
taatctaaatgg

SEQ ID NO: 2599185 - DNA, 13 bp, Homo sapiens
taatctaaatgga

SEQ ID NO: 2599186 - DNA, 14 bp, Homo sapiens
taatctagaacaca

SEQ ID NO: 2599187 - DNA, 19 bp, Homo sapiens
taatctcgtttcaaaaaca

SEQ ID NO: 2599188 - DNA, 22 bp, Homo sapiens
taatctggactcctctgtccag

SEQ ID NO: 2599189 - DNA, 16 bp, Homo sapiens
taatctgtagggctgg

SEQ ID NO: 2599190 - DNA, 17 bp, Homo sapiens
taatctgtagggctgga

SEQ ID NO: 2599191 - DNA, 15 bp, Homo sapiens
taatcttctgccttc

SEQ ID NO: 2599192 - DNA, 16 bp, Homo sapiens
taatcttgaattgtaa

SEQ ID NO: 2599193 - DNA, 22 bp, Homo sapiens
taatcttgaattgtaactgttc

SEQ ID NO: 2599194 - DNA, 20 bp, Homo sapiens
taatgaaacaccttctctgg

SEQ ID NO: 2599195 - DNA, 14 bp, Homo sapiens
taatgaaagactgt

SEQ ID NO: 2599196 - DNA, 18 bp, Homo sapiens
taatgaaagactgtacaa

SEQ ID NO: 2599197 - DNA, 22 bp, Homo sapiens
taatgaaagactgtacaaagta

SEQ ID NO: 2599198 - DNA, 19 bp, Homo sapiens
taatgaaatatctgtattt

SEQ ID NO: 2599199 - DNA, 22 bp, Homo sapiens
taatgaagaaagtggaaaacaa

SEQ ID NO: 2599200 - DNA, 23 bp, Homo sapiens
taatgaagaaagtggaaaacaag

SEQ ID NO: 2599201 - DNA, 14 bp, Homo sapiens
taatgaagctttat

SEQ ID NO: 2599202 - DNA, 22 bp, Homo sapiens
taatgaagggaaaggatatttt

SEQ ID NO: 2599203 - DNA, 23 bp, Homo sapiens
taatgatgtcgtttgaatcacag

SEQ ID NO: 2599204 - DNA, 13 bp, Homo sapiens
taatgcactttct

SEQ ID NO: 2599205 - DNA, 19 bp, Homo sapiens
taatgccactaaattgaca

SEQ ID NO: 2599206 - DNA, 14 bp, Homo sapiens
taatgcgtgcatac

SEQ ID NO: 2599207 - DNA, 23 bp, Homo sapiens
taatgcgtgcataccacttttgt

SEQ ID NO: 2599208 - DNA, 22 bp, Homo sapiens
taatgctacgtgtgatttttct

SEQ ID NO: 2599209 - DNA, 19 bp, Homo sapiens
taatggacatgagataatg

SEQ ID NO: 2599210 - DNA, 23 bp, Homo sapiens
taatggacatgagataatgttag

SEQ ID NO: 2599211 - DNA, 17 bp, Homo sapiens
taatggccggctggaaa

SEQ ID NO: 2599212 - DNA, 17 bp, Homo sapiens
taatgggggtagcagct

SEQ ID NO: 2599213 - DNA, 18 bp, Homo sapiens
taatgggggtagcagctg

SEQ ID NO: 2599214 - DNA, 19 bp, Homo sapiens
taatggtaccagataaaat

SEQ ID NO: 2599215 - DNA, 18 bp, Homo sapiens
taatggtcccatccaggc

SEQ ID NO: 2599216 - DNA, 20 bp, Homo sapiens
taatggtcccatccaggcag

SEQ ID NO: 2599217 - DNA, 14 bp, Homo sapiens
taatgtagccatgg

SEQ ID NO: 2599218 - DNA, 16 bp, Homo sapiens
taatgtagccatggga

SEQ ID NO: 2599219 - DNA, 16 bp, Homo sapiens
taatgtcacaggcagg

SEQ ID NO: 2599220 - DNA, 21 bp, Homo sapiens
taatgtgaaaatggtccagga

SEQ ID NO: 2599221 - DNA, 20 bp, Homo sapiens
taatgtgaaactggattaaa

SEQ ID NO: 2599222 - DNA, 22 bp, Homo sapiens
taatgtgaaactggattaaact

SEQ ID NO: 2599223 - DNA, 17 bp, Homo sapiens
taatgtgcctagttctt

SEQ ID NO: 2599224 - DNA, 15 bp, Homo sapiens
taatgtgctgtgtaa

SEQ ID NO: 2599225 - DNA, 18 bp, Homo sapiens
taatgtgctgtgtaaagt

SEQ ID NO: 2599226 - DNA, 22 bp, Homo sapiens
taatgtgctgtgtaaagttagt

SEQ ID NO: 2599227 - DNA, 16 bp, Homo sapiens
taatgtggttatttct

SEQ ID NO: 2599228 - DNA, 13 bp, Homo sapiens
taatgttaaattt

SEQ ID NO: 2599229 - DNA, 20 bp, Homo sapiens
taatgttaaatttgtaagtt

SEQ ID NO: 2599230 - DNA, 11 bp, Homo sapiens
taatgttactg

SEQ ID NO: 2599231 - DNA, 21 bp, Homo sapiens
taatgttgtatgtcttgttta

SEQ ID NO: 2599232 - DNA, 16 bp, Homo sapiens
taatgtttatgagcca

SEQ ID NO: 2599233 - DNA, 17 bp, Homo sapiens
taatgtttatgagccag

SEQ ID NO: 2599234 - DNA, 14 bp, Homo sapiens
taattaaaaaattt

SEQ ID NO: 2599235 - DNA, 21 bp, Homo sapiens
taattaaataaaaatctgtgg

SEQ ID NO: 2599236 - DNA, 17 bp, Homo sapiens
taattaatgaaatatct

SEQ ID NO: 2599237 - DNA, 21 bp, Homo sapiens
taattaatgaaatatctgtat

SEQ ID NO: 2599238 - DNA, 18 bp, Homo sapiens
taattaggggttgctaag

SEQ ID NO: 2599239 - DNA, 18 bp, Homo sapiens
taattatcggaagcagtg

SEQ ID NO: 2599240 - DNA, 21 bp, Homo sapiens
taattatcggaagcagtgcct

SEQ ID NO: 2599241 - DNA, 21 bp, Homo sapiens
taattatgccttttttgatca

SEQ ID NO: 2599242 - DNA, 13 bp, Homo sapiens
taattattattaa

SEQ ID NO: 2599243 - DNA, 14 bp, Homo sapiens
taattattattctt

SEQ ID NO: 2599244 - DNA, 13 bp, Homo sapiens
taattattattta

SEQ ID NO: 2599245 - DNA, 14 bp, Homo sapiens
taattattatttat

SEQ ID NO: 2599246 - DNA, 22 bp, Homo sapiens
taattattatttatatatgtat

SEQ ID NO: 2599247 - DNA, 17 bp, Homo sapiens
taattattatttgtgtt

SEQ ID NO: 2599248 - DNA, 13 bp, Homo sapiens
taattattttggt

SEQ ID NO: 2599249 - DNA, 19 bp, Homo sapiens
taattcagcactgatttca

SEQ ID NO: 2599250 - DNA, 19 bp, Homo sapiens
taattccaatatgatgact

SEQ ID NO: 2599251 - DNA, 17 bp, Homo sapiens
taattcccattttgcaa

SEQ ID NO: 2599252 - DNA, 23 bp, Homo sapiens
taattcccattttgcaaaatttc

SEQ ID NO: 2599253 - DNA, 18 bp, Homo sapiens
taattctaaatgaatgtt

SEQ ID NO: 2599254 - DNA, 15 bp, Homo sapiens
taattcttgtatatt

SEQ ID NO: 2599255 - DNA, 19 bp, Homo sapiens
taattgatcaaattcattt

SEQ ID NO: 2599256 - DNA, 19 bp, Homo sapiens
taattgatttcaagacctt

SEQ ID NO: 2599257 - DNA, 15 bp, Homo sapiens
taattgcttacattt

SEQ ID NO: 2599258 - DNA, 21 bp, Homo sapiens
taattggaagaaattcctgta

SEQ ID NO: 2599259 - DNA, 19 bp, Homo sapiens
taattgtatcgtatagctg

SEQ ID NO: 2599260 - DNA, 21 bp, Homo sapiens
taattgtatcgtatagctgta

SEQ ID NO: 2599261 - DNA, 14 bp, Homo sapiens
taattgttgtttct

SEQ ID NO: 2599262 - DNA, 15 bp, Homo sapiens
taattgttgtttctt

SEQ ID NO: 2599263 - DNA, 22 bp, Homo sapiens
taattgttgtttgtatgtataa

SEQ ID NO: 2599264 - DNA, 16 bp, Homo sapiens
taattgttttgcactt

SEQ ID NO: 2599265 - DNA, 18 bp, Homo sapiens
taattgttttgcactttt

SEQ ID NO: 2599266 - DNA, 16 bp, Homo sapiens
taatttaaaattgtga

SEQ ID NO: 2599267 - DNA, 20 bp, Homo sapiens
taatttaaaattgtgatgtg

SEQ ID NO: 2599268 - DNA, 14 bp, Homo sapiens
taatttaaacaggc

SEQ ID NO: 2599269 - DNA, 17 bp, Homo sapiens
taatttaaacaggccca

SEQ ID NO: 2599270 - DNA, 14 bp, Homo sapiens
taatttaatgcatg

SEQ ID NO: 2599271 - DNA, 21 bp, Homo sapiens
taatttataaaagaataaaat

SEQ ID NO: 2599272 - DNA, 17 bp, Homo sapiens
taatttattattgaaat

SEQ ID NO: 2599273 - DNA, 20 bp, Homo sapiens
taatttattattgaaattgt

SEQ ID NO: 2599274 - DNA, 14 bp, Homo sapiens
taatttatttatta

SEQ ID NO: 2599275 - DNA, 17 bp, Homo sapiens
taatttatttattaaga

SEQ ID NO: 2599276 - DNA, 18 bp, Homo sapiens
taatttatttttgcatgg

SEQ ID NO: 2599277 - DNA, 17 bp, Homo sapiens
taatttcaaaaatataa

SEQ ID NO: 2599278 - DNA, 19 bp, Homo sapiens
taatttcaaaaatataact

SEQ ID NO: 2599279 - DNA, 12 bp, Homo sapiens
taatttctttgc

SEQ ID NO: 2599280 - DNA, 23 bp, Homo sapiens
taatttctttgcctgttcagtta

SEQ ID NO: 2599281 - DNA, 18 bp, Homo sapiens
taatttgaggacaaccat

SEQ ID NO: 2599282 - DNA, 18 bp, Homo sapiens
taatttgtgatacaatgc

SEQ ID NO: 2599283 - DNA, 22 bp, Homo sapiens
taatttgtgatacaatgctgtg

SEQ ID NO: 2599284 - DNA, 18 bp, Homo sapiens
taattttatgaatgtctt

SEQ ID NO: 2599285 - DNA, 17 bp, Homo sapiens
taattttggttgtattc

SEQ ID NO: 2599286 - DNA, 18 bp, Homo sapiens
taattttggttgtattct

SEQ ID NO: 2599287 - DNA, 15 bp, Homo sapiens
taattttgtattttc

SEQ ID NO: 2599288 - DNA, 13 bp, Homo sapiens
taatttttaaagt

SEQ ID NO: 2599289 - DNA, 19 bp, Homo sapiens
tacaaaaaaaaagttttat

SEQ ID NO: 2599290 - DNA, 20 bp, Homo sapiens
tacaaaaaaaaagttttatt

SEQ ID NO: 2599291 - DNA, 13 bp, Homo sapiens
tacaaaaacacag

SEQ ID NO: 2599292 - DNA, 17 bp, Homo sapiens
tacaaaaacacagcaag

SEQ ID NO: 2599293 - DNA, 16 bp, Homo sapiens
tacaaaaacatggcct

SEQ ID NO: 2599294 - DNA, 15 bp, Homo sapiens
tacaaaaagcataaa

SEQ ID NO: 2599295 - DNA, 14 bp, Homo sapiens
tacaaaaatataaa

SEQ ID NO: 2599296 - DNA, 18 bp, Homo sapiens
tacaaaaatataaaatat

SEQ ID NO: 2599297 - DNA, 19 bp, Homo sapiens
tacaaaacctgatgttaaa

SEQ ID NO: 2599298 - DNA, 17 bp, Homo sapiens
tacaaacatgtggttaa

SEQ ID NO: 2599299 - DNA, 19 bp, Homo sapiens
tacaaactcccacttgtca

SEQ ID NO: 2599300 - DNA, 13 bp, Homo sapiens
tacaaagaagaca

SEQ ID NO: 2599301 - DNA, 18 bp, Homo sapiens
tacaaagaagacatgttt

SEQ ID NO: 2599302 - DNA, 17 bp, Homo sapiens
tacaaatactcttagga

SEQ ID NO: 2599303 - DNA, 15 bp, Homo sapiens
tacaaattgcttact

SEQ ID NO: 2599304 - DNA, 19 bp, Homo sapiens
tacaacaagagtttatttc

SEQ ID NO: 2599305 - DNA, 16 bp, Homo sapiens
tacaacagatttgtga

SEQ ID NO: 2599306 - DNA, 14 bp, Homo sapiens
tacaactgagtcct

SEQ ID NO: 2599307 - DNA, 18 bp, Homo sapiens
tacaacttaaataataaa

SEQ ID NO: 2599308 - DNA, 21 bp, Homo sapiens
tacaagattagaagctgaaaa

SEQ ID NO: 2599309 - DNA, 14 bp, Homo sapiens
tacaagccccccct

SEQ ID NO: 2599310 - DNA, 15 bp, Homo sapiens
tacaagccccccctt

SEQ ID NO: 2599311 - DNA, 18 bp, Homo sapiens
tacaagcgtgagccactg

SEQ ID NO: 2599312 - DNA, 13 bp, Homo sapiens
tacaagtgtatat

SEQ ID NO: 2599313 - DNA, 15 bp, Homo sapiens
tacaagtgtatatca

SEQ ID NO: 2599314 - DNA, 21 bp, Homo sapiens
tacaataaaactttgctgcca

SEQ ID NO: 2599315 - DNA, 20 bp, Homo sapiens
tacaataaaatcttgaaaat

SEQ ID NO: 2599316 - DNA, 20 bp, Homo sapiens
tacaatcaaaggaaaatagt

SEQ ID NO: 2599317 - DNA, 21 bp, Homo sapiens
tacaatgaacccccatgatgt

SEQ ID NO: 2599318 - DNA, 16 bp, Homo sapiens
tacaatgctgtgccct

SEQ ID NO: 2599319 - DNA, 18 bp, Homo sapiens
tacaattatttttacagt

SEQ ID NO: 2599320 - DNA, 14 bp, Homo sapiens
tacaattgaaatga

SEQ ID NO: 2599321 - DNA, 14 bp, Homo sapiens
tacaattgaactta

SEQ ID NO: 2599322 - DNA, 18 bp, Homo sapiens
tacaattttctcccagga

SEQ ID NO: 2599323 - DNA, 21 bp, Homo sapiens
tacaatttttttaattttgta

SEQ ID NO: 2599324 - DNA, 16 bp, Homo sapiens
tacacaagtaaacatt

SEQ ID NO: 2599325 - DNA, 13 bp, Homo sapiens
tacacacacacac

SEQ ID NO: 2599326 - DNA, 16 bp, Homo sapiens
tacacacacacacaca

SEQ ID NO: 2599327 - DNA, 18 bp, Homo sapiens
tacacacacacacacagc

SEQ ID NO: 2599328 - DNA, 22 bp, Homo sapiens
tacacacctaagggacatgttt

SEQ ID NO: 2599329 - DNA, 16 bp, Homo sapiens
tacacactcaaatcaa

SEQ ID NO: 2599330 - DNA, 17 bp, Homo sapiens
tacacactcaaatcaag

SEQ ID NO: 2599331 - DNA, 22 bp, Homo sapiens
tacacagatcacagcttcagcc

SEQ ID NO: 2599332 - DNA, 17 bp, Homo sapiens
taagatggaagcttcca

SEQ ID NO: 2599333 - DNA, 18 bp, Homo sapiens
taagatggaagcttccag

SEQ ID NO: 2599334 - DNA, 17 bp, Homo sapiens
taagatggattctcaga

SEQ ID NO: 2599335 - DNA, 22 bp, Homo sapiens
taagatggattctcagatattt

SEQ ID NO: 2599336 - DNA, 16 bp, Homo sapiens
taagattatctgggga

SEQ ID NO: 2599337 - DNA, 15 bp, Homo sapiens
taagatttttctcaa

SEQ ID NO: 2599338 - DNA, 20 bp, Homo sapiens
taagatttttctcaaagttt

SEQ ID NO: 2599339 - DNA, 14 bp, Homo sapiens
taagcaaaatgtga

SEQ ID NO: 2599340 - DNA, 13 bp, Homo sapiens
taagcaagagaga

SEQ ID NO: 2599341 - DNA, 18 bp, Homo sapiens
taagcaagagagatgttt

SEQ ID NO: 2599342 - DNA, 14 bp, Homo sapiens
taagcactgtgcta

SEQ ID NO: 2599343 - DNA, 21 bp, Homo sapiens
taagcagatttaacaattcca

SEQ ID NO: 2599344 - DNA, 23 bp, Homo sapiens
taagcagcatttctgaagtggac

SEQ ID NO: 2599345 - DNA, 12 bp, Homo sapiens
taagcagctctt

SEQ ID NO: 2599346 - DNA, 17 bp, Homo sapiens
taagcagctcttgctaa

SEQ ID NO: 2599347 - DNA, 18 bp, Homo sapiens
taagcattgggtgggtaa

SEQ ID NO: 2599348 - DNA, 19 bp, Homo sapiens
taagcattgtttgcttatt

SEQ ID NO: 2599349 - DNA, 21 bp, Homo sapiens
taagcattgtttgcttattgt

SEQ ID NO: 2599350 - DNA, 17 bp, Homo sapiens
taagccacttaaaatgt

SEQ ID NO: 2599351 - DNA, 20 bp, Homo sapiens
taagccagacatcaacagat

SEQ ID NO: 2599352 - DNA, 21 bp, Homo sapiens
taagccagacatcaacagata

SEQ ID NO: 2599353 - DNA, 19 bp, Homo sapiens
taagccctcttccatcatg

SEQ ID NO: 2599354 - DNA, 11 bp, Homo sapiens
taagccctgtc

SEQ ID NO: 2599355 - DNA, 20 bp, Homo sapiens
taagcctccatttagttctt

SEQ ID NO: 2599356 - DNA, 12 bp, Homo sapiens
taagccttgtcg

SEQ ID NO: 2599357 - DNA, 13 bp, Homo sapiens
taagctgtttatt

SEQ ID NO: 2599358 - DNA, 16 bp, Homo sapiens
taagcttatgtcagac

SEQ ID NO: 2599359 - DNA, 14 bp, Homo sapiens
taagcttatttaat

SEQ ID NO: 2599360 - DNA, 18 bp, Homo sapiens
taagctttgccagctgct

SEQ ID NO: 2599361 - DNA, 17 bp, Homo sapiens
taaggaaaaaaagacaa

SEQ ID NO: 2599362 - DNA, 19 bp, Homo sapiens
taaggaaactcttatctca

SEQ ID NO: 2599363 - DNA, 19 bp, Homo sapiens
taaggaaactgggttcctg

SEQ ID NO: 2599364 - DNA, 9 bp, Homo sapiens
taaggaata

SEQ ID NO: 2599365 - DNA, 17 bp, Homo sapiens
taaggaatacctgtccc

SEQ ID NO: 2599366 - DNA, 18 bp, Homo sapiens
taaggacaaaaatgaact

SEQ ID NO: 2599367 - DNA, 15 bp, Homo sapiens
taaggacacactaat

SEQ ID NO: 2599368 - DNA, 17 bp, Homo sapiens
taaggatgctaaacctt

SEQ ID NO: 2599369 - DNA, 19 bp, Homo sapiens
taaggatgcttgtacataa

SEQ ID NO: 2599370 - DNA, 21 bp, Homo sapiens
taaggatgcttgtacataatg

SEQ ID NO: 2599371 - DNA, 22 bp, Homo sapiens
taaggatgcttgtacataatgc

SEQ ID NO: 2599372 - DNA, 23 bp, Homo sapiens
taaggatgcttgtacataatgcg

SEQ ID NO: 2599373 - DNA, 20 bp, Homo sapiens
taaggatggagccagctctg

SEQ ID NO: 2599374 - DNA, 17 bp, Homo sapiens
taaggatgtcacagggc

SEQ ID NO: 2599375 - DNA, 20 bp, Homo sapiens
taaggatgtcacagggccaa

SEQ ID NO: 2599376 - DNA, 15 bp, Homo sapiens
taaggattgtgatat

SEQ ID NO: 2599377 - DNA, 12 bp, Homo sapiens
taaggattttat

SEQ ID NO: 2599378 - DNA, 13 bp, Homo sapiens
taaggattttatg

SEQ ID NO: 2599379 - DNA, 16 bp, Homo sapiens
taaggcgtggagctgc

SEQ ID NO: 2599380 - DNA, 14 bp, Homo sapiens
taagggcagagtca

SEQ ID NO: 2599381 - DNA, 13 bp, Homo sapiens
taaggggcagctt

SEQ ID NO: 2599382 - DNA, 15 bp, Homo sapiens
taagggttaagaaaa

SEQ ID NO: 2599383 - DNA, 12 bp, Homo sapiens
taaggtgcagtt

SEQ ID NO: 2599384 - DNA, 17 bp, Homo sapiens
taagtaaaaccacagca

SEQ ID NO: 2599385 - DNA, 19 bp, Homo sapiens
taagtaaaaccacagcagt

SEQ ID NO: 2599386 - DNA, 19 bp, Homo sapiens
taagtaagcaacagcataa

SEQ ID NO: 2599387 - DNA, 13 bp, Homo sapiens
taagtactatgta

SEQ ID NO: 2599388 - DNA, 16 bp, Homo sapiens
taagtatctgacatct

SEQ ID NO: 2599389 - DNA, 21 bp, Homo sapiens
taagtattatgtctcttctga

SEQ ID NO: 2599390 - DNA, 20 bp, Homo sapiens
taagtattcttatttaatga

SEQ ID NO: 2599391 - DNA, 13 bp, Homo sapiens
taagtatttcaaa

SEQ ID NO: 2599392 - DNA, 17 bp, Homo sapiens
taagtatttgaaactga

SEQ ID NO: 2599393 - DNA, 19 bp, Homo sapiens
taagtcatgttccttcaag

SEQ ID NO: 2599394 - DNA, 22 bp, Homo sapiens
taagtcatgttccttcaagatc

SEQ ID NO: 2599395 - DNA, 13 bp, Homo sapiens
taagtctgtttta

SEQ ID NO: 2599396 - DNA, 16 bp, Homo sapiens
taagtctgttttatga

SEQ ID NO: 2599397 - DNA, 22 bp, Homo sapiens
taagtcttatcaagcagccaag

SEQ ID NO: 2599398 - DNA, 16 bp, Homo sapiens
taagtgattgtatgaa

SEQ ID NO: 2599399 - DNA, 22 bp, Homo sapiens
taagtgccaggatggaatgatg

SEQ ID NO: 2599400 - DNA, 13 bp, Homo sapiens
taagtgccttcca

SEQ ID NO: 2599401 - DNA, 21 bp, Homo sapiens
taagtgcgtgtgtagagttaa

SEQ ID NO: 2599402 - DNA, 15 bp, Homo sapiens
taagtgctgcattta

SEQ ID NO: 2599403 - DNA, 15 bp, Homo sapiens
taagtgctttgtaat

SEQ ID NO: 2599404 - DNA, 21 bp, Homo sapiens
taagtggggttgcaaccactg

SEQ ID NO: 2599405 - DNA, 14 bp, Homo sapiens
taagtgttgtaaat

SEQ ID NO: 2599406 - DNA, 13 bp, Homo sapiens
taagttgtttgca

SEQ ID NO: 2599407 - DNA, 18 bp, Homo sapiens
taagtttcaggtgacatg

SEQ ID NO: 2599408 - DNA, 13 bp, Homo sapiens
taagtttctcagc

SEQ ID NO: 2599409 - DNA, 19 bp, Homo sapiens
taagtttctcagctcccat

SEQ ID NO: 2599410 - DNA, 14 bp, Homo sapiens
taagtttctgggac

SEQ ID NO: 2599411 - DNA, 18 bp, Homo sapiens
taagtttgaaggaaacag

SEQ ID NO: 2599412 - DNA, 19 bp, Homo sapiens
taataaaaaatggaaagaa

SEQ ID NO: 2599413 - DNA, 20 bp, Homo sapiens
taataaaaaatggaaagaat

SEQ ID NO: 2599414 - DNA, 16 bp, Homo sapiens
taataaaaagattgaa

SEQ ID NO: 2599415 - DNA, 13 bp, Homo sapiens
taataaaataatt

SEQ ID NO: 2599416 - DNA, 14 bp, Homo sapiens
taataaactgtgtt

SEQ ID NO: 2599417 - DNA, 15 bp, Homo sapiens
taataaactgtgttt

SEQ ID NO: 2599418 - DNA, 19 bp, Homo sapiens
taataaacttttttttgag

SEQ ID NO: 2599419 - DNA, 16 bp, Homo sapiens
taataaagatgctctt

SEQ ID NO: 2599420 - DNA, 17 bp, Homo sapiens
taataaagatgctcttt

SEQ ID NO: 2599421 - DNA, 16 bp, Homo sapiens
taataaatatttatgt

SEQ ID NO: 2599422 - DNA, 15 bp, Homo sapiens
taataaatctggtag

SEQ ID NO: 2599423 - DNA, 19 bp, Homo sapiens
taataaatgtacattaatt

SEQ ID NO: 2599424 - DNA, 19 bp, Homo sapiens
taataagaatggttgcctt

SEQ ID NO: 2599425 - DNA, 12 bp, Homo sapiens
taataagacata

SEQ ID NO: 2599426 - DNA, 17 bp, Homo sapiens
taataagacataacgtt

SEQ ID NO: 2599427 - DNA, 19 bp, Homo sapiens
taataagacataacgtttt

SEQ ID NO: 2599428 - DNA, 20 bp, Homo sapiens
taataagacataacgttttt

SEQ ID NO: 2599429 - DNA, 16 bp, Homo sapiens
taataatatatgttta

SEQ ID NO: 2599430 - DNA, 15 bp, Homo sapiens
taataatgtttaata

SEQ ID NO: 2599431 - DNA, 21 bp, Homo sapiens
taatacaccactacattctgt

SEQ ID NO: 2599432 - DNA, 21 bp, Homo sapiens
taatacagcaacaatttatga

SEQ ID NO: 2599433 - DNA, 22 bp, Homo sapiens
taatacagcaacaatttatgaa

SEQ ID NO: 2599434 - DNA, 19 bp, Homo sapiens
taatacagcagtgtcatca

SEQ ID NO: 2599435 - DNA, 22 bp, Homo sapiens
taataccattttttaaggaaac

SEQ ID NO: 2599436 - DNA, 15 bp, Homo sapiens
taatacctctgtgtg

SEQ ID NO: 2599437 - DNA, 18 bp, Homo sapiens
taatacctctgtgtgctc

SEQ ID NO: 2599438 - DNA, 20 bp, Homo sapiens
taatacctgggtgattacat

SEQ ID NO: 2599439 - DNA, 15 bp, Homo sapiens
taatactagttgtga

SEQ ID NO: 2599440 - DNA, 14 bp, Homo sapiens
taatactgtatttg

SEQ ID NO: 2599441 - DNA, 15 bp, Homo sapiens
taatagaaaactgaa

SEQ ID NO: 2599442 - DNA, 12 bp, Homo sapiens
taatagaagaac

SEQ ID NO: 2599443 - DNA, 21 bp, Homo sapiens
taatagaatataattatcgga

SEQ ID NO: 2599444 - DNA, 15 bp, Homo sapiens
gttgatgaggcctct

SEQ ID NO: 2599445 - DNA, 16 bp, Homo sapiens
gttgatgaggcctctt

SEQ ID NO: 2599446 - DNA, 17 bp, Homo sapiens
gttgattgctaaatgta

SEQ ID NO: 2599447 - DNA, 14 bp, Homo sapiens
gttgcaaccactgc

SEQ ID NO: 2599448 - DNA, 19 bp, Homo sapiens
ggaatctggagagctagaa

SEQ ID NO: 2599449 - DNA, 18 bp, Homo sapiens
ggaatgaagcttgtgtat

SEQ ID NO: 2599450 - DNA, 21 bp, Homo sapiens
ggaatgaggcttgctgagagg

SEQ ID NO: 2599451 - DNA, 16 bp, Homo sapiens
ggaatgcggcaagaag

SEQ ID NO: 2599452 - DNA, 23 bp, Homo sapiens
ggaatgctcccccatcctcccct

SEQ ID NO: 2599453 - DNA, 19 bp, Homo sapiens
ggaatgtttgcctctgcct

SEQ ID NO: 2599454 - DNA, 14 bp, Homo sapiens
ggaattgtgtgatg

SEQ ID NO: 2599455 - DNA, 21 bp, Homo sapiens
ggaatttgcaagtcatggctg

SEQ ID NO: 2599456 - DNA, 16 bp, Homo sapiens
ggaatttgtaacctca

SEQ ID NO: 2599457 - DNA, 17 bp, Homo sapiens
ggaatttgtaacctcag

SEQ ID NO: 2599458 - DNA, 18 bp, Homo sapiens
ggaatttgtaacctcagc

SEQ ID NO: 2599459 - DNA, 22 bp, Homo sapiens
ggacaaaaatgaactgaagttt

SEQ ID NO: 2599460 - DNA, 18 bp, Homo sapiens
ggacaaaacccaccttgt

SEQ ID NO: 2599461 - DNA, 15 bp, Homo sapiens
ggacaaacagctcag

SEQ ID NO: 2599462 - DNA, 21 bp, Homo sapiens
ggacaagccaacttgtaaata

SEQ ID NO: 2599463 - DNA, 23 bp, Homo sapiens
ggacaagccaacttgtaaataca

SEQ ID NO: 2599464 - DNA, 20 bp, Homo sapiens
ggacaatcagtcccctccca

SEQ ID NO: 2599465 - DNA, 19 bp, Homo sapiens
ggacaatcatgaaatatgc

SEQ ID NO: 2599466 - DNA, 13 bp, Homo sapiens
ggacacacaaggt

SEQ ID NO: 2599467 - DNA, 12 bp, Homo sapiens
ggacacagctct

SEQ ID NO: 2599468 - DNA, 13 bp, Homo sapiens
ggacacagctctt

SEQ ID NO: 2599469 - DNA, 14 bp, Homo sapiens
ggacacagctcttc

SEQ ID NO: 2599470 - DNA, 17 bp, Homo sapiens
ggacaccagccaggctc

SEQ ID NO: 2599471 - DNA, 19 bp, Homo sapiens
ggacaccagccaggctctg

SEQ ID NO: 2599472 - DNA, 22 bp, Homo sapiens
ggacaccagccaggctctgtgc

SEQ ID NO: 2599473 - DNA, 20 bp, Homo sapiens
ggacaccccttatccaggac

SEQ ID NO: 2599474 - DNA, 12 bp, Homo sapiens
ggacaccctgtg

SEQ ID NO: 2599475 - DNA, 23 bp, Homo sapiens
ggacaccctgtgatggggccctg

SEQ ID NO: 2599476 - DNA, 14 bp, Homo sapiens
ggacacctgccctg

SEQ ID NO: 2599477 - DNA, 15 bp, Homo sapiens
ggacacctgccctgc

SEQ ID NO: 2599478 - DNA, 16 bp, Homo sapiens
ggacacctgccctgcc

SEQ ID NO: 2599479 - DNA, 16 bp, Homo sapiens
ggacactccagtgcca

SEQ ID NO: 2599480 - DNA, 14 bp, Homo sapiens
ggacactcctagag

SEQ ID NO: 2599481 - DNA, 14 bp, Homo sapiens
ggacagaagcagct

SEQ ID NO: 2599482 - DNA, 17 bp, Homo sapiens
ggacagaagcagctctt

SEQ ID NO: 2599483 - DNA, 16 bp, Homo sapiens
ggacagaggcctgccc

SEQ ID NO: 2599484 - DNA, 17 bp, Homo sapiens
ggacagaggcctgcccg

SEQ ID NO: 2599485 - DNA, 16 bp, Homo sapiens
ggacagagggggtggc

SEQ ID NO: 2599486 - DNA, 21 bp, Homo sapiens
ggacagaggttatctgtccca

SEQ ID NO: 2599487 - DNA, 18 bp, Homo sapiens
ggacagatcaatggcgca

SEQ ID NO: 2599488 - DNA, 15 bp, Homo sapiens
ggacagccacggcca

SEQ ID NO: 2599489 - DNA, 15 bp, Homo sapiens
ggacagctccttctg

SEQ ID NO: 2599490 - DNA, 16 bp, Homo sapiens
ggacagctccttctgt

SEQ ID NO: 2599491 - DNA, 20 bp, Homo sapiens
ggacaggatgacctggataa

SEQ ID NO: 2599492 - DNA, 23 bp, Homo sapiens
ggacaggcatgttctctgaggac

SEQ ID NO: 2599493 - DNA, 15 bp, Homo sapiens
ggacagggctggccc

SEQ ID NO: 2599494 - DNA, 18 bp, Homo sapiens
ggacagggctggcccagc

SEQ ID NO: 2599495 - DNA, 15 bp, Homo sapiens
ggcagataatcagcc

SEQ ID NO: 2599496 - DNA, 20 bp, Homo sapiens
ggcagataatcagcctctta

SEQ ID NO: 2599497 - DNA, 23 bp, Homo sapiens
ggcagatacaggaaaagctgctg

SEQ ID NO: 2599498 - DNA, 18 bp, Homo sapiens
ggcagatcaccagaggtc

SEQ ID NO: 2599499 - DNA, 14 bp, Homo sapiens
ggcagcacagagac

SEQ ID NO: 2599500 - DNA, 21 bp, Homo sapiens
ggcagcacagagacccccgga

SEQ ID NO: 2599501 - DNA, 13 bp, Homo sapiens
ggcagcagtgtga

SEQ ID NO: 2599502 - DNA, 20 bp, Homo sapiens
ggcagcagtgtgaggccagg

SEQ ID NO: 2599503 - DNA, 22 bp, Homo sapiens
ggcagcagtgtgaggccagggc

SEQ ID NO: 2599504 - DNA, 17 bp, Homo sapiens
ggcagccaggccacaag

SEQ ID NO: 2599505 - DNA, 12 bp, Homo sapiens
ggcagccaggct

SEQ ID NO: 2599506 - DNA, 19 bp, Homo sapiens
ggcagccaggctgccaagg

SEQ ID NO: 2599507 - DNA, 15 bp, Homo sapiens
ggcagccctgtaggg

SEQ ID NO: 2599508 - DNA, 11 bp, Homo sapiens
ggcagcccttg

SEQ ID NO: 2599509 - DNA, 21 bp, Homo sapiens
ggcagcccttgcttgttggga

SEQ ID NO: 2599510 - DNA, 11 bp, Homo sapiens
ggcagcctgga

SEQ ID NO: 2599511 - DNA, 20 bp, Homo sapiens
ggcagcctggacatagagag

SEQ ID NO: 2599512 - DNA, 15 bp, Homo sapiens
ggcagcgccaagcaa

SEQ ID NO: 2599513 - DNA, 21 bp, Homo sapiens
ggcagctcacctctcccttgg

SEQ ID NO: 2599514 - DNA, 21 bp, Homo sapiens
ggcagctcagagagggtggga

SEQ ID NO: 2599515 - DNA, 14 bp, Homo sapiens
ggcagctctccagt

SEQ ID NO: 2599516 - DNA, 16 bp, Homo sapiens
ggcagctctccagtca

SEQ ID NO: 2599517 - DNA, 15 bp, Homo sapiens
ggcagctgccagaga

SEQ ID NO: 2599518 - DNA, 16 bp, Homo sapiens
ggcagctgccagagaa

SEQ ID NO: 2599519 - DNA, 21 bp, Homo sapiens
ggcagctgcggtccacccagg

SEQ ID NO: 2599520 - DNA, 24 bp, Homo sapiens
ggcagctgcggtccacccaggagc

SEQ ID NO: 2599521 - DNA, 14 bp, Homo sapiens
ggcagctgggccca

SEQ ID NO: 2599522 - DNA, 19 bp, Homo sapiens
ggcagctgggcccaaccct

SEQ ID NO: 2599523 - DNA, 17 bp, Homo sapiens
ggcagcttgagggttgg

SEQ ID NO: 2599524 - DNA, 21 bp, Homo sapiens
ggcagcttgagggttgggctg

SEQ ID NO: 2599525 - DNA, 15 bp, Homo sapiens
ggcaggaaggagagc

SEQ ID NO: 2599526 - DNA, 19 bp, Homo sapiens
ggcaggacaacgaggaagc

SEQ ID NO: 2599527 - DNA, 20 bp, Homo sapiens
ggcaggacaacgaggaagcc

SEQ ID NO: 2599528 - DNA, 15 bp, Homo sapiens
ggcaggaccaggact

SEQ ID NO: 2599529 - DNA, 18 bp, Homo sapiens
ggcaggaggatcacttga

SEQ ID NO: 2599530 - DNA, 24 bp, Homo sapiens
ggcaggaggattgcttgagcccag

SEQ ID NO: 2599531 - DNA, 15 bp, Homo sapiens
ggcaggatgaccctg

SEQ ID NO: 2599532 - DNA, 19 bp, Homo sapiens
ggcaggctagaacctggca

SEQ ID NO: 2599533 - DNA, 18 bp, Homo sapiens
ggcaggctgacatctgtg

SEQ ID NO: 2599534 - DNA, 19 bp, Homo sapiens
ggcagggcctagctgctac

SEQ ID NO: 2599535 - DNA, 11 bp, Homo sapiens
ggcagggctca

SEQ ID NO: 2599536 - DNA, 13 bp, Homo sapiens
ggcagggctcagg

SEQ ID NO: 2599537 - DNA, 18 bp, Homo sapiens
ggcagggtctcactctgt

SEQ ID NO: 2599538 - DNA, 13 bp, Homo sapiens
ggcaggtccaggg

SEQ ID NO: 2599539 - DNA, 22 bp, Homo sapiens
ggcaggtgccatgtctgggaac

SEQ ID NO: 2599540 - DNA, 23 bp, Homo sapiens
ggcaggtggaggtgtcaggctgc

SEQ ID NO: 2599541 - DNA, 21 bp, Homo sapiens
ggcagtagaaggtcggaggct

SEQ ID NO: 2599542 - DNA, 22 bp, Homo sapiens
ggcagtcattcagcaccagagc

SEQ ID NO: 2599543 - DNA, 22 bp, Homo sapiens
ggcagtcgggggctggcctagg

SEQ ID NO: 2599544 - DNA, 14 bp, Homo sapiens
ggcagtgccagggc

SEQ ID NO: 2599545 - DNA, 18 bp, Homo sapiens
ggcagtgggagctgcctg

SEQ ID NO: 2599546 - DNA, 14 bp, Homo sapiens
ggcataggcctggg

SEQ ID NO: 2599547 - DNA, 17 bp, Homo sapiens
ggcatcacagggcagag

SEQ ID NO: 2599548 - DNA, 23 bp, Homo sapiens
ggcatcacagggcagagccggga

SEQ ID NO: 2599549 - DNA, 15 bp, Homo sapiens
ggcatcccaggggac

SEQ ID NO: 2599550 - DNA, 14 bp, Homo sapiens
ggcatctcctgtgc

SEQ ID NO: 2599551 - DNA, 18 bp, Homo sapiens
ggcatctctaattggaag

SEQ ID NO: 2599552 - DNA, 21 bp, Homo sapiens
ggcatctttgccttgggctgc

SEQ ID NO: 2599553 - DNA, 22 bp, Homo sapiens
ggcatctttgccttgggctgct

SEQ ID NO: 2599554 - DNA, 22 bp, Homo sapiens
ggcatgaagtttccttggctgg

SEQ ID NO: 2599555 - DNA, 23 bp, Homo sapiens
ggcatgaagtttccttggctggt

SEQ ID NO: 2599556 - DNA, 19 bp, Homo sapiens
ggcatgcgcacaaggctga

SEQ ID NO: 2599557 - DNA, 20 bp, Homo sapiens
ggcatggggtgggcctctgg

SEQ ID NO: 2599558 - DNA, 19 bp, Homo sapiens
ggcatggtacggagatgtt

SEQ ID NO: 2599559 - DNA, 17 bp, Homo sapiens
ggcatgtattggcctgg

SEQ ID NO: 2599560 - DNA, 17 bp, Homo sapiens
ggcatgtggcctgtggc

SEQ ID NO: 2599561 - DNA, 20 bp, Homo sapiens
ggcatgtggcctgtggcctg

SEQ ID NO: 2599562 - DNA, 14 bp, Homo sapiens
ggcatgttcctctg

SEQ ID NO: 2599563 - DNA, 15 bp, Homo sapiens
ggcattccccaggag

SEQ ID NO: 2599564 - DNA, 17 bp, Homo sapiens
ggcattccccaggaggc

SEQ ID NO: 2599565 - DNA, 16 bp, Homo sapiens
ggccaaacctctgttc

SEQ ID NO: 2599566 - DNA, 18 bp, Homo sapiens
ggccaacaccagggatgg

SEQ ID NO: 2599567 - DNA, 19 bp, Homo sapiens
ggccaacatcgtgaaaccc

SEQ ID NO: 2599568 - DNA, 15 bp, Homo sapiens
ggccaaggactgccg

SEQ ID NO: 2599569 - DNA, 19 bp, Homo sapiens
ggccaaggccttctcctcc

SEQ ID NO: 2599570 - DNA, 16 bp, Homo sapiens
ggccaagtgcaggctg

SEQ ID NO: 2599571 - DNA, 18 bp, Homo sapiens
ggccaagtgcaggctggc

SEQ ID NO: 2599572 - DNA, 20 bp, Homo sapiens
ggccaagtgcaggctggcac

SEQ ID NO: 2599573 - DNA, 23 bp, Homo sapiens
ggccacagggcgagactccgtct

SEQ ID NO: 2599574 - DNA, 16 bp, Homo sapiens
ggccacagttgtttga

SEQ ID NO: 2599575 - DNA, 16 bp, Homo sapiens
ggccacatggggctgg

SEQ ID NO: 2599576 - DNA, 11 bp, Homo sapiens
ggccaccagga

SEQ ID NO: 2599577 - DNA, 14 bp, Homo sapiens
ggccaccaggctgg

SEQ ID NO: 2599578 - DNA, 19 bp, Homo sapiens
ggccaccaggctggcgcag

SEQ ID NO: 2599579 - DNA, 23 bp, Homo sapiens
ggccacccgttctgctggcctgg

SEQ ID NO: 2599580 - DNA, 13 bp, Homo sapiens
ggccacctctcca

SEQ ID NO: 2599581 - DNA, 18 bp, Homo sapiens
ggccacctctccaagggc

SEQ ID NO: 2599582 - DNA, 21 bp, Homo sapiens
ggccacctgaggtgggcccag

SEQ ID NO: 2599583 - DNA, 13 bp, Homo sapiens
ggccacctgcccc

SEQ ID NO: 2599584 - DNA, 16 bp, Homo sapiens
ggccacctgcggtgct

SEQ ID NO: 2599585 - DNA, 22 bp, Homo sapiens
ggccacctgcggtgctatctcc

SEQ ID NO: 2599586 - DNA, 23 bp, Homo sapiens
ggccacgtgggcaaacaggcagt

SEQ ID NO: 2599587 - DNA, 15 bp, Homo sapiens
ggccactctgcctct

SEQ ID NO: 2599588 - DNA, 16 bp, Homo sapiens
ggccactctgcctctg

SEQ ID NO: 2599589 - DNA, 20 bp, Homo sapiens
ggccactctgcctctgcctg

SEQ ID NO: 2599590 - DNA, 16 bp, Homo sapiens
ggccactgtgaagaga

SEQ ID NO: 2599591 - DNA, 22 bp, Homo sapiens
ggccagagagcctggtgctgct

SEQ ID NO: 2599592 - DNA, 23 bp, Homo sapiens
ggccagagagcctggtgctgctg

SEQ ID NO: 2599593 - DNA, 16 bp, Homo sapiens
ggccagagctgggagg

SEQ ID NO: 2599594 - DNA, 22 bp, Homo sapiens
ggccagaggaactgtccagaga

SEQ ID NO: 2599595 - DNA, 17 bp, Homo sapiens
ggccagagggagtgaca

SEQ ID NO: 2599596 - DNA, 19 bp, Homo sapiens
ggccagagtattggtctcc

SEQ ID NO: 2599597 - DNA, 17 bp, Homo sapiens
ggccagatgcaccagcc

SEQ ID NO: 2599598 - DNA, 13 bp, Homo sapiens
ggccagccaggcg

SEQ ID NO: 2599599 - DNA, 16 bp, Homo sapiens
ggccagccaggcgggc

SEQ ID NO: 2599600 - DNA, 13 bp, Homo sapiens
ggccagccccacc

SEQ ID NO: 2599601 - DNA, 16 bp, Homo sapiens
ggccagccccacccag

SEQ ID NO: 2599602 - DNA, 20 bp, Homo sapiens
ggccagccccacccaggagg

SEQ ID NO: 2599603 - DNA, 15 bp, Homo sapiens
ggccagcccctccca

SEQ ID NO: 2599604 - DNA, 18 bp, Homo sapiens
ggccagcccctcccacca

SEQ ID NO: 2599605 - DNA, 14 bp, Homo sapiens
ggccagcccggctg

SEQ ID NO: 2599606 - DNA, 15 bp, Homo sapiens
ggccagcccggctgg

SEQ ID NO: 2599607 - DNA, 19 bp, Homo sapiens
ggccagcccggctggtttt

SEQ ID NO: 2599608 - DNA, 20 bp, Homo sapiens
ggccagccttgaccattctc

SEQ ID NO: 2599609 - DNA, 22 bp, Homo sapiens
ggccaggcagatctgtgcccca

SEQ ID NO: 2599610 - DNA, 12 bp, Homo sapiens
ggccaggcaggt

SEQ ID NO: 2599611 - DNA, 16 bp, Homo sapiens
ggccaggccaccagga

SEQ ID NO: 2599612 - DNA, 17 bp, Homo sapiens
ggccaggccaccaggat

SEQ ID NO: 2599613 - DNA, 16 bp, Homo sapiens
ggccaggccagaggga

SEQ ID NO: 2599614 - DNA, 15 bp, Homo sapiens
ggccaggccctctgc

SEQ ID NO: 2599615 - DNA, 18 bp, Homo sapiens
ggccaggccctctgccca

SEQ ID NO: 2599616 - DNA, 14 bp, Homo sapiens
ggccaggctggtct

SEQ ID NO: 2599617 - DNA, 16 bp, Homo sapiens
ggccagggccctgcag

SEQ ID NO: 2599618 - DNA, 18 bp, Homo sapiens
ggccagggccctgcagag

SEQ ID NO: 2599619 - DNA, 12 bp, Homo sapiens
ggccagggcctg

SEQ ID NO: 2599620 - DNA, 19 bp, Homo sapiens
ggccagggctatagctcag

SEQ ID NO: 2599621 - DNA, 19 bp, Homo sapiens
ggccagtcctgcctggcca

SEQ ID NO: 2599622 - DNA, 18 bp, Homo sapiens
gctttccacacctggcac

SEQ ID NO: 2599623 - DNA, 11 bp, Homo sapiens
gctttccagct

SEQ ID NO: 2599624 - DNA, 12 bp, Homo sapiens
gctttcctgaat

SEQ ID NO: 2599625 - DNA, 22 bp, Homo sapiens
gctttcctgaatccaaactaat

SEQ ID NO: 2599626 - DNA, 23 bp, Homo sapiens
gctttccttttttaaaaatgcaa

SEQ ID NO: 2599627 - DNA, 23 bp, Homo sapiens
gctttctacccagcgagccctgg

SEQ ID NO: 2599628 - DNA, 11 bp, Homo sapiens
gctttctgtct

SEQ ID NO: 2599629 - DNA, 15 bp, Homo sapiens
gctttctgttgtcat

SEQ ID NO: 2599630 - DNA, 23 bp, Homo sapiens
gctttctgttgtcattgctgttg

SEQ ID NO: 2599631 - DNA, 20 bp, Homo sapiens
gctttctttcgtttgtttgt

SEQ ID NO: 2599632 - DNA, 21 bp, Homo sapiens
gctttctttcgtttgtttgtt

SEQ ID NO: 2599633 - DNA, 17 bp, Homo sapiens
gctttgcatgttccact

SEQ ID NO: 2599634 - DNA, 19 bp, Homo sapiens
gctttgccagctgctgctg

SEQ ID NO: 2599635 - DNA, 12 bp, Homo sapiens
gctttgcccagc

SEQ ID NO: 2599636 - DNA, 13 bp, Homo sapiens
gctttgccttcca

SEQ ID NO: 2599637 - DNA, 12 bp, Homo sapiens
gctttgctctgc

SEQ ID NO: 2599638 - DNA, 15 bp, Homo sapiens
gctttgtgatttttg

SEQ ID NO: 2599639 - DNA, 21 bp, Homo sapiens
gctttgtttgttgtcagctga

SEQ ID NO: 2599640 - DNA, 14 bp, Homo sapiens
gcttttacttaaac

SEQ ID NO: 2599641 - DNA, 18 bp, Homo sapiens
gcttttattaatgcactt

SEQ ID NO: 2599642 - DNA, 19 bp, Homo sapiens
gcttttattaatgcacttt

SEQ ID NO: 2599643 - DNA, 15 bp, Homo sapiens
gcttttattgtataa

SEQ ID NO: 2599644 - DNA, 16 bp, Homo sapiens
gcttttcactgctgca

SEQ ID NO: 2599645 - DNA, 17 bp, Homo sapiens
gcttttcactgctgcaa

SEQ ID NO: 2599646 - DNA, 22 bp, Homo sapiens
gcttttcctatttgttttcatg

SEQ ID NO: 2599647 - DNA, 15 bp, Homo sapiens
gcttttcctcccttg

SEQ ID NO: 2599648 - DNA, 18 bp, Homo sapiens
gcttttgtctatgggact

SEQ ID NO: 2599649 - DNA, 22 bp, Homo sapiens
gctttttaattgttgtttcttt

SEQ ID NO: 2599650 - DNA, 15 bp, Homo sapiens
ggaaaaaagagaagt

SEQ ID NO: 2599651 - DNA, 15 bp, Homo sapiens
ggaaaaatgagtaat

SEQ ID NO: 2599652 - DNA, 18 bp, Homo sapiens
ggaaaacagactcaggtt

SEQ ID NO: 2599653 - DNA, 18 bp, Homo sapiens
ggaaaacatgctacacac

SEQ ID NO: 2599654 - DNA, 14 bp, Homo sapiens
ggaaaagcagctct

SEQ ID NO: 2599655 - DNA, 14 bp, Homo sapiens
ggaaaagctgctga

SEQ ID NO: 2599656 - DNA, 13 bp, Homo sapiens
ggaaaatacccca

SEQ ID NO: 2599657 - DNA, 13 bp, Homo sapiens
ggaaacaacagct

SEQ ID NO: 2599658 - DNA, 12 bp, Homo sapiens
ggaaacaatata

SEQ ID NO: 2599659 - DNA, 13 bp, Homo sapiens
ggaaacagactcg

SEQ ID NO: 2599660 - DNA, 19 bp, Homo sapiens
ggaaaccacagctgctgga

SEQ ID NO: 2599661 - DNA, 15 bp, Homo sapiens
ggaaacccagctctg

SEQ ID NO: 2599662 - DNA, 16 bp, Homo sapiens
ggaaacccagctctgg

SEQ ID NO: 2599663 - DNA, 12 bp, Homo sapiens
ggaaacctgccc

SEQ ID NO: 2599664 - DNA, 21 bp, Homo sapiens
ggaaactcacctgctggcccc

SEQ ID NO: 2599665 - DNA, 22 bp, Homo sapiens
ggaaagacatccataaagaagc

SEQ ID NO: 2599666 - DNA, 11 bp, Homo sapiens
ggaaagcaggt

SEQ ID NO: 2599667 - DNA, 19 bp, Homo sapiens
ggaaagcaggtggcatctc

SEQ ID NO: 2599668 - DNA, 21 bp, Homo sapiens
ggaaagcaggtggcatctcta

SEQ ID NO: 2599669 - DNA, 18 bp, Homo sapiens
ggaaagcatcacctcagg

SEQ ID NO: 2599670 - DNA, 20 bp, Homo sapiens
ggaaagccacctctccctca

SEQ ID NO: 2599671 - DNA, 21 bp, Homo sapiens
ggaaagccagtgactccagga

SEQ ID NO: 2599672 - DNA, 14 bp, Homo sapiens
ggaaagcctctgct

SEQ ID NO: 2599673 - DNA, 16 bp, Homo sapiens
ggaaagcctctgctgc

SEQ ID NO: 2599674 - DNA, 18 bp, Homo sapiens
ggaaaggcaaatgcccaa

SEQ ID NO: 2599675 - DNA, 15 bp, Homo sapiens
ggaaaggccagctgg

SEQ ID NO: 2599676 - DNA, 20 bp, Homo sapiens
ggaaaggctcagtctcagga

SEQ ID NO: 2599677 - DNA, 23 bp, Homo sapiens
ggaaaggctcagtctcaggagca

SEQ ID NO: 2599678 - DNA, 12 bp, Homo sapiens
ggaaaggctcca

SEQ ID NO: 2599679 - DNA, 19 bp, Homo sapiens
gctgggaactgcagacctg

SEQ ID NO: 2599680 - DNA, 12 bp, Homo sapiens
gctgggagagcc

SEQ ID NO: 2599681 - DNA, 13 bp, Homo sapiens
gctgggagagcct

SEQ ID NO: 2599682 - DNA, 14 bp, Homo sapiens
gctgggaggcatgg

SEQ ID NO: 2599683 - DNA, 21 bp, Homo sapiens
gctgggatgattggagggggg

SEQ ID NO: 2599684 - DNA, 18 bp, Homo sapiens
gctgggattacaggtgtg

SEQ ID NO: 2599685 - DNA, 22 bp, Homo sapiens
gctgggcacacgcctcccactg

SEQ ID NO: 2599686 - DNA, 12 bp, Homo sapiens
gctgggcagcta

SEQ ID NO: 2599687 - DNA, 14 bp, Homo sapiens
gctgggcaggttgg

SEQ ID NO: 2599688 - DNA, 13 bp, Homo sapiens
gctgggccccagc

SEQ ID NO: 2599689 - DNA, 15 bp, Homo sapiens
gctgggccccagccc

SEQ ID NO: 2599690 - DNA, 16 bp, Homo sapiens
gctgggccccagccca

SEQ ID NO: 2599691 - DNA, 17 bp, Homo sapiens
gctgggccccagcccac

SEQ ID NO: 2599692 - DNA, 21 bp, Homo sapiens
gctgggccccagcccaccctc

SEQ ID NO: 2599693 - DNA, 17 bp, Homo sapiens
gctgggctcccttccca

SEQ ID NO: 2599694 - DNA, 20 bp, Homo sapiens
gctgggctcccttcccacct

SEQ ID NO: 2599695 - DNA, 21 bp, Homo sapiens
gctgggctctgccaccctacc

SEQ ID NO: 2599696 - DNA, 18 bp, Homo sapiens
gctgggctgagcccctac

SEQ ID NO: 2599697 - DNA, 14 bp, Homo sapiens
gctgggctgggcgc

SEQ ID NO: 2599698 - DNA, 17 bp, Homo sapiens
gctgggcttcagtggca

SEQ ID NO: 2599699 - DNA, 19 bp, Homo sapiens
gctgggcttcagtggcagc

SEQ ID NO: 2599700 - DNA, 22 bp, Homo sapiens
gctgggcttcagtggcagctgc

SEQ ID NO: 2599701 - DNA, 12 bp, Homo sapiens
gctggggccagt

SEQ ID NO: 2599702 - DNA, 17 bp, Homo sapiens
gctggggcgtggggagg

SEQ ID NO: 2599703 - DNA, 16 bp, Homo sapiens
gctgggggccatgagc

SEQ ID NO: 2599704 - DNA, 18 bp, Homo sapiens
gctgggggcctcagtgcc

SEQ ID NO: 2599705 - DNA, 23 bp, Homo sapiens
gctgggtggcaccagcagcctgg

SEQ ID NO: 2599706 - DNA, 17 bp, Homo sapiens
gctgggtggcactgcca

SEQ ID NO: 2599707 - DNA, 17 bp, Homo sapiens
gctgggtggtaccctct

SEQ ID NO: 2599708 - DNA, 15 bp, Homo sapiens
gctgggtgtggcgca

SEQ ID NO: 2599709 - DNA, 16 bp, Homo sapiens
gctgggttggtgcaca

SEQ ID NO: 2599710 - DNA, 17 bp, Homo sapiens
gctgggttggtgcacag

SEQ ID NO: 2599711 - DNA, 15 bp, Homo sapiens
gctggtaaactattt

SEQ ID NO: 2599712 - DNA, 19 bp, Homo sapiens
gctggtaggctcctgccag

SEQ ID NO: 2599713 - DNA, 17 bp, Homo sapiens
gctggtcacagcctcct

SEQ ID NO: 2599714 - DNA, 18 bp, Homo sapiens
gctggtcacagcctcctc

SEQ ID NO: 2599715 - DNA, 20 bp, Homo sapiens
gctggtcacagcctcctctg

SEQ ID NO: 2599716 - DNA, 22 bp, Homo sapiens
gctggtcacagcctcctctgtc

SEQ ID NO: 2599717 - DNA, 20 bp, Homo sapiens
gctggtgagtgatgcggcag

SEQ ID NO: 2599718 - DNA, 17 bp, Homo sapiens
gctggtgcattacagag

SEQ ID NO: 2599719 - DNA, 13 bp, Homo sapiens
gctggtgccagcc

SEQ ID NO: 2599720 - DNA, 14 bp, Homo sapiens
gctggtgccagcct

SEQ ID NO: 2599721 - DNA, 14 bp, Homo sapiens
gctggtgcccggag

SEQ ID NO: 2599722 - DNA, 15 bp, Homo sapiens
gctggtggctcccgg

SEQ ID NO: 2599723 - DNA, 12 bp, Homo sapiens
gctggtggtttc

SEQ ID NO: 2599724 - DNA, 13 bp, Homo sapiens
gctggtggtttca

SEQ ID NO: 2599725 - DNA, 22 bp, Homo sapiens
gctggtggtttcacggtgccag

SEQ ID NO: 2599726 - DNA, 14 bp, Homo sapiens
gctggtgtcacctg

SEQ ID NO: 2599727 - DNA, 15 bp, Homo sapiens
gctggtgtcacctga

SEQ ID NO: 2599728 - DNA, 16 bp, Homo sapiens
gctggtgtcctgacca

SEQ ID NO: 2599729 - DNA, 15 bp, Homo sapiens
gctggttgctgtgtg

SEQ ID NO: 2599730 - DNA, 24 bp, Homo sapiens
gctggttgtcatttttgcagtaga

SEQ ID NO: 2599731 - DNA, 15 bp, Homo sapiens
gctggtttcctcatt

SEQ ID NO: 2599732 - DNA, 12 bp, Homo sapiens
gctggttttcct

SEQ ID NO: 2599733 - DNA, 14 bp, Homo sapiens
gctggttttcctaa

SEQ ID NO: 2599734 - DNA, 15 bp, Homo sapiens
gctggtttttcagtt

SEQ ID NO: 2599735 - DNA, 17 bp, Homo sapiens
gctgtaaggcatgaagg

SEQ ID NO: 2599736 - DNA, 21 bp, Homo sapiens
gctgtagtagccctttctgtg

SEQ ID NO: 2599737 - DNA, 17 bp, Homo sapiens
gctgtatcccatgagcc

SEQ ID NO: 2599738 - DNA, 19 bp, Homo sapiens
gctgtatcccatgagcctc

SEQ ID NO: 2599739 - DNA, 20 bp, Homo sapiens
gctgtatcccatgagcctca

SEQ ID NO: 2599740 - DNA, 14 bp, Homo sapiens
gctgtatcttgttt

SEQ ID NO: 2599741 - DNA, 13 bp, Homo sapiens
gctgtcacaggcg

SEQ ID NO: 2599742 - DNA, 13 bp, Homo sapiens
gctgtcatctcag

SEQ ID NO: 2599743 - DNA, 13 bp, Homo sapiens
gctgtccagacag

SEQ ID NO: 2599744 - DNA, 22 bp, Homo sapiens
gctgtcccatctccactgttat

SEQ ID NO: 2599745 - DNA, 22 bp, Homo sapiens
gctgtcgatgtaggcattctgg

SEQ ID NO: 2599746 - DNA, 14 bp, Homo sapiens
gctgtctccagacc

SEQ ID NO: 2599747 - DNA, 17 bp, Homo sapiens
gctgtctggccaggcct

SEQ ID NO: 2599748 - DNA, 13 bp, Homo sapiens
gctgtgaaaaaaa

SEQ ID NO: 2599749 - DNA, 22 bp, Homo sapiens
gctgtgacaatggcaacaattt

SEQ ID NO: 2599750 - DNA, 16 bp, Homo sapiens
gctgtgacttctccag

SEQ ID NO: 2599751 - DNA, 20 bp, Homo sapiens
gctgtgagacagtgggaaat

SEQ ID NO: 2599752 - DNA, 16 bp, Homo sapiens
gctgtgagcccctggt

SEQ ID NO: 2599753 - DNA, 18 bp, Homo sapiens
gctgtgaggcccctggac

SEQ ID NO: 2599754 - DNA, 22 bp, Homo sapiens
gctgtgaggcccctggacaagc

SEQ ID NO: 2599755 - DNA, 17 bp, Homo sapiens
gcctcagccattcactg

SEQ ID NO: 2599756 - DNA, 14 bp, Homo sapiens
gcctcagcctccca

SEQ ID NO: 2599757 - DNA, 16 bp, Homo sapiens
gcctcagctgcctcac

SEQ ID NO: 2599758 - DNA, 20 bp, Homo sapiens
gcctcagctgcctcacttcc

SEQ ID NO: 2599759 - DNA, 21 bp, Homo sapiens
gcctcagtggactttccaccc

SEQ ID NO: 2599760 - DNA, 13 bp, Homo sapiens
gcctcatatttaa

SEQ ID NO: 2599761 - DNA, 16 bp, Homo sapiens
gcctcatccgaggcag

SEQ ID NO: 2599762 - DNA, 18 bp, Homo sapiens
gcctcatccgaggcaggg

SEQ ID NO: 2599763 - DNA, 22 bp, Homo sapiens
gcctcatccgaggcagggtcag

SEQ ID NO: 2599764 - DNA, 14 bp, Homo sapiens
gcctccaccaccac

SEQ ID NO: 2599765 - DNA, 15 bp, Homo sapiens
gcctccaccaccact

SEQ ID NO: 2599766 - DNA, 16 bp, Homo sapiens
gcctccaccaccactg

SEQ ID NO: 2599767 - DNA, 20 bp, Homo sapiens
gcctccaccaccactggcca

SEQ ID NO: 2599768 - DNA, 21 bp, Homo sapiens
gcctccaccaccactggccac

SEQ ID NO: 2599769 - DNA, 17 bp, Homo sapiens
gcctccaccctctgagc

SEQ ID NO: 2599770 - DNA, 18 bp, Homo sapiens
gcctccaccctctgagct

SEQ ID NO: 2599771 - DNA, 13 bp, Homo sapiens
gcctccaggtgtg

SEQ ID NO: 2599772 - DNA, 14 bp, Homo sapiens
gcctccaggtgtgc

SEQ ID NO: 2599773 - DNA, 11 bp, Homo sapiens
gcctccatctc

SEQ ID NO: 2599774 - DNA, 17 bp, Homo sapiens
gcctccatttagttctt

SEQ ID NO: 2599775 - DNA, 13 bp, Homo sapiens
gcctcccacagac

SEQ ID NO: 2599776 - DNA, 18 bp, Homo sapiens
gcctcccacccgatgctg

SEQ ID NO: 2599777 - DNA, 20 bp, Homo sapiens
gcctcccacccgatgctgct

SEQ ID NO: 2599778 - DNA, 23 bp, Homo sapiens
gcctcccacccgatgctgctttc

SEQ ID NO: 2599779 - DNA, 21 bp, Homo sapiens
gcctcccacgactgcccggca

SEQ ID NO: 2599780 - DNA, 13 bp, Homo sapiens
gcctcccactggg

SEQ ID NO: 2599781 - DNA, 10 bp, Homo sapiens
gcctcccagc

SEQ ID NO: 2599782 - DNA, 14 bp, Homo sapiens
gcctcccatcaccc

SEQ ID NO: 2599783 - DNA, 17 bp, Homo sapiens
gcctccccaaccctgcc

SEQ ID NO: 2599784 - DNA, 20 bp, Homo sapiens
gcctccccaaccctgcccct

SEQ ID NO: 2599785 - DNA, 14 bp, Homo sapiens
gcctcccctgccag

SEQ ID NO: 2599786 - DNA, 18 bp, Homo sapiens
gcctcccgaatagctggg

SEQ ID NO: 2599787 - DNA, 23 bp, Homo sapiens
gcctcccgaatagctgggactac

SEQ ID NO: 2599788 - DNA, 17 bp, Homo sapiens
gcctcccgagtagctgg

SEQ ID NO: 2599789 - DNA, 19 bp, Homo sapiens
gcctcccgcgttgggcaac

SEQ ID NO: 2599790 - DNA, 16 bp, Homo sapiens
gcctccctagccagca

SEQ ID NO: 2599791 - DNA, 17 bp, Homo sapiens
gcctccctcaccctgag

SEQ ID NO: 2599792 - DNA, 22 bp, Homo sapiens
gcctccctctctcttctgctcc

SEQ ID NO: 2599793 - DNA, 12 bp, Homo sapiens
gcctccctctga

SEQ ID NO: 2599794 - DNA, 14 bp, Homo sapiens
gcctccctctgacc

SEQ ID NO: 2599795 - DNA, 16 bp, Homo sapiens
gcctccctggtccctt

SEQ ID NO: 2599796 - DNA, 15 bp, Homo sapiens
gcctcccttcatgca

SEQ ID NO: 2599797 - DNA, 18 bp, Homo sapiens
gcctcccttcatgcatgg

SEQ ID NO: 2599798 - DNA, 23 bp, Homo sapiens
gcctcccttcatgcatggaaatt

SEQ ID NO: 2599799 - DNA, 19 bp, Homo sapiens
gcctccggcgtcagcctcc

SEQ ID NO: 2599800 - DNA, 20 bp, Homo sapiens
gcctccggcgtcagcctcca

SEQ ID NO: 2599801 - DNA, 23 bp, Homo sapiens
gcctccggcgtcagcctccagcc

SEQ ID NO: 2599802 - DNA, 19 bp, Homo sapiens
gcctcctcacccccagctt

SEQ ID NO: 2599803 - DNA, 12 bp, Homo sapiens
gcctcctcatcc

SEQ ID NO: 2599804 - DNA, 16 bp, Homo sapiens
gcctcctccttcccaa

SEQ ID NO: 2599805 - DNA, 21 bp, Homo sapiens
gcctcctctgtctgcccttca

SEQ ID NO: 2599806 - DNA, 21 bp, Homo sapiens
gcctcctgacctgaggctcct

SEQ ID NO: 2599807 - DNA, 17 bp, Homo sapiens
gcctcctgcctgcccct

SEQ ID NO: 2599808 - DNA, 23 bp, Homo sapiens
gcctcctgtgtgtgcgcctacag

SEQ ID NO: 2599809 - DNA, 20 bp, Homo sapiens
gcctcctttgtgaggaagcc

SEQ ID NO: 2599810 - DNA, 22 bp, Homo sapiens
gcctcctttgtgaggaagccgc

SEQ ID NO: 2599811 - DNA, 14 bp, Homo sapiens
gcctcggagcctca

SEQ ID NO: 2599812 - DNA, 21 bp, Homo sapiens
gcctcgggacacctgccctgc

SEQ ID NO: 2599813 - DNA, 16 bp, Homo sapiens
gcctctaaccccaggc

SEQ ID NO: 2599814 - DNA, 20 bp, Homo sapiens
gcctctaaccccaggccccg

SEQ ID NO: 2599815 - DNA, 23 bp, Homo sapiens
gcctctagggacccctcctccct

SEQ ID NO: 2599816 - DNA, 12 bp, Homo sapiens
gcctctcccctg

SEQ ID NO: 2599817 - DNA, 19 bp, Homo sapiens
gcctctcccgtcagggccc

SEQ ID NO: 2599818 - DNA, 15 bp, Homo sapiens
gcctctccctggccc

SEQ ID NO: 2599819 - DNA, 21 bp, Homo sapiens
gcctctccttgtggcctgggc

SEQ ID NO: 2599820 - DNA, 22 bp, Homo sapiens
gcctctccttgtggcctgggcc

SEQ ID NO: 2599821 - DNA, 12 bp, Homo sapiens
gcctctcctttg

SEQ ID NO: 2599822 - DNA, 15 bp, Homo sapiens
gcctctcctttgtat

SEQ ID NO: 2599823 - DNA, 23 bp, Homo sapiens
gcctctcctttgtatattatttc

SEQ ID NO: 2599824 - DNA, 12 bp, Homo sapiens
gcctctctccca

SEQ ID NO: 2599825 - DNA, 13 bp, Homo sapiens
gcctctctcccag

SEQ ID NO: 2599826 - DNA, 15 bp, Homo sapiens
gcctctctcccagtc

SEQ ID NO: 2599827 - DNA, 16 bp, Homo sapiens
gcctctctcccagtct

SEQ ID NO: 2599828 - DNA, 15 bp, Homo sapiens
gcctctctggcctcc

SEQ ID NO: 2599829 - DNA, 16 bp, Homo sapiens
gcctctctggcctccc

SEQ ID NO: 2599830 - DNA, 19 bp, Homo sapiens
gcctctctggcctcccacc

SEQ ID NO: 2599831 - DNA, 19 bp, Homo sapiens
gcctctcttggtttccttc

SEQ ID NO: 2599832 - DNA, 15 bp, Homo sapiens
gcctctgacacacag

SEQ ID NO: 2599833 - DNA, 20 bp, Homo sapiens
gcctctgacacacagctctg

SEQ ID NO: 2599834 - DNA, 20 bp, Homo sapiens
gcctctgagggaaagcccag

SEQ ID NO: 2599835 - DNA, 22 bp, Homo sapiens
gcctctgagggaaagcccagaa

SEQ ID NO: 2599836 - DNA, 17 bp, Homo sapiens
gcctctgcaaaggaaat

SEQ ID NO: 2599837 - DNA, 19 bp, Homo sapiens
gcctctgcactcccctgct

SEQ ID NO: 2599838 - DNA, 15 bp, Homo sapiens
gcctctgcattcagg

SEQ ID NO: 2599839 - DNA, 12 bp, Homo sapiens
gcctctgcctgt

SEQ ID NO: 2599840 - DNA, 22 bp, Homo sapiens
gcctctggctagaggccagccc

SEQ ID NO: 2599841 - DNA, 23 bp, Homo sapiens
gcctctggctagaggccagcccc

SEQ ID NO: 2599842 - DNA, 21 bp, Homo sapiens
gcctctgtgtccttccctgca

SEQ ID NO: 2599843 - DNA, 20 bp, Homo sapiens
gcctcttaaagctgcctgta

SEQ ID NO: 2599844 - DNA, 16 bp, Homo sapiens
gcctcttatgggctgg

SEQ ID NO: 2599845 - DNA, 12 bp, Homo sapiens
gcctcttcctcc

SEQ ID NO: 2599846 - DNA, 22 bp, Homo sapiens
gcctcttcctccctcattccac

SEQ ID NO: 2599847 - DNA, 14 bp, Homo sapiens
gcctcttctgggag

SEQ ID NO: 2599848 - DNA, 14 bp, Homo sapiens
gcctgaaccttcca

SEQ ID NO: 2599849 - DNA, 18 bp, Homo sapiens
gcctgaagttggagtgag

SEQ ID NO: 2599850 - DNA, 22 bp, Homo sapiens
gcctgaatgcttataggtggcc

SEQ ID NO: 2599851 - DNA, 13 bp, Homo sapiens
gcctgagagtatt

SEQ ID NO: 2599852 - DNA, 20 bp, Homo sapiens
gcctgaggatgagctggaag

SEQ ID NO: 2599853 - DNA, 15 bp, Homo sapiens
gcctgagggcccctc

SEQ ID NO: 2599854 - DNA, 16 bp, Homo sapiens
gcctgagggcccctct

SEQ ID NO: 2599855 - DNA, 17 bp, Homo sapiens
gcctgagggcccctctg

SEQ ID NO: 2599856 - DNA, 19 bp, Homo sapiens
gcctgagggcccctctgcc

SEQ ID NO: 2599857 - DNA, 23 bp, Homo sapiens
gcctgagggcgaggggagggtgg

SEQ ID NO: 2599858 - DNA, 14 bp, Homo sapiens
gcctgagggtggag

SEQ ID NO: 2599859 - DNA, 15 bp, Homo sapiens
gcctgagggtggaga

SEQ ID NO: 2599860 - DNA, 18 bp, Homo sapiens
gcctgaggtctgtacgtt

SEQ ID NO: 2599861 - DNA, 22 bp, Homo sapiens
gcctgatccagcctctcccctg

SEQ ID NO: 2599862 - DNA, 17 bp, Homo sapiens
gcctgatgacagagcga

SEQ ID NO: 2599863 - DNA, 14 bp, Homo sapiens
gcctgatgctccct

SEQ ID NO: 2599864 - DNA, 16 bp, Homo sapiens
gcctgatgctccctcc

SEQ ID NO: 2599865 - DNA, 17 bp, Homo sapiens
gcctgatgctccctccc

SEQ ID NO: 2599866 - DNA, 21 bp, Homo sapiens
gcctgattgccaagctcagga

SEQ ID NO: 2599867 - DNA, 13 bp, Homo sapiens
gcctgcaagggag

SEQ ID NO: 2599868 - DNA, 15 bp, Homo sapiens
gcctgcaagggagtg

SEQ ID NO: 2599869 - DNA, 22 bp, Homo sapiens
gcctgcacggtgggccttgctg

SEQ ID NO: 2599870 - DNA, 11 bp, Homo sapiens
gcctgcagccc

SEQ ID NO: 2599871 - DNA, 21 bp, Homo sapiens
gcctgcagggtggtgctggga

SEQ ID NO: 2599872 - DNA, 24 bp, Homo sapiens
gcctgcagggtggtgctgggactg

SEQ ID NO: 2599873 - DNA, 14 bp, Homo sapiens
gcctgcaggtgctg

SEQ ID NO: 2599874 - DNA, 17 bp, Homo sapiens
gcctgcagtcctggaag

SEQ ID NO: 2599875 - DNA, 14 bp, Homo sapiens
gcctgcccacccgt

SEQ ID NO: 2599876 - DNA, 16 bp, Homo sapiens
gcgcagtgcctctggt

SEQ ID NO: 2599877 - DNA, 14 bp, Homo sapiens
gcgccaagcaacct

SEQ ID NO: 2599878 - DNA, 22 bp, Homo sapiens
gcgccactacactccagcctga

SEQ ID NO: 2599879 - DNA, 20 bp, Homo sapiens
gcgccattgcactccagcct

SEQ ID NO: 2599880 - DNA, 22 bp, Homo sapiens
gcgcccagtccttccacctcga

SEQ ID NO: 2599881 - DNA, 23 bp, Homo sapiens
gcgcccagttgggtggatgcctg

SEQ ID NO: 2599882 - DNA, 14 bp, Homo sapiens
gcgcccgctgggct

SEQ ID NO: 2599883 - DNA, 17 bp, Homo sapiens
gcgccgagtctgtctct

SEQ ID NO: 2599884 - DNA, 19 bp, Homo sapiens
gcgccgcaaaccacactgg

SEQ ID NO: 2599885 - DNA, 21 bp, Homo sapiens
gcgccgcaaaccacactggac

SEQ ID NO: 2599886 - DNA, 23 bp, Homo sapiens
gcgccggcaaaactttggcactg

SEQ ID NO: 2599887 - DNA, 18 bp, Homo sapiens
gcgccggcgggcgggccg

SEQ ID NO: 2599888 - DNA, 19 bp, Homo sapiens
gcgccgtgagttctcaggg

SEQ ID NO: 2599889 - DNA, 20 bp, Homo sapiens
gcgccgtgagttctcagggc

SEQ ID NO: 2599890 - DNA, 22 bp, Homo sapiens
gcgccgtgagttctcagggctc

SEQ ID NO: 2599891 - DNA, 23 bp, Homo sapiens
gcgccgtgagttctcagggctcc

SEQ ID NO: 2599892 - DNA, 20 bp, Homo sapiens
gcgcctacaggagtgagcac

SEQ ID NO: 2599893 - DNA, 22 bp, Homo sapiens
gcgcctccttccttgctgtcct

SEQ ID NO: 2599894 - DNA, 16 bp, Homo sapiens
gcgcctgcccctccca

SEQ ID NO: 2599895 - DNA, 18 bp, Homo sapiens
gcgcctgcccctcccaga

SEQ ID NO: 2599896 - DNA, 20 bp, Homo sapiens
gcgcgagggcctcaaaggcc

SEQ ID NO: 2599897 - DNA, 14 bp, Homo sapiens
gcgcggccagcccc

SEQ ID NO: 2599898 - DNA, 16 bp, Homo sapiens
gcgctacccacttcta

SEQ ID NO: 2599899 - DNA, 11 bp, Homo sapiens
gcgctgcaaat

SEQ ID NO: 2599900 - DNA, 10 bp, Homo sapiens
gcgctggccc

SEQ ID NO: 2599901 - DNA, 11 bp, Homo sapiens
gcgctggccca

SEQ ID NO: 2599902 - DNA, 12 bp, Homo sapiens
gcgctggcccag

SEQ ID NO: 2599903 - DNA, 15 bp, Homo sapiens
gcgctggcccagccg

SEQ ID NO: 2599904 - DNA, 16 bp, Homo sapiens
gcgctggcccagccgg

SEQ ID NO: 2599905 - DNA, 15 bp, Homo sapiens
gcgctttctggaaaa

SEQ ID NO: 2599906 - DNA, 13 bp, Homo sapiens
gcggacagccacg

SEQ ID NO: 2599907 - DNA, 16 bp, Homo sapiens
gcggacatcagctggt

SEQ ID NO: 2599908 - DNA, 16 bp, Homo sapiens
gcggacgttccagccg

SEQ ID NO: 2599909 - DNA, 23 bp, Homo sapiens
gcggagaaccttgtgcctggctc

SEQ ID NO: 2599910 - DNA, 20 bp, Homo sapiens
gcggagagtacagtgagcca

SEQ ID NO: 2599911 - DNA, 14 bp, Homo sapiens
gcggcagcagccat

SEQ ID NO: 2599912 - DNA, 11 bp, Homo sapiens
gcggccagccc

SEQ ID NO: 2599913 - DNA, 18 bp, Homo sapiens
gcggccagccccggccct

SEQ ID NO: 2599914 - DNA, 22 bp, Homo sapiens
gcggcccaagcccgacttgctg

SEQ ID NO: 2599915 - DNA, 16 bp, Homo sapiens
gcggcccagcccggct

SEQ ID NO: 2599916 - DNA, 21 bp, Homo sapiens
gcggcccagcccggctcccac

SEQ ID NO: 2599917 - DNA, 15 bp, Homo sapiens
gcggcccctcccaca

SEQ ID NO: 2599918 - DNA, 21 bp, Homo sapiens
gcggctgagagccccagctga

SEQ ID NO: 2599919 - DNA, 22 bp, Homo sapiens
gcggctgtgcagcctgtcctgg

SEQ ID NO: 2599920 - DNA, 23 bp, Homo sapiens
gcgggacgagaccctacaggaga

SEQ ID NO: 2599921 - DNA, 21 bp, Homo sapiens
gcgggaggatgttctgggaca

SEQ ID NO: 2599922 - DNA, 22 bp, Homo sapiens
gcgggaggatgttctgggacac

SEQ ID NO: 2599923 - DNA, 16 bp, Homo sapiens
gcgggccagccaggcg

SEQ ID NO: 2599924 - DNA, 21 bp, Homo sapiens
gcgggccagccaggcgggctc

SEQ ID NO: 2599925 - DNA, 18 bp, Homo sapiens
gcggggacagctccttct

SEQ ID NO: 2599926 - DNA, 23 bp, Homo sapiens
gcggggacagctccttctgtcct

SEQ ID NO: 2599927 - DNA, 18 bp, Homo sapiens
gcggggcgaagcccaggc

SEQ ID NO: 2599928 - DNA, 20 bp, Homo sapiens
gcggggcgaagcccaggccc

SEQ ID NO: 2599929 - DNA, 19 bp, Homo sapiens
gcggtcccctccgccaggc

SEQ ID NO: 2599930 - DNA, 22 bp, Homo sapiens
gcggtgctatctcccccagccc

SEQ ID NO: 2599931 - DNA, 15 bp, Homo sapiens
gcgtagaagtttttg

SEQ ID NO: 2599932 - DNA, 21 bp, Homo sapiens
gcgtagatcaccagaataaac

SEQ ID NO: 2599933 - DNA, 12 bp, Homo sapiens
gcgtcagcctcc

SEQ ID NO: 2599934 - DNA, 16 bp, Homo sapiens
gcgtcagtattttccc

SEQ ID NO: 2599935 - DNA, 19 bp, Homo sapiens
gcgtcccagtctctggcag

SEQ ID NO: 2599936 - DNA, 14 bp, Homo sapiens
gcgtccccctgccg

SEQ ID NO: 2599937 - DNA, 16 bp, Homo sapiens
gcgtccgcgcgccagc

SEQ ID NO: 2599938 - DNA, 21 bp, Homo sapiens
gcgtcctgtccacacccagct

SEQ ID NO: 2599939 - DNA, 24 bp, Homo sapiens
gcgtcctgtccacacccagctcag

SEQ ID NO: 2599940 - DNA, 16 bp, Homo sapiens
gcgtcgccctcccagg

SEQ ID NO: 2599941 - DNA, 11 bp, Homo sapiens
gcgtctcctgt

SEQ ID NO: 2599942 - DNA, 18 bp, Homo sapiens
gcgtctgtcttcaagggc

SEQ ID NO: 2599943 - DNA, 19 bp, Homo sapiens
gcgtgaaacacaccaggct

SEQ ID NO: 2599944 - DNA, 15 bp, Homo sapiens
gcgtgagccactgca

SEQ ID NO: 2599945 - DNA, 15 bp, Homo sapiens
gcgtgatcaaagcca

SEQ ID NO: 2599946 - DNA, 18 bp, Homo sapiens
gcgtgcacacaccagagc

SEQ ID NO: 2599947 - DNA, 19 bp, Homo sapiens
gcgtgcacacaccagagcc

SEQ ID NO: 2599948 - DNA, 19 bp, Homo sapiens
gcgtgctccagcctggctc

SEQ ID NO: 2599949 - DNA, 17 bp, Homo sapiens
gcgtggactctgcacat

SEQ ID NO: 2599950 - DNA, 12 bp, Homo sapiens
gcgtggagctgc

SEQ ID NO: 2599951 - DNA, 17 bp, Homo sapiens
gcgtggggacagggctc

SEQ ID NO: 2599952 - DNA, 16 bp, Homo sapiens
gcgtggtcactgctgt

SEQ ID NO: 2599953 - DNA, 17 bp, Homo sapiens
gcgtgtcacctgtgctt

SEQ ID NO: 2599954 - DNA, 19 bp, Homo sapiens
gcgtgtcgtgggtgtgtgt

SEQ ID NO: 2599955 - DNA, 18 bp, Homo sapiens
gcgtgtgcgtgcatgtgc

SEQ ID NO: 2599956 - DNA, 18 bp, Homo sapiens
gcgtgtgtacacgggact

SEQ ID NO: 2599957 - DNA, 15 bp, Homo sapiens
gcgtgtgtagagtta

SEQ ID NO: 2599958 - DNA, 15 bp, Homo sapiens
gcgtgtttgcacgtt

SEQ ID NO: 2599959 - DNA, 15 bp, Homo sapiens
gcgttgcatgtcgtg

SEQ ID NO: 2599960 - DNA, 14 bp, Homo sapiens
gctaaaaatgggac

SEQ ID NO: 2599961 - DNA, 15 bp, Homo sapiens
gctaaagcccagaga

SEQ ID NO: 2599962 - DNA, 19 bp, Homo sapiens
gctaaataaaatttgttgc

SEQ ID NO: 2599963 - DNA, 16 bp, Homo sapiens
gctaaatgtgaatgat

SEQ ID NO: 2599964 - DNA, 16 bp, Homo sapiens
gctaacaccagacaga

SEQ ID NO: 2599965 - DNA, 13 bp, Homo sapiens
gctaacattttaa

SEQ ID NO: 2599966 - DNA, 18 bp, Homo sapiens
gctaacttggagccccag

SEQ ID NO: 2599967 - DNA, 13 bp, Homo sapiens
gctaagagggagg

SEQ ID NO: 2599968 - DNA, 21 bp, Homo sapiens
gctaagagggagggagggctc

SEQ ID NO: 2599969 - DNA, 18 bp, Homo sapiens
gctaagattatctgggga

SEQ ID NO: 2599970 - DNA, 15 bp, Homo sapiens
gctaagctaggaatg

SEQ ID NO: 2599971 - DNA, 19 bp, Homo sapiens
gctaagctaggaatgaaat

SEQ ID NO: 2599972 - DNA, 22 bp, Homo sapiens
gctaagtgatcctcccacctca

SEQ ID NO: 2599973 - DNA, 20 bp, Homo sapiens
gctaatatcaatagaaggat

SEQ ID NO: 2599974 - DNA, 18 bp, Homo sapiens
gctaatcagtgtctcaca

SEQ ID NO: 2599975 - DNA, 19 bp, Homo sapiens
gctaatctgtagggctgga

SEQ ID NO: 2599976 - DNA, 20 bp, Homo sapiens
gctaatctgtagggctggac

SEQ ID NO: 2599977 - DNA, 21 bp, Homo sapiens
gctaatctgtagggctggacc

SEQ ID NO: 2599978 - DNA, 18 bp, Homo sapiens
gctacaaaaacacagcaa

SEQ ID NO: 2599979 - DNA, 19 bp, Homo sapiens
gctacaaaaacacagcaag

SEQ ID NO: 2599980 - DNA, 16 bp, Homo sapiens
gctacaaagaagacat

SEQ ID NO: 2599981 - DNA, 18 bp, Homo sapiens
gctacaaagaagacatgt

SEQ ID NO: 2599982 - DNA, 20 bp, Homo sapiens
gctacaaagaagacatgttt

SEQ ID NO: 2599983 - DNA, 22 bp, Homo sapiens
gctacaaagaagacatgtttta

SEQ ID NO: 2599984 - DNA, 20 bp, Homo sapiens
gctacaattttctcccagga

SEQ ID NO: 2599985 - DNA, 21 bp, Homo sapiens
gctacaattttctcccaggaa

SEQ ID NO: 2599986 - DNA, 16 bp, Homo sapiens
gctacacagatcacag

SEQ ID NO: 2599987 - DNA, 19 bp, Homo sapiens
gctacacccttttccagct

SEQ ID NO: 2599988 - DNA, 22 bp, Homo sapiens
gctacaggaagcaccccatgcc

SEQ ID NO: 2599989 - DNA, 20 bp, Homo sapiens
gctaccaaagcaccttagct

SEQ ID NO: 2599990 - DNA, 20 bp, Homo sapiens
gctacccccatgctggaggt

SEQ ID NO: 2599991 - DNA, 19 bp, Homo sapiens
gctaccctgagctgaggca

SEQ ID NO: 2599992 - DNA, 21 bp, Homo sapiens
gctaccctttttctccagctg

SEQ ID NO: 2599993 - DNA, 22 bp, Homo sapiens
gctaccctttttctccagctgg

SEQ ID NO: 2599994 - DNA, 16 bp, Homo sapiens
gctactaatgatgttt

SEQ ID NO: 2599995 - DNA, 18 bp, Homo sapiens
gctactaatgatgttttc

SEQ ID NO: 2599996 - DNA, 20 bp, Homo sapiens
gctactcaagaggctgaggc

SEQ ID NO: 2599997 - DNA, 21 bp, Homo sapiens
gctactcaagaggctgaggca

SEQ ID NO: 2599998 - DNA, 14 bp, Homo sapiens
gctactcagaagcc

SEQ ID NO: 2599999 - DNA, 18 bp, Homo sapiens
gctactcagaagcctgag

SEQ ID NO: 2600000 - DNA, 17 bp, Homo sapiens
gctactgatttttgtga

SEQ ID NO: 2600001 - DNA, 19 bp, Homo sapiens
gctactgtcctacccaccc

SEQ ID NO: 2600002 - DNA, 18 bp, Homo sapiens
gctagaaatatgatttta

SEQ ID NO: 2600003 - DNA, 20 bp, Homo sapiens
gctagaaccaagaagggcta

SEQ ID NO: 2600004 - DNA, 13 bp, Homo sapiens
gctagaaggccac

SEQ ID NO: 2600005 - DNA, 17 bp, Homo sapiens
gctagaaggccacatgt

SEQ ID NO: 2600006 - DNA, 22 bp, Homo sapiens
gctagaattccctctctctgac

SEQ ID NO: 2600007 - DNA, 18 bp, Homo sapiens
gctagaggccagccccac

SEQ ID NO: 2600008 - DNA, 21 bp, Homo sapiens
gctagaggccagccccaccca

SEQ ID NO: 2600009 - DNA, 18 bp, Homo sapiens
gctagaggttcaaagata

SEQ ID NO: 2600010 - DNA, 19 bp, Homo sapiens
gctagaggttcaaagatat

SEQ ID NO: 2600011 - DNA, 21 bp, Homo sapiens
gctagaggttcaaagatattt

SEQ ID NO: 2600012 - DNA, 22 bp, Homo sapiens
gctagcagcagggagggcttct

SEQ ID NO: 2600013 - DNA, 14 bp, Homo sapiens
gctagcatccctga

SEQ ID NO: 2600014 - DNA, 16 bp, Homo sapiens
gctagctcccctcctc

SEQ ID NO: 2600015 - DNA, 13 bp, Homo sapiens
gctaggaatgaaa

SEQ ID NO: 2600016 - DNA, 20 bp, Homo sapiens
gctaggacccctccatgtgg

SEQ ID NO: 2600017 - DNA, 14 bp, Homo sapiens
gctaggcctggcca

SEQ ID NO: 2600018 - DNA, 17 bp, Homo sapiens
gctaggcctggccagat

SEQ ID NO: 2600019 - DNA, 15 bp, Homo sapiens
gctcctctccccagc

SEQ ID NO: 2600020 - DNA, 16 bp, Homo sapiens
gctcctctccccagca

SEQ ID NO: 2600021 - DNA, 15 bp, Homo sapiens
gctcctctcctggag

SEQ ID NO: 2600022 - DNA, 16 bp, Homo sapiens
gctcctctcctggagg

SEQ ID NO: 2600023 - DNA, 18 bp, Homo sapiens
gctcctctcctggaggat

SEQ ID NO: 2600024 - DNA, 12 bp, Homo sapiens
gctcctctgctt

SEQ ID NO: 2600025 - DNA, 14 bp, Homo sapiens
gctcctctgggcag

SEQ ID NO: 2600026 - DNA, 19 bp, Homo sapiens
gctcctctgggcaggacct

SEQ ID NO: 2600027 - DNA, 18 bp, Homo sapiens
gctcctggaaaggctcag

SEQ ID NO: 2600028 - DNA, 14 bp, Homo sapiens
gctcctggcccact

SEQ ID NO: 2600029 - DNA, 20 bp, Homo sapiens
gctcctggcccactgcatcg

SEQ ID NO: 2600030 - DNA, 23 bp, Homo sapiens
gctcctgggggttctttcttcct

SEQ ID NO: 2600031 - DNA, 13 bp, Homo sapiens
gctcctgtcctcc

SEQ ID NO: 2600032 - DNA, 14 bp, Homo sapiens
gctcctgtctgcca

SEQ ID NO: 2600033 - DNA, 18 bp, Homo sapiens
gctcctgtctgccagcca

SEQ ID NO: 2600034 - DNA, 20 bp, Homo sapiens
gctcctgtctgccagccagc

SEQ ID NO: 2600035 - DNA, 21 bp, Homo sapiens
gctcctgtctgccagccagca

SEQ ID NO: 2600036 - DNA, 14 bp, Homo sapiens
gctcctgtgctttc

SEQ ID NO: 2600037 - DNA, 16 bp, Homo sapiens
gctcctgtgctttccc

SEQ ID NO: 2600038 - DNA, 23 bp, Homo sapiens
gctccttcccaggagtggaggag

SEQ ID NO: 2600039 - DNA, 13 bp, Homo sapiens
gctccttcctgtc

SEQ ID NO: 2600040 - DNA, 19 bp, Homo sapiens
gctccttcctgtcttcctg

SEQ ID NO: 2600041 - DNA, 15 bp, Homo sapiens
gctccttctgtccta

SEQ ID NO: 2600042 - DNA, 14 bp, Homo sapiens
gctccttgggaggc

SEQ ID NO: 2600043 - DNA, 11 bp, Homo sapiens
gctccttgggc

SEQ ID NO: 2600044 - DNA, 14 bp, Homo sapiens
gctccttgggccct

SEQ ID NO: 2600045 - DNA, 17 bp, Homo sapiens
gctccttgggccctttg

SEQ ID NO: 2600046 - DNA, 16 bp, Homo sapiens
gctcctttctccagcc

SEQ ID NO: 2600047 - DNA, 14 bp, Homo sapiens
gctcctttttctcc

SEQ ID NO: 2600048 - DNA, 16 bp, Homo sapiens
gctcctttttctccct

SEQ ID NO: 2600049 - DNA, 17 bp, Homo sapiens
gctcgagcatgcctgga

SEQ ID NO: 2600050 - DNA, 13 bp, Homo sapiens
gctcgccatgccg

SEQ ID NO: 2600051 - DNA, 16 bp, Homo sapiens
gctcggaggctgcccc

SEQ ID NO: 2600052 - DNA, 17 bp, Homo sapiens
gctcggaggctgccccc

SEQ ID NO: 2600053 - DNA, 18 bp, Homo sapiens
gctcggaggctgcccccg

SEQ ID NO: 2600054 - DNA, 19 bp, Homo sapiens
gctcgtgtatcctggggct

SEQ ID NO: 2600055 - DNA, 18 bp, Homo sapiens
gctctacatcttctgcct

SEQ ID NO: 2600056 - DNA, 18 bp, Homo sapiens
gctctagacaaccctgca

SEQ ID NO: 2600057 - DNA, 19 bp, Homo sapiens
gctctagacaaccctgcaa

SEQ ID NO: 2600058 - DNA, 23 bp, Homo sapiens
gctctagattgagagaagagaca

SEQ ID NO: 2600059 - DNA, 21 bp, Homo sapiens
gctctatcttgctctgtaatc

SEQ ID NO: 2600060 - DNA, 22 bp, Homo sapiens
gctctatcttgctctgtaatct

SEQ ID NO: 2600061 - DNA, 21 bp, Homo sapiens
gctctatgggcagatctaccc

SEQ ID NO: 2600062 - DNA, 20 bp, Homo sapiens
gctctccagtcaggaggcat

SEQ ID NO: 2600063 - DNA, 19 bp, Homo sapiens
gctctctcattgtctgtgt

SEQ ID NO: 2600064 - DNA, 11 bp, Homo sapiens
gctctctgctg

SEQ ID NO: 2600065 - DNA, 20 bp, Homo sapiens
gctctctgtgggctggcagt

SEQ ID NO: 2600066 - DNA, 15 bp, Homo sapiens
gctctgaaagccagc

SEQ ID NO: 2600067 - DNA, 17 bp, Homo sapiens
gctctgaaagccagctg

SEQ ID NO: 2600068 - DNA, 17 bp, Homo sapiens
gctctgacccagtgaga

SEQ ID NO: 2600069 - DNA, 21 bp, Homo sapiens
gctctgaccgaaacagcgctg

SEQ ID NO: 2600070 - DNA, 20 bp, Homo sapiens
gctctgagcaaatgtggctc

SEQ ID NO: 2600071 - DNA, 13 bp, Homo sapiens
gctctgagccagt

SEQ ID NO: 2600072 - DNA, 19 bp, Homo sapiens
gctctgaggcttccagaga

SEQ ID NO: 2600073 - DNA, 21 bp, Homo sapiens
gctctgatattccatgaatgt

SEQ ID NO: 2600074 - DNA, 22 bp, Homo sapiens
gccagttggtcccccttccatg

SEQ ID NO: 2600075 - DNA, 16 bp, Homo sapiens
gccatactttgtctga

SEQ ID NO: 2600076 - DNA, 12 bp, Homo sapiens
gccatagctcct

SEQ ID NO: 2600077 - DNA, 23 bp, Homo sapiens
gccatataagtttgaaggaaaca

SEQ ID NO: 2600078 - DNA, 23 bp, Homo sapiens
gccatcatctcctgccttcctcc

SEQ ID NO: 2600079 - DNA, 14 bp, Homo sapiens
gctgagagccccag

SEQ ID NO: 2600080 - DNA, 15 bp, Homo sapiens
gctgagagccccagc

SEQ ID NO: 2600081 - DNA, 21 bp, Homo sapiens
gctgagcccctaccccacacc

SEQ ID NO: 2600082 - DNA, 14 bp, Homo sapiens
gctgagccctggca

SEQ ID NO: 2600083 - DNA, 16 bp, Homo sapiens
gctgagccctggcagg

SEQ ID NO: 2600084 - DNA, 23 bp, Homo sapiens
gctgagcgaggagatgctccttg

SEQ ID NO: 2600085 - DNA, 21 bp, Homo sapiens
gctgaggaggcctccatctca

SEQ ID NO: 2600086 - DNA, 20 bp, Homo sapiens
gctgaggatttcaagcctgc

SEQ ID NO: 2600087 - DNA, 14 bp, Homo sapiens
gctgaggcaattct

SEQ ID NO: 2600088 - DNA, 13 bp, Homo sapiens
gctgaggcagcag

SEQ ID NO: 2600089 - DNA, 23 bp, Homo sapiens
gctgaggcagcagtgtgaggcca

SEQ ID NO: 2600090 - DNA, 15 bp, Homo sapiens
gctgaggcaggagga

SEQ ID NO: 2600091 - DNA, 22 bp, Homo sapiens
gctgaggccggatgcggtggct

SEQ ID NO: 2600092 - DNA, 15 bp, Homo sapiens
gctgagggaccagcc

SEQ ID NO: 2600093 - DNA, 16 bp, Homo sapiens
gctgagggaccagcca

SEQ ID NO: 2600094 - DNA, 23 bp, Homo sapiens
gctgagggtgagtgggtgaataa

SEQ ID NO: 2600095 - DNA, 14 bp, Homo sapiens
gctgaggtgggagg

SEQ ID NO: 2600096 - DNA, 17 bp, Homo sapiens
gctgagtaggaggcctc

SEQ ID NO: 2600097 - DNA, 22 bp, Homo sapiens
gctgagtgggggatcacagcct

SEQ ID NO: 2600098 - DNA, 18 bp, Homo sapiens
gctgatccagagcacaga

SEQ ID NO: 2600099 - DNA, 20 bp, Homo sapiens
gctgatgtcctcaccacatg

SEQ ID NO: 2600100 - DNA, 17 bp, Homo sapiens
gctgatgttcagtgtaa

SEQ ID NO: 2600101 - DNA, 18 bp, Homo sapiens
gctgatgttcagtgtaat

SEQ ID NO: 2600102 - DNA, 20 bp, Homo sapiens
gctgatgttcagtgtaattt

SEQ ID NO: 2600103 - DNA, 19 bp, Homo sapiens
gctgcaaggcctttctgtg

SEQ ID NO: 2600104 - DNA, 20 bp, Homo sapiens
gctgcacagggcagctgggc

SEQ ID NO: 2600105 - DNA, 15 bp, Homo sapiens
gctgcaccctcaggc

SEQ ID NO: 2600106 - DNA, 18 bp, Homo sapiens
gctgcaccctcaggcagg

SEQ ID NO: 2600107 - DNA, 16 bp, Homo sapiens
gctgcaccggctggcc

SEQ ID NO: 2600108 - DNA, 17 bp, Homo sapiens
gctgcaccggctggcct

SEQ ID NO: 2600109 - DNA, 22 bp, Homo sapiens
gctgcacctgccagcctggctt

SEQ ID NO: 2600110 - DNA, 17 bp, Homo sapiens
gctgcagatttgggctg

SEQ ID NO: 2600111 - DNA, 18 bp, Homo sapiens
gctgcagatttgggctgg

SEQ ID NO: 2600112 - DNA, 16 bp, Homo sapiens
gctgcagcagaggcac

SEQ ID NO: 2600113 - DNA, 20 bp, Homo sapiens
gctgcagtgacgtgcacctg

SEQ ID NO: 2600114 - DNA, 17 bp, Homo sapiens
gctgcagttgccagtca

SEQ ID NO: 2600115 - DNA, 18 bp, Homo sapiens
gctgcagttgccagtcac

SEQ ID NO: 2600116 - DNA, 21 bp, Homo sapiens
gctgcagttgccagtcacccc

SEQ ID NO: 2600117 - DNA, 19 bp, Homo sapiens
gctgcatttaaaagataca

SEQ ID NO: 2600118 - DNA, 17 bp, Homo sapiens
gctgccaaggccagagt

SEQ ID NO: 2600119 - DNA, 23 bp, Homo sapiens
gctgccaaggccagagtggcctg

SEQ ID NO: 2600120 - DNA, 16 bp, Homo sapiens
gctgccacacctgagc

SEQ ID NO: 2600121 - DNA, 12 bp, Homo sapiens
gctgccagagaa

SEQ ID NO: 2600122 - DNA, 17 bp, Homo sapiens
gctgccatccaggttca

SEQ ID NO: 2600123 - DNA, 21 bp, Homo sapiens
gctgccatccaggttcagctt

SEQ ID NO: 2600124 - DNA, 22 bp, Homo sapiens
gctgccatggcgtgtccctctc

SEQ ID NO: 2600125 - DNA, 17 bp, Homo sapiens
gctgccatgtgaagagg

SEQ ID NO: 2600126 - DNA, 12 bp, Homo sapiens
gctgcccaggcc

SEQ ID NO: 2600127 - DNA, 20 bp, Homo sapiens
gctgccccaacctgctgaag

SEQ ID NO: 2600128 - DNA, 14 bp, Homo sapiens
gctgccccagccag

SEQ ID NO: 2600129 - DNA, 18 bp, Homo sapiens
gctgcccccggccccctg

SEQ ID NO: 2600130 - DNA, 17 bp, Homo sapiens
gctgcccctggctctga

SEQ ID NO: 2600131 - DNA, 20 bp, Homo sapiens
gctgcccgtcttcagcctag

SEQ ID NO: 2600132 - DNA, 14 bp, Homo sapiens
gctgccctccatcc

SEQ ID NO: 2600133 - DNA, 15 bp, Homo sapiens
gctgccctccatccc

SEQ ID NO: 2600134 - DNA, 21 bp, Homo sapiens
gctgccctccatcccgacatg

SEQ ID NO: 2600135 - DNA, 18 bp, Homo sapiens
gctgccctgcccacctgg

SEQ ID NO: 2600136 - DNA, 20 bp, Homo sapiens
gctgccctgcccacctggcc

SEQ ID NO: 2600137 - DNA, 21 bp, Homo sapiens
gctgccctgcccacctggcct

SEQ ID NO: 2600138 - DNA, 15 bp, Homo sapiens
gctgccctgcggccc

SEQ ID NO: 2600139 - DNA, 13 bp, Homo sapiens
gctgccctggccc

SEQ ID NO: 2600140 - DNA, 23 bp, Homo sapiens
gctgccctggccctgaggtgtgg

SEQ ID NO: 2600141 - DNA, 11 bp, Homo sapiens
gctgccctgtg

SEQ ID NO: 2600142 - DNA, 16 bp, Homo sapiens
gctgccgaccagagcc

SEQ ID NO: 2600143 - DNA, 19 bp, Homo sapiens
gtgtaatcaataaacgatt

SEQ ID NO: 2600144 - DNA, 19 bp, Homo sapiens
gtgtaatcatttcttgggc

SEQ ID NO: 2600145 - DNA, 20 bp, Homo sapiens
gtgtaatttaaaattgtgat

SEQ ID NO: 2600146 - DNA, 23 bp, Homo sapiens
gtgtaatttaaaattgtgatgtg

SEQ ID NO: 2600147 - DNA, 15 bp, Homo sapiens
gtgtacacgggactg

SEQ ID NO: 2600148 - DNA, 21 bp, Homo sapiens
gtgtacacgggactgacgcaa

SEQ ID NO: 2600149 - DNA, 18 bp, Homo sapiens
gtgtacagaattctgcta

SEQ ID NO: 2600150 - DNA, 16 bp, Homo sapiens
gtgtacataactgaaa

SEQ ID NO: 2600151 - DNA, 17 bp, Homo sapiens
gtgtacatggaataaca

SEQ ID NO: 2600152 - DNA, 13 bp, Homo sapiens
gtgtagaagcatt

SEQ ID NO: 2600153 - DNA, 14 bp, Homo sapiens
gtgtagaagcattc

SEQ ID NO: 2600154 - DNA, 17 bp, Homo sapiens
gtgtagaagcattcctt

SEQ ID NO: 2600155 - DNA, 19 bp, Homo sapiens
gtgtagaagcattccttct

SEQ ID NO: 2600156 - DNA, 14 bp, Homo sapiens
gtgtagcctgtgca

SEQ ID NO: 2600157 - DNA, 20 bp, Homo sapiens
gtgtatccattatcatgtgt

SEQ ID NO: 2600158 - DNA, 22 bp, Homo sapiens
gtgtatccattatcatgtgtaa

SEQ ID NO: 2600159 - DNA, 23 bp, Homo sapiens
gtgtatccattatcatgtgtaat

SEQ ID NO: 2600160 - DNA, 15 bp, Homo sapiens
gtgtatcctggggct

SEQ ID NO: 2600161 - DNA, 16 bp, Homo sapiens
gtgtatgtgcgtgtgt

SEQ ID NO: 2600162 - DNA, 21 bp, Homo sapiens
gtgtatgtgggggtctgtgtg

SEQ ID NO: 2600163 - DNA, 13 bp, Homo sapiens
gtgtattccaaga

SEQ ID NO: 2600164 - DNA, 19 bp, Homo sapiens
gtgtatttattttcctccc

SEQ ID NO: 2600165 - DNA, 22 bp, Homo sapiens
gtgtatttattttcctccccag

SEQ ID NO: 2600166 - DNA, 14 bp, Homo sapiens
gtgtcacctgaaga

SEQ ID NO: 2600167 - DNA, 14 bp, Homo sapiens
gtgtcaggctgctg

SEQ ID NO: 2600168 - DNA, 16 bp, Homo sapiens
gtgtcaggctgctggc

SEQ ID NO: 2600169 - DNA, 19 bp, Homo sapiens
gtgtcaggctgctggcgcc

SEQ ID NO: 2600170 - DNA, 22 bp, Homo sapiens
gtgtcaggctgctggcgcctct

SEQ ID NO: 2600171 - DNA, 14 bp, Homo sapiens
gtgtcaggtggggc

SEQ ID NO: 2600172 - DNA, 18 bp, Homo sapiens
gtgtcaggtggggcagct

SEQ ID NO: 2600173 - DNA, 16 bp, Homo sapiens
gtgtccatgtgtgtgc

SEQ ID NO: 2600174 - DNA, 21 bp, Homo sapiens
gtgtcccatgacccacccctg

SEQ ID NO: 2600175 - DNA, 22 bp, Homo sapiens
gtgtcccatgacccacccctgt

SEQ ID NO: 2600176 - DNA, 14 bp, Homo sapiens
gtgtccccctctgt

SEQ ID NO: 2600177 - DNA, 13 bp, Homo sapiens
gtgtcccctccac

SEQ ID NO: 2600178 - DNA, 13 bp, Homo sapiens
gtgtccctgcact

SEQ ID NO: 2600179 - DNA, 13 bp, Homo sapiens
gtgtcctgaccac

SEQ ID NO: 2600180 - DNA, 15 bp, Homo sapiens
gtgtcgtagccaagg

SEQ ID NO: 2600181 - DNA, 14 bp, Homo sapiens
gtgtctcttggtcc

SEQ ID NO: 2600182 - DNA, 19 bp, Homo sapiens
gtgtctcttggtcctgctg

SEQ ID NO: 2600183 - DNA, 20 bp, Homo sapiens
gtgtctcttggtcctgctgc

SEQ ID NO: 2600184 - DNA, 22 bp, Homo sapiens
gtgtctgagccctcaaagtgag

SEQ ID NO: 2600185 - DNA, 21 bp, Homo sapiens
gtgtctgcacccaggggtggg

SEQ ID NO: 2600186 - DNA, 17 bp, Homo sapiens
gtgtctggattcccagg

SEQ ID NO: 2600187 - DNA, 21 bp, Homo sapiens
gtgtctgtacacgtgtcctgt

SEQ ID NO: 2600188 - DNA, 13 bp, Homo sapiens
gtgtgaaggtcct

SEQ ID NO: 2600189 - DNA, 12 bp, Homo sapiens
gtgtgaagttag

SEQ ID NO: 2600190 - DNA, 13 bp, Homo sapiens
gtgtgaagttaga

SEQ ID NO: 2600191 - DNA, 20 bp, Homo sapiens
gtgtgacatcagtggcatgg

SEQ ID NO: 2600192 - DNA, 17 bp, Homo sapiens
gtgtgactactccccca

SEQ ID NO: 2600193 - DNA, 16 bp, Homo sapiens
gtgtgaggagctgctg

SEQ ID NO: 2600194 - DNA, 19 bp, Homo sapiens
gtgtgaggagctgctggct

SEQ ID NO: 2600195 - DNA, 12 bp, Homo sapiens
gtgtgaggccag

SEQ ID NO: 2600196 - DNA, 14 bp, Homo sapiens
gtgtgaggccaggg

SEQ ID NO: 2600197 - DNA, 13 bp, Homo sapiens
gtgtgagtcacca

SEQ ID NO: 2600198 - DNA, 11 bp, Homo sapiens
gtgtgagtgtg

SEQ ID NO: 2600199 - DNA, 17 bp, Homo sapiens
gtgtgatgaactttctc

SEQ ID NO: 2600200 - DNA, 14 bp, Homo sapiens
gtgtgatttttctg

SEQ ID NO: 2600201 - DNA, 20 bp, Homo sapiens
gtgtgcacaaatatttattt

SEQ ID NO: 2600202 - DNA, 22 bp, Homo sapiens
gtgtgcacacacaccacacata

SEQ ID NO: 2600203 - DNA, 22 bp, Homo sapiens
gtgtgcaccttaccaactttct

SEQ ID NO: 2600204 - DNA, 15 bp, Homo sapiens
gtgtgcatattgtac

SEQ ID NO: 2600205 - DNA, 16 bp, Homo sapiens
gtgtgcatattgtaca

SEQ ID NO: 2600206 - DNA, 14 bp, Homo sapiens
gtgtgcctgcagcc

SEQ ID NO: 2600207 - DNA, 15 bp, Homo sapiens
gtgtgcctgcagccc

SEQ ID NO: 2600208 - DNA, 12 bp, Homo sapiens
gtgtgctctgat

SEQ ID NO: 2600209 - DNA, 15 bp, Homo sapiens
gtgtgctctgatcat

SEQ ID NO: 2600210 - DNA, 20 bp, Homo sapiens
gtgtggaaattaagaagaaa

SEQ ID NO: 2600211 - DNA, 13 bp, Homo sapiens
gtgtggagaagcg

SEQ ID NO: 2600212 - DNA, 20 bp, Homo sapiens
gtgtggctgaggaggcctcc

SEQ ID NO: 2600213 - DNA, 14 bp, Homo sapiens
gtgtgggtctgtgt

SEQ ID NO: 2600214 - DNA, 21 bp, Homo sapiens
gtgtggtttggtgtgttcccg

SEQ ID NO: 2600215 - DNA, 16 bp, Homo sapiens
gtgtgtagagttaaga

SEQ ID NO: 2600216 - DNA, 17 bp, Homo sapiens
gtgtgtagagttaagaa

SEQ ID NO: 2600217 - DNA, 17 bp, Homo sapiens
gtgtgtccccctctgtc

SEQ ID NO: 2600218 - DNA, 11 bp, Homo sapiens
gtgtgtccttg

SEQ ID NO: 2600219 - DNA, 12 bp, Homo sapiens
gtgtgtccttgt

SEQ ID NO: 2600220 - DNA, 15 bp, Homo sapiens
gtgtgtctgttcact

SEQ ID NO: 2600221 - DNA, 14 bp, Homo sapiens
gtgtgtcttaatta

SEQ ID NO: 2600222 - DNA, 10 bp, Homo sapiens
gtgtgtgcgt

SEQ ID NO: 2600223 - DNA, 9 bp, Homo sapiens
gtgtgtgtg

SEQ ID NO: 2600224 - DNA, 14 bp, Homo sapiens
gtgtgtgtgcgtgt

SEQ ID NO: 2600225 - DNA, 14 bp, Homo sapiens
gtgtgttatttaaa

SEQ ID NO: 2600226 - DNA, 18 bp, Homo sapiens
gtgtgttccaactgcccc

SEQ ID NO: 2600227 - DNA, 16 bp, Homo sapiens
gtgtgttgtcttgaaa

SEQ ID NO: 2600228 - DNA, 14 bp, Homo sapiens
gtgtgtttatgtgt

SEQ ID NO: 2600229 - DNA, 18 bp, Homo sapiens
gtgtgttttcataataaa

SEQ ID NO: 2600230 - DNA, 12 bp, Homo sapiens
gtgttactaagt

SEQ ID NO: 2600231 - DNA, 23 bp, Homo sapiens
gtgttagggaagggcctgccaca

SEQ ID NO: 2600232 - DNA, 19 bp, Homo sapiens
gtgttccccttccactgag

SEQ ID NO: 2600233 - DNA, 23 bp, Homo sapiens
gtgttccccttccactgagggca

SEQ ID NO: 2600234 - DNA, 15 bp, Homo sapiens
gtgttcctggcaata

SEQ ID NO: 2600235 - DNA, 16 bp, Homo sapiens
gtgttctccttttcct

SEQ ID NO: 2600236 - DNA, 14 bp, Homo sapiens
gtgttctctcttat

SEQ ID NO: 2600237 - DNA, 16 bp, Homo sapiens
gtgttgtcttgaaaga

SEQ ID NO: 2600238 - DNA, 20 bp, Homo sapiens
gtgttgtgatagctaacatt

SEQ ID NO: 2600239 - DNA, 16 bp, Homo sapiens
gtgtttatttttcata

SEQ ID NO: 2600240 - DNA, 23 bp, Homo sapiens
gtgtttcctggcactgcttccag

SEQ ID NO: 2600241 - DNA, 19 bp, Homo sapiens
gtgtttctagcactggcct

SEQ ID NO: 2600242 - DNA, 13 bp, Homo sapiens
gtgtttctgtgca

SEQ ID NO: 2600243 - DNA, 12 bp, Homo sapiens
gtgtttgtgtga

SEQ ID NO: 2600244 - DNA, 13 bp, Homo sapiens
gtgttttaattta

SEQ ID NO: 2600245 - DNA, 15 bp, Homo sapiens
gtgttttaatttaaa

SEQ ID NO: 2600246 - DNA, 15 bp, Homo sapiens
gtgtttttgaaatat

SEQ ID NO: 2600247 - DNA, 16 bp, Homo sapiens
gttaaaagatgaaaat

SEQ ID NO: 2600248 - DNA, 20 bp, Homo sapiens
gttaaaagatgaaaatattt

SEQ ID NO: 2600249 - DNA, 15 bp, Homo sapiens
gttaaaattccatcc

SEQ ID NO: 2600250 - DNA, 19 bp, Homo sapiens
gttaaacttacttagtgtt

SEQ ID NO: 2600251 - DNA, 19 bp, Homo sapiens
gttaaatagagtatatgca

SEQ ID NO: 2600252 - DNA, 20 bp, Homo sapiens
gttaaatagagtatatgcac

SEQ ID NO: 2600253 - DNA, 22 bp, Homo sapiens
gttaaatatttacatatgaaat

SEQ ID NO: 2600254 - DNA, 20 bp, Homo sapiens
gttaaatgaaattgtaaaac

SEQ ID NO: 2600255 - DNA, 17 bp, Homo sapiens
gttaaatttctggacct

SEQ ID NO: 2600256 - DNA, 13 bp, Homo sapiens
gttaacacatttt

SEQ ID NO: 2600257 - DNA, 23 bp, Homo sapiens
gttaacagagacagataactctc

SEQ ID NO: 2600258 - DNA, 19 bp, Homo sapiens
gttaagaagctgttgtaca

SEQ ID NO: 2600259 - DNA, 21 bp, Homo sapiens
gttaaggaaactcttatctca

SEQ ID NO: 2600260 - DNA, 22 bp, Homo sapiens
gttaagggaaggaactctggct

SEQ ID NO: 2600261 - DNA, 15 bp, Homo sapiens
gttaagtctgtttta

SEQ ID NO: 2600262 - DNA, 22 bp, Homo sapiens
gttaagttacttcactttaatt

SEQ ID NO: 2600263 - DNA, 14 bp, Homo sapiens
gttaatcaatttaa

SEQ ID NO: 2600264 - DNA, 22 bp, Homo sapiens
gttaatgatggttgatgggttc

SEQ ID NO: 2600265 - DNA, 18 bp, Homo sapiens
gttaattcagcactgatt

SEQ ID NO: 2600266 - DNA, 21 bp, Homo sapiens
gttaattcagcactgatttca

SEQ ID NO: 2600267 - DNA, 14 bp, Homo sapiens
gttacaacagattt

SEQ ID NO: 2600268 - DNA, 22 bp, Homo sapiens
gttacaacagatttgtgaactc

SEQ ID NO: 2600269 - DNA, 23 bp, Homo sapiens
gttacaacagatttgtgaactca

SEQ ID NO: 2600270 - DNA, 18 bp, Homo sapiens
gttacaatcattgctgaa

SEQ ID NO: 2600271 - DNA, 15 bp, Homo sapiens
gttacactaaaaggt

SEQ ID NO: 2600272 - DNA, 16 bp, Homo sapiens
gttacactaaaaggtg

SEQ ID NO: 2600273 - DNA, 12 bp, Homo sapiens
gttacagaaagt

SEQ ID NO: 2600274 - DNA, 22 bp, Homo sapiens
gttacagaaagtggtgctcagt

SEQ ID NO: 2600275 - DNA, 19 bp, Homo sapiens
gttacataagataaatgtg

SEQ ID NO: 2600276 - DNA, 15 bp, Homo sapiens
gttaccatgtcactg

SEQ ID NO: 2600277 - DNA, 23 bp, Homo sapiens
gttaccattttggggtacccact

SEQ ID NO: 2600278 - DNA, 17 bp, Homo sapiens
gttaccctcctgtaaat

SEQ ID NO: 2600279 - DNA, 17 bp, Homo sapiens
gttacctcctataaact

SEQ ID NO: 2600280 - DNA, 22 bp, Homo sapiens
gttacctgaaaacactgtgcac

SEQ ID NO: 2600281 - DNA, 23 bp, Homo sapiens
gttactaattggcctctttaaga

SEQ ID NO: 2600282 - DNA, 14 bp, Homo sapiens
gttactatctgctt

SEQ ID NO: 2600283 - DNA, 16 bp, Homo sapiens
gttactccagtgccaa

SEQ ID NO: 2600284 - DNA, 11 bp, Homo sapiens
gttactctgaa

SEQ ID NO: 2600285 - DNA, 17 bp, Homo sapiens
gttactgatcatgcatt

SEQ ID NO: 2600286 - DNA, 19 bp, Homo sapiens
gttactgatcatgcattgt

SEQ ID NO: 2600287 - DNA, 16 bp, Homo sapiens
gttactgttatagagg

SEQ ID NO: 2600288 - DNA, 16 bp, Homo sapiens
gttactgttgtgacct

SEQ ID NO: 2600289 - DNA, 17 bp, Homo sapiens
gttacttacctaaacag

SEQ ID NO: 2600290 - DNA, 19 bp, Homo sapiens
gttagaaatgcagaatcct

SEQ ID NO: 2600291 - DNA, 19 bp, Homo sapiens
gttagaggttccctttgac

SEQ ID NO: 2600292 - DNA, 21 bp, Homo sapiens
gttagattttgtattcagggg

SEQ ID NO: 2600293 - DNA, 11 bp, Homo sapiens
gttagctgagc

SEQ ID NO: 2600294 - DNA, 14 bp, Homo sapiens
gttaggaaataaaa

SEQ ID NO: 2600295 - DNA, 13 bp, Homo sapiens
gtgattctgcctt

SEQ ID NO: 2600296 - DNA, 20 bp, Homo sapiens
gtgattgggaataaatatgc

SEQ ID NO: 2600297 - DNA, 18 bp, Homo sapiens
gtgatttaatagtgttaa

SEQ ID NO: 2600298 - DNA, 19 bp, Homo sapiens
gtgatttaatagtgttaat

SEQ ID NO: 2600299 - DNA, 14 bp, Homo sapiens
gtgatttgactgtt

SEQ ID NO: 2600300 - DNA, 21 bp, Homo sapiens
gtgatttgactgtttttaccc

SEQ ID NO: 2600301 - DNA, 14 bp, Homo sapiens
gtgattttaactct

SEQ ID NO: 2600302 - DNA, 19 bp, Homo sapiens
gtgcaaatgtcagatacaa

SEQ ID NO: 2600303 - DNA, 23 bp, Homo sapiens
gtgcaaatgtcagatacaatgta

SEQ ID NO: 2600304 - DNA, 20 bp, Homo sapiens
gtgcaacagcactggctctc

SEQ ID NO: 2600305 - DNA, 13 bp, Homo sapiens
gtgcaacccaagg

SEQ ID NO: 2600306 - DNA, 23 bp, Homo sapiens
gtgcaacccttaccccttagcct

SEQ ID NO: 2600307 - DNA, 18 bp, Homo sapiens
gtgcaagagactctggcc

SEQ ID NO: 2600308 - DNA, 15 bp, Homo sapiens
gtgcaagcccctgct

SEQ ID NO: 2600309 - DNA, 22 bp, Homo sapiens
gtgcaagtgtatgcacgtgtgc

SEQ ID NO: 2600310 - DNA, 18 bp, Homo sapiens
gtgcaagtgtctgtgtgc

SEQ ID NO: 2600311 - DNA, 22 bp, Homo sapiens
gtgcaattgtaggggtgtgtgt

SEQ ID NO: 2600312 - DNA, 13 bp, Homo sapiens
gtgcacaagctcc

SEQ ID NO: 2600313 - DNA, 23 bp, Homo sapiens
gtgcacaagctccaagctcccag

SEQ ID NO: 2600314 - DNA, 21 bp, Homo sapiens
gtgcacatgcacgtgtgtgca

SEQ ID NO: 2600315 - DNA, 18 bp, Homo sapiens
gtgcacgcagtggccttc

SEQ ID NO: 2600316 - DNA, 18 bp, Homo sapiens
gtgcacgtggcatgtggc

SEQ ID NO: 2600317 - DNA, 18 bp, Homo sapiens
gtgcagagtgcccagaac

SEQ ID NO: 2600318 - DNA, 17 bp, Homo sapiens
gtgcagatgaggttgct

SEQ ID NO: 2600319 - DNA, 18 bp, Homo sapiens
gtgcagccgctgagcgag

SEQ ID NO: 2600320 - DNA, 21 bp, Homo sapiens
gtgcagcctgtcctgggctgg

SEQ ID NO: 2600321 - DNA, 16 bp, Homo sapiens
gtgcagctgattttaa

SEQ ID NO: 2600322 - DNA, 16 bp, Homo sapiens
gtgcagcttctgtcct

SEQ ID NO: 2600323 - DNA, 15 bp, Homo sapiens
gtgcaggctggcacc

SEQ ID NO: 2600324 - DNA, 15 bp, Homo sapiens
gtgcaggtggggaga

SEQ ID NO: 2600325 - DNA, 16 bp, Homo sapiens
gtgcagtcctgatcag

SEQ ID NO: 2600326 - DNA, 20 bp, Homo sapiens
gtgcagtggtgcgatctggg

SEQ ID NO: 2600327 - DNA, 19 bp, Homo sapiens
gtgcagttctagtttgcat

SEQ ID NO: 2600328 - DNA, 15 bp, Homo sapiens
gtgcagttgacagca

SEQ ID NO: 2600329 - DNA, 16 bp, Homo sapiens
gtgcatattcctttct

SEQ ID NO: 2600330 - DNA, 18 bp, Homo sapiens
gtgcatccgggggcagct

SEQ ID NO: 2600331 - DNA, 14 bp, Homo sapiens
gtgcatggtggcac

SEQ ID NO: 2600332 - DNA, 16 bp, Homo sapiens
gtgcatgtatgtcttg

SEQ ID NO: 2600333 - DNA, 23 bp, Homo sapiens
gtgcatgtatgtcttggacactg

SEQ ID NO: 2600334 - DNA, 13 bp, Homo sapiens
gtgcatgtgtgtg

SEQ ID NO: 2600335 - DNA, 14 bp, Homo sapiens
gtgcattacagaga

SEQ ID NO: 2600336 - DNA, 23 bp, Homo sapiens
gtgcattatctagatactgtatc

SEQ ID NO: 2600337 - DNA, 20 bp, Homo sapiens
gtgcattggaagaccccacc

SEQ ID NO: 2600338 - DNA, 15 bp, Homo sapiens
gtctgttttatgact

SEQ ID NO: 2600339 - DNA, 14 bp, Homo sapiens
gtcttaattaaaag

SEQ ID NO: 2600340 - DNA, 21 bp, Homo sapiens
gtcttaattaaaagaatattt

SEQ ID NO: 2600341 - DNA, 19 bp, Homo sapiens
gtcttaattattatttgtg

SEQ ID NO: 2600342 - DNA, 23 bp, Homo sapiens
gtcttagacttgaaatactactt

SEQ ID NO: 2600343 - DNA, 15 bp, Homo sapiens
gtcttatcaagcagc

SEQ ID NO: 2600344 - DNA, 15 bp, Homo sapiens
gtcttcacggcagga

SEQ ID NO: 2600345 - DNA, 23 bp, Homo sapiens
gtcttcagcctagccgacctcag

SEQ ID NO: 2600346 - DNA, 16 bp, Homo sapiens
gtcttcagtaagccgt

SEQ ID NO: 2600347 - DNA, 23 bp, Homo sapiens
gtcttcatacctacatgtatttg

SEQ ID NO: 2600348 - DNA, 17 bp, Homo sapiens
gtcttcatttcattgta

SEQ ID NO: 2600349 - DNA, 12 bp, Homo sapiens
gtcttcccaggg

SEQ ID NO: 2600350 - DNA, 15 bp, Homo sapiens
gtcttcccagggtag

SEQ ID NO: 2600351 - DNA, 15 bp, Homo sapiens
gtcttccctacctca

SEQ ID NO: 2600352 - DNA, 16 bp, Homo sapiens
gtcttccctacctcag

SEQ ID NO: 2600353 - DNA, 18 bp, Homo sapiens
gtcttccctacctcaggc

SEQ ID NO: 2600354 - DNA, 18 bp, Homo sapiens
gtcttcctgacactttaa

SEQ ID NO: 2600355 - DNA, 20 bp, Homo sapiens
gtcttcctgcattcacccag

SEQ ID NO: 2600356 - DNA, 15 bp, Homo sapiens
gtcttctgcctgtta

SEQ ID NO: 2600357 - DNA, 16 bp, Homo sapiens
gtcttcttacatgcat

SEQ ID NO: 2600358 - DNA, 17 bp, Homo sapiens
gtcttgaactcctggcc

SEQ ID NO: 2600359 - DNA, 18 bp, Homo sapiens
gtcttgaactcctggcct

SEQ ID NO: 2600360 - DNA, 20 bp, Homo sapiens
gtcttgaactcctggcctca

SEQ ID NO: 2600361 - DNA, 17 bp, Homo sapiens
gtcttgaatgtcttttg

SEQ ID NO: 2600362 - DNA, 20 bp, Homo sapiens
gtcttgcaatggcagccttg

SEQ ID NO: 2600363 - DNA, 15 bp, Homo sapiens
gtcttggacactgta

SEQ ID NO: 2600364 - DNA, 16 bp, Homo sapiens
gtcttggcggcagcag

SEQ ID NO: 2600365 - DNA, 23 bp, Homo sapiens
gtcttggcggcagcagccatcat

SEQ ID NO: 2600366 - DNA, 21 bp, Homo sapiens
gtcttgggaaatatgaatgcc

SEQ ID NO: 2600367 - DNA, 20 bp, Homo sapiens
gtcttgttaagtgcagtctg

SEQ ID NO: 2600368 - DNA, 16 bp, Homo sapiens
gtctttcacagctcct

SEQ ID NO: 2600369 - DNA, 14 bp, Homo sapiens
gtctttggaccctg

SEQ ID NO: 2600370 - DNA, 18 bp, Homo sapiens
gtctttggaccctgaggc

SEQ ID NO: 2600371 - DNA, 22 bp, Homo sapiens
gtctttgggtacctattttcat

SEQ ID NO: 2600372 - DNA, 15 bp, Homo sapiens
gtctttggttcagct

SEQ ID NO: 2600373 - DNA, 14 bp, Homo sapiens
gtcttttcatctgg

SEQ ID NO: 2600374 - DNA, 16 bp, Homo sapiens
gtcttttgacatgtgg

SEQ ID NO: 2600375 - DNA, 19 bp, Homo sapiens
gtcttttgacatgtggaaa

SEQ ID NO: 2600376 - DNA, 23 bp, Homo sapiens
gtgaaaagaaaaatgagcctggc

SEQ ID NO: 2600377 - DNA, 15 bp, Homo sapiens
gtgaaaatggtccag

SEQ ID NO: 2600378 - DNA, 17 bp, Homo sapiens
gtgaaacacaccaggct

SEQ ID NO: 2600379 - DNA, 12 bp, Homo sapiens
gtgaaaccctgt

SEQ ID NO: 2600380 - DNA, 19 bp, Homo sapiens
gtgaaacctttagggcagc

SEQ ID NO: 2600381 - DNA, 23 bp, Homo sapiens
gtgaaactgcttgtttcctagca

SEQ ID NO: 2600382 - DNA, 16 bp, Homo sapiens
gtgaaacttcctaagt

SEQ ID NO: 2600383 - DNA, 21 bp, Homo sapiens
gtgaaagtcagatgcccagag

SEQ ID NO: 2600384 - DNA, 18 bp, Homo sapiens
gtgaacaaaagatgctct

SEQ ID NO: 2600385 - DNA, 19 bp, Homo sapiens
gtgaacaaaagatgctctt

SEQ ID NO: 2600386 - DNA, 16 bp, Homo sapiens
gtgaacgatttagaaa

SEQ ID NO: 2600387 - DNA, 21 bp, Homo sapiens
gtgaactcagccaagcacagt

SEQ ID NO: 2600388 - DNA, 22 bp, Homo sapiens
gtgaactcagccaagcacagtg

SEQ ID NO: 2600389 - DNA, 23 bp, Homo sapiens
gtgaactcagccaagcacagtgg

SEQ ID NO: 2600390 - DNA, 12 bp, Homo sapiens
ggtcagagcctg

SEQ ID NO: 2600391 - DNA, 21 bp, Homo sapiens
ggtcagcatgtctattcagct

SEQ ID NO: 2600392 - DNA, 18 bp, Homo sapiens
ggtcagccagggccaggg

SEQ ID NO: 2600393 - DNA, 16 bp, Homo sapiens
ggtcagcgttgcatgt

SEQ ID NO: 2600394 - DNA, 21 bp, Homo sapiens
ggtcaggagttagaggccagc

SEQ ID NO: 2600395 - DNA, 22 bp, Homo sapiens
ggtcaggagttagaggccagcc

SEQ ID NO: 2600396 - DNA, 21 bp, Homo sapiens
ggtcaggagttcctaaccagc

SEQ ID NO: 2600397 - DNA, 13 bp, Homo sapiens
ggtcaggctccat

SEQ ID NO: 2600398 - DNA, 11 bp, Homo sapiens
ggtccaaataa

SEQ ID NO: 2600399 - DNA, 15 bp, Homo sapiens
ggtccaaataaaaac

SEQ ID NO: 2600400 - DNA, 17 bp, Homo sapiens
ggtccaaataaaaacta

SEQ ID NO: 2600401 - DNA, 20 bp, Homo sapiens
ggtccacaggaagtgaagaa

SEQ ID NO: 2600402 - DNA, 16 bp, Homo sapiens
ggtccacccagcaaag

SEQ ID NO: 2600403 - DNA, 12 bp, Homo sapiens
ggtccacccagg

SEQ ID NO: 2600404 - DNA, 13 bp, Homo sapiens
ggtccacccagga

SEQ ID NO: 2600405 - DNA, 20 bp, Homo sapiens
ggtccacccaggagccccga

SEQ ID NO: 2600406 - DNA, 21 bp, Homo sapiens
ggtccagccctggctgaagga

SEQ ID NO: 2600407 - DNA, 22 bp, Homo sapiens
ggtccagccctggctgaaggac

SEQ ID NO: 2600408 - DNA, 11 bp, Homo sapiens
ggtccagggaa

SEQ ID NO: 2600409 - DNA, 16 bp, Homo sapiens
ggtccagggagcaggc

SEQ ID NO: 2600410 - DNA, 15 bp, Homo sapiens
ggtccaggggcccct

SEQ ID NO: 2600411 - DNA, 23 bp, Homo sapiens
ggtccaggggcccctccagcttg

SEQ ID NO: 2600412 - DNA, 13 bp, Homo sapiens
ggtccagggttga

SEQ ID NO: 2600413 - DNA, 21 bp, Homo sapiens
ggtccagggttgatcacactc

SEQ ID NO: 2600414 - DNA, 15 bp, Homo sapiens
ggtccatagagagca

SEQ ID NO: 2600415 - DNA, 17 bp, Homo sapiens
ggtccatggaatgcttg

SEQ ID NO: 2600416 - DNA, 17 bp, Homo sapiens
ggtccatgggcagagcc

SEQ ID NO: 2600417 - DNA, 12 bp, Homo sapiens
ggtcccaacagg

SEQ ID NO: 2600418 - DNA, 23 bp, Homo sapiens
ggtcccaacaggaggacaattca

SEQ ID NO: 2600419 - DNA, 13 bp, Homo sapiens
ggtcccacactgg

SEQ ID NO: 2600420 - DNA, 12 bp, Homo sapiens
ggtcccacccca

SEQ ID NO: 2600421 - DNA, 16 bp, Homo sapiens
ggtcccaccccacaca

SEQ ID NO: 2600422 - DNA, 22 bp, Homo sapiens
ggtcccaccccacacacgccag

SEQ ID NO: 2600423 - DNA, 22 bp, Homo sapiens
ggtcccactcagtccatagcag

SEQ ID NO: 2600424 - DNA, 20 bp, Homo sapiens
ggtcccagtgggaggggcag

SEQ ID NO: 2600425 - DNA, 23 bp, Homo sapiens
ggtcccagtgggaggggcaggct

SEQ ID NO: 2600426 - DNA, 17 bp, Homo sapiens
ggtcccatttctcactg

SEQ ID NO: 2600427 - DNA, 16 bp, Homo sapiens
ggtccccatcatccca

SEQ ID NO: 2600428 - DNA, 20 bp, Homo sapiens
ggtccctgataacaacctgg

SEQ ID NO: 2600429 - DNA, 18 bp, Homo sapiens
ggtccctgctgtgttccc

SEQ ID NO: 2600430 - DNA, 14 bp, Homo sapiens
ggtccctggtggca

SEQ ID NO: 2600431 - DNA, 17 bp, Homo sapiens
ggtccggacactcctag

SEQ ID NO: 2600432 - DNA, 14 bp, Homo sapiens
ggtcctcagagaat

SEQ ID NO: 2600433 - DNA, 12 bp, Homo sapiens
ggtcctgctgca

SEQ ID NO: 2600434 - DNA, 14 bp, Homo sapiens
ggtcctgctgcagt

SEQ ID NO: 2600435 - DNA, 23 bp, Homo sapiens
ggtcctgctgcagttgccagtca

SEQ ID NO: 2600436 - DNA, 15 bp, Homo sapiens
ggtcctggggctctg

SEQ ID NO: 2600437 - DNA, 21 bp, Homo sapiens
ggtcctgtggcaggcagcgcc

SEQ ID NO: 2600438 - DNA, 16 bp, Homo sapiens
ggtccttccaggcccc

SEQ ID NO: 2600439 - DNA, 20 bp, Homo sapiens
ggtcgaccccaaagcccctt

SEQ ID NO: 2600440 - DNA, 13 bp, Homo sapiens
ggtcgcccaggag

SEQ ID NO: 2600441 - DNA, 14 bp, Homo sapiens
ggtcggaccagctt

SEQ ID NO: 2600442 - DNA, 18 bp, Homo sapiens
ggtctaaagtgagctcta

SEQ ID NO: 2600443 - DNA, 21 bp, Homo sapiens
ggtctcacagtgttgcccagg

SEQ ID NO: 2600444 - DNA, 21 bp, Homo sapiens
ggtctcactatgttgcccagg

SEQ ID NO: 2600445 - DNA, 12 bp, Homo sapiens
ggtctcactctg

SEQ ID NO: 2600446 - DNA, 19 bp, Homo sapiens
ggtctcctcactcccttct

SEQ ID NO: 2600447 - DNA, 21 bp, Homo sapiens
ggtctcgctttgttgcccagg

SEQ ID NO: 2600448 - DNA, 19 bp, Homo sapiens
ggtctctgccggctctttc

SEQ ID NO: 2600449 - DNA, 13 bp, Homo sapiens
ggtctctgctgcc

SEQ ID NO: 2600450 - DNA, 14 bp, Homo sapiens
ggtctctgctgccg

SEQ ID NO: 2600451 - DNA, 21 bp, Homo sapiens
ggtctcttgagggagcttagc

SEQ ID NO: 2600452 - DNA, 14 bp, Homo sapiens
ggtctgaatgttct

SEQ ID NO: 2600453 - DNA, 22 bp, Homo sapiens
ggtctgaatgttctgacattaa

SEQ ID NO: 2600454 - DNA, 14 bp, Homo sapiens
ggtctgacccactg

SEQ ID NO: 2600455 - DNA, 17 bp, Homo sapiens
ggtctgcaagtcagagg

SEQ ID NO: 2600456 - DNA, 19 bp, Homo sapiens
ggtctgcaagtcagaggat

SEQ ID NO: 2600457 - DNA, 15 bp, Homo sapiens
ggtctggctgagctg

SEQ ID NO: 2600458 - DNA, 17 bp, Homo sapiens
ggtctgggacttccttg

SEQ ID NO: 2600459 - DNA, 21 bp, Homo sapiens
ggtctgtgtgtgtgtatgtgg

SEQ ID NO: 2600460 - DNA, 18 bp, Homo sapiens
ggtctgttcttgaagcag

SEQ ID NO: 2600461 - DNA, 13 bp, Homo sapiens
ggtcttcccaggc

SEQ ID NO: 2600462 - DNA, 22 bp, Homo sapiens
ggtcttgaactcctggcctcaa

SEQ ID NO: 2600463 - DNA, 21 bp, Homo sapiens
ggtctttcatggggtgatgct

SEQ ID NO: 2600464 - DNA, 12 bp, Homo sapiens
ggtctttgtaag

SEQ ID NO: 2600465 - DNA, 19 bp, Homo sapiens
ggtctttgtaagagtgtag

SEQ ID NO: 2600466 - DNA, 20 bp, Homo sapiens
ggtctttgtaagagtgtaga

SEQ ID NO: 2600467 - DNA, 16 bp, Homo sapiens
ggtcttttcatctggg

SEQ ID NO: 2600468 - DNA, 19 bp, Homo sapiens
ggtcttttcatctgggaaa

SEQ ID NO: 2600469 - DNA, 20 bp, Homo sapiens
ggtcttttcatctgggaaag

SEQ ID NO: 2600470 - DNA, 23 bp, Homo sapiens
ggtgaaatttattagttaatata

SEQ ID NO: 2600471 - DNA, 18 bp, Homo sapiens
ggtgaagggagagccagc

SEQ ID NO: 2600472 - DNA, 18 bp, Homo sapiens
ggtgacaagatagagagc

SEQ ID NO: 2600473 - DNA, 12 bp, Homo sapiens
ggtgacagtggc

SEQ ID NO: 2600474 - DNA, 14 bp, Homo sapiens
ggtgacatgtgaaa

SEQ ID NO: 2600475 - DNA, 15 bp, Homo sapiens
ggtgacatgtgaaac

SEQ ID NO: 2600476 - DNA, 21 bp, Homo sapiens
ggtgaccaaaatccccttctc

SEQ ID NO: 2600477 - DNA, 16 bp, Homo sapiens
ggtgacctctgcctga

SEQ ID NO: 2600478 - DNA, 21 bp, Homo sapiens
ggtgacctctgcctgaagtca

SEQ ID NO: 2600479 - DNA, 15 bp, Homo sapiens
ggtgagaagcagagg

SEQ ID NO: 2600480 - DNA, 19 bp, Homo sapiens
ggtgagcagaagtggagct

SEQ ID NO: 2600481 - DNA, 15 bp, Homo sapiens
ggtgaggaccactcc

SEQ ID NO: 2600482 - DNA, 18 bp, Homo sapiens
ggtgaggaccactcctgt

SEQ ID NO: 2600483 - DNA, 12 bp, Homo sapiens
ggtgagggatgt

SEQ ID NO: 2600484 - DNA, 17 bp, Homo sapiens
ggtgagtcttggcggca

SEQ ID NO: 2600485 - DNA, 23 bp, Homo sapiens
ggtgagtcttggcggcagcagcc

SEQ ID NO: 2600486 - DNA, 13 bp, Homo sapiens
ggtgatgccaggt

SEQ ID NO: 2600487 - DNA, 12 bp, Homo sapiens
ggtgcaaatcct

SEQ ID NO: 2600488 - DNA, 16 bp, Homo sapiens
ggtgcaacccttaccc

SEQ ID NO: 2600489 - DNA, 16 bp, Homo sapiens
ggtgcacaagctccaa

SEQ ID NO: 2600490 - DNA, 22 bp, Homo sapiens
ggtgcacaagctccaagctccc

SEQ ID NO: 2600491 - DNA, 15 bp, Homo sapiens
ggtgcacagtgattt

SEQ ID NO: 2600492 - DNA, 23 bp, Homo sapiens
ggtgccaatttcaagttccaagt

SEQ ID NO: 2600493 - DNA, 14 bp, Homo sapiens
ggtgccagcaactg

SEQ ID NO: 2600494 - DNA, 14 bp, Homo sapiens
ggtgccagccttcc

SEQ ID NO: 2600495 - DNA, 23 bp, Homo sapiens
ggtgcccagaataagttattgca

SEQ ID NO: 2600496 - DNA, 22 bp, Homo sapiens
ggtgccccccttgccagacatg

SEQ ID NO: 2600497 - DNA, 12 bp, Homo sapiens
ggtgccccctcc

SEQ ID NO: 2600498 - DNA, 19 bp, Homo sapiens
ggtgccccctcctctccca

SEQ ID NO: 2600499 - DNA, 23 bp, Homo sapiens
ggtgccccctcctctcccatccc

SEQ ID NO: 2600500 - DNA, 21 bp, Homo sapiens
gtaaaatattttgaatcaata

SEQ ID NO: 2600501 - DNA, 20 bp, Homo sapiens
gtaaacagatggcactttga

SEQ ID NO: 2600502 - DNA, 14 bp, Homo sapiens
gtaaacatgtgttt

SEQ ID NO: 2600503 - DNA, 15 bp, Homo sapiens
gtaaactatttatct

SEQ ID NO: 2600504 - DNA, 16 bp, Homo sapiens
gtaaactatttatctg

SEQ ID NO: 2600505 - DNA, 20 bp, Homo sapiens
gtaaactgtgtattccaaga

SEQ ID NO: 2600506 - DNA, 15 bp, Homo sapiens
gtaaagaaagagaga

SEQ ID NO: 2600507 - DNA, 16 bp, Homo sapiens
gtaaagaaagagagaa

SEQ ID NO: 2600508 - DNA, 21 bp, Homo sapiens
gtaaagaaagagagaaaataa

SEQ ID NO: 2600509 - DNA, 23 bp, Homo sapiens
gtaaagaaagagagaaaataaaa

SEQ ID NO: 2600510 - DNA, 14 bp, Homo sapiens
gtaaagactggctt

SEQ ID NO: 2600511 - DNA, 19 bp, Homo sapiens
gtaaagactggcttttatt

SEQ ID NO: 2600512 - DNA, 22 bp, Homo sapiens
gtaaagatatttttatctttat

SEQ ID NO: 2600513 - DNA, 16 bp, Homo sapiens
gtaaagcattccaaca

SEQ ID NO: 2600514 - DNA, 16 bp, Homo sapiens
gtaaagtatgtaaaca

SEQ ID NO: 2600515 - DNA, 18 bp, Homo sapiens
gtaaagtgataatttctg

SEQ ID NO: 2600516 - DNA, 18 bp, Homo sapiens
gtaaagttagtctactct

SEQ ID NO: 2600517 - DNA, 14 bp, Homo sapiens
gtaaatattctata

SEQ ID NO: 2600518 - DNA, 11 bp, Homo sapiens
gtaaatattta

SEQ ID NO: 2600519 - DNA, 16 bp, Homo sapiens
gtaaatcctttttctt

SEQ ID NO: 2600520 - DNA, 22 bp, Homo sapiens
gtaaatggcttatccagctggt

SEQ ID NO: 2600521 - DNA, 19 bp, Homo sapiens
gtaaatgggggtgcatttg

SEQ ID NO: 2600522 - DNA, 17 bp, Homo sapiens
gtaaattaacttttata

SEQ ID NO: 2600523 - DNA, 18 bp, Homo sapiens
gtaaatttccccaacagt

SEQ ID NO: 2600524 - DNA, 19 bp, Homo sapiens
gtaaatttccccaacagtg

SEQ ID NO: 2600525 - DNA, 21 bp, Homo sapiens
gtaaatttccccaacagtgtg

SEQ ID NO: 2600526 - DNA, 16 bp, Homo sapiens
gtaacagaaagggcaa

SEQ ID NO: 2600527 - DNA, 21 bp, Homo sapiens
gtaacagaaagggcaacaata

SEQ ID NO: 2600528 - DNA, 21 bp, Homo sapiens
gtaacagaacagcttcaggtt

SEQ ID NO: 2600529 - DNA, 19 bp, Homo sapiens
gtaacaggaaaattttaaa

SEQ ID NO: 2600530 - DNA, 16 bp, Homo sapiens
gtaacaggtctcctct

SEQ ID NO: 2600531 - DNA, 17 bp, Homo sapiens
gtaacagttcatgtttg

SEQ ID NO: 2600532 - DNA, 20 bp, Homo sapiens
gtaacagttcatgtttgctt

SEQ ID NO: 2600533 - DNA, 13 bp, Homo sapiens
gtaacatcctttc

SEQ ID NO: 2600534 - DNA, 17 bp, Homo sapiens
gtaacatcctttctatt

SEQ ID NO: 2600535 - DNA, 23 bp, Homo sapiens
gtaacattgggtcctgggtcttt

SEQ ID NO: 2600536 - DNA, 11 bp, Homo sapiens
gtaaccagcca

SEQ ID NO: 2600537 - DNA, 12 bp, Homo sapiens
gtaaccagccag

SEQ ID NO: 2600538 - DNA, 20 bp, Homo sapiens
gtaaccagccagatcctctt

SEQ ID NO: 2600539 - DNA, 23 bp, Homo sapiens
gtaactctaattcccattttgca

SEQ ID NO: 2600540 - DNA, 19 bp, Homo sapiens
gtaactgcattgagaactg

SEQ ID NO: 2600541 - DNA, 14 bp, Homo sapiens
gtaactggctgtgt

SEQ ID NO: 2600542 - DNA, 13 bp, Homo sapiens
gtaactgttcttg

SEQ ID NO: 2600543 - DNA, 14 bp, Homo sapiens
gtaactttatgtgt

SEQ ID NO: 2600544 - DNA, 17 bp, Homo sapiens
gtaacttttgtaagaca

SEQ ID NO: 2600545 - DNA, 20 bp, Homo sapiens
gtaagaaagtgaagcaaatc

SEQ ID NO: 2600546 - DNA, 11 bp, Homo sapiens
gtaagaagccg

SEQ ID NO: 2600547 - DNA, 17 bp, Homo sapiens
gtaagagtgtagaagca

SEQ ID NO: 2600548 - DNA, 18 bp, Homo sapiens
gtaagagtgtagaagcat

SEQ ID NO: 2600549 - DNA, 22 bp, Homo sapiens
gtaagagtgtagaagcattcct

SEQ ID NO: 2600550 - DNA, 21 bp, Homo sapiens
gtattttagtaagagattcct

SEQ ID NO: 2600551 - DNA, 17 bp, Homo sapiens
gtattttccaagtgtgc

SEQ ID NO: 2600552 - DNA, 20 bp, Homo sapiens
gtattttccaagtgtgcata

SEQ ID NO: 2600553 - DNA, 22 bp, Homo sapiens
gtattttcccccttttctgcat

SEQ ID NO: 2600554 - DNA, 18 bp, Homo sapiens
gtattttctttctctact

SEQ ID NO: 2600555 - DNA, 14 bp, Homo sapiens
gtattttggagaaa

SEQ ID NO: 2600556 - DNA, 14 bp, Homo sapiens
gtatttttaatggg

SEQ ID NO: 2600557 - DNA, 18 bp, Homo sapiens
gtatttttaatgggggta

SEQ ID NO: 2600558 - DNA, 22 bp, Homo sapiens
gtatttttaatgggggtagcag

SEQ ID NO: 2600559 - DNA, 14 bp, Homo sapiens
gtatttttttacta

SEQ ID NO: 2600560 - DNA, 21 bp, Homo sapiens
gtatttttttactaatagaca

SEQ ID NO: 2600561 - DNA, 15 bp, Homo sapiens
gtcaaacaaagccag

SEQ ID NO: 2600562 - DNA, 15 bp, Homo sapiens
gtcaaacatgaagtg

SEQ ID NO: 2600563 - DNA, 16 bp, Homo sapiens
gtcaaacatgaagtgt

SEQ ID NO: 2600564 - DNA, 16 bp, Homo sapiens
gtcaaaccataaactt

SEQ ID NO: 2600565 - DNA, 21 bp, Homo sapiens
gtcaaaccgcactcacccatg

SEQ ID NO: 2600566 - DNA, 15 bp, Homo sapiens
gtcaaacgtgaaaat

SEQ ID NO: 2600567 - DNA, 12 bp, Homo sapiens
gtcaaagaaatg

SEQ ID NO: 2600568 - DNA, 11 bp, Homo sapiens
gtcaaagaagg

SEQ ID NO: 2600569 - DNA, 13 bp, Homo sapiens
gtcaaagtaaaac

SEQ ID NO: 2600570 - DNA, 22 bp, Homo sapiens
gtcaacacttaagggttttaga

SEQ ID NO: 2600571 - DNA, 14 bp, Homo sapiens
gtcaacctcctgga

SEQ ID NO: 2600572 - DNA, 14 bp, Homo sapiens
gtcaacctgggcaa

SEQ ID NO: 2600573 - DNA, 17 bp, Homo sapiens
gtcaacttcaacattta

SEQ ID NO: 2600574 - DNA, 17 bp, Homo sapiens
gtcaagaagaagatgga

SEQ ID NO: 2600575 - DNA, 14 bp, Homo sapiens
gtcaagattttgaa

SEQ ID NO: 2600576 - DNA, 15 bp, Homo sapiens
gtcaagtaagaagac

SEQ ID NO: 2600577 - DNA, 17 bp, Homo sapiens
gtcaagttgtgcttgtt

SEQ ID NO: 2600578 - DNA, 21 bp, Homo sapiens
gtcaatacagtacaggcagca

SEQ ID NO: 2600579 - DNA, 17 bp, Homo sapiens
gtcaatattaaatacag

SEQ ID NO: 2600580 - DNA, 12 bp, Homo sapiens
gtcaatatttaa

SEQ ID NO: 2600581 - DNA, 13 bp, Homo sapiens
gtcaatatttaaa

SEQ ID NO: 2600582 - DNA, 19 bp, Homo sapiens
gtcaatcctgtgggtgaag

SEQ ID NO: 2600583 - DNA, 18 bp, Homo sapiens
gtcaatgtgcagtgtagc

SEQ ID NO: 2600584 - DNA, 14 bp, Homo sapiens
gtcacacagggcag

SEQ ID NO: 2600585 - DNA, 21 bp, Homo sapiens
gtcacagcctcctctgtctgc

SEQ ID NO: 2600586 - DNA, 17 bp, Homo sapiens
gtcacaggactctgcct

SEQ ID NO: 2600587 - DNA, 19 bp, Homo sapiens
gtcacaggactctgcctcc

SEQ ID NO: 2600588 - DNA, 12 bp, Homo sapiens
gtcacagggcca

SEQ ID NO: 2600589 - DNA, 16 bp, Homo sapiens
gtcacattcaggaaga

SEQ ID NO: 2600590 - DNA, 22 bp, Homo sapiens
gtcaccccggccacctgcggtg

SEQ ID NO: 2600591 - DNA, 16 bp, Homo sapiens
gtcaccctccacctct

SEQ ID NO: 2600592 - DNA, 16 bp, Homo sapiens
gtcaccggatcctggg

SEQ ID NO: 2600593 - DNA, 19 bp, Homo sapiens
gtcaccgtggaccttcctg

SEQ ID NO: 2600594 - DNA, 20 bp, Homo sapiens
gtcacctgaagactcattct

SEQ ID NO: 2600595 - DNA, 13 bp, Homo sapiens
gtcacctgtgctt

SEQ ID NO: 2600596 - DNA, 17 bp, Homo sapiens
gtcactactcacagtct

SEQ ID NO: 2600597 - DNA, 14 bp, Homo sapiens
gtcactcccaagcc

SEQ ID NO: 2600598 - DNA, 18 bp, Homo sapiens
gtcactcccaagccccct

SEQ ID NO: 2600599 - DNA, 13 bp, Homo sapiens
gtcactctggcag

SEQ ID NO: 2600600 - DNA, 23 bp, Homo sapiens
gtcactctggcagctcagagagg

SEQ ID NO: 2600601 - DNA, 19 bp, Homo sapiens
gtcactcttcctgcaagga

SEQ ID NO: 2600602 - DNA, 15 bp, Homo sapiens
gtcactgaaggcctg

SEQ ID NO: 2600603 - DNA, 16 bp, Homo sapiens
gtcactgagacagccc

SEQ ID NO: 2600604 - DNA, 12 bp, Homo sapiens
gtcactgcctct

SEQ ID NO: 2600605 - DNA, 11 bp, Homo sapiens
gtcactgctgt

SEQ ID NO: 2600606 - DNA, 15 bp, Homo sapiens
gtcactggctctcca

SEQ ID NO: 2600607 - DNA, 17 bp, Homo sapiens
gtcactgttccttgtca

SEQ ID NO: 2600608 - DNA, 13 bp, Homo sapiens
gtcagaaactgtt

SEQ ID NO: 2600609 - DNA, 20 bp, Homo sapiens
gtcagacatccatgtttgta

SEQ ID NO: 2600610 - DNA, 18 bp, Homo sapiens
gtcagacgcctgaggaac

SEQ ID NO: 2600611 - DNA, 16 bp, Homo sapiens
gtcagactgctgggac

SEQ ID NO: 2600612 - DNA, 20 bp, Homo sapiens
gtcagactgctgggactggc

SEQ ID NO: 2600613 - DNA, 14 bp, Homo sapiens
gtcagactggctgg

SEQ ID NO: 2600614 - DNA, 16 bp, Homo sapiens
gtcagactttaaagaa

SEQ ID NO: 2600615 - DNA, 16 bp, Homo sapiens
gtcagagactgctgtg

SEQ ID NO: 2600616 - DNA, 13 bp, Homo sapiens
gtcagagctggga

SEQ ID NO: 2600617 - DNA, 15 bp, Homo sapiens
gtcagaggatggcca

SEQ ID NO: 2600618 - DNA, 18 bp, Homo sapiens
gtcagatgggaagacatg

SEQ ID NO: 2600619 - DNA, 13 bp, Homo sapiens
gtcagcaggaagc

SEQ ID NO: 2600620 - DNA, 15 bp, Homo sapiens
gtcagccaaatgtaa

SEQ ID NO: 2600621 - DNA, 15 bp, Homo sapiens
ggcccagcattgctg

SEQ ID NO: 2600622 - DNA, 17 bp, Homo sapiens
ggcccagcccccacagt

SEQ ID NO: 2600623 - DNA, 19 bp, Homo sapiens
ggcccagcccccacagtgc

SEQ ID NO: 2600624 - DNA, 14 bp, Homo sapiens
ggcccagcccggct

SEQ ID NO: 2600625 - DNA, 16 bp, Homo sapiens
ggcccagccctgctgg

SEQ ID NO: 2600626 - DNA, 22 bp, Homo sapiens
ggcccagccggcctctctggcc

SEQ ID NO: 2600627 - DNA, 16 bp, Homo sapiens
ggcccagcggcccctc

SEQ ID NO: 2600628 - DNA, 16 bp, Homo sapiens
ggcccaggaccagctg

SEQ ID NO: 2600629 - DNA, 15 bp, Homo sapiens
ggcccaggcaggcca

SEQ ID NO: 2600630 - DNA, 17 bp, Homo sapiens
ggcccagggacaccagc

SEQ ID NO: 2600631 - DNA, 19 bp, Homo sapiens
ggcccagggacaccagcca

SEQ ID NO: 2600632 - DNA, 20 bp, Homo sapiens
ggcccagggacaccagccag

SEQ ID NO: 2600633 - DNA, 17 bp, Homo sapiens
ggcccagtatgagccct

SEQ ID NO: 2600634 - DNA, 14 bp, Homo sapiens
ggcccagtcctggc

SEQ ID NO: 2600635 - DNA, 21 bp, Homo sapiens
ggcccagtcctggcctggctt

SEQ ID NO: 2600636 - DNA, 24 bp, Homo sapiens
ggcccatatctgtgaaatgctggc

SEQ ID NO: 2600637 - DNA, 18 bp, Homo sapiens
ggccccagagactcagag

SEQ ID NO: 2600638 - DNA, 12 bp, Homo sapiens
ggccccagccag

SEQ ID NO: 2600639 - DNA, 15 bp, Homo sapiens
ggccccaggaagccg

SEQ ID NO: 2600640 - DNA, 15 bp, Homo sapiens
ggccccagtcagcct

SEQ ID NO: 2600641 - DNA, 21 bp, Homo sapiens
ggccccagtcagcctctctcc

SEQ ID NO: 2600642 - DNA, 15 bp, Homo sapiens
ggcccccagagcgcc

SEQ ID NO: 2600643 - DNA, 19 bp, Homo sapiens
ggcccccagagcgcccctc

SEQ ID NO: 2600644 - DNA, 15 bp, Homo sapiens
ggcccccgagctggg

SEQ ID NO: 2600645 - DNA, 18 bp, Homo sapiens
ggccccctggtctctggt

SEQ ID NO: 2600646 - DNA, 18 bp, Homo sapiens
ggccccgaggacccagac

SEQ ID NO: 2600647 - DNA, 14 bp, Homo sapiens
ggccccgccgcctg

SEQ ID NO: 2600648 - DNA, 13 bp, Homo sapiens
ggccccggcccca

SEQ ID NO: 2600649 - DNA, 16 bp, Homo sapiens
ggccccggccccagcc

SEQ ID NO: 2600650 - DNA, 17 bp, Homo sapiens
ggccccggccccagcca

SEQ ID NO: 2600651 - DNA, 17 bp, Homo sapiens
ggcccctctgcccagct

SEQ ID NO: 2600652 - DNA, 19 bp, Homo sapiens
ggcccctctgcccagcttg

SEQ ID NO: 2600653 - DNA, 16 bp, Homo sapiens
ggcccctgccaccctg

SEQ ID NO: 2600654 - DNA, 13 bp, Homo sapiens
ggcccctgcccgg

SEQ ID NO: 2600655 - DNA, 13 bp, Homo sapiens
ggcccctgtgagt

SEQ ID NO: 2600656 - DNA, 20 bp, Homo sapiens
ggccccttgactctggggac

SEQ ID NO: 2600657 - DNA, 18 bp, Homo sapiens
ggccccttttcactccct

SEQ ID NO: 2600658 - DNA, 20 bp, Homo sapiens
ggccccttttcactccctcc

SEQ ID NO: 2600659 - DNA, 19 bp, Homo sapiens
ggcccgcctggcagaactg

SEQ ID NO: 2600660 - DNA, 22 bp, Homo sapiens
ggcccgttgaggatgaggccgc

SEQ ID NO: 2600661 - DNA, 22 bp, Homo sapiens
ggccctaccagcgcccgctggg

SEQ ID NO: 2600662 - DNA, 22 bp, Homo sapiens
ggccctcacccctgccctggga

SEQ ID NO: 2600663 - DNA, 20 bp, Homo sapiens
ggccctcattaatgacactt

SEQ ID NO: 2600664 - DNA, 12 bp, Homo sapiens
ggccctcccagt

SEQ ID NO: 2600665 - DNA, 15 bp, Homo sapiens
ggccctcccttggaa

SEQ ID NO: 2600666 - DNA, 19 bp, Homo sapiens
ggccctcctaccctgcgcc

SEQ ID NO: 2600667 - DNA, 16 bp, Homo sapiens
ggccctcgggcccagc

SEQ ID NO: 2600668 - DNA, 17 bp, Homo sapiens
ggccctcgggcccagcc

SEQ ID NO: 2600669 - DNA, 16 bp, Homo sapiens
ggccctctgcccactc

SEQ ID NO: 2600670 - DNA, 19 bp, Homo sapiens
ggccctgacattggagcct

SEQ ID NO: 2600671 - DNA, 19 bp, Homo sapiens
ggccctgagctcggtggac

SEQ ID NO: 2600672 - DNA, 14 bp, Homo sapiens
ggccctgagctgag

SEQ ID NO: 2600673 - DNA, 15 bp, Homo sapiens
ggccctgaggtgtgg

SEQ ID NO: 2600674 - DNA, 18 bp, Homo sapiens
ggccctgaggtgtggggg

SEQ ID NO: 2600675 - DNA, 19 bp, Homo sapiens
ggccctgcaaaaggactct

SEQ ID NO: 2600676 - DNA, 18 bp, Homo sapiens
ggccctgcacctgtgcag

SEQ ID NO: 2600677 - DNA, 14 bp, Homo sapiens
ggccctgcctcctt

SEQ ID NO: 2600678 - DNA, 13 bp, Homo sapiens
ggccctgcctctg

SEQ ID NO: 2600679 - DNA, 16 bp, Homo sapiens
ggccctgggctcggag

SEQ ID NO: 2600680 - DNA, 20 bp, Homo sapiens
ggcccttcactgcctttgct

SEQ ID NO: 2600681 - DNA, 16 bp, Homo sapiens
ggcccttctctccagc

SEQ ID NO: 2600682 - DNA, 18 bp, Homo sapiens
ggcccttctctccagccc

SEQ ID NO: 2600683 - DNA, 23 bp, Homo sapiens
ggcccttctctccagcccctgga

SEQ ID NO: 2600684 - DNA, 21 bp, Homo sapiens
ggcccttgcagttcagcacca

SEQ ID NO: 2600685 - DNA, 15 bp, Homo sapiens
ggccgaagctctggc

SEQ ID NO: 2600686 - DNA, 17 bp, Homo sapiens
ggccgaagctctggctg

SEQ ID NO: 2600687 - DNA, 16 bp, Homo sapiens
ggccgaaggcagtgca

SEQ ID NO: 2600688 - DNA, 19 bp, Homo sapiens
ggccgaatcccctccctgt

SEQ ID NO: 2600689 - DNA, 21 bp, Homo sapiens
ggccgaatcccctccctgtca

SEQ ID NO: 2600690 - DNA, 12 bp, Homo sapiens
ggccgagaagca

SEQ ID NO: 2600691 - DNA, 15 bp, Homo sapiens
ggccgagaagcaaga

SEQ ID NO: 2600692 - DNA, 16 bp, Homo sapiens
ggccgagggtcctggc

SEQ ID NO: 2600693 - DNA, 18 bp, Homo sapiens
ggccgagggtcctggctc

SEQ ID NO: 2600694 - DNA, 14 bp, Homo sapiens
ggccgagtgagagc

SEQ ID NO: 2600695 - DNA, 18 bp, Homo sapiens
ggccgcagctcttgccct

SEQ ID NO: 2600696 - DNA, 21 bp, Homo sapiens
ggccgcagctcttgcccttcc

SEQ ID NO: 2600697 - DNA, 12 bp, Homo sapiens
ggccgcctcacc

SEQ ID NO: 2600698 - DNA, 13 bp, Homo sapiens
ggccggggctgag

SEQ ID NO: 2600699 - DNA, 22 bp, Homo sapiens
ggccgtaccccaccctcagcac

SEQ ID NO: 2600700 - DNA, 19 bp, Homo sapiens
ggccgtcacttgtgggggt

SEQ ID NO: 2600701 - DNA, 18 bp, Homo sapiens
ggccgtcctcccgggccc

SEQ ID NO: 2600702 - DNA, 21 bp, Homo sapiens
ggccgtcctcccgggccctcc

SEQ ID NO: 2600703 - DNA, 22 bp, Homo sapiens
ggcctcaaagttggggcaggct

SEQ ID NO: 2600704 - DNA, 15 bp, Homo sapiens
ggcctcaaccctccc

SEQ ID NO: 2600705 - DNA, 18 bp, Homo sapiens
ggcctcaagatcaatgaa

SEQ ID NO: 2600706 - DNA, 15 bp, Homo sapiens
ggcctcaaggacttg

SEQ ID NO: 2600707 - DNA, 14 bp, Homo sapiens
ggcctcaagtgatt

SEQ ID NO: 2600708 - DNA, 18 bp, Homo sapiens
ggcctcaccgagtggggg

SEQ ID NO: 2600709 - DNA, 17 bp, Homo sapiens
ggcctcagcacccctgt

SEQ ID NO: 2600710 - DNA, 16 bp, Homo sapiens
ggcctcagctgcctca

SEQ ID NO: 2600711 - DNA, 17 bp, Homo sapiens
ggcctcaggtttgcctg

SEQ ID NO: 2600712 - DNA, 20 bp, Homo sapiens
ggcctcagtggactttccac

SEQ ID NO: 2600713 - DNA, 14 bp, Homo sapiens
ggcctcccaactca

SEQ ID NO: 2600714 - DNA, 17 bp, Homo sapiens
ggcctcccaactcaccc

SEQ ID NO: 2600715 - DNA, 11 bp, Homo sapiens
ggcctcccacc

SEQ ID NO: 2600716 - DNA, 14 bp, Homo sapiens
ggcctcccacccga

SEQ ID NO: 2600717 - DNA, 23 bp, Homo sapiens
ggcctcccacccgatgctgcttt

SEQ ID NO: 2600718 - DNA, 15 bp, Homo sapiens
ggcctcccctgctga

SEQ ID NO: 2600719 - DNA, 15 bp, Homo sapiens
ggcctccctctctct

SEQ ID NO: 2600720 - DNA, 16 bp, Homo sapiens
ggcctccggcctcccc

SEQ ID NO: 2600721 - DNA, 20 bp, Homo sapiens
ggcctccggcgtcagcctcc

SEQ ID NO: 2600722 - DNA, 23 bp, Homo sapiens
ggcctccggcgtcagcctccagc

SEQ ID NO: 2600723 - DNA, 17 bp, Homo sapiens
ggcctcctcccttagct

SEQ ID NO: 2600724 - DNA, 18 bp, Homo sapiens
ggcctcctctgtccaggg

SEQ ID NO: 2600725 - DNA, 19 bp, Homo sapiens
ggcctcggagcctcatccg

SEQ ID NO: 2600726 - DNA, 15 bp, Homo sapiens
ggcctctctggcctc

SEQ ID NO: 2600727 - DNA, 20 bp, Homo sapiens
ggcctctctggcctcccacc

SEQ ID NO: 2600728 - DNA, 21 bp, Homo sapiens
ggcctctgcaaaggaaatacc

SEQ ID NO: 2600729 - DNA, 13 bp, Homo sapiens
ggcctctgcactc

SEQ ID NO: 2600730 - DNA, 18 bp, Homo sapiens
ggcctcttatgggctggg

SEQ ID NO: 2600731 - DNA, 23 bp, Homo sapiens
ggcctgaagagtcctctgaatga

SEQ ID NO: 2600732 - DNA, 14 bp, Homo sapiens
ggcctgatgctccc

SEQ ID NO: 2600733 - DNA, 17 bp, Homo sapiens
ggcctgatgctccctcc

SEQ ID NO: 2600734 - DNA, 18 bp, Homo sapiens
ggcctgatgctccctccc

SEQ ID NO: 2600735 - DNA, 20 bp, Homo sapiens
ggcctgatgctccctcccct

SEQ ID NO: 2600736 - DNA, 17 bp, Homo sapiens
ggcctgcacggtgggcc

SEQ ID NO: 2600737 - DNA, 19 bp, Homo sapiens
ggcctgcacggtgggcctt

SEQ ID NO: 2600738 - DNA, 16 bp, Homo sapiens
ggcctggaagacagag

SEQ ID NO: 2600739 - DNA, 15 bp, Homo sapiens
ggcctggagcaggcc

SEQ ID NO: 2600740 - DNA, 19 bp, Homo sapiens
ggcctggagcaggccttgc

SEQ ID NO: 2600741 - DNA, 21 bp, Homo sapiens
ggcctggatctccccactcta

SEQ ID NO: 2600742 - DNA, 14 bp, Homo sapiens
ggcctggccacctc

SEQ ID NO: 2600743 - DNA, 16 bp, Homo sapiens
ggcctggccaggagct

SEQ ID NO: 2600744 - DNA, 18 bp, Homo sapiens
ggcctggccaggagctct

SEQ ID NO: 2600745 - DNA, 23 bp, Homo sapiens
ggcctggcccctcagggtccctg

SEQ ID NO: 2600746 - DNA, 10 bp, Homo sapiens
ggcctggcct

SEQ ID NO: 2600747 - DNA, 23 bp, Homo sapiens
ggcctggggctcctttctccagc

SEQ ID NO: 2600748 - DNA, 23 bp, Homo sapiens
ggcctgtctcatccccaggggtc

SEQ ID NO: 2600749 - DNA, 20 bp, Homo sapiens
ggcctgtggcctgtgtccca

SEQ ID NO: 2600750 - DNA, 22 bp, Homo sapiens
ggcctgtgtcccatgacccacc

SEQ ID NO: 2600751 - DNA, 22 bp, Homo sapiens
ggcctgtgtgtgaaaggaagct

SEQ ID NO: 2600752 - DNA, 13 bp, Homo sapiens
ggccttcctgccc

SEQ ID NO: 2600753 - DNA, 16 bp, Homo sapiens
ggccttctctgaagga

SEQ ID NO: 2600754 - DNA, 19 bp, Homo sapiens
ggcctttgagcccacaaag

SEQ ID NO: 2600755 - DNA, 15 bp, Homo sapiens
ggcgaatcatttgtt

SEQ ID NO: 2600756 - DNA, 23 bp, Homo sapiens
ggcgacagagcgagagtctgtct

SEQ ID NO: 2600757 - DNA, 11 bp, Homo sapiens
ggcgaggcaga

SEQ ID NO: 2600758 - DNA, 14 bp, Homo sapiens
gatccacctgtctc

SEQ ID NO: 2600759 - DNA, 17 bp, Homo sapiens
gatccagcctctcccct

SEQ ID NO: 2600760 - DNA, 19 bp, Homo sapiens
gatcccagctcacgtcaca

SEQ ID NO: 2600761 - DNA, 14 bp, Homo sapiens
gatccccaagtgtg

SEQ ID NO: 2600762 - DNA, 18 bp, Homo sapiens
gatccccaagtgtgaaca

SEQ ID NO: 2600763 - DNA, 12 bp, Homo sapiens
gatccctcatct

SEQ ID NO: 2600764 - DNA, 18 bp, Homo sapiens
gatccctcatctgtccct

SEQ ID NO: 2600765 - DNA, 20 bp, Homo sapiens
gatcctagccttatcctctg

SEQ ID NO: 2600766 - DNA, 22 bp, Homo sapiens
gatcctagccttatcctctgat

SEQ ID NO: 2600767 - DNA, 23 bp, Homo sapiens
gatcctagccttatcctctgatc

SEQ ID NO: 2600768 - DNA, 18 bp, Homo sapiens
gatcctattctcaccagg

SEQ ID NO: 2600769 - DNA, 18 bp, Homo sapiens
gatcctcccacctcagcc

SEQ ID NO: 2600770 - DNA, 19 bp, Homo sapiens
gatcctcccacctcagcct

SEQ ID NO: 2600771 - DNA, 16 bp, Homo sapiens
gatcctgtctttaagg

SEQ ID NO: 2600772 - DNA, 12 bp, Homo sapiens
gatccttcctcc

SEQ ID NO: 2600773 - DNA, 13 bp, Homo sapiens
gatcgcagtttgc

SEQ ID NO: 2600774 - DNA, 23 bp, Homo sapiens
gatcgcgccactacactccagcc

SEQ ID NO: 2600775 - DNA, 22 bp, Homo sapiens
gatcggaggcttgtcagagctg

SEQ ID NO: 2600776 - DNA, 17 bp, Homo sapiens
gatctaagcctttccat

SEQ ID NO: 2600777 - DNA, 17 bp, Homo sapiens
gatctaccccttactta

SEQ ID NO: 2600778 - DNA, 20 bp, Homo sapiens
gatctagaatgtgttttctg

SEQ ID NO: 2600779 - DNA, 22 bp, Homo sapiens
gatctagaatgtgttttctgaa

SEQ ID NO: 2600780 - DNA, 13 bp, Homo sapiens
gatctaggaagac

SEQ ID NO: 2600781 - DNA, 19 bp, Homo sapiens
gatctaggtttaactcaga

SEQ ID NO: 2600782 - DNA, 22 bp, Homo sapiens
gatctaggtttaactcagatca

SEQ ID NO: 2600783 - DNA, 20 bp, Homo sapiens
gatctctcaggagcacaggc

SEQ ID NO: 2600784 - DNA, 21 bp, Homo sapiens
gatctctcaggagcacaggca

SEQ ID NO: 2600785 - DNA, 23 bp, Homo sapiens
gatctctcaggagcacaggcagc

SEQ ID NO: 2600786 - DNA, 19 bp, Homo sapiens
gatctcttgagcctgggag

SEQ ID NO: 2600787 - DNA, 18 bp, Homo sapiens
gatctggttttgctatta

SEQ ID NO: 2600788 - DNA, 20 bp, Homo sapiens
gatctgtatatacaataaca

SEQ ID NO: 2600789 - DNA, 16 bp, Homo sapiens
gatctgtcacaccagc

SEQ ID NO: 2600790 - DNA, 23 bp, Homo sapiens
gatctgtgctttccagctcaccc

SEQ ID NO: 2600791 - DNA, 21 bp, Homo sapiens
gatctgtttttaaaaatcata

SEQ ID NO: 2600792 - DNA, 12 bp, Homo sapiens
gatcttaaattt

SEQ ID NO: 2600793 - DNA, 16 bp, Homo sapiens
gatcttcaatggcttt

SEQ ID NO: 2600794 - DNA, 18 bp, Homo sapiens
gatctttctttcctttct

SEQ ID NO: 2600795 - DNA, 18 bp, Homo sapiens
gatgaaataactccttct

SEQ ID NO: 2600796 - DNA, 21 bp, Homo sapiens
gatgaaatgaggtcagagcct

SEQ ID NO: 2600797 - DNA, 23 bp, Homo sapiens
gatgaaattttctagactttctg

SEQ ID NO: 2600798 - DNA, 19 bp, Homo sapiens
gatgaacttattctgtaga

SEQ ID NO: 2600799 - DNA, 20 bp, Homo sapiens
gatgaagaaaagtgggccag

SEQ ID NO: 2600800 - DNA, 15 bp, Homo sapiens
gatgaagcaaacaca

SEQ ID NO: 2600801 - DNA, 16 bp, Homo sapiens
gatgaagcaaacacat

SEQ ID NO: 2600802 - DNA, 19 bp, Homo sapiens
gatgaagcaaacacattaa

SEQ ID NO: 2600803 - DNA, 20 bp, Homo sapiens
gatgacaaaaattcaactca

SEQ ID NO: 2600804 - DNA, 15 bp, Homo sapiens
gatgactaaaatatt

SEQ ID NO: 2600805 - DNA, 18 bp, Homo sapiens
gatgactaaaatatttat

SEQ ID NO: 2600806 - DNA, 15 bp, Homo sapiens
gatgactagaggcag

SEQ ID NO: 2600807 - DNA, 18 bp, Homo sapiens
gatgactcccttaaaata

SEQ ID NO: 2600808 - DNA, 21 bp, Homo sapiens
gatgactcccttaaaatagaa

SEQ ID NO: 2600809 - DNA, 18 bp, Homo sapiens
gatgagcatttagggcaa

SEQ ID NO: 2600810 - DNA, 20 bp, Homo sapiens
gatgagctggaaggagtgag

SEQ ID NO: 2600811 - DNA, 22 bp, Homo sapiens
gatgaggcctcttggacctctg

SEQ ID NO: 2600812 - DNA, 20 bp, Homo sapiens
gatgagtcccctgtgagatt

SEQ ID NO: 2600813 - DNA, 14 bp, Homo sapiens
gatgatgctgccag

SEQ ID NO: 2600814 - DNA, 17 bp, Homo sapiens
gatgatgggaattgtgt

SEQ ID NO: 2600815 - DNA, 14 bp, Homo sapiens
gatgatgtgcctgg

SEQ ID NO: 2600816 - DNA, 17 bp, Homo sapiens
gatgatgtgcctgggtg

SEQ ID NO: 2600817 - DNA, 15 bp, Homo sapiens
gatgattcagaaatt

SEQ ID NO: 2600818 - DNA, 14 bp, Homo sapiens
gatgcaaagaaaat

SEQ ID NO: 2600819 - DNA, 17 bp, Homo sapiens
gatgcaaagaggcaaga

SEQ ID NO: 2600820 - DNA, 19 bp, Homo sapiens
gatgcaaggaccaggactc

SEQ ID NO: 2600821 - DNA, 13 bp, Homo sapiens
gatgcaatgaaca

SEQ ID NO: 2600822 - DNA, 16 bp, Homo sapiens
gcacctgccccctggt

SEQ ID NO: 2600823 - DNA, 18 bp, Homo sapiens
gcacctggaatatataac

SEQ ID NO: 2600824 - DNA, 14 bp, Homo sapiens
gcaccttgtgtctg

SEQ ID NO: 2600825 - DNA, 13 bp, Homo sapiens
gcacgatttctgt

SEQ ID NO: 2600826 - DNA, 16 bp, Homo sapiens
gcacgatttctgttta

SEQ ID NO: 2600827 - DNA, 10 bp, Homo sapiens
gcacgcacac

SEQ ID NO: 2600828 - DNA, 17 bp, Homo sapiens
gcacgcccatgtgtgag

SEQ ID NO: 2600829 - DNA, 22 bp, Homo sapiens
gcacgcccatgtgtgagtgtgt

SEQ ID NO: 2600830 - DNA, 18 bp, Homo sapiens
gcacggtgggccttgctg

SEQ ID NO: 2600831 - DNA, 14 bp, Homo sapiens
gcactaaagcagtg

SEQ ID NO: 2600832 - DNA, 20 bp, Homo sapiens
gcactaaagcagtggacacc

SEQ ID NO: 2600833 - DNA, 20 bp, Homo sapiens
gcactaaagtatgtaaagta

SEQ ID NO: 2600834 - DNA, 17 bp, Homo sapiens
gcactaaggtgtgctct

SEQ ID NO: 2600835 - DNA, 14 bp, Homo sapiens
gcactacataaact

SEQ ID NO: 2600836 - DNA, 15 bp, Homo sapiens
gcactacataaactg

SEQ ID NO: 2600837 - DNA, 16 bp, Homo sapiens
gcactacataaactga

SEQ ID NO: 2600838 - DNA, 17 bp, Homo sapiens
gcactactcctctgcag

SEQ ID NO: 2600839 - DNA, 19 bp, Homo sapiens
gcactactcctctgcagtg

SEQ ID NO: 2600840 - DNA, 16 bp, Homo sapiens
gcactcacacaggacc

SEQ ID NO: 2600841 - DNA, 13 bp, Homo sapiens
gcactcagaagac

SEQ ID NO: 2600842 - DNA, 16 bp, Homo sapiens
gcactcagaagacact

SEQ ID NO: 2600843 - DNA, 20 bp, Homo sapiens
gcactcagaagacactgatg

SEQ ID NO: 2600844 - DNA, 12 bp, Homo sapiens
gcactccagcct

SEQ ID NO: 2600845 - DNA, 16 bp, Homo sapiens
gcactccagcctgggc

SEQ ID NO: 2600846 - DNA, 17 bp, Homo sapiens
gcactcccctgctgggt

SEQ ID NO: 2600847 - DNA, 14 bp, Homo sapiens
gcactccggaggta

SEQ ID NO: 2600848 - DNA, 19 bp, Homo sapiens
gcactctgttatttagact

SEQ ID NO: 2600849 - DNA, 17 bp, Homo sapiens
gcactgaagtgcttagt

SEQ ID NO: 2600850 - DNA, 12 bp, Homo sapiens
gcactgacattg

SEQ ID NO: 2600851 - DNA, 21 bp, Homo sapiens
gcactgagatatttattgttt

SEQ ID NO: 2600852 - DNA, 24 bp, Homo sapiens
gcactgagggccacactattacca

SEQ ID NO: 2600853 - DNA, 13 bp, Homo sapiens
gcactgcaggggc

SEQ ID NO: 2600854 - DNA, 14 bp, Homo sapiens
gcactgccatgcag

SEQ ID NO: 2600855 - DNA, 17 bp, Homo sapiens
gcactgccatgcagggc

SEQ ID NO: 2600856 - DNA, 18 bp, Homo sapiens
gcactgcctgatggacct

SEQ ID NO: 2600857 - DNA, 23 bp, Homo sapiens
gcactgctaggcgagtgccagga

SEQ ID NO: 2600858 - DNA, 18 bp, Homo sapiens
gcactgctgcccagcctc

SEQ ID NO: 2600859 - DNA, 15 bp, Homo sapiens
gcactgctgtgctgt

SEQ ID NO: 2600860 - DNA, 12 bp, Homo sapiens
gcactgcttcca

SEQ ID NO: 2600861 - DNA, 14 bp, Homo sapiens
gcactgcttccagt

SEQ ID NO: 2600862 - DNA, 15 bp, Homo sapiens
gcatatcctgagcca

SEQ ID NO: 2600863 - DNA, 17 bp, Homo sapiens
gcatattcaggaagctc

SEQ ID NO: 2600864 - DNA, 15 bp, Homo sapiens
gcatattgtacactt

SEQ ID NO: 2600865 - DNA, 16 bp, Homo sapiens
gcatattgtacacttt

SEQ ID NO: 2600866 - DNA, 17 bp, Homo sapiens
gcatattgtacactttt

SEQ ID NO: 2600867 - DNA, 17 bp, Homo sapiens
gcatcaaaagacaattc

SEQ ID NO: 2600868 - DNA, 18 bp, Homo sapiens
gcatcaaaagacaattct

SEQ ID NO: 2600869 - DNA, 16 bp, Homo sapiens
gcatcacagggcagag

SEQ ID NO: 2600870 - DNA, 22 bp, Homo sapiens
gcatcacagggcagagccggga

SEQ ID NO: 2600871 - DNA, 22 bp, Homo sapiens
gcatcaccttaggcagggaagt

SEQ ID NO: 2600872 - DNA, 12 bp, Homo sapiens
gcatcagctgct

SEQ ID NO: 2600873 - DNA, 21 bp, Homo sapiens
gcatcagctggcgtcatgcaa

SEQ ID NO: 2600874 - DNA, 17 bp, Homo sapiens
gcatcaggccaggccct

SEQ ID NO: 2600875 - DNA, 18 bp, Homo sapiens
gcatcaggccaggccctc

SEQ ID NO: 2600876 - DNA, 19 bp, Homo sapiens
gcatcagtccctatgtatt

SEQ ID NO: 2600877 - DNA, 21 bp, Homo sapiens
gcatcccaggggaccacacct

SEQ ID NO: 2600878 - DNA, 14 bp, Homo sapiens
gcatcccagtggcc

SEQ ID NO: 2600879 - DNA, 21 bp, Homo sapiens
gcatccccttggctgtgaggc

SEQ ID NO: 2600880 - DNA, 18 bp, Homo sapiens
gcatcccttgaccaggcc

SEQ ID NO: 2600881 - DNA, 20 bp, Homo sapiens
gcatcccttgaccaggcctg

SEQ ID NO: 2600882 - DNA, 22 bp, Homo sapiens
gcatcccttgaccaggcctggg

SEQ ID NO: 2600883 - DNA, 19 bp, Homo sapiens
gcatcctccaagaatctat

SEQ ID NO: 2600884 - DNA, 22 bp, Homo sapiens
gcatcctggcacccggcccctg

SEQ ID NO: 2600885 - DNA, 13 bp, Homo sapiens
gcatcgtggagac

SEQ ID NO: 2600886 - DNA, 14 bp, Homo sapiens
gccacacctgagcc

SEQ ID NO: 2600887 - DNA, 21 bp, Homo sapiens
gccacactattaccatgagaa

SEQ ID NO: 2600888 - DNA, 14 bp, Homo sapiens
gccacagagaaagt

SEQ ID NO: 2600889 - DNA, 21 bp, Homo sapiens
gccaccaacatactcccatct

SEQ ID NO: 2600890 - DNA, 12 bp, Homo sapiens
gccaccaactct

SEQ ID NO: 2600891 - DNA, 14 bp, Homo sapiens
gccaccacgtccag

SEQ ID NO: 2600892 - DNA, 17 bp, Homo sapiens
gccaccaggatggccct

SEQ ID NO: 2600893 - DNA, 14 bp, Homo sapiens
gccaccaggctggc

SEQ ID NO: 2600894 - DNA, 18 bp, Homo sapiens
gccaccaggctggcgcag

SEQ ID NO: 2600895 - DNA, 18 bp, Homo sapiens
gccaccatcctattgcaa

SEQ ID NO: 2600896 - DNA, 14 bp, Homo sapiens
gccaccatcctgct

SEQ ID NO: 2600897 - DNA, 17 bp, Homo sapiens
gccaccatggccagcca

SEQ ID NO: 2600898 - DNA, 22 bp, Homo sapiens
gccaccccaccctccctggagt

SEQ ID NO: 2600899 - DNA, 18 bp, Homo sapiens
gccaccccgggctctctg

SEQ ID NO: 2600900 - DNA, 16 bp, Homo sapiens
gccacccctccttcct

SEQ ID NO: 2600901 - DNA, 23 bp, Homo sapiens
gccacccgttctgctggcctgga

SEQ ID NO: 2600902 - DNA, 13 bp, Homo sapiens
gccaccctacctg

SEQ ID NO: 2600903 - DNA, 22 bp, Homo sapiens
gccacctatctcgtgggagagc

SEQ ID NO: 2600904 - DNA, 13 bp, Homo sapiens
gccacctctccaa

SEQ ID NO: 2600905 - DNA, 17 bp, Homo sapiens
gccacctctccaagggc

SEQ ID NO: 2600906 - DNA, 23 bp, Homo sapiens
gccacctctccaagggcttctgc

SEQ ID NO: 2600907 - DNA, 13 bp, Homo sapiens
gccacctctctcc

SEQ ID NO: 2600908 - DNA, 19 bp, Homo sapiens
gccacctgaggtgggccca

SEQ ID NO: 2600909 - DNA, 13 bp, Homo sapiens
gccacctgccccc

SEQ ID NO: 2600910 - DNA, 22 bp, Homo sapiens
gccacctgcggtgctatctccc

SEQ ID NO: 2600911 - DNA, 19 bp, Homo sapiens
gccacggccaggccagagg

SEQ ID NO: 2600912 - DNA, 21 bp, Homo sapiens
gccacgtgggcaaacaggcag

SEQ ID NO: 2600913 - DNA, 22 bp, Homo sapiens
gccacgttcttactagtttccc

SEQ ID NO: 2600914 - DNA, 18 bp, Homo sapiens
gccactacactccagcct

SEQ ID NO: 2600915 - DNA, 13 bp, Homo sapiens
gccactcagcttc

SEQ ID NO: 2600916 - DNA, 16 bp, Homo sapiens
gccactcattcctgta

SEQ ID NO: 2600917 - DNA, 15 bp, Homo sapiens
gccactcctctgact

SEQ ID NO: 2600918 - DNA, 23 bp, Homo sapiens
gccactcgggaggctgagacagg

SEQ ID NO: 2600919 - DNA, 19 bp, Homo sapiens
gccactctgcctctgcctg

SEQ ID NO: 2600920 - DNA, 21 bp, Homo sapiens
gccactgcaccgggccacaga

SEQ ID NO: 2600921 - DNA, 22 bp, Homo sapiens
gccactgcaccgggccacagag

SEQ ID NO: 2600922 - DNA, 23 bp, Homo sapiens
gccactgcaccgggccacagaga

SEQ ID NO: 2600923 - DNA, 18 bp, Homo sapiens
gccactgcactccagcct

SEQ ID NO: 2600924 - DNA, 19 bp, Homo sapiens
gccactgcactccagcctg

SEQ ID NO: 2600925 - DNA, 15 bp, Homo sapiens
gccactgcactccgg

SEQ ID NO: 2600926 - DNA, 17 bp, Homo sapiens
gccactgcccgagctgg

SEQ ID NO: 2600927 - DNA, 21 bp, Homo sapiens
gccactgcccgagctggtgca

SEQ ID NO: 2600928 - DNA, 21 bp, Homo sapiens
gccacttgatgacccccaacc

SEQ ID NO: 2600929 - DNA, 23 bp, Homo sapiens
gccactttggtacatggccagtg

SEQ ID NO: 2600930 - DNA, 12 bp, Homo sapiens
gccagaaataaa

SEQ ID NO: 2600931 - DNA, 21 bp, Homo sapiens
gccagaagctgagcaccaggg

SEQ ID NO: 2600932 - DNA, 15 bp, Homo sapiens
gccagactctggtct

SEQ ID NO: 2600933 - DNA, 15 bp, Homo sapiens
gccagactggcacag

SEQ ID NO: 2600934 - DNA, 10 bp, Homo sapiens
gccagagaag

SEQ ID NO: 2600935 - DNA, 13 bp, Homo sapiens
gccagagaagtga

SEQ ID NO: 2600936 - DNA, 18 bp, Homo sapiens
gccagagaagtgacaggg

SEQ ID NO: 2600937 - DNA, 19 bp, Homo sapiens
gccagagggagtgacagag

SEQ ID NO: 2600938 - DNA, 20 bp, Homo sapiens
gccagagggagtgacagagg

SEQ ID NO: 2600939 - DNA, 20 bp, Homo sapiens
gccagaggtgggcaggtggt

SEQ ID NO: 2600940 - DNA, 22 bp, Homo sapiens
gccagaggtgggcaggtggtgg

SEQ ID NO: 2600941 - DNA, 13 bp, Homo sapiens
gccagagtggcct

SEQ ID NO: 2600942 - DNA, 15 bp, Homo sapiens
gccagagtggcctgg

SEQ ID NO: 2600943 - DNA, 17 bp, Homo sapiens
gccagagtggcctggcc

SEQ ID NO: 2600944 - DNA, 22 bp, Homo sapiens
gccagagtggcctggccaggag

SEQ ID NO: 2600945 - DNA, 23 bp, Homo sapiens
gccagagtggcctggccaggagc

SEQ ID NO: 2600946 - DNA, 18 bp, Homo sapiens
gccagagttcctgcggag

SEQ ID NO: 2600947 - DNA, 22 bp, Homo sapiens
gccagagttcctgcggagtgaa

SEQ ID NO: 2600948 - DNA, 18 bp, Homo sapiens
gccagatgcaccagccct

SEQ ID NO: 2600949 - DNA, 11 bp, Homo sapiens
gccagatgctg

SEQ ID NO: 2600950 - DNA, 22 bp, Homo sapiens
gccagatggactccagcctgcc

SEQ ID NO: 2600951 - DNA, 18 bp, Homo sapiens
gccagatggggcctctgt

SEQ ID NO: 2600952 - DNA, 16 bp, Homo sapiens
gccagattctttcctg

SEQ ID NO: 2600953 - DNA, 19 bp, Homo sapiens
gccagattctttcctgagg

SEQ ID NO: 2600954 - DNA, 20 bp, Homo sapiens
gccagattctttcctgaggc

SEQ ID NO: 2600955 - DNA, 13 bp, Homo sapiens
gccagcaatgaca

SEQ ID NO: 2600956 - DNA, 21 bp, Homo sapiens
gccagcaatgatgtccagaag

SEQ ID NO: 2600957 - DNA, 15 bp, Homo sapiens
gccagcacttgtata

SEQ ID NO: 2600958 - DNA, 16 bp, Homo sapiens
gccagcacttgtatat

SEQ ID NO: 2600959 - DNA, 13 bp, Homo sapiens
gccagcagccagc

SEQ ID NO: 2600960 - DNA, 15 bp, Homo sapiens
gccagcagccagctc

SEQ ID NO: 2600961 - DNA, 16 bp, Homo sapiens
gccagcagccagctct

SEQ ID NO: 2600962 - DNA, 17 bp, Homo sapiens
gccagcagccagctctc

SEQ ID NO: 2600963 - DNA, 13 bp, Homo sapiens
gccagccagcagc

SEQ ID NO: 2600964 - DNA, 16 bp, Homo sapiens
gccagccagcagccag

SEQ ID NO: 2600965 - DNA, 18 bp, Homo sapiens
gccagccaggcgggctca

SEQ ID NO: 2600966 - DNA, 21 bp, Homo sapiens
gccagccaggcgggctcaagg

SEQ ID NO: 2600967 - DNA, 19 bp, Homo sapiens
gccagccccacccaggagg

SEQ ID NO: 2600968 - DNA, 18 bp, Homo sapiens
gccagccccggccctggg

SEQ ID NO: 2600969 - DNA, 21 bp, Homo sapiens
gccagccccggccctgggctc

SEQ ID NO: 2600970 - DNA, 17 bp, Homo sapiens
gccagcccctcccacca

SEQ ID NO: 2600971 - DNA, 15 bp, Homo sapiens
gccagcccggctggt

SEQ ID NO: 2600972 - DNA, 12 bp, Homo sapiens
gccagcctggct

SEQ ID NO: 2600973 - DNA, 16 bp, Homo sapiens
gccagccttcctctgc

SEQ ID NO: 2600974 - DNA, 17 bp, Homo sapiens
gccagccttcctctgca

SEQ ID NO: 2600975 - DNA, 22 bp, Homo sapiens
gccagccttcctctgcagctga

SEQ ID NO: 2600976 - DNA, 19 bp, Homo sapiens
gccagcgggaatggcagct

SEQ ID NO: 2600977 - DNA, 19 bp, Homo sapiens
gccagcgtcctcctctgtg

SEQ ID NO: 2600978 - DNA, 13 bp, Homo sapiens
gccagctctcagc

SEQ ID NO: 2600979 - DNA, 18 bp, Homo sapiens
gccagctgccccagccag

SEQ ID NO: 2600980 - DNA, 15 bp, Homo sapiens
gccagctgccgacca

SEQ ID NO: 2600981 - DNA, 13 bp, Homo sapiens
gccagctgcctcc

SEQ ID NO: 2600982 - DNA, 13 bp, Homo sapiens
gccagctggagaa

SEQ ID NO: 2600983 - DNA, 20 bp, Homo sapiens
gccaggagctcttcaggcct

SEQ ID NO: 2600984 - DNA, 13 bp, Homo sapiens
gccaggagctggg

SEQ ID NO: 2600985 - DNA, 18 bp, Homo sapiens
gccaggccacaagaccct

SEQ ID NO: 2600986 - DNA, 19 bp, Homo sapiens
gccaggccaccaggatggc

SEQ ID NO: 2600987 - DNA, 12 bp, Homo sapiens
gccaggccagag

SEQ ID NO: 2600988 - DNA, 22 bp, Homo sapiens
gccaggccagagggagtgacag

SEQ ID NO: 2600989 - DNA, 18 bp, Homo sapiens
gccaggcccccaagcctg

SEQ ID NO: 2600990 - DNA, 14 bp, Homo sapiens
gccaggccctctgc

SEQ ID NO: 2600991 - DNA, 16 bp, Homo sapiens
gccaggccctctgccc

SEQ ID NO: 2600992 - DNA, 17 bp, Homo sapiens
gccaggccctctgccca

SEQ ID NO: 2600993 - DNA, 13 bp, Homo sapiens
gccaggccgggcc

SEQ ID NO: 2600994 - DNA, 20 bp, Homo sapiens
gccaggctccttcctgtctt

SEQ ID NO: 2600995 - DNA, 21 bp, Homo sapiens
gccaggctctgtgctgaccct

SEQ ID NO: 2600996 - DNA, 23 bp, Homo sapiens
gccagggacagagggggtggcct

SEQ ID NO: 2600997 - DNA, 16 bp, Homo sapiens
gccagggagacagagc

SEQ ID NO: 2600998 - DNA, 13 bp, Homo sapiens
gccagggccaggg

SEQ ID NO: 2600999 - DNA, 17 bp, Homo sapiens
gccagggccctgcagag

SEQ ID NO: 2601000 - DNA, 15 bp, Homo sapiens
gccagggcctggaag

SEQ ID NO: 2601001 - DNA, 17 bp, Homo sapiens
gccaggggaaaatcagc

SEQ ID NO: 2601002 - DNA, 22 bp, Homo sapiens
gccaggggaaaatcagcctgct

SEQ ID NO: 2601003 - DNA, 16 bp, Homo sapiens
gccagggtgagagctg

SEQ ID NO: 2601004 - DNA, 17 bp, Homo sapiens
gccagggtgagagctgc

SEQ ID NO: 2601005 - DNA, 23 bp, Homo sapiens
gccagggtgagagctgctctgga

SEQ ID NO: 2601006 - DNA, 15 bp, Homo sapiens
gccaggtaatgtgaa

SEQ ID NO: 2601007 - DNA, 14 bp, Homo sapiens
gccaggtgcagtgg

SEQ ID NO: 2601008 - DNA, 12 bp, Homo sapiens
gccaggtgcctt

SEQ ID NO: 2601009 - DNA, 13 bp, Homo sapiens
gccaggtgccttg

SEQ ID NO: 2601010 - DNA, 22 bp, Homo sapiens
gccaggtttctgcccacattgg

SEQ ID NO: 2601011 - DNA, 21 bp, Homo sapiens
gccagtaagggaaatagaaaa

SEQ ID NO: 2601012 - DNA, 23 bp, Homo sapiens
gccagtatctatatatgtgtatg

SEQ ID NO: 2601013 - DNA, 18 bp, Homo sapiens
gccagtcaccccggccac

SEQ ID NO: 2601014 - DNA, 14 bp, Homo sapiens
gccagtcctgcctg

SEQ ID NO: 2601015 - DNA, 15 bp, Homo sapiens
gccagtctgggctgc

SEQ ID NO: 2601016 - DNA, 17 bp, Homo sapiens
gccagtctgggctgccg

SEQ ID NO: 2601017 - DNA, 23 bp, Homo sapiens
gccagtggctggatctgtgaggg

SEQ ID NO: 2601018 - DNA, 13 bp, Homo sapiens
gccagtgtctgtc

SEQ ID NO: 2601019 - DNA, 21 bp, Homo sapiens
gccagtgtctgtcccggggtc

SEQ ID NO: 2601020 - DNA, 22 bp, Homo sapiens
gccagtgtctgtcccggggtcc

SEQ ID NO: 2601021 - DNA, 22 bp, Homo sapiens
gccagttatggctataggtgct

SEQ ID NO: 2601022 - DNA, 15 bp, Homo sapiens
gagtctgtctctgtc

SEQ ID NO: 2601023 - DNA, 14 bp, Homo sapiens
gagtgaagaggggc

SEQ ID NO: 2601024 - DNA, 20 bp, Homo sapiens
gagtgaagaggggcagccct

SEQ ID NO: 2601025 - DNA, 18 bp, Homo sapiens
gagtgacagaggcagccc

SEQ ID NO: 2601026 - DNA, 19 bp, Homo sapiens
gagtgacagtggattgcat

SEQ ID NO: 2601027 - DNA, 15 bp, Homo sapiens
gagtgacggtcccac

SEQ ID NO: 2601028 - DNA, 15 bp, Homo sapiens
gagtgactcgagggt

SEQ ID NO: 2601029 - DNA, 12 bp, Homo sapiens
gagtgagctggt

SEQ ID NO: 2601030 - DNA, 19 bp, Homo sapiens
gagtgaggggtaaaagctg

SEQ ID NO: 2601031 - DNA, 16 bp, Homo sapiens
gagtgcaacagtagca

SEQ ID NO: 2601032 - DNA, 17 bp, Homo sapiens
gagtgcaggcctgctca

SEQ ID NO: 2601033 - DNA, 18 bp, Homo sapiens
gagtgcagtgagccgaga

SEQ ID NO: 2601034 - DNA, 12 bp, Homo sapiens
gagtgccaggac

SEQ ID NO: 2601035 - DNA, 20 bp, Homo sapiens
gagtgccaggactccccagg

SEQ ID NO: 2601036 - DNA, 18 bp, Homo sapiens
gagtggagtggaagaaga

SEQ ID NO: 2601037 - DNA, 16 bp, Homo sapiens
gagtggatctccaagg

SEQ ID NO: 2601038 - DNA, 22 bp, Homo sapiens
gagtggatctccaaggaccagg

SEQ ID NO: 2601039 - DNA, 18 bp, Homo sapiens
gagtggatgatgtttcgt

SEQ ID NO: 2601040 - DNA, 10 bp, Homo sapiens
gagtggcctg

SEQ ID NO: 2601041 - DNA, 12 bp, Homo sapiens
gagtggcctggc

SEQ ID NO: 2601042 - DNA, 17 bp, Homo sapiens
gagtgggacagagtctg

SEQ ID NO: 2601043 - DNA, 16 bp, Homo sapiens
gagtggtcagaacaga

SEQ ID NO: 2601044 - DNA, 14 bp, Homo sapiens
gagtggtctttctg

SEQ ID NO: 2601045 - DNA, 20 bp, Homo sapiens
gagtgtaagtgtgagtaaga

SEQ ID NO: 2601046 - DNA, 14 bp, Homo sapiens
gagtgtgctggagg

SEQ ID NO: 2601047 - DNA, 17 bp, Homo sapiens
gagtgtggctcccctct

SEQ ID NO: 2601048 - DNA, 17 bp, Homo sapiens
gagtgtgtattgttccc

SEQ ID NO: 2601049 - DNA, 21 bp, Homo sapiens
gagtgtgtccaagtgtgtgtg

SEQ ID NO: 2601050 - DNA, 11 bp, Homo sapiens
gagtgtgtgca

SEQ ID NO: 2601051 - DNA, 17 bp, Homo sapiens
gagtgtgtttgtcaccg

SEQ ID NO: 2601052 - DNA, 16 bp, Homo sapiens
gagttagaggccagcc

SEQ ID NO: 2601053 - DNA, 18 bp, Homo sapiens
gagttaggctattcacaa

SEQ ID NO: 2601054 - DNA, 18 bp, Homo sapiens
gagttagtttctttggga

SEQ ID NO: 2601055 - DNA, 14 bp, Homo sapiens
gagttatatgttca

SEQ ID NO: 2601056 - DNA, 22 bp, Homo sapiens
gagttcaataaatgtctgttga

SEQ ID NO: 2601057 - DNA, 19 bp, Homo sapiens
gagttcaggtagctgcccc

SEQ ID NO: 2601058 - DNA, 22 bp, Homo sapiens
gagttcaggtagctgcccctgg

SEQ ID NO: 2601059 - DNA, 20 bp, Homo sapiens
gagttcataccctgttacca

SEQ ID NO: 2601060 - DNA, 15 bp, Homo sapiens
gagttccatgaagac

SEQ ID NO: 2601061 - DNA, 23 bp, Homo sapiens
gagttcctgcggagtgaagaggg

SEQ ID NO: 2601062 - DNA, 21 bp, Homo sapiens
gagttccttgatctgtatata

SEQ ID NO: 2601063 - DNA, 13 bp, Homo sapiens
gagttctcagggc

SEQ ID NO: 2601064 - DNA, 20 bp, Homo sapiens
gagttctcagggctcctgcc

SEQ ID NO: 2601065 - DNA, 15 bp, Homo sapiens
gagttcttgtgccat

SEQ ID NO: 2601066 - DNA, 22 bp, Homo sapiens
gagttgatactacagtttgtta

SEQ ID NO: 2601067 - DNA, 21 bp, Homo sapiens
gagttgatagcacagaccctg

SEQ ID NO: 2601068 - DNA, 14 bp, Homo sapiens
gagttgatgtctcc

SEQ ID NO: 2601069 - DNA, 17 bp, Homo sapiens
gagttgattcagctctg

SEQ ID NO: 2601070 - DNA, 18 bp, Homo sapiens
gagttgattcagctctgc

SEQ ID NO: 2601071 - DNA, 11 bp, Homo sapiens
gagttgggggt

SEQ ID NO: 2601072 - DNA, 20 bp, Homo sapiens
gagtttcattctcctgcctg

SEQ ID NO: 2601073 - DNA, 18 bp, Homo sapiens
gagtttgtgtgttgtctt

SEQ ID NO: 2601074 - DNA, 13 bp, Homo sapiens
gagttttgtttta

SEQ ID NO: 2601075 - DNA, 19 bp, Homo sapiens
gagtttttgtttggagagc

SEQ ID NO: 2601076 - DNA, 14 bp, Homo sapiens
gataaaataaatga

SEQ ID NO: 2601077 - DNA, 13 bp, Homo sapiens
gataaacagtagt

SEQ ID NO: 2601078 - DNA, 15 bp, Homo sapiens
gataaagatatcaat

SEQ ID NO: 2601079 - DNA, 15 bp, Homo sapiens
gataaagtagtaaaa

SEQ ID NO: 2601080 - DNA, 15 bp, Homo sapiens
gataaagtttctcag

SEQ ID NO: 2601081 - DNA, 17 bp, Homo sapiens
gataacaacctggagac

SEQ ID NO: 2601082 - DNA, 22 bp, Homo sapiens
gataacctgtacttcaagttaa

SEQ ID NO: 2601083 - DNA, 18 bp, Homo sapiens
gataactgcaattttaat

SEQ ID NO: 2601084 - DNA, 21 bp, Homo sapiens
gataactgcaattttaattga

SEQ ID NO: 2601085 - DNA, 22 bp, Homo sapiens
gataagaatgctggttttccta

SEQ ID NO: 2601086 - DNA, 20 bp, Homo sapiens
gataagagggcacacactgt

SEQ ID NO: 2601087 - DNA, 23 bp, Homo sapiens
gataagttcttatgccatgttaa

SEQ ID NO: 2601088 - DNA, 12 bp, Homo sapiens
gataatacacca

SEQ ID NO: 2601089 - DNA, 14 bp, Homo sapiens
gataatacaccact

SEQ ID NO: 2601090 - DNA, 11 bp, Homo sapiens
gataatgttaa

SEQ ID NO: 2601091 - DNA, 14 bp, Homo sapiens
gataattataatat

SEQ ID NO: 2601092 - DNA, 18 bp, Homo sapiens
gatacaatgctgtgccct

SEQ ID NO: 2601093 - DNA, 19 bp, Homo sapiens
gatacacccaaagtatcag

SEQ ID NO: 2601094 - DNA, 21 bp, Homo sapiens
gatacacccaaagtatcagga

SEQ ID NO: 2601095 - DNA, 21 bp, Homo sapiens
gatacaggaaaagctgctgac

SEQ ID NO: 2601096 - DNA, 12 bp, Homo sapiens
gaggaggccacc

SEQ ID NO: 2601097 - DNA, 14 bp, Homo sapiens
gaggaggccacctc

SEQ ID NO: 2601098 - DNA, 16 bp, Homo sapiens
gaggaggccacctctc

SEQ ID NO: 2601099 - DNA, 13 bp, Homo sapiens
gaggaggcctcca

SEQ ID NO: 2601100 - DNA, 15 bp, Homo sapiens
gaggaggtggcagcc

SEQ ID NO: 2601101 - DNA, 22 bp, Homo sapiens
gaggaggtggcagccctgtagg

SEQ ID NO: 2601102 - DNA, 15 bp, Homo sapiens
gaggagtacaggtga

SEQ ID NO: 2601103 - DNA, 14 bp, Homo sapiens
gaggagtcttgtgt

SEQ ID NO: 2601104 - DNA, 16 bp, Homo sapiens
gaggagttcaatgatc

SEQ ID NO: 2601105 - DNA, 19 bp, Homo sapiens
gaggagttcaatgatctag

SEQ ID NO: 2601106 - DNA, 18 bp, Homo sapiens
gaggatatattttcactt

SEQ ID NO: 2601107 - DNA, 20 bp, Homo sapiens
gaggatcactggagcccagg

SEQ ID NO: 2601108 - DNA, 17 bp, Homo sapiens
gaggatccctctctgga

SEQ ID NO: 2601109 - DNA, 22 bp, Homo sapiens
gaggatctcttgagcctgggag

SEQ ID NO: 2601110 - DNA, 17 bp, Homo sapiens
gaggatgagagcccaga

SEQ ID NO: 2601111 - DNA, 18 bp, Homo sapiens
gaggatgagagcccagag

SEQ ID NO: 2601112 - DNA, 14 bp, Homo sapiens
gaggatggagagag

SEQ ID NO: 2601113 - DNA, 19 bp, Homo sapiens
gaggatggccagtgtctgt

SEQ ID NO: 2601114 - DNA, 20 bp, Homo sapiens
gaggatggcctctgctaagc

SEQ ID NO: 2601115 - DNA, 20 bp, Homo sapiens
gaggatgttctgggacacag

SEQ ID NO: 2601116 - DNA, 19 bp, Homo sapiens
gaggattgcttgagcccag

SEQ ID NO: 2601117 - DNA, 16 bp, Homo sapiens
gaggattgcttgagct

SEQ ID NO: 2601118 - DNA, 15 bp, Homo sapiens
gaggatttcaagcct

SEQ ID NO: 2601119 - DNA, 17 bp, Homo sapiens
gaggatttcaagcctgc

SEQ ID NO: 2601120 - DNA, 19 bp, Homo sapiens
gaggcaatgtcaggaacag

SEQ ID NO: 2601121 - DNA, 18 bp, Homo sapiens
gaggcactgaagtgctta

SEQ ID NO: 2601122 - DNA, 12 bp, Homo sapiens
gaggcagacagc

SEQ ID NO: 2601123 - DNA, 15 bp, Homo sapiens
gaggcagacagcagc

SEQ ID NO: 2601124 - DNA, 16 bp, Homo sapiens
gaggcagacagcagct

SEQ ID NO: 2601125 - DNA, 22 bp, Homo sapiens
gaggcagacttccctgaatgta

SEQ ID NO: 2601126 - DNA, 11 bp, Homo sapiens
gaggcagagga

SEQ ID NO: 2601127 - DNA, 21 bp, Homo sapiens
gaggcagcagtgtgaggccag

SEQ ID NO: 2601128 - DNA, 22 bp, Homo sapiens
gaggcagcagtgtgaggccagg

SEQ ID NO: 2601129 - DNA, 18 bp, Homo sapiens
gaggcagccccattctgc

SEQ ID NO: 2601130 - DNA, 22 bp, Homo sapiens
gaggcagggaagtccccaggcc

SEQ ID NO: 2601131 - DNA, 13 bp, Homo sapiens
gaggcagggtcag

SEQ ID NO: 2601132 - DNA, 14 bp, Homo sapiens
gaggcagggtctca

SEQ ID NO: 2601133 - DNA, 15 bp, Homo sapiens
gaggcagggtctcac

SEQ ID NO: 2601134 - DNA, 18 bp, Homo sapiens
gaggcagggtctcactct

SEQ ID NO: 2601135 - DNA, 19 bp, Homo sapiens
gaggcagggtctcactctg

SEQ ID NO: 2601136 - DNA, 13 bp, Homo sapiens
gaggcatggccct

SEQ ID NO: 2601137 - DNA, 18 bp, Homo sapiens
gaggcatggccctggggt

SEQ ID NO: 2601138 - DNA, 17 bp, Homo sapiens
gaggccaagtgcaggct

SEQ ID NO: 2601139 - DNA, 16 bp, Homo sapiens
gaggccacatgagtcc

SEQ ID NO: 2601140 - DNA, 22 bp, Homo sapiens
gaggccacatgagtcccagtgg

SEQ ID NO: 2601141 - DNA, 13 bp, Homo sapiens
gaggccagcccca

SEQ ID NO: 2601142 - DNA, 12 bp, Homo sapiens
gaggccagcctt

SEQ ID NO: 2601143 - DNA, 13 bp, Homo sapiens
gaggccagccttg

SEQ ID NO: 2601144 - DNA, 12 bp, Homo sapiens
gaggccaggagt

SEQ ID NO: 2601145 - DNA, 15 bp, Homo sapiens
gaggccagggcagag

SEQ ID NO: 2601146 - DNA, 19 bp, Homo sapiens
gaggccagggcagagtgag

SEQ ID NO: 2601147 - DNA, 14 bp, Homo sapiens
gaggccatgggcct

SEQ ID NO: 2601148 - DNA, 18 bp, Homo sapiens
gaggccatgggcctcctg

SEQ ID NO: 2601149 - DNA, 11 bp, Homo sapiens
gaggcccagag

SEQ ID NO: 2601150 - DNA, 13 bp, Homo sapiens
gaggcccagggag

SEQ ID NO: 2601151 - DNA, 20 bp, Homo sapiens
gaggcccctgtctcagggtg

SEQ ID NO: 2601152 - DNA, 17 bp, Homo sapiens
gaggccctcgggcccag

SEQ ID NO: 2601153 - DNA, 19 bp, Homo sapiens
gaggccctcgggcccagcc

SEQ ID NO: 2601154 - DNA, 21 bp, Homo sapiens
gaggccctcgggcccagcccc

SEQ ID NO: 2601155 - DNA, 16 bp, Homo sapiens
gagccagaacctggag

SEQ ID NO: 2601156 - DNA, 13 bp, Homo sapiens
gagccagagaagt

SEQ ID NO: 2601157 - DNA, 15 bp, Homo sapiens
gagccagagaagtga

SEQ ID NO: 2601158 - DNA, 16 bp, Homo sapiens
gagccagagaagtgac

SEQ ID NO: 2601159 - DNA, 19 bp, Homo sapiens
gagccagagaagtgacagg

SEQ ID NO: 2601160 - DNA, 20 bp, Homo sapiens
gagccagagaagtgacaggg

SEQ ID NO: 2601161 - DNA, 15 bp, Homo sapiens
gagccagtcccaggg

SEQ ID NO: 2601162 - DNA, 19 bp, Homo sapiens
gagccagttcagtacctgg

SEQ ID NO: 2601163 - DNA, 21 bp, Homo sapiens
gagccagttcagtacctggag

SEQ ID NO: 2601164 - DNA, 23 bp, Homo sapiens
gagccagttcagtacctggagga

SEQ ID NO: 2601165 - DNA, 19 bp, Homo sapiens
gagccatataagtttgaag

SEQ ID NO: 2601166 - DNA, 23 bp, Homo sapiens
gagccatataagtttgaaggaaa

SEQ ID NO: 2601167 - DNA, 21 bp, Homo sapiens
gagccattttgtgaatggatt

SEQ ID NO: 2601168 - DNA, 15 bp, Homo sapiens
gagcccaccttggct

SEQ ID NO: 2601169 - DNA, 16 bp, Homo sapiens
gagcccacgcccccac

SEQ ID NO: 2601170 - DNA, 22 bp, Homo sapiens
gagcccagaggtaacagaacag

SEQ ID NO: 2601171 - DNA, 21 bp, Homo sapiens
gagcccagctctgaaaccagt

SEQ ID NO: 2601172 - DNA, 13 bp, Homo sapiens
gagccccaagtcc

SEQ ID NO: 2601173 - DNA, 22 bp, Homo sapiens
gagccccacactggggtgccgc

SEQ ID NO: 2601174 - DNA, 12 bp, Homo sapiens
gagccccagccc

SEQ ID NO: 2601175 - DNA, 19 bp, Homo sapiens
gagccccagccccctttgg

SEQ ID NO: 2601176 - DNA, 13 bp, Homo sapiens
gagccccaggcct

SEQ ID NO: 2601177 - DNA, 14 bp, Homo sapiens
gagccccagtgcca

SEQ ID NO: 2601178 - DNA, 17 bp, Homo sapiens
gagccccattcctggga

SEQ ID NO: 2601179 - DNA, 13 bp, Homo sapiens
gagccccgaggcc

SEQ ID NO: 2601180 - DNA, 17 bp, Homo sapiens
gagcccctaccccacac

SEQ ID NO: 2601181 - DNA, 20 bp, Homo sapiens
gagcccctaccccacaccag

SEQ ID NO: 2601182 - DNA, 19 bp, Homo sapiens
gagcccctgggtgggtggt

SEQ ID NO: 2601183 - DNA, 19 bp, Homo sapiens
gagccccttccttgctctg

SEQ ID NO: 2601184 - DNA, 17 bp, Homo sapiens
gagcccggatgcttctc

SEQ ID NO: 2601185 - DNA, 22 bp, Homo sapiens
gagcccgggctgcctgggctgt

SEQ ID NO: 2601186 - DNA, 15 bp, Homo sapiens
gagccctcaaagtga

SEQ ID NO: 2601187 - DNA, 14 bp, Homo sapiens
gagccctggtggca

SEQ ID NO: 2601188 - DNA, 18 bp, Homo sapiens
gagccctggtggcagtgg

SEQ ID NO: 2601189 - DNA, 22 bp, Homo sapiens
gagccgagatcacgccactgca

SEQ ID NO: 2601190 - DNA, 20 bp, Homo sapiens
gagccgagatcgcgccactg

SEQ ID NO: 2601191 - DNA, 17 bp, Homo sapiens
gagccgggtctgcctct

SEQ ID NO: 2601192 - DNA, 13 bp, Homo sapiens
gagccgtggtcct

SEQ ID NO: 2601193 - DNA, 19 bp, Homo sapiens
gagcctcatccgaggcagg

SEQ ID NO: 2601194 - DNA, 22 bp, Homo sapiens
gagcctcctctctcaaactggg

SEQ ID NO: 2601195 - DNA, 12 bp, Homo sapiens
gagcctctgtca

SEQ ID NO: 2601196 - DNA, 21 bp, Homo sapiens
gagcctctgtcactgcaggca

SEQ ID NO: 2601197 - DNA, 12 bp, Homo sapiens
gagcctgaggga

SEQ ID NO: 2601198 - DNA, 16 bp, Homo sapiens
gagcctgcagggtggt

SEQ ID NO: 2601199 - DNA, 20 bp, Homo sapiens
gagcctgcagggtggtgctg

SEQ ID NO: 2601200 - DNA, 22 bp, Homo sapiens
gagcctgcagggtggtgctggg

SEQ ID NO: 2601201 - DNA, 23 bp, Homo sapiens
gagcctgcagggtggtgctggga

SEQ ID NO: 2601202 - DNA, 13 bp, Homo sapiens
gagcctgcctgga

SEQ ID NO: 2601203 - DNA, 19 bp, Homo sapiens
gacaaacacctcccaggag

SEQ ID NO: 2601204 - DNA, 19 bp, Homo sapiens
gacaaactgcatatgtact

SEQ ID NO: 2601205 - DNA, 17 bp, Homo sapiens
gacaaactgccagtttt

SEQ ID NO: 2601206 - DNA, 18 bp, Homo sapiens
gacaaaggttttcctctt

SEQ ID NO: 2601207 - DNA, 23 bp, Homo sapiens
gacaaagttactgattcactgca

SEQ ID NO: 2601208 - DNA, 18 bp, Homo sapiens
gacaaatactcatgtgta

SEQ ID NO: 2601209 - DNA, 15 bp, Homo sapiens
gacaaatcaaagcag

SEQ ID NO: 2601210 - DNA, 17 bp, Homo sapiens
gacaaatcaagcttcag

SEQ ID NO: 2601211 - DNA, 22 bp, Homo sapiens
gacaaatgtgtatcggatgctt

SEQ ID NO: 2601212 - DNA, 22 bp, Homo sapiens
gacaacactcattgacctgagg

SEQ ID NO: 2601213 - DNA, 23 bp, Homo sapiens
gacaacactcattgacctgaggc

SEQ ID NO: 2601214 - DNA, 12 bp, Homo sapiens
gacaacagaagc

SEQ ID NO: 2601215 - DNA, 12 bp, Homo sapiens
gacaacagaagt

SEQ ID NO: 2601216 - DNA, 17 bp, Homo sapiens
gacaaccaccgctcccc

SEQ ID NO: 2601217 - DNA, 19 bp, Homo sapiens
gacaaccaccgctccccag

SEQ ID NO: 2601218 - DNA, 22 bp, Homo sapiens
gacaaccaccgctccccagccc

SEQ ID NO: 2601219 - DNA, 12 bp, Homo sapiens
gacaaccatgac

SEQ ID NO: 2601220 - DNA, 13 bp, Homo sapiens
gacaaccctgcaa

SEQ ID NO: 2601221 - DNA, 21 bp, Homo sapiens
gacaaccgatgctccagccaa

SEQ ID NO: 2601222 - DNA, 16 bp, Homo sapiens
gacaacgaggaagccc

SEQ ID NO: 2601223 - DNA, 22 bp, Homo sapiens
gacaagccaacttgtaaataca

SEQ ID NO: 2601224 - DNA, 22 bp, Homo sapiens
gacaaggattgctactgtccta

SEQ ID NO: 2601225 - DNA, 16 bp, Homo sapiens
gacaaggccccagaga

SEQ ID NO: 2601226 - DNA, 17 bp, Homo sapiens
gacaaggccccagagac

SEQ ID NO: 2601227 - DNA, 14 bp, Homo sapiens
gacaatcagtcccc

SEQ ID NO: 2601228 - DNA, 17 bp, Homo sapiens
gacaatcagtcccctcc

SEQ ID NO: 2601229 - DNA, 19 bp, Homo sapiens
gacaatcagtcccctccca

SEQ ID NO: 2601230 - DNA, 19 bp, Homo sapiens
gacaatcatgaaatatgca

SEQ ID NO: 2601231 - DNA, 17 bp, Homo sapiens
gacaatgacttactgta

SEQ ID NO: 2601232 - DNA, 18 bp, Homo sapiens
gacaatgtgaaaagaaaa

SEQ ID NO: 2601233 - DNA, 16 bp, Homo sapiens
gacaattcatgaactt

SEQ ID NO: 2601234 - DNA, 22 bp, Homo sapiens
gacaatttatatttaataaaat

SEQ ID NO: 2601235 - DNA, 19 bp, Homo sapiens
gacaatttattatggcaca

SEQ ID NO: 2601236 - DNA, 16 bp, Homo sapiens
gacacaaaaagtagat

SEQ ID NO: 2601237 - DNA, 14 bp, Homo sapiens
gacacaacaactcc

SEQ ID NO: 2601238 - DNA, 13 bp, Homo sapiens
gacacacacacgc

SEQ ID NO: 2601239 - DNA, 14 bp, Homo sapiens
gacacacacacgca

SEQ ID NO: 2601240 - DNA, 15 bp, Homo sapiens
gacacacacacgcac

SEQ ID NO: 2601241 - DNA, 19 bp, Homo sapiens
gacacacacacgcacgcac

SEQ ID NO: 2601242 - DNA, 15 bp, Homo sapiens
gacacacagctctgt

SEQ ID NO: 2601243 - DNA, 23 bp, Homo sapiens
gacacagcagcttcaccagagca

SEQ ID NO: 2601244 - DNA, 16 bp, Homo sapiens
gacacagctcttctcc

SEQ ID NO: 2601245 - DNA, 19 bp, Homo sapiens
gacacagctcttctccagg

SEQ ID NO: 2601246 - DNA, 21 bp, Homo sapiens
gacacagctcttctccaggct

SEQ ID NO: 2601247 - DNA, 23 bp, Homo sapiens
gacacagctcttctccaggctgt

SEQ ID NO: 2601248 - DNA, 23 bp, Homo sapiens
gacacagctttatcaccagagag

SEQ ID NO: 2601249 - DNA, 12 bp, Homo sapiens
gacacaggcccg

SEQ ID NO: 2601250 - DNA, 18 bp, Homo sapiens
gacacaggcccggctcca

SEQ ID NO: 2601251 - DNA, 14 bp, Homo sapiens
gacacatgcaaggt

SEQ ID NO: 2601252 - DNA, 20 bp, Homo sapiens
gacacatgtccaagaagccc

SEQ ID NO: 2601253 - DNA, 20 bp, Homo sapiens
gacacattcaaccctggaga

SEQ ID NO: 2601254 - DNA, 13 bp, Homo sapiens
gacaccagagcag

SEQ ID NO: 2601255 - DNA, 18 bp, Homo sapiens
gacaccagagcagatgca

SEQ ID NO: 2601256 - DNA, 14 bp, Homo sapiens
gacaccagccaggc

SEQ ID NO: 2601257 - DNA, 23 bp, Homo sapiens
gacaccagccaggctctgtgctg

SEQ ID NO: 2601258 - DNA, 22 bp, Homo sapiens
gacaccagcctttctcccaggc

SEQ ID NO: 2601259 - DNA, 19 bp, Homo sapiens
gacaccaggagtccctggt

SEQ ID NO: 2601260 - DNA, 19 bp, Homo sapiens
gacaccccttatccaggac

SEQ ID NO: 2601261 - DNA, 20 bp, Homo sapiens
gacaccccttatccaggact

SEQ ID NO: 2601262 - DNA, 12 bp, Homo sapiens
gacaccctgtga

SEQ ID NO: 2601263 - DNA, 14 bp, Homo sapiens
gacacctgccctgc

SEQ ID NO: 2601264 - DNA, 18 bp, Homo sapiens
gacaccttgacagggcac

SEQ ID NO: 2601265 - DNA, 20 bp, Homo sapiens
gacaccttgacagggcacac

SEQ ID NO: 2601266 - DNA, 17 bp, Homo sapiens
gacactaagttatagta

SEQ ID NO: 2601267 - DNA, 18 bp, Homo sapiens
gacactagcccaatgaaa

SEQ ID NO: 2601268 - DNA, 12 bp, Homo sapiens
gacactatatct

SEQ ID NO: 2601269 - DNA, 21 bp, Homo sapiens
gacactcctagagaacgcagc

SEQ ID NO: 2601270 - DNA, 23 bp, Homo sapiens
gacactgaaatatacacacagca

SEQ ID NO: 2601271 - DNA, 13 bp, Homo sapiens
gacactgatgggc

SEQ ID NO: 2601272 - DNA, 16 bp, Homo sapiens
gacactgccacacagg

SEQ ID NO: 2601273 - DNA, 13 bp, Homo sapiens
gacactggcccct

SEQ ID NO: 2601274 - DNA, 20 bp, Homo sapiens
gacactggtattcctgcctc

SEQ ID NO: 2601275 - DNA, 16 bp, Homo sapiens
gacactgtgcccagcc

SEQ ID NO: 2601276 - DNA, 20 bp, Homo sapiens
gacactgtgcccagcccgga

SEQ ID NO: 2601277 - DNA, 23 bp, Homo sapiens
gacactgtgcccagcccggacct

SEQ ID NO: 2601278 - DNA, 16 bp, Homo sapiens
gacacttaaaaatggt

SEQ ID NO: 2601279 - DNA, 19 bp, Homo sapiens
gacacttcagagagctggt

SEQ ID NO: 2601280 - DNA, 20 bp, Homo sapiens
gacacttcagagagctggta

SEQ ID NO: 2601281 - DNA, 16 bp, Homo sapiens
gacagaaaacatgttt

SEQ ID NO: 2601282 - DNA, 14 bp, Homo sapiens
gacagaacactgtc

SEQ ID NO: 2601283 - DNA, 15 bp, Homo sapiens
gacagaacactgtct

SEQ ID NO: 2601284 - DNA, 15 bp, Homo sapiens
gacagacacacacac

SEQ ID NO: 2601285 - DNA, 14 bp, Homo sapiens
gacagacacaggcc

SEQ ID NO: 2601286 - DNA, 15 bp, Homo sapiens
gacagacacaggccc

SEQ ID NO: 2601287 - DNA, 20 bp, Homo sapiens
gacagacacaggcccggctc

SEQ ID NO: 2601288 - DNA, 18 bp, Homo sapiens
gacagacatctctgcacc

SEQ ID NO: 2601289 - DNA, 15 bp, Homo sapiens
gacagagacctcctg

SEQ ID NO: 2601290 - DNA, 14 bp, Homo sapiens
gacagagagagaga

SEQ ID NO: 2601291 - DNA, 19 bp, Homo sapiens
gacagagccatgctgggaa

SEQ ID NO: 2601292 - DNA, 12 bp, Homo sapiens
gacagaggcagc

SEQ ID NO: 2601293 - DNA, 23 bp, Homo sapiens
gacagaggcagccccattctgcc

SEQ ID NO: 2601294 - DNA, 12 bp, Homo sapiens
gacagaggcctg

SEQ ID NO: 2601295 - DNA, 13 bp, Homo sapiens
gacagaggcctgc

SEQ ID NO: 2601296 - DNA, 22 bp, Homo sapiens
gacagagggggtggcctcccaa

SEQ ID NO: 2601297 - DNA, 16 bp, Homo sapiens
gacagagtatgaacac

SEQ ID NO: 2601298 - DNA, 15 bp, Homo sapiens
gacagagtctgggtg

SEQ ID NO: 2601299 - DNA, 22 bp, Homo sapiens
gacagagtgagactctgtctca

SEQ ID NO: 2601300 - DNA, 20 bp, Homo sapiens
gacagatcaagctgtgagac

SEQ ID NO: 2601301 - DNA, 18 bp, Homo sapiens
gacagatcaatggcgcag

SEQ ID NO: 2601302 - DNA, 22 bp, Homo sapiens
gacagcaacggggaggccaagt

SEQ ID NO: 2601303 - DNA, 13 bp, Homo sapiens
gacagcagctcag

SEQ ID NO: 2601304 - DNA, 12 bp, Homo sapiens
gacagcaggtgg

SEQ ID NO: 2601305 - DNA, 16 bp, Homo sapiens
gacagcaggtgggaaa

SEQ ID NO: 2601306 - DNA, 20 bp, Homo sapiens
gacagccacggccaggccag

SEQ ID NO: 2601307 - DNA, 21 bp, Homo sapiens
gacagccacggccaggccaga

SEQ ID NO: 2601308 - DNA, 11 bp, Homo sapiens
gacagcctgta

SEQ ID NO: 2601309 - DNA, 13 bp, Homo sapiens
gacagctccttct

SEQ ID NO: 2601310 - DNA, 15 bp, Homo sapiens
gacagctccttctgt

SEQ ID NO: 2601311 - DNA, 19 bp, Homo sapiens
gacagctccttctgtccta

SEQ ID NO: 2601312 - DNA, 12 bp, Homo sapiens
gacagctctgca

SEQ ID NO: 2601313 - DNA, 15 bp, Homo sapiens
gacagctctgcctgt

SEQ ID NO: 2601314 - DNA, 12 bp, Homo sapiens
gacagctgcctg

SEQ ID NO: 2601315 - DNA, 21 bp, Homo sapiens
gacagcttctcatcctgcagg

SEQ ID NO: 2601316 - DNA, 14 bp, Homo sapiens
gacaggacagtgct

SEQ ID NO: 2601317 - DNA, 15 bp, Homo sapiens
gacaggacctgacta

SEQ ID NO: 2601318 - DNA, 23 bp, Homo sapiens
gacaggatgggggctggcctctg

SEQ ID NO: 2601319 - DNA, 20 bp, Homo sapiens
gacaggcaagcacctcctgc

SEQ ID NO: 2601320 - DNA, 16 bp, Homo sapiens
gacaggcaatgctggc

SEQ ID NO: 2601321 - DNA, 24 bp, Homo sapiens
gacaggcaatgctggctgttggct

SEQ ID NO: 2601322 - DNA, 22 bp, Homo sapiens
gacaggcatgttctctgaggac

SEQ ID NO: 2601323 - DNA, 11 bp, Homo sapiens
gacaggcccaa

SEQ ID NO: 2601324 - DNA, 15 bp, Homo sapiens
gacaggcccaagaga

SEQ ID NO: 2601325 - DNA, 17 bp, Homo sapiens
gacagggaagctacagg

SEQ ID NO: 2601326 - DNA, 16 bp, Homo sapiens
gacagggaggtgaccc

SEQ ID NO: 2601327 - DNA, 23 bp, Homo sapiens
gacagggatgagcatggagctgg

SEQ ID NO: 2601328 - DNA, 23 bp, Homo sapiens
gacagggcacaccgggcactcag

SEQ ID NO: 2601329 - DNA, 24 bp, Homo sapiens
gacagggcacaccgggcactcaga

SEQ ID NO: 2601330 - DNA, 14 bp, Homo sapiens
gacagggctggccc

SEQ ID NO: 2601331 - DNA, 20 bp, Homo sapiens
gacagtatggcagctttcct

SEQ ID NO: 2601332 - DNA, 14 bp, Homo sapiens
gacagtcaccccag

SEQ ID NO: 2601333 - DNA, 16 bp, Homo sapiens
gacagtcaccccagga

SEQ ID NO: 2601334 - DNA, 15 bp, Homo sapiens
gacagtccagcctgg

SEQ ID NO: 2601335 - DNA, 12 bp, Homo sapiens
gacagtccctgc

SEQ ID NO: 2601336 - DNA, 15 bp, Homo sapiens
gacagtccctgccaa

SEQ ID NO: 2601337 - DNA, 23 bp, Homo sapiens
gacagtcctgggagaacctcagg

SEQ ID NO: 2601338 - DNA, 21 bp, Homo sapiens
gacagtgcctgggaatgtatt

SEQ ID NO: 2601339 - DNA, 17 bp, Homo sapiens
gacagtgcttcagcctg

SEQ ID NO: 2601340 - DNA, 20 bp, Homo sapiens
gacagtggattgcatttctt

SEQ ID NO: 2601341 - DNA, 15 bp, Homo sapiens
gacagtgggaaatat

SEQ ID NO: 2601342 - DNA, 15 bp, Homo sapiens
gacagttcatatgta

SEQ ID NO: 2601343 - DNA, 12 bp, Homo sapiens
gacagtttctta

SEQ ID NO: 2601344 - DNA, 14 bp, Homo sapiens
gacagtttcttagc

SEQ ID NO: 2601345 - DNA, 20 bp, Homo sapiens
gacagtttcttagcttttta

SEQ ID NO: 2601346 - DNA, 14 bp, Homo sapiens
gacataacgttttt

SEQ ID NO: 2601347 - DNA, 22 bp, Homo sapiens
gacataacgtttttcctttaaa

SEQ ID NO: 2601348 - DNA, 19 bp, Homo sapiens
gagagacgtgtacatagtg

SEQ ID NO: 2601349 - DNA, 23 bp, Homo sapiens
gagagagaagtgcccctgctgcc

SEQ ID NO: 2601350 - DNA, 18 bp, Homo sapiens
gagagatgggagctcctc

SEQ ID NO: 2601351 - DNA, 21 bp, Homo sapiens
gagagcaggctggcagctctc

SEQ ID NO: 2601352 - DNA, 16 bp, Homo sapiens
gagagccagaacctgg

SEQ ID NO: 2601353 - DNA, 15 bp, Homo sapiens
gagagccagagaagt

SEQ ID NO: 2601354 - DNA, 19 bp, Homo sapiens
gagagccagagaagtgaca

SEQ ID NO: 2601355 - DNA, 10 bp, Homo sapiens
gagagcccag

SEQ ID NO: 2601356 - DNA, 11 bp, Homo sapiens
gagagcccagc

SEQ ID NO: 2601357 - DNA, 18 bp, Homo sapiens
gagagcccctcacacagc

SEQ ID NO: 2601358 - DNA, 13 bp, Homo sapiens
gagagcctggtgc

SEQ ID NO: 2601359 - DNA, 14 bp, Homo sapiens
gagagccttccagg

SEQ ID NO: 2601360 - DNA, 21 bp, Homo sapiens
gagagcgtgctccagcctggc

SEQ ID NO: 2601361 - DNA, 19 bp, Homo sapiens
gagagctagaacccggcag

SEQ ID NO: 2601362 - DNA, 19 bp, Homo sapiens
gagagctagaacctggaga

SEQ ID NO: 2601363 - DNA, 15 bp, Homo sapiens
gagagctagcagcag

SEQ ID NO: 2601364 - DNA, 21 bp, Homo sapiens
gagagctagcagcagggaggg

SEQ ID NO: 2601365 - DNA, 14 bp, Homo sapiens
gagagctggagcct

SEQ ID NO: 2601366 - DNA, 16 bp, Homo sapiens
gagagctggagcctgg

SEQ ID NO: 2601367 - DNA, 21 bp, Homo sapiens
gagagctggagcctggtgccc

SEQ ID NO: 2601368 - DNA, 14 bp, Homo sapiens
gagagctggggaag

SEQ ID NO: 2601369 - DNA, 23 bp, Homo sapiens
gagagctttctgtccttttggca

SEQ ID NO: 2601370 - DNA, 20 bp, Homo sapiens
gagaggaaatattgctgggg

SEQ ID NO: 2601371 - DNA, 21 bp, Homo sapiens
gagaggaaatattgctggggt

SEQ ID NO: 2601372 - DNA, 16 bp, Homo sapiens
gagaggagagccagag

SEQ ID NO: 2601373 - DNA, 19 bp, Homo sapiens
gagaggagcgggacctgtg

SEQ ID NO: 2601374 - DNA, 21 bp, Homo sapiens
gagaggagcgggacctgtggc

SEQ ID NO: 2601375 - DNA, 22 bp, Homo sapiens
gagaggagcgggacctgtggct

SEQ ID NO: 2601376 - DNA, 13 bp, Homo sapiens
gagaggagttcaa

SEQ ID NO: 2601377 - DNA, 16 bp, Homo sapiens
gagaggagttcaatga

SEQ ID NO: 2601378 - DNA, 17 bp, Homo sapiens
gagaggagttcaatgat

SEQ ID NO: 2601379 - DNA, 18 bp, Homo sapiens
gagaggagttcaatgatc

SEQ ID NO: 2601380 - DNA, 12 bp, Homo sapiens
gagaggatgaat

SEQ ID NO: 2601381 - DNA, 21 bp, Homo sapiens
gagaggatgaatgtatgtgca

SEQ ID NO: 2601382 - DNA, 18 bp, Homo sapiens
gagaggatgagagcccag

SEQ ID NO: 2601383 - DNA, 19 bp, Homo sapiens
gagaggatgagagcccaga

SEQ ID NO: 2601384 - DNA, 20 bp, Homo sapiens
gagaggatgagagcccagag

SEQ ID NO: 2601385 - DNA, 12 bp, Homo sapiens
gaagacacagac

SEQ ID NO: 2601386 - DNA, 18 bp, Homo sapiens
gaagacaccagagcagat

SEQ ID NO: 2601387 - DNA, 15 bp, Homo sapiens
gaagacatggagact

SEQ ID NO: 2601388 - DNA, 21 bp, Homo sapiens
gaagacatggagactcctgcc

SEQ ID NO: 2601389 - DNA, 21 bp, Homo sapiens
gaagaccacatccacacacgc

SEQ ID NO: 2601390 - DNA, 20 bp, Homo sapiens
gaagaccagctttgcagtga

SEQ ID NO: 2601391 - DNA, 15 bp, Homo sapiens
gaagaccccacccaa

SEQ ID NO: 2601392 - DNA, 13 bp, Homo sapiens
gaagactgtggct

SEQ ID NO: 2601393 - DNA, 13 bp, Homo sapiens
gaagactttggaa

SEQ ID NO: 2601394 - DNA, 12 bp, Homo sapiens
gaagagaaacca

SEQ ID NO: 2601395 - DNA, 20 bp, Homo sapiens
gaagagaggagttcaatgat

SEQ ID NO: 2601396 - DNA, 21 bp, Homo sapiens
gaagagaggagttcaatgatc

SEQ ID NO: 2601397 - DNA, 21 bp, Homo sapiens
gaagagagtccatatttcaat

SEQ ID NO: 2601398 - DNA, 13 bp, Homo sapiens
gaagagctgttca

SEQ ID NO: 2601399 - DNA, 15 bp, Homo sapiens
gaagagctgttcaca

SEQ ID NO: 2601400 - DNA, 18 bp, Homo sapiens
gaagaggcgggccagcca

SEQ ID NO: 2601401 - DNA, 16 bp, Homo sapiens
gaagaggctggtgctg

SEQ ID NO: 2601402 - DNA, 20 bp, Homo sapiens
gaagagggagaagcatgaaa

SEQ ID NO: 2601403 - DNA, 13 bp, Homo sapiens
gaagagggcctgt

SEQ ID NO: 2601404 - DNA, 20 bp, Homo sapiens
gaagagtagcatttcattct

SEQ ID NO: 2601405 - DNA, 16 bp, Homo sapiens
gaagagtcctctgaat

SEQ ID NO: 2601406 - DNA, 21 bp, Homo sapiens
gaagatataactattgcccag

SEQ ID NO: 2601407 - DNA, 13 bp, Homo sapiens
gaagatcctaccc

SEQ ID NO: 2601408 - DNA, 13 bp, Homo sapiens
gaagatgaaagag

SEQ ID NO: 2601409 - DNA, 13 bp, Homo sapiens
gaagatgatcaga

SEQ ID NO: 2601410 - DNA, 16 bp, Homo sapiens
gaagatgatcagacct

SEQ ID NO: 2601411 - DNA, 20 bp, Homo sapiens
gaagatggcatcctgtgaag

SEQ ID NO: 2601412 - DNA, 20 bp, Homo sapiens
gaagatttgatgctggagag

SEQ ID NO: 2601413 - DNA, 17 bp, Homo sapiens
gaagcaaactaagcccc

SEQ ID NO: 2601414 - DNA, 16 bp, Homo sapiens
gaagcaaagcaccagc

SEQ ID NO: 2601415 - DNA, 23 bp, Homo sapiens
gaagcaacccaaatgttcatcaa

SEQ ID NO: 2601416 - DNA, 23 bp, Homo sapiens
gaagcactttgggattctttcca

SEQ ID NO: 2601417 - DNA, 21 bp, Homo sapiens
gaagcagatgcaaagaggcaa

SEQ ID NO: 2601418 - DNA, 23 bp, Homo sapiens
gaagcagatgcaaagaggcaaga

SEQ ID NO: 2601419 - DNA, 14 bp, Homo sapiens
gaagcaggctacac

SEQ ID NO: 2601420 - DNA, 19 bp, Homo sapiens
gaagcaggctacactgaca

SEQ ID NO: 2601421 - DNA, 23 bp, Homo sapiens
gaagcaggctacactgacactgg

SEQ ID NO: 2601422 - DNA, 15 bp, Homo sapiens
gaagcaggctggagg

SEQ ID NO: 2601423 - DNA, 16 bp, Homo sapiens
gaagcatgtttcatgt

SEQ ID NO: 2601424 - DNA, 17 bp, Homo sapiens
gaagcatttactttgtg

SEQ ID NO: 2601425 - DNA, 15 bp, Homo sapiens
gaagccactgaagct

SEQ ID NO: 2601426 - DNA, 18 bp, Homo sapiens
gaagccactgaagctggg

SEQ ID NO: 2601427 - DNA, 22 bp, Homo sapiens
gaagccactttctacaggccag

SEQ ID NO: 2601428 - DNA, 18 bp, Homo sapiens
gaagccaggagcaaatgt

SEQ ID NO: 2601429 - DNA, 15 bp, Homo sapiens
gaagcccaagtgaaa

SEQ ID NO: 2601430 - DNA, 16 bp, Homo sapiens
gaagcccaagtgaaat

SEQ ID NO: 2601431 - DNA, 14 bp, Homo sapiens
gaagccgctgctgg

SEQ ID NO: 2601432 - DNA, 16 bp, Homo sapiens
gaagccggagggtgtt

SEQ ID NO: 2601433 - DNA, 18 bp, Homo sapiens
gaagccggcggcccaagc

SEQ ID NO: 2601434 - DNA, 16 bp, Homo sapiens
gaagccgtgccctgcc

SEQ ID NO: 2601435 - DNA, 19 bp, Homo sapiens
gaagccgtgccctgccccc

SEQ ID NO: 2601436 - DNA, 15 bp, Homo sapiens
gaagcctgcaggagt

SEQ ID NO: 2601437 - DNA, 20 bp, Homo sapiens
gaagcctgttttgttggaag

SEQ ID NO: 2601438 - DNA, 13 bp, Homo sapiens
gaagcctttggga

SEQ ID NO: 2601439 - DNA, 16 bp, Homo sapiens
gaagcgagcactgacc

SEQ ID NO: 2601440 - DNA, 12 bp, Homo sapiens
gaagctagctcc

SEQ ID NO: 2601441 - DNA, 15 bp, Homo sapiens
gaagctagctcccct

SEQ ID NO: 2601442 - DNA, 19 bp, Homo sapiens
gaagctagctcccctcctc

SEQ ID NO: 2601443 - DNA, 21 bp, Homo sapiens
gaagctcagcccacccccctc

SEQ ID NO: 2601444 - DNA, 14 bp, Homo sapiens
gaagctcagggcct

SEQ ID NO: 2601445 - DNA, 16 bp, Homo sapiens
gaagctcagggcctgg

SEQ ID NO: 2601446 - DNA, 20 bp, Homo sapiens
gaagctcagggcctggctca

SEQ ID NO: 2601447 - DNA, 14 bp, Homo sapiens
gaagctcccaggaa

SEQ ID NO: 2601448 - DNA, 13 bp, Homo sapiens
gaagctctgaagt

SEQ ID NO: 2601449 - DNA, 16 bp, Homo sapiens
gaagctctgaagtcac

SEQ ID NO: 2601450 - DNA, 20 bp, Homo sapiens
gaagctctgaagtcacatca

SEQ ID NO: 2601451 - DNA, 12 bp, Homo sapiens
gaagctctggct

SEQ ID NO: 2601452 - DNA, 20 bp, Homo sapiens
gaagctctggctgaaccctg

SEQ ID NO: 2601453 - DNA, 23 bp, Homo sapiens
gaagctctggctgaaccctgtgc

SEQ ID NO: 2601454 - DNA, 22 bp, Homo sapiens
gaagctgaagtgcatccaaagg

SEQ ID NO: 2601455 - DNA, 18 bp, Homo sapiens
gaagctgacgaacttcca

SEQ ID NO: 2601456 - DNA, 17 bp, Homo sapiens
gaagctgagcaccaggg

SEQ ID NO: 2601457 - DNA, 21 bp, Homo sapiens
gaagctgatgctttgcttcaa

SEQ ID NO: 2601458 - DNA, 18 bp, Homo sapiens
gaagctgttgtacattta

SEQ ID NO: 2601459 - DNA, 15 bp, Homo sapiens
gaagcttcagaagtt

SEQ ID NO: 2601460 - DNA, 23 bp, Homo sapiens
gaagcttcttaaatgagaaggaa

SEQ ID NO: 2601461 - DNA, 15 bp, Homo sapiens
gaagctttgaaggcc

SEQ ID NO: 2601462 - DNA, 18 bp, Homo sapiens
gaaggaaaaggcagggag

SEQ ID NO: 2601463 - DNA, 20 bp, Homo sapiens
gaaggaaaaggcagggagcg

SEQ ID NO: 2601464 - DNA, 21 bp, Homo sapiens
gaaggaaacccagctctggtc

SEQ ID NO: 2601465 - DNA, 22 bp, Homo sapiens
gaaggaaacccagctctggtcc

SEQ ID NO: 2601466 - DNA, 16 bp, Homo sapiens
gaaggaagtgaagagg

SEQ ID NO: 2601467 - DNA, 16 bp, Homo sapiens
gaaggacaaggctaga

SEQ ID NO: 2601468 - DNA, 21 bp, Homo sapiens
gaaggactgtgacaggcagca

SEQ ID NO: 2601469 - DNA, 15 bp, Homo sapiens
gaaggagacagagct

SEQ ID NO: 2601470 - DNA, 18 bp, Homo sapiens
gaaggaggaggaggaggt

SEQ ID NO: 2601471 - DNA, 19 bp, Homo sapiens
gaaggagggttagggaggg

SEQ ID NO: 2601472 - DNA, 15 bp, Homo sapiens
gaaggaggtgaggga

SEQ ID NO: 2601473 - DNA, 12 bp, Homo sapiens
gaaggatacaaa

SEQ ID NO: 2601474 - DNA, 16 bp, Homo sapiens
gaaggatgagcattta

SEQ ID NO: 2601475 - DNA, 15 bp, Homo sapiens
gaaggatgtacattt

SEQ ID NO: 2601476 - DNA, 16 bp, Homo sapiens
gaaggatgtacatttc

SEQ ID NO: 2601477 - DNA, 17 bp, Homo sapiens
gaaggatgtacatttcc

SEQ ID NO: 2601478 - DNA, 13 bp, Homo sapiens
gaaggattgtaaa

SEQ ID NO: 2601479 - DNA, 12 bp, Homo sapiens
gaaggcaaaaaa

SEQ ID NO: 2601480 - DNA, 15 bp, Homo sapiens
gaaggcaaatgactt

SEQ ID NO: 2601481 - DNA, 16 bp, Homo sapiens
gaaggcagccaccagc

SEQ ID NO: 2601482 - DNA, 17 bp, Homo sapiens
gaaggccccgcccaggc

SEQ ID NO: 2601483 - DNA, 16 bp, Homo sapiens
gaaggctcgagcatgc

SEQ ID NO: 2601484 - DNA, 23 bp, Homo sapiens
gaaggctcttctccccagagttc

SEQ ID NO: 2601485 - DNA, 13 bp, Homo sapiens
gaaggctggctgg

SEQ ID NO: 2601486 - DNA, 16 bp, Homo sapiens
gaaggctggctgggca

SEQ ID NO: 2601487 - DNA, 20 bp, Homo sapiens
gaaggctgggttctgatcct

SEQ ID NO: 2601488 - DNA, 22 bp, Homo sapiens
gaaggctgggttctgatcctag

SEQ ID NO: 2601489 - DNA, 20 bp, Homo sapiens
gaagggaccaaggcaaggca

SEQ ID NO: 2601490 - DNA, 22 bp, Homo sapiens
gaagggaccaaggcaaggcagg

SEQ ID NO: 2601491 - DNA, 16 bp, Homo sapiens
gaagggagagccagct

SEQ ID NO: 2601492 - DNA, 17 bp, Homo sapiens
gaagggatggattccaa

SEQ ID NO: 2601493 - DNA, 20 bp, Homo sapiens
gaagggattttagtcacacg

SEQ ID NO: 2601494 - DNA, 19 bp, Homo sapiens
gaagggcagggctgaggcc

SEQ ID NO: 2601495 - DNA, 20 bp, Homo sapiens
gaagggccagtcctgcctgg

SEQ ID NO: 2601496 - DNA, 18 bp, Homo sapiens
gaagggccagtctgggct

SEQ ID NO: 2601497 - DNA, 20 bp, Homo sapiens
gaagggctagaacctggagg

SEQ ID NO: 2601498 - DNA, 21 bp, Homo sapiens
gaagggcttggactcaagcaa

SEQ ID NO: 2601499 - DNA, 22 bp, Homo sapiens
gaaggggcctcaccgagtgggg

SEQ ID NO: 2601500 - DNA, 14 bp, Homo sapiens
gaagggggccatga

SEQ ID NO: 2601501 - DNA, 22 bp, Homo sapiens
gaagggggccatgaggcctcag

SEQ ID NO: 2601502 - DNA, 23 bp, Homo sapiens
gaaggtcactcttcctgcaagga

SEQ ID NO: 2601503 - DNA, 13 bp, Homo sapiens
gaaggttgaagag

SEQ ID NO: 2601504 - DNA, 20 bp, Homo sapiens
gaaggtttactctgtggcca

SEQ ID NO: 2601505 - DNA, 20 bp, Homo sapiens
gaaggtttggtgtgtggaga

SEQ ID NO: 2601506 - DNA, 15 bp, Homo sapiens
gaaggtttgtatatt

SEQ ID NO: 2601507 - DNA, 16 bp, Homo sapiens
gaaggtttgtatattg

SEQ ID NO: 2601508 - DNA, 16 bp, Homo sapiens
gaaggtttgtgttttt

SEQ ID NO: 2601509 - DNA, 19 bp, Homo sapiens
gaagtaaccatttgcactg

SEQ ID NO: 2601510 - DNA, 20 bp, Homo sapiens
gaagtaatatgcacacattt

SEQ ID NO: 2601511 - DNA, 22 bp, Homo sapiens
gaagtaatatgcacacattttt

SEQ ID NO: 2601512 - DNA, 13 bp, Homo sapiens
gaagtaatgaatt

SEQ ID NO: 2601513 - DNA, 21 bp, Homo sapiens
gaagtacgttattgttgactt

SEQ ID NO: 2601514 - DNA, 13 bp, Homo sapiens
gaagtagaaaggg

SEQ ID NO: 2601515 - DNA, 14 bp, Homo sapiens
gaagtatacctgat

SEQ ID NO: 2601516 - DNA, 16 bp, Homo sapiens
gaagtatccttcagcc

SEQ ID NO: 2601517 - DNA, 15 bp, Homo sapiens
gaagtattataaatt

SEQ ID NO: 2601518 - DNA, 19 bp, Homo sapiens
gaagtattataaattatgt

SEQ ID NO: 2601519 - DNA, 20 bp, Homo sapiens
gaagtattataaattatgtt

SEQ ID NO: 2601520 - DNA, 18 bp, Homo sapiens
gaagtctctaggttctga

SEQ ID NO: 2601521 - DNA, 15 bp, Homo sapiens
gaagtctcttttctt

SEQ ID NO: 2601522 - DNA, 14 bp, Homo sapiens
gaagtgaaactgct

SEQ ID NO: 2601523 - DNA, 13 bp, Homo sapiens
gaagtgacaggga

SEQ ID NO: 2601524 - DNA, 15 bp, Homo sapiens
gaagtgacagggaag

SEQ ID NO: 2601525 - DNA, 21 bp, Homo sapiens
gaagtgactttggctgcatgc

SEQ ID NO: 2601526 - DNA, 15 bp, Homo sapiens
gaagtgcccctgctg

SEQ ID NO: 2601527 - DNA, 22 bp, Homo sapiens
gaagtgcccctgctgcctcccc

SEQ ID NO: 2601528 - DNA, 17 bp, Homo sapiens
gaagtggactggcccct

SEQ ID NO: 2601529 - DNA, 15 bp, Homo sapiens
gaagtggggacagag

SEQ ID NO: 2601530 - DNA, 15 bp, Homo sapiens
gaagtgtaacagctg

SEQ ID NO: 2601531 - DNA, 16 bp, Homo sapiens
gaagtgtaacagctga

SEQ ID NO: 2601532 - DNA, 18 bp, Homo sapiens
gaagtgtaacagctgagg

SEQ ID NO: 2601533 - DNA, 17 bp, Homo sapiens
gaagtgtgggtctgtgt

SEQ ID NO: 2601534 - DNA, 13 bp, Homo sapiens
gaagtgttgcatg

SEQ ID NO: 2601535 - DNA, 21 bp, Homo sapiens
gaagtgttgcatggatgtttt

SEQ ID NO: 2601536 - DNA, 17 bp, Homo sapiens
gaataaagcctgctttt

SEQ ID NO: 2601537 - DNA, 20 bp, Homo sapiens
gaataaagttctgagtgttt

SEQ ID NO: 2601538 - DNA, 16 bp, Homo sapiens
gaataaagttgaagct

SEQ ID NO: 2601539 - DNA, 16 bp, Homo sapiens
gaataaatatgcctct

SEQ ID NO: 2601540 - DNA, 11 bp, Homo sapiens
gaataaatgtc

SEQ ID NO: 2601541 - DNA, 15 bp, Homo sapiens
gaataaattgctcct

SEQ ID NO: 2601542 - DNA, 14 bp, Homo sapiens
gaataacatgtaat

SEQ ID NO: 2601543 - DNA, 18 bp, Homo sapiens
gaataacatgtaattaag

SEQ ID NO: 2601544 - DNA, 22 bp, Homo sapiens
gaataaccacttaaaaaatgtc

SEQ ID NO: 2601545 - DNA, 21 bp, Homo sapiens
gaataagccattctgactcat

SEQ ID NO: 2601546 - DNA, 12 bp, Homo sapiens
gaataaggcctt

SEQ ID NO: 2601547 - DNA, 14 bp, Homo sapiens
gaataagttattgc

SEQ ID NO: 2601548 - DNA, 21 bp, Homo sapiens
gaataataaaagtatatatat

SEQ ID NO: 2601549 - DNA, 17 bp, Homo sapiens
gaataatacagtatctc

SEQ ID NO: 2601550 - DNA, 18 bp, Homo sapiens
gaataatcacgctttcct

SEQ ID NO: 2601551 - DNA, 22 bp, Homo sapiens
gaataatctttgggtaacttca

SEQ ID NO: 2601552 - DNA, 13 bp, Homo sapiens
gaataatgggctt

SEQ ID NO: 2601553 - DNA, 20 bp, Homo sapiens
gaataatggtaccagataaa

SEQ ID NO: 2601554 - DNA, 14 bp, Homo sapiens
gaataatgtaaaat

SEQ ID NO: 2601555 - DNA, 22 bp, Homo sapiens
gaataatgtaaaatgttgaata

SEQ ID NO: 2601556 - DNA, 17 bp, Homo sapiens
gaatacaaacacctgga

SEQ ID NO: 2601557 - DNA, 15 bp, Homo sapiens
gaatacctgtccccc

SEQ ID NO: 2601558 - DNA, 19 bp, Homo sapiens
gaatacttttgccctttga

SEQ ID NO: 2601559 - DNA, 19 bp, Homo sapiens
gaatagcaaggtgctcaca

SEQ ID NO: 2601560 - DNA, 15 bp, Homo sapiens
gaatagctgggacta

SEQ ID NO: 2601561 - DNA, 23 bp, Homo sapiens
gaatagctgggactacaggtgtg

SEQ ID NO: 2601562 - DNA, 16 bp, Homo sapiens
gaatagttgagcccca

SEQ ID NO: 2601563 - DNA, 21 bp, Homo sapiens
gaatataaacactatatggca

SEQ ID NO: 2601564 - DNA, 11 bp, Homo sapiens
gaatatattat

SEQ ID NO: 2601565 - DNA, 12 bp, Homo sapiens
gaatatattata

SEQ ID NO: 2601566 - DNA, 17 bp, Homo sapiens
gaatatcccctcccagt

SEQ ID NO: 2601567 - DNA, 17 bp, Homo sapiens
gaatatgggagaaatag

SEQ ID NO: 2601568 - DNA, 18 bp, Homo sapiens
gaatatgggagaaatagt

SEQ ID NO: 2601569 - DNA, 11 bp, Homo sapiens
gaatattcagg

SEQ ID NO: 2601570 - DNA, 18 bp, Homo sapiens
gaatattcccaagcccat

SEQ ID NO: 2601571 - DNA, 20 bp, Homo sapiens
gaatatttatatttcactat

SEQ ID NO: 2601572 - DNA, 19 bp, Homo sapiens
gaatatttattacctctga

SEQ ID NO: 2601573 - DNA, 21 bp, Homo sapiens
gaatatttattacctctgata

SEQ ID NO: 2601574 - DNA, 19 bp, Homo sapiens
gaatatttccatatggatt

SEQ ID NO: 2601575 - DNA, 17 bp, Homo sapiens
gaatcaaagacatggaa

SEQ ID NO: 2601576 - DNA, 22 bp, Homo sapiens
gaatcaaagcagttaactttaa

SEQ ID NO: 2601577 - DNA, 15 bp, Homo sapiens
gaatcaagagctgcc

SEQ ID NO: 2601578 - DNA, 21 bp, Homo sapiens
gaatcaataatatattttctg

SEQ ID NO: 2601579 - DNA, 18 bp, Homo sapiens
gaatcactcttgtggatg

SEQ ID NO: 2601580 - DNA, 13 bp, Homo sapiens
gaatcatgtagta

SEQ ID NO: 2601581 - DNA, 19 bp, Homo sapiens
gaatcatgtgaacccggga

SEQ ID NO: 2601582 - DNA, 23 bp, Homo sapiens
gaatcatttgttcaaagctgttg

SEQ ID NO: 2601583 - DNA, 15 bp, Homo sapiens
gaatccacccatcct

SEQ ID NO: 2601584 - DNA, 24 bp, Homo sapiens
gaatccacccatcctaccaatgca

SEQ ID NO: 2601585 - DNA, 13 bp, Homo sapiens
gaatccatgcttg

SEQ ID NO: 2601586 - DNA, 23 bp, Homo sapiens
gaatcccccttgccaccccaccc

SEQ ID NO: 2601587 - DNA, 16 bp, Homo sapiens
gaatcccctccctgtc

SEQ ID NO: 2601588 - DNA, 16 bp, Homo sapiens
gaatcgaggaaccaga

SEQ ID NO: 2601589 - DNA, 19 bp, Homo sapiens
gaatcgaggaaccagagcc

SEQ ID NO: 2601590 - DNA, 14 bp, Homo sapiens
gaatcgcttctctt

SEQ ID NO: 2601591 - DNA, 21 bp, Homo sapiens
gaatctattatactgtattaa

SEQ ID NO: 2601592 - DNA, 13 bp, Homo sapiens
gaatctatttaag

SEQ ID NO: 2601593 - DNA, 21 bp, Homo sapiens
gaatctggaccccatctgtga

SEQ ID NO: 2601594 - DNA, 15 bp, Homo sapiens
gaatgaaaaatttaa

SEQ ID NO: 2601595 - DNA, 23 bp, Homo sapiens
gaatgaaaaatttaagcattgtt

SEQ ID NO: 2601596 - DNA, 15 bp, Homo sapiens
gaatgaaaactcatt

SEQ ID NO: 2601597 - DNA, 20 bp, Homo sapiens
gaatgaaacccccacacaca

SEQ ID NO: 2601598 - DNA, 12 bp, Homo sapiens
gaatgaaagagt

SEQ ID NO: 2601599 - DNA, 15 bp, Homo sapiens
gaatgaaatactgtt

SEQ ID NO: 2601600 - DNA, 18 bp, Homo sapiens
gaatgaaccacatcttgc

SEQ ID NO: 2601601 - DNA, 23 bp, Homo sapiens
gaatgaaccacatcttgctctgc

SEQ ID NO: 2601602 - DNA, 17 bp, Homo sapiens
gaatgaaccttctggcc

SEQ ID NO: 2601603 - DNA, 17 bp, Homo sapiens
gaatgaaggtgtcagaa

SEQ ID NO: 2601604 - DNA, 14 bp, Homo sapiens
gaatgaatggctaa

SEQ ID NO: 2601605 - DNA, 18 bp, Homo sapiens
gaatgaccttgttgcatg

SEQ ID NO: 2601606 - DNA, 13 bp, Homo sapiens
gaatgagcctcgg

SEQ ID NO: 2601607 - DNA, 18 bp, Homo sapiens
gaatgaggcttgctgaga

SEQ ID NO: 2601608 - DNA, 17 bp, Homo sapiens
gaatgatctcttctttt

SEQ ID NO: 2601609 - DNA, 20 bp, Homo sapiens
gaatgatgatcctaggcatt

SEQ ID NO: 2601610 - DNA, 23 bp, Homo sapiens
gaatgattctaatttttaagcaa

SEQ ID NO: 2601611 - DNA, 14 bp, Homo sapiens
gaatgatttcatgc

SEQ ID NO: 2601612 - DNA, 13 bp, Homo sapiens
gaatgcctcctcc

SEQ ID NO: 2601613 - DNA, 16 bp, Homo sapiens
gaatgcctgagtgcct

SEQ ID NO: 2601614 - DNA, 19 bp, Homo sapiens
gaatgcctgagtgcctggc

SEQ ID NO: 2601615 - DNA, 23 bp, Homo sapiens
gaatgctcccccatcctcccctt

SEQ ID NO: 2601616 - DNA, 13 bp, Homo sapiens
gaatgctgaaacc

SEQ ID NO: 2601617 - DNA, 15 bp, Homo sapiens
gaatgctgaaaccaa

SEQ ID NO: 2601618 - DNA, 15 bp, Homo sapiens
gaatgctgtatatgt

SEQ ID NO: 2601619 - DNA, 18 bp, Homo sapiens
gaatgcttataggtggcc

SEQ ID NO: 2601620 - DNA, 18 bp, Homo sapiens
gaatgcttctgacttcat

SEQ ID NO: 2601621 - DNA, 21 bp, Homo sapiens
gaatgcttctgacttcataga

SEQ ID NO: 2601622 - DNA, 16 bp, Homo sapiens
gaatgggcagttacat

SEQ ID NO: 2601623 - DNA, 17 bp, Homo sapiens
gaatgggctgtttttgg

SEQ ID NO: 2601624 - DNA, 15 bp, Homo sapiens
gaatggtccagggtt

SEQ ID NO: 2601625 - DNA, 15 bp, Homo sapiens
gaatgtaactgctga

SEQ ID NO: 2601626 - DNA, 16 bp, Homo sapiens
gaatgtaatcaatgtt

SEQ ID NO: 2601627 - DNA, 17 bp, Homo sapiens
gaatgtatcaggaaata

SEQ ID NO: 2601628 - DNA, 16 bp, Homo sapiens
gaatgtattattctgc

SEQ ID NO: 2601629 - DNA, 12 bp, Homo sapiens
gaatgtattgta

SEQ ID NO: 2601630 - DNA, 14 bp, Homo sapiens
gaatgtattgtacc

SEQ ID NO: 2601631 - DNA, 21 bp, Homo sapiens
gaatgtattgtaccttttaac

SEQ ID NO: 2601632 - DNA, 13 bp, Homo sapiens
gaatgtcagtatg

SEQ ID NO: 2601633 - DNA, 16 bp, Homo sapiens
gaatgtcagtatgtgg

SEQ ID NO: 2601634 - DNA, 21 bp, Homo sapiens
gaatgtgcaggtttgttacat

SEQ ID NO: 2601635 - DNA, 22 bp, Homo sapiens
gaatgtggcccctgaacaagaa

SEQ ID NO: 2601636 - DNA, 18 bp, Homo sapiens
gaatgtgtacaaagtgta

SEQ ID NO: 2601637 - DNA, 11 bp, Homo sapiens
gaatgttctga

SEQ ID NO: 2601638 - DNA, 15 bp, Homo sapiens
gaatgttctgacatt

SEQ ID NO: 2601639 - DNA, 16 bp, Homo sapiens
gaatgttctgacatta

SEQ ID NO: 2601640 - DNA, 17 bp, Homo sapiens
gaatgttctgacattaa

SEQ ID NO: 2601641 - DNA, 16 bp, Homo sapiens
gaatgtttgcctctgc

SEQ ID NO: 2601642 - DNA, 18 bp, Homo sapiens
gaatgtttgcctctgcct

SEQ ID NO: 2601643 - DNA, 20 bp, Homo sapiens
gaattaaattaggaataaat

SEQ ID NO: 2601644 - DNA, 13 bp, Homo sapiens
gaattaaatttaa

SEQ ID NO: 2601645 - DNA, 18 bp, Homo sapiens
gaattaacctggtgctgg

SEQ ID NO: 2601646 - DNA, 19 bp, Homo sapiens
gaattaacctggtgctgga

SEQ ID NO: 2601647 - DNA, 17 bp, Homo sapiens
gaattaactccattcca

SEQ ID NO: 2601648 - DNA, 15 bp, Homo sapiens
gaattaatagctttt

SEQ ID NO: 2601649 - DNA, 21 bp, Homo sapiens
gaattacatgtaaaacattat

SEQ ID NO: 2601650 - DNA, 22 bp, Homo sapiens
gaattacatgtaaaacattatc

SEQ ID NO: 2601651 - DNA, 16 bp, Homo sapiens
gaattccaaggagttc

SEQ ID NO: 2601652 - DNA, 17 bp, Homo sapiens
gaattccttcagggtga

SEQ ID NO: 2601653 - DNA, 15 bp, Homo sapiens
gaattctatttgctg

SEQ ID NO: 2601654 - DNA, 19 bp, Homo sapiens
gaattctctagtttgatta

SEQ ID NO: 2601655 - DNA, 22 bp, Homo sapiens
gaattcttacatgttttctttg

SEQ ID NO: 2601656 - DNA, 15 bp, Homo sapiens
gaattgaggtctgct

SEQ ID NO: 2601657 - DNA, 20 bp, Homo sapiens
gaattgatcattttcccccc

SEQ ID NO: 2601658 - DNA, 16 bp, Homo sapiens
gaattgtgctcaaaat

SEQ ID NO: 2601659 - DNA, 15 bp, Homo sapiens
gaatttaaatataat

SEQ ID NO: 2601660 - DNA, 22 bp, Homo sapiens
gaatttaaatataattctgtaa

SEQ ID NO: 2601661 - DNA, 21 bp, Homo sapiens
gaatttagggagaaatgttgt

SEQ ID NO: 2601662 - DNA, 21 bp, Homo sapiens
gaatttcacctgtaaacctga

SEQ ID NO: 2601663 - DNA, 20 bp, Homo sapiens
gaatttcttcactgttgaaa

SEQ ID NO: 2601664 - DNA, 21 bp, Homo sapiens
gaatttcttggtaagaagccg

SEQ ID NO: 2601665 - DNA, 22 bp, Homo sapiens
gaatttcttttgccgttattaa

SEQ ID NO: 2601666 - DNA, 17 bp, Homo sapiens
gaatttgagtgctctga

SEQ ID NO: 2601667 - DNA, 17 bp, Homo sapiens
gaatttgtaacctcagc

SEQ ID NO: 2601668 - DNA, 19 bp, Homo sapiens
gaatttgtaacctcagctc

SEQ ID NO: 2601669 - DNA, 15 bp, Homo sapiens
gaattttaaaaatga

SEQ ID NO: 2601670 - DNA, 15 bp, Homo sapiens
gaattttgttgctgt

SEQ ID NO: 2601671 - DNA, 22 bp, Homo sapiens
gaatttttttttcctagccctc

SEQ ID NO: 2601672 - DNA, 18 bp, Homo sapiens
gacaaaaagtttccatat

SEQ ID NO: 2601673 - DNA, 16 bp, Homo sapiens
ctttctcagttttcat

SEQ ID NO: 2601674 - DNA, 13 bp, Homo sapiens
ctttctccagcca

SEQ ID NO: 2601675 - DNA, 16 bp, Homo sapiens
ctttctccagccagca

SEQ ID NO: 2601676 - DNA, 21 bp, Homo sapiens
ctttctcccaggccaggctcc

SEQ ID NO: 2601677 - DNA, 16 bp, Homo sapiens
ctttctctcctttctt

SEQ ID NO: 2601678 - DNA, 17 bp, Homo sapiens
ctttctctcctttcttt

SEQ ID NO: 2601679 - DNA, 15 bp, Homo sapiens
ctttctcttctctgt

SEQ ID NO: 2601680 - DNA, 17 bp, Homo sapiens
ctttctcttctctgttc

SEQ ID NO: 2601681 - DNA, 20 bp, Homo sapiens
ctttctgaagcctcacttat

SEQ ID NO: 2601682 - DNA, 21 bp, Homo sapiens
ctttctgagcacactttagtg

SEQ ID NO: 2601683 - DNA, 20 bp, Homo sapiens
ctttctggctatgcatttga

SEQ ID NO: 2601684 - DNA, 13 bp, Homo sapiens
ctttctggctctc

SEQ ID NO: 2601685 - DNA, 16 bp, Homo sapiens
ctttctgtaaccataa

SEQ ID NO: 2601686 - DNA, 16 bp, Homo sapiens
ctttctgtattgagta

SEQ ID NO: 2601687 - DNA, 12 bp, Homo sapiens
ctttctgtgtgc

SEQ ID NO: 2601688 - DNA, 15 bp, Homo sapiens
ctttctgttggtgta

SEQ ID NO: 2601689 - DNA, 22 bp, Homo sapiens
ctttctgttgtcattgctgttg

SEQ ID NO: 2601690 - DNA, 13 bp, Homo sapiens
ctttcttggccag

SEQ ID NO: 2601691 - DNA, 21 bp, Homo sapiens
ctttcttggttcataaatgaa

SEQ ID NO: 2601692 - DNA, 15 bp, Homo sapiens
ctttgaaattgttta

SEQ ID NO: 2601693 - DNA, 19 bp, Homo sapiens
ctttgaagcagttgtgtca

SEQ ID NO: 2601694 - DNA, 16 bp, Homo sapiens
ctttgaaggggcctca

SEQ ID NO: 2601695 - DNA, 18 bp, Homo sapiens
ctttgaaggggcctcacc

SEQ ID NO: 2601696 - DNA, 18 bp, Homo sapiens
ctttgaataaaaatgcac

SEQ ID NO: 2601697 - DNA, 16 bp, Homo sapiens
ctttgaatgctttttg

SEQ ID NO: 2601698 - DNA, 17 bp, Homo sapiens
ctttgaattttctgtgt

SEQ ID NO: 2601699 - DNA, 17 bp, Homo sapiens
ctttgacctcaacctgt

SEQ ID NO: 2601700 - DNA, 17 bp, Homo sapiens
ctttgacctctgcagca

SEQ ID NO: 2601701 - DNA, 24 bp, Homo sapiens
ctttgacctctgcagcaataaagc

SEQ ID NO: 2601702 - DNA, 14 bp, Homo sapiens
ctttgacctgcctc

SEQ ID NO: 2601703 - DNA, 19 bp, Homo sapiens
ctttgacgccatcccagcc

SEQ ID NO: 2601704 - DNA, 21 bp, Homo sapiens
ctttgacgccatcccagcccc

SEQ ID NO: 2601705 - DNA, 19 bp, Homo sapiens
ctttgactcacctgttact

SEQ ID NO: 2601706 - DNA, 14 bp, Homo sapiens
ctttgactttttgc

SEQ ID NO: 2601707 - DNA, 16 bp, Homo sapiens
ctttgagcttaagaat

SEQ ID NO: 2601708 - DNA, 13 bp, Homo sapiens
ctttgagtgatcc

SEQ ID NO: 2601709 - DNA, 21 bp, Homo sapiens
ctttgagtgtcttaattaaaa

SEQ ID NO: 2601710 - DNA, 18 bp, Homo sapiens
ctttgataaaataaatga

SEQ ID NO: 2601711 - DNA, 14 bp, Homo sapiens
ctttgataatgtta

SEQ ID NO: 2601712 - DNA, 15 bp, Homo sapiens
ctttgataatgttaa

SEQ ID NO: 2601713 - DNA, 21 bp, Homo sapiens
ctttgatgattaattcacctt

SEQ ID NO: 2601714 - DNA, 18 bp, Homo sapiens
ctttgatgtcatatggaa

SEQ ID NO: 2601715 - DNA, 18 bp, Homo sapiens
ctttgatgttaacacatt

SEQ ID NO: 2601716 - DNA, 16 bp, Homo sapiens
ctttgcaaaggagctc

SEQ ID NO: 2601717 - DNA, 16 bp, Homo sapiens
ctttgcactgagggcc

SEQ ID NO: 2601718 - DNA, 23 bp, Homo sapiens
ctttgcactgagggccacactat

SEQ ID NO: 2601719 - DNA, 15 bp, Homo sapiens
ctttgcagacaggca

SEQ ID NO: 2601720 - DNA, 20 bp, Homo sapiens
ctttgcagacaggcaagcac

SEQ ID NO: 2601721 - DNA, 21 bp, Homo sapiens
ctttgcatggagacttgagga

SEQ ID NO: 2601722 - DNA, 20 bp, Homo sapiens
ctttgcatgttccactaacc

SEQ ID NO: 2601723 - DNA, 22 bp, Homo sapiens
ctttgcatgttccactaacccc

SEQ ID NO: 2601724 - DNA, 18 bp, Homo sapiens
ctttgccaccctcatgct

SEQ ID NO: 2601725 - DNA, 23 bp, Homo sapiens
ctttgccccacctttattaaaat

SEQ ID NO: 2601726 - DNA, 15 bp, Homo sapiens
ctttgcctgttcagt

SEQ ID NO: 2601727 - DNA, 13 bp, Homo sapiens
ctttgctcctccc

SEQ ID NO: 2601728 - DNA, 14 bp, Homo sapiens
ctttgctctttctt

SEQ ID NO: 2601729 - DNA, 15 bp, Homo sapiens
ctttgcttcccattg

SEQ ID NO: 2601730 - DNA, 14 bp, Homo sapiens
ctttgcttgcagta

SEQ ID NO: 2601731 - DNA, 17 bp, Homo sapiens
ctttggaaggagtgaga

SEQ ID NO: 2601732 - DNA, 16 bp, Homo sapiens
ctttggaccctgaggc

SEQ ID NO: 2601733 - DNA, 12 bp, Homo sapiens
ctttggcactgg

SEQ ID NO: 2601734 - DNA, 24 bp, Homo sapiens
ctttggcaggtgcagcccccactg

SEQ ID NO: 2601735 - DNA, 13 bp, Homo sapiens
ctttgggaagggg

SEQ ID NO: 2601736 - DNA, 13 bp, Homo sapiens
ctttgggaggcca

SEQ ID NO: 2601737 - DNA, 15 bp, Homo sapiens
gaacaaagtgagaca

SEQ ID NO: 2601738 - DNA, 17 bp, Homo sapiens
gaacaaatttacagaga

SEQ ID NO: 2601739 - DNA, 15 bp, Homo sapiens
gaacaactactgtga

SEQ ID NO: 2601740 - DNA, 14 bp, Homo sapiens
gaacacactccatc

SEQ ID NO: 2601741 - DNA, 16 bp, Homo sapiens
gaacactaacctgacc

SEQ ID NO: 2601742 - DNA, 17 bp, Homo sapiens
gaacactcatgctgaaa

SEQ ID NO: 2601743 - DNA, 23 bp, Homo sapiens
gaacactgcactcttaagcttcc

SEQ ID NO: 2601744 - DNA, 18 bp, Homo sapiens
gaacactgggggagggga

SEQ ID NO: 2601745 - DNA, 12 bp, Homo sapiens
gaacagaaggat

SEQ ID NO: 2601746 - DNA, 19 bp, Homo sapiens
gaacagactggaagcacag

SEQ ID NO: 2601747 - DNA, 20 bp, Homo sapiens
gaacagactggaagcacagc

SEQ ID NO: 2601748 - DNA, 17 bp, Homo sapiens
gaacagattcacactgt

SEQ ID NO: 2601749 - DNA, 22 bp, Homo sapiens
gaacagccaaatgcatggtgca

SEQ ID NO: 2601750 - DNA, 22 bp, Homo sapiens
gaacagctatgggagccccagg

SEQ ID NO: 2601751 - DNA, 23 bp, Homo sapiens
gaacagctatgggagccccaggg

SEQ ID NO: 2601752 - DNA, 14 bp, Homo sapiens
gaacagcttcaggt

SEQ ID NO: 2601753 - DNA, 19 bp, Homo sapiens
gaacaggcaagtgaagaaa

SEQ ID NO: 2601754 - DNA, 13 bp, Homo sapiens
gaacagtaaacat

SEQ ID NO: 2601755 - DNA, 14 bp, Homo sapiens
gaacagtaactgcc

SEQ ID NO: 2601756 - DNA, 16 bp, Homo sapiens
gaacagtgattaccag

SEQ ID NO: 2601757 - DNA, 20 bp, Homo sapiens
gaacagtgattaccagggac

SEQ ID NO: 2601758 - DNA, 14 bp, Homo sapiens
gaacagtgtttccc

SEQ ID NO: 2601759 - DNA, 21 bp, Homo sapiens
gaacagtgtttcccataattt

SEQ ID NO: 2601760 - DNA, 18 bp, Homo sapiens
gaacatattgttgaaagg

SEQ ID NO: 2601761 - DNA, 23 bp, Homo sapiens
gaacatcaccgacgcgtctcctg

SEQ ID NO: 2601762 - DNA, 17 bp, Homo sapiens
gaacatctgtcctgtga

SEQ ID NO: 2601763 - DNA, 22 bp, Homo sapiens
gaacatggacttgtatatttgt

SEQ ID NO: 2601764 - DNA, 15 bp, Homo sapiens
gaacatggagagcta

SEQ ID NO: 2601765 - DNA, 17 bp, Homo sapiens
gaaccaaagagactgga

SEQ ID NO: 2601766 - DNA, 20 bp, Homo sapiens
gaaccaaagagactggagca

SEQ ID NO: 2601767 - DNA, 23 bp, Homo sapiens
gaaccaagtggaccttgagacca

SEQ ID NO: 2601768 - DNA, 20 bp, Homo sapiens
gaaccacatcttgctctgct

SEQ ID NO: 2601769 - DNA, 21 bp, Homo sapiens
gaaccacatcttgctctgctg

SEQ ID NO: 2601770 - DNA, 16 bp, Homo sapiens
gaaccaccacacccag

SEQ ID NO: 2601771 - DNA, 20 bp, Homo sapiens
gaaccaccacacccagccca

SEQ ID NO: 2601772 - DNA, 21 bp, Homo sapiens
gaaccaccacacccagcccac

SEQ ID NO: 2601773 - DNA, 22 bp, Homo sapiens
gaaccaccacacccagcccact

SEQ ID NO: 2601774 - DNA, 19 bp, Homo sapiens
gaaccactacatgcagccc

SEQ ID NO: 2601775 - DNA, 12 bp, Homo sapiens
gaaccatcagaa

SEQ ID NO: 2601776 - DNA, 18 bp, Homo sapiens
gaaccatgaagacaggat

SEQ ID NO: 2601777 - DNA, 22 bp, Homo sapiens
gaaccatggtcggaaaacatgc

SEQ ID NO: 2601778 - DNA, 17 bp, Homo sapiens
gaaccccaaggagggag

SEQ ID NO: 2601779 - DNA, 17 bp, Homo sapiens
gaacccttttggccccc

SEQ ID NO: 2601780 - DNA, 18 bp, Homo sapiens
gaacccttttggcccccg

SEQ ID NO: 2601781 - DNA, 17 bp, Homo sapiens
gaaccgagcaaagatca

SEQ ID NO: 2601782 - DNA, 16 bp, Homo sapiens
gaaccgcaggaagctg

SEQ ID NO: 2601783 - DNA, 14 bp, Homo sapiens
gaacctagaagggc

SEQ ID NO: 2601784 - DNA, 21 bp, Homo sapiens
gaacctcacgcacctcccatc

SEQ ID NO: 2601785 - DNA, 14 bp, Homo sapiens
gaacctcaggcttc

SEQ ID NO: 2601786 - DNA, 18 bp, Homo sapiens
gaacctcaggcttccttg

SEQ ID NO: 2601787 - DNA, 16 bp, Homo sapiens
gaacctcctctgtgaa

SEQ ID NO: 2601788 - DNA, 17 bp, Homo sapiens
gaacctcttccccagaa

SEQ ID NO: 2601789 - DNA, 16 bp, Homo sapiens
gaacctggagggctag

SEQ ID NO: 2601790 - DNA, 16 bp, Homo sapiens
gaacctggaggggcta

SEQ ID NO: 2601791 - DNA, 15 bp, Homo sapiens
gaacctggagttcct

SEQ ID NO: 2601792 - DNA, 14 bp, Homo sapiens
gaaccttgtgcctg

SEQ ID NO: 2601793 - DNA, 12 bp, Homo sapiens
gaacgcagccct

SEQ ID NO: 2601794 - DNA, 16 bp, Homo sapiens
gaacgcagccctagag

SEQ ID NO: 2601795 - DNA, 17 bp, Homo sapiens
gaacgcagccctagagc

SEQ ID NO: 2601796 - DNA, 20 bp, Homo sapiens
gaacgcagccctagagcctg

SEQ ID NO: 2601797 - DNA, 15 bp, Homo sapiens
gaacggtaaatttct

SEQ ID NO: 2601798 - DNA, 14 bp, Homo sapiens
gaactaaactttca

SEQ ID NO: 2601799 - DNA, 19 bp, Homo sapiens
gaactaccttggttccccc

SEQ ID NO: 2601800 - DNA, 20 bp, Homo sapiens
gaactaccttggttccccca

SEQ ID NO: 2601801 - DNA, 19 bp, Homo sapiens
gaactagaatttgattatt

SEQ ID NO: 2601802 - DNA, 23 bp, Homo sapiens
gaactagccaccaactcttgcag

SEQ ID NO: 2601803 - DNA, 15 bp, Homo sapiens
gaactataaagaagt

SEQ ID NO: 2601804 - DNA, 15 bp, Homo sapiens
gaactatgaactaca

SEQ ID NO: 2601805 - DNA, 21 bp, Homo sapiens
gaactatggacggtgctccag

SEQ ID NO: 2601806 - DNA, 13 bp, Homo sapiens
gaactattagagc

SEQ ID NO: 2601807 - DNA, 22 bp, Homo sapiens
gaactcacctggggctgctggc

SEQ ID NO: 2601808 - DNA, 24 bp, Homo sapiens
gaactcagccaagcacagtggtgg

SEQ ID NO: 2601809 - DNA, 18 bp, Homo sapiens
gaactcatccctaatgct

SEQ ID NO: 2601810 - DNA, 11 bp, Homo sapiens
gaactcccagc

SEQ ID NO: 2601811 - DNA, 17 bp, Homo sapiens
gaactctggcttccagg

SEQ ID NO: 2601812 - DNA, 18 bp, Homo sapiens
gaactctgggctgccatg

SEQ ID NO: 2601813 - DNA, 17 bp, Homo sapiens
gaactgaagtttcacat

SEQ ID NO: 2601814 - DNA, 19 bp, Homo sapiens
gaactgagctcctctgggc

SEQ ID NO: 2601815 - DNA, 21 bp, Homo sapiens
gaactgagctcctctgggcag

SEQ ID NO: 2601816 - DNA, 19 bp, Homo sapiens
gaactgatagttactgttg

SEQ ID NO: 2601817 - DNA, 15 bp, Homo sapiens
gaactgcatatgttt

SEQ ID NO: 2601818 - DNA, 21 bp, Homo sapiens
gaactgcctttggcagagttc

SEQ ID NO: 2601819 - DNA, 21 bp, Homo sapiens
gaactggactcaggatgccca

SEQ ID NO: 2601820 - DNA, 23 bp, Homo sapiens
gaactggactcaggatgcccagg

SEQ ID NO: 2601821 - DNA, 12 bp, Homo sapiens
gaactggctgca

SEQ ID NO: 2601822 - DNA, 13 bp, Homo sapiens
gaactgtccagag

SEQ ID NO: 2601823 - DNA, 14 bp, Homo sapiens
gaactgttgtataa

SEQ ID NO: 2601824 - DNA, 13 bp, Homo sapiens
gaacttaaaatga

SEQ ID NO: 2601825 - DNA, 15 bp, Homo sapiens
gaacttaaataaatg

SEQ ID NO: 2601826 - DNA, 17 bp, Homo sapiens
gaacttaaataatgtga

SEQ ID NO: 2601827 - DNA, 15 bp, Homo sapiens
gaacttattctgtag

SEQ ID NO: 2601828 - DNA, 18 bp, Homo sapiens
gaacttcgcatcaaaaga

SEQ ID NO: 2601829 - DNA, 19 bp, Homo sapiens
gaacttggaaagaaatgcc

SEQ ID NO: 2601830 - DNA, 15 bp, Homo sapiens
gaacttggaggcacc

SEQ ID NO: 2601831 - DNA, 17 bp, Homo sapiens
gaacttggggaacaagg

SEQ ID NO: 2601832 - DNA, 24 bp, Homo sapiens
gaactttccacattcagagcttac

SEQ ID NO: 2601833 - DNA, 21 bp, Homo sapiens
gaactttctcttcatactttt

SEQ ID NO: 2601834 - DNA, 19 bp, Homo sapiens
gaactttgctgagcctgta

SEQ ID NO: 2601835 - DNA, 15 bp, Homo sapiens
gaagaaacagatctc

SEQ ID NO: 2601836 - DNA, 18 bp, Homo sapiens
gaagaaaggccatcagag

SEQ ID NO: 2601837 - DNA, 21 bp, Homo sapiens
gaagaaagggtgtttttctgt

SEQ ID NO: 2601838 - DNA, 16 bp, Homo sapiens
gaagaacatccaagga

SEQ ID NO: 2601839 - DNA, 17 bp, Homo sapiens
gaagaacatccaaggag

SEQ ID NO: 2601840 - DNA, 22 bp, Homo sapiens
gaagaacatctttatggtaaag

SEQ ID NO: 2601841 - DNA, 14 bp, Homo sapiens
gaagaagagggaga

SEQ ID NO: 2601842 - DNA, 16 bp, Homo sapiens
gaagaagggcacccta

SEQ ID NO: 2601843 - DNA, 13 bp, Homo sapiens
gaagaagtgtgtc

SEQ ID NO: 2601844 - DNA, 18 bp, Homo sapiens
gaagaatacaaacatatt

SEQ ID NO: 2601845 - DNA, 12 bp, Homo sapiens
gaagaattccag

SEQ ID NO: 2601846 - DNA, 12 bp, Homo sapiens
gaagaattttaa

SEQ ID NO: 2601847 - DNA, 14 bp, Homo sapiens
gaagaattttaaaa

SEQ ID NO: 2601848 - DNA, 15 bp, Homo sapiens
cttgggcccttccct

SEQ ID NO: 2601849 - DNA, 22 bp, Homo sapiens
cttgggcggctgagagccccag

SEQ ID NO: 2601850 - DNA, 22 bp, Homo sapiens
cttggggggtttttactccagt

SEQ ID NO: 2601851 - DNA, 17 bp, Homo sapiens
cttgggtggagaagcca

SEQ ID NO: 2601852 - DNA, 20 bp, Homo sapiens
cttgggtggagaagccattg

SEQ ID NO: 2601853 - DNA, 14 bp, Homo sapiens
cttgggttctgata

SEQ ID NO: 2601854 - DNA, 17 bp, Homo sapiens
cttgggtttttgttacc

SEQ ID NO: 2601855 - DNA, 15 bp, Homo sapiens
cttggtcttcccagg

SEQ ID NO: 2601856 - DNA, 20 bp, Homo sapiens
cttggtgaatttttttttcc

SEQ ID NO: 2601857 - DNA, 16 bp, Homo sapiens
cttggttggctggcct

SEQ ID NO: 2601858 - DNA, 15 bp, Homo sapiens
cttggtttgtaaatt

SEQ ID NO: 2601859 - DNA, 18 bp, Homo sapiens
cttgtaaaaattaaaagt

SEQ ID NO: 2601860 - DNA, 18 bp, Homo sapiens
cttgtaaagactgtagaa

SEQ ID NO: 2601861 - DNA, 21 bp, Homo sapiens
cttgtaaatagctcaggtgtc

SEQ ID NO: 2601862 - DNA, 20 bp, Homo sapiens
cttgtaatgatatagccaga

SEQ ID NO: 2601863 - DNA, 13 bp, Homo sapiens
cttgtaattctaa

SEQ ID NO: 2601864 - DNA, 23 bp, Homo sapiens
cttgtaattctaaatgaatgttt

SEQ ID NO: 2601865 - DNA, 13 bp, Homo sapiens
cttgtacaaaata

SEQ ID NO: 2601866 - DNA, 21 bp, Homo sapiens
cttgtacataatgcgtgcata

SEQ ID NO: 2601867 - DNA, 15 bp, Homo sapiens
cttgtatagtgtaaa

SEQ ID NO: 2601868 - DNA, 17 bp, Homo sapiens
cttgtatagtgtaaaat

SEQ ID NO: 2601869 - DNA, 20 bp, Homo sapiens
cttgtatatacgcatctata

SEQ ID NO: 2601870 - DNA, 17 bp, Homo sapiens
cttgtatatcttgtttt

SEQ ID NO: 2601871 - DNA, 14 bp, Homo sapiens
cttgtatatttgta

SEQ ID NO: 2601872 - DNA, 16 bp, Homo sapiens
cttgtatatttgtaca

SEQ ID NO: 2601873 - DNA, 19 bp, Homo sapiens
cttgtatatttgtacaaaa

SEQ ID NO: 2601874 - DNA, 14 bp, Homo sapiens
cttgtattaagaat

SEQ ID NO: 2601875 - DNA, 15 bp, Homo sapiens
cttgtattaagaatg

SEQ ID NO: 2601876 - DNA, 13 bp, Homo sapiens
cttgtattaagtt

SEQ ID NO: 2601877 - DNA, 12 bp, Homo sapiens
cttgtatttaaa

SEQ ID NO: 2601878 - DNA, 18 bp, Homo sapiens
cttgtatttaaatattaa

SEQ ID NO: 2601879 - DNA, 13 bp, Homo sapiens
cttgtcaaagaag

SEQ ID NO: 2601880 - DNA, 15 bp, Homo sapiens
cttgtcaaagaaggt

SEQ ID NO: 2601881 - DNA, 22 bp, Homo sapiens
cttgtcaatatttaaacatggt

SEQ ID NO: 2601882 - DNA, 14 bp, Homo sapiens
cttgtcagagctgg

SEQ ID NO: 2601883 - DNA, 21 bp, Homo sapiens
cttgtcagagctgggaggggt

SEQ ID NO: 2601884 - DNA, 16 bp, Homo sapiens
cttgtcccactcaagc

SEQ ID NO: 2601885 - DNA, 18 bp, Homo sapiens
cttgtcccactcaagcca

SEQ ID NO: 2601886 - DNA, 19 bp, Homo sapiens
cttgtcccactcaagccaa

SEQ ID NO: 2601887 - DNA, 12 bp, Homo sapiens
cttgtccccaca

SEQ ID NO: 2601888 - DNA, 18 bp, Homo sapiens
cttgtccccacactccta

SEQ ID NO: 2601889 - DNA, 13 bp, Homo sapiens
cttgtctgtagat

SEQ ID NO: 2601890 - DNA, 19 bp, Homo sapiens
cttgtctttggaccctgag

SEQ ID NO: 2601891 - DNA, 21 bp, Homo sapiens
cttgtgacatattatgtcttc

SEQ ID NO: 2601892 - DNA, 17 bp, Homo sapiens
cttgtgacccagcactg

SEQ ID NO: 2601893 - DNA, 11 bp, Homo sapiens
cttgtgccata

SEQ ID NO: 2601894 - DNA, 20 bp, Homo sapiens
cttgtgctgatcgtgctaaa

SEQ ID NO: 2601895 - DNA, 21 bp, Homo sapiens
cttgtggaagcaaaaatctga

SEQ ID NO: 2601896 - DNA, 13 bp, Homo sapiens
cttgtggagcccc

SEQ ID NO: 2601897 - DNA, 19 bp, Homo sapiens
cttgtggagccccacactg

SEQ ID NO: 2601898 - DNA, 14 bp, Homo sapiens
cttgtggcctggga

SEQ ID NO: 2601899 - DNA, 19 bp, Homo sapiens
cttgtggtcccaccccaca

SEQ ID NO: 2601900 - DNA, 14 bp, Homo sapiens
cttgtggtttatgt

SEQ ID NO: 2601901 - DNA, 14 bp, Homo sapiens
cttgtgtatccatt

SEQ ID NO: 2601902 - DNA, 22 bp, Homo sapiens
cttgtgtatccattatcatgtg

SEQ ID NO: 2601903 - DNA, 23 bp, Homo sapiens
cttgtgtatccattatcatgtgt

SEQ ID NO: 2601904 - DNA, 17 bp, Homo sapiens
cttgtgtctctgtgctt

SEQ ID NO: 2601905 - DNA, 21 bp, Homo sapiens
cttgtgtctctgtgcttttaa

SEQ ID NO: 2601906 - DNA, 18 bp, Homo sapiens
cttgtgtctgtacacgtg

SEQ ID NO: 2601907 - DNA, 19 bp, Homo sapiens
cttgtgtgtgggctgtgag

SEQ ID NO: 2601908 - DNA, 19 bp, Homo sapiens
cttgtgtgtttcactttta

SEQ ID NO: 2601909 - DNA, 13 bp, Homo sapiens
cttgttatttata

SEQ ID NO: 2601910 - DNA, 20 bp, Homo sapiens
cttgttcaaaatatgttctt

SEQ ID NO: 2601911 - DNA, 16 bp, Homo sapiens
cttgttcacactctca

SEQ ID NO: 2601912 - DNA, 16 bp, Homo sapiens
cttgttccagctcttt

SEQ ID NO: 2601913 - DNA, 21 bp, Homo sapiens
cttgttccccactgacagcct

SEQ ID NO: 2601914 - DNA, 13 bp, Homo sapiens
cttgttctactca

SEQ ID NO: 2601915 - DNA, 22 bp, Homo sapiens
cttgttctactcatatatatct

SEQ ID NO: 2601916 - DNA, 22 bp, Homo sapiens
cttgttgctgttgatgttttgt

SEQ ID NO: 2601917 - DNA, 23 bp, Homo sapiens
cttgttggatttttgtcttgtgt

SEQ ID NO: 2601918 - DNA, 20 bp, Homo sapiens
cttgttgggattcctgaccc

SEQ ID NO: 2601919 - DNA, 19 bp, Homo sapiens
cttgtttacagcactactc

SEQ ID NO: 2601920 - DNA, 18 bp, Homo sapiens
cttgtttgctcacctggg

SEQ ID NO: 2601921 - DNA, 20 bp, Homo sapiens
cttgtttgctcacctggggt

SEQ ID NO: 2601922 - DNA, 18 bp, Homo sapiens
cttgttttcttgccaatg

SEQ ID NO: 2601923 - DNA, 14 bp, Homo sapiens
cttatcaagtgtct

SEQ ID NO: 2601924 - DNA, 15 bp, Homo sapiens
cttatcaagtgtctt

SEQ ID NO: 2601925 - DNA, 16 bp, Homo sapiens
cttatcaccagctgcc

SEQ ID NO: 2601926 - DNA, 22 bp, Homo sapiens
cttatcaccagctgcctcttct

SEQ ID NO: 2601927 - DNA, 21 bp, Homo sapiens
cttatcatccacattgtttta

SEQ ID NO: 2601928 - DNA, 20 bp, Homo sapiens
cttatctcagtcatgcataa

SEQ ID NO: 2601929 - DNA, 23 bp, Homo sapiens
cttatctcagtcatgcataaata

SEQ ID NO: 2601930 - DNA, 14 bp, Homo sapiens
cttatctccaagac

SEQ ID NO: 2601931 - DNA, 14 bp, Homo sapiens
cttatctctctgtg

SEQ ID NO: 2601932 - DNA, 15 bp, Homo sapiens
cttatctctctgtgc

SEQ ID NO: 2601933 - DNA, 20 bp, Homo sapiens
cttatctgtgcgtgaaacac

SEQ ID NO: 2601934 - DNA, 13 bp, Homo sapiens
cttatgagatggg

SEQ ID NO: 2601935 - DNA, 14 bp, Homo sapiens
cttatgggctgggt

SEQ ID NO: 2601936 - DNA, 21 bp, Homo sapiens
cttatgggctgggttctaccc

SEQ ID NO: 2601937 - DNA, 19 bp, Homo sapiens
cttatgtagcaggaaataa

SEQ ID NO: 2601938 - DNA, 21 bp, Homo sapiens
cttattagagtgtctttccac

SEQ ID NO: 2601939 - DNA, 14 bp, Homo sapiens
cttattctgtagat

SEQ ID NO: 2601940 - DNA, 12 bp, Homo sapiens
cttattgcccac

SEQ ID NO: 2601941 - DNA, 17 bp, Homo sapiens
cttattggaactctgct

SEQ ID NO: 2601942 - DNA, 13 bp, Homo sapiens
cttattgtacctc

SEQ ID NO: 2601943 - DNA, 14 bp, Homo sapiens
cttattgttccaag

SEQ ID NO: 2601944 - DNA, 20 bp, Homo sapiens
cttattgttccaagacattg

SEQ ID NO: 2601945 - DNA, 17 bp, Homo sapiens
cttatttcatgaaaatt

SEQ ID NO: 2601946 - DNA, 23 bp, Homo sapiens
cttatttgctgccacacctgagc

SEQ ID NO: 2601947 - DNA, 15 bp, Homo sapiens
cttattttctctgtg

SEQ ID NO: 2601948 - DNA, 17 bp, Homo sapiens
cttatttttgacagtgt

SEQ ID NO: 2601949 - DNA, 16 bp, Homo sapiens
cttcaaatccatccag

SEQ ID NO: 2601950 - DNA, 17 bp, Homo sapiens
cttcaaatccatccaga

SEQ ID NO: 2601951 - DNA, 17 bp, Homo sapiens
cttcaagttagctcagg

SEQ ID NO: 2601952 - DNA, 16 bp, Homo sapiens
cttcaattcctgggcc

SEQ ID NO: 2601953 - DNA, 17 bp, Homo sapiens
cttcacacacaggcaac

SEQ ID NO: 2601954 - DNA, 21 bp, Homo sapiens
cttcacacacaggcaactgag

SEQ ID NO: 2601955 - DNA, 11 bp, Homo sapiens
cttcacagagt

SEQ ID NO: 2601956 - DNA, 13 bp, Homo sapiens
cttcacagagtgt

SEQ ID NO: 2601957 - DNA, 22 bp, Homo sapiens
cttcacagagtgtgctggagga

SEQ ID NO: 2601958 - DNA, 22 bp, Homo sapiens
cttcaccagaggaatcactctt

SEQ ID NO: 2601959 - DNA, 17 bp, Homo sapiens
cttcaccatttggcaat

SEQ ID NO: 2601960 - DNA, 22 bp, Homo sapiens
cttcacccagctaatctgtagg

SEQ ID NO: 2601961 - DNA, 24 bp, Homo sapiens
cttcacccagctaatctgtagggc

SEQ ID NO: 2601962 - DNA, 14 bp, Homo sapiens
cttcaccccagtgg

SEQ ID NO: 2601963 - DNA, 15 bp, Homo sapiens
cttcaccctggagcc

SEQ ID NO: 2601964 - DNA, 18 bp, Homo sapiens
cttcacctgattcaacta

SEQ ID NO: 2601965 - DNA, 20 bp, Homo sapiens
cttcacctttgtccccaccg

SEQ ID NO: 2601966 - DNA, 13 bp, Homo sapiens
cttcacggcagga

SEQ ID NO: 2601967 - DNA, 17 bp, Homo sapiens
cttcacggcaggacaac

SEQ ID NO: 2601968 - DNA, 19 bp, Homo sapiens
cttcactgcctttgctcct

SEQ ID NO: 2601969 - DNA, 16 bp, Homo sapiens
cttcactgtataaata

SEQ ID NO: 2601970 - DNA, 23 bp, Homo sapiens
cttcactgtataaataggagagg

SEQ ID NO: 2601971 - DNA, 17 bp, Homo sapiens
cttcactgtcctccaag

SEQ ID NO: 2601972 - DNA, 15 bp, Homo sapiens
cttcactgttgaaaa

SEQ ID NO: 2601973 - DNA, 15 bp, Homo sapiens
cttcactttaattct

SEQ ID NO: 2601974 - DNA, 16 bp, Homo sapiens
cttcactttaattctc

SEQ ID NO: 2601975 - DNA, 16 bp, Homo sapiens
cttcagaatgtgattt

SEQ ID NO: 2601976 - DNA, 19 bp, Homo sapiens
cttcagacacaaaagtcca

SEQ ID NO: 2601977 - DNA, 11 bp, Homo sapiens
cttcagacata

SEQ ID NO: 2601978 - DNA, 15 bp, Homo sapiens
cttcagactttgctt

SEQ ID NO: 2601979 - DNA, 19 bp, Homo sapiens
cttcagactttgcttccca

SEQ ID NO: 2601980 - DNA, 17 bp, Homo sapiens
cttcagagactcctgca

SEQ ID NO: 2601981 - DNA, 19 bp, Homo sapiens
cttcagagactcctgcagg

SEQ ID NO: 2601982 - DNA, 22 bp, Homo sapiens
cttcagagactcctgcaggcag

SEQ ID NO: 2601983 - DNA, 24 bp, Homo sapiens
cttcagagactcctgcaggcagcc

SEQ ID NO: 2601984 - DNA, 15 bp, Homo sapiens
cttcagagagctggt

SEQ ID NO: 2601985 - DNA, 14 bp, Homo sapiens
cttcagagctgaca

SEQ ID NO: 2601986 - DNA, 23 bp, Homo sapiens
cttcagaggccctcgctgccagc

SEQ ID NO: 2601987 - DNA, 18 bp, Homo sapiens
cttcagatttgtgttata

SEQ ID NO: 2601988 - DNA, 18 bp, Homo sapiens
cttcagcatatttatagc

SEQ ID NO: 2601989 - DNA, 17 bp, Homo sapiens
cttcagccaggagctgg

SEQ ID NO: 2601990 - DNA, 22 bp, Homo sapiens
cttcagcctagccgacctcagc

SEQ ID NO: 2601991 - DNA, 23 bp, Homo sapiens
cttcagcctagccgacctcagcc

SEQ ID NO: 2601992 - DNA, 15 bp, Homo sapiens
cttcagcctgaggct

SEQ ID NO: 2601993 - DNA, 19 bp, Homo sapiens
cttcagctgacttttctgt

SEQ ID NO: 2601994 - DNA, 12 bp, Homo sapiens
cttcaggcctcc

SEQ ID NO: 2601995 - DNA, 21 bp, Homo sapiens
cttcaggggagtcccgtcagg

SEQ ID NO: 2601996 - DNA, 19 bp, Homo sapiens
cttcaggggcacttcattg

SEQ ID NO: 2601997 - DNA, 15 bp, Homo sapiens
cttcagtaagccgtg

SEQ ID NO: 2601998 - DNA, 17 bp, Homo sapiens
cttcagtggagaattat

SEQ ID NO: 2601999 - DNA, 14 bp, Homo sapiens
cttcagtggcagct

SEQ ID NO: 2602000 - DNA, 17 bp, Homo sapiens
cttcagtggcagctgct

SEQ ID NO: 2602001 - DNA, 12 bp, Homo sapiens
cttcataatcca

SEQ ID NO: 2602002 - DNA, 17 bp, Homo sapiens
cttcatcccacaatctt

SEQ ID NO: 2602003 - DNA, 13 bp, Homo sapiens
cttcatctggcaa

SEQ ID NO: 2602004 - DNA, 19 bp, Homo sapiens
cttcatctggcaacatctt

SEQ ID NO: 2602005 - DNA, 20 bp, Homo sapiens
cttcatcttctcagctccca

SEQ ID NO: 2602006 - DNA, 15 bp, Homo sapiens
cttcatgcatggaaa

SEQ ID NO: 2602007 - DNA, 21 bp, Homo sapiens
cttcatgcatggaaattccct

SEQ ID NO: 2602008 - DNA, 14 bp, Homo sapiens
cttcatgccagcta

SEQ ID NO: 2602009 - DNA, 15 bp, Homo sapiens
cttcatgctcagccc

SEQ ID NO: 2602010 - DNA, 17 bp, Homo sapiens
cttcatgctcagccctg

SEQ ID NO: 2602011 - DNA, 19 bp, Homo sapiens
cttcatgctcagccctgac

SEQ ID NO: 2602012 - DNA, 21 bp, Homo sapiens
cttcatggcagaaggcaaacc

SEQ ID NO: 2602013 - DNA, 20 bp, Homo sapiens
cttcatgtcaacttctggct

SEQ ID NO: 2602014 - DNA, 22 bp, Homo sapiens
cttcattcaagtctatgatgct

SEQ ID NO: 2602015 - DNA, 21 bp, Homo sapiens
cttcattcttgaaagctgtgg

SEQ ID NO: 2602016 - DNA, 19 bp, Homo sapiens
cttcattgccttaactgga

SEQ ID NO: 2602017 - DNA, 14 bp, Homo sapiens
cttcatttggagat

SEQ ID NO: 2602018 - DNA, 11 bp, Homo sapiens
cttcatttgtg

SEQ ID NO: 2602019 - DNA, 13 bp, Homo sapiens
cttccaaagcaca

SEQ ID NO: 2602020 - DNA, 18 bp, Homo sapiens
cttccaacaggagctggg

SEQ ID NO: 2602021 - DNA, 23 bp, Homo sapiens
cttccacacccccaccccttgct

SEQ ID NO: 2602022 - DNA, 13 bp, Homo sapiens
cttccaccagcct

SEQ ID NO: 2602023 - DNA, 15 bp, Homo sapiens
cttccaccagcctgc

SEQ ID NO: 2602024 - DNA, 15 bp, Homo sapiens
cttccacctccctcc

SEQ ID NO: 2602025 - DNA, 16 bp, Homo sapiens
cttccacgctgtctcc

SEQ ID NO: 2602026 - DNA, 21 bp, Homo sapiens
cttccacgctgtctccagacc

SEQ ID NO: 2602027 - DNA, 18 bp, Homo sapiens
cttccactgagggcagtc

SEQ ID NO: 2602028 - DNA, 17 bp, Homo sapiens
cttccagaagtgtgatt

SEQ ID NO: 2602029 - DNA, 21 bp, Homo sapiens
cttccagagagtcctctggat

SEQ ID NO: 2602030 - DNA, 12 bp, Homo sapiens
cttccagctcct

SEQ ID NO: 2602031 - DNA, 23 bp, Homo sapiens
cttctgacccatgctgccctgtg

SEQ ID NO: 2602032 - DNA, 22 bp, Homo sapiens
cttctgacgtgccttttgcacc

SEQ ID NO: 2602033 - DNA, 13 bp, Homo sapiens
cttctgactgctg

SEQ ID NO: 2602034 - DNA, 15 bp, Homo sapiens
cttctgaggacattc

SEQ ID NO: 2602035 - DNA, 12 bp, Homo sapiens
cttctgcaccct

SEQ ID NO: 2602036 - DNA, 22 bp, Homo sapiens
cttctgcaccctccaccctgtc

SEQ ID NO: 2602037 - DNA, 17 bp, Homo sapiens
cttctgccggccctggg

SEQ ID NO: 2602038 - DNA, 12 bp, Homo sapiens
cttctgcctgca

SEQ ID NO: 2602039 - DNA, 14 bp, Homo sapiens
cttctgcctgttat

SEQ ID NO: 2602040 - DNA, 20 bp, Homo sapiens
cttctgccttagtctcagtt

SEQ ID NO: 2602041 - DNA, 16 bp, Homo sapiens
cttctgccttctcatg

SEQ ID NO: 2602042 - DNA, 15 bp, Homo sapiens
cttctgctccaccct

SEQ ID NO: 2602043 - DNA, 16 bp, Homo sapiens
cttctgcttaggagag

SEQ ID NO: 2602044 - DNA, 18 bp, Homo sapiens
cttctgcttaggagagac

SEQ ID NO: 2602045 - DNA, 16 bp, Homo sapiens
cttctgcttcagcctc

SEQ ID NO: 2602046 - DNA, 18 bp, Homo sapiens
cttctgcttcagcctccc

SEQ ID NO: 2602047 - DNA, 13 bp, Homo sapiens
cttctggagccct

SEQ ID NO: 2602048 - DNA, 16 bp, Homo sapiens
cttctggagtctccag

SEQ ID NO: 2602049 - DNA, 20 bp, Homo sapiens
cttctggagtctccagtggt

SEQ ID NO: 2602050 - DNA, 22 bp, Homo sapiens
cttctgggagggcagcagggct

SEQ ID NO: 2602051 - DNA, 19 bp, Homo sapiens
cttctggtactctcctaga

SEQ ID NO: 2602052 - DNA, 20 bp, Homo sapiens
cttctggtactctcctagag

SEQ ID NO: 2602053 - DNA, 17 bp, Homo sapiens
cttctgtagttttatca

SEQ ID NO: 2602054 - DNA, 18 bp, Homo sapiens
cttctgtatactgtggag

SEQ ID NO: 2602055 - DNA, 16 bp, Homo sapiens
cttctgtcctactctg

SEQ ID NO: 2602056 - DNA, 21 bp, Homo sapiens
cttctgtcctactctgtgtca

SEQ ID NO: 2602057 - DNA, 22 bp, Homo sapiens
cttctgtgagacccccacacct

SEQ ID NO: 2602058 - DNA, 21 bp, Homo sapiens
cttctgtgggtgacccaggtc

SEQ ID NO: 2602059 - DNA, 19 bp, Homo sapiens
cttcttaaagtattcttct

SEQ ID NO: 2602060 - DNA, 17 bp, Homo sapiens
cttcttaatcttttcac

SEQ ID NO: 2602061 - DNA, 15 bp, Homo sapiens
cttcttacatgcatt

SEQ ID NO: 2602062 - DNA, 16 bp, Homo sapiens
cttcttatacatttga

SEQ ID NO: 2602063 - DNA, 13 bp, Homo sapiens
cttcttcaccatt

SEQ ID NO: 2602064 - DNA, 15 bp, Homo sapiens
cttcttcacccagct

SEQ ID NO: 2602065 - DNA, 22 bp, Homo sapiens
cttcttcacccagctaatctgt

SEQ ID NO: 2602066 - DNA, 20 bp, Homo sapiens
cttcttcagaagacactgca

SEQ ID NO: 2602067 - DNA, 17 bp, Homo sapiens
cttcttcagccacctct

SEQ ID NO: 2602068 - DNA, 21 bp, Homo sapiens
cttcttcagccacctctcttt

SEQ ID NO: 2602069 - DNA, 14 bp, Homo sapiens
cttcttccctccct

SEQ ID NO: 2602070 - DNA, 15 bp, Homo sapiens
cttcttcctgaagct

SEQ ID NO: 2602071 - DNA, 14 bp, Homo sapiens
cttcttcttcagaa

SEQ ID NO: 2602072 - DNA, 15 bp, Homo sapiens
cttcttctttctaca

SEQ ID NO: 2602073 - DNA, 20 bp, Homo sapiens
cttcttggtcttatttatta

SEQ ID NO: 2602074 - DNA, 22 bp, Homo sapiens
cttctttataattctactttga

SEQ ID NO: 2602075 - DNA, 14 bp, Homo sapiens
cttctttgataatg

SEQ ID NO: 2602076 - DNA, 17 bp, Homo sapiens
cttctttgataatgtta

SEQ ID NO: 2602077 - DNA, 15 bp, Homo sapiens
cttctttgcttgcct

SEQ ID NO: 2602078 - DNA, 19 bp, Homo sapiens
cttctttgctttgcccagc

SEQ ID NO: 2602079 - DNA, 15 bp, Homo sapiens
cttcttttggcttcc

SEQ ID NO: 2602080 - DNA, 23 bp, Homo sapiens
cttctttttattttcttttgtaa

SEQ ID NO: 2602081 - DNA, 16 bp, Homo sapiens
cttctttttgctgttg

SEQ ID NO: 2602082 - DNA, 17 bp, Homo sapiens
cttctttttttgtgatg

SEQ ID NO: 2602083 - DNA, 12 bp, Homo sapiens
cttgaaaaatgt

SEQ ID NO: 2602084 - DNA, 13 bp, Homo sapiens
cttgaaaaatgtg

SEQ ID NO: 2602085 - DNA, 19 bp, Homo sapiens
ctgttctttccaaagtaca

SEQ ID NO: 2602086 - DNA, 13 bp, Homo sapiens
ctgttctttctgg

SEQ ID NO: 2602087 - DNA, 14 bp, Homo sapiens
ctgttgaaaattat

SEQ ID NO: 2602088 - DNA, 17 bp, Homo sapiens
ctgttgacgaagtctct

SEQ ID NO: 2602089 - DNA, 20 bp, Homo sapiens
ctgttgagctgttttccctg

SEQ ID NO: 2602090 - DNA, 17 bp, Homo sapiens
ctgttgattgctaaatg

SEQ ID NO: 2602091 - DNA, 18 bp, Homo sapiens
ctgttgcacccagccctg

SEQ ID NO: 2602092 - DNA, 13 bp, Homo sapiens
ctgttgccacaac

SEQ ID NO: 2602093 - DNA, 16 bp, Homo sapiens
ctgttgcttacaattt

SEQ ID NO: 2602094 - DNA, 19 bp, Homo sapiens
ctgttggacccgctctgga

SEQ ID NO: 2602095 - DNA, 20 bp, Homo sapiens
ctgttggacccgctctggac

SEQ ID NO: 2602096 - DNA, 22 bp, Homo sapiens
ctgttgtataaatttatttact

SEQ ID NO: 2602097 - DNA, 12 bp, Homo sapiens
ctgttgtcattg

SEQ ID NO: 2602098 - DNA, 15 bp, Homo sapiens
ctgttgtcattgctg

SEQ ID NO: 2602099 - DNA, 17 bp, Homo sapiens
ctgttgtcattgctgtt

SEQ ID NO: 2602100 - DNA, 20 bp, Homo sapiens
ctgttgtcctccccttgggc

SEQ ID NO: 2602101 - DNA, 13 bp, Homo sapiens
ctgttgttgttaa

SEQ ID NO: 2602102 - DNA, 17 bp, Homo sapiens
ctgttgttgttaatgaa

SEQ ID NO: 2602103 - DNA, 16 bp, Homo sapiens
ctgttgttttgtttta

SEQ ID NO: 2602104 - DNA, 21 bp, Homo sapiens
ctgtttaatatttaaacagca

SEQ ID NO: 2602105 - DNA, 14 bp, Homo sapiens
ctgtttacaagaaa

SEQ ID NO: 2602106 - DNA, 16 bp, Homo sapiens
ctgtttacaagaaaaa

SEQ ID NO: 2602107 - DNA, 18 bp, Homo sapiens
ctgtttacaagaaaaaat

SEQ ID NO: 2602108 - DNA, 17 bp, Homo sapiens
ctgtttagataatacac

SEQ ID NO: 2602109 - DNA, 15 bp, Homo sapiens
ctgtttatagaataa

SEQ ID NO: 2602110 - DNA, 18 bp, Homo sapiens
ctgtttatggcctcagct

SEQ ID NO: 2602111 - DNA, 16 bp, Homo sapiens
ctgtttctgtcaggag

SEQ ID NO: 2602112 - DNA, 15 bp, Homo sapiens
ctgtttgacaaacct

SEQ ID NO: 2602113 - DNA, 16 bp, Homo sapiens
ctgtttgtcttctccc

SEQ ID NO: 2602114 - DNA, 18 bp, Homo sapiens
ctgtttgtttctgaaagg

SEQ ID NO: 2602115 - DNA, 13 bp, Homo sapiens
ctgttttatgact

SEQ ID NO: 2602116 - DNA, 15 bp, Homo sapiens
ctgttttctgagccc

SEQ ID NO: 2602117 - DNA, 17 bp, Homo sapiens
ctgttttctgagcccgg

SEQ ID NO: 2602118 - DNA, 19 bp, Homo sapiens
ctgttttctgagcccgggc

SEQ ID NO: 2602119 - DNA, 22 bp, Homo sapiens
ctgttttgcctgaagttggagt

SEQ ID NO: 2602120 - DNA, 23 bp, Homo sapiens
ctgtttttaagctgtttccatag

SEQ ID NO: 2602121 - DNA, 13 bp, Homo sapiens
ctgtttttaccca

SEQ ID NO: 2602122 - DNA, 22 bp, Homo sapiens
ctgtttttacccatatcccctc

SEQ ID NO: 2602123 - DNA, 12 bp, Homo sapiens
ctgtttttcaca

SEQ ID NO: 2602124 - DNA, 17 bp, Homo sapiens
ctgtttttcagggaggt

SEQ ID NO: 2602125 - DNA, 21 bp, Homo sapiens
ctgtttttctgggtggcctcg

SEQ ID NO: 2602126 - DNA, 13 bp, Homo sapiens
ctgttttttagtt

SEQ ID NO: 2602127 - DNA, 16 bp, Homo sapiens
cttaaaaagtggaaaa

SEQ ID NO: 2602128 - DNA, 17 bp, Homo sapiens
cttaaaaagtggaaaaa

SEQ ID NO: 2602129 - DNA, 20 bp, Homo sapiens
cttaaaaatcattgattgtc

SEQ ID NO: 2602130 - DNA, 15 bp, Homo sapiens
cttaaaaatgtaaat

SEQ ID NO: 2602131 - DNA, 13 bp, Homo sapiens
cttaaaataactt

SEQ ID NO: 2602132 - DNA, 13 bp, Homo sapiens
cttaaaatatttt

SEQ ID NO: 2602133 - DNA, 14 bp, Homo sapiens
cttaaaatatttta

SEQ ID NO: 2602134 - DNA, 24 bp, Homo sapiens
cttaaaatgttcacttttgacaaa

SEQ ID NO: 2602135 - DNA, 14 bp, Homo sapiens
cttaaacaaatgta

SEQ ID NO: 2602136 - DNA, 23 bp, Homo sapiens
cttaaactgtgtggactgtgatg

SEQ ID NO: 2602137 - DNA, 16 bp, Homo sapiens
cttaaagatttatcaa

SEQ ID NO: 2602138 - DNA, 19 bp, Homo sapiens
cttaaagatttatcaaatc

SEQ ID NO: 2602139 - DNA, 18 bp, Homo sapiens
cttaaagctgcctgtagt

SEQ ID NO: 2602140 - DNA, 23 bp, Homo sapiens
cttaaaggctgtggtagtactcc

SEQ ID NO: 2602141 - DNA, 21 bp, Homo sapiens
cttaaataataaacagtggaa

SEQ ID NO: 2602142 - DNA, 13 bp, Homo sapiens
cttaaataatgtg

SEQ ID NO: 2602143 - DNA, 14 bp, Homo sapiens
cttaaataatgtga

SEQ ID NO: 2602144 - DNA, 16 bp, Homo sapiens
cttaaatgagaaggaa

SEQ ID NO: 2602145 - DNA, 16 bp, Homo sapiens
cttaaattttaattta

SEQ ID NO: 2602146 - DNA, 23 bp, Homo sapiens
cttaacaatttctgtccttcaga

SEQ ID NO: 2602147 - DNA, 17 bp, Homo sapiens
cttaacatatttactaa

SEQ ID NO: 2602148 - DNA, 19 bp, Homo sapiens
cttaactgcatttttagac

SEQ ID NO: 2602149 - DNA, 22 bp, Homo sapiens
cttaacttcacatattgatttc

SEQ ID NO: 2602150 - DNA, 17 bp, Homo sapiens
cttaagagatgcctcat

SEQ ID NO: 2602151 - DNA, 18 bp, Homo sapiens
cttaagcagaagcattaa

SEQ ID NO: 2602152 - DNA, 20 bp, Homo sapiens
cttaagccttttgctcacaa

SEQ ID NO: 2602153 - DNA, 20 bp, Homo sapiens
cttaaggattgtgatatttt

SEQ ID NO: 2602154 - DNA, 12 bp, Homo sapiens
cttaaggggcag

SEQ ID NO: 2602155 - DNA, 15 bp, Homo sapiens
cttaagtttctcagc

SEQ ID NO: 2602156 - DNA, 17 bp, Homo sapiens
cttaagtttctcagctc

SEQ ID NO: 2602157 - DNA, 17 bp, Homo sapiens
cttaatacacacagtta

SEQ ID NO: 2602158 - DNA, 20 bp, Homo sapiens
cttaatagaaacattgaaga

SEQ ID NO: 2602159 - DNA, 22 bp, Homo sapiens
cttaatcaggtcctcagagaat

SEQ ID NO: 2602160 - DNA, 20 bp, Homo sapiens
cttaatcttttcacaaataa

SEQ ID NO: 2602161 - DNA, 15 bp, Homo sapiens
cttaatgcttctttc

SEQ ID NO: 2602162 - DNA, 14 bp, Homo sapiens
cttaatgtttattc

SEQ ID NO: 2602163 - DNA, 16 bp, Homo sapiens
cttaattaaaagaata

SEQ ID NO: 2602164 - DNA, 20 bp, Homo sapiens
cttaattaaaagaatatttt

SEQ ID NO: 2602165 - DNA, 14 bp, Homo sapiens
cttaattttcagta

SEQ ID NO: 2602166 - DNA, 16 bp, Homo sapiens
cttaattttggttgta

SEQ ID NO: 2602167 - DNA, 17 bp, Homo sapiens
cttacaagccagctgga

SEQ ID NO: 2602168 - DNA, 20 bp, Homo sapiens
cttacaattccctgctgtcg

SEQ ID NO: 2602169 - DNA, 21 bp, Homo sapiens
cttacaatttttttaattttg

SEQ ID NO: 2602170 - DNA, 13 bp, Homo sapiens
cttacacacaaaa

SEQ ID NO: 2602171 - DNA, 17 bp, Homo sapiens
cttacacttactgttgt

SEQ ID NO: 2602172 - DNA, 22 bp, Homo sapiens
cttacagctgggtggcactgcc

SEQ ID NO: 2602173 - DNA, 14 bp, Homo sapiens
cttaccaactttct

SEQ ID NO: 2602174 - DNA, 15 bp, Homo sapiens
cttaccaactttctg

SEQ ID NO: 2602175 - DNA, 19 bp, Homo sapiens
cttaccaactttctgtaaa

SEQ ID NO: 2602176 - DNA, 15 bp, Homo sapiens
cttaccagcagagca

SEQ ID NO: 2602177 - DNA, 16 bp, Homo sapiens
cttaccagcagagcac

SEQ ID NO: 2602178 - DNA, 14 bp, Homo sapiens
cttaccatgtgcct

SEQ ID NO: 2602179 - DNA, 23 bp, Homo sapiens
cttacccatctgcacccccctgg

SEQ ID NO: 2602180 - DNA, 19 bp, Homo sapiens
cttaccctcatgttcttaa

SEQ ID NO: 2602181 - DNA, 19 bp, Homo sapiens
cttacctcggtgccttcct

SEQ ID NO: 2602182 - DNA, 21 bp, Homo sapiens
cttaccttcaataaagtatct

SEQ ID NO: 2602183 - DNA, 12 bp, Homo sapiens
cttactgatata

SEQ ID NO: 2602184 - DNA, 19 bp, Homo sapiens
cttactgatatattttaca

SEQ ID NO: 2602185 - DNA, 19 bp, Homo sapiens
cttactgtggaggaaggat

SEQ ID NO: 2602186 - DNA, 15 bp, Homo sapiens
cttactgtttctgtc

SEQ ID NO: 2602187 - DNA, 19 bp, Homo sapiens
cttagaattagtggcactt

SEQ ID NO: 2602188 - DNA, 14 bp, Homo sapiens
cttagacctcagcc

SEQ ID NO: 2602189 - DNA, 18 bp, Homo sapiens
cttagacctcagcctgtg

SEQ ID NO: 2602190 - DNA, 16 bp, Homo sapiens
cttagaccttccataa

SEQ ID NO: 2602191 - DNA, 16 bp, Homo sapiens
cttagacttgaaatac

SEQ ID NO: 2602192 - DNA, 19 bp, Homo sapiens
cttagagcagtttctgtcc

SEQ ID NO: 2602193 - DNA, 16 bp, Homo sapiens
cttagagcctccctca

SEQ ID NO: 2602194 - DNA, 17 bp, Homo sapiens
cttagattagctctgga

SEQ ID NO: 2602195 - DNA, 20 bp, Homo sapiens
cttagattagctctggacca

SEQ ID NO: 2602196 - DNA, 22 bp, Homo sapiens
cttagcagctatctctcagtga

SEQ ID NO: 2602197 - DNA, 23 bp, Homo sapiens
cttagcagctatctctcagtgaa

SEQ ID NO: 2602198 - DNA, 16 bp, Homo sapiens
cttagcatgtttgctg

SEQ ID NO: 2602199 - DNA, 18 bp, Homo sapiens
cttagcatgtttgctgaa

SEQ ID NO: 2602200 - DNA, 20 bp, Homo sapiens
cttagcccccacccacttcc

SEQ ID NO: 2602201 - DNA, 14 bp, Homo sapiens
cttagcctccctga

SEQ ID NO: 2602202 - DNA, 14 bp, Homo sapiens
cttagctgtctgct

SEQ ID NO: 2602203 - DNA, 17 bp, Homo sapiens
cttagctgtctgctcag

SEQ ID NO: 2602204 - DNA, 15 bp, Homo sapiens
ccttgacagggcaca

SEQ ID NO: 2602205 - DNA, 23 bp, Homo sapiens
ccttgaccagcagatcccagctc

SEQ ID NO: 2602206 - DNA, 15 bp, Homo sapiens
ccttgaccaggcctg

SEQ ID NO: 2602207 - DNA, 16 bp, Homo sapiens
ccttgaccaggcctgg

SEQ ID NO: 2602208 - DNA, 19 bp, Homo sapiens
ccttgaccattctccacct

SEQ ID NO: 2602209 - DNA, 23 bp, Homo sapiens
ccttgaccattctccacctgcca

SEQ ID NO: 2602210 - DNA, 20 bp, Homo sapiens
ccttgacgtcaagtctcctt

SEQ ID NO: 2602211 - DNA, 19 bp, Homo sapiens
ccttgagaaaccttattgt

SEQ ID NO: 2602212 - DNA, 11 bp, Homo sapiens
ccttgagacca

SEQ ID NO: 2602213 - DNA, 21 bp, Homo sapiens
ccttgagagaccaggcaaagc

SEQ ID NO: 2602214 - DNA, 21 bp, Homo sapiens
ccttgagagtatcaggtctcc

SEQ ID NO: 2602215 - DNA, 17 bp, Homo sapiens
ccttgagctccccaaaa

SEQ ID NO: 2602216 - DNA, 14 bp, Homo sapiens
ccttgagctgagat

SEQ ID NO: 2602217 - DNA, 18 bp, Homo sapiens
ccttgaggaaacaacagc

SEQ ID NO: 2602218 - DNA, 18 bp, Homo sapiens
ccttgaggagtcttgtgt

SEQ ID NO: 2602219 - DNA, 12 bp, Homo sapiens
ccttgaggtctt

SEQ ID NO: 2602220 - DNA, 16 bp, Homo sapiens
ccttgcaacacacaga

SEQ ID NO: 2602221 - DNA, 17 bp, Homo sapiens
ccttgcaacttcatgtc

SEQ ID NO: 2602222 - DNA, 18 bp, Homo sapiens
ccttgcacactcagaagc

SEQ ID NO: 2602223 - DNA, 13 bp, Homo sapiens
ccttgcacccctc

SEQ ID NO: 2602224 - DNA, 20 bp, Homo sapiens
ccttgcagttcagcaccacc

SEQ ID NO: 2602225 - DNA, 22 bp, Homo sapiens
ccttgcagttcagcaccaccct

SEQ ID NO: 2602226 - DNA, 15 bp, Homo sapiens
ccttgcccagggctc

SEQ ID NO: 2602227 - DNA, 19 bp, Homo sapiens
ccttgccctgacctcccag

SEQ ID NO: 2602228 - DNA, 15 bp, Homo sapiens
ccttgcccttgccct

SEQ ID NO: 2602229 - DNA, 17 bp, Homo sapiens
ccttgcccttgccctga

SEQ ID NO: 2602230 - DNA, 14 bp, Homo sapiens
ccttgcctcctgtg

SEQ ID NO: 2602231 - DNA, 15 bp, Homo sapiens
ccttgcgctgttgcg

SEQ ID NO: 2602232 - DNA, 17 bp, Homo sapiens
ccttgctacctcaaggg

SEQ ID NO: 2602233 - DNA, 18 bp, Homo sapiens
ccttgctcgctgtaaaat

SEQ ID NO: 2602234 - DNA, 22 bp, Homo sapiens
ccttgctctcccctgccctgct

SEQ ID NO: 2602235 - DNA, 13 bp, Homo sapiens
ccttgctctccct

SEQ ID NO: 2602236 - DNA, 15 bp, Homo sapiens
ccttgctctccctct

SEQ ID NO: 2602237 - DNA, 17 bp, Homo sapiens
ccttgctggaaaaccca

SEQ ID NO: 2602238 - DNA, 22 bp, Homo sapiens
ccttgctggacggggactgggg

SEQ ID NO: 2602239 - DNA, 21 bp, Homo sapiens
ccttgctggttttctggatgg

SEQ ID NO: 2602240 - DNA, 16 bp, Homo sapiens
ccttgctgtcctaggc

SEQ ID NO: 2602241 - DNA, 18 bp, Homo sapiens
ccttggaaacctgccctg

SEQ ID NO: 2602242 - DNA, 15 bp, Homo sapiens
ccttggattgtcccc

SEQ ID NO: 2602243 - DNA, 15 bp, Homo sapiens
ccttggcatgccttc

SEQ ID NO: 2602244 - DNA, 22 bp, Homo sapiens
ccttggctcaagtcctcttttc

SEQ ID NO: 2602245 - DNA, 14 bp, Homo sapiens
ccttggctgcaggg

SEQ ID NO: 2602246 - DNA, 12 bp, Homo sapiens
ccttgggccctt

SEQ ID NO: 2602247 - DNA, 17 bp, Homo sapiens
ccttgggccctttgagt

SEQ ID NO: 2602248 - DNA, 18 bp, Homo sapiens
ccttgggcggctgagagc

SEQ ID NO: 2602249 - DNA, 12 bp, Homo sapiens
ccttgggctccc

SEQ ID NO: 2602250 - DNA, 15 bp, Homo sapiens
ccttgggctgctcct

SEQ ID NO: 2602251 - DNA, 17 bp, Homo sapiens
ccttgggctgctcctca

SEQ ID NO: 2602252 - DNA, 17 bp, Homo sapiens
ccttggggaatttcctc

SEQ ID NO: 2602253 - DNA, 15 bp, Homo sapiens
ccttggggcaggcag

SEQ ID NO: 2602254 - DNA, 21 bp, Homo sapiens
ccttggttaggcattgtggga

SEQ ID NO: 2602255 - DNA, 22 bp, Homo sapiens
ccttggttaggcattgtgggaa

SEQ ID NO: 2602256 - DNA, 16 bp, Homo sapiens
ccttggttcccccact

SEQ ID NO: 2602257 - DNA, 14 bp, Homo sapiens
ccttgtccacccac

SEQ ID NO: 2602258 - DNA, 14 bp, Homo sapiens
ccttgtcctttccc

SEQ ID NO: 2602259 - DNA, 23 bp, Homo sapiens
ccttgtgatgtggcaataaattt

SEQ ID NO: 2602260 - DNA, 18 bp, Homo sapiens
ccttgttggagcctgcag

SEQ ID NO: 2602261 - DNA, 19 bp, Homo sapiens
ccttgttggagcctgcagg

SEQ ID NO: 2602262 - DNA, 19 bp, Homo sapiens
cctttatgtggaaaacaga

SEQ ID NO: 2602263 - DNA, 23 bp, Homo sapiens
cctttatgtggaaaacagaacat

SEQ ID NO: 2602264 - DNA, 15 bp, Homo sapiens
cctttcaaatttcac

SEQ ID NO: 2602265 - DNA, 17 bp, Homo sapiens
cctttcagatgtcttct

SEQ ID NO: 2602266 - DNA, 19 bp, Homo sapiens
cctttcagatgtcttctgc

SEQ ID NO: 2602267 - DNA, 22 bp, Homo sapiens
cctttcagatgtcttctgcctg

SEQ ID NO: 2602268 - DNA, 12 bp, Homo sapiens
cctttcagggaa

SEQ ID NO: 2602269 - DNA, 12 bp, Homo sapiens
cctttcatattt

SEQ ID NO: 2602270 - DNA, 16 bp, Homo sapiens
cctttcatttactgtg

SEQ ID NO: 2602271 - DNA, 12 bp, Homo sapiens
cctttcccttct

SEQ ID NO: 2602272 - DNA, 15 bp, Homo sapiens
cctttcccttcttgg

SEQ ID NO: 2602273 - DNA, 14 bp, Homo sapiens
cctttctcccaggc

SEQ ID NO: 2602274 - DNA, 13 bp, Homo sapiens
cctttctgtgtgc

SEQ ID NO: 2602275 - DNA, 15 bp, Homo sapiens
cctttcttggccagt

SEQ ID NO: 2602276 - DNA, 13 bp, Homo sapiens
cctttcttggttc

SEQ ID NO: 2602277 - DNA, 14 bp, Homo sapiens
cctcacccctgccc

SEQ ID NO: 2602278 - DNA, 18 bp, Homo sapiens
cctcacccctgccctggg

SEQ ID NO: 2602279 - DNA, 15 bp, Homo sapiens
cctcaccctgagccc

SEQ ID NO: 2602280 - DNA, 13 bp, Homo sapiens
cctcacctcctct

SEQ ID NO: 2602281 - DNA, 18 bp, Homo sapiens
cctcacctgggcacctgg

SEQ ID NO: 2602282 - DNA, 17 bp, Homo sapiens
cctcaccttgcaacaca

SEQ ID NO: 2602283 - DNA, 21 bp, Homo sapiens
cctcaccttgcaacacacaga

SEQ ID NO: 2602284 - DNA, 14 bp, Homo sapiens
cctcacgcacctcc

SEQ ID NO: 2602285 - DNA, 19 bp, Homo sapiens
cctcactcccttctacctg

SEQ ID NO: 2602286 - DNA, 12 bp, Homo sapiens
cctcactcctgt

SEQ ID NO: 2602287 - DNA, 19 bp, Homo sapiens
cctcactggggtcctgggg

SEQ ID NO: 2602288 - DNA, 13 bp, Homo sapiens
cctcactgggtgg

SEQ ID NO: 2602289 - DNA, 21 bp, Homo sapiens
cctcactgggtggggtgagga

SEQ ID NO: 2602290 - DNA, 19 bp, Homo sapiens
cctcacttccatacagctc

SEQ ID NO: 2602291 - DNA, 20 bp, Homo sapiens
cctcagaaacactggggctg

SEQ ID NO: 2602292 - DNA, 17 bp, Homo sapiens
cctcagacttaccagga

SEQ ID NO: 2602293 - DNA, 16 bp, Homo sapiens
cctcagagtccaggcc

SEQ ID NO: 2602294 - DNA, 18 bp, Homo sapiens
cctcagcaccccttccat

SEQ ID NO: 2602295 - DNA, 20 bp, Homo sapiens
cctcagcccctcttgccccc

SEQ ID NO: 2602296 - DNA, 20 bp, Homo sapiens
cctcagcctagaccctcctc

SEQ ID NO: 2602297 - DNA, 12 bp, Homo sapiens
cctcagcctccg

SEQ ID NO: 2602298 - DNA, 11 bp, Homo sapiens
cctcagcctgt

SEQ ID NO: 2602299 - DNA, 12 bp, Homo sapiens
cctcagcctgtg

SEQ ID NO: 2602300 - DNA, 13 bp, Homo sapiens
cctcagctctggg

SEQ ID NO: 2602301 - DNA, 14 bp, Homo sapiens
cctcagctctggga

SEQ ID NO: 2602302 - DNA, 15 bp, Homo sapiens
cctcagctctgggag

SEQ ID NO: 2602303 - DNA, 16 bp, Homo sapiens
cctcagctctgggaga

SEQ ID NO: 2602304 - DNA, 18 bp, Homo sapiens
cctcagctctgggagagg

SEQ ID NO: 2602305 - DNA, 13 bp, Homo sapiens
cctcagctgcctc

SEQ ID NO: 2602306 - DNA, 17 bp, Homo sapiens
cctcaggaatgggctgt

SEQ ID NO: 2602307 - DNA, 13 bp, Homo sapiens
cctcaggactgca

SEQ ID NO: 2602308 - DNA, 13 bp, Homo sapiens
cctcaggcagctc

SEQ ID NO: 2602309 - DNA, 15 bp, Homo sapiens
cctcaggcagctcaa

SEQ ID NO: 2602310 - DNA, 13 bp, Homo sapiens
cctcaggcaggaa

SEQ ID NO: 2602311 - DNA, 15 bp, Homo sapiens
cctcaggcaggaagg

SEQ ID NO: 2602312 - DNA, 12 bp, Homo sapiens
cctcaggcaggt

SEQ ID NO: 2602313 - DNA, 22 bp, Homo sapiens
cctcaggcataggcctgggtgc

SEQ ID NO: 2602314 - DNA, 16 bp, Homo sapiens
cctcaggcttccttgg

SEQ ID NO: 2602315 - DNA, 17 bp, Homo sapiens
cctcaggcttccttggc

SEQ ID NO: 2602316 - DNA, 16 bp, Homo sapiens
cctcagggtccctggt

SEQ ID NO: 2602317 - DNA, 20 bp, Homo sapiens
cctcaggtcagggtgaggat

SEQ ID NO: 2602318 - DNA, 17 bp, Homo sapiens
cctcaggtgagaagcag

SEQ ID NO: 2602319 - DNA, 22 bp, Homo sapiens
cctcaggtgagaagcagaggaa

SEQ ID NO: 2602320 - DNA, 17 bp, Homo sapiens
cctcaggtgatccaccc

SEQ ID NO: 2602321 - DNA, 22 bp, Homo sapiens
cctcaggtgatccacccacctc

SEQ ID NO: 2602322 - DNA, 15 bp, Homo sapiens
cctcaggttcctatg

SEQ ID NO: 2602323 - DNA, 22 bp, Homo sapiens
cctcaggttgctggttgctgtg

SEQ ID NO: 2602324 - DNA, 23 bp, Homo sapiens
cctcaggttgctggttgctgtgt

SEQ ID NO: 2602325 - DNA, 19 bp, Homo sapiens
cctcaggtttgcctgaggg

SEQ ID NO: 2602326 - DNA, 15 bp, Homo sapiens
cctcagtaagacgac

SEQ ID NO: 2602327 - DNA, 21 bp, Homo sapiens
cctcagtaagtatctggagga

SEQ ID NO: 2602328 - DNA, 21 bp, Homo sapiens
cctcagtggactttccacccc

SEQ ID NO: 2602329 - DNA, 11 bp, Homo sapiens
cctcagtgtca

SEQ ID NO: 2602330 - DNA, 15 bp, Homo sapiens
cctcagtttccctat

SEQ ID NO: 2602331 - DNA, 12 bp, Homo sapiens
cctcatacccac

SEQ ID NO: 2602332 - DNA, 20 bp, Homo sapiens
cctcatagtatggtggctgg

SEQ ID NO: 2602333 - DNA, 13 bp, Homo sapiens
cctcatcaccaac

SEQ ID NO: 2602334 - DNA, 19 bp, Homo sapiens
cctcatcaggatgaaccca

SEQ ID NO: 2602335 - DNA, 23 bp, Homo sapiens
cctcatcaggatgaacccaggac

SEQ ID NO: 2602336 - DNA, 20 bp, Homo sapiens
cctcatcccgtgttctcctt

SEQ ID NO: 2602337 - DNA, 15 bp, Homo sapiens
cctcatccgaggcag

SEQ ID NO: 2602338 - DNA, 20 bp, Homo sapiens
cctcatccgaggcagggtca

SEQ ID NO: 2602339 - DNA, 13 bp, Homo sapiens
cctcatctgctca

SEQ ID NO: 2602340 - DNA, 19 bp, Homo sapiens
cctcatctgctcagcagct

SEQ ID NO: 2602341 - DNA, 13 bp, Homo sapiens
cctcatgcatctc

SEQ ID NO: 2602342 - DNA, 21 bp, Homo sapiens
cctcatgtacataccctggcc

SEQ ID NO: 2602343 - DNA, 18 bp, Homo sapiens
cctcatgtgatcacaatt

SEQ ID NO: 2602344 - DNA, 20 bp, Homo sapiens
cctcatttatccctcaaccc

SEQ ID NO: 2602345 - DNA, 20 bp, Homo sapiens
cctcatttggggtagctaga

SEQ ID NO: 2602346 - DNA, 23 bp, Homo sapiens
cctcatttttgaatacaggcata

SEQ ID NO: 2602347 - DNA, 19 bp, Homo sapiens
cctccaaaactcctgcccc

SEQ ID NO: 2602348 - DNA, 17 bp, Homo sapiens
cctccaagaatctatct

SEQ ID NO: 2602349 - DNA, 16 bp, Homo sapiens
cctccaagaccttctc

SEQ ID NO: 2602350 - DNA, 20 bp, Homo sapiens
cctccaagaccttctccttc

SEQ ID NO: 2602351 - DNA, 23 bp, Homo sapiens
cctccacagttcgacctgcggct

SEQ ID NO: 2602352 - DNA, 15 bp, Homo sapiens
cctccaccaccactg

SEQ ID NO: 2602353 - DNA, 17 bp, Homo sapiens
cctccacgttctgctca

SEQ ID NO: 2602354 - DNA, 13 bp, Homo sapiens
cctccactgtcac

SEQ ID NO: 2602355 - DNA, 12 bp, Homo sapiens
cctccagaagcc

SEQ ID NO: 2602356 - DNA, 13 bp, Homo sapiens
cctccagaagcct

SEQ ID NO: 2602357 - DNA, 19 bp, Homo sapiens
cctccagaagcctctggct

SEQ ID NO: 2602358 - DNA, 20 bp, Homo sapiens
cctccagaagcctctggcta

SEQ ID NO: 2602359 - DNA, 21 bp, Homo sapiens
cctccagaagcctctggctag

SEQ ID NO: 2602360 - DNA, 12 bp, Homo sapiens
cctccagcctct

SEQ ID NO: 2602361 - DNA, 14 bp, Homo sapiens
cctccagcctctgt

SEQ ID NO: 2602362 - DNA, 15 bp, Homo sapiens
cctccagcctctgtt

SEQ ID NO: 2602363 - DNA, 19 bp, Homo sapiens
cctccagcttgtggagccc

SEQ ID NO: 2602364 - DNA, 13 bp, Homo sapiens
cctccaggcaaaa

SEQ ID NO: 2602365 - DNA, 17 bp, Homo sapiens
cctccaggtgcacaagc

SEQ ID NO: 2602366 - DNA, 19 bp, Homo sapiens
cctccaggtgcacaagctc

SEQ ID NO: 2602367 - DNA, 19 bp, Homo sapiens
cctccaggtgtgcacgtgg

SEQ ID NO: 2602368 - DNA, 16 bp, Homo sapiens
cctccaggtttttcaa

SEQ ID NO: 2602369 - DNA, 17 bp, Homo sapiens
cctccaggtttttcaat

SEQ ID NO: 2602370 - DNA, 18 bp, Homo sapiens
cctccaggtttttcaatt

SEQ ID NO: 2602371 - DNA, 19 bp, Homo sapiens
cctccaggtttttcaatta

SEQ ID NO: 2602372 - DNA, 21 bp, Homo sapiens
cctccaggtttttcaattaaa

SEQ ID NO: 2602373 - DNA, 24 bp, Homo sapiens
cctccatctcatgtatcatctgga

SEQ ID NO: 2602374 - DNA, 16 bp, Homo sapiens
cctccatgctgcctcc

SEQ ID NO: 2602375 - DNA, 19 bp, Homo sapiens
cctccatgctgcctccaga

SEQ ID NO: 2602376 - DNA, 12 bp, Homo sapiens
cctccatgtggg

SEQ ID NO: 2602377 - DNA, 15 bp, Homo sapiens
cctccatgtgggcta

SEQ ID NO: 2602378 - DNA, 23 bp, Homo sapiens
cctccatgtgggctagttgggct

SEQ ID NO: 2602379 - DNA, 14 bp, Homo sapiens
cctcccaactcacc

SEQ ID NO: 2602380 - DNA, 15 bp, Homo sapiens
cctcccaactcaccc

SEQ ID NO: 2602381 - DNA, 21 bp, Homo sapiens
cctcccaactcaccccagccc

SEQ ID NO: 2602382 - DNA, 22 bp, Homo sapiens
cctcccaaggggcccaaattct

SEQ ID NO: 2602383 - DNA, 11 bp, Homo sapiens
cctcccacaca

SEQ ID NO: 2602384 - DNA, 12 bp, Homo sapiens
cctcccaccccc

SEQ ID NO: 2602385 - DNA, 13 bp, Homo sapiens
cctcccaccccca

SEQ ID NO: 2602386 - DNA, 20 bp, Homo sapiens
cctcccacccccttctctgc

SEQ ID NO: 2602387 - DNA, 12 bp, Homo sapiens
cctcccacccga

SEQ ID NO: 2602388 - DNA, 21 bp, Homo sapiens
cctcccacccgatgctgcttt

SEQ ID NO: 2602389 - DNA, 15 bp, Homo sapiens
cctcccacctcagcc

SEQ ID NO: 2602390 - DNA, 18 bp, Homo sapiens
cctcccagaacacactcc

SEQ ID NO: 2602391 - DNA, 12 bp, Homo sapiens
cctcccagccct

SEQ ID NO: 2602392 - DNA, 13 bp, Homo sapiens
cctcccagcccta

SEQ ID NO: 2602393 - DNA, 18 bp, Homo sapiens
cctcccagccctatggat

SEQ ID NO: 2602394 - DNA, 12 bp, Homo sapiens
cctcccagcctg

SEQ ID NO: 2602395 - DNA, 14 bp, Homo sapiens
cctcccagggccag

SEQ ID NO: 2602396 - DNA, 16 bp, Homo sapiens
cctcccagtcaccttg

SEQ ID NO: 2602397 - DNA, 17 bp, Homo sapiens
cctcccatcccctggac

SEQ ID NO: 2602398 - DNA, 13 bp, Homo sapiens
cctcccatctcac

SEQ ID NO: 2602399 - DNA, 13 bp, Homo sapiens
cctcccatctggg

SEQ ID NO: 2602400 - DNA, 21 bp, Homo sapiens
cctcccatctgggagtcccct

SEQ ID NO: 2602401 - DNA, 15 bp, Homo sapiens
cctcccatggcacct

SEQ ID NO: 2602402 - DNA, 18 bp, Homo sapiens
cctcccccaacccccacc

SEQ ID NO: 2602403 - DNA, 17 bp, Homo sapiens
cctcccccgccactcct

SEQ ID NO: 2602404 - DNA, 16 bp, Homo sapiens
cctccccctgccagga

SEQ ID NO: 2602405 - DNA, 17 bp, Homo sapiens
cctcccctctcttgcac

SEQ ID NO: 2602406 - DNA, 14 bp, Homo sapiens
cctcccctgaggct

SEQ ID NO: 2602407 - DNA, 14 bp, Homo sapiens
cctcccctgcccta

SEQ ID NO: 2602408 - DNA, 16 bp, Homo sapiens
cctcccctgctgaagg

SEQ ID NO: 2602409 - DNA, 20 bp, Homo sapiens
cctcccctggggacagcaag

SEQ ID NO: 2602410 - DNA, 13 bp, Homo sapiens
cctccccttgggc

SEQ ID NO: 2602411 - DNA, 23 bp, Homo sapiens
cctccccttgggcggctgagagc

SEQ ID NO: 2602412 - DNA, 19 bp, Homo sapiens
cctcccgaatagctgggac

SEQ ID NO: 2602413 - DNA, 19 bp, Homo sapiens
cctcccgagtagctgggac

SEQ ID NO: 2602414 - DNA, 17 bp, Homo sapiens
cctcccgggccctccct

SEQ ID NO: 2602415 - DNA, 18 bp, Homo sapiens
cctccctagtgacccgga

SEQ ID NO: 2602416 - DNA, 14 bp, Homo sapiens
cctccctcaccctg

SEQ ID NO: 2602417 - DNA, 19 bp, Homo sapiens
cctccctcaccctgagccc

SEQ ID NO: 2602418 - DNA, 22 bp, Homo sapiens
cctccctcaccctgagcccctt

SEQ ID NO: 2602419 - DNA, 15 bp, Homo sapiens
cctccctcagcccct

SEQ ID NO: 2602420 - DNA, 15 bp, Homo sapiens
cctccctcctgccga

SEQ ID NO: 2602421 - DNA, 13 bp, Homo sapiens
cctccctgaacca

SEQ ID NO: 2602422 - DNA, 13 bp, Homo sapiens
cctccctggctcc

SEQ ID NO: 2602423 - DNA, 15 bp, Homo sapiens
cctccctggctccca

SEQ ID NO: 2602424 - DNA, 12 bp, Homo sapiens
cctccctggctg

SEQ ID NO: 2602425 - DNA, 16 bp, Homo sapiens
cctccctggctgccct

SEQ ID NO: 2602426 - DNA, 18 bp, Homo sapiens
cctccctggctgccctgg

SEQ ID NO: 2602427 - DNA, 22 bp, Homo sapiens
cctccctggctgccctggccct

SEQ ID NO: 2602428 - DNA, 12 bp, Homo sapiens
cctccctgggtt

SEQ ID NO: 2602429 - DNA, 14 bp, Homo sapiens
cctccctgggttca

SEQ ID NO: 2602430 - DNA, 14 bp, Homo sapiens
tgttagctgttatt

SEQ ID NO: 2602431 - DNA, 19 bp, Homo sapiens
tgttagtatgaggcatttg

SEQ ID NO: 2602432 - DNA, 15 bp, Homo sapiens
tgttataactctgca

SEQ ID NO: 2602433 - DNA, 17 bp, Homo sapiens
tgttataactctgcact

SEQ ID NO: 2602434 - DNA, 20 bp, Homo sapiens
tgttatcaaaactttctttt

SEQ ID NO: 2602435 - DNA, 19 bp, Homo sapiens
tgttatcaccgtgggctcc

SEQ ID NO: 2602436 - DNA, 16 bp, Homo sapiens
tgttatgaaataaaga

SEQ ID NO: 2602437 - DNA, 21 bp, Homo sapiens
tgttattaaacgtatgcatgt

SEQ ID NO: 2602438 - DNA, 23 bp, Homo sapiens
tgttattaaacgtatgcatgtga

SEQ ID NO: 2602439 - DNA, 23 bp, Homo sapiens
tgttattagagattacctcctga

SEQ ID NO: 2602440 - DNA, 15 bp, Homo sapiens
tgttatttaaatgag

SEQ ID NO: 2602441 - DNA, 17 bp, Homo sapiens
tgttatttctcagactt

SEQ ID NO: 2602442 - DNA, 16 bp, Homo sapiens
tgttatttttgtttct

SEQ ID NO: 2602443 - DNA, 21 bp, Homo sapiens
tgttcaaagccagcgtcctcc

SEQ ID NO: 2602444 - DNA, 22 bp, Homo sapiens
tgttcaaagccagcgtcctcct

SEQ ID NO: 2602445 - DNA, 16 bp, Homo sapiens
tgttcacagccagact

SEQ ID NO: 2602446 - DNA, 16 bp, Homo sapiens
tgttcacttttcctcc

SEQ ID NO: 2602447 - DNA, 17 bp, Homo sapiens
tgttcacttttgacaaa

SEQ ID NO: 2602448 - DNA, 17 bp, Homo sapiens
tgttcagattgctttga

SEQ ID NO: 2602449 - DNA, 17 bp, Homo sapiens
tgttcagtgtaatttct

SEQ ID NO: 2602450 - DNA, 21 bp, Homo sapiens
tgttcagtgtaatttctttgc

SEQ ID NO: 2602451 - DNA, 18 bp, Homo sapiens
tgttcagttacagaaagt

SEQ ID NO: 2602452 - DNA, 22 bp, Homo sapiens
tgttcattaaagcatgaatggt

SEQ ID NO: 2602453 - DNA, 13 bp, Homo sapiens
tgttcattgtaat

SEQ ID NO: 2602454 - DNA, 20 bp, Homo sapiens
tgttcattgtaatgttactg

SEQ ID NO: 2602455 - DNA, 22 bp, Homo sapiens
tgttcatttagattgaaaactt

SEQ ID NO: 2602456 - DNA, 20 bp, Homo sapiens
tgttccacaagttaaataaa

SEQ ID NO: 2602457 - DNA, 20 bp, Homo sapiens
tgttcccaccaggctgctca

SEQ ID NO: 2602458 - DNA, 22 bp, Homo sapiens
tgttccccactgacagcctccc

SEQ ID NO: 2602459 - DNA, 15 bp, Homo sapiens
tgttcccctcactgg

SEQ ID NO: 2602460 - DNA, 14 bp, Homo sapiens
tgttccccttccac

SEQ ID NO: 2602461 - DNA, 16 bp, Homo sapiens
tgttccctctgctcct

SEQ ID NO: 2602462 - DNA, 19 bp, Homo sapiens
tgttccctctgctcctgga

SEQ ID NO: 2602463 - DNA, 18 bp, Homo sapiens
tgttcctagtgaaagagg

SEQ ID NO: 2602464 - DNA, 22 bp, Homo sapiens
tgttcctgaattctatttgctg

SEQ ID NO: 2602465 - DNA, 14 bp, Homo sapiens
tgttcctggcaata

SEQ ID NO: 2602466 - DNA, 19 bp, Homo sapiens
tgttccttagaccttccat

SEQ ID NO: 2602467 - DNA, 22 bp, Homo sapiens
tgttctaattaataaattattt

SEQ ID NO: 2602468 - DNA, 21 bp, Homo sapiens
tgttctccttttcctctctcc

SEQ ID NO: 2602469 - DNA, 16 bp, Homo sapiens
tgttctctcttctcca

SEQ ID NO: 2602470 - DNA, 13 bp, Homo sapiens
tgttctctgccct

SEQ ID NO: 2602471 - DNA, 16 bp, Homo sapiens
tgttctctgccctcca

SEQ ID NO: 2602472 - DNA, 22 bp, Homo sapiens
tgttctgacattaacagttttc

SEQ ID NO: 2602473 - DNA, 18 bp, Homo sapiens
tgttctgaccctgcttca

SEQ ID NO: 2602474 - DNA, 19 bp, Homo sapiens
tgttctgattagaaatgac

SEQ ID NO: 2602475 - DNA, 15 bp, Homo sapiens
tgttctggccctcac

SEQ ID NO: 2602476 - DNA, 12 bp, Homo sapiens
tgttctggctct

SEQ ID NO: 2602477 - DNA, 17 bp, Homo sapiens
tgttctggctcttccag

SEQ ID NO: 2602478 - DNA, 16 bp, Homo sapiens
tgttctgggacacagt

SEQ ID NO: 2602479 - DNA, 20 bp, Homo sapiens
tgttctggtgaggccttgct

SEQ ID NO: 2602480 - DNA, 21 bp, Homo sapiens
tgttctggtgaggccttgctc

SEQ ID NO: 2602481 - DNA, 14 bp, Homo sapiens
tgttcttaattctt

SEQ ID NO: 2602482 - DNA, 20 bp, Homo sapiens
tgttcttgaagcagtagcct

SEQ ID NO: 2602483 - DNA, 19 bp, Homo sapiens
tgttcttggtttgtaaatt

SEQ ID NO: 2602484 - DNA, 22 bp, Homo sapiens
tgttcttggtttgtaaattaac

SEQ ID NO: 2602485 - DNA, 13 bp, Homo sapiens
tgttctttccaaa

SEQ ID NO: 2602486 - DNA, 18 bp, Homo sapiens
tgttctttccaaagtaca

SEQ ID NO: 2602487 - DNA, 20 bp, Homo sapiens
tgttctttctggctatgcat

SEQ ID NO: 2602488 - DNA, 17 bp, Homo sapiens
tgttgaaaatgttcaga

SEQ ID NO: 2602489 - DNA, 14 bp, Homo sapiens
tgttgaaattatgt

SEQ ID NO: 2602490 - DNA, 15 bp, Homo sapiens
tgttgaaattatgta

SEQ ID NO: 2602491 - DNA, 16 bp, Homo sapiens
tgttgatcccaagaca

SEQ ID NO: 2602492 - DNA, 16 bp, Homo sapiens
tgttgattgctaaatg

SEQ ID NO: 2602493 - DNA, 17 bp, Homo sapiens
tgttgattgctaaatgt

SEQ ID NO: 2602494 - DNA, 18 bp, Homo sapiens
tgttgattgctaaatgta

SEQ ID NO: 2602495 - DNA, 19 bp, Homo sapiens
tgttgatttctttccagag

SEQ ID NO: 2602496 - DNA, 20 bp, Homo sapiens
tgttgatttctttccagagg

SEQ ID NO: 2602497 - DNA, 14 bp, Homo sapiens
tgttgattttctgt

SEQ ID NO: 2602498 - DNA, 15 bp, Homo sapiens
tgttgattttctgtt

SEQ ID NO: 2602499 - DNA, 14 bp, Homo sapiens
tgttgcacccagcc

SEQ ID NO: 2602500 - DNA, 16 bp, Homo sapiens
tgttgcacccagccct

SEQ ID NO: 2602501 - DNA, 18 bp, Homo sapiens
tgttgcacccagccctgg

SEQ ID NO: 2602502 - DNA, 19 bp, Homo sapiens
tgttgcacccagccctggt

SEQ ID NO: 2602503 - DNA, 14 bp, Homo sapiens
tgttgccaagctgg

SEQ ID NO: 2602504 - DNA, 12 bp, Homo sapiens
tgttgcccaggc

SEQ ID NO: 2602505 - DNA, 15 bp, Homo sapiens
tgttgcccaggcagg

SEQ ID NO: 2602506 - DNA, 16 bp, Homo sapiens
tgttgcccaggcaggt

SEQ ID NO: 2602507 - DNA, 17 bp, Homo sapiens
tgttgcccaggcaggtc

SEQ ID NO: 2602508 - DNA, 18 bp, Homo sapiens
tgttgcccaggcaggtct

SEQ ID NO: 2602509 - DNA, 15 bp, Homo sapiens
tgttgcccaggctgg

SEQ ID NO: 2602510 - DNA, 20 bp, Homo sapiens
tgttgcccaggctggcgtgc

SEQ ID NO: 2602511 - DNA, 20 bp, Homo sapiens
tgttgccttgaaccacttcc

SEQ ID NO: 2602512 - DNA, 18 bp, Homo sapiens
tgttgcctttatggtttc

SEQ ID NO: 2602513 - DNA, 19 bp, Homo sapiens
tgttgctcaaaaaatgagc

SEQ ID NO: 2602514 - DNA, 21 bp, Homo sapiens
tgttgctcaaatctattcaga

SEQ ID NO: 2602515 - DNA, 14 bp, Homo sapiens
tgttgctcagtctc

SEQ ID NO: 2602516 - DNA, 16 bp, Homo sapiens
tgttgctgttgatgtt

SEQ ID NO: 2602517 - DNA, 21 bp, Homo sapiens
tgttgcttttgtgaacttttt

SEQ ID NO: 2602518 - DNA, 12 bp, Homo sapiens
tgttggaatgaa

SEQ ID NO: 2602519 - DNA, 18 bp, Homo sapiens
tgttggacccgctctgga

SEQ ID NO: 2602520 - DNA, 17 bp, Homo sapiens
tgttggatttttgtctt

SEQ ID NO: 2602521 - DNA, 21 bp, Homo sapiens
tgttggcactcacagacctgg

SEQ ID NO: 2602522 - DNA, 14 bp, Homo sapiens
tgttggccaggctg

SEQ ID NO: 2602523 - DNA, 16 bp, Homo sapiens
tgttggcctccggcct

SEQ ID NO: 2602524 - DNA, 23 bp, Homo sapiens
tgttggcgtggggcctttgtcag

SEQ ID NO: 2602525 - DNA, 19 bp, Homo sapiens
tgttgggactgctaaataa

SEQ ID NO: 2602526 - DNA, 17 bp, Homo sapiens
tgttgggattcctgacc

SEQ ID NO: 2602527 - DNA, 15 bp, Homo sapiens
tgttggggcagtggt

SEQ ID NO: 2602528 - DNA, 14 bp, Homo sapiens
tgttggttttgact

SEQ ID NO: 2602529 - DNA, 21 bp, Homo sapiens
tgttgtaaatatttatgtaaa

SEQ ID NO: 2602530 - DNA, 13 bp, Homo sapiens
tgttgtacattta

SEQ ID NO: 2602531 - DNA, 22 bp, Homo sapiens
tgttgtacatttatgatttaat

SEQ ID NO: 2602532 - DNA, 11 bp, Homo sapiens
tgttgtataaa

SEQ ID NO: 2602533 - DNA, 14 bp, Homo sapiens
tgttgtataaattt

SEQ ID NO: 2602534 - DNA, 14 bp, Homo sapiens
tgttgtcattgctg

SEQ ID NO: 2602535 - DNA, 13 bp, Homo sapiens
tgttgtgaatgtc

SEQ ID NO: 2602536 - DNA, 12 bp, Homo sapiens
tgttgtttgtat

SEQ ID NO: 2602537 - DNA, 13 bp, Homo sapiens
tgtttaaaatcat

SEQ ID NO: 2602538 - DNA, 18 bp, Homo sapiens
tgtttaaaatcatttctg

SEQ ID NO: 2602539 - DNA, 11 bp, Homo sapiens
tgtttaaatat

SEQ ID NO: 2602540 - DNA, 21 bp, Homo sapiens
tgtttaagtgttgtaaatatt

SEQ ID NO: 2602541 - DNA, 15 bp, Homo sapiens
tgtttaatatttaaa

SEQ ID NO: 2602542 - DNA, 12 bp, Homo sapiens
tgtttacatatc

SEQ ID NO: 2602543 - DNA, 12 bp, Homo sapiens
tgtttactgaaa

SEQ ID NO: 2602544 - DNA, 18 bp, Homo sapiens
tgtttacttaaagattta

SEQ ID NO: 2602545 - DNA, 23 bp, Homo sapiens
tgtttacttaaagatttatcaaa

SEQ ID NO: 2602546 - DNA, 16 bp, Homo sapiens
tgtttagagttgcaat

SEQ ID NO: 2602547 - DNA, 15 bp, Homo sapiens
tgtttatacagctca

SEQ ID NO: 2602548 - DNA, 14 bp, Homo sapiens
tgtttatataaatg

SEQ ID NO: 2602549 - DNA, 16 bp, Homo sapiens
tgtttatataaatgct

SEQ ID NO: 2602550 - DNA, 21 bp, Homo sapiens
tgtttatgcaaggaaggaaag

SEQ ID NO: 2602551 - DNA, 15 bp, Homo sapiens
tgtttatggcctcag

SEQ ID NO: 2602552 - DNA, 16 bp, Homo sapiens
tgtttatgtgtgtgtg

SEQ ID NO: 2602553 - DNA, 14 bp, Homo sapiens
tgtttattaacaaa

SEQ ID NO: 2602554 - DNA, 15 bp, Homo sapiens
tgtttatttttcata

SEQ ID NO: 2602555 - DNA, 15 bp, Homo sapiens
tgtttcaaactttac

SEQ ID NO: 2602556 - DNA, 16 bp, Homo sapiens
tgtttcaattgcatct

SEQ ID NO: 2602557 - DNA, 20 bp, Homo sapiens
tgtttcatattgatgtgtgt

SEQ ID NO: 2602558 - DNA, 13 bp, Homo sapiens
tgtttcatgtttt

SEQ ID NO: 2602559 - DNA, 14 bp, Homo sapiens
tgtttcatgttttg

SEQ ID NO: 2602560 - DNA, 19 bp, Homo sapiens
tgtttcatgttttgtgact

SEQ ID NO: 2602561 - DNA, 22 bp, Homo sapiens
tgtttcatgttttgtgactata

SEQ ID NO: 2602562 - DNA, 14 bp, Homo sapiens
tgtttcccataatt

SEQ ID NO: 2602563 - DNA, 22 bp, Homo sapiens
tgtttcccataattttcttcat

SEQ ID NO: 2602564 - DNA, 21 bp, Homo sapiens
tgtttcgctgatatatgtgtt

SEQ ID NO: 2602565 - DNA, 19 bp, Homo sapiens
tgtttcgtgaagtatactg

SEQ ID NO: 2602566 - DNA, 15 bp, Homo sapiens
tgtttctagggaaat

SEQ ID NO: 2602567 - DNA, 19 bp, Homo sapiens
tgtttctattgacttcaat

SEQ ID NO: 2602568 - DNA, 15 bp, Homo sapiens
tgtttctccctctca

SEQ ID NO: 2602569 - DNA, 13 bp, Homo sapiens
tgtttctctgctg

SEQ ID NO: 2602570 - DNA, 14 bp, Homo sapiens
tgtttctctgctgt

SEQ ID NO: 2602571 - DNA, 19 bp, Homo sapiens
tgtttctgactctgagcta

SEQ ID NO: 2602572 - DNA, 12 bp, Homo sapiens
tgtttctgcagt

SEQ ID NO: 2602573 - DNA, 14 bp, Homo sapiens
tgtttctgtcagga

SEQ ID NO: 2602574 - DNA, 17 bp, Homo sapiens
tgtttcttccaaagcac

SEQ ID NO: 2602575 - DNA, 13 bp, Homo sapiens
tgtttgaaatctt

SEQ ID NO: 2602576 - DNA, 22 bp, Homo sapiens
tgtttgaatcccacgcttctct

SEQ ID NO: 2602577 - DNA, 21 bp, Homo sapiens
tgtttgacgggaaacaaaact

SEQ ID NO: 2602578 - DNA, 18 bp, Homo sapiens
tgtttgagctctgcagcc

SEQ ID NO: 2602579 - DNA, 21 bp, Homo sapiens
tgtttgatgcattaaaagaaa

SEQ ID NO: 2602580 - DNA, 22 bp, Homo sapiens
tgtttgattcagacagctgcct

SEQ ID NO: 2602581 - DNA, 22 bp, Homo sapiens
tgtttgccatactttgtctgaa

SEQ ID NO: 2602582 - DNA, 16 bp, Homo sapiens
tgtttgcctctgcctc

SEQ ID NO: 2602583 - DNA, 18 bp, Homo sapiens
tgtttgcttcataaatga

SEQ ID NO: 2602584 - DNA, 15 bp, Homo sapiens
tgtttggaggagcaa

SEQ ID NO: 2602585 - DNA, 22 bp, Homo sapiens
tgtttgggcagaagggagaagg

SEQ ID NO: 2602586 - DNA, 16 bp, Homo sapiens
tgtttgtcagatatga

SEQ ID NO: 2602587 - DNA, 17 bp, Homo sapiens
tgtttgtctgtcttcat

SEQ ID NO: 2602588 - DNA, 19 bp, Homo sapiens
tgtttgtctgtcttcatag

SEQ ID NO: 2602589 - DNA, 13 bp, Homo sapiens
tgtttgtgattga

SEQ ID NO: 2602590 - DNA, 13 bp, Homo sapiens
tgtttgtgctgtg

SEQ ID NO: 2602591 - DNA, 14 bp, Homo sapiens
tgtttgtgtgagag

SEQ ID NO: 2602592 - DNA, 12 bp, Homo sapiens
tgtttgttatgg

SEQ ID NO: 2602593 - DNA, 17 bp, Homo sapiens
tgtttgtttcctttgtt

SEQ ID NO: 2602594 - DNA, 11 bp, Homo sapiens
tgttttaacaa

SEQ ID NO: 2602595 - DNA, 22 bp, Homo sapiens
tgttttaagaggcagggtctca

SEQ ID NO: 2602596 - DNA, 22 bp, Homo sapiens
tgttttaatttaaacacctcct

SEQ ID NO: 2602597 - DNA, 19 bp, Homo sapiens
tgttttacgtctgggagaa

SEQ ID NO: 2602598 - DNA, 15 bp, Homo sapiens
tgttttactgtgaaa

SEQ ID NO: 2602599 - DNA, 23 bp, Homo sapiens
tgttttagacaaatactcatgtg

SEQ ID NO: 2602600 - DNA, 19 bp, Homo sapiens
tgttttagagttaacaatg

SEQ ID NO: 2602601 - DNA, 17 bp, Homo sapiens
tgttttagttaaatttc

SEQ ID NO: 2602602 - DNA, 18 bp, Homo sapiens
tgttttatgacttcatta

SEQ ID NO: 2602603 - DNA, 23 bp, Homo sapiens
tgttttattttttattgttttca

SEQ ID NO: 2602604 - DNA, 15 bp, Homo sapiens
tgttttcagtgtaca

SEQ ID NO: 2602605 - DNA, 17 bp, Homo sapiens
tgttttcagtgtacatg

SEQ ID NO: 2602606 - DNA, 19 bp, Homo sapiens
tgttttcattatctcaaaa

SEQ ID NO: 2602607 - DNA, 21 bp, Homo sapiens
tgttttctctggagtattcta

SEQ ID NO: 2602608 - DNA, 17 bp, Homo sapiens
tgttttctgaataacat

SEQ ID NO: 2602609 - DNA, 19 bp, Homo sapiens
tgttttgaatggtgttgta

SEQ ID NO: 2602610 - DNA, 17 bp, Homo sapiens
tgtttttaaaaatcata

SEQ ID NO: 2602611 - DNA, 14 bp, Homo sapiens
tgtttttaagctgt

SEQ ID NO: 2602612 - DNA, 15 bp, Homo sapiens
tgtttttaagctgtt

SEQ ID NO: 2602613 - DNA, 22 bp, Homo sapiens
tgtttttaagctgtttccatag

SEQ ID NO: 2602614 - DNA, 22 bp, Homo sapiens
tgtttttacccatatcccctct

SEQ ID NO: 2602615 - DNA, 20 bp, Homo sapiens
tgtttttatgaagaaaaaat

SEQ ID NO: 2602616 - DNA, 13 bp, Homo sapiens
tgtttttcatgaa

SEQ ID NO: 2602617 - DNA, 12 bp, Homo sapiens
tgtttttctggg

SEQ ID NO: 2602618 - DNA, 13 bp, Homo sapiens
tgtttttgaaata

SEQ ID NO: 2602619 - DNA, 12 bp, Homo sapiens
tgtttttgtaaa

SEQ ID NO: 2602620 - DNA, 17 bp, Homo sapiens
tgttttttagatcaaat

SEQ ID NO: 2602621 - DNA, 14 bp, Homo sapiens
tgttttttgaaaac

SEQ ID NO: 2602622 - DNA, 22 bp, Homo sapiens
ttaaaaaaaaacctgagcccca

SEQ ID NO: 2602623 - DNA, 23 bp, Homo sapiens
ttaaaaagggcagggcatctcct

SEQ ID NO: 2602624 - DNA, 20 bp, Homo sapiens
ttaaaaatatggaacttcta

SEQ ID NO: 2602625 - DNA, 22 bp, Homo sapiens
ttaaaaatatggaacttctaat

SEQ ID NO: 2602626 - DNA, 16 bp, Homo sapiens
ttaaaaatctcaaatt

SEQ ID NO: 2602627 - DNA, 19 bp, Homo sapiens
ttaaaaatctcaaatttct

SEQ ID NO: 2602628 - DNA, 20 bp, Homo sapiens
ttaaaaatctcaaatttcta

SEQ ID NO: 2602629 - DNA, 14 bp, Homo sapiens
ttaaaacagacact

SEQ ID NO: 2602630 - DNA, 14 bp, Homo sapiens
ttaaaacatgtaat

SEQ ID NO: 2602631 - DNA, 14 bp, Homo sapiens
ttaaaacccaagtg

SEQ ID NO: 2602632 - DNA, 17 bp, Homo sapiens
ttaaaactgaagtctga

SEQ ID NO: 2602633 - DNA, 20 bp, Homo sapiens
ttaaaactgaagtctgaaat

SEQ ID NO: 2602634 - DNA, 15 bp, Homo sapiens
ttaaaacttgtaatt

SEQ ID NO: 2602635 - DNA, 22 bp, Homo sapiens
ttaaaagaaaataaaaaaaaga

SEQ ID NO: 2602636 - DNA, 17 bp, Homo sapiens
ttaaaagatacagttac

SEQ ID NO: 2602637 - DNA, 17 bp, Homo sapiens
ttaaaaggatttttatc

SEQ ID NO: 2602638 - DNA, 21 bp, Homo sapiens
ttaaaagggattacccaagca

SEQ ID NO: 2602639 - DNA, 19 bp, Homo sapiens
ttaaaagtttcaatgtgat

SEQ ID NO: 2602640 - DNA, 16 bp, Homo sapiens
ttaaaataaaaattct

SEQ ID NO: 2602641 - DNA, 15 bp, Homo sapiens
ttaaaataactagtg

SEQ ID NO: 2602642 - DNA, 18 bp, Homo sapiens
ttaaaatacacactcaaa

SEQ ID NO: 2602643 - DNA, 15 bp, Homo sapiens
ttaaaatagaaataa

SEQ ID NO: 2602644 - DNA, 12 bp, Homo sapiens
ttaaaatatatt

SEQ ID NO: 2602645 - DNA, 12 bp, Homo sapiens
ttaaaatatttt

SEQ ID NO: 2602646 - DNA, 14 bp, Homo sapiens
ttaaaatattttat

SEQ ID NO: 2602647 - DNA, 14 bp, Homo sapiens
ttaaaatcatttct

SEQ ID NO: 2602648 - DNA, 12 bp, Homo sapiens
ttaaaatcctca

SEQ ID NO: 2602649 - DNA, 15 bp, Homo sapiens
ttaaaatttattgct

SEQ ID NO: 2602650 - DNA, 16 bp, Homo sapiens
ttaaacacctcctcat

SEQ ID NO: 2602651 - DNA, 12 bp, Homo sapiens
ttaaacagcagt

SEQ ID NO: 2602652 - DNA, 21 bp, Homo sapiens
ttaaacagggcatctccagga

SEQ ID NO: 2602653 - DNA, 13 bp, Homo sapiens
ttaaacattgaag

SEQ ID NO: 2602654 - DNA, 15 bp, Homo sapiens
ttaaacattgaagta

SEQ ID NO: 2602655 - DNA, 20 bp, Homo sapiens
ttaaacattggttcttgtat

SEQ ID NO: 2602656 - DNA, 22 bp, Homo sapiens
ttaaacattggttcttgtatta

SEQ ID NO: 2602657 - DNA, 16 bp, Homo sapiens
ttaaacccattttagt

SEQ ID NO: 2602658 - DNA, 14 bp, Homo sapiens
ttaaacggattatt

SEQ ID NO: 2602659 - DNA, 15 bp, Homo sapiens
ttaaacggattattt

SEQ ID NO: 2602660 - DNA, 16 bp, Homo sapiens
ttaaacggattatttt

SEQ ID NO: 2602661 - DNA, 22 bp, Homo sapiens
ttaaacggattattttttcaga

SEQ ID NO: 2602662 - DNA, 16 bp, Homo sapiens
ttaaactcagggacag

SEQ ID NO: 2602663 - DNA, 22 bp, Homo sapiens
ttaaactcagggacagagccat

SEQ ID NO: 2602664 - DNA, 20 bp, Homo sapiens
ttaaacttaatctaaatgga

SEQ ID NO: 2602665 - DNA, 22 bp, Homo sapiens
ttaaacttaatctaaatggaac

SEQ ID NO: 2602666 - DNA, 15 bp, Homo sapiens
ttaaagaaaacccac

SEQ ID NO: 2602667 - DNA, 11 bp, Homo sapiens
ttaaagaaagt

SEQ ID NO: 2602668 - DNA, 11 bp, Homo sapiens
ttaaagacaga

SEQ ID NO: 2602669 - DNA, 12 bp, Homo sapiens
ttaaagacagag

SEQ ID NO: 2602670 - DNA, 21 bp, Homo sapiens
ttaaagatttatcaaatcagt

SEQ ID NO: 2602671 - DNA, 13 bp, Homo sapiens
ttaaagcctcctc

SEQ ID NO: 2602672 - DNA, 18 bp, Homo sapiens
ttaaagctgcctgtagtt

SEQ ID NO: 2602673 - DNA, 18 bp, Homo sapiens
ttaaaggcaccatctaat

SEQ ID NO: 2602674 - DNA, 15 bp, Homo sapiens
ttaaaggtgtcttcc

SEQ ID NO: 2602675 - DNA, 13 bp, Homo sapiens
ttaaagtatatat

SEQ ID NO: 2602676 - DNA, 12 bp, Homo sapiens
ttaaagtgatta

SEQ ID NO: 2602677 - DNA, 13 bp, Homo sapiens
ttaaataaaagtg

SEQ ID NO: 2602678 - DNA, 20 bp, Homo sapiens
ttaaataaaagtgatcaata

SEQ ID NO: 2602679 - DNA, 12 bp, Homo sapiens
ttaaataaatgt

SEQ ID NO: 2602680 - DNA, 18 bp, Homo sapiens
ttaaataaatgtcattaa

SEQ ID NO: 2602681 - DNA, 16 bp, Homo sapiens
ttaaataataaagatc

SEQ ID NO: 2602682 - DNA, 15 bp, Homo sapiens
ttaaataatgtgaaa

SEQ ID NO: 2602683 - DNA, 18 bp, Homo sapiens
ttaaataatgtgaaactg

SEQ ID NO: 2602684 - DNA, 19 bp, Homo sapiens
ttaaataatgtgaaactgg

SEQ ID NO: 2602685 - DNA, 20 bp, Homo sapiens
ttaaataatgtgaaactgga

SEQ ID NO: 2602686 - DNA, 22 bp, Homo sapiens
ttaaataatgtgaaactggatt

SEQ ID NO: 2602687 - DNA, 17 bp, Homo sapiens
ttaaatacagacactaa

SEQ ID NO: 2602688 - DNA, 19 bp, Homo sapiens
ttaaatagagtatatgcac

SEQ ID NO: 2602689 - DNA, 18 bp, Homo sapiens
ttaaataggatattaaca

SEQ ID NO: 2602690 - DNA, 18 bp, Homo sapiens
ttaaatagtaaaaataaa

SEQ ID NO: 2602691 - DNA, 14 bp, Homo sapiens
ttaaatataattct

SEQ ID NO: 2602692 - DNA, 21 bp, Homo sapiens
ttaaatctatgaagtatataa

SEQ ID NO: 2602693 - DNA, 23 bp, Homo sapiens
ttaaatgaaattgtaaaacctgt

SEQ ID NO: 2602694 - DNA, 23 bp, Homo sapiens
ttaaatgagaaggaatttgagtt

SEQ ID NO: 2602695 - DNA, 13 bp, Homo sapiens
ttaaattcttgca

SEQ ID NO: 2602696 - DNA, 16 bp, Homo sapiens
ttaaattgctgtgtat

SEQ ID NO: 2602697 - DNA, 15 bp, Homo sapiens
ttaaatttctaccgc

SEQ ID NO: 2602698 - DNA, 15 bp, Homo sapiens
ttaaatttgtaagtt

SEQ ID NO: 2602699 - DNA, 15 bp, Homo sapiens
ttaacaatttctgtc

SEQ ID NO: 2602700 - DNA, 23 bp, Homo sapiens
ttaacaatttctgtccttcagat

SEQ ID NO: 2602701 - DNA, 11 bp, Homo sapiens
ttaacacattt

SEQ ID NO: 2602702 - DNA, 14 bp, Homo sapiens
ttaacacattttgt

SEQ ID NO: 2602703 - DNA, 22 bp, Homo sapiens
ttaacacattttgtataattgt

SEQ ID NO: 2602704 - DNA, 20 bp, Homo sapiens
ttaacacctgatgtgtacat

SEQ ID NO: 2602705 - DNA, 13 bp, Homo sapiens
ttaacagggaggg

SEQ ID NO: 2602706 - DNA, 15 bp, Homo sapiens
ttaacagtcatttaa

SEQ ID NO: 2602707 - DNA, 17 bp, Homo sapiens
ttaacagttttccatga

SEQ ID NO: 2602708 - DNA, 20 bp, Homo sapiens
ttaacagttttccatgaaaa

SEQ ID NO: 2602709 - DNA, 21 bp, Homo sapiens
ttaacagttttccatgaaaac

SEQ ID NO: 2602710 - DNA, 13 bp, Homo sapiens
ttaacctgatgca

SEQ ID NO: 2602711 - DNA, 14 bp, Homo sapiens
ttaactagaattta

SEQ ID NO: 2602712 - DNA, 16 bp, Homo sapiens
ttaactagaatttatt

SEQ ID NO: 2602713 - DNA, 16 bp, Homo sapiens
ttaacttcacatattg

SEQ ID NO: 2602714 - DNA, 15 bp, Homo sapiens
ttaacttgagtttta

SEQ ID NO: 2602715 - DNA, 15 bp, Homo sapiens
ttaacttttataaac

SEQ ID NO: 2602716 - DNA, 20 bp, Homo sapiens
ttaagaaaaaataacacaca

SEQ ID NO: 2602717 - DNA, 14 bp, Homo sapiens
ttaagaaaagagat

SEQ ID NO: 2602718 - DNA, 13 bp, Homo sapiens
ttaagaagaaact

SEQ ID NO: 2602719 - DNA, 11 bp, Homo sapiens
ttaagaagctg

SEQ ID NO: 2602720 - DNA, 13 bp, Homo sapiens
ttaagaagctgtt

SEQ ID NO: 2602721 - DNA, 17 bp, Homo sapiens
ttaagacgtgtttgtgt

SEQ ID NO: 2602722 - DNA, 20 bp, Homo sapiens
ttaagaggcagaaaattgca

SEQ ID NO: 2602723 - DNA, 15 bp, Homo sapiens
ttaagaggcagggtc

SEQ ID NO: 2602724 - DNA, 16 bp, Homo sapiens
ttaagaggcagggtct

SEQ ID NO: 2602725 - DNA, 20 bp, Homo sapiens
ttaagagtagcaagttctag

SEQ ID NO: 2602726 - DNA, 16 bp, Homo sapiens
ttaagataattataat

SEQ ID NO: 2602727 - DNA, 22 bp, Homo sapiens
ttaagatggattctcagatatt

SEQ ID NO: 2602728 - DNA, 14 bp, Homo sapiens
ttaagcactacata

SEQ ID NO: 2602729 - DNA, 17 bp, Homo sapiens
ttaagcactacataaac

SEQ ID NO: 2602730 - DNA, 15 bp, Homo sapiens
ttaagcagaagcatt

SEQ ID NO: 2602731 - DNA, 12 bp, Homo sapiens
ttaagcagctct

SEQ ID NO: 2602732 - DNA, 17 bp, Homo sapiens
ttaagcagctcttgcta

SEQ ID NO: 2602733 - DNA, 18 bp, Homo sapiens
ttaagcagctcttgctaa

SEQ ID NO: 2602734 - DNA, 19 bp, Homo sapiens
ttaagcattgtttgcttat

SEQ ID NO: 2602735 - DNA, 22 bp, Homo sapiens
ttaagcattgtttgcttattgt

SEQ ID NO: 2602736 - DNA, 17 bp, Homo sapiens
ttaagctgttactgtct

SEQ ID NO: 2602737 - DNA, 14 bp, Homo sapiens
ttaagctgtttcca

SEQ ID NO: 2602738 - DNA, 12 bp, Homo sapiens
ttaaggaaacaa

SEQ ID NO: 2602739 - DNA, 20 bp, Homo sapiens
ttaaggaaactcttatctca

SEQ ID NO: 2602740 - DNA, 19 bp, Homo sapiens
ttaaggacaaaaatgaact

SEQ ID NO: 2602741 - DNA, 19 bp, Homo sapiens
ttaaggatgcttgtacata

SEQ ID NO: 2602742 - DNA, 18 bp, Homo sapiens
ttaaggattttatgcttt

SEQ ID NO: 2602743 - DNA, 20 bp, Homo sapiens
ttaaggattttatgctttaa

SEQ ID NO: 2602744 - DNA, 18 bp, Homo sapiens
ttaagggaagaattccag

SEQ ID NO: 2602745 - DNA, 17 bp, Homo sapiens
ttaagtactatgtatca

SEQ ID NO: 2602746 - DNA, 17 bp, Homo sapiens
ttaagtctgttttatga

SEQ ID NO: 2602747 - DNA, 18 bp, Homo sapiens
ttaagtctgttttatgac

SEQ ID NO: 2602748 - DNA, 21 bp, Homo sapiens
ttaagtctgttttatgacttc

SEQ ID NO: 2602749 - DNA, 18 bp, Homo sapiens
ttaagtgcgtgtgtagag

SEQ ID NO: 2602750 - DNA, 19 bp, Homo sapiens
ttaagtgctgcatttaaaa

SEQ ID NO: 2602751 - DNA, 12 bp, Homo sapiens
ttaagttacttc

SEQ ID NO: 2602752 - DNA, 18 bp, Homo sapiens
ttaagttgctgatgaact

SEQ ID NO: 2602753 - DNA, 19 bp, Homo sapiens
ttaagttgtttgcatgtga

SEQ ID NO: 2602754 - DNA, 12 bp, Homo sapiens
ttaagtttctca

SEQ ID NO: 2602755 - DNA, 20 bp, Homo sapiens
ttaataaaaaaacaatcatt

SEQ ID NO: 2602756 - DNA, 15 bp, Homo sapiens
ttaataaaaaggcac

SEQ ID NO: 2602757 - DNA, 16 bp, Homo sapiens
ttaataaaagtacatg

SEQ ID NO: 2602758 - DNA, 20 bp, Homo sapiens
ttaataaaataattctaaag

SEQ ID NO: 2602759 - DNA, 18 bp, Homo sapiens
ttaataaattatttatta

SEQ ID NO: 2602760 - DNA, 17 bp, Homo sapiens
ttaatagtgttaatcaa

SEQ ID NO: 2602761 - DNA, 19 bp, Homo sapiens
ttaatatatcccagaaatt

SEQ ID NO: 2602762 - DNA, 22 bp, Homo sapiens
ttaatatggggatgcagcatta

SEQ ID NO: 2602763 - DNA, 23 bp, Homo sapiens
ttaatatgttaacctcagtgtca

SEQ ID NO: 2602764 - DNA, 22 bp, Homo sapiens
ttaatattcattgtataaaaat

SEQ ID NO: 2602765 - DNA, 18 bp, Homo sapiens
ttaatatttaaacagcag

SEQ ID NO: 2602766 - DNA, 21 bp, Homo sapiens
ttaatatttaaacagcagtgt

SEQ ID NO: 2602767 - DNA, 12 bp, Homo sapiens
ttaatatttgct

SEQ ID NO: 2602768 - DNA, 18 bp, Homo sapiens
ttaatcatctataaagaa

SEQ ID NO: 2602769 - DNA, 18 bp, Homo sapiens
ttaatcatgaatgtgtaa

SEQ ID NO: 2602770 - DNA, 20 bp, Homo sapiens
ttaatccagaataactagca

SEQ ID NO: 2602771 - DNA, 23 bp, Homo sapiens
ttaatccagaataactagcacca

SEQ ID NO: 2602772 - DNA, 16 bp, Homo sapiens
ttaatctgtatttccc

SEQ ID NO: 2602773 - DNA, 17 bp, Homo sapiens
ttaatcttcagttttat

SEQ ID NO: 2602774 - DNA, 16 bp, Homo sapiens
ttaatgaaaatgtcag

SEQ ID NO: 2602775 - DNA, 20 bp, Homo sapiens
ttaatgaaagactgtacaaa

SEQ ID NO: 2602776 - DNA, 17 bp, Homo sapiens
ttaatgaaatatctgta

SEQ ID NO: 2602777 - DNA, 22 bp, Homo sapiens
ttaatgaaatatctgtatttaa

SEQ ID NO: 2602778 - DNA, 18 bp, Homo sapiens
ttaatgaagaaagtggaa

SEQ ID NO: 2602779 - DNA, 23 bp, Homo sapiens
ttaatgaagaaagtggaaaacaa

SEQ ID NO: 2602780 - DNA, 19 bp, Homo sapiens
ttaatgacacttgtcccca

SEQ ID NO: 2602781 - DNA, 23 bp, Homo sapiens
ttaatgacacttgtccccaaatc

SEQ ID NO: 2602782 - DNA, 19 bp, Homo sapiens
ttaatgacagagccagtgg

SEQ ID NO: 2602783 - DNA, 19 bp, Homo sapiens
ttaatgccattatccctga

SEQ ID NO: 2602784 - DNA, 19 bp, Homo sapiens
ttaatgggggtagcagctg

SEQ ID NO: 2602785 - DNA, 18 bp, Homo sapiens
ttaatgtcacaggcaggt

SEQ ID NO: 2602786 - DNA, 15 bp, Homo sapiens
ttaatgtgctgtgta

SEQ ID NO: 2602787 - DNA, 16 bp, Homo sapiens
ttaatgtgctgtgtaa

SEQ ID NO: 2602788 - DNA, 17 bp, Homo sapiens
ttaatgtgctgtgtaaa

SEQ ID NO: 2602789 - DNA, 18 bp, Homo sapiens
ttaatgtgctgtgtaaag

SEQ ID NO: 2602790 - DNA, 19 bp, Homo sapiens
ttaatgtgctgtgtaaagt

SEQ ID NO: 2602791 - DNA, 16 bp, Homo sapiens
ttaattaccaacctgt

SEQ ID NO: 2602792 - DNA, 20 bp, Homo sapiens
ttaattaggggttgctaaga

SEQ ID NO: 2602793 - DNA, 15 bp, Homo sapiens
ttaattatcttttct

SEQ ID NO: 2602794 - DNA, 22 bp, Homo sapiens
ttaattatgccttttttgatca

SEQ ID NO: 2602795 - DNA, 22 bp, Homo sapiens
ttaattcagcactgatttcaca

SEQ ID NO: 2602796 - DNA, 14 bp, Homo sapiens
ttaattctcttgaa

SEQ ID NO: 2602797 - DNA, 22 bp, Homo sapiens
ttaattgattattctgattcca

SEQ ID NO: 2602798 - DNA, 20 bp, Homo sapiens
ttaatttatgagtttttgat

SEQ ID NO: 2602799 - DNA, 13 bp, Homo sapiens
ttaattttcctgg

SEQ ID NO: 2602800 - DNA, 22 bp, Homo sapiens
ttaattttgacactatatctgt

SEQ ID NO: 2602801 - DNA, 17 bp, Homo sapiens
ttaattttggttgtatt

SEQ ID NO: 2602802 - DNA, 23 bp, Homo sapiens
ttaattttggttgtattctttga

SEQ ID NO: 2602803 - DNA, 21 bp, Homo sapiens
ttacaacagatttgtgaactc

SEQ ID NO: 2602804 - DNA, 17 bp, Homo sapiens
ttacaagaaaaaatgaa

SEQ ID NO: 2602805 - DNA, 21 bp, Homo sapiens
ttacaagcgtgagccactgca

SEQ ID NO: 2602806 - DNA, 21 bp, Homo sapiens
ttacaataaaactttgctgcc

SEQ ID NO: 2602807 - DNA, 12 bp, Homo sapiens
ttacaatcaaag

SEQ ID NO: 2602808 - DNA, 17 bp, Homo sapiens
ttacaatcattgctgaa

SEQ ID NO: 2602809 - DNA, 19 bp, Homo sapiens
ttacaattccctgctgtcg

SEQ ID NO: 2602810 - DNA, 17 bp, Homo sapiens
ttacaattgaaatgact

SEQ ID NO: 2602811 - DNA, 17 bp, Homo sapiens
ttacaattttttatcat

SEQ ID NO: 2602812 - DNA, 18 bp, Homo sapiens
ttacaattttttatcatg

SEQ ID NO: 2602813 - DNA, 21 bp, Homo sapiens
ttacactggaggagagaagaa

SEQ ID NO: 2602814 - DNA, 14 bp, Homo sapiens
ttacactgtatttg

SEQ ID NO: 2602815 - DNA, 20 bp, Homo sapiens
ttacagaacacgctttcaca

SEQ ID NO: 2602816 - DNA, 14 bp, Homo sapiens
ttacagagaggaga

SEQ ID NO: 2602817 - DNA, 17 bp, Homo sapiens
ttacagagaggagaaac

SEQ ID NO: 2602818 - DNA, 18 bp, Homo sapiens
ttacagagaggagaaaca

SEQ ID NO: 2602819 - DNA, 23 bp, Homo sapiens
ttacagatagtatctagcaatca

SEQ ID NO: 2602820 - DNA, 17 bp, Homo sapiens
ttacagcctcacttgaa

SEQ ID NO: 2602821 - DNA, 14 bp, Homo sapiens
ttacagctgcctgc

SEQ ID NO: 2602822 - DNA, 17 bp, Homo sapiens
ttacaggcaccgagaat

SEQ ID NO: 2602823 - DNA, 20 bp, Homo sapiens
ttacagggatgagccaccgc

SEQ ID NO: 2602824 - DNA, 19 bp, Homo sapiens
ttacagtaggagcccagct

SEQ ID NO: 2602825 - DNA, 17 bp, Homo sapiens
ttacagtgaaaatgtaa

SEQ ID NO: 2602826 - DNA, 18 bp, Homo sapiens
ttacatcaaggcttcaaa

SEQ ID NO: 2602827 - DNA, 20 bp, Homo sapiens
ttacatcatttttgtatcta

SEQ ID NO: 2602828 - DNA, 14 bp, Homo sapiens
ttacatctgtttta

SEQ ID NO: 2602829 - DNA, 18 bp, Homo sapiens
ttacatctgttttaaatt

SEQ ID NO: 2602830 - DNA, 17 bp, Homo sapiens
ttacatgaattgcattt

SEQ ID NO: 2602831 - DNA, 23 bp, Homo sapiens
ttacatgcaatttattaaaatga

SEQ ID NO: 2602832 - DNA, 12 bp, Homo sapiens
ttacatgcatac

SEQ ID NO: 2602833 - DNA, 22 bp, Homo sapiens
ttacatggttaaggtaaagtaa

SEQ ID NO: 2602834 - DNA, 17 bp, Homo sapiens
ttacatgtattatttca

SEQ ID NO: 2602835 - DNA, 12 bp, Homo sapiens
ttacatgttttc

SEQ ID NO: 2602836 - DNA, 22 bp, Homo sapiens
ttacatgttttctttgctttaa

SEQ ID NO: 2602837 - DNA, 16 bp, Homo sapiens
ttacattaatgttaat

SEQ ID NO: 2602838 - DNA, 17 bp, Homo sapiens
ttacatttttaagtgct

SEQ ID NO: 2602839 - DNA, 16 bp, Homo sapiens
ttacatttttacaata

SEQ ID NO: 2602840 - DNA, 12 bp, Homo sapiens
ttaccaacctgt

SEQ ID NO: 2602841 - DNA, 20 bp, Homo sapiens
ttaccaacctgttacctact

SEQ ID NO: 2602842 - DNA, 16 bp, Homo sapiens
ttaccaactttctgta

SEQ ID NO: 2602843 - DNA, 17 bp, Homo sapiens
ttaccagaagcttccat

SEQ ID NO: 2602844 - DNA, 18 bp, Homo sapiens
ttaccagataatgctact

SEQ ID NO: 2602845 - DNA, 14 bp, Homo sapiens
ttaccagcagagca

SEQ ID NO: 2602846 - DNA, 20 bp, Homo sapiens
ttaccagcctccgtatttca

SEQ ID NO: 2602847 - DNA, 21 bp, Homo sapiens
ttaccagcctccgtatttcag

SEQ ID NO: 2602848 - DNA, 20 bp, Homo sapiens
ttaccatgagaagagggcct

SEQ ID NO: 2602849 - DNA, 16 bp, Homo sapiens
ttaccatgtgcctgat

SEQ ID NO: 2602850 - DNA, 13 bp, Homo sapiens
ttacccatatccc

SEQ ID NO: 2602851 - DNA, 17 bp, Homo sapiens
ttacccatatcccctct

SEQ ID NO: 2602852 - DNA, 17 bp, Homo sapiens
ttacctaccacagtgtc

SEQ ID NO: 2602853 - DNA, 19 bp, Homo sapiens
ttacctaccacatgccaag

SEQ ID NO: 2602854 - DNA, 20 bp, Homo sapiens
ttacctagtagtcatttcat

SEQ ID NO: 2602855 - DNA, 23 bp, Homo sapiens
ttacctgatcaatgacagagcct

SEQ ID NO: 2602856 - DNA, 22 bp, Homo sapiens
ttacctgttttcgcacctacca

SEQ ID NO: 2602857 - DNA, 19 bp, Homo sapiens
ttaccttagattagctctg

SEQ ID NO: 2602858 - DNA, 16 bp, Homo sapiens
ttaccttcaataaagt

SEQ ID NO: 2602859 - DNA, 19 bp, Homo sapiens
ttaccttcaataaagtatc

SEQ ID NO: 2602860 - DNA, 15 bp, Homo sapiens
ttacctttttatttg

SEQ ID NO: 2602861 - DNA, 19 bp, Homo sapiens
ttaccttttttatacataa

SEQ ID NO: 2602862 - DNA, 20 bp, Homo sapiens
ttacgcacacgtacttaaat

SEQ ID NO: 2602863 - DNA, 18 bp, Homo sapiens
ttactaaagaaaatatct

SEQ ID NO: 2602864 - DNA, 23 bp, Homo sapiens
ttactaaagaaaatatctgaaat

SEQ ID NO: 2602865 - DNA, 21 bp, Homo sapiens
ttactaagatgacattgctaa

SEQ ID NO: 2602866 - DNA, 21 bp, Homo sapiens
ttactaagcatagcaaacaga

SEQ ID NO: 2602867 - DNA, 21 bp, Homo sapiens
ttactaagccacaagaaattt

SEQ ID NO: 2602868 - DNA, 22 bp, Homo sapiens
ttactaagccacaagaaatttg

SEQ ID NO: 2602869 - DNA, 22 bp, Homo sapiens
ttactaagctttgccagctgct

SEQ ID NO: 2602870 - DNA, 13 bp, Homo sapiens
ttactaagttttt

SEQ ID NO: 2602871 - DNA, 16 bp, Homo sapiens
ttactaatagacaatt

SEQ ID NO: 2602872 - DNA, 15 bp, Homo sapiens
ttactacagttgttt

SEQ ID NO: 2602873 - DNA, 13 bp, Homo sapiens
ttactactgtgga

SEQ ID NO: 2602874 - DNA, 21 bp, Homo sapiens
ttactatcatgtcaaacgtga

SEQ ID NO: 2602875 - DNA, 18 bp, Homo sapiens
ttactcagaattctctag

SEQ ID NO: 2602876 - DNA, 18 bp, Homo sapiens
ttactcatagcacttccc

SEQ ID NO: 2602877 - DNA, 13 bp, Homo sapiens
ttactgagcttct

SEQ ID NO: 2602878 - DNA, 19 bp, Homo sapiens
ttactgagcttctctgtga

SEQ ID NO: 2602879 - DNA, 13 bp, Homo sapiens
ttactgatcatgc

SEQ ID NO: 2602880 - DNA, 16 bp, Homo sapiens
ttactgatcatgcatt

SEQ ID NO: 2602881 - DNA, 21 bp, Homo sapiens
ttactgatcatgcattgttga

SEQ ID NO: 2602882 - DNA, 13 bp, Homo sapiens
ttactgcaaatgt

SEQ ID NO: 2602883 - DNA, 22 bp, Homo sapiens
ttatccaaggtgtaactctaat

SEQ ID NO: 2602884 - DNA, 18 bp, Homo sapiens
ttatccaggactctgtca

SEQ ID NO: 2602885 - DNA, 18 bp, Homo sapiens
ttatccatggggaaggga

SEQ ID NO: 2602886 - DNA, 19 bp, Homo sapiens
ttatcctaaaacaaatagt

SEQ ID NO: 2602887 - DNA, 14 bp, Homo sapiens
ttatcctctgatct

SEQ ID NO: 2602888 - DNA, 19 bp, Homo sapiens
ttatcctctgatctccatg

SEQ ID NO: 2602889 - DNA, 16 bp, Homo sapiens
ttatcctctggtttaa

SEQ ID NO: 2602890 - DNA, 16 bp, Homo sapiens
ttatcctgaaatttca

SEQ ID NO: 2602891 - DNA, 15 bp, Homo sapiens
ttatcggaagcagtg

SEQ ID NO: 2602892 - DNA, 16 bp, Homo sapiens
ttatcggaagcagtgc

SEQ ID NO: 2602893 - DNA, 23 bp, Homo sapiens
ttatcgggaacagtgtttcccat

SEQ ID NO: 2602894 - DNA, 21 bp, Homo sapiens
ttatcgggagcagtgtcttcc

SEQ ID NO: 2602895 - DNA, 14 bp, Homo sapiens
ttatctagatactg

SEQ ID NO: 2602896 - DNA, 14 bp, Homo sapiens
ttatctctatttaa

SEQ ID NO: 2602897 - DNA, 15 bp, Homo sapiens
ttatctctatttaat

SEQ ID NO: 2602898 - DNA, 19 bp, Homo sapiens
ttatctctatttaatattt

SEQ ID NO: 2602899 - DNA, 12 bp, Homo sapiens
ttatctctgtgt

SEQ ID NO: 2602900 - DNA, 18 bp, Homo sapiens
ttcatgttttgtgactat

SEQ ID NO: 2602901 - DNA, 15 bp, Homo sapiens
ttcattaaagcattt

SEQ ID NO: 2602902 - DNA, 15 bp, Homo sapiens
ttcattaataataaa

SEQ ID NO: 2602903 - DNA, 21 bp, Homo sapiens
ttcattaataataaattccct

SEQ ID NO: 2602904 - DNA, 18 bp, Homo sapiens
ttcattacagcttaatca

SEQ ID NO: 2602905 - DNA, 14 bp, Homo sapiens
ttcattatgtaaaa

SEQ ID NO: 2602906 - DNA, 13 bp, Homo sapiens
ttcattattggaa

SEQ ID NO: 2602907 - DNA, 20 bp, Homo sapiens
ttcattattggaattaacct

SEQ ID NO: 2602908 - DNA, 22 bp, Homo sapiens
ttcattcatgtcatgtgtacaa

SEQ ID NO: 2602909 - DNA, 18 bp, Homo sapiens
ttcattcttctctagctg

SEQ ID NO: 2602910 - DNA, 13 bp, Homo sapiens
ttcattcttgaaa

SEQ ID NO: 2602911 - DNA, 20 bp, Homo sapiens
ttcattgtaatgttactgat

SEQ ID NO: 2602912 - DNA, 15 bp, Homo sapiens
ttcatttaaaatgat

SEQ ID NO: 2602913 - DNA, 19 bp, Homo sapiens
ttcatttactgtggcttct

SEQ ID NO: 2602914 - DNA, 16 bp, Homo sapiens
ttcatttcctgtgtct

SEQ ID NO: 2602915 - DNA, 20 bp, Homo sapiens
ttcatttgagttattttaat

SEQ ID NO: 2602916 - DNA, 15 bp, Homo sapiens
ttcatttgtgtcaat

SEQ ID NO: 2602917 - DNA, 17 bp, Homo sapiens
ttccaaaagtggcctct

SEQ ID NO: 2602918 - DNA, 22 bp, Homo sapiens
ttccaaaagtggcctctttgtc

SEQ ID NO: 2602919 - DNA, 23 bp, Homo sapiens
ttccaaaggccatggagagctgg

SEQ ID NO: 2602920 - DNA, 16 bp, Homo sapiens
ttccaaagtacactgt

SEQ ID NO: 2602921 - DNA, 14 bp, Homo sapiens
ttccaacaaagggt

SEQ ID NO: 2602922 - DNA, 15 bp, Homo sapiens
ttccaacaaagggtt

SEQ ID NO: 2602923 - DNA, 21 bp, Homo sapiens
ttccaacaaagggttttaatg

SEQ ID NO: 2602924 - DNA, 22 bp, Homo sapiens
ttccaacaaagggttttaatgt

SEQ ID NO: 2602925 - DNA, 23 bp, Homo sapiens
ttccaacaaagggttttaatgta

SEQ ID NO: 2602926 - DNA, 18 bp, Homo sapiens
ttccaacaccacagacac

SEQ ID NO: 2602927 - DNA, 19 bp, Homo sapiens
ttccaacaccacagacaca

SEQ ID NO: 2602928 - DNA, 21 bp, Homo sapiens
ttccaacaccacagacacaca

SEQ ID NO: 2602929 - DNA, 14 bp, Homo sapiens
ttccaagacagtat

SEQ ID NO: 2602930 - DNA, 13 bp, Homo sapiens
ttccaagacattg

SEQ ID NO: 2602931 - DNA, 12 bp, Homo sapiens
ttccaagagctg

SEQ ID NO: 2602932 - DNA, 13 bp, Homo sapiens
ttccaagagctga

SEQ ID NO: 2602933 - DNA, 16 bp, Homo sapiens
ttccaaggagttccat

SEQ ID NO: 2602934 - DNA, 22 bp, Homo sapiens
ttccaagtgtgcatattgtaca

SEQ ID NO: 2602935 - DNA, 21 bp, Homo sapiens
ttccaataaaccaggtttaga

SEQ ID NO: 2602936 - DNA, 22 bp, Homo sapiens
ttccaatttacatactctgctt

SEQ ID NO: 2602937 - DNA, 19 bp, Homo sapiens
ttccacacctagcatctca

SEQ ID NO: 2602938 - DNA, 18 bp, Homo sapiens
ttccacactcacctctaa

SEQ ID NO: 2602939 - DNA, 22 bp, Homo sapiens
ttccacatctacgtttttggtg

SEQ ID NO: 2602940 - DNA, 18 bp, Homo sapiens
ttccaccccctccctggc

SEQ ID NO: 2602941 - DNA, 11 bp, Homo sapiens
ttccaccctgg

SEQ ID NO: 2602942 - DNA, 15 bp, Homo sapiens
ttccaccttcccatg

SEQ ID NO: 2602943 - DNA, 18 bp, Homo sapiens
ttccacgctgtctccaga

SEQ ID NO: 2602944 - DNA, 16 bp, Homo sapiens
ttccactgagggcagt

SEQ ID NO: 2602945 - DNA, 17 bp, Homo sapiens
ttccactgcgttgtcca

SEQ ID NO: 2602946 - DNA, 18 bp, Homo sapiens
ttccacttgattttgcaa

SEQ ID NO: 2602947 - DNA, 12 bp, Homo sapiens
ttccacttggct

SEQ ID NO: 2602948 - DNA, 19 bp, Homo sapiens
ttccacttggctacacagg

SEQ ID NO: 2602949 - DNA, 17 bp, Homo sapiens
ttccagaaaaccccagc

SEQ ID NO: 2602950 - DNA, 21 bp, Homo sapiens
ttccagaaaaccccagcatcc

SEQ ID NO: 2602951 - DNA, 11 bp, Homo sapiens
ttccagagaag

SEQ ID NO: 2602952 - DNA, 23 bp, Homo sapiens
ttccagataaccagctgtaacac

SEQ ID NO: 2602953 - DNA, 20 bp, Homo sapiens
ttccagatgccttctccaga

SEQ ID NO: 2602954 - DNA, 23 bp, Homo sapiens
ttccagctcaccccccacactca

SEQ ID NO: 2602955 - DNA, 11 bp, Homo sapiens
ttccagctcct

SEQ ID NO: 2602956 - DNA, 13 bp, Homo sapiens
ttccaggctggga

SEQ ID NO: 2602957 - DNA, 17 bp, Homo sapiens
ttccaggggtgggacac

SEQ ID NO: 2602958 - DNA, 18 bp, Homo sapiens
ttccaggtttaagctgtt

SEQ ID NO: 2602959 - DNA, 15 bp, Homo sapiens
ttccagtccaatctc

SEQ ID NO: 2602960 - DNA, 17 bp, Homo sapiens
ttccagtcttcctgaca

SEQ ID NO: 2602961 - DNA, 22 bp, Homo sapiens
ttccagtgaggctctgcccttg

SEQ ID NO: 2602962 - DNA, 23 bp, Homo sapiens
ttccagtggtccatggaatgctt

SEQ ID NO: 2602963 - DNA, 11 bp, Homo sapiens
ttccagttccc

SEQ ID NO: 2602964 - DNA, 15 bp, Homo sapiens
ttccataaacaccca

SEQ ID NO: 2602965 - DNA, 23 bp, Homo sapiens
ttccataatctggactcctctgt

SEQ ID NO: 2602966 - DNA, 13 bp, Homo sapiens
ttccataattatg

SEQ ID NO: 2602967 - DNA, 20 bp, Homo sapiens
ttccatatgacctcatgcat

SEQ ID NO: 2602968 - DNA, 14 bp, Homo sapiens
ttccatcatgtccc

SEQ ID NO: 2602969 - DNA, 13 bp, Homo sapiens
ttccatgaaaacg

SEQ ID NO: 2602970 - DNA, 24 bp, Homo sapiens
ttccatgaaaatgcaacaacatgt

SEQ ID NO: 2602971 - DNA, 15 bp, Homo sapiens
ttccatgaatgtatc

SEQ ID NO: 2602972 - DNA, 13 bp, Homo sapiens
ttccatgatgctg

SEQ ID NO: 2602973 - DNA, 18 bp, Homo sapiens
ttccatgatgctgggatt

SEQ ID NO: 2602974 - DNA, 16 bp, Homo sapiens
ttccatgcctgagggt

SEQ ID NO: 2602975 - DNA, 22 bp, Homo sapiens
ttccatgcctgagggtggagac

SEQ ID NO: 2602976 - DNA, 18 bp, Homo sapiens
ttccatgcgtgtttctga

SEQ ID NO: 2602977 - DNA, 21 bp, Homo sapiens
ttccatgcgtgtttctgactc

SEQ ID NO: 2602978 - DNA, 16 bp, Homo sapiens
ttccatggccctcatt

SEQ ID NO: 2602979 - DNA, 17 bp, Homo sapiens
ttccatggccctcatta

SEQ ID NO: 2602980 - DNA, 12 bp, Homo sapiens
ttccatggcctc

SEQ ID NO: 2602981 - DNA, 16 bp, Homo sapiens
ttccatgtcgcctctg

SEQ ID NO: 2602982 - DNA, 16 bp, Homo sapiens
ttccatgtcggcctct

SEQ ID NO: 2602983 - DNA, 15 bp, Homo sapiens
ttccattatgattct

SEQ ID NO: 2602984 - DNA, 13 bp, Homo sapiens
ttccattccagaa

SEQ ID NO: 2602985 - DNA, 13 bp, Homo sapiens
ttccattctggaa

SEQ ID NO: 2602986 - DNA, 15 bp, Homo sapiens
ttccattctggaagt

SEQ ID NO: 2602987 - DNA, 16 bp, Homo sapiens
ttccattggatctcat

SEQ ID NO: 2602988 - DNA, 13 bp, Homo sapiens
ttccattgtgtga

SEQ ID NO: 2602989 - DNA, 21 bp, Homo sapiens
ttcccaaaagcccattcattc

SEQ ID NO: 2602990 - DNA, 12 bp, Homo sapiens
ttcccaaatttc

SEQ ID NO: 2602991 - DNA, 14 bp, Homo sapiens
ttcccaagctctgc

SEQ ID NO: 2602992 - DNA, 20 bp, Homo sapiens
ttcccaatagcaacgtagct

SEQ ID NO: 2602993 - DNA, 13 bp, Homo sapiens
ttcccaattgctt

SEQ ID NO: 2602994 - DNA, 17 bp, Homo sapiens
ttcccacacctccacag

SEQ ID NO: 2602995 - DNA, 12 bp, Homo sapiens
ttcccacctctc

SEQ ID NO: 2602996 - DNA, 13 bp, Homo sapiens
ttcccagaatcaa

SEQ ID NO: 2602997 - DNA, 15 bp, Homo sapiens
ttcccagaatcaaag

SEQ ID NO: 2602998 - DNA, 23 bp, Homo sapiens
ttcccagagcaaaataattttaa

SEQ ID NO: 2602999 - DNA, 12 bp, Homo sapiens
ttcccaggtgct

SEQ ID NO: 2603000 - DNA, 17 bp, Homo sapiens
ttcccagtggctgctgc

SEQ ID NO: 2603001 - DNA, 15 bp, Homo sapiens
ttcccataattttct

SEQ ID NO: 2603002 - DNA, 17 bp, Homo sapiens
ttcccattgtggctcct

SEQ ID NO: 2603003 - DNA, 16 bp, Homo sapiens
ttccccaacagtgtga

SEQ ID NO: 2603004 - DNA, 20 bp, Homo sapiens
ttccccaacagtgtgaagtt

SEQ ID NO: 2603005 - DNA, 22 bp, Homo sapiens
ttccccaccccagctcatgccc

SEQ ID NO: 2603006 - DNA, 21 bp, Homo sapiens
ttccccactgacagcctccca

SEQ ID NO: 2603007 - DNA, 19 bp, Homo sapiens
ttccccaggaggccagcct

SEQ ID NO: 2603008 - DNA, 18 bp, Homo sapiens
ttccccaggggaaaatga

SEQ ID NO: 2603009 - DNA, 18 bp, Homo sapiens
ttcccccaccagctaagg

SEQ ID NO: 2603010 - DNA, 19 bp, Homo sapiens
ttccccccactctccccac

SEQ ID NO: 2603011 - DNA, 21 bp, Homo sapiens
ttcccctaccccctcctctct

SEQ ID NO: 2603012 - DNA, 13 bp, Homo sapiens
ttcccctccctgg

SEQ ID NO: 2603013 - DNA, 15 bp, Homo sapiens
ttcccctctgctgct

SEQ ID NO: 2603014 - DNA, 14 bp, Homo sapiens
ttccccttgccctt

SEQ ID NO: 2603015 - DNA, 20 bp, Homo sapiens
ttccccttgcccttgccctg

SEQ ID NO: 2603016 - DNA, 23 bp, Homo sapiens
ttcccgtggaacgtttttcctgt

SEQ ID NO: 2603017 - DNA, 13 bp, Homo sapiens
ttccctacctcag

SEQ ID NO: 2603018 - DNA, 15 bp, Homo sapiens
ttccctacctcaggc

SEQ ID NO: 2603019 - DNA, 13 bp, Homo sapiens
ttccctatctttt

SEQ ID NO: 2603020 - DNA, 15 bp, Homo sapiens
ttccctattagagaa

SEQ ID NO: 2603021 - DNA, 14 bp, Homo sapiens
ttccctctctctga

SEQ ID NO: 2603022 - DNA, 22 bp, Homo sapiens
ttccctctgagaattccaagga

SEQ ID NO: 2603023 - DNA, 23 bp, Homo sapiens
ttccctctgagaattccaaggag

SEQ ID NO: 2603024 - DNA, 13 bp, Homo sapiens
ttccctctgcctg

SEQ ID NO: 2603025 - DNA, 14 bp, Homo sapiens
ttccctctgcctgt

SEQ ID NO: 2603026 - DNA, 18 bp, Homo sapiens
ttccctctgcctgtccct

SEQ ID NO: 2603027 - DNA, 14 bp, Homo sapiens
ttccctctttggct

SEQ ID NO: 2603028 - DNA, 16 bp, Homo sapiens
ttccctctttggctcc

SEQ ID NO: 2603029 - DNA, 20 bp, Homo sapiens
ttccctctttggctcccctg

SEQ ID NO: 2603030 - DNA, 19 bp, Homo sapiens
ttccctgcatttctgagtt

SEQ ID NO: 2603031 - DNA, 23 bp, Homo sapiens
ttccctgcctctcatcaactgaa

SEQ ID NO: 2603032 - DNA, 22 bp, Homo sapiens
ttccctgctgtcgtcttagcaa

SEQ ID NO: 2603033 - DNA, 17 bp, Homo sapiens
ttccctgcttaatgaaa

SEQ ID NO: 2603034 - DNA, 20 bp, Homo sapiens
ttccctgtattttctttctc

SEQ ID NO: 2603035 - DNA, 12 bp, Homo sapiens
ttccctgtgctg

SEQ ID NO: 2603036 - DNA, 19 bp, Homo sapiens
ttcccttcagtaccctctc

SEQ ID NO: 2603037 - DNA, 12 bp, Homo sapiens
ttcccttctcca

SEQ ID NO: 2603038 - DNA, 15 bp, Homo sapiens
ttcccttgagccctc

SEQ ID NO: 2603039 - DNA, 12 bp, Homo sapiens
ttcccttggcct

SEQ ID NO: 2603040 - DNA, 15 bp, Homo sapiens
ttcccttggcctcag

SEQ ID NO: 2603041 - DNA, 23 bp, Homo sapiens
ttctattgacttcaatgatagta

SEQ ID NO: 2603042 - DNA, 17 bp, Homo sapiens
ttctattgtttattctt

SEQ ID NO: 2603043 - DNA, 19 bp, Homo sapiens
ttctatttcagtgccaata

SEQ ID NO: 2603044 - DNA, 15 bp, Homo sapiens
ttctatttgctgggc

SEQ ID NO: 2603045 - DNA, 22 bp, Homo sapiens
ttctcaacaaagcacagtgtta

SEQ ID NO: 2603046 - DNA, 14 bp, Homo sapiens
ttctcaacctacca

SEQ ID NO: 2603047 - DNA, 15 bp, Homo sapiens
ttctcaacctaccac

SEQ ID NO: 2603048 - DNA, 15 bp, Homo sapiens
ttctcaagtgcctta

SEQ ID NO: 2603049 - DNA, 17 bp, Homo sapiens
ttctcaagtgccttaat

SEQ ID NO: 2603050 - DNA, 19 bp, Homo sapiens
ttctcacagtgggagccag

SEQ ID NO: 2603051 - DNA, 12 bp, Homo sapiens
ttctcaccagga

SEQ ID NO: 2603052 - DNA, 13 bp, Homo sapiens
ttctcaccaggaa

SEQ ID NO: 2603053 - DNA, 21 bp, Homo sapiens
ttctcactgccatgccagctt

SEQ ID NO: 2603054 - DNA, 22 bp, Homo sapiens
ttctcagaaggcaaatgacttt

SEQ ID NO: 2603055 - DNA, 19 bp, Homo sapiens
ttctcagaatctcaaataa

SEQ ID NO: 2603056 - DNA, 22 bp, Homo sapiens
ttctcagaatctcaaataacta

SEQ ID NO: 2603057 - DNA, 23 bp, Homo sapiens
ttctcagaatctcaaataactaa

SEQ ID NO: 2603058 - DNA, 14 bp, Homo sapiens
ttctcagatattta

SEQ ID NO: 2603059 - DNA, 15 bp, Homo sapiens
ttctcagatatttat

SEQ ID NO: 2603060 - DNA, 20 bp, Homo sapiens
ttctcagatatttatatttt

SEQ ID NO: 2603061 - DNA, 17 bp, Homo sapiens
ttctcaggccatcatca

SEQ ID NO: 2603062 - DNA, 15 bp, Homo sapiens
ttctcagggctcctg

SEQ ID NO: 2603063 - DNA, 17 bp, Homo sapiens
ttctcagggctcctgcc

SEQ ID NO: 2603064 - DNA, 18 bp, Homo sapiens
ttctcagggtctctgctg

SEQ ID NO: 2603065 - DNA, 19 bp, Homo sapiens
ttctcagggtctctgctgc

SEQ ID NO: 2603066 - DNA, 20 bp, Homo sapiens
ttctcagggtctctgctgcc

SEQ ID NO: 2603067 - DNA, 14 bp, Homo sapiens
ttctcagttttcat

SEQ ID NO: 2603068 - DNA, 18 bp, Homo sapiens
ttctcatagcattaacta

SEQ ID NO: 2603069 - DNA, 15 bp, Homo sapiens
ttctcatcactcccc

SEQ ID NO: 2603070 - DNA, 16 bp, Homo sapiens
ttctcatcactcccct

SEQ ID NO: 2603071 - DNA, 17 bp, Homo sapiens
ttctcatcccacgcact

SEQ ID NO: 2603072 - DNA, 20 bp, Homo sapiens
ttctcattccaacagtgagt

SEQ ID NO: 2603073 - DNA, 14 bp, Homo sapiens
ttctccaaatgaga

SEQ ID NO: 2603074 - DNA, 21 bp, Homo sapiens
ttctccacctagactgtaaac

SEQ ID NO: 2603075 - DNA, 14 bp, Homo sapiens
ttctccacctgcca

SEQ ID NO: 2603076 - DNA, 15 bp, Homo sapiens
ttctccacctgccag

SEQ ID NO: 2603077 - DNA, 11 bp, Homo sapiens
ttctccaggct

SEQ ID NO: 2603078 - DNA, 21 bp, Homo sapiens
ttctcccgttcacgttgccta

SEQ ID NO: 2603079 - DNA, 17 bp, Homo sapiens
ttctccctctcactgtc

SEQ ID NO: 2603080 - DNA, 13 bp, Homo sapiens
ttctccctctgga

SEQ ID NO: 2603081 - DNA, 23 bp, Homo sapiens
ttctccgactgctagggagtggt

SEQ ID NO: 2603082 - DNA, 13 bp, Homo sapiens
ttctcctcccagg

SEQ ID NO: 2603083 - DNA, 20 bp, Homo sapiens
ttctccttagtcttctcata

SEQ ID NO: 2603084 - DNA, 21 bp, Homo sapiens
ttctctaacttcaaggcccat

SEQ ID NO: 2603085 - DNA, 23 bp, Homo sapiens
ttctctaagttccactgagctcc

SEQ ID NO: 2603086 - DNA, 17 bp, Homo sapiens
ttctctactctagggaa

SEQ ID NO: 2603087 - DNA, 17 bp, Homo sapiens
ttctctagtttgattaa

SEQ ID NO: 2603088 - DNA, 15 bp, Homo sapiens
ttctctccagcccct

SEQ ID NO: 2603089 - DNA, 14 bp, Homo sapiens
ttctctcctgtacc

SEQ ID NO: 2603090 - DNA, 19 bp, Homo sapiens
ttctctcctgtacctcttg

SEQ ID NO: 2603091 - DNA, 16 bp, Homo sapiens
ttctctgaagggaggt

SEQ ID NO: 2603092 - DNA, 18 bp, Homo sapiens
ttctctgagctgtgcagg

SEQ ID NO: 2603093 - DNA, 14 bp, Homo sapiens
ttctctgaggacac

SEQ ID NO: 2603094 - DNA, 22 bp, Homo sapiens
ttctctgagtatctcctcgcaa

SEQ ID NO: 2603095 - DNA, 17 bp, Homo sapiens
ttctctggagccaagtc

SEQ ID NO: 2603096 - DNA, 17 bp, Homo sapiens
ttctctgtctcatccat

SEQ ID NO: 2603097 - DNA, 17 bp, Homo sapiens
ttctctgtctcatgtgt

SEQ ID NO: 2603098 - DNA, 12 bp, Homo sapiens
ttctctgtgaac

SEQ ID NO: 2603099 - DNA, 14 bp, Homo sapiens
ttctcttctctgtt

SEQ ID NO: 2603100 - DNA, 16 bp, Homo sapiens
ttctcttttcaaaaca

SEQ ID NO: 2603101 - DNA, 20 bp, Homo sapiens
ttctgttctgtggaaagtgt

SEQ ID NO: 2603102 - DNA, 15 bp, Homo sapiens
ttctgtttccttttt

SEQ ID NO: 2603103 - DNA, 15 bp, Homo sapiens
ttcttaaaatatatt

SEQ ID NO: 2603104 - DNA, 21 bp, Homo sapiens
ttcttaaaatatatttcagat

SEQ ID NO: 2603105 - DNA, 17 bp, Homo sapiens
ttcttaaagtcaagatt

SEQ ID NO: 2603106 - DNA, 21 bp, Homo sapiens
ttcttaagacgtgattttgct

SEQ ID NO: 2603107 - DNA, 20 bp, Homo sapiens
ttcttaatcttttcacaaat

SEQ ID NO: 2603108 - DNA, 22 bp, Homo sapiens
ttcttaatcttttcacaaataa

SEQ ID NO: 2603109 - DNA, 13 bp, Homo sapiens
ttcttaattctta

SEQ ID NO: 2603110 - DNA, 13 bp, Homo sapiens
ttcttacagactg

SEQ ID NO: 2603111 - DNA, 14 bp, Homo sapiens
ttcttacatgcatt

SEQ ID NO: 2603112 - DNA, 13 bp, Homo sapiens
ttcttacatgttt

SEQ ID NO: 2603113 - DNA, 14 bp, Homo sapiens
ttcttacatgtttt

SEQ ID NO: 2603114 - DNA, 20 bp, Homo sapiens
ttcttagctttttaattgtt

SEQ ID NO: 2603115 - DNA, 13 bp, Homo sapiens
ttcttagttctca

SEQ ID NO: 2603116 - DNA, 14 bp, Homo sapiens
ttcttataaatatg

SEQ ID NO: 2603117 - DNA, 15 bp, Homo sapiens
ttcttataaatatga

SEQ ID NO: 2603118 - DNA, 15 bp, Homo sapiens
ttcttatcttctgca

SEQ ID NO: 2603119 - DNA, 21 bp, Homo sapiens
ttcttatgtatgtgaaagtta

SEQ ID NO: 2603120 - DNA, 19 bp, Homo sapiens
ttcttatttaatgaaagac

SEQ ID NO: 2603121 - DNA, 21 bp, Homo sapiens
ttcttcatccggcagcctgga

SEQ ID NO: 2603122 - DNA, 15 bp, Homo sapiens
ttcttcatgcaatga

SEQ ID NO: 2603123 - DNA, 21 bp, Homo sapiens
ttcttcctatttgccatgggc

SEQ ID NO: 2603124 - DNA, 11 bp, Homo sapiens
ttcttcctctg

SEQ ID NO: 2603125 - DNA, 13 bp, Homo sapiens
ttcttcctctgct

SEQ ID NO: 2603126 - DNA, 13 bp, Homo sapiens
ttcttctgaactc

SEQ ID NO: 2603127 - DNA, 23 bp, Homo sapiens
ttcttctgaactcaaactgagga

SEQ ID NO: 2603128 - DNA, 13 bp, Homo sapiens
ttcttctgcttca

SEQ ID NO: 2603129 - DNA, 13 bp, Homo sapiens
ttcttcttcagaa

SEQ ID NO: 2603130 - DNA, 15 bp, Homo sapiens
ttcttcttcagaaga

SEQ ID NO: 2603131 - DNA, 13 bp, Homo sapiens
ttcttcttcctga

SEQ ID NO: 2603132 - DNA, 16 bp, Homo sapiens
ttcttctttttgctgt

SEQ ID NO: 2603133 - DNA, 17 bp, Homo sapiens
ttcttctttttgcttca

SEQ ID NO: 2603134 - DNA, 15 bp, Homo sapiens
ttcttgaaagctgtg

SEQ ID NO: 2603135 - DNA, 21 bp, Homo sapiens
ttcttgaacactcatgctgaa

SEQ ID NO: 2603136 - DNA, 12 bp, Homo sapiens
ttcttgcaaagt

SEQ ID NO: 2603137 - DNA, 14 bp, Homo sapiens
ttcttgctggttgt

SEQ ID NO: 2603138 - DNA, 15 bp, Homo sapiens
ttcttggtagagatt

SEQ ID NO: 2603139 - DNA, 22 bp, Homo sapiens
ttcttggttgaggaaacaaaca

SEQ ID NO: 2603140 - DNA, 20 bp, Homo sapiens
ttcttggttggctggccttc

SEQ ID NO: 2603141 - DNA, 13 bp, Homo sapiens
ttcttggtttgta

SEQ ID NO: 2603142 - DNA, 23 bp, Homo sapiens
ttcttgtaatttaaacaggccca

SEQ ID NO: 2603143 - DNA, 18 bp, Homo sapiens
ttcttgtattaagaatga

SEQ ID NO: 2603144 - DNA, 13 bp, Homo sapiens
ttcttgtcaaaaa

SEQ ID NO: 2603145 - DNA, 16 bp, Homo sapiens
ttctttaaaagaatgg

SEQ ID NO: 2603146 - DNA, 14 bp, Homo sapiens
ttctttaacttaat

SEQ ID NO: 2603147 - DNA, 22 bp, Homo sapiens
ttctttaggagattttaggtgt

SEQ ID NO: 2603148 - DNA, 13 bp, Homo sapiens
ttctttataaact

SEQ ID NO: 2603149 - DNA, 19 bp, Homo sapiens
ttctttatacaacagtgct

SEQ ID NO: 2603150 - DNA, 14 bp, Homo sapiens
ttctttcattttct

SEQ ID NO: 2603151 - DNA, 17 bp, Homo sapiens
ttctttccattatgatt

SEQ ID NO: 2603152 - DNA, 21 bp, Homo sapiens
ttctttccctgcttaatgaaa

SEQ ID NO: 2603153 - DNA, 22 bp, Homo sapiens
ttctttcctcttccccttgccc

SEQ ID NO: 2603154 - DNA, 12 bp, Homo sapiens
ttctttctggct

SEQ ID NO: 2603155 - DNA, 17 bp, Homo sapiens
ttctttctggctatgca

SEQ ID NO: 2603156 - DNA, 20 bp, Homo sapiens
ttctttctggctatgcattt

SEQ ID NO: 2603157 - DNA, 13 bp, Homo sapiens
ttctttcttcctc

SEQ ID NO: 2603158 - DNA, 17 bp, Homo sapiens
ttctttgagactgggtc

SEQ ID NO: 2603159 - DNA, 16 bp, Homo sapiens
ttctttgataatgtta

SEQ ID NO: 2603160 - DNA, 18 bp, Homo sapiens
ttctttgcctgttcagtt

SEQ ID NO: 2603161 - DNA, 19 bp, Homo sapiens
ttctttgtgtagctttgct

SEQ ID NO: 2603162 - DNA, 12 bp, Homo sapiens
ttcttttcacat

SEQ ID NO: 2603163 - DNA, 15 bp, Homo sapiens
ttcttttcacattct

SEQ ID NO: 2603164 - DNA, 17 bp, Homo sapiens
ttcttttcacattctta

SEQ ID NO: 2603165 - DNA, 19 bp, Homo sapiens
ttcttttcacattcttata

SEQ ID NO: 2603166 - DNA, 20 bp, Homo sapiens
ttcttttcacattcttataa

SEQ ID NO: 2603167 - DNA, 23 bp, Homo sapiens
ttcttttgagcaactttcttaca

SEQ ID NO: 2603168 - DNA, 21 bp, Homo sapiens
ttcttttgcccttcacagtgt

SEQ ID NO: 2603169 - DNA, 22 bp, Homo sapiens
ttcttttgcccttcacagtgtt

SEQ ID NO: 2603170 - DNA, 20 bp, Homo sapiens
ttcttttgccgttattaaaa

SEQ ID NO: 2603171 - DNA, 13 bp, Homo sapiens
ttcttttggtaaa

SEQ ID NO: 2603172 - DNA, 20 bp, Homo sapiens
ttgacgccatcccagcccca

SEQ ID NO: 2603173 - DNA, 14 bp, Homo sapiens
ttgactcacctgtt

SEQ ID NO: 2603174 - DNA, 15 bp, Homo sapiens
ttgactcttttgcca

SEQ ID NO: 2603175 - DNA, 20 bp, Homo sapiens
ttgagaaacaaataatttgt

SEQ ID NO: 2603176 - DNA, 22 bp, Homo sapiens
ttgagaaaccttattgtacctc

SEQ ID NO: 2603177 - DNA, 16 bp, Homo sapiens
ttgagaaatgaataat

SEQ ID NO: 2603178 - DNA, 19 bp, Homo sapiens
ttgagaactgcatatgttt

SEQ ID NO: 2603179 - DNA, 19 bp, Homo sapiens
ttgagaagttttgtacaga

SEQ ID NO: 2603180 - DNA, 18 bp, Homo sapiens
ttgagaatggttacaaag

SEQ ID NO: 2603181 - DNA, 11 bp, Homo sapiens
ttgagacagag

SEQ ID NO: 2603182 - DNA, 12 bp, Homo sapiens
ttgagacagagt

SEQ ID NO: 2603183 - DNA, 22 bp, Homo sapiens
ttgagacagtttcttagctttt

SEQ ID NO: 2603184 - DNA, 17 bp, Homo sapiens
ttgagagaagagacaaa

SEQ ID NO: 2603185 - DNA, 17 bp, Homo sapiens
ttgagatagaagaactg

SEQ ID NO: 2603186 - DNA, 12 bp, Homo sapiens
ttgagattagag

SEQ ID NO: 2603187 - DNA, 19 bp, Homo sapiens
ttgagccccaagtcctgaa

SEQ ID NO: 2603188 - DNA, 19 bp, Homo sapiens
ttgagccttgaactttgac

SEQ ID NO: 2603189 - DNA, 18 bp, Homo sapiens
ttgagctctctcattgtc

SEQ ID NO: 2603190 - DNA, 14 bp, Homo sapiens
ttgagctgagatgg

SEQ ID NO: 2603191 - DNA, 18 bp, Homo sapiens
ttgagcttagtgaaatta

SEQ ID NO: 2603192 - DNA, 19 bp, Homo sapiens
ttgaggaggggcaggtaaa

SEQ ID NO: 2603193 - DNA, 18 bp, Homo sapiens
ttgaggatatattttcac

SEQ ID NO: 2603194 - DNA, 19 bp, Homo sapiens
ttgaggcctgccctcaggg

SEQ ID NO: 2603195 - DNA, 19 bp, Homo sapiens
ttgagggcccagagcagga

SEQ ID NO: 2603196 - DNA, 15 bp, Homo sapiens
ttgaggggctcctgg

SEQ ID NO: 2603197 - DNA, 19 bp, Homo sapiens
ttgaggtactctgcacata

SEQ ID NO: 2603198 - DNA, 21 bp, Homo sapiens
ttgaggtaggagaattgcttg

SEQ ID NO: 2603199 - DNA, 22 bp, Homo sapiens
ttgaggtcaagtaagaagacat

SEQ ID NO: 2603200 - DNA, 18 bp, Homo sapiens
ttgaggtcttttgacatg

SEQ ID NO: 2603201 - DNA, 14 bp, Homo sapiens
ttgagtgactcgag

SEQ ID NO: 2603202 - DNA, 20 bp, Homo sapiens
ttgagtgactcgagggttgg

SEQ ID NO: 2603203 - DNA, 15 bp, Homo sapiens
ttgagtgctctgatc

SEQ ID NO: 2603204 - DNA, 16 bp, Homo sapiens
ttgagttttatttatt

SEQ ID NO: 2603205 - DNA, 21 bp, Homo sapiens
ttgataaattccactggactt

SEQ ID NO: 2603206 - DNA, 14 bp, Homo sapiens
ttgataactttgct

SEQ ID NO: 2603207 - DNA, 14 bp, Homo sapiens
ttgataatgttaaa

SEQ ID NO: 2603208 - DNA, 15 bp, Homo sapiens
ttgataatgttaaat

SEQ ID NO: 2603209 - DNA, 20 bp, Homo sapiens
ttgataatgttaaatttgta

SEQ ID NO: 2603210 - DNA, 22 bp, Homo sapiens
ttgataatgttaaatttgtaag

SEQ ID NO: 2603211 - DNA, 15 bp, Homo sapiens
ttgataattgcattc

SEQ ID NO: 2603212 - DNA, 23 bp, Homo sapiens
ttgataattgcattcatcttgtg

SEQ ID NO: 2603213 - DNA, 13 bp, Homo sapiens
ttgatacccccct

SEQ ID NO: 2603214 - DNA, 17 bp, Homo sapiens
ttgatactacagtttgt

SEQ ID NO: 2603215 - DNA, 17 bp, Homo sapiens
ttgatacttgttcaaaa

SEQ ID NO: 2603216 - DNA, 19 bp, Homo sapiens
ttgatagcacagaccctgc

SEQ ID NO: 2603217 - DNA, 20 bp, Homo sapiens
ttgatagcacagaccctgcc

SEQ ID NO: 2603218 - DNA, 19 bp, Homo sapiens
ttgatagctttatttttta

SEQ ID NO: 2603219 - DNA, 22 bp, Homo sapiens
ttgatatagaacagtgcttgcc

SEQ ID NO: 2603220 - DNA, 16 bp, Homo sapiens
ttgatatgcttataca

SEQ ID NO: 2603221 - DNA, 16 bp, Homo sapiens
ttgatgatctttgcag

SEQ ID NO: 2603222 - DNA, 23 bp, Homo sapiens
ttgatgcattaaaagaaaataaa

SEQ ID NO: 2603223 - DNA, 20 bp, Homo sapiens
ttgatgtttgtggcctcaga

SEQ ID NO: 2603224 - DNA, 14 bp, Homo sapiens
ttgattaaattctt

SEQ ID NO: 2603225 - DNA, 12 bp, Homo sapiens
ttgattattctg

SEQ ID NO: 2603226 - DNA, 15 bp, Homo sapiens
ttgattcagacagct

SEQ ID NO: 2603227 - DNA, 13 bp, Homo sapiens
ttgattgctaaat

SEQ ID NO: 2603228 - DNA, 20 bp, Homo sapiens
ttgattgctaaatgtaacag

SEQ ID NO: 2603229 - DNA, 15 bp, Homo sapiens
ttgattgtcagctac

SEQ ID NO: 2603230 - DNA, 21 bp, Homo sapiens
ttgattgtcagctactaatga

SEQ ID NO: 2603231 - DNA, 12 bp, Homo sapiens
ttgatttatgca

SEQ ID NO: 2603232 - DNA, 17 bp, Homo sapiens
ttgatttctttccagag

SEQ ID NO: 2603233 - DNA, 18 bp, Homo sapiens
ttgatttttaccgtttct

SEQ ID NO: 2603234 - DNA, 20 bp, Homo sapiens
ttgatttttgcctcttccag

SEQ ID NO: 2603235 - DNA, 22 bp, Homo sapiens
ttgcaaaatttccagtaccttt

SEQ ID NO: 2603236 - DNA, 23 bp, Homo sapiens
ttgcaaaatttccagtacctttg

SEQ ID NO: 2603237 - DNA, 17 bp, Homo sapiens
ttgcaacaggctgggct

SEQ ID NO: 2603238 - DNA, 14 bp, Homo sapiens
ttgcaacctcgctg

SEQ ID NO: 2603239 - DNA, 22 bp, Homo sapiens
ttgcaacttcatgtcaacttct

SEQ ID NO: 2603240 - DNA, 13 bp, Homo sapiens
ttgcaagggaaaa

SEQ ID NO: 2603241 - DNA, 15 bp, Homo sapiens
ttgcaagtcatggct

SEQ ID NO: 2603242 - DNA, 20 bp, Homo sapiens
ttgcaataatacttctcaaa

SEQ ID NO: 2603243 - DNA, 20 bp, Homo sapiens
ttgcaatccacaatctgaca

SEQ ID NO: 2603244 - DNA, 14 bp, Homo sapiens
ttgcaatggcagcc

SEQ ID NO: 2603245 - DNA, 19 bp, Homo sapiens
ttgcacaatattgaacttt

SEQ ID NO: 2603246 - DNA, 20 bp, Homo sapiens
ttgcacaatattgaactttt

SEQ ID NO: 2603247 - DNA, 14 bp, Homo sapiens
ttgcaccactgcac

SEQ ID NO: 2603248 - DNA, 15 bp, Homo sapiens
ttgcaccactgcact

SEQ ID NO: 2603249 - DNA, 13 bp, Homo sapiens
ttgcacccagccc

SEQ ID NO: 2603250 - DNA, 24 bp, Homo sapiens
ttgcacccctcactctggcctcag

SEQ ID NO: 2603251 - DNA, 12 bp, Homo sapiens
ttgcacccctcc

SEQ ID NO: 2603252 - DNA, 16 bp, Homo sapiens
ttgcacccgcctctcc

SEQ ID NO: 2603253 - DNA, 14 bp, Homo sapiens
ttgcacctgctctc

SEQ ID NO: 2603254 - DNA, 17 bp, Homo sapiens
ttgcacgcccatgtgtg

SEQ ID NO: 2603255 - DNA, 18 bp, Homo sapiens
ttgcacgcccatgtgtga

SEQ ID NO: 2603256 - DNA, 12 bp, Homo sapiens
ttgcactgaggg

SEQ ID NO: 2603257 - DNA, 17 bp, Homo sapiens
ttgcactggagttctat

SEQ ID NO: 2603258 - DNA, 22 bp, Homo sapiens
ttgcagaaacattttgtggtca

SEQ ID NO: 2603259 - DNA, 23 bp, Homo sapiens
ttgcagacaggcaagcacctcct

SEQ ID NO: 2603260 - DNA, 19 bp, Homo sapiens
ttgcagagacaggacctga

SEQ ID NO: 2603261 - DNA, 14 bp, Homo sapiens
ttgcagatgacaaa

SEQ ID NO: 2603262 - DNA, 18 bp, Homo sapiens
ttgcagcactcacacagg

SEQ ID NO: 2603263 - DNA, 20 bp, Homo sapiens
ttgcaggtggaactcagtca

SEQ ID NO: 2603264 - DNA, 20 bp, Homo sapiens
ttgcagtgtggtgagatcat

SEQ ID NO: 2603265 - DNA, 13 bp, Homo sapiens
ttgcagttcacct

SEQ ID NO: 2603266 - DNA, 18 bp, Homo sapiens
ttgcagtttatcattcaa

SEQ ID NO: 2603267 - DNA, 19 bp, Homo sapiens
ttgcagtttatcattcaag

SEQ ID NO: 2603268 - DNA, 21 bp, Homo sapiens
ttgcataataagctaaagagg

SEQ ID NO: 2603269 - DNA, 17 bp, Homo sapiens
ttgcatataacttatat

SEQ ID NO: 2603270 - DNA, 13 bp, Homo sapiens
ttgcatcaatttt

SEQ ID NO: 2603271 - DNA, 20 bp, Homo sapiens
ttgcatctgggtagctgtaa

SEQ ID NO: 2603272 - DNA, 14 bp, Homo sapiens
ttgcatgatgtatt

SEQ ID NO: 2603273 - DNA, 15 bp, Homo sapiens
ttgcatgatgtattt

SEQ ID NO: 2603274 - DNA, 19 bp, Homo sapiens
ttgcatggcacttgcatct

SEQ ID NO: 2603275 - DNA, 14 bp, Homo sapiens
ttgcatgtgaaaat

SEQ ID NO: 2603276 - DNA, 20 bp, Homo sapiens
ttgcatgtgaaaatcaaata

SEQ ID NO: 2603277 - DNA, 14 bp, Homo sapiens
ttgcattgaatata

SEQ ID NO: 2603278 - DNA, 20 bp, Homo sapiens
ttgcatttaaaacagacact

SEQ ID NO: 2603279 - DNA, 15 bp, Homo sapiens
ttgcatttgctcttt

SEQ ID NO: 2603280 - DNA, 15 bp, Homo sapiens
ttgcatttggtcaag

SEQ ID NO: 2603281 - DNA, 22 bp, Homo sapiens
ttgccaaccttatagggatgag

SEQ ID NO: 2603282 - DNA, 14 bp, Homo sapiens
ttgccaccaggaga

SEQ ID NO: 2603283 - DNA, 15 bp, Homo sapiens
ttgccaccaggagaa

SEQ ID NO: 2603284 - DNA, 12 bp, Homo sapiens
ttgccaccccac

SEQ ID NO: 2603285 - DNA, 17 bp, Homo sapiens
ttgccaccccaccctcc

SEQ ID NO: 2603286 - DNA, 18 bp, Homo sapiens
ttgccaccccaccctccc

SEQ ID NO: 2603287 - DNA, 23 bp, Homo sapiens
ttgccaccccaccctccctggag

SEQ ID NO: 2603288 - DNA, 16 bp, Homo sapiens
ttgccaccctcatgct

SEQ ID NO: 2603289 - DNA, 22 bp, Homo sapiens
ttgccagacatgtggtgggaca

SEQ ID NO: 2603290 - DNA, 15 bp, Homo sapiens
ttgccagctgctgct

SEQ ID NO: 2603291 - DNA, 20 bp, Homo sapiens
ttgccagcttttcctccctt

SEQ ID NO: 2603292 - DNA, 18 bp, Homo sapiens
ttgccatactttgtctga

SEQ ID NO: 2603293 - DNA, 22 bp, Homo sapiens
ttgccatactttgtctgaaaaa

SEQ ID NO: 2603294 - DNA, 19 bp, Homo sapiens
ttgccatattttcaccatt

SEQ ID NO: 2603295 - DNA, 22 bp, Homo sapiens
ttgccatgggcttcactgtata

SEQ ID NO: 2603296 - DNA, 17 bp, Homo sapiens
ttgccatgttggccagg

SEQ ID NO: 2603297 - DNA, 19 bp, Homo sapiens
ttgccatgttggccaggct

SEQ ID NO: 2603298 - DNA, 21 bp, Homo sapiens
ttgccatgttggccaggctgg

SEQ ID NO: 2603299 - DNA, 14 bp, Homo sapiens
ttgcccatccatct

SEQ ID NO: 2603300 - DNA, 19 bp, Homo sapiens
ttgccccccaccccagcct

SEQ ID NO: 2603301 - DNA, 12 bp, Homo sapiens
ttgccctcccat

SEQ ID NO: 2603302 - DNA, 13 bp, Homo sapiens
ttgccctgacctc

SEQ ID NO: 2603303 - DNA, 15 bp, Homo sapiens
ttgccctgacctccc

SEQ ID NO: 2603304 - DNA, 14 bp, Homo sapiens
ttgcccttcacagt

SEQ ID NO: 2603305 - DNA, 11 bp, Homo sapiens
ttgcccttccc

SEQ ID NO: 2603306 - DNA, 14 bp, Homo sapiens
ttgcccttgccctg

SEQ ID NO: 2603307 - DNA, 15 bp, Homo sapiens
ttgcccttgccctga

SEQ ID NO: 2603308 - DNA, 16 bp, Homo sapiens
ttgcccttgccctgac

SEQ ID NO: 2603309 - DNA, 18 bp, Homo sapiens
ttgccgtctacctgaggg

SEQ ID NO: 2603310 - DNA, 19 bp, Homo sapiens
ttgccgtctacctgagggg

SEQ ID NO: 2603311 - DNA, 19 bp, Homo sapiens
ttgcctaataaacatcctt

SEQ ID NO: 2603312 - DNA, 24 bp, Homo sapiens
ttgcctattcccacacctccacag

SEQ ID NO: 2603313 - DNA, 14 bp, Homo sapiens
ttgcctctgcctct

SEQ ID NO: 2603314 - DNA, 16 bp, Homo sapiens
ttgcctctgcctctga

SEQ ID NO: 2603315 - DNA, 19 bp, Homo sapiens
ttgcctcttccagtcttcc

SEQ ID NO: 2603316 - DNA, 22 bp, Homo sapiens
ttgcctgcgttttggaagctct

SEQ ID NO: 2603317 - DNA, 16 bp, Homo sapiens
ttgcctgttcagttac

SEQ ID NO: 2603318 - DNA, 21 bp, Homo sapiens
ttgccttccacgctgtctcca

SEQ ID NO: 2603319 - DNA, 13 bp, Homo sapiens
ttgccttttgcaa

SEQ ID NO: 2603320 - DNA, 18 bp, Homo sapiens
ttgccttttgcaaacttt

SEQ ID NO: 2603321 - DNA, 17 bp, Homo sapiens
ttgcgaatggttccatt

SEQ ID NO: 2603322 - DNA, 15 bp, Homo sapiens
ttgcggggggaggga

SEQ ID NO: 2603323 - DNA, 17 bp, Homo sapiens
ttgcgtaactggctgtg

SEQ ID NO: 2603324 - DNA, 18 bp, Homo sapiens
ttgcgtaactggctgtgt

SEQ ID NO: 2603325 - DNA, 20 bp, Homo sapiens
ttgcgtatgtctgttaccat

SEQ ID NO: 2603326 - DNA, 15 bp, Homo sapiens
ttgcgtggactctgc

SEQ ID NO: 2603327 - DNA, 20 bp, Homo sapiens
ttgctaagatgctctatctt

SEQ ID NO: 2603328 - DNA, 14 bp, Homo sapiens
ttgctaatcagtgt

SEQ ID NO: 2603329 - DNA, 15 bp, Homo sapiens
ttgctaatcagtgtc

SEQ ID NO: 2603330 - DNA, 21 bp, Homo sapiens
ttgctaatcagtgtctcacac

SEQ ID NO: 2603331 - DNA, 14 bp, Homo sapiens
ttgctattagagca

SEQ ID NO: 2603332 - DNA, 17 bp, Homo sapiens
ttgctattagagcattg

SEQ ID NO: 2603333 - DNA, 17 bp, Homo sapiens
ttgctcaaaaaatgagc

SEQ ID NO: 2603334 - DNA, 16 bp, Homo sapiens
ttgctcaaaaatctgt

SEQ ID NO: 2603335 - DNA, 15 bp, Homo sapiens
ttgctcacctggggt

SEQ ID NO: 2603336 - DNA, 12 bp, Homo sapiens
ttgctccttgac

SEQ ID NO: 2603337 - DNA, 16 bp, Homo sapiens
ttgctctccctcttct

SEQ ID NO: 2603338 - DNA, 20 bp, Homo sapiens
ttgctctctggccttttcct

SEQ ID NO: 2603339 - DNA, 13 bp, Homo sapiens
ttgctctgcaccc

SEQ ID NO: 2603340 - DNA, 16 bp, Homo sapiens
ttgctctttctactct

SEQ ID NO: 2603341 - DNA, 11 bp, Homo sapiens
ttgctgagcct

SEQ ID NO: 2603342 - DNA, 15 bp, Homo sapiens
ttgctgattcttgag

SEQ ID NO: 2603343 - DNA, 21 bp, Homo sapiens
ttgctgcctgaagaacagtaa

SEQ ID NO: 2603344 - DNA, 23 bp, Homo sapiens
ttgctgcttttccttggggcagg

SEQ ID NO: 2603345 - DNA, 23 bp, Homo sapiens
ttgctggactgtcatagaaatta

SEQ ID NO: 2603346 - DNA, 16 bp, Homo sapiens
ttgctggcaaagacag

SEQ ID NO: 2603347 - DNA, 12 bp, Homo sapiens
ttgctggctgga

SEQ ID NO: 2603348 - DNA, 23 bp, Homo sapiens
ttgctggggacggggggccccag

SEQ ID NO: 2603349 - DNA, 20 bp, Homo sapiens
ttgctggggccgaaagaaca

SEQ ID NO: 2603350 - DNA, 23 bp, Homo sapiens
ttgctgtaccagcccagatgttt

SEQ ID NO: 2603351 - DNA, 21 bp, Homo sapiens
ttgctgttgatgaggcctctt

SEQ ID NO: 2603352 - DNA, 13 bp, Homo sapiens
ttgctgttttgat

SEQ ID NO: 2603353 - DNA, 15 bp, Homo sapiens
ttgcttacaattttt

SEQ ID NO: 2603354 - DNA, 22 bp, Homo sapiens
ttgcttacaatttttttaattt

SEQ ID NO: 2603355 - DNA, 12 bp, Homo sapiens
ttgcttactaag

SEQ ID NO: 2603356 - DNA, 23 bp, Homo sapiens
ttgcttactttggaatacatttc

SEQ ID NO: 2603357 - DNA, 24 bp, Homo sapiens
ttgcttaggatgtttttcatgaaa

SEQ ID NO: 2603358 - DNA, 16 bp, Homo sapiens
ttgcttattgttccaa

SEQ ID NO: 2603359 - DNA, 18 bp, Homo sapiens
ttgcttattgttccaaga

SEQ ID NO: 2603360 - DNA, 22 bp, Homo sapiens
ttgcttattgttccaagacatt

SEQ ID NO: 2603361 - DNA, 12 bp, Homo sapiens
ttgcttgaaaga

SEQ ID NO: 2603362 - DNA, 14 bp, Homo sapiens
ttgcttgaaagaaa

SEQ ID NO: 2603363 - DNA, 15 bp, Homo sapiens
ttgcttgaaagaaaa

SEQ ID NO: 2603364 - DNA, 16 bp, Homo sapiens
ttgcttgagcccagga

SEQ ID NO: 2603365 - DNA, 17 bp, Homo sapiens
ttgcttgagcccaggag

SEQ ID NO: 2603366 - DNA, 16 bp, Homo sapiens
ttgcttggactattat

SEQ ID NO: 2603367 - DNA, 15 bp, Homo sapiens
ttgcttgggaagggg

SEQ ID NO: 2603368 - DNA, 24 bp, Homo sapiens
ttgcttgttgggattcctgaccca

SEQ ID NO: 2603369 - DNA, 16 bp, Homo sapiens
ttgctttactgtcaaa

SEQ ID NO: 2603370 - DNA, 13 bp, Homo sapiens
ttgctttctgaaa

SEQ ID NO: 2603371 - DNA, 15 bp, Homo sapiens
ttgctttctgaaatt

SEQ ID NO: 2603372 - DNA, 15 bp, Homo sapiens
ttgctttgaagcagt

SEQ ID NO: 2603373 - DNA, 13 bp, Homo sapiens
ttgctttgccctg

SEQ ID NO: 2603374 - DNA, 14 bp, Homo sapiens
ttggaaaagaatac

SEQ ID NO: 2603375 - DNA, 17 bp, Homo sapiens
ttggaaaataaattatt

SEQ ID NO: 2603376 - DNA, 20 bp, Homo sapiens
ttggaaacctgccctgcctg

SEQ ID NO: 2603377 - DNA, 14 bp, Homo sapiens
ttggaaaggaccag

SEQ ID NO: 2603378 - DNA, 15 bp, Homo sapiens
ttggaagaccccacc

SEQ ID NO: 2603379 - DNA, 21 bp, Homo sapiens
ttggaagctagctcccctcct

SEQ ID NO: 2603380 - DNA, 23 bp, Homo sapiens
ttggaatattgtccattgtccaa

SEQ ID NO: 2603381 - DNA, 19 bp, Homo sapiens
ttggaattaacctggtgct

SEQ ID NO: 2603382 - DNA, 16 bp, Homo sapiens
ttggacagaagcagct

SEQ ID NO: 2603383 - DNA, 13 bp, Homo sapiens
ttggaccccagct

SEQ ID NO: 2603384 - DNA, 15 bp, Homo sapiens
ttggaccccagctgg

SEQ ID NO: 2603385 - DNA, 16 bp, Homo sapiens
ttggaccccagctggg

SEQ ID NO: 2603386 - DNA, 15 bp, Homo sapiens
ttggacccgctctgg

SEQ ID NO: 2603387 - DNA, 17 bp, Homo sapiens
ttggacccgctctggac

SEQ ID NO: 2603388 - DNA, 15 bp, Homo sapiens
ttggaccctgaggcc

SEQ ID NO: 2603389 - DNA, 18 bp, Homo sapiens
ttggaccctgaggcccag

SEQ ID NO: 2603390 - DNA, 19 bp, Homo sapiens
ttggaccctgaggcccaga

SEQ ID NO: 2603391 - DNA, 17 bp, Homo sapiens
ttggacctaatccaagc

SEQ ID NO: 2603392 - DNA, 14 bp, Homo sapiens
ttggacctctgctc

SEQ ID NO: 2603393 - DNA, 18 bp, Homo sapiens
ttggacctctgctctgag

SEQ ID NO: 2603394 - DNA, 21 bp, Homo sapiens
ttggacctctgctctgaggct

SEQ ID NO: 2603395 - DNA, 17 bp, Homo sapiens
ttggacggctgggcaca

SEQ ID NO: 2603396 - DNA, 13 bp, Homo sapiens
ttggactattata

SEQ ID NO: 2603397 - DNA, 16 bp, Homo sapiens
ttggactcttgctctt

SEQ ID NO: 2603398 - DNA, 15 bp, Homo sapiens
ttggactgacattta

SEQ ID NO: 2603399 - DNA, 22 bp, Homo sapiens
ttggagagctagaacctggaga

SEQ ID NO: 2603400 - DNA, 13 bp, Homo sapiens
ttggagagtaaaa

SEQ ID NO: 2603401 - DNA, 18 bp, Homo sapiens
ttggagagtaaaaactga

SEQ ID NO: 2603402 - DNA, 14 bp, Homo sapiens
ttggagatcaagga

SEQ ID NO: 2603403 - DNA, 14 bp, Homo sapiens
ttggagcctgcagg

SEQ ID NO: 2603404 - DNA, 17 bp, Homo sapiens
ttggaggcctttcatcc

SEQ ID NO: 2603405 - DNA, 21 bp, Homo sapiens
ttgggcggctgagagccccag

SEQ ID NO: 2603406 - DNA, 21 bp, Homo sapiens
ttgggggacagggctggccca

SEQ ID NO: 2603407 - DNA, 16 bp, Homo sapiens
ttgggggctgtgggga

SEQ ID NO: 2603408 - DNA, 15 bp, Homo sapiens
ttggggtcagccagg

SEQ ID NO: 2603409 - DNA, 14 bp, Homo sapiens
ttggggtctgaccc

SEQ ID NO: 2603410 - DNA, 14 bp, Homo sapiens
ttgggtaggcggga

SEQ ID NO: 2603411 - DNA, 14 bp, Homo sapiens
ttgggtggagaagc

SEQ ID NO: 2603412 - DNA, 19 bp, Homo sapiens
ttgggtggagaagccattg

SEQ ID NO: 2603413 - DNA, 20 bp, Homo sapiens
ttgggtgtaacaggtctcct

SEQ ID NO: 2603414 - DNA, 23 bp, Homo sapiens
ttgggtgtaacaggtctcctctt

SEQ ID NO: 2603415 - DNA, 16 bp, Homo sapiens
ttgggttcatctgagc

SEQ ID NO: 2603416 - DNA, 16 bp, Homo sapiens
ttggtaaagactggct

SEQ ID NO: 2603417 - DNA, 21 bp, Homo sapiens
ttggtaacatcctttctattg

SEQ ID NO: 2603418 - DNA, 20 bp, Homo sapiens
ttggtacatggccagtgtga

SEQ ID NO: 2603419 - DNA, 15 bp, Homo sapiens
ttggtagagattcat

SEQ ID NO: 2603420 - DNA, 18 bp, Homo sapiens
ttggtatctgttctttaa

SEQ ID NO: 2603421 - DNA, 13 bp, Homo sapiens
ttggtcctgctgc

SEQ ID NO: 2603422 - DNA, 17 bp, Homo sapiens
ttggtctgggacttcct

SEQ ID NO: 2603423 - DNA, 19 bp, Homo sapiens
ttggtcttatttattattg

SEQ ID NO: 2603424 - DNA, 17 bp, Homo sapiens
ttggtgcacagtgattt

SEQ ID NO: 2603425 - DNA, 12 bp, Homo sapiens
ttggtgcctggc

SEQ ID NO: 2603426 - DNA, 18 bp, Homo sapiens
ttggtggtttcagaaatg

SEQ ID NO: 2603427 - DNA, 19 bp, Homo sapiens
ttggtggtttcagaaatgt

SEQ ID NO: 2603428 - DNA, 13 bp, Homo sapiens
ttggtgttgacat

SEQ ID NO: 2603429 - DNA, 16 bp, Homo sapiens
ttggttaagtctgttt

SEQ ID NO: 2603430 - DNA, 14 bp, Homo sapiens
ttggttcataaatg

SEQ ID NO: 2603431 - DNA, 18 bp, Homo sapiens
ttggttcccccactgatc

SEQ ID NO: 2603432 - DNA, 16 bp, Homo sapiens
ttggttgctttaatat

SEQ ID NO: 2603433 - DNA, 13 bp, Homo sapiens
ttggttgtattct

SEQ ID NO: 2603434 - DNA, 18 bp, Homo sapiens
ttggtttgcagatgacaa

SEQ ID NO: 2603435 - DNA, 16 bp, Homo sapiens
ttgtaaaaaaaaatgc

SEQ ID NO: 2603436 - DNA, 20 bp, Homo sapiens
ttgtaaaaaaaaatgccttt

SEQ ID NO: 2603437 - DNA, 22 bp, Homo sapiens
ttgtaaaaaaaaatgcctttga

SEQ ID NO: 2603438 - DNA, 22 bp, Homo sapiens
ttgtaaaaattaaaagttatgg

SEQ ID NO: 2603439 - DNA, 20 bp, Homo sapiens
ttgtaaaagaacagtaaaca

SEQ ID NO: 2603440 - DNA, 21 bp, Homo sapiens
ttgtaaaatagcttgtatagt

SEQ ID NO: 2603441 - DNA, 12 bp, Homo sapiens
ttgtaaaatggt

SEQ ID NO: 2603442 - DNA, 22 bp, Homo sapiens
ttgtaaagtgtggtcccaacag

SEQ ID NO: 2603443 - DNA, 16 bp, Homo sapiens
ttgtaaatgtggtaaa

SEQ ID NO: 2603444 - DNA, 18 bp, Homo sapiens
ttgtaaattaacttttat

SEQ ID NO: 2603445 - DNA, 16 bp, Homo sapiens
ttgtaacctcagctct

SEQ ID NO: 2603446 - DNA, 20 bp, Homo sapiens
ttgtaacctcagctctggga

SEQ ID NO: 2603447 - DNA, 20 bp, Homo sapiens
ttgtaactaggctcagagat

SEQ ID NO: 2603448 - DNA, 11 bp, Homo sapiens
ttgtaagaaat

SEQ ID NO: 2603449 - DNA, 22 bp, Homo sapiens
ttgtaagacaaaggttttcctc

SEQ ID NO: 2603450 - DNA, 16 bp, Homo sapiens
ttgtaagacaatccat

SEQ ID NO: 2603451 - DNA, 20 bp, Homo sapiens
ttgtaagagtggaaccaaca

SEQ ID NO: 2603452 - DNA, 15 bp, Homo sapiens
ttgtaagagtgtaga

SEQ ID NO: 2603453 - DNA, 15 bp, Homo sapiens
ttgtaagatgctggg

SEQ ID NO: 2603454 - DNA, 23 bp, Homo sapiens
ttgtaattctaaatgaatgttta

SEQ ID NO: 2603455 - DNA, 23 bp, Homo sapiens
ttgtaatttttttaatttacaaa

SEQ ID NO: 2603456 - DNA, 23 bp, Homo sapiens
ttgtacaaaataaacaaataaca

SEQ ID NO: 2603457 - DNA, 16 bp, Homo sapiens
ttgtacagctgtttaa

SEQ ID NO: 2603458 - DNA, 16 bp, Homo sapiens
ttgtacatagttattt

SEQ ID NO: 2603459 - DNA, 20 bp, Homo sapiens
ttgtacatgtgtagcctgtg

SEQ ID NO: 2603460 - DNA, 15 bp, Homo sapiens
ttgtactgtaaagag

SEQ ID NO: 2603461 - DNA, 22 bp, Homo sapiens
ttgtagaagggttatattttac

SEQ ID NO: 2603462 - DNA, 17 bp, Homo sapiens
ttgtagaatgtattgta

SEQ ID NO: 2603463 - DNA, 20 bp, Homo sapiens
ttgtagaatgtattgtacct

SEQ ID NO: 2603464 - DNA, 22 bp, Homo sapiens
ttgtagaatgtattgtaccttt

SEQ ID NO: 2603465 - DNA, 20 bp, Homo sapiens
ttgtaggcgaatcatttgtt

SEQ ID NO: 2603466 - DNA, 20 bp, Homo sapiens
ttgtaggggtcaaagaaatg

SEQ ID NO: 2603467 - DNA, 20 bp, Homo sapiens
ttgtagtagtctcattactt

SEQ ID NO: 2603468 - DNA, 12 bp, Homo sapiens
ttgtataaaaat

SEQ ID NO: 2603469 - DNA, 20 bp, Homo sapiens
ttgtataaaaatagaagaat

SEQ ID NO: 2603470 - DNA, 13 bp, Homo sapiens
ttgtataacaggt

SEQ ID NO: 2603471 - DNA, 16 bp, Homo sapiens
ttgtataacaggttat

SEQ ID NO: 2603472 - DNA, 14 bp, Homo sapiens
ttgtataacttctt

SEQ ID NO: 2603473 - DNA, 13 bp, Homo sapiens
ttgtataattgta

SEQ ID NO: 2603474 - DNA, 18 bp, Homo sapiens
ttgtataggtagatgttc

SEQ ID NO: 2603475 - DNA, 14 bp, Homo sapiens
ttgtatagtaaagt

SEQ ID NO: 2603476 - DNA, 15 bp, Homo sapiens
ttgtatagtgtaaaa

SEQ ID NO: 2603477 - DNA, 13 bp, Homo sapiens
ttgtatatatctg

SEQ ID NO: 2603478 - DNA, 14 bp, Homo sapiens
ttgtatatatgtgt

SEQ ID NO: 2603479 - DNA, 16 bp, Homo sapiens
ttgtatatatgtgtgt

SEQ ID NO: 2603480 - DNA, 21 bp, Homo sapiens
ttgtatatatgtgtgtttaaa

SEQ ID NO: 2603481 - DNA, 21 bp, Homo sapiens
ttgtatattatggaagatttt

SEQ ID NO: 2603482 - DNA, 19 bp, Homo sapiens
ttgtatattgtcagatatt

SEQ ID NO: 2603483 - DNA, 14 bp, Homo sapiens
ttgtatatttgtac

SEQ ID NO: 2603484 - DNA, 16 bp, Homo sapiens
ttgtatatttgtacaa

SEQ ID NO: 2603485 - DNA, 17 bp, Homo sapiens
ttgtatatttgtacaaa

SEQ ID NO: 2603486 - DNA, 18 bp, Homo sapiens
ttgtatatttgtacaaaa

SEQ ID NO: 2603487 - DNA, 15 bp, Homo sapiens
ttgtatcagaggcct

SEQ ID NO: 2603488 - DNA, 22 bp, Homo sapiens
ttgtatcagaggcctataatga

SEQ ID NO: 2603489 - DNA, 22 bp, Homo sapiens
ttgtatcgtatagctgtattga

SEQ ID NO: 2603490 - DNA, 20 bp, Homo sapiens
ttgtatctctgaagcatgtt

SEQ ID NO: 2603491 - DNA, 20 bp, Homo sapiens
ttgtatctcttttgaatcca

SEQ ID NO: 2603492 - DNA, 16 bp, Homo sapiens
ttgtatgatgtgttgt

SEQ ID NO: 2603493 - DNA, 18 bp, Homo sapiens
ttgtatgatgtgttgtga

SEQ ID NO: 2603494 - DNA, 21 bp, Homo sapiens
ttgtatgatgtgttgtgatag

SEQ ID NO: 2603495 - DNA, 17 bp, Homo sapiens
ttgtatgtgtgtagaca

SEQ ID NO: 2603496 - DNA, 16 bp, Homo sapiens
ttgtattaaagacaga

SEQ ID NO: 2603497 - DNA, 15 bp, Homo sapiens
ttgtattctctgagc

SEQ ID NO: 2603498 - DNA, 22 bp, Homo sapiens
ttgtcaaactgtagaaatgatg

SEQ ID NO: 2603499 - DNA, 23 bp, Homo sapiens
ttgtcacaatcctaacacattat

SEQ ID NO: 2603500 - DNA, 18 bp, Homo sapiens
ttgtcacacactttggct

SEQ ID NO: 2603501 - DNA, 19 bp, Homo sapiens
ttgtcacgcttcttctttt

SEQ ID NO: 2603502 - DNA, 18 bp, Homo sapiens
ttgtcagatatgatatgt

SEQ ID NO: 2603503 - DNA, 23 bp, Homo sapiens
ttgtcatcattgtatatatgtgt

SEQ ID NO: 2603504 - DNA, 14 bp, Homo sapiens
ttgtcattgctgtt

SEQ ID NO: 2603505 - DNA, 20 bp, Homo sapiens
ttgtcccactcaagccaagc

SEQ ID NO: 2603506 - DNA, 21 bp, Homo sapiens
ttgtcccagaggctgccccac

SEQ ID NO: 2603507 - DNA, 12 bp, Homo sapiens
ttgtccccacac

SEQ ID NO: 2603508 - DNA, 17 bp, Homo sapiens
ttgtccccacactccta

SEQ ID NO: 2603509 - DNA, 14 bp, Homo sapiens
ttgtcccctcttga

SEQ ID NO: 2603510 - DNA, 21 bp, Homo sapiens
ttgtcccctgcctgtgcctgc

SEQ ID NO: 2603511 - DNA, 15 bp, Homo sapiens
ttgtccctgtgccta

SEQ ID NO: 2603512 - DNA, 14 bp, Homo sapiens
ttgtccttgctggt

SEQ ID NO: 2603513 - DNA, 22 bp, Homo sapiens
ttgtcgttgactttagggactc

SEQ ID NO: 2603514 - DNA, 14 bp, Homo sapiens
ttgtctatgggact

SEQ ID NO: 2603515 - DNA, 18 bp, Homo sapiens
ttgtctatttttgtctta

SEQ ID NO: 2603516 - DNA, 12 bp, Homo sapiens
ttgtctctgggc

SEQ ID NO: 2603517 - DNA, 19 bp, Homo sapiens
ttgtctgtgcatccggggg

SEQ ID NO: 2603518 - DNA, 22 bp, Homo sapiens
ttgtcttaaaaagtggaaaaat

SEQ ID NO: 2603519 - DNA, 22 bp, Homo sapiens
ttgtcttgaatgtcttttgaat

SEQ ID NO: 2603520 - DNA, 18 bp, Homo sapiens
ttgtcttgccttattaaa

SEQ ID NO: 2603521 - DNA, 17 bp, Homo sapiens
ttgtgaaatgaaaacat

SEQ ID NO: 2603522 - DNA, 14 bp, Homo sapiens
ttgtgaaatgatgg

SEQ ID NO: 2603523 - DNA, 17 bp, Homo sapiens
ttgtgaactttttgtag

SEQ ID NO: 2603524 - DNA, 21 bp, Homo sapiens
ttgtgaatggattggattatt

SEQ ID NO: 2603525 - DNA, 16 bp, Homo sapiens
ttgtgaccttagtgtt

SEQ ID NO: 2603526 - DNA, 17 bp, Homo sapiens
ttgtgaccttagtgttt

SEQ ID NO: 2603527 - DNA, 23 bp, Homo sapiens
ttgtgactaattgtataacaggt

SEQ ID NO: 2603528 - DNA, 16 bp, Homo sapiens
ttgtgactgtatataa

SEQ ID NO: 2603529 - DNA, 22 bp, Homo sapiens
ttgtgactgtatataaaggaaa

SEQ ID NO: 2603530 - DNA, 23 bp, Homo sapiens
ttgtgactgtatataaaggaaaa

SEQ ID NO: 2603531 - DNA, 12 bp, Homo sapiens
ttgtgagatggg

SEQ ID NO: 2603532 - DNA, 18 bp, Homo sapiens
ttgtgagccaccacgtcc

SEQ ID NO: 2603533 - DNA, 17 bp, Homo sapiens
ttgtgaggaagccgctg

SEQ ID NO: 2603534 - DNA, 18 bp, Homo sapiens
ttgtgaggaagccgctgg

SEQ ID NO: 2603535 - DNA, 21 bp, Homo sapiens
ttgtgaggaagccgctggggc

SEQ ID NO: 2603536 - DNA, 22 bp, Homo sapiens
ttgtgagtttagtaaggctgtg

SEQ ID NO: 2603537 - DNA, 19 bp, Homo sapiens
ttgtgatacaatgctgtgc

SEQ ID NO: 2603538 - DNA, 20 bp, Homo sapiens
ttgtgatagctaacatttta

SEQ ID NO: 2603539 - DNA, 23 bp, Homo sapiens
ttgtgatcagaccataatgttac

SEQ ID NO: 2603540 - DNA, 18 bp, Homo sapiens
ttgtgatgtcccaacttg

SEQ ID NO: 2603541 - DNA, 22 bp, Homo sapiens
ttgtgatgtcccaacttgtaaa

SEQ ID NO: 2603542 - DNA, 12 bp, Homo sapiens
ttgtgatgtgtc

SEQ ID NO: 2603543 - DNA, 23 bp, Homo sapiens
ttgtgattatttcactttagatg

SEQ ID NO: 2603544 - DNA, 12 bp, Homo sapiens
tttaataacatt

SEQ ID NO: 2603545 - DNA, 20 bp, Homo sapiens
tttaataacattaccttact

SEQ ID NO: 2603546 - DNA, 21 bp, Homo sapiens
tttaatagaatataattatcg

SEQ ID NO: 2603547 - DNA, 15 bp, Homo sapiens
tttaatatagctatt

SEQ ID NO: 2603548 - DNA, 16 bp, Homo sapiens
tttaatatagctattt

SEQ ID NO: 2603549 - DNA, 22 bp, Homo sapiens
tttaatattgagaaagaaacta

SEQ ID NO: 2603550 - DNA, 12 bp, Homo sapiens
tttaatatttaa

SEQ ID NO: 2603551 - DNA, 14 bp, Homo sapiens
tttaatcatgaaat

SEQ ID NO: 2603552 - DNA, 21 bp, Homo sapiens
tttaatccagaattgaccttt

SEQ ID NO: 2603553 - DNA, 21 bp, Homo sapiens
tttaatggacatgagataatg

SEQ ID NO: 2603554 - DNA, 20 bp, Homo sapiens
tttaatgggggtagcagctg

SEQ ID NO: 2603555 - DNA, 18 bp, Homo sapiens
tttaatgtgctgtgtaaa

SEQ ID NO: 2603556 - DNA, 22 bp, Homo sapiens
tttaatgtgctgtgtaaagtta

SEQ ID NO: 2603557 - DNA, 13 bp, Homo sapiens
tttaattaaataa

SEQ ID NO: 2603558 - DNA, 19 bp, Homo sapiens
tttaattaatcatgaatgt

SEQ ID NO: 2603559 - DNA, 17 bp, Homo sapiens
tttaattaatgaaatat

SEQ ID NO: 2603560 - DNA, 19 bp, Homo sapiens
tttaattaatgaaatatct

SEQ ID NO: 2603561 - DNA, 23 bp, Homo sapiens
tttaattattattcttcataaca

SEQ ID NO: 2603562 - DNA, 21 bp, Homo sapiens
tttaattccaatatgatgact

SEQ ID NO: 2603563 - DNA, 13 bp, Homo sapiens
tttaattccatga

SEQ ID NO: 2603564 - DNA, 13 bp, Homo sapiens
tttaattctcttg

SEQ ID NO: 2603565 - DNA, 23 bp, Homo sapiens
tttaattgttgtttctttctagt

SEQ ID NO: 2603566 - DNA, 24 bp, Homo sapiens
tttaattgttgtttctttctagtg

SEQ ID NO: 2603567 - DNA, 16 bp, Homo sapiens
tttaatttatgagttt

SEQ ID NO: 2603568 - DNA, 20 bp, Homo sapiens
tttaatttatttattaagat

SEQ ID NO: 2603569 - DNA, 11 bp, Homo sapiens
tttaattttgt

SEQ ID NO: 2603570 - DNA, 16 bp, Homo sapiens
tttaattttgtatttt

SEQ ID NO: 2603571 - DNA, 15 bp, Homo sapiens
tttacaagtgtatat

SEQ ID NO: 2603572 - DNA, 21 bp, Homo sapiens
tttacaccagttcctttcaat

SEQ ID NO: 2603573 - DNA, 16 bp, Homo sapiens
tttacactctttgtaa

SEQ ID NO: 2603574 - DNA, 13 bp, Homo sapiens
tttacagagacag

SEQ ID NO: 2603575 - DNA, 20 bp, Homo sapiens
tttacagaggacagtatttg

SEQ ID NO: 2603576 - DNA, 18 bp, Homo sapiens
tttacagcactactctgt

SEQ ID NO: 2603577 - DNA, 20 bp, Homo sapiens
tttacagcctcacttgaatg

SEQ ID NO: 2603578 - DNA, 23 bp, Homo sapiens
tttacagctttcatgattagcaa

SEQ ID NO: 2603579 - DNA, 19 bp, Homo sapiens
tttacagtgaaaatgtaag

SEQ ID NO: 2603580 - DNA, 18 bp, Homo sapiens
tttacatgaattgcattt

SEQ ID NO: 2603581 - DNA, 19 bp, Homo sapiens
tttacatggggttttcaat

SEQ ID NO: 2603582 - DNA, 15 bp, Homo sapiens
tttacatgtagtagt

SEQ ID NO: 2603583 - DNA, 18 bp, Homo sapiens
tttaccacccccacacct

SEQ ID NO: 2603584 - DNA, 23 bp, Homo sapiens
tttaccagcctccgtatttcaga

SEQ ID NO: 2603585 - DNA, 18 bp, Homo sapiens
tttacccaaaaactaaat

SEQ ID NO: 2603586 - DNA, 19 bp, Homo sapiens
tttacccacacacagataa

SEQ ID NO: 2603587 - DNA, 14 bp, Homo sapiens
tttacccatatccc

SEQ ID NO: 2603588 - DNA, 18 bp, Homo sapiens
tttacccatatcccctct

SEQ ID NO: 2603589 - DNA, 21 bp, Homo sapiens
tttacccatatcccctctccc

SEQ ID NO: 2603590 - DNA, 13 bp, Homo sapiens
tttacctgagacc

SEQ ID NO: 2603591 - DNA, 16 bp, Homo sapiens
tttacctgcaaaaaat

SEQ ID NO: 2603592 - DNA, 15 bp, Homo sapiens
tttacctgtgaaata

SEQ ID NO: 2603593 - DNA, 14 bp, Homo sapiens
tttaccttttttat

SEQ ID NO: 2603594 - DNA, 21 bp, Homo sapiens
tttaccttttttatacataaa

SEQ ID NO: 2603595 - DNA, 15 bp, Homo sapiens
tttactaagatgaca

SEQ ID NO: 2603596 - DNA, 21 bp, Homo sapiens
tttactaagccacaagaaatt

SEQ ID NO: 2603597 - DNA, 21 bp, Homo sapiens
tttactactgtggaaaaatat

SEQ ID NO: 2603598 - DNA, 18 bp, Homo sapiens
tttactagggatccctca

SEQ ID NO: 2603599 - DNA, 23 bp, Homo sapiens
tttactagggatccctcatctgt

SEQ ID NO: 2603600 - DNA, 17 bp, Homo sapiens
tttactcaaccctctca

SEQ ID NO: 2603601 - DNA, 13 bp, Homo sapiens
tttactccagtgg

SEQ ID NO: 2603602 - DNA, 12 bp, Homo sapiens
tttactcccctt

SEQ ID NO: 2603603 - DNA, 22 bp, Homo sapiens
tttacttaaagatttatcaaat

SEQ ID NO: 2603604 - DNA, 23 bp, Homo sapiens
tttacttaaagatttatcaaatc

SEQ ID NO: 2603605 - DNA, 21 bp, Homo sapiens
tttacttgcattgaatatatt

SEQ ID NO: 2603606 - DNA, 13 bp, Homo sapiens
tttactttgaatt

SEQ ID NO: 2603607 - DNA, 16 bp, Homo sapiens
tttacttttaaatgtc

SEQ ID NO: 2603608 - DNA, 23 bp, Homo sapiens
tttagaaagaagcccaatattat

SEQ ID NO: 2603609 - DNA, 14 bp, Homo sapiens
tttagaaatataat

SEQ ID NO: 2603610 - DNA, 16 bp, Homo sapiens
tttagacaaatactca

SEQ ID NO: 2603611 - DNA, 21 bp, Homo sapiens
tttagacaaatactcatgtgt

SEQ ID NO: 2603612 - DNA, 22 bp, Homo sapiens
tttagacaaatactcatgtgta

SEQ ID NO: 2603613 - DNA, 11 bp, Homo sapiens
tttagacagta

SEQ ID NO: 2603614 - DNA, 15 bp, Homo sapiens
tttagaccatttatc

SEQ ID NO: 2603615 - DNA, 22 bp, Homo sapiens
tttagaccctattgctgcttga

SEQ ID NO: 2603616 - DNA, 15 bp, Homo sapiens
tttagataatacacc

SEQ ID NO: 2603617 - DNA, 17 bp, Homo sapiens
tttagatcaaatacttt

SEQ ID NO: 2603618 - DNA, 22 bp, Homo sapiens
tttagattgaaaacttttctca

SEQ ID NO: 2603619 - DNA, 16 bp, Homo sapiens
tttagcataaaatttt

SEQ ID NO: 2603620 - DNA, 12 bp, Homo sapiens
tttagcatgtgt

SEQ ID NO: 2603621 - DNA, 18 bp, Homo sapiens
tttagccaaacccttgtc

SEQ ID NO: 2603622 - DNA, 17 bp, Homo sapiens
tttaggagattttaggt

SEQ ID NO: 2603623 - DNA, 16 bp, Homo sapiens
tttagggccaggcagg

SEQ ID NO: 2603624 - DNA, 22 bp, Homo sapiens
tttaggtcaagaagaagatgga

SEQ ID NO: 2603625 - DNA, 22 bp, Homo sapiens
tttaggtgttgattttctgttg

SEQ ID NO: 2603626 - DNA, 19 bp, Homo sapiens
tttagtgatcacagcagct

SEQ ID NO: 2603627 - DNA, 13 bp, Homo sapiens
tttagtggcttca

SEQ ID NO: 2603628 - DNA, 14 bp, Homo sapiens
tttagttatagttt

SEQ ID NO: 2603629 - DNA, 19 bp, Homo sapiens
tttagttgcagactcagtt

SEQ ID NO: 2603630 - DNA, 15 bp, Homo sapiens
tttagtttttgttct

SEQ ID NO: 2603631 - DNA, 16 bp, Homo sapiens
tttagtttttgttctt

SEQ ID NO: 2603632 - DNA, 16 bp, Homo sapiens
tttataaactttacct

SEQ ID NO: 2603633 - DNA, 15 bp, Homo sapiens
tttataaatcgcttt

SEQ ID NO: 2603634 - DNA, 22 bp, Homo sapiens
tttataaatcgcttttgataat

SEQ ID NO: 2603635 - DNA, 13 bp, Homo sapiens
tttataaatgcta

SEQ ID NO: 2603636 - DNA, 14 bp, Homo sapiens
tttataaatgctat

SEQ ID NO: 2603637 - DNA, 19 bp, Homo sapiens
tttataactagtcctttac

SEQ ID NO: 2603638 - DNA, 16 bp, Homo sapiens
tttataactcatcata

SEQ ID NO: 2603639 - DNA, 18 bp, Homo sapiens
tttataactcatcataaa

SEQ ID NO: 2603640 - DNA, 20 bp, Homo sapiens
tttataactcatcataaaat

SEQ ID NO: 2603641 - DNA, 20 bp, Homo sapiens
tttataagcagatttaacaa

SEQ ID NO: 2603642 - DNA, 13 bp, Homo sapiens
tttataaggtttt

SEQ ID NO: 2603643 - DNA, 16 bp, Homo sapiens
tttatacaacagtgct

SEQ ID NO: 2603644 - DNA, 16 bp, Homo sapiens
tttatacgtgtagcta

SEQ ID NO: 2603645 - DNA, 17 bp, Homo sapiens
tttatacgtgtagctat

SEQ ID NO: 2603646 - DNA, 13 bp, Homo sapiens
tttatactgtata

SEQ ID NO: 2603647 - DNA, 16 bp, Homo sapiens
tttatagctcagttta

SEQ ID NO: 2603648 - DNA, 19 bp, Homo sapiens
tttatagtttgtacatgca

SEQ ID NO: 2603649 - DNA, 23 bp, Homo sapiens
tttatatattggtaacatccttt

SEQ ID NO: 2603650 - DNA, 12 bp, Homo sapiens
tttatatattta

SEQ ID NO: 2603651 - DNA, 13 bp, Homo sapiens
tttatatatttat

SEQ ID NO: 2603652 - DNA, 15 bp, Homo sapiens
tttatatcacatgtt

SEQ ID NO: 2603653 - DNA, 17 bp, Homo sapiens
tttatatcagcctgagt

SEQ ID NO: 2603654 - DNA, 14 bp, Homo sapiens
tttatatgaagaaa

SEQ ID NO: 2603655 - DNA, 23 bp, Homo sapiens
tttatatggatgattcagaaatt

SEQ ID NO: 2603656 - DNA, 17 bp, Homo sapiens
tttatcacacttctgtg

SEQ ID NO: 2603657 - DNA, 18 bp, Homo sapiens
tttatcacatgtatgttt

SEQ ID NO: 2603658 - DNA, 23 bp, Homo sapiens
tttatcatgacatgttatatatt

SEQ ID NO: 2603659 - DNA, 23 bp, Homo sapiens
tttatcatgcatgtcctgtaaag

SEQ ID NO: 2603660 - DNA, 15 bp, Homo sapiens
tttatcattcaagtg

SEQ ID NO: 2603661 - DNA, 18 bp, Homo sapiens
tttatcctgaaatttcag

SEQ ID NO: 2603662 - DNA, 13 bp, Homo sapiens
tttatctgttctt

SEQ ID NO: 2603663 - DNA, 13 bp, Homo sapiens
tttatgaaaagag

SEQ ID NO: 2603664 - DNA, 19 bp, Homo sapiens
tttatgaaaggtttacatt

SEQ ID NO: 2603665 - DNA, 18 bp, Homo sapiens
tttatgaagaaaaaatac

SEQ ID NO: 2603666 - DNA, 20 bp, Homo sapiens
tttatgaatgaaaaaacagt

SEQ ID NO: 2603667 - DNA, 16 bp, Homo sapiens
tttatgaattaaagta

SEQ ID NO: 2603668 - DNA, 20 bp, Homo sapiens
tttatgacttcattaataat

SEQ ID NO: 2603669 - DNA, 21 bp, Homo sapiens
tttattaataaacattctatc

SEQ ID NO: 2603670 - DNA, 12 bp, Homo sapiens
tttattaatgca

SEQ ID NO: 2603671 - DNA, 16 bp, Homo sapiens
tttattacatctttca

SEQ ID NO: 2603672 - DNA, 13 bp, Homo sapiens
tttattatggcac

SEQ ID NO: 2603673 - DNA, 17 bp, Homo sapiens
tttattcaagttattgt

SEQ ID NO: 2603674 - DNA, 19 bp, Homo sapiens
tttattcagcttcatttgt

SEQ ID NO: 2603675 - DNA, 21 bp, Homo sapiens
tttattcagcttcatttgtgt

SEQ ID NO: 2603676 - DNA, 22 bp, Homo sapiens
tttattcctatatagtttattg

SEQ ID NO: 2603677 - DNA, 16 bp, Homo sapiens
tttattggctgagata

SEQ ID NO: 2603678 - DNA, 13 bp, Homo sapiens
tttattgtgatct

SEQ ID NO: 2603679 - DNA, 17 bp, Homo sapiens
tttattgtgtttttaat

SEQ ID NO: 2603680 - DNA, 17 bp, Homo sapiens
tttatttaaaagattca

SEQ ID NO: 2603681 - DNA, 22 bp, Homo sapiens
tttatttaaaagattcattttt

SEQ ID NO: 2603682 - DNA, 17 bp, Homo sapiens
tttatttatacactgtc

SEQ ID NO: 2603683 - DNA, 15 bp, Homo sapiens
tttatttattttatc

SEQ ID NO: 2603684 - DNA, 16 bp, Homo sapiens
tttattttcctcccca

SEQ ID NO: 2603685 - DNA, 16 bp, Homo sapiens
tttatttttcatattg

SEQ ID NO: 2603686 - DNA, 17 bp, Homo sapiens
tttattttttaagtatt

SEQ ID NO: 2603687 - DNA, 14 bp, Homo sapiens
tttatttttttcta

SEQ ID NO: 2603688 - DNA, 15 bp, Homo sapiens
tttcaaaaaaataaa

SEQ ID NO: 2603689 - DNA, 18 bp, Homo sapiens
tttcaaaaatataactta

SEQ ID NO: 2603690 - DNA, 23 bp, Homo sapiens
tttcaaaacacatctttcctgtc

SEQ ID NO: 2603691 - DNA, 17 bp, Homo sapiens
tttcaaacacaaatgca

SEQ ID NO: 2603692 - DNA, 14 bp, Homo sapiens
tttcaaagaaggaa

SEQ ID NO: 2603693 - DNA, 16 bp, Homo sapiens
tttcaaagattcaaaa

SEQ ID NO: 2603694 - DNA, 17 bp, Homo sapiens
tttcaaagctttttcca

SEQ ID NO: 2603695 - DNA, 14 bp, Homo sapiens
tttcaaattgtatc

SEQ ID NO: 2603696 - DNA, 19 bp, Homo sapiens
tttcaagaaactgaggaat

SEQ ID NO: 2603697 - DNA, 23 bp, Homo sapiens
tttcaagaataatcacgctttcc

SEQ ID NO: 2603698 - DNA, 13 bp, Homo sapiens
tttcaatgtgatt

SEQ ID NO: 2603699 - DNA, 13 bp, Homo sapiens
tttcaattaaacg

SEQ ID NO: 2603700 - DNA, 15 bp, Homo sapiens
tttcaattaaacgga

SEQ ID NO: 2603701 - DNA, 22 bp, Homo sapiens
tttcaattccacctgcaatcaa

SEQ ID NO: 2603702 - DNA, 17 bp, Homo sapiens
tttcaattttgcatgct

SEQ ID NO: 2603703 - DNA, 12 bp, Homo sapiens
tttcacaaataa

SEQ ID NO: 2603704 - DNA, 13 bp, Homo sapiens
tttcacagctcct

SEQ ID NO: 2603705 - DNA, 19 bp, Homo sapiens
tttcacagtgtgtttgtga

SEQ ID NO: 2603706 - DNA, 14 bp, Homo sapiens
tttcacatagatgt

SEQ ID NO: 2603707 - DNA, 15 bp, Homo sapiens
tttcacattaatatt

SEQ ID NO: 2603708 - DNA, 15 bp, Homo sapiens
tttcaccacattcgt

SEQ ID NO: 2603709 - DNA, 22 bp, Homo sapiens
tttcaccccacccttcccctcc

SEQ ID NO: 2603710 - DNA, 18 bp, Homo sapiens
tttcacctgtaaacctga

SEQ ID NO: 2603711 - DNA, 22 bp, Homo sapiens
tttcacctgtttttaagctgtt

SEQ ID NO: 2603712 - DNA, 15 bp, Homo sapiens
tttcacgggagattt

SEQ ID NO: 2603713 - DNA, 19 bp, Homo sapiens
tttcactatttttatttat

SEQ ID NO: 2603714 - DNA, 17 bp, Homo sapiens
tttcactccctccatca

SEQ ID NO: 2603715 - DNA, 13 bp, Homo sapiens
tttcactgccata

SEQ ID NO: 2603716 - DNA, 18 bp, Homo sapiens
tttcactggagttacatt

SEQ ID NO: 2603717 - DNA, 19 bp, Homo sapiens
tttcactggagttacatta

SEQ ID NO: 2603718 - DNA, 17 bp, Homo sapiens
tttcactttagatgctg

SEQ ID NO: 2603719 - DNA, 17 bp, Homo sapiens
tttcactttgtgattat

SEQ ID NO: 2603720 - DNA, 12 bp, Homo sapiens
tttcagaaatgt

SEQ ID NO: 2603721 - DNA, 20 bp, Homo sapiens
tttcagatgcttctgggaga

SEQ ID NO: 2603722 - DNA, 15 bp, Homo sapiens
tttcagatgtcttct

SEQ ID NO: 2603723 - DNA, 20 bp, Homo sapiens
tttcagatgtcttctgcctg

SEQ ID NO: 2603724 - DNA, 17 bp, Homo sapiens
tttcagcgatgtatgca

SEQ ID NO: 2603725 - DNA, 22 bp, Homo sapiens
tttcagcgatgtatgcagctat

SEQ ID NO: 2603726 - DNA, 19 bp, Homo sapiens
tttcaggatactctgtcag

SEQ ID NO: 2603727 - DNA, 20 bp, Homo sapiens
tttcaggatactctgtcaga

SEQ ID NO: 2603728 - DNA, 21 bp, Homo sapiens
tttcaggatactctgtcagat

SEQ ID NO: 2603729 - DNA, 22 bp, Homo sapiens
tttcagggaggtggctgggttt

SEQ ID NO: 2603730 - DNA, 22 bp, Homo sapiens
tttcaggtgacatgtgaaacct

SEQ ID NO: 2603731 - DNA, 21 bp, Homo sapiens
tttcagtggggcagtcattat

SEQ ID NO: 2603732 - DNA, 14 bp, Homo sapiens
tttcagtgtacatg

SEQ ID NO: 2603733 - DNA, 15 bp, Homo sapiens
tttcatatgttgctc

SEQ ID NO: 2603734 - DNA, 14 bp, Homo sapiens
tttcatattgtgcc

SEQ ID NO: 2603735 - DNA, 16 bp, Homo sapiens
tttcatctatttctga

SEQ ID NO: 2603736 - DNA, 16 bp, Homo sapiens
tttcatctcttgtata

SEQ ID NO: 2603737 - DNA, 20 bp, Homo sapiens
tttcatggtgaaaatgtact

SEQ ID NO: 2603738 - DNA, 21 bp, Homo sapiens
tttcatggtgaaaatgtactg

SEQ ID NO: 2603739 - DNA, 22 bp, Homo sapiens
tttcatggtgaaaatgtactga

SEQ ID NO: 2603740 - DNA, 16 bp, Homo sapiens
tttcatgttttgtgac

SEQ ID NO: 2603741 - DNA, 17 bp, Homo sapiens
tttcatgttttgtgact

SEQ ID NO: 2603742 - DNA, 13 bp, Homo sapiens
tttcattaaagca

SEQ ID NO: 2603743 - DNA, 20 bp, Homo sapiens
tttcattatgtaaaatgttt

SEQ ID NO: 2603744 - DNA, 16 bp, Homo sapiens
tttcattgtatgatgt

SEQ ID NO: 2603745 - DNA, 12 bp, Homo sapiens
tttcatttcttg

SEQ ID NO: 2603746 - DNA, 18 bp, Homo sapiens
tttccaaaagtggcctct

SEQ ID NO: 2603747 - DNA, 21 bp, Homo sapiens
tttccaacaccacagacacac

SEQ ID NO: 2603748 - DNA, 19 bp, Homo sapiens
tttccaggtttaagctgtt

SEQ ID NO: 2603749 - DNA, 19 bp, Homo sapiens
tttccagtgagcttatcat

SEQ ID NO: 2603750 - DNA, 17 bp, Homo sapiens
tttccatgagtcccctg

SEQ ID NO: 2603751 - DNA, 18 bp, Homo sapiens
tttccatgagtcccctgt

SEQ ID NO: 2603752 - DNA, 14 bp, Homo sapiens
tttccattccagaa

SEQ ID NO: 2603753 - DNA, 12 bp, Homo sapiens
tttcccaattca

SEQ ID NO: 2603754 - DNA, 23 bp, Homo sapiens
tttcccacaccgtgtaaaccaaa

SEQ ID NO: 2603755 - DNA, 12 bp, Homo sapiens
tttcccataatt

SEQ ID NO: 2603756 - DNA, 14 bp, Homo sapiens
tttcccataatttt

SEQ ID NO: 2603757 - DNA, 14 bp, Homo sapiens
tttccccaacagtg

SEQ ID NO: 2603758 - DNA, 18 bp, Homo sapiens
tttccccaacagtgtgaa

SEQ ID NO: 2603759 - DNA, 19 bp, Homo sapiens
tttccccccactctcccca

SEQ ID NO: 2603760 - DNA, 16 bp, Homo sapiens
tttcccccttctacat

SEQ ID NO: 2603761 - DNA, 16 bp, Homo sapiens
tttcccctccctgggt

SEQ ID NO: 2603762 - DNA, 14 bp, Homo sapiens
tttcccctgtcctg

SEQ ID NO: 2603763 - DNA, 23 bp, Homo sapiens
tttcccctgtcctgatggtcagc

SEQ ID NO: 2603764 - DNA, 16 bp, Homo sapiens
tttccctattagagaa

SEQ ID NO: 2603765 - DNA, 22 bp, Homo sapiens
tttccctgcttaatgaaaagct

SEQ ID NO: 2603766 - DNA, 13 bp, Homo sapiens
tttccctgtgctg

SEQ ID NO: 2603767 - DNA, 16 bp, Homo sapiens
tttcccttcagtaccc

SEQ ID NO: 2603768 - DNA, 15 bp, Homo sapiens
tttcctaaatgcagt

SEQ ID NO: 2603769 - DNA, 14 bp, Homo sapiens
tttcctaaatgttt

SEQ ID NO: 2603770 - DNA, 17 bp, Homo sapiens
tttcctagccctctcac

SEQ ID NO: 2603771 - DNA, 23 bp, Homo sapiens
tttcctagccctctcacatttat

SEQ ID NO: 2603772 - DNA, 22 bp, Homo sapiens
tttcctcaaaacttcagacata

SEQ ID NO: 2603773 - DNA, 12 bp, Homo sapiens
tttcctcatctg

SEQ ID NO: 2603774 - DNA, 14 bp, Homo sapiens
tttcctcatctgtc

SEQ ID NO: 2603775 - DNA, 19 bp, Homo sapiens
tttcctcattcctgaaaga

SEQ ID NO: 2603776 - DNA, 12 bp, Homo sapiens
tttcctccccag

SEQ ID NO: 2603777 - DNA, 15 bp, Homo sapiens
tttcctcccttgggt

SEQ ID NO: 2603778 - DNA, 21 bp, Homo sapiens
tttcctctttggtctacactg

SEQ ID NO: 2603779 - DNA, 20 bp, Homo sapiens
tttcctggacactcagacct

SEQ ID NO: 2603780 - DNA, 20 bp, Homo sapiens
tttcctggacatcctcttct

SEQ ID NO: 2603781 - DNA, 16 bp, Homo sapiens
tttcctggtgccaatt

SEQ ID NO: 2603782 - DNA, 23 bp, Homo sapiens
tttccttaaactgtgtggactgt

SEQ ID NO: 2603783 - DNA, 15 bp, Homo sapiens
tttccttccatccct

SEQ ID NO: 2603784 - DNA, 15 bp, Homo sapiens
tttccttctcatctg

SEQ ID NO: 2603785 - DNA, 19 bp, Homo sapiens
tttcctttatatttagtga

SEQ ID NO: 2603786 - DNA, 12 bp, Homo sapiens
tttcctttggag

SEQ ID NO: 2603787 - DNA, 21 bp, Homo sapiens
tttccttttaaaacacttcca

SEQ ID NO: 2603788 - DNA, 15 bp, Homo sapiens
tttccttttttaaaa

SEQ ID NO: 2603789 - DNA, 17 bp, Homo sapiens
tttccttttttgttatt

SEQ ID NO: 2603790 - DNA, 18 bp, Homo sapiens
tttctaaaggctaccttt

SEQ ID NO: 2603791 - DNA, 20 bp, Homo sapiens
tttctaaaggctacctttgt

SEQ ID NO: 2603792 - DNA, 13 bp, Homo sapiens
tttctaaatgttt

SEQ ID NO: 2603793 - DNA, 15 bp, Homo sapiens
tttctaatgtgtgaa

SEQ ID NO: 2603794 - DNA, 20 bp, Homo sapiens
tttctaccctagccattcct

SEQ ID NO: 2603795 - DNA, 13 bp, Homo sapiens
tttctacctccca

SEQ ID NO: 2603796 - DNA, 15 bp, Homo sapiens
tttctacctcccaga

SEQ ID NO: 2603797 - DNA, 17 bp, Homo sapiens
tttctactctgaactaa

SEQ ID NO: 2603798 - DNA, 18 bp, Homo sapiens
tttctactttgaagtcat

SEQ ID NO: 2603799 - DNA, 22 bp, Homo sapiens
tttctactttgaagtcatacca

SEQ ID NO: 2603800 - DNA, 22 bp, Homo sapiens
tttctagaacatccctgccagc

SEQ ID NO: 2603801 - DNA, 21 bp, Homo sapiens
tttctaggaagaattttaaaa

SEQ ID NO: 2603802 - DNA, 22 bp, Homo sapiens
tttctaggaagaattttaaaaa

SEQ ID NO: 2603803 - DNA, 14 bp, Homo sapiens
tttctagggaaatg

SEQ ID NO: 2603804 - DNA, 15 bp, Homo sapiens
tttttggaggtgctt

SEQ ID NO: 2603805 - DNA, 20 bp, Homo sapiens
tttttggaggtgcttaagca

SEQ ID NO: 2603806 - DNA, 16 bp, Homo sapiens
tttttggggatatgct

SEQ ID NO: 2603807 - DNA, 16 bp, Homo sapiens
tttttgtaaagtgtgg

SEQ ID NO: 2603808 - DNA, 13 bp, Homo sapiens
tttttgtaattta

SEQ ID NO: 2603809 - DNA, 18 bp, Homo sapiens
tttttgtacagtttgctg

SEQ ID NO: 2603810 - DNA, 19 bp, Homo sapiens
tttttgtagagccagggtc

SEQ ID NO: 2603811 - DNA, 12 bp, Homo sapiens
ttttttaagatt

SEQ ID NO: 2603812 - DNA, 16 bp, Homo sapiens
ttttttagatcaaata

SEQ ID NO: 2603813 - DNA, 18 bp, Homo sapiens
ttttttcaatatttatta

SEQ ID NO: 2603814 - DNA, 12 bp, Homo sapiens
ttttttcatctt

SEQ ID NO: 2603815 - DNA, 11 bp, Homo sapiens
ttttttctgag

SEQ ID NO: 2603816 - DNA, 12 bp, Homo sapiens
ttttttttaaga

SEQ ID NO: 2603817 - DNA, 21 bp, Homo sapiens
tcctggcacccggcccctgct

SEQ ID NO: 2603818 - DNA, 16 bp, Homo sapiens
tcctggcactgcttcc

SEQ ID NO: 2603819 - DNA, 13 bp, Homo sapiens
tcctggctcctga

SEQ ID NO: 2603820 - DNA, 14 bp, Homo sapiens
tcctgggaaatatt

SEQ ID NO: 2603821 - DNA, 21 bp, Homo sapiens
tcctgggaaatattccctaga

SEQ ID NO: 2603822 - DNA, 19 bp, Homo sapiens
tcctgggagaacctcaggc

SEQ ID NO: 2603823 - DNA, 20 bp, Homo sapiens
tcctgggagaacctcaggct

SEQ ID NO: 2603824 - DNA, 18 bp, Homo sapiens
tcctgggatgtggctgca

SEQ ID NO: 2603825 - DNA, 16 bp, Homo sapiens
tcctgggccctctctg

SEQ ID NO: 2603826 - DNA, 13 bp, Homo sapiens
tcctggggcctcg

SEQ ID NO: 2603827 - DNA, 14 bp, Homo sapiens
tcctggggctccct

SEQ ID NO: 2603828 - DNA, 15 bp, Homo sapiens
tcctggggctctgtg

SEQ ID NO: 2603829 - DNA, 18 bp, Homo sapiens
tcctggggctctgtgcag

SEQ ID NO: 2603830 - DNA, 19 bp, Homo sapiens
tcctgggtggtctgcaggc

SEQ ID NO: 2603831 - DNA, 22 bp, Homo sapiens
tcctgggtggtctgcaggcagg

SEQ ID NO: 2603832 - DNA, 17 bp, Homo sapiens
tcctgggttttgtattc

SEQ ID NO: 2603833 - DNA, 20 bp, Homo sapiens
tcctgggttttgtattctct

SEQ ID NO: 2603834 - DNA, 22 bp, Homo sapiens
tcctggtgggtccaggggcccc

SEQ ID NO: 2603835 - DNA, 14 bp, Homo sapiens
tcctggtgtcactt

SEQ ID NO: 2603836 - DNA, 15 bp, Homo sapiens
tcctggttcccgttt

SEQ ID NO: 2603837 - DNA, 19 bp, Homo sapiens
tcctgtaaaggttacaagc

SEQ ID NO: 2603838 - DNA, 22 bp, Homo sapiens
tcctgtagcatcttctggagtc

SEQ ID NO: 2603839 - DNA, 22 bp, Homo sapiens
tcctgtagttgcgtggactctg

SEQ ID NO: 2603840 - DNA, 21 bp, Homo sapiens
tcctgtcccttctcttaattt

SEQ ID NO: 2603841 - DNA, 15 bp, Homo sapiens
tcctgtctaactgct

SEQ ID NO: 2603842 - DNA, 14 bp, Homo sapiens
tcctgtcttcccag

SEQ ID NO: 2603843 - DNA, 15 bp, Homo sapiens
tcctgtcttcccagg

SEQ ID NO: 2603844 - DNA, 16 bp, Homo sapiens
tcctgtcttcccaggg

SEQ ID NO: 2603845 - DNA, 19 bp, Homo sapiens
tcctgtctttaaggaaaaa

SEQ ID NO: 2603846 - DNA, 15 bp, Homo sapiens
tcctgtctttctgag

SEQ ID NO: 2603847 - DNA, 16 bp, Homo sapiens
tcctgtgcatgggtga

SEQ ID NO: 2603848 - DNA, 16 bp, Homo sapiens
tcctgtggcaggcagc

SEQ ID NO: 2603849 - DNA, 23 bp, Homo sapiens
tcctgtgtcttgcaatggcagcc

SEQ ID NO: 2603850 - DNA, 15 bp, Homo sapiens
tcctgtgtgcagtga

SEQ ID NO: 2603851 - DNA, 12 bp, Homo sapiens
tcctgtgtttct

SEQ ID NO: 2603852 - DNA, 19 bp, Homo sapiens
tcctgttcttaagacgtga

SEQ ID NO: 2603853 - DNA, 16 bp, Homo sapiens
tcctgttgcacccagc

SEQ ID NO: 2603854 - DNA, 20 bp, Homo sapiens
tcctgttgcacccagccctg

SEQ ID NO: 2603855 - DNA, 21 bp, Homo sapiens
tcctgttggatttgtttaaaa

SEQ ID NO: 2603856 - DNA, 16 bp, Homo sapiens
tcctgtttttctgggt

SEQ ID NO: 2603857 - DNA, 17 bp, Homo sapiens
tcctgtttttctgggtg

SEQ ID NO: 2603858 - DNA, 14 bp, Homo sapiens
tccttaaactgtgt

SEQ ID NO: 2603859 - DNA, 22 bp, Homo sapiens
tccttaaaggcaccatctaata

SEQ ID NO: 2603860 - DNA, 23 bp, Homo sapiens
tccattgtttgaaacaaagaagg

SEQ ID NO: 2603861 - DNA, 19 bp, Homo sapiens
tccattgtttggagacatt

SEQ ID NO: 2603862 - DNA, 20 bp, Homo sapiens
tccatttagttctttgttat

SEQ ID NO: 2603863 - DNA, 20 bp, Homo sapiens
tccatttcgcccctcattta

SEQ ID NO: 2603864 - DNA, 14 bp, Homo sapiens
tccatttgaaagaa

SEQ ID NO: 2603865 - DNA, 12 bp, Homo sapiens
tccatttgcaag

SEQ ID NO: 2603866 - DNA, 15 bp, Homo sapiens
tccatttgcaaggga

SEQ ID NO: 2603867 - DNA, 14 bp, Homo sapiens
tccatttgtgtgtg

SEQ ID NO: 2603868 - DNA, 16 bp, Homo sapiens
tcccaaatttcatacc

SEQ ID NO: 2603869 - DNA, 23 bp, Homo sapiens
tcccaacaggaggacaattcatg

SEQ ID NO: 2603870 - DNA, 15 bp, Homo sapiens
tcccaactcacccca

SEQ ID NO: 2603871 - DNA, 21 bp, Homo sapiens
tcccaactcaccccagcccca

SEQ ID NO: 2603872 - DNA, 18 bp, Homo sapiens
tcccaagatctgtgcagc

SEQ ID NO: 2603873 - DNA, 12 bp, Homo sapiens
tcccaagctctg

SEQ ID NO: 2603874 - DNA, 12 bp, Homo sapiens
tcccaagctggg

SEQ ID NO: 2603875 - DNA, 16 bp, Homo sapiens
tcccaagctgggcccc

SEQ ID NO: 2603876 - DNA, 17 bp, Homo sapiens
tcccaagctgggcccca

SEQ ID NO: 2603877 - DNA, 21 bp, Homo sapiens
tcccaagctgggccccagccc

SEQ ID NO: 2603878 - DNA, 18 bp, Homo sapiens
tcccaaggaaagccccag

SEQ ID NO: 2603879 - DNA, 22 bp, Homo sapiens
tcccaaggctctgagcaaatgt

SEQ ID NO: 2603880 - DNA, 21 bp, Homo sapiens
tcccaagggatggtgccctgt

SEQ ID NO: 2603881 - DNA, 12 bp, Homo sapiens
tcccaagtggtg

SEQ ID NO: 2603882 - DNA, 18 bp, Homo sapiens
tcccaagtggtgcctaaa

SEQ ID NO: 2603883 - DNA, 22 bp, Homo sapiens
tcccaatagcaacgtagcttct

SEQ ID NO: 2603884 - DNA, 14 bp, Homo sapiens
tcccaattaggaag

SEQ ID NO: 2603885 - DNA, 15 bp, Homo sapiens
tcccaattcacatct

SEQ ID NO: 2603886 - DNA, 22 bp, Homo sapiens
tcccacaatcttaaggggcagc

SEQ ID NO: 2603887 - DNA, 23 bp, Homo sapiens
tcccacaatcttaaggggcagct

SEQ ID NO: 2603888 - DNA, 16 bp, Homo sapiens
tcccacacctccacag

SEQ ID NO: 2603889 - DNA, 22 bp, Homo sapiens
tcccacactgctaggtgggcca

SEQ ID NO: 2603890 - DNA, 13 bp, Homo sapiens
tcccacagcgctg

SEQ ID NO: 2603891 - DNA, 21 bp, Homo sapiens
tcccacaggacatttctctaa

SEQ ID NO: 2603892 - DNA, 15 bp, Homo sapiens
tcccacaggcagctt

SEQ ID NO: 2603893 - DNA, 18 bp, Homo sapiens
tcccaccaaggtcttcag

SEQ ID NO: 2603894 - DNA, 17 bp, Homo sapiens
tcccaccacagcaggtg

SEQ ID NO: 2603895 - DNA, 15 bp, Homo sapiens
tcccaccaccctgag

SEQ ID NO: 2603896 - DNA, 22 bp, Homo sapiens
tcccaccaggctgctcagggct

SEQ ID NO: 2603897 - DNA, 18 bp, Homo sapiens
tcccacccacatgtgaca

SEQ ID NO: 2603898 - DNA, 14 bp, Homo sapiens
tcccaccccacaca

SEQ ID NO: 2603899 - DNA, 20 bp, Homo sapiens
tcccaccccattttctgtgg

SEQ ID NO: 2603900 - DNA, 20 bp, Homo sapiens
tcccacccccacccccagct

SEQ ID NO: 2603901 - DNA, 19 bp, Homo sapiens
tcccacccccttctctgct

SEQ ID NO: 2603902 - DNA, 22 bp, Homo sapiens
tcccacccccttctctgctcca

SEQ ID NO: 2603903 - DNA, 14 bp, Homo sapiens
tcccacctctctca

SEQ ID NO: 2603904 - DNA, 17 bp, Homo sapiens
tcccacctctctcactc

SEQ ID NO: 2603905 - DNA, 22 bp, Homo sapiens
tcccacctctctcactccttga

SEQ ID NO: 2603906 - DNA, 13 bp, Homo sapiens
tcccaccttggct

SEQ ID NO: 2603907 - DNA, 18 bp, Homo sapiens
tcccaccttggctgcagg

SEQ ID NO: 2603908 - DNA, 21 bp, Homo sapiens
tcccaccttggctgcagggag

SEQ ID NO: 2603909 - DNA, 15 bp, Homo sapiens
tcccacgaatttgct

SEQ ID NO: 2603910 - DNA, 20 bp, Homo sapiens
tcccacgcactccatgagca

SEQ ID NO: 2603911 - DNA, 14 bp, Homo sapiens
tcccactatctggg

SEQ ID NO: 2603912 - DNA, 14 bp, Homo sapiens
tcccactgcctcag

SEQ ID NO: 2603913 - DNA, 22 bp, Homo sapiens
tcccactggggtccagggagca

SEQ ID NO: 2603914 - DNA, 22 bp, Homo sapiens
tcccagaatcaaagcaatgcat

SEQ ID NO: 2603915 - DNA, 18 bp, Homo sapiens
tcccagacacccaccctc

SEQ ID NO: 2603916 - DNA, 17 bp, Homo sapiens
tcccagagcaggaggcc

SEQ ID NO: 2603917 - DNA, 21 bp, Homo sapiens
tcccagagcaggaggcccctg

SEQ ID NO: 2603918 - DNA, 15 bp, Homo sapiens
tcccagagtgctggg

SEQ ID NO: 2603919 - DNA, 16 bp, Homo sapiens
tcccagataatgtgaa

SEQ ID NO: 2603920 - DNA, 17 bp, Homo sapiens
tcccagatcggatctgt

SEQ ID NO: 2603921 - DNA, 16 bp, Homo sapiens
tcccagcactttggga

SEQ ID NO: 2603922 - DNA, 18 bp, Homo sapiens
tcctactcccagacaccc

SEQ ID NO: 2603923 - DNA, 12 bp, Homo sapiens
tcctactctgtg

SEQ ID NO: 2603924 - DNA, 15 bp, Homo sapiens
tcctactctgtgtca

SEQ ID NO: 2603925 - DNA, 19 bp, Homo sapiens
tcctagaagttactgaatg

SEQ ID NO: 2603926 - DNA, 21 bp, Homo sapiens
tcctagaagttactgaatgca

SEQ ID NO: 2603927 - DNA, 19 bp, Homo sapiens
tcctagagacagaagcagg

SEQ ID NO: 2603928 - DNA, 12 bp, Homo sapiens
tcctagcagaga

SEQ ID NO: 2603929 - DNA, 21 bp, Homo sapiens
tcctagcctgtgcctctggga

SEQ ID NO: 2603930 - DNA, 14 bp, Homo sapiens
tcctagctgcacag

SEQ ID NO: 2603931 - DNA, 22 bp, Homo sapiens
tcctagcttgggaggcttcccc

SEQ ID NO: 2603932 - DNA, 22 bp, Homo sapiens
tcctaggctccaccccatccag

SEQ ID NO: 2603933 - DNA, 20 bp, Homo sapiens
tcctagggaaaagttcatag

SEQ ID NO: 2603934 - DNA, 19 bp, Homo sapiens
tcctagggaagggtggtgg

SEQ ID NO: 2603935 - DNA, 23 bp, Homo sapiens
tcctagtgaaagaggcagcttga

SEQ ID NO: 2603936 - DNA, 22 bp, Homo sapiens
tcctagtgctttccttttttaa

SEQ ID NO: 2603937 - DNA, 17 bp, Homo sapiens
tcctatcagaagtttct

SEQ ID NO: 2603938 - DNA, 22 bp, Homo sapiens
tcctatggctggccactgcaca

SEQ ID NO: 2603939 - DNA, 22 bp, Homo sapiens
tcctatgtgattttaactctgt

SEQ ID NO: 2603940 - DNA, 14 bp, Homo sapiens
tcctattcagttcc

SEQ ID NO: 2603941 - DNA, 16 bp, Homo sapiens
tcctattctcaccagg

SEQ ID NO: 2603942 - DNA, 18 bp, Homo sapiens
tcctattctcaccaggaa

SEQ ID NO: 2603943 - DNA, 16 bp, Homo sapiens
tcctattctcgggctg

SEQ ID NO: 2603944 - DNA, 22 bp, Homo sapiens
tcctattgtgatttgactgttt

SEQ ID NO: 2603945 - DNA, 15 bp, Homo sapiens
tcctatttcttatag

SEQ ID NO: 2603946 - DNA, 14 bp, Homo sapiens
tcctcaaacactgc

SEQ ID NO: 2603947 - DNA, 15 bp, Homo sapiens
tcctcaaacactgca

SEQ ID NO: 2603948 - DNA, 15 bp, Homo sapiens
tcctcaaggggccat

SEQ ID NO: 2603949 - DNA, 18 bp, Homo sapiens
tcctcaaggggccatcct

SEQ ID NO: 2603950 - DNA, 14 bp, Homo sapiens
tcctcaatccagct

SEQ ID NO: 2603951 - DNA, 20 bp, Homo sapiens
tcctcacatctttcacactt

SEQ ID NO: 2603952 - DNA, 16 bp, Homo sapiens
tcctcacccccagctt

SEQ ID NO: 2603953 - DNA, 12 bp, Homo sapiens
tcctcacctctg

SEQ ID NO: 2603954 - DNA, 21 bp, Homo sapiens
tcctcactcccttcccataag

SEQ ID NO: 2603955 - DNA, 22 bp, Homo sapiens
tcctcactgggtggggtgagga

SEQ ID NO: 2603956 - DNA, 17 bp, Homo sapiens
tcctcagagaatttcta

SEQ ID NO: 2603957 - DNA, 14 bp, Homo sapiens
tcctcatccacccc

SEQ ID NO: 2603958 - DNA, 15 bp, Homo sapiens
tcctcatccacccca

SEQ ID NO: 2603959 - DNA, 18 bp, Homo sapiens
tcctcatccaccccatcc

SEQ ID NO: 2603960 - DNA, 19 bp, Homo sapiens
tcctcatctgggggagtgg

SEQ ID NO: 2603961 - DNA, 21 bp, Homo sapiens
tcctcatctgggggagtggaa

SEQ ID NO: 2603962 - DNA, 17 bp, Homo sapiens
tcctcattagcattttg

SEQ ID NO: 2603963 - DNA, 14 bp, Homo sapiens
tcctcattcctgaa

SEQ ID NO: 2603964 - DNA, 19 bp, Homo sapiens
tcctcatttggggtagcta

SEQ ID NO: 2603965 - DNA, 23 bp, Homo sapiens
tcctcatttggggtagctagagg

SEQ ID NO: 2603966 - DNA, 20 bp, Homo sapiens
tcctccaagacactgtggac

SEQ ID NO: 2603967 - DNA, 14 bp, Homo sapiens
tcctccaagccagc

SEQ ID NO: 2603968 - DNA, 23 bp, Homo sapiens
tcctccacgttctgctcatcatt

SEQ ID NO: 2603969 - DNA, 14 bp, Homo sapiens
tcctccagaagcct

SEQ ID NO: 2603970 - DNA, 10 bp, Homo sapiens
tcctccagct

SEQ ID NO: 2603971 - DNA, 13 bp, Homo sapiens
tcctccagcttct

SEQ ID NO: 2603972 - DNA, 21 bp, Homo sapiens
tcctccagggatgatcaacag

SEQ ID NO: 2603973 - DNA, 10 bp, Homo sapiens
tcctccaggt

SEQ ID NO: 2603974 - DNA, 14 bp, Homo sapiens
tcctccaggtgcac

SEQ ID NO: 2603975 - DNA, 20 bp, Homo sapiens
tcctccaggtgcacaagctc

SEQ ID NO: 2603976 - DNA, 11 bp, Homo sapiens
tcctccaggtt

SEQ ID NO: 2603977 - DNA, 12 bp, Homo sapiens
tcctccaggttt

SEQ ID NO: 2603978 - DNA, 15 bp, Homo sapiens
tcctccaggtttttc

SEQ ID NO: 2603979 - DNA, 18 bp, Homo sapiens
tcctccaggtttttcaat

SEQ ID NO: 2603980 - DNA, 16 bp, Homo sapiens
tcctccatctccaaga

SEQ ID NO: 2603981 - DNA, 19 bp, Homo sapiens
tcctccatctccaagaatg

SEQ ID NO: 2603982 - DNA, 12 bp, Homo sapiens
tcctcccacctc

SEQ ID NO: 2603983 - DNA, 14 bp, Homo sapiens
tcctcccacctcag

SEQ ID NO: 2603984 - DNA, 15 bp, Homo sapiens
tcctcccacctcagc

SEQ ID NO: 2603985 - DNA, 18 bp, Homo sapiens
tcctcccacctcagcctc

SEQ ID NO: 2603986 - DNA, 13 bp, Homo sapiens
tcctcccatcccc

SEQ ID NO: 2603987 - DNA, 18 bp, Homo sapiens
tcctcccatcccctggac

SEQ ID NO: 2603988 - DNA, 13 bp, Homo sapiens
tcctccccagcag

SEQ ID NO: 2603989 - DNA, 16 bp, Homo sapiens
tcctccccagcaggtg

SEQ ID NO: 2603990 - DNA, 18 bp, Homo sapiens
tcctccccttccctgcaa

SEQ ID NO: 2603991 - DNA, 14 bp, Homo sapiens
tcctcccgggccct

SEQ ID NO: 2603992 - DNA, 17 bp, Homo sapiens
tcctcccgggccctccc

SEQ ID NO: 2603993 - DNA, 17 bp, Homo sapiens
tcctccctggctgccct

SEQ ID NO: 2603994 - DNA, 21 bp, Homo sapiens
tcctccctggctgccctggcc

SEQ ID NO: 2603995 - DNA, 14 bp, Homo sapiens
tcctccgaggccag

SEQ ID NO: 2603996 - DNA, 11 bp, Homo sapiens
tcctcctctgt

SEQ ID NO: 2603997 - DNA, 13 bp, Homo sapiens
tcctcctggcaga

SEQ ID NO: 2603998 - DNA, 16 bp, Homo sapiens
tcctccttggtgcctg

SEQ ID NO: 2603999 - DNA, 17 bp, Homo sapiens
tcctcgagggcagggac

SEQ ID NO: 2604000 - DNA, 16 bp, Homo sapiens
tcctcgcagagaggcc

SEQ ID NO: 2604001 - DNA, 17 bp, Homo sapiens
tcctcgcagagaggcca

SEQ ID NO: 2604002 - DNA, 24 bp, Homo sapiens
tcctcgcagagaggccaggtgcag

SEQ ID NO: 2604003 - DNA, 20 bp, Homo sapiens
tcctctaagccactcttcca

SEQ ID NO: 2604004 - DNA, 21 bp, Homo sapiens
tcctctaagccactcttccaa

SEQ ID NO: 2604005 - DNA, 19 bp, Homo sapiens
tcctctacttaatgagata

SEQ ID NO: 2604006 - DNA, 21 bp, Homo sapiens
tcctctagctgtgggggtgag

SEQ ID NO: 2604007 - DNA, 14 bp, Homo sapiens
tcctctcagcccct

SEQ ID NO: 2604008 - DNA, 12 bp, Homo sapiens
tcctctccaggc

SEQ ID NO: 2604009 - DNA, 16 bp, Homo sapiens
tcctctcccatccccc

SEQ ID NO: 2604010 - DNA, 19 bp, Homo sapiens
tcctctcccatccccctgc

SEQ ID NO: 2604011 - DNA, 18 bp, Homo sapiens
tcctctgactcagggctc

SEQ ID NO: 2604012 - DNA, 17 bp, Homo sapiens
tcctctgatctccatgg

SEQ ID NO: 2604013 - DNA, 17 bp, Homo sapiens
tcctctgctgctggctg

SEQ ID NO: 2604014 - DNA, 23 bp, Homo sapiens
tcctctgtacagagcccacgccc

SEQ ID NO: 2604015 - DNA, 13 bp, Homo sapiens
tcctctgtccagg

SEQ ID NO: 2604016 - DNA, 16 bp, Homo sapiens
tcctctgtccagggcc

SEQ ID NO: 2604017 - DNA, 21 bp, Homo sapiens
tcctctgtgaccaatgtcttg

SEQ ID NO: 2604018 - DNA, 22 bp, Homo sapiens
tcctctgtttctccttctgaaa

SEQ ID NO: 2604019 - DNA, 16 bp, Homo sapiens
tcctcttcctctgagg

SEQ ID NO: 2604020 - DNA, 14 bp, Homo sapiens
tcctcttgctcaaa

SEQ ID NO: 2604021 - DNA, 19 bp, Homo sapiens
tcctctttggtctacactg

SEQ ID NO: 2604022 - DNA, 21 bp, Homo sapiens
tcctcttttatcttggactga

SEQ ID NO: 2604023 - DNA, 14 bp, Homo sapiens
tcctgaaatttcag

SEQ ID NO: 2604024 - DNA, 15 bp, Homo sapiens
tcctgaaatttcaga

SEQ ID NO: 2604025 - DNA, 16 bp, Homo sapiens
tcctgaacctgatgct

SEQ ID NO: 2604026 - DNA, 20 bp, Homo sapiens
tcctgaacctgatgctgact

SEQ ID NO: 2604027 - DNA, 20 bp, Homo sapiens
tcctgaagaggcgggccagc

SEQ ID NO: 2604028 - DNA, 13 bp, Homo sapiens
tcctgaccaccct

SEQ ID NO: 2604029 - DNA, 14 bp, Homo sapiens
tcctgaccaccctc

SEQ ID NO: 2604030 - DNA, 17 bp, Homo sapiens
tcctgacccaggccgca

SEQ ID NO: 2604031 - DNA, 17 bp, Homo sapiens
tcctgactctgccccct

SEQ ID NO: 2604032 - DNA, 19 bp, Homo sapiens
tcctgagaaaaaaggttcc

SEQ ID NO: 2604033 - DNA, 24 bp, Homo sapiens
tcctgagaaaaaaggttccgcttg

SEQ ID NO: 2604034 - DNA, 13 bp, Homo sapiens
tcctgaggctgag

SEQ ID NO: 2604035 - DNA, 12 bp, Homo sapiens
tcctgaggctgg

SEQ ID NO: 2604036 - DNA, 16 bp, Homo sapiens
tcctgaggggcatctg

SEQ ID NO: 2604037 - DNA, 19 bp, Homo sapiens
tcctgagtagctggattac

SEQ ID NO: 2604038 - DNA, 15 bp, Homo sapiens
tcctgatcagagccg

SEQ ID NO: 2604039 - DNA, 19 bp, Homo sapiens
tcctgatgcttcttcagag

SEQ ID NO: 2604040 - DNA, 17 bp, Homo sapiens
tcctgatggtcagctcc

SEQ ID NO: 2604041 - DNA, 18 bp, Homo sapiens
tcctgatggtcagctccc

SEQ ID NO: 2604042 - DNA, 20 bp, Homo sapiens
tcctgatggtcagctccctt

SEQ ID NO: 2604043 - DNA, 15 bp, Homo sapiens
tcctgcaatgaagtc

SEQ ID NO: 2604044 - DNA, 21 bp, Homo sapiens
tcctgcaatgaagtctctgaa

SEQ ID NO: 2604045 - DNA, 14 bp, Homo sapiens
tcctgcaggccagg

SEQ ID NO: 2604046 - DNA, 22 bp, Homo sapiens
tcctgcagggccagacctgcct

SEQ ID NO: 2604047 - DNA, 16 bp, Homo sapiens
tcctgcattcacccag

SEQ ID NO: 2604048 - DNA, 22 bp, Homo sapiens
tcctgcattcacccagacagct

SEQ ID NO: 2604049 - DNA, 16 bp, Homo sapiens
tcctgccaccagtcac

SEQ ID NO: 2604050 - DNA, 22 bp, Homo sapiens
tcctgccaccagtcactgtccc

SEQ ID NO: 2604051 - DNA, 17 bp, Homo sapiens
tcctgccagtgtggaac

SEQ ID NO: 2604052 - DNA, 19 bp, Homo sapiens
tcctgccccctgaaactta

SEQ ID NO: 2604053 - DNA, 22 bp, Homo sapiens
tcctgccccctgaaacttattt

SEQ ID NO: 2604054 - DNA, 23 bp, Homo sapiens
tcctgccctacagaggtctctgc

SEQ ID NO: 2604055 - DNA, 14 bp, Homo sapiens
tcctgccgactcct

SEQ ID NO: 2604056 - DNA, 16 bp, Homo sapiens
tcctgccgactcctgg

SEQ ID NO: 2604057 - DNA, 19 bp, Homo sapiens
tcctgcctcagcctcccaa

SEQ ID NO: 2604058 - DNA, 17 bp, Homo sapiens
tcctgcctcagcctccg

SEQ ID NO: 2604059 - DNA, 14 bp, Homo sapiens
tcctgcctggccag

SEQ ID NO: 2604060 - DNA, 18 bp, Homo sapiens
tcctgcctgtctgaagcc

SEQ ID NO: 2604061 - DNA, 14 bp, Homo sapiens
tcctgccttcctcc

SEQ ID NO: 2604062 - DNA, 22 bp, Homo sapiens
tcctgccttcctcctgggccct

SEQ ID NO: 2604063 - DNA, 17 bp, Homo sapiens
tcctgccttctgtcctg

SEQ ID NO: 2604064 - DNA, 19 bp, Homo sapiens
tcctgctacaacttcagca

SEQ ID NO: 2604065 - DNA, 14 bp, Homo sapiens
tcctgctactctgt

SEQ ID NO: 2604066 - DNA, 14 bp, Homo sapiens
tcctgctccacagc

SEQ ID NO: 2604067 - DNA, 16 bp, Homo sapiens
tcctggaaaggctcag

SEQ ID NO: 2604068 - DNA, 19 bp, Homo sapiens
tcctggaaaggctcagtct

SEQ ID NO: 2604069 - DNA, 14 bp, Homo sapiens
tcctggaagccagc

SEQ ID NO: 2604070 - DNA, 22 bp, Homo sapiens
tcctggacatgaagattctttc

SEQ ID NO: 2604071 - DNA, 19 bp, Homo sapiens
tcctggacattttttcagt

SEQ ID NO: 2604072 - DNA, 22 bp, Homo sapiens
tcctggcaatagtgtgttctga

SEQ ID NO: 2604073 - DNA, 19 bp, Homo sapiens
tcccagcactttgggaggc

SEQ ID NO: 2604074 - DNA, 23 bp, Homo sapiens
tcccagcactttgggaggccaag

SEQ ID NO: 2604075 - DNA, 18 bp, Homo sapiens
tcccagcagccctaagga

SEQ ID NO: 2604076 - DNA, 20 bp, Homo sapiens
tcccagccaccccgggctct

SEQ ID NO: 2604077 - DNA, 24 bp, Homo sapiens
tcccagccaccccgggctctctgc

SEQ ID NO: 2604078 - DNA, 17 bp, Homo sapiens
tcccagccctatggatg

SEQ ID NO: 2604079 - DNA, 21 bp, Homo sapiens
tcccagccttggcatctagag

SEQ ID NO: 2604080 - DNA, 16 bp, Homo sapiens
tcccagctacctcaac

SEQ ID NO: 2604081 - DNA, 19 bp, Homo sapiens
tcccagctactcagaagcc

SEQ ID NO: 2604082 - DNA, 17 bp, Homo sapiens
tcccagctcacgtcaca

SEQ ID NO: 2604083 - DNA, 17 bp, Homo sapiens
tcccagctgaaatactg

SEQ ID NO: 2604084 - DNA, 17 bp, Homo sapiens
tcccagctgtgctctgg

SEQ ID NO: 2604085 - DNA, 23 bp, Homo sapiens
tcccagctgtgctctggacaggc

SEQ ID NO: 2604086 - DNA, 16 bp, Homo sapiens
tcccaggaactgggcc

SEQ ID NO: 2604087 - DNA, 17 bp, Homo sapiens
tcccaggcattccccag

SEQ ID NO: 2604088 - DNA, 23 bp, Homo sapiens
tcccaggcattccccaggaggcc

SEQ ID NO: 2604089 - DNA, 24 bp, Homo sapiens
tcccaggcattccccaggaggcca

SEQ ID NO: 2604090 - DNA, 15 bp, Homo sapiens
tcccaggcttcaccc

SEQ ID NO: 2604091 - DNA, 16 bp, Homo sapiens
tcccagggccagggcc

SEQ ID NO: 2604092 - DNA, 21 bp, Homo sapiens
tcccagggccagggccctgca

SEQ ID NO: 2604093 - DNA, 22 bp, Homo sapiens
tcccagtcatttaataaatgtg

SEQ ID NO: 2604094 - DNA, 15 bp, Homo sapiens
tcccagtctacccag

SEQ ID NO: 2604095 - DNA, 18 bp, Homo sapiens
tcccagtctacccagaga

SEQ ID NO: 2604096 - DNA, 16 bp, Homo sapiens
tcccagtctctggcag

SEQ ID NO: 2604097 - DNA, 19 bp, Homo sapiens
tcccagtgacacttcagag

SEQ ID NO: 2604098 - DNA, 22 bp, Homo sapiens
tcccagtgacacttcagagagc

SEQ ID NO: 2604099 - DNA, 22 bp, Homo sapiens
tcccagtgccgagaaggaagcc

SEQ ID NO: 2604100 - DNA, 22 bp, Homo sapiens
tcccagtggcctcaaccctccc

SEQ ID NO: 2604101 - DNA, 15 bp, Homo sapiens
tcccagtggctgctg

SEQ ID NO: 2604102 - DNA, 18 bp, Homo sapiens
tcccagtggctgctgccc

SEQ ID NO: 2604103 - DNA, 15 bp, Homo sapiens
tcccagtgggaggcg

SEQ ID NO: 2604104 - DNA, 21 bp, Homo sapiens
tcccagtgggaggggcaggct

SEQ ID NO: 2604105 - DNA, 23 bp, Homo sapiens
tcccagtgggaggggcaggctga

SEQ ID NO: 2604106 - DNA, 23 bp, Homo sapiens
tcccagttcaggagtcccaagga

SEQ ID NO: 2604107 - DNA, 18 bp, Homo sapiens
tcccataaccgctgattc

SEQ ID NO: 2604108 - DNA, 14 bp, Homo sapiens
tcccataccaccca

SEQ ID NO: 2604109 - DNA, 17 bp, Homo sapiens
tcccatagccaggaaac

SEQ ID NO: 2604110 - DNA, 14 bp, Homo sapiens
tcccatccaggcag

SEQ ID NO: 2604111 - DNA, 16 bp, Homo sapiens
tcccatcccagctgaa

SEQ ID NO: 2604112 - DNA, 22 bp, Homo sapiens
tcccatcccagctgaaatactg

SEQ ID NO: 2604113 - DNA, 13 bp, Homo sapiens
tcccatcccctgg

SEQ ID NO: 2604114 - DNA, 14 bp, Homo sapiens
tcccatcctaccct

SEQ ID NO: 2604115 - DNA, 13 bp, Homo sapiens
tcccatctcacac

SEQ ID NO: 2604116 - DNA, 13 bp, Homo sapiens
tcccatctgggag

SEQ ID NO: 2604117 - DNA, 14 bp, Homo sapiens
tcccatctgggagt

SEQ ID NO: 2604118 - DNA, 19 bp, Homo sapiens
tcccatctgggagtcccct

SEQ ID NO: 2604119 - DNA, 17 bp, Homo sapiens
tcccatgacccacccct

SEQ ID NO: 2604120 - DNA, 21 bp, Homo sapiens
tcccatgacccacccctgtgc

SEQ ID NO: 2604121 - DNA, 15 bp, Homo sapiens
tcccatgacccaggc

SEQ ID NO: 2604122 - DNA, 19 bp, Homo sapiens
tcccatgacccaggctggg

SEQ ID NO: 2604123 - DNA, 16 bp, Homo sapiens
tcccatgagcctcagc

SEQ ID NO: 2604124 - DNA, 19 bp, Homo sapiens
tcccatgagcctcagcatc

SEQ ID NO: 2604125 - DNA, 15 bp, Homo sapiens
tcccatggacactcc

SEQ ID NO: 2604126 - DNA, 20 bp, Homo sapiens
tcccatggacactccagtgc

SEQ ID NO: 2604127 - DNA, 13 bp, Homo sapiens
tcccatggagccc

SEQ ID NO: 2604128 - DNA, 16 bp, Homo sapiens
tcccatggagccccag

SEQ ID NO: 2604129 - DNA, 18 bp, Homo sapiens
tcccatggagccccagcc

SEQ ID NO: 2604130 - DNA, 18 bp, Homo sapiens
tcccatggcttaatgctt

SEQ ID NO: 2604131 - DNA, 19 bp, Homo sapiens
tcccatgtaacagaaaggg

SEQ ID NO: 2604132 - DNA, 16 bp, Homo sapiens
tcccattgtggctcct

SEQ ID NO: 2604133 - DNA, 14 bp, Homo sapiens
tcccatttctactc

SEQ ID NO: 2604134 - DNA, 16 bp, Homo sapiens
tcccatttctcactga

SEQ ID NO: 2604135 - DNA, 18 bp, Homo sapiens
tcccatttctcactgaga

SEQ ID NO: 2604136 - DNA, 21 bp, Homo sapiens
tcccattttgcaaaatttcca

SEQ ID NO: 2604137 - DNA, 16 bp, Homo sapiens
tccccaaacctgcaag

SEQ ID NO: 2604138 - DNA, 18 bp, Homo sapiens
tccccaaagtcttaaaat

SEQ ID NO: 2604139 - DNA, 19 bp, Homo sapiens
tccccaacagtgtgaagtt

SEQ ID NO: 2604140 - DNA, 20 bp, Homo sapiens
tccccaacagtgtgaagtta

SEQ ID NO: 2604141 - DNA, 18 bp, Homo sapiens
tccccaaccctgcccctg

SEQ ID NO: 2604142 - DNA, 20 bp, Homo sapiens
tccccaaccctgcccctgcc

SEQ ID NO: 2604143 - DNA, 17 bp, Homo sapiens
tccccaagaaagcctca

SEQ ID NO: 2604144 - DNA, 23 bp, Homo sapiens
tccccaccctgaaagccctgagc

SEQ ID NO: 2604145 - DNA, 23 bp, Homo sapiens
tccccacggggcctcgggacctc

SEQ ID NO: 2604146 - DNA, 16 bp, Homo sapiens
tccccactgacagcct

SEQ ID NO: 2604147 - DNA, 20 bp, Homo sapiens
tccccactgcctactgcatc

SEQ ID NO: 2604148 - DNA, 14 bp, Homo sapiens
tccccactgcctgc

SEQ ID NO: 2604149 - DNA, 22 bp, Homo sapiens
tccccactgcctgcccacccgt

SEQ ID NO: 2604150 - DNA, 19 bp, Homo sapiens
tccccacttgtccgctggg

SEQ ID NO: 2604151 - DNA, 19 bp, Homo sapiens
tccccagagtcctctatga

SEQ ID NO: 2604152 - DNA, 19 bp, Homo sapiens
tccccagattgcaacaggc

SEQ ID NO: 2604153 - DNA, 10 bp, Homo sapiens
tccccagcag

SEQ ID NO: 2604154 - DNA, 15 bp, Homo sapiens
tccccagcaggtggg

SEQ ID NO: 2604155 - DNA, 12 bp, Homo sapiens
tccccagcccag

SEQ ID NO: 2604156 - DNA, 22 bp, Homo sapiens
tccccagcccagggttccccca

SEQ ID NO: 2604157 - DNA, 23 bp, Homo sapiens
tccccagcccagggttcccccag

SEQ ID NO: 2604158 - DNA, 12 bp, Homo sapiens
tccccagcctct

SEQ ID NO: 2604159 - DNA, 17 bp, Homo sapiens
tccccagctcacccctg

SEQ ID NO: 2604160 - DNA, 15 bp, Homo sapiens
tccccaggaggccag

SEQ ID NO: 2604161 - DNA, 19 bp, Homo sapiens
tccccaggccaggccacca

SEQ ID NO: 2604162 - DNA, 20 bp, Homo sapiens
tccccaggccccaggaagcc

SEQ ID NO: 2604163 - DNA, 18 bp, Homo sapiens
tccccaggggtcccagcc

SEQ ID NO: 2604164 - DNA, 20 bp, Homo sapiens
tccccaggggtcccagccac

SEQ ID NO: 2604165 - DNA, 14 bp, Homo sapiens
tccccatcatccca

SEQ ID NO: 2604166 - DNA, 17 bp, Homo sapiens
tccccatcatcccagct

SEQ ID NO: 2604167 - DNA, 19 bp, Homo sapiens
tccccatcctccagcttct

SEQ ID NO: 2604168 - DNA, 11 bp, Homo sapiens
tccccatggga

SEQ ID NO: 2604169 - DNA, 24 bp, Homo sapiens
tccccattagctttcaattccgta

SEQ ID NO: 2604170 - DNA, 17 bp, Homo sapiens
tccccattcttcctagt

SEQ ID NO: 2604171 - DNA, 15 bp, Homo sapiens
tcccccaacccccac

SEQ ID NO: 2604172 - DNA, 16 bp, Homo sapiens
tcccccaacccccacc

SEQ ID NO: 2604173 - DNA, 21 bp, Homo sapiens
tcccccaacccccaccccaca

SEQ ID NO: 2604174 - DNA, 22 bp, Homo sapiens
tcccccaacccccaccccacac

SEQ ID NO: 2604175 - DNA, 11 bp, Homo sapiens
tcccccagccc

SEQ ID NO: 2604176 - DNA, 13 bp, Homo sapiens
tcccccagcccca

SEQ ID NO: 2604177 - DNA, 17 bp, Homo sapiens
tcccccagccccatcct

SEQ ID NO: 2604178 - DNA, 22 bp, Homo sapiens
tcccccagccccatcctctgta

SEQ ID NO: 2604179 - DNA, 18 bp, Homo sapiens
tcccccatcctccccttc

SEQ ID NO: 2604180 - DNA, 21 bp, Homo sapiens
tcccccatcctccccttccct

SEQ ID NO: 2604181 - DNA, 16 bp, Homo sapiens
tcccccccccctccaa

SEQ ID NO: 2604182 - DNA, 16 bp, Homo sapiens
tcccccccctgtatag

SEQ ID NO: 2604183 - DNA, 19 bp, Homo sapiens
tccccctcccagggccagg

SEQ ID NO: 2604184 - DNA, 20 bp, Homo sapiens
tccccctcccccttctccca

SEQ ID NO: 2604185 - DNA, 13 bp, Homo sapiens
tccccctgcccca

SEQ ID NO: 2604186 - DNA, 12 bp, Homo sapiens
tccccctgccct

SEQ ID NO: 2604187 - DNA, 21 bp, Homo sapiens
tccccctggccaccacccccc

SEQ ID NO: 2604188 - DNA, 10 bp, Homo sapiens
tccccctggg

SEQ ID NO: 2604189 - DNA, 12 bp, Homo sapiens
tccccctgggct

SEQ ID NO: 2604190 - DNA, 15 bp, Homo sapiens
tccccctgggctctg

SEQ ID NO: 2604191 - DNA, 15 bp, Homo sapiens
tcccccttccatgga

SEQ ID NO: 2604192 - DNA, 10 bp, Homo sapiens
tcccccttct

SEQ ID NO: 2604193 - DNA, 12 bp, Homo sapiens
tcccccttgcca

SEQ ID NO: 2604194 - DNA, 16 bp, Homo sapiens
tcccccttgccacccc

SEQ ID NO: 2604195 - DNA, 15 bp, Homo sapiens
tccccggccctacca

SEQ ID NO: 2604196 - DNA, 13 bp, Homo sapiens
tccccggcctcag

SEQ ID NO: 2604197 - DNA, 20 bp, Homo sapiens
tcccctaagcagaccactga

SEQ ID NO: 2604198 - DNA, 21 bp, Homo sapiens
tcccctagtaagtgccttcca

SEQ ID NO: 2604199 - DNA, 12 bp, Homo sapiens
tcccctcactgg

SEQ ID NO: 2604200 - DNA, 13 bp, Homo sapiens
tcccctcactgga

SEQ ID NO: 2604201 - DNA, 18 bp, Homo sapiens
tcccctccccggccctac

SEQ ID NO: 2604202 - DNA, 13 bp, Homo sapiens
tcccctccctggc

SEQ ID NO: 2604203 - DNA, 16 bp, Homo sapiens
tcccctccctggctcc

SEQ ID NO: 2604204 - DNA, 17 bp, Homo sapiens
tcccctccgccaggcga

SEQ ID NO: 2604205 - DNA, 20 bp, Homo sapiens
tcccctccgccaggcgagat

SEQ ID NO: 2604206 - DNA, 18 bp, Homo sapiens
tcccctccttctcccttt

SEQ ID NO: 2604207 - DNA, 21 bp, Homo sapiens
tcccctccttgcctcctgtgt

SEQ ID NO: 2604208 - DNA, 23 bp, Homo sapiens
tcccctccttgcctcctgtgtaa

SEQ ID NO: 2604209 - DNA, 12 bp, Homo sapiens
tcccctccttgg

SEQ ID NO: 2604210 - DNA, 17 bp, Homo sapiens
tcccctcggagaagagc

SEQ ID NO: 2604211 - DNA, 17 bp, Homo sapiens
tcccctctatttagcat

SEQ ID NO: 2604212 - DNA, 12 bp, Homo sapiens
tcccctgaggct

SEQ ID NO: 2604213 - DNA, 15 bp, Homo sapiens
tcccctgccagggca

SEQ ID NO: 2604214 - DNA, 22 bp, Homo sapiens
tcccctgcccctttacggacac

SEQ ID NO: 2604215 - DNA, 12 bp, Homo sapiens
tcccctgccctg

SEQ ID NO: 2604216 - DNA, 13 bp, Homo sapiens
tcccctgccctgg

SEQ ID NO: 2604217 - DNA, 17 bp, Homo sapiens
tcccctggactgggagg

SEQ ID NO: 2604218 - DNA, 15 bp, Homo sapiens
tcccctgggccctga

SEQ ID NO: 2604219 - DNA, 12 bp, Homo sapiens
tcccctgtgggg

SEQ ID NO: 2604220 - DNA, 18 bp, Homo sapiens
tccccttccactgagggc

SEQ ID NO: 2604221 - DNA, 19 bp, Homo sapiens
tccccttctcatcactccc

SEQ ID NO: 2604222 - DNA, 16 bp, Homo sapiens
tccccttctgaatcag

SEQ ID NO: 2604223 - DNA, 16 bp, Homo sapiens
tccccttgagctgaga

SEQ ID NO: 2604224 - DNA, 22 bp, Homo sapiens
tccccttgcccagggctcagcc

SEQ ID NO: 2604225 - DNA, 14 bp, Homo sapiens
tccccttgcccttg

SEQ ID NO: 2604226 - DNA, 14 bp, Homo sapiens
tccccttgggcggc

SEQ ID NO: 2604227 - DNA, 17 bp, Homo sapiens
tccccttgggcggctga

SEQ ID NO: 2604228 - DNA, 21 bp, Homo sapiens
tcccctttgtattccttaaat

SEQ ID NO: 2604229 - DNA, 22 bp, Homo sapiens
tccccttttcttttctacccta

SEQ ID NO: 2604230 - DNA, 23 bp, Homo sapiens
tcccgaaccccaaggagggagat

SEQ ID NO: 2604231 - DNA, 15 bp, Homo sapiens
tcccgagtagctggg

SEQ ID NO: 2604232 - DNA, 18 bp, Homo sapiens
tcccgagtagctgggact

SEQ ID NO: 2604233 - DNA, 19 bp, Homo sapiens
tcccgattcaccctgtcca

SEQ ID NO: 2604234 - DNA, 22 bp, Homo sapiens
tcccgcaaaccccctttgtgct

SEQ ID NO: 2604235 - DNA, 13 bp, Homo sapiens
tcccgctgctgct

SEQ ID NO: 2604236 - DNA, 16 bp, Homo sapiens
tcccggagggccctga

SEQ ID NO: 2604237 - DNA, 21 bp, Homo sapiens
tcccggagggccctgagctga

SEQ ID NO: 2604238 - DNA, 20 bp, Homo sapiens
tcccgtcagggcccaagtcc

SEQ ID NO: 2604239 - DNA, 23 bp, Homo sapiens
tcccgtcagggcccaagtccctg

SEQ ID NO: 2604240 - DNA, 15 bp, Homo sapiens
tcccgtgttctcctt

SEQ ID NO: 2604241 - DNA, 20 bp, Homo sapiens
tcccgtttctccacctagac

SEQ ID NO: 2604242 - DNA, 13 bp, Homo sapiens
tccctaaactgta

SEQ ID NO: 2604243 - DNA, 20 bp, Homo sapiens
tccctaatgctgcagatttg

SEQ ID NO: 2604244 - DNA, 19 bp, Homo sapiens
tccctagagggttcctgta

SEQ ID NO: 2604245 - DNA, 20 bp, Homo sapiens
tccctagagggttcctgtag

SEQ ID NO: 2604246 - DNA, 17 bp, Homo sapiens
tccctagccagcacttg

SEQ ID NO: 2604247 - DNA, 22 bp, Homo sapiens
tccctattttttttctgttata

SEQ ID NO: 2604248 - DNA, 13 bp, Homo sapiens
tccctcaaatgac

SEQ ID NO: 2604249 - DNA, 19 bp, Homo sapiens
tccctcaaatgacccaaag

SEQ ID NO: 2604250 - DNA, 20 bp, Homo sapiens
tccctcaaatgacccaaaga

SEQ ID NO: 2604251 - DNA, 22 bp, Homo sapiens
tccctcaacaagggagagacct

SEQ ID NO: 2604252 - DNA, 16 bp, Homo sapiens
tccctcaaccccacca

SEQ ID NO: 2604253 - DNA, 21 bp, Homo sapiens
tccctcaccctgagccccttc

SEQ ID NO: 2604254 - DNA, 14 bp, Homo sapiens
tccctcagcccctc

SEQ ID NO: 2604255 - DNA, 17 bp, Homo sapiens
tccctcagcccctcttg

SEQ ID NO: 2604256 - DNA, 16 bp, Homo sapiens
tccctcagtgccctca

SEQ ID NO: 2604257 - DNA, 15 bp, Homo sapiens
tccctcatttcagga

SEQ ID NO: 2604258 - DNA, 19 bp, Homo sapiens
tccctcatttcaggagcag

SEQ ID NO: 2604259 - DNA, 15 bp, Homo sapiens
tccctcccctgccct

SEQ ID NO: 2604260 - DNA, 15 bp, Homo sapiens
tccctccgatccttc

SEQ ID NO: 2604261 - DNA, 12 bp, Homo sapiens
tccctcctcacc

SEQ ID NO: 2604262 - DNA, 14 bp, Homo sapiens
tccctcctgctact

SEQ ID NO: 2604263 - DNA, 19 bp, Homo sapiens
tccctctcaggcatgcctg

SEQ ID NO: 2604264 - DNA, 22 bp, Homo sapiens
tccctctcaggcatgcctgtgt

SEQ ID NO: 2604265 - DNA, 23 bp, Homo sapiens
tccctctcggaaggctggctggg

SEQ ID NO: 2604266 - DNA, 15 bp, Homo sapiens
tccctctctctgact

SEQ ID NO: 2604267 - DNA, 22 bp, Homo sapiens
tccctctctctgactctcaaat

SEQ ID NO: 2604268 - DNA, 18 bp, Homo sapiens
tccctctctcttctgctc

SEQ ID NO: 2604269 - DNA, 19 bp, Homo sapiens
tccctctctcttctgctcc

SEQ ID NO: 2604270 - DNA, 17 bp, Homo sapiens
tccctctgacctgcagg

SEQ ID NO: 2604271 - DNA, 21 bp, Homo sapiens
tccctctgagaattccaagga

SEQ ID NO: 2604272 - DNA, 17 bp, Homo sapiens
tccctgaaaatgttttt

SEQ ID NO: 2604273 - DNA, 14 bp, Homo sapiens
tccctgaactggga

SEQ ID NO: 2604274 - DNA, 16 bp, Homo sapiens
tccctgaactgggacc

SEQ ID NO: 2604275 - DNA, 17 bp, Homo sapiens
tccctgaactgggacct

SEQ ID NO: 2604276 - DNA, 16 bp, Homo sapiens
tccctgacctccctct

SEQ ID NO: 2604277 - DNA, 21 bp, Homo sapiens
tccctgacctccctctaattt

SEQ ID NO: 2604278 - DNA, 19 bp, Homo sapiens
tccctgactcattctgaag

SEQ ID NO: 2604279 - DNA, 16 bp, Homo sapiens
tccctgactctctgtg

SEQ ID NO: 2604280 - DNA, 19 bp, Homo sapiens
tccctgataacaacctgga

SEQ ID NO: 2604281 - DNA, 13 bp, Homo sapiens
tccctgcacttgc

SEQ ID NO: 2604282 - DNA, 14 bp, Homo sapiens
tccctgcacttgca

SEQ ID NO: 2604283 - DNA, 17 bp, Homo sapiens
tccctggagccagactc

SEQ ID NO: 2604284 - DNA, 22 bp, Homo sapiens
tccctggagtgtggctgaggag

SEQ ID NO: 2604285 - DNA, 11 bp, Homo sapiens
tccctggcctt

SEQ ID NO: 2604286 - DNA, 16 bp, Homo sapiens
tccctggcctttcata

SEQ ID NO: 2604287 - DNA, 15 bp, Homo sapiens
tccctggctctcaga

SEQ ID NO: 2604288 - DNA, 14 bp, Homo sapiens
tccctggctgccct

SEQ ID NO: 2604289 - DNA, 15 bp, Homo sapiens
tccctggctgccctg

SEQ ID NO: 2604290 - DNA, 21 bp, Homo sapiens
tccctggctgccctggccctg

SEQ ID NO: 2604291 - DNA, 22 bp, Homo sapiens
tccctggctgccctggccctga

SEQ ID NO: 2604292 - DNA, 16 bp, Homo sapiens
tccctgggcagaaagt

SEQ ID NO: 2604293 - DNA, 20 bp, Homo sapiens
tccctggtggcagctcacct

SEQ ID NO: 2604294 - DNA, 21 bp, Homo sapiens
tccctggtggcagctcacctc

SEQ ID NO: 2604295 - DNA, 18 bp, Homo sapiens
tccctgtaacctcttcag

SEQ ID NO: 2604296 - DNA, 22 bp, Homo sapiens
tccctgtaacctcttcagaggc

SEQ ID NO: 2604297 - DNA, 20 bp, Homo sapiens
tccctgtaattgttgtttgt

SEQ ID NO: 2604298 - DNA, 14 bp, Homo sapiens
tccctgtccctcta

SEQ ID NO: 2604299 - DNA, 20 bp, Homo sapiens
tccctgtgcctaacaccagc

SEQ ID NO: 2604300 - DNA, 20 bp, Homo sapiens
tccctgttgacgaagtctct

SEQ ID NO: 2604301 - DNA, 18 bp, Homo sapiens
tccctgttggtcggtggg

SEQ ID NO: 2604302 - DNA, 22 bp, Homo sapiens
tccctgtttaatatttaaacag

SEQ ID NO: 2604303 - DNA, 11 bp, Homo sapiens
tccctgttttc

SEQ ID NO: 2604304 - DNA, 21 bp, Homo sapiens
tccctgttttctgagcccggg

SEQ ID NO: 2604305 - DNA, 18 bp, Homo sapiens
tcccttaaaatagaaata

SEQ ID NO: 2604306 - DNA, 22 bp, Homo sapiens
tcccttaaacaaaaattaaaat

SEQ ID NO: 2604307 - DNA, 21 bp, Homo sapiens
tcccttcagtaccctctcagc

SEQ ID NO: 2604308 - DNA, 21 bp, Homo sapiens
tcccttcatctggaaccatca

SEQ ID NO: 2604309 - DNA, 11 bp, Homo sapiens
tcccttctcca

SEQ ID NO: 2604310 - DNA, 17 bp, Homo sapiens
tcccttgaaattttaaa

SEQ ID NO: 2604311 - DNA, 17 bp, Homo sapiens
tcccttgaccaggcctg

SEQ ID NO: 2604312 - DNA, 18 bp, Homo sapiens
tcccttggaaacctgccc

SEQ ID NO: 2604313 - DNA, 19 bp, Homo sapiens
tcccttggaaacctgccct

SEQ ID NO: 2604314 - DNA, 12 bp, Homo sapiens
tcccttggagct

SEQ ID NO: 2604315 - DNA, 20 bp, Homo sapiens
tcccttggattgtccccgac

SEQ ID NO: 2604316 - DNA, 12 bp, Homo sapiens
tcccttgggctc

SEQ ID NO: 2604317 - DNA, 19 bp, Homo sapiens
tcccttggtggcaagagcc

SEQ ID NO: 2604318 - DNA, 13 bp, Homo sapiens
tcccttgttctct

SEQ ID NO: 2604319 - DNA, 13 bp, Homo sapiens
tccctttcccttc

SEQ ID NO: 2604320 - DNA, 15 bp, Homo sapiens
tccctttcccttctt

SEQ ID NO: 2604321 - DNA, 17 bp, Homo sapiens
tccctttccttccatcc

SEQ ID NO: 2604322 - DNA, 17 bp, Homo sapiens
tccctttcttggccagt

SEQ ID NO: 2604323 - DNA, 19 bp, Homo sapiens
tccctttgacgccatccca

SEQ ID NO: 2604324 - DNA, 21 bp, Homo sapiens
tccctttgacgccatcccagc

SEQ ID NO: 2604325 - DNA, 19 bp, Homo sapiens
tcccttttacatactgctg

SEQ ID NO: 2604326 - DNA, 20 bp, Homo sapiens
tcccttttacatactgctgt

SEQ ID NO: 2604327 - DNA, 14 bp, Homo sapiens
tccctttttccttg

SEQ ID NO: 2604328 - DNA, 15 bp, Homo sapiens
tccctttttccttgt

SEQ ID NO: 2604329 - DNA, 16 bp, Homo sapiens
tccctttttccttgtc

SEQ ID NO: 2604330 - DNA, 19 bp, Homo sapiens
tcccttttttggctgctga

SEQ ID NO: 2604331 - DNA, 23 bp, Homo sapiens
tcccttttttggctgctgaaggc

SEQ ID NO: 2604332 - DNA, 21 bp, Homo sapiens
tccgaaagggacttggaagct

SEQ ID NO: 2604333 - DNA, 22 bp, Homo sapiens
tccgaaagggacttggaagctc

SEQ ID NO: 2604334 - DNA, 16 bp, Homo sapiens
tccgaacctcctctgt

SEQ ID NO: 2604335 - DNA, 19 bp, Homo sapiens
tccgaacctcctctgtgaa

SEQ ID NO: 2604336 - DNA, 21 bp, Homo sapiens
tccgacaaccgatgctccagc

SEQ ID NO: 2604337 - DNA, 22 bp, Homo sapiens
tccgacaaccgatgctccagcc

SEQ ID NO: 2604338 - DNA, 23 bp, Homo sapiens
tccgacaaccgatgctccagcca

SEQ ID NO: 2604339 - DNA, 17 bp, Homo sapiens
tccgacagccccctctg

SEQ ID NO: 2604340 - DNA, 13 bp, Homo sapiens
tccgaggcagggt

SEQ ID NO: 2604341 - DNA, 15 bp, Homo sapiens
tccgaggggcgggac

SEQ ID NO: 2604342 - DNA, 14 bp, Homo sapiens
tccgatccttcctc

SEQ ID NO: 2604343 - DNA, 22 bp, Homo sapiens
tccgccctcaaaatgacagcca

SEQ ID NO: 2604344 - DNA, 12 bp, Homo sapiens
tccgccctgctc

SEQ ID NO: 2604345 - DNA, 14 bp, Homo sapiens
tccgccctgctcct

SEQ ID NO: 2604346 - DNA, 14 bp, Homo sapiens
tccgcctcttgggt

SEQ ID NO: 2604347 - DNA, 21 bp, Homo sapiens
tccgctttctacccagcgagc

SEQ ID NO: 2604348 - DNA, 15 bp, Homo sapiens
tccggacactcctag

SEQ ID NO: 2604349 - DNA, 14 bp, Homo sapiens
tccggcctcccctc

SEQ ID NO: 2604350 - DNA, 19 bp, Homo sapiens
tccggcgtcagcctccagc

SEQ ID NO: 2604351 - DNA, 23 bp, Homo sapiens
tccgggagggtgcggctgtgcag

SEQ ID NO: 2604352 - DNA, 16 bp, Homo sapiens
tccggggagcgcccgc

SEQ ID NO: 2604353 - DNA, 15 bp, Homo sapiens
tccggtgtgcctgca

SEQ ID NO: 2604354 - DNA, 20 bp, Homo sapiens
tccgtgagtgaaccatcatt

SEQ ID NO: 2604355 - DNA, 17 bp, Homo sapiens
tccgtgcctccaccacc

SEQ ID NO: 2604356 - DNA, 22 bp, Homo sapiens
tccgttgggccccagccttctt

SEQ ID NO: 2604357 - DNA, 19 bp, Homo sapiens
tcctaagagtgctgggcat

SEQ ID NO: 2604358 - DNA, 16 bp, Homo sapiens
tcctaagctattcagt

SEQ ID NO: 2604359 - DNA, 18 bp, Homo sapiens
tcctaagctattcagtaa

SEQ ID NO: 2604360 - DNA, 18 bp, Homo sapiens
tcctaaggacacactaat

SEQ ID NO: 2604361 - DNA, 15 bp, Homo sapiens
tcctaatcatccaat

SEQ ID NO: 2604362 - DNA, 22 bp, Homo sapiens
tcctaatgaatgcataaaatgt

SEQ ID NO: 2604363 - DNA, 15 bp, Homo sapiens
tcctacaaagatgtt

SEQ ID NO: 2604364 - DNA, 15 bp, Homo sapiens
tcctacacctaactc

SEQ ID NO: 2604365 - DNA, 16 bp, Homo sapiens
tcctacagatagtcaa

SEQ ID NO: 2604366 - DNA, 13 bp, Homo sapiens
tcctaccaatgca

SEQ ID NO: 2604367 - DNA, 20 bp, Homo sapiens
tcctacccacacctctgcca

SEQ ID NO: 2604368 - DNA, 17 bp, Homo sapiens
tcctaccctcgggccca

SEQ ID NO: 2604369 - DNA, 20 bp, Homo sapiens
tcctaccgaaaccttgcctt

SEQ ID NO: 2604370 - DNA, 12 bp, Homo sapiens
tcctacctcagc

SEQ ID NO: 2604371 - DNA, 14 bp, Homo sapiens
tcctacctcagcct

SEQ ID NO: 2604372 - DNA, 16 bp, Homo sapiens
tcctacctcagcctag

SEQ ID NO: 2604373 - DNA, 17 bp, Homo sapiens
tcctactcccagacacc

SEQ ID NO: 2604374 - DNA, 19 bp, Homo sapiens
caaaaattcaactcagact

SEQ ID NO: 2604375 - DNA, 19 bp, Homo sapiens
caaaacactcggcatttca

SEQ ID NO: 2604376 - DNA, 19 bp, Homo sapiens
caaaacagagatgtgataa

SEQ ID NO: 2604377 - DNA, 18 bp, Homo sapiens
caaaacagcgtttaagac

SEQ ID NO: 2604378 - DNA, 18 bp, Homo sapiens
caaaaccacagccctgtc

SEQ ID NO: 2604379 - DNA, 19 bp, Homo sapiens
caaaaccacagccctgtca

SEQ ID NO: 2604380 - DNA, 19 bp, Homo sapiens
caaaaccccactacacagt

SEQ ID NO: 2604381 - DNA, 21 bp, Homo sapiens
caaaacctgatgttaaaattc

SEQ ID NO: 2604382 - DNA, 19 bp, Homo sapiens
caaaacgcatggagtgtgt

SEQ ID NO: 2604383 - DNA, 13 bp, Homo sapiens
caaaacggggcag

SEQ ID NO: 2604384 - DNA, 15 bp, Homo sapiens
caaaacggttttact

SEQ ID NO: 2604385 - DNA, 15 bp, Homo sapiens
caaaacgtcttattg

SEQ ID NO: 2604386 - DNA, 21 bp, Homo sapiens
caaaactcatttcctatgtaa

SEQ ID NO: 2604387 - DNA, 21 bp, Homo sapiens
caaaactcctgcccctgttct

SEQ ID NO: 2604388 - DNA, 19 bp, Homo sapiens
caaaactctcctctgctgc

SEQ ID NO: 2604389 - DNA, 20 bp, Homo sapiens
caaaactctcctctgctgct

SEQ ID NO: 2604390 - DNA, 21 bp, Homo sapiens
caaaactctcctctgctgctg

SEQ ID NO: 2604391 - DNA, 22 bp, Homo sapiens
caaaactctcctctgctgctgg

SEQ ID NO: 2604392 - DNA, 17 bp, Homo sapiens
caaaactgcactgtcaa

SEQ ID NO: 2604393 - DNA, 18 bp, Homo sapiens
caaaactgcactgtcaag

SEQ ID NO: 2604394 - DNA, 23 bp, Homo sapiens
caaaacttcagacatagaattaa

SEQ ID NO: 2604395 - DNA, 21 bp, Homo sapiens
caaaagaaaaaaaaaagcacc

SEQ ID NO: 2604396 - DNA, 12 bp, Homo sapiens
caaaagacaatt

SEQ ID NO: 2604397 - DNA, 21 bp, Homo sapiens
caaaagacaattctttataca

SEQ ID NO: 2604398 - DNA, 20 bp, Homo sapiens
caaaagatgctcttctgtgg

SEQ ID NO: 2604399 - DNA, 16 bp, Homo sapiens
caaaagattgctgaaa

SEQ ID NO: 2604400 - DNA, 23 bp, Homo sapiens
caaaagcaagactgttgctcaaa

SEQ ID NO: 2604401 - DNA, 14 bp, Homo sapiens
caaaagctgctcag

SEQ ID NO: 2604402 - DNA, 15 bp, Homo sapiens
caaaagctgggcagg

SEQ ID NO: 2604403 - DNA, 13 bp, Homo sapiens
caaaagcttttta

SEQ ID NO: 2604404 - DNA, 13 bp, Homo sapiens
caaaaggaagtct

SEQ ID NO: 2604405 - DNA, 15 bp, Homo sapiens
caaaaggcagaagca

SEQ ID NO: 2604406 - DNA, 19 bp, Homo sapiens
caaaagtattttcctgtaa

SEQ ID NO: 2604407 - DNA, 14 bp, Homo sapiens
caaaagtggcctct

SEQ ID NO: 2604408 - DNA, 18 bp, Homo sapiens
caaaagtggcctctttgt

SEQ ID NO: 2604409 - DNA, 20 bp, Homo sapiens
caaaagtggcctctttgtct

SEQ ID NO: 2604410 - DNA, 17 bp, Homo sapiens
caaaagttttcctgaga

SEQ ID NO: 2604411 - DNA, 11 bp, Homo sapiens
caaaataaaaa

SEQ ID NO: 2604412 - DNA, 14 bp, Homo sapiens
caaaataaaacttt

SEQ ID NO: 2604413 - DNA, 16 bp, Homo sapiens
caaaataaaacttttt

SEQ ID NO: 2604414 - DNA, 16 bp, Homo sapiens
caaaatatttgtacat

SEQ ID NO: 2604415 - DNA, 17 bp, Homo sapiens
caaaatatttgtacata

SEQ ID NO: 2604416 - DNA, 16 bp, Homo sapiens
caaaatcattttaatg

SEQ ID NO: 2604417 - DNA, 12 bp, Homo sapiens
caaaatcccctt

SEQ ID NO: 2604418 - DNA, 20 bp, Homo sapiens
caaaatccttgcttatgaca

SEQ ID NO: 2604419 - DNA, 21 bp, Homo sapiens
caaaatcgatgcagtgcttcc

SEQ ID NO: 2604420 - DNA, 13 bp, Homo sapiens
caaaatctgtcca

SEQ ID NO: 2604421 - DNA, 15 bp, Homo sapiens
caaaatgtagggtta

SEQ ID NO: 2604422 - DNA, 13 bp, Homo sapiens
caaaatgtctgta

SEQ ID NO: 2604423 - DNA, 17 bp, Homo sapiens
caaaatgttggtcattt

SEQ ID NO: 2604424 - DNA, 18 bp, Homo sapiens
caaaatgttggtcatttt

SEQ ID NO: 2604425 - DNA, 21 bp, Homo sapiens
caaaatgttggtcattttatg

SEQ ID NO: 2604426 - DNA, 20 bp, Homo sapiens
caaaattaccaaaaatcttg

SEQ ID NO: 2604427 - DNA, 12 bp, Homo sapiens
tccacaaaataa

SEQ ID NO: 2604428 - DNA, 12 bp, Homo sapiens
tccacacacaga

SEQ ID NO: 2604429 - DNA, 13 bp, Homo sapiens
tccacacacagag

SEQ ID NO: 2604430 - DNA, 23 bp, Homo sapiens
tccacactcacctctaaaacagt

SEQ ID NO: 2604431 - DNA, 20 bp, Homo sapiens
tccacagaaacattttcatt

SEQ ID NO: 2604432 - DNA, 18 bp, Homo sapiens
tccacagagagtcccact

SEQ ID NO: 2604433 - DNA, 21 bp, Homo sapiens
tccacagagagtcccactgcc

SEQ ID NO: 2604434 - DNA, 17 bp, Homo sapiens
tccacagatgcctccac

SEQ ID NO: 2604435 - DNA, 14 bp, Homo sapiens
tccacagccatccc

SEQ ID NO: 2604436 - DNA, 14 bp, Homo sapiens
tccacagccgcagc

SEQ ID NO: 2604437 - DNA, 16 bp, Homo sapiens
tccacagccgcagcct

SEQ ID NO: 2604438 - DNA, 13 bp, Homo sapiens
tccacaggaagtg

SEQ ID NO: 2604439 - DNA, 14 bp, Homo sapiens
tccacagtgactcc

SEQ ID NO: 2604440 - DNA, 19 bp, Homo sapiens
tccacatcctccacgttct

SEQ ID NO: 2604441 - DNA, 21 bp, Homo sapiens
tccacatctacgtttttggtg

SEQ ID NO: 2604442 - DNA, 16 bp, Homo sapiens
tccacattgttttaaa

SEQ ID NO: 2604443 - DNA, 17 bp, Homo sapiens
tccaccaagaaagcagg

SEQ ID NO: 2604444 - DNA, 14 bp, Homo sapiens
tccaccaccactgg

SEQ ID NO: 2604445 - DNA, 14 bp, Homo sapiens
tccaccacctccct

SEQ ID NO: 2604446 - DNA, 18 bp, Homo sapiens
tccaccacctccctcacc

SEQ ID NO: 2604447 - DNA, 22 bp, Homo sapiens
tccaccacctccctcaccaaca

SEQ ID NO: 2604448 - DNA, 14 bp, Homo sapiens
tccaccagcctgca

SEQ ID NO: 2604449 - DNA, 16 bp, Homo sapiens
tccaccagcctgcact

SEQ ID NO: 2604450 - DNA, 14 bp, Homo sapiens
tccacccaggagcc

SEQ ID NO: 2604451 - DNA, 20 bp, Homo sapiens
tccacccaggagccccgagg

SEQ ID NO: 2604452 - DNA, 23 bp, Homo sapiens
tccaccccccagaacctgtcctt

SEQ ID NO: 2604453 - DNA, 13 bp, Homo sapiens
tccaccccctccc

SEQ ID NO: 2604454 - DNA, 18 bp, Homo sapiens
tccaccccctccctggcc

SEQ ID NO: 2604455 - DNA, 19 bp, Homo sapiens
tccaccccctccctggcct

SEQ ID NO: 2604456 - DNA, 20 bp, Homo sapiens
tccaccccctccctggcctg

SEQ ID NO: 2604457 - DNA, 12 bp, Homo sapiens
tccaccctctga

SEQ ID NO: 2604458 - DNA, 14 bp, Homo sapiens
tccaccctctgagc

SEQ ID NO: 2604459 - DNA, 21 bp, Homo sapiens
tccaccctgctctccgaccag

SEQ ID NO: 2604460 - DNA, 12 bp, Homo sapiens
tccaccctggaa

SEQ ID NO: 2604461 - DNA, 16 bp, Homo sapiens
tccaccctgtccccca

SEQ ID NO: 2604462 - DNA, 14 bp, Homo sapiens
tccacccttggcct

SEQ ID NO: 2604463 - DNA, 13 bp, Homo sapiens
tccacctccctcc

SEQ ID NO: 2604464 - DNA, 16 bp, Homo sapiens
tccacctccttctctg

SEQ ID NO: 2604465 - DNA, 18 bp, Homo sapiens
tccacctcttcacccccc

SEQ ID NO: 2604466 - DNA, 15 bp, Homo sapiens
tccacctgccaggga

SEQ ID NO: 2604467 - DNA, 13 bp, Homo sapiens
tccacctgctccc

SEQ ID NO: 2604468 - DNA, 23 bp, Homo sapiens
tccacctgggcatatccaccacc

SEQ ID NO: 2604469 - DNA, 17 bp, Homo sapiens
tccacctgtctcagcct

SEQ ID NO: 2604470 - DNA, 20 bp, Homo sapiens
tccacctgtctcagcctccc

SEQ ID NO: 2604471 - DNA, 15 bp, Homo sapiens
tccacgactgtctcc

SEQ ID NO: 2604472 - DNA, 16 bp, Homo sapiens
tccacgactgtctcca

SEQ ID NO: 2604473 - DNA, 22 bp, Homo sapiens
tccacgagctgtttactaggga

SEQ ID NO: 2604474 - DNA, 12 bp, Homo sapiens
tccacgctgtct

SEQ ID NO: 2604475 - DNA, 17 bp, Homo sapiens
tccacgctgtctccaga

SEQ ID NO: 2604476 - DNA, 19 bp, Homo sapiens
tccacgctgtctccagacc

SEQ ID NO: 2604477 - DNA, 21 bp, Homo sapiens
tccacgctgtctccagacccc

SEQ ID NO: 2604478 - DNA, 22 bp, Homo sapiens
tccacgctgtctccagaccccc

SEQ ID NO: 2604479 - DNA, 14 bp, Homo sapiens
tccacggctctagg

SEQ ID NO: 2604480 - DNA, 19 bp, Homo sapiens
tccacgttctgctcatcat

SEQ ID NO: 2604481 - DNA, 19 bp, Homo sapiens
tccactaaccccgggcggg

SEQ ID NO: 2604482 - DNA, 18 bp, Homo sapiens
tccactctaccctcccac

SEQ ID NO: 2604483 - DNA, 21 bp, Homo sapiens
tccactctaccctcccacccc

SEQ ID NO: 2604484 - DNA, 14 bp, Homo sapiens
tccactgagctcca

SEQ ID NO: 2604485 - DNA, 12 bp, Homo sapiens
tccactggactt

SEQ ID NO: 2604486 - DNA, 22 bp, Homo sapiens
tccactggttcttcttggtctc

SEQ ID NO: 2604487 - DNA, 17 bp, Homo sapiens
tccactgtcaccctcca

SEQ ID NO: 2604488 - DNA, 19 bp, Homo sapiens
tccactgtcaccctccacc

SEQ ID NO: 2604489 - DNA, 19 bp, Homo sapiens
tccactgtcactgtttctc

SEQ ID NO: 2604490 - DNA, 18 bp, Homo sapiens
tccagaaaaccccagcat

SEQ ID NO: 2604491 - DNA, 11 bp, Homo sapiens
tccagaaagaa

SEQ ID NO: 2604492 - DNA, 17 bp, Homo sapiens
tccagaagaatattcag

SEQ ID NO: 2604493 - DNA, 12 bp, Homo sapiens
tccagaatatct

SEQ ID NO: 2604494 - DNA, 19 bp, Homo sapiens
tccagaatctaaagccagt

SEQ ID NO: 2604495 - DNA, 19 bp, Homo sapiens
tccagacaaaccagaagca

SEQ ID NO: 2604496 - DNA, 17 bp, Homo sapiens
tccagacccccacccct

SEQ ID NO: 2604497 - DNA, 14 bp, Homo sapiens
tccagacccccagc

SEQ ID NO: 2604498 - DNA, 15 bp, Homo sapiens
tccagacccggctgc

SEQ ID NO: 2604499 - DNA, 18 bp, Homo sapiens
tccagacccggctgcgtg

SEQ ID NO: 2604500 - DNA, 15 bp, Homo sapiens
tccagagagtcctct

SEQ ID NO: 2604501 - DNA, 19 bp, Homo sapiens
tccagagagtcctctggat

SEQ ID NO: 2604502 - DNA, 20 bp, Homo sapiens
tccagaggctattattttca

SEQ ID NO: 2604503 - DNA, 12 bp, Homo sapiens
tccagagggcac

SEQ ID NO: 2604504 - DNA, 18 bp, Homo sapiens
tccagatctgcagtcact

SEQ ID NO: 2604505 - DNA, 23 bp, Homo sapiens
tccagccaaagcctcctccagcc

SEQ ID NO: 2604506 - DNA, 20 bp, Homo sapiens
tccagccaacccctgtggag

SEQ ID NO: 2604507 - DNA, 23 bp, Homo sapiens
tccagccaacccctgtggagccc

SEQ ID NO: 2604508 - DNA, 14 bp, Homo sapiens
tccagccagggctg

SEQ ID NO: 2604509 - DNA, 13 bp, Homo sapiens
tccagcccctgga

SEQ ID NO: 2604510 - DNA, 14 bp, Homo sapiens
tccagcccctggat

SEQ ID NO: 2604511 - DNA, 17 bp, Homo sapiens
tccagccctggctgaag

SEQ ID NO: 2604512 - DNA, 23 bp, Homo sapiens
tccagccgccattgccaccagga

SEQ ID NO: 2604513 - DNA, 13 bp, Homo sapiens
tccagcctgagca

SEQ ID NO: 2604514 - DNA, 21 bp, Homo sapiens
tccagcctgagcgacagtgag

SEQ ID NO: 2604515 - DNA, 14 bp, Homo sapiens
tccagcctggagat

SEQ ID NO: 2604516 - DNA, 20 bp, Homo sapiens
tccagcctgggcaacagagc

SEQ ID NO: 2604517 - DNA, 19 bp, Homo sapiens
tccagcctgggcagccagg

SEQ ID NO: 2604518 - DNA, 21 bp, Homo sapiens
tccagctatttttatttgttt

SEQ ID NO: 2604519 - DNA, 17 bp, Homo sapiens
tccagctcaccagcccc

SEQ ID NO: 2604520 - DNA, 18 bp, Homo sapiens
tccagctcaccagcccca

SEQ ID NO: 2604521 - DNA, 18 bp, Homo sapiens
tccagctcctcatccagg

SEQ ID NO: 2604522 - DNA, 13 bp, Homo sapiens
tccagctcctgta

SEQ ID NO: 2604523 - DNA, 17 bp, Homo sapiens
tccagctgttcagctgg

SEQ ID NO: 2604524 - DNA, 19 bp, Homo sapiens
tccagcttctggtactctc

SEQ ID NO: 2604525 - DNA, 20 bp, Homo sapiens
tccagcttctggtactctcc

SEQ ID NO: 2604526 - DNA, 17 bp, Homo sapiens
tccagcttgtggagccc

SEQ ID NO: 2604527 - DNA, 23 bp, Homo sapiens
tccagcttgtggagccccacact

SEQ ID NO: 2604528 - DNA, 21 bp, Homo sapiens
tccagctttgttcttcttaaa

SEQ ID NO: 2604529 - DNA, 20 bp, Homo sapiens
tccaggaaggcggggcttca

SEQ ID NO: 2604530 - DNA, 23 bp, Homo sapiens
tccaggagaaggccaattcctat

SEQ ID NO: 2604531 - DNA, 14 bp, Homo sapiens
tccaggagcagcca

SEQ ID NO: 2604532 - DNA, 22 bp, Homo sapiens
tccaggagcagccacattcctg

SEQ ID NO: 2604533 - DNA, 16 bp, Homo sapiens
tccaggcacccttctt

SEQ ID NO: 2604534 - DNA, 14 bp, Homo sapiens
tccaggcactgaga

SEQ ID NO: 2604535 - DNA, 23 bp, Homo sapiens
tccaggcagtcgggggctggcct

SEQ ID NO: 2604536 - DNA, 19 bp, Homo sapiens
tccaggcgatgtgcaagtg

SEQ ID NO: 2604537 - DNA, 22 bp, Homo sapiens
tccaggctcctttagcgcccag

SEQ ID NO: 2604538 - DNA, 14 bp, Homo sapiens
tccaggctgtatcc

SEQ ID NO: 2604539 - DNA, 20 bp, Homo sapiens
tccaggctgtctttcactga

SEQ ID NO: 2604540 - DNA, 12 bp, Homo sapiens
tccagggaagct

SEQ ID NO: 2604541 - DNA, 16 bp, Homo sapiens
tccagggaagctggcc

SEQ ID NO: 2604542 - DNA, 13 bp, Homo sapiens
tccagggccctga

SEQ ID NO: 2604543 - DNA, 20 bp, Homo sapiens
tccagggccctgagctcggt

SEQ ID NO: 2604544 - DNA, 13 bp, Homo sapiens
tccaggggcccct

SEQ ID NO: 2604545 - DNA, 22 bp, Homo sapiens
tccaggggtgggacaccctgtg

SEQ ID NO: 2604546 - DNA, 18 bp, Homo sapiens
tccagggttgatcacact

SEQ ID NO: 2604547 - DNA, 18 bp, Homo sapiens
tccaggtgcacaagctcc

SEQ ID NO: 2604548 - DNA, 20 bp, Homo sapiens
tccaggtgcacaagctccaa

SEQ ID NO: 2604549 - DNA, 21 bp, Homo sapiens
tccaggtgcacaagctccaag

SEQ ID NO: 2604550 - DNA, 15 bp, Homo sapiens
tccaggttcagcttg

SEQ ID NO: 2604551 - DNA, 20 bp, Homo sapiens
tccaggtttaagctgttact

SEQ ID NO: 2604552 - DNA, 13 bp, Homo sapiens
tccaggtttttca

SEQ ID NO: 2604553 - DNA, 16 bp, Homo sapiens
tccaggtttttcaatt

SEQ ID NO: 2604554 - DNA, 18 bp, Homo sapiens
tccaggtttttcaattaa

SEQ ID NO: 2604555 - DNA, 22 bp, Homo sapiens
tccaggtttttcaattaaacgg

SEQ ID NO: 2604556 - DNA, 16 bp, Homo sapiens
tccagtaggatccagt

SEQ ID NO: 2604557 - DNA, 20 bp, Homo sapiens
tccagtcaggcctatctaaa

SEQ ID NO: 2604558 - DNA, 14 bp, Homo sapiens
tccagtctgctgcc

SEQ ID NO: 2604559 - DNA, 15 bp, Homo sapiens
tccagtctgctgccc

SEQ ID NO: 2604560 - DNA, 19 bp, Homo sapiens
tccagtcttcctgacactt

SEQ ID NO: 2604561 - DNA, 21 bp, Homo sapiens
tccagtcttcctgacacttta

SEQ ID NO: 2604562 - DNA, 23 bp, Homo sapiens
tccagtcttcctgacactttaat

SEQ ID NO: 2604563 - DNA, 18 bp, Homo sapiens
tccagtgagacagctctg

SEQ ID NO: 2604564 - DNA, 15 bp, Homo sapiens
tccagtgaggctctg

SEQ ID NO: 2604565 - DNA, 16 bp, Homo sapiens
tccagtgaggctctgc

SEQ ID NO: 2604566 - DNA, 17 bp, Homo sapiens
tccagtgaggctctgcc

SEQ ID NO: 2604567 - DNA, 18 bp, Homo sapiens
tccagtgaggctctgccc

SEQ ID NO: 2604568 - DNA, 22 bp, Homo sapiens
tccagtggtccatggaatgctt

SEQ ID NO: 2604569 - DNA, 16 bp, Homo sapiens
tccagtgtctcggagg

SEQ ID NO: 2604570 - DNA, 22 bp, Homo sapiens
tccagttaaaaaaaattttaat

SEQ ID NO: 2604571 - DNA, 13 bp, Homo sapiens
tccagttcccact

SEQ ID NO: 2604572 - DNA, 18 bp, Homo sapiens
tcccatgacccacccctg

SEQ ID NO: 2604573 - DNA, 24 bp, Homo sapiens
tcccatgacccacccctgtgctcc

SEQ ID NO: 2604574 - DNA, 15 bp, Homo sapiens
tcccatgagcctcag

SEQ ID NO: 2604575 - DNA, 17 bp, Homo sapiens
tcccatgagcctcagca

SEQ ID NO: 2604576 - DNA, 12 bp, Homo sapiens
tcccatgccctg

SEQ ID NO: 2604577 - DNA, 14 bp, Homo sapiens
tcccatggacactc

SEQ ID NO: 2604578 - DNA, 22 bp, Homo sapiens
tcccatggacactccagtgcca

SEQ ID NO: 2604579 - DNA, 15 bp, Homo sapiens
tcccatggagcccca

SEQ ID NO: 2604580 - DNA, 17 bp, Homo sapiens
tcccatggagccccagc

SEQ ID NO: 2604581 - DNA, 21 bp, Homo sapiens
tcccatggagccccagccccc

SEQ ID NO: 2604582 - DNA, 18 bp, Homo sapiens
tcccatgtaacagaaagg

SEQ ID NO: 2604583 - DNA, 23 bp, Homo sapiens
tcccattaggacaatcagtcccc

SEQ ID NO: 2604584 - DNA, 13 bp, Homo sapiens
tcccatttcagct

SEQ ID NO: 2604585 - DNA, 18 bp, Homo sapiens
tcccattttggaagtttt

SEQ ID NO: 2604586 - DNA, 22 bp, Homo sapiens
tccccaaaaacctcacccgagg

SEQ ID NO: 2604587 - DNA, 19 bp, Homo sapiens
tccccaaatccgaacctcc

SEQ ID NO: 2604588 - DNA, 18 bp, Homo sapiens
tccccaccgcagacagga

SEQ ID NO: 2604589 - DNA, 21 bp, Homo sapiens
tccccaccgcagacaggacca

SEQ ID NO: 2604590 - DNA, 24 bp, Homo sapiens
tccccaccgcagacaggaccaggg

SEQ ID NO: 2604591 - DNA, 22 bp, Homo sapiens
tccccaccttcaattcctgggc

SEQ ID NO: 2604592 - DNA, 19 bp, Homo sapiens
tccccacggccgctccagg

SEQ ID NO: 2604593 - DNA, 20 bp, Homo sapiens
tccccacggccgctccaggg

SEQ ID NO: 2604594 - DNA, 22 bp, Homo sapiens
tccccacggggcctcgggacct

SEQ ID NO: 2604595 - DNA, 15 bp, Homo sapiens
tccccactgcctact

SEQ ID NO: 2604596 - DNA, 21 bp, Homo sapiens
tccccagagcactgggttgca

SEQ ID NO: 2604597 - DNA, 17 bp, Homo sapiens
tccccagagttccccat

SEQ ID NO: 2604598 - DNA, 13 bp, Homo sapiens
tccccagattgca

SEQ ID NO: 2604599 - DNA, 18 bp, Homo sapiens
tccccagattgcaacagg

SEQ ID NO: 2604600 - DNA, 22 bp, Homo sapiens
tccccagattgcaacaggctgg

SEQ ID NO: 2604601 - DNA, 23 bp, Homo sapiens
tccccagattgcaacaggctggg

SEQ ID NO: 2604602 - DNA, 21 bp, Homo sapiens
tccccagcaagtgagagctgg

SEQ ID NO: 2604603 - DNA, 19 bp, Homo sapiens
tccccagcaggtggggagg

SEQ ID NO: 2604604 - DNA, 15 bp, Homo sapiens
tccccagccctggct

SEQ ID NO: 2604605 - DNA, 18 bp, Homo sapiens
tccccagccctggctctg

SEQ ID NO: 2604606 - DNA, 22 bp, Homo sapiens
tccccagctcacccctggagga

SEQ ID NO: 2604607 - DNA, 14 bp, Homo sapiens
tccccagctgttta

SEQ ID NO: 2604608 - DNA, 21 bp, Homo sapiens
tccccaggaggccagccttga

SEQ ID NO: 2604609 - DNA, 19 bp, Homo sapiens
tccccaggggaaaatgaag

SEQ ID NO: 2604610 - DNA, 23 bp, Homo sapiens
tccccaggggtcccagccacccc

SEQ ID NO: 2604611 - DNA, 18 bp, Homo sapiens
tccccatcatctgtggaa

SEQ ID NO: 2604612 - DNA, 14 bp, Homo sapiens
tccccatctgggtc

SEQ ID NO: 2604613 - DNA, 16 bp, Homo sapiens
tccccatgcagacatg

SEQ ID NO: 2604614 - DNA, 19 bp, Homo sapiens
tccccattagagtcagcct

SEQ ID NO: 2604615 - DNA, 18 bp, Homo sapiens
tccccattgcctcctcct

SEQ ID NO: 2604616 - DNA, 13 bp, Homo sapiens
tcccccagacttt

SEQ ID NO: 2604617 - DNA, 16 bp, Homo sapiens
tcccccagccccatcc

SEQ ID NO: 2604618 - DNA, 20 bp, Homo sapiens
tcccccagccccatcctctg

SEQ ID NO: 2604619 - DNA, 16 bp, Homo sapiens
tcccccagccctgtgg

SEQ ID NO: 2604620 - DNA, 18 bp, Homo sapiens
tcccccagctctggtgag

SEQ ID NO: 2604621 - DNA, 21 bp, Homo sapiens
tccccccactctccccacact

SEQ ID NO: 2604622 - DNA, 17 bp, Homo sapiens
tcccccccctgtatagt

SEQ ID NO: 2604623 - DNA, 18 bp, Homo sapiens
tccccctcccagggccag

SEQ ID NO: 2604624 - DNA, 20 bp, Homo sapiens
tccccctgccctcgtggcca

SEQ ID NO: 2604625 - DNA, 20 bp, Homo sapiens
tccccctgggctctgcccca

SEQ ID NO: 2604626 - DNA, 14 bp, Homo sapiens
tcccccttgccacc

SEQ ID NO: 2604627 - DNA, 19 bp, Homo sapiens
tcccccttttctgcatttt

SEQ ID NO: 2604628 - DNA, 14 bp, Homo sapiens
tccccgcacccccc

SEQ ID NO: 2604629 - DNA, 18 bp, Homo sapiens
tccccgcttctgcctgca

SEQ ID NO: 2604630 - DNA, 15 bp, Homo sapiens
tccccggagttcagt

SEQ ID NO: 2604631 - DNA, 17 bp, Homo sapiens
tccccggccctaccagc

SEQ ID NO: 2604632 - DNA, 14 bp, Homo sapiens
tcccctaacctcat

SEQ ID NO: 2604633 - DNA, 18 bp, Homo sapiens
tcccctcaaagtctgcaa

SEQ ID NO: 2604634 - DNA, 21 bp, Homo sapiens
tcccctcaaagtctgcaactt

SEQ ID NO: 2604635 - DNA, 17 bp, Homo sapiens
tcccctcacctcctcta

SEQ ID NO: 2604636 - DNA, 19 bp, Homo sapiens
tcccctcactgatggacaa

SEQ ID NO: 2604637 - DNA, 15 bp, Homo sapiens
tcccctccactgtca

SEQ ID NO: 2604638 - DNA, 15 bp, Homo sapiens
tcccctcccatctgg

SEQ ID NO: 2604639 - DNA, 12 bp, Homo sapiens
tcccctccctgg

SEQ ID NO: 2604640 - DNA, 19 bp, Homo sapiens
tcccctccctggctcccat

SEQ ID NO: 2604641 - DNA, 16 bp, Homo sapiens
tcccctccctgggttc

SEQ ID NO: 2604642 - DNA, 13 bp, Homo sapiens
tcccctccctgtc

SEQ ID NO: 2604643 - DNA, 20 bp, Homo sapiens
tcccctccttgcctcctgtg

SEQ ID NO: 2604644 - DNA, 17 bp, Homo sapiens
tcccctctcttgcaccc

SEQ ID NO: 2604645 - DNA, 19 bp, Homo sapiens
tcccctctcttgcacccgc

SEQ ID NO: 2604646 - DNA, 14 bp, Homo sapiens
tcccctgcactgga

SEQ ID NO: 2604647 - DNA, 12 bp, Homo sapiens
tcccctgccagg

SEQ ID NO: 2604648 - DNA, 14 bp, Homo sapiens
tcccctgccagggc

SEQ ID NO: 2604649 - DNA, 13 bp, Homo sapiens
tcccctgccattt

SEQ ID NO: 2604650 - DNA, 16 bp, Homo sapiens
tcccctgccctgctgc

SEQ ID NO: 2604651 - DNA, 23 bp, Homo sapiens
tcccctgccctgctgccgcctcc

SEQ ID NO: 2604652 - DNA, 15 bp, Homo sapiens
tcccctgccctggtc

SEQ ID NO: 2604653 - DNA, 24 bp, Homo sapiens
tcccctgccctggtccagggaagc

SEQ ID NO: 2604654 - DNA, 15 bp, Homo sapiens
tcccctggactggga

SEQ ID NO: 2604655 - DNA, 19 bp, Homo sapiens
tcccctgtagagtgggagc

SEQ ID NO: 2604656 - DNA, 15 bp, Homo sapiens
tccccttccctgcaa

SEQ ID NO: 2604657 - DNA, 17 bp, Homo sapiens
tccccttgcccagggct

SEQ ID NO: 2604658 - DNA, 20 bp, Homo sapiens
tccccttgcccagggctcag

SEQ ID NO: 2604659 - DNA, 19 bp, Homo sapiens
tccccttgcccttgccctg

SEQ ID NO: 2604660 - DNA, 22 bp, Homo sapiens
tccccttgggcggctgagagcc

SEQ ID NO: 2604661 - DNA, 17 bp, Homo sapiens
tccccttttattgctgc

SEQ ID NO: 2604662 - DNA, 15 bp, Homo sapiens
tcccgaatagctggg

SEQ ID NO: 2604663 - DNA, 21 bp, Homo sapiens
tcccgcaaaccccctttgtgc

SEQ ID NO: 2604664 - DNA, 18 bp, Homo sapiens
tcccgccagactgttaga

SEQ ID NO: 2604665 - DNA, 21 bp, Homo sapiens
tcccggactgcaagcagggct

SEQ ID NO: 2604666 - DNA, 21 bp, Homo sapiens
tcccgggcccgttgaggatga

SEQ ID NO: 2604667 - DNA, 13 bp, Homo sapiens
tcccgggccctcc

SEQ ID NO: 2604668 - DNA, 15 bp, Homo sapiens
tcccgggccctccct

SEQ ID NO: 2604669 - DNA, 19 bp, Homo sapiens
tcccggggtcctgtggcag

SEQ ID NO: 2604670 - DNA, 13 bp, Homo sapiens
tcccgtgcagctt

SEQ ID NO: 2604671 - DNA, 18 bp, Homo sapiens
tccctaaaaacacagaca

SEQ ID NO: 2604672 - DNA, 18 bp, Homo sapiens
tccctaccacctccccag

SEQ ID NO: 2604673 - DNA, 15 bp, Homo sapiens
tccctacctcaggca

SEQ ID NO: 2604674 - DNA, 17 bp, Homo sapiens
tccctacttcctgtgac

SEQ ID NO: 2604675 - DNA, 18 bp, Homo sapiens
tccctagaaacttccaaa

SEQ ID NO: 2604676 - DNA, 17 bp, Homo sapiens
tccctagagggttcctg

SEQ ID NO: 2604677 - DNA, 16 bp, Homo sapiens
tccctagatctttcta

SEQ ID NO: 2604678 - DNA, 22 bp, Homo sapiens
tccctagccagcacttgtatat

SEQ ID NO: 2604679 - DNA, 22 bp, Homo sapiens
tccctagtctattcattatatt

SEQ ID NO: 2604680 - DNA, 13 bp, Homo sapiens
tccctatgtattt

SEQ ID NO: 2604681 - DNA, 15 bp, Homo sapiens
tccctatgtatttgc

SEQ ID NO: 2604682 - DNA, 16 bp, Homo sapiens
tccctattagagaaga

SEQ ID NO: 2604683 - DNA, 18 bp, Homo sapiens
tccctcaacaagggagag

SEQ ID NO: 2604684 - DNA, 23 bp, Homo sapiens
tccctcaacaagggagagacctc

SEQ ID NO: 2604685 - DNA, 16 bp, Homo sapiens
tccctcaattccccct

SEQ ID NO: 2604686 - DNA, 16 bp, Homo sapiens
tccctcagcccctctt

SEQ ID NO: 2604687 - DNA, 22 bp, Homo sapiens
tccctcatcctcatacccaccc

SEQ ID NO: 2604688 - DNA, 16 bp, Homo sapiens
tccctcatctgtccct

SEQ ID NO: 2604689 - DNA, 23 bp, Homo sapiens
tccctcatttcaggagcagcctc

SEQ ID NO: 2604690 - DNA, 13 bp, Homo sapiens
tccctcccctgcc

SEQ ID NO: 2604691 - DNA, 19 bp, Homo sapiens
tccctcccctgccctggtc

SEQ ID NO: 2604692 - DNA, 18 bp, Homo sapiens
tccctccgatccttcctc

SEQ ID NO: 2604693 - DNA, 14 bp, Homo sapiens
tccctccgggacct

SEQ ID NO: 2604694 - DNA, 16 bp, Homo sapiens
tccctcctcacctctg

SEQ ID NO: 2604695 - DNA, 18 bp, Homo sapiens
tccctcctgggatctgct

SEQ ID NO: 2604696 - DNA, 14 bp, Homo sapiens
tccctctaatttat

SEQ ID NO: 2604697 - DNA, 23 bp, Homo sapiens
tccctctcaggcatgcctgtgtg

SEQ ID NO: 2604698 - DNA, 12 bp, Homo sapiens
tccctctccctg

SEQ ID NO: 2604699 - DNA, 12 bp, Homo sapiens
tccctctctctg

SEQ ID NO: 2604700 - DNA, 20 bp, Homo sapiens
tccctctctcttctgctcca

SEQ ID NO: 2604701 - DNA, 21 bp, Homo sapiens
tccctctctcttctgctccac

SEQ ID NO: 2604702 - DNA, 22 bp, Homo sapiens
tccctctgagaattccaaggag

SEQ ID NO: 2604703 - DNA, 19 bp, Homo sapiens
tccctctgaggctgtagga

SEQ ID NO: 2604704 - DNA, 15 bp, Homo sapiens
tccctctgctcctgg

SEQ ID NO: 2604705 - DNA, 20 bp, Homo sapiens
tccctctgctcctggagcct

SEQ ID NO: 2604706 - DNA, 14 bp, Homo sapiens
tccctcttctcaag

SEQ ID NO: 2604707 - DNA, 17 bp, Homo sapiens
tccctcttctcaagtgc

SEQ ID NO: 2604708 - DNA, 19 bp, Homo sapiens
tccctcttctcaagtgcct

SEQ ID NO: 2604709 - DNA, 17 bp, Homo sapiens
tccctcttggtcttccc

SEQ ID NO: 2604710 - DNA, 15 bp, Homo sapiens
tccctgaactgggac

SEQ ID NO: 2604711 - DNA, 16 bp, Homo sapiens
tccctgaaggccccgc

SEQ ID NO: 2604712 - DNA, 17 bp, Homo sapiens
tccctgaaggccccgcc

SEQ ID NO: 2604713 - DNA, 22 bp, Homo sapiens
tccctgactcattctgaaggag

SEQ ID NO: 2604714 - DNA, 17 bp, Homo sapiens
tccctgactctctgtga

SEQ ID NO: 2604715 - DNA, 20 bp, Homo sapiens
tccctgactctctgtgacct

SEQ ID NO: 2604716 - DNA, 19 bp, Homo sapiens
tcctgtccacacccagctc

SEQ ID NO: 2604717 - DNA, 14 bp, Homo sapiens
tcctgtccagagag

SEQ ID NO: 2604718 - DNA, 16 bp, Homo sapiens
tcctgtcccaccatgc

SEQ ID NO: 2604719 - DNA, 15 bp, Homo sapiens
tcctgtctctggcct

SEQ ID NO: 2604720 - DNA, 12 bp, Homo sapiens
tcctgtctgcca

SEQ ID NO: 2604721 - DNA, 16 bp, Homo sapiens
tcctgtctgccagcca

SEQ ID NO: 2604722 - DNA, 15 bp, Homo sapiens
tcctgtcttcctgca

SEQ ID NO: 2604723 - DNA, 17 bp, Homo sapiens
tcctgtctttaaggaaa

SEQ ID NO: 2604724 - DNA, 18 bp, Homo sapiens
tcctgtctttaaggaaaa

SEQ ID NO: 2604725 - DNA, 14 bp, Homo sapiens
tcctgtgacatgta

SEQ ID NO: 2604726 - DNA, 18 bp, Homo sapiens
tcctgtgcatgggtgaag

SEQ ID NO: 2604727 - DNA, 18 bp, Homo sapiens
tcctgtgctactttgcct

SEQ ID NO: 2604728 - DNA, 24 bp, Homo sapiens
tcctgtgtcttgcaatggcagcct

SEQ ID NO: 2604729 - DNA, 13 bp, Homo sapiens
tcctgtgtgtgcg

SEQ ID NO: 2604730 - DNA, 14 bp, Homo sapiens
tcctgtgtgtgcgc

SEQ ID NO: 2604731 - DNA, 19 bp, Homo sapiens
tcctgttgttgttaatgaa

SEQ ID NO: 2604732 - DNA, 21 bp, Homo sapiens
tcctgttgttgttaatgaaaa

SEQ ID NO: 2604733 - DNA, 18 bp, Homo sapiens
tcctgtttgggcccctct

SEQ ID NO: 2604734 - DNA, 15 bp, Homo sapiens
tccttaaacagggca

SEQ ID NO: 2604735 - DNA, 23 bp, Homo sapiens
tccttaaacagggcatctccagg

SEQ ID NO: 2604736 - DNA, 17 bp, Homo sapiens
tccttaaactgtgtgga

SEQ ID NO: 2604737 - DNA, 14 bp, Homo sapiens
tccttaatgatccg

SEQ ID NO: 2604738 - DNA, 20 bp, Homo sapiens
tccttaccagcagagcacct

SEQ ID NO: 2604739 - DNA, 21 bp, Homo sapiens
tccttaccagcagagcacctt

SEQ ID NO: 2604740 - DNA, 17 bp, Homo sapiens
tccttagaccttccata

SEQ ID NO: 2604741 - DNA, 21 bp, Homo sapiens
tccttagcttagacctcagcc

SEQ ID NO: 2604742 - DNA, 23 bp, Homo sapiens
tccttagcttagacctcagcctg

SEQ ID NO: 2604743 - DNA, 16 bp, Homo sapiens
tccttagtcttctcat

SEQ ID NO: 2604744 - DNA, 22 bp, Homo sapiens
tccttagtcttctcatagcatt

SEQ ID NO: 2604745 - DNA, 22 bp, Homo sapiens
tccttatgtatatttaaaagaa

SEQ ID NO: 2604746 - DNA, 20 bp, Homo sapiens
tccttcaagatcatgtaccc

SEQ ID NO: 2604747 - DNA, 23 bp, Homo sapiens
tccttcaagttagctcaggaggc

SEQ ID NO: 2604748 - DNA, 18 bp, Homo sapiens
tccttcacagatgggtgc

SEQ ID NO: 2604749 - DNA, 19 bp, Homo sapiens
tccttcacagatgggtgct

SEQ ID NO: 2604750 - DNA, 17 bp, Homo sapiens
tccttcacctcactgaa

SEQ ID NO: 2604751 - DNA, 19 bp, Homo sapiens
tccttcacctcactgaaaa

SEQ ID NO: 2604752 - DNA, 13 bp, Homo sapiens
tccttcacctctg

SEQ ID NO: 2604753 - DNA, 20 bp, Homo sapiens
tccttcacctttgtccccac

SEQ ID NO: 2604754 - DNA, 21 bp, Homo sapiens
tccttcacctttgtccccacc

SEQ ID NO: 2604755 - DNA, 12 bp, Homo sapiens
tccttcagtgca

SEQ ID NO: 2604756 - DNA, 13 bp, Homo sapiens
tccttccaggccc

SEQ ID NO: 2604757 - DNA, 16 bp, Homo sapiens
tccttccaggccccca

SEQ ID NO: 2604758 - DNA, 16 bp, Homo sapiens
tccttccatccctacc

SEQ ID NO: 2604759 - DNA, 13 bp, Homo sapiens
tccttcctgtctt

SEQ ID NO: 2604760 - DNA, 14 bp, Homo sapiens
tccttcctgtcttc

SEQ ID NO: 2604761 - DNA, 20 bp, Homo sapiens
tccttctttgataatgttaa

SEQ ID NO: 2604762 - DNA, 23 bp, Homo sapiens
tccttgaaaacactgttctctgc

SEQ ID NO: 2604763 - DNA, 21 bp, Homo sapiens
tccttgcacactcccctgcac

SEQ ID NO: 2604764 - DNA, 20 bp, Homo sapiens
tccttgcacccctcactctg

SEQ ID NO: 2604765 - DNA, 15 bp, Homo sapiens
tccttgcatcaattt

SEQ ID NO: 2604766 - DNA, 19 bp, Homo sapiens
tccttgctgtcctaggcca

SEQ ID NO: 2604767 - DNA, 12 bp, Homo sapiens
tccttggaaatc

SEQ ID NO: 2604768 - DNA, 16 bp, Homo sapiens
tccttggactcatttt

SEQ ID NO: 2604769 - DNA, 20 bp, Homo sapiens
tccttggcatcacagggcag

SEQ ID NO: 2604770 - DNA, 18 bp, Homo sapiens
tccttggcatgccttcca

SEQ ID NO: 2604771 - DNA, 20 bp, Homo sapiens
tccttggcatgccttccagc

SEQ ID NO: 2604772 - DNA, 15 bp, Homo sapiens
tccttggctggtgca

SEQ ID NO: 2604773 - DNA, 21 bp, Homo sapiens
tccttgggaggccccactggg

SEQ ID NO: 2604774 - DNA, 17 bp, Homo sapiens
tccttgggcacttttta

SEQ ID NO: 2604775 - DNA, 13 bp, Homo sapiens
tccttgggccctt

SEQ ID NO: 2604776 - DNA, 14 bp, Homo sapiens
tccttgggcccttt

SEQ ID NO: 2604777 - DNA, 18 bp, Homo sapiens
tccttggtgcctggcctg

SEQ ID NO: 2604778 - DNA, 13 bp, Homo sapiens
tccttgtcactgg

SEQ ID NO: 2604779 - DNA, 13 bp, Homo sapiens
tccttgtccccac

SEQ ID NO: 2604780 - DNA, 22 bp, Homo sapiens
tccttgtccccacactcctaca

SEQ ID NO: 2604781 - DNA, 18 bp, Homo sapiens
tccttgtggcctgggcct

SEQ ID NO: 2604782 - DNA, 17 bp, Homo sapiens
tccttgtggtttatgtc

SEQ ID NO: 2604783 - DNA, 19 bp, Homo sapiens
tccttgtggtttatgtcat

SEQ ID NO: 2604784 - DNA, 22 bp, Homo sapiens
tccttgtttcaaacacaaatgc

SEQ ID NO: 2604785 - DNA, 22 bp, Homo sapiens
tcctttaaaaaaatttaagtgc

SEQ ID NO: 2604786 - DNA, 12 bp, Homo sapiens
tcctttacacat

SEQ ID NO: 2604787 - DNA, 22 bp, Homo sapiens
tcctttacacattcggctccct

SEQ ID NO: 2604788 - DNA, 22 bp, Homo sapiens
tcctttagcgcccagttgggtg

SEQ ID NO: 2604789 - DNA, 23 bp, Homo sapiens
tcctttcagggaatttcaggaac

SEQ ID NO: 2604790 - DNA, 23 bp, Homo sapiens
tcctttctcagccgcttctgact

SEQ ID NO: 2604791 - DNA, 16 bp, Homo sapiens
tcctttctccagccag

SEQ ID NO: 2604792 - DNA, 17 bp, Homo sapiens
tcctttctccagccagc

SEQ ID NO: 2604793 - DNA, 18 bp, Homo sapiens
tcctttctccagccagca

SEQ ID NO: 2604794 - DNA, 16 bp, Homo sapiens
tcctttctttttcttc

SEQ ID NO: 2604795 - DNA, 22 bp, Homo sapiens
tcctttgatcagtataattttt

SEQ ID NO: 2604796 - DNA, 15 bp, Homo sapiens
tcctttgcaggctca

SEQ ID NO: 2604797 - DNA, 11 bp, Homo sapiens
tcctttgtata

SEQ ID NO: 2604798 - DNA, 19 bp, Homo sapiens
tcctttgtatattatttct

SEQ ID NO: 2604799 - DNA, 15 bp, Homo sapiens
tcctttgtttttatg

SEQ ID NO: 2604800 - DNA, 17 bp, Homo sapiens
tccttttgtgtacagtg

SEQ ID NO: 2604801 - DNA, 14 bp, Homo sapiens
tcctttttctccct

SEQ ID NO: 2604802 - DNA, 19 bp, Homo sapiens
tcctttttctttataaact

SEQ ID NO: 2604803 - DNA, 20 bp, Homo sapiens
tcgaaataacaatgttaagg

SEQ ID NO: 2604804 - DNA, 15 bp, Homo sapiens
tcgaactggctgcaa

SEQ ID NO: 2604805 - DNA, 14 bp, Homo sapiens
tcgaagctcagccc

SEQ ID NO: 2604806 - DNA, 18 bp, Homo sapiens
tcgaagctcagcccaccc

SEQ ID NO: 2604807 - DNA, 19 bp, Homo sapiens
tcgaagctcagcccacccc

SEQ ID NO: 2604808 - DNA, 15 bp, Homo sapiens
tcgaattaatagctt

SEQ ID NO: 2604809 - DNA, 21 bp, Homo sapiens
tcgaattaatagcttttattg

SEQ ID NO: 2604810 - DNA, 22 bp, Homo sapiens
tcgacctgcggctgctgtgtgc

SEQ ID NO: 2604811 - DNA, 14 bp, Homo sapiens
tcgagacagaacct

SEQ ID NO: 2604812 - DNA, 17 bp, Homo sapiens
tcgagaccagcctggcc

SEQ ID NO: 2604813 - DNA, 16 bp, Homo sapiens
tcgagcatgcctggat

SEQ ID NO: 2604814 - DNA, 17 bp, Homo sapiens
tcgaggaaccagagcca

SEQ ID NO: 2604815 - DNA, 17 bp, Homo sapiens
tcgaggacagggaggtg

SEQ ID NO: 2604816 - DNA, 16 bp, Homo sapiens
tcgaggctgcagtcag

SEQ ID NO: 2604817 - DNA, 20 bp, Homo sapiens
tcgaggctgcagtcagtcat

SEQ ID NO: 2604818 - DNA, 21 bp, Homo sapiens
tcgaggtagagtttgaaggag

SEQ ID NO: 2604819 - DNA, 13 bp, Homo sapiens
tcgcacagtctct

SEQ ID NO: 2604820 - DNA, 19 bp, Homo sapiens
tcgcagagaggccaggtgc

SEQ ID NO: 2604821 - DNA, 15 bp, Homo sapiens
tcgcatcaaaagaca

SEQ ID NO: 2604822 - DNA, 21 bp, Homo sapiens
tcgccacctggcattccttct

SEQ ID NO: 2604823 - DNA, 18 bp, Homo sapiens
tcgcccaaagccagacag

SEQ ID NO: 2604824 - DNA, 19 bp, Homo sapiens
tcgcccaggctggagtgca

SEQ ID NO: 2604825 - DNA, 14 bp, Homo sapiens
tcgcccagtctgga

SEQ ID NO: 2604826 - DNA, 22 bp, Homo sapiens
tcgccccagatcaccagcccgg

SEQ ID NO: 2604827 - DNA, 13 bp, Homo sapiens
tcgccctcccagg

SEQ ID NO: 2604828 - DNA, 17 bp, Homo sapiens
tcgccctcccaggctct

SEQ ID NO: 2604829 - DNA, 15 bp, Homo sapiens
tcgccgtctgtgaat

SEQ ID NO: 2604830 - DNA, 16 bp, Homo sapiens
tcgcctgtaatctcac

SEQ ID NO: 2604831 - DNA, 23 bp, Homo sapiens
tcgcctttcccaggtgctacacc

SEQ ID NO: 2604832 - DNA, 14 bp, Homo sapiens
tcgcgctcagcatg

SEQ ID NO: 2604833 - DNA, 16 bp, Homo sapiens
tcgcggcggagctggc

SEQ ID NO: 2604834 - DNA, 13 bp, Homo sapiens
tcgctcctgtgtc

SEQ ID NO: 2604835 - DNA, 21 bp, Homo sapiens
tcgctctgttgcccaggctgg

SEQ ID NO: 2604836 - DNA, 20 bp, Homo sapiens
tcgctgccagctctgtatca

SEQ ID NO: 2604837 - DNA, 22 bp, Homo sapiens
tcgctggactctcagtctctga

SEQ ID NO: 2604838 - DNA, 23 bp, Homo sapiens
tcgctgtgtcagcatagaagtaa

SEQ ID NO: 2604839 - DNA, 15 bp, Homo sapiens
tcgcttttgataatc

SEQ ID NO: 2604840 - DNA, 15 bp, Homo sapiens
tcggaaaacatgcta

SEQ ID NO: 2604841 - DNA, 13 bp, Homo sapiens
tcggaagcagtgc

SEQ ID NO: 2604842 - DNA, 19 bp, Homo sapiens
tcggaaggctggctgggca

SEQ ID NO: 2604843 - DNA, 23 bp, Homo sapiens
tcggactaagcctacctgctctc

SEQ ID NO: 2604844 - DNA, 15 bp, Homo sapiens
tcggagacagtgatc

SEQ ID NO: 2604845 - DNA, 23 bp, Homo sapiens
tcggagacagtgatctccatatg

SEQ ID NO: 2604846 - DNA, 23 bp, Homo sapiens
tcggaggctgcccccggccccct

SEQ ID NO: 2604847 - DNA, 20 bp, Homo sapiens
tcggatctggggctctggga

SEQ ID NO: 2604848 - DNA, 16 bp, Homo sapiens
tcggcatttcaaatgt

SEQ ID NO: 2604849 - DNA, 12 bp, Homo sapiens
tcgggaagagag

SEQ ID NO: 2604850 - DNA, 16 bp, Homo sapiens
tcgggacacctgccct

SEQ ID NO: 2604851 - DNA, 19 bp, Homo sapiens
tcgggacacctgccctgcc

SEQ ID NO: 2604852 - DNA, 15 bp, Homo sapiens
tcgggagcagtgtct

SEQ ID NO: 2604853 - DNA, 22 bp, Homo sapiens
tcgggagcagtgtcttccataa

SEQ ID NO: 2604854 - DNA, 21 bp, Homo sapiens
tcgggaggtcgaggcaggagg

SEQ ID NO: 2604855 - DNA, 14 bp, Homo sapiens
tcgggcccacctgg

SEQ ID NO: 2604856 - DNA, 18 bp, Homo sapiens
tcgggcccacctggccac

SEQ ID NO: 2604857 - DNA, 21 bp, Homo sapiens
tcgggcccacctggccacctg

SEQ ID NO: 2604858 - DNA, 11 bp, Homo sapiens
tcgggcccagc

SEQ ID NO: 2604859 - DNA, 14 bp, Homo sapiens
tcgggcccagcccc

SEQ ID NO: 2604860 - DNA, 15 bp, Homo sapiens
aaaatactgccagat

SEQ ID NO: 2604861 - DNA, 18 bp, Homo sapiens
aaaatactgccagatgct

SEQ ID NO: 2604862 - DNA, 9 bp, Homo sapiens
aaaatactt

SEQ ID NO: 2604863 - DNA, 21 bp, Homo sapiens
aaaatacttgtcaatatttaa

SEQ ID NO: 2604864 - DNA, 14 bp, Homo sapiens
aaaatagaagaata

SEQ ID NO: 2604865 - DNA, 22 bp, Homo sapiens
aaaatagataagagtagaaact

SEQ ID NO: 2604866 - DNA, 19 bp, Homo sapiens
aaaatagcttgtatagtgt

SEQ ID NO: 2604867 - DNA, 21 bp, Homo sapiens
aaaatagcttgtatagtgtaa

SEQ ID NO: 2604868 - DNA, 13 bp, Homo sapiens
aaaatataaaata

SEQ ID NO: 2604869 - DNA, 24 bp, Homo sapiens
aaaatataattttttagagagctg

SEQ ID NO: 2604870 - DNA, 11 bp, Homo sapiens
aaaatatactg

SEQ ID NO: 2604871 - DNA, 16 bp, Homo sapiens
aaaatatactgtaaag

SEQ ID NO: 2604872 - DNA, 18 bp, Homo sapiens
aaaatatactgtaaagaa

SEQ ID NO: 2604873 - DNA, 22 bp, Homo sapiens
aaaatatactgtaaagaaagag

SEQ ID NO: 2604874 - DNA, 23 bp, Homo sapiens
aaaatatactgtaaagaaagaga

SEQ ID NO: 2604875 - DNA, 13 bp, Homo sapiens
aaaatatgatatt

SEQ ID NO: 2604876 - DNA, 16 bp, Homo sapiens
aaaatatggaacttct

SEQ ID NO: 2604877 - DNA, 13 bp, Homo sapiens
aaaatattttcat

SEQ ID NO: 2604878 - DNA, 12 bp, Homo sapiens
aaaatattttga

SEQ ID NO: 2604879 - DNA, 20 bp, Homo sapiens
aaaatattttttatatatac

SEQ ID NO: 2604880 - DNA, 13 bp, Homo sapiens
aaaatcagcctgc

SEQ ID NO: 2604881 - DNA, 22 bp, Homo sapiens
aaaatcataaactgtgtgcaga

SEQ ID NO: 2604882 - DNA, 10 bp, Homo sapiens
aaaatcattt

SEQ ID NO: 2604883 - DNA, 20 bp, Homo sapiens
aaaatctaccttctgtagtt

SEQ ID NO: 2604884 - DNA, 21 bp, Homo sapiens
aaaatctaccttctgtagttt

SEQ ID NO: 2604885 - DNA, 17 bp, Homo sapiens
aaaatgacagatgttga

SEQ ID NO: 2604886 - DNA, 21 bp, Homo sapiens
aaaatgactaaaaatattata

SEQ ID NO: 2604887 - DNA, 19 bp, Homo sapiens
aaaatgattgtaaaatagc

SEQ ID NO: 2604888 - DNA, 20 bp, Homo sapiens
aaaatgattgtaaaatagct

SEQ ID NO: 2604889 - DNA, 18 bp, Homo sapiens
aaaatgcaaatcctatgt

SEQ ID NO: 2604890 - DNA, 14 bp, Homo sapiens
aaaatgcacatagc

SEQ ID NO: 2604891 - DNA, 17 bp, Homo sapiens
aaaatgcccttaaatca

SEQ ID NO: 2604892 - DNA, 11 bp, Homo sapiens
aaaatgccttt

SEQ ID NO: 2604893 - DNA, 15 bp, Homo sapiens
aaaatgcctttgaga

SEQ ID NO: 2604894 - DNA, 13 bp, Homo sapiens
aaaatggaaagaa

SEQ ID NO: 2604895 - DNA, 19 bp, Homo sapiens
aaaatggccatttgctttt

SEQ ID NO: 2604896 - DNA, 23 bp, Homo sapiens
aaaatggccatttgctttttcac

SEQ ID NO: 2604897 - DNA, 20 bp, Homo sapiens
aaaatgtaaatattctatat

SEQ ID NO: 2604898 - DNA, 21 bp, Homo sapiens
aaaatgtagggttataataat

SEQ ID NO: 2604899 - DNA, 18 bp, Homo sapiens
aaaatgtatgtgtaagta

SEQ ID NO: 2604900 - DNA, 16 bp, Homo sapiens
aaaatgtgacccagat

SEQ ID NO: 2604901 - DNA, 18 bp, Homo sapiens
aaaatgtgatttttctga

SEQ ID NO: 2604902 - DNA, 19 bp, Homo sapiens
aaaatgtgcaaaacagcgt

SEQ ID NO: 2604903 - DNA, 20 bp, Homo sapiens
aaaatgtgctatactgcata

SEQ ID NO: 2604904 - DNA, 14 bp, Homo sapiens
aaaattaacactgc

SEQ ID NO: 2604905 - DNA, 18 bp, Homo sapiens
aaaattatagatgggaat

SEQ ID NO: 2604906 - DNA, 14 bp, Homo sapiens
aaaattatttcaga

SEQ ID NO: 2604907 - DNA, 21 bp, Homo sapiens
aaaattatttgaaaacatata

SEQ ID NO: 2604908 - DNA, 17 bp, Homo sapiens
aaaattattttaaacaa

SEQ ID NO: 2604909 - DNA, 13 bp, Homo sapiens
aaaattattttgg

SEQ ID NO: 2604910 - DNA, 14 bp, Homo sapiens
aaaattcaaaaagt

SEQ ID NO: 2604911 - DNA, 16 bp, Homo sapiens
aaaattcaaaaagtgt

SEQ ID NO: 2604912 - DNA, 14 bp, Homo sapiens
aaaattcctattgt

SEQ ID NO: 2604913 - DNA, 13 bp, Homo sapiens
aaaattgtgatca

SEQ ID NO: 2604914 - DNA, 23 bp, Homo sapiens
aaaatttaagcattgtttgctta

SEQ ID NO: 2604915 - DNA, 18 bp, Homo sapiens
aaaatttaagtgcgtgtg

SEQ ID NO: 2604916 - DNA, 23 bp, Homo sapiens
aaaatttaagtgcgtgtgtagag

SEQ ID NO: 2604917 - DNA, 19 bp, Homo sapiens
aaaatttagtttttgttct

SEQ ID NO: 2604918 - DNA, 23 bp, Homo sapiens
aaaatttccagtacctttgtcac

SEQ ID NO: 2604919 - DNA, 16 bp, Homo sapiens
aaaatttgttttgacg

SEQ ID NO: 2604920 - DNA, 14 bp, Homo sapiens
aaaattttatagct

SEQ ID NO: 2604921 - DNA, 13 bp, Homo sapiens
aaaattttattcc

SEQ ID NO: 2604922 - DNA, 17 bp, Homo sapiens
aaaattttttttcatgt

SEQ ID NO: 2604923 - DNA, 14 bp, Homo sapiens
aaacaaatatgcaa

SEQ ID NO: 2604924 - DNA, 17 bp, Homo sapiens
aaacaaatatgcaaaag

SEQ ID NO: 2604925 - DNA, 21 bp, Homo sapiens
aaacaaattcatattctgtct

SEQ ID NO: 2604926 - DNA, 17 bp, Homo sapiens
aaacaactctttgagaa

SEQ ID NO: 2604927 - DNA, 20 bp, Homo sapiens
aaacaagaccacgtttctaa

SEQ ID NO: 2604928 - DNA, 20 bp, Homo sapiens
aaacacaaaagttagctgag

SEQ ID NO: 2604929 - DNA, 15 bp, Homo sapiens
aaacacactgaggca

SEQ ID NO: 2604930 - DNA, 14 bp, Homo sapiens
aaacacagcaaggg

SEQ ID NO: 2604931 - DNA, 15 bp, Homo sapiens
aaacaccctcacact

SEQ ID NO: 2604932 - DNA, 14 bp, Homo sapiens
aaacacctagcttt

SEQ ID NO: 2604933 - DNA, 15 bp, Homo sapiens
aaacacctagcttta

SEQ ID NO: 2604934 - DNA, 15 bp, Homo sapiens
aaacaccttctctgg

SEQ ID NO: 2604935 - DNA, 21 bp, Homo sapiens
aaacacgcacttagtctctaa

SEQ ID NO: 2604936 - DNA, 23 bp, Homo sapiens
aaacactgccatcttagtttgga

SEQ ID NO: 2604937 - DNA, 18 bp, Homo sapiens
aaacactgttctctgccc

SEQ ID NO: 2604938 - DNA, 21 bp, Homo sapiens
aaacagaaacaaaaacactaa

SEQ ID NO: 2604939 - DNA, 15 bp, Homo sapiens
aaacagagacaggcc

SEQ ID NO: 2604940 - DNA, 16 bp, Homo sapiens
aaacagagacaggccc

SEQ ID NO: 2604941 - DNA, 15 bp, Homo sapiens
aaacagatttttaca

SEQ ID NO: 2604942 - DNA, 23 bp, Homo sapiens
aaacagccgtcagccaaatgtaa

SEQ ID NO: 2604943 - DNA, 16 bp, Homo sapiens
aaacaggagacaggaa

SEQ ID NO: 2604944 - DNA, 17 bp, Homo sapiens
aaacaggagacaggaag

SEQ ID NO: 2604945 - DNA, 11 bp, Homo sapiens
aaacaggcagt

SEQ ID NO: 2604946 - DNA, 21 bp, Homo sapiens
aaacaggcagttggccagaga

SEQ ID NO: 2604947 - DNA, 13 bp, Homo sapiens
aaacaggcccagc

SEQ ID NO: 2604948 - DNA, 19 bp, Homo sapiens
aaacagggcatctccagga

SEQ ID NO: 2604949 - DNA, 17 bp, Homo sapiens
aaacaggtcaatacagt

SEQ ID NO: 2604950 - DNA, 14 bp, Homo sapiens
aaacagtagtgata

SEQ ID NO: 2604951 - DNA, 14 bp, Homo sapiens
aaacagtgagcctg

SEQ ID NO: 2604952 - DNA, 14 bp, Homo sapiens
aaacagttaacttt

SEQ ID NO: 2604953 - DNA, 20 bp, Homo sapiens
aaacataatcttctgccttc

SEQ ID NO: 2604954 - DNA, 13 bp, Homo sapiens
aaacataattctt

SEQ ID NO: 2604955 - DNA, 20 bp, Homo sapiens
aaacatccttcaagaactct

SEQ ID NO: 2604956 - DNA, 12 bp, Homo sapiens
aaacatgaagtg

SEQ ID NO: 2604957 - DNA, 21 bp, Homo sapiens
aaacatgaccctaaatcttga

SEQ ID NO: 2604958 - DNA, 17 bp, Homo sapiens
aaacatggcctttgctt

SEQ ID NO: 2604959 - DNA, 22 bp, Homo sapiens
aaacatggggttggctgggccc

SEQ ID NO: 2604960 - DNA, 16 bp, Homo sapiens
aaacatgttagaagca

SEQ ID NO: 2604961 - DNA, 12 bp, Homo sapiens
aaacatgtttcc

SEQ ID NO: 2604962 - DNA, 20 bp, Homo sapiens
aaacattggttcttgtatta

SEQ ID NO: 2604963 - DNA, 13 bp, Homo sapiens
aaacattttcaca

SEQ ID NO: 2604964 - DNA, 14 bp, Homo sapiens
aaacattttcacac

SEQ ID NO: 2604965 - DNA, 15 bp, Homo sapiens
aaaccaagcaaagga

SEQ ID NO: 2604966 - DNA, 17 bp, Homo sapiens
aaaccacagccctgtca

SEQ ID NO: 2604967 - DNA, 18 bp, Homo sapiens
aaaccacagccctgtcag

SEQ ID NO: 2604968 - DNA, 15 bp, Homo sapiens
aaaccataaacttca

SEQ ID NO: 2604969 - DNA, 13 bp, Homo sapiens
aaaccatgtagaa

SEQ ID NO: 2604970 - DNA, 20 bp, Homo sapiens
aaaccattatgaagaagaga

SEQ ID NO: 2604971 - DNA, 15 bp, Homo sapiens
aaacccccacacaca

SEQ ID NO: 2604972 - DNA, 22 bp, Homo sapiens
aaacccccacacacacacacat

SEQ ID NO: 2604973 - DNA, 16 bp, Homo sapiens
aaaccctattggtaaa

SEQ ID NO: 2604974 - DNA, 21 bp, Homo sapiens
aaaccctgtctctactaaaaa

SEQ ID NO: 2604975 - DNA, 15 bp, Homo sapiens
aaaccgccaaggctg

SEQ ID NO: 2604976 - DNA, 11 bp, Homo sapiens
aaacctctgtt

SEQ ID NO: 2604977 - DNA, 17 bp, Homo sapiens
aaacctctgttcagtgt

SEQ ID NO: 2604978 - DNA, 16 bp, Homo sapiens
aaacctgaaaaaaagt

SEQ ID NO: 2604979 - DNA, 12 bp, Homo sapiens
aaacctgcctgg

SEQ ID NO: 2604980 - DNA, 16 bp, Homo sapiens
aaacctgcctgggttt

SEQ ID NO: 2604981 - DNA, 16 bp, Homo sapiens
aaacctgtttaaatat

SEQ ID NO: 2604982 - DNA, 18 bp, Homo sapiens
aaaccttattgtacctct

SEQ ID NO: 2604983 - DNA, 14 bp, Homo sapiens
aaaccttgcctttc

SEQ ID NO: 2604984 - DNA, 11 bp, Homo sapiens
aaacctttcaa

SEQ ID NO: 2604985 - DNA, 15 bp, Homo sapiens
aaaccttttttaaga

SEQ ID NO: 2604986 - DNA, 18 bp, Homo sapiens
aaaccttttttaagattt

SEQ ID NO: 2604987 - DNA, 23 bp, Homo sapiens
aaaccttttttaagatttttctc

SEQ ID NO: 2604988 - DNA, 16 bp, Homo sapiens
aaacgatttaattctc

SEQ ID NO: 2604989 - DNA, 19 bp, Homo sapiens
aaacgcaaagggctgaaag

SEQ ID NO: 2604990 - DNA, 20 bp, Homo sapiens
aaacgcatggagtgtgtatt

SEQ ID NO: 2604991 - DNA, 12 bp, Homo sapiens
aaacggattatt

SEQ ID NO: 2604992 - DNA, 14 bp, Homo sapiens
aaacggattatttt

SEQ ID NO: 2604993 - DNA, 15 bp, Homo sapiens
aaacgggctcagcaa

SEQ ID NO: 2604994 - DNA, 16 bp, Homo sapiens
aaacgtatgcatgtga

SEQ ID NO: 2604995 - DNA, 12 bp, Homo sapiens
aaacgtgaaaat

SEQ ID NO: 2604996 - DNA, 17 bp, Homo sapiens
aaacgtgttgccttgaa

SEQ ID NO: 2604997 - DNA, 18 bp, Homo sapiens
aaactaaatctctaatat

SEQ ID NO: 2604998 - DNA, 20 bp, Homo sapiens
aaactaaattgtaaactcct

SEQ ID NO: 2604999 - DNA, 18 bp, Homo sapiens
aaactaaggccctcttga

SEQ ID NO: 2605000 - DNA, 11 bp, Homo sapiens
aaactaatcca

SEQ ID NO: 2605001 - DNA, 20 bp, Homo sapiens
aaactacctaacattattta

SEQ ID NO: 2605002 - DNA, 15 bp, Homo sapiens
aaactagctcgtgat

SEQ ID NO: 2605003 - DNA, 17 bp, Homo sapiens
aaactaggaaatttttt

SEQ ID NO: 2605004 - DNA, 11 bp, Homo sapiens
aaactatcagt

SEQ ID NO: 2605005 - DNA, 16 bp, Homo sapiens
aaactatcttggtgaa

SEQ ID NO: 2605006 - DNA, 20 bp, Homo sapiens
aaattctcagtcagtaattg

SEQ ID NO: 2605007 - DNA, 14 bp, Homo sapiens
aaattctgtttctt

SEQ ID NO: 2605008 - DNA, 21 bp, Homo sapiens
aaattcttgcaaagtatccct

SEQ ID NO: 2605009 - DNA, 22 bp, Homo sapiens
aaattgacagatcaagctgtga

SEQ ID NO: 2605010 - DNA, 20 bp, Homo sapiens
aaattggtatcaagaaagtc

SEQ ID NO: 2605011 - DNA, 21 bp, Homo sapiens
aaattgtcccttaaacaaaaa

SEQ ID NO: 2605012 - DNA, 22 bp, Homo sapiens
aaattgtttaagtgttgtaaat

SEQ ID NO: 2605013 - DNA, 16 bp, Homo sapiens
aaatttaagtgcgtgt

SEQ ID NO: 2605014 - DNA, 18 bp, Homo sapiens
aaatttaattcatgtttc

SEQ ID NO: 2605015 - DNA, 19 bp, Homo sapiens
aaatttatttactgctagt

SEQ ID NO: 2605016 - DNA, 21 bp, Homo sapiens
aaatttatttactgctagtct

SEQ ID NO: 2605017 - DNA, 19 bp, Homo sapiens
aaatttccagtgagcttat

SEQ ID NO: 2605018 - DNA, 18 bp, Homo sapiens
aaatttccccaacagtgt

SEQ ID NO: 2605019 - DNA, 19 bp, Homo sapiens
aaatttccccaacagtgtg

SEQ ID NO: 2605020 - DNA, 22 bp, Homo sapiens
aaatttccccaacagtgtgaag

SEQ ID NO: 2605021 - DNA, 23 bp, Homo sapiens
aaatttccccaacagtgtgaagt

SEQ ID NO: 2605022 - DNA, 19 bp, Homo sapiens
aaatttctaaatctccaaa

SEQ ID NO: 2605023 - DNA, 14 bp, Homo sapiens
aaatttgatttcta

SEQ ID NO: 2605024 - DNA, 13 bp, Homo sapiens
aaatttgtaagtt

SEQ ID NO: 2605025 - DNA, 19 bp, Homo sapiens
aaatttgtaagtttcaggt

SEQ ID NO: 2605026 - DNA, 20 bp, Homo sapiens
aaatttgtaagtttcaggtg

SEQ ID NO: 2605027 - DNA, 23 bp, Homo sapiens
aaatttgtcttgccttattaaag

SEQ ID NO: 2605028 - DNA, 14 bp, Homo sapiens
aaatttgttgcata

SEQ ID NO: 2605029 - DNA, 22 bp, Homo sapiens
aaatttgttttgacggatgatt

SEQ ID NO: 2605030 - DNA, 12 bp, Homo sapiens
aaattttattcc

SEQ ID NO: 2605031 - DNA, 18 bp, Homo sapiens
aaattttgatgttttaag

SEQ ID NO: 2605032 - DNA, 23 bp, Homo sapiens
aaattttgatgttttaaggatgc

SEQ ID NO: 2605033 - DNA, 15 bp, Homo sapiens
aaatttttatttttc

SEQ ID NO: 2605034 - DNA, 17 bp, Homo sapiens
aaatttttcagatgctt

SEQ ID NO: 2605035 - DNA, 22 bp, Homo sapiens
aaattttttttcatgttttaac

SEQ ID NO: 2605036 - DNA, 23 bp, Homo sapiens
aaattttttttcatgttttaaca

SEQ ID NO: 2605037 - DNA, 22 bp, Homo sapiens
aacaaaatttagtttttgttct

SEQ ID NO: 2605038 - DNA, 15 bp, Homo sapiens
aacaaactatttctt

SEQ ID NO: 2605039 - DNA, 16 bp, Homo sapiens
aacaaactctctgaac

SEQ ID NO: 2605040 - DNA, 16 bp, Homo sapiens
aacaaagcacagtgtt

SEQ ID NO: 2605041 - DNA, 11 bp, Homo sapiens
aacaaagccag

SEQ ID NO: 2605042 - DNA, 14 bp, Homo sapiens
aacaaagcttagca

SEQ ID NO: 2605043 - DNA, 20 bp, Homo sapiens
aacaaattaggttttgtaca

SEQ ID NO: 2605044 - DNA, 18 bp, Homo sapiens
aacaaattcatattctgt

SEQ ID NO: 2605045 - DNA, 22 bp, Homo sapiens
aacaaattcatcaaatggaaga

SEQ ID NO: 2605046 - DNA, 18 bp, Homo sapiens
aacaacctcaactgccta

SEQ ID NO: 2605047 - DNA, 16 bp, Homo sapiens
aacaactaggcttcag

SEQ ID NO: 2605048 - DNA, 16 bp, Homo sapiens
aacaacttctttgtaa

SEQ ID NO: 2605049 - DNA, 21 bp, Homo sapiens
aacaagaagccacagacctag

SEQ ID NO: 2605050 - DNA, 16 bp, Homo sapiens
aacaagaccacgtttc

SEQ ID NO: 2605051 - DNA, 20 bp, Homo sapiens
aacaagaccacgtttctaaa

SEQ ID NO: 2605052 - DNA, 23 bp, Homo sapiens
aacaagacctcagtgccttcctg

SEQ ID NO: 2605053 - DNA, 17 bp, Homo sapiens
aacaagtttttctgtca

SEQ ID NO: 2605054 - DNA, 23 bp, Homo sapiens
aacaataaaattttttttcatgt

SEQ ID NO: 2605055 - DNA, 21 bp, Homo sapiens
aacaataactactgtgttcct

SEQ ID NO: 2605056 - DNA, 16 bp, Homo sapiens
aacaatattgtttcta

SEQ ID NO: 2605057 - DNA, 23 bp, Homo sapiens
aacaatcaaagcacttggactct

SEQ ID NO: 2605058 - DNA, 22 bp, Homo sapiens
aacaatcctagtgctttccttt

SEQ ID NO: 2605059 - DNA, 16 bp, Homo sapiens
aacaatggaaactgaa

SEQ ID NO: 2605060 - DNA, 12 bp, Homo sapiens
aacaatgttaag

SEQ ID NO: 2605061 - DNA, 13 bp, Homo sapiens
aacaatgttaagg

SEQ ID NO: 2605062 - DNA, 14 bp, Homo sapiens
aacaattgtgaagt

SEQ ID NO: 2605063 - DNA, 19 bp, Homo sapiens
aacacaaacgggctcagca

SEQ ID NO: 2605064 - DNA, 20 bp, Homo sapiens
aacacaaatgcagggattgc

SEQ ID NO: 2605065 - DNA, 14 bp, Homo sapiens
aacacaagccacag

SEQ ID NO: 2605066 - DNA, 15 bp, Homo sapiens
aacacaccaggctgt

SEQ ID NO: 2605067 - DNA, 19 bp, Homo sapiens
aacacagacattctgccag

SEQ ID NO: 2605068 - DNA, 18 bp, Homo sapiens
aacacagcatgtgtattt

SEQ ID NO: 2605069 - DNA, 22 bp, Homo sapiens
aacacaggcaaaatccttgctt

SEQ ID NO: 2605070 - DNA, 16 bp, Homo sapiens
aacacagtgtttttgt

SEQ ID NO: 2605071 - DNA, 22 bp, Homo sapiens
aacacagtgtttttgtaaagtg

SEQ ID NO: 2605072 - DNA, 21 bp, Homo sapiens
aacacatacaggaaggtagaa

SEQ ID NO: 2605073 - DNA, 21 bp, Homo sapiens
aacacattaagccttccacac

SEQ ID NO: 2605074 - DNA, 22 bp, Homo sapiens
aacacattttgtataattgtat

SEQ ID NO: 2605075 - DNA, 23 bp, Homo sapiens
aacacattttgtataattgtatc

SEQ ID NO: 2605076 - DNA, 19 bp, Homo sapiens
aacacatttttcttaggga

SEQ ID NO: 2605077 - DNA, 23 bp, Homo sapiens
aacaccacagacacacacacgca

SEQ ID NO: 2605078 - DNA, 21 bp, Homo sapiens
aacaccaggtttatggaaaat

SEQ ID NO: 2605079 - DNA, 16 bp, Homo sapiens
aacaccctatattttg

SEQ ID NO: 2605080 - DNA, 21 bp, Homo sapiens
aacaccctcacactgggactt

SEQ ID NO: 2605081 - DNA, 19 bp, Homo sapiens
aacacctagctttattctt

SEQ ID NO: 2605082 - DNA, 13 bp, Homo sapiens
aacacctcccagg

SEQ ID NO: 2605083 - DNA, 17 bp, Homo sapiens
aacacctgatgtgtaca

SEQ ID NO: 2605084 - DNA, 19 bp, Homo sapiens
aacacctgggcttaagaaa

SEQ ID NO: 2605085 - DNA, 15 bp, Homo sapiens
aacacgagcaggcta

SEQ ID NO: 2605086 - DNA, 15 bp, Homo sapiens
aacactataaaggtt

SEQ ID NO: 2605087 - DNA, 18 bp, Homo sapiens
aacactatatggcagtgt

SEQ ID NO: 2605088 - DNA, 21 bp, Homo sapiens
aacactcacatttattctgct

SEQ ID NO: 2605089 - DNA, 13 bp, Homo sapiens
aacactctatatt

SEQ ID NO: 2605090 - DNA, 15 bp, Homo sapiens
aacactggcccctag

SEQ ID NO: 2605091 - DNA, 18 bp, Homo sapiens
aacactggggctggcaca

SEQ ID NO: 2605092 - DNA, 23 bp, Homo sapiens
aacactggtggaggatggaaagg

SEQ ID NO: 2605093 - DNA, 17 bp, Homo sapiens
aacactggtgtgacctg

SEQ ID NO: 2605094 - DNA, 20 bp, Homo sapiens
aacactggtgtgacctgagg

SEQ ID NO: 2605095 - DNA, 12 bp, Homo sapiens
aacactgtgaaa

SEQ ID NO: 2605096 - DNA, 16 bp, Homo sapiens
aacactgttctctgcc

SEQ ID NO: 2605097 - DNA, 14 bp, Homo sapiens
aacagaaaacattc

SEQ ID NO: 2605098 - DNA, 16 bp, Homo sapiens
aacagaaacaaaaaca

SEQ ID NO: 2605099 - DNA, 15 bp, Homo sapiens
aacagaaatgtacag

SEQ ID NO: 2605100 - DNA, 14 bp, Homo sapiens
aacagaacagcttc

SEQ ID NO: 2605101 - DNA, 16 bp, Homo sapiens
aacagaacagcttcag

SEQ ID NO: 2605102 - DNA, 13 bp, Homo sapiens
aacagaagtggtt

SEQ ID NO: 2605103 - DNA, 13 bp, Homo sapiens
aacagaattttaa

SEQ ID NO: 2605104 - DNA, 21 bp, Homo sapiens
aacagaggccatggcagaata

SEQ ID NO: 2605105 - DNA, 18 bp, Homo sapiens
aacagataagcaagagag

SEQ ID NO: 2605106 - DNA, 23 bp, Homo sapiens
aacagatactggaagttttgcat

SEQ ID NO: 2605107 - DNA, 20 bp, Homo sapiens
aacagatagttgtgttttta

SEQ ID NO: 2605108 - DNA, 23 bp, Homo sapiens
aacagatgcaatgtgctactgat

SEQ ID NO: 2605109 - DNA, 14 bp, Homo sapiens
aacagatttgtgaa

SEQ ID NO: 2605110 - DNA, 21 bp, Homo sapiens
aacagatttgtgaactcagcc

SEQ ID NO: 2605111 - DNA, 22 bp, Homo sapiens
aacagatttgtgaactcagcca

SEQ ID NO: 2605112 - DNA, 23 bp, Homo sapiens
aacagatttgtgaactcagccaa

SEQ ID NO: 2605113 - DNA, 18 bp, Homo sapiens
aacagcactggctctctc

SEQ ID NO: 2605114 - DNA, 17 bp, Homo sapiens
aacagcagaggttcttt

SEQ ID NO: 2605115 - DNA, 15 bp, Homo sapiens
aacagcattgctttc

SEQ ID NO: 2605116 - DNA, 17 bp, Homo sapiens
aacagcattgctttctg

SEQ ID NO: 2605117 - DNA, 16 bp, Homo sapiens
aacagccaacaggtgg

SEQ ID NO: 2605118 - DNA, 14 bp, Homo sapiens
aacagcgtttaaga

SEQ ID NO: 2605119 - DNA, 23 bp, Homo sapiens
aacagcgtttaagactgtaatga

SEQ ID NO: 2605120 - DNA, 16 bp, Homo sapiens
aacagctaatgggaca

SEQ ID NO: 2605121 - DNA, 19 bp, Homo sapiens
aacagctgaggtctcttga

SEQ ID NO: 2605122 - DNA, 20 bp, Homo sapiens
aacagctgaggtctcttgag

SEQ ID NO: 2605123 - DNA, 14 bp, Homo sapiens
aacagcttcaggtt

SEQ ID NO: 2605124 - DNA, 16 bp, Homo sapiens
aacagcttcaggttat

SEQ ID NO: 2605125 - DNA, 14 bp, Homo sapiens
aacaggaagatctt

SEQ ID NO: 2605126 - DNA, 20 bp, Homo sapiens
aacaggaatcaagagctgcc

SEQ ID NO: 2605127 - DNA, 20 bp, Homo sapiens
aacaggaccacaaaaatgaa

SEQ ID NO: 2605128 - DNA, 17 bp, Homo sapiens
aacaggagacaggaagg

SEQ ID NO: 2605129 - DNA, 21 bp, Homo sapiens
aacaggagctgggatcctaag

SEQ ID NO: 2605130 - DNA, 19 bp, Homo sapiens
aacaggaggacaattcatg

SEQ ID NO: 2605131 - DNA, 22 bp, Homo sapiens
aacaggctgggcttcagtggca

SEQ ID NO: 2605132 - DNA, 11 bp, Homo sapiens
aacagggaggg

SEQ ID NO: 2605133 - DNA, 17 bp, Homo sapiens
aacagggcatctccagg

SEQ ID NO: 2605134 - DNA, 18 bp, Homo sapiens
aacagggtctctagtgct

SEQ ID NO: 2605135 - DNA, 22 bp, Homo sapiens
aacagggtctctagtgctgtga

SEQ ID NO: 2605136 - DNA, 18 bp, Homo sapiens
aacaggtctcctcttaaa

SEQ ID NO: 2605137 - DNA, 19 bp, Homo sapiens
aacaggtctcctcttaaaa

SEQ ID NO: 2605138 - DNA, 14 bp, Homo sapiens
aacaggtggagaaa

SEQ ID NO: 2605139 - DNA, 16 bp, Homo sapiens
aacaggtggcaggacc

SEQ ID NO: 2605140 - DNA, 16 bp, Homo sapiens
aacaggttttataatt

SEQ ID NO: 2605141 - DNA, 14 bp, Homo sapiens
aacagtcatttaaa

SEQ ID NO: 2605142 - DNA, 18 bp, Homo sapiens
aacagtccattgaaaggg

SEQ ID NO: 2605143 - DNA, 13 bp, Homo sapiens
aacagtctcagga

SEQ ID NO: 2605144 - DNA, 14 bp, Homo sapiens
aacagtctcaggaa

SEQ ID NO: 2605145 - DNA, 15 bp, Homo sapiens
aacagtgctaaaaat

SEQ ID NO: 2605146 - DNA, 20 bp, Homo sapiens
aacagtgcttgccacagagc

SEQ ID NO: 2605147 - DNA, 15 bp, Homo sapiens
aacagtggaatataa

SEQ ID NO: 2605148 - DNA, 14 bp, Homo sapiens
aacagtgtgaagtt

SEQ ID NO: 2605149 - DNA, 18 bp, Homo sapiens
aagaaaaatgagcctggc

SEQ ID NO: 2605150 - DNA, 15 bp, Homo sapiens
aagaaaagtgggcca

SEQ ID NO: 2605151 - DNA, 15 bp, Homo sapiens
aagaaaatagtggtg

SEQ ID NO: 2605152 - DNA, 19 bp, Homo sapiens
aagaaacaactctttgaga

SEQ ID NO: 2605153 - DNA, 22 bp, Homo sapiens
aagaaacacactgaggcaggga

SEQ ID NO: 2605154 - DNA, 16 bp, Homo sapiens
aagaaacccgacagag

SEQ ID NO: 2605155 - DNA, 20 bp, Homo sapiens
aagaaactgaggaattttct

SEQ ID NO: 2605156 - DNA, 13 bp, Homo sapiens
aagaaagaaaatc

SEQ ID NO: 2605157 - DNA, 14 bp, Homo sapiens
aagaaagaaaatca

SEQ ID NO: 2605158 - DNA, 15 bp, Homo sapiens
aagaaagaaggaagt

SEQ ID NO: 2605159 - DNA, 22 bp, Homo sapiens
aagaaagactatctaaatgttg

SEQ ID NO: 2605160 - DNA, 16 bp, Homo sapiens
aagaaagagagaaaat

SEQ ID NO: 2605161 - DNA, 18 bp, Homo sapiens
aagaaagagagaaaataa

SEQ ID NO: 2605162 - DNA, 16 bp, Homo sapiens
aagaaagggtgttttt

SEQ ID NO: 2605163 - DNA, 15 bp, Homo sapiens
aagaaatactgtaca

SEQ ID NO: 2605164 - DNA, 13 bp, Homo sapiens
aagaaatccctgt

SEQ ID NO: 2605165 - DNA, 17 bp, Homo sapiens
aagaaattcctgtagca

SEQ ID NO: 2605166 - DNA, 16 bp, Homo sapiens
aagaaatttgatttct

SEQ ID NO: 2605167 - DNA, 21 bp, Homo sapiens
aagaacaccctatattttgca

SEQ ID NO: 2605168 - DNA, 12 bp, Homo sapiens
aagaacatagaa

SEQ ID NO: 2605169 - DNA, 18 bp, Homo sapiens
aagaacatggacttgtat

SEQ ID NO: 2605170 - DNA, 21 bp, Homo sapiens
aagaacatggacttgtatatt

SEQ ID NO: 2605171 - DNA, 22 bp, Homo sapiens
aagaacatggacttgtatattt

SEQ ID NO: 2605172 - DNA, 16 bp, Homo sapiens
aagaagacatgaacca

SEQ ID NO: 2605173 - DNA, 19 bp, Homo sapiens
aagaagaccagactgtgga

SEQ ID NO: 2605174 - DNA, 10 bp, Homo sapiens
aagaagagac

SEQ ID NO: 2605175 - DNA, 11 bp, Homo sapiens
aagaagagaca

SEQ ID NO: 2605176 - DNA, 13 bp, Homo sapiens
aagaagagggaga

SEQ ID NO: 2605177 - DNA, 12 bp, Homo sapiens
aagaagcaggct

SEQ ID NO: 2605178 - DNA, 19 bp, Homo sapiens
aagaagcaggctacactga

SEQ ID NO: 2605179 - DNA, 16 bp, Homo sapiens
aagaagcccaggaaag

SEQ ID NO: 2605180 - DNA, 17 bp, Homo sapiens
aagaagcccaggaaagg

SEQ ID NO: 2605181 - DNA, 15 bp, Homo sapiens
aagaagctctctcct

SEQ ID NO: 2605182 - DNA, 16 bp, Homo sapiens
aagaagctgttgtaca

SEQ ID NO: 2605183 - DNA, 17 bp, Homo sapiens
aagaagctgttgtacat

SEQ ID NO: 2605184 - DNA, 19 bp, Homo sapiens
aagaaggcagcaggtggca

SEQ ID NO: 2605185 - DNA, 14 bp, Homo sapiens
aagaagtttaagga

SEQ ID NO: 2605186 - DNA, 22 bp, Homo sapiens
aagaataatcacgctttcctga

SEQ ID NO: 2605187 - DNA, 23 bp, Homo sapiens
aagaataatcacgctttcctgaa

SEQ ID NO: 2605188 - DNA, 16 bp, Homo sapiens
aagaatacaaacatat

SEQ ID NO: 2605189 - DNA, 16 bp, Homo sapiens
aagaatctatctgctt

SEQ ID NO: 2605190 - DNA, 19 bp, Homo sapiens
aagaatctatctgcttatg

SEQ ID NO: 2605191 - DNA, 21 bp, Homo sapiens
aagaatgagaaggagtcagaa

SEQ ID NO: 2605192 - DNA, 12 bp, Homo sapiens
aagaatgctgaa

SEQ ID NO: 2605193 - DNA, 14 bp, Homo sapiens
aagaatgctgaaac

SEQ ID NO: 2605194 - DNA, 16 bp, Homo sapiens
aagaatgctgaaacca

SEQ ID NO: 2605195 - DNA, 21 bp, Homo sapiens
aagaatgggcagttacatgca

SEQ ID NO: 2605196 - DNA, 16 bp, Homo sapiens
aagaattattttgatg

SEQ ID NO: 2605197 - DNA, 18 bp, Homo sapiens
aagaattttaaaaatgaa

SEQ ID NO: 2605198 - DNA, 18 bp, Homo sapiens
aagacaaattctgtttct

SEQ ID NO: 2605199 - DNA, 12 bp, Homo sapiens
aagacaacatta

SEQ ID NO: 2605200 - DNA, 13 bp, Homo sapiens
aagacaatataat

SEQ ID NO: 2605201 - DNA, 15 bp, Homo sapiens
aagacaattctttat

SEQ ID NO: 2605202 - DNA, 13 bp, Homo sapiens
aagacaccagagc

SEQ ID NO: 2605203 - DNA, 16 bp, Homo sapiens
aagacagatgccccag

SEQ ID NO: 2605204 - DNA, 17 bp, Homo sapiens
aagacagatgccccaga

SEQ ID NO: 2605205 - DNA, 22 bp, Homo sapiens
aagacagcttctcatcctgcag

SEQ ID NO: 2605206 - DNA, 22 bp, Homo sapiens
aagacataacgtttttccttta

SEQ ID NO: 2605207 - DNA, 15 bp, Homo sapiens
aagacatgaatatga

SEQ ID NO: 2605208 - DNA, 19 bp, Homo sapiens
aagacatgcactatgagga

SEQ ID NO: 2605209 - DNA, 18 bp, Homo sapiens
aagacatggagactcctg

SEQ ID NO: 2605210 - DNA, 17 bp, Homo sapiens
aagacatgttttagaca

SEQ ID NO: 2605211 - DNA, 15 bp, Homo sapiens
aagacattaaatcta

SEQ ID NO: 2605212 - DNA, 13 bp, Homo sapiens
aagacattgtcaa

SEQ ID NO: 2605213 - DNA, 14 bp, Homo sapiens
aagacattgtcaat

SEQ ID NO: 2605214 - DNA, 17 bp, Homo sapiens
aagacattgtcaataaa

SEQ ID NO: 2605215 - DNA, 12 bp, Homo sapiens
aagaccagacta

SEQ ID NO: 2605216 - DNA, 12 bp, Homo sapiens
aagaccagtcca

SEQ ID NO: 2605217 - DNA, 13 bp, Homo sapiens
aagaccatttttc

SEQ ID NO: 2605218 - DNA, 16 bp, Homo sapiens
aagaccccacccaagc

SEQ ID NO: 2605219 - DNA, 17 bp, Homo sapiens
aagacctgttggttcca

SEQ ID NO: 2605220 - DNA, 19 bp, Homo sapiens
aagacctgttggttccaag

SEQ ID NO: 2605221 - DNA, 21 bp, Homo sapiens
aagaccttctccaaatgagat

SEQ ID NO: 2605222 - DNA, 20 bp, Homo sapiens
aagaccttctccccattctg

SEQ ID NO: 2605223 - DNA, 15 bp, Homo sapiens
aagaccttctccttc

SEQ ID NO: 2605224 - DNA, 14 bp, Homo sapiens
aagacgcctgagct

SEQ ID NO: 2605225 - DNA, 15 bp, Homo sapiens
aagacgctgtgctgc

SEQ ID NO: 2605226 - DNA, 17 bp, Homo sapiens
aagacgctgtgctgccc

SEQ ID NO: 2605227 - DNA, 18 bp, Homo sapiens
aagacgctgtgctgccct

SEQ ID NO: 2605228 - DNA, 23 bp, Homo sapiens
aagacgctgtgctgccctgccca

SEQ ID NO: 2605229 - DNA, 18 bp, Homo sapiens
aagacgtcccttttttct

SEQ ID NO: 2605230 - DNA, 19 bp, Homo sapiens
aagactaatttaaaaaata

SEQ ID NO: 2605231 - DNA, 20 bp, Homo sapiens
aagactagaggcttgcataa

SEQ ID NO: 2605232 - DNA, 18 bp, Homo sapiens
aagactatctaaatgttg

SEQ ID NO: 2605233 - DNA, 13 bp, Homo sapiens
aagactattcaaa

SEQ ID NO: 2605234 - DNA, 21 bp, Homo sapiens
aagactcaagtgggaacgact

SEQ ID NO: 2605235 - DNA, 23 bp, Homo sapiens
aagactcaagtgggaacgactgg

SEQ ID NO: 2605236 - DNA, 17 bp, Homo sapiens
aagactcattcttctgt

SEQ ID NO: 2605237 - DNA, 14 bp, Homo sapiens
aagactccaaagaa

SEQ ID NO: 2605238 - DNA, 16 bp, Homo sapiens
aagactccaaagaaat

SEQ ID NO: 2605239 - DNA, 17 bp, Homo sapiens
aagactccaaagaaatg

SEQ ID NO: 2605240 - DNA, 19 bp, Homo sapiens
aagactgagcacctgcttc

SEQ ID NO: 2605241 - DNA, 17 bp, Homo sapiens
aagactgagtacgttgt

SEQ ID NO: 2605242 - DNA, 21 bp, Homo sapiens
aagactgagtacgttgtgcat

SEQ ID NO: 2605243 - DNA, 22 bp, Homo sapiens
aagactgagtacgttgtgcatt

SEQ ID NO: 2605244 - DNA, 22 bp, Homo sapiens
aagactggcttttattaatgca

SEQ ID NO: 2605245 - DNA, 23 bp, Homo sapiens
aagactggcttttattaatgcac

SEQ ID NO: 2605246 - DNA, 12 bp, Homo sapiens
aagactgtggct

SEQ ID NO: 2605247 - DNA, 24 bp, Homo sapiens
aagactgttgctcaaatctattca

SEQ ID NO: 2605248 - DNA, 17 bp, Homo sapiens
aagacttggcaacagaa

SEQ ID NO: 2605249 - DNA, 17 bp, Homo sapiens
aagacttttccaaccct

SEQ ID NO: 2605250 - DNA, 20 bp, Homo sapiens
aagagaacccacgaacattc

SEQ ID NO: 2605251 - DNA, 22 bp, Homo sapiens
aagagaaccgagcaaagatcaa

SEQ ID NO: 2605252 - DNA, 21 bp, Homo sapiens
aagagacagtcaccccaggac

SEQ ID NO: 2605253 - DNA, 17 bp, Homo sapiens
aagagacctacctcagg

SEQ ID NO: 2605254 - DNA, 18 bp, Homo sapiens
aagagacctacctcaggt

SEQ ID NO: 2605255 - DNA, 18 bp, Homo sapiens
aagagactggagcatctg

SEQ ID NO: 2605256 - DNA, 15 bp, Homo sapiens
aagagagaaaataaa

SEQ ID NO: 2605257 - DNA, 17 bp, Homo sapiens
aagagagaaaataaaaa

SEQ ID NO: 2605258 - DNA, 14 bp, Homo sapiens
aagagagaaagaag

SEQ ID NO: 2605259 - DNA, 12 bp, Homo sapiens
aagagagaatgt

SEQ ID NO: 2605260 - DNA, 21 bp, Homo sapiens
aagagaggagttcaatgatct

SEQ ID NO: 2605261 - DNA, 18 bp, Homo sapiens
aagagatgggcttgtttt

SEQ ID NO: 2605262 - DNA, 14 bp, Homo sapiens
aagagatttaatta

SEQ ID NO: 2605263 - DNA, 16 bp, Homo sapiens
aagagatttaattaat

SEQ ID NO: 2605264 - DNA, 15 bp, Homo sapiens
aagagatttcaagag

SEQ ID NO: 2605265 - DNA, 14 bp, Homo sapiens
aagagatttttcat

SEQ ID NO: 2605266 - DNA, 17 bp, Homo sapiens
aagagatttttcatgat

SEQ ID NO: 2605267 - DNA, 19 bp, Homo sapiens
aagagcaccttcctcactt

SEQ ID NO: 2605268 - DNA, 14 bp, Homo sapiens
aagagcagcctgtg

SEQ ID NO: 2605269 - DNA, 20 bp, Homo sapiens
aagagccatataagtttgaa

SEQ ID NO: 2605270 - DNA, 12 bp, Homo sapiens
aagagcctgcag

SEQ ID NO: 2605271 - DNA, 16 bp, Homo sapiens
aagagcctgcaggtgc

SEQ ID NO: 2605272 - DNA, 11 bp, Homo sapiens
aagagcctgga

SEQ ID NO: 2605273 - DNA, 13 bp, Homo sapiens
aagagcctggaga

SEQ ID NO: 2605274 - DNA, 16 bp, Homo sapiens
aagagcctggagaagc

SEQ ID NO: 2605275 - DNA, 17 bp, Homo sapiens
aagagcctggagaagct

SEQ ID NO: 2605276 - DNA, 18 bp, Homo sapiens
aagagctgaggcaattct

SEQ ID NO: 2605277 - DNA, 13 bp, Homo sapiens
aagagctgccctc

SEQ ID NO: 2605278 - DNA, 16 bp, Homo sapiens
aagagctgtcctggta

SEQ ID NO: 2605279 - DNA, 14 bp, Homo sapiens
aagaggcaagaggc

SEQ ID NO: 2605280 - DNA, 14 bp, Homo sapiens
aagaggcgggccag

SEQ ID NO: 2605281 - DNA, 17 bp, Homo sapiens
aagaggcgggccagcca

SEQ ID NO: 2605282 - DNA, 20 bp, Homo sapiens
aagaggcgggccagccaggc

SEQ ID NO: 2605283 - DNA, 21 bp, Homo sapiens
aagaggcgggccagccaggcg

SEQ ID NO: 2605284 - DNA, 19 bp, Homo sapiens
aagaggcgtctgtatattt

SEQ ID NO: 2605285 - DNA, 16 bp, Homo sapiens
aagaggctgaaagagg

SEQ ID NO: 2605286 - DNA, 21 bp, Homo sapiens
aagaggctgataattccagtg

SEQ ID NO: 2605287 - DNA, 16 bp, Homo sapiens
aagagggacgcctggg

SEQ ID NO: 2605288 - DNA, 21 bp, Homo sapiens
aagagggagggagggctccag

SEQ ID NO: 2605289 - DNA, 16 bp, Homo sapiens
aagagggcacacactg

SEQ ID NO: 2605290 - DNA, 17 bp, Homo sapiens
aagagggcacacactgt

SEQ ID NO: 2605291 - DNA, 19 bp, Homo sapiens
aagagggcctgtgggagcc

SEQ ID NO: 2605292 - DNA, 13 bp, Homo sapiens
aagaggggacagg

SEQ ID NO: 2605293 - DNA, 16 bp, Homo sapiens
aagaggggcagccctt

SEQ ID NO: 2605294 - DNA, 19 bp, Homo sapiens
aagaggtagaaaagattgg

SEQ ID NO: 2605295 - DNA, 13 bp, Homo sapiens
aagtctgttttat

SEQ ID NO: 2605296 - DNA, 15 bp, Homo sapiens
aagtctgttttatga

SEQ ID NO: 2605297 - DNA, 19 bp, Homo sapiens
aagtctgttttatgacttc

SEQ ID NO: 2605298 - DNA, 20 bp, Homo sapiens
aagtctgttttatgacttca

SEQ ID NO: 2605299 - DNA, 17 bp, Homo sapiens
aagtcttaaaataactt

SEQ ID NO: 2605300 - DNA, 16 bp, Homo sapiens
aagtcttagatgtata

SEQ ID NO: 2605301 - DNA, 20 bp, Homo sapiens
aagtcttcactctctgaaga

SEQ ID NO: 2605302 - DNA, 12 bp, Homo sapiens
aagtcttcaggg

SEQ ID NO: 2605303 - DNA, 18 bp, Homo sapiens
aagtgaatgctcaagttt

SEQ ID NO: 2605304 - DNA, 14 bp, Homo sapiens
aagtgaatttgaat

SEQ ID NO: 2605305 - DNA, 23 bp, Homo sapiens
aagtgaatttgaatgaaaaattt

SEQ ID NO: 2605306 - DNA, 17 bp, Homo sapiens
aagtgaatttttctcta

SEQ ID NO: 2605307 - DNA, 12 bp, Homo sapiens
aagtgacaggga

SEQ ID NO: 2605308 - DNA, 19 bp, Homo sapiens
aagtgacagggaagctaca

SEQ ID NO: 2605309 - DNA, 20 bp, Homo sapiens
aagtgacagggaagctacag

SEQ ID NO: 2605310 - DNA, 15 bp, Homo sapiens
aagtgagaagatggt

SEQ ID NO: 2605311 - DNA, 23 bp, Homo sapiens
aagtgatcaataaaatgtgattt

SEQ ID NO: 2605312 - DNA, 18 bp, Homo sapiens
aagtgattctcctgcctc

SEQ ID NO: 2605313 - DNA, 20 bp, Homo sapiens
aagtgattctcctgcctcag

SEQ ID NO: 2605314 - DNA, 19 bp, Homo sapiens
aagtgcatccaaaggtgct

SEQ ID NO: 2605315 - DNA, 20 bp, Homo sapiens
aagtgccactcattcctgta

SEQ ID NO: 2605316 - DNA, 23 bp, Homo sapiens
aagtgcccctgctgcctccccaa

SEQ ID NO: 2605317 - DNA, 18 bp, Homo sapiens
aagtgcgtgtgtagagtt

SEQ ID NO: 2605318 - DNA, 23 bp, Homo sapiens
aagtgcgtgtgtagagttaagaa

SEQ ID NO: 2605319 - DNA, 13 bp, Homo sapiens
aagtgctgcattt

SEQ ID NO: 2605320 - DNA, 17 bp, Homo sapiens
aagtgcttccaaggcag

SEQ ID NO: 2605321 - DNA, 21 bp, Homo sapiens
aagtggaaaaatagcctgcct

SEQ ID NO: 2605322 - DNA, 15 bp, Homo sapiens
aagtggggacagagc

SEQ ID NO: 2605323 - DNA, 13 bp, Homo sapiens
aagtggtatagaa

SEQ ID NO: 2605324 - DNA, 17 bp, Homo sapiens
aagtggtatagaaatgc

SEQ ID NO: 2605325 - DNA, 17 bp, Homo sapiens
aagtggtgctcagttgt

SEQ ID NO: 2605326 - DNA, 19 bp, Homo sapiens
aagtggtgctcagttgtag

SEQ ID NO: 2605327 - DNA, 11 bp, Homo sapiens
aagtgtaaagc

SEQ ID NO: 2605328 - DNA, 17 bp, Homo sapiens
aagtgtaaagcattcca

SEQ ID NO: 2605329 - DNA, 22 bp, Homo sapiens
aagtgtaaagcattccaacaaa

SEQ ID NO: 2605330 - DNA, 16 bp, Homo sapiens
aagtgtaacagctgag

SEQ ID NO: 2605331 - DNA, 21 bp, Homo sapiens
aagtgtaacagctgaggtctc

SEQ ID NO: 2605332 - DNA, 21 bp, Homo sapiens
aagtgtatttttttactaata

SEQ ID NO: 2605333 - DNA, 14 bp, Homo sapiens
aagtgtctgtgtgc

SEQ ID NO: 2605334 - DNA, 18 bp, Homo sapiens
aagtgtgagtaagagctg

SEQ ID NO: 2605335 - DNA, 11 bp, Homo sapiens
aagtgtgattg

SEQ ID NO: 2605336 - DNA, 22 bp, Homo sapiens
aagtgtgattgggaataaatat

SEQ ID NO: 2605337 - DNA, 17 bp, Homo sapiens
aagtgtgcatattgtac

SEQ ID NO: 2605338 - DNA, 22 bp, Homo sapiens
aagtgtgcatattgtacacttt

SEQ ID NO: 2605339 - DNA, 23 bp, Homo sapiens
aagtgtgtggtcccaagttggaa

SEQ ID NO: 2605340 - DNA, 17 bp, Homo sapiens
aagtgtgtttccttcag

SEQ ID NO: 2605341 - DNA, 16 bp, Homo sapiens
aagtgttaatactagt

SEQ ID NO: 2605342 - DNA, 22 bp, Homo sapiens
aagtgttgtaaatatttatgta

SEQ ID NO: 2605343 - DNA, 23 bp, Homo sapiens
aagtgttttgttctttctggagt

SEQ ID NO: 2605344 - DNA, 12 bp, Homo sapiens
aagttaaataaa

SEQ ID NO: 2605345 - DNA, 20 bp, Homo sapiens
aagttacaaattgcttgaaa

SEQ ID NO: 2605346 - DNA, 18 bp, Homo sapiens
aagttacaacttcctaat

SEQ ID NO: 2605347 - DNA, 12 bp, Homo sapiens
aagttactgaat

SEQ ID NO: 2605348 - DNA, 16 bp, Homo sapiens
aagttacttattctag

SEQ ID NO: 2605349 - DNA, 22 bp, Homo sapiens
aagttacttcactttaattctc

SEQ ID NO: 2605350 - DNA, 15 bp, Homo sapiens
aagttagaattcctt

SEQ ID NO: 2605351 - DNA, 16 bp, Homo sapiens
aagttatagtatatct

SEQ ID NO: 2605352 - DNA, 22 bp, Homo sapiens
aagttatcagacactctggctg

SEQ ID NO: 2605353 - DNA, 17 bp, Homo sapiens
aagttattgcagtttat

SEQ ID NO: 2605354 - DNA, 11 bp, Homo sapiens
aagttattgta

SEQ ID NO: 2605355 - DNA, 15 bp, Homo sapiens
aagttcaccattaaa

SEQ ID NO: 2605356 - DNA, 14 bp, Homo sapiens
aagttcatagggtc

SEQ ID NO: 2605357 - DNA, 21 bp, Homo sapiens
aagttcatattccatatttat

SEQ ID NO: 2605358 - DNA, 23 bp, Homo sapiens
aagttcatattccatatttattc

SEQ ID NO: 2605359 - DNA, 14 bp, Homo sapiens
aagttcctctagtg

SEQ ID NO: 2605360 - DNA, 17 bp, Homo sapiens
aagttctagagaagagg

SEQ ID NO: 2605361 - DNA, 17 bp, Homo sapiens
aagttctgcagataaac

SEQ ID NO: 2605362 - DNA, 15 bp, Homo sapiens
aagttcttctccaat

SEQ ID NO: 2605363 - DNA, 21 bp, Homo sapiens
aagttgaatggcctgccttga

SEQ ID NO: 2605364 - DNA, 17 bp, Homo sapiens
aagttgatatagaacag

SEQ ID NO: 2605365 - DNA, 21 bp, Homo sapiens
aagttgatatagaacagtgct

SEQ ID NO: 2605366 - DNA, 18 bp, Homo sapiens
aagttgcactgatatttt

SEQ ID NO: 2605367 - DNA, 16 bp, Homo sapiens
aagttgcagtgagctg

SEQ ID NO: 2605368 - DNA, 22 bp, Homo sapiens
aagttgcagtgagctgatatca

SEQ ID NO: 2605369 - DNA, 22 bp, Homo sapiens
aagttgtttgagaaattaagta

SEQ ID NO: 2605370 - DNA, 23 bp, Homo sapiens
aagtttaaggaatatgggagaaa

SEQ ID NO: 2605371 - DNA, 14 bp, Homo sapiens
aagtttcaggtgac

SEQ ID NO: 2605372 - DNA, 19 bp, Homo sapiens
aagtttcaggtgacatgtg

SEQ ID NO: 2605373 - DNA, 12 bp, Homo sapiens
aagtttccatat

SEQ ID NO: 2605374 - DNA, 17 bp, Homo sapiens
aagtttccttggctggt

SEQ ID NO: 2605375 - DNA, 19 bp, Homo sapiens
aagtttctagctagaaata

SEQ ID NO: 2605376 - DNA, 13 bp, Homo sapiens
aagtttctcagat

SEQ ID NO: 2605377 - DNA, 13 bp, Homo sapiens
aagtttctcagct

SEQ ID NO: 2605378 - DNA, 14 bp, Homo sapiens
aagtttgcactgta

SEQ ID NO: 2605379 - DNA, 14 bp, Homo sapiens
aagtttgtttttaa

SEQ ID NO: 2605380 - DNA, 21 bp, Homo sapiens
aagttttcccttgaggaaaca

SEQ ID NO: 2605381 - DNA, 13 bp, Homo sapiens
aagttttgaaaag

SEQ ID NO: 2605382 - DNA, 16 bp, Homo sapiens
aagttttgaaaagcta

SEQ ID NO: 2605383 - DNA, 13 bp, Homo sapiens
aagttttgtacag

SEQ ID NO: 2605384 - DNA, 13 bp, Homo sapiens
aagtttttgtact

SEQ ID NO: 2605385 - DNA, 14 bp, Homo sapiens
aataaaaaaaagaa

SEQ ID NO: 2605386 - DNA, 17 bp, Homo sapiens
aataaaaaaaagaaaaa

SEQ ID NO: 2605387 - DNA, 23 bp, Homo sapiens
aataaaaagatcactttctcagt

SEQ ID NO: 2605388 - DNA, 12 bp, Homo sapiens
aataaaaagtta

SEQ ID NO: 2605389 - DNA, 13 bp, Homo sapiens
aataaaaagttaa

SEQ ID NO: 2605390 - DNA, 15 bp, Homo sapiens
aataaaaatgtttaa

SEQ ID NO: 2605391 - DNA, 16 bp, Homo sapiens
aataaaacctttcaaa

SEQ ID NO: 2605392 - DNA, 21 bp, Homo sapiens
aataaaacctttcaaatttca

SEQ ID NO: 2605393 - DNA, 12 bp, Homo sapiens
aataaaactttt

SEQ ID NO: 2605394 - DNA, 18 bp, Homo sapiens
aataaaactttttaaaat

SEQ ID NO: 2605395 - DNA, 16 bp, Homo sapiens
aataaaagatataaat

SEQ ID NO: 2605396 - DNA, 13 bp, Homo sapiens
aataaaaggaaaa

SEQ ID NO: 2605397 - DNA, 17 bp, Homo sapiens
aataaaaggaaaagcaa

SEQ ID NO: 2605398 - DNA, 17 bp, Homo sapiens
aataaaataattctaaa

SEQ ID NO: 2605399 - DNA, 18 bp, Homo sapiens
aataaaatcatgtacatt

SEQ ID NO: 2605400 - DNA, 23 bp, Homo sapiens
aataaaattaaagctgaaaactg

SEQ ID NO: 2605401 - DNA, 15 bp, Homo sapiens
aataaaattattttg

SEQ ID NO: 2605402 - DNA, 15 bp, Homo sapiens
aataaaattgcactt

SEQ ID NO: 2605403 - DNA, 12 bp, Homo sapiens
aataaaatttgt

SEQ ID NO: 2605404 - DNA, 19 bp, Homo sapiens
aataaaattttttttcatg

SEQ ID NO: 2605405 - DNA, 13 bp, Homo sapiens
aataaacatcctt

SEQ ID NO: 2605406 - DNA, 12 bp, Homo sapiens
aataaacgattt

SEQ ID NO: 2605407 - DNA, 15 bp, Homo sapiens
aataaactctaaaca

SEQ ID NO: 2605408 - DNA, 12 bp, Homo sapiens
aataaacttttt

SEQ ID NO: 2605409 - DNA, 13 bp, Homo sapiens
aataaagaaattg

SEQ ID NO: 2605410 - DNA, 12 bp, Homo sapiens
aataaagacagg

SEQ ID NO: 2605411 - DNA, 18 bp, Homo sapiens
aataaagagttagaatga

SEQ ID NO: 2605412 - DNA, 14 bp, Homo sapiens
aataaagcagcgtt

SEQ ID NO: 2605413 - DNA, 15 bp, Homo sapiens
aataaagcctgcttt

SEQ ID NO: 2605414 - DNA, 15 bp, Homo sapiens
aataaagtatatata

SEQ ID NO: 2605415 - DNA, 20 bp, Homo sapiens
aataaatacctcttagctga

SEQ ID NO: 2605416 - DNA, 19 bp, Homo sapiens
aataaatagctatatccat

SEQ ID NO: 2605417 - DNA, 10 bp, Homo sapiens
aataaatatg

SEQ ID NO: 2605418 - DNA, 19 bp, Homo sapiens
aataaatatgcctctcctt

SEQ ID NO: 2605419 - DNA, 21 bp, Homo sapiens
aataaatcattaatactcttc

SEQ ID NO: 2605420 - DNA, 17 bp, Homo sapiens
aataaatggtatagcaa

SEQ ID NO: 2605421 - DNA, 21 bp, Homo sapiens
aataaatggtatagcaaatgt

SEQ ID NO: 2605422 - DNA, 21 bp, Homo sapiens
aataaatgtatcttattcaca

SEQ ID NO: 2605423 - DNA, 17 bp, Homo sapiens
aataaatgtcattaaaa

SEQ ID NO: 2605424 - DNA, 12 bp, Homo sapiens
aataaatgtgcc

SEQ ID NO: 2605425 - DNA, 21 bp, Homo sapiens
aataaatgtgccttcattttt

SEQ ID NO: 2605426 - DNA, 12 bp, Homo sapiens
aataaattattt

SEQ ID NO: 2605427 - DNA, 16 bp, Homo sapiens
aataacaagtcgatga

SEQ ID NO: 2605428 - DNA, 13 bp, Homo sapiens
aataacaatgtta

SEQ ID NO: 2605429 - DNA, 20 bp, Homo sapiens
aataacaatgttaaggaaac

SEQ ID NO: 2605430 - DNA, 20 bp, Homo sapiens
aataacataatttgtacata

SEQ ID NO: 2605431 - DNA, 12 bp, Homo sapiens
aataacatgtaa

SEQ ID NO: 2605432 - DNA, 19 bp, Homo sapiens
aataacatgtaattaagta

SEQ ID NO: 2605433 - DNA, 21 bp, Homo sapiens
aataaccacttaaaaaatgtc

SEQ ID NO: 2605434 - DNA, 18 bp, Homo sapiens
aataacctcaaagtgact

SEQ ID NO: 2605435 - DNA, 13 bp, Homo sapiens
aataactactgtg

SEQ ID NO: 2605436 - DNA, 15 bp, Homo sapiens
aataactactgtgtt

SEQ ID NO: 2605437 - DNA, 17 bp, Homo sapiens
aataactactgtgttcc

SEQ ID NO: 2605438 - DNA, 19 bp, Homo sapiens
aataactagtgttgcttgg

SEQ ID NO: 2605439 - DNA, 14 bp, Homo sapiens
aataactccttctt

SEQ ID NO: 2605440 - DNA, 19 bp, Homo sapiens
aataactctgtggcattat

SEQ ID NO: 2605441 - DNA, 18 bp, Homo sapiens
aatattttcatacagcat

SEQ ID NO: 2605442 - DNA, 18 bp, Homo sapiens
aatattttgaatcaataa

SEQ ID NO: 2605443 - DNA, 21 bp, Homo sapiens
aatattttttatatatacagt

SEQ ID NO: 2605444 - DNA, 20 bp, Homo sapiens
aatcaaaataacgccccaga

SEQ ID NO: 2605445 - DNA, 13 bp, Homo sapiens
aatcaaaatatgt

SEQ ID NO: 2605446 - DNA, 14 bp, Homo sapiens
aatcaactgggctg

SEQ ID NO: 2605447 - DNA, 16 bp, Homo sapiens
aatcaagagctgccct

SEQ ID NO: 2605448 - DNA, 17 bp, Homo sapiens
aatcaagagctgccctc

SEQ ID NO: 2605449 - DNA, 20 bp, Homo sapiens
aatcaattactggtccaaaa

SEQ ID NO: 2605450 - DNA, 19 bp, Homo sapiens
aatcacattcgagtgtttc

SEQ ID NO: 2605451 - DNA, 16 bp, Homo sapiens
aatcactcttgtggat

SEQ ID NO: 2605452 - DNA, 22 bp, Homo sapiens
aatcactcttgtggatgtttta

SEQ ID NO: 2605453 - DNA, 16 bp, Homo sapiens
aatcacttaggaaatg

SEQ ID NO: 2605454 - DNA, 13 bp, Homo sapiens
aatcagacaaagt

SEQ ID NO: 2605455 - DNA, 15 bp, Homo sapiens
aatcagatcatttca

SEQ ID NO: 2605456 - DNA, 15 bp, Homo sapiens
aatcagatctttatt

SEQ ID NO: 2605457 - DNA, 16 bp, Homo sapiens
aatcagcctcttaaag

SEQ ID NO: 2605458 - DNA, 18 bp, Homo sapiens
aatcagcctgctccagct

SEQ ID NO: 2605459 - DNA, 11 bp, Homo sapiens
aatcagtatat

SEQ ID NO: 2605460 - DNA, 19 bp, Homo sapiens
aatcagtcagtgcaaatgt

SEQ ID NO: 2605461 - DNA, 14 bp, Homo sapiens
aatcagtcccctcc

SEQ ID NO: 2605462 - DNA, 16 bp, Homo sapiens
aatcagtcccctccca

SEQ ID NO: 2605463 - DNA, 18 bp, Homo sapiens
aatcagtcccctcccatc

SEQ ID NO: 2605464 - DNA, 19 bp, Homo sapiens
aatcatagtactctttgta

SEQ ID NO: 2605465 - DNA, 16 bp, Homo sapiens
aatcatgaaattactt

SEQ ID NO: 2605466 - DNA, 22 bp, Homo sapiens
aatcatgaatgtgtaacacagt

SEQ ID NO: 2605467 - DNA, 21 bp, Homo sapiens
aatcatggaatggttataaaa

SEQ ID NO: 2605468 - DNA, 16 bp, Homo sapiens
aatcatgtacatttct

SEQ ID NO: 2605469 - DNA, 22 bp, Homo sapiens
aatcatgtagtatcaaatatta

SEQ ID NO: 2605470 - DNA, 16 bp, Homo sapiens
aatcatgtcaggcctg

SEQ ID NO: 2605471 - DNA, 16 bp, Homo sapiens
aatcatgtgaacccgg

SEQ ID NO: 2605472 - DNA, 17 bp, Homo sapiens
aatcattaggtgtgact

SEQ ID NO: 2605473 - DNA, 20 bp, Homo sapiens
aatcattgctgaaaatggta

SEQ ID NO: 2605474 - DNA, 12 bp, Homo sapiens
aatcatttctat

SEQ ID NO: 2605475 - DNA, 20 bp, Homo sapiens
aatcatttctatttctcctc

SEQ ID NO: 2605476 - DNA, 22 bp, Homo sapiens
aatcatttctgcatcagctgct

SEQ ID NO: 2605477 - DNA, 21 bp, Homo sapiens
aatcatttcttgggccctcct

SEQ ID NO: 2605478 - DNA, 22 bp, Homo sapiens
aatcatttcttgggccctcctg

SEQ ID NO: 2605479 - DNA, 15 bp, Homo sapiens
aatcattttaattat

SEQ ID NO: 2605480 - DNA, 16 bp, Homo sapiens
aatcattttaattatt

SEQ ID NO: 2605481 - DNA, 20 bp, Homo sapiens
aatcattttacccttggctc

SEQ ID NO: 2605482 - DNA, 23 bp, Homo sapiens
aatccacccatcctaccaatgca

SEQ ID NO: 2605483 - DNA, 18 bp, Homo sapiens
aatccacctgcctcggcc

SEQ ID NO: 2605484 - DNA, 19 bp, Homo sapiens
aatccacctgcctcggcct

SEQ ID NO: 2605485 - DNA, 18 bp, Homo sapiens
aatccactcccaggcagc

SEQ ID NO: 2605486 - DNA, 17 bp, Homo sapiens
aatccagaaagaaaaaa

SEQ ID NO: 2605487 - DNA, 22 bp, Homo sapiens
aatccagaattgaccttttgac

SEQ ID NO: 2605488 - DNA, 21 bp, Homo sapiens
aatccatctaaatacctgccc

SEQ ID NO: 2605489 - DNA, 22 bp, Homo sapiens
aatccatctaaatacctgccct

SEQ ID NO: 2605490 - DNA, 22 bp, Homo sapiens
aatccatgttagtttttacttt

SEQ ID NO: 2605491 - DNA, 15 bp, Homo sapiens
aatcccagcactttg

SEQ ID NO: 2605492 - DNA, 12 bp, Homo sapiens
aatcccctcctt

SEQ ID NO: 2605493 - DNA, 17 bp, Homo sapiens
aatcccctccttgggca

SEQ ID NO: 2605494 - DNA, 19 bp, Homo sapiens
aatcccctccttgggcact

SEQ ID NO: 2605495 - DNA, 18 bp, Homo sapiens
aatccccttctcatcact

SEQ ID NO: 2605496 - DNA, 16 bp, Homo sapiens
aatcccgattcaccct

SEQ ID NO: 2605497 - DNA, 14 bp, Homo sapiens
aatccctggcaaag

SEQ ID NO: 2605498 - DNA, 23 bp, Homo sapiens
aatccctgtttaatatttaaaca

SEQ ID NO: 2605499 - DNA, 19 bp, Homo sapiens
aatccgaacctcctctgtg

SEQ ID NO: 2605500 - DNA, 21 bp, Homo sapiens
aatccgaccactaattgccaa

SEQ ID NO: 2605501 - DNA, 14 bp, Homo sapiens
aatcctatgtgatt

SEQ ID NO: 2605502 - DNA, 21 bp, Homo sapiens
aatcctatgtgattttaactc

SEQ ID NO: 2605503 - DNA, 16 bp, Homo sapiens
aatcctcactgggtgg

SEQ ID NO: 2605504 - DNA, 21 bp, Homo sapiens
aatcctctcaaccacctttca

SEQ ID NO: 2605505 - DNA, 17 bp, Homo sapiens
aatcctcttcctctgag

SEQ ID NO: 2605506 - DNA, 10 bp, Homo sapiens
aatcctgccc

SEQ ID NO: 2605507 - DNA, 14 bp, Homo sapiens
aatcctggggaaca

SEQ ID NO: 2605508 - DNA, 14 bp, Homo sapiens
aatcgcttaaagat

SEQ ID NO: 2605509 - DNA, 12 bp, Homo sapiens
aatcgcttctct

SEQ ID NO: 2605510 - DNA, 22 bp, Homo sapiens
aatcggatctggggctctggga

SEQ ID NO: 2605511 - DNA, 15 bp, Homo sapiens
aatcggtttaaacat

SEQ ID NO: 2605512 - DNA, 14 bp, Homo sapiens
aatctaaaagcttt

SEQ ID NO: 2605513 - DNA, 13 bp, Homo sapiens
aatctaaatggaa

SEQ ID NO: 2605514 - DNA, 16 bp, Homo sapiens
aatctaatattaaaaa

SEQ ID NO: 2605515 - DNA, 19 bp, Homo sapiens
aatctacactccagtgaga

SEQ ID NO: 2605516 - DNA, 17 bp, Homo sapiens
aatctaccttctgtagt

SEQ ID NO: 2605517 - DNA, 16 bp, Homo sapiens
aatctattatactgta

SEQ ID NO: 2605518 - DNA, 18 bp, Homo sapiens
aatctattatactgtatt

SEQ ID NO: 2605519 - DNA, 12 bp, Homo sapiens
aatctattcaga

SEQ ID NO: 2605520 - DNA, 16 bp, Homo sapiens
aatctattgggttcat

SEQ ID NO: 2605521 - DNA, 19 bp, Homo sapiens
aatctattgggttcattat

SEQ ID NO: 2605522 - DNA, 17 bp, Homo sapiens
aatctattttgtaactt

SEQ ID NO: 2605523 - DNA, 14 bp, Homo sapiens
aatctcaaatttct

SEQ ID NO: 2605524 - DNA, 17 bp, Homo sapiens
aatctcaattcttccct

SEQ ID NO: 2605525 - DNA, 15 bp, Homo sapiens
aatctccagtattct

SEQ ID NO: 2605526 - DNA, 17 bp, Homo sapiens
aatctcccgctgctgct

SEQ ID NO: 2605527 - DNA, 19 bp, Homo sapiens
aatctcccgctgctgctgc

SEQ ID NO: 2605528 - DNA, 17 bp, Homo sapiens
aatctgaggcctcctct

SEQ ID NO: 2605529 - DNA, 17 bp, Homo sapiens
aatctgatggcttctcc

SEQ ID NO: 2605530 - DNA, 18 bp, Homo sapiens
aatctggactcctctgtc

SEQ ID NO: 2605531 - DNA, 14 bp, Homo sapiens
aatctggagtgagg

SEQ ID NO: 2605532 - DNA, 11 bp, Homo sapiens
aatctgtaaac

SEQ ID NO: 2605533 - DNA, 21 bp, Homo sapiens
aatctgtaaactgtgtattcc

SEQ ID NO: 2605534 - DNA, 15 bp, Homo sapiens
aatctgtagggctgg

SEQ ID NO: 2605535 - DNA, 16 bp, Homo sapiens
aatctgtagggctgga

SEQ ID NO: 2605536 - DNA, 12 bp, Homo sapiens
aatctgtgatga

SEQ ID NO: 2605537 - DNA, 23 bp, Homo sapiens
aatcttacagctgggtggcactg

SEQ ID NO: 2605538 - DNA, 19 bp, Homo sapiens
aatcttaggggagagcttt

SEQ ID NO: 2605539 - DNA, 19 bp, Homo sapiens
aatcttggggggtttttac

SEQ ID NO: 2605540 - DNA, 13 bp, Homo sapiens
aatctttctgcag

SEQ ID NO: 2605541 - DNA, 17 bp, Homo sapiens
aatctttctttacctga

SEQ ID NO: 2605542 - DNA, 21 bp, Homo sapiens
aatctttctttacctgagacc

SEQ ID NO: 2605543 - DNA, 17 bp, Homo sapiens
aatgaaaaattctcagt

SEQ ID NO: 2605544 - DNA, 21 bp, Homo sapiens
aatgaaaaatttaagcattgt

SEQ ID NO: 2605545 - DNA, 16 bp, Homo sapiens
aatgaaacaccttctc

SEQ ID NO: 2605546 - DNA, 20 bp, Homo sapiens
aatgaaacccccacacacac

SEQ ID NO: 2605547 - DNA, 19 bp, Homo sapiens
aatgaaagagtaaaggaaa

SEQ ID NO: 2605548 - DNA, 15 bp, Homo sapiens
aatgaaagcatgtgg

SEQ ID NO: 2605549 - DNA, 17 bp, Homo sapiens
aatgaaagtataactga

SEQ ID NO: 2605550 - DNA, 19 bp, Homo sapiens
aatgaaagtataactgagt

SEQ ID NO: 2605551 - DNA, 14 bp, Homo sapiens
aatgaaatacacaa

SEQ ID NO: 2605552 - DNA, 22 bp, Homo sapiens
aatgaaatatctgtatttaatt

SEQ ID NO: 2605553 - DNA, 19 bp, Homo sapiens
aatgaaatgctctcctttc

SEQ ID NO: 2605554 - DNA, 14 bp, Homo sapiens
aatgaacaaattga

SEQ ID NO: 2605555 - DNA, 14 bp, Homo sapiens
aatgaactgaagtt

SEQ ID NO: 2605556 - DNA, 12 bp, Homo sapiens
aatgaagcttgt

SEQ ID NO: 2605557 - DNA, 14 bp, Homo sapiens
aatgaagcttgtgt

SEQ ID NO: 2605558 - DNA, 19 bp, Homo sapiens
aatgaagctttatacgtgt

SEQ ID NO: 2605559 - DNA, 22 bp, Homo sapiens
aatgaaggtgtcagaataataa

SEQ ID NO: 2605560 - DNA, 22 bp, Homo sapiens
aatgaaggttaggatttaacag

SEQ ID NO: 2605561 - DNA, 14 bp, Homo sapiens
aatgaagtctctga

SEQ ID NO: 2605562 - DNA, 17 bp, Homo sapiens
aatgaagttgtaggtaa

SEQ ID NO: 2605563 - DNA, 13 bp, Homo sapiens
aatgaattttgtt

SEQ ID NO: 2605564 - DNA, 13 bp, Homo sapiens
aatgacaacagaa

SEQ ID NO: 2605565 - DNA, 17 bp, Homo sapiens
aatgacacttgtcccca

SEQ ID NO: 2605566 - DNA, 18 bp, Homo sapiens
aatgacatcttcaaagct

SEQ ID NO: 2605567 - DNA, 19 bp, Homo sapiens
aatgagaccctcgtggcct

SEQ ID NO: 2605568 - DNA, 15 bp, Homo sapiens
aatgagacttgctct

SEQ ID NO: 2605569 - DNA, 11 bp, Homo sapiens
aatgagcctgg

SEQ ID NO: 2605570 - DNA, 14 bp, Homo sapiens
aatgagcctggcaa

SEQ ID NO: 2605571 - DNA, 20 bp, Homo sapiens
aatgagggactggaaccagg

SEQ ID NO: 2605572 - DNA, 18 bp, Homo sapiens
aatgagggccaagaaaga

SEQ ID NO: 2605573 - DNA, 16 bp, Homo sapiens
aatgaggtcagagcct

SEQ ID NO: 2605574 - DNA, 19 bp, Homo sapiens
aatgagttacctacatttt

SEQ ID NO: 2605575 - DNA, 15 bp, Homo sapiens
aatgataaactctct

SEQ ID NO: 2605576 - DNA, 20 bp, Homo sapiens
aatgataatattgtggtgcc

SEQ ID NO: 2605577 - DNA, 15 bp, Homo sapiens
aatgatagctactgt

SEQ ID NO: 2605578 - DNA, 18 bp, Homo sapiens
aatgatagtaagaaaagt

SEQ ID NO: 2605579 - DNA, 20 bp, Homo sapiens
aatgatccccaagtgtgaac

SEQ ID NO: 2605580 - DNA, 22 bp, Homo sapiens
aatgatccccagctgtttatgc

SEQ ID NO: 2605581 - DNA, 16 bp, Homo sapiens
aatgatctaggtttaa

SEQ ID NO: 2605582 - DNA, 18 bp, Homo sapiens
aatgatctaggtttaact

SEQ ID NO: 2605583 - DNA, 20 bp, Homo sapiens
aatgatgatgggaattgtgt

SEQ ID NO: 2605584 - DNA, 22 bp, Homo sapiens
aatgatggacccaatgcacaca

SEQ ID NO: 2605585 - DNA, 13 bp, Homo sapiens
aatgattcagtgt

SEQ ID NO: 2605586 - DNA, 19 bp, Homo sapiens
aatttcccaattaggaagt

SEQ ID NO: 2605587 - DNA, 17 bp, Homo sapiens
aatttccccaacagtgt

SEQ ID NO: 2605588 - DNA, 20 bp, Homo sapiens
aatttccccaacagtgtgaa

SEQ ID NO: 2605589 - DNA, 22 bp, Homo sapiens
aatttcctggtgtgaaggtcct

SEQ ID NO: 2605590 - DNA, 20 bp, Homo sapiens
aatttcctgttggatttgtt

SEQ ID NO: 2605591 - DNA, 18 bp, Homo sapiens
aatttcgccgttgaagag

SEQ ID NO: 2605592 - DNA, 21 bp, Homo sapiens
aatttcgccgttgaagaggaa

SEQ ID NO: 2605593 - DNA, 22 bp, Homo sapiens
aatttctaaaaaacagaggcca

SEQ ID NO: 2605594 - DNA, 13 bp, Homo sapiens
aatttctaaatct

SEQ ID NO: 2605595 - DNA, 15 bp, Homo sapiens
aatttctactttgaa

SEQ ID NO: 2605596 - DNA, 17 bp, Homo sapiens
aatttctactttgaagt

SEQ ID NO: 2605597 - DNA, 19 bp, Homo sapiens
aatttctcccagtcattta

SEQ ID NO: 2605598 - DNA, 20 bp, Homo sapiens
aatttctcccagtcatttaa

SEQ ID NO: 2605599 - DNA, 12 bp, Homo sapiens
aatttctcccca

SEQ ID NO: 2605600 - DNA, 13 bp, Homo sapiens
aatttctccccag

SEQ ID NO: 2605601 - DNA, 20 bp, Homo sapiens
aatttcttcactgttgaaaa

SEQ ID NO: 2605602 - DNA, 15 bp, Homo sapiens
aatttctttgcctgt

SEQ ID NO: 2605603 - DNA, 23 bp, Homo sapiens
aatttgaaaacataatctgcaaa

SEQ ID NO: 2605604 - DNA, 15 bp, Homo sapiens
aatttgaatgaaaaa

SEQ ID NO: 2605605 - DNA, 20 bp, Homo sapiens
aatttgagagaaatatgaag

SEQ ID NO: 2605606 - DNA, 20 bp, Homo sapiens
aatttgagttggatcatcta

SEQ ID NO: 2605607 - DNA, 16 bp, Homo sapiens
aatttgcttcactcaa

SEQ ID NO: 2605608 - DNA, 18 bp, Homo sapiens
aatttgggggaaaattta

SEQ ID NO: 2605609 - DNA, 22 bp, Homo sapiens
aatttggttctaatagaactca

SEQ ID NO: 2605610 - DNA, 13 bp, Homo sapiens
aatttgtaagttt

SEQ ID NO: 2605611 - DNA, 23 bp, Homo sapiens
aatttgtaagtttcaggtgacat

SEQ ID NO: 2605612 - DNA, 18 bp, Homo sapiens
aatttgtgatacaatgct

SEQ ID NO: 2605613 - DNA, 18 bp, Homo sapiens
aatttgttgaaattatgt

SEQ ID NO: 2605614 - DNA, 22 bp, Homo sapiens
aattttaaataaaagtgatcaa

SEQ ID NO: 2605615 - DNA, 12 bp, Homo sapiens
aattttaaatta

SEQ ID NO: 2605616 - DNA, 19 bp, Homo sapiens
aattttaacctatgatatt

SEQ ID NO: 2605617 - DNA, 15 bp, Homo sapiens
aattttaatttattt

SEQ ID NO: 2605618 - DNA, 18 bp, Homo sapiens
aattttaccctttagact

SEQ ID NO: 2605619 - DNA, 19 bp, Homo sapiens
aattttcctaataaagttc

SEQ ID NO: 2605620 - DNA, 12 bp, Homo sapiens
aattttctagac

SEQ ID NO: 2605621 - DNA, 17 bp, Homo sapiens
aattttctagactttct

SEQ ID NO: 2605622 - DNA, 20 bp, Homo sapiens
aattttctagactttctgtt

SEQ ID NO: 2605623 - DNA, 22 bp, Homo sapiens
aattttcttcatgcaatgacat

SEQ ID NO: 2605624 - DNA, 14 bp, Homo sapiens
aattttgatgaaca

SEQ ID NO: 2605625 - DNA, 16 bp, Homo sapiens
aattttgatgaacaaa

SEQ ID NO: 2605626 - DNA, 22 bp, Homo sapiens
aattttggccaaagtgttaatc

SEQ ID NO: 2605627 - DNA, 15 bp, Homo sapiens
aattttggttgtatt

SEQ ID NO: 2605628 - DNA, 18 bp, Homo sapiens
aattttggttgtattctt

SEQ ID NO: 2605629 - DNA, 14 bp, Homo sapiens
aattttgtacaaat

SEQ ID NO: 2605630 - DNA, 12 bp, Homo sapiens
aattttgtattt

SEQ ID NO: 2605631 - DNA, 15 bp, Homo sapiens
aattttgtattttcc

SEQ ID NO: 2605632 - DNA, 16 bp, Homo sapiens
aattttgtattttcca

SEQ ID NO: 2605633 - DNA, 17 bp, Homo sapiens
aattttgtattttccaa

SEQ ID NO: 2605634 - DNA, 21 bp, Homo sapiens
aattttgtattttccaagtgt

SEQ ID NO: 2605635 - DNA, 23 bp, Homo sapiens
aattttgtattttccaagtgtgc

SEQ ID NO: 2605636 - DNA, 19 bp, Homo sapiens
aatttttaaagtatatatt

SEQ ID NO: 2605637 - DNA, 20 bp, Homo sapiens
aatttttaaagtatatattt

SEQ ID NO: 2605638 - DNA, 15 bp, Homo sapiens
aatttttatttttct

SEQ ID NO: 2605639 - DNA, 16 bp, Homo sapiens
aatttttatttttcta

SEQ ID NO: 2605640 - DNA, 15 bp, Homo sapiens
aatttttcagatgct

SEQ ID NO: 2605641 - DNA, 23 bp, Homo sapiens
aatttttcattgatatgaaaaat

SEQ ID NO: 2605642 - DNA, 20 bp, Homo sapiens
aatttttgccttcattacct

SEQ ID NO: 2605643 - DNA, 14 bp, Homo sapiens
aatttttggttgaa

SEQ ID NO: 2605644 - DNA, 19 bp, Homo sapiens
aatttttttaatttacaaa

SEQ ID NO: 2605645 - DNA, 17 bp, Homo sapiens
aatttttttaattttgt

SEQ ID NO: 2605646 - DNA, 17 bp, Homo sapiens
aatttttttattactga

SEQ ID NO: 2605647 - DNA, 16 bp, Homo sapiens
aatttttttctgcaac

SEQ ID NO: 2605648 - DNA, 23 bp, Homo sapiens
aattttttttcatgttttaacaa

SEQ ID NO: 2605649 - DNA, 21 bp, Homo sapiens
acaaaaaaaaagttttatttt

SEQ ID NO: 2605650 - DNA, 15 bp, Homo sapiens
acaaaaaactcccct

SEQ ID NO: 2605651 - DNA, 15 bp, Homo sapiens
acaaaaacacagcaa

SEQ ID NO: 2605652 - DNA, 15 bp, Homo sapiens
acaaaaagcttcccc

SEQ ID NO: 2605653 - DNA, 22 bp, Homo sapiens
acaaaaaggtaaaactttttat

SEQ ID NO: 2605654 - DNA, 18 bp, Homo sapiens
acaaaaagtttccatatg

SEQ ID NO: 2605655 - DNA, 15 bp, Homo sapiens
acaaaaattgactca

SEQ ID NO: 2605656 - DNA, 17 bp, Homo sapiens
acaaaacaaccctagag

SEQ ID NO: 2605657 - DNA, 22 bp, Homo sapiens
acaaaagtttcatccttttcat

SEQ ID NO: 2605658 - DNA, 12 bp, Homo sapiens
acaaaatagaag

SEQ ID NO: 2605659 - DNA, 18 bp, Homo sapiens
acaaaatagaagctgtag

SEQ ID NO: 2605660 - DNA, 22 bp, Homo sapiens
acaaacatatttgttaaatatt

SEQ ID NO: 2605661 - DNA, 12 bp, Homo sapiens
acaaacctgcct

SEQ ID NO: 2605662 - DNA, 14 bp, Homo sapiens
acaaacctgcctgg

SEQ ID NO: 2605663 - DNA, 15 bp, Homo sapiens
acaaagaagacatgt

SEQ ID NO: 2605664 - DNA, 22 bp, Homo sapiens
acaaagaagacatgttttagac

SEQ ID NO: 2605665 - DNA, 17 bp, Homo sapiens
acaaagcacagtttgaa

SEQ ID NO: 2605666 - DNA, 19 bp, Homo sapiens
acaaagcacagtttgaaca

SEQ ID NO: 2605667 - DNA, 19 bp, Homo sapiens
acaaagccaaactctgcca

SEQ ID NO: 2605668 - DNA, 19 bp, Homo sapiens
acaaagccttatcaagtgt

SEQ ID NO: 2605669 - DNA, 17 bp, Homo sapiens
acaaagggttttaatgt

SEQ ID NO: 2605670 - DNA, 18 bp, Homo sapiens
acaaagtgagacagtcca

SEQ ID NO: 2605671 - DNA, 14 bp, Homo sapiens
acaaatactcatgt

SEQ ID NO: 2605672 - DNA, 15 bp, Homo sapiens
acaaatactcttagg

SEQ ID NO: 2605673 - DNA, 22 bp, Homo sapiens
acaaatcaagcttcagtttcct

SEQ ID NO: 2605674 - DNA, 15 bp, Homo sapiens
acaaatgccacacat

SEQ ID NO: 2605675 - DNA, 20 bp, Homo sapiens
acaaatgccacacatcaccc

SEQ ID NO: 2605676 - DNA, 13 bp, Homo sapiens
acaaatgtatgat

SEQ ID NO: 2605677 - DNA, 22 bp, Homo sapiens
acaaatgtgtatcggatgcttt

SEQ ID NO: 2605678 - DNA, 17 bp, Homo sapiens
acaaattcatattctgt

SEQ ID NO: 2605679 - DNA, 12 bp, Homo sapiens
acaaattctgtt

SEQ ID NO: 2605680 - DNA, 15 bp, Homo sapiens
acaaattctgtttct

SEQ ID NO: 2605681 - DNA, 17 bp, Homo sapiens
acaacaaaaagcttccc

SEQ ID NO: 2605682 - DNA, 21 bp, Homo sapiens
acaacactcattgacctgagg

SEQ ID NO: 2605683 - DNA, 13 bp, Homo sapiens
acaacagaagtca

SEQ ID NO: 2605684 - DNA, 13 bp, Homo sapiens
acaacagatttgt

SEQ ID NO: 2605685 - DNA, 16 bp, Homo sapiens
acaacattaaaacaat

SEQ ID NO: 2605686 - DNA, 15 bp, Homo sapiens
acaaccaccgctccc

SEQ ID NO: 2605687 - DNA, 20 bp, Homo sapiens
acaaccaccgctccccagcc

SEQ ID NO: 2605688 - DNA, 17 bp, Homo sapiens
acaaccactcattcaaa

SEQ ID NO: 2605689 - DNA, 17 bp, Homo sapiens
acaaccctgttttatac

SEQ ID NO: 2605690 - DNA, 22 bp, Homo sapiens
acaaccgatgctccagccaacc

SEQ ID NO: 2605691 - DNA, 13 bp, Homo sapiens
acaactttgccag

SEQ ID NO: 2605692 - DNA, 17 bp, Homo sapiens
acaagaccacgtttcta

SEQ ID NO: 2605693 - DNA, 18 bp, Homo sapiens
acaagaccacgtttctaa

SEQ ID NO: 2605694 - DNA, 16 bp, Homo sapiens
acaagagcagcctgtg

SEQ ID NO: 2605695 - DNA, 20 bp, Homo sapiens
acaagagcccagcagggcct

SEQ ID NO: 2605696 - DNA, 14 bp, Homo sapiens
acaagatctttcag

SEQ ID NO: 2605697 - DNA, 15 bp, Homo sapiens
acaagatctttcagg

SEQ ID NO: 2605698 - DNA, 21 bp, Homo sapiens
acaagccaacttgtaaataca

SEQ ID NO: 2605699 - DNA, 13 bp, Homo sapiens
acaagccacagaa

SEQ ID NO: 2605700 - DNA, 13 bp, Homo sapiens
acaagccagctgg

SEQ ID NO: 2605701 - DNA, 14 bp, Homo sapiens
acaagccccaggca

SEQ ID NO: 2605702 - DNA, 17 bp, Homo sapiens
acaagccccaggcaggc

SEQ ID NO: 2605703 - DNA, 18 bp, Homo sapiens
acaagcccccccttccac

SEQ ID NO: 2605704 - DNA, 20 bp, Homo sapiens
acaagcgtgagccactgcac

SEQ ID NO: 2605705 - DNA, 16 bp, Homo sapiens
acaagctccaagctcc

SEQ ID NO: 2605706 - DNA, 19 bp, Homo sapiens
acaagctccaagctcccag

SEQ ID NO: 2605707 - DNA, 22 bp, Homo sapiens
acaagctccaagctcccaggca

SEQ ID NO: 2605708 - DNA, 15 bp, Homo sapiens
acaagctcccaggcc

SEQ ID NO: 2605709 - DNA, 22 bp, Homo sapiens
acaagctgcaccctcaggcagg

SEQ ID NO: 2605710 - DNA, 16 bp, Homo sapiens
acaagctggaagcaca

SEQ ID NO: 2605711 - DNA, 18 bp, Homo sapiens
acaagctggaagcacatg

SEQ ID NO: 2605712 - DNA, 20 bp, Homo sapiens
acaaggatgatctaggaaga

SEQ ID NO: 2605713 - DNA, 17 bp, Homo sapiens
acaaggattgctactgt

SEQ ID NO: 2605714 - DNA, 23 bp, Homo sapiens
acaaggcattcaagtgtacagtg

SEQ ID NO: 2605715 - DNA, 11 bp, Homo sapiens
acaaggcccca

SEQ ID NO: 2605716 - DNA, 17 bp, Homo sapiens
acaaggccccagagact

SEQ ID NO: 2605717 - DNA, 18 bp, Homo sapiens
acaaggctgaccaagaga

SEQ ID NO: 2605718 - DNA, 20 bp, Homo sapiens
acaaggctgaccaagagaga

SEQ ID NO: 2605719 - DNA, 21 bp, Homo sapiens
acaagtcattttaactttatc

SEQ ID NO: 2605720 - DNA, 15 bp, Homo sapiens
acaagtcctgtgaat

SEQ ID NO: 2605721 - DNA, 16 bp, Homo sapiens
acaagtcctgtgaatt

SEQ ID NO: 2605722 - DNA, 18 bp, Homo sapiens
acaagtgtatatcagaaa

SEQ ID NO: 2605723 - DNA, 15 bp, Homo sapiens
acaagttaaataaat

SEQ ID NO: 2605724 - DNA, 14 bp, Homo sapiens
acaagttgtgtttg

SEQ ID NO: 2605725 - DNA, 14 bp, Homo sapiens
acaagttttaaata

SEQ ID NO: 2605726 - DNA, 22 bp, Homo sapiens
acaagtttttctgtcaagaaga

SEQ ID NO: 2605727 - DNA, 23 bp, Homo sapiens
acaataaagatcgcccccacctc

SEQ ID NO: 2605728 - DNA, 14 bp, Homo sapiens
acaataaataatct

SEQ ID NO: 2605729 - DNA, 15 bp, Homo sapiens
acaataaatgtgctt

SEQ ID NO: 2605730 - DNA, 16 bp, Homo sapiens
acagagttgttacatt

SEQ ID NO: 2605731 - DNA, 17 bp, Homo sapiens
acagagttgttacattt

SEQ ID NO: 2605732 - DNA, 20 bp, Homo sapiens
acagagttgttacattttta

SEQ ID NO: 2605733 - DNA, 20 bp, Homo sapiens
acagataagcaagagagatg

SEQ ID NO: 2605734 - DNA, 22 bp, Homo sapiens
acagatactggaagttttgcat

SEQ ID NO: 2605735 - DNA, 20 bp, Homo sapiens
acagatagatatatgctctg

SEQ ID NO: 2605736 - DNA, 23 bp, Homo sapiens
acagatagtcaaaccataaactt

SEQ ID NO: 2605737 - DNA, 15 bp, Homo sapiens
acagatcaagctgtg

SEQ ID NO: 2605738 - DNA, 22 bp, Homo sapiens
acagatctctgctttggaaatc

SEQ ID NO: 2605739 - DNA, 20 bp, Homo sapiens
acagatgaaacacaaacaat

SEQ ID NO: 2605740 - DNA, 16 bp, Homo sapiens
acagatgcaatgtgct

SEQ ID NO: 2605741 - DNA, 13 bp, Homo sapiens
acagatgccccag

SEQ ID NO: 2605742 - DNA, 16 bp, Homo sapiens
acagatgccccagagc

SEQ ID NO: 2605743 - DNA, 19 bp, Homo sapiens
acagatgccccagagctgt

SEQ ID NO: 2605744 - DNA, 22 bp, Homo sapiens
acagatgccccagagctgttta

SEQ ID NO: 2605745 - DNA, 14 bp, Homo sapiens
acagatgcttttct

SEQ ID NO: 2605746 - DNA, 17 bp, Homo sapiens
acagatggatttgcctg

SEQ ID NO: 2605747 - DNA, 12 bp, Homo sapiens
acagatgttgaa

SEQ ID NO: 2605748 - DNA, 16 bp, Homo sapiens
acagattcacactgtc

SEQ ID NO: 2605749 - DNA, 21 bp, Homo sapiens
acagatttgtgaactcagcca

SEQ ID NO: 2605750 - DNA, 20 bp, Homo sapiens
acagattttggggttgtgtt

SEQ ID NO: 2605751 - DNA, 20 bp, Homo sapiens
acagcaacaatttatgaatt

SEQ ID NO: 2605752 - DNA, 21 bp, Homo sapiens
acagcaaggagatttacaact

SEQ ID NO: 2605753 - DNA, 14 bp, Homo sapiens
acagcacagagaag

SEQ ID NO: 2605754 - DNA, 20 bp, Homo sapiens
acagcactactctgtgccag

SEQ ID NO: 2605755 - DNA, 22 bp, Homo sapiens
acagcactggctctctccagga

SEQ ID NO: 2605756 - DNA, 14 bp, Homo sapiens
acagcagctgaaca

SEQ ID NO: 2605757 - DNA, 22 bp, Homo sapiens
acagcagggtagtctggtttct

SEQ ID NO: 2605758 - DNA, 13 bp, Homo sapiens
acagcagtgttcc

SEQ ID NO: 2605759 - DNA, 21 bp, Homo sapiens
acagcagttgaaaagactcca

SEQ ID NO: 2605760 - DNA, 17 bp, Homo sapiens
acagcatcattttgcat

SEQ ID NO: 2605761 - DNA, 13 bp, Homo sapiens
acagcattgcttt

SEQ ID NO: 2605762 - DNA, 15 bp, Homo sapiens
acagcattgctttct

SEQ ID NO: 2605763 - DNA, 23 bp, Homo sapiens
acagccaacaggtggcaggacca

SEQ ID NO: 2605764 - DNA, 12 bp, Homo sapiens
acagccacacac

SEQ ID NO: 2605765 - DNA, 17 bp, Homo sapiens
acagccacacacacaga

SEQ ID NO: 2605766 - DNA, 20 bp, Homo sapiens
acagccacacacacagaaaa

SEQ ID NO: 2605767 - DNA, 23 bp, Homo sapiens
acagccacacacacagaaaatat

SEQ ID NO: 2605768 - DNA, 13 bp, Homo sapiens
acagccagactgg

SEQ ID NO: 2605769 - DNA, 17 bp, Homo sapiens
acagcccaaagaaggaa

SEQ ID NO: 2605770 - DNA, 15 bp, Homo sapiens
acagccccctctgcc

SEQ ID NO: 2605771 - DNA, 16 bp, Homo sapiens
acagcccgggctctgc

SEQ ID NO: 2605772 - DNA, 22 bp, Homo sapiens
acagcccgggctctgcctccca

SEQ ID NO: 2605773 - DNA, 22 bp, Homo sapiens
acagccgcagcctccctctgac

SEQ ID NO: 2605774 - DNA, 23 bp, Homo sapiens
acagccgcagcctccctctgacc

SEQ ID NO: 2605775 - DNA, 19 bp, Homo sapiens
acagccgctcctgtctgcc

SEQ ID NO: 2605776 - DNA, 24 bp, Homo sapiens
acagccgctcctgtctgccagcca

SEQ ID NO: 2605777 - DNA, 19 bp, Homo sapiens
acagccgtcagccaaatgt

SEQ ID NO: 2605778 - DNA, 18 bp, Homo sapiens
acagcctcccctgccagg

SEQ ID NO: 2605779 - DNA, 19 bp, Homo sapiens
acagcctcccctgccaggg

SEQ ID NO: 2605780 - DNA, 15 bp, Homo sapiens
acagcctcctctgtc

SEQ ID NO: 2605781 - DNA, 20 bp, Homo sapiens
acagcctcctctgtctgccc

SEQ ID NO: 2605782 - DNA, 23 bp, Homo sapiens
acagcctcctctgtctgcccttc

SEQ ID NO: 2605783 - DNA, 14 bp, Homo sapiens
acagcgagaggcag

SEQ ID NO: 2605784 - DNA, 12 bp, Homo sapiens
acagcgctgggt

SEQ ID NO: 2605785 - DNA, 15 bp, Homo sapiens
acagcggcccctgca

SEQ ID NO: 2605786 - DNA, 16 bp, Homo sapiens
acagcgtttaagactg

SEQ ID NO: 2605787 - DNA, 17 bp, Homo sapiens
acagctaatgggacact

SEQ ID NO: 2605788 - DNA, 19 bp, Homo sapiens
acagctaatgggacactaa

SEQ ID NO: 2605789 - DNA, 20 bp, Homo sapiens
acagctcaagtcttccctga

SEQ ID NO: 2605790 - DNA, 14 bp, Homo sapiens
acagctcctcccac

SEQ ID NO: 2605791 - DNA, 13 bp, Homo sapiens
acagctccttctg

SEQ ID NO: 2605792 - DNA, 13 bp, Homo sapiens
acagctctagaca

SEQ ID NO: 2605793 - DNA, 20 bp, Homo sapiens
acagctctgcatactcatta

SEQ ID NO: 2605794 - DNA, 13 bp, Homo sapiens
acagctctgtcct

SEQ ID NO: 2605795 - DNA, 19 bp, Homo sapiens
acagctcttctccaggctg

SEQ ID NO: 2605796 - DNA, 18 bp, Homo sapiens
acagctgagcacattctg

SEQ ID NO: 2605797 - DNA, 23 bp, Homo sapiens
acagctgagcacattctggctca

SEQ ID NO: 2605798 - DNA, 16 bp, Homo sapiens
acagctgaggtctctt

SEQ ID NO: 2605799 - DNA, 12 bp, Homo sapiens
acagctgcctgc

SEQ ID NO: 2605800 - DNA, 13 bp, Homo sapiens
acagctgcctggg

SEQ ID NO: 2605801 - DNA, 14 bp, Homo sapiens
acagctgcctggga

SEQ ID NO: 2605802 - DNA, 23 bp, Homo sapiens
acagctgcctgggatccctcatc

SEQ ID NO: 2605803 - DNA, 23 bp, Homo sapiens
acagctgctttctgttgtcattg

SEQ ID NO: 2605804 - DNA, 13 bp, Homo sapiens
acagctggcctcc

SEQ ID NO: 2605805 - DNA, 16 bp, Homo sapiens
acagctgggtggcact

SEQ ID NO: 2605806 - DNA, 18 bp, Homo sapiens
acagctgggtggcactgc

SEQ ID NO: 2605807 - DNA, 23 bp, Homo sapiens
acagctgggtggcactgccatgc

SEQ ID NO: 2605808 - DNA, 22 bp, Homo sapiens
acagcttcaggttatcgaaata

SEQ ID NO: 2605809 - DNA, 17 bp, Homo sapiens
acagcttcatttcctgt

SEQ ID NO: 2605810 - DNA, 22 bp, Homo sapiens
acagcttcccctctctcctcct

SEQ ID NO: 2605811 - DNA, 21 bp, Homo sapiens
acagcttctcatcctgcaggc

SEQ ID NO: 2605812 - DNA, 20 bp, Homo sapiens
acagctttgtgactgtatat

SEQ ID NO: 2605813 - DNA, 21 bp, Homo sapiens
acagctttgtgactgtatata

SEQ ID NO: 2605814 - DNA, 23 bp, Homo sapiens
acagctttgtgactgtatataaa

SEQ ID NO: 2605815 - DNA, 15 bp, Homo sapiens
acaggaaaagctgct

SEQ ID NO: 2605816 - DNA, 16 bp, Homo sapiens
acaggaaaagctgctg

SEQ ID NO: 2605817 - DNA, 18 bp, Homo sapiens
acaggaagatcttaaatt

SEQ ID NO: 2605818 - DNA, 17 bp, Homo sapiens
acaggaagtagaggagg

SEQ ID NO: 2605819 - DNA, 15 bp, Homo sapiens
acaggaagtgaagaa

SEQ ID NO: 2605820 - DNA, 19 bp, Homo sapiens
acaggaatcaagagctgcc

SEQ ID NO: 2605821 - DNA, 14 bp, Homo sapiens
acaggacccccttc

SEQ ID NO: 2605822 - DNA, 15 bp, Homo sapiens
acaggactctgcctc

SEQ ID NO: 2605823 - DNA, 17 bp, Homo sapiens
acaggaggacaattcat

SEQ ID NO: 2605824 - DNA, 22 bp, Homo sapiens
acaggaggacaattcatgaact

SEQ ID NO: 2605825 - DNA, 16 bp, Homo sapiens
acaggagtgagcacta

SEQ ID NO: 2605826 - DNA, 20 bp, Homo sapiens
acaggatttgaactcagatc

SEQ ID NO: 2605827 - DNA, 19 bp, Homo sapiens
acaggcaaaatccttgctt

SEQ ID NO: 2605828 - DNA, 16 bp, Homo sapiens
acaggcaactgaggca

SEQ ID NO: 2605829 - DNA, 19 bp, Homo sapiens
acaggcaactgaggcagac

SEQ ID NO: 2605830 - DNA, 15 bp, Homo sapiens
acaggcaagcacctc

SEQ ID NO: 2605831 - DNA, 18 bp, Homo sapiens
acaggcaagcacctcctg

SEQ ID NO: 2605832 - DNA, 19 bp, Homo sapiens
acaggcaatgctggctgtt

SEQ ID NO: 2605833 - DNA, 14 bp, Homo sapiens
acaggcaccgagaa

SEQ ID NO: 2605834 - DNA, 20 bp, Homo sapiens
acaggcaccgagaatgttgt

SEQ ID NO: 2605835 - DNA, 21 bp, Homo sapiens
acaggcaccgagaatgttgta

SEQ ID NO: 2605836 - DNA, 14 bp, Homo sapiens
acaggcagcattta

SEQ ID NO: 2605837 - DNA, 21 bp, Homo sapiens
acaggcagctggatgagactt

SEQ ID NO: 2605838 - DNA, 14 bp, Homo sapiens
acaggcaggtccag

SEQ ID NO: 2605839 - DNA, 19 bp, Homo sapiens
acaggcatgttctctgagg

SEQ ID NO: 2605840 - DNA, 11 bp, Homo sapiens
acaggcccagc

SEQ ID NO: 2605841 - DNA, 18 bp, Homo sapiens
acaggcccggctccaggc

SEQ ID NO: 2605842 - DNA, 14 bp, Homo sapiens
acaggctcaatatt

SEQ ID NO: 2605843 - DNA, 12 bp, Homo sapiens
acaggctgggct

SEQ ID NO: 2605844 - DNA, 22 bp, Homo sapiens
acagggaaccctgcttgcactt

SEQ ID NO: 2605845 - DNA, 15 bp, Homo sapiens
acagggaagagcaga

SEQ ID NO: 2605846 - DNA, 15 bp, Homo sapiens
acagggaagctacag

SEQ ID NO: 2605847 - DNA, 23 bp, Homo sapiens
acagggaagctacaggttacaac

SEQ ID NO: 2605848 - DNA, 22 bp, Homo sapiens
acagggaatgcctgagtgcctg

SEQ ID NO: 2605849 - DNA, 22 bp, Homo sapiens
acagggactgaaaacctctcct

SEQ ID NO: 2605850 - DNA, 14 bp, Homo sapiens
acagggatgagcat

SEQ ID NO: 2605851 - DNA, 12 bp, Homo sapiens
acagggcacacc

SEQ ID NO: 2605852 - DNA, 20 bp, Homo sapiens
acagggcacaccgggcactc

SEQ ID NO: 2605853 - DNA, 22 bp, Homo sapiens
acagggcacaccgggcactcag

SEQ ID NO: 2605854 - DNA, 16 bp, Homo sapiens
acagggcagagccggg

SEQ ID NO: 2605855 - DNA, 16 bp, Homo sapiens
acagggcagctgggcc

SEQ ID NO: 2605856 - DNA, 21 bp, Homo sapiens
acagggcagctgggcccaacc

SEQ ID NO: 2605857 - DNA, 16 bp, Homo sapiens
acagggcatctccagg

SEQ ID NO: 2605858 - DNA, 17 bp, Homo sapiens
acagggcatctccagga

SEQ ID NO: 2605859 - DNA, 21 bp, Homo sapiens
acagggcctttggcaggtgca

SEQ ID NO: 2605860 - DNA, 13 bp, Homo sapiens
acagggctggccc

SEQ ID NO: 2605861 - DNA, 18 bp, Homo sapiens
acagggctggcccagccc

SEQ ID NO: 2605862 - DNA, 21 bp, Homo sapiens
acagggctggcccagccctgc

SEQ ID NO: 2605863 - DNA, 16 bp, Homo sapiens
acagggttcaaaatgt

SEQ ID NO: 2605864 - DNA, 14 bp, Homo sapiens
acagggttgggccc

SEQ ID NO: 2605865 - DNA, 23 bp, Homo sapiens
acaggtcaatacagtacaggcag

SEQ ID NO: 2605866 - DNA, 18 bp, Homo sapiens
acaggtctcctcttaaaa

SEQ ID NO: 2605867 - DNA, 16 bp, Homo sapiens
acaggtggcaggacca

SEQ ID NO: 2605868 - DNA, 19 bp, Homo sapiens
acaggtgtgaaccaccaca

SEQ ID NO: 2605869 - DNA, 23 bp, Homo sapiens
acaggtgtgagtcaccaagccca

SEQ ID NO: 2605870 - DNA, 14 bp, Homo sapiens
acaggttacaacag

SEQ ID NO: 2605871 - DNA, 16 bp, Homo sapiens
acaggttacaacagat

SEQ ID NO: 2605872 - DNA, 17 bp, Homo sapiens
acaggttacaacagatt

SEQ ID NO: 2605873 - DNA, 16 bp, Homo sapiens
acccagaagaaaatag

SEQ ID NO: 2605874 - DNA, 13 bp, Homo sapiens
acccagacccagt

SEQ ID NO: 2605875 - DNA, 17 bp, Homo sapiens
acccagagaagcccctt

SEQ ID NO: 2605876 - DNA, 18 bp, Homo sapiens
acccagagaagccccttc

SEQ ID NO: 2605877 - DNA, 24 bp, Homo sapiens
acccagagcattacgtgagccagg

SEQ ID NO: 2605878 - DNA, 22 bp, Homo sapiens
acccagaggaaggggccagagg

SEQ ID NO: 2605879 - DNA, 22 bp, Homo sapiens
acccagatgggggaaagcacag

SEQ ID NO: 2605880 - DNA, 18 bp, Homo sapiens
acccagccatctgcccag

SEQ ID NO: 2605881 - DNA, 19 bp, Homo sapiens
acccagccatctgcccagg

SEQ ID NO: 2605882 - DNA, 15 bp, Homo sapiens
acccagcccacttct

SEQ ID NO: 2605883 - DNA, 17 bp, Homo sapiens
acccagcccacttctgc

SEQ ID NO: 2605884 - DNA, 13 bp, Homo sapiens
acccagccctggt

SEQ ID NO: 2605885 - DNA, 21 bp, Homo sapiens
acccagccctggtctcagcag

SEQ ID NO: 2605886 - DNA, 13 bp, Homo sapiens
acccagcgagccc

SEQ ID NO: 2605887 - DNA, 13 bp, Homo sapiens
acccagctctggt

SEQ ID NO: 2605888 - DNA, 18 bp, Homo sapiens
acccaggacgcttctgaa

SEQ ID NO: 2605889 - DNA, 15 bp, Homo sapiens
acccaggcacctgca

SEQ ID NO: 2605890 - DNA, 22 bp, Homo sapiens
acccaggctgggcaaggaggcc

SEQ ID NO: 2605891 - DNA, 13 bp, Homo sapiens
acccaggggtggg

SEQ ID NO: 2605892 - DNA, 11 bp, Homo sapiens
acccaggtgct

SEQ ID NO: 2605893 - DNA, 14 bp, Homo sapiens
acccagtgagcact

SEQ ID NO: 2605894 - DNA, 20 bp, Homo sapiens
acccatatcccctctccccc

SEQ ID NO: 2605895 - DNA, 15 bp, Homo sapiens
acccatcaacaaaaa

SEQ ID NO: 2605896 - DNA, 13 bp, Homo sapiens
acccatctgcacc

SEQ ID NO: 2605897 - DNA, 21 bp, Homo sapiens
acccatctgcacccccctggg

SEQ ID NO: 2605898 - DNA, 17 bp, Homo sapiens
acccatctgttttttgt

SEQ ID NO: 2605899 - DNA, 20 bp, Homo sapiens
acccatgaagacaggacagt

SEQ ID NO: 2605900 - DNA, 20 bp, Homo sapiens
acccatgatgagctcctctt

SEQ ID NO: 2605901 - DNA, 16 bp, Homo sapiens
acccatgctgccctgt

SEQ ID NO: 2605902 - DNA, 17 bp, Homo sapiens
acccatgctgccctgtg

SEQ ID NO: 2605903 - DNA, 14 bp, Homo sapiens
acccatgggctctg

SEQ ID NO: 2605904 - DNA, 16 bp, Homo sapiens
acccatgtttctctgg

SEQ ID NO: 2605905 - DNA, 22 bp, Homo sapiens
acccattcgtggtgatcaatta

SEQ ID NO: 2605906 - DNA, 16 bp, Homo sapiens
accccaaacaccttcc

SEQ ID NO: 2605907 - DNA, 22 bp, Homo sapiens
accccaaagagcctggagaagc

SEQ ID NO: 2605908 - DNA, 15 bp, Homo sapiens
accccaaagcccctt

SEQ ID NO: 2605909 - DNA, 17 bp, Homo sapiens
accccaaggagggagat

SEQ ID NO: 2605910 - DNA, 14 bp, Homo sapiens
accccaatcccagc

SEQ ID NO: 2605911 - DNA, 17 bp, Homo sapiens
accccacaccaggccgt

SEQ ID NO: 2605912 - DNA, 20 bp, Homo sapiens
accccacaccaggccgtcct

SEQ ID NO: 2605913 - DNA, 12 bp, Homo sapiens
accccaccctca

SEQ ID NO: 2605914 - DNA, 14 bp, Homo sapiens
accccactacacag

SEQ ID NO: 2605915 - DNA, 17 bp, Homo sapiens
accccagctccctagga

SEQ ID NO: 2605916 - DNA, 17 bp, Homo sapiens
accccatccctccccag

SEQ ID NO: 2605917 - DNA, 18 bp, Homo sapiens
accccatctgtgaataag

SEQ ID NO: 2605918 - DNA, 16 bp, Homo sapiens
accccatgccaaagct

SEQ ID NO: 2605919 - DNA, 12 bp, Homo sapiens
accccatgctgt

SEQ ID NO: 2605920 - DNA, 20 bp, Homo sapiens
accccatgctgttgattgct

SEQ ID NO: 2605921 - DNA, 23 bp, Homo sapiens
accccatgtcaccggatcctggg

SEQ ID NO: 2605922 - DNA, 13 bp, Homo sapiens
acccccacacaca

SEQ ID NO: 2605923 - DNA, 14 bp, Homo sapiens
acccccacacacac

SEQ ID NO: 2605924 - DNA, 17 bp, Homo sapiens
acccccacacctcagtt

SEQ ID NO: 2605925 - DNA, 16 bp, Homo sapiens
acccccaccccacact

SEQ ID NO: 2605926 - DNA, 14 bp, Homo sapiens
acccccaccccttc

SEQ ID NO: 2605927 - DNA, 17 bp, Homo sapiens
acccccaccccttgctc

SEQ ID NO: 2605928 - DNA, 12 bp, Homo sapiens
acccccaccctt

SEQ ID NO: 2605929 - DNA, 14 bp, Homo sapiens
acccccagcctgct

SEQ ID NO: 2605930 - DNA, 21 bp, Homo sapiens
acccccaggcctcagtctccc

SEQ ID NO: 2605931 - DNA, 17 bp, Homo sapiens
acccccatttctattta

SEQ ID NO: 2605932 - DNA, 14 bp, Homo sapiens
accccccaagctgt

SEQ ID NO: 2605933 - DNA, 12 bp, Homo sapiens
accccccacctg

SEQ ID NO: 2605934 - DNA, 13 bp, Homo sapiens
accccccacctgc

SEQ ID NO: 2605935 - DNA, 19 bp, Homo sapiens
accccccagaacctgtcct

SEQ ID NO: 2605936 - DNA, 11 bp, Homo sapiens
acccccctctg

SEQ ID NO: 2605937 - DNA, 12 bp, Homo sapiens
acccccctgggc

SEQ ID NO: 2605938 - DNA, 15 bp, Homo sapiens
acccccgccccctgc

SEQ ID NO: 2605939 - DNA, 19 bp, Homo sapiens
acccccgccccctgccctc

SEQ ID NO: 2605940 - DNA, 14 bp, Homo sapiens
accccctccctggc

SEQ ID NO: 2605941 - DNA, 15 bp, Homo sapiens
accccctccctggcc

SEQ ID NO: 2605942 - DNA, 17 bp, Homo sapiens
accccctccctggcctg

SEQ ID NO: 2605943 - DNA, 21 bp, Homo sapiens
accccctcgggtctcctcact

SEQ ID NO: 2605944 - DNA, 19 bp, Homo sapiens
acccccttcctactcccag

SEQ ID NO: 2605945 - DNA, 19 bp, Homo sapiens
acccccttctccatccaca

SEQ ID NO: 2605946 - DNA, 14 bp, Homo sapiens
accccgcctgccct

SEQ ID NO: 2605947 - DNA, 14 bp, Homo sapiens
accccgctctgcat

SEQ ID NO: 2605948 - DNA, 13 bp, Homo sapiens
accccgggctctc

SEQ ID NO: 2605949 - DNA, 21 bp, Homo sapiens
accccgtgtccccggcctcag

SEQ ID NO: 2605950 - DNA, 20 bp, Homo sapiens
acccctcaacacctctgcac

SEQ ID NO: 2605951 - DNA, 15 bp, Homo sapiens
acccctcaccttgca

SEQ ID NO: 2605952 - DNA, 19 bp, Homo sapiens
acccctcaccttgcaacac

SEQ ID NO: 2605953 - DNA, 12 bp, Homo sapiens
acccctccccat

SEQ ID NO: 2605954 - DNA, 18 bp, Homo sapiens
acccctcctccctttttc

SEQ ID NO: 2605955 - DNA, 23 bp, Homo sapiens
acccctccttccttgaccagcag

SEQ ID NO: 2605956 - DNA, 12 bp, Homo sapiens
acccctgccctg

SEQ ID NO: 2605957 - DNA, 14 bp, Homo sapiens
acccctgccctggg

SEQ ID NO: 2605958 - DNA, 16 bp, Homo sapiens
acccctgcccttgtcc

SEQ ID NO: 2605959 - DNA, 14 bp, Homo sapiens
acccctgcctccac

SEQ ID NO: 2605960 - DNA, 16 bp, Homo sapiens
acccctgcctccaccc

SEQ ID NO: 2605961 - DNA, 13 bp, Homo sapiens
acccctggcctcc

SEQ ID NO: 2605962 - DNA, 13 bp, Homo sapiens
acccctgtggagc

SEQ ID NO: 2605963 - DNA, 15 bp, Homo sapiens
accccttatccagga

SEQ ID NO: 2605964 - DNA, 21 bp, Homo sapiens
accccttccccactgcctgcc

SEQ ID NO: 2605965 - DNA, 23 bp, Homo sapiens
accccttccccactgcctgccca

SEQ ID NO: 2605966 - DNA, 12 bp, Homo sapiens
accccttcctgt

SEQ ID NO: 2605967 - DNA, 15 bp, Homo sapiens
accccttcgctcctg

SEQ ID NO: 2605968 - DNA, 16 bp, Homo sapiens
accccttcgctcctgt

SEQ ID NO: 2605969 - DNA, 20 bp, Homo sapiens
accccttcgctcctgtgtct

SEQ ID NO: 2605970 - DNA, 16 bp, Homo sapiens
acccgacagagggaag

SEQ ID NO: 2605971 - DNA, 14 bp, Homo sapiens
acccgaggcccgca

SEQ ID NO: 2605972 - DNA, 21 bp, Homo sapiens
acccgcctctcccgtcagggc

SEQ ID NO: 2605973 - DNA, 24 bp, Homo sapiens
acccgcctctcccgtcagggccca

SEQ ID NO: 2605974 - DNA, 15 bp, Homo sapiens
acccgctctggacca

SEQ ID NO: 2605975 - DNA, 14 bp, Homo sapiens
acccggcccctgct

SEQ ID NO: 2605976 - DNA, 22 bp, Homo sapiens
acccggcccctgctggttcagg

SEQ ID NO: 2605977 - DNA, 20 bp, Homo sapiens
acccgggaagggggctggga

SEQ ID NO: 2605978 - DNA, 22 bp, Homo sapiens
acccgggaagggggctgggaca

SEQ ID NO: 2605979 - DNA, 16 bp, Homo sapiens
acccgttcacattttt

SEQ ID NO: 2605980 - DNA, 17 bp, Homo sapiens
accctacctgtgcctga

SEQ ID NO: 2605981 - DNA, 18 bp, Homo sapiens
accctacttcttttgctc

SEQ ID NO: 2605982 - DNA, 13 bp, Homo sapiens
accctattgctgc

SEQ ID NO: 2605983 - DNA, 14 bp, Homo sapiens
accctattgctgct

SEQ ID NO: 2605984 - DNA, 18 bp, Homo sapiens
accctcagaaacactggg

SEQ ID NO: 2605985 - DNA, 21 bp, Homo sapiens
accctcagaaacactggggct

SEQ ID NO: 2605986 - DNA, 14 bp, Homo sapiens
accctcagcacccc

SEQ ID NO: 2605987 - DNA, 19 bp, Homo sapiens
accctcagcaccccttcca

SEQ ID NO: 2605988 - DNA, 15 bp, Homo sapiens
accctcaggcaggtg

SEQ ID NO: 2605989 - DNA, 22 bp, Homo sapiens
accctcaggcataggcctgggt

SEQ ID NO: 2605990 - DNA, 23 bp, Homo sapiens
accctcaggcataggcctgggtg

SEQ ID NO: 2605991 - DNA, 13 bp, Homo sapiens
accctcatcacca

SEQ ID NO: 2605992 - DNA, 20 bp, Homo sapiens
accctcatgctgtgtgactc

SEQ ID NO: 2605993 - DNA, 14 bp, Homo sapiens
accctccaccctgt

SEQ ID NO: 2605994 - DNA, 13 bp, Homo sapiens
accctcccacccc

SEQ ID NO: 2605995 - DNA, 20 bp, Homo sapiens
accctcccacccccttctct

SEQ ID NO: 2605996 - DNA, 23 bp, Homo sapiens
accctcccacccccttctctgct

SEQ ID NO: 2605997 - DNA, 12 bp, Homo sapiens
accctccctcag

SEQ ID NO: 2605998 - DNA, 14 bp, Homo sapiens
accctccctcagcc

SEQ ID NO: 2605999 - DNA, 23 bp, Homo sapiens
accctccctcagcccctcttgcc

SEQ ID NO: 2606000 - DNA, 16 bp, Homo sapiens
accctccctccgatcc

SEQ ID NO: 2606001 - DNA, 15 bp, Homo sapiens
accctccctggagtg

SEQ ID NO: 2606002 - DNA, 17 bp, Homo sapiens
accctcctatcacctcc

SEQ ID NO: 2606003 - DNA, 11 bp, Homo sapiens
accctcctggc

SEQ ID NO: 2606004 - DNA, 14 bp, Homo sapiens
accctcctgtaaat

SEQ ID NO: 2606005 - DNA, 16 bp, Homo sapiens
accctcctgtcttccc

SEQ ID NO: 2606006 - DNA, 20 bp, Homo sapiens
accctcctgtcttcccaggg

SEQ ID NO: 2606007 - DNA, 21 bp, Homo sapiens
accctcctgtcttcccagggt

SEQ ID NO: 2606008 - DNA, 24 bp, Homo sapiens
accctcctgttgcacccagccctg

SEQ ID NO: 2606009 - DNA, 21 bp, Homo sapiens
accctcctttcaccacatgtg

SEQ ID NO: 2606010 - DNA, 18 bp, Homo sapiens
accctcgaggcggatctt

SEQ ID NO: 2606011 - DNA, 19 bp, Homo sapiens
accctcgaggcggatcttt

SEQ ID NO: 2606012 - DNA, 20 bp, Homo sapiens
accctcgggcccacctggcc

SEQ ID NO: 2606013 - DNA, 21 bp, Homo sapiens
accctcgggcccacctggcca

SEQ ID NO: 2606014 - DNA, 22 bp, Homo sapiens
accctcgggcccacctggccac

SEQ ID NO: 2606015 - DNA, 19 bp, Homo sapiens
accctctcaggtgaccaaa

SEQ ID NO: 2606016 - DNA, 14 bp, Homo sapiens
accctctcccagga

SEQ ID NO: 2606017 - DNA, 23 bp, Homo sapiens
accctctggaggggtgtggctcc

SEQ ID NO: 2606018 - DNA, 21 bp, Homo sapiens
accctgaatggttccatgcct

SEQ ID NO: 2606019 - DNA, 23 bp, Homo sapiens
acctgacccctgctcagtaaagc

SEQ ID NO: 2606020 - DNA, 13 bp, Homo sapiens
acctgactctgaa

SEQ ID NO: 2606021 - DNA, 14 bp, Homo sapiens
acctgactctgaaa

SEQ ID NO: 2606022 - DNA, 17 bp, Homo sapiens
acctgactctgaaatct

SEQ ID NO: 2606023 - DNA, 18 bp, Homo sapiens
acctgactctgaaatctg

SEQ ID NO: 2606024 - DNA, 23 bp, Homo sapiens
acctgagaccagttgggagcact

SEQ ID NO: 2606025 - DNA, 16 bp, Homo sapiens
acctgagccagcctgc

SEQ ID NO: 2606026 - DNA, 23 bp, Homo sapiens
acctgagcccggatgcttctcca

SEQ ID NO: 2606027 - DNA, 14 bp, Homo sapiens
acctgaggcccttc

SEQ ID NO: 2606028 - DNA, 15 bp, Homo sapiens
acctgaggcccttct

SEQ ID NO: 2606029 - DNA, 21 bp, Homo sapiens
acctgaggcccttctctccag

SEQ ID NO: 2606030 - DNA, 16 bp, Homo sapiens
acctgaggctcctgtg

SEQ ID NO: 2606031 - DNA, 19 bp, Homo sapiens
acctgaggctcctgtgcta

SEQ ID NO: 2606032 - DNA, 12 bp, Homo sapiens
acctgaggtggg

SEQ ID NO: 2606033 - DNA, 17 bp, Homo sapiens
acctgaggtgggcccag

SEQ ID NO: 2606034 - DNA, 24 bp, Homo sapiens
acctgaggtgggcccaggaccagc

SEQ ID NO: 2606035 - DNA, 22 bp, Homo sapiens
acctgagtcaccctacctgtgc

SEQ ID NO: 2606036 - DNA, 20 bp, Homo sapiens
acctgatcaatgacagagcc

SEQ ID NO: 2606037 - DNA, 21 bp, Homo sapiens
acctgatgttaaaattccatc

SEQ ID NO: 2606038 - DNA, 14 bp, Homo sapiens
acctgattgtgtct

SEQ ID NO: 2606039 - DNA, 18 bp, Homo sapiens
acctgattgtgtctcttg

SEQ ID NO: 2606040 - DNA, 20 bp, Homo sapiens
acctgcaagggctccccact

SEQ ID NO: 2606041 - DNA, 17 bp, Homo sapiens
acctgccactcacacag

SEQ ID NO: 2606042 - DNA, 19 bp, Homo sapiens
acctgccactcacacagcc

SEQ ID NO: 2606043 - DNA, 22 bp, Homo sapiens
acctgccactcacacagccagg

SEQ ID NO: 2606044 - DNA, 16 bp, Homo sapiens
acctgccagcctggct

SEQ ID NO: 2606045 - DNA, 18 bp, Homo sapiens
acctgccagggacagagg

SEQ ID NO: 2606046 - DNA, 13 bp, Homo sapiens
acctgccagggag

SEQ ID NO: 2606047 - DNA, 21 bp, Homo sapiens
acctgccagggagacagagct

SEQ ID NO: 2606048 - DNA, 18 bp, Homo sapiens
acctgccatttgcaccct

SEQ ID NO: 2606049 - DNA, 15 bp, Homo sapiens
acctgccccctggtg

SEQ ID NO: 2606050 - DNA, 17 bp, Homo sapiens
acctgcccccttctccc

SEQ ID NO: 2606051 - DNA, 19 bp, Homo sapiens
acctgcccccttctcccac

SEQ ID NO: 2606052 - DNA, 20 bp, Homo sapiens
acctgcccccttctcccaca

SEQ ID NO: 2606053 - DNA, 22 bp, Homo sapiens
acctgcccccttctcccacact

SEQ ID NO: 2606054 - DNA, 23 bp, Homo sapiens
acctgccccgcccagctgcacct

SEQ ID NO: 2606055 - DNA, 15 bp, Homo sapiens
acctgccctgcctga

SEQ ID NO: 2606056 - DNA, 16 bp, Homo sapiens
acctgccctgcctgag

SEQ ID NO: 2606057 - DNA, 17 bp, Homo sapiens
acctgccctgcctgagg

SEQ ID NO: 2606058 - DNA, 13 bp, Homo sapiens
acctgcctcctgc

SEQ ID NO: 2606059 - DNA, 17 bp, Homo sapiens
acctgcctcctgcctgc

SEQ ID NO: 2606060 - DNA, 21 bp, Homo sapiens
acctgcctgacatttggagtg

SEQ ID NO: 2606061 - DNA, 16 bp, Homo sapiens
acctgcggtgctatct

SEQ ID NO: 2606062 - DNA, 13 bp, Homo sapiens
acctgctctcttg

SEQ ID NO: 2606063 - DNA, 16 bp, Homo sapiens
acctgctctcttgtaa

SEQ ID NO: 2606064 - DNA, 18 bp, Homo sapiens
acctgctgagggaccagc

SEQ ID NO: 2606065 - DNA, 14 bp, Homo sapiens
acctgctggcccct

SEQ ID NO: 2606066 - DNA, 15 bp, Homo sapiens
acctgctggcccctc

SEQ ID NO: 2606067 - DNA, 16 bp, Homo sapiens
acctgctggcccctca

SEQ ID NO: 2606068 - DNA, 17 bp, Homo sapiens
acctgctggcccctcac

SEQ ID NO: 2606069 - DNA, 18 bp, Homo sapiens
acctgcttgggtggagaa

SEQ ID NO: 2606070 - DNA, 20 bp, Homo sapiens
acctgcttgggtggagaagc

SEQ ID NO: 2606071 - DNA, 17 bp, Homo sapiens
acctggaatatataacc

SEQ ID NO: 2606072 - DNA, 16 bp, Homo sapiens
acctggagcccctggg

SEQ ID NO: 2606073 - DNA, 21 bp, Homo sapiens
acctggagggctagaacctag

SEQ ID NO: 2606074 - DNA, 14 bp, Homo sapiens
acctggaggggcta

SEQ ID NO: 2606075 - DNA, 15 bp, Homo sapiens
acctggcactgctgt

SEQ ID NO: 2606076 - DNA, 16 bp, Homo sapiens
acctggcctctgcact

SEQ ID NO: 2606077 - DNA, 15 bp, Homo sapiens
acctggggagtggga

SEQ ID NO: 2606078 - DNA, 18 bp, Homo sapiens
acctggggctgctggcct

SEQ ID NO: 2606079 - DNA, 21 bp, Homo sapiens
acctggggtgtgggaggcccg

SEQ ID NO: 2606080 - DNA, 14 bp, Homo sapiens
acctgggtccaaat

SEQ ID NO: 2606081 - DNA, 18 bp, Homo sapiens
acctgggtccaaataaaa

SEQ ID NO: 2606082 - DNA, 21 bp, Homo sapiens
acctgggtccaaataaaaact

SEQ ID NO: 2606083 - DNA, 17 bp, Homo sapiens
acctgggttccctttcc

SEQ ID NO: 2606084 - DNA, 16 bp, Homo sapiens
acctggtgctgcctct

SEQ ID NO: 2606085 - DNA, 14 bp, Homo sapiens
acctggtgctggat

SEQ ID NO: 2606086 - DNA, 22 bp, Homo sapiens
acctggtgctggatattttcaa

SEQ ID NO: 2606087 - DNA, 15 bp, Homo sapiens
acctgtaacttttgt

SEQ ID NO: 2606088 - DNA, 11 bp, Homo sapiens
acctgtaatca

SEQ ID NO: 2606089 - DNA, 14 bp, Homo sapiens
acctgtccttgcac

SEQ ID NO: 2606090 - DNA, 23 bp, Homo sapiens
acctgtgaccagcactgtctcag

SEQ ID NO: 2606091 - DNA, 19 bp, Homo sapiens
acctgtgcttcgggccctt

SEQ ID NO: 2606092 - DNA, 22 bp, Homo sapiens
acctgtgcttcgggcccttccc

SEQ ID NO: 2606093 - DNA, 19 bp, Homo sapiens
acctgtggggatttctccc

SEQ ID NO: 2606094 - DNA, 20 bp, Homo sapiens
acctgtggggatttctccca

SEQ ID NO: 2606095 - DNA, 22 bp, Homo sapiens
acctgtggggatttctcccagc

SEQ ID NO: 2606096 - DNA, 13 bp, Homo sapiens
acctgtgtcacta

SEQ ID NO: 2606097 - DNA, 17 bp, Homo sapiens
acctgttacctactttg

SEQ ID NO: 2606098 - DNA, 18 bp, Homo sapiens
acctgttcagtgtcccgg

SEQ ID NO: 2606099 - DNA, 20 bp, Homo sapiens
acctgttcagtgtcccgggc

SEQ ID NO: 2606100 - DNA, 15 bp, Homo sapiens
acctgttgcttacaa

SEQ ID NO: 2606101 - DNA, 18 bp, Homo sapiens
acctgttgcttacaattt

SEQ ID NO: 2606102 - DNA, 20 bp, Homo sapiens
acctgttgcttacaattttt

SEQ ID NO: 2606103 - DNA, 21 bp, Homo sapiens
acctgttgcttacaatttttt

SEQ ID NO: 2606104 - DNA, 16 bp, Homo sapiens
acctgtttaaatattt

SEQ ID NO: 2606105 - DNA, 22 bp, Homo sapiens
accttaagtaagcaacagcata

SEQ ID NO: 2606106 - DNA, 16 bp, Homo sapiens
accttaccaactttct

SEQ ID NO: 2606107 - DNA, 17 bp, Homo sapiens
accttaccaactttctg

SEQ ID NO: 2606108 - DNA, 19 bp, Homo sapiens
accttaccaactttctgta

SEQ ID NO: 2606109 - DNA, 18 bp, Homo sapiens
accttagacagtccctgc

SEQ ID NO: 2606110 - DNA, 19 bp, Homo sapiens
accttagacagtccctgcc

SEQ ID NO: 2606111 - DNA, 19 bp, Homo sapiens
accttagattagctctgga

SEQ ID NO: 2606112 - DNA, 23 bp, Homo sapiens
accttaggaataatctcctgtta

SEQ ID NO: 2606113 - DNA, 13 bp, Homo sapiens
accttaggcaggg

SEQ ID NO: 2606114 - DNA, 16 bp, Homo sapiens
accttaggcagggaag

SEQ ID NO: 2606115 - DNA, 14 bp, Homo sapiens
accttagtggcttt

SEQ ID NO: 2606116 - DNA, 14 bp, Homo sapiens
accttagtgtttct

SEQ ID NO: 2606117 - DNA, 15 bp, Homo sapiens
accttagtgtttctg

SEQ ID NO: 2606118 - DNA, 22 bp, Homo sapiens
accttagtgtttctgtgcatgg

SEQ ID NO: 2606119 - DNA, 13 bp, Homo sapiens
accttatctgtgc

SEQ ID NO: 2606120 - DNA, 17 bp, Homo sapiens
accttattgtacctctc

SEQ ID NO: 2606121 - DNA, 18 bp, Homo sapiens
accttattgtacctctct

SEQ ID NO: 2606122 - DNA, 17 bp, Homo sapiens
accttcaattcctgggc

SEQ ID NO: 2606123 - DNA, 19 bp, Homo sapiens
accttccatggctcttttt

SEQ ID NO: 2606124 - DNA, 16 bp, Homo sapiens
accttcctcgcagaga

SEQ ID NO: 2606125 - DNA, 18 bp, Homo sapiens
accttcctgccaccagtc

SEQ ID NO: 2606126 - DNA, 14 bp, Homo sapiens
accttctccttcac

SEQ ID NO: 2606127 - DNA, 12 bp, Homo sapiens
accttctctgga

SEQ ID NO: 2606128 - DNA, 15 bp, Homo sapiens
accttctctggagcc

SEQ ID NO: 2606129 - DNA, 22 bp, Homo sapiens
accttctctggagccaagtcca

SEQ ID NO: 2606130 - DNA, 22 bp, Homo sapiens
accttctggcctcccacagact

SEQ ID NO: 2606131 - DNA, 11 bp, Homo sapiens
accttctgtag

SEQ ID NO: 2606132 - DNA, 19 bp, Homo sapiens
accttgaaaactttatgct

SEQ ID NO: 2606133 - DNA, 20 bp, Homo sapiens
accttgaactgggtacttgt

SEQ ID NO: 2606134 - DNA, 15 bp, Homo sapiens
accttgacagggcac

SEQ ID NO: 2606135 - DNA, 14 bp, Homo sapiens
accttggctcaagt

SEQ ID NO: 2606136 - DNA, 17 bp, Homo sapiens
accttggctgcagggag

SEQ ID NO: 2606137 - DNA, 18 bp, Homo sapiens
accttggctgcagggagt

SEQ ID NO: 2606138 - DNA, 12 bp, Homo sapiens
accttgtgtctg

SEQ ID NO: 2606139 - DNA, 18 bp, Homo sapiens
accttgtgtctgtacacg

SEQ ID NO: 2606140 - DNA, 14 bp, Homo sapiens
accttgttcacact

SEQ ID NO: 2606141 - DNA, 15 bp, Homo sapiens
accttgttggagcct

SEQ ID NO: 2606142 - DNA, 20 bp, Homo sapiens
acctttagtggtggccattt

SEQ ID NO: 2606143 - DNA, 23 bp, Homo sapiens
acctttcagataactgttattta

SEQ ID NO: 2606144 - DNA, 14 bp, Homo sapiens
acctttgcaggcat

SEQ ID NO: 2606145 - DNA, 15 bp, Homo sapiens
acctttgtattctct

SEQ ID NO: 2606146 - DNA, 14 bp, Homo sapiens
acctttgtccccac

SEQ ID NO: 2606147 - DNA, 15 bp, Homo sapiens
acctttgtccccacc

SEQ ID NO: 2606148 - DNA, 16 bp, Homo sapiens
acctttgtccccaccg

SEQ ID NO: 2606149 - DNA, 18 bp, Homo sapiens
acctttgtccccaccgca

SEQ ID NO: 2606150 - DNA, 14 bp, Homo sapiens
acctttttatctcc

SEQ ID NO: 2606151 - DNA, 14 bp, Homo sapiens
acctttttccttcc

SEQ ID NO: 2606152 - DNA, 15 bp, Homo sapiens
acctttttccttcct

SEQ ID NO: 2606153 - DNA, 20 bp, Homo sapiens
accttttttaagatttttct

SEQ ID NO: 2606154 - DNA, 22 bp, Homo sapiens
accttttttaagatttttctca

SEQ ID NO: 2606155 - DNA, 13 bp, Homo sapiens
accttttttatac

SEQ ID NO: 2606156 - DNA, 14 bp, Homo sapiens
accttttttataca

SEQ ID NO: 2606157 - DNA, 19 bp, Homo sapiens
accttttttatacataaac

SEQ ID NO: 2606158 - DNA, 21 bp, Homo sapiens
accttttttatacataaacaa

SEQ ID NO: 2606159 - DNA, 22 bp, Homo sapiens
accttttttatacataaacaag

SEQ ID NO: 2606160 - DNA, 13 bp, Homo sapiens
acgaaatgttatt

SEQ ID NO: 2606161 - DNA, 14 bp, Homo sapiens
acgaacttccatgg

SEQ ID NO: 2606162 - DNA, 17 bp, Homo sapiens
acgaagggaaatgtctt

SEQ ID NO: 2606163 - DNA, 22 bp, Homo sapiens
acgacaaagccaaactctgcca

SEQ ID NO: 2606164 - DNA, 13 bp, Homo sapiens
actctaccctccc

SEQ ID NO: 2606165 - DNA, 15 bp, Homo sapiens
actctaccctcccac

SEQ ID NO: 2606166 - DNA, 16 bp, Homo sapiens
actctaccctcccacc

SEQ ID NO: 2606167 - DNA, 13 bp, Homo sapiens
actctagggcagt

SEQ ID NO: 2606168 - DNA, 17 bp, Homo sapiens
actctatgttctaagaa

SEQ ID NO: 2606169 - DNA, 18 bp, Homo sapiens
actctcaggatcaagaaa

SEQ ID NO: 2606170 - DNA, 17 bp, Homo sapiens
actctcagtctctgagc

SEQ ID NO: 2606171 - DNA, 13 bp, Homo sapiens
actctccatctta

SEQ ID NO: 2606172 - DNA, 10 bp, Homo sapiens
actctcccca

SEQ ID NO: 2606173 - DNA, 11 bp, Homo sapiens
actctccccac

SEQ ID NO: 2606174 - DNA, 12 bp, Homo sapiens
actctccccaca

SEQ ID NO: 2606175 - DNA, 13 bp, Homo sapiens
actctcctagaga

SEQ ID NO: 2606176 - DNA, 12 bp, Homo sapiens
actctcctctgc

SEQ ID NO: 2606177 - DNA, 14 bp, Homo sapiens
actctcctctgcct

SEQ ID NO: 2606178 - DNA, 17 bp, Homo sapiens
actctcctctgctgctg

SEQ ID NO: 2606179 - DNA, 18 bp, Homo sapiens
actctcctctgctgctgg

SEQ ID NO: 2606180 - DNA, 18 bp, Homo sapiens
actctcctggaaatatta

SEQ ID NO: 2606181 - DNA, 15 bp, Homo sapiens
actctcctggactgc

SEQ ID NO: 2606182 - DNA, 20 bp, Homo sapiens
actctctccaccctatatgt

SEQ ID NO: 2606183 - DNA, 14 bp, Homo sapiens
actctgaaatctga

SEQ ID NO: 2606184 - DNA, 15 bp, Homo sapiens
actctgaagcctctg

SEQ ID NO: 2606185 - DNA, 11 bp, Homo sapiens
actctgcacat

SEQ ID NO: 2606186 - DNA, 14 bp, Homo sapiens
actctgcacatacg

SEQ ID NO: 2606187 - DNA, 13 bp, Homo sapiens
actctgcacatgt

SEQ ID NO: 2606188 - DNA, 18 bp, Homo sapiens
actctgcacatgtcttgt

SEQ ID NO: 2606189 - DNA, 21 bp, Homo sapiens
actctgcacatgtcttgtaca

SEQ ID NO: 2606190 - DNA, 22 bp, Homo sapiens
actctgcacatgtcttgtacat

SEQ ID NO: 2606191 - DNA, 23 bp, Homo sapiens
actctgcactactcctctgcagt

SEQ ID NO: 2606192 - DNA, 16 bp, Homo sapiens
actctgcattctagta

SEQ ID NO: 2606193 - DNA, 16 bp, Homo sapiens
actctgccagccacat

SEQ ID NO: 2606194 - DNA, 19 bp, Homo sapiens
actctgccccctgctggct

SEQ ID NO: 2606195 - DNA, 14 bp, Homo sapiens
actctgcctctgcc

SEQ ID NO: 2606196 - DNA, 16 bp, Homo sapiens
actctgcttgattttt

SEQ ID NO: 2606197 - DNA, 21 bp, Homo sapiens
actctggaggtttgtttagaa

SEQ ID NO: 2606198 - DNA, 19 bp, Homo sapiens
actctggcagctcagagag

SEQ ID NO: 2606199 - DNA, 11 bp, Homo sapiens
actctggcctc

SEQ ID NO: 2606200 - DNA, 22 bp, Homo sapiens
actctggctggtttggaatgct

SEQ ID NO: 2606201 - DNA, 13 bp, Homo sapiens
actctgggaaata

SEQ ID NO: 2606202 - DNA, 16 bp, Homo sapiens
actctgggctccagag

SEQ ID NO: 2606203 - DNA, 15 bp, Homo sapiens
actctgtctcagtcc

SEQ ID NO: 2606204 - DNA, 16 bp, Homo sapiens
actctgtggggccttg

SEQ ID NO: 2606205 - DNA, 19 bp, Homo sapiens
actctgtgtcaggtggggc

SEQ ID NO: 2606206 - DNA, 16 bp, Homo sapiens
actctgttatttagac

SEQ ID NO: 2606207 - DNA, 17 bp, Homo sapiens
actctgttccttcacat

SEQ ID NO: 2606208 - DNA, 20 bp, Homo sapiens
actctgttccttcacatcct

SEQ ID NO: 2606209 - DNA, 22 bp, Homo sapiens
actctgttccttcacatcctgt

SEQ ID NO: 2606210 - DNA, 14 bp, Homo sapiens
actcttaagtttct

SEQ ID NO: 2606211 - DNA, 14 bp, Homo sapiens
actcttaatcaaat

SEQ ID NO: 2606212 - DNA, 17 bp, Homo sapiens
actcttaggaagagaaa

SEQ ID NO: 2606213 - DNA, 21 bp, Homo sapiens
actcttccgaaaaatcctctt

SEQ ID NO: 2606214 - DNA, 16 bp, Homo sapiens
actcttcctgcaagga

SEQ ID NO: 2606215 - DNA, 20 bp, Homo sapiens
actcttcttaacttaaattt

SEQ ID NO: 2606216 - DNA, 15 bp, Homo sapiens
actcttcttgaaatt

SEQ ID NO: 2606217 - DNA, 15 bp, Homo sapiens
actcttgacctcagg

SEQ ID NO: 2606218 - DNA, 16 bp, Homo sapiens
actcttgacctcaggt

SEQ ID NO: 2606219 - DNA, 18 bp, Homo sapiens
actcttgtggatgtttta

SEQ ID NO: 2606220 - DNA, 18 bp, Homo sapiens
actctttgagaaacaaca

SEQ ID NO: 2606221 - DNA, 23 bp, Homo sapiens
actctttgagatagaagaactgc

SEQ ID NO: 2606222 - DNA, 14 bp, Homo sapiens
actctttggtggct

SEQ ID NO: 2606223 - DNA, 14 bp, Homo sapiens
actctttttagggc

SEQ ID NO: 2606224 - DNA, 17 bp, Homo sapiens
actctttttgggctcct

SEQ ID NO: 2606225 - DNA, 18 bp, Homo sapiens
actctttttgttttttgt

SEQ ID NO: 2606226 - DNA, 17 bp, Homo sapiens
actgaaaacatctggaa

SEQ ID NO: 2606227 - DNA, 18 bp, Homo sapiens
actgaaaacatctggaag

SEQ ID NO: 2606228 - DNA, 15 bp, Homo sapiens
actgaaaacctctcc

SEQ ID NO: 2606229 - DNA, 22 bp, Homo sapiens
actgaaaattcgaaccaggaaa

SEQ ID NO: 2606230 - DNA, 22 bp, Homo sapiens
actgaacaaactatcagaggaa

SEQ ID NO: 2606231 - DNA, 16 bp, Homo sapiens
actgaacattccagag

SEQ ID NO: 2606232 - DNA, 19 bp, Homo sapiens
actgaactttgctgagcct

SEQ ID NO: 2606233 - DNA, 12 bp, Homo sapiens
actgaagcctgc

SEQ ID NO: 2606234 - DNA, 14 bp, Homo sapiens
actgaagcctgcag

SEQ ID NO: 2606235 - DNA, 19 bp, Homo sapiens
actgaagtagtgtgcagtt

SEQ ID NO: 2606236 - DNA, 13 bp, Homo sapiens
actgaagtgctta

SEQ ID NO: 2606237 - DNA, 19 bp, Homo sapiens
actgaagtttcacatgagc

SEQ ID NO: 2606238 - DNA, 12 bp, Homo sapiens
actgaatgaggt

SEQ ID NO: 2606239 - DNA, 19 bp, Homo sapiens
actgaatgtttattccttg

SEQ ID NO: 2606240 - DNA, 17 bp, Homo sapiens
actgacacctttgcagg

SEQ ID NO: 2606241 - DNA, 20 bp, Homo sapiens
actgacaggcagcctggaca

SEQ ID NO: 2606242 - DNA, 21 bp, Homo sapiens
actgacaggcagcctggacat

SEQ ID NO: 2606243 - DNA, 21 bp, Homo sapiens
actgacctgtcatgcccccct

SEQ ID NO: 2606244 - DNA, 13 bp, Homo sapiens
actgacttctaag

SEQ ID NO: 2606245 - DNA, 18 bp, Homo sapiens
actgagacagcccgggct

SEQ ID NO: 2606246 - DNA, 18 bp, Homo sapiens
actgagagtgaacaaatt

SEQ ID NO: 2606247 - DNA, 13 bp, Homo sapiens
actgagccccccc

SEQ ID NO: 2606248 - DNA, 14 bp, Homo sapiens
actgagctcctctg

SEQ ID NO: 2606249 - DNA, 19 bp, Homo sapiens
actgagctcctctgggcag

SEQ ID NO: 2606250 - DNA, 19 bp, Homo sapiens
actgaggaatttcacctgt

SEQ ID NO: 2606251 - DNA, 19 bp, Homo sapiens
actgaggcagacagcagct

SEQ ID NO: 2606252 - DNA, 14 bp, Homo sapiens
actgaggcagggaa

SEQ ID NO: 2606253 - DNA, 17 bp, Homo sapiens
actgagggactctgaag

SEQ ID NO: 2606254 - DNA, 18 bp, Homo sapiens
actgagggactctgaagc

SEQ ID NO: 2606255 - DNA, 22 bp, Homo sapiens
actgagggccacactattacca

SEQ ID NO: 2606256 - DNA, 22 bp, Homo sapiens
actgaggggaggggagcatggg

SEQ ID NO: 2606257 - DNA, 19 bp, Homo sapiens
actgagtacgttgtgcatt

SEQ ID NO: 2606258 - DNA, 21 bp, Homo sapiens
actgagtacgttgtgcatttg

SEQ ID NO: 2606259 - DNA, 22 bp, Homo sapiens
actgagtacgttgtgcatttgg

SEQ ID NO: 2606260 - DNA, 17 bp, Homo sapiens
actgatagtgtccaaat

SEQ ID NO: 2606261 - DNA, 15 bp, Homo sapiens
actgatcatgcattg

SEQ ID NO: 2606262 - DNA, 23 bp, Homo sapiens
actgatgggcaacccccagcctg

SEQ ID NO: 2606263 - DNA, 21 bp, Homo sapiens
actgatgttacatcacagtgt

SEQ ID NO: 2606264 - DNA, 13 bp, Homo sapiens
actgattgtttca

SEQ ID NO: 2606265 - DNA, 13 bp, Homo sapiens
actgatttcacaa

SEQ ID NO: 2606266 - DNA, 18 bp, Homo sapiens
actgatttttgtaagaca

SEQ ID NO: 2606267 - DNA, 15 bp, Homo sapiens
actgatttttgtgat

SEQ ID NO: 2606268 - DNA, 15 bp, Homo sapiens
actgcaaaggcgcag

SEQ ID NO: 2606269 - DNA, 18 bp, Homo sapiens
actgcaacaggcttgtgc

SEQ ID NO: 2606270 - DNA, 22 bp, Homo sapiens
actgcaacctccgcctcttggg

SEQ ID NO: 2606271 - DNA, 14 bp, Homo sapiens
actgcaacttctgc

SEQ ID NO: 2606272 - DNA, 16 bp, Homo sapiens
actgcaacttctgcct

SEQ ID NO: 2606273 - DNA, 20 bp, Homo sapiens
actgcaatcctgtctttctg

SEQ ID NO: 2606274 - DNA, 12 bp, Homo sapiens
actgcacagagc

SEQ ID NO: 2606275 - DNA, 16 bp, Homo sapiens
actgcacagagctctc

SEQ ID NO: 2606276 - DNA, 18 bp, Homo sapiens
actgcacagagctctcca

SEQ ID NO: 2606277 - DNA, 19 bp, Homo sapiens
actgcacagagctctccag

SEQ ID NO: 2606278 - DNA, 20 bp, Homo sapiens
actgcacagcggcccctgca

SEQ ID NO: 2606279 - DNA, 22 bp, Homo sapiens
actgcacagcggcccctgcatc

SEQ ID NO: 2606280 - DNA, 14 bp, Homo sapiens
actgcaccgggcca

SEQ ID NO: 2606281 - DNA, 20 bp, Homo sapiens
actgcactatagcctaggtg

SEQ ID NO: 2606282 - DNA, 21 bp, Homo sapiens
actgcactccagcctgggcga

SEQ ID NO: 2606283 - DNA, 19 bp, Homo sapiens
actgcagcctcaacctcct

SEQ ID NO: 2606284 - DNA, 21 bp, Homo sapiens
actgcagcctcaacctcctgg

SEQ ID NO: 2606285 - DNA, 10 bp, Homo sapiens
actgcaggga

SEQ ID NO: 2606286 - DNA, 14 bp, Homo sapiens
actgcatacaatct

SEQ ID NO: 2606287 - DNA, 23 bp, Homo sapiens
actgcatactttttaaatgtaaa

SEQ ID NO: 2606288 - DNA, 15 bp, Homo sapiens
actgcatgtttgtga

SEQ ID NO: 2606289 - DNA, 16 bp, Homo sapiens
actgcatgtttgtgat

SEQ ID NO: 2606290 - DNA, 15 bp, Homo sapiens
actgcattgagaact

SEQ ID NO: 2606291 - DNA, 14 bp, Homo sapiens
actgccaacctggg

SEQ ID NO: 2606292 - DNA, 22 bp, Homo sapiens
actgccagatgctgatgttcag

SEQ ID NO: 2606293 - DNA, 19 bp, Homo sapiens
actgccagtccccctgccc

SEQ ID NO: 2606294 - DNA, 13 bp, Homo sapiens
actgcccaccccc

SEQ ID NO: 2606295 - DNA, 14 bp, Homo sapiens
actgcccaccccct

SEQ ID NO: 2606296 - DNA, 16 bp, Homo sapiens
actgcccaccccctca

SEQ ID NO: 2606297 - DNA, 19 bp, Homo sapiens
actgcccaggcctgcctgt

SEQ ID NO: 2606298 - DNA, 14 bp, Homo sapiens
actgcccgagctgg

SEQ ID NO: 2606299 - DNA, 22 bp, Homo sapiens
actgcccgagctggtgcattac

SEQ ID NO: 2606300 - DNA, 22 bp, Homo sapiens
actgcccggggcagctgccaga

SEQ ID NO: 2606301 - DNA, 19 bp, Homo sapiens
actgccgaccgaggctgga

SEQ ID NO: 2606302 - DNA, 15 bp, Homo sapiens
actgcctaagccctc

SEQ ID NO: 2606303 - DNA, 16 bp, Homo sapiens
actgcctactgcatcg

SEQ ID NO: 2606304 - DNA, 13 bp, Homo sapiens
actgcctgcccac

SEQ ID NO: 2606305 - DNA, 19 bp, Homo sapiens
actgcctgcccacccgtgg

SEQ ID NO: 2606306 - DNA, 17 bp, Homo sapiens
actgccttgaatatccc

SEQ ID NO: 2606307 - DNA, 11 bp, Homo sapiens
actgcctttga

SEQ ID NO: 2606308 - DNA, 23 bp, Homo sapiens
actgctaggcgagtgccaggact

SEQ ID NO: 2606309 - DNA, 22 bp, Homo sapiens
actgctaggtgggccagcccct

SEQ ID NO: 2606310 - DNA, 15 bp, Homo sapiens
actttagagtagcat

SEQ ID NO: 2606311 - DNA, 19 bp, Homo sapiens
actttagagtagcatgaga

SEQ ID NO: 2606312 - DNA, 15 bp, Homo sapiens
actttagatgctgat

SEQ ID NO: 2606313 - DNA, 21 bp, Homo sapiens
actttatcacattatttgcat

SEQ ID NO: 2606314 - DNA, 21 bp, Homo sapiens
actttcaggtactaaatacct

SEQ ID NO: 2606315 - DNA, 19 bp, Homo sapiens
actttcatcctgactctgc

SEQ ID NO: 2606316 - DNA, 16 bp, Homo sapiens
actttccaccccctcc

SEQ ID NO: 2606317 - DNA, 18 bp, Homo sapiens
actttccaccccctccct

SEQ ID NO: 2606318 - DNA, 13 bp, Homo sapiens
actttctcagttt

SEQ ID NO: 2606319 - DNA, 14 bp, Homo sapiens
actttctcagtttt

SEQ ID NO: 2606320 - DNA, 18 bp, Homo sapiens
actttctgtaaactcaaa

SEQ ID NO: 2606321 - DNA, 19 bp, Homo sapiens
actttctgttgccacaacc

SEQ ID NO: 2606322 - DNA, 15 bp, Homo sapiens
actttcttttctgga

SEQ ID NO: 2606323 - DNA, 14 bp, Homo sapiens
actttgacctctgc

SEQ ID NO: 2606324 - DNA, 15 bp, Homo sapiens
actttgacctctgca

SEQ ID NO: 2606325 - DNA, 20 bp, Homo sapiens
actttgactttttgcattta

SEQ ID NO: 2606326 - DNA, 15 bp, Homo sapiens
actttgctctttctt

SEQ ID NO: 2606327 - DNA, 20 bp, Homo sapiens
actttgcttgcagtagattt

SEQ ID NO: 2606328 - DNA, 15 bp, Homo sapiens
actttggaaaatgca

SEQ ID NO: 2606329 - DNA, 12 bp, Homo sapiens
actttggaaaga

SEQ ID NO: 2606330 - DNA, 14 bp, Homo sapiens
actttggaaagact

SEQ ID NO: 2606331 - DNA, 15 bp, Homo sapiens
actttggaatacatt

SEQ ID NO: 2606332 - DNA, 23 bp, Homo sapiens
actttggagtcccctcacctcct

SEQ ID NO: 2606333 - DNA, 14 bp, Homo sapiens
actttgggaggcca

SEQ ID NO: 2606334 - DNA, 22 bp, Homo sapiens
actttgtatgtcatttccttca

SEQ ID NO: 2606335 - DNA, 16 bp, Homo sapiens
actttgtggatgtctt

SEQ ID NO: 2606336 - DNA, 21 bp, Homo sapiens
actttgtggatgtcttccttg

SEQ ID NO: 2606337 - DNA, 19 bp, Homo sapiens
actttgttctttaggagat

SEQ ID NO: 2606338 - DNA, 13 bp, Homo sapiens
acttttataaact

SEQ ID NO: 2606339 - DNA, 22 bp, Homo sapiens
acttttataaactttacctttt

SEQ ID NO: 2606340 - DNA, 12 bp, Homo sapiens
acttttcagtga

SEQ ID NO: 2606341 - DNA, 20 bp, Homo sapiens
acttttccgtttcagcggaa

SEQ ID NO: 2606342 - DNA, 17 bp, Homo sapiens
acttttcctccctcagt

SEQ ID NO: 2606343 - DNA, 15 bp, Homo sapiens
acttttctccatgag

SEQ ID NO: 2606344 - DNA, 12 bp, Homo sapiens
acttttgacaaa

SEQ ID NO: 2606345 - DNA, 12 bp, Homo sapiens
acttttgtaaga

SEQ ID NO: 2606346 - DNA, 13 bp, Homo sapiens
acttttgttcttg

SEQ ID NO: 2606347 - DNA, 18 bp, Homo sapiens
actttttaaatgtaaaga

SEQ ID NO: 2606348 - DNA, 21 bp, Homo sapiens
actttttatattttatacatt

SEQ ID NO: 2606349 - DNA, 22 bp, Homo sapiens
acttttttggggatatgcttag

SEQ ID NO: 2606350 - DNA, 20 bp, Homo sapiens
agaaaaaaaaaaacttacac

SEQ ID NO: 2606351 - DNA, 15 bp, Homo sapiens
agaaaaaaaaagaaa

SEQ ID NO: 2606352 - DNA, 17 bp, Homo sapiens
agaaaaaagagaaaaga

SEQ ID NO: 2606353 - DNA, 17 bp, Homo sapiens
agaaaaaggatgcacag

SEQ ID NO: 2606354 - DNA, 17 bp, Homo sapiens
agaaaaatgagcctggc

SEQ ID NO: 2606355 - DNA, 18 bp, Homo sapiens
agaaaaatgagcctggca

SEQ ID NO: 2606356 - DNA, 19 bp, Homo sapiens
agaaaaatttacatggcaa

SEQ ID NO: 2606357 - DNA, 16 bp, Homo sapiens
agaaaacagaaaacaa

SEQ ID NO: 2606358 - DNA, 23 bp, Homo sapiens
agaaaacataatcttctgccttc

SEQ ID NO: 2606359 - DNA, 13 bp, Homo sapiens
agaaaacccaccc

SEQ ID NO: 2606360 - DNA, 14 bp, Homo sapiens
agaaaacccacccc

SEQ ID NO: 2606361 - DNA, 16 bp, Homo sapiens
agaaaacccttttcta

SEQ ID NO: 2606362 - DNA, 15 bp, Homo sapiens
agaaaactgaaaatc

SEQ ID NO: 2606363 - DNA, 16 bp, Homo sapiens
agaaaactgaaaatct

SEQ ID NO: 2606364 - DNA, 9 bp, Homo sapiens
agaaaagaa

SEQ ID NO: 2606365 - DNA, 11 bp, Homo sapiens
agaaaagaaaa

SEQ ID NO: 2606366 - DNA, 23 bp, Homo sapiens
agaaaagagatattttaaaatga

SEQ ID NO: 2606367 - DNA, 12 bp, Homo sapiens
agaaaataaaaa

SEQ ID NO: 2606368 - DNA, 16 bp, Homo sapiens
agaaaataaaaaaaag

SEQ ID NO: 2606369 - DNA, 22 bp, Homo sapiens
agaaaataaaaaaaagaaaaaa

SEQ ID NO: 2606370 - DNA, 14 bp, Homo sapiens
agaaaataaaaagt

SEQ ID NO: 2606371 - DNA, 15 bp, Homo sapiens
agaaaataaaaagtt

SEQ ID NO: 2606372 - DNA, 14 bp, Homo sapiens
agaaaatatactgt

SEQ ID NO: 2606373 - DNA, 22 bp, Homo sapiens
agaaaatatctgaaatgtgata

SEQ ID NO: 2606374 - DNA, 16 bp, Homo sapiens
agaaaatcaggctggc

SEQ ID NO: 2606375 - DNA, 17 bp, Homo sapiens
agaaacaactctttgag

SEQ ID NO: 2606376 - DNA, 14 bp, Homo sapiens
agaaacacaatatt

SEQ ID NO: 2606377 - DNA, 19 bp, Homo sapiens
agaaacacactgaggcagg

SEQ ID NO: 2606378 - DNA, 14 bp, Homo sapiens
agaaacagagacag

SEQ ID NO: 2606379 - DNA, 13 bp, Homo sapiens
agaaacagttaac

SEQ ID NO: 2606380 - DNA, 16 bp, Homo sapiens
agaaacccgacagagg

SEQ ID NO: 2606381 - DNA, 18 bp, Homo sapiens
agaaacccgacagaggga

SEQ ID NO: 2606382 - DNA, 17 bp, Homo sapiens
agaaaccttaatatgtg

SEQ ID NO: 2606383 - DNA, 18 bp, Homo sapiens
agaaaccttattgtacct

SEQ ID NO: 2606384 - DNA, 19 bp, Homo sapiens
agaaacgtttggaacaatc

SEQ ID NO: 2606385 - DNA, 21 bp, Homo sapiens
agaaacgtttggaacaatcta

SEQ ID NO: 2606386 - DNA, 16 bp, Homo sapiens
agaaactgaggaattt

SEQ ID NO: 2606387 - DNA, 20 bp, Homo sapiens
agaaactgtagtctcaggac

SEQ ID NO: 2606388 - DNA, 19 bp, Homo sapiens
agaaacttccaaatcccct

SEQ ID NO: 2606389 - DNA, 12 bp, Homo sapiens
agaaactttatt

SEQ ID NO: 2606390 - DNA, 20 bp, Homo sapiens
agaaagaaacccgacagagg

SEQ ID NO: 2606391 - DNA, 13 bp, Homo sapiens
agaaagaaggaag

SEQ ID NO: 2606392 - DNA, 14 bp, Homo sapiens
agaaagaaggaagt

SEQ ID NO: 2606393 - DNA, 18 bp, Homo sapiens
agaaagaaggaagtgaag

SEQ ID NO: 2606394 - DNA, 20 bp, Homo sapiens
agaaagactattcaaacagt

SEQ ID NO: 2606395 - DNA, 11 bp, Homo sapiens
agaaagagaga

SEQ ID NO: 2606396 - DNA, 12 bp, Homo sapiens
agaaagagagaa

SEQ ID NO: 2606397 - DNA, 16 bp, Homo sapiens
agaaagagagaaaata

SEQ ID NO: 2606398 - DNA, 17 bp, Homo sapiens
agaaagagagaaaataa

SEQ ID NO: 2606399 - DNA, 23 bp, Homo sapiens
agaaagagagagaattctttcaa

SEQ ID NO: 2606400 - DNA, 17 bp, Homo sapiens
agaaagcaaaattatgt

SEQ ID NO: 2606401 - DNA, 21 bp, Homo sapiens
agaaagcagatacctcaccct

SEQ ID NO: 2606402 - DNA, 20 bp, Homo sapiens
agaaagcccttaggaagaat

SEQ ID NO: 2606403 - DNA, 19 bp, Homo sapiens
agaaagcctgttcccctca

SEQ ID NO: 2606404 - DNA, 22 bp, Homo sapiens
agaaagtacttctccaccctgc

SEQ ID NO: 2606405 - DNA, 20 bp, Homo sapiens
agaaagtggaaaacaaggaa

SEQ ID NO: 2606406 - DNA, 19 bp, Homo sapiens
agaaagttgcacggctgct

SEQ ID NO: 2606407 - DNA, 19 bp, Homo sapiens
agaaataaagttggtgaca

SEQ ID NO: 2606408 - DNA, 22 bp, Homo sapiens
agaaataaatagctatatccat

SEQ ID NO: 2606409 - DNA, 16 bp, Homo sapiens
agaaataatatgcatt

SEQ ID NO: 2606410 - DNA, 18 bp, Homo sapiens
agaaataccaaaattatt

SEQ ID NO: 2606411 - DNA, 19 bp, Homo sapiens
agaaatagctccgtggagc

SEQ ID NO: 2606412 - DNA, 20 bp, Homo sapiens
agaaatatctgaaaatgtat

SEQ ID NO: 2606413 - DNA, 13 bp, Homo sapiens
agaaatatgattt

SEQ ID NO: 2606414 - DNA, 15 bp, Homo sapiens
agaaatatgtggttt

SEQ ID NO: 2606415 - DNA, 18 bp, Homo sapiens
agaaatcagtaatattta

SEQ ID NO: 2606416 - DNA, 19 bp, Homo sapiens
agaaatccctgtttaatat

SEQ ID NO: 2606417 - DNA, 22 bp, Homo sapiens
agaaatccctgtttaatattta

SEQ ID NO: 2606418 - DNA, 14 bp, Homo sapiens
agaaatctagaaga

SEQ ID NO: 2606419 - DNA, 23 bp, Homo sapiens
agaaatctagtatttcatgctgg

SEQ ID NO: 2606420 - DNA, 23 bp, Homo sapiens
agaaatgaccaatattatactaa

SEQ ID NO: 2606421 - DNA, 20 bp, Homo sapiens
agaaatgagatcaggctctg

SEQ ID NO: 2606422 - DNA, 18 bp, Homo sapiens
agaaatgcatattgtatt

SEQ ID NO: 2606423 - DNA, 15 bp, Homo sapiens
agaaatgctgcccat

SEQ ID NO: 2606424 - DNA, 13 bp, Homo sapiens
agaaatgctgcct

SEQ ID NO: 2606425 - DNA, 20 bp, Homo sapiens
agaaatgctggtttttcagt

SEQ ID NO: 2606426 - DNA, 17 bp, Homo sapiens
agaaatgtacagcaagg

SEQ ID NO: 2606427 - DNA, 20 bp, Homo sapiens
agaaatgtctaaatgctgaa

SEQ ID NO: 2606428 - DNA, 14 bp, Homo sapiens
agaaattagccggg

SEQ ID NO: 2606429 - DNA, 15 bp, Homo sapiens
agaaattagccgggc

SEQ ID NO: 2606430 - DNA, 18 bp, Homo sapiens
agaaatttaaaagacact

SEQ ID NO: 2606431 - DNA, 22 bp, Homo sapiens
agaaatttaattcatgtttctt

SEQ ID NO: 2606432 - DNA, 16 bp, Homo sapiens
agaaatttccagagaa

SEQ ID NO: 2606433 - DNA, 14 bp, Homo sapiens
agaacaaaggacag

SEQ ID NO: 2606434 - DNA, 20 bp, Homo sapiens
agaacaaagtgagacagtcc

SEQ ID NO: 2606435 - DNA, 19 bp, Homo sapiens
agaacaaggtagtttttac

SEQ ID NO: 2606436 - DNA, 12 bp, Homo sapiens
agaacactaacc

SEQ ID NO: 2606437 - DNA, 19 bp, Homo sapiens
agaacagccgctcctgtct

SEQ ID NO: 2606438 - DNA, 14 bp, Homo sapiens
agaacagcttcagg

SEQ ID NO: 2606439 - DNA, 14 bp, Homo sapiens
agaacagtaaacat

SEQ ID NO: 2606440 - DNA, 22 bp, Homo sapiens
agaacagtgattaccagggact

SEQ ID NO: 2606441 - DNA, 17 bp, Homo sapiens
agaacagtttgtacaga

SEQ ID NO: 2606442 - DNA, 16 bp, Homo sapiens
agaacatcattagaac

SEQ ID NO: 2606443 - DNA, 18 bp, Homo sapiens
agaacatcattagaacaa

SEQ ID NO: 2606444 - DNA, 20 bp, Homo sapiens
agaacatcattagaacaaag

SEQ ID NO: 2606445 - DNA, 18 bp, Homo sapiens
agaacatccaaggagaaa

SEQ ID NO: 2606446 - DNA, 18 bp, Homo sapiens
agaacatccctgccagct

SEQ ID NO: 2606447 - DNA, 19 bp, Homo sapiens
agaacatccctgccagctc

SEQ ID NO: 2606448 - DNA, 20 bp, Homo sapiens
agaaccaggcaacttgggaa

SEQ ID NO: 2606449 - DNA, 19 bp, Homo sapiens
agaacccctacatgaaaca

SEQ ID NO: 2606450 - DNA, 22 bp, Homo sapiens
agaaccgagcaaagatcaaaat

SEQ ID NO: 2606451 - DNA, 21 bp, Homo sapiens
agaacctcaggcttccttggc

SEQ ID NO: 2606452 - DNA, 14 bp, Homo sapiens
agaacctcttcccc

SEQ ID NO: 2606453 - DNA, 17 bp, Homo sapiens
agaacctggagagctag

SEQ ID NO: 2606454 - DNA, 12 bp, Homo sapiens
agaacctggagg

SEQ ID NO: 2606455 - DNA, 21 bp, Homo sapiens
agactgaccaatattgtacag

SEQ ID NO: 2606456 - DNA, 22 bp, Homo sapiens
agactgagtacgttgtgcattt

SEQ ID NO: 2606457 - DNA, 23 bp, Homo sapiens
agactgcgatttgtcccaggtcc

SEQ ID NO: 2606458 - DNA, 17 bp, Homo sapiens
agactgcttcccatcct

SEQ ID NO: 2606459 - DNA, 23 bp, Homo sapiens
agactgcttcccatcctaccctc

SEQ ID NO: 2606460 - DNA, 16 bp, Homo sapiens
agactggaagcacagc

SEQ ID NO: 2606461 - DNA, 17 bp, Homo sapiens
agactggaagcacagct

SEQ ID NO: 2606462 - DNA, 15 bp, Homo sapiens
agactggagcatctg

SEQ ID NO: 2606463 - DNA, 14 bp, Homo sapiens
agactggcacagtt

SEQ ID NO: 2606464 - DNA, 20 bp, Homo sapiens
agactggctggctgcagtga

SEQ ID NO: 2606465 - DNA, 18 bp, Homo sapiens
agactggcttttattaat

SEQ ID NO: 2606466 - DNA, 21 bp, Homo sapiens
agactgggaagataggctctg

SEQ ID NO: 2606467 - DNA, 20 bp, Homo sapiens
agactgggctgagggagcct

SEQ ID NO: 2606468 - DNA, 16 bp, Homo sapiens
agactgtaatgaatct

SEQ ID NO: 2606469 - DNA, 16 bp, Homo sapiens
agactgtacaaagtag

SEQ ID NO: 2606470 - DNA, 18 bp, Homo sapiens
agactgtagcctggatat

SEQ ID NO: 2606471 - DNA, 22 bp, Homo sapiens
agactgtaggaagagtagcatt

SEQ ID NO: 2606472 - DNA, 11 bp, Homo sapiens
agactgtggct

SEQ ID NO: 2606473 - DNA, 15 bp, Homo sapiens
agactgttgctcaaa

SEQ ID NO: 2606474 - DNA, 20 bp, Homo sapiens
agacttactttactcatttt

SEQ ID NO: 2606475 - DNA, 18 bp, Homo sapiens
agacttagtatattttct

SEQ ID NO: 2606476 - DNA, 19 bp, Homo sapiens
agacttagtatattttctt

SEQ ID NO: 2606477 - DNA, 22 bp, Homo sapiens
agacttagtatattttcttttc

SEQ ID NO: 2606478 - DNA, 20 bp, Homo sapiens
agacttccaaacctgacaga

SEQ ID NO: 2606479 - DNA, 18 bp, Homo sapiens
agacttggcaacagaagc

SEQ ID NO: 2606480 - DNA, 14 bp, Homo sapiens
agactttaaagaat

SEQ ID NO: 2606481 - DNA, 12 bp, Homo sapiens
agactttctgtt

SEQ ID NO: 2606482 - DNA, 14 bp, Homo sapiens
agactttggaaaat

SEQ ID NO: 2606483 - DNA, 22 bp, Homo sapiens
agactttggaaaatgcattgta

SEQ ID NO: 2606484 - DNA, 13 bp, Homo sapiens
agagaaaaacaaa

SEQ ID NO: 2606485 - DNA, 10 bp, Homo sapiens
agagaaaaga

SEQ ID NO: 2606486 - DNA, 14 bp, Homo sapiens
agagaaaagaaaaa

SEQ ID NO: 2606487 - DNA, 15 bp, Homo sapiens
agagaaaagaaaaaa

SEQ ID NO: 2606488 - DNA, 13 bp, Homo sapiens
agagaaaataaaa

SEQ ID NO: 2606489 - DNA, 20 bp, Homo sapiens
agagaaaataaaaagttaaa

SEQ ID NO: 2606490 - DNA, 15 bp, Homo sapiens
agagaaagaaaatga

SEQ ID NO: 2606491 - DNA, 18 bp, Homo sapiens
agagaaagcacgtgtctc

SEQ ID NO: 2606492 - DNA, 18 bp, Homo sapiens
agagaaagtacttctcca

SEQ ID NO: 2606493 - DNA, 18 bp, Homo sapiens
agagaaagtgatttctag

SEQ ID NO: 2606494 - DNA, 22 bp, Homo sapiens
agagaacctcacgcacctccca

SEQ ID NO: 2606495 - DNA, 14 bp, Homo sapiens
agagaacgcagccc

SEQ ID NO: 2606496 - DNA, 14 bp, Homo sapiens
agagaactgtggcc

SEQ ID NO: 2606497 - DNA, 14 bp, Homo sapiens
agagaagtgacagg

SEQ ID NO: 2606498 - DNA, 15 bp, Homo sapiens
agagaagtgacaggg

SEQ ID NO: 2606499 - DNA, 14 bp, Homo sapiens
agagaagtgcccct

SEQ ID NO: 2606500 - DNA, 18 bp, Homo sapiens
agagaagtgcccctgctg

SEQ ID NO: 2606501 - DNA, 15 bp, Homo sapiens
agagaatcatactta

SEQ ID NO: 2606502 - DNA, 19 bp, Homo sapiens
agagaattgtttgaacccg

SEQ ID NO: 2606503 - DNA, 23 bp, Homo sapiens
agagaatttctaccatttcagag

SEQ ID NO: 2606504 - DNA, 15 bp, Homo sapiens
agagacagaaagcag

SEQ ID NO: 2606505 - DNA, 14 bp, Homo sapiens
agagacagaagcag

SEQ ID NO: 2606506 - DNA, 15 bp, Homo sapiens
agagacagaagcagg

SEQ ID NO: 2606507 - DNA, 17 bp, Homo sapiens
agagacagaagcaggct

SEQ ID NO: 2606508 - DNA, 23 bp, Homo sapiens
agagacagaagcaggctggaggt

SEQ ID NO: 2606509 - DNA, 15 bp, Homo sapiens
agagacaggagggca

SEQ ID NO: 2606510 - DNA, 19 bp, Homo sapiens
agagaccaggcaaagcaag

SEQ ID NO: 2606511 - DNA, 15 bp, Homo sapiens
agagaccatccctga

SEQ ID NO: 2606512 - DNA, 18 bp, Homo sapiens
agagaccatccctgaagg

SEQ ID NO: 2606513 - DNA, 23 bp, Homo sapiens
agagaccatccctgaaggccccg

SEQ ID NO: 2606514 - DNA, 15 bp, Homo sapiens
agagacctacctcag

SEQ ID NO: 2606515 - DNA, 17 bp, Homo sapiens
agagacctacctcaggt

SEQ ID NO: 2606516 - DNA, 18 bp, Homo sapiens
agagacctacctcaggtt

SEQ ID NO: 2606517 - DNA, 20 bp, Homo sapiens
agagacctacctcaggttgc

SEQ ID NO: 2606518 - DNA, 19 bp, Homo sapiens
agagacctcatcaggatga

SEQ ID NO: 2606519 - DNA, 15 bp, Homo sapiens
agagactcctgcagg

SEQ ID NO: 2606520 - DNA, 18 bp, Homo sapiens
agagactcctgcaggcag

SEQ ID NO: 2606521 - DNA, 19 bp, Homo sapiens
agagactcctgcaggcagc

SEQ ID NO: 2606522 - DNA, 23 bp, Homo sapiens
agagactcctgcaggcagccagg

SEQ ID NO: 2606523 - DNA, 22 bp, Homo sapiens
agagactccttgagagaccagg

SEQ ID NO: 2606524 - DNA, 14 bp, Homo sapiens
agagactggagcat

SEQ ID NO: 2606525 - DNA, 16 bp, Homo sapiens
agagacttttaatcag

SEQ ID NO: 2606526 - DNA, 12 bp, Homo sapiens
agagagaaaata

SEQ ID NO: 2606527 - DNA, 16 bp, Homo sapiens
agagagaaaataaaaa

SEQ ID NO: 2606528 - DNA, 20 bp, Homo sapiens
agagagaaaataaaaagtta

SEQ ID NO: 2606529 - DNA, 18 bp, Homo sapiens
agagagatgggagctcct

SEQ ID NO: 2606530 - DNA, 19 bp, Homo sapiens
agagagatgggagctcctc

SEQ ID NO: 2606531 - DNA, 13 bp, Homo sapiens
agagagccatttt

SEQ ID NO: 2606532 - DNA, 19 bp, Homo sapiens
agagagccattttgtgaat

SEQ ID NO: 2606533 - DNA, 14 bp, Homo sapiens
agagaggagaaaca

SEQ ID NO: 2606534 - DNA, 16 bp, Homo sapiens
agagaggagaaacaca

SEQ ID NO: 2606535 - DNA, 18 bp, Homo sapiens
agagaggagaaacacatc

SEQ ID NO: 2606536 - DNA, 13 bp, Homo sapiens
agagaggagtcag

SEQ ID NO: 2606537 - DNA, 15 bp, Homo sapiens
agagaggagttcaat

SEQ ID NO: 2606538 - DNA, 20 bp, Homo sapiens
agagaggccttttggaatgt

SEQ ID NO: 2606539 - DNA, 15 bp, Homo sapiens
agagagggcagaggg

SEQ ID NO: 2606540 - DNA, 20 bp, Homo sapiens
agagaggttatagagtagaa

SEQ ID NO: 2606541 - DNA, 23 bp, Homo sapiens
agagagtcccactgcctcaggtt

SEQ ID NO: 2606542 - DNA, 18 bp, Homo sapiens
agagatattttaaaatga

SEQ ID NO: 2606543 - DNA, 18 bp, Homo sapiens
agagatgactgagtcctc

SEQ ID NO: 2606544 - DNA, 15 bp, Homo sapiens
agagatgggagctcc

SEQ ID NO: 2606545 - DNA, 14 bp, Homo sapiens
agagatgtgcaccc

SEQ ID NO: 2606546 - DNA, 20 bp, Homo sapiens
agagatgtttttaaaagttt

SEQ ID NO: 2606547 - DNA, 22 bp, Homo sapiens
agagattggaatgggcagctca

SEQ ID NO: 2606548 - DNA, 13 bp, Homo sapiens
agagatttttcat

SEQ ID NO: 2606549 - DNA, 18 bp, Homo sapiens
agagcacctagtccagtg

SEQ ID NO: 2606550 - DNA, 18 bp, Homo sapiens
agagcagagaccatccct

SEQ ID NO: 2606551 - DNA, 20 bp, Homo sapiens
agagcagagaccatccctga

SEQ ID NO: 2606552 - DNA, 12 bp, Homo sapiens
agagcagatgca

SEQ ID NO: 2606553 - DNA, 14 bp, Homo sapiens
agagcagatgcaga

SEQ ID NO: 2606554 - DNA, 19 bp, Homo sapiens
agagcagatgcagagagcc

SEQ ID NO: 2606555 - DNA, 12 bp, Homo sapiens
agagcagcctgt

SEQ ID NO: 2606556 - DNA, 19 bp, Homo sapiens
agagcagcctgtggcatct

SEQ ID NO: 2606557 - DNA, 20 bp, Homo sapiens
agagcaggaagcattcagag

SEQ ID NO: 2606558 - DNA, 23 bp, Homo sapiens
agagcaggaagcattcagagagc

SEQ ID NO: 2606559 - DNA, 13 bp, Homo sapiens
agagcaggcacat

SEQ ID NO: 2606560 - DNA, 19 bp, Homo sapiens
agagcaggcgttcagctca

SEQ ID NO: 2606561 - DNA, 13 bp, Homo sapiens
agagcaggctggc

SEQ ID NO: 2606562 - DNA, 23 bp, Homo sapiens
agagcaggctggcagctctccag

SEQ ID NO: 2606563 - DNA, 22 bp, Homo sapiens
agagcaggggtccttggtgtga

SEQ ID NO: 2606564 - DNA, 20 bp, Homo sapiens
agagcattacgtgagccagg

SEQ ID NO: 2606565 - DNA, 16 bp, Homo sapiens
agagccaccctgtgtt

SEQ ID NO: 2606566 - DNA, 18 bp, Homo sapiens
agagccagagaagtgaca

SEQ ID NO: 2606567 - DNA, 19 bp, Homo sapiens
agagccatataagtttgaa

SEQ ID NO: 2606568 - DNA, 22 bp, Homo sapiens
agagccatataagtttgaagga

SEQ ID NO: 2606569 - DNA, 16 bp, Homo sapiens
agagccattttgtgaa

SEQ ID NO: 2606570 - DNA, 19 bp, Homo sapiens
agagcccaccttggctcaa

SEQ ID NO: 2606571 - DNA, 14 bp, Homo sapiens
agagcccagaggta

SEQ ID NO: 2606572 - DNA, 22 bp, Homo sapiens
agagcccagaggtaacagaaca

SEQ ID NO: 2606573 - DNA, 14 bp, Homo sapiens
agagcccagccatt

SEQ ID NO: 2606574 - DNA, 17 bp, Homo sapiens
agagccccacacggagg

SEQ ID NO: 2606575 - DNA, 13 bp, Homo sapiens
agagccccagctg

SEQ ID NO: 2606576 - DNA, 22 bp, Homo sapiens
agagcctccctcaattccccct

SEQ ID NO: 2606577 - DNA, 15 bp, Homo sapiens
agagcctgcctggag

SEQ ID NO: 2606578 - DNA, 16 bp, Homo sapiens
agagcctgcctggagc

SEQ ID NO: 2606579 - DNA, 17 bp, Homo sapiens
agagcctggagaagctg

SEQ ID NO: 2606580 - DNA, 15 bp, Homo sapiens
agagccttccagggg

SEQ ID NO: 2606581 - DNA, 23 bp, Homo sapiens
agagcctttggatgaccagaaca

SEQ ID NO: 2606582 - DNA, 17 bp, Homo sapiens
agagcgagagtctgtct

SEQ ID NO: 2606583 - DNA, 20 bp, Homo sapiens
agagcgcctgcccctcccag

SEQ ID NO: 2606584 - DNA, 13 bp, Homo sapiens
agagcgcgtctgg

SEQ ID NO: 2606585 - DNA, 17 bp, Homo sapiens
agagctagaacatggag

SEQ ID NO: 2606586 - DNA, 18 bp, Homo sapiens
agagctagaacctggaga

SEQ ID NO: 2606587 - DNA, 20 bp, Homo sapiens
agagctagcagcagggaggg

SEQ ID NO: 2606588 - DNA, 15 bp, Homo sapiens
agagctctccagctc

SEQ ID NO: 2606589 - DNA, 16 bp, Homo sapiens
agagctctccagctcc

SEQ ID NO: 2606590 - DNA, 22 bp, Homo sapiens
agagctgacacaaacctgcctg

SEQ ID NO: 2606591 - DNA, 16 bp, Homo sapiens
agagctgctctggaaa

SEQ ID NO: 2606592 - DNA, 12 bp, Homo sapiens
agagctggagcc

SEQ ID NO: 2606593 - DNA, 18 bp, Homo sapiens
agagctggagcctggtgc

SEQ ID NO: 2606594 - DNA, 19 bp, Homo sapiens
agagctggagcctggtgcc

SEQ ID NO: 2606595 - DNA, 18 bp, Homo sapiens
agagctggcaaaggtggc

SEQ ID NO: 2606596 - DNA, 23 bp, Homo sapiens
agagctgggaggcatggccctgg

SEQ ID NO: 2606597 - DNA, 21 bp, Homo sapiens
agagctggtagttagtagcat

SEQ ID NO: 2606598 - DNA, 13 bp, Homo sapiens
agagctggtgccc

SEQ ID NO: 2606599 - DNA, 11 bp, Homo sapiens
agagctggtgt

SEQ ID NO: 2606600 - DNA, 20 bp, Homo sapiens
agcaacattttacccacaca

SEQ ID NO: 2606601 - DNA, 18 bp, Homo sapiens
agcaaccggtggatcctc

SEQ ID NO: 2606602 - DNA, 19 bp, Homo sapiens
agcaacctgggtccaaata

SEQ ID NO: 2606603 - DNA, 20 bp, Homo sapiens
agcaacctgggtccaaataa

SEQ ID NO: 2606604 - DNA, 21 bp, Homo sapiens
agcaacctgggtccaaataaa

SEQ ID NO: 2606605 - DNA, 22 bp, Homo sapiens
agcaacctgggtccaaataaaa

SEQ ID NO: 2606606 - DNA, 23 bp, Homo sapiens
agcaactctaagactacagcaca

SEQ ID NO: 2606607 - DNA, 19 bp, Homo sapiens
agcaactgaataaatacct

SEQ ID NO: 2606608 - DNA, 21 bp, Homo sapiens
agcaactgaataaatacctct

SEQ ID NO: 2606609 - DNA, 22 bp, Homo sapiens
agcaactgaataaatacctctt

SEQ ID NO: 2606610 - DNA, 17 bp, Homo sapiens
agcaactgttatgaaat

SEQ ID NO: 2606611 - DNA, 21 bp, Homo sapiens
agcaactgttatgaaataaag

SEQ ID NO: 2606612 - DNA, 14 bp, Homo sapiens
agcaagatttcaga

SEQ ID NO: 2606613 - DNA, 11 bp, Homo sapiens
agcaagctccc

SEQ ID NO: 2606614 - DNA, 17 bp, Homo sapiens
agcaaggagatttacaa

SEQ ID NO: 2606615 - DNA, 22 bp, Homo sapiens
agcaagggtgatgggaaagcat

SEQ ID NO: 2606616 - DNA, 23 bp, Homo sapiens
agcaaggtgctcacaccccattg

SEQ ID NO: 2606617 - DNA, 14 bp, Homo sapiens
agcaagtcagggtt

SEQ ID NO: 2606618 - DNA, 18 bp, Homo sapiens
agcaagtgagagagatgg

SEQ ID NO: 2606619 - DNA, 14 bp, Homo sapiens
agcaagtgagagct

SEQ ID NO: 2606620 - DNA, 21 bp, Homo sapiens
agcaagtgattgggacagagg

SEQ ID NO: 2606621 - DNA, 14 bp, Homo sapiens
agcaataaatgaat

SEQ ID NO: 2606622 - DNA, 15 bp, Homo sapiens
agcaataaatgaatg

SEQ ID NO: 2606623 - DNA, 20 bp, Homo sapiens
agcaataatggtcccatcca

SEQ ID NO: 2606624 - DNA, 15 bp, Homo sapiens
agcaatatgtaaata

SEQ ID NO: 2606625 - DNA, 17 bp, Homo sapiens
agcaatccatgttagtt

SEQ ID NO: 2606626 - DNA, 20 bp, Homo sapiens
agcaatgacatctcaggggc

SEQ ID NO: 2606627 - DNA, 21 bp, Homo sapiens
agcaatgacatctcaggggcc

SEQ ID NO: 2606628 - DNA, 22 bp, Homo sapiens
agcaatttcgccgttgaagagg

SEQ ID NO: 2606629 - DNA, 14 bp, Homo sapiens
agcacacacttttg

SEQ ID NO: 2606630 - DNA, 20 bp, Homo sapiens
agcacactcatcccctcact

SEQ ID NO: 2606631 - DNA, 14 bp, Homo sapiens
agcacactgtagca

SEQ ID NO: 2606632 - DNA, 14 bp, Homo sapiens
agcacagaccctgc

SEQ ID NO: 2606633 - DNA, 16 bp, Homo sapiens
agcacagaccctgccc

SEQ ID NO: 2606634 - DNA, 19 bp, Homo sapiens
agcacagaccctgccctgt

SEQ ID NO: 2606635 - DNA, 21 bp, Homo sapiens
agcacagaccctgccctgtgg

SEQ ID NO: 2606636 - DNA, 12 bp, Homo sapiens
agcacagcctag

SEQ ID NO: 2606637 - DNA, 15 bp, Homo sapiens
agcacaggcagctgg

SEQ ID NO: 2606638 - DNA, 23 bp, Homo sapiens
agcacagtggtggcagggcctag

SEQ ID NO: 2606639 - DNA, 19 bp, Homo sapiens
agcacagtgttaaatgaaa

SEQ ID NO: 2606640 - DNA, 22 bp, Homo sapiens
agcacagtgttaaatgaaattg

SEQ ID NO: 2606641 - DNA, 16 bp, Homo sapiens
agcacatctgcatttt

SEQ ID NO: 2606642 - DNA, 17 bp, Homo sapiens
agcaccaaaataagaaa

SEQ ID NO: 2606643 - DNA, 18 bp, Homo sapiens
agcaccaaaataagaaaa

SEQ ID NO: 2606644 - DNA, 19 bp, Homo sapiens
agcaccaaaataagaaaag

SEQ ID NO: 2606645 - DNA, 21 bp, Homo sapiens
agcaccaaaataagaaaagat

SEQ ID NO: 2606646 - DNA, 21 bp, Homo sapiens
agcaccagcttctccaggctc

SEQ ID NO: 2606647 - DNA, 15 bp, Homo sapiens
agcaccagggactat

SEQ ID NO: 2606648 - DNA, 17 bp, Homo sapiens
agcaccagggctcacgt

SEQ ID NO: 2606649 - DNA, 19 bp, Homo sapiens
agcaccatccgccagggcc

SEQ ID NO: 2606650 - DNA, 19 bp, Homo sapiens
agcacccctctctgcatct

SEQ ID NO: 2606651 - DNA, 21 bp, Homo sapiens
agcacctacagtgtacagtct

SEQ ID NO: 2606652 - DNA, 22 bp, Homo sapiens
agcacctacagtgtacagtctt

SEQ ID NO: 2606653 - DNA, 15 bp, Homo sapiens
agcaccttcctcact

SEQ ID NO: 2606654 - DNA, 18 bp, Homo sapiens
agcaccttcctcacttcc

SEQ ID NO: 2606655 - DNA, 19 bp, Homo sapiens
agcaccttcctcacttcca

SEQ ID NO: 2606656 - DNA, 15 bp, Homo sapiens
agcacgatttctgtt

SEQ ID NO: 2606657 - DNA, 17 bp, Homo sapiens
agcacgatttctgttta

SEQ ID NO: 2606658 - DNA, 20 bp, Homo sapiens
agcacggccaacaaagctgt

SEQ ID NO: 2606659 - DNA, 16 bp, Homo sapiens
agcactaaagcagtgg

SEQ ID NO: 2606660 - DNA, 16 bp, Homo sapiens
agcactaacgtaaata

SEQ ID NO: 2606661 - DNA, 20 bp, Homo sapiens
agcactaaggtgtgctctga

SEQ ID NO: 2606662 - DNA, 16 bp, Homo sapiens
agcactacataaactg

SEQ ID NO: 2606663 - DNA, 21 bp, Homo sapiens
agcactacataaactgacttt

SEQ ID NO: 2606664 - DNA, 17 bp, Homo sapiens
agcactactctgtgcca

SEQ ID NO: 2606665 - DNA, 16 bp, Homo sapiens
agcactcacacaggac

SEQ ID NO: 2606666 - DNA, 13 bp, Homo sapiens
agcactcccaagt

SEQ ID NO: 2606667 - DNA, 19 bp, Homo sapiens
agcactcccaagtctacag

SEQ ID NO: 2606668 - DNA, 20 bp, Homo sapiens
agcactcccaagtctacaga

SEQ ID NO: 2606669 - DNA, 12 bp, Homo sapiens
agcactgacctg

SEQ ID NO: 2606670 - DNA, 20 bp, Homo sapiens
agcactgacctgtcatgccc

SEQ ID NO: 2606671 - DNA, 16 bp, Homo sapiens
agcactggagtgcagg

SEQ ID NO: 2606672 - DNA, 20 bp, Homo sapiens
agcactggagtgcagggagg

SEQ ID NO: 2606673 - DNA, 18 bp, Homo sapiens
agcactggctctctccag

SEQ ID NO: 2606674 - DNA, 15 bp, Homo sapiens
agcactgtgctaata

SEQ ID NO: 2606675 - DNA, 18 bp, Homo sapiens
agcactgtgctcagggct

SEQ ID NO: 2606676 - DNA, 17 bp, Homo sapiens
agcactgttccagcctg

SEQ ID NO: 2606677 - DNA, 13 bp, Homo sapiens
agcacttgctgta

SEQ ID NO: 2606678 - DNA, 13 bp, Homo sapiens
agcacttgtatat

SEQ ID NO: 2606679 - DNA, 21 bp, Homo sapiens
agcacttgtgggtttttgttt

SEQ ID NO: 2606680 - DNA, 14 bp, Homo sapiens
agcactttgggagg

SEQ ID NO: 2606681 - DNA, 16 bp, Homo sapiens
agcactttgggaggct

SEQ ID NO: 2606682 - DNA, 23 bp, Homo sapiens
agcagagaatgaaagggcccaga

SEQ ID NO: 2606683 - DNA, 14 bp, Homo sapiens
agcagagaattctc

SEQ ID NO: 2606684 - DNA, 16 bp, Homo sapiens
agcagagcttcctcag

SEQ ID NO: 2606685 - DNA, 17 bp, Homo sapiens
agcagaggaaggagagg

SEQ ID NO: 2606686 - DNA, 17 bp, Homo sapiens
agcagaggcactggggg

SEQ ID NO: 2606687 - DNA, 14 bp, Homo sapiens
agcagaggggctga

SEQ ID NO: 2606688 - DNA, 18 bp, Homo sapiens
agcagatacctcaccctg

SEQ ID NO: 2606689 - DNA, 19 bp, Homo sapiens
agcagatacctcaccctgc

SEQ ID NO: 2606690 - DNA, 20 bp, Homo sapiens
agcagatgcaaagaggcaag

SEQ ID NO: 2606691 - DNA, 21 bp, Homo sapiens
agcagatgcaaagaggcaaga

SEQ ID NO: 2606692 - DNA, 18 bp, Homo sapiens
agcagatgcagagagcca

SEQ ID NO: 2606693 - DNA, 13 bp, Homo sapiens
agcagattttaat

SEQ ID NO: 2606694 - DNA, 16 bp, Homo sapiens
agcagcagggagggct

SEQ ID NO: 2606695 - DNA, 16 bp, Homo sapiens
agcagcagtgaaaaca

SEQ ID NO: 2606696 - DNA, 18 bp, Homo sapiens
agcagcagtgaaaacaag

SEQ ID NO: 2606697 - DNA, 23 bp, Homo sapiens
agcagcagtgaaaacaagtgctg

SEQ ID NO: 2606698 - DNA, 18 bp, Homo sapiens
agcagcatctgctaataa

SEQ ID NO: 2606699 - DNA, 21 bp, Homo sapiens
agcagccacattcctgatgct

SEQ ID NO: 2606700 - DNA, 13 bp, Homo sapiens
agcagccagctct

SEQ ID NO: 2606701 - DNA, 14 bp, Homo sapiens
agcagccagctctc

SEQ ID NO: 2606702 - DNA, 23 bp, Homo sapiens
agcagccagctctcagccaacga

SEQ ID NO: 2606703 - DNA, 19 bp, Homo sapiens
agcagccatcataggaagg

SEQ ID NO: 2606704 - DNA, 20 bp, Homo sapiens
agcagcctcagaacaaagtg

SEQ ID NO: 2606705 - DNA, 22 bp, Homo sapiens
agcagcgaccacccctgcctcc

SEQ ID NO: 2606706 - DNA, 11 bp, Homo sapiens
agcagctacca

SEQ ID NO: 2606707 - DNA, 19 bp, Homo sapiens
agcagctatctctcagtga

SEQ ID NO: 2606708 - DNA, 15 bp, Homo sapiens
agcagctcaaaggca

SEQ ID NO: 2606709 - DNA, 16 bp, Homo sapiens
agcagctcaaaggcac

SEQ ID NO: 2606710 - DNA, 20 bp, Homo sapiens
agcagctcaaaggcacagtg

SEQ ID NO: 2606711 - DNA, 18 bp, Homo sapiens
agcagctgaacagccaaa

SEQ ID NO: 2606712 - DNA, 16 bp, Homo sapiens
agcagctttaaacaaa

SEQ ID NO: 2606713 - DNA, 20 bp, Homo sapiens
agcagctttaaactcaggga

SEQ ID NO: 2606714 - DNA, 13 bp, Homo sapiens
agcaggacatgga

SEQ ID NO: 2606715 - DNA, 16 bp, Homo sapiens
agcaggaggcccctgg

SEQ ID NO: 2606716 - DNA, 20 bp, Homo sapiens
agcaggaggcccctggccca

SEQ ID NO: 2606717 - DNA, 20 bp, Homo sapiens
agcaggcacttgattccttg

SEQ ID NO: 2606718 - DNA, 12 bp, Homo sapiens
agcaggccttgc

SEQ ID NO: 2606719 - DNA, 13 bp, Homo sapiens
agcaggccttgcg

SEQ ID NO: 2606720 - DNA, 17 bp, Homo sapiens
agcaggctactgtcagc

SEQ ID NO: 2606721 - DNA, 14 bp, Homo sapiens
agcaggctggcagc

SEQ ID NO: 2606722 - DNA, 20 bp, Homo sapiens
agcaggctggcagctctcca

SEQ ID NO: 2606723 - DNA, 23 bp, Homo sapiens
agcagggctaccctgagctgagg

SEQ ID NO: 2606724 - DNA, 15 bp, Homo sapiens
agcagggctcagcgg

SEQ ID NO: 2606725 - DNA, 16 bp, Homo sapiens
agcagggctctgcccc

SEQ ID NO: 2606726 - DNA, 22 bp, Homo sapiens
agcaggggtccttggtgtgacc

SEQ ID NO: 2606727 - DNA, 16 bp, Homo sapiens
agcagggtctgggcag

SEQ ID NO: 2606728 - DNA, 19 bp, Homo sapiens
agcagggtcttttcatctg

SEQ ID NO: 2606729 - DNA, 20 bp, Homo sapiens
agcagggtcttttcatctgg

SEQ ID NO: 2606730 - DNA, 19 bp, Homo sapiens
agcaggtggcatctctaat

SEQ ID NO: 2606731 - DNA, 14 bp, Homo sapiens
agcaggtggggagg

SEQ ID NO: 2606732 - DNA, 20 bp, Homo sapiens
agcaggtggtcctgagacct

SEQ ID NO: 2606733 - DNA, 17 bp, Homo sapiens
agcagtgaaaacaagtg

SEQ ID NO: 2606734 - DNA, 20 bp, Homo sapiens
agcagtgaatgattcagtgt

SEQ ID NO: 2606735 - DNA, 21 bp, Homo sapiens
agcagtgagaaaaagctcctg

SEQ ID NO: 2606736 - DNA, 23 bp, Homo sapiens
agcagtgagttacagcgagaggc

SEQ ID NO: 2606737 - DNA, 14 bp, Homo sapiens
agcagtgcttctca

SEQ ID NO: 2606738 - DNA, 19 bp, Homo sapiens
agcagtgtcatcagaagat

SEQ ID NO: 2606739 - DNA, 20 bp, Homo sapiens
agcagtgtcatcagaagata

SEQ ID NO: 2606740 - DNA, 15 bp, Homo sapiens
agcagtgtcttccat

SEQ ID NO: 2606741 - DNA, 22 bp, Homo sapiens
agcagtgtcttccataatgtat

SEQ ID NO: 2606742 - DNA, 21 bp, Homo sapiens
agcagtgtgaggccagggcag

SEQ ID NO: 2606743 - DNA, 20 bp, Homo sapiens
agctactgatttcctttgga

SEQ ID NO: 2606744 - DNA, 18 bp, Homo sapiens
agctacttgggaggctga

SEQ ID NO: 2606745 - DNA, 16 bp, Homo sapiens
agctagaacctggaga

SEQ ID NO: 2606746 - DNA, 16 bp, Homo sapiens
agctagaaggccacat

SEQ ID NO: 2606747 - DNA, 17 bp, Homo sapiens
agctagctgcagagcca

SEQ ID NO: 2606748 - DNA, 12 bp, Homo sapiens
agctaggcctgg

SEQ ID NO: 2606749 - DNA, 15 bp, Homo sapiens
agctaggcctggcca

SEQ ID NO: 2606750 - DNA, 17 bp, Homo sapiens
agctatagacccgagga

SEQ ID NO: 2606751 - DNA, 14 bp, Homo sapiens
agctatatccatgt

SEQ ID NO: 2606752 - DNA, 15 bp, Homo sapiens
agctatatctatata

SEQ ID NO: 2606753 - DNA, 19 bp, Homo sapiens
agctatatctatatataat

SEQ ID NO: 2606754 - DNA, 22 bp, Homo sapiens
agctatcaagtgtgctttagct

SEQ ID NO: 2606755 - DNA, 16 bp, Homo sapiens
agctatcctggctctt

SEQ ID NO: 2606756 - DNA, 20 bp, Homo sapiens
agctatggtgagatgcagct

SEQ ID NO: 2606757 - DNA, 18 bp, Homo sapiens
agctatgttatattgaaa

SEQ ID NO: 2606758 - DNA, 19 bp, Homo sapiens
agctattcagtaataactc

SEQ ID NO: 2606759 - DNA, 17 bp, Homo sapiens
agctattgatataaata

SEQ ID NO: 2606760 - DNA, 14 bp, Homo sapiens
agctatttcatcta

SEQ ID NO: 2606761 - DNA, 21 bp, Homo sapiens
agctatttcatctatttttgg

SEQ ID NO: 2606762 - DNA, 18 bp, Homo sapiens
agctatttccattccaga

SEQ ID NO: 2606763 - DNA, 10 bp, Homo sapiens
agctattttt

SEQ ID NO: 2606764 - DNA, 13 bp, Homo sapiens
agctcaaaggcac

SEQ ID NO: 2606765 - DNA, 14 bp, Homo sapiens
agctcaatggactg

SEQ ID NO: 2606766 - DNA, 19 bp, Homo sapiens
agctcaccagccccagtgc

SEQ ID NO: 2606767 - DNA, 21 bp, Homo sapiens
agctcaccagccccagtgccc

SEQ ID NO: 2606768 - DNA, 21 bp, Homo sapiens
agctcacccaataaacattaa

SEQ ID NO: 2606769 - DNA, 17 bp, Homo sapiens
agctcaccccccacact

SEQ ID NO: 2606770 - DNA, 15 bp, Homo sapiens
agctcacctctccct

SEQ ID NO: 2606771 - DNA, 18 bp, Homo sapiens
agctcacctctcccttgg

SEQ ID NO: 2606772 - DNA, 21 bp, Homo sapiens
agctcacctgttgcttacaat

SEQ ID NO: 2606773 - DNA, 15 bp, Homo sapiens
agctcagaaggctct

SEQ ID NO: 2606774 - DNA, 23 bp, Homo sapiens
agctcagaaggctcttctgacta

SEQ ID NO: 2606775 - DNA, 12 bp, Homo sapiens
agctcagagagg

SEQ ID NO: 2606776 - DNA, 14 bp, Homo sapiens
agctcagagagggc

SEQ ID NO: 2606777 - DNA, 14 bp, Homo sapiens
agctcagagagggt

SEQ ID NO: 2606778 - DNA, 15 bp, Homo sapiens
agctcagcccacccc

SEQ ID NO: 2606779 - DNA, 20 bp, Homo sapiens
agctcagcccacccccctca

SEQ ID NO: 2606780 - DNA, 22 bp, Homo sapiens
agctcagctttttgtcttttct

SEQ ID NO: 2606781 - DNA, 17 bp, Homo sapiens
agctcaggaggcttgga

SEQ ID NO: 2606782 - DNA, 13 bp, Homo sapiens
agctcagggcctg

SEQ ID NO: 2606783 - DNA, 17 bp, Homo sapiens
agctcagggcctggctc

SEQ ID NO: 2606784 - DNA, 20 bp, Homo sapiens
agctcaggtgtccctgcact

SEQ ID NO: 2606785 - DNA, 21 bp, Homo sapiens
agctcaggtgtccctgcactt

SEQ ID NO: 2606786 - DNA, 13 bp, Homo sapiens
agctcagtcccat

SEQ ID NO: 2606787 - DNA, 21 bp, Homo sapiens
agctcagtcccatcagagagc

SEQ ID NO: 2606788 - DNA, 21 bp, Homo sapiens
agctcagttctagtctctctg

SEQ ID NO: 2606789 - DNA, 21 bp, Homo sapiens
agctcattctccttgtgttac

SEQ ID NO: 2606790 - DNA, 12 bp, Homo sapiens
agctcatttcac

SEQ ID NO: 2606791 - DNA, 23 bp, Homo sapiens
agctccaagacctgttggttcca

SEQ ID NO: 2606792 - DNA, 15 bp, Homo sapiens
agctccaagctccca

SEQ ID NO: 2606793 - DNA, 16 bp, Homo sapiens
agctccaagctcccag

SEQ ID NO: 2606794 - DNA, 17 bp, Homo sapiens
agctccaagctcccagg

SEQ ID NO: 2606795 - DNA, 19 bp, Homo sapiens
agctccaagctcccaggca

SEQ ID NO: 2606796 - DNA, 22 bp, Homo sapiens
agctccacaccctctcccagga

SEQ ID NO: 2606797 - DNA, 23 bp, Homo sapiens
agctccacaccctctcccaggac

SEQ ID NO: 2606798 - DNA, 18 bp, Homo sapiens
agctccactgtcaccctc

SEQ ID NO: 2606799 - DNA, 21 bp, Homo sapiens
agctccactgtcaccctccac

SEQ ID NO: 2606800 - DNA, 14 bp, Homo sapiens
agctccagaccccc

SEQ ID NO: 2606801 - DNA, 16 bp, Homo sapiens
agctccagacccccag

SEQ ID NO: 2606802 - DNA, 18 bp, Homo sapiens
agctccagacccccagca

SEQ ID NO: 2606803 - DNA, 19 bp, Homo sapiens
agctccagacccccagcaa

SEQ ID NO: 2606804 - DNA, 23 bp, Homo sapiens
agctcccaagggatggtgccctg

SEQ ID NO: 2606805 - DNA, 12 bp, Homo sapiens
agctcccaggaa

SEQ ID NO: 2606806 - DNA, 13 bp, Homo sapiens
agctcccaggcat

SEQ ID NO: 2606807 - DNA, 13 bp, Homo sapiens
agctcccaggccg

SEQ ID NO: 2606808 - DNA, 17 bp, Homo sapiens
agctcccatttctactc

SEQ ID NO: 2606809 - DNA, 23 bp, Homo sapiens
agctcccatttctactctcccat

SEQ ID NO: 2606810 - DNA, 18 bp, Homo sapiens
agctccccagagtcctct

SEQ ID NO: 2606811 - DNA, 21 bp, Homo sapiens
agctccccgcttctgcctgca

SEQ ID NO: 2606812 - DNA, 19 bp, Homo sapiens
agctcccctcctctcccct

SEQ ID NO: 2606813 - DNA, 17 bp, Homo sapiens
agctcccctcggagaag

SEQ ID NO: 2606814 - DNA, 14 bp, Homo sapiens
agctcccttctctg

SEQ ID NO: 2606815 - DNA, 16 bp, Homo sapiens
agctcccttctctgta

SEQ ID NO: 2606816 - DNA, 16 bp, Homo sapiens
agctcctcaactcacc

SEQ ID NO: 2606817 - DNA, 23 bp, Homo sapiens
agctcctcaactcacctaatgtt

SEQ ID NO: 2606818 - DNA, 16 bp, Homo sapiens
agctcctcccttgttc

SEQ ID NO: 2606819 - DNA, 20 bp, Homo sapiens
agctcctcccttgttctcta

SEQ ID NO: 2606820 - DNA, 17 bp, Homo sapiens
agctcctctcctggagg

SEQ ID NO: 2606821 - DNA, 18 bp, Homo sapiens
agctcctctcctggagga

SEQ ID NO: 2606822 - DNA, 17 bp, Homo sapiens
agctcctctgggcagga

SEQ ID NO: 2606823 - DNA, 22 bp, Homo sapiens
agctcctggtcttgagatgtct

SEQ ID NO: 2606824 - DNA, 14 bp, Homo sapiens
agctcctgtcctcc

SEQ ID NO: 2606825 - DNA, 15 bp, Homo sapiens
agctcctgtcctccc

SEQ ID NO: 2606826 - DNA, 21 bp, Homo sapiens
agctcctgtcctcccatcccc

SEQ ID NO: 2606827 - DNA, 15 bp, Homo sapiens
agctccttgggaggc

SEQ ID NO: 2606828 - DNA, 20 bp, Homo sapiens
agctccttgggaggccccac

SEQ ID NO: 2606829 - DNA, 22 bp, Homo sapiens
agctccttgggaggccccactg

SEQ ID NO: 2606830 - DNA, 15 bp, Homo sapiens
agctcggtggaccca

SEQ ID NO: 2606831 - DNA, 16 bp, Homo sapiens
agctcggtggacccag

SEQ ID NO: 2606832 - DNA, 20 bp, Homo sapiens
agctcggtggacccagggat

SEQ ID NO: 2606833 - DNA, 17 bp, Homo sapiens
agctcgtgtatcctggg

SEQ ID NO: 2606834 - DNA, 17 bp, Homo sapiens
agctctagacaaccctg

SEQ ID NO: 2606835 - DNA, 20 bp, Homo sapiens
agctctagacaaccctgcaa

SEQ ID NO: 2606836 - DNA, 20 bp, Homo sapiens
agctctattaagatttccaa

SEQ ID NO: 2606837 - DNA, 16 bp, Homo sapiens
agctctccagctccaa

SEQ ID NO: 2606838 - DNA, 21 bp, Homo sapiens
agctctgaagtcacatcacag

SEQ ID NO: 2606839 - DNA, 17 bp, Homo sapiens
agctctgccgcaatggc

SEQ ID NO: 2606840 - DNA, 18 bp, Homo sapiens
agctctgggagaggattt

SEQ ID NO: 2606841 - DNA, 12 bp, Homo sapiens
agctctggtcca

SEQ ID NO: 2606842 - DNA, 21 bp, Homo sapiens
agctctggtgacaccagcctt

SEQ ID NO: 2606843 - DNA, 22 bp, Homo sapiens
agctctgtatcaggacccagag

SEQ ID NO: 2606844 - DNA, 23 bp, Homo sapiens
agctctgtatcaggacccagagg

SEQ ID NO: 2606845 - DNA, 16 bp, Homo sapiens
agctctgtcctgggag

SEQ ID NO: 2606846 - DNA, 21 bp, Homo sapiens
agctctgtcctgggagtgagc

SEQ ID NO: 2606847 - DNA, 13 bp, Homo sapiens
agctcttcaggcc

SEQ ID NO: 2606848 - DNA, 20 bp, Homo sapiens
agctcttctgccggccctgg

SEQ ID NO: 2606849 - DNA, 21 bp, Homo sapiens
agctcttctgccggccctggg

SEQ ID NO: 2606850 - DNA, 22 bp, Homo sapiens
agctcttctgccggccctgggg

SEQ ID NO: 2606851 - DNA, 18 bp, Homo sapiens
agctcttcttaaagtatt

SEQ ID NO: 2606852 - DNA, 19 bp, Homo sapiens
agctcttgaagacactgaa

SEQ ID NO: 2606853 - DNA, 18 bp, Homo sapiens
agctcttgcccttccctg

SEQ ID NO: 2606854 - DNA, 13 bp, Homo sapiens
agctcttgctaat

SEQ ID NO: 2606855 - DNA, 20 bp, Homo sapiens
agctcttgctaatcagtgtc

SEQ ID NO: 2606856 - DNA, 23 bp, Homo sapiens
agctcttgctaatcagtgtctca

SEQ ID NO: 2606857 - DNA, 12 bp, Homo sapiens
agctgaaatact

SEQ ID NO: 2606858 - DNA, 19 bp, Homo sapiens
agctgaacccattttgagt

SEQ ID NO: 2606859 - DNA, 14 bp, Homo sapiens
agctgacacaaacc

SEQ ID NO: 2606860 - DNA, 14 bp, Homo sapiens
agctgacatggaaa

SEQ ID NO: 2606861 - DNA, 15 bp, Homo sapiens
agctgacctctgttg

SEQ ID NO: 2606862 - DNA, 22 bp, Homo sapiens
agctgacctctgttgtcctccc

SEQ ID NO: 2606863 - DNA, 19 bp, Homo sapiens
agctgacgaacttccatgg

SEQ ID NO: 2606864 - DNA, 15 bp, Homo sapiens
agctgacttttctgt

SEQ ID NO: 2606865 - DNA, 15 bp, Homo sapiens
agctgagcaccaggg

SEQ ID NO: 2606866 - DNA, 13 bp, Homo sapiens
agctgagcaggga

SEQ ID NO: 2606867 - DNA, 14 bp, Homo sapiens
agctgagcctctca

SEQ ID NO: 2606868 - DNA, 17 bp, Homo sapiens
agctgaggcaattctaa

SEQ ID NO: 2606869 - DNA, 15 bp, Homo sapiens
agctgaggcagcagt

SEQ ID NO: 2606870 - DNA, 16 bp, Homo sapiens
agctgaggcagcagtg

SEQ ID NO: 2606871 - DNA, 13 bp, Homo sapiens
agctgatccagag

SEQ ID NO: 2606872 - DNA, 20 bp, Homo sapiens
agctgatgttggaagagaaa

SEQ ID NO: 2606873 - DNA, 15 bp, Homo sapiens
agctgcaagtgacat

SEQ ID NO: 2606874 - DNA, 15 bp, Homo sapiens
agctgcacagggcag

SEQ ID NO: 2606875 - DNA, 22 bp, Homo sapiens
agctgcacagggcagctgggcc

SEQ ID NO: 2606876 - DNA, 23 bp, Homo sapiens
agctgcacagggcagctgggccc

SEQ ID NO: 2606877 - DNA, 20 bp, Homo sapiens
agctgcaccctcaggcaggt

SEQ ID NO: 2606878 - DNA, 21 bp, Homo sapiens
agctgcacctgccagcctggc

SEQ ID NO: 2606879 - DNA, 22 bp, Homo sapiens
agctgcacctgccagcctggct

SEQ ID NO: 2606880 - DNA, 18 bp, Homo sapiens
agctgcatcctccaagaa

SEQ ID NO: 2606881 - DNA, 13 bp, Homo sapiens
agctgccagagaa

SEQ ID NO: 2606882 - DNA, 16 bp, Homo sapiens
agctgccccagccaga

SEQ ID NO: 2606883 - DNA, 13 bp, Homo sapiens
agctgccgaccag

SEQ ID NO: 2606884 - DNA, 18 bp, Homo sapiens
agctgccgaccagagccc

SEQ ID NO: 2606885 - DNA, 13 bp, Homo sapiens
agctgcctcactt

SEQ ID NO: 2606886 - DNA, 12 bp, Homo sapiens
agctgcctgctt

SEQ ID NO: 2606887 - DNA, 14 bp, Homo sapiens
aggcatcacagcta

SEQ ID NO: 2606888 - DNA, 16 bp, Homo sapiens
aggcatcccaggggac

SEQ ID NO: 2606889 - DNA, 17 bp, Homo sapiens
aggcatcccaggggacc

SEQ ID NO: 2606890 - DNA, 20 bp, Homo sapiens
aggcatccttcctcacacca

SEQ ID NO: 2606891 - DNA, 14 bp, Homo sapiens
aggcatctgcaccc

SEQ ID NO: 2606892 - DNA, 15 bp, Homo sapiens
aggcatgagggatca

SEQ ID NO: 2606893 - DNA, 14 bp, Homo sapiens
aggcatgcctgtgt

SEQ ID NO: 2606894 - DNA, 15 bp, Homo sapiens
aggcatgcctgtgtg

SEQ ID NO: 2606895 - DNA, 18 bp, Homo sapiens
aggcatgttctctgagga

SEQ ID NO: 2606896 - DNA, 19 bp, Homo sapiens
aggcatgttctctgaggac

SEQ ID NO: 2606897 - DNA, 20 bp, Homo sapiens
aggcattccccaggaggcca

SEQ ID NO: 2606898 - DNA, 21 bp, Homo sapiens
aggcattccccaggaggccag

SEQ ID NO: 2606899 - DNA, 22 bp, Homo sapiens
aggcattccccaggaggccagc

SEQ ID NO: 2606900 - DNA, 13 bp, Homo sapiens
aggcattctctga

SEQ ID NO: 2606901 - DNA, 18 bp, Homo sapiens
aggcattgcacagggaga

SEQ ID NO: 2606902 - DNA, 14 bp, Homo sapiens
aggcattgccaagg

SEQ ID NO: 2606903 - DNA, 16 bp, Homo sapiens
aggcatttgctgaata

SEQ ID NO: 2606904 - DNA, 14 bp, Homo sapiens
aggccaaacctctg

SEQ ID NO: 2606905 - DNA, 21 bp, Homo sapiens
aggccaaactggcaaacttca

SEQ ID NO: 2606906 - DNA, 22 bp, Homo sapiens
aggccaacccaaaataagcagg

SEQ ID NO: 2606907 - DNA, 17 bp, Homo sapiens
aggccaaggccttctcc

SEQ ID NO: 2606908 - DNA, 16 bp, Homo sapiens
aggccaaggtgggagg

SEQ ID NO: 2606909 - DNA, 18 bp, Homo sapiens
aggccaaggtgggaggat

SEQ ID NO: 2606910 - DNA, 18 bp, Homo sapiens
aggccaagtcaggccctt

SEQ ID NO: 2606911 - DNA, 21 bp, Homo sapiens
aggccaagtgcaggctggcac

SEQ ID NO: 2606912 - DNA, 22 bp, Homo sapiens
aggccaagtgtgataaataaac

SEQ ID NO: 2606913 - DNA, 17 bp, Homo sapiens
aggccacaagacccttg

SEQ ID NO: 2606914 - DNA, 21 bp, Homo sapiens
aggccacaccatctcctttca

SEQ ID NO: 2606915 - DNA, 16 bp, Homo sapiens
aggccacctccagaaa

SEQ ID NO: 2606916 - DNA, 11 bp, Homo sapiens
aggccacctct

SEQ ID NO: 2606917 - DNA, 15 bp, Homo sapiens
aggccacctctccaa

SEQ ID NO: 2606918 - DNA, 18 bp, Homo sapiens
aggccacctctccaaggg

SEQ ID NO: 2606919 - DNA, 16 bp, Homo sapiens
aggccagagtggcctg

SEQ ID NO: 2606920 - DNA, 22 bp, Homo sapiens
aggccagagtggcctggccagg

SEQ ID NO: 2606921 - DNA, 18 bp, Homo sapiens
aggccagccccacccagg

SEQ ID NO: 2606922 - DNA, 19 bp, Homo sapiens
aggccagctgccccagcca

SEQ ID NO: 2606923 - DNA, 15 bp, Homo sapiens
aggccagctggcagc

SEQ ID NO: 2606924 - DNA, 16 bp, Homo sapiens
aggccagctggcagca

SEQ ID NO: 2606925 - DNA, 18 bp, Homo sapiens
aggccagctggcagcaga

SEQ ID NO: 2606926 - DNA, 19 bp, Homo sapiens
aggccagctggcagcagag

SEQ ID NO: 2606927 - DNA, 16 bp, Homo sapiens
aggccaggccaccagg

SEQ ID NO: 2606928 - DNA, 18 bp, Homo sapiens
aggccaggccaccaggat

SEQ ID NO: 2606929 - DNA, 13 bp, Homo sapiens
aggccaggccctc

SEQ ID NO: 2606930 - DNA, 14 bp, Homo sapiens
aggccaggccctct

SEQ ID NO: 2606931 - DNA, 16 bp, Homo sapiens
aggccaggccctctgc

SEQ ID NO: 2606932 - DNA, 17 bp, Homo sapiens
aggccaggccctctgcc

SEQ ID NO: 2606933 - DNA, 11 bp, Homo sapiens
aggccaggctc

SEQ ID NO: 2606934 - DNA, 22 bp, Homo sapiens
aggccaggctccttcctgtctt

SEQ ID NO: 2606935 - DNA, 15 bp, Homo sapiens
aggccaggtgcaggt

SEQ ID NO: 2606936 - DNA, 21 bp, Homo sapiens
aggccagtaagggaaatagaa

SEQ ID NO: 2606937 - DNA, 15 bp, Homo sapiens
aggccatggcagaat

SEQ ID NO: 2606938 - DNA, 20 bp, Homo sapiens
aggcccaagagatgaagagt

SEQ ID NO: 2606939 - DNA, 21 bp, Homo sapiens
aggcccagagggcctgcaagg

SEQ ID NO: 2606940 - DNA, 10 bp, Homo sapiens
aggcccagca

SEQ ID NO: 2606941 - DNA, 13 bp, Homo sapiens
aggcccagcattg

SEQ ID NO: 2606942 - DNA, 18 bp, Homo sapiens
aggcccagcattgctggt

SEQ ID NO: 2606943 - DNA, 21 bp, Homo sapiens
aggcccagcattgctggttct

SEQ ID NO: 2606944 - DNA, 18 bp, Homo sapiens
aggccccaaaaccacagc

SEQ ID NO: 2606945 - DNA, 13 bp, Homo sapiens
aggcccccaagcc

SEQ ID NO: 2606946 - DNA, 15 bp, Homo sapiens
aggcccccaggtgcc

SEQ ID NO: 2606947 - DNA, 23 bp, Homo sapiens
aggccccgaggacccagacccag

SEQ ID NO: 2606948 - DNA, 14 bp, Homo sapiens
aggccccgcccagg

SEQ ID NO: 2606949 - DNA, 21 bp, Homo sapiens
aggcccctgccaccctgggga

SEQ ID NO: 2606950 - DNA, 21 bp, Homo sapiens
aggcccctgtctcagggtgag

SEQ ID NO: 2606951 - DNA, 19 bp, Homo sapiens
aggcccgcatgcggcccag

SEQ ID NO: 2606952 - DNA, 17 bp, Homo sapiens
aggcccggctccaggct

SEQ ID NO: 2606953 - DNA, 15 bp, Homo sapiens
aggcccgtccggcag

SEQ ID NO: 2606954 - DNA, 15 bp, Homo sapiens
aggccctcgctgcca

SEQ ID NO: 2606955 - DNA, 16 bp, Homo sapiens
aggccctcgggcccag

SEQ ID NO: 2606956 - DNA, 17 bp, Homo sapiens
aggccctcgggcccagc

SEQ ID NO: 2606957 - DNA, 13 bp, Homo sapiens
aggccctgtctgt

SEQ ID NO: 2606958 - DNA, 14 bp, Homo sapiens
aggccctgtctgta

SEQ ID NO: 2606959 - DNA, 20 bp, Homo sapiens
aggcccttattttcaagaaa

SEQ ID NO: 2606960 - DNA, 20 bp, Homo sapiens
aggcccttctctccagcccc

SEQ ID NO: 2606961 - DNA, 21 bp, Homo sapiens
aggcccttctctccagcccct

SEQ ID NO: 2606962 - DNA, 14 bp, Homo sapiens
aggccgaagctctg

SEQ ID NO: 2606963 - DNA, 15 bp, Homo sapiens
aggccgaagctctgg

SEQ ID NO: 2606964 - DNA, 15 bp, Homo sapiens
aggccgagaagcaag

SEQ ID NO: 2606965 - DNA, 17 bp, Homo sapiens
aggccgagaagccagtg

SEQ ID NO: 2606966 - DNA, 17 bp, Homo sapiens
aggccgcagctcttgcc

SEQ ID NO: 2606967 - DNA, 18 bp, Homo sapiens
aggccgctagaggcctga

SEQ ID NO: 2606968 - DNA, 21 bp, Homo sapiens
aggccgctagaggcctgagga

SEQ ID NO: 2606969 - DNA, 19 bp, Homo sapiens
aggccggggccgggtactg

SEQ ID NO: 2606970 - DNA, 13 bp, Homo sapiens
aggccgtcctccc

SEQ ID NO: 2606971 - DNA, 22 bp, Homo sapiens
aggccgtcctcccgggccctcc

SEQ ID NO: 2606972 - DNA, 17 bp, Homo sapiens
aggcctaaaagtaaaca

SEQ ID NO: 2606973 - DNA, 13 bp, Homo sapiens
aggcctcagtgga

SEQ ID NO: 2606974 - DNA, 23 bp, Homo sapiens
aggcctcagtggactttccaccc

SEQ ID NO: 2606975 - DNA, 13 bp, Homo sapiens
aggcctccctcaa

SEQ ID NO: 2606976 - DNA, 20 bp, Homo sapiens
aggcctcgaaaaccatcaca

SEQ ID NO: 2606977 - DNA, 16 bp, Homo sapiens
aggcctctgtgtcctt

SEQ ID NO: 2606978 - DNA, 22 bp, Homo sapiens
aggcctctgtgtccttccctgc

SEQ ID NO: 2606979 - DNA, 21 bp, Homo sapiens
aggcctcttggacctctgctc

SEQ ID NO: 2606980 - DNA, 22 bp, Homo sapiens
aggcctcttggacctctgctct

SEQ ID NO: 2606981 - DNA, 23 bp, Homo sapiens
aggcctcttggacctctgctctg

SEQ ID NO: 2606982 - DNA, 24 bp, Homo sapiens
aggcctcttggacctctgctctga

SEQ ID NO: 2606983 - DNA, 16 bp, Homo sapiens
aggcctgactctcagc

SEQ ID NO: 2606984 - DNA, 16 bp, Homo sapiens
aggcctgaggatgagc

SEQ ID NO: 2606985 - DNA, 18 bp, Homo sapiens
aggcctgaggatgagctg

SEQ ID NO: 2606986 - DNA, 19 bp, Homo sapiens
aggcctgaggatgagctgg

SEQ ID NO: 2606987 - DNA, 23 bp, Homo sapiens
aggcctgaggatgagctggaagg

SEQ ID NO: 2606988 - DNA, 16 bp, Homo sapiens
aggcctgccctcaggg

SEQ ID NO: 2606989 - DNA, 22 bp, Homo sapiens
aggcctgccctcagggatcttg

SEQ ID NO: 2606990 - DNA, 13 bp, Homo sapiens
aggcctggccaga

SEQ ID NO: 2606991 - DNA, 16 bp, Homo sapiens
aggcctggccagatgc

SEQ ID NO: 2606992 - DNA, 19 bp, Homo sapiens
aggcctgggtctgtgtctc

SEQ ID NO: 2606993 - DNA, 16 bp, Homo sapiens
aggcctgggtgctggc

SEQ ID NO: 2606994 - DNA, 12 bp, Homo sapiens
aggcctgtgtgt

SEQ ID NO: 2606995 - DNA, 17 bp, Homo sapiens
aggccttatctccaaga

SEQ ID NO: 2606996 - DNA, 18 bp, Homo sapiens
aggcgagtgccaggactc

SEQ ID NO: 2606997 - DNA, 24 bp, Homo sapiens
aggcgagtgccaggactccccagg

SEQ ID NO: 2606998 - DNA, 23 bp, Homo sapiens
aggcgcactttcctcctggcaga

SEQ ID NO: 2606999 - DNA, 15 bp, Homo sapiens
aggcggagagtacag

SEQ ID NO: 2607000 - DNA, 12 bp, Homo sapiens
aggcggcccctc

SEQ ID NO: 2607001 - DNA, 16 bp, Homo sapiens
aggcggcccctcccgc

SEQ ID NO: 2607002 - DNA, 14 bp, Homo sapiens
aggcgggagtggag

SEQ ID NO: 2607003 - DNA, 14 bp, Homo sapiens
aggcggtgggcacc

SEQ ID NO: 2607004 - DNA, 18 bp, Homo sapiens
aggcgtctgtatattttg

SEQ ID NO: 2607005 - DNA, 14 bp, Homo sapiens
aggcgtgaggatgg

SEQ ID NO: 2607006 - DNA, 16 bp, Homo sapiens
aggcgtggagctgcct

SEQ ID NO: 2607007 - DNA, 18 bp, Homo sapiens
aggctaaagcccagagac

SEQ ID NO: 2607008 - DNA, 19 bp, Homo sapiens
aggctaaggcaggaaaatt

SEQ ID NO: 2607009 - DNA, 18 bp, Homo sapiens
aggctaaggcgtggagct

SEQ ID NO: 2607010 - DNA, 19 bp, Homo sapiens
aggctaaggcgtggagctg

SEQ ID NO: 2607011 - DNA, 19 bp, Homo sapiens
aggctacactgacactggt

SEQ ID NO: 2607012 - DNA, 14 bp, Homo sapiens
aggctacctttgta

SEQ ID NO: 2607013 - DNA, 19 bp, Homo sapiens
aggctagaacctggcaagc

SEQ ID NO: 2607014 - DNA, 20 bp, Homo sapiens
aggctagagtgcagtggcat

SEQ ID NO: 2607015 - DNA, 19 bp, Homo sapiens
aggctatggggatagatgt

SEQ ID NO: 2607016 - DNA, 21 bp, Homo sapiens
aggctatggggatagatgtgt

SEQ ID NO: 2607017 - DNA, 18 bp, Homo sapiens
aggctattattttcactg

SEQ ID NO: 2607018 - DNA, 16 bp, Homo sapiens
aggctcagtctcagga

SEQ ID NO: 2607019 - DNA, 17 bp, Homo sapiens
aggctcagtctcaggag

SEQ ID NO: 2607020 - DNA, 13 bp, Homo sapiens
aggctccagaggg

SEQ ID NO: 2607021 - DNA, 13 bp, Homo sapiens
aggctccaggagc

SEQ ID NO: 2607022 - DNA, 17 bp, Homo sapiens
aggctccaggagcagcc

SEQ ID NO: 2607023 - DNA, 19 bp, Homo sapiens
aggctccaggagcagccac

SEQ ID NO: 2607024 - DNA, 19 bp, Homo sapiens
aggctcctgtgctactttg

SEQ ID NO: 2607025 - DNA, 13 bp, Homo sapiens
aggctccttcctg

SEQ ID NO: 2607026 - DNA, 15 bp, Homo sapiens
aggctccttcctgtc

SEQ ID NO: 2607027 - DNA, 23 bp, Homo sapiens
aggctccttcctgtcttcctgca

SEQ ID NO: 2607028 - DNA, 15 bp, Homo sapiens
aggctcgagcatgcc

SEQ ID NO: 2607029 - DNA, 18 bp, Homo sapiens
aggctctgaaagccagct

SEQ ID NO: 2607030 - DNA, 13 bp, Homo sapiens
aggctctgccctg

SEQ ID NO: 2607031 - DNA, 15 bp, Homo sapiens
aggctctgcccttgg

SEQ ID NO: 2607032 - DNA, 20 bp, Homo sapiens
aggtcactggctctccaagt

SEQ ID NO: 2607033 - DNA, 16 bp, Homo sapiens
aggtcagcatgtctat

SEQ ID NO: 2607034 - DNA, 15 bp, Homo sapiens
aggtcaggagttcct

SEQ ID NO: 2607035 - DNA, 17 bp, Homo sapiens
aggtcatagctgagatt

SEQ ID NO: 2607036 - DNA, 20 bp, Homo sapiens
aggtcattttttttaagaaa

SEQ ID NO: 2607037 - DNA, 16 bp, Homo sapiens
aggtccaatttgtaaa

SEQ ID NO: 2607038 - DNA, 16 bp, Homo sapiens
aggtccagccctggct

SEQ ID NO: 2607039 - DNA, 18 bp, Homo sapiens
aggtccagccctggctga

SEQ ID NO: 2607040 - DNA, 21 bp, Homo sapiens
aggtccagccctggctgaagg

SEQ ID NO: 2607041 - DNA, 23 bp, Homo sapiens
aggtccagccctggctgaaggac

SEQ ID NO: 2607042 - DNA, 14 bp, Homo sapiens
aggtcccaggcaga

SEQ ID NO: 2607043 - DNA, 21 bp, Homo sapiens
aggtcgaccccaaagcccctt

SEQ ID NO: 2607044 - DNA, 22 bp, Homo sapiens
aggtctaggaacatacttcagc

SEQ ID NO: 2607045 - DNA, 17 bp, Homo sapiens
aggtctcccacgtggga

SEQ ID NO: 2607046 - DNA, 16 bp, Homo sapiens
aggtctctgccggctc

SEQ ID NO: 2607047 - DNA, 16 bp, Homo sapiens
aggtctcttgagggag

SEQ ID NO: 2607048 - DNA, 14 bp, Homo sapiens
aggtctgctcggcc

SEQ ID NO: 2607049 - DNA, 23 bp, Homo sapiens
aggtctggagaagctcccaggaa

SEQ ID NO: 2607050 - DNA, 15 bp, Homo sapiens
aggtctgttctttcc

SEQ ID NO: 2607051 - DNA, 16 bp, Homo sapiens
aggtctgttctttcca

SEQ ID NO: 2607052 - DNA, 22 bp, Homo sapiens
aggtctgttctttccaaagtac

SEQ ID NO: 2607053 - DNA, 23 bp, Homo sapiens
aggtctgttctttccaaagtaca

SEQ ID NO: 2607054 - DNA, 20 bp, Homo sapiens
aggtcttgaactcctggcct

SEQ ID NO: 2607055 - DNA, 18 bp, Homo sapiens
aggtctttggttcagcta

SEQ ID NO: 2607056 - DNA, 14 bp, Homo sapiens
aggtcttttgacat

SEQ ID NO: 2607057 - DNA, 18 bp, Homo sapiens
aggtcttttgacatgtgg

SEQ ID NO: 2607058 - DNA, 19 bp, Homo sapiens
aggtcttttgacatgtgga

SEQ ID NO: 2607059 - DNA, 21 bp, Homo sapiens
aggtcttttgacatgtggaaa

SEQ ID NO: 2607060 - DNA, 14 bp, Homo sapiens
aggtgaaagggagc

SEQ ID NO: 2607061 - DNA, 19 bp, Homo sapiens
aggtgaaagttaatccact

SEQ ID NO: 2607062 - DNA, 14 bp, Homo sapiens
aggtgacatgtgaa

SEQ ID NO: 2607063 - DNA, 16 bp, Homo sapiens
aggtgacatgtgaaac

SEQ ID NO: 2607064 - DNA, 19 bp, Homo sapiens
aggtgacccaatgattcag

SEQ ID NO: 2607065 - DNA, 21 bp, Homo sapiens
aggtgagaagcagaggaagga

SEQ ID NO: 2607066 - DNA, 18 bp, Homo sapiens
aggtgagcacggccaaca

SEQ ID NO: 2607067 - DNA, 20 bp, Homo sapiens
aggtgagcccatggccctcc

SEQ ID NO: 2607068 - DNA, 15 bp, Homo sapiens
aggtgcacaagctcc

SEQ ID NO: 2607069 - DNA, 20 bp, Homo sapiens
aggtgcacaagctccaagct

SEQ ID NO: 2607070 - DNA, 21 bp, Homo sapiens
aggtgcacaagctccaagctc

SEQ ID NO: 2607071 - DNA, 18 bp, Homo sapiens
aggtgcagagtgcccaga

SEQ ID NO: 2607072 - DNA, 11 bp, Homo sapiens
aggtgcagtgg

SEQ ID NO: 2607073 - DNA, 14 bp, Homo sapiens
aggtgccagcaact

SEQ ID NO: 2607074 - DNA, 18 bp, Homo sapiens
aggtgccagcaactgaat

SEQ ID NO: 2607075 - DNA, 21 bp, Homo sapiens
aggtgcccagaataagttatt

SEQ ID NO: 2607076 - DNA, 15 bp, Homo sapiens
aggtgcctccaggtg

SEQ ID NO: 2607077 - DNA, 18 bp, Homo sapiens
aggtgcctgtcccacccc

SEQ ID NO: 2607078 - DNA, 10 bp, Homo sapiens
aggtgccttg

SEQ ID NO: 2607079 - DNA, 23 bp, Homo sapiens
aggtgccttggagggtcccaagc

SEQ ID NO: 2607080 - DNA, 23 bp, Homo sapiens
aggtgctaaatggtcgcccagga

SEQ ID NO: 2607081 - DNA, 20 bp, Homo sapiens
aggtgctacaaaaacacagc

SEQ ID NO: 2607082 - DNA, 24 bp, Homo sapiens
aggtgctacaaaaacacagcaagg

SEQ ID NO: 2607083 - DNA, 20 bp, Homo sapiens
aggtgctacacccttttcca

SEQ ID NO: 2607084 - DNA, 22 bp, Homo sapiens
aggtgctaggaacactccttca

SEQ ID NO: 2607085 - DNA, 23 bp, Homo sapiens
aggtgctaggaacactccttcac

SEQ ID NO: 2607086 - DNA, 19 bp, Homo sapiens
aggtgcttaagcagaagca

SEQ ID NO: 2607087 - DNA, 20 bp, Homo sapiens
aggtgcttaagcagaagcat

SEQ ID NO: 2607088 - DNA, 18 bp, Homo sapiens
aggtggcaaggctgtgct

SEQ ID NO: 2607089 - DNA, 17 bp, Homo sapiens
aggtggcactttttcat

SEQ ID NO: 2607090 - DNA, 18 bp, Homo sapiens
aggtggcactttttcatt

SEQ ID NO: 2607091 - DNA, 14 bp, Homo sapiens
aggtggcaggacca

SEQ ID NO: 2607092 - DNA, 17 bp, Homo sapiens
aggtggcaggaccagga

SEQ ID NO: 2607093 - DNA, 17 bp, Homo sapiens
aggtggctatggccacc

SEQ ID NO: 2607094 - DNA, 12 bp, Homo sapiens
aggtgggaggat

SEQ ID NO: 2607095 - DNA, 20 bp, Homo sapiens
aggtgggatcctccaggtgc

SEQ ID NO: 2607096 - DNA, 18 bp, Homo sapiens
aggtgggcccaggaccag

SEQ ID NO: 2607097 - DNA, 19 bp, Homo sapiens
aggtgggccttgctacctc

SEQ ID NO: 2607098 - DNA, 15 bp, Homo sapiens
aggtgggcttcccag

SEQ ID NO: 2607099 - DNA, 14 bp, Homo sapiens
aggtggggacaggg

SEQ ID NO: 2607100 - DNA, 22 bp, Homo sapiens
aggtggggagggggtttggggg

SEQ ID NO: 2607101 - DNA, 13 bp, Homo sapiens
aggtggggagtca

SEQ ID NO: 2607102 - DNA, 17 bp, Homo sapiens
aggtggggcgggaaagc

SEQ ID NO: 2607103 - DNA, 23 bp, Homo sapiens
aggtggggtcactctggcagctc

SEQ ID NO: 2607104 - DNA, 23 bp, Homo sapiens
aggtgggttttcatcaagactgg

SEQ ID NO: 2607105 - DNA, 18 bp, Homo sapiens
aggtggtctgaatgttct

SEQ ID NO: 2607106 - DNA, 17 bp, Homo sapiens
aggtggttatggagagg

SEQ ID NO: 2607107 - DNA, 17 bp, Homo sapiens
aggtgtcaggctgctgg

SEQ ID NO: 2607108 - DNA, 18 bp, Homo sapiens
aggtgtcaggctgctggc

SEQ ID NO: 2607109 - DNA, 16 bp, Homo sapiens
aggtgtccctgcactt

SEQ ID NO: 2607110 - DNA, 17 bp, Homo sapiens
aggtgtctgcacccagg

SEQ ID NO: 2607111 - DNA, 15 bp, Homo sapiens
aggtgtcttcctccc

SEQ ID NO: 2607112 - DNA, 16 bp, Homo sapiens
aggtgtcttcctccca

SEQ ID NO: 2607113 - DNA, 19 bp, Homo sapiens
aggtgtcttcctcccaagt

SEQ ID NO: 2607114 - DNA, 20 bp, Homo sapiens
aggtgtcttcctcccaagtg

SEQ ID NO: 2607115 - DNA, 22 bp, Homo sapiens
aggtgtgaaccaccacacccag

SEQ ID NO: 2607116 - DNA, 22 bp, Homo sapiens
aggtgtgagtcaccaagcccag

SEQ ID NO: 2607117 - DNA, 20 bp, Homo sapiens
aggtgtgctctgatcatcca

SEQ ID NO: 2607118 - DNA, 16 bp, Homo sapiens
aggtgtgggggctgca

SEQ ID NO: 2607119 - DNA, 17 bp, Homo sapiens
aggtgttctacactcat

SEQ ID NO: 2607120 - DNA, 12 bp, Homo sapiens
aggtgtttatac

SEQ ID NO: 2607121 - DNA, 14 bp, Homo sapiens
aggtgtttatacag

SEQ ID NO: 2607122 - DNA, 15 bp, Homo sapiens
aggttacaacagatt

SEQ ID NO: 2607123 - DNA, 21 bp, Homo sapiens
aggttacaacagatttgtgaa

SEQ ID NO: 2607124 - DNA, 16 bp, Homo sapiens
aggttaccaagaagcc

SEQ ID NO: 2607125 - DNA, 17 bp, Homo sapiens
aggttaccctgtaacat

SEQ ID NO: 2607126 - DNA, 22 bp, Homo sapiens
aggttagattttgtattcaggg

SEQ ID NO: 2607127 - DNA, 21 bp, Homo sapiens
aggttaggagttcgagaccag

SEQ ID NO: 2607128 - DNA, 17 bp, Homo sapiens
aggttatcgaaataaca

SEQ ID NO: 2607129 - DNA, 20 bp, Homo sapiens
aggttatcgaaataacaatg

SEQ ID NO: 2607130 - DNA, 16 bp, Homo sapiens
aggttatctgtcccag

SEQ ID NO: 2607131 - DNA, 17 bp, Homo sapiens
aggttattttagtttct

SEQ ID NO: 2607132 - DNA, 18 bp, Homo sapiens
aggttccaactgtatata

SEQ ID NO: 2607133 - DNA, 21 bp, Homo sapiens
aggttccgcttggagcagagg

SEQ ID NO: 2607134 - DNA, 23 bp, Homo sapiens
aggttccgcttggagcagagggg

SEQ ID NO: 2607135 - DNA, 15 bp, Homo sapiens
aggttctatttggaa

SEQ ID NO: 2607136 - DNA, 23 bp, Homo sapiens
aggttcttcccttttacatactg

SEQ ID NO: 2607137 - DNA, 16 bp, Homo sapiens
aggttcttcttcctga

SEQ ID NO: 2607138 - DNA, 19 bp, Homo sapiens
aggttcttcttcctgaagc

SEQ ID NO: 2607139 - DNA, 23 bp, Homo sapiens
aggttcttcttcctgaagctgag

SEQ ID NO: 2607140 - DNA, 12 bp, Homo sapiens
aggttgaaagac

SEQ ID NO: 2607141 - DNA, 17 bp, Homo sapiens
aggttgagctcttctta

SEQ ID NO: 2607142 - DNA, 24 bp, Homo sapiens
aggttgagctcttcttaaagtatt

SEQ ID NO: 2607143 - DNA, 15 bp, Homo sapiens
aggttgataactttg

SEQ ID NO: 2607144 - DNA, 18 bp, Homo sapiens
aggttgcagggagccgag

SEQ ID NO: 2607145 - DNA, 14 bp, Homo sapiens
aggttgcagtgagc

SEQ ID NO: 2607146 - DNA, 17 bp, Homo sapiens
aggttgctggttgctgt

SEQ ID NO: 2607147 - DNA, 24 bp, Homo sapiens
aggttgctggttgctgtgtggttt

SEQ ID NO: 2607148 - DNA, 18 bp, Homo sapiens
aggttggaagctagctcc

SEQ ID NO: 2607149 - DNA, 19 bp, Homo sapiens
aggttggaagctagctccc

SEQ ID NO: 2607150 - DNA, 22 bp, Homo sapiens
aggttgggaatgaggcttgctg

SEQ ID NO: 2607151 - DNA, 20 bp, Homo sapiens
aggtttaactcagatcacta

SEQ ID NO: 2607152 - DNA, 18 bp, Homo sapiens
aggtttctggtctctagg

SEQ ID NO: 2607153 - DNA, 17 bp, Homo sapiens
aggtttgagaagcactg

SEQ ID NO: 2607154 - DNA, 16 bp, Homo sapiens
aggtttggtgtgtgga

SEQ ID NO: 2607155 - DNA, 22 bp, Homo sapiens
aggtttggtgtgtggagatgca

SEQ ID NO: 2607156 - DNA, 12 bp, Homo sapiens
aggtttgtatat

SEQ ID NO: 2607157 - DNA, 23 bp, Homo sapiens
aggtttgtttagaagaagtgtgt

SEQ ID NO: 2607158 - DNA, 17 bp, Homo sapiens
aggttttaaagtgatta

SEQ ID NO: 2607159 - DNA, 14 bp, Homo sapiens
aggttttaagttgt

SEQ ID NO: 2607160 - DNA, 19 bp, Homo sapiens
aggttttaagttgtttgca

SEQ ID NO: 2607161 - DNA, 22 bp, Homo sapiens
aggttttcctcttctattttgt

SEQ ID NO: 2607162 - DNA, 18 bp, Homo sapiens
aggttttgtttgctatct

SEQ ID NO: 2607163 - DNA, 14 bp, Homo sapiens
aggtttttaagcct

SEQ ID NO: 2607164 - DNA, 15 bp, Homo sapiens
aggtttttcaattaa

SEQ ID NO: 2607165 - DNA, 17 bp, Homo sapiens
aggtttttcaattaaac

SEQ ID NO: 2607166 - DNA, 18 bp, Homo sapiens
aggtttttcaattaaacg

SEQ ID NO: 2607167 - DNA, 12 bp, Homo sapiens
agtaaaaataaa

SEQ ID NO: 2607168 - DNA, 15 bp, Homo sapiens
agtaaaaccacagca

SEQ ID NO: 2607169 - DNA, 14 bp, Homo sapiens
agtaaaacttgctg

SEQ ID NO: 2607170 - DNA, 13 bp, Homo sapiens
agtaaagaaatga

SEQ ID NO: 2607171 - DNA, 13 bp, Homo sapiens
agtaaagaaattt

SEQ ID NO: 2607172 - DNA, 17 bp, Homo sapiens
agtaaagccgttgttta

SEQ ID NO: 2607173 - DNA, 19 bp, Homo sapiens
agtaaagtgataatttctg

SEQ ID NO: 2607174 - DNA, 14 bp, Homo sapiens
agtaaatatttcag

SEQ ID NO: 2607175 - DNA, 17 bp, Homo sapiens
agtcccttcccctccct

SEQ ID NO: 2607176 - DNA, 19 bp, Homo sapiens
agtcccttcccctccctgg

SEQ ID NO: 2607177 - DNA, 17 bp, Homo sapiens
agtccgaggggcgggac

SEQ ID NO: 2607178 - DNA, 17 bp, Homo sapiens
agtcctagccactcagg

SEQ ID NO: 2607179 - DNA, 12 bp, Homo sapiens
agtcctagctgc

SEQ ID NO: 2607180 - DNA, 16 bp, Homo sapiens
agtcctagctgcacag

SEQ ID NO: 2607181 - DNA, 20 bp, Homo sapiens
agtcctagctgcacagggca

SEQ ID NO: 2607182 - DNA, 14 bp, Homo sapiens
agtcctcttttctg

SEQ ID NO: 2607183 - DNA, 12 bp, Homo sapiens
agtcctgaagag

SEQ ID NO: 2607184 - DNA, 13 bp, Homo sapiens
agtcctgaagagg

SEQ ID NO: 2607185 - DNA, 19 bp, Homo sapiens
agtcctgaagaggcgggcc

SEQ ID NO: 2607186 - DNA, 23 bp, Homo sapiens
agtcctgaagaggcgggccagcc

SEQ ID NO: 2607187 - DNA, 20 bp, Homo sapiens
agtcctgatcagagccgtgg

SEQ ID NO: 2607188 - DNA, 23 bp, Homo sapiens
agtcctgcacagttttctggctg

SEQ ID NO: 2607189 - DNA, 14 bp, Homo sapiens
agtcctgcctggcc

SEQ ID NO: 2607190 - DNA, 17 bp, Homo sapiens
agtcctgcctggccagg

SEQ ID NO: 2607191 - DNA, 20 bp, Homo sapiens
agtcctgcctggccaggcag

SEQ ID NO: 2607192 - DNA, 21 bp, Homo sapiens
agtcctgcctggccaggcaga

SEQ ID NO: 2607193 - DNA, 20 bp, Homo sapiens
agtcctggaagccagctttc

SEQ ID NO: 2607194 - DNA, 23 bp, Homo sapiens
agtcctggaagccagctttccct

SEQ ID NO: 2607195 - DNA, 20 bp, Homo sapiens
agtcctggcctggcttctcc

SEQ ID NO: 2607196 - DNA, 21 bp, Homo sapiens
agtcctgggagaacctcaggc

SEQ ID NO: 2607197 - DNA, 22 bp, Homo sapiens
agtcctgggagaacctcaggct

SEQ ID NO: 2607198 - DNA, 16 bp, Homo sapiens
agtccttaccagcaga

SEQ ID NO: 2607199 - DNA, 19 bp, Homo sapiens
agtccttaccagcagagca

SEQ ID NO: 2607200 - DNA, 14 bp, Homo sapiens
agtccttgaaaata

SEQ ID NO: 2607201 - DNA, 22 bp, Homo sapiens
agtccttgaaaatattttttat

SEQ ID NO: 2607202 - DNA, 14 bp, Homo sapiens
agtcctttatgtgg

SEQ ID NO: 2607203 - DNA, 17 bp, Homo sapiens
agtcctttatgtggaaa

SEQ ID NO: 2607204 - DNA, 18 bp, Homo sapiens
agtcgaattaatagcttt

SEQ ID NO: 2607205 - DNA, 16 bp, Homo sapiens
agtcgaggacagggag

SEQ ID NO: 2607206 - DNA, 20 bp, Homo sapiens
agtcgggggctggcctagga

SEQ ID NO: 2607207 - DNA, 16 bp, Homo sapiens
agtcgtcgcacagtct

SEQ ID NO: 2607208 - DNA, 16 bp, Homo sapiens
agtctaaatatttcct

SEQ ID NO: 2607209 - DNA, 17 bp, Homo sapiens
agtctacgctctccttt

SEQ ID NO: 2607210 - DNA, 20 bp, Homo sapiens
agtctacgctctcctttctt

SEQ ID NO: 2607211 - DNA, 21 bp, Homo sapiens
agtctactcttaagccatctt

SEQ ID NO: 2607212 - DNA, 18 bp, Homo sapiens
agtctatcaatcaactta

SEQ ID NO: 2607213 - DNA, 16 bp, Homo sapiens
agtctcactgttgccc

SEQ ID NO: 2607214 - DNA, 17 bp, Homo sapiens
agtctcactgttgccca

SEQ ID NO: 2607215 - DNA, 19 bp, Homo sapiens
agtctcactgttgcccagg

SEQ ID NO: 2607216 - DNA, 19 bp, Homo sapiens
agtctcagtggcttcatct

SEQ ID NO: 2607217 - DNA, 18 bp, Homo sapiens
agtctcagtttgtgtgtc

SEQ ID NO: 2607218 - DNA, 21 bp, Homo sapiens
agtctcagtttgtgtgtctta

SEQ ID NO: 2607219 - DNA, 23 bp, Homo sapiens
agtctccctcacagcacagagaa

SEQ ID NO: 2607220 - DNA, 17 bp, Homo sapiens
agtctcccttctcccat

SEQ ID NO: 2607221 - DNA, 21 bp, Homo sapiens
agtctcctttgcactgagggc

SEQ ID NO: 2607222 - DNA, 19 bp, Homo sapiens
agtctcgctctgttgccca

SEQ ID NO: 2607223 - DNA, 16 bp, Homo sapiens
agtctctaggttctga

SEQ ID NO: 2607224 - DNA, 18 bp, Homo sapiens
agtctctgaagtgaaact

SEQ ID NO: 2607225 - DNA, 19 bp, Homo sapiens
agtctctgaagtgaaactg

SEQ ID NO: 2607226 - DNA, 13 bp, Homo sapiens
agtctctgagcag

SEQ ID NO: 2607227 - DNA, 21 bp, Homo sapiens
agtctctgagggcttcctttg

SEQ ID NO: 2607228 - DNA, 17 bp, Homo sapiens
agtctctgctggcccag

SEQ ID NO: 2607229 - DNA, 17 bp, Homo sapiens
agtctctttaatcttca

SEQ ID NO: 2607230 - DNA, 21 bp, Homo sapiens
agtctctttaatcttcagttt

SEQ ID NO: 2607231 - DNA, 23 bp, Homo sapiens
agtctctttaatcttcagtttta

SEQ ID NO: 2607232 - DNA, 23 bp, Homo sapiens
agtctcttttctttagagcattg

SEQ ID NO: 2607233 - DNA, 15 bp, Homo sapiens
agtctgaaggctggg

SEQ ID NO: 2607234 - DNA, 17 bp, Homo sapiens
agtctgaaggctgggtt

SEQ ID NO: 2607235 - DNA, 15 bp, Homo sapiens
agtctgatccaggag

SEQ ID NO: 2607236 - DNA, 22 bp, Homo sapiens
agtctgatcgtgacgctgaata

SEQ ID NO: 2607237 - DNA, 18 bp, Homo sapiens
agtctgctgccctccatc

SEQ ID NO: 2607238 - DNA, 17 bp, Homo sapiens
agtctggaatgcagtgg

SEQ ID NO: 2607239 - DNA, 17 bp, Homo sapiens
agtctggctgagccctg

SEQ ID NO: 2607240 - DNA, 15 bp, Homo sapiens
agtctggtgaagctc

SEQ ID NO: 2607241 - DNA, 17 bp, Homo sapiens
agtctgtctcaaaagaa

SEQ ID NO: 2607242 - DNA, 14 bp, Homo sapiens
agtctgtctctgtc

SEQ ID NO: 2607243 - DNA, 15 bp, Homo sapiens
agtctgtctctgtca

SEQ ID NO: 2607244 - DNA, 18 bp, Homo sapiens
agtctgtctctgtcatgg

SEQ ID NO: 2607245 - DNA, 18 bp, Homo sapiens
agtctgtgagattcattc

SEQ ID NO: 2607246 - DNA, 21 bp, Homo sapiens
agtctgtgagattcattcatg

SEQ ID NO: 2607247 - DNA, 11 bp, Homo sapiens
agtctgtgtga

SEQ ID NO: 2607248 - DNA, 12 bp, Homo sapiens
agtctgtgtgaa

SEQ ID NO: 2607249 - DNA, 19 bp, Homo sapiens
agtctgtgtgatgaacttt

SEQ ID NO: 2607250 - DNA, 13 bp, Homo sapiens
agtcttaagaact

SEQ ID NO: 2607251 - DNA, 16 bp, Homo sapiens
agtcttacgaatactt

SEQ ID NO: 2607252 - DNA, 16 bp, Homo sapiens
agtcttagatgtatat

SEQ ID NO: 2607253 - DNA, 23 bp, Homo sapiens
agtcttagatgtatatatttcct

SEQ ID NO: 2607254 - DNA, 15 bp, Homo sapiens
agtcttatcaagcag

SEQ ID NO: 2607255 - DNA, 16 bp, Homo sapiens
agtcttcactctctga

SEQ ID NO: 2607256 - DNA, 18 bp, Homo sapiens
agtcttctcatagcatta

SEQ ID NO: 2607257 - DNA, 21 bp, Homo sapiens
agtcttctcatagcattaact

SEQ ID NO: 2607258 - DNA, 22 bp, Homo sapiens
agtcttggcggcagcagccatc

SEQ ID NO: 2607259 - DNA, 15 bp, Homo sapiens
agtcttggctcactg

SEQ ID NO: 2607260 - DNA, 18 bp, Homo sapiens
agtcttgtattaagttgt

SEQ ID NO: 2607261 - DNA, 15 bp, Homo sapiens
agtcttgtgcttttc

SEQ ID NO: 2607262 - DNA, 15 bp, Homo sapiens
agtcttttccatgaa

SEQ ID NO: 2607263 - DNA, 20 bp, Homo sapiens
agtgaaaaaggaggaagaga

SEQ ID NO: 2607264 - DNA, 16 bp, Homo sapiens
agtgaaagaggcagct

SEQ ID NO: 2607265 - DNA, 23 bp, Homo sapiens
agtgaaccaaagagactggagca

SEQ ID NO: 2607266 - DNA, 17 bp, Homo sapiens
agtgaacctaccttcat

SEQ ID NO: 2607267 - DNA, 16 bp, Homo sapiens
agtgaacttgggccac

SEQ ID NO: 2607268 - DNA, 19 bp, Homo sapiens
agtgaagaaaagtgaatgc

SEQ ID NO: 2607269 - DNA, 14 bp, Homo sapiens
agtgaagaggggca

SEQ ID NO: 2607270 - DNA, 17 bp, Homo sapiens
agtgaagaggggcagcc

SEQ ID NO: 2607271 - DNA, 21 bp, Homo sapiens
agtgaagaggggcagcccttg

SEQ ID NO: 2607272 - DNA, 15 bp, Homo sapiens
agtgaaggcttctct

SEQ ID NO: 2607273 - DNA, 13 bp, Homo sapiens
agtgaatgattca

SEQ ID NO: 2607274 - DNA, 18 bp, Homo sapiens
agtgaatgctcaagtttt

SEQ ID NO: 2607275 - DNA, 21 bp, Homo sapiens
agtgaattgtgaccaagttat

SEQ ID NO: 2607276 - DNA, 13 bp, Homo sapiens
agtgaatttgaat

SEQ ID NO: 2607277 - DNA, 15 bp, Homo sapiens
agtgaatttgaatga

SEQ ID NO: 2607278 - DNA, 16 bp, Homo sapiens
agtgacaaggccccag

SEQ ID NO: 2607279 - DNA, 15 bp, Homo sapiens
agtgacacttcagag

SEQ ID NO: 2607280 - DNA, 18 bp, Homo sapiens
agtgacacttcagagagc

SEQ ID NO: 2607281 - DNA, 21 bp, Homo sapiens
agtgacacttcagagagctgg

SEQ ID NO: 2607282 - DNA, 19 bp, Homo sapiens
agtgacagaggcagcccca

SEQ ID NO: 2607283 - DNA, 19 bp, Homo sapiens
agtgacagagttcactata

SEQ ID NO: 2607284 - DNA, 13 bp, Homo sapiens
agtgacagggaag

SEQ ID NO: 2607285 - DNA, 15 bp, Homo sapiens
agtgacagtattttg

SEQ ID NO: 2607286 - DNA, 20 bp, Homo sapiens
agtgacagtggattgcattt

SEQ ID NO: 2607287 - DNA, 16 bp, Homo sapiens
agtgacccggaggcca

SEQ ID NO: 2607288 - DNA, 19 bp, Homo sapiens
agtgacccggaggccacat

SEQ ID NO: 2607289 - DNA, 17 bp, Homo sapiens
agtgactccaggagagg

SEQ ID NO: 2607290 - DNA, 21 bp, Homo sapiens
agtgactgatggctaatgtac

SEQ ID NO: 2607291 - DNA, 14 bp, Homo sapiens
agtgacttgcccag

SEQ ID NO: 2607292 - DNA, 18 bp, Homo sapiens
agtgagaaaaagctcctg

SEQ ID NO: 2607293 - DNA, 20 bp, Homo sapiens
agtgagaagctttgccctcc

SEQ ID NO: 2607294 - DNA, 12 bp, Homo sapiens
agtgagacagaa

SEQ ID NO: 2607295 - DNA, 17 bp, Homo sapiens
agtgagaccctgtctca

SEQ ID NO: 2607296 - DNA, 13 bp, Homo sapiens
agtgagactctgt

SEQ ID NO: 2607297 - DNA, 17 bp, Homo sapiens
agtgagactctgtctca

SEQ ID NO: 2607298 - DNA, 22 bp, Homo sapiens
agtgagactctgtctcaaaaaa

SEQ ID NO: 2607299 - DNA, 22 bp, Homo sapiens
agtgagagggcatgcgcacaag

SEQ ID NO: 2607300 - DNA, 22 bp, Homo sapiens
agtgagcactaaggtgtgctct

SEQ ID NO: 2607301 - DNA, 16 bp, Homo sapiens
agtgagcactcccaag

SEQ ID NO: 2607302 - DNA, 23 bp, Homo sapiens
agtgagctggtttttagcggaga

SEQ ID NO: 2607303 - DNA, 19 bp, Homo sapiens
agtgaggaagccaggtcca

SEQ ID NO: 2607304 - DNA, 22 bp, Homo sapiens
agtgaggaaggcaggaagagag

SEQ ID NO: 2607305 - DNA, 20 bp, Homo sapiens
agtgaggaatagttgagccc

SEQ ID NO: 2607306 - DNA, 13 bp, Homo sapiens
agtgaggcccagg

SEQ ID NO: 2607307 - DNA, 12 bp, Homo sapiens
agtgaggctctg

SEQ ID NO: 2607308 - DNA, 14 bp, Homo sapiens
agtgaggctctgcc

SEQ ID NO: 2607309 - DNA, 15 bp, Homo sapiens
agtgaggctctgccc

SEQ ID NO: 2607310 - DNA, 21 bp, Homo sapiens
agtgaggctctgcccttggtt

SEQ ID NO: 2607311 - DNA, 18 bp, Homo sapiens
agtgaggggaaaccaggg

SEQ ID NO: 2607312 - DNA, 24 bp, Homo sapiens
agtgaggggtaaaagctgatctgg

SEQ ID NO: 2607313 - DNA, 16 bp, Homo sapiens
agtgagtcgaggacag

SEQ ID NO: 2607314 - DNA, 14 bp, Homo sapiens
agtgagtctgtcag

SEQ ID NO: 2607315 - DNA, 22 bp, Homo sapiens
agtgagttacagcgagaggcag

SEQ ID NO: 2607316 - DNA, 22 bp, Homo sapiens
agtgagttgatagcacagaccc

SEQ ID NO: 2607317 - DNA, 19 bp, Homo sapiens
agtgagttgttgccctggg

SEQ ID NO: 2607318 - DNA, 19 bp, Homo sapiens
agtgataatttctggaatt

SEQ ID NO: 2607319 - DNA, 18 bp, Homo sapiens
agtttcagagaagttctg

SEQ ID NO: 2607320 - DNA, 14 bp, Homo sapiens
agtttcagatatat

SEQ ID NO: 2607321 - DNA, 17 bp, Homo sapiens
agtttcagatatatatc

SEQ ID NO: 2607322 - DNA, 23 bp, Homo sapiens
agtttcagatatatatcatattg

SEQ ID NO: 2607323 - DNA, 16 bp, Homo sapiens
agtttcaggtgacatg

SEQ ID NO: 2607324 - DNA, 17 bp, Homo sapiens
agtttcaggtgacatgt

SEQ ID NO: 2607325 - DNA, 22 bp, Homo sapiens
agtttcaggtgacatgtgaaac

SEQ ID NO: 2607326 - DNA, 18 bp, Homo sapiens
agtttcaggtgtttagtt

SEQ ID NO: 2607327 - DNA, 18 bp, Homo sapiens
agtttccttggctggtgc

SEQ ID NO: 2607328 - DNA, 13 bp, Homo sapiens
agtttctcagctc

SEQ ID NO: 2607329 - DNA, 17 bp, Homo sapiens
agtttctgttctgtgga

SEQ ID NO: 2607330 - DNA, 18 bp, Homo sapiens
agtttctttcctgccttc

SEQ ID NO: 2607331 - DNA, 19 bp, Homo sapiens
agtttctttcctgccttct

SEQ ID NO: 2607332 - DNA, 23 bp, Homo sapiens
agtttctttcctgccttcttctt

SEQ ID NO: 2607333 - DNA, 13 bp, Homo sapiens
agtttctttggga

SEQ ID NO: 2607334 - DNA, 16 bp, Homo sapiens
agtttgaaggaaacag

SEQ ID NO: 2607335 - DNA, 17 bp, Homo sapiens
agtttgatattaaagga

SEQ ID NO: 2607336 - DNA, 23 bp, Homo sapiens
agtttgattattcagtgtcactg

SEQ ID NO: 2607337 - DNA, 11 bp, Homo sapiens
agtttgcagtt

SEQ ID NO: 2607338 - DNA, 20 bp, Homo sapiens
agtttgcattcctgatatga

SEQ ID NO: 2607339 - DNA, 17 bp, Homo sapiens
agtttggcaatagtttg

SEQ ID NO: 2607340 - DNA, 22 bp, Homo sapiens
agtttggccgggtgcggtggct

SEQ ID NO: 2607341 - DNA, 22 bp, Homo sapiens
agtttgtacagacgtatgctta

SEQ ID NO: 2607342 - DNA, 18 bp, Homo sapiens
agtttgtacatgcattca

SEQ ID NO: 2607343 - DNA, 14 bp, Homo sapiens
agtttgtataactt

SEQ ID NO: 2607344 - DNA, 14 bp, Homo sapiens
agtttgtgtgtctt

SEQ ID NO: 2607345 - DNA, 18 bp, Homo sapiens
agtttgtgtgttgtcttg

SEQ ID NO: 2607346 - DNA, 19 bp, Homo sapiens
agtttgtgtgttgtcttga

SEQ ID NO: 2607347 - DNA, 20 bp, Homo sapiens
agtttgtgtgttgtcttgaa

SEQ ID NO: 2607348 - DNA, 16 bp, Homo sapiens
agttttaatccagaat

SEQ ID NO: 2607349 - DNA, 20 bp, Homo sapiens
agttttacttttaaactgtg

SEQ ID NO: 2607350 - DNA, 13 bp, Homo sapiens
agttttatcacat

SEQ ID NO: 2607351 - DNA, 17 bp, Homo sapiens
agttttatcacatgtat

SEQ ID NO: 2607352 - DNA, 12 bp, Homo sapiens
agttttatcatt

SEQ ID NO: 2607353 - DNA, 15 bp, Homo sapiens
agttttatcattttc

SEQ ID NO: 2607354 - DNA, 23 bp, Homo sapiens
agttttattaataaacattctat

SEQ ID NO: 2607355 - DNA, 16 bp, Homo sapiens
agttttcagaacctct

SEQ ID NO: 2607356 - DNA, 20 bp, Homo sapiens
agttttcagaacctcttccc

SEQ ID NO: 2607357 - DNA, 22 bp, Homo sapiens
agttttcagaacctcttcccca

SEQ ID NO: 2607358 - DNA, 12 bp, Homo sapiens
agttttccatga

SEQ ID NO: 2607359 - DNA, 13 bp, Homo sapiens
agttttccatgaa

SEQ ID NO: 2607360 - DNA, 16 bp, Homo sapiens
agttttccatgaaaac

SEQ ID NO: 2607361 - DNA, 21 bp, Homo sapiens
agttttccatgaaaacgtttt

SEQ ID NO: 2607362 - DNA, 20 bp, Homo sapiens
agttttcccttgaggaaaca

SEQ ID NO: 2607363 - DNA, 22 bp, Homo sapiens
agttttcctaagtgattgtatg

SEQ ID NO: 2607364 - DNA, 11 bp, Homo sapiens
agttttcctga

SEQ ID NO: 2607365 - DNA, 18 bp, Homo sapiens
agttttccttctcatctg

SEQ ID NO: 2607366 - DNA, 12 bp, Homo sapiens
agttttctgaga

SEQ ID NO: 2607367 - DNA, 13 bp, Homo sapiens
agttttctgagaa

SEQ ID NO: 2607368 - DNA, 23 bp, Homo sapiens
agttttctgagaaagactattca

SEQ ID NO: 2607369 - DNA, 13 bp, Homo sapiens
agttttctggctg

SEQ ID NO: 2607370 - DNA, 15 bp, Homo sapiens
agttttggttgcttt

SEQ ID NO: 2607371 - DNA, 22 bp, Homo sapiens
agttttggttgctttaatatca

SEQ ID NO: 2607372 - DNA, 12 bp, Homo sapiens
agttttgtcttg

SEQ ID NO: 2607373 - DNA, 13 bp, Homo sapiens
agttttgtcttga

SEQ ID NO: 2607374 - DNA, 18 bp, Homo sapiens
agttttgttttaaaatta

SEQ ID NO: 2607375 - DNA, 17 bp, Homo sapiens
agtttttacctaccaca

SEQ ID NO: 2607376 - DNA, 15 bp, Homo sapiens
agtttttactgaaca

SEQ ID NO: 2607377 - DNA, 20 bp, Homo sapiens
agtttttattgcttgttgga

SEQ ID NO: 2607378 - DNA, 13 bp, Homo sapiens
agtttttctgtca

SEQ ID NO: 2607379 - DNA, 19 bp, Homo sapiens
agtttttgtactgtaaaga

SEQ ID NO: 2607380 - DNA, 17 bp, Homo sapiens
ataaaaaaaagaaaaaa

SEQ ID NO: 2607381 - DNA, 12 bp, Homo sapiens
ataaaaaatgga

SEQ ID NO: 2607382 - DNA, 16 bp, Homo sapiens
ataaaaactaaattgt

SEQ ID NO: 2607383 - DNA, 22 bp, Homo sapiens
ataaaaagaaaagataaagatg

SEQ ID NO: 2607384 - DNA, 12 bp, Homo sapiens
ataaaaaggcac

SEQ ID NO: 2607385 - DNA, 12 bp, Homo sapiens
ataaaaagttaa

SEQ ID NO: 2607386 - DNA, 13 bp, Homo sapiens
ataaaacctttca

SEQ ID NO: 2607387 - DNA, 20 bp, Homo sapiens
ataaaacctttcaaatttca

SEQ ID NO: 2607388 - DNA, 15 bp, Homo sapiens
ataaaactttttaaa

SEQ ID NO: 2607389 - DNA, 17 bp, Homo sapiens
ataaaagcaattccaac

SEQ ID NO: 2607390 - DNA, 16 bp, Homo sapiens
ataaaagcagcatctg

SEQ ID NO: 2607391 - DNA, 18 bp, Homo sapiens
ataaaagcataaatgcaa

SEQ ID NO: 2607392 - DNA, 20 bp, Homo sapiens
ataaaagcataaatgcaaac

SEQ ID NO: 2607393 - DNA, 12 bp, Homo sapiens
ataaaaggaaaa

SEQ ID NO: 2607394 - DNA, 21 bp, Homo sapiens
ataaaagtacatgttaaactt

SEQ ID NO: 2607395 - DNA, 13 bp, Homo sapiens
ataaaagtgatca

SEQ ID NO: 2607396 - DNA, 14 bp, Homo sapiens
ataaaagtgattgt

SEQ ID NO: 2607397 - DNA, 18 bp, Homo sapiens
ataaaagtgattgttggc

SEQ ID NO: 2607398 - DNA, 17 bp, Homo sapiens
ataaaataattctaaag

SEQ ID NO: 2607399 - DNA, 20 bp, Homo sapiens
ataaaatcatgtacatttct

SEQ ID NO: 2607400 - DNA, 14 bp, Homo sapiens
ataaaattatagat

SEQ ID NO: 2607401 - DNA, 20 bp, Homo sapiens
ataaaattatagatgggaat

SEQ ID NO: 2607402 - DNA, 13 bp, Homo sapiens
ataaaattattcc

SEQ ID NO: 2607403 - DNA, 18 bp, Homo sapiens
ataaaattattttggatt

SEQ ID NO: 2607404 - DNA, 16 bp, Homo sapiens
ataaacatcacacaca

SEQ ID NO: 2607405 - DNA, 13 bp, Homo sapiens
ataaacattgtat

SEQ ID NO: 2607406 - DNA, 22 bp, Homo sapiens
ataaacatttgtagcatcctct

SEQ ID NO: 2607407 - DNA, 21 bp, Homo sapiens
ataaaccaggtttagacagta

SEQ ID NO: 2607408 - DNA, 20 bp, Homo sapiens
ataaacgcgggaaaaaagat

SEQ ID NO: 2607409 - DNA, 14 bp, Homo sapiens
ataaactatcagtt

SEQ ID NO: 2607410 - DNA, 15 bp, Homo sapiens
ataaactttaccttt

SEQ ID NO: 2607411 - DNA, 16 bp, Homo sapiens
ataaactttacctttt

SEQ ID NO: 2607412 - DNA, 21 bp, Homo sapiens
ataaactttaccttttttata

SEQ ID NO: 2607413 - DNA, 24 bp, Homo sapiens
ataaactttaccttttttatacat

SEQ ID NO: 2607414 - DNA, 21 bp, Homo sapiens
ataaagaacaaggtagttttt

SEQ ID NO: 2607415 - DNA, 19 bp, Homo sapiens
ataaagatcatgtaaaagt

SEQ ID NO: 2607416 - DNA, 18 bp, Homo sapiens
ataaagatcgcccccacc

SEQ ID NO: 2607417 - DNA, 21 bp, Homo sapiens
ataaagatgagtgagcatgcc

SEQ ID NO: 2607418 - DNA, 11 bp, Homo sapiens
ataaagatgat

SEQ ID NO: 2607419 - DNA, 14 bp, Homo sapiens
ataaagcagcgttt

SEQ ID NO: 2607420 - DNA, 12 bp, Homo sapiens
ataaagccactg

SEQ ID NO: 2607421 - DNA, 22 bp, Homo sapiens
ataaaggttgacaataaatgtg

SEQ ID NO: 2607422 - DNA, 14 bp, Homo sapiens
ataaagtaaagcta

SEQ ID NO: 2607423 - DNA, 17 bp, Homo sapiens
ataaagtaaagctaaaa

SEQ ID NO: 2607424 - DNA, 15 bp, Homo sapiens
ataaagtatcatgca

SEQ ID NO: 2607425 - DNA, 14 bp, Homo sapiens
ataaagtatctaca

SEQ ID NO: 2607426 - DNA, 16 bp, Homo sapiens
ataaagttggtgacag

SEQ ID NO: 2607427 - DNA, 14 bp, Homo sapiens
ataaataacttttt

SEQ ID NO: 2607428 - DNA, 15 bp, Homo sapiens
ataaatagtttatga

SEQ ID NO: 2607429 - DNA, 20 bp, Homo sapiens
ataaatatttatgtagatgt

SEQ ID NO: 2607430 - DNA, 17 bp, Homo sapiens
ataaatgagctatgtat

SEQ ID NO: 2607431 - DNA, 18 bp, Homo sapiens
ataaatgagctatgtatt

SEQ ID NO: 2607432 - DNA, 17 bp, Homo sapiens
ataaatgcaatatgtat

SEQ ID NO: 2607433 - DNA, 21 bp, Homo sapiens
ataaatgcttttaaaaatcta

SEQ ID NO: 2607434 - DNA, 13 bp, Homo sapiens
ataaatggctggt

SEQ ID NO: 2607435 - DNA, 16 bp, Homo sapiens
ataaatggctggtttt

SEQ ID NO: 2607436 - DNA, 15 bp, Homo sapiens
ataaatgtacattaa

SEQ ID NO: 2607437 - DNA, 12 bp, Homo sapiens
ataaatgtctgt

SEQ ID NO: 2607438 - DNA, 15 bp, Homo sapiens
ataaattatgtttat

SEQ ID NO: 2607439 - DNA, 19 bp, Homo sapiens
ataaattcacctagtctaa

SEQ ID NO: 2607440 - DNA, 16 bp, Homo sapiens
ataaattcagatatat

SEQ ID NO: 2607441 - DNA, 22 bp, Homo sapiens
ataaattccctggcctttcata

SEQ ID NO: 2607442 - DNA, 13 bp, Homo sapiens
ataaattgctcct

SEQ ID NO: 2607443 - DNA, 15 bp, Homo sapiens
ataaatttatttact

SEQ ID NO: 2607444 - DNA, 20 bp, Homo sapiens
ataaatttggttctaataga

SEQ ID NO: 2607445 - DNA, 19 bp, Homo sapiens
ataacaagatctttcagga

SEQ ID NO: 2607446 - DNA, 13 bp, Homo sapiens
ataacaatgttaa

SEQ ID NO: 2607447 - DNA, 16 bp, Homo sapiens
ataacaatgttaagga

SEQ ID NO: 2607448 - DNA, 23 bp, Homo sapiens
ataacacacagctaacacacagc

SEQ ID NO: 2607449 - DNA, 19 bp, Homo sapiens
ataacattaccttactgtg

SEQ ID NO: 2607450 - DNA, 14 bp, Homo sapiens
ataaccagctgtaa

SEQ ID NO: 2607451 - DNA, 20 bp, Homo sapiens
ataaccagtgttgtggattt

SEQ ID NO: 2607452 - DNA, 13 bp, Homo sapiens
ataacctatatga

SEQ ID NO: 2607453 - DNA, 23 bp, Homo sapiens
ataacctattttgaaaaattcct

SEQ ID NO: 2607454 - DNA, 16 bp, Homo sapiens
ataactaaaaggtatg

SEQ ID NO: 2607455 - DNA, 13 bp, Homo sapiens
ataactactgtgt

SEQ ID NO: 2607456 - DNA, 15 bp, Homo sapiens
ataactactgtgttc

SEQ ID NO: 2607457 - DNA, 15 bp, Homo sapiens
ataactatgttgata

SEQ ID NO: 2607458 - DNA, 12 bp, Homo sapiens
ataactccttct

SEQ ID NO: 2607459 - DNA, 21 bp, Homo sapiens
ataactctgcactactcctct

SEQ ID NO: 2607460 - DNA, 13 bp, Homo sapiens
ataactgaaaatg

SEQ ID NO: 2607461 - DNA, 20 bp, Homo sapiens
ataactgttatttataatca

SEQ ID NO: 2607462 - DNA, 16 bp, Homo sapiens
ataacttaaaatattt

SEQ ID NO: 2607463 - DNA, 16 bp, Homo sapiens
ataacttcttaaaagt

SEQ ID NO: 2607464 - DNA, 13 bp, Homo sapiens
ataacttgtctaa

SEQ ID NO: 2607465 - DNA, 14 bp, Homo sapiens
atatcatattggta

SEQ ID NO: 2607466 - DNA, 20 bp, Homo sapiens
atatcatcagcataccttta

SEQ ID NO: 2607467 - DNA, 22 bp, Homo sapiens
atatcatcagtattgaagcatt

SEQ ID NO: 2607468 - DNA, 21 bp, Homo sapiens
atatcatttattttttacatt

SEQ ID NO: 2607469 - DNA, 19 bp, Homo sapiens
atatccaaaagctttttat

SEQ ID NO: 2607470 - DNA, 16 bp, Homo sapiens
atatccaccacctccc

SEQ ID NO: 2607471 - DNA, 21 bp, Homo sapiens
atatccatgacctagttttcc

SEQ ID NO: 2607472 - DNA, 14 bp, Homo sapiens
atatccatgtactg

SEQ ID NO: 2607473 - DNA, 17 bp, Homo sapiens
atatccatgtactgtag

SEQ ID NO: 2607474 - DNA, 18 bp, Homo sapiens
atatcccctatttaacag

SEQ ID NO: 2607475 - DNA, 16 bp, Homo sapiens
atatcctacttctcca

SEQ ID NO: 2607476 - DNA, 13 bp, Homo sapiens
atatcctgagcca

SEQ ID NO: 2607477 - DNA, 17 bp, Homo sapiens
atatctaaattgaataa

SEQ ID NO: 2607478 - DNA, 20 bp, Homo sapiens
atatctaattattttgcagt

SEQ ID NO: 2607479 - DNA, 13 bp, Homo sapiens
atatctatcttat

SEQ ID NO: 2607480 - DNA, 17 bp, Homo sapiens
atatctgaaaatgtatg

SEQ ID NO: 2607481 - DNA, 11 bp, Homo sapiens
atatctgctgt

SEQ ID NO: 2607482 - DNA, 13 bp, Homo sapiens
atatctgctgtcc

SEQ ID NO: 2607483 - DNA, 16 bp, Homo sapiens
atatctgcttcagtgg

SEQ ID NO: 2607484 - DNA, 15 bp, Homo sapiens
atatctggacaagcc

SEQ ID NO: 2607485 - DNA, 14 bp, Homo sapiens
atatgaaaaatatg

SEQ ID NO: 2607486 - DNA, 18 bp, Homo sapiens
atatgaaaaatatgatat

SEQ ID NO: 2607487 - DNA, 14 bp, Homo sapiens
atatgaaatttaat

SEQ ID NO: 2607488 - DNA, 20 bp, Homo sapiens
atatgaacatattgttgaaa

SEQ ID NO: 2607489 - DNA, 17 bp, Homo sapiens
atatgaagctcacctgt

SEQ ID NO: 2607490 - DNA, 18 bp, Homo sapiens
atatgacggaagaacata

SEQ ID NO: 2607491 - DNA, 23 bp, Homo sapiens
atatgagaaggtgcctcaagaat

SEQ ID NO: 2607492 - DNA, 23 bp, Homo sapiens
atatgagtgtggaagccggaggg

SEQ ID NO: 2607493 - DNA, 14 bp, Homo sapiens
atatgatatgtaaa

SEQ ID NO: 2607494 - DNA, 16 bp, Homo sapiens
atatgatatgtaaaca

SEQ ID NO: 2607495 - DNA, 15 bp, Homo sapiens
atatgatttaaaaca

SEQ ID NO: 2607496 - DNA, 12 bp, Homo sapiens
atatgatttata

SEQ ID NO: 2607497 - DNA, 22 bp, Homo sapiens
atatgattttatttgacaaaat

SEQ ID NO: 2607498 - DNA, 14 bp, Homo sapiens
atatgcaaagcact

SEQ ID NO: 2607499 - DNA, 13 bp, Homo sapiens
atatgcacacatt

SEQ ID NO: 2607500 - DNA, 21 bp, Homo sapiens
atatgcaccttgtgtctgtac

SEQ ID NO: 2607501 - DNA, 12 bp, Homo sapiens
atatgctgctca

SEQ ID NO: 2607502 - DNA, 18 bp, Homo sapiens
atatggaacttctaatat

SEQ ID NO: 2607503 - DNA, 22 bp, Homo sapiens
atatggattttctattgttact

SEQ ID NO: 2607504 - DNA, 13 bp, Homo sapiens
atatggcaagaaa

SEQ ID NO: 2607505 - DNA, 17 bp, Homo sapiens
atatggcaagaaagctg

SEQ ID NO: 2607506 - DNA, 18 bp, Homo sapiens
atatggcaagaaagctgg

SEQ ID NO: 2607507 - DNA, 12 bp, Homo sapiens
atatggcagaag

SEQ ID NO: 2607508 - DNA, 17 bp, Homo sapiens
atatggcagaagacacc

SEQ ID NO: 2607509 - DNA, 17 bp, Homo sapiens
atatgggcattgtagtt

SEQ ID NO: 2607510 - DNA, 17 bp, Homo sapiens
atatggggggccaacac

SEQ ID NO: 2607511 - DNA, 22 bp, Homo sapiens
atatgggttgcatttggtcaag

SEQ ID NO: 2607512 - DNA, 14 bp, Homo sapiens
atatgtaaaataaa

SEQ ID NO: 2607513 - DNA, 23 bp, Homo sapiens
atatgtacctaacgaagtatcct

SEQ ID NO: 2607514 - DNA, 17 bp, Homo sapiens
atatgtaggtgtctgca

SEQ ID NO: 2607515 - DNA, 19 bp, Homo sapiens
atatgtagtataaagaaaa

SEQ ID NO: 2607516 - DNA, 17 bp, Homo sapiens
atatgtgtttttcacat

SEQ ID NO: 2607517 - DNA, 15 bp, Homo sapiens
atatgttcaactgga

SEQ ID NO: 2607518 - DNA, 16 bp, Homo sapiens
atatgttcaactggag

SEQ ID NO: 2607519 - DNA, 13 bp, Homo sapiens
atatgttgctcag

SEQ ID NO: 2607520 - DNA, 24 bp, Homo sapiens
atatgtttaccttttaattaatga

SEQ ID NO: 2607521 - DNA, 23 bp, Homo sapiens
atattaaaaatatggaacttcta

SEQ ID NO: 2607522 - DNA, 21 bp, Homo sapiens
atattaaaataagcactgtgc

SEQ ID NO: 2607523 - DNA, 17 bp, Homo sapiens
atattaaatacagacac

SEQ ID NO: 2607524 - DNA, 23 bp, Homo sapiens
atattaaatatgttagcaaagag

SEQ ID NO: 2607525 - DNA, 16 bp, Homo sapiens
atattaagaaagacta

SEQ ID NO: 2607526 - DNA, 16 bp, Homo sapiens
atattactagcatatg

SEQ ID NO: 2607527 - DNA, 13 bp, Homo sapiens
atattagatgtga

SEQ ID NO: 2607528 - DNA, 15 bp, Homo sapiens
atattagcatttagt

SEQ ID NO: 2607529 - DNA, 21 bp, Homo sapiens
atattagctttactgtttgtt

SEQ ID NO: 2607530 - DNA, 15 bp, Homo sapiens
atattaggaaaatat

SEQ ID NO: 2607531 - DNA, 21 bp, Homo sapiens
atattatcatgcaaatgctgt

SEQ ID NO: 2607532 - DNA, 20 bp, Homo sapiens
atattatttctaggaagaat

SEQ ID NO: 2607533 - DNA, 22 bp, Homo sapiens
atattatttctaggaagaattt

SEQ ID NO: 2607534 - DNA, 22 bp, Homo sapiens
atattcagtgctgtggcctggg

SEQ ID NO: 2607535 - DNA, 14 bp, Homo sapiens
atattcatgtaaac

SEQ ID NO: 2607536 - DNA, 15 bp, Homo sapiens
atattcctgaatgaa

SEQ ID NO: 2607537 - DNA, 22 bp, Homo sapiens
atattcctgaatgaaatatcag

SEQ ID NO: 2607538 - DNA, 19 bp, Homo sapiens
atattcctttctatcattt

SEQ ID NO: 2607539 - DNA, 20 bp, Homo sapiens
atattcctttctatcatttt

SEQ ID NO: 2607540 - DNA, 18 bp, Homo sapiens
atattgaatataatatat

SEQ ID NO: 2607541 - DNA, 18 bp, Homo sapiens
atattgaatgtttccaac

SEQ ID NO: 2607542 - DNA, 13 bp, Homo sapiens
atattgatgtgtg

SEQ ID NO: 2607543 - DNA, 16 bp, Homo sapiens
atattgatttctgcct

SEQ ID NO: 2607544 - DNA, 13 bp, Homo sapiens
atattgctttttc

SEQ ID NO: 2607545 - DNA, 15 bp, Homo sapiens
atattgctttttcta

SEQ ID NO: 2607546 - DNA, 18 bp, Homo sapiens
atattgctttttctaatg

SEQ ID NO: 2607547 - DNA, 22 bp, Homo sapiens
atattgctttttctaatgtggt

SEQ ID NO: 2607548 - DNA, 13 bp, Homo sapiens
atattggtattca

SEQ ID NO: 2607549 - DNA, 14 bp, Homo sapiens
atattgtacacttt

SEQ ID NO: 2607550 - DNA, 18 bp, Homo sapiens
atattgtattactagaag

SEQ ID NO: 2607551 - DNA, 22 bp, Homo sapiens
atattgtcagagttctgctcta

SEQ ID NO: 2607552 - DNA, 12 bp, Homo sapiens
atattgtcagat

SEQ ID NO: 2607553 - DNA, 16 bp, Homo sapiens
atattgtcagatattt

SEQ ID NO: 2607554 - DNA, 17 bp, Homo sapiens
atattgtcagatatttt

SEQ ID NO: 2607555 - DNA, 18 bp, Homo sapiens
atattgtcattcctgtat

SEQ ID NO: 2607556 - DNA, 17 bp, Homo sapiens
atattgtgattctgcct

SEQ ID NO: 2607557 - DNA, 18 bp, Homo sapiens
atattgtgccaatatgta

SEQ ID NO: 2607558 - DNA, 20 bp, Homo sapiens
atattgttattatataatta

SEQ ID NO: 2607559 - DNA, 17 bp, Homo sapiens
atattgttttcagtgta

SEQ ID NO: 2607560 - DNA, 20 bp, Homo sapiens
atattgttttcagtgtacat

SEQ ID NO: 2607561 - DNA, 15 bp, Homo sapiens
atatttaaaagaaag

SEQ ID NO: 2607562 - DNA, 14 bp, Homo sapiens
atatttaaacagca

SEQ ID NO: 2607563 - DNA, 18 bp, Homo sapiens
atatttaaacagcagtgt

SEQ ID NO: 2607564 - DNA, 21 bp, Homo sapiens
atatttagttatagtttcaga

SEQ ID NO: 2607565 - DNA, 11 bp, Homo sapiens
atatttataac

SEQ ID NO: 2607566 - DNA, 13 bp, Homo sapiens
atatttataactc

SEQ ID NO: 2607567 - DNA, 21 bp, Homo sapiens
atatttataactcatcataaa

SEQ ID NO: 2607568 - DNA, 22 bp, Homo sapiens
atatttataactcatcataaaa

SEQ ID NO: 2607569 - DNA, 15 bp, Homo sapiens
atatttatatatatt

SEQ ID NO: 2607570 - DNA, 15 bp, Homo sapiens
atatttatatattta

SEQ ID NO: 2607571 - DNA, 19 bp, Homo sapiens
atatttatgtctatttaag

SEQ ID NO: 2607572 - DNA, 21 bp, Homo sapiens
atatttatgtctatttaagcc

SEQ ID NO: 2607573 - DNA, 23 bp, Homo sapiens
atatttattattttcacctgttt

SEQ ID NO: 2607574 - DNA, 19 bp, Homo sapiens
atatttattttttttaagt

SEQ ID NO: 2607575 - DNA, 13 bp, Homo sapiens
atatttcaagaca

SEQ ID NO: 2607576 - DNA, 21 bp, Homo sapiens
atatttccatatggattttct

SEQ ID NO: 2607577 - DNA, 13 bp, Homo sapiens
atatttgcttttt

SEQ ID NO: 2607578 - DNA, 13 bp, Homo sapiens
atatttgtacaaa

SEQ ID NO: 2607579 - DNA, 13 bp, Homo sapiens
atatttgttaaat

SEQ ID NO: 2607580 - DNA, 21 bp, Homo sapiens
atatttgttaaatatttacat

SEQ ID NO: 2607581 - DNA, 22 bp, Homo sapiens
atatttgttaaatatttacata

SEQ ID NO: 2607582 - DNA, 12 bp, Homo sapiens
atattttaaata

SEQ ID NO: 2607583 - DNA, 11 bp, Homo sapiens
atattttaatt

SEQ ID NO: 2607584 - DNA, 23 bp, Homo sapiens
atattttacctcttattgcaaaa

SEQ ID NO: 2607585 - DNA, 21 bp, Homo sapiens
atattttcaccatttgattat

SEQ ID NO: 2607586 - DNA, 12 bp, Homo sapiens
atattttctgtt

SEQ ID NO: 2607587 - DNA, 13 bp, Homo sapiens
atattttctgttt

SEQ ID NO: 2607588 - DNA, 19 bp, Homo sapiens
atattttcttccaagcaaa

SEQ ID NO: 2607589 - DNA, 12 bp, Homo sapiens
atattttgaatc

SEQ ID NO: 2607590 - DNA, 14 bp, Homo sapiens
atattttgaatcaa

SEQ ID NO: 2607591 - DNA, 13 bp, Homo sapiens
atattttgattat

SEQ ID NO: 2607592 - DNA, 19 bp, Homo sapiens
atattttgattattgtatt

SEQ ID NO: 2607593 - DNA, 21 bp, Homo sapiens
atattttgcacagttagcaaa

SEQ ID NO: 2607594 - DNA, 20 bp, Homo sapiens
atatttttaagataataata

SEQ ID NO: 2607595 - DNA, 22 bp, Homo sapiens
atatttttatctttatatgaag

SEQ ID NO: 2607596 - DNA, 16 bp, Homo sapiens
atatttttattttatt

SEQ ID NO: 2607597 - DNA, 21 bp, Homo sapiens
atatttttcatgattttgaaa

SEQ ID NO: 2607598 - DNA, 18 bp, Homo sapiens
atatttttttcttttctt

SEQ ID NO: 2607599 - DNA, 21 bp, Homo sapiens
atcaaaactttcttttctgga

SEQ ID NO: 2607600 - DNA, 14 bp, Homo sapiens
atcaaaagacaatt

SEQ ID NO: 2607601 - DNA, 16 bp, Homo sapiens
atcaaaagacaattct

SEQ ID NO: 2607602 - DNA, 17 bp, Homo sapiens
atcaaaagacaattctt

SEQ ID NO: 2607603 - DNA, 19 bp, Homo sapiens
atcaaaagacaattcttta

SEQ ID NO: 2607604 - DNA, 22 bp, Homo sapiens
atcaaacccggcggtcccctcc

SEQ ID NO: 2607605 - DNA, 14 bp, Homo sapiens
atcaaactgaagcc

SEQ ID NO: 2607606 - DNA, 19 bp, Homo sapiens
atcaaagaggttttaaaaa

SEQ ID NO: 2607607 - DNA, 20 bp, Homo sapiens
atcaaagaggttttaaaaaa

SEQ ID NO: 2607608 - DNA, 23 bp, Homo sapiens
atcaaagaggttttaaaaaaatc

SEQ ID NO: 2607609 - DNA, 15 bp, Homo sapiens
atcaaagcaatgcat

SEQ ID NO: 2607610 - DNA, 20 bp, Homo sapiens
atcttaggggagagctttct

SEQ ID NO: 2607611 - DNA, 12 bp, Homo sapiens
atcttagtggtt

SEQ ID NO: 2607612 - DNA, 23 bp, Homo sapiens
atcttagtttggattcttatgta

SEQ ID NO: 2607613 - DNA, 14 bp, Homo sapiens
atcttcagcttctt

SEQ ID NO: 2607614 - DNA, 14 bp, Homo sapiens
atcttcagttttat

SEQ ID NO: 2607615 - DNA, 17 bp, Homo sapiens
atcttccagaagtgtga

SEQ ID NO: 2607616 - DNA, 19 bp, Homo sapiens
atcttccagaagtgtgatt

SEQ ID NO: 2607617 - DNA, 22 bp, Homo sapiens
atcttccctagagggttcctgt

SEQ ID NO: 2607618 - DNA, 12 bp, Homo sapiens
atcttctcagct

SEQ ID NO: 2607619 - DNA, 13 bp, Homo sapiens
atcttctcagctc

SEQ ID NO: 2607620 - DNA, 14 bp, Homo sapiens
atcttctcagctcc

SEQ ID NO: 2607621 - DNA, 14 bp, Homo sapiens
atcttctctggcga

SEQ ID NO: 2607622 - DNA, 21 bp, Homo sapiens
atcttctgccttagtctcagt

SEQ ID NO: 2607623 - DNA, 14 bp, Homo sapiens
atcttcttcaccat

SEQ ID NO: 2607624 - DNA, 12 bp, Homo sapiens
atcttgaaggaa

SEQ ID NO: 2607625 - DNA, 21 bp, Homo sapiens
atcttgaccaagcaggaagct

SEQ ID NO: 2607626 - DNA, 14 bp, Homo sapiens
atcttgctctgctg

SEQ ID NO: 2607627 - DNA, 15 bp, Homo sapiens
atcttgctctgctga

SEQ ID NO: 2607628 - DNA, 17 bp, Homo sapiens
atcttgctctgctgaca

SEQ ID NO: 2607629 - DNA, 14 bp, Homo sapiens
atcttgctctgtaa

SEQ ID NO: 2607630 - DNA, 16 bp, Homo sapiens
atcttgctctgtaatc

SEQ ID NO: 2607631 - DNA, 16 bp, Homo sapiens
atcttggactgacatt

SEQ ID NO: 2607632 - DNA, 23 bp, Homo sapiens
atcttggcacatttaagagacag

SEQ ID NO: 2607633 - DNA, 17 bp, Homo sapiens
atcttggggacatctct

SEQ ID NO: 2607634 - DNA, 23 bp, Homo sapiens
atcttggtaaatttccccaacag

SEQ ID NO: 2607635 - DNA, 15 bp, Homo sapiens
atcttgtctctgggc

SEQ ID NO: 2607636 - DNA, 12 bp, Homo sapiens
atctttaaaata

SEQ ID NO: 2607637 - DNA, 17 bp, Homo sapiens
atctttcacacttccac

SEQ ID NO: 2607638 - DNA, 17 bp, Homo sapiens
atctttctttacctgag

SEQ ID NO: 2607639 - DNA, 13 bp, Homo sapiens
atctttgccttgg

SEQ ID NO: 2607640 - DNA, 14 bp, Homo sapiens
atctttgccttggg

SEQ ID NO: 2607641 - DNA, 13 bp, Homo sapiens
atcttttcacaaa

SEQ ID NO: 2607642 - DNA, 14 bp, Homo sapiens
atctttttctctaa

SEQ ID NO: 2607643 - DNA, 18 bp, Homo sapiens
atcttttttagcataaaa

SEQ ID NO: 2607644 - DNA, 19 bp, Homo sapiens
atcttttttagcataaaat

SEQ ID NO: 2607645 - DNA, 14 bp, Homo sapiens
atcttttttcaaaa

SEQ ID NO: 2607646 - DNA, 17 bp, Homo sapiens
atcttttttcacaaatt

SEQ ID NO: 2607647 - DNA, 16 bp, Homo sapiens
atgaaaaatttaagca

SEQ ID NO: 2607648 - DNA, 20 bp, Homo sapiens
atgaaaaatttaagcattgt

SEQ ID NO: 2607649 - DNA, 16 bp, Homo sapiens
atgaaaacacattttt

SEQ ID NO: 2607650 - DNA, 15 bp, Homo sapiens
atgaaaatgtcttgt

SEQ ID NO: 2607651 - DNA, 12 bp, Homo sapiens
atgaaacacctt

SEQ ID NO: 2607652 - DNA, 17 bp, Homo sapiens
atgaaacaccttctctg

SEQ ID NO: 2607653 - DNA, 13 bp, Homo sapiens
atgaaacagaaac

SEQ ID NO: 2607654 - DNA, 22 bp, Homo sapiens
atgaaacagaaacaaaaacact

SEQ ID NO: 2607655 - DNA, 12 bp, Homo sapiens
atgaaagactgt

SEQ ID NO: 2607656 - DNA, 13 bp, Homo sapiens
atgaaagactgta

SEQ ID NO: 2607657 - DNA, 20 bp, Homo sapiens
atgaaagatggctgtgcctc

SEQ ID NO: 2607658 - DNA, 23 bp, Homo sapiens
atgaaagatggctgtgcctctgc
